United States Patent 7,655,785 (BIOINFORMATICALLY DETECTABLE GROUP OF NOVEL REGULATORY OLIGONUCLEOTIDES AND USES THEREOF) - sequence listing, part 42

SEQ ID NO: 1733851 - RNA, 20 nt, Homo sapiens
cacuuauaggaauugaccca

SEQ ID NO: 1733852 - RNA, 19 nt, Homo sapiens
cacuuuaacacagugucug

SEQ ID NO: 1733853 - RNA, 23 nt, Homo sapiens
cagaagaaauucugcaagcuuuu

SEQ ID NO: 1733854 - RNA, 21 nt, Homo sapiens
cagagaaaauaaaagcacuua

SEQ ID NO: 1733855 - RNA, 19 nt, Homo sapiens
cagagacgggguuugccau

SEQ ID NO: 1733856 - RNA, 16 nt, Homo sapiens
cagcccaagggugggu

SEQ ID NO: 1733857 - RNA, 13 nt, Homo sapiens
cagcuaaguugca

SEQ ID NO: 1733858 - RNA, 18 nt, Homo sapiens
caggauagagugggacag

SEQ ID NO: 1733859 - RNA, 19 nt, Homo sapiens
caggauagagugggacagu

SEQ ID NO: 1733860 - RNA, 16 nt, Homo sapiens
caggcuccaaacugga

SEQ ID NO: 1733861 - RNA, 22 nt, Homo sapiens
caguaacggaacaguauccagu

SEQ ID NO: 1733862 - RNA, 16 nt, Homo sapiens
caguggcgcaaucuua

SEQ ID NO: 1733863 - RNA, 17 nt, Homo sapiens
caguggcgcaaucuuaa

SEQ ID NO: 1733864 - RNA, 22 nt, Homo sapiens
cauaaauuagaggucuccaaaa

SEQ ID NO: 1733865 - RNA, 13 nt, Homo sapiens
cauacauguuaca

SEQ ID NO: 1733866 - RNA, 15 nt, Homo sapiens
cauccagauagguua

SEQ ID NO: 1733867 - RNA, 15 nt, Homo sapiens
caucuguaaaaugga

SEQ ID NO: 1733868 - RNA, 16 nt, Homo sapiens
caucuguaaaauggag

SEQ ID NO: 1733869 - RNA, 14 nt, Homo sapiens
caugaaaagauuau

SEQ ID NO: 1733870 - RNA, 19 nt, Homo sapiens
cauggcacucuauguucua

SEQ ID NO: 1733871 - RNA, 21 nt, Homo sapiens
cauuucuauuuauuuacugag

SEQ ID NO: 1733872 - RNA, 13 nt, Homo sapiens
cauuugcacuauu

SEQ ID NO: 1733873 - RNA, 19 nt, Homo sapiens
cauuugcuggagcucugcc

SEQ ID NO: 1733874 - RNA, 18 nt, Homo sapiens
ccaaacuggagcuugaaa

SEQ ID NO: 1733875 - RNA, 18 nt, Homo sapiens
ccacugcagaagacagua

SEQ ID NO: 1733876 - RNA, 20 nt, Homo sapiens
ccagccugggugacagagca

SEQ ID NO: 1733877 - RNA, 14 nt, Homo sapiens
ccauuguggucaca

SEQ ID NO: 1733878 - RNA, 15 nt, Homo sapiens
cccauuucuauuuau

SEQ ID NO: 1733879 - RNA, 20 nt, Homo sapiens
cccucugggucucagugucc

SEQ ID NO: 1733880 - RNA, 19 nt, Homo sapiens
cccuuugaugauuaauuca

SEQ ID NO: 1733881 - RNA, 22 nt, Homo sapiens
ccgcaaugugacuuaaugccac

SEQ ID NO: 1733882 - RNA, 13 nt, Homo sapiens
ccucuguugccaa

SEQ ID NO: 1733883 - RNA, 14 nt, Homo sapiens
ccucuguugccaag

SEQ ID NO: 1733884 - RNA, 15 nt, Homo sapiens
ccucuguugccaagg

SEQ ID NO: 1733885 - RNA, 13 nt, Homo sapiens
ccugcaauuccac

SEQ ID NO: 1733886 - RNA, 22 nt, Homo sapiens
ccuggacaguuuucugcuuuaa

SEQ ID NO: 1733887 - RNA, 18 nt, Homo sapiens
ccuggcugggaguggcau

SEQ ID NO: 1733888 - RNA, 16 nt, Homo sapiens
ccuuauuguaccucuc

SEQ ID NO: 1733889 - RNA, 11 nt, Homo sapiens
ccuugagaaac

SEQ ID NO: 1733890 - RNA, 16 nt, Homo sapiens
cgcaaugugacuuaau

SEQ ID NO: 1733891 - RNA, 20 nt, Homo sapiens
cgucucuacuaaaaauacaa

SEQ ID NO: 1733892 - RNA, 15 nt, Homo sapiens
cgugagccaccaaac

SEQ ID NO: 1733893 - RNA, 16 nt, Homo sapiens
cuaaccagccugguca

SEQ ID NO: 1733894 - RNA, 23 nt, Homo sapiens
cuaagugaaauaagccagacauc

SEQ ID NO: 1733895 - RNA, 15 nt, Homo sapiens
cuagauacugaaugu

SEQ ID NO: 1733896 - RNA, 14 nt, Homo sapiens
cuaugugauuacaa

SEQ ID NO: 1733897 - RNA, 15 nt, Homo sapiens
cuauuacgugcaaua

SEQ ID NO: 1733898 - RNA, 18 nt, Homo sapiens
cucaaaacuucagacaua

SEQ ID NO: 1733899 - RNA, 14 nt, Homo sapiens
cucacaagcacuuu

SEQ ID NO: 1733900 - RNA, 11 nt, Homo sapiens
cucaugcugcc

SEQ ID NO: 1733901 - RNA, 20 nt, Homo sapiens
cucuacuaaaaauacaaaaa

SEQ ID NO: 1733902 - RNA, 21 nt, Homo sapiens
cucugugaacgauuuagaaag

SEQ ID NO: 1733903 - RNA, 13 nt, Homo sapiens
cucuuggugccuc

SEQ ID NO: 1733904 - RNA, 18 nt, Homo sapiens
cugaaagaggaaugaagu

SEQ ID NO: 1733905 - RNA, 15 nt, Homo sapiens
cugagcgacagugag

SEQ ID NO: 1733906 - RNA, 13 nt, Homo sapiens
cugauuaaaccaa

SEQ ID NO: 1733907 - RNA, 18 nt, Homo sapiens
cugccaauauccuaauaa

SEQ ID NO: 1733908 - RNA, 16 nt, Homo sapiens
cugccccugagcccau

SEQ ID NO: 1733909 - RNA, 18 nt, Homo sapiens
cugcuggauucaagugau

SEQ ID NO: 1733910 - RNA, 19 nt, Homo sapiens
cugcuggauucaagugauc

SEQ ID NO: 1733911 - RNA, 16 nt, Homo sapiens
cuggagugcaguggcg

SEQ ID NO: 1733912 - RNA, 19 nt, Homo sapiens
cuggaucucacaagcacuu

SEQ ID NO: 1733913 - RNA, 15 nt, Homo sapiens
cugguaacauagguu

SEQ ID NO: 1733914 - RNA, 17 nt, Homo sapiens
cuguaaaauggagacac

SEQ ID NO: 1733915 - RNA, 19 nt, Homo sapiens
cugugucaguggaugcugc

SEQ ID NO: 1733916 - RNA, 21 nt, Homo sapiens
cuuaguguacaugaaagcgua

SEQ ID NO: 1733917 - RNA, 14 nt, Homo sapiens
cuuauugacuauua

SEQ ID NO: 1733918 - RNA, 21 nt, Homo sapiens
cuuccaaacagaacuauggaa

SEQ ID NO: 1733919 - RNA, 18 nt, Homo sapiens
cuucucuucacagucaca

SEQ ID NO: 1733920 - RNA, 18 nt, Homo sapiens
cuucuggguucaagcgau

SEQ ID NO: 1733921 - RNA, 21 nt, Homo sapiens
cuucuuggucucagugucaau

SEQ ID NO: 1733922 - RNA, 15 nt, Homo sapiens
cuugguauagcauau

SEQ ID NO: 1733923 - RNA, 20 nt, Homo sapiens
gaaaacauagcaucucagga

SEQ ID NO: 1733924 - RNA, 18 nt, Homo sapiens
gaaaagauuaugaucuca

SEQ ID NO: 1733925 - RNA, 17 nt, Homo sapiens
gaaaauaaaagcacuua

SEQ ID NO: 1733926 - RNA, 20 nt, Homo sapiens
gaaaaucuacacuccaguga

SEQ ID NO: 1733927 - RNA, 12 nt, Homo sapiens
gaaaaugugcaa

SEQ ID NO: 1733928 - RNA, 17 nt, Homo sapiens
gaaaccuuauuguaccu

SEQ ID NO: 1733929 - RNA, 14 nt, Homo sapiens
gaaagggucucccu

SEQ ID NO: 1733930 - RNA, 13 nt, Homo sapiens
gaaauagugucug

SEQ ID NO: 1733931 - RNA, 23 nt, Homo sapiens
gaaauuugccaauuuacuuuguu

SEQ ID NO: 1733932 - RNA, 19 nt, Homo sapiens
gaagaaauuccaggaaaau

SEQ ID NO: 1733933 - RNA, 19 nt, Homo sapiens
gaagcaacccaaauguuca

SEQ ID NO: 1733934 - RNA, 19 nt, Homo sapiens
gaaguacucauacauguua

SEQ ID NO: 1733935 - RNA, 14 nt, Homo sapiens
gaauuuucuuccaa

SEQ ID NO: 1733936 - RNA, 13 nt, Homo sapiens
gacaacugugacu

SEQ ID NO: 1733937 - RNA, 21 nt, Homo sapiens
gacaccaccacccuugccaug

SEQ ID NO: 1733938 - RNA, 13 nt, Homo sapiens
gacagaaagcaga

SEQ ID NO: 1733939 - RNA, 21 nt, Homo sapiens
gacagaaagcagaacagugau

SEQ ID NO: 1733940 - RNA, 15 nt, Homo sapiens
gacccaaaaggcaga

SEQ ID NO: 1733941 - RNA, 14 nt, Homo sapiens
gacgaaccuugaaa

SEQ ID NO: 1733942 - RNA, 17 nt, Homo sapiens
gacgggguuugccaugc

SEQ ID NO: 1733943 - RNA, 16 nt, Homo sapiens
gacugucucacuuaau

SEQ ID NO: 1733944 - RNA, 15 nt, Homo sapiens
gacuuaaaaucuaau

SEQ ID NO: 1733945 - RNA, 12 nt, Homo sapiens
gacuugaaccca

SEQ ID NO: 1733946 - RNA, 14 nt, Homo sapiens
gagaaaagacauaa

SEQ ID NO: 1733947 - RNA, 19 nt, Homo sapiens
gagaaaauaaaagcacuua

SEQ ID NO: 1733948 - RNA, 23 nt, Homo sapiens
gagaaaccagggagccccuuuga

SEQ ID NO: 1733949 - RNA, 20 nt, Homo sapiens
gagaaaccuuauuguaccuc

SEQ ID NO: 1733950 - RNA, 22 nt, Homo sapiens
gagacaccaccacccuugccau

SEQ ID NO: 1733951 - RNA, 17 nt, Homo sapiens
gagacgggguuugccau

SEQ ID NO: 1733952 - RNA, 21 nt, Homo sapiens
gagauugugccccugcacucc

SEQ ID NO: 1733953 - RNA, 22 nt, Homo sapiens
gagcaagacucugucucaaaaa

SEQ ID NO: 1733954 - RNA, 23 nt, Homo sapiens
gagcaccugcaggcgugaccuga

SEQ ID NO: 1733955 - RNA, 13 nt, Homo sapiens
gagcgacagugag

SEQ ID NO: 1733956 - RNA, 20 nt, Homo sapiens
gagcuguuuucccugaccuc

SEQ ID NO: 1733957 - RNA, 18 nt, Homo sapiens
gagcuugaaauagugucu

SEQ ID NO: 1733958 - RNA, 20 nt, Homo sapiens
gaggcaagagaauugcuuga

SEQ ID NO: 1733959 - RNA, 21 nt, Homo sapiens
gaggcauuugcagcugugcca

SEQ ID NO: 1733960 - RNA, 19 nt, Homo sapiens
gaggcggguggaucacuug

SEQ ID NO: 1733961 - RNA, 16 nt, Homo sapiens
gaggcugaggcaagag

SEQ ID NO: 1733962 - RNA, 15 nt, Homo sapiens
gauaucaugccccug

SEQ ID NO: 1733963 - RNA, 21 nt, Homo sapiens
gauaucaugccccuguacucc

SEQ ID NO: 1733964 - RNA, 16 nt, Homo sapiens
gaucucacaagcacuu

SEQ ID NO: 1733965 - RNA, 19 nt, Homo sapiens
aaaauauuuuuaugugcaa

SEQ ID NO: 1733966 - RNA, 12 nt, Homo sapiens
aaaaugugcaau

SEQ ID NO: 1733967 - RNA, 13 nt, Homo sapiens
aaaaugugcaaua

SEQ ID NO: 1733968 - RNA, 14 nt, Homo sapiens
aaacauagcaucuc

SEQ ID NO: 1733969 - RNA, 17 nt, Homo sapiens
aaacauagcaucucagg

SEQ ID NO: 1733970 - RNA, 23 nt, Homo sapiens
aaagcagggacuugaacccauau

SEQ ID NO: 1733971 - RNA, 15 nt, Homo sapiens
aaauaaaagcacuua

SEQ ID NO: 1733972 - RNA, 23 nt, Homo sapiens
aaauauuguugacaacugugacu

SEQ ID NO: 1733973 - RNA, 23 nt, Homo sapiens
aaaucggaucuggggcucuggga

SEQ ID NO: 1733974 - RNA, 12 nt, Homo sapiens
aaauuggacuua

SEQ ID NO: 1733975 - RNA, 14 nt, Homo sapiens
aacagaagcuucca

SEQ ID NO: 1733976 - RNA, 20 nt, Homo sapiens
aaccaaauggagugacuuag

SEQ ID NO: 1733977 - RNA, 20 nt, Homo sapiens
aacccaggagauggaaguug

SEQ ID NO: 1733978 - RNA, 22 nt, Homo sapiens
aacccggccugauuaaaguuaa

SEQ ID NO: 1733979 - RNA, 12 nt, Homo sapiens
aacccugucucu

SEQ ID NO: 1733980 - RNA, 12 nt, Homo sapiens
aacugugacugu

SEQ ID NO: 1733981 - RNA, 15 nt, Homo sapiens
cacgcccagcuaauu

SEQ ID NO: 1733982 - RNA, 16 nt, Homo sapiens
cacgccuguaauccca

SEQ ID NO: 1733983 - RNA, 23 nt, Homo sapiens
cacuccagccugagcgacaguga

SEQ ID NO: 1733984 - RNA, 16 nt, Homo sapiens
cacugcagaagacagu

SEQ ID NO: 1733985 - RNA, 16 nt, Homo sapiens
cacugugggcuuuuau

SEQ ID NO: 1733986 - RNA, 12 nt, Homo sapiens
cacuugaacccg

SEQ ID NO: 1733987 - RNA, 15 nt, Homo sapiens
cacuugaugauacaa

SEQ ID NO: 1733988 - RNA, 18 nt, Homo sapiens
cagaaagcagaacaguga

SEQ ID NO: 1733989 - RNA, 12 nt, Homo sapiens
cagaacagugau

SEQ ID NO: 1733990 - RNA, 14 nt, Homo sapiens
cagaacuugaaugu

SEQ ID NO: 1733991 - RNA, 21 nt, Homo sapiens
cagagacgggguuugccaugc

SEQ ID NO: 1733992 - RNA, 15 nt, Homo sapiens
cagcagagacggggu

SEQ ID NO: 1733993 - RNA, 12 nt, Homo sapiens
cagccaaccugg

SEQ ID NO: 1733994 - RNA, 13 nt, Homo sapiens
cagggacuugaac

SEQ ID NO: 1733995 - RNA, 21 nt, Homo sapiens
caguaauuuuaaguaauuuca

SEQ ID NO: 1733996 - RNA, 15 nt, Homo sapiens
caguauccaguacuc

SEQ ID NO: 1733997 - RNA, 18 nt, Homo sapiens
cagugucuggcacuuggg

SEQ ID NO: 1733998 - RNA, 18 nt, Homo sapiens
cauaagcaaagacuauga

SEQ ID NO: 1733999 - RNA, 16 nt, Homo sapiens
cauaauuacuauguca

SEQ ID NO: 1734000 - RNA, 16 nt, Homo sapiens
cauuguggucacagga

SEQ ID NO: 1734001 - RNA, 22 nt, Homo sapiens
cauuucaaaagguauuuauuga

SEQ ID NO: 1734002 - RNA, 13 nt, Homo sapiens
cauuuucacuuuu

SEQ ID NO: 1734003 - RNA, 18 nt, Homo sapiens
ccaaaaucggaucugggg

SEQ ID NO: 1734004 - RNA, 17 nt, Homo sapiens
ccaaacagaacuaugga

SEQ ID NO: 1734005 - RNA, 12 nt, Homo sapiens
ccaacuaggcag

SEQ ID NO: 1734006 - RNA, 20 nt, Homo sapiens
ccaacuuugaagucugauuu

SEQ ID NO: 1734007 - RNA, 13 nt, Homo sapiens
ccaagccugacca

SEQ ID NO: 1734008 - RNA, 14 nt, Homo sapiens
ccacccuugccaug

SEQ ID NO: 1734009 - RNA, 21 nt, Homo sapiens
ccaggagauggaaguugcagu

SEQ ID NO: 1734010 - RNA, 19 nt, Homo sapiens
ccagugagacagcucugca

SEQ ID NO: 1734011 - RNA, 15 nt, Homo sapiens
ccauagagacuuugu

SEQ ID NO: 1734012 - RNA, 16 nt, Homo sapiens
ccauagagacuuugug

SEQ ID NO: 1734013 - RNA, 13 nt, Homo sapiens
cccaaaaggcaga

SEQ ID NO: 1734014 - RNA, 21 nt, Homo sapiens
cccccauuguggucacaggaa

SEQ ID NO: 1734015 - RNA, 22 nt, Homo sapiens
cccccauuguggucacaggaag

SEQ ID NO: 1734016 - RNA, 15 nt, Homo sapiens
cccugcacuccagcc

SEQ ID NO: 1734017 - RNA, 11 nt, Homo sapiens
cccuugccaug

SEQ ID NO: 1734018 - RNA, 22 nt, Homo sapiens
ccucaucuguaaaauggagaca

SEQ ID NO: 1734019 - RNA, 14 nt, Homo sapiens
ccucaugcugccaa

SEQ ID NO: 1734020 - RNA, 20 nt, Homo sapiens
ccucauuccccaaccacuuc

SEQ ID NO: 1734021 - RNA, 17 nt, Homo sapiens
ccucccuucucuucaca

SEQ ID NO: 1734022 - RNA, 20 nt, Homo sapiens
ccuggaucucacaagcacuu

SEQ ID NO: 1734023 - RNA, 19 nt, Homo sapiens
ccuggucaacauggugaaa

SEQ ID NO: 1734024 - RNA, 11 nt, Homo sapiens
ccugugacugu

SEQ ID NO: 1734025 - RNA, 12 nt, Homo sapiens
ccugugacuguc

SEQ ID NO: 1734026 - RNA, 13 nt, Homo sapiens
ccuuaaacucagg

SEQ ID NO: 1734027 - RNA, 14 nt, Homo sapiens
ccuuauuguaccuc

SEQ ID NO: 1734028 - RNA, 15 nt, Homo sapiens
ccuuuacauccagau

SEQ ID NO: 1734029 - RNA, 13 nt, Homo sapiens
cgaagucuuccau

SEQ ID NO: 1734030 - RNA, 20 nt, Homo sapiens
cgcgcaccuguaaucccagc

SEQ ID NO: 1734031 - RNA, 17 nt, Homo sapiens
cuaaaucaauucuauua

SEQ ID NO: 1734032 - RNA, 17 nt, Homo sapiens
cuaaccagccuggucaa

SEQ ID NO: 1734033 - RNA, 21 nt, Homo sapiens
cuaagaagugaaaaucuacac

SEQ ID NO: 1734034 - RNA, 19 nt, Homo sapiens
cuacuugggaggcugaggc

SEQ ID NO: 1734035 - RNA, 13 nt, Homo sapiens
cuaugugauuaca

SEQ ID NO: 1734036 - RNA, 23 nt, Homo sapiens
cuauuauagaauggaacucaagg

SEQ ID NO: 1734037 - RNA, 13 nt, Homo sapiens
cucacaagcacuu

SEQ ID NO: 1734038 - RNA, 15 nt, Homo sapiens
cucaguguccucauc

SEQ ID NO: 1734039 - RNA, 20 nt, Homo sapiens
cucaguguccucaucuguaa

SEQ ID NO: 1734040 - RNA, 13 nt, Homo sapiens
cucaucaaucaaa

SEQ ID NO: 1734041 - RNA, 21 nt, Homo sapiens
cucuauagacucuaggacaua

SEQ ID NO: 1734042 - RNA, 12 nt, Homo sapiens
cucugauaccuc

SEQ ID NO: 1734043 - RNA, 18 nt, Homo sapiens
cucugggucucagugucc

SEQ ID NO: 1734044 - RNA, 16 nt, Homo sapiens
cugacuaauuaggcaa

SEQ ID NO: 1734045 - RNA, 22 nt, Homo sapiens
cugaggcaagagaauugcuuga

SEQ ID NO: 1734046 - RNA, 15 nt, Homo sapiens
cugcaagcuuuucaa

SEQ ID NO: 1734047 - RNA, 20 nt, Homo sapiens
cugcagaagacaguauggca

SEQ ID NO: 1734048 - RNA, 22 nt, Homo sapiens
cugcauacucauuaggauggcu

SEQ ID NO: 1734049 - RNA, 14 nt, Homo sapiens
cugcuuuaauuuca

SEQ ID NO: 1734050 - RNA, 22 nt, Homo sapiens
cuggagcuugaaauagugucug

SEQ ID NO: 1734051 - RNA, 17 nt, Homo sapiens
cugggucucaguguccu

SEQ ID NO: 1734052 - RNA, 15 nt, Homo sapiens
uaucuuaguugguau

SEQ ID NO: 1734053 - RNA, 15 nt, Homo sapiens
uauuacgugcaauac

SEQ ID NO: 1734054 - RNA, 16 nt, Homo sapiens
uauugagcaccugcag

SEQ ID NO: 1734055 - RNA, 17 nt, Homo sapiens
ucacauuccaagccuca

SEQ ID NO: 1734056 - RNA, 23 nt, Homo sapiens
ucacauuccaagccucaugucca

SEQ ID NO: 1734057 - RNA, 18 nt, Homo sapiens
ucacuuuuuuucuuuucu

SEQ ID NO: 1734058 - RNA, 16 nt, Homo sapiens
ucagaagaaauucugc

SEQ ID NO: 1734059 - RNA, 18 nt, Homo sapiens
ucaggaguuccuaaccag

SEQ ID NO: 1734060 - RNA, 18 nt, Homo sapiens
ucaguccaugaagaugua

SEQ ID NO: 1734061 - RNA, 15 nt, Homo sapiens
ucaucaaucaaauaa

SEQ ID NO: 1734062 - RNA, 14 nt, Homo sapiens
ucaugcauuugcac

SEQ ID NO: 1734063 - RNA, 19 nt, Homo sapiens
ucccuucucuucacaguca

SEQ ID NO: 1734064 - RNA, 16 nt, Homo sapiens
uccugagaccagccaa

SEQ ID NO: 1734065 - RNA, 22 nt, Homo sapiens
uccugagaccagccaaccuggg

SEQ ID NO: 1734066 - RNA, 21 nt, Homo sapiens
uccugguuccuaggugagcag

SEQ ID NO: 1734067 - RNA, 16 nt, Homo sapiens
ucuauuacgugcaaua

SEQ ID NO: 1734068 - RNA, 16 nt, Homo sapiens
ucuccgucucccaaag

SEQ ID NO: 1734069 - RNA, 16 nt, Homo sapiens
ucucgaacugcuggau

SEQ ID NO: 1734070 - RNA, 18 nt, Homo sapiens
ucucgaacugcuggauuc

SEQ ID NO: 1734071 - RNA, 13 nt, Homo sapiens
ucugauaccucaa

SEQ ID NO: 1734072 - RNA, 18 nt, Homo sapiens
ugaaaacauagcaucuca

SEQ ID NO: 1734073 - RNA, 21 nt, Homo sapiens
ugaaaacauagcaucucagga

SEQ ID NO: 1734074 - RNA, 19 nt, Homo sapiens
ugaaaagauuaugaucuca

SEQ ID NO: 1734075 - RNA, 19 nt, Homo sapiens
ugaacacuuauaagugaag

SEQ ID NO: 1734076 - RNA, 21 nt, Homo sapiens
ugaauaaaguguaaguucaca

SEQ ID NO: 1734077 - RNA, 14 nt, Homo sapiens
ugaaugugucaggu

SEQ ID NO: 1734078 - RNA, 17 nt, Homo sapiens
ugacaacugugacugua

SEQ ID NO: 1734079 - RNA, 13 nt, Homo sapiens
ugacccacaagaa

SEQ ID NO: 1734080 - RNA, 14 nt, Homo sapiens
ugaccugacagccc

SEQ ID NO: 1734081 - RNA, 14 nt, Homo sapiens
ugacuggccugcug

SEQ ID NO: 1734082 - RNA, 13 nt, Homo sapiens
ugagcgacaguga

SEQ ID NO: 1734083 - RNA, 16 nt, Homo sapiens
ugagugccuguaauca

SEQ ID NO: 1734084 - RNA, 18 nt, Homo sapiens
ugauccugcaauuccacu

SEQ ID NO: 1734085 - RNA, 17 nt, Homo sapiens
ugaugauuaauucaccu

SEQ ID NO: 1734086 - RNA, 21 nt, Homo sapiens
ugcaagacauagaauaguguu

SEQ ID NO: 1734087 - RNA, 11 nt, Homo sapiens
ugcaagcuuuu

SEQ ID NO: 1734088 - RNA, 16 nt, Homo sapiens
ugcaccaacuuugaag

SEQ ID NO: 1734089 - RNA, 20 nt, Homo sapiens
ugccaaggcuggagugcagu

SEQ ID NO: 1734090 - RNA, 17 nt, Homo sapiens
ugccccugcacuccagc

SEQ ID NO: 1734091 - RNA, 13 nt, Homo sapiens
ugcuaagugaaau

SEQ ID NO: 1734092 - RNA, 17 nt, Homo sapiens
ugcuggauucaagugau

SEQ ID NO: 1734093 - RNA, 19 nt, Homo sapiens
ugcuggccaggcuggucuc

SEQ ID NO: 1734094 - RNA, 18 nt, Homo sapiens
uggaucucacaagcacuu

SEQ ID NO: 1734095 - RNA, 15 nt, Homo sapiens
uggcauuuucacuuu

SEQ ID NO: 1734096 - RNA, 17 nt, Homo sapiens
ugggaauuuucuuccaa

SEQ ID NO: 1734097 - RNA, 18 nt, Homo sapiens
ugggucucaguguccuca

SEQ ID NO: 1734098 - RNA, 17 nt, Homo sapiens
uggguuguguguuuauu

SEQ ID NO: 1734099 - RNA, 18 nt, Homo sapiens
ugguccgaagucuuccau

SEQ ID NO: 1734100 - RNA, 19 nt, Homo sapiens
uguaaucccagcacuuugg

SEQ ID NO: 1734101 - RNA, 18 nt, Homo sapiens
uguaaugaaaaugaauau

SEQ ID NO: 1734102 - RNA, 16 nt, Homo sapiens
uguacaccaauauuca

SEQ ID NO: 1734103 - RNA, 17 nt, Homo sapiens
uguagccacuucacuuu

SEQ ID NO: 1734104 - RNA, 19 nt, Homo sapiens
ugucuggcacuugggacaa

SEQ ID NO: 1734105 - RNA, 18 nt, Homo sapiens
ugucuucauagcagauuu

SEQ ID NO: 1734106 - RNA, 22 nt, Homo sapiens
ugugauauguaccuaacgaagu

SEQ ID NO: 1734107 - RNA, 19 nt, Homo sapiens
uguguggcauuuucacuuu

SEQ ID NO: 1734108 - RNA, 15 nt, Homo sapiens
uguguucaguacaau

SEQ ID NO: 1734109 - RNA, 18 nt, Homo sapiens
uuauaauuccuauauccu

SEQ ID NO: 1734110 - RNA, 16 nt, Homo sapiens
guuggaaaaugugcaa

SEQ ID NO: 1734111 - RNA, 18 nt, Homo sapiens
guuggaaaaugugcaaua

SEQ ID NO: 1734112 - RNA, 19 nt, Homo sapiens
guuuucugcuuuaauuuca

SEQ ID NO: 1734113 - RNA, 12 nt, Homo sapiens
uaaaagcacuua

SEQ ID NO: 1734114 - RNA, 20 nt, Homo sapiens
uaaaauauuuuuaugugcaa

SEQ ID NO: 1734115 - RNA, 14 nt, Homo sapiens
uaaaaucuaauuca

SEQ ID NO: 1734116 - RNA, 17 nt, Homo sapiens
uaaacaaaggaauuaug

SEQ ID NO: 1734117 - RNA, 21 nt, Homo sapiens
uaaauaaauguaucuuauuca

SEQ ID NO: 1734118 - RNA, 20 nt, Homo sapiens
uaaauggacaaaugcuuaug

SEQ ID NO: 1734119 - RNA, 19 nt, Homo sapiens
uaaauguaucuuauucaca

SEQ ID NO: 1734120 - RNA, 17 nt, Homo sapiens
uaacuuaugaaccuuua

SEQ ID NO: 1734121 - RNA, 13 nt, Homo sapiens
uaaguaauuucag

SEQ ID NO: 1734122 - RNA, 20 nt, Homo sapiens
uaaucccagcuacuugggag

SEQ ID NO: 1734123 - RNA, 13 nt, Homo sapiens
uaauuucaugaaa

SEQ ID NO: 1734124 - RNA, 20 nt, Homo sapiens
uacaaggcuuuaucucaggg

SEQ ID NO: 1734125 - RNA, 17 nt, Homo sapiens
uaccucugauaccucaa

SEQ ID NO: 1734126 - RNA, 20 nt, Homo sapiens
uagaauaauacuagucuuau

SEQ ID NO: 1734127 - RNA, 13 nt, Homo sapiens
uagaauuuauuca

SEQ ID NO: 1734128 - RNA, 17 nt, Homo sapiens
uagagacuuugugaaaa

SEQ ID NO: 1734129 - RNA, 19 nt, Homo sapiens
uagcgcagccaugugauua

SEQ ID NO: 1734130 - RNA, 16 nt, Homo sapiens
uaggaagagaaaccag

SEQ ID NO: 1734131 - RNA, 14 nt, Homo sapiens
uaguguacaugaaa

SEQ ID NO: 1734132 - RNA, 17 nt, Homo sapiens
uagugucugaugaaugu

SEQ ID NO: 1734133 - RNA, 22 nt, Homo sapiens
uaguguuggaaaaugugcaaua

SEQ ID NO: 1734134 - RNA, 14 nt, Homo sapiens
uauauccugugacu

SEQ ID NO: 1734135 - RNA, 20 nt, Homo sapiens
uaucuaauauauaugaauaa

SEQ ID NO: 1734136 - RNA, 10 nt, Homo sapiens
uaugugcaau

SEQ ID NO: 1734137 - RNA, 11 nt, Homo sapiens
uaugugcaaua

SEQ ID NO: 1734138 - RNA, 14 nt, Homo sapiens
uauuacgugcaaua

SEQ ID NO: 1734139 - RNA, 16 nt, Homo sapiens
uauuacgugcaauacu

SEQ ID NO: 1734140 - RNA, 17 nt, Homo sapiens
uauugcugaaugacuac

SEQ ID NO: 1734141 - RNA, 19 nt, Homo sapiens
uauuuauugagcaccugca

SEQ ID NO: 1734142 - RNA, 13 nt, Homo sapiens
uauuuuaaucacc

SEQ ID NO: 1734143 - RNA, 17 nt, Homo sapiens
uauuuuauaucaauuua

SEQ ID NO: 1734144 - RNA, 22 nt, Homo sapiens
uauuuuuuaugaaacauuacag

SEQ ID NO: 1734145 - RNA, 20 nt, Homo sapiens
ucaaaacuucagacauagaa

SEQ ID NO: 1734146 - RNA, 23 nt, Homo sapiens
ucacaggaaguagaggaggccac

SEQ ID NO: 1734147 - RNA, 13 nt, Homo sapiens
ucaccaaggcuga

SEQ ID NO: 1734148 - RNA, 15 nt, Homo sapiens
ucacuuaauccuuug

SEQ ID NO: 1734149 - RNA, 21 nt, Homo sapiens
ucaucuguaaaauggagacac

SEQ ID NO: 1734150 - RNA, 23 nt, Homo sapiens
uccaagccugaccacgcuuucua

SEQ ID NO: 1734151 - RNA, 20 nt, Homo sapiens
uccagccugagcgacaguga

SEQ ID NO: 1734152 - RNA, 15 nt, Homo sapiens
ucccagcuacuuggg

SEQ ID NO: 1734153 - RNA, 22 nt, Homo sapiens
ucccauggguuguguguuuauu

SEQ ID NO: 1734154 - RNA, 16 nt, Homo sapiens
uccccaaccacuucau

SEQ ID NO: 1734155 - RNA, 13 nt, Homo sapiens
uccuggacaguuu

SEQ ID NO: 1734156 - RNA, 18 nt, Homo sapiens
ucugauuuuccuggacag

SEQ ID NO: 1734157 - RNA, 16 nt, Homo sapiens
ucugcaagcuuuucaa

SEQ ID NO: 1734158 - RNA, 15 nt, Homo sapiens
ucugcuuuaauuuca

SEQ ID NO: 1734159 - RNA, 12 nt, Homo sapiens
ucuguaaucuuc

SEQ ID NO: 1734160 - RNA, 13 nt, Homo sapiens
ucuugaaagcugu

SEQ ID NO: 1734161 - RNA, 20 nt, Homo sapiens
ucuugggaauuuucuuccaa

SEQ ID NO: 1734162 - RNA, 17 nt, Homo sapiens
ugaaaaucuacacucca

SEQ ID NO: 1734163 - RNA, 16 nt, Homo sapiens
ugaaaaugaauaucua

SEQ ID NO: 1734164 - RNA, 16 nt, Homo sapiens
ugaaacauuacaguua

SEQ ID NO: 1734165 - RNA, 21 nt, Homo sapiens
ugaaauaagccagacaucaac

SEQ ID NO: 1734166 - RNA, 23 nt, Homo sapiens
ugaaauaagccagacaucaacag

SEQ ID NO: 1734167 - RNA, 19 nt, Homo sapiens
ugaacaaauuuacagagac

SEQ ID NO: 1734168 - RNA, 22 nt, Homo sapiens
ugacaacugugacuguacccaa

SEQ ID NO: 1734169 - RNA, 23 nt, Homo sapiens
ugagaaaccuuauuguaccucuc

SEQ ID NO: 1734170 - RNA, 14 nt, Homo sapiens
ugagaagaaugacu

SEQ ID NO: 1734171 - RNA, 18 nt, Homo sapiens
ugagacagcucugcauac

SEQ ID NO: 1734172 - RNA, 22 nt, Homo sapiens
ugagaugggagaaucacuugaa

SEQ ID NO: 1734173 - RNA, 14 nt, Homo sapiens
ugagcgacagugag

SEQ ID NO: 1734174 - RNA, 18 nt, Homo sapiens
ugauuccaccuacaugag

SEQ ID NO: 1734175 - RNA, 12 nt, Homo sapiens
ugcaauuccacu

SEQ ID NO: 1734176 - RNA, 14 nt, Homo sapiens
ugcagaagacagua

SEQ ID NO: 1734177 - RNA, 15 nt, Homo sapiens
ugcagauaaacagua

SEQ ID NO: 1734178 - RNA, 22 nt, Homo sapiens
ugcagcccccauuguggucaca

SEQ ID NO: 1734179 - RNA, 20 nt, Homo sapiens
ugcugggaauuacaggcgug

SEQ ID NO: 1734180 - RNA, 14 nt, Homo sapiens
uggaaaaugugcaa

SEQ ID NO: 1734181 - RNA, 15 nt, Homo sapiens
uggaacucaaggaaa

SEQ ID NO: 1734182 - RNA, 19 nt, Homo sapiens
uggaucucacaagcacuuu

SEQ ID NO: 1734183 - RNA, 14 nt, Homo sapiens
uggccagaagucaa

SEQ ID NO: 1734184 - RNA, 13 nt, Homo sapiens
uggccugcuggau

SEQ ID NO: 1734185 - RNA, 16 nt, Homo sapiens
uggcugggaguggcau

SEQ ID NO: 1734186 - RNA, 16 nt, Homo sapiens
uggguucaagcgauuc

SEQ ID NO: 1734187 - RNA, 21 nt, Homo sapiens
uguaaugaaaaugaauaucua

SEQ ID NO: 1734188 - RNA, 16 nt, Homo sapiens
ugucucaguccaugaa

SEQ ID NO: 1734189 - RNA, 21 nt, Homo sapiens
ugucucggagggauuccccua

SEQ ID NO: 1734190 - RNA, 22 nt, Homo sapiens
ugucuuacagagaaaagacaua

SEQ ID NO: 1734191 - RNA, 16 nt, Homo sapiens
ugugucaguggaugcu

SEQ ID NO: 1734192 - RNA, 17 nt, Homo sapiens
uguguuuauuucacuug

SEQ ID NO: 1734193 - RNA, 17 nt, Homo sapiens
uguuggaaaaugugcaa

SEQ ID NO: 1734194 - RNA, 21 nt, Homo sapiens
uuaaaaaaaaaccugagcccc

SEQ ID NO: 1734195 - RNA, 12 nt, Homo sapiens
uuaccucugaua

SEQ ID NO: 1734196 - RNA, 20 nt, Homo sapiens
uuagacccucaugcugccaa

SEQ ID NO: 1734197 - RNA, 21 nt, Homo sapiens
uuauagaauauuuauuaccuc

SEQ ID NO: 1734198 - RNA, 16 nt, Homo sapiens
uuaugaaacauuacag

SEQ ID NO: 1734199 - RNA, 16 nt, Homo sapiens
uuaugaaccuuuacau

SEQ ID NO: 1734200 - RNA, 20 nt, Homo sapiens
uuaugaaccuuuacauccag

SEQ ID NO: 1734201 - RNA, 12 nt, Homo sapiens
uuauuaccucug

SEQ ID NO: 1734202 - RNA, 16 nt, Homo sapiens
uucacaagacccaaaa

SEQ ID NO: 1734203 - RNA, 16 nt, Homo sapiens
uucacuuauugacuau

SEQ ID NO: 1734204 - RNA, 16 nt, Homo sapiens
uucaugcauuugcacu

SEQ ID NO: 1734205 - RNA, 19 nt, Homo sapiens
uuccaggaaaaucugcacu

SEQ ID NO: 1734206 - RNA, 15 nt, Homo sapiens
uucuauuuauuuacu

SEQ ID NO: 1734207 - RNA, 17 nt, Homo sapiens
uucugcaagcuuuucaa

SEQ ID NO: 1734208 - RNA, 22 nt, Homo sapiens
uucugcagauaaacaguaguga

SEQ ID NO: 1734209 - RNA, 15 nt, Homo sapiens
uugacaacugugacu

SEQ ID NO: 1734210 - RNA, 19 nt, Homo sapiens
uugaugauuaauucaccuu

SEQ ID NO: 1734211 - RNA, 21 nt, Homo sapiens
uugccaaggcuggagugcagu

SEQ ID NO: 1734212 - RNA, 15 nt, Homo sapiens
uuggaaaaugugcaa

SEQ ID NO: 1734213 - RNA, 22 nt, Homo sapiens
uugggaggcugaggcaagagaa

SEQ ID NO: 1734214 - RNA, 17 nt, Homo sapiens
uuguaaguuuaugcaua

SEQ ID NO: 1734215 - RNA, 16 nt, Homo sapiens
uuguaccgcaauguga

SEQ ID NO: 1734216 - RNA, 17 nt, Homo sapiens
uuuaucuugucucuggg

SEQ ID NO: 1734217 - RNA, 16 nt, Homo sapiens
uuuauuaccucugaua

SEQ ID NO: 1734218 - RNA, 15 nt, Homo sapiens
uuuauugcugaauga

SEQ ID NO: 1734219 - RNA, 20 nt, Homo sapiens
uuucacuuuuggcuuguaaa

SEQ ID NO: 1734220 - RNA, 19 nt, Homo sapiens
uuuguagccacuucacuuu

SEQ ID NO: 1734221 - RNA, 18 nt, Homo sapiens
uuuguuauuuuuccccaa

SEQ ID NO: 1734222 - RNA, 20 nt, Homo sapiens
uuuuagucuaauugaauccc

SEQ ID NO: 1734223 - RNA, 18 nt, Homo sapiens
gauggaaguugcagugag

SEQ ID NO: 1734224 - RNA, 20 nt, Homo sapiens
gaugggagaaucacuugaac

SEQ ID NO: 1734225 - RNA, 19 nt, Homo sapiens
gcaacccaaauguucauca

SEQ ID NO: 1734226 - RNA, 15 nt, Homo sapiens
gcaaugugacuuaau

SEQ ID NO: 1734227 - RNA, 18 nt, Homo sapiens
gcagcuuauucacaagac

SEQ ID NO: 1734228 - RNA, 19 nt, Homo sapiens
gcauguaugacgugacugg

SEQ ID NO: 1734229 - RNA, 21 nt, Homo sapiens
gcaugucagacagaacuugaa

SEQ ID NO: 1734230 - RNA, 12 nt, Homo sapiens
gccaauuuacuu

SEQ ID NO: 1734231 - RNA, 15 nt, Homo sapiens
gccacuucacuuuuu

SEQ ID NO: 1734232 - RNA, 20 nt, Homo sapiens
gccauggagguuaagcacuu

SEQ ID NO: 1734233 - RNA, 22 nt, Homo sapiens
gccaugugauuacccucugggu

SEQ ID NO: 1734234 - RNA, 18 nt, Homo sapiens
gcccaucuccgucuccca

SEQ ID NO: 1734235 - RNA, 13 nt, Homo sapiens
gccccugcacucc

SEQ ID NO: 1734236 - RNA, 15 nt, Homo sapiens
gcccuucaugcauuu

SEQ ID NO: 1734237 - RNA, 20 nt, Homo sapiens
gcuaagugaaauaagccaga

SEQ ID NO: 1734238 - RNA, 15 nt, Homo sapiens
gcugggaguggcaug

SEQ ID NO: 1734239 - RNA, 19 nt, Homo sapiens
gcuguuuuuauauauguga

SEQ ID NO: 1734240 - RNA, 18 nt, Homo sapiens
gcuugaaauagugucuga

SEQ ID NO: 1734241 - RNA, 15 nt, Homo sapiens
ggaaaaugugcaaua

SEQ ID NO: 1734242 - RNA, 20 nt, Homo sapiens
ggaauauuugcaagacauag

SEQ ID NO: 1734243 - RNA, 16 nt, Homo sapiens
ggacacaggcuccaaa

SEQ ID NO: 1734244 - RNA, 18 nt, Homo sapiens
ggacuugggcgggacaca

SEQ ID NO: 1734245 - RNA, 20 nt, Homo sapiens
ggaggcagagguugcaguga

SEQ ID NO: 1734246 - RNA, 15 nt, Homo sapiens
ggaggcugaggcaag

SEQ ID NO: 1734247 - RNA, 17 nt, Homo sapiens
ggaucucacaagcacuu

SEQ ID NO: 1734248 - RNA, 14 nt, Homo sapiens
ggcacuugggacaa

SEQ ID NO: 1734249 - RNA, 20 nt, Homo sapiens
ggccagaagucaaggcuuag

SEQ ID NO: 1734250 - RNA, 19 nt, Homo sapiens
ggcuaagcaaaaugugaua

SEQ ID NO: 1734251 - RNA, 14 nt, Homo sapiens
ggcuggagugcagu

SEQ ID NO: 1734252 - RNA, 17 nt, Homo sapiens
ggcuuuagggaccugcu

SEQ ID NO: 1734253 - RNA, 20 nt, Homo sapiens
gggaggcagagguugcagug

SEQ ID NO: 1734254 - RNA, 13 nt, Homo sapiens
gggaguggcgcgc

SEQ ID NO: 1734255 - RNA, 14 nt, Homo sapiens
gggucucagugucc

SEQ ID NO: 1734256 - RNA, 19 nt, Homo sapiens
gggucucccucuguugcca

SEQ ID NO: 1734257 - RNA, 14 nt, Homo sapiens
gguacauauuucuu

SEQ ID NO: 1734258 - RNA, 14 nt, Homo sapiens
ggucucgaacugcu

SEQ ID NO: 1734259 - RNA, 17 nt, Homo sapiens
gguggcucacgccugua

SEQ ID NO: 1734260 - RNA, 23 nt, Homo sapiens
gguuaccaguaacggaacaguau

SEQ ID NO: 1734261 - RNA, 15 nt, Homo sapiens
guaaacaaaggaauu

SEQ ID NO: 1734262 - RNA, 17 nt, Homo sapiens
guaaaguacagacuuuu

SEQ ID NO: 1734263 - RNA, 19 nt, Homo sapiens
guaauuuuaaguaauuuca

SEQ ID NO: 1734264 - RNA, 14 nt, Homo sapiens
guaccucucuuaua

SEQ ID NO: 1734265 - RNA, 15 nt, Homo sapiens
gucucaguccaugaa

SEQ ID NO: 1734266 - RNA, 16 nt, Homo sapiens
gugacuuaguguacau

SEQ ID NO: 1734267 - RNA, 16 nt, Homo sapiens
guggcauuuucacuuu

SEQ ID NO: 1734268 - RNA, 12 nt, Homo sapiens
gugucaggugac

SEQ ID NO: 1734269 - RNA, 18 nt, Homo sapiens
guucuucuuggucucagu

SEQ ID NO: 1734270 - RNA, 20 nt, Homo sapiens
guucuucuuggucucagugu

SEQ ID NO: 1734271 - RNA, 19 nt, Homo sapiens
guugaaaaaguucugcaga

SEQ ID NO: 1734272 - RNA, 15 nt, Homo sapiens
guugacaacugugac

SEQ ID NO: 1734273 - RNA, 18 nt, Homo sapiens
guuuaaugggcacagggu

SEQ ID NO: 1734274 - RNA, 21 nt, Homo sapiens
guuuucccugaccucccucua

SEQ ID NO: 1734275 - RNA, 13 nt, Homo sapiens
guuuucugacuaa

SEQ ID NO: 1734276 - RNA, 21 nt, Homo sapiens
uaaaauauuuuuaugugcaau

SEQ ID NO: 1734277 - RNA, 21 nt, Homo sapiens
uaaacaguagugauaguugua

SEQ ID NO: 1734278 - RNA, 16 nt, Homo sapiens
uaaaguacagacuuuu

SEQ ID NO: 1734279 - RNA, 17 nt, Homo sapiens
uaaaguacagacuuuuu

SEQ ID NO: 1734280 - RNA, 18 nt, Homo sapiens
uaaauaguuuaugauucc

SEQ ID NO: 1734281 - RNA, 13 nt, Homo sapiens
uaacacagugucu

SEQ ID NO: 1734282 - RNA, 17 nt, Homo sapiens
uaacuagaauuuauuca

SEQ ID NO: 1734283 - RNA, 20 nt, Homo sapiens
uaagcaaaaugugauaugua

SEQ ID NO: 1734284 - RNA, 16 nt, Homo sapiens
uaagcaaagacuauga

SEQ ID NO: 1734285 - RNA, 19 nt, Homo sapiens
uaagugaaauaagccagac

SEQ ID NO: 1734286 - RNA, 15 nt, Homo sapiens
uaaucccagcacuuu

SEQ ID NO: 1734287 - RNA, 23 nt, Homo sapiens
uaaugaaaaugaauaucuauuaa

SEQ ID NO: 1734288 - RNA, 18 nt, Homo sapiens
uaauuuuaaguaauuuca

SEQ ID NO: 1734289 - RNA, 18 nt, Homo sapiens
uacaguuagagauuuuua

SEQ ID NO: 1734290 - RNA, 23 nt, Homo sapiens
uacauuguuugucugucuucaua

SEQ ID NO: 1734291 - RNA, 11 nt, Homo sapiens
uacgugcaaua

SEQ ID NO: 1734292 - RNA, 15 nt, Homo sapiens
uacucauacauguua

SEQ ID NO: 1734293 - RNA, 17 nt, Homo sapiens
uagaauauuuauuaccu

SEQ ID NO: 1734294 - RNA, 20 nt, Homo sapiens
uagaauauuuauuaccucug

SEQ ID NO: 1734295 - RNA, 19 nt, Homo sapiens
uagagaaauuugccaauuu

SEQ ID NO: 1734296 - RNA, 16 nt, Homo sapiens
uagagugggacaguuc

SEQ ID NO: 1734297 - RNA, 13 nt, Homo sapiens
uagcaucucagga

SEQ ID NO: 1734298 - RNA, 17 nt, Homo sapiens
uaguuuaugauuccacc

SEQ ID NO: 1734299 - RNA, 14 nt, Homo sapiens
uauagacucuagga

SEQ ID NO: 1734300 - RNA, 21 nt, Homo sapiens
uauagugucuugggaauuuuc

SEQ ID NO: 1734301 - RNA, 15 nt, Homo sapiens
uaucaauaucuaaua

SEQ ID NO: 1734302 - RNA, 15 nt, Homo sapiens
uauccugugacuguc

SEQ ID NO: 1734303 - RNA, 18 nt, Homo sapiens
uaugacgugacuggccug

SEQ ID NO: 1734304 - RNA, 23 nt, Homo sapiens
uaugcaaccuuuggaugcacuuu

SEQ ID NO: 1734305 - RNA, 14 nt, Homo sapiens
uaugcauacaguaa

SEQ ID NO: 1734306 - RNA, 9 nt, Homo sapiens
uaugugcaa

SEQ ID NO: 1734307 - RNA, 15 nt, Homo sapiens
uauguucuaagaagu

SEQ ID NO: 1734308 - RNA, 18 nt, Homo sapiens
uauuguugacaacuguga

SEQ ID NO: 1734309 - RNA, 21 nt, Homo sapiens
uauuuauaauuccuauauccu

SEQ ID NO: 1734310 - RNA, 17 nt, Homo sapiens
uauuugcaagacauaga

SEQ ID NO: 1734311 - RNA, 20 nt, Homo sapiens
uauuuguacaccaauauuca

SEQ ID NO: 1734312 - RNA, 15 nt, Homo sapiens
uauuuuuaugugcaa

SEQ ID NO: 1734313 - RNA, 21 nt, Homo sapiens
ucaauucuauuacgugcaaua

SEQ ID NO: 1734314 - RNA, 13 nt, Homo sapiens
ucacaagcacuuu

SEQ ID NO: 1734315 - RNA, 15 nt, Homo sapiens
ucacagguugaccaa

SEQ ID NO: 1734316 - RNA, 23 nt, Homo sapiens
ucacuuuuuuucuuuucucugcc

SEQ ID NO: 1734317 - RNA, 15 nt, Homo sapiens
ucagacagaacuuga

SEQ ID NO: 1734318 - RNA, 14 nt, Homo sapiens
ucauacauguuaca

SEQ ID NO: 1734319 - RNA, 12 nt, Homo sapiens
ucaucaaugaau

SEQ ID NO: 1734320 - RNA, 13 nt, Homo sapiens
ucaugcauuugca

SEQ ID NO: 1734321 - RNA, 16 nt, Homo sapiens
uccaagccucaugucc

SEQ ID NO: 1734322 - RNA, 16 nt, Homo sapiens
ucccaaagugcuggga

SEQ ID NO: 1734323 - RNA, 20 nt, Homo sapiens
uccuagcgcagccaugugau

SEQ ID NO: 1734324 - RNA, 14 nt, Homo sapiens
uccuauauccugug

SEQ ID NO: 1734325 - RNA, 13 nt, Homo sapiens
uccugugacuguc

SEQ ID NO: 1734326 - RNA, 20 nt, Homo sapiens
uccugugacugucucacuua

SEQ ID NO: 1734327 - RNA, 22 nt, Homo sapiens
ucgaacugcuggauucaaguga

SEQ ID NO: 1734328 - RNA, 14 nt, Homo sapiens
ucucacaagcacuu

SEQ ID NO: 1734329 - RNA, 11 nt, Homo sapiens
ucucagugucc

SEQ ID NO: 1734330 - RNA, 16 nt, Homo sapiens
ucucuuauagaauauu

SEQ ID NO: 1734331 - RNA, 23 nt, Homo sapiens
ucucuuuuuagagaaauuugcca

SEQ ID NO: 1734332 - RNA, 21 nt, Homo sapiens
ucugauuuuccuggacaguuu

SEQ ID NO: 1734333 - RNA, 20 nt, Homo sapiens
ucugggcuuggggcuuccua

SEQ ID NO: 1734334 - RNA, 13 nt, Homo sapiens
ucuucacagucac

SEQ ID NO: 1734335 - RNA, 12 nt, Homo sapiens
ucuuggugccuc

SEQ ID NO: 1734336 - RNA, 20 nt, Homo sapiens
ucuuuuuuuuaauaaaccau

SEQ ID NO: 1734337 - RNA, 23 nt, Homo sapiens
ugaaaaucuacacuccagugaga

SEQ ID NO: 1734338 - RNA, 23 nt, Homo sapiens
ugaacaaauuuacagagacagaa

SEQ ID NO: 1734339 - RNA, 15 nt, Homo sapiens
ugaauaaaguguaag

SEQ ID NO: 1734340 - RNA, 12 nt, Homo sapiens
ugacaacuguga

SEQ ID NO: 1734341 - RNA, 19 nt, Homo sapiens
ugacuaauuaggcaaggcu

SEQ ID NO: 1734342 - RNA, 15 nt, Homo sapiens
ugacugucucacuua

SEQ ID NO: 1734343 - RNA, 22 nt, Homo sapiens
ugagacagcucugcauacucau

SEQ ID NO: 1734344 - RNA, 20 nt, Homo sapiens
ugaggacuugggcgggacac

SEQ ID NO: 1734345 - RNA, 23 nt, Homo sapiens
ugauccugcaauuccacuuauag

SEQ ID NO: 1734346 - RNA, 14 nt, Homo sapiens
ugaugaauguuaaa

SEQ ID NO: 1734347 - RNA, 21 nt, Homo sapiens
aaaaaaauuuuauagugucuu

SEQ ID NO: 1734348 - RNA, 21 nt, Homo sapiens
aaaaaugguuuaaauggucaa

SEQ ID NO: 1734349 - RNA, 10 nt, Homo sapiens
aaaauaugcc

SEQ ID NO: 1734350 - RNA, 14 nt, Homo sapiens
aaaaugaauaucua

SEQ ID NO: 1734351 - RNA, 15 nt, Homo sapiens
aaaaugugcaauaug

SEQ ID NO: 1734352 - RNA, 17 nt, Homo sapiens
aaacccggccugauuaa

SEQ ID NO: 1734353 - RNA, 17 nt, Homo sapiens
aaagacuaugaggaaua

SEQ ID NO: 1734354 - RNA, 16 nt, Homo sapiens
aaagcagggacuugaa

SEQ ID NO: 1734355 - RNA, 19 nt, Homo sapiens
aaagcagggacuugaaccc

SEQ ID NO: 1734356 - RNA, 17 nt, Homo sapiens
aaaguguaaguucacaa

SEQ ID NO: 1734357 - RNA, 16 nt, Homo sapiens
aaauggaaaguaacuc

SEQ ID NO: 1734358 - RNA, 16 nt, Homo sapiens
aacaaaaaaagcauug

SEQ ID NO: 1734359 - RNA, 14 nt, Homo sapiens
aacagaacuaugga

SEQ ID NO: 1734360 - RNA, 16 nt, Homo sapiens
aacauuucaaaaggua

SEQ ID NO: 1734361 - RNA, 15 nt, Homo sapiens
aacccaaauguucau

SEQ ID NO: 1734362 - RNA, 16 nt, Homo sapiens
aacccggccugauuaa

SEQ ID NO: 1734363 - RNA, 15 nt, Homo sapiens
aaccucauuccccaa

SEQ ID NO: 1734364 - RNA, 15 nt, Homo sapiens
caaggcuuuaucuca

SEQ ID NO: 1734365 - RNA, 18 nt, Homo sapiens
caagugauccgcccaucu

SEQ ID NO: 1734366 - RNA, 15 nt, Homo sapiens
caaucuuaacucauu

SEQ ID NO: 1734367 - RNA, 19 nt, Homo sapiens
caaucuuaacucauugcaa

SEQ ID NO: 1734368 - RNA, 13 nt, Homo sapiens
caauuccucuggg

SEQ ID NO: 1734369 - RNA, 20 nt, Homo sapiens
caauucuauuacgugcaaua

SEQ ID NO: 1734370 - RNA, 16 nt, Homo sapiens
cacagucacauuccaa

SEQ ID NO: 1734371 - RNA, 12 nt, Homo sapiens
cacagugucugg

SEQ ID NO: 1734372 - RNA, 19 nt, Homo sapiens
caccacccuugccauggag

SEQ ID NO: 1734373 - RNA, 16 nt, Homo sapiens
caccagggccuggcug

SEQ ID NO: 1734374 - RNA, 22 nt, Homo sapiens
cacgccuguaaucccagcacuu

SEQ ID NO: 1734375 - RNA, 13 nt, Homo sapiens
cacuccagccuga

SEQ ID NO: 1734376 - RNA, 16 nt, Homo sapiens
cacuuauugacuauua

SEQ ID NO: 1734377 - RNA, 19 nt, Homo sapiens
cacuuugggaggcugaggc

SEQ ID NO: 1734378 - RNA, 21 nt, Homo sapiens
cagaacuugaaugugucaggu

SEQ ID NO: 1734379 - RNA, 16 nt, Homo sapiens
cagacaucaacagaua

SEQ ID NO: 1734380 - RNA, 16 nt, Homo sapiens
cagagaaaagacauaa

SEQ ID NO: 1734381 - RNA, 20 nt, Homo sapiens
cagagaaaauaaaagcacuu

SEQ ID NO: 1734382 - RNA, 20 nt, Homo sapiens
cagagguugcagugagccga

SEQ ID NO: 1734383 - RNA, 18 nt, Homo sapiens
cagccaggcggcuggaau

SEQ ID NO: 1734384 - RNA, 13 nt, Homo sapiens
cagcuuauucaca

SEQ ID NO: 1734385 - RNA, 15 nt, Homo sapiens
caggaaaaucugcac

SEQ ID NO: 1734386 - RNA, 20 nt, Homo sapiens
cagugagcugauaucaugcc

SEQ ID NO: 1734387 - RNA, 17 nt, Homo sapiens
caguguccucaucugua

SEQ ID NO: 1734388 - RNA, 18 nt, Homo sapiens
caguuccugagaccagcc

SEQ ID NO: 1734389 - RNA, 16 nt, Homo sapiens
aacggaacaguaucca

SEQ ID NO: 1734390 - RNA, 16 nt, Homo sapiens
aagcaaaaugugauau

SEQ ID NO: 1734391 - RNA, 21 nt, Homo sapiens
aagcacuuuaacacagugucu

SEQ ID NO: 1734392 - RNA, 14 nt, Homo sapiens
aagccagacaucaa

SEQ ID NO: 1734393 - RNA, 14 nt, Homo sapiens
aagccucaugucca

SEQ ID NO: 1734394 - RNA, 19 nt, Homo sapiens
aagcuguuuccauagggug

SEQ ID NO: 1734395 - RNA, 23 nt, Homo sapiens
aaggaagaaauuccaggaaaauc

SEQ ID NO: 1734396 - RNA, 18 nt, Homo sapiens
aagguauuuauugagcac

SEQ ID NO: 1734397 - RNA, 13 nt, Homo sapiens
aaguacagacuuu

SEQ ID NO: 1734398 - RNA, 11 nt, Homo sapiens
aagucuuccau

SEQ ID NO: 1734399 - RNA, 17 nt, Homo sapiens
aagugauacuauccagu

SEQ ID NO: 1734400 - RNA, 18 nt, Homo sapiens
aaguuuaugcauacagua

SEQ ID NO: 1734401 - RNA, 22 nt, Homo sapiens
aauaguguuggaaaaugugcaa

SEQ ID NO: 1734402 - RNA, 19 nt, Homo sapiens
aauauauuuuuagacucau

SEQ ID NO: 1734403 - RNA, 23 nt, Homo sapiens
aauauguaaauagaaacguguau

SEQ ID NO: 1734404 - RNA, 22 nt, Homo sapiens
aauauuguugacaacugugacu

SEQ ID NO: 1734405 - RNA, 23 nt, Homo sapiens
aauauuguugacaacugugacug

SEQ ID NO: 1734406 - RNA, 17 nt, Homo sapiens
aauauuuauuaccucug

SEQ ID NO: 1734407 - RNA, 20 nt, Homo sapiens
aauauuuauuaccucugaua

SEQ ID NO: 1734408 - RNA, 18 nt, Homo sapiens
aauauuugcaagacauag

SEQ ID NO: 1734409 - RNA, 19 nt, Homo sapiens
aauauuuuuaugugcaaua

SEQ ID NO: 1734410 - RNA, 19 nt, Homo sapiens
aaucaccaaggcugauuaa

SEQ ID NO: 1734411 - RNA, 14 nt, Homo sapiens
aaucccagcacuuu

SEQ ID NO: 1734412 - RNA, 13 nt, Homo sapiens
aaucugcacugug

SEQ ID NO: 1734413 - RNA, 13 nt, Homo sapiens
aauggcaugucag

SEQ ID NO: 1734414 - RNA, 12 nt, Homo sapiens
gggaguggcgcg

SEQ ID NO: 1734415 - RNA, 12 nt, Homo sapiens
gggcgcgguggc

SEQ ID NO: 1734416 - RNA, 17 nt, Homo sapiens
gggcuuuagggaccugc

SEQ ID NO: 1734417 - RNA, 15 nt, Homo sapiens
gggucucaguguccu

SEQ ID NO: 1734418 - RNA, 14 nt, Homo sapiens
ggugacagagcaag

SEQ ID NO: 1734419 - RNA, 16 nt, Homo sapiens
guaccgcaaugugacu

SEQ ID NO: 1734420 - RNA, 15 nt, Homo sapiens
guagccacuucacuu

SEQ ID NO: 1734421 - RNA, 16 nt, Homo sapiens
guagccacuucacuuu

SEQ ID NO: 1734422 - RNA, 18 nt, Homo sapiens
guaucaaccaaauggagu

SEQ ID NO: 1734423 - RNA, 20 nt, Homo sapiens
gugaaauaaaaguagaauaa

SEQ ID NO: 1734424 - RNA, 13 nt, Homo sapiens
gugacuggccugc

SEQ ID NO: 1734425 - RNA, 16 nt, Homo sapiens
gugccuguaaucacag

SEQ ID NO: 1734426 - RNA, 15 nt, Homo sapiens
guggcauuuucacuu

SEQ ID NO: 1734427 - RNA, 22 nt, Homo sapiens
guuaagcacuuuaacacagugu

SEQ ID NO: 1734428 - RNA, 22 nt, Homo sapiens
guuaccaguaacggaacaguau

SEQ ID NO: 1734429 - RNA, 23 nt, Homo sapiens
guuuccuagcgcagccaugugau

SEQ ID NO: 1734430 - RNA, 18 nt, Homo sapiens
guuugaaaauaugccugc

SEQ ID NO: 1734431 - RNA, 15 nt, Homo sapiens
guuuuuaagcuguuu

SEQ ID NO: 1734432 - RNA, 11 nt, Homo sapiens
uaaaagcacuu

SEQ ID NO: 1734433 - RNA, 22 nt, Homo sapiens
uaaaauauuuuuaugugcaaua

SEQ ID NO: 1734434 - RNA, 23 nt, Homo sapiens
uaaaauauuuuuaugugcaauaa

SEQ ID NO: 1734435 - RNA, 18 nt, Homo sapiens
uaaaauuaucaauaucua

SEQ ID NO: 1734436 - RNA, 20 nt, Homo sapiens
uaaaauuaucaauaucuaau

SEQ ID NO: 1734437 - RNA, 15 nt, Homo sapiens
uaaacaguagugaua

SEQ ID NO: 1734438 - RNA, 14 nt, Homo sapiens
cuguaaucacagcu

SEQ ID NO: 1734439 - RNA, 17 nt, Homo sapiens
cuguaaucccagcacuu

SEQ ID NO: 1734440 - RNA, 18 nt, Homo sapiens
cuguaaucccagcuacuu

SEQ ID NO: 1734441 - RNA, 19 nt, Homo sapiens
cuguuuccauagggugaca

SEQ ID NO: 1734442 - RNA, 14 nt, Homo sapiens
cuuaaaaucuaauu

SEQ ID NO: 1734443 - RNA, 17 nt, Homo sapiens
cuuaaaaucuaauucaa

SEQ ID NO: 1734444 - RNA, 15 nt, Homo sapiens
cuuaacucauugcaa

SEQ ID NO: 1734445 - RNA, 22 nt, Homo sapiens
cuuagacccucaugcugccaau

SEQ ID NO: 1734446 - RNA, 15 nt, Homo sapiens
cuuaugaaacuaaga

SEQ ID NO: 1734447 - RNA, 16 nt, Homo sapiens
cuucaugcauuugcac

SEQ ID NO: 1734448 - RNA, 19 nt, Homo sapiens
cuuccaaacagaacuaugg

SEQ ID NO: 1734449 - RNA, 19 nt, Homo sapiens
cuucuggguucaagcgauu

SEQ ID NO: 1734450 - RNA, 15 nt, Homo sapiens
cuucuuggucucagu

SEQ ID NO: 1734451 - RNA, 13 nt, Homo sapiens
cuugaugauacaa

SEQ ID NO: 1734452 - RNA, 22 nt, Homo sapiens
cuuuaauuucaugaaaagauua

SEQ ID NO: 1734453 - RNA, 13 nt, Homo sapiens
cuuuaucucaggg

SEQ ID NO: 1734454 - RNA, 13 nt, Homo sapiens
gaaaaacauuuca

SEQ ID NO: 1734455 - RNA, 19 nt, Homo sapiens
gaaaaaguucugcagauaa

SEQ ID NO: 1734456 - RNA, 14 nt, Homo sapiens
gaaagaggaaugaa

SEQ ID NO: 1734457 - RNA, 22 nt, Homo sapiens
gaaagcuguggccagcuuguua

SEQ ID NO: 1734458 - RNA, 13 nt, Homo sapiens
gaaauaagccaga

SEQ ID NO: 1734459 - RNA, 21 nt, Homo sapiens
gaacucaaggaaaucuguguc

SEQ ID NO: 1734460 - RNA, 20 nt, Homo sapiens
gaacugcuggauucaaguga

SEQ ID NO: 1734461 - RNA, 14 nt, Homo sapiens
gaagaaauucugca

SEQ ID NO: 1734462 - RNA, 14 nt, Homo sapiens
gaagcaacccaaau

SEQ ID NO: 1734463 - RNA, 22 nt, Homo sapiens
gaaguacucauacauguuacaa

SEQ ID NO: 1734464 - RNA, 21 nt, Homo sapiens
gaaguauccuucagccugaaa

SEQ ID NO: 1734465 - RNA, 23 nt, Homo sapiens
gaauaguguuggaaaaugugcaa

SEQ ID NO: 1734466 - RNA, 17 nt, Homo sapiens
gaauauguaaauagaaa

SEQ ID NO: 1734467 - RNA, 21 nt, Homo sapiens
gaauauuuauuaccucugaua

SEQ ID NO: 1734468 - RNA, 14 nt, Homo sapiens
gaaugagaagaaug

SEQ ID NO: 1734469 - RNA, 17 nt, Homo sapiens
gaauuuauucaauuccu

SEQ ID NO: 1734470 - RNA, 15 nt, Homo sapiens
gacaacugugacugu

SEQ ID NO: 1734471 - RNA, 19 nt, Homo sapiens
gacauaagcaaagacuaug

SEQ ID NO: 1734472 - RNA, 20 nt, Homo sapiens
gacauagaauuaacacauga

SEQ ID NO: 1734473 - RNA, 15 nt, Homo sapiens
gacaucaacagauaa

SEQ ID NO: 1734474 - RNA, 22 nt, Homo sapiens
gaccuuuguagccacuucacuu

SEQ ID NO: 1734475 - RNA, 20 nt, Homo sapiens
gacuauuauagaauggaacu

SEQ ID NO: 1734476 - RNA, 15 nt, Homo sapiens
gacuggccugcugga

SEQ ID NO: 1734477 - RNA, 18 nt, Homo sapiens
gagaagaaugacuaugca

SEQ ID NO: 1734478 - RNA, 21 nt, Homo sapiens
gagacaccaccacccuugcca

SEQ ID NO: 1734479 - RNA, 22 nt, Homo sapiens
gagacagaaagcagaacaguga

SEQ ID NO: 1734480 - RNA, 21 nt, Homo sapiens
gagaugggagaaucacuugaa

SEQ ID NO: 1734481 - RNA, 19 nt, Homo sapiens
gagcauuuauaaauggaca

SEQ ID NO: 1734482 - RNA, 18 nt, Homo sapiens
gagccaccaaacccggcc

SEQ ID NO: 1734483 - RNA, 18 nt, Homo sapiens
gaggcugaggcgggugga

SEQ ID NO: 1734484 - RNA, 15 nt, Homo sapiens
gagguuaagcacuuu

SEQ ID NO: 1734485 - RNA, 15 nt, Homo sapiens
gagugcaguggcgca

SEQ ID NO: 1734486 - RNA, 14 nt, Homo sapiens
gauagagugggaca

SEQ ID NO: 1734487 - RNA, 23 nt, Homo sapiens
gauuucaugccuggugcuuccaa

SEQ ID NO: 1734488 - RNA, 20 nt, Homo sapiens
gcaaccuccaccuucugggu

SEQ ID NO: 1734489 - RNA, 19 nt, Homo sapiens
gcagagacgggguuugcca

SEQ ID NO: 1734490 - RNA, 14 nt, Homo sapiens
gcagcuuauucaca

SEQ ID NO: 1734491 - RNA, 18 nt, Homo sapiens
gcaggauagagugggaca

SEQ ID NO: 1734492 - RNA, 14 nt, Homo sapiens
gcaggcgugaccug

SEQ ID NO: 1734493 - RNA, 18 nt, Homo sapiens
aguuuaugcauacaguaa

SEQ ID NO: 1734494 - RNA, 18 nt, Homo sapiens
auaaacaguagugauagu

SEQ ID NO: 1734495 - RNA, 22 nt, Homo sapiens
auaagugaagugauacuaucca

SEQ ID NO: 1734496 - RNA, 23 nt, Homo sapiens
auaauagguuugugacuuuccua

SEQ ID NO: 1734497 - RNA, 23 nt, Homo sapiens
auaauuccuauauccugugacug

SEQ ID NO: 1734498 - RNA, 21 nt, Homo sapiens
auagcagcuuauucacaagac

SEQ ID NO: 1734499 - RNA, 14 nt, Homo sapiens
auagcaucucagga

SEQ ID NO: 1734500 - RNA, 16 nt, Homo sapiens
auaguguuggaaaaug

SEQ ID NO: 1734501 - RNA, 23 nt, Homo sapiens
auaguguuggaaaaugugcaaua

SEQ ID NO: 1734502 - RNA, 13 nt, Homo sapiens
auauauuuuuaga

SEQ ID NO: 1734503 - RNA, 21 nt, Homo sapiens
auauuguugacaacugugacu

SEQ ID NO: 1734504 - RNA, 13 nt, Homo sapiens
aucaaaagaaaga

SEQ ID NO: 1734505 - RNA, 14 nt, Homo sapiens
aucaaccaaaugga

SEQ ID NO: 1734506 - RNA, 16 nt, Homo sapiens
aucaaccaaauggagu

SEQ ID NO: 1734507 - RNA, 23 nt, Homo sapiens
aucacuugaacccgggaggcaga

SEQ ID NO: 1734508 - RNA, 20 nt, Homo sapiens
aucaugccccuguacuccag

SEQ ID NO: 1734509 - RNA, 16 nt, Homo sapiens
auccagaaauaaugaa

SEQ ID NO: 1734510 - RNA, 14 nt, Homo sapiens
auccugcaauucca

SEQ ID NO: 1734511 - RNA, 17 nt, Homo sapiens
auccugugacugucuca

SEQ ID NO: 1734512 - RNA, 16 nt, Homo sapiens
aucuaauauauaugaa

SEQ ID NO: 1734513 - RNA, 12 nt, Homo sapiens
aucuacacucca

SEQ ID NO: 1734514 - RNA, 21 nt, Homo sapiens
augaaaacauagcaucucagg

SEQ ID NO: 1734515 - RNA, 17 nt, Homo sapiens
augaggaauauuugcaa

SEQ ID NO: 1734516 - RNA, 13 nt, Homo sapiens
augauacaaugaa

SEQ ID NO: 1734517 - RNA, 13 nt, Homo sapiens
augauccugcaau

SEQ ID NO: 1734518 - RNA, 13 nt, Homo sapiens
augauuucauuca

SEQ ID NO: 1734519 - RNA, 11 nt, Homo sapiens
augcuggccag

SEQ ID NO: 1734520 - RNA, 20 nt, Homo sapiens
auggagguuaagcacuuuaa

SEQ ID NO: 1734521 - RNA, 20 nt, Homo sapiens
augguggcgcgcaccuguaa

SEQ ID NO: 1734522 - RNA, 11 nt, Homo sapiens
augugcaauaa

SEQ ID NO: 1734523 - RNA, 22 nt, Homo sapiens
auguucacuuauugacuauuau

SEQ ID NO: 1734524 - RNA, 22 nt, Homo sapiens
auguugaaaaaguucugcagau

SEQ ID NO: 1734525 - RNA, 13 nt, Homo sapiens
auuacgugcaaua

SEQ ID NO: 1734526 - RNA, 17 nt, Homo sapiens
auucacaagacccaaaa

SEQ ID NO: 1734527 - RNA, 23 nt, Homo sapiens
auuucacuugaugauacaaugaa

SEQ ID NO: 1734528 - RNA, 14 nt, Homo sapiens
auuugagacaggga

SEQ ID NO: 1734529 - RNA, 14 nt, Homo sapiens
auuugcaagacaua

SEQ ID NO: 1734530 - RNA, 11 nt, Homo sapiens
auuugcacuau

SEQ ID NO: 1734531 - RNA, 17 nt, Homo sapiens
auuugccaauuuacuuu

SEQ ID NO: 1734532 - RNA, 13 nt, Homo sapiens
auuuucacuuuug

SEQ ID NO: 1734533 - RNA, 17 nt, Homo sapiens
caaacagaacuauggaa

SEQ ID NO: 1734534 - RNA, 22 nt, Homo sapiens
caaauaaguauuuauaauagca

SEQ ID NO: 1734535 - RNA, 18 nt, Homo sapiens
caacagaagcuuccauuc

SEQ ID NO: 1734536 - RNA, 19 nt, Homo sapiens
caaccugggggcuuuaggg

SEQ ID NO: 1734537 - RNA, 13 nt, Homo sapiens
caacugugacugu

SEQ ID NO: 1734538 - RNA, 15 nt, Homo sapiens
caagccucaugucca

SEQ ID NO: 1734539 - RNA, 17 nt, Homo sapiens
caaggcuggagugcagu

SEQ ID NO: 1734540 - RNA, 17 nt, Homo sapiens
caagugauccgcccauc

SEQ ID NO: 1734541 - RNA, 14 nt, Homo sapiens
caauauccuaauaa

SEQ ID NO: 1734542 - RNA, 21 nt, Homo sapiens
caaucugagccagugcuuuaa

SEQ ID NO: 1734543 - RNA, 12 nt, Homo sapiens
cacaagcacuuu

SEQ ID NO: 1734544 - RNA, 21 nt, Homo sapiens
cacauuccaagccucaugucc

SEQ ID NO: 1734545 - RNA, 16 nt, Homo sapiens
caccaaacccggccug

SEQ ID NO: 1734546 - RNA, 15 nt, Homo sapiens
uuaucuugucucugg

SEQ ID NO: 1734547 - RNA, 18 nt, Homo sapiens
uuaugaaacauuacaguu

SEQ ID NO: 1734548 - RNA, 14 nt, Homo sapiens
uuauuguaccucuc

SEQ ID NO: 1734549 - RNA, 16 nt, Homo sapiens
uucaaaauuggacuua

SEQ ID NO: 1734550 - RNA, 20 nt, Homo sapiens
uucaccuuccagugucucgg

SEQ ID NO: 1734551 - RNA, 18 nt, Homo sapiens
uucacuugaugauacaau

SEQ ID NO: 1734552 - RNA, 22 nt, Homo sapiens
uucuauuacgugcaauacuuca

SEQ ID NO: 1734553 - RNA, 15 nt, Homo sapiens
uugaacccaggagau

SEQ ID NO: 1734554 - RNA, 14 nt, Homo sapiens
uugaaugugucagg

SEQ ID NO: 1734555 - RNA, 20 nt, Homo sapiens
uugacuauuauagaauggaa

SEQ ID NO: 1734556 - RNA, 21 nt, Homo sapiens
uuuaacuagaauuuauucaau

SEQ ID NO: 1734557 - RNA, 16 nt, Homo sapiens
uuuauaaauggacaaa

SEQ ID NO: 1734558 - RNA, 13 nt, Homo sapiens
uuuauuaccucug

SEQ ID NO: 1734559 - RNA, 17 nt, Homo sapiens
uuuauuauuuucaccug

SEQ ID NO: 1734560 - RNA, 13 nt, Homo sapiens
uuuauugccauga

SEQ ID NO: 1734561 - RNA, 16 nt, Homo sapiens
uuugugacuuuccuaa

SEQ ID NO: 1734562 - RNA, 15 nt, Homo sapiens
uuuuaaguaauuuca

SEQ ID NO: 1734563 - RNA, 11 nt, Homo sapiens
aaaagcacuua

SEQ ID NO: 1734564 - RNA, 21 nt, Homo sapiens
aaaauuagccgggcauggugg

SEQ ID NO: 1734565 - RNA, 14 nt, Homo sapiens
aaacaguagugaua

SEQ ID NO: 1734566 - RNA, 15 nt, Homo sapiens
aaacauguucacuua

SEQ ID NO: 1734567 - RNA, 20 nt, Homo sapiens
aaacuuuaugcuaagugaaa

SEQ ID NO: 1734568 - RNA, 21 nt, Homo sapiens
aaagaaaaucaggcuggccaa

SEQ ID NO: 1734569 - RNA, 16 nt, Homo sapiens
aaagcagaacagugau

SEQ ID NO: 1734570 - RNA, 17 nt, Homo sapiens
aaagcagggacuugaac

SEQ ID NO: 1734571 - RNA, 17 nt, Homo sapiens
aaagcauuguaacuuau

SEQ ID NO: 1734572 - RNA, 11 nt, Homo sapiens
aaaggugacca

SEQ ID NO: 1734573 - RNA, 17 nt, Homo sapiens
aaaguucugcagauaaa

SEQ ID NO: 1734574 - RNA, 14 nt, Homo sapiens
aaauaaaagcacuu

SEQ ID NO: 1734575 - RNA, 17 nt, Homo sapiens
aaauaagccagacauca

SEQ ID NO: 1734576 - RNA, 13 nt, Homo sapiens
aaauagugucuga

SEQ ID NO: 1734577 - RNA, 19 nt, Homo sapiens
aaauaguuuaugauuccac

SEQ ID NO: 1734578 - RNA, 18 nt, Homo sapiens
aaauauuuuuaugugcaa

SEQ ID NO: 1734579 - RNA, 20 nt, Homo sapiens
aaauauuuuuaugugcaaua

SEQ ID NO: 1734580 - RNA, 18 nt, Homo sapiens
aaaucuacacuccaguga

SEQ ID NO: 1734581 - RNA, 13 nt, Homo sapiens
aacacagugucug

SEQ ID NO: 1734582 - RNA, 17 nt, Homo sapiens
aacauagcaucucagga

SEQ ID NO: 1734583 - RNA, 14 nt, Homo sapiens
aacauguucacuua

SEQ ID NO: 1734584 - RNA, 18 nt, Homo sapiens
aaccacuucauucuugaa

SEQ ID NO: 1734585 - RNA, 15 nt, Homo sapiens
aaccaugcccaagaa

SEQ ID NO: 1734586 - RNA, 21 nt, Homo sapiens
aaccucauuccccaaccacuu

SEQ ID NO: 1734587 - RNA, 12 nt, Homo sapiens
ugcaagacauag

SEQ ID NO: 1734588 - RNA, 20 nt, Homo sapiens
ugcacuccagccugagcgac

SEQ ID NO: 1734589 - RNA, 22 nt, Homo sapiens
ugcagauaaacaguagugauag

SEQ ID NO: 1734590 - RNA, 15 nt, Homo sapiens
ugcagcugugccaua

SEQ ID NO: 1734591 - RNA, 14 nt, Homo sapiens
ugcauacaguaauu

SEQ ID NO: 1734592 - RNA, 14 nt, Homo sapiens
ugcauuugcacuau

SEQ ID NO: 1734593 - RNA, 17 nt, Homo sapiens
ugccaugcuggccaggc

SEQ ID NO: 1734594 - RNA, 14 nt, Homo sapiens
ugccuguaaucaca

SEQ ID NO: 1734595 - RNA, 16 nt, Homo sapiens
uggaaaaaaaggaaga

SEQ ID NO: 1734596 - RNA, 15 nt, Homo sapiens
uggaaaaugugcaau

SEQ ID NO: 1734597 - RNA, 16 nt, Homo sapiens
uggaaaaugugcaaua

SEQ ID NO: 1734598 - RNA, 21 nt, Homo sapiens
uggacaguuuucugcuuuaau

SEQ ID NO: 1734599 - RNA, 14 nt, Homo sapiens
uggagacaccacca

SEQ ID NO: 1734600 - RNA, 22 nt, Homo sapiens
uggcaaaucucuauuaggaaau

SEQ ID NO: 1734601 - RNA, 17 nt, Homo sapiens
uggcgcgcgccaccacg

SEQ ID NO: 1734602 - RNA, 22 nt, Homo sapiens
uguaaguuuaugcauacaguaa

SEQ ID NO: 1734603 - RNA, 19 nt, Homo sapiens
uguaaucacagcuacuugg

SEQ ID NO: 1734604 - RNA, 19 nt, Homo sapiens
uguaaucccagcuacuugg

SEQ ID NO: 1734605 - RNA, 16 nt, Homo sapiens
uguaucuuauucacau

SEQ ID NO: 1734606 - RNA, 23 nt, Homo sapiens
ugucuuacagagaaaagacauaa

SEQ ID NO: 1734607 - RNA, 22 nt, Homo sapiens
ugucuugggaauuuucuuccaa

SEQ ID NO: 1734608 - RNA, 21 nt, Homo sapiens
ugugacuuaaugccacuaaau

SEQ ID NO: 1734609 - RNA, 15 nt, Homo sapiens
ugugauuacaaggcu

SEQ ID NO: 1734610 - RNA, 9 nt, Homo sapiens
ugugcaaua

SEQ ID NO: 1734611 - RNA, 17 nt, Homo sapiens
uguggcauuuucacuuu

SEQ ID NO: 1734612 - RNA, 14 nt, Homo sapiens
uguggucacaggaa

SEQ ID NO: 1734613 - RNA, 21 nt, Homo sapiens
ugugguccgaagucuuccaua

SEQ ID NO: 1734614 - RNA, 21 nt, Homo sapiens
uguuuucugacuaauuaggca

SEQ ID NO: 1734615 - RNA, 20 nt, Homo sapiens
uuaaaaucuaauucaaacua

SEQ ID NO: 1734616 - RNA, 21 nt, Homo sapiens
uuaaacucagggagcauuuau

SEQ ID NO: 1734617 - RNA, 14 nt, Homo sapiens
uuaacacagugucu

SEQ ID NO: 1734618 - RNA, 14 nt, Homo sapiens
uuacagagacagaa

SEQ ID NO: 1734619 - RNA, 22 nt, Homo sapiens
uuacuauuuauugcugaaugac

SEQ ID NO: 1734620 - RNA, 21 nt, Homo sapiens
uuauaagugaagugauacuau

SEQ ID NO: 1734621 - RNA, 16 nt, Homo sapiens
uuaugcuaagugaaau

SEQ ID NO: 1734622 - RNA, 17 nt, Homo sapiens
uucaaaauuggacuuaa

SEQ ID NO: 1734623 - RNA, 15 nt, Homo sapiens
uuccauuccaagccu

SEQ ID NO: 1734624 - RNA, 18 nt, Homo sapiens
uucccugaccucccucua

SEQ ID NO: 1734625 - RNA, 17 nt, Homo sapiens
uucuauuacgugcaaua

SEQ ID NO: 1734626 - RNA, 22 nt, Homo sapiens
uucucugccuugguauagcaua

SEQ ID NO: 1734627 - RNA, 13 nt, Homo sapiens
uucugcaagcuuu

SEQ ID NO: 1734628 - RNA, 17 nt, Homo sapiens
uuggaaaaugugcaaua

SEQ ID NO: 1734629 - RNA, 21 nt, Homo sapiens
uugguacuagauacugaaugu

SEQ ID NO: 1734630 - RNA, 14 nt, Homo sapiens
uuguaaaauggugu

SEQ ID NO: 1734631 - RNA, 18 nt, Homo sapiens
uuguaaaauggugugacc

SEQ ID NO: 1734632 - RNA, 18 nt, Homo sapiens
uuguacaccaauauucau

SEQ ID NO: 1734633 - RNA, 18 nt, Homo sapiens
uuguagccacuucacuuu

SEQ ID NO: 1734634 - RNA, 14 nt, Homo sapiens
uuuaaguaauuuca

SEQ ID NO: 1734635 - RNA, 16 nt, Homo sapiens
uuuaaucaccaaggcu

SEQ ID NO: 1734636 - RNA, 15 nt, Homo sapiens
uuuaauggcauguca

SEQ ID NO: 1734637 - RNA, 17 nt, Homo sapiens
uuuaauggcaugucaga

SEQ ID NO: 1734638 - RNA, 17 nt, Homo sapiens
uuuaaugggcacagggu

SEQ ID NO: 1734639 - RNA, 13 nt, Homo sapiens
uuuacuuccucag

SEQ ID NO: 1734640 - RNA, 11 nt, Homo sapiens
uuuacuuuguu

SEQ ID NO: 1734641 - RNA, 15 nt, Homo sapiens
uuuagggaccugcug

SEQ ID NO: 1734642 - RNA, 14 nt, Homo sapiens
uuuaugauuccacc

SEQ ID NO: 1734643 - RNA, 15 nt, Homo sapiens
uuuaugcuaagugaa

SEQ ID NO: 1734644 - RNA, 13 nt, Homo sapiens
uuuaugugcaaua

SEQ ID NO: 1734645 - RNA, 21 nt, Homo sapiens
uuucaccuguuuuuaagcugu

SEQ ID NO: 1734646 - RNA, 22 nt, Homo sapiens
uuucaugaaaagauuaugaucu

SEQ ID NO: 1734647 - RNA, 22 nt, Homo sapiens
uuuccuagcgcagccaugugau

SEQ ID NO: 1734648 - RNA, 13 nt, Homo sapiens
uuugcaagacaua

SEQ ID NO: 1734649 - RNA, 21 nt, Homo sapiens
uuuuuaaacaaaaaaagcauu

SEQ ID NO: 1734650 - RNA, 19 nt, Homo sapiens
aaaacuuuaugcuaaguga

SEQ ID NO: 1734651 - RNA, 11 nt, Homo sapiens
aaaagacauaa

SEQ ID NO: 1734652 - RNA, 22 nt, Homo sapiens
aaaauauuuuuaugugcaauaa

SEQ ID NO: 1734653 - RNA, 17 nt, Homo sapiens
aaaauuaucaauaucua

SEQ ID NO: 1734654 - RNA, 14 nt, Homo sapiens
aaaccaaggcuaga

SEQ ID NO: 1734655 - RNA, 18 nt, Homo sapiens
aaacuuuaugcuaaguga

SEQ ID NO: 1734656 - RNA, 22 nt, Homo sapiens
aaagggucucccucuguugcca

SEQ ID NO: 1734657 - RNA, 21 nt, Homo sapiens
aaauaacuaggcguggacuua

SEQ ID NO: 1734658 - RNA, 12 nt, Homo sapiens
aaauagugucug

SEQ ID NO: 1734659 - RNA, 17 nt, Homo sapiens
aaauagugucugaugaa

SEQ ID NO: 1734660 - RNA, 15 nt, Homo sapiens
aaauggagugacuua

SEQ ID NO: 1734661 - RNA, 12 nt, Homo sapiens
aaaugugcaaua

SEQ ID NO: 1734662 - RNA, 16 nt, Homo sapiens
aacagaagcuuccauu

SEQ ID NO: 1734663 - RNA, 15 nt, Homo sapiens
aacauagcaucucag

SEQ ID NO: 1734664 - RNA, 22 nt, Homo sapiens
aacccaaauguucaucaaugaa

SEQ ID NO: 1734665 - RNA, 20 nt, Homo sapiens
aaccuccaccuucuggguuc

SEQ ID NO: 1734666 - RNA, 15 nt, Homo sapiens
aaccuuuacauccag

SEQ ID NO: 1734667 - RNA, 17 nt, Homo sapiens
aacuagaauuuauucaa

SEQ ID NO: 1734668 - RNA, 21 nt, Homo sapiens
aacucaaggaaaucuguguca

SEQ ID NO: 1734669 - RNA, 18 nt, Homo sapiens
aacucauugcaaccucca

SEQ ID NO: 1734670 - RNA, 13 nt, Homo sapiens
aagaaauucugca

SEQ ID NO: 1734671 - RNA, 23 nt, Homo sapiens
aagaaauucugcaagcuuuucaa

SEQ ID NO: 1734672 - RNA, 16 nt, Homo sapiens
aagaaugacuaugcaa

SEQ ID NO: 1734673 - RNA, 23 nt, Homo sapiens
aagauguagaggagaaacuggaa

SEQ ID NO: 1734674 - RNA, 18 nt, Homo sapiens
aagcaacccaaauguuca

SEQ ID NO: 1734675 - RNA, 15 nt, Homo sapiens
aagcccaauauuaua

SEQ ID NO: 1734676 - RNA, 22 nt, Homo sapiens
aagcuuccauuccaagccugac

SEQ ID NO: 1734677 - RNA, 15 nt, Homo sapiens
aagugauacuaucca

SEQ ID NO: 1734678 - RNA, 15 nt, Homo sapiens
aagugcugggaauua

SEQ ID NO: 1734679 - RNA, 12 nt, Homo sapiens
aaguuuaugcau

SEQ ID NO: 1734680 - RNA, 13 nt, Homo sapiens
aauaaaagcacuu

SEQ ID NO: 1734681 - RNA, 16 nt, Homo sapiens
aauagugucugaugaa

SEQ ID NO: 1734682 - RNA, 13 nt, Homo sapiens
aauauuguugaca

SEQ ID NO: 1734683 - RNA, 17 nt, Homo sapiens
aauauuugcaagacaua

SEQ ID NO: 1734684 - RNA, 12 nt, Homo sapiens
aaucuacacucc

SEQ ID NO: 1734685 - RNA, 13 nt, Homo sapiens
aaucugagccagu

SEQ ID NO: 1734686 - RNA, 23 nt, Homo sapiens
aaucugagccagugcuuuaaugg

SEQ ID NO: 1734687 - RNA, 13 nt, Homo sapiens
aaugaauggcuaa

SEQ ID NO: 1734688 - RNA, 15 nt, Homo sapiens
aaugauuucauucaa

SEQ ID NO: 1734689 - RNA, 17 nt, Homo sapiens
aauggaaaguaacucau

SEQ ID NO: 1734690 - RNA, 21 nt, Homo sapiens
aauggcuaagcaaaaugugau

SEQ ID NO: 1734691 - RNA, 11 nt, Homo sapiens
aaugugcaaua

SEQ ID NO: 1734692 - RNA, 16 nt, Homo sapiens
aauguucaucaaugaa

SEQ ID NO: 1734693 - RNA, 18 nt, Homo sapiens
aacauuggcuacaaagac

SEQ ID NO: 1734694 - RNA, 21 nt, Homo sapiens
aagaccuaccuagaugcuccu

SEQ ID NO: 1734695 - RNA, 18 nt, Homo sapiens
aaggccuuauucauuuca

SEQ ID NO: 1734696 - RNA, 22 nt, Homo sapiens
aauaaaggccuuauucauuuca

SEQ ID NO: 1734697 - RNA, 16 nt, Homo sapiens
aauauuuaagugcagu

SEQ ID NO: 1734698 - RNA, 16 nt, Homo sapiens
acagcccucacuuucu

SEQ ID NO: 1734699 - RNA, 16 nt, Homo sapiens
auuccuugccaugugg

SEQ ID NO: 1734700 - RNA, 19 nt, Homo sapiens
cuaaauauuuaagugcagu

SEQ ID NO: 1734701 - RNA, 16 nt, Homo sapiens
cuaccuagaugcuccu

SEQ ID NO: 1734702 - RNA, 11 nt, Homo sapiens
cuggcuaauaa

SEQ ID NO: 1734703 - RNA, 21 nt, Homo sapiens
cuuauguuuaguuucaauauu

SEQ ID NO: 1734704 - RNA, 16 nt, Homo sapiens
cuuuuauuacagucaa

SEQ ID NO: 1734705 - RNA, 22 nt, Homo sapiens
gucauuucuuuuugguuugcaa

SEQ ID NO: 1734706 - RNA, 18 nt, Homo sapiens
uacaaagaccuaccuaga

SEQ ID NO: 1734707 - RNA, 13 nt, Homo sapiens
uauucuggacuaa

SEQ ID NO: 1734708 - RNA, 22 nt, Homo sapiens
aaagaccuaccuagaugcuccu

SEQ ID NO: 1734709 - RNA, 18 nt, Homo sapiens
aacuuuuauuacagucaa

SEQ ID NO: 1734710 - RNA, 22 nt, Homo sapiens
acuaaauauuuaagugcaguca

SEQ ID NO: 1734711 - RNA, 17 nt, Homo sapiens
acucuauucauuccuug

SEQ ID NO: 1734712 - RNA, 22 nt, Homo sapiens
aucggguaacauuggcuacaaa

SEQ ID NO: 1734713 - RNA, 14 nt, Homo sapiens
auuccuugccaugu

SEQ ID NO: 1734714 - RNA, 13 nt, Homo sapiens
auuuaagugcagu

SEQ ID NO: 1734715 - RNA, 15 nt, Homo sapiens
cuuuuauuacaguca

SEQ ID NO: 1734716 - RNA, 21 nt, Homo sapiens
gacuaaauauuuaagugcagu

SEQ ID NO: 1734717 - RNA, 17 nt, Homo sapiens
gcaacucuauucauucc

SEQ ID NO: 1734718 - RNA, 22 nt, Homo sapiens
gcaacucuauucauuccuugcc

SEQ ID NO: 1734719 - RNA, 22 nt, Homo sapiens
gcuaacuuuuauuacagucaau

SEQ ID NO: 1734720 - RNA, 21 nt, Homo sapiens
gguaacauuggcuacaaagac

SEQ ID NO: 1734721 - RNA, 19 nt, Homo sapiens
uaacauuggcuacaaagac

SEQ ID NO: 1734722 - RNA, 19 nt, Homo sapiens
uaacuuuuauuacagucaa

SEQ ID NO: 1734723 - RNA, 23 nt, Homo sapiens
uaauaaaggccuuauucauuuca

SEQ ID NO: 1734724 - RNA, 17 nt, Homo sapiens
uagaugcuccuuuuuac

SEQ ID NO: 1734725 - RNA, 17 nt, Homo sapiens
aaauauuuaagugcagu

SEQ ID NO: 1734726 - RNA, 20 nt, Homo sapiens
acauuggcuacaaagaccua

SEQ ID NO: 1734727 - RNA, 12 nt, Homo sapiens
agaccuaccuag

SEQ ID NO: 1734728 - RNA, 16 nt, Homo sapiens
auucauuccuugccau

SEQ ID NO: 1734729 - RNA, 18 nt, Homo sapiens
auuggcuacaaagaccua

SEQ ID NO: 1734730 - RNA, 22 nt, Homo sapiens
auuggcuacaaagaccuaccua

SEQ ID NO: 1734731 - RNA, 19 nt, Homo sapiens
cuaacuuuuauuacaguca

SEQ ID NO: 1734732 - RNA, 13 nt, Homo sapiens
cuacaaagaccua

SEQ ID NO: 1734733 - RNA, 20 nt, Homo sapiens
gaccuaccuagaugcuccuu

SEQ ID NO: 1734734 - RNA, 18 nt, Homo sapiens
uaaauauuuaagugcagu

SEQ ID NO: 1734735 - RNA, 13 nt, Homo sapiens
aaagaccuaccua

SEQ ID NO: 1734736 - RNA, 23 nt, Homo sapiens
aaagaccuaccuagaugcuccuu

SEQ ID NO: 1734737 - RNA, 21 nt, Homo sapiens
aaauauuuaagugcagucauu

SEQ ID NO: 1734738 - RNA, 15 nt, Homo sapiens
acaaagaccuaccua

SEQ ID NO: 1734739 - RNA, 20 nt, Homo sapiens
acuaaauauuuaagugcagu

SEQ ID NO: 1734740 - RNA, 13 nt, Homo sapiens
auucuggacuaaa

SEQ ID NO: 1734741 - RNA, 17 nt, Homo sapiens
auuuaagugcagucauu

SEQ ID NO: 1734742 - RNA, 13 nt, Homo sapiens
ccuagaugcuccu

SEQ ID NO: 1734743 - RNA, 17 nt, Homo sapiens
cuaccuagaugcuccuu

SEQ ID NO: 1734744 - RNA, 22 nt, Homo sapiens
ggacuaaauauuuaagugcagu

SEQ ID NO: 1734745 - RNA, 13 nt, Homo sapiens
uaauaaaggccuu

SEQ ID NO: 1734746 - RNA, 14 nt, Homo sapiens
ucauuccuugccau

SEQ ID NO: 1734747 - RNA, 19 nt, Homo sapiens
uggcuacaaagaccuaccu

SEQ ID NO: 1734748 - RNA, 20 nt, Homo sapiens
uggcuacaaagaccuaccua

SEQ ID NO: 1734749 - RNA, 16 nt, Homo sapiens
uaacauuggcuacaaa

SEQ ID NO: 1734750 - RNA, 14 nt, Homo sapiens
uauucuggacuaaa

SEQ ID NO: 1734751 - RNA, 17 nt, Homo sapiens
uauuguuuucuuuucuc

SEQ ID NO: 1734752 - RNA, 11 nt, Homo sapiens
ugcagucauuu

SEQ ID NO: 1734753 - RNA, 21 nt, Homo sapiens
ugccauguggcuaacuuuuau

SEQ ID NO: 1734754 - RNA, 23 nt, Homo sapiens
uggacuaaauauuuaagugcagu

SEQ ID NO: 1734755 - RNA, 11 nt, Homo sapiens
uuaagugcagu

SEQ ID NO: 1734756 - RNA, 15 nt, Homo sapiens
aaaagaacaaugaca

SEQ ID NO: 1734757 - RNA, 14 nt, Homo sapiens
aaaagcaauacugu

SEQ ID NO: 1734758 - RNA, 16 nt, Homo sapiens
aaaagcaauacuguuu

SEQ ID NO: 1734759 - RNA, 15 nt, Homo sapiens
aaaauaugaccacac

SEQ ID NO: 1734760 - RNA, 21 nt, Homo sapiens
aaaaucucccagugacaacau

SEQ ID NO: 1734761 - RNA, 19 nt, Homo sapiens
aaaauuaaucugggccaga

SEQ ID NO: 1734762 - RNA, 15 nt, Homo sapiens
aaacaaacucauuca

SEQ ID NO: 1734763 - RNA, 9 nt, Homo sapiens
aaacauguu

SEQ ID NO: 1734764 - RNA, 20 nt, Homo sapiens
aaacauguuguacauuucac

SEQ ID NO: 1734765 - RNA, 14 nt, Homo sapiens
aaacauuucuggac

SEQ ID NO: 1734766 - RNA, 14 nt, Homo sapiens
aaaccauccaguga

SEQ ID NO: 1734767 - RNA, 13 nt, Homo sapiens
aaacccucgaggc

SEQ ID NO: 1734768 - RNA, 14 nt, Homo sapiens
aaacugucuuggcu

SEQ ID NO: 1734769 - RNA, 18 nt, Homo sapiens
aaacuuugcaucucagua

SEQ ID NO: 1734770 - RNA, 11 nt, Homo sapiens
aaagacaucag

SEQ ID NO: 1734771 - RNA, 18 nt, Homo sapiens
aaagacgauuugucaguu

SEQ ID NO: 1734772 - RNA, 12 nt, Homo sapiens
aaagcaaauguc

SEQ ID NO: 1734773 - RNA, 17 nt, Homo sapiens
aaagccuccucaucccg

SEQ ID NO: 1734774 - RNA, 22 nt, Homo sapiens
aaagcuuuauuaccaguggcgu

SEQ ID NO: 1734775 - RNA, 15 nt, Homo sapiens
aaaggcugguggcaa

SEQ ID NO: 1734776 - RNA, 15 nt, Homo sapiens
aaauaaaagcacuua

SEQ ID NO: 1734777 - RNA, 22 nt, Homo sapiens
aaauacacagugcugaccagac

SEQ ID NO: 1734778 - RNA, 22 nt, Homo sapiens
aaauacuguuugagguuuuuaa

SEQ ID NO: 1734779 - RNA, 22 nt, Homo sapiens
aaauagacccacaagaggcagu

SEQ ID NO: 1734780 - RNA, 12 nt, Homo sapiens
aaauagugucug

SEQ ID NO: 1734781 - RNA, 14 nt, Homo sapiens
aaauccaaguagau

SEQ ID NO: 1734782 - RNA, 15 nt, Homo sapiens
aaaugggaauucuca

SEQ ID NO: 1734783 - RNA, 22 nt, Homo sapiens
aaaugugucauuggaagccauc

SEQ ID NO: 1734784 - RNA, 20 nt, Homo sapiens
aaauuaaccucucacaguua

SEQ ID NO: 1734785 - RNA, 22 nt, Homo sapiens
aaauucccaacuucucuugcuu

SEQ ID NO: 1734786 - RNA, 19 nt, Homo sapiens
aaauucccuggccuuucau

SEQ ID NO: 1734787 - RNA, 12 nt, Homo sapiens
aaauugcugcuu

SEQ ID NO: 1734788 - RNA, 14 nt, Homo sapiens
aacaaauaauuugu

SEQ ID NO: 1734789 - RNA, 20 nt, Homo sapiens
aacagacaagugacuguauc

SEQ ID NO: 1734790 - RNA, 17 nt, Homo sapiens
aacagauggcacuuuga

SEQ ID NO: 1734791 - RNA, 21 nt, Homo sapiens
aacagcaugggccucaccucc

SEQ ID NO: 1734792 - RNA, 19 nt, Homo sapiens
aacauguuguacauuucac

SEQ ID NO: 1734793 - RNA, 20 nt, Homo sapiens
aacauuucuggacaguaccu

SEQ ID NO: 1734794 - RNA, 17 nt, Homo sapiens
aaccagagccugagugu

SEQ ID NO: 1734795 - RNA, 17 nt, Homo sapiens
aaccauccagugacaaa

SEQ ID NO: 1734796 - RNA, 23 nt, Homo sapiens
aacccaaagugugacucauuaaa

SEQ ID NO: 1734797 - RNA, 14 nt, Homo sapiens
aaccuccauucuau

SEQ ID NO: 1734798 - RNA, 13 nt, Homo sapiens
aaccuccuaaaau

SEQ ID NO: 1734799 - RNA, 18 nt, Homo sapiens
aacugaaaacaagccaug

SEQ ID NO: 1734800 - RNA, 21 nt, Homo sapiens
aacugaaggggugcacccacc

SEQ ID NO: 1734801 - RNA, 22 nt, Homo sapiens
aacuugagcgugaaucuguauc

SEQ ID NO: 1734802 - RNA, 16 nt, Homo sapiens
aacuuuaucauaugcu

SEQ ID NO: 1734803 - RNA, 15 nt, Homo sapiens
aacuuugcaucucag

SEQ ID NO: 1734804 - RNA, 22 nt, Homo sapiens
aagaaggccacuguuugucuca

SEQ ID NO: 1734805 - RNA, 15 nt, Homo sapiens
aagacaaacuuugca

SEQ ID NO: 1734806 - RNA, 15 nt, Homo sapiens
aagacaucagucucc

SEQ ID NO: 1734807 - RNA, 16 nt, Homo sapiens
aagaccugagaaugua

SEQ ID NO: 1734808 - RNA, 16 nt, Homo sapiens
aagagaucuuucuuuc

SEQ ID NO: 1734809 - RNA, 17 nt, Homo sapiens
aagagaucuuucuuucc

SEQ ID NO: 1734810 - RNA, 21 nt, Homo sapiens
aagcacuuuaacacagugucu

SEQ ID NO: 1734811 - RNA, 17 nt, Homo sapiens
aagcugugcccugacca

SEQ ID NO: 1734812 - RNA, 12 nt, Homo sapiens
aaggaaacuggg

SEQ ID NO: 1734813 - RNA, 18 nt, Homo sapiens
aaggaaacuggguuccug

SEQ ID NO: 1734814 - RNA, 15 nt, Homo sapiens
aaggauaugauuaau

SEQ ID NO: 1734815 - RNA, 19 nt, Homo sapiens
aaggccacuguuugucuca

SEQ ID NO: 1734816 - RNA, 23 nt, Homo sapiens
aaggggccucaccgagugggggc

SEQ ID NO: 1734817 - RNA, 15 nt, Homo sapiens
aaguacccugagaua

SEQ ID NO: 1734818 - RNA, 18 nt, Homo sapiens
aagucucugugaauugaa

SEQ ID NO: 1734819 - RNA, 14 nt, Homo sapiens
aauaaaagcacuua

SEQ ID NO: 1734820 - RNA, 22 nt, Homo sapiens
aauacauaaaguaugugcauau

SEQ ID NO: 1734821 - RNA, 24 nt, Homo sapiens
aauacauaaaguaugugcauauuu

SEQ ID NO: 1734822 - RNA, 16 nt, Homo sapiens
aauagacaauuugcac

SEQ ID NO: 1734823 - RNA, 14 nt, Homo sapiens
aauaguauuugcau

SEQ ID NO: 1734824 - RNA, 21 nt, Homo sapiens
aauaugggcacuuuaaaugaa

SEQ ID NO: 1734825 - RNA, 15 nt, Homo sapiens
aaucaaucuacucaa

SEQ ID NO: 1734826 - RNA, 13 nt, Homo sapiens
aaucucccaguga

SEQ ID NO: 1734827 - RNA, 22 nt, Homo sapiens
aaucucccagugacaacaucgc

SEQ ID NO: 1734828 - RNA, 18 nt, Homo sapiens
aaugagcacccauuccaa

SEQ ID NO: 1734829 - RNA, 17 nt, Homo sapiens
aaugaggucuguuuaaa

SEQ ID NO: 1734830 - RNA, 15 nt, Homo sapiens
aaugggaaaaccaga

SEQ ID NO: 1734831 - RNA, 20 nt, Homo sapiens
aauucaaucagagcuccagu

SEQ ID NO: 1734832 - RNA, 22 nt, Homo sapiens
aauuuauaguuaaggcuaaaaa

SEQ ID NO: 1734833 - RNA, 20 nt, Homo sapiens
aauuugguaaaaaugcugcu

SEQ ID NO: 1734834 - RNA, 19 nt, Homo sapiens
aauuuuagaacaguccagc

SEQ ID NO: 1734835 - RNA, 13 nt, Homo sapiens
acaaaacaaacuc

SEQ ID NO: 1734836 - RNA, 13 nt, Homo sapiens
acaaacugaagag

SEQ ID NO: 1734837 - RNA, 18 nt, Homo sapiens
acaaaugggaaaaccaga

SEQ ID NO: 1734838 - RNA, 13 nt, Homo sapiens
acaagugacugua

SEQ ID NO: 1734839 - RNA, 11 nt, Homo sapiens
acaaugcauuc

SEQ ID NO: 1734840 - RNA, 12 nt, Homo sapiens
acacacacaaac

SEQ ID NO: 1734841 - RNA, 21 nt, Homo sapiens
acacaggccagcuccacagug

SEQ ID NO: 1734842 - RNA, 20 nt, Homo sapiens
acacccagcucagcauuucc

SEQ ID NO: 1734843 - RNA, 13 nt, Homo sapiens
acacccuguacug

SEQ ID NO: 1734844 - RNA, 17 nt, Homo sapiens
acacgagcaaacccaga

SEQ ID NO: 1734845 - RNA, 12 nt, Homo sapiens
acacugcugcuc

SEQ ID NO: 1734846 - RNA, 20 nt, Homo sapiens
acacugcugcuccagugcag

SEQ ID NO: 1734847 - RNA, 23 nt, Homo sapiens
acagauuccuggcagagccaugg

SEQ ID NO: 1734848 - RNA, 19 nt, Homo sapiens
acagcgcuggccgggaccc

SEQ ID NO: 1734849 - RNA, 22 nt, Homo sapiens
acagcugugucugccaaacaca

SEQ ID NO: 1734850 - RNA, 22 nt, Homo sapiens
acaggaaaaaaaauuaggccgu

SEQ ID NO: 1734851 - RNA, 15 nt, Homo sapiens
acaggcgugagccac

SEQ ID NO: 1734852 - RNA, 14 nt, Homo sapiens
acagggcauucaaa

SEQ ID NO: 1734853 - RNA, 19 nt, Homo sapiens
acagugccucuuccaguga

SEQ ID NO: 1734854 - RNA, 21 nt, Homo sapiens
acaguggccaagaucacagug

SEQ ID NO: 1734855 - RNA, 16 nt, Homo sapiens
acagugucuggcacuu

SEQ ID NO: 1734856 - RNA, 20 nt, Homo sapiens
acaguguuuuguagauuuca

SEQ ID NO: 1734857 - RNA, 22 nt, Homo sapiens
acauacauugauucaugucuca

SEQ ID NO: 1734858 - RNA, 14 nt, Homo sapiens
acaucucugcaauc

SEQ ID NO: 1734859 - RNA, 14 nt, Homo sapiens
acauucccacugcc

SEQ ID NO: 1734860 - RNA, 14 nt, Homo sapiens
acauugauucaugu

SEQ ID NO: 1734861 - RNA, 22 nt, Homo sapiens
acauuucuggacaguaccugau

SEQ ID NO: 1734862 - RNA, 16 nt, Homo sapiens
accaaagacaucaguc

SEQ ID NO: 1734863 - RNA, 19 nt, Homo sapiens
caggaugaggcagaaggaa

SEQ ID NO: 1734864 - RNA, 16 nt, Homo sapiens
caggauguacaaggac

SEQ ID NO: 1734865 - RNA, 18 nt, Homo sapiens
caggcaacgcacaaaaca

SEQ ID NO: 1734866 - RNA, 20 nt, Homo sapiens
caggccaccccgcugaugga

SEQ ID NO: 1734867 - RNA, 17 nt, Homo sapiens
caggccgcagcuccauu

SEQ ID NO: 1734868 - RNA, 15 nt, Homo sapiens
caggcuccaaacugg

SEQ ID NO: 1734869 - RNA, 19 nt, Homo sapiens
cagguaguauuacaccacc

SEQ ID NO: 1734870 - RNA, 16 nt, Homo sapiens
caguaaucccauuucc

SEQ ID NO: 1734871 - RNA, 18 nt, Homo sapiens
caguaaucccauuuccca

SEQ ID NO: 1734872 - RNA, 16 nt, Homo sapiens
caguacccucucagcu

SEQ ID NO: 1734873 - RNA, 15 nt, Homo sapiens
cagugcaaagauuug

SEQ ID NO: 1734874 - RNA, 18 nt, Homo sapiens
cagugucuggcacuuggg

SEQ ID NO: 1734875 - RNA, 18 nt, Homo sapiens
caguucauugcacuuuga

SEQ ID NO: 1734876 - RNA, 23 nt, Homo sapiens
caguuccauuucauuugugccag

SEQ ID NO: 1734877 - RNA, 16 nt, Homo sapiens
cauaaaguaugugcau

SEQ ID NO: 1734878 - RNA, 13 nt, Homo sapiens
cauacaacagaaa

SEQ ID NO: 1734879 - RNA, 21 nt, Homo sapiens
cauacauugauucaugucuca

SEQ ID NO: 1734880 - RNA, 18 nt, Homo sapiens
cauacuggccuggacugu

SEQ ID NO: 1734881 - RNA, 14 nt, Homo sapiens
cauccagugacaaa

SEQ ID NO: 1734882 - RNA, 15 nt, Homo sapiens
caucccuggaaggac

SEQ ID NO: 1734883 - RNA, 16 nt, Homo sapiens
caucccuuuuuuuaca

SEQ ID NO: 1734884 - RNA, 24 nt, Homo sapiens
cauccuuggaaauuggaagagcac

SEQ ID NO: 1734885 - RNA, 14 nt, Homo sapiens
caucucagugcagg

SEQ ID NO: 1734886 - RNA, 15 nt, Homo sapiens
caucucagugcagga

SEQ ID NO: 1734887 - RNA, 17 nt, Homo sapiens
caucucugcaguuuuuc

SEQ ID NO: 1734888 - RNA, 18 nt, Homo sapiens
caugaauuauuacagugu

SEQ ID NO: 1734889 - RNA, 23 nt, Homo sapiens
caugaccugaagccccucccuga

SEQ ID NO: 1734890 - RNA, 21 nt, Homo sapiens
caugcuuagcaguccccuucc

SEQ ID NO: 1734891 - RNA, 14 nt, Homo sapiens
cauggccaccacca

SEQ ID NO: 1734892 - RNA, 17 nt, Homo sapiens
cauguacauacccuggc

SEQ ID NO: 1734893 - RNA, 18 nt, Homo sapiens
cauguaccucugauuaau

SEQ ID NO: 1734894 - RNA, 21 nt, Homo sapiens
caugugcguccauauuuaaca

SEQ ID NO: 1734895 - RNA, 22 nt, Homo sapiens
cauuauuuuuguuagcaaagau

SEQ ID NO: 1734896 - RNA, 19 nt, Homo sapiens
cauucaggcaacgcacaaa

SEQ ID NO: 1734897 - RNA, 21 nt, Homo sapiens
cauucaugacugaacugaaaa

SEQ ID NO: 1734898 - RNA, 13 nt, Homo sapiens
cauucuacucaaa

SEQ ID NO: 1734899 - RNA, 15 nt, Homo sapiens
cauucuauuuuagaa

SEQ ID NO: 1734900 - RNA, 18 nt, Homo sapiens
cauugccuuuucuagccc

SEQ ID NO: 1734901 - RNA, 14 nt, Homo sapiens
cauugggauauucu

SEQ ID NO: 1734902 - RNA, 21 nt, Homo sapiens
cauuguucuugugaacccaaa

SEQ ID NO: 1734903 - RNA, 14 nt, Homo sapiens
cauuguugucaagg

SEQ ID NO: 1734904 - RNA, 18 nt, Homo sapiens
cauuuaucuaaauaugga

SEQ ID NO: 1734905 - RNA, 15 nt, Homo sapiens
cauuuccaagcacuu

SEQ ID NO: 1734906 - RNA, 11 nt, Homo sapiens
cauuuggucuc

SEQ ID NO: 1734907 - RNA, 14 nt, Homo sapiens
cauuuggucucagg

SEQ ID NO: 1734908 - RNA, 16 nt, Homo sapiens
cauuuuugaaaccaaa

SEQ ID NO: 1734909 - RNA, 18 nt, Homo sapiens
ccaaacuggagcuugaaa

SEQ ID NO: 1734910 - RNA, 20 nt, Homo sapiens
ccaaagcccuuauguuuaau

SEQ ID NO: 1734911 - RNA, 16 nt, Homo sapiens
ccaaccugaagacacc

SEQ ID NO: 1734912 - RNA, 21 nt, Homo sapiens
ccaagccuacuuuugccauug

SEQ ID NO: 1734913 - RNA, 14 nt, Homo sapiens
ccaaggcuggagug

SEQ ID NO: 1734914 - RNA, 18 nt, Homo sapiens
ccaaggcuggagugcagu

SEQ ID NO: 1734915 - RNA, 13 nt, Homo sapiens
ccaauaaagccuu

SEQ ID NO: 1734916 - RNA, 22 nt, Homo sapiens
ccaauaaagccuucaaacuccc

SEQ ID NO: 1734917 - RNA, 12 nt, Homo sapiens
ccaauuccucau

SEQ ID NO: 1734918 - RNA, 23 nt, Homo sapiens
ccaauuugguaaaaaugcugcuc

SEQ ID NO: 1734919 - RNA, 17 nt, Homo sapiens
ccacaaaguaucuaaca

SEQ ID NO: 1734920 - RNA, 21 nt, Homo sapiens
ccacaaaugggaaaaccagac

SEQ ID NO: 1734921 - RNA, 19 nt, Homo sapiens
ccacagcgcuggccgggac

SEQ ID NO: 1734922 - RNA, 13 nt, Homo sapiens
ccaccacugcucc

SEQ ID NO: 1734923 - RNA, 14 nt, Homo sapiens
ccacccccagcuca

SEQ ID NO: 1734924 - RNA, 16 nt, Homo sapiens
ccacccccagcucaau

SEQ ID NO: 1734925 - RNA, 13 nt, Homo sapiens
ccaccuagacugu

SEQ ID NO: 1734926 - RNA, 14 nt, Homo sapiens
ccaccuuucuggac

SEQ ID NO: 1734927 - RNA, 15 nt, Homo sapiens
ccacuucugugccac

SEQ ID NO: 1734928 - RNA, 16 nt, Homo sapiens
ccagaaccaauuauuu

SEQ ID NO: 1734929 - RNA, 13 nt, Homo sapiens
ccagaauuucaaa

SEQ ID NO: 1734930 - RNA, 23 nt, Homo sapiens
ccagagccuuaauaaacguccac

SEQ ID NO: 1734931 - RNA, 12 nt, Homo sapiens
ccagaguaguuu

SEQ ID NO: 1734932 - RNA, 19 nt, Homo sapiens
ccagccagauggacuccag

SEQ ID NO: 1734933 - RNA, 16 nt, Homo sapiens
ccagccguauuuuaca

SEQ ID NO: 1734934 - RNA, 16 nt, Homo sapiens
ccagccugccuggcag

SEQ ID NO: 1734935 - RNA, 16 nt, Homo sapiens
ccaggccucuuggcag

SEQ ID NO: 1734936 - RNA, 20 nt, Homo sapiens
ccaguucauugcacuuugau

SEQ ID NO: 1734937 - RNA, 22 nt, Homo sapiens
ccaucccuuuuuuuacauuuca

SEQ ID NO: 1734938 - RNA, 15 nt, Homo sapiens
ccaucucgggcacag

SEQ ID NO: 1734939 - RNA, 23 nt, Homo sapiens
ccaugcacccucauacacagaaa

SEQ ID NO: 1734940 - RNA, 15 nt, Homo sapiens
ccaugcagcugcucc

SEQ ID NO: 1734941 - RNA, 11 nt, Homo sapiens
cccaagacauu

SEQ ID NO: 1734942 - RNA, 17 nt, Homo sapiens
cccacuucugugccacc

SEQ ID NO: 1734943 - RNA, 11 nt, Homo sapiens
cccacuuugaa

SEQ ID NO: 1734944 - RNA, 22 nt, Homo sapiens
cccagaaagugauaagugcagg

SEQ ID NO: 1734945 - RNA, 22 nt, Homo sapiens
cccagcuguugggaacagcaug

SEQ ID NO: 1734946 - RNA, 19 nt, Homo sapiens
cccagugacaacaucgcaa

SEQ ID NO: 1734947 - RNA, 19 nt, Homo sapiens
cccaguucauugcacuuug

SEQ ID NO: 1734948 - RNA, 21 nt, Homo sapiens
cccaguucauugcacuuugau

SEQ ID NO: 1734949 - RNA, 19 nt, Homo sapiens
cccauucuacacagagcag

SEQ ID NO: 1734950 - RNA, 19 nt, Homo sapiens
cccauucuacucaaaguca

SEQ ID NO: 1734951 - RNA, 11 nt, Homo sapiens
cccccaaagcc

SEQ ID NO: 1734952 - RNA, 19 nt, Homo sapiens
ccccucccacagcgcuggc

SEQ ID NO: 1734953 - RNA, 17 nt, Homo sapiens
ccccugcgggcgcgggc

SEQ ID NO: 1734954 - RNA, 22 nt, Homo sapiens
ccccugucucggggcuugcccc

SEQ ID NO: 1734955 - RNA, 14 nt, Homo sapiens
ccccuuguccuuuc

SEQ ID NO: 1734956 - RNA, 16 nt, Homo sapiens
cccgagccuggcucca

SEQ ID NO: 1734957 - RNA, 17 nt, Homo sapiens
cccgcagggccaugcag

SEQ ID NO: 1734958 - RNA, 22 nt, Homo sapiens
cccuauggaagcauauuguuau

SEQ ID NO: 1734959 - RNA, 13 nt, Homo sapiens
cccucagauuccg

SEQ ID NO: 1734960 - RNA, 19 nt, Homo sapiens
cccucggcucuggaggcaa

SEQ ID NO: 1734961 - RNA, 15 nt, Homo sapiens
cccucugucuuguga

SEQ ID NO: 1734962 - RNA, 20 nt, Homo sapiens
cccugcacucccuccuggag

SEQ ID NO: 1734963 - RNA, 23 nt, Homo sapiens
cccugccaagacuccucaggcag

SEQ ID NO: 1734964 - RNA, 15 nt, Homo sapiens
cccuguccuuucuca

SEQ ID NO: 1734965 - RNA, 20 nt, Homo sapiens
cccugucucggggcuugccc

SEQ ID NO: 1734966 - RNA, 15 nt, Homo sapiens
cccuucucuaccuca

SEQ ID NO: 1734967 - RNA, 19 nt, Homo sapiens
cccuucuuacaaugcauuc

SEQ ID NO: 1734968 - RNA, 20 nt, Homo sapiens
cccuugauuuaaacacacag

SEQ ID NO: 1734969 - RNA, 17 nt, Homo sapiens
cccuugucgugggaugg

SEQ ID NO: 1734970 - RNA, 19 nt, Homo sapiens
cccuuuuucuccagcuggg

SEQ ID NO: 1734971 - RNA, 18 nt, Homo sapiens
cccuuuuuuuacauuuca

SEQ ID NO: 1734972 - RNA, 19 nt, Homo sapiens
ccgcaccaauaaagccuuc

SEQ ID NO: 1734973 - RNA, 16 nt, Homo sapiens
ccgcucacugaacucc

SEQ ID NO: 1734974 - RNA, 13 nt, Homo sapiens
ccguccauuccag

SEQ ID NO: 1734975 - RNA, 17 nt, Homo sapiens
ccuacuccgcucacuga

SEQ ID NO: 1734976 - RNA, 12 nt, Homo sapiens
ucacuucacccu

SEQ ID NO: 1734977 - RNA, 18 nt, Homo sapiens
ucagauuccgcaccaaua

SEQ ID NO: 1734978 - RNA, 13 nt, Homo sapiens
ucagcaaaccauu

SEQ ID NO: 1734979 - RNA, 20 nt, Homo sapiens
ucaggaaacgagacuuucca

SEQ ID NO: 1734980 - RNA, 17 nt, Homo sapiens
ucaguccaaagggcaug

SEQ ID NO: 1734981 - RNA, 19 nt, Homo sapiens
ucagugcaaagauuugcuu

SEQ ID NO: 1734982 - RNA, 18 nt, Homo sapiens
ucaguuaaaucuuugaag

SEQ ID NO: 1734983 - RNA, 22 nt, Homo sapiens
ucaguugucucugaugcagcuu

SEQ ID NO: 1734984 - RNA, 15 nt, Homo sapiens
ucauauacugccaug

SEQ ID NO: 1734985 - RNA, 22 nt, Homo sapiens
ucaucaguauugaagcauuuua

SEQ ID NO: 1734986 - RNA, 18 nt, Homo sapiens
ucaucucagugcuguaaa

SEQ ID NO: 1734987 - RNA, 14 nt, Homo sapiens
ucaugcuucacuua

SEQ ID NO: 1734988 - RNA, 20 nt, Homo sapiens
ucaugcuuuuucagccaugu

SEQ ID NO: 1734989 - RNA, 21 nt, Homo sapiens
ucaugucucacgucucccuaa

SEQ ID NO: 1734990 - RNA, 17 nt, Homo sapiens
ucauuaucaguccaaag

SEQ ID NO: 1734991 - RNA, 22 nt, Homo sapiens
ucauuauuuuuguuagcaaaga

SEQ ID NO: 1734992 - RNA, 13 nt, Homo sapiens
ucauucaguacuu

SEQ ID NO: 1734993 - RNA, 14 nt, Homo sapiens
ucauucaguacuua

SEQ ID NO: 1734994 - RNA, 13 nt, Homo sapiens
uccaaaacauuuc

SEQ ID NO: 1734995 - RNA, 14 nt, Homo sapiens
uccaaagcuuuauu

SEQ ID NO: 1734996 - RNA, 21 nt, Homo sapiens
uccaaagggcauggguuuuau

SEQ ID NO: 1734997 - RNA, 12 nt, Homo sapiens
uccacaccaagc

SEQ ID NO: 1734998 - RNA, 14 nt, Homo sapiens
uccacacccagcuc

SEQ ID NO: 1734999 - RNA, 14 nt, Homo sapiens
uccaggaggcccug

SEQ ID NO: 1735000 - RNA, 16 nt, Homo sapiens
uccagggcaaggccau

SEQ ID NO: 1735001 - RNA, 11 nt, Homo sapiens
uccagugcagg

SEQ ID NO: 1735002 - RNA, 16 nt, Homo sapiens
uccaguuugcauuugg

SEQ ID NO: 1735003 - RNA, 20 nt, Homo sapiens
uccauuuauucuuugaucuu

SEQ ID NO: 1735004 - RNA, 23 nt, Homo sapiens
ucccacccccacccccagcucaa

SEQ ID NO: 1735005 - RNA, 12 nt, Homo sapiens
ucccaggcuucc

SEQ ID NO: 1735006 - RNA, 13 nt, Homo sapiens
uccccacagugcc

SEQ ID NO: 1735007 - RNA, 18 nt, Homo sapiens
uccccacuucugugccac

SEQ ID NO: 1735008 - RNA, 23 nt, Homo sapiens
uccccugucacgugugggcaaug

SEQ ID NO: 1735009 - RNA, 20 nt, Homo sapiens
ucccuccccaguucauugca

SEQ ID NO: 1735010 - RNA, 19 nt, Homo sapiens
ucccugcgccugugaugcu

SEQ ID NO: 1735011 - RNA, 14 nt, Homo sapiens
ucccugggccucag

SEQ ID NO: 1735012 - RNA, 19 nt, Homo sapiens
uccuaagucucuuacaaaa

SEQ ID NO: 1735013 - RNA, 23 nt, Homo sapiens
uccuagcgcagccaugugauuac

SEQ ID NO: 1735014 - RNA, 16 nt, Homo sapiens
uccugagaccagccaa

SEQ ID NO: 1735015 - RNA, 16 nt, Homo sapiens
uccuugcacauaguag

SEQ ID NO: 1735016 - RNA, 16 nt, Homo sapiens
uccuuuuucacuuuga

SEQ ID NO: 1735017 - RNA, 21 nt, Homo sapiens
ucgauccccugucacgugugg

SEQ ID NO: 1735018 - RNA, 16 nt, Homo sapiens
ucgcaucucagugcag

SEQ ID NO: 1735019 - RNA, 17 nt, Homo sapiens
ucgcaucucagugcagg

SEQ ID NO: 1735020 - RNA, 16 nt, Homo sapiens
ucggggacacaggcca

SEQ ID NO: 1735021 - RNA, 15 nt, Homo sapiens
ucuaggacugcagug

SEQ ID NO: 1735022 - RNA, 23 nt, Homo sapiens
ucuaugaccucgcccuccacaaa

SEQ ID NO: 1735023 - RNA, 13 nt, Homo sapiens
ucuauuugugcuu

SEQ ID NO: 1735024 - RNA, 16 nt, Homo sapiens
ucucaaccaccuuuca

SEQ ID NO: 1735025 - RNA, 17 nt, Homo sapiens
ucucaaugaagccagcu

SEQ ID NO: 1735026 - RNA, 15 nt, Homo sapiens
ucucacaagcacuuu

SEQ ID NO: 1735027 - RNA, 23 nt, Homo sapiens
ucucagguaggaagcaacagcuu

SEQ ID NO: 1735028 - RNA, 21 nt, Homo sapiens
ucucauguuuuuuccuuuuca

SEQ ID NO: 1735029 - RNA, 12 nt, Homo sapiens
ucuccacaaagu

SEQ ID NO: 1735030 - RNA, 16 nt, Homo sapiens
ucucccguccauucca

SEQ ID NO: 1735031 - RNA, 16 nt, Homo sapiens
ucucgaacugcuggau

SEQ ID NO: 1735032 - RNA, 18 nt, Homo sapiens
ucucgaacugcuggauuc

SEQ ID NO: 1735033 - RNA, 15 nt, Homo sapiens
ucucgggcacaggcc

SEQ ID NO: 1735034 - RNA, 23 nt, Homo sapiens
ucucuucccugcgccugugaugc

SEQ ID NO: 1735035 - RNA, 20 nt, Homo sapiens
ucugaaucagccagucucag

SEQ ID NO: 1735036 - RNA, 16 nt, Homo sapiens
ucugacaacagacuuc

SEQ ID NO: 1735037 - RNA, 19 nt, Homo sapiens
ucugacgcuugugacagug

SEQ ID NO: 1735038 - RNA, 14 nt, Homo sapiens
ucuguguuaggggu

SEQ ID NO: 1735039 - RNA, 12 nt, Homo sapiens
ucuuaauacugu

SEQ ID NO: 1735040 - RNA, 19 nt, Homo sapiens
ucuuacaaugcauucugag

SEQ ID NO: 1735041 - RNA, 22 nt, Homo sapiens
ucuuccuggcuccaacacugcu

SEQ ID NO: 1735042 - RNA, 19 nt, Homo sapiens
ucuuuaaaaacucacuuac

SEQ ID NO: 1735043 - RNA, 13 nt, Homo sapiens
ucuuuccaaaaca

SEQ ID NO: 1735044 - RNA, 14 nt, Homo sapiens
ucuuuccuggcacu

SEQ ID NO: 1735045 - RNA, 14 nt, Homo sapiens
ucuuuccuguaaag

SEQ ID NO: 1735046 - RNA, 19 nt, Homo sapiens
ucuuucugucugcuuuaaa

SEQ ID NO: 1735047 - RNA, 19 nt, Homo sapiens
ucuuucuuugcaccaaaga

SEQ ID NO: 1735048 - RNA, 13 nt, Homo sapiens
ucuuuggacagaa

SEQ ID NO: 1735049 - RNA, 18 nt, Homo sapiens
ucuuuggacagaagcagc

SEQ ID NO: 1735050 - RNA, 21 nt, Homo sapiens
ucuuuuuuaauaaacuacucu

SEQ ID NO: 1735051 - RNA, 17 nt, Homo sapiens
ucuuuuuuugagugaca

SEQ ID NO: 1735052 - RNA, 14 nt, Homo sapiens
ugaaaacaagccau

SEQ ID NO: 1735053 - RNA, 22 nt, Homo sapiens
ugaaagaggacguguuacccac

SEQ ID NO: 1735054 - RNA, 15 nt, Homo sapiens
ugaacuuuaugcugu

SEQ ID NO: 1735055 - RNA, 13 nt, Homo sapiens
ugaagacuaugaa

SEQ ID NO: 1735056 - RNA, 22 nt, Homo sapiens
ugaagaguccgugguugcccua

SEQ ID NO: 1735057 - RNA, 22 nt, Homo sapiens
ugaaucaugguuuuucuuagua

SEQ ID NO: 1735058 - RNA, 12 nt, Homo sapiens
ugacaaaccauc

SEQ ID NO: 1735059 - RNA, 17 nt, Homo sapiens
ugacaaccuccauucua

SEQ ID NO: 1735060 - RNA, 21 nt, Homo sapiens
ugacaggcagcagagacuugg

SEQ ID NO: 1735061 - RNA, 20 nt, Homo sapiens
ugacagggacaugcccugug

SEQ ID NO: 1735062 - RNA, 14 nt, Homo sapiens
ugacagugccucuu

SEQ ID NO: 1735063 - RNA, 14 nt, Homo sapiens
ugaccucagcuuug

SEQ ID NO: 1735064 - RNA, 20 nt, Homo sapiens
ugaccucgcccuccacaaau

SEQ ID NO: 1735065 - RNA, 18 nt, Homo sapiens
ugacgcuugugacagugc

SEQ ID NO: 1735066 - RNA, 20 nt, Homo sapiens
ugacgcuugugacagugccu

SEQ ID NO: 1735067 - RNA, 15 nt, Homo sapiens
ugacuccucaggguu

SEQ ID NO: 1735068 - RNA, 12 nt, Homo sapiens
ugacuguaucug

SEQ ID NO: 1735069 - RNA, 16 nt, Homo sapiens
ugacuucuucccaaga

SEQ ID NO: 1735070 - RNA, 15 nt, Homo sapiens
ugagaugggcuuccc

SEQ ID NO: 1735071 - RNA, 22 nt, Homo sapiens
ugagcuuuauguaauaauguga

SEQ ID NO: 1735072 - RNA, 20 nt, Homo sapiens
ugaggacuugggcgggacac

SEQ ID NO: 1735073 - RNA, 15 nt, Homo sapiens
ugaggcccagugcau

SEQ ID NO: 1735074 - RNA, 21 nt, Homo sapiens
ugaggcccagugcauaugcaa

SEQ ID NO: 1735075 - RNA, 17 nt, Homo sapiens
ugaggggcuggcacuga

SEQ ID NO: 1735076 - RNA, 21 nt, Homo sapiens
ugaucaguuaagaaauuucac

SEQ ID NO: 1735077 - RNA, 21 nt, Homo sapiens
ugaugaaaacuaaggauuuuu

SEQ ID NO: 1735078 - RNA, 18 nt, Homo sapiens
ugauucaaauugcugcuu

SEQ ID NO: 1735079 - RNA, 13 nt, Homo sapiens
ugcacacaggaca

SEQ ID NO: 1735080 - RNA, 15 nt, Homo sapiens
ugcacccacccagga

SEQ ID NO: 1735081 - RNA, 13 nt, Homo sapiens
ugcagccagcuca

SEQ ID NO: 1735082 - RNA, 17 nt, Homo sapiens
ugcaggagagacaguga

SEQ ID NO: 1735083 - RNA, 17 nt, Homo sapiens
ugcaguguggaguucac

SEQ ID NO: 1735084 - RNA, 22 nt, Homo sapiens
ugcauaggugaucucauuuaau

SEQ ID NO: 1735085 - RNA, 15 nt, Homo sapiens
ugcauauguaugacu

SEQ ID NO: 1735086 - RNA, 20 nt, Homo sapiens
ugcauucugagguaaccuca

SEQ ID NO: 1735087 - RNA, 23 nt, Homo sapiens
ugcauucugagguaaccucauua

SEQ ID NO: 1735088 - RNA, 17 nt, Homo sapiens
ugcauuuaauuuauuga

SEQ ID NO: 1735089 - RNA, 12 nt, Homo sapiens
aaaaaaacguau

SEQ ID NO: 1735090 - RNA, 13 nt, Homo sapiens
aaaaaugcugcuc

SEQ ID NO: 1735091 - RNA, 13 nt, Homo sapiens
aaaacaagccaug

SEQ ID NO: 1735092 - RNA, 14 nt, Homo sapiens
aaaacguauugcau

SEQ ID NO: 1735093 - RNA, 21 nt, Homo sapiens
aaaacuuuggaguccccucac

SEQ ID NO: 1735094 - RNA, 19 nt, Homo sapiens
aaaauaugaccacacucca

SEQ ID NO: 1735095 - RNA, 18 nt, Homo sapiens
aaaaugauguauguugaa

SEQ ID NO: 1735096 - RNA, 15 nt, Homo sapiens
aaaaugcugcucuca

SEQ ID NO: 1735097 - RNA, 20 nt, Homo sapiens
aaaauuaggccguuccuuca

SEQ ID NO: 1735098 - RNA, 20 nt, Homo sapiens
aaaauuggaacucuacucaa

SEQ ID NO: 1735099 - RNA, 21 nt, Homo sapiens
aaacacacgagcaaacccaga

SEQ ID NO: 1735100 - RNA, 14 nt, Homo sapiens
aaacaccuccucau

SEQ ID NO: 1735101 - RNA, 18 nt, Homo sapiens
aaacagcucgacuuuaaa

SEQ ID NO: 1735102 - RNA, 22 nt, Homo sapiens
aaacaggcaguuggccagagag

SEQ ID NO: 1735103 - RNA, 22 nt, Homo sapiens
aaacucaaaagaaggccacugu

SEQ ID NO: 1735104 - RNA, 19 nt, Homo sapiens
aaacuggguuccugcaaug

SEQ ID NO: 1735105 - RNA, 18 nt, Homo sapiens
aaacugucuuuaaaagag

SEQ ID NO: 1735106 - RNA, 19 nt, Homo sapiens
aaacuuucacaccccagac

SEQ ID NO: 1735107 - RNA, 22 nt, Homo sapiens
aaagaccuuuuccaugcacccu

SEQ ID NO: 1735108 - RNA, 19 nt, Homo sapiens
aaagagagucgcaucucag

SEQ ID NO: 1735109 - RNA, 17 nt, Homo sapiens
aaagaugccacauucaa

SEQ ID NO: 1735110 - RNA, 14 nt, Homo sapiens
aaagauuaaaugug

SEQ ID NO: 1735111 - RNA, 16 nt, Homo sapiens
aaagauuugcuuuaau

SEQ ID NO: 1735112 - RNA, 13 nt, Homo sapiens
aaagccuccucau

SEQ ID NO: 1735113 - RNA, 15 nt, Homo sapiens
aaagggaccagggga

SEQ ID NO: 1735114 - RNA, 21 nt, Homo sapiens
aaagucaucccucuguucaca

SEQ ID NO: 1735115 - RNA, 14 nt, Homo sapiens
aaauaaaagcacuu

SEQ ID NO: 1735116 - RNA, 16 nt, Homo sapiens
aaauaaaucaguucau

SEQ ID NO: 1735117 - RNA, 15 nt, Homo sapiens
aaaugcagcuuuaaa

SEQ ID NO: 1735118 - RNA, 19 nt, Homo sapiens
aaauguuguuuuaggaaua

SEQ ID NO: 1735119 - RNA, 13 nt, Homo sapiens
aaauugcugcuug

SEQ ID NO: 1735120 - RNA, 15 nt, Homo sapiens
aaauugucagaugcu

SEQ ID NO: 1735121 - RNA, 22 nt, Homo sapiens
aacaaacucauucauuagucau

SEQ ID NO: 1735122 - RNA, 20 nt, Homo sapiens
aacaaagaugccacauucaa

SEQ ID NO: 1735123 - RNA, 13 nt, Homo sapiens
aacaccuccucau

SEQ ID NO: 1735124 - RNA, 21 nt, Homo sapiens
aacacugcugcuccagugcag

SEQ ID NO: 1735125 - RNA, 21 nt, Homo sapiens
aacagacucauaccacacuua

SEQ ID NO: 1735126 - RNA, 13 nt, Homo sapiens
aacagauaauccc

SEQ ID NO: 1735127 - RNA, 12 nt, Homo sapiens
aacaggcaguug

SEQ ID NO: 1735128 - RNA, 20 nt, Homo sapiens
aacauacuggccuggacugu

SEQ ID NO: 1735129 - RNA, 13 nt, Homo sapiens
aacauuaugaugu

SEQ ID NO: 1735130 - RNA, 13 nt, Homo sapiens
aacauucccacug

SEQ ID NO: 1735131 - RNA, 18 nt, Homo sapiens
aaccaaaagaauuugcac

SEQ ID NO: 1735132 - RNA, 13 nt, Homo sapiens
aaccaccuuucag

SEQ ID NO: 1735133 - RNA, 18 nt, Homo sapiens
aaccaucgguccacaccu

SEQ ID NO: 1735134 - RNA, 19 nt, Homo sapiens
aacccaaagugugacucau

SEQ ID NO: 1735135 - RNA, 17 nt, Homo sapiens
aacccagagguggaugu

SEQ ID NO: 1735136 - RNA, 12 nt, Homo sapiens
aacgcacaaaac

SEQ ID NO: 1735137 - RNA, 14 nt, Homo sapiens
aacuaaacuuucac

SEQ ID NO: 1735138 - RNA, 15 nt, Homo sapiens
aacucacagagcuuu

SEQ ID NO: 1735139 - RNA, 17 nt, Homo sapiens
aacucuacucaacccau

SEQ ID NO: 1735140 - RNA, 12 nt, Homo sapiens
aacuucauucuc

SEQ ID NO: 1735141 - RNA, 19 nt, Homo sapiens
aagaaaucuuucucccuca

SEQ ID NO: 1735142 - RNA, 13 nt, Homo sapiens
aagaaccucucac

SEQ ID NO: 1735143 - RNA, 17 nt, Homo sapiens
aagacaccguucauuca

SEQ ID NO: 1735144 - RNA, 14 nt, Homo sapiens
aagauuaaaugugu

SEQ ID NO: 1735145 - RNA, 16 nt, Homo sapiens
aagcaaaugucuuccu

SEQ ID NO: 1735146 - RNA, 19 nt, Homo sapiens
aagcacagauguucuucaa

SEQ ID NO: 1735147 - RNA, 21 nt, Homo sapiens
aagcacucgugugcaacagac

SEQ ID NO: 1735148 - RNA, 16 nt, Homo sapiens
aagcauauuguuauua

SEQ ID NO: 1735149 - RNA, 19 nt, Homo sapiens
aagcuuugaauacugugaa

SEQ ID NO: 1735150 - RNA, 21 nt, Homo sapiens
aaggaaacuggguuccugcaa

SEQ ID NO: 1735151 - RNA, 19 nt, Homo sapiens
aaggauuuuaugcuuuaaa

SEQ ID NO: 1735152 - RNA, 23 nt, Homo sapiens
aaggcaguaguuuucaaaacaca

SEQ ID NO: 1735153 - RNA, 16 nt, Homo sapiens
aagggagguggcaaga

SEQ ID NO: 1735154 - RNA, 20 nt, Homo sapiens
aagguuuuagacccauagca

SEQ ID NO: 1735155 - RNA, 14 nt, Homo sapiens
aaguaugugcauau

SEQ ID NO: 1735156 - RNA, 12 nt, Homo sapiens
aagugagcagaa

SEQ ID NO: 1735157 - RNA, 16 nt, Homo sapiens
aagugauuugccugua

SEQ ID NO: 1735158 - RNA, 11 nt, Homo sapiens
aaguugcagcu

SEQ ID NO: 1735159 - RNA, 16 nt, Homo sapiens
aauaaagucucuuccu

SEQ ID NO: 1735160 - RNA, 22 nt, Homo sapiens
aauaaauucccuggccuuucau

SEQ ID NO: 1735161 - RNA, 20 nt, Homo sapiens
aauacauaaaguaugugcau

SEQ ID NO: 1735162 - RNA, 13 nt, Homo sapiens
aauacuguuucca

SEQ ID NO: 1735163 - RNA, 21 nt, Homo sapiens
aauauccuguguaacacuugg

SEQ ID NO: 1735164 - RNA, 17 nt, Homo sapiens
gaagcuguauaauuaau

SEQ ID NO: 1735165 - RNA, 16 nt, Homo sapiens
gaaggcaaaugacuuu

SEQ ID NO: 1735166 - RNA, 19 nt, Homo sapiens
gaagggacacacaagaaga

SEQ ID NO: 1735167 - RNA, 15 nt, Homo sapiens
gaauacauaaaguau

SEQ ID NO: 1735168 - RNA, 14 nt, Homo sapiens
gaauauccauguac

SEQ ID NO: 1735169 - RNA, 21 nt, Homo sapiens
gaauuaagaauugguugccau

SEQ ID NO: 1735170 - RNA, 20 nt, Homo sapiens
gaauuauuuaaacaaaaacu

SEQ ID NO: 1735171 - RNA, 15 nt, Homo sapiens
gacaaagugccucau

SEQ ID NO: 1735172 - RNA, 23 nt, Homo sapiens
gacacaggccagcuccacagugu

SEQ ID NO: 1735173 - RNA, 15 nt, Homo sapiens
gacaccuaacucuuc

SEQ ID NO: 1735174 - RNA, 13 nt, Homo sapiens
gacagaagcagcu

SEQ ID NO: 1735175 - RNA, 14 nt, Homo sapiens
gacagaagcagcuc

SEQ ID NO: 1735176 - RNA, 21 nt, Homo sapiens
gacagggacaugcccugugug

SEQ ID NO: 1735177 - RNA, 15 nt, Homo sapiens
gacagugccucuucc

SEQ ID NO: 1735178 - RNA, 22 nt, Homo sapiens
gacaguuuguggcaucuugcca

SEQ ID NO: 1735179 - RNA, 18 nt, Homo sapiens
gacaugcccaaggccacg

SEQ ID NO: 1735180 - RNA, 13 nt, Homo sapiens
gacaugcccugug

SEQ ID NO: 1735181 - RNA, 15 nt, Homo sapiens
gaccacacuccagcu

SEQ ID NO: 1735182 - RNA, 21 nt, Homo sapiens
gaccauaaccccggaagccaa

SEQ ID NO: 1735183 - RNA, 18 nt, Homo sapiens
gaccgcccccuccucuag

SEQ ID NO: 1735184 - RNA, 17 nt, Homo sapiens
gacgggguuugccaugc

SEQ ID NO: 1735185 - RNA, 20 nt, Homo sapiens
gacgguaaguguucucauga

SEQ ID NO: 1735186 - RNA, 22 nt, Homo sapiens
gacucuuuuuuugagugacagc

SEQ ID NO: 1735187 - RNA, 18 nt, Homo sapiens
gacuuggauucuuuccau

SEQ ID NO: 1735188 - RNA, 17 nt, Homo sapiens
gacuuuucccaagccua

SEQ ID NO: 1735189 - RNA, 19 nt, Homo sapiens
gagaaaauaaaagcacuua

SEQ ID NO: 1735190 - RNA, 22 nt, Homo sapiens
gagacaccaccacccuugccau

SEQ ID NO: 1735191 - RNA, 19 nt, Homo sapiens
gagagcggggaugugacau

SEQ ID NO: 1735192 - RNA, 14 nt, Homo sapiens
gagcaggcugugag

SEQ ID NO: 1735193 - RNA, 18 nt, Homo sapiens
gagccaccaaacccggcc

SEQ ID NO: 1735194 - RNA, 19 nt, Homo sapiens
gagccaccaaacccggccu

SEQ ID NO: 1735195 - RNA, 15 nt, Homo sapiens
gagcccauccagucu

SEQ ID NO: 1735196 - RNA, 17 nt, Homo sapiens
gagcgugaaucuguauc

SEQ ID NO: 1735197 - RNA, 23 nt, Homo sapiens
gagcuugaaauagugucugauga

SEQ ID NO: 1735198 - RNA, 19 nt, Homo sapiens
gaggcaagugugggccacu

SEQ ID NO: 1735199 - RNA, 14 nt, Homo sapiens
gagggcagggacca

SEQ ID NO: 1735200 - RNA, 21 nt, Homo sapiens
gagggugaggggcuggcacug

SEQ ID NO: 1735201 - RNA, 15 nt, Homo sapiens
gagugacagcuuucu

SEQ ID NO: 1735202 - RNA, 13 nt, Homo sapiens
gagugaucuuucc

SEQ ID NO: 1735203 - RNA, 22 nt, Homo sapiens
gauagagugggacaguuccuga

SEQ ID NO: 1735204 - RNA, 20 nt, Homo sapiens
gaucaucacuuccuugcccc

SEQ ID NO: 1735205 - RNA, 13 nt, Homo sapiens
gaugcauucgaga

SEQ ID NO: 1735206 - RNA, 19 nt, Homo sapiens
gauguuugaccuucagagc

SEQ ID NO: 1735207 - RNA, 15 nt, Homo sapiens
gauuacccucugggu

SEQ ID NO: 1735208 - RNA, 19 nt, Homo sapiens
gauuauuagaaucaaacau

SEQ ID NO: 1735209 - RNA, 14 nt, Homo sapiens
gauucaugucucac

SEQ ID NO: 1735210 - RNA, 15 nt, Homo sapiens
gauuuaauacaguuu

SEQ ID NO: 1735211 - RNA, 22 nt, Homo sapiens
gauuucuuucuuugcaccaaag

SEQ ID NO: 1735212 - RNA, 14 nt, Homo sapiens
gauuuuaccaaagc

SEQ ID NO: 1735213 - RNA, 14 nt, Homo sapiens
gcaaaaaucuccca

SEQ ID NO: 1735214 - RNA, 16 nt, Homo sapiens
gcaaaauagcuuggac

SEQ ID NO: 1735215 - RNA, 19 nt, Homo sapiens
gcaaauaacaaaugccaaa

SEQ ID NO: 1735216 - RNA, 17 nt, Homo sapiens
gcaacagacaagugacu

SEQ ID NO: 1735217 - RNA, 16 nt, Homo sapiens
gcaaucucagaugcag

SEQ ID NO: 1735218 - RNA, 15 nt, Homo sapiens
gcacaauaugggcac

SEQ ID NO: 1735219 - RNA, 12 nt, Homo sapiens
gcacagccaccc

SEQ ID NO: 1735220 - RNA, 15 nt, Homo sapiens
gcaccaauaaagccu

SEQ ID NO: 1735221 - RNA, 20 nt, Homo sapiens
gcaccucggggacaccagag

SEQ ID NO: 1735222 - RNA, 18 nt, Homo sapiens
gcacuaucacgagccuuu

SEQ ID NO: 1735223 - RNA, 22 nt, Homo sapiens
gcacuggggagcccgucucagu

SEQ ID NO: 1735224 - RNA, 15 nt, Homo sapiens
gcacuugggacaaaa

SEQ ID NO: 1735225 - RNA, 20 nt, Homo sapiens
gcagacauagaagagccaag

SEQ ID NO: 1735226 - RNA, 19 nt, Homo sapiens
gcagagacgggguuugcca

SEQ ID NO: 1735227 - RNA, 22 nt, Homo sapiens
gcaggaggcccuugucguggga

SEQ ID NO: 1735228 - RNA, 18 nt, Homo sapiens
gcaggauagagugggaca

SEQ ID NO: 1735229 - RNA, 14 nt, Homo sapiens
gcaggcgugaccug

SEQ ID NO: 1735230 - RNA, 15 nt, Homo sapiens
gcaggcgugaccuga

SEQ ID NO: 1735231 - RNA, 13 nt, Homo sapiens
gcaguaguuuuca

SEQ ID NO: 1735232 - RNA, 15 nt, Homo sapiens
gcaguuuuucccaag

SEQ ID NO: 1735233 - RNA, 16 nt, Homo sapiens
gcauaaaaacauuuua

SEQ ID NO: 1735234 - RNA, 19 nt, Homo sapiens
gcauauuaauuucuucccc

SEQ ID NO: 1735235 - RNA, 16 nt, Homo sapiens
gcauggaaggggcuuc

SEQ ID NO: 1735236 - RNA, 15 nt, Homo sapiens
gcauucaaaugggcu

SEQ ID NO: 1735237 - RNA, 10 nt, Homo sapiens
gcauugcugg

SEQ ID NO: 1735238 - RNA, 19 nt, Homo sapiens
gcauuuggugagagucaaa

SEQ ID NO: 1735239 - RNA, 18 nt, Homo sapiens
gccaaccggucacccagg

SEQ ID NO: 1735240 - RNA, 19 nt, Homo sapiens
gccaagcagugccugccua

SEQ ID NO: 1735241 - RNA, 19 nt, Homo sapiens
gccacccugccucuaccca

SEQ ID NO: 1735242 - RNA, 22 nt, Homo sapiens
gccacgugggcaaacaggcagu

SEQ ID NO: 1735243 - RNA, 22 nt, Homo sapiens
gccacugccccccgaggcugcu

SEQ ID NO: 1735244 - RNA, 17 nt, Homo sapiens
gccaggggcgaggcccu

SEQ ID NO: 1735245 - RNA, 13 nt, Homo sapiens
gccaggugcugcu

SEQ ID NO: 1735246 - RNA, 16 nt, Homo sapiens
gcccagugcauaugca

SEQ ID NO: 1735247 - RNA, 13 nt, Homo sapiens
gccccacuuugaa

SEQ ID NO: 1735248 - RNA, 17 nt, Homo sapiens
gccccucggcucuggag

SEQ ID NO: 1735249 - RNA, 20 nt, Homo sapiens
gccccugucgucaggaccuc

SEQ ID NO: 1735250 - RNA, 16 nt, Homo sapiens
uaaaauauccugugua

SEQ ID NO: 1735251 - RNA, 17 nt, Homo sapiens
uaaacagauggcacuuu

SEQ ID NO: 1735252 - RNA, 14 nt, Homo sapiens
uaaacuguacagug

SEQ ID NO: 1735253 - RNA, 19 nt, Homo sapiens
uaaagaaaaaaauguauuu

SEQ ID NO: 1735254 - RNA, 14 nt, Homo sapiens
uaaagccuccucau

SEQ ID NO: 1735255 - RNA, 17 nt, Homo sapiens
uaaagcuuugugcagau

SEQ ID NO: 1735256 - RNA, 15 nt, Homo sapiens
uaaaguaugugcaua

SEQ ID NO: 1735257 - RNA, 16 nt, Homo sapiens
uaaaguaugugcauau

SEQ ID NO: 1735258 - RNA, 14 nt, Homo sapiens
uaaauaaacaugug

SEQ ID NO: 1735259 - RNA, 13 nt, Homo sapiens
uaaauaaccaauu

SEQ ID NO: 1735260 - RNA, 21 nt, Homo sapiens
uaaaugauucuuagugacuuu

SEQ ID NO: 1735261 - RNA, 19 nt, Homo sapiens
uaaaugggaauucucaggu

SEQ ID NO: 1735262 - RNA, 20 nt, Homo sapiens
uaaauucccaacuucucuug

SEQ ID NO: 1735263 - RNA, 22 nt, Homo sapiens
uaaauugucagaugcugugcaa

SEQ ID NO: 1735264 - RNA, 16 nt, Homo sapiens
uaaccucuucaccuua

SEQ ID NO: 1735265 - RNA, 20 nt, Homo sapiens
uaaggaauaugagcuuuaug

SEQ ID NO: 1735266 - RNA, 14 nt, Homo sapiens
uaaggauuuuucaa

SEQ ID NO: 1735267 - RNA, 14 nt, Homo sapiens
uaagucucugugaa

SEQ ID NO: 1735268 - RNA, 13 nt, Homo sapiens
uaaguguucucau

SEQ ID NO: 1735269 - RNA, 15 nt, Homo sapiens
uaauuuagacuugga

SEQ ID NO: 1735270 - RNA, 23 nt, Homo sapiens
uaauuuuuuugugggaaauccac

SEQ ID NO: 1735271 - RNA, 16 nt, Homo sapiens
uacaaaagcuuugaau

SEQ ID NO: 1735272 - RNA, 11 nt, Homo sapiens
uacaaccagcc

SEQ ID NO: 1735273 - RNA, 14 nt, Homo sapiens
uacaaccagcccaa

SEQ ID NO: 1735274 - RNA, 20 nt, Homo sapiens
uacauaaaguaugugcauau

SEQ ID NO: 1735275 - RNA, 23 nt, Homo sapiens
uaccagauguuuugauguuaucg

SEQ ID NO: 1735276 - RNA, 13 nt, Homo sapiens
uacccaugaccug

SEQ ID NO: 1735277 - RNA, 11 nt, Homo sapiens
uacccucucag

SEQ ID NO: 1735278 - RNA, 14 nt, Homo sapiens
uacuauauauguga

SEQ ID NO: 1735279 - RNA, 13 nt, Homo sapiens
uacucaacccauu

SEQ ID NO: 1735280 - RNA, 20 nt, Homo sapiens
uacucaacccauuguuguca

SEQ ID NO: 1735281 - RNA, 16 nt, Homo sapiens
ugaacuaaacuuucac

SEQ ID NO: 1735282 - RNA, 16 nt, Homo sapiens
ugaacuccuuccccac

SEQ ID NO: 1735283 - RNA, 20 nt, Homo sapiens
ugaacugaaaacaagccaug

SEQ ID NO: 1735284 - RNA, 17 nt, Homo sapiens
ugaagccccucccugag

SEQ ID NO: 1735285 - RNA, 19 nt, Homo sapiens
ugaagguggaacaagcaca

SEQ ID NO: 1735286 - RNA, 18 nt, Homo sapiens
ugaagucucugaagugaa

SEQ ID NO: 1735287 - RNA, 16 nt, Homo sapiens
ugaaugagagguuccu

SEQ ID NO: 1735288 - RNA, 16 nt, Homo sapiens
ugaauuucccacauac

SEQ ID NO: 1735289 - RNA, 16 nt, Homo sapiens
ugacaacaucgcaaua

SEQ ID NO: 1735290 - RNA, 16 nt, Homo sapiens
ugacaguuuguggcau

SEQ ID NO: 1735291 - RNA, 12 nt, Homo sapiens
ugaccacacucc

SEQ ID NO: 1735292 - RNA, 16 nt, Homo sapiens
ugaccuucagagccag

SEQ ID NO: 1735293 - RNA, 15 nt, Homo sapiens
ugacuguaucugugu

SEQ ID NO: 1735294 - RNA, 17 nt, Homo sapiens
ugacuguaucuguguag

SEQ ID NO: 1735295 - RNA, 20 nt, Homo sapiens
ugacuugagaaacaaauaau

SEQ ID NO: 1735296 - RNA, 21 nt, Homo sapiens
ugagauaguuuucauccauaa

SEQ ID NO: 1735297 - RNA, 16 nt, Homo sapiens
ugagcacccauuccaa

SEQ ID NO: 1735298 - RNA, 20 nt, Homo sapiens
ugagccccuggaggcacuga

SEQ ID NO: 1735299 - RNA, 14 nt, Homo sapiens
ugagcuggggaccu

SEQ ID NO: 1735300 - RNA, 14 nt, Homo sapiens
ugaggcugcaccca

SEQ ID NO: 1735301 - RNA, 16 nt, Homo sapiens
ugaggugccuguccca

SEQ ID NO: 1735302 - RNA, 22 nt, Homo sapiens
ugaucuucagggaacugcauag

SEQ ID NO: 1735303 - RNA, 14 nt, Homo sapiens
ugaugaauguuaaa

SEQ ID NO: 1735304 - RNA, 18 nt, Homo sapiens
ugauuucuuucuuugcac

SEQ ID NO: 1735305 - RNA, 23 nt, Homo sapiens
ugcaaccgggcccucucucugcg

SEQ ID NO: 1735306 - RNA, 11 nt, Homo sapiens
ugcaccaaaga

SEQ ID NO: 1735307 - RNA, 12 nt, Homo sapiens
ugcaccaaagac

SEQ ID NO: 1735308 - RNA, 13 nt, Homo sapiens
ugcaccaaagaca

SEQ ID NO: 1735309 - RNA, 14 nt, Homo sapiens
ugcacccaccuguu

SEQ ID NO: 1735310 - RNA, 12 nt, Homo sapiens
ugcagcucucua

SEQ ID NO: 1735311 - RNA, 15 nt, Homo sapiens
ugcagcugugccaua

SEQ ID NO: 1735312 - RNA, 20 nt, Homo sapiens
ugccaaccggucacccagga

SEQ ID NO: 1735313 - RNA, 20 nt, Homo sapiens
ugccacccugccccuugcca

SEQ ID NO: 1735314 - RNA, 21 nt, Homo sapiens
ugccacccugccccuugccau

SEQ ID NO: 1735315 - RNA, 23 nt, Homo sapiens
ugccauugacuucuucccaagau

SEQ ID NO: 1735316 - RNA, 18 nt, Homo sapiens
ugccccacauguggccau

SEQ ID NO: 1735317 - RNA, 14 nt, Homo sapiens
ugcccucagauucc

SEQ ID NO: 1735318 - RNA, 15 nt, Homo sapiens
ugcccucagauuccg

SEQ ID NO: 1735319 - RNA, 18 nt, Homo sapiens
ugcccuggagaugucaca

SEQ ID NO: 1735320 - RNA, 13 nt, Homo sapiens
ugcccuuuuccag

SEQ ID NO: 1735321 - RNA, 22 nt, Homo sapiens
ugccgaaccaaaagaauuugca

SEQ ID NO: 1735322 - RNA, 14 nt, Homo sapiens
ugccgccagcugcc

SEQ ID NO: 1735323 - RNA, 13 nt, Homo sapiens
ugcucccacagaa

SEQ ID NO: 1735324 - RNA, 15 nt, Homo sapiens
ugcugaggcccagug

SEQ ID NO: 1735325 - RNA, 23 nt, Homo sapiens
ugcugaggcccagugcauaugca

SEQ ID NO: 1735326 - RNA, 19 nt, Homo sapiens
ugcuucuaaguaaauacaa

SEQ ID NO: 1735327 - RNA, 17 nt, Homo sapiens
uggaaauuuagcauugu

SEQ ID NO: 1735328 - RNA, 16 nt, Homo sapiens
uggaacaagcacagau

SEQ ID NO: 1735329 - RNA, 15 nt, Homo sapiens
uggaacucaguguga

SEQ ID NO: 1735330 - RNA, 22 nt, Homo sapiens
uggaagaaaaaaaccacacaaa

SEQ ID NO: 1735331 - RNA, 13 nt, Homo sapiens
uggaaucuuguaa

SEQ ID NO: 1735332 - RNA, 15 nt, Homo sapiens
uggaauuuguucaag

SEQ ID NO: 1735333 - RNA, 17 nt, Homo sapiens
uggacagaagcagcucu

SEQ ID NO: 1735334 - RNA, 23 nt, Homo sapiens
uggaccauaaccccggaagccaa

SEQ ID NO: 1735335 - RNA, 19 nt, Homo sapiens
uggaccuaggguggccuga

SEQ ID NO: 1735336 - RNA, 13 nt, Homo sapiens
uggagcagcagcc

SEQ ID NO: 1735337 - RNA, 14 nt, Homo sapiens
uggaugcauguucu

SEQ ID NO: 1735338 - RNA, 15 nt, Homo sapiens
uggauucaagugauc

SEQ ID NO: 1735339 - RNA, 23 nt, Homo sapiens
uggcaaucucagaugcaguuugg

SEQ ID NO: 1735340 - RNA, 16 nt, Homo sapiens
uggcacugacugggca

SEQ ID NO: 1735341 - RNA, 16 nt, Homo sapiens
uggcacuggaugcaga

SEQ ID NO: 1735342 - RNA, 15 nt, Homo sapiens
uggcagccucuucaa

SEQ ID NO: 1735343 - RNA, 15 nt, Homo sapiens
uggcagucacaucuc

SEQ ID NO: 1735344 - RNA, 14 nt, Homo sapiens
uggcaucuugccaa

SEQ ID NO: 1735345 - RNA, 21 nt, Homo sapiens
uggccaagaucacaguggcca

SEQ ID NO: 1735346 - RNA, 12 nt, Homo sapiens
uggccacggcca

SEQ ID NO: 1735347 - RNA, 18 nt, Homo sapiens
uggccacggccacggcca

SEQ ID NO: 1735348 - RNA, 13 nt, Homo sapiens
uggccgggacccc

SEQ ID NO: 1735349 - RNA, 12 nt, Homo sapiens
uggccuuucaua

SEQ ID NO: 1735350 - RNA, 20 nt, Homo sapiens
uggcuccaacacugcugcuc

SEQ ID NO: 1735351 - RNA, 14 nt, Homo sapiens
ugggacauugccuu

SEQ ID NO: 1735352 - RNA, 21 nt, Homo sapiens
ugggagcgggggggacagugc

SEQ ID NO: 1735353 - RNA, 16 nt, Homo sapiens
ugggcaaacaggcagu

SEQ ID NO: 1735354 - RNA, 23 nt, Homo sapiens
ugggccccugucgucaggaccuc

SEQ ID NO: 1735355 - RNA, 20 nt, Homo sapiens
uggggaaaauggccaugcag

SEQ ID NO: 1735356 - RNA, 22 nt, Homo sapiens
uggggccaaauaaagucucuuc

SEQ ID NO: 1735357 - RNA, 22 nt, Homo sapiens
uggggcuaggggcuggggccaa

SEQ ID NO: 1735358 - RNA, 14 nt, Homo sapiens
uggggguauuguau

SEQ ID NO: 1735359 - RNA, 16 nt, Homo sapiens
uggguucaagcgauuc

SEQ ID NO: 1735360 - RNA, 23 nt, Homo sapiens
uggguuuugaacauaaagccuug

SEQ ID NO: 1735361 - RNA, 22 nt, Homo sapiens
uggucacuggaacucaguguga

SEQ ID NO: 1735362 - RNA, 11 nt, Homo sapiens
ugguggcaugg

SEQ ID NO: 1735363 - RNA, 14 nt, Homo sapiens
ugucccguggcauu

SEQ ID NO: 1735364 - RNA, 23 nt, Homo sapiens
uuagaaauauucuacuucucugu

SEQ ID NO: 1735365 - RNA, 17 nt, Homo sapiens
uuaguccaauuccuugc

SEQ ID NO: 1735366 - RNA, 18 nt, Homo sapiens
uuagugaccucagcuuug

SEQ ID NO: 1735367 - RNA, 16 nt, Homo sapiens
uuauaggucacuuugu

SEQ ID NO: 1735368 - RNA, 14 nt, Homo sapiens
uuauauuuugcagu

SEQ ID NO: 1735369 - RNA, 12 nt, Homo sapiens
uuaucaguccaa

SEQ ID NO: 1735370 - RNA, 12 nt, Homo sapiens
uuaucauaugcu

SEQ ID NO: 1735371 - RNA, 16 nt, Homo sapiens
uuaugacuucauuaau

SEQ ID NO: 1735372 - RNA, 18 nt, Homo sapiens
uucaaacggccucacuag

SEQ ID NO: 1735373 - RNA, 10 nt, Homo sapiens
uucacuuuga

SEQ ID NO: 1735374 - RNA, 19 nt, Homo sapiens
uucaggaggaauacugaac

SEQ ID NO: 1735375 - RNA, 19 nt, Homo sapiens
uucauuaaaucaacuuuau

SEQ ID NO: 1735376 - RNA, 21 nt, Homo sapiens
uucauucaggcaacgcacaaa

SEQ ID NO: 1735377 - RNA, 16 nt, Homo sapiens
uuccaaaaacauuuua

SEQ ID NO: 1735378 - RNA, 15 nt, Homo sapiens
uuccaaaacauuucu

SEQ ID NO: 1735379 - RNA, 19 nt, Homo sapiens
uuccagugaacauucccag

SEQ ID NO: 1735380 - RNA, 21 nt, Homo sapiens
uuccgcaccaauaaagccuuc

SEQ ID NO: 1735381 - RNA, 21 nt, Homo sapiens
uuccuccgaggccaguaccuu

SEQ ID NO: 1735382 - RNA, 23 nt, Homo sapiens
uuccugagugcguggaucugggu

SEQ ID NO: 1735383 - RNA, 11 nt, Homo sapiens
uuccugcaaug

SEQ ID NO: 1735384 - RNA, 20 nt, Homo sapiens
uucuccugccugugcuguga

SEQ ID NO: 1735385 - RNA, 17 nt, Homo sapiens
uucucucugaccuuuca

SEQ ID NO: 1735386 - RNA, 20 nt, Homo sapiens
uucucuuuuccuuugguccu

SEQ ID NO: 1735387 - RNA, 21 nt, Homo sapiens
uucuuaaauaauaaagaucau

SEQ ID NO: 1735388 - RNA, 14 nt, Homo sapiens
uugaaauagugucu

SEQ ID NO: 1735389 - RNA, 20 nt, Homo sapiens
uugaaauagugucugaugaa

SEQ ID NO: 1735390 - RNA, 17 nt, Homo sapiens
uugaacuugauugccua

SEQ ID NO: 1735391 - RNA, 18 nt, Homo sapiens
uugaaucugaaucagcca

SEQ ID NO: 1735392 - RNA, 21 nt, Homo sapiens
uugagugacagcuuucuggga

SEQ ID NO: 1735393 - RNA, 13 nt, Homo sapiens
uugcacauaguag

SEQ ID NO: 1735394 - RNA, 18 nt, Homo sapiens
uugcaccaaagacaucag

SEQ ID NO: 1735395 - RNA, 17 nt, Homo sapiens
uugcauauguaugacuc

SEQ ID NO: 1735396 - RNA, 13 nt, Homo sapiens
uugccagagccuu

SEQ ID NO: 1735397 - RNA, 16 nt, Homo sapiens
uuggacagaagcagcu

SEQ ID NO: 1735398 - RNA, 19 nt, Homo sapiens
uuggagaagcucaucagaa

SEQ ID NO: 1735399 - RNA, 22 nt, Homo sapiens
uuggcugugcccucagauuccg

SEQ ID NO: 1735400 - RNA, 16 nt, Homo sapiens
uugggauauucugaaa

SEQ ID NO: 1735401 - RNA, 13 nt, Homo sapiens
uugucuacacucu

SEQ ID NO: 1735402 - RNA, 20 nt, Homo sapiens
uugucuuuccuggcacuaac

SEQ ID NO: 1735403 - RNA, 17 nt, Homo sapiens
uugugagcaggcuguga

SEQ ID NO: 1735404 - RNA, 17 nt, Homo sapiens
uuuaaacauuaugaugu

SEQ ID NO: 1735405 - RNA, 23 nt, Homo sapiens
uuuaagauccgcaauguggagca

SEQ ID NO: 1735406 - RNA, 18 nt, Homo sapiens
uuuacacgcuuuugugau

SEQ ID NO: 1735407 - RNA, 15 nt, Homo sapiens
uuuagggaccugcug

SEQ ID NO: 1735408 - RNA, 13 nt, Homo sapiens
uuuauaagucauu

SEQ ID NO: 1735409 - RNA, 18 nt, Homo sapiens
uuuauacucuuauagaca

SEQ ID NO: 1735410 - RNA, 21 nt, Homo sapiens
uuucaggaggaauacugaaca

SEQ ID NO: 1735411 - RNA, 19 nt, Homo sapiens
uuucauccauaacugaaca

SEQ ID NO: 1735412 - RNA, 11 nt, Homo sapiens
uuuccaaagag

SEQ ID NO: 1735413 - RNA, 19 nt, Homo sapiens
uuucccagagucaucugau

SEQ ID NO: 1735414 - RNA, 19 nt, Homo sapiens
uuucccuucuuacaaugca

SEQ ID NO: 1735415 - RNA, 18 nt, Homo sapiens
uuucuuuuuuauacucaa

SEQ ID NO: 1735416 - RNA, 23 nt, Homo sapiens
uuugaagaauauuuguaguuauc

SEQ ID NO: 1735417 - RNA, 15 nt, Homo sapiens
uuugaaucacaugaa

SEQ ID NO: 1735418 - RNA, 20 nt, Homo sapiens
uuugaaucugaaucagccag

SEQ ID NO: 1735419 - RNA, 17 nt, Homo sapiens
uuugaccuucagagcca

SEQ ID NO: 1735420 - RNA, 14 nt, Homo sapiens
uuugagacaggaga

SEQ ID NO: 1735421 - RNA, 11 nt, Homo sapiens
uuugcauuugg

SEQ ID NO: 1735422 - RNA, 11 nt, Homo sapiens
uuugcuuuaau

SEQ ID NO: 1735423 - RNA, 19 nt, Homo sapiens
uuugguaaaaaugcugcuc

SEQ ID NO: 1735424 - RNA, 14 nt, Homo sapiens
uuuguuagcaaaga

SEQ ID NO: 1735425 - RNA, 16 nt, Homo sapiens
uuuuaaaaguuauuaa

SEQ ID NO: 1735426 - RNA, 22 nt, Homo sapiens
uuuuaauuuaaucuuccaugga

SEQ ID NO: 1735427 - RNA, 22 nt, Homo sapiens
uuuuacauacauugauucaugu

SEQ ID NO: 1735428 - RNA, 21 nt, Homo sapiens
uuuuacauuucauacaacaga

SEQ ID NO: 1735429 - RNA, 20 nt, Homo sapiens
uuuucucuuagaacauugua

SEQ ID NO: 1735430 - RNA, 17 nt, Homo sapiens
uuuucuuauugcgcugc

SEQ ID NO: 1735431 - RNA, 21 nt, Homo sapiens
uuuugguugcuuuaauaucau

SEQ ID NO: 1735432 - RNA, 21 nt, Homo sapiens
uuuuuggaaggggacacguga

SEQ ID NO: 1735433 - RNA, 18 nt, Homo sapiens
uuuaaauguguacaaugu

SEQ ID NO: 1735434 - RNA, 17 nt, Homo sapiens
uuuaaccccccuguaca

SEQ ID NO: 1735435 - RNA, 11 nt, Homo sapiens
uuuaccaaagc

SEQ ID NO: 1735436 - RNA, 22 nt, Homo sapiens
uuuagauccuaagucucuuaca

SEQ ID NO: 1735437 - RNA, 13 nt, Homo sapiens
uuuaugcuuuaaa

SEQ ID NO: 1735438 - RNA, 12 nt, Homo sapiens
uuucaagagauc

SEQ ID NO: 1735439 - RNA, 20 nt, Homo sapiens
uuucaugcuuuuucagccau

SEQ ID NO: 1735440 - RNA, 12 nt, Homo sapiens
uuuccaaaacau

SEQ ID NO: 1735441 - RNA, 23 nt, Homo sapiens
uuuccacauaaggaaacuggguu

SEQ ID NO: 1735442 - RNA, 17 nt, Homo sapiens
uuuccagcagaagacaa

SEQ ID NO: 1735443 - RNA, 17 nt, Homo sapiens
uuuccauuuuaaggaua

SEQ ID NO: 1735444 - RNA, 22 nt, Homo sapiens
uuuccuagcgcagccaugugau

SEQ ID NO: 1735445 - RNA, 18 nt, Homo sapiens
uuuccuuugguccuucaa

SEQ ID NO: 1735446 - RNA, 13 nt, Homo sapiens
uuucgcucuuuga

SEQ ID NO: 1735447 - RNA, 23 nt, Homo sapiens
uuucuggacaguaccugauugua

SEQ ID NO: 1735448 - RNA, 17 nt, Homo sapiens
uuugaaaccaaaccaga

SEQ ID NO: 1735449 - RNA, 15 nt, Homo sapiens
uuugauucagcaaaa

SEQ ID NO: 1735450 - RNA, 16 nt, Homo sapiens
uuugauucagcaaaaa

SEQ ID NO: 1735451 - RNA, 13 nt, Homo sapiens
uuugccugugauu

SEQ ID NO: 1735452 - RNA, 17 nt, Homo sapiens
uuuggccccacuuugaa

SEQ ID NO: 1735453 - RNA, 13 nt, Homo sapiens
uuugguugcuuua

SEQ ID NO: 1735454 - RNA, 11 nt, Homo sapiens
uuuguggcauc

SEQ ID NO: 1735455 - RNA, 18 nt, Homo sapiens
uuuguggcaucuugccaa

SEQ ID NO: 1735456 - RNA, 17 nt, Homo sapiens
uuugugggaaauccaca

SEQ ID NO: 1735457 - RNA, 22 nt, Homo sapiens
uuuguuguuugauucagcaaaa

SEQ ID NO: 1735458 - RNA, 19 nt, Homo sapiens
uuuuaaauaaaagcacaag

SEQ ID NO: 1735459 - RNA, 21 nt, Homo sapiens
uuuuaauuuaaacaccuccuc

SEQ ID NO: 1735460 - RNA, 22 nt, Homo sapiens
uuuuaccaccgucugucucaga

SEQ ID NO: 1735461 - RNA, 22 nt, Homo sapiens
uuuucaagguuuuaaaacaguc

SEQ ID NO: 1735462 - RNA, 21 nt, Homo sapiens
uuuucuccugccugugcugug

SEQ ID NO: 1735463 - RNA, 19 nt, Homo sapiens
uuuugaacauaaagccuug

SEQ ID NO: 1735464 - RNA, 20 nt, Homo sapiens
uuuugcaguucccacauuaa

SEQ ID NO: 1735465 - RNA, 16 nt, Homo sapiens
uuuuguugacauuagu

SEQ ID NO: 1735466 - RNA, 20 nt, Homo sapiens
guguguaugugugugcaugu

SEQ ID NO: 1735467 - RNA, 19 nt, Homo sapiens
guguuacccacugccaugc

SEQ ID NO: 1735468 - RNA, 13 nt, Homo sapiens
guguucauuuuau

SEQ ID NO: 1735469 - RNA, 16 nt, Homo sapiens
guguuuaagacauuuu

SEQ ID NO: 1735470 - RNA, 15 nt, Homo sapiens
guuaacugagugccu

SEQ ID NO: 1735471 - RNA, 12 nt, Homo sapiens
guuaagccuuug

SEQ ID NO: 1735472 - RNA, 14 nt, Homo sapiens
guuacccacugcca

SEQ ID NO: 1735473 - RNA, 22 nt, Homo sapiens
guucugagauuauuuuaaucua

SEQ ID NO: 1735474 - RNA, 16 nt, Homo sapiens
guugaauuucccacau

SEQ ID NO: 1735475 - RNA, 23 nt, Homo sapiens
guugucaaacugaaauucagagc

SEQ ID NO: 1735476 - RNA, 19 nt, Homo sapiens
guugucucugaugcagcuu

SEQ ID NO: 1735477 - RNA, 14 nt, Homo sapiens
guuuaagacauuuu

SEQ ID NO: 1735478 - RNA, 14 nt, Homo sapiens
guuuaaucagcgau

SEQ ID NO: 1735479 - RNA, 23 nt, Homo sapiens
guuuccuagcgcagccaugugau

SEQ ID NO: 1735480 - RNA, 21 nt, Homo sapiens
guuuguuccccaagacauucu

SEQ ID NO: 1735481 - RNA, 15 nt, Homo sapiens
guuuuagaaccagcc

SEQ ID NO: 1735482 - RNA, 23 nt, Homo sapiens
uaaaaaaaaaacguauugcauuu

SEQ ID NO: 1735483 - RNA, 15 nt, Homo sapiens
uaaaaaugcugcucu

SEQ ID NO: 1735484 - RNA, 11 nt, Homo sapiens
uaaaagcacuu

SEQ ID NO: 1735485 - RNA, 21 nt, Homo sapiens
uaaaauggagacaccaccacc

SEQ ID NO: 1735486 - RNA, 18 nt, Homo sapiens
uaaacagauggcacuuug

SEQ ID NO: 1735487 - RNA, 19 nt, Homo sapiens
uaaacagauggcacuuuga

SEQ ID NO: 1735488 - RNA, 15 nt, Homo sapiens
uaaagaucauguaaa

SEQ ID NO: 1735489 - RNA, 16 nt, Homo sapiens
uaaagcuuugugcaga

SEQ ID NO: 1735490 - RNA, 17 nt, Homo sapiens
uaaagguccuggcaaag

SEQ ID NO: 1735491 - RNA, 14 nt, Homo sapiens
uaaagugccaguau

SEQ ID NO: 1735492 - RNA, 20 nt, Homo sapiens
uaaauucccuggccuuucau

SEQ ID NO: 1735493 - RNA, 12 nt, Homo sapiens
uaacauucccac

SEQ ID NO: 1735494 - RNA, 15 nt, Homo sapiens
uaacauucccacugc

SEQ ID NO: 1735495 - RNA, 17 nt, Homo sapiens
uaacauucccacugcca

SEQ ID NO: 1735496 - RNA, 23 nt, Homo sapiens
uaagaccaagcugugcccugacc

SEQ ID NO: 1735497 - RNA, 20 nt, Homo sapiens
uaagcacuuuaacacagugu

SEQ ID NO: 1735498 - RNA, 15 nt, Homo sapiens
uaaggcugaacuugu

SEQ ID NO: 1735499 - RNA, 15 nt, Homo sapiens
uaagucucugugaau

SEQ ID NO: 1735500 - RNA, 15 nt, Homo sapiens
uaauaaacuacucuu

SEQ ID NO: 1735501 - RNA, 18 nt, Homo sapiens
uaauaucaucaguauuga

SEQ ID NO: 1735502 - RNA, 21 nt, Homo sapiens
uaaucugggccagaauuucaa

SEQ ID NO: 1735503 - RNA, 13 nt, Homo sapiens
uaauuacaccaua

SEQ ID NO: 1735504 - RNA, 19 nt, Homo sapiens
uaauuuaaucuuccaugga

SEQ ID NO: 1735505 - RNA, 13 nt, Homo sapiens
uacaaacaccugg

SEQ ID NO: 1735506 - RNA, 18 nt, Homo sapiens
uacagggcauucaaaugg

SEQ ID NO: 1735507 - RNA, 19 nt, Homo sapiens
uacauaaaguaugugcaua

SEQ ID NO: 1735508 - RNA, 14 nt, Homo sapiens
uacauuccauuuca

SEQ ID NO: 1735509 - RNA, 14 nt, Homo sapiens
uacauuucauacaa

SEQ ID NO: 1735510 - RNA, 21 nt, Homo sapiens
uacccuuuggccccacuuuga

SEQ ID NO: 1735511 - RNA, 22 nt, Homo sapiens
uacccuuuggccccacuuugaa

SEQ ID NO: 1735512 - RNA, 15 nt, Homo sapiens
uacucaaagucaucc

SEQ ID NO: 1735513 - RNA, 14 nt, Homo sapiens
uacuuuuuacauac

SEQ ID NO: 1735514 - RNA, 23 nt, Homo sapiens
uagaauaaauucccaacuucucu

SEQ ID NO: 1735515 - RNA, 19 nt, Homo sapiens
ucuugcuuucuaugcuguu

SEQ ID NO: 1735516 - RNA, 12 nt, Homo sapiens
ucuuggugccuc

SEQ ID NO: 1735517 - RNA, 22 nt, Homo sapiens
ucuuguaaagguccuggcaaag

SEQ ID NO: 1735518 - RNA, 20 nt, Homo sapiens
ucuuucacauuguuugcugc

SEQ ID NO: 1735519 - RNA, 18 nt, Homo sapiens
ucuuuccaaaacauuucu

SEQ ID NO: 1735520 - RNA, 23 nt, Homo sapiens
ucuuuccuggcacuaacguugag

SEQ ID NO: 1735521 - RNA, 23 nt, Homo sapiens
ucuuuccuguaaagaaacauuuc

SEQ ID NO: 1735522 - RNA, 20 nt, Homo sapiens
ucuuucuuugcaccaaagac

SEQ ID NO: 1735523 - RNA, 22 nt, Homo sapiens
ucuuucuuugcaccaaagacau

SEQ ID NO: 1735524 - RNA, 19 nt, Homo sapiens
ucuuucuuuuuuggccauc

SEQ ID NO: 1735525 - RNA, 20 nt, Homo sapiens
ucuuugcaccaaagacauca

SEQ ID NO: 1735526 - RNA, 22 nt, Homo sapiens
ugaaaagaauuguuggggguuu

SEQ ID NO: 1735527 - RNA, 23 nt, Homo sapiens
ugaaauacuauuuaaagccuccu

SEQ ID NO: 1735528 - RNA, 13 nt, Homo sapiens
ugaaauagaccca

SEQ ID NO: 1735529 - RNA, 15 nt, Homo sapiens
ugaagcuaauaauuc

SEQ ID NO: 1735530 - RNA, 13 nt, Homo sapiens
ugaaggacuguga

SEQ ID NO: 1735531 - RNA, 19 nt, Homo sapiens
ugaagugcuuaguguacuu

SEQ ID NO: 1735532 - RNA, 17 nt, Homo sapiens
ugaaucuguaucuugcc

SEQ ID NO: 1735533 - RNA, 15 nt, Homo sapiens
ugaauugaaauguuc

SEQ ID NO: 1735534 - RNA, 15 nt, Homo sapiens
ugacaaaccauuucc

SEQ ID NO: 1735535 - RNA, 14 nt, Homo sapiens
ugacuggccugcug

SEQ ID NO: 1735536 - RNA, 14 nt, Homo sapiens
ugagagucaaagcu

SEQ ID NO: 1735537 - RNA, 23 nt, Homo sapiens
ugagcgugaaucuguaucuugcc

SEQ ID NO: 1735538 - RNA, 22 nt, Homo sapiens
ugaggcuuuaaaacuuauccuc

SEQ ID NO: 1735539 - RNA, 16 nt, Homo sapiens
ugaggcuuuggcaaau

SEQ ID NO: 1735540 - RNA, 23 nt, Homo sapiens
ugagucauuuaaauguguacaau

SEQ ID NO: 1735541 - RNA, 15 nt, Homo sapiens
ugauaaagcacagcu

SEQ ID NO: 1735542 - RNA, 13 nt, Homo sapiens
ugauaagugcagg

SEQ ID NO: 1735543 - RNA, 11 nt, Homo sapiens
ugaugcagcuu

SEQ ID NO: 1735544 - RNA, 15 nt, Homo sapiens
ugauuacugcucuau

SEQ ID NO: 1735545 - RNA, 16 nt, Homo sapiens
ugauucaaauugcugc

SEQ ID NO: 1735546 - RNA, 16 nt, Homo sapiens
ugcaaagauuugcuuu

SEQ ID NO: 1735547 - RNA, 19 nt, Homo sapiens
ugcaaagauuugcuuuaau

SEQ ID NO: 1735548 - RNA, 16 nt, Homo sapiens
ugcacacgcuccuucc

SEQ ID NO: 1735549 - RNA, 23 nt, Homo sapiens
ugcacauaguagguacccaauuc

SEQ ID NO: 1735550 - RNA, 18 nt, Homo sapiens
ugcaccaaagacaucagu

SEQ ID NO: 1735551 - RNA, 22 nt, Homo sapiens
ugcacuggggagcccgucucag

SEQ ID NO: 1735552 - RNA, 17 nt, Homo sapiens
ugcagaaacaguucacc

SEQ ID NO: 1735553 - RNA, 19 nt, Homo sapiens
ugcagaggccugggggacc

SEQ ID NO: 1735554 - RNA, 16 nt, Homo sapiens
ugcauauuuuauuaua

SEQ ID NO: 1735555 - RNA, 20 nt, Homo sapiens
ugcauauuuuauuauaguca

SEQ ID NO: 1735556 - RNA, 24 nt, Homo sapiens
ugcauguagucacuuuauaaguca

SEQ ID NO: 1735557 - RNA, 20 nt, Homo sapiens
ugccaaacacauuuacccuu

SEQ ID NO: 1735558 - RNA, 23 nt, Homo sapiens
ugccaagggaggcggauuucccu

SEQ ID NO: 1735559 - RNA, 14 nt, Homo sapiens
ugcccccauuucac

SEQ ID NO: 1735560 - RNA, 19 nt, Homo sapiens
ugccccuuuauaaauccaa

SEQ ID NO: 1735561 - RNA, 14 nt, Homo sapiens
ugcccuguguggcu

SEQ ID NO: 1735562 - RNA, 15 nt, Homo sapiens
ugccgccagcugccg

SEQ ID NO: 1735563 - RNA, 13 nt, Homo sapiens
ugccuaaggcuga

SEQ ID NO: 1735564 - RNA, 13 nt, Homo sapiens
ugccucuacccaa

SEQ ID NO: 1735565 - RNA, 14 nt, Homo sapiens
ugccugguacagua

SEQ ID NO: 1735566 - RNA, 20 nt, Homo sapiens
ugcuaguggccgaaccagaa

SEQ ID NO: 1735567 - RNA, 16 nt, Homo sapiens
ugcucauguaccucug

SEQ ID NO: 1735568 - RNA, 14 nt, Homo sapiens
ugcuccagugcagg

SEQ ID NO: 1735569 - RNA, 21 nt, Homo sapiens
ugcugauccucccaggcuucc

SEQ ID NO: 1735570 - RNA, 16 nt, Homo sapiens
ugcugcuccagugcag

SEQ ID NO: 1735571 - RNA, 14 nt, Homo sapiens
ugcugcuuagcuug

SEQ ID NO: 1735572 - RNA, 17 nt, Homo sapiens
ugcuggauucaagugau

SEQ ID NO: 1735573 - RNA, 20 nt, Homo sapiens
ugcugggcacuucaucugau

SEQ ID NO: 1735574 - RNA, 17 nt, Homo sapiens
ugcuguaaaaacugugg

SEQ ID NO: 1735575 - RNA, 21 nt, Homo sapiens
ugcuucccagaggagcagcuc

SEQ ID NO: 1735576 - RNA, 14 nt, Homo sapiens
ugcuuggauuuuga

SEQ ID NO: 1735577 - RNA, 16 nt, Homo sapiens
uggaaagacugggaca

SEQ ID NO: 1735578 - RNA, 17 nt, Homo sapiens
uggaacaagcacagaug

SEQ ID NO: 1735579 - RNA, 15 nt, Homo sapiens
uggaagggcguucua

SEQ ID NO: 1735580 - RNA, 17 nt, Homo sapiens
cuuugaucuucagggaa

SEQ ID NO: 1735581 - RNA, 15 nt, Homo sapiens
cuuugcaucucagua

SEQ ID NO: 1735582 - RNA, 21 nt, Homo sapiens
cuuuggacagaagcagcucuu

SEQ ID NO: 1735583 - RNA, 18 nt, Homo sapiens
cuuuggccccacuuugaa

SEQ ID NO: 1735584 - RNA, 12 nt, Homo sapiens
cuuugucugucg

SEQ ID NO: 1735585 - RNA, 13 nt, Homo sapiens
cuuuugccauuga

SEQ ID NO: 1735586 - RNA, 15 nt, Homo sapiens
cuuuuucacuuugaa

SEQ ID NO: 1735587 - RNA, 17 nt, Homo sapiens
cuuuuuuuguauaguua

SEQ ID NO: 1735588 - RNA, 20 nt, Homo sapiens
gaaaaagguuugcauucuca

SEQ ID NO: 1735589 - RNA, 16 nt, Homo sapiens
gaaaacugguuaauau

SEQ ID NO: 1735590 - RNA, 18 nt, Homo sapiens
gaaaccagaaaagcaaua

SEQ ID NO: 1735591 - RNA, 17 nt, Homo sapiens
gaaacgagacuuuccau

SEQ ID NO: 1735592 - RNA, 16 nt, Homo sapiens
gaaagccccugccccu

SEQ ID NO: 1735593 - RNA, 13 nt, Homo sapiens
gaaauagugacau

SEQ ID NO: 1735594 - RNA, 14 nt, Homo sapiens
gaaauagugucuga

SEQ ID NO: 1735595 - RNA, 22 nt, Homo sapiens
gaaauguucguuuucuccugcc

SEQ ID NO: 1735596 - RNA, 19 nt, Homo sapiens
gaaccaaaagaauuugcac

SEQ ID NO: 1735597 - RNA, 23 nt, Homo sapiens
gaaccagccguauuuuacaugaa

SEQ ID NO: 1735598 - RNA, 22 nt, Homo sapiens
gaacucugacaacagacuucug

SEQ ID NO: 1735599 - RNA, 20 nt, Homo sapiens
gaacugcuggauucaaguga

SEQ ID NO: 1735600 - RNA, 15 nt, Homo sapiens
gaacuugagcgugaa

SEQ ID NO: 1735601 - RNA, 16 nt, Homo sapiens
gaacuuuaugcuguaa

SEQ ID NO: 1735602 - RNA, 23 nt, Homo sapiens
gaagagcccgcagggccaugcag

SEQ ID NO: 1735603 - RNA, 18 nt, Homo sapiens
gaagcaacagcuucagaa

SEQ ID NO: 1735604 - RNA, 21 nt, Homo sapiens
gaaggccacuguuugucucac

SEQ ID NO: 1735605 - RNA, 15 nt, Homo sapiens
gaauaaauucccaac

SEQ ID NO: 1735606 - RNA, 16 nt, Homo sapiens
gaauaccacucuguaa

SEQ ID NO: 1735607 - RNA, 15 nt, Homo sapiens
gaauauuagugaccu

SEQ ID NO: 1735608 - RNA, 23 nt, Homo sapiens
gaauccuuuggugccaacuggug

SEQ ID NO: 1735609 - RNA, 18 nt, Homo sapiens
gaaugagagguuccuaag

SEQ ID NO: 1735610 - RNA, 12 nt, Homo sapiens
gaaugugucuuu

SEQ ID NO: 1735611 - RNA, 15 nt, Homo sapiens
gaauuauuacagugu

SEQ ID NO: 1735612 - RNA, 14 nt, Homo sapiens
gaauugguugccau

SEQ ID NO: 1735613 - RNA, 20 nt, Homo sapiens
gacaccaccacccuugccau

SEQ ID NO: 1735614 - RNA, 21 nt, Homo sapiens
gacaccaccacccuugccaug

SEQ ID NO: 1735615 - RNA, 15 nt, Homo sapiens
gacagggacaugccc

SEQ ID NO: 1735616 - RNA, 12 nt, Homo sapiens
gacaguaccuga

SEQ ID NO: 1735617 - RNA, 17 nt, Homo sapiens
gacagugccucuuccag

SEQ ID NO: 1735618 - RNA, 21 nt, Homo sapiens
gacaguuuguggcaucuugcc

SEQ ID NO: 1735619 - RNA, 23 nt, Homo sapiens
gaccaccaccccaacaaaccauc

SEQ ID NO: 1735620 - RNA, 22 nt, Homo sapiens
gaccauaaccccggaagccaaa

SEQ ID NO: 1735621 - RNA, 23 nt, Homo sapiens
gaccucagcuuugauauuucacu

SEQ ID NO: 1735622 - RNA, 15 nt, Homo sapiens
gaccugacagcccaa

SEQ ID NO: 1735623 - RNA, 15 nt, Homo sapiens
gaccuucagagccag

SEQ ID NO: 1735624 - RNA, 19 nt, Homo sapiens
gacgugugagggaggacag

SEQ ID NO: 1735625 - RNA, 22 nt, Homo sapiens
gacucuauucuuuaacucccau

SEQ ID NO: 1735626 - RNA, 23 nt, Homo sapiens
gacugggacagcccaggaaacaa

SEQ ID NO: 1735627 - RNA, 15 nt, Homo sapiens
gacuuggagacuccu

SEQ ID NO: 1735628 - RNA, 14 nt, Homo sapiens
gagacagugaggcu

SEQ ID NO: 1735629 - RNA, 17 nt, Homo sapiens
gagagccuggugcugcu

SEQ ID NO: 1735630 - RNA, 13 nt, Homo sapiens
gagagcuggccaa

SEQ ID NO: 1735631 - RNA, 12 nt, Homo sapiens
uaaagccuucaa

SEQ ID NO: 1735632 - RNA, 22 nt, Homo sapiens
uaaagccuuggauguauauguc

SEQ ID NO: 1735633 - RNA, 14 nt, Homo sapiens
uaaaguaugugcau

SEQ ID NO: 1735634 - RNA, 15 nt, Homo sapiens
uaaaugaacaagaga

SEQ ID NO: 1735635 - RNA, 18 nt, Homo sapiens
uaaauucccaacuucucu

SEQ ID NO: 1735636 - RNA, 13 nt, Homo sapiens
uaacacagugucu

SEQ ID NO: 1735637 - RNA, 15 nt, Homo sapiens
uaacugagugccuuu

SEQ ID NO: 1735638 - RNA, 13 nt, Homo sapiens
uaagaaugaaaua

SEQ ID NO: 1735639 - RNA, 21 nt, Homo sapiens
uaagcacuuuaacacaguguc

SEQ ID NO: 1735640 - RNA, 15 nt, Homo sapiens
uaaguguucucauga

SEQ ID NO: 1735641 - RNA, 15 nt, Homo sapiens
uaauuaauugucauu

SEQ ID NO: 1735642 - RNA, 16 nt, Homo sapiens
uaauuacauauuugca

SEQ ID NO: 1735643 - RNA, 15 nt, Homo sapiens
uaauuuaaucuucca

SEQ ID NO: 1735644 - RNA, 19 nt, Homo sapiens
uacaaugcauucugaggua

SEQ ID NO: 1735645 - RNA, 21 nt, Homo sapiens
uacacacccugcauaucauaa

SEQ ID NO: 1735646 - RNA, 17 nt, Homo sapiens
uacaggaaguaguucua

SEQ ID NO: 1735647 - RNA, 19 nt, Homo sapiens
uacauugauucaugucuca

SEQ ID NO: 1735648 - RNA, 17 nt, Homo sapiens
uaccacugcucugauga

SEQ ID NO: 1735649 - RNA, 21 nt, Homo sapiens
uacccugagauacuucccaaa

SEQ ID NO: 1735650 - RNA, 16 nt, Homo sapiens
uacccuucuuguccaa

SEQ ID NO: 1735651 - RNA, 18 nt, Homo sapiens
uagaaaaguauguucuaa

SEQ ID NO: 1735652 - RNA, 21 nt, Homo sapiens
uagaagaggguuuuagguaga

SEQ ID NO: 1735653 - RNA, 21 nt, Homo sapiens
uagaaggcacaauaugggcac

SEQ ID NO: 1735654 - RNA, 15 nt, Homo sapiens
uagacuuuucccaag

SEQ ID NO: 1735655 - RNA, 20 nt, Homo sapiens
uagagugggacaguuccuga

SEQ ID NO: 1735656 - RNA, 23 nt, Homo sapiens
uagcaaagauuaaaugugucauu

SEQ ID NO: 1735657 - RNA, 20 nt, Homo sapiens
uagcaagcugccgaaccaaa

SEQ ID NO: 1735658 - RNA, 13 nt, Homo sapiens
uagcuugcaccuu

SEQ ID NO: 1735659 - RNA, 17 nt, Homo sapiens
uaggagggagacacugg

SEQ ID NO: 1735660 - RNA, 17 nt, Homo sapiens
uaggcagccugcaggga

SEQ ID NO: 1735661 - RNA, 22 nt, Homo sapiens
uaguuguaauuuuuuuguggga

SEQ ID NO: 1735662 - RNA, 17 nt, Homo sapiens
uauagucacuaguugua

SEQ ID NO: 1735663 - RNA, 14 nt, Homo sapiens
uaucaucaguauug

SEQ ID NO: 1735664 - RNA, 18 nt, Homo sapiens
uauccuccaugaauauca

SEQ ID NO: 1735665 - RNA, 23 nt, Homo sapiens
uaugaccucgcccuccacaaaug

SEQ ID NO: 1735666 - RNA, 18 nt, Homo sapiens
uaugacgugacuggccug

SEQ ID NO: 1735667 - RNA, 13 nt, Homo sapiens
uauguugaagccu

SEQ ID NO: 1735668 - RNA, 23 nt, Homo sapiens
uauuacaguguuuauccuuucau

SEQ ID NO: 1735669 - RNA, 15 nt, Homo sapiens
uauucuaaaaccauu

SEQ ID NO: 1735670 - RNA, 23 nt, Homo sapiens
uauugaagguuuuagacccauag

SEQ ID NO: 1735671 - RNA, 22 nt, Homo sapiens
uauuuaaagccuccucaucccg

SEQ ID NO: 1735672 - RNA, 22 nt, Homo sapiens
uauuuuaaucuaauucuaagga

SEQ ID NO: 1735673 - RNA, 12 nt, Homo sapiens
ucaaaacacaua

SEQ ID NO: 1735674 - RNA, 22 nt, Homo sapiens
ucaaacaaagaugccacauuca

SEQ ID NO: 1735675 - RNA, 23 nt, Homo sapiens
ucaaacggccucacuaggcuucu

SEQ ID NO: 1735676 - RNA, 18 nt, Homo sapiens
ucaacccauuguugucaa

SEQ ID NO: 1735677 - RNA, 19 nt, Homo sapiens
ucaacuguuuuugucuaca

SEQ ID NO: 1735678 - RNA, 21 nt, Homo sapiens
ucaaguuuuggguauguuuaa

SEQ ID NO: 1735679 - RNA, 18 nt, Homo sapiens
ucaaucccaggauguaca

SEQ ID NO: 1735680 - RNA, 15 nt, Homo sapiens
ucaauggacuggaag

SEQ ID NO: 1735681 - RNA, 20 nt, Homo sapiens
ucacaauaccucaugcuuca

SEQ ID NO: 1735682 - RNA, 20 nt, Homo sapiens
ucacaguuuugguugcuuua

SEQ ID NO: 1735683 - RNA, 19 nt, Homo sapiens
ucacaugaauuauuacagu

SEQ ID NO: 1735684 - RNA, 19 nt, Homo sapiens
ucacauuguuugcugcuau

SEQ ID NO: 1735685 - RNA, 21 nt, Homo sapiens
ucacauuguuugcugcuauug

SEQ ID NO: 1735686 - RNA, 18 nt, Homo sapiens
ucaccuaagucucuguga

SEQ ID NO: 1735687 - RNA, 14 nt, Homo sapiens
ucacgagccuuugu

SEQ ID NO: 1735688 - RNA, 18 nt, Homo sapiens
ucagaaccaaaagggagg

SEQ ID NO: 1735689 - RNA, 18 nt, Homo sapiens
ucagaaggcaaaugacuu

SEQ ID NO: 1735690 - RNA, 10 nt, Homo sapiens
ucagagccag

SEQ ID NO: 1735691 - RNA, 21 nt, Homo sapiens
ucagcaaaaaucucccaguga

SEQ ID NO: 1735692 - RNA, 21 nt, Homo sapiens
ucaggaaacgagacuuuccau

SEQ ID NO: 1735693 - RNA, 15 nt, Homo sapiens
ucaggcaacgcacaa

SEQ ID NO: 1735694 - RNA, 16 nt, Homo sapiens
ucagugaagacuauga

SEQ ID NO: 1735695 - RNA, 16 nt, Homo sapiens
ucaguuuuuuguuuua

SEQ ID NO: 1735696 - RNA, 21 nt, Homo sapiens
ucauacgucuuuauuacccaa

SEQ ID NO: 1735697 - RNA, 21 nt, Homo sapiens
ucauagaugcaggaggcucag

SEQ ID NO: 1735698 - RNA, 15 nt, Homo sapiens
ucauggaaagacugg

SEQ ID NO: 1735699 - RNA, 18 nt, Homo sapiens
ucauguaccucugauuaa

SEQ ID NO: 1735700 - RNA, 19 nt, Homo sapiens
ucauuggaaauuuagcauu

SEQ ID NO: 1735701 - RNA, 15 nt, Homo sapiens
ucauuggaagccauc

SEQ ID NO: 1735702 - RNA, 22 nt, Homo sapiens
ucauuguucuugugaacccaaa

SEQ ID NO: 1735703 - RNA, 19 nt, Homo sapiens
ucauuucugcagauggaaa

SEQ ID NO: 1735704 - RNA, 17 nt, Homo sapiens
uccaaaccccaggguag

SEQ ID NO: 1735705 - RNA, 16 nt, Homo sapiens
uccaacacugcugcuc

SEQ ID NO: 1735706 - RNA, 24 nt, Homo sapiens
uccaauuaaggauuuuaugcuuua

SEQ ID NO: 1735707 - RNA, 17 nt, Homo sapiens
uccacaccugggcauuu

SEQ ID NO: 1735708 - RNA, 17 nt, Homo sapiens
uccaggauagacuuuuc

SEQ ID NO: 1735709 - RNA, 15 nt, Homo sapiens
uccagugcaggagac

SEQ ID NO: 1735710 - RNA, 17 nt, Homo sapiens
uccauauuuaacaugua

SEQ ID NO: 1735711 - RNA, 20 nt, Homo sapiens
uccauccuuuacguguuuaa

SEQ ID NO: 1735712 - RNA, 19 nt, Homo sapiens
uccauucuggaaacaccug

SEQ ID NO: 1735713 - RNA, 16 nt, Homo sapiens
ucccaaagugcuggga

SEQ ID NO: 1735714 - RNA, 21 nt, Homo sapiens
ucccaacuuguauuaaagaca

SEQ ID NO: 1735715 - RNA, 16 nt, Homo sapiens
ucccaggcuucccaaa

SEQ ID NO: 1735716 - RNA, 15 nt, Homo sapiens
uccccaggcauuugc

SEQ ID NO: 1735717 - RNA, 16 nt, Homo sapiens
uccccucucagaacau

SEQ ID NO: 1735718 - RNA, 17 nt, Homo sapiens
ucccuauggaagcauau

SEQ ID NO: 1735719 - RNA, 15 nt, Homo sapiens
ucccucuccaacugc

SEQ ID NO: 1735720 - RNA, 22 nt, Homo sapiens
ucccucuuuggcuccccuguac

SEQ ID NO: 1735721 - RNA, 23 nt, Homo sapiens
uccgcaauguggagcagcagcca

SEQ ID NO: 1735722 - RNA, 21 nt, Homo sapiens
uccgugugauugucuuugaau

SEQ ID NO: 1735723 - RNA, 13 nt, Homo sapiens
uccucauguacau

SEQ ID NO: 1735724 - RNA, 22 nt, Homo sapiens
uccuccaugaauaucaguuauu

SEQ ID NO: 1735725 - RNA, 20 nt, Homo sapiens
uccucucaaccaccuuucag

SEQ ID NO: 1735726 - RNA, 16 nt, Homo sapiens
uccucucccucaucaa

SEQ ID NO: 1735727 - RNA, 20 nt, Homo sapiens
uccugaaaaaaaaccugaga

SEQ ID NO: 1735728 - RNA, 22 nt, Homo sapiens
uccugagaccagccaaccuggg

SEQ ID NO: 1735729 - RNA, 16 nt, Homo sapiens
uccuggaucucccuga

SEQ ID NO: 1735730 - RNA, 23 nt, Homo sapiens
uccuggcaaagaugaucaguaug

SEQ ID NO: 1735731 - RNA, 19 nt, Homo sapiens
uccuggcacuaacguugag

SEQ ID NO: 1735732 - RNA, 17 nt, Homo sapiens
uccuguaaagaaacauu

SEQ ID NO: 1735733 - RNA, 20 nt, Homo sapiens
uccuguccuuuuaacaccuu

SEQ ID NO: 1735734 - RNA, 17 nt, Homo sapiens
uccuuugguccuucaaa

SEQ ID NO: 1735735 - RNA, 14 nt, Homo sapiens
uccuuuuucacuuu

SEQ ID NO: 1735736 - RNA, 22 nt, Homo sapiens
ucgaacugcuggauucaaguga

SEQ ID NO: 1735737 - RNA, 15 nt, Homo sapiens
ucgagagcuggccaa

SEQ ID NO: 1735738 - RNA, 22 nt, Homo sapiens
ucuaacaaaaccaaugugcaga

SEQ ID NO: 1735739 - RNA, 20 nt, Homo sapiens
ucuaccucaggcagcucaag

SEQ ID NO: 1735740 - RNA, 21 nt, Homo sapiens
ucucaaccaccuuucagauaa

SEQ ID NO: 1735741 - RNA, 24 nt, Homo sapiens
ucucagguaggaagcaacagcuuc

SEQ ID NO: 1735742 - RNA, 11 nt, Homo sapiens
ucucagugucc

SEQ ID NO: 1735743 - RNA, 15 nt, Homo sapiens
caggaggauggcaaa

SEQ ID NO: 1735744 - RNA, 14 nt, Homo sapiens
caggcaacgcacaa

SEQ ID NO: 1735745 - RNA, 15 nt, Homo sapiens
caggcaacgcacaaa

SEQ ID NO: 1735746 - RNA, 11 nt, Homo sapiens
caggcauuugc

SEQ ID NO: 1735747 - RNA, 14 nt, Homo sapiens
caggccagcuccac

SEQ ID NO: 1735748 - RNA, 14 nt, Homo sapiens
caggcccuguggca

SEQ ID NO: 1735749 - RNA, 20 nt, Homo sapiens
cagggugacccugaagugag

SEQ ID NO: 1735750 - RNA, 22 nt, Homo sapiens
cagucaugguggccacggccac

SEQ ID NO: 1735751 - RNA, 16 nt, Homo sapiens
caguccaauaggugua

SEQ ID NO: 1735752 - RNA, 17 nt, Homo sapiens
cagugaagacuaugaaa

SEQ ID NO: 1735753 - RNA, 19 nt, Homo sapiens
cagugacaacaucgcaaua

SEQ ID NO: 1735754 - RNA, 18 nt, Homo sapiens
cagugaggcugcacccac

SEQ ID NO: 1735755 - RNA, 16 nt, Homo sapiens
caguggcgcaaucuua

SEQ ID NO: 1735756 - RNA, 17 nt, Homo sapiens
caguggcgcaaucuuaa

SEQ ID NO: 1735757 - RNA, 17 nt, Homo sapiens
caguguccucaucugua

SEQ ID NO: 1735758 - RNA, 13 nt, Homo sapiens
caguguugccaga

SEQ ID NO: 1735759 - RNA, 18 nt, Homo sapiens
caguguuuauccuuucau

SEQ ID NO: 1735760 - RNA, 20 nt, Homo sapiens
caguguuuauccuuucauau

SEQ ID NO: 1735761 - RNA, 13 nt, Homo sapiens
caguuaagccuuu

SEQ ID NO: 1735762 - RNA, 16 nt, Homo sapiens
caguucaccuugaaga

SEQ ID NO: 1735763 - RNA, 15 nt, Homo sapiens
caguugcauucauua

SEQ ID NO: 1735764 - RNA, 19 nt, Homo sapiens
cauaaccccggaagccaaa

SEQ ID NO: 1735765 - RNA, 22 nt, Homo sapiens
cauaacuucauagaugcaggag

SEQ ID NO: 1735766 - RNA, 22 nt, Homo sapiens
cauaauucaggaagcagcuuuc

SEQ ID NO: 1735767 - RNA, 14 nt, Homo sapiens
cauagaagagccaa

SEQ ID NO: 1735768 - RNA, 17 nt, Homo sapiens
cauagagugaucuuucc

SEQ ID NO: 1735769 - RNA, 22 nt, Homo sapiens
cauaguagguacccaauucaau

SEQ ID NO: 1735770 - RNA, 15 nt, Homo sapiens
cauauuuaacaugua

SEQ ID NO: 1735771 - RNA, 19 nt, Homo sapiens
cauauuuuauuauagucac

SEQ ID NO: 1735772 - RNA, 17 nt, Homo sapiens
caucacuuccuugcccc

SEQ ID NO: 1735773 - RNA, 19 nt, Homo sapiens
caucagugcccuccaggau

SEQ ID NO: 1735774 - RNA, 21 nt, Homo sapiens
caucauggaaagacugggaca

SEQ ID NO: 1735775 - RNA, 17 nt, Homo sapiens
caucauuucacuuguca

SEQ ID NO: 1735776 - RNA, 17 nt, Homo sapiens
cauccaggccauucccc

SEQ ID NO: 1735777 - RNA, 17 nt, Homo sapiens
cauccagugacaaacca

SEQ ID NO: 1735778 - RNA, 15 nt, Homo sapiens
cauccuuuacguguu

SEQ ID NO: 1735779 - RNA, 20 nt, Homo sapiens
caucgcaauaguuuuuuacu

SEQ ID NO: 1735780 - RNA, 13 nt, Homo sapiens
caucucagugcag

SEQ ID NO: 1735781 - RNA, 13 nt, Homo sapiens
caucucugcaauc

SEQ ID NO: 1735782 - RNA, 15 nt, Homo sapiens
caucuguaaaaugga

SEQ ID NO: 1735783 - RNA, 20 nt, Homo sapiens
caugaggagggaaaagagug

SEQ ID NO: 1735784 - RNA, 18 nt, Homo sapiens
caugcacccucauacaca

SEQ ID NO: 1735785 - RNA, 14 nt, Homo sapiens
cauggcugaaguca

SEQ ID NO: 1735786 - RNA, 15 nt, Homo sapiens
cauggggguauugua

SEQ ID NO: 1735787 - RNA, 19 nt, Homo sapiens
caugucucacgucucccua

SEQ ID NO: 1735788 - RNA, 19 nt, Homo sapiens
caugugauuacccucuggg

SEQ ID NO: 1735789 - RNA, 13 nt, Homo sapiens
cauuaacacaaag

SEQ ID NO: 1735790 - RNA, 13 nt, Homo sapiens
cauuaucagucca

SEQ ID NO: 1735791 - RNA, 19 nt, Homo sapiens
cauucucgugagucauuua

SEQ ID NO: 1735792 - RNA, 14 nt, Homo sapiens
cauugagcauuuga

SEQ ID NO: 1735793 - RNA, 14 nt, Homo sapiens
cauugcacuuugau

SEQ ID NO: 1735794 - RNA, 13 nt, Homo sapiens
cauuggaagccau

SEQ ID NO: 1735795 - RNA, 17 nt, Homo sapiens
cauuuuuauguuauuac

SEQ ID NO: 1735796 - RNA, 21 nt, Homo sapiens
ccaaacauguuguacauuuca

SEQ ID NO: 1735797 - RNA, 14 nt, Homo sapiens
ccaaagacaucagu

SEQ ID NO: 1735798 - RNA, 23 nt, Homo sapiens
cucaucauagcaauaacauuccc

SEQ ID NO: 1735799 - RNA, 15 nt, Homo sapiens
cuccaaaugcagcuu

SEQ ID NO: 1735800 - RNA, 14 nt, Homo sapiens
cuccagauucugau

SEQ ID NO: 1735801 - RNA, 17 nt, Homo sapiens
cuccaguuugcauuugg

SEQ ID NO: 1735802 - RNA, 17 nt, Homo sapiens
cucccacaaugcugaau

SEQ ID NO: 1735803 - RNA, 23 nt, Homo sapiens
cuccccaguucauugcacuuuga

SEQ ID NO: 1735804 - RNA, 23 nt, Homo sapiens
cucccuauuuuuuuucuguuaua

SEQ ID NO: 1735805 - RNA, 13 nt, Homo sapiens
cuccgaggccagu

SEQ ID NO: 1735806 - RNA, 23 nt, Homo sapiens
cuccugaaaaaaaaccugagauu

SEQ ID NO: 1735807 - RNA, 17 nt, Homo sapiens
cuccuuccucugaggcu

SEQ ID NO: 1735808 - RNA, 16 nt, Homo sapiens
cucgaggcggaucuuu

SEQ ID NO: 1735809 - RNA, 21 nt, Homo sapiens
cucuaguuucuuccuguagua

SEQ ID NO: 1735810 - RNA, 14 nt, Homo sapiens
cucugaugcagcuu

SEQ ID NO: 1735811 - RNA, 18 nt, Homo sapiens
cucugggucucagugucc

SEQ ID NO: 1735812 - RNA, 21 nt, Homo sapiens
cucugucuaggacugcagugu

SEQ ID NO: 1735813 - RNA, 18 nt, Homo sapiens
cucugugggucucuggaa

SEQ ID NO: 1735814 - RNA, 13 nt, Homo sapiens
cucuuacaaaagc

SEQ ID NO: 1735815 - RNA, 12 nt, Homo sapiens
cucuuggcaguc

SEQ ID NO: 1735816 - RNA, 13 nt, Homo sapiens
cucuuggugccuc

SEQ ID NO: 1735817 - RNA, 15 nt, Homo sapiens
cugaaaacaagccau

SEQ ID NO: 1735818 - RNA, 14 nt, Homo sapiens
cugaaggacuguga

SEQ ID NO: 1735819 - RNA, 21 nt, Homo sapiens
cugaagucaccucuugguuac

SEQ ID NO: 1735820 - RNA, 13 nt, Homo sapiens
cugaagugcuuag

SEQ ID NO: 1735821 - RNA, 18 nt, Homo sapiens
cugagaaggcaguaguuu

SEQ ID NO: 1735822 - RNA, 22 nt, Homo sapiens
cugaggcccagugcauaugcaa

SEQ ID NO: 1735823 - RNA, 15 nt, Homo sapiens
cugcaguuuuuccca

SEQ ID NO: 1735824 - RNA, 14 nt, Homo sapiens
cugccaaacacauu

SEQ ID NO: 1735825 - RNA, 15 nt, Homo sapiens
cugccaagacuccuc

SEQ ID NO: 1735826 - RNA, 18 nt, Homo sapiens
cugcuaaauaaacaugug

SEQ ID NO: 1735827 - RNA, 16 nt, Homo sapiens
cuggagugcaguggcg

SEQ ID NO: 1735828 - RNA, 16 nt, Homo sapiens
cuggcuccaaacccuc

SEQ ID NO: 1735829 - RNA, 20 nt, Homo sapiens
cugggauccgggaucaaagu

SEQ ID NO: 1735830 - RNA, 22 nt, Homo sapiens
cuggggcuccgaaauuccaagg

SEQ ID NO: 1735831 - RNA, 16 nt, Homo sapiens
cuggguuccugcaaug

SEQ ID NO: 1735832 - RNA, 17 nt, Homo sapiens
cuguaaaauggagacac

SEQ ID NO: 1735833 - RNA, 20 nt, Homo sapiens
cuguaaagcuuugugcagau

SEQ ID NO: 1735834 - RNA, 14 nt, Homo sapiens
cuguaaauaaucag

SEQ ID NO: 1735835 - RNA, 17 nt, Homo sapiens
cuguauuucaagaccuc

SEQ ID NO: 1735836 - RNA, 18 nt, Homo sapiens
cugucacgugugggcaau

SEQ ID NO: 1735837 - RNA, 20 nt, Homo sapiens
cugucauccucaggaaccaa

SEQ ID NO: 1735838 - RNA, 21 nt, Homo sapiens
cugugauuucuuucuuugcac

SEQ ID NO: 1735839 - RNA, 22 nt, Homo sapiens
cuguguguuaagcucugcuauu

SEQ ID NO: 1735840 - RNA, 18 nt, Homo sapiens
cuuaaaauacaagacugc

SEQ ID NO: 1735841 - RNA, 13 nt, Homo sapiens
cuuaauucucugc

SEQ ID NO: 1735842 - RNA, 20 nt, Homo sapiens
cuuacauuuacaaacugaag

SEQ ID NO: 1735843 - RNA, 21 nt, Homo sapiens
cuuacauuuacaaacugaaga

SEQ ID NO: 1735844 - RNA, 16 nt, Homo sapiens
cuucaguuaagccuuu

SEQ ID NO: 1735845 - RNA, 23 nt, Homo sapiens
cuucucuucccugcgccugugau

SEQ ID NO: 1735846 - RNA, 19 nt, Homo sapiens
cuucuggguucaagcgauu

SEQ ID NO: 1735847 - RNA, 16 nt, Homo sapiens
cuucuuacaaugcauu

SEQ ID NO: 1735848 - RNA, 22 nt, Homo sapiens
cuugaagaaccucucacuucac

SEQ ID NO: 1735849 - RNA, 17 nt, Homo sapiens
cuugaaggacuaauaga

SEQ ID NO: 1735850 - RNA, 21 nt, Homo sapiens
cuugaggggaagcuagucuuu

SEQ ID NO: 1735851 - RNA, 16 nt, Homo sapiens
cuugcccccauuucac

SEQ ID NO: 1735852 - RNA, 17 nt, Homo sapiens
cuuggauucuuuccauu

SEQ ID NO: 1735853 - RNA, 15 nt, Homo sapiens
cuuuaaaacuuaucc

SEQ ID NO: 1735854 - RNA, 14 nt, Homo sapiens
cuuuaucauaugcu

SEQ ID NO: 1735855 - RNA, 23 nt, Homo sapiens
cuuuccccaugucucgacucauc

SEQ ID NO: 1735856 - RNA, 19 nt, Homo sapiens
cuuucccuucaguacccuc

SEQ ID NO: 1735857 - RNA, 13 nt, Homo sapiens
cuuucuaugcugu

SEQ ID NO: 1735858 - RNA, 17 nt, Homo sapiens
cuuugaauacugugaaa

SEQ ID NO: 1735859 - RNA, 20 nt, Homo sapiens
caauguacaggaaguaguuc

SEQ ID NO: 1735860 - RNA, 22 nt, Homo sapiens
caauuugguaaaaaugcugcuc

SEQ ID NO: 1735861 - RNA, 12 nt, Homo sapiens
cacaagcacuuu

SEQ ID NO: 1735862 - RNA, 19 nt, Homo sapiens
cacaauaugggcacuuuaa

SEQ ID NO: 1735863 - RNA, 15 nt, Homo sapiens
cacaccugggcauuu

SEQ ID NO: 1735864 - RNA, 23 nt, Homo sapiens
cacacgcacugcgccugucagua

SEQ ID NO: 1735865 - RNA, 20 nt, Homo sapiens
cacagaacacagcaauuccu

SEQ ID NO: 1735866 - RNA, 20 nt, Homo sapiens
cacagagcaggacugcacag

SEQ ID NO: 1735867 - RNA, 19 nt, Homo sapiens
cacagcguccuguccacac

SEQ ID NO: 1735868 - RNA, 19 nt, Homo sapiens
cacaggaagccugcagucc

SEQ ID NO: 1735869 - RNA, 17 nt, Homo sapiens
cacagugcugaccagac

SEQ ID NO: 1735870 - RNA, 12 nt, Homo sapiens
cacagugucugg

SEQ ID NO: 1735871 - RNA, 21 nt, Homo sapiens
cacaguuuugguugcuuuaau

SEQ ID NO: 1735872 - RNA, 20 nt, Homo sapiens
cacauuuuuaaaagaacaau

SEQ ID NO: 1735873 - RNA, 16 nt, Homo sapiens
caccaaacccggccug

SEQ ID NO: 1735874 - RNA, 21 nt, Homo sapiens
caccaaacccggccugauuaa

SEQ ID NO: 1735875 - RNA, 20 nt, Homo sapiens
caccaagcagcaacagcaaa

SEQ ID NO: 1735876 - RNA, 14 nt, Homo sapiens
caccacgcccagcu

SEQ ID NO: 1735877 - RNA, 13 nt, Homo sapiens
caccccugcaguu

SEQ ID NO: 1735878 - RNA, 18 nt, Homo sapiens
cacccgccgccucccacg

SEQ ID NO: 1735879 - RNA, 13 nt, Homo sapiens
caccuagacugua

SEQ ID NO: 1735880 - RNA, 16 nt, Homo sapiens
caccuccucauguaca

SEQ ID NO: 1735881 - RNA, 15 nt, Homo sapiens
caccuccucuaaggu

SEQ ID NO: 1735882 - RNA, 12 nt, Homo sapiens
caccuguaggca

SEQ ID NO: 1735883 - RNA, 21 nt, Homo sapiens
caccuuccagcuccuguaaca

SEQ ID NO: 1735884 - RNA, 14 nt, Homo sapiens
cacgagcaaaccca

SEQ ID NO: 1735885 - RNA, 20 nt, Homo sapiens
cacugcugcuccagugcagg

SEQ ID NO: 1735886 - RNA, 23 nt, Homo sapiens
cacuucaaacuacuuugcugcua

SEQ ID NO: 1735887 - RNA, 13 nt, Homo sapiens
cacuuccuugccc

SEQ ID NO: 1735888 - RNA, 17 nt, Homo sapiens
cacuuuaacacaguguc

SEQ ID NO: 1735889 - RNA, 19 nt, Homo sapiens
cacuuuaacacagugucug

SEQ ID NO: 1735890 - RNA, 17 nt, Homo sapiens
cagaaaagcaauacugu

SEQ ID NO: 1735891 - RNA, 21 nt, Homo sapiens
cagaacacagcaauuccucag

SEQ ID NO: 1735892 - RNA, 20 nt, Homo sapiens
cagagaaaauaaaagcacuu

SEQ ID NO: 1735893 - RNA, 21 nt, Homo sapiens
cagagacgggguuugccaugc

SEQ ID NO: 1735894 - RNA, 19 nt, Homo sapiens
cagagagccuggugcugcu

SEQ ID NO: 1735895 - RNA, 22 nt, Homo sapiens
cagagauggaugcauguucuga

SEQ ID NO: 1735896 - RNA, 21 nt, Homo sapiens
cagagccagccggcuaugaaa

SEQ ID NO: 1735897 - RNA, 23 nt, Homo sapiens
cagagccauggucccaggcuucc

SEQ ID NO: 1735898 - RNA, 15 nt, Homo sapiens
cagaugcugugcaaa

SEQ ID NO: 1735899 - RNA, 17 nt, Homo sapiens
cagauggcacuuugaag

SEQ ID NO: 1735900 - RNA, 14 nt, Homo sapiens
cagcaacacagcca

SEQ ID NO: 1735901 - RNA, 21 nt, Homo sapiens
cagcacugccugcucccaucc

SEQ ID NO: 1735902 - RNA, 15 nt, Homo sapiens
cagcaggugcucaau

SEQ ID NO: 1735903 - RNA, 17 nt, Homo sapiens
cagcauuuccacaccaa

SEQ ID NO: 1735904 - RNA, 14 nt, Homo sapiens
cagccacccaagcc

SEQ ID NO: 1735905 - RNA, 12 nt, Homo sapiens
cagccagucuca

SEQ ID NO: 1735906 - RNA, 17 nt, Homo sapiens
cagccccuccuccauag

SEQ ID NO: 1735907 - RNA, 19 nt, Homo sapiens
cagcgaccuuccucaucca

SEQ ID NO: 1735908 - RNA, 14 nt, Homo sapiens
cagcucagcacugc

SEQ ID NO: 1735909 - RNA, 14 nt, Homo sapiens
cagcuccuguaaca

SEQ ID NO: 1735910 - RNA, 21 nt, Homo sapiens
cagcuccuguaacauacuggc

SEQ ID NO: 1735911 - RNA, 18 nt, Homo sapiens
cagcugggcucugcaauu

SEQ ID NO: 1735912 - RNA, 18 nt, Homo sapiens
cagcuguuuuguugacau

SEQ ID NO: 1735913 - RNA, 11 nt, Homo sapiens
cagcuuuucaa

SEQ ID NO: 1735914 - RNA, 13 nt, Homo sapiens
caggagacugggc

SEQ ID NO: 1735915 - RNA, 21 nt, Homo sapiens
caggagacuuuacauggaugc

SEQ ID NO: 1735916 - RNA, 19 nt, Homo sapiens
caggagagacagugaggcu

SEQ ID NO: 1735917 - RNA, 16 nt, Homo sapiens
ucuccgucucccaaag

SEQ ID NO: 1735918 - RNA, 16 nt, Homo sapiens
ucucucugaccuuuca

SEQ ID NO: 1735919 - RNA, 18 nt, Homo sapiens
ucucugcaguuuuuccca

SEQ ID NO: 1735920 - RNA, 11 nt, Homo sapiens
ucucugggcug

SEQ ID NO: 1735921 - RNA, 12 nt, Homo sapiens
ucucugugaauu

SEQ ID NO: 1735922 - RNA, 20 nt, Homo sapiens
ucucuuucacauuguuugcu

SEQ ID NO: 1735923 - RNA, 13 nt, Homo sapiens
ucugaaucagcca

SEQ ID NO: 1735924 - RNA, 15 nt, Homo sapiens
ucugcccacagucuu

SEQ ID NO: 1735925 - RNA, 15 nt, Homo sapiens
ucuggaggcaaucaa

SEQ ID NO: 1735926 - RNA, 15 nt, Homo sapiens
ucugggccagaauuu

SEQ ID NO: 1735927 - RNA, 19 nt, Homo sapiens
ucugggccagaauuucaaa

SEQ ID NO: 1735928 - RNA, 22 nt, Homo sapiens
ucugguccaggcccuguggcag

SEQ ID NO: 1735929 - RNA, 15 nt, Homo sapiens
ucuucaccuuauuca

SEQ ID NO: 1735930 - RNA, 21 nt, Homo sapiens
ucuucagggaacugcauagau

SEQ ID NO: 1735931 - RNA, 14 nt, Homo sapiens
ucuucauaccuaca

SEQ ID NO: 1735932 - RNA, 14 nt, Homo sapiens
ucuucccccaaagc

SEQ ID NO: 1735933 - RNA, 14 nt, Homo sapiens
ucuuccucccugga

SEQ ID NO: 1735934 - RNA, 16 nt, Homo sapiens
ucuuccucccuggaau

SEQ ID NO: 1735935 - RNA, 19 nt, Homo sapiens
ucuuccuggauuauucaaa

SEQ ID NO: 1735936 - RNA, 13 nt, Homo sapiens
ucuuucuuuccaa

SEQ ID NO: 1735937 - RNA, 15 nt, Homo sapiens
ucuuugcaccaaaga

SEQ ID NO: 1735938 - RNA, 15 nt, Homo sapiens
ucuuuggacagaagc

SEQ ID NO: 1735939 - RNA, 20 nt, Homo sapiens
ucuuuggacagaagcagcuc

SEQ ID NO: 1735940 - RNA, 14 nt, Homo sapiens
ucuuugguggcaug

SEQ ID NO: 1735941 - RNA, 21 nt, Homo sapiens
ugaaaggugugcuagaacaag

SEQ ID NO: 1735942 - RNA, 19 nt, Homo sapiens
ugaaaucaguuacucuuca

SEQ ID NO: 1735943 - RNA, 21 nt, Homo sapiens
ugaaauucacccccuuuccug

SEQ ID NO: 1735944 - RNA, 15 nt, Homo sapiens
ugaaggacugugaca

SEQ ID NO: 1735945 - RNA, 15 nt, Homo sapiens
ugaauaucaguuauu

SEQ ID NO: 1735946 - RNA, 13 nt, Homo sapiens
ugaauugccaggg

SEQ ID NO: 1735947 - RNA, 12 nt, Homo sapiens
ugacaacaucgc

SEQ ID NO: 1735948 - RNA, 16 nt, Homo sapiens
ugacauaauauauucu

SEQ ID NO: 1735949 - RNA, 16 nt, Homo sapiens
ugacaucucugcaauc

SEQ ID NO: 1735950 - RNA, 14 nt, Homo sapiens
ugaccugacagccc

SEQ ID NO: 1735951 - RNA, 23 nt, Homo sapiens
ugagacaggagaccuggcacugg

SEQ ID NO: 1735952 - RNA, 21 nt, Homo sapiens
ugagccccuggaggcacugaa

SEQ ID NO: 1735953 - RNA, 20 nt, Homo sapiens
ugaggagagcacccuaggca

SEQ ID NO: 1735954 - RNA, 12 nt, Homo sapiens
ugagguaaccuc

SEQ ID NO: 1735955 - RNA, 17 nt, Homo sapiens
ugauacuucgacacugu

SEQ ID NO: 1735956 - RNA, 18 nt, Homo sapiens
ugaucaguaugaaaaugu

SEQ ID NO: 1735957 - RNA, 19 nt, Homo sapiens
ugaucuuaauauauuugaa

SEQ ID NO: 1735958 - RNA, 22 nt, Homo sapiens
ugaugucccuauggaagcauau

SEQ ID NO: 1735959 - RNA, 18 nt, Homo sapiens
ugauucacucaagaguuc

SEQ ID NO: 1735960 - RNA, 14 nt, Homo sapiens
ugauucaugucuca

SEQ ID NO: 1735961 - RNA, 15 nt, Homo sapiens
ugauucaugucucac

SEQ ID NO: 1735962 - RNA, 20 nt, Homo sapiens
ugcaaacucuuuggucguuu

SEQ ID NO: 1735963 - RNA, 21 nt, Homo sapiens
ugcaaucuucucagaaggcaa

SEQ ID NO: 1735964 - RNA, 15 nt, Homo sapiens
ugccaaccggucacc

SEQ ID NO: 1735965 - RNA, 21 nt, Homo sapiens
ugccaaccggucacccaggag

SEQ ID NO: 1735966 - RNA, 16 nt, Homo sapiens
ugccaccggaggucac

SEQ ID NO: 1735967 - RNA, 17 nt, Homo sapiens
ugccaugcuggccaggc

SEQ ID NO: 1735968 - RNA, 19 nt, Homo sapiens
ugccauugacuucuuccca

SEQ ID NO: 1735969 - RNA, 21 nt, Homo sapiens
ugccauugacuucuucccaag

SEQ ID NO: 1735970 - RNA, 19 nt, Homo sapiens
ugccccccagccucuggca

SEQ ID NO: 1735971 - RNA, 13 nt, Homo sapiens
ugccgcaccagcc

SEQ ID NO: 1735972 - RNA, 17 nt, Homo sapiens
ugccuaugaaauuucaa

SEQ ID NO: 1735973 - RNA, 14 nt, Homo sapiens
ugccucuacccaac

SEQ ID NO: 1735974 - RNA, 22 nt, Homo sapiens
ugccuggaucucacaagcacuu

SEQ ID NO: 1735975 - RNA, 16 nt, Homo sapiens
ugccugugauuuccua

SEQ ID NO: 1735976 - RNA, 15 nt, Homo sapiens
ugccuuagucucagu

SEQ ID NO: 1735977 - RNA, 14 nt, Homo sapiens
ugcucccacagaac

SEQ ID NO: 1735978 - RNA, 23 nt, Homo sapiens
ugcuccccaggccaccccgcuga

SEQ ID NO: 1735979 - RNA, 17 nt, Homo sapiens
ugcugcuccagugcagg

SEQ ID NO: 1735980 - RNA, 19 nt, Homo sapiens
ugcuggccaggcuggucuc

SEQ ID NO: 1735981 - RNA, 20 nt, Homo sapiens
ugcugggaauuacaggcgug

SEQ ID NO: 1735982 - RNA, 19 nt, Homo sapiens
ugcuguuuuguuauauaau

SEQ ID NO: 1735983 - RNA, 18 nt, Homo sapiens
ugcuuaguguacuuggag

SEQ ID NO: 1735984 - RNA, 22 nt, Homo sapiens
ugcuucccagaggagcagcucu

SEQ ID NO: 1735985 - RNA, 23 nt, Homo sapiens
ugcuuuugcccauuuugaaucac

SEQ ID NO: 1735986 - RNA, 15 nt, Homo sapiens
ugcuuuuucagccau

SEQ ID NO: 1735987 - RNA, 13 nt, Homo sapiens
uggaaacagcucg

SEQ ID NO: 1735988 - RNA, 13 nt, Homo sapiens
uggaacaagcaca

SEQ ID NO: 1735989 - RNA, 16 nt, Homo sapiens
uggaagagcacaagag

SEQ ID NO: 1735990 - RNA, 12 nt, Homo sapiens
uggacggaacca

SEQ ID NO: 1735991 - RNA, 15 nt, Homo sapiens
uggacugcucaggaa

SEQ ID NO: 1735992 - RNA, 23 nt, Homo sapiens
uggagaagcucaucagaaacuca

SEQ ID NO: 1735993 - RNA, 14 nt, Homo sapiens
uggagacaccacca

SEQ ID NO: 1735994 - RNA, 20 nt, Homo sapiens
uggagagucagaucuuucuc

SEQ ID NO: 1735995 - RNA, 20 nt, Homo sapiens
uggagggguguggcuccuuc

SEQ ID NO: 1735996 - RNA, 17 nt, Homo sapiens
uggaugccaaccgguca

SEQ ID NO: 1735997 - RNA, 19 nt, Homo sapiens
uggauuuugaaauuuacug

SEQ ID NO: 1735998 - RNA, 17 nt, Homo sapiens
uggcacuggaugcagaa

SEQ ID NO: 1735999 - RNA, 16 nt, Homo sapiens
uggcacuugggacaaa

SEQ ID NO: 1736000 - RNA, 16 nt, Homo sapiens
uggcauggccaccacc

SEQ ID NO: 1736001 - RNA, 11 nt, Homo sapiens
uggcauuucaa

SEQ ID NO: 1736002 - RNA, 17 nt, Homo sapiens
uggccacggccacagcc

SEQ ID NO: 1736003 - RNA, 23 nt, Homo sapiens
uggccagagagccuggugcugcu

SEQ ID NO: 1736004 - RNA, 16 nt, Homo sapiens
uggccccacuuugaag

SEQ ID NO: 1736005 - RNA, 16 nt, Homo sapiens
uggccucugcaacugc

SEQ ID NO: 1736006 - RNA, 12 nt, Homo sapiens
uggcuccaaacc

SEQ ID NO: 1736007 - RNA, 14 nt, Homo sapiens
uggcuccaaacccu

SEQ ID NO: 1736008 - RNA, 15 nt, Homo sapiens
uggcuccaacacugc

SEQ ID NO: 1736009 - RNA, 19 nt, Homo sapiens
uggcuccaacacugcugcu

SEQ ID NO: 1736010 - RNA, 16 nt, Homo sapiens
uggcugggaguggcau

SEQ ID NO: 1736011 - RNA, 20 nt, Homo sapiens
uggcuuaagugagcagaaca

SEQ ID NO: 1736012 - RNA, 14 nt, Homo sapiens
ugggaaaaccagac

SEQ ID NO: 1736013 - RNA, 15 nt, Homo sapiens
ugggaaaaccagacu

SEQ ID NO: 1736014 - RNA, 16 nt, Homo sapiens
ugggccagaauuucaa

SEQ ID NO: 1736015 - RNA, 18 nt, Homo sapiens
ugguggccacggccacag

SEQ ID NO: 1736016 - RNA, 13 nt, Homo sapiens
uguaacugucagu

SEQ ID NO: 1736017 - RNA, 23 nt, Homo sapiens
uguacuguucugugucuuucaca

SEQ ID NO: 1736018 - RNA, 18 nt, Homo sapiens
uguaggcacagagcugca

SEQ ID NO: 1736019 - RNA, 19 nt, Homo sapiens
ugucacauagagugaucuu

SEQ ID NO: 1736020 - RNA, 20 nt, Homo sapiens
ugucacauagagugaucuuu

SEQ ID NO: 1736021 - RNA, 22 nt, Homo sapiens
ugucagaugcugugcaaauguu

SEQ ID NO: 1736022 - RNA, 13 nt, Homo sapiens
ugucugccaaaca

SEQ ID NO: 1736023 - RNA, 16 nt, Homo sapiens
ugugaacccaaagugu

SEQ ID NO: 1736024 - RNA, 18 nt, Homo sapiens
ugugaacccaaaguguga

SEQ ID NO: 1736025 - RNA, 17 nt, Homo sapiens
ugugauugucuuugaau

SEQ ID NO: 1736026 - RNA, 13 nt, Homo sapiens
ugugcccucagau

SEQ ID NO: 1736027 - RNA, 13 nt, Homo sapiens
ugugcuacagaug

SEQ ID NO: 1736028 - RNA, 20 nt, Homo sapiens
uguggagagagaggcuucaa

SEQ ID NO: 1736029 - RNA, 15 nt, Homo sapiens
uguggcaucuugcca

SEQ ID NO: 1736030 - RNA, 15 nt, Homo sapiens
ugugggaaauccaca

SEQ ID NO: 1736031 - RNA, 18 nt, Homo sapiens
auucuuuacccccuggga

SEQ ID NO: 1736032 - RNA, 17 nt, Homo sapiens
auugacuucuucccaag

SEQ ID NO: 1736033 - RNA, 12 nt, Homo sapiens
auugagcaccug

SEQ ID NO: 1736034 - RNA, 16 nt, Homo sapiens
auugauucaugucuca

SEQ ID NO: 1736035 - RNA, 16 nt, Homo sapiens
auuggaacucuacuca

SEQ ID NO: 1736036 - RNA, 14 nt, Homo sapiens
auuggaagagcaca

SEQ ID NO: 1736037 - RNA, 21 nt, Homo sapiens
auugucagaugcugugcaaau

SEQ ID NO: 1736038 - RNA, 16 nt, Homo sapiens
auuuaaacaccuccuc

SEQ ID NO: 1736039 - RNA, 13 nt, Homo sapiens
auuucaagaccuc

SEQ ID NO: 1736040 - RNA, 22 nt, Homo sapiens
auuucauacaacagaaaccaga

SEQ ID NO: 1736041 - RNA, 23 nt, Homo sapiens
auuugaaaaaaacuucauucucg

SEQ ID NO: 1736042 - RNA, 15 nt, Homo sapiens
auuugcauauguaug

SEQ ID NO: 1736043 - RNA, 19 nt, Homo sapiens
auuuuaccaaagcaucaau

SEQ ID NO: 1736044 - RNA, 15 nt, Homo sapiens
auuuuagcuacuaua

SEQ ID NO: 1736045 - RNA, 12 nt, Homo sapiens
auuuugacuuaa

SEQ ID NO: 1736046 - RNA, 13 nt, Homo sapiens
auuuuucuaacua

SEQ ID NO: 1736047 - RNA, 14 nt, Homo sapiens
auuuuugaaaccaa

SEQ ID NO: 1736048 - RNA, 17 nt, Homo sapiens
auuuuuguuagcaaaga

SEQ ID NO: 1736049 - RNA, 21 nt, Homo sapiens
auuuuuguuagcaaagauuaa

SEQ ID NO: 1736050 - RNA, 12 nt, Homo sapiens
caaaaacuuugg

SEQ ID NO: 1736051 - RNA, 23 nt, Homo sapiens
caaaauaaauuggaaaugugaau

SEQ ID NO: 1736052 - RNA, 19 nt, Homo sapiens
caaaaucuugaucaguuaa

SEQ ID NO: 1736053 - RNA, 13 nt, Homo sapiens
caaacaccuucca

SEQ ID NO: 1736054 - RNA, 20 nt, Homo sapiens
caaacauuuugaaagucugu

SEQ ID NO: 1736055 - RNA, 21 nt, Homo sapiens
caaaccuaaaaucuguuuuuc

SEQ ID NO: 1736056 - RNA, 22 nt, Homo sapiens
caaaccuucugccuuugauguu

SEQ ID NO: 1736057 - RNA, 16 nt, Homo sapiens
caaacuuugcaucuca

SEQ ID NO: 1736058 - RNA, 19 nt, Homo sapiens
caaagaugaucaguaugaa

SEQ ID NO: 1736059 - RNA, 21 nt, Homo sapiens
caaagauuaaaugugucauug

SEQ ID NO: 1736060 - RNA, 12 nt, Homo sapiens
caaagauuugcu

SEQ ID NO: 1736061 - RNA, 14 nt, Homo sapiens
caaauaauuuguau

SEQ ID NO: 1736062 - RNA, 17 nt, Homo sapiens
caaauuuucacauaaaa

SEQ ID NO: 1736063 - RNA, 18 nt, Homo sapiens
caacagaaaccagaaaag

SEQ ID NO: 1736064 - RNA, 23 nt, Homo sapiens
caacagaaaccagaaaagcaaua

SEQ ID NO: 1736065 - RNA, 17 nt, Homo sapiens
caacagcaaaucacgac

SEQ ID NO: 1736066 - RNA, 20 nt, Homo sapiens
caacuuguauuaaagacaga

SEQ ID NO: 1736067 - RNA, 19 nt, Homo sapiens
caagagaucuuucuuucca

SEQ ID NO: 1736068 - RNA, 17 nt, Homo sapiens
caagaguucagugcuca

SEQ ID NO: 1736069 - RNA, 18 nt, Homo sapiens
caagugauccgcccaucu

SEQ ID NO: 1736070 - RNA, 21 nt, Homo sapiens
caagugugggccacuguggug

SEQ ID NO: 1736071 - RNA, 17 nt, Homo sapiens
caaguuguuugagaaau

SEQ ID NO: 1736072 - RNA, 15 nt, Homo sapiens
caauaaagccuucaa

SEQ ID NO: 1736073 - RNA, 13 nt, Homo sapiens
caauaacauuccc

SEQ ID NO: 1736074 - RNA, 15 nt, Homo sapiens
caaucuuaacucauu

SEQ ID NO: 1736075 - RNA, 19 nt, Homo sapiens
caaucuuaacucauugcaa

SEQ ID NO: 1736076 - RNA, 21 nt, Homo sapiens
caauuugguaaaaaugcugcu

SEQ ID NO: 1736077 - RNA, 23 nt, Homo sapiens
caauuuucuuuuuuauacucaau

SEQ ID NO: 1736078 - RNA, 23 nt, Homo sapiens
cacaaaguaucuaacaaaaccaa

SEQ ID NO: 1736079 - RNA, 15 nt, Homo sapiens
cacaaggccuugccu

SEQ ID NO: 1736080 - RNA, 12 nt, Homo sapiens
cacacacacaaa

SEQ ID NO: 1736081 - RNA, 13 nt, Homo sapiens
cacacacacaaac

SEQ ID NO: 1736082 - RNA, 17 nt, Homo sapiens
cacaccccagacgaugu

SEQ ID NO: 1736083 - RNA, 22 nt, Homo sapiens
cacaccugggcauuuggugaga

SEQ ID NO: 1736084 - RNA, 14 nt, Homo sapiens
cacacgagcaaacc

SEQ ID NO: 1736085 - RNA, 13 nt, Homo sapiens
cacacucaaggga

SEQ ID NO: 1736086 - RNA, 22 nt, Homo sapiens
cacagauuccuggcagagccau

SEQ ID NO: 1736087 - RNA, 14 nt, Homo sapiens
cacagcguccuguc

SEQ ID NO: 1736088 - RNA, 18 nt, Homo sapiens
cacaggcuccaaacugga

SEQ ID NO: 1736089 - RNA, 22 nt, Homo sapiens
cacaguccaaccagaaacaccc

SEQ ID NO: 1736090 - RNA, 14 nt, Homo sapiens
cacauguggacuuu

SEQ ID NO: 1736091 - RNA, 19 nt, Homo sapiens
caccacggcguuguaccug

SEQ ID NO: 1736092 - RNA, 20 nt, Homo sapiens
caccacgguggucacuggaa

SEQ ID NO: 1736093 - RNA, 23 nt, Homo sapiens
cacccagcucagcauuuccacac

SEQ ID NO: 1736094 - RNA, 20 nt, Homo sapiens
cacccauggggagacaguug

SEQ ID NO: 1736095 - RNA, 18 nt, Homo sapiens
caccccgccugcccucau

SEQ ID NO: 1736096 - RNA, 17 nt, Homo sapiens
cacccugccccuugcca

SEQ ID NO: 1736097 - RNA, 22 nt, Homo sapiens
cacccuugccauggagguuaag

SEQ ID NO: 1736098 - RNA, 19 nt, Homo sapiens
caccuaagucucugugaau

SEQ ID NO: 1736099 - RNA, 16 nt, Homo sapiens
caccuagacuguaaac

SEQ ID NO: 1736100 - RNA, 20 nt, Homo sapiens
caccuccucauguacauacc

SEQ ID NO: 1736101 - RNA, 20 nt, Homo sapiens
caccuuucuggacggaacca

SEQ ID NO: 1736102 - RNA, 14 nt, Homo sapiens
cacggccacaguca

SEQ ID NO: 1736103 - RNA, 12 nt, Homo sapiens
cacggggcacag

SEQ ID NO: 1736104 - RNA, 17 nt, Homo sapiens
cacgguggucacuggaa

SEQ ID NO: 1736105 - RNA, 20 nt, Homo sapiens
cacgugggcaaacaggcagu

SEQ ID NO: 1736106 - RNA, 19 nt, Homo sapiens
cacuaccgaaugugucuuu

SEQ ID NO: 1736107 - RNA, 14 nt, Homo sapiens
cacugagcugaggg

SEQ ID NO: 1736108 - RNA, 19 nt, Homo sapiens
cacugccagucucacugug

SEQ ID NO: 1736109 - RNA, 14 nt, Homo sapiens
cacuggaugcagaa

SEQ ID NO: 1736110 - RNA, 22 nt, Homo sapiens
cacuggccccucaaaucgucca

SEQ ID NO: 1736111 - RNA, 18 nt, Homo sapiens
cacugugggaaggccagc

SEQ ID NO: 1736112 - RNA, 22 nt, Homo sapiens
cacuuccuugcccccauuucac

SEQ ID NO: 1736113 - RNA, 19 nt, Homo sapiens
cagaaacaguucaccuuga

SEQ ID NO: 1736114 - RNA, 20 nt, Homo sapiens
cagaauauuagugaccucag

SEQ ID NO: 1736115 - RNA, 13 nt, Homo sapiens
cagaccucaugcc

SEQ ID NO: 1736116 - RNA, 19 nt, Homo sapiens
cagagacgggguuugccau

SEQ ID NO: 1736117 - RNA, 19 nt, Homo sapiens
cagagauggaugcauguuc

SEQ ID NO: 1736118 - RNA, 22 nt, Homo sapiens
cagagcaaguuccugagugcgu

SEQ ID NO: 1736119 - RNA, 20 nt, Homo sapiens
cagagcgaggaaaggauuuu

SEQ ID NO: 1736120 - RNA, 22 nt, Homo sapiens
cagagcuccaguuugcauuugg

SEQ ID NO: 1736121 - RNA, 21 nt, Homo sapiens
cagaggcugggugacaugugu

SEQ ID NO: 1736122 - RNA, 21 nt, Homo sapiens
cagaucuuucuccuugaauau

SEQ ID NO: 1736123 - RNA, 13 nt, Homo sapiens
cagaugcaguuug

SEQ ID NO: 1736124 - RNA, 18 nt, Homo sapiens
cagauuccgcaccaauaa

SEQ ID NO: 1736125 - RNA, 23 nt, Homo sapiens
cagcaaggccagaugcacauccc

SEQ ID NO: 1736126 - RNA, 15 nt, Homo sapiens
cagcagagacggggu

SEQ ID NO: 1736127 - RNA, 17 nt, Homo sapiens
cagccacuaaucaggag

SEQ ID NO: 1736128 - RNA, 18 nt, Homo sapiens
cagccaggcggcuggaau

SEQ ID NO: 1736129 - RNA, 16 nt, Homo sapiens
cagcccaagggugggu

SEQ ID NO: 1736130 - RNA, 14 nt, Homo sapiens
cagcccccucacag

SEQ ID NO: 1736131 - RNA, 15 nt, Homo sapiens
cagccguauuuuaca

SEQ ID NO: 1736132 - RNA, 21 nt, Homo sapiens
cagccguuuguuccccaagac

SEQ ID NO: 1736133 - RNA, 15 nt, Homo sapiens
cagccucaggaugag

SEQ ID NO: 1736134 - RNA, 15 nt, Homo sapiens
cagcuccacaguguu

SEQ ID NO: 1736135 - RNA, 19 nt, Homo sapiens
cagcuccacaguguugcca

SEQ ID NO: 1736136 - RNA, 16 nt, Homo sapiens
cagcuuucugggaugu

SEQ ID NO: 1736137 - RNA, 19 nt, Homo sapiens
caggagaccuggcacugga

SEQ ID NO: 1736138 - RNA, 16 nt, Homo sapiens
caggaggaauacugaa

SEQ ID NO: 1736139 - RNA, 21 nt, Homo sapiens
caggaggcccugguccuggcc

SEQ ID NO: 1736140 - RNA, 20 nt, Homo sapiens
caggaguguggccacguggg

SEQ ID NO: 1736141 - RNA, 18 nt, Homo sapiens
caggauagagugggacag

SEQ ID NO: 1736142 - RNA, 19 nt, Homo sapiens
caggauagagugggacagu

SEQ ID NO: 1736143 - RNA, 20 nt, Homo sapiens
gcacagcguccuguccacac

SEQ ID NO: 1736144 - RNA, 10 nt, Homo sapiens
gcaccaaaga

SEQ ID NO: 1736145 - RNA, 16 nt, Homo sapiens
gcaccaauaaagccuu

SEQ ID NO: 1736146 - RNA, 12 nt, Homo sapiens
gcacccauucca

SEQ ID NO: 1736147 - RNA, 13 nt, Homo sapiens
gcacuucaucuga

SEQ ID NO: 1736148 - RNA, 15 nt, Homo sapiens
gcacuuuaaaugaag

SEQ ID NO: 1736149 - RNA, 17 nt, Homo sapiens
gcacuuuaacacagugu

SEQ ID NO: 1736150 - RNA, 19 nt, Homo sapiens
gcacuuuaacacagugucu

SEQ ID NO: 1736151 - RNA, 19 nt, Homo sapiens
gcagacauagaagagccaa

SEQ ID NO: 1736152 - RNA, 16 nt, Homo sapiens
gcagacugauuggccu

SEQ ID NO: 1736153 - RNA, 13 nt, Homo sapiens
gcagccucuucaa

SEQ ID NO: 1736154 - RNA, 19 nt, Homo sapiens
gcauagauugaucaaagug

SEQ ID NO: 1736155 - RNA, 19 nt, Homo sapiens
gcaucaauacaaccagccc

SEQ ID NO: 1736156 - RNA, 15 nt, Homo sapiens
gcaucauuauuuaug

SEQ ID NO: 1736157 - RNA, 17 nt, Homo sapiens
gccaaccggucacccag

SEQ ID NO: 1736158 - RNA, 19 nt, Homo sapiens
gccaaccggucacccagga

SEQ ID NO: 1736159 - RNA, 19 nt, Homo sapiens
gccaaggcuggagugcagu

SEQ ID NO: 1736160 - RNA, 17 nt, Homo sapiens
gccaaggugggauuugu

SEQ ID NO: 1736161 - RNA, 21 nt, Homo sapiens
gccaggccucuuggcagucac

SEQ ID NO: 1736162 - RNA, 22 nt, Homo sapiens
gccauaaaaauaaaucaguuca

SEQ ID NO: 1736163 - RNA, 23 nt, Homo sapiens
gccaucccuuuuuuuacauuuca

SEQ ID NO: 1736164 - RNA, 21 nt, Homo sapiens
gccaugacuugagaaacaaau

SEQ ID NO: 1736165 - RNA, 17 nt, Homo sapiens
gcccaggaaacaagggg

SEQ ID NO: 1736166 - RNA, 14 nt, Homo sapiens
gcccauccagucuc

SEQ ID NO: 1736167 - RNA, 20 nt, Homo sapiens
gcccaucuccgucucccaaa

SEQ ID NO: 1736168 - RNA, 13 nt, Homo sapiens
gcccccauuucac

SEQ ID NO: 1736169 - RNA, 20 nt, Homo sapiens
gcccccgccugccaccggag

SEQ ID NO: 1736170 - RNA, 17 nt, Homo sapiens
gccccggggccuguuau

SEQ ID NO: 1736171 - RNA, 17 nt, Homo sapiens
gccccucugaccugcac

SEQ ID NO: 1736172 - RNA, 19 nt, Homo sapiens
gccccucugaccugcacug

SEQ ID NO: 1736173 - RNA, 22 nt, Homo sapiens
gccccugucgucaggaccuccu

SEQ ID NO: 1736174 - RNA, 21 nt, Homo sapiens
gcccgugcccccgccugccac

SEQ ID NO: 1736175 - RNA, 17 nt, Homo sapiens
gcccuccuuagaccuga

SEQ ID NO: 1736176 - RNA, 12 nt, Homo sapiens
gcccuguggcag

SEQ ID NO: 1736177 - RNA, 18 nt, Homo sapiens
gccgacuuggagacuccu

SEQ ID NO: 1736178 - RNA, 19 nt, Homo sapiens
gccgggcaccaacuccaug

SEQ ID NO: 1736179 - RNA, 13 nt, Homo sapiens
gccucuuggcagu

SEQ ID NO: 1736180 - RNA, 23 nt, Homo sapiens
gccugccuguccccccgcacuuu

SEQ ID NO: 1736181 - RNA, 22 nt, Homo sapiens
gccuggacuguuuucucucggc

SEQ ID NO: 1736182 - RNA, 13 nt, Homo sapiens
gccuucaaacucc

SEQ ID NO: 1736183 - RNA, 11 nt, Homo sapiens
gcgggggcuug

SEQ ID NO: 1736184 - RNA, 20 nt, Homo sapiens
gcucaucagaaacucaaaag

SEQ ID NO: 1736185 - RNA, 13 nt, Homo sapiens
gcuccaaacccuc

SEQ ID NO: 1736186 - RNA, 16 nt, Homo sapiens
gcuccaaaugcagcuu

SEQ ID NO: 1736187 - RNA, 17 nt, Homo sapiens
gcuccacaguguugcca

SEQ ID NO: 1736188 - RNA, 18 nt, Homo sapiens
gcuccagauucugaugca

SEQ ID NO: 1736189 - RNA, 17 nt, Homo sapiens
gcuccagugcaggagac

SEQ ID NO: 1736190 - RNA, 14 nt, Homo sapiens
gcucccacagaaca

SEQ ID NO: 1736191 - RNA, 16 nt, Homo sapiens
gcucucaaaucccucu

SEQ ID NO: 1736192 - RNA, 23 nt, Homo sapiens
gcucuccccaggcauuugccaag

SEQ ID NO: 1736193 - RNA, 21 nt, Homo sapiens
gcucucugacgcuugugacag

SEQ ID NO: 1736194 - RNA, 14 nt, Homo sapiens
gcuggagugcagug

SEQ ID NO: 1736195 - RNA, 22 nt, Homo sapiens
gcuggccaaagagccuuuccaa

SEQ ID NO: 1736196 - RNA, 20 nt, Homo sapiens
gcuggucucgaacugcugga

SEQ ID NO: 1736197 - RNA, 17 nt, Homo sapiens
gcuuaagugagcagaac

SEQ ID NO: 1736198 - RNA, 23 nt, Homo sapiens
gcuucuggaauuuguucaaguuu

SEQ ID NO: 1736199 - RNA, 18 nt, Homo sapiens
gcuugaaauagugucuga

SEQ ID NO: 1736200 - RNA, 22 nt, Homo sapiens
gcuugaaauagugucugaugaa

SEQ ID NO: 1736201 - RNA, 23 nt, Homo sapiens
gcuuguuaacugagugccuuuug

SEQ ID NO: 1736202 - RNA, 21 nt, Homo sapiens
gcuuuggcaaauaaaccuccu

SEQ ID NO: 1736203 - RNA, 21 nt, Homo sapiens
ggaaaggauuuuaccaaagca

SEQ ID NO: 1736204 - RNA, 22 nt, Homo sapiens
ggaagagcccgcagggccaugc

SEQ ID NO: 1736205 - RNA, 13 nt, Homo sapiens
ggaauaaacuguu

SEQ ID NO: 1736206 - RNA, 16 nt, Homo sapiens
ggacacaggcuccaaa

SEQ ID NO: 1736207 - RNA, 13 nt, Homo sapiens
ggacagaagcagc

SEQ ID NO: 1736208 - RNA, 15 nt, Homo sapiens
ggacagaagcagcuc

SEQ ID NO: 1736209 - RNA, 16 nt, Homo sapiens
ggacaugcccugugug

SEQ ID NO: 1736210 - RNA, 20 nt, Homo sapiens
ggacauugccuuuucuagcc

SEQ ID NO: 1736211 - RNA, 21 nt, Homo sapiens
ggacauugccuuuucuagccc

SEQ ID NO: 1736212 - RNA, 19 nt, Homo sapiens
ggacuugggcgggacacag

SEQ ID NO: 1736213 - RNA, 20 nt, Homo sapiens
ggacuuuuauuuccagugaa

SEQ ID NO: 1736214 - RNA, 14 nt, Homo sapiens
ggagaccuggcacu

SEQ ID NO: 1736215 - RNA, 20 nt, Homo sapiens
ggagacuccuggucugugaa

SEQ ID NO: 1736216 - RNA, 22 nt, Homo sapiens
ggagcaucagugcccuccagga

SEQ ID NO: 1736217 - RNA, 17 nt, Homo sapiens
ggaggcugcgugccagu

SEQ ID NO: 1736218 - RNA, 18 nt, Homo sapiens
ggagggaaaagagugccu

SEQ ID NO: 1736219 - RNA, 16 nt, Homo sapiens
ggagucagacauuuua

SEQ ID NO: 1736220 - RNA, 17 nt, Homo sapiens
ggaucucacaagcacuu

SEQ ID NO: 1736221 - RNA, 21 nt, Homo sapiens
ggauguuaugaacagcugugu

SEQ ID NO: 1736222 - RNA, 15 nt, Homo sapiens
ggauuuuaccaaagc

SEQ ID NO: 1736223 - RNA, 14 nt, Homo sapiens
ggcaaacaggcagu

SEQ ID NO: 1736224 - RNA, 19 nt, Homo sapiens
ggcaaucucagaugcaguu

SEQ ID NO: 1736225 - RNA, 13 nt, Homo sapiens
ggcaccaacucca

SEQ ID NO: 1736226 - RNA, 12 nt, Homo sapiens
ggcagagccaug

SEQ ID NO: 1736227 - RNA, 16 nt, Homo sapiens
ggccacagucauggug

SEQ ID NO: 1736228 - RNA, 21 nt, Homo sapiens
ggccacccugccucuacccaa

SEQ ID NO: 1736229 - RNA, 13 nt, Homo sapiens
ggccagaauuuca

SEQ ID NO: 1736230 - RNA, 16 nt, Homo sapiens
ggcggaucuuuggaca

SEQ ID NO: 1736231 - RNA, 23 nt, Homo sapiens
ggcggaucuuuggacagaagcag

SEQ ID NO: 1736232 - RNA, 17 nt, Homo sapiens
ggcucucuguaggcaca

SEQ ID NO: 1736233 - RNA, 14 nt, Homo sapiens
ggcuggagugcagu

SEQ ID NO: 1736234 - RNA, 13 nt, Homo sapiens
ggcuggcacugac

SEQ ID NO: 1736235 - RNA, 18 nt, Homo sapiens
gggaaagcuucauucucc

SEQ ID NO: 1736236 - RNA, 15 nt, Homo sapiens
gggaauaaacuguug

SEQ ID NO: 1736237 - RNA, 14 nt, Homo sapiens
gggagcgaaaguug

SEQ ID NO: 1736238 - RNA, 12 nt, Homo sapiens
gggaguggcgcg

SEQ ID NO: 1736239 - RNA, 13 nt, Homo sapiens
gggaguggcgcgc

SEQ ID NO: 1736240 - RNA, 16 nt, Homo sapiens
gggccuguuaugucaa

SEQ ID NO: 1736241 - RNA, 12 nt, Homo sapiens
gggggaaggugg

SEQ ID NO: 1736242 - RNA, 17 nt, Homo sapiens
ggguccugccgguggga

SEQ ID NO: 1736243 - RNA, 14 nt, Homo sapiens
gggucucagugucc

SEQ ID NO: 1736244 - RNA, 19 nt, Homo sapiens
gggucucccucuguugcca

SEQ ID NO: 1736245 - RNA, 14 nt, Homo sapiens
gggugguacccucu

SEQ ID NO: 1736246 - RNA, 17 nt, Homo sapiens
gguaguauuacaccacc

SEQ ID NO: 1736247 - RNA, 19 nt, Homo sapiens
ggucauuuuuauguuauua

SEQ ID NO: 1736248 - RNA, 24 nt, Homo sapiens
ggugaucucauuuaauccucucaa

SEQ ID NO: 1736249 - RNA, 15 nt, Homo sapiens
gguggaacaagcaca

SEQ ID NO: 1736250 - RNA, 11 nt, Homo sapiens
ggugggguccu

SEQ ID NO: 1736251 - RNA, 19 nt, Homo sapiens
gguuugccaugcuggccag

SEQ ID NO: 1736252 - RNA, 15 nt, Homo sapiens
guaaaaaugcugcuc

SEQ ID NO: 1736253 - RNA, 16 nt, Homo sapiens
guaaagcuuugugcag

SEQ ID NO: 1736254 - RNA, 19 nt, Homo sapiens
guacacacugguacuuaga

SEQ ID NO: 1736255 - RNA, 16 nt, Homo sapiens
guacuuuuuacauaca

SEQ ID NO: 1736256 - RNA, 14 nt, Homo sapiens
aauaugggcacuuu

SEQ ID NO: 1736257 - RNA, 21 nt, Homo sapiens
aauauuuauaggucacuuugu

SEQ ID NO: 1736258 - RNA, 17 nt, Homo sapiens
aaucaguuacucuucag

SEQ ID NO: 1736259 - RNA, 21 nt, Homo sapiens
aaucguccagcgaccuuccuc

SEQ ID NO: 1736260 - RNA, 19 nt, Homo sapiens
aaucucagaugcaguuugg

SEQ ID NO: 1736261 - RNA, 22 nt, Homo sapiens
aaugaagcuaauaauucuucac

SEQ ID NO: 1736262 - RNA, 13 nt, Homo sapiens
aauggccaugcag

SEQ ID NO: 1736263 - RNA, 16 nt, Homo sapiens
aaugugaaucaugguu

SEQ ID NO: 1736264 - RNA, 22 nt, Homo sapiens
aauguuguuuuaggaauacaua

SEQ ID NO: 1736265 - RNA, 20 nt, Homo sapiens
aauucacccccuuuccugga

SEQ ID NO: 1736266 - RNA, 22 nt, Homo sapiens
aauucaggaagcagcuuucccc

SEQ ID NO: 1736267 - RNA, 15 nt, Homo sapiens
aauuccuugcacaua

SEQ ID NO: 1736268 - RNA, 19 nt, Homo sapiens
acaaagaugccacauucaa

SEQ ID NO: 1736269 - RNA, 19 nt, Homo sapiens
acaagacugccauauuaaa

SEQ ID NO: 1736270 - RNA, 19 nt, Homo sapiens
acaauuaaaccgcauguga

SEQ ID NO: 1736271 - RNA, 13 nt, Homo sapiens
acacaaagacauu

SEQ ID NO: 1736272 - RNA, 19 nt, Homo sapiens
acacagagcaggacugcac

SEQ ID NO: 1736273 - RNA, 17 nt, Homo sapiens
acacaggcuccaaacug

SEQ ID NO: 1736274 - RNA, 19 nt, Homo sapiens
acacugcugcuccagugca

SEQ ID NO: 1736275 - RNA, 20 nt, Homo sapiens
acagacaagugacuguaucu

SEQ ID NO: 1736276 - RNA, 11 nt, Homo sapiens
acagaccucag

SEQ ID NO: 1736277 - RNA, 18 nt, Homo sapiens
acagagcaggacugcaca

SEQ ID NO: 1736278 - RNA, 21 nt, Homo sapiens
acagauuccuggcagagccau

SEQ ID NO: 1736279 - RNA, 17 nt, Homo sapiens
cucagaacauacugauu

SEQ ID NO: 1736280 - RNA, 11 nt, Homo sapiens
cucagugcagg

SEQ ID NO: 1736281 - RNA, 19 nt, Homo sapiens
cucaguuugugugucuuaa

SEQ ID NO: 1736282 - RNA, 17 nt, Homo sapiens
cucaucagaaacucaaa

SEQ ID NO: 1736283 - RNA, 22 nt, Homo sapiens
cuccagguggcucugaggugcc

SEQ ID NO: 1736284 - RNA, 12 nt, Homo sapiens
cuccagugcagg

SEQ ID NO: 1736285 - RNA, 14 nt, Homo sapiens
cuccccacagugcc

SEQ ID NO: 1736286 - RNA, 17 nt, Homo sapiens
cucccuucucuaccuca

SEQ ID NO: 1736287 - RNA, 14 nt, Homo sapiens
cuccgaggccagua

SEQ ID NO: 1736288 - RNA, 13 nt, Homo sapiens
cuccucaggguug

SEQ ID NO: 1736289 - RNA, 14 nt, Homo sapiens
cuccuggacuccug

SEQ ID NO: 1736290 - RNA, 19 nt, Homo sapiens
cucuccccaggcauuugcc

SEQ ID NO: 1736291 - RNA, 13 nt, Homo sapiens
cucucucuguggg

SEQ ID NO: 1736292 - RNA, 19 nt, Homo sapiens
cucucuguaggcacagagc

SEQ ID NO: 1736293 - RNA, 15 nt, Homo sapiens
cucugaccugcacug

SEQ ID NO: 1736294 - RNA, 17 nt, Homo sapiens
cucugaccugcacuggg

SEQ ID NO: 1736295 - RNA, 13 nt, Homo sapiens
cucugaccuuuca

SEQ ID NO: 1736296 - RNA, 19 nt, Homo sapiens
cucuucaguuaagccuuug

SEQ ID NO: 1736297 - RNA, 19 nt, Homo sapiens
cucuuuuuuugagugacag

SEQ ID NO: 1736298 - RNA, 22 nt, Homo sapiens
cugaaauagacccacaagaggc

SEQ ID NO: 1736299 - RNA, 13 nt, Homo sapiens
cugaacacuccaa

SEQ ID NO: 1736300 - RNA, 19 nt, Homo sapiens
cugaacucugacaacagac

SEQ ID NO: 1736301 - RNA, 20 nt, Homo sapiens
cugaacuuguuuucugggaa

SEQ ID NO: 1736302 - RNA, 19 nt, Homo sapiens
cugaaggcugaaagacagg

SEQ ID NO: 1736303 - RNA, 13 nt, Homo sapiens
cugagaaggcagu

SEQ ID NO: 1736304 - RNA, 17 nt, Homo sapiens
cugaggcccagugcaua

SEQ ID NO: 1736305 - RNA, 21 nt, Homo sapiens
cugaggcccagugcauaugca

SEQ ID NO: 1736306 - RNA, 14 nt, Homo sapiens
cugaggcugaaauu

SEQ ID NO: 1736307 - RNA, 14 nt, Homo sapiens
cugcaacacuuuga

SEQ ID NO: 1736308 - RNA, 23 nt, Homo sapiens
cugcaaucuucucagaaggcaaa

SEQ ID NO: 1736309 - RNA, 17 nt, Homo sapiens
cugcacccacccaggag

SEQ ID NO: 1736310 - RNA, 12 nt, Homo sapiens
cugcagccagcu

SEQ ID NO: 1736311 - RNA, 20 nt, Homo sapiens
cugcauaucauaaugggggu

SEQ ID NO: 1736312 - RNA, 13 nt, Homo sapiens
cugccaaacacau

SEQ ID NO: 1736313 - RNA, 17 nt, Homo sapiens
cugcccugcucccacag

SEQ ID NO: 1736314 - RNA, 17 nt, Homo sapiens
cugccgaaccaaaagaa

SEQ ID NO: 1736315 - RNA, 15 nt, Homo sapiens
cugcggcgucugucu

SEQ ID NO: 1736316 - RNA, 15 nt, Homo sapiens
cugcuccagugcagg

SEQ ID NO: 1736317 - RNA, 14 nt, Homo sapiens
cugcucccacagaa

SEQ ID NO: 1736318 - RNA, 22 nt, Homo sapiens
cugcuccuggaucucccugaga

SEQ ID NO: 1736319 - RNA, 18 nt, Homo sapiens
cugcugcuccagugcagg

SEQ ID NO: 1736320 - RNA, 21 nt, Homo sapiens
cugcuguggcgugagggugag

SEQ ID NO: 1736321 - RNA, 18 nt, Homo sapiens
cuggaacauuaguaguua

SEQ ID NO: 1736322 - RNA, 22 nt, Homo sapiens
cuggagcuugaaauagugucug

SEQ ID NO: 1736323 - RNA, 16 nt, Homo sapiens
cuggaucucccugaga

SEQ ID NO: 1736324 - RNA, 21 nt, Homo sapiens
cuggauguggagggggcgcgu

SEQ ID NO: 1736325 - RNA, 16 nt, Homo sapiens
cuggcacuugggacaa

SEQ ID NO: 1736326 - RNA, 19 nt, Homo sapiens
cuggccucugcugauccuc

SEQ ID NO: 1736327 - RNA, 17 nt, Homo sapiens
cugggaucacaugugga

SEQ ID NO: 1736328 - RNA, 17 nt, Homo sapiens
cugggcugaacacucca

SEQ ID NO: 1736329 - RNA, 17 nt, Homo sapiens
cugguacuuagaguuuc

SEQ ID NO: 1736330 - RNA, 18 nt, Homo sapiens
cugguugaugccugugaa

SEQ ID NO: 1736331 - RNA, 11 nt, Homo sapiens
cuguacagugu

SEQ ID NO: 1736332 - RNA, 15 nt, Homo sapiens
cuguacagugucuuu

SEQ ID NO: 1736333 - RNA, 20 nt, Homo sapiens
cuguacuguucugugucuuu

SEQ ID NO: 1736334 - RNA, 20 nt, Homo sapiens
cugucacaucagcaauuuca

SEQ ID NO: 1736335 - RNA, 14 nt, Homo sapiens
cuguccacacccag

SEQ ID NO: 1736336 - RNA, 20 nt, Homo sapiens
cuguccacccugccaagacu

SEQ ID NO: 1736337 - RNA, 13 nt, Homo sapiens
cuguccuuucuca

SEQ ID NO: 1736338 - RNA, 11 nt, Homo sapiens
cugucuaggac

SEQ ID NO: 1736339 - RNA, 12 nt, Homo sapiens
cugugcccugac

SEQ ID NO: 1736340 - RNA, 21 nt, Homo sapiens
cuguguuauucuuugcgugua

SEQ ID NO: 1736341 - RNA, 18 nt, Homo sapiens
cuguugaauuucccacau

SEQ ID NO: 1736342 - RNA, 19 nt, Homo sapiens
cuguuuuugucuacacucu

SEQ ID NO: 1736343 - RNA, 23 nt, Homo sapiens
cuuaaaggaagguucugguguga

SEQ ID NO: 1736344 - RNA, 18 nt, Homo sapiens
cuuaccacugcucugaug

SEQ ID NO: 1736345 - RNA, 12 nt, Homo sapiens
cuuagugacaaa

SEQ ID NO: 1736346 - RNA, 12 nt, Homo sapiens
cuucagagccag

SEQ ID NO: 1736347 - RNA, 16 nt, Homo sapiens
cuuccagugaacauuc

SEQ ID NO: 1736348 - RNA, 20 nt, Homo sapiens
cuuccuggcuccaacacugc

SEQ ID NO: 1736349 - RNA, 22 nt, Homo sapiens
cuucucuguugucaaacugaaa

SEQ ID NO: 1736350 - RNA, 18 nt, Homo sapiens
cuucuggguucaagcgau

SEQ ID NO: 1736351 - RNA, 21 nt, Homo sapiens
cuugaaauagugucugaugaa

SEQ ID NO: 1736352 - RNA, 20 nt, Homo sapiens
cuugccaagggucccugugu

SEQ ID NO: 1736353 - RNA, 18 nt, Homo sapiens
cuugcucauaugcaugua

SEQ ID NO: 1736354 - RNA, 13 nt, Homo sapiens
cuuggauguauau

SEQ ID NO: 1736355 - RNA, 15 nt, Homo sapiens
cuuggcugugcccuc

SEQ ID NO: 1736356 - RNA, 15 nt, Homo sapiens
cuugugaacccaaag

SEQ ID NO: 1736357 - RNA, 19 nt, Homo sapiens
cuuuaaaacuuauccucca

SEQ ID NO: 1736358 - RNA, 13 nt, Homo sapiens
cuuuaaauggaaa

SEQ ID NO: 1736359 - RNA, 22 nt, Homo sapiens
cuuuaauuguuaagauaugaug

SEQ ID NO: 1736360 - RNA, 18 nt, Homo sapiens
cuuuaugcuguaaauaau

SEQ ID NO: 1736361 - RNA, 20 nt, Homo sapiens
cuuuaugcuguaaauaauca

SEQ ID NO: 1736362 - RNA, 22 nt, Homo sapiens
cuuucccccugugaaagcaaaa

SEQ ID NO: 1736363 - RNA, 23 nt, Homo sapiens
cuuucuaggagggagacacuggc

SEQ ID NO: 1736364 - RNA, 18 nt, Homo sapiens
cuuucuuugcaccaaaga

SEQ ID NO: 1736365 - RNA, 22 nt, Homo sapiens
cuuugaagaauauuuguaguua

SEQ ID NO: 1736366 - RNA, 18 nt, Homo sapiens
uguccggcccagugccac

SEQ ID NO: 1736367 - RNA, 20 nt, Homo sapiens
uguccuuuuucacuuugaaa

SEQ ID NO: 1736368 - RNA, 21 nt, Homo sapiens
ugucgagagcuggccaaagag

SEQ ID NO: 1736369 - RNA, 18 nt, Homo sapiens
ugucuaggacugcagugu

SEQ ID NO: 1736370 - RNA, 13 nt, Homo sapiens
ugucuauucuugu

SEQ ID NO: 1736371 - RNA, 19 nt, Homo sapiens
ugucucaccuacccaugac

SEQ ID NO: 1736372 - RNA, 19 nt, Homo sapiens
ugucuggcacuugggacaa

SEQ ID NO: 1736373 - RNA, 23 nt, Homo sapiens
ugugcaauguguauaaacaagaa

SEQ ID NO: 1736374 - RNA, 23 nt, Homo sapiens
ugugcguccauauuuaacaugua

SEQ ID NO: 1736375 - RNA, 21 nt, Homo sapiens
ugugggucccgcacucugccc

SEQ ID NO: 1736376 - RNA, 19 nt, Homo sapiens
uguuaacugagugccuuuu

SEQ ID NO: 1736377 - RNA, 13 nt, Homo sapiens
uguuacccacugc

SEQ ID NO: 1736378 - RNA, 17 nt, Homo sapiens
uguugacauuagucuca

SEQ ID NO: 1736379 - RNA, 15 nt, Homo sapiens
uguuuaaaguggcaa

SEQ ID NO: 1736380 - RNA, 12 nt, Homo sapiens
uguuuaagacau

SEQ ID NO: 1736381 - RNA, 15 nt, Homo sapiens
uguuuaagacauuuu

SEQ ID NO: 1736382 - RNA, 15 nt, Homo sapiens
uguuuuucuaaagga

SEQ ID NO: 1736383 - RNA, 21 nt, Homo sapiens
uuaaaaaagauaaacacaaga

SEQ ID NO: 1736384 - RNA, 15 nt, Homo sapiens
uuaaacaccuccuca

SEQ ID NO: 1736385 - RNA, 11 nt, Homo sapiens
uuaaacgucau

SEQ ID NO: 1736386 - RNA, 13 nt, Homo sapiens
uuaaagccuccuc

SEQ ID NO: 1736387 - RNA, 14 nt, Homo sapiens
uuaaaugaacaaga

SEQ ID NO: 1736388 - RNA, 17 nt, Homo sapiens
uuaaauuuuuuguugac

SEQ ID NO: 1736389 - RNA, 14 nt, Homo sapiens
uuaacacagugucu

SEQ ID NO: 1736390 - RNA, 17 nt, Homo sapiens
uuaagaaauuucacaua

SEQ ID NO: 1736391 - RNA, 15 nt, Homo sapiens
uuaauucucugcaac

SEQ ID NO: 1736392 - RNA, 16 nt, Homo sapiens
uuaauuguuaagauau

SEQ ID NO: 1736393 - RNA, 19 nt, Homo sapiens
uuacaguaaucccauuucc

SEQ ID NO: 1736394 - RNA, 15 nt, Homo sapiens
uuacauuccauuuca

SEQ ID NO: 1736395 - RNA, 20 nt, Homo sapiens
uuaccaaagcaucaauacaa

SEQ ID NO: 1736396 - RNA, 13 nt, Homo sapiens
uuacccacugcca

SEQ ID NO: 1736397 - RNA, 23 nt, Homo sapiens
uuacccuuuggccccacuuugaa

SEQ ID NO: 1736398 - RNA, 12 nt, Homo sapiens
uccucugugauu

SEQ ID NO: 1736399 - RNA, 17 nt, Homo sapiens
uccugagugcuugcuuu

SEQ ID NO: 1736400 - RNA, 12 nt, Homo sapiens
uccugcaaugaa

SEQ ID NO: 1736401 - RNA, 14 nt, Homo sapiens
uccuggucugugaa

SEQ ID NO: 1736402 - RNA, 18 nt, Homo sapiens
uccuugcccccauuucac

SEQ ID NO: 1736403 - RNA, 15 nt, Homo sapiens
uccuuggaaauugga

SEQ ID NO: 1736404 - RNA, 23 nt, Homo sapiens
uccuuuaaaaaacuuagugacaa

SEQ ID NO: 1736405 - RNA, 20 nt, Homo sapiens
ucgagauggcagauucccac

SEQ ID NO: 1736406 - RNA, 19 nt, Homo sapiens
ucgcaucucagugcaggag

SEQ ID NO: 1736407 - RNA, 22 nt, Homo sapiens
ucuaaggaauaugagcuuuaug

SEQ ID NO: 1736408 - RNA, 14 nt, Homo sapiens
ucuaaguaaauaca

SEQ ID NO: 1736409 - RNA, 18 nt, Homo sapiens
ucuacauugagcauuuga

SEQ ID NO: 1736410 - RNA, 13 nt, Homo sapiens
ucuaccucaggca

SEQ ID NO: 1736411 - RNA, 14 nt, Homo sapiens
ucucacaagcacuu

SEQ ID NO: 1736412 - RNA, 19 nt, Homo sapiens
ucucaccuacccaugaccu

SEQ ID NO: 1736413 - RNA, 22 nt, Homo sapiens
ucucagagugguucugagauua

SEQ ID NO: 1736414 - RNA, 19 nt, Homo sapiens
ucucaguaugaauuauuca

SEQ ID NO: 1736415 - RNA, 13 nt, Homo sapiens
ucucccugagaug

SEQ ID NO: 1736416 - RNA, 19 nt, Homo sapiens
ucugacuuaagcaaaagaa

SEQ ID NO: 1736417 - RNA, 16 nt, Homo sapiens
ucugcaacacuuugag

SEQ ID NO: 1736418 - RNA, 23 nt, Homo sapiens
ucugcgcuuggucuuucugugcu

SEQ ID NO: 1736419 - RNA, 17 nt, Homo sapiens
ucugucauccucaggaa

SEQ ID NO: 1736420 - RNA, 17 nt, Homo sapiens
ucuguuaacucuugaag

SEQ ID NO: 1736421 - RNA, 21 nt, Homo sapiens
ucuuaaguuuauacucuuaua

SEQ ID NO: 1736422 - RNA, 15 nt, Homo sapiens
ucuuagcucaaugag

SEQ ID NO: 1736423 - RNA, 21 nt, Homo sapiens
ucuucauauucuaaaaccauu

SEQ ID NO: 1736424 - RNA, 14 nt, Homo sapiens
ucuuugcaccaaag

SEQ ID NO: 1736425 - RNA, 17 nt, Homo sapiens
ucuuugcaccaaagaca

SEQ ID NO: 1736426 - RNA, 23 nt, Homo sapiens
ugaaauaccaaccugaagacacc

SEQ ID NO: 1736427 - RNA, 13 nt, Homo sapiens
ugaaauagugucu

SEQ ID NO: 1736428 - RNA, 14 nt, Homo sapiens
ugaacauaaagccu

SEQ ID NO: 1736429 - RNA, 18 nt, Homo sapiens
gcccugggacaucaggag

SEQ ID NO: 1736430 - RNA, 24 nt, Homo sapiens
gccucuuccagugaacauucccag

SEQ ID NO: 1736431 - RNA, 16 nt, Homo sapiens
gccugccuggcaggcu

SEQ ID NO: 1736432 - RNA, 22 nt, Homo sapiens
gccuggaucucacaagcacuuu

SEQ ID NO: 1736433 - RNA, 23 nt, Homo sapiens
gccuggcuccaaacccucgaggc

SEQ ID NO: 1736434 - RNA, 14 nt, Homo sapiens
gccugugaugcugg

SEQ ID NO: 1736435 - RNA, 14 nt, Homo sapiens
gccugugcugugac

SEQ ID NO: 1736436 - RNA, 15 nt, Homo sapiens
gccugugcugugacu

SEQ ID NO: 1736437 - RNA, 16 nt, Homo sapiens
gccuuucccccuguga

SEQ ID NO: 1736438 - RNA, 20 nt, Homo sapiens
gcguccauauuuaacaugua

SEQ ID NO: 1736439 - RNA, 19 nt, Homo sapiens
gcgugaaucuguaucuugc

SEQ ID NO: 1736440 - RNA, 18 nt, Homo sapiens
gcuaauuagaaauauucu

SEQ ID NO: 1736441 - RNA, 21 nt, Homo sapiens
gcucauaugcauguagucacu

SEQ ID NO: 1736442 - RNA, 19 nt, Homo sapiens
gcucaucagaaacucaaaa

SEQ ID NO: 1736443 - RNA, 18 nt, Homo sapiens
gcucauguaccucugauu

SEQ ID NO: 1736444 - RNA, 14 nt, Homo sapiens
gcuccaaaugcagc

SEQ ID NO: 1736445 - RNA, 21 nt, Homo sapiens
gcucuccccaggcauuugcca

SEQ ID NO: 1736446 - RNA, 10 nt, Homo sapiens
gcucugggaa

SEQ ID NO: 1736447 - RNA, 17 nt, Homo sapiens
gcugcacccacccagga

SEQ ID NO: 1736448 - RNA, 13 nt, Homo sapiens
gcugcuccagugc

SEQ ID NO: 1736449 - RNA, 23 nt, Homo sapiens
gcugcugcuuagcuugcaccuug

SEQ ID NO: 1736450 - RNA, 19 nt, Homo sapiens
gcuggagugcaguggcgca

SEQ ID NO: 1736451 - RNA, 15 nt, Homo sapiens
gcugggaguggcaug

SEQ ID NO: 1736452 - RNA, 13 nt, Homo sapiens
gcuguagaugaca

SEQ ID NO: 1736453 - RNA, 14 nt, Homo sapiens
gcuguagaugacaa

SEQ ID NO: 1736454 - RNA, 21 nt, Homo sapiens
gcugugaguuugggccccaga

SEQ ID NO: 1736455 - RNA, 21 nt, Homo sapiens
gcuucugguugaugccuguga

SEQ ID NO: 1736456 - RNA, 23 nt, Homo sapiens
gcuuggcugugcccucagauucc

SEQ ID NO: 1736457 - RNA, 17 nt, Homo sapiens
aaaguagggaccucaga

SEQ ID NO: 1736458 - RNA, 16 nt, Homo sapiens
aaaguguuuguuggca

SEQ ID NO: 1736459 - RNA, 13 nt, Homo sapiens
aaauaaaccuccu

SEQ ID NO: 1736460 - RNA, 16 nt, Homo sapiens
aaauacaagacugcca

SEQ ID NO: 1736461 - RNA, 17 nt, Homo sapiens
aaauagugucugaugaa

SEQ ID NO: 1736462 - RNA, 19 nt, Homo sapiens
aaauauggacugcucagga

SEQ ID NO: 1736463 - RNA, 23 nt, Homo sapiens
aaaucagcaugcccgccuaguua

SEQ ID NO: 1736464 - RNA, 11 nt, Homo sapiens
aaaugcugcuc

SEQ ID NO: 1736465 - RNA, 22 nt, Homo sapiens
aaaugucauuguucuugugaac

SEQ ID NO: 1736466 - RNA, 21 nt, Homo sapiens
aaaugugucauuggaagccau

SEQ ID NO: 1736467 - RNA, 23 nt, Homo sapiens
aaauucagaacagccugccuguc

SEQ ID NO: 1736468 - RNA, 22 nt, Homo sapiens
aaauuuuuuguugacauuaguc

SEQ ID NO: 1736469 - RNA, 20 nt, Homo sapiens
aacacacgagcaaacccaga

SEQ ID NO: 1736470 - RNA, 23 nt, Homo sapiens
aacacacuaccgaaugugucuuu

SEQ ID NO: 1736471 - RNA, 13 nt, Homo sapiens
aacacagugucug

SEQ ID NO: 1736472 - RNA, 13 nt, Homo sapiens
aacacugcugcuc

SEQ ID NO: 1736473 - RNA, 21 nt, Homo sapiens
aacagaaaccagaaaagcaau

SEQ ID NO: 1736474 - RNA, 22 nt, Homo sapiens
aacagauaaucccuguauuuca

SEQ ID NO: 1736475 - RNA, 18 nt, Homo sapiens
aacagcaacacagccacu

SEQ ID NO: 1736476 - RNA, 20 nt, Homo sapiens
aacauggccgugaacuuuau

SEQ ID NO: 1736477 - RNA, 16 nt, Homo sapiens
aacauuucaaaaggua

SEQ ID NO: 1736478 - RNA, 16 nt, Homo sapiens
aaccagaaaagcaaua

SEQ ID NO: 1736479 - RNA, 19 nt, Homo sapiens
aaccagaaacaccccucug

SEQ ID NO: 1736480 - RNA, 23 nt, Homo sapiens
aaccagggccccggggccuguua

SEQ ID NO: 1736481 - RNA, 16 nt, Homo sapiens
aaccauccagugacaa

SEQ ID NO: 1736482 - RNA, 19 nt, Homo sapiens
aacccagagguggauguua

SEQ ID NO: 1736483 - RNA, 16 nt, Homo sapiens
aacccggccugauuaa

SEQ ID NO: 1736484 - RNA, 16 nt, Homo sapiens
aaccggucacccagga

SEQ ID NO: 1736485 - RNA, 19 nt, Homo sapiens
aaccuccaccuucuggguu

SEQ ID NO: 1736486 - RNA, 18 nt, Homo sapiens
aacguccacagaguauaa

SEQ ID NO: 1736487 - RNA, 12 nt, Homo sapiens
aacucaguguga

SEQ ID NO: 1736488 - RNA, 19 nt, Homo sapiens
aacucaugaggagggaaaa

SEQ ID NO: 1736489 - RNA, 19 nt, Homo sapiens
aacucuugaagacuccagu

SEQ ID NO: 1736490 - RNA, 18 nt, Homo sapiens
aacuggguuccugcaaug

SEQ ID NO: 1736491 - RNA, 13 nt, Homo sapiens
aacuuagugacaa

SEQ ID NO: 1736492 - RNA, 14 nt, Homo sapiens
aacuuagugacaaa

SEQ ID NO: 1736493 - RNA, 19 nt, Homo sapiens
aacuucucuugcuuucuau

SEQ ID NO: 1736494 - RNA, 20 nt, Homo sapiens
aacuuuggaguccccucacc

SEQ ID NO: 1736495 - RNA, 17 nt, Homo sapiens
aagaaaaagguuugcau

SEQ ID NO: 1736496 - RNA, 18 nt, Homo sapiens
aagaaagaagacaaacuu

SEQ ID NO: 1736497 - RNA, 20 nt, Homo sapiens
aagaaaucuuucucccucaa

SEQ ID NO: 1736498 - RNA, 10 nt, Homo sapiens
aagacauuuu

SEQ ID NO: 1736499 - RNA, 19 nt, Homo sapiens
aagagaucuuucuuuccaa

SEQ ID NO: 1736500 - RNA, 23 nt, Homo sapiens
aagagaucuuucuuuccaaaaca

SEQ ID NO: 1736501 - RNA, 17 nt, Homo sapiens
aagagccaggugcugcu

SEQ ID NO: 1736502 - RNA, 17 nt, Homo sapiens
aagcacaaguacuuuug

SEQ ID NO: 1736503 - RNA, 22 nt, Homo sapiens
aagcagcgaccgcccccuccuc

SEQ ID NO: 1736504 - RNA, 23 nt, Homo sapiens
aagcauuuaaccccccuguacac

SEQ ID NO: 1736505 - RNA, 12 nt, Homo sapiens
aagccuccucau

SEQ ID NO: 1736506 - RNA, 16 nt, Homo sapiens
aagccuuggauguaua

SEQ ID NO: 1736507 - RNA, 21 nt, Homo sapiens
aagcuuuauuaccaguggcgu

SEQ ID NO: 1736508 - RNA, 23 nt, Homo sapiens
aaggaaacuggguuccugcaaug

SEQ ID NO: 1736509 - RNA, 16 nt, Homo sapiens
aaggauuuuaccaaag

SEQ ID NO: 1736510 - RNA, 20 nt, Homo sapiens
aaggccacuguuugucucac

SEQ ID NO: 1736511 - RNA, 16 nt, Homo sapiens
gagagucgcaucucag

SEQ ID NO: 1736512 - RNA, 22 nt, Homo sapiens
gagagucgcaucucagugcagg

SEQ ID NO: 1736513 - RNA, 20 nt, Homo sapiens
gagaucaucacuuccuugcc

SEQ ID NO: 1736514 - RNA, 10 nt, Homo sapiens
gagauuuauu

SEQ ID NO: 1736515 - RNA, 19 nt, Homo sapiens
gagcauuugaaaggugugc

SEQ ID NO: 1736516 - RNA, 14 nt, Homo sapiens
gagcuugcuccaga

SEQ ID NO: 1736517 - RNA, 14 nt, Homo sapiens
gaggauaugggugg

SEQ ID NO: 1736518 - RNA, 18 nt, Homo sapiens
gaggcaguuccauuucau

SEQ ID NO: 1736519 - RNA, 22 nt, Homo sapiens
gaggcaguuccauuucauuugu

SEQ ID NO: 1736520 - RNA, 21 nt, Homo sapiens
gaggcauuugcagcugugcca

SEQ ID NO: 1736521 - RNA, 20 nt, Homo sapiens
gaggcugcacccacccagga

SEQ ID NO: 1736522 - RNA, 22 nt, Homo sapiens
gagucagaucuuucuccuugaa

SEQ ID NO: 1736523 - RNA, 14 nt, Homo sapiens
gaguucagugcuca

SEQ ID NO: 1736524 - RNA, 15 nt, Homo sapiens
gaguuuagggaacaa

SEQ ID NO: 1736525 - RNA, 13 nt, Homo sapiens
gauagaugucuau

SEQ ID NO: 1736526 - RNA, 15 nt, Homo sapiens
gaucaaagaaauuca

SEQ ID NO: 1736527 - RNA, 20 nt, Homo sapiens
gaucaaaguguaaacaccau

SEQ ID NO: 1736528 - RNA, 16 nt, Homo sapiens
gaucucacaagcacuu

SEQ ID NO: 1736529 - RNA, 19 nt, Homo sapiens
gaucuucagggaacugcau

SEQ ID NO: 1736530 - RNA, 17 nt, Homo sapiens
gaucuuucuuuccaaaa

SEQ ID NO: 1736531 - RNA, 14 nt, Homo sapiens
gaucuuuggacaga

SEQ ID NO: 1736532 - RNA, 15 nt, Homo sapiens
gaucuuuggacagaa

SEQ ID NO: 1736533 - RNA, 20 nt, Homo sapiens
gauggcauuuggucucaggc

SEQ ID NO: 1736534 - RNA, 18 nt, Homo sapiens
gauggggcaagggcacaa

SEQ ID NO: 1736535 - RNA, 16 nt, Homo sapiens
gauucaaauugcugcu

SEQ ID NO: 1736536 - RNA, 12 nt, Homo sapiens
gauucagcaaaa

SEQ ID NO: 1736537 - RNA, 23 nt, Homo sapiens
gauuccgcaccaauaaagccuuc

SEQ ID NO: 1736538 - RNA, 14 nt, Homo sapiens
gauucuaaucucau

SEQ ID NO: 1736539 - RNA, 23 nt, Homo sapiens
gauuucuuucuuugcaccaaaga

SEQ ID NO: 1736540 - RNA, 13 nt, Homo sapiens
gauuuuaccaaag

SEQ ID NO: 1736541 - RNA, 19 nt, Homo sapiens
gauuuuaccaaagcaucaa

SEQ ID NO: 1736542 - RNA, 16 nt, Homo sapiens
gauuuuaugcuuuaaa

SEQ ID NO: 1736543 - RNA, 15 nt, Homo sapiens
gcaacacagccacua

SEQ ID NO: 1736544 - RNA, 20 nt, Homo sapiens
gcaaccuccaccuucugggu

SEQ ID NO: 1736545 - RNA, 21 nt, Homo sapiens
gcaaucuucucagaaggcaaa

SEQ ID NO: 1736546 - RNA, 16 nt, Homo sapiens
gcaauguauagugucu

SEQ ID NO: 1736547 - RNA, 18 nt, Homo sapiens
gcaauuucagaaccaaaa

SEQ ID NO: 1736548 - RNA, 22 nt, Homo sapiens
gcacacugccagucucacugug

SEQ ID NO: 1736549 - RNA, 11 nt, Homo sapiens
gcaccaaagac

SEQ ID NO: 1736550 - RNA, 22 nt, Homo sapiens
gcagagucugccccacaugugg

SEQ ID NO: 1736551 - RNA, 14 nt, Homo sapiens
gcauagauugauca

SEQ ID NO: 1736552 - RNA, 14 nt, Homo sapiens
gcaucaaguucucc

SEQ ID NO: 1736553 - RNA, 17 nt, Homo sapiens
gcaucaauacaaccagc

SEQ ID NO: 1736554 - RNA, 21 nt, Homo sapiens
gcaucaauacaaccagcccaa

SEQ ID NO: 1736555 - RNA, 13 nt, Homo sapiens
gcaucagugcccu

SEQ ID NO: 1736556 - RNA, 15 nt, Homo sapiens
gcaucucagugcagg

SEQ ID NO: 1736557 - RNA, 13 nt, Homo sapiens
gcauguccuuugc

SEQ ID NO: 1736558 - RNA, 22 nt, Homo sapiens
gcauguccuuugcgccugugac

SEQ ID NO: 1736559 - RNA, 13 nt, Homo sapiens
gcauucaaauggg

SEQ ID NO: 1736560 - RNA, 9 nt, Homo sapiens
gcauuucaa

SEQ ID NO: 1736561 - RNA, 23 nt, Homo sapiens
gccaaauaaagucucuuccucca

SEQ ID NO: 1736562 - RNA, 12 nt, Homo sapiens
gccaagacuccu

SEQ ID NO: 1736563 - RNA, 20 nt, Homo sapiens
gccaaggcuggagugcagug

SEQ ID NO: 1736564 - RNA, 18 nt, Homo sapiens
gccacacccagcggcccc

SEQ ID NO: 1736565 - RNA, 17 nt, Homo sapiens
gccacagccacuaauca

SEQ ID NO: 1736566 - RNA, 20 nt, Homo sapiens
gccacggccacagccacuaa

SEQ ID NO: 1736567 - RNA, 14 nt, Homo sapiens
gccacgugggcaaa

SEQ ID NO: 1736568 - RNA, 14 nt, Homo sapiens
gccacuaaaacaca

SEQ ID NO: 1736569 - RNA, 13 nt, Homo sapiens
gccagagccuuaa

SEQ ID NO: 1736570 - RNA, 17 nt, Homo sapiens
gccagauggacuccagc

SEQ ID NO: 1736571 - RNA, 17 nt, Homo sapiens
gccagccggcuaugaaa

SEQ ID NO: 1736572 - RNA, 14 nt, Homo sapiens
gccagcuacuuccu

SEQ ID NO: 1736573 - RNA, 14 nt, Homo sapiens
uguuauuauauaau

SEQ ID NO: 1736574 - RNA, 16 nt, Homo sapiens
uguucuauuugugcuu

SEQ ID NO: 1736575 - RNA, 19 nt, Homo sapiens
uguucuucuucauauucua

SEQ ID NO: 1736576 - RNA, 21 nt, Homo sapiens
uguuguuuuaggaauacauaa

SEQ ID NO: 1736577 - RNA, 12 nt, Homo sapiens
uguuugucucac

SEQ ID NO: 1736578 - RNA, 22 nt, Homo sapiens
uguuugucucaccuacccauga

SEQ ID NO: 1736579 - RNA, 17 nt, Homo sapiens
uuaaaauauccugugua

SEQ ID NO: 1736580 - RNA, 17 nt, Homo sapiens
uuaaaguggcaaucuca

SEQ ID NO: 1736581 - RNA, 23 nt, Homo sapiens
uuaaaucaacuuuaucauaugcu

SEQ ID NO: 1736582 - RNA, 19 nt, Homo sapiens
uuaaauggaaacagacuca

SEQ ID NO: 1736583 - RNA, 16 nt, Homo sapiens
uuaacauaagcuauuu

SEQ ID NO: 1736584 - RNA, 13 nt, Homo sapiens
uuaacucccauua

SEQ ID NO: 1736585 - RNA, 17 nt, Homo sapiens
uuaagcucugcuauuag

SEQ ID NO: 1736586 - RNA, 19 nt, Homo sapiens
uuaaggauuuuaugcuuua

SEQ ID NO: 1736587 - RNA, 20 nt, Homo sapiens
uuaaggauuuuaugcuuuaa

SEQ ID NO: 1736588 - RNA, 15 nt, Homo sapiens
uuaauaaacuacucu

SEQ ID NO: 1736589 - RNA, 17 nt, Homo sapiens
uuaauuguuaagauaug

SEQ ID NO: 1736590 - RNA, 20 nt, Homo sapiens
uuaauuuauugaggcuuuaa

SEQ ID NO: 1736591 - RNA, 17 nt, Homo sapiens
uuacaugaagcuguaua

SEQ ID NO: 1736592 - RNA, 10 nt, Homo sapiens
uuaccaaagc

SEQ ID NO: 1736593 - RNA, 15 nt, Homo sapiens
uuaccaaagcaucaa

SEQ ID NO: 1736594 - RNA, 19 nt, Homo sapiens
uuaccaaagcaucaauaca

SEQ ID NO: 1736595 - RNA, 22 nt, Homo sapiens
uuacccuuuggccccacuuuga

SEQ ID NO: 1736596 - RNA, 20 nt, Homo sapiens
uuagaaauauucuacuucuc

SEQ ID NO: 1736597 - RNA, 12 nt, Homo sapiens
uuaggauguaca

SEQ ID NO: 1736598 - RNA, 16 nt, Homo sapiens
uuaguauuguuguccu

SEQ ID NO: 1736599 - RNA, 17 nt, Homo sapiens
uuauucaaaaugaugua

SEQ ID NO: 1736600 - RNA, 15 nt, Homo sapiens
uuauugcgcugcuac

SEQ ID NO: 1736601 - RNA, 15 nt, Homo sapiens
uucaaacuacuuugc

SEQ ID NO: 1736602 - RNA, 17 nt, Homo sapiens
uucauccauaacugaac

SEQ ID NO: 1736603 - RNA, 19 nt, Homo sapiens
uucauggcugaagucaccu

SEQ ID NO: 1736604 - RNA, 16 nt, Homo sapiens
uuccagcuccuguaac

SEQ ID NO: 1736605 - RNA, 21 nt, Homo sapiens
uuccauuuauucuuugaucuu

SEQ ID NO: 1736606 - RNA, 21 nt, Homo sapiens
uuccugcaaugaagucucuga

SEQ ID NO: 1736607 - RNA, 21 nt, Homo sapiens
uucgucggaggcaucauggaa

SEQ ID NO: 1736608 - RNA, 23 nt, Homo sapiens
uucuacacagagcaggacugcac

SEQ ID NO: 1736609 - RNA, 18 nt, Homo sapiens
uucucagagugguucuga

SEQ ID NO: 1736610 - RNA, 21 nt, Homo sapiens
uucuccaccuagacuguaaac

SEQ ID NO: 1736611 - RNA, 16 nt, Homo sapiens
uucucuaccucauggg

SEQ ID NO: 1736612 - RNA, 14 nt, Homo sapiens
uucucuguugucaa

SEQ ID NO: 1736613 - RNA, 21 nt, Homo sapiens
uucucuuagaacauuguauua

SEQ ID NO: 1736614 - RNA, 15 nt, Homo sapiens
uucuguuaacugaau

SEQ ID NO: 1736615 - RNA, 11 nt, Homo sapiens
uugaagccuuu

SEQ ID NO: 1736616 - RNA, 13 nt, Homo sapiens
uugaagccuuugu

SEQ ID NO: 1736617 - RNA, 20 nt, Homo sapiens
uugaagggcaagaaauggcg

SEQ ID NO: 1736618 - RNA, 20 nt, Homo sapiens
uugacauuagucucagugaa

SEQ ID NO: 1736619 - RNA, 14 nt, Homo sapiens
uugagacaggagac

SEQ ID NO: 1736620 - RNA, 18 nt, Homo sapiens
uugagugacagcuuucug

SEQ ID NO: 1736621 - RNA, 12 nt, Homo sapiens
uugcaccaaaga

SEQ ID NO: 1736622 - RNA, 21 nt, Homo sapiens
uugcaguucccacauuaaaga

SEQ ID NO: 1736623 - RNA, 11 nt, Homo sapiens
uugcuuucuau

SEQ ID NO: 1736624 - RNA, 15 nt, Homo sapiens
uuggauucuuuccau

SEQ ID NO: 1736625 - RNA, 16 nt, Homo sapiens
uuggccccacuuugaa

SEQ ID NO: 1736626 - RNA, 21 nt, Homo sapiens
uugggagcaccgccugugaaa

SEQ ID NO: 1736627 - RNA, 18 nt, Homo sapiens
uugggugugugguggauu

SEQ ID NO: 1736628 - RNA, 18 nt, Homo sapiens
uugguaaaaaugcugcuc

SEQ ID NO: 1736629 - RNA, 13 nt, Homo sapiens
uuguacauuucac

SEQ ID NO: 1736630 - RNA, 20 nt, Homo sapiens
uuguaguuuuggcuaguccu

SEQ ID NO: 1736631 - RNA, 15 nt, Homo sapiens
uugucccguggcauu

SEQ ID NO: 1736632 - RNA, 19 nt, Homo sapiens
uugucccguggcauuucaa

SEQ ID NO: 1736633 - RNA, 13 nt, Homo sapiens
uuguugugugugc

SEQ ID NO: 1736634 - RNA, 22 nt, Homo sapiens
uuguuugagaaauuaaguaucu

SEQ ID NO: 1736635 - RNA, 19 nt, Homo sapiens
uuguuugcauaggugaucu

SEQ ID NO: 1736636 - RNA, 13 nt, Homo sapiens
uuuaaaaacucac

SEQ ID NO: 1736637 - RNA, 17 nt, Homo sapiens
uuuaaauaaaagcacaa

SEQ ID NO: 1736638 - RNA, 21 nt, Homo sapiens
ccaacacugcugcuccagugc

SEQ ID NO: 1736639 - RNA, 19 nt, Homo sapiens
ccaacuucucuugcuuucu

SEQ ID NO: 1736640 - RNA, 15 nt, Homo sapiens
ccaagaucacagugg

SEQ ID NO: 1736641 - RNA, 19 nt, Homo sapiens
ccaauucaauuacuauuga

SEQ ID NO: 1736642 - RNA, 22 nt, Homo sapiens
ccaauuugguaaaaaugcugcu

SEQ ID NO: 1736643 - RNA, 14 nt, Homo sapiens
ccacacuccagcug

SEQ ID NO: 1736644 - RNA, 18 nt, Homo sapiens
ccacauucaaaauagggu

SEQ ID NO: 1736645 - RNA, 22 nt, Homo sapiens
ccaccuguuuucugaaacacac

SEQ ID NO: 1736646 - RNA, 16 nt, Homo sapiens
ccacggagcaguucag

SEQ ID NO: 1736647 - RNA, 15 nt, Homo sapiens
ccacggccacagcca

SEQ ID NO: 1736648 - RNA, 13 nt, Homo sapiens
ccacuaaaacaca

SEQ ID NO: 1736649 - RNA, 16 nt, Homo sapiens
ccacuguuugucucac

SEQ ID NO: 1736650 - RNA, 19 nt, Homo sapiens
ccagagguggauguuauga

SEQ ID NO: 1736651 - RNA, 17 nt, Homo sapiens
ccagccguauuuuacau

SEQ ID NO: 1736652 - RNA, 16 nt, Homo sapiens
ccagcgagcucucaaa

SEQ ID NO: 1736653 - RNA, 20 nt, Homo sapiens
ccaguggggaaggaggccaa

SEQ ID NO: 1736654 - RNA, 19 nt, Homo sapiens
ccaguucauugcacuuuga

SEQ ID NO: 1736655 - RNA, 21 nt, Homo sapiens
ccauagggacccauucuacac

SEQ ID NO: 1736656 - RNA, 20 nt, Homo sapiens
ccaucagcaaauauuauucu

SEQ ID NO: 1736657 - RNA, 17 nt, Homo sapiens
ccaucccuuuuuuuaca

SEQ ID NO: 1736658 - RNA, 22 nt, Homo sapiens
ccaucucgggcacaggcccacc

SEQ ID NO: 1736659 - RNA, 17 nt, Homo sapiens
ccaugucucgacucauc

SEQ ID NO: 1736660 - RNA, 19 nt, Homo sapiens
ccauuauguaauagugaca

SEQ ID NO: 1736661 - RNA, 16 nt, Homo sapiens
ccauuccaaagcuuua

SEQ ID NO: 1736662 - RNA, 17 nt, Homo sapiens
ccauuuuugaaaccaaa

SEQ ID NO: 1736663 - RNA, 12 nt, Homo sapiens
cccaaacauguu

SEQ ID NO: 1736664 - RNA, 19 nt, Homo sapiens
cccaagccuacuuuugcca

SEQ ID NO: 1736665 - RNA, 12 nt, Homo sapiens
cccacuuugaag

SEQ ID NO: 1736666 - RNA, 24 nt, Homo sapiens
cccagacucuuuuuuugagugaca

SEQ ID NO: 1736667 - RNA, 16 nt, Homo sapiens
cccagagucaucugau

SEQ ID NO: 1736668 - RNA, 16 nt, Homo sapiens
cccaggaguguggcca

SEQ ID NO: 1736669 - RNA, 17 nt, Homo sapiens
cccagugacaacaucgc

SEQ ID NO: 1736670 - RNA, 18 nt, Homo sapiens
cccauuccaaagcuuuau

SEQ ID NO: 1736671 - RNA, 15 nt, Homo sapiens
cccauucuacacaga

SEQ ID NO: 1736672 - RNA, 12 nt, Homo sapiens
ccccagcucaau

SEQ ID NO: 1736673 - RNA, 12 nt, Homo sapiens
cccccauuucac

SEQ ID NO: 1736674 - RNA, 15 nt, Homo sapiens
ccccuggcucugggc

SEQ ID NO: 1736675 - RNA, 14 nt, Homo sapiens
ccccuguaccuuuu

SEQ ID NO: 1736676 - RNA, 15 nt, Homo sapiens
cccggccucucacaa

SEQ ID NO: 1736677 - RNA, 17 nt, Homo sapiens
cccggcgccgggcacca

SEQ ID NO: 1736678 - RNA, 19 nt, Homo sapiens
cccucuccucucuuccucc

SEQ ID NO: 1736679 - RNA, 19 nt, Homo sapiens
cccucugucauccucagga

SEQ ID NO: 1736680 - RNA, 22 nt, Homo sapiens
cccugagauacuucccaaagcc

SEQ ID NO: 1736681 - RNA, 14 nt, Homo sapiens
cccugggacaucag

SEQ ID NO: 1736682 - RNA, 15 nt, Homo sapiens
cccuuuaacucauga

SEQ ID NO: 1736683 - RNA, 17 nt, Homo sapiens
ccgagccuggcuccaaa

SEQ ID NO: 1736684 - RNA, 16 nt, Homo sapiens
ccgcagggccaugcag

SEQ ID NO: 1736685 - RNA, 20 nt, Homo sapiens
ccgcugcuuccaggcugggc

SEQ ID NO: 1736686 - RNA, 18 nt, Homo sapiens
ccgguguuuaagacauuu

SEQ ID NO: 1736687 - RNA, 17 nt, Homo sapiens
ccgguucuuaaauccau

SEQ ID NO: 1736688 - RNA, 20 nt, Homo sapiens
ccguuuuuuucuuuccugua

SEQ ID NO: 1736689 - RNA, 22 nt, Homo sapiens
ccuaagcgggggugaaagagga

SEQ ID NO: 1736690 - RNA, 15 nt, Homo sapiens
ccuagcccugggaca

SEQ ID NO: 1736691 - RNA, 14 nt, Homo sapiens
ccucauacacagaa

SEQ ID NO: 1736692 - RNA, 13 nt, Homo sapiens
ccucaugcccagc

SEQ ID NO: 1736693 - RNA, 22 nt, Homo sapiens
ccuccaggauagacuuuuccca

SEQ ID NO: 1736694 - RNA, 17 nt, Homo sapiens
ccuccugaggcuuuggc

SEQ ID NO: 1736695 - RNA, 19 nt, Homo sapiens
ccuccuggagcucuguggg

SEQ ID NO: 1736696 - RNA, 18 nt, Homo sapiens
ccucgaggcggaucuuug

SEQ ID NO: 1736697 - RNA, 20 nt, Homo sapiens
aggcccuugucgugggaugg

SEQ ID NO: 1736698 - RNA, 15 nt, Homo sapiens
aggcugaaagacagg

SEQ ID NO: 1736699 - RNA, 17 nt, Homo sapiens
aggcugcuagauguagg

SEQ ID NO: 1736700 - RNA, 20 nt, Homo sapiens
aggcuggagugcaguggcgc

SEQ ID NO: 1736701 - RNA, 14 nt, Homo sapiens
aggcugguggcaag

SEQ ID NO: 1736702 - RNA, 21 nt, Homo sapiens
agggacaugcccuguguggcu

SEQ ID NO: 1736703 - RNA, 23 nt, Homo sapiens
agggcaagaaauggcgucugcuc

SEQ ID NO: 1736704 - RNA, 22 nt, Homo sapiens
agggcacccuaguucuaccuca

SEQ ID NO: 1736705 - RNA, 19 nt, Homo sapiens
agggccccggggccuguua

SEQ ID NO: 1736706 - RNA, 15 nt, Homo sapiens
aggggcuggggccaa

SEQ ID NO: 1736707 - RNA, 24 nt, Homo sapiens
aggucacuuuguuuuacugucuua

SEQ ID NO: 1736708 - RNA, 18 nt, Homo sapiens
aggugacaaaccauuucc

SEQ ID NO: 1736709 - RNA, 18 nt, Homo sapiens
agguggaacaagcacaga

SEQ ID NO: 1736710 - RNA, 15 nt, Homo sapiens
agguuaagcacuuua

SEQ ID NO: 1736711 - RNA, 19 nt, Homo sapiens
agguucuggugugaacuaa

SEQ ID NO: 1736712 - RNA, 19 nt, Homo sapiens
aguaaucaaucuacucaaa

SEQ ID NO: 1736713 - RNA, 22 nt, Homo sapiens
aguaccuuuccauuuauucuuu

SEQ ID NO: 1736714 - RNA, 21 nt, Homo sapiens
aguagauuuuaaaaguuauua

SEQ ID NO: 1736715 - RNA, 18 nt, Homo sapiens
aguaugaaaaugucauug

SEQ ID NO: 1736716 - RNA, 19 nt, Homo sapiens
agucgcaucucagugcagg

SEQ ID NO: 1736717 - RNA, 22 nt, Homo sapiens
agucucugaagugaaacugcuu

SEQ ID NO: 1736718 - RNA, 13 nt, Homo sapiens
agucucugugaau

SEQ ID NO: 1736719 - RNA, 23 nt, Homo sapiens
agugacaaaauagacaauuugca

SEQ ID NO: 1736720 - RNA, 21 nt, Homo sapiens
agugacagcuuucugggaugu

SEQ ID NO: 1736721 - RNA, 18 nt, Homo sapiens
agugacuguaucugugua

SEQ ID NO: 1736722 - RNA, 12 nt, Homo sapiens
agugcauaugca

SEQ ID NO: 1736723 - RNA, 17 nt, Homo sapiens
agugccugccuaugaaa

SEQ ID NO: 1736724 - RNA, 17 nt, Homo sapiens
agugccuuuugguggag

SEQ ID NO: 1736725 - RNA, 22 nt, Homo sapiens
aguggcguuguugcauguuuga

SEQ ID NO: 1736726 - RNA, 23 nt, Homo sapiens
aguguggccacgugggcaaacag

SEQ ID NO: 1736727 - RNA, 19 nt, Homo sapiens
aguuuuaguuuucucuuag

SEQ ID NO: 1736728 - RNA, 13 nt, Homo sapiens
auaaaagcacuua

SEQ ID NO: 1736729 - RNA, 15 nt, Homo sapiens
auaaaguaugugcau

SEQ ID NO: 1736730 - RNA, 17 nt, Homo sapiens
auaauaaagaucaugua

SEQ ID NO: 1736731 - RNA, 15 nt, Homo sapiens
auaauucuucaccua

SEQ ID NO: 1736732 - RNA, 21 nt, Homo sapiens
auaauuuguauacccuguccu

SEQ ID NO: 1736733 - RNA, 15 nt, Homo sapiens
auacacagugcugac

SEQ ID NO: 1736734 - RNA, 21 nt, Homo sapiens
auacccuccuuccaccaaguu

SEQ ID NO: 1736735 - RNA, 19 nt, Homo sapiens
auacuggccuggacuguuu

SEQ ID NO: 1736736 - RNA, 13 nt, Homo sapiens
auacuuugcauau

SEQ ID NO: 1736737 - RNA, 18 nt, Homo sapiens
auacuuugcauauugucu

SEQ ID NO: 1736738 - RNA, 15 nt, Homo sapiens
auagaaaaguauguu

SEQ ID NO: 1736739 - RNA, 21 nt, Homo sapiens
auagaaugagcacccauucca

SEQ ID NO: 1736740 - RNA, 20 nt, Homo sapiens
auagacccacaagaggcagu

SEQ ID NO: 1736741 - RNA, 19 nt, Homo sapiens
auagccacuaaccuugccu

SEQ ID NO: 1736742 - RNA, 21 nt, Homo sapiens
auagugucugaugaauguuaa

SEQ ID NO: 1736743 - RNA, 13 nt, Homo sapiens
auaugagcuuuau

SEQ ID NO: 1736744 - RNA, 20 nt, Homo sapiens
auaugcaauguauagugucu

SEQ ID NO: 1736745 - RNA, 18 nt, Homo sapiens
auauuuuguuuugugcag

SEQ ID NO: 1736746 - RNA, 23 nt, Homo sapiens
aucacaguuuugguugcuuuaau

SEQ ID NO: 1736747 - RNA, 14 nt, Homo sapiens
aucagaaacucaaa

SEQ ID NO: 1736748 - RNA, 18 nt, Homo sapiens
aucaggaggccaggccac

SEQ ID NO: 1736749 - RNA, 17 nt, Homo sapiens
aucaguccaaagggcau

SEQ ID NO: 1736750 - RNA, 18 nt, Homo sapiens
aucagucuccaacauguu

SEQ ID NO: 1736751 - RNA, 18 nt, Homo sapiens
aucagugcccuccaggau

SEQ ID NO: 1736752 - RNA, 19 nt, Homo sapiens
aucaucaaaaacuuuggag

SEQ ID NO: 1736753 - RNA, 16 nt, Homo sapiens
auccacacugagcuga

SEQ ID NO: 1736754 - RNA, 14 nt, Homo sapiens
aucccucuguucac

SEQ ID NO: 1736755 - RNA, 15 nt, Homo sapiens
aucccuggaaggaca

SEQ ID NO: 1736756 - RNA, 15 nt, Homo sapiens
auccgggaucaaagu

SEQ ID NO: 1736757 - RNA, 16 nt, Homo sapiens
auccuaagucucuuac

SEQ ID NO: 1736758 - RNA, 13 nt, Homo sapiens
aucucugacuuaa

SEQ ID NO: 1736759 - RNA, 17 nt, Homo sapiens
aucugacaucucugcaa

SEQ ID NO: 1736760 - RNA, 19 nt, Homo sapiens
aucugacaucucugcaauc

SEQ ID NO: 1736761 - RNA, 18 nt, Homo sapiens
aucugggucuuaguucug

SEQ ID NO: 1736762 - RNA, 17 nt, Homo sapiens
aucuuagauguuucaca

SEQ ID NO: 1736763 - RNA, 15 nt, Homo sapiens
aucuuccauggauuu

SEQ ID NO: 1736764 - RNA, 16 nt, Homo sapiens
aucuuucuccuugaau

SEQ ID NO: 1736765 - RNA, 11 nt, Homo sapiens
aucuuuggaca

SEQ ID NO: 1736766 - RNA, 17 nt, Homo sapiens
augaaaacuaaggauuu

SEQ ID NO: 1736767 - RNA, 13 nt, Homo sapiens
augaaaaugucau

SEQ ID NO: 1736768 - RNA, 20 nt, Homo sapiens
augaaccugcccugcuccca

SEQ ID NO: 1736769 - RNA, 21 nt, Homo sapiens
augaagguggaacaagcacag

SEQ ID NO: 1736770 - RNA, 22 nt, Homo sapiens
augacgguaaguguucucauga

SEQ ID NO: 1736771 - RNA, 23 nt, Homo sapiens
augagcuuuauguaauaauguga

SEQ ID NO: 1736772 - RNA, 23 nt, Homo sapiens
augaggucuguuuaaaguggcaa

SEQ ID NO: 1736773 - RNA, 14 nt, Homo sapiens
augaucaguaugaa

SEQ ID NO: 1736774 - RNA, 21 nt, Homo sapiens
augaugaaaacuaaggauuuu

SEQ ID NO: 1736775 - RNA, 22 nt, Homo sapiens
augaugucccuauggaagcaua

SEQ ID NO: 1736776 - RNA, 18 nt, Homo sapiens
augauucaaauugcugcu

SEQ ID NO: 1736777 - RNA, 18 nt, Homo sapiens
augccaaccggucaccca

SEQ ID NO: 1736778 - RNA, 14 nt, Homo sapiens
augccagcuacuuc

SEQ ID NO: 1736779 - RNA, 13 nt, Homo sapiens
augcccugugugg

SEQ ID NO: 1736780 - RNA, 19 nt, Homo sapiens
augcugguuuucuacccaa

SEQ ID NO: 1736781 - RNA, 13 nt, Homo sapiens
auggaagcauauu

SEQ ID NO: 1736782 - RNA, 17 nt, Homo sapiens
auggagguuaagcacuu

SEQ ID NO: 1736783 - RNA, 20 nt, Homo sapiens
auggagguuaagcacuuuaa

SEQ ID NO: 1736784 - RNA, 18 nt, Homo sapiens
auggaucccuggggccaa

SEQ ID NO: 1736785 - RNA, 16 nt, Homo sapiens
auggcauuuggucuca

SEQ ID NO: 1736786 - RNA, 23 nt, Homo sapiens
auggcauuuggucucaggcagca

SEQ ID NO: 1736787 - RNA, 20 nt, Homo sapiens
auggucccaggcuucccaaa

SEQ ID NO: 1736788 - RNA, 16 nt, Homo sapiens
auguaauaaugugaau

SEQ ID NO: 1736789 - RNA, 17 nt, Homo sapiens
auguaauagugacagca

SEQ ID NO: 1736790 - RNA, 19 nt, Homo sapiens
auguaauagugacagcaaa

SEQ ID NO: 1736791 - RNA, 16 nt, Homo sapiens
auguacuuguuugcaa

SEQ ID NO: 1736792 - RNA, 19 nt, Homo sapiens
augucauuguucuugugaa

SEQ ID NO: 1736793 - RNA, 20 nt, Homo sapiens
augugauuacccucuggguc

SEQ ID NO: 1736794 - RNA, 19 nt, Homo sapiens
augugucauuggaagccau

SEQ ID NO: 1736795 - RNA, 18 nt, Homo sapiens
auuacaggcgugagccac

SEQ ID NO: 1736796 - RNA, 19 nt, Homo sapiens
auuacauauuugcauaugu

SEQ ID NO: 1736797 - RNA, 15 nt, Homo sapiens
auucaaauugcugcu

SEQ ID NO: 1736798 - RNA, 17 nt, Homo sapiens
auucaaucccaggaugu

SEQ ID NO: 1736799 - RNA, 18 nt, Homo sapiens
auucaggaagcagcuuuc

SEQ ID NO: 1736800 - RNA, 13 nt, Homo sapiens
auuccaaaaacau

SEQ ID NO: 1736801 - RNA, 11 nt, Homo sapiens
auucccacugc

SEQ ID NO: 1736802 - RNA, 14 nt, Homo sapiens
auucccacugccag

SEQ ID NO: 1736803 - RNA, 13 nt, Homo sapiens
auuccccuaggcu

SEQ ID NO: 1736804 - RNA, 14 nt, Homo sapiens
auuccgcaccaaua

SEQ ID NO: 1736805 - RNA, 12 nt, Homo sapiens
auuccuugcaca

SEQ ID NO: 1736806 - RNA, 14 nt, Homo sapiens
auuccuugcacaua

SEQ ID NO: 1736807 - RNA, 16 nt, Homo sapiens
auucuacucaaaguca

SEQ ID NO: 1736808 - RNA, 19 nt, Homo sapiens
auucuagguuugcaagaaa

SEQ ID NO: 1736809 - RNA, 22 nt, Homo sapiens
auucuuguuggagacaugggau

SEQ ID NO: 1736810 - RNA, 13 nt, Homo sapiens
cuuaauacugucc

SEQ ID NO: 1736811 - RNA, 15 nt, Homo sapiens
cuuaauucucugcaa

SEQ ID NO: 1736812 - RNA, 23 nt, Homo sapiens
cuuaguccaauuccuugcacaua

SEQ ID NO: 1736813 - RNA, 16 nt, Homo sapiens
cuuagugacaaaauag

SEQ ID NO: 1736814 - RNA, 23 nt, Homo sapiens
cuuaguucugguugauucacuca

SEQ ID NO: 1736815 - RNA, 23 nt, Homo sapiens
cuuauggauguccccagcagaga

SEQ ID NO: 1736816 - RNA, 18 nt, Homo sapiens
cuucaaucggcuuguggg

SEQ ID NO: 1736817 - RNA, 17 nt, Homo sapiens
cuucacccuggagccca

SEQ ID NO: 1736818 - RNA, 20 nt, Homo sapiens
cuucauucuccuuguuguug

SEQ ID NO: 1736819 - RNA, 15 nt, Homo sapiens
cuuccuggauuauuc

SEQ ID NO: 1736820 - RNA, 20 nt, Homo sapiens
cuuccuggauuauucaaaau

SEQ ID NO: 1736821 - RNA, 14 nt, Homo sapiens
cuucuucauauucu

SEQ ID NO: 1736822 - RNA, 22 nt, Homo sapiens
cuugagcgugaaucuguaucuu

SEQ ID NO: 1736823 - RNA, 23 nt, Homo sapiens
cuugccauggagguuaagcacuu

SEQ ID NO: 1736824 - RNA, 15 nt, Homo sapiens
cuuggaacccggugc

SEQ ID NO: 1736825 - RNA, 10 nt, Homo sapiens
cuuggcugug

SEQ ID NO: 1736826 - RNA, 17 nt, Homo sapiens
cuugggagcaccgccug

SEQ ID NO: 1736827 - RNA, 23 nt, Homo sapiens
cuuguccgcugggugguacccuc

SEQ ID NO: 1736828 - RNA, 13 nt, Homo sapiens
cuugucugcuaaa

SEQ ID NO: 1736829 - RNA, 15 nt, Homo sapiens
cuuuaaaaagcucca

SEQ ID NO: 1736830 - RNA, 22 nt, Homo sapiens
cuuuaaaaagcuccaaaugcag

SEQ ID NO: 1736831 - RNA, 18 nt, Homo sapiens
cuuuaacacagugucugg

SEQ ID NO: 1736832 - RNA, 16 nt, Homo sapiens
cuuuacauggaugcca

SEQ ID NO: 1736833 - RNA, 14 nt, Homo sapiens
cuuucauauaguua

SEQ ID NO: 1736834 - RNA, 15 nt, Homo sapiens
cuuugcaccaaagac

SEQ ID NO: 1736835 - RNA, 17 nt, Homo sapiens
cuuugcaccaaagacau

SEQ ID NO: 1736836 - RNA, 17 nt, Homo sapiens
cuuugucccguggcauu

SEQ ID NO: 1736837 - RNA, 19 nt, Homo sapiens
cuuuuccugauaaagcaca

SEQ ID NO: 1736838 - RNA, 14 nt, Homo sapiens
cuuuuucacuuuga

SEQ ID NO: 1736839 - RNA, 13 nt, Homo sapiens
gaaaaacauuuca

SEQ ID NO: 1736840 - RNA, 21 nt, Homo sapiens
gaaaagcaauacuguuuccau

SEQ ID NO: 1736841 - RNA, 17 nt, Homo sapiens
gaaaauaaaagcacuua

SEQ ID NO: 1736842 - RNA, 21 nt, Homo sapiens
gaaacaccccucugucuagga

SEQ ID NO: 1736843 - RNA, 18 nt, Homo sapiens
gaaacauuuccuuugaac

SEQ ID NO: 1736844 - RNA, 17 nt, Homo sapiens
gaaaggauuuuaccaaa

SEQ ID NO: 1736845 - RNA, 20 nt, Homo sapiens
gaaaggauuuuaccaaagca

SEQ ID NO: 1736846 - RNA, 20 nt, Homo sapiens
gaaaggugugcuagaacaag

SEQ ID NO: 1736847 - RNA, 20 nt, Homo sapiens
gaaagugagagccagcagca

SEQ ID NO: 1736848 - RNA, 17 nt, Homo sapiens
gaaaucuuucucccuca

SEQ ID NO: 1736849 - RNA, 14 nt, Homo sapiens
gaaccccaggagau

SEQ ID NO: 1736850 - RNA, 21 nt, Homo sapiens
gaacugcuggauucaagugau

SEQ ID NO: 1736851 - RNA, 14 nt, Homo sapiens
gaagagcaggugac

SEQ ID NO: 1736852 - RNA, 22 nt, Homo sapiens
gaagcauuuuauaaaucgcuuu

SEQ ID NO: 1736853 - RNA, 12 nt, Homo sapiens
gaaggacuguga

SEQ ID NO: 1736854 - RNA, 10 nt, Homo sapiens
gaaggccagc

SEQ ID NO: 1736855 - RNA, 17 nt, Homo sapiens
gaagggcguucuaggua

SEQ ID NO: 1736856 - RNA, 18 nt, Homo sapiens
gaaguaaacagauggcac

SEQ ID NO: 1736857 - RNA, 17 nt, Homo sapiens
gaauacauaaaguaugu

SEQ ID NO: 1736858 - RNA, 19 nt, Homo sapiens
gaaugagcacccauuccaa

SEQ ID NO: 1736859 - RNA, 18 nt, Homo sapiens
gaaugauuuuucuuuaca

SEQ ID NO: 1736860 - RNA, 13 nt, Homo sapiens
gacaacaucgcaa

SEQ ID NO: 1736861 - RNA, 16 nt, Homo sapiens
gacaaccuccauucua

SEQ ID NO: 1736862 - RNA, 15 nt, Homo sapiens
gacagacccucugcc

SEQ ID NO: 1736863 - RNA, 17 nt, Homo sapiens
gacagccccuccuccau

SEQ ID NO: 1736864 - RNA, 15 nt, Homo sapiens
gacagcuuucuggga

SEQ ID NO: 1736865 - RNA, 20 nt, Homo sapiens
gacagggacaugcccugugu

SEQ ID NO: 1736866 - RNA, 15 nt, Homo sapiens
gacagugaggcugca

SEQ ID NO: 1736867 - RNA, 16 nt, Homo sapiens
gacauagaagagccaa

SEQ ID NO: 1736868 - RNA, 17 nt, Homo sapiens
gacaugcccaaggccac

SEQ ID NO: 1736869 - RNA, 15 nt, Homo sapiens
gacaugcccugugug

SEQ ID NO: 1736870 - RNA, 22 nt, Homo sapiens
gaccacaguggccaagaucaca

SEQ ID NO: 1736871 - RNA, 13 nt, Homo sapiens
gaccucagcuuug

SEQ ID NO: 1736872 - RNA, 15 nt, Homo sapiens
gaccuuccucaucca

SEQ ID NO: 1736873 - RNA, 15 nt, Homo sapiens
gacgcuugugacagu

SEQ ID NO: 1736874 - RNA, 22 nt, Homo sapiens
gacugcacagcguccuguccac

SEQ ID NO: 1736875 - RNA, 15 nt, Homo sapiens
gacuggccugcugga

SEQ ID NO: 1736876 - RNA, 14 nt, Homo sapiens
gacuuaaugugauu

SEQ ID NO: 1736877 - RNA, 21 nt, Homo sapiens
gagaaaauuggaacucuacuc

SEQ ID NO: 1736878 - RNA, 21 nt, Homo sapiens
gagaaacaaauaauuuguaua

SEQ ID NO: 1736879 - RNA, 21 nt, Homo sapiens
gagacaccaccacccuugcca

SEQ ID NO: 1736880 - RNA, 18 nt, Homo sapiens
gagacgggguuugccaug

SEQ ID NO: 1736881 - RNA, 18 nt, Homo sapiens
gagaggcccggccucuca

SEQ ID NO: 1736882 - RNA, 19 nt, Homo sapiens
gagaguuauccugauaaau

SEQ ID NO: 1736883 - RNA, 15 nt, Homo sapiens
gagauacuucccaaa

SEQ ID NO: 1736884 - RNA, 17 nt, Homo sapiens
gagaucuuucuuuccaa

SEQ ID NO: 1736885 - RNA, 21 nt, Homo sapiens
gagaucuuucuuuccaaaaca

SEQ ID NO: 1736886 - RNA, 16 nt, Homo sapiens
gagcacccauuccaaa

SEQ ID NO: 1736887 - RNA, 16 nt, Homo sapiens
gagcaccgccugugaa

SEQ ID NO: 1736888 - RNA, 23 nt, Homo sapiens
gagcaccugcaggcgugaccuga

SEQ ID NO: 1736889 - RNA, 13 nt, Homo sapiens
gagcagaacaggu

SEQ ID NO: 1736890 - RNA, 14 nt, Homo sapiens
gagcaguucagagu

SEQ ID NO: 1736891 - RNA, 21 nt, Homo sapiens
gagccaccaaacccggccuga

SEQ ID NO: 1736892 - RNA, 20 nt, Homo sapiens
gagcccgcagggccaugcag

SEQ ID NO: 1736893 - RNA, 16 nt, Homo sapiens
gagccuggcuccaaac

SEQ ID NO: 1736894 - RNA, 15 nt, Homo sapiens
gagcugcacuaucac

SEQ ID NO: 1736895 - RNA, 18 nt, Homo sapiens
gagcuugaaauagugucu

SEQ ID NO: 1736896 - RNA, 23 nt, Homo sapiens
gagcuugcuccagauucugaugc

SEQ ID NO: 1736897 - RNA, 15 nt, Homo sapiens
gagcuuuauguaaua

SEQ ID NO: 1736898 - RNA, 18 nt, Homo sapiens
gaggacucuauucuuuaa

SEQ ID NO: 1736899 - RNA, 22 nt, Homo sapiens
gaggauguucgucucaguuugu

SEQ ID NO: 1736900 - RNA, 19 nt, Homo sapiens
gaggccaguaccuuuccau

SEQ ID NO: 1736901 - RNA, 17 nt, Homo sapiens
gagggggcgcgugcagg

SEQ ID NO: 1736902 - RNA, 22 nt, Homo sapiens
gagguggauguuaugaacagcu

SEQ ID NO: 1736903 - RNA, 15 nt, Homo sapiens
gagguuaagcacuuu

SEQ ID NO: 1736904 - RNA, 20 nt, Homo sapiens
gagucgcaucucagugcagg

SEQ ID NO: 1736905 - RNA, 23 nt, Homo sapiens
gagucugccccacauguggccau

SEQ ID NO: 1736906 - RNA, 13 nt, Homo sapiens
gauagacuuggga

SEQ ID NO: 1736907 - RNA, 20 nt, Homo sapiens
gaucacauguggacuuuuau

SEQ ID NO: 1736908 - RNA, 16 nt, Homo sapiens
gaucuuuggacagaag

SEQ ID NO: 1736909 - RNA, 21 nt, Homo sapiens
gauguauguugaagccuuugu

SEQ ID NO: 1736910 - RNA, 14 nt, Homo sapiens
gaugucccuaugga

SEQ ID NO: 1736911 - RNA, 14 nt, Homo sapiens
gauuaauauuauua

SEQ ID NO: 1736912 - RNA, 15 nt, Homo sapiens
gauucaugucucacg

SEQ ID NO: 1736913 - RNA, 18 nt, Homo sapiens
gauuccuggcagagccau

SEQ ID NO: 1736914 - RNA, 19 nt, Homo sapiens
gauucuuaauucucugcaa

SEQ ID NO: 1736915 - RNA, 15 nt, Homo sapiens
gauuuuaccaaagca

SEQ ID NO: 1736916 - RNA, 16 nt, Homo sapiens
gcaaagauuugcuuua

SEQ ID NO: 1736917 - RNA, 18 nt, Homo sapiens
gcaaagauuugcuuuaau

SEQ ID NO: 1736918 - RNA, 22 nt, Homo sapiens
gcaacagcaaaucacgaccacu

SEQ ID NO: 1736919 - RNA, 18 nt, Homo sapiens
gcaagcggggaugucccu

SEQ ID NO: 1736920 - RNA, 19 nt, Homo sapiens
gcaauguggagcagcagcc

SEQ ID NO: 1736921 - RNA, 15 nt, Homo sapiens
gcacaaggccuugcc

SEQ ID NO: 1736922 - RNA, 11 nt, Homo sapiens
gcacagccacc

SEQ ID NO: 1736923 - RNA, 13 nt, Homo sapiens
ugccaagacuccu

SEQ ID NO: 1736924 - RNA, 20 nt, Homo sapiens
ugccaaggcuggagugcagu

SEQ ID NO: 1736925 - RNA, 22 nt, Homo sapiens
ugccagaaugcuuuaggaugua

SEQ ID NO: 1736926 - RNA, 13 nt, Homo sapiens
ugcccucauggcc

SEQ ID NO: 1736927 - RNA, 15 nt, Homo sapiens
ugccugccacccugc

SEQ ID NO: 1736928 - RNA, 16 nt, Homo sapiens
ugccugugaacugaac

SEQ ID NO: 1736929 - RNA, 11 nt, Homo sapiens
ugccugugauu

SEQ ID NO: 1736930 - RNA, 12 nt, Homo sapiens
ugcuagaacaag

SEQ ID NO: 1736931 - RNA, 14 nt, Homo sapiens
ugcucauaugcaug

SEQ ID NO: 1736932 - RNA, 18 nt, Homo sapiens
ugcuccagugcaggagac

SEQ ID NO: 1736933 - RNA, 20 nt, Homo sapiens
ugcuccuggaucucccugag

SEQ ID NO: 1736934 - RNA, 18 nt, Homo sapiens
ugcugaccagacagccuc

SEQ ID NO: 1736935 - RNA, 17 nt, Homo sapiens
ugcugaggcccagugca

SEQ ID NO: 1736936 - RNA, 13 nt, Homo sapiens
ugcugggaauuac

SEQ ID NO: 1736937 - RNA, 21 nt, Homo sapiens
ugcuguuucacaauaccucau

SEQ ID NO: 1736938 - RNA, 22 nt, Homo sapiens
ugcuuuaaauggaaacagacuc

SEQ ID NO: 1736939 - RNA, 24 nt, Homo sapiens
ugcuuuaaauggaaacagacucau

SEQ ID NO: 1736940 - RNA, 21 nt, Homo sapiens
ugcuuuaauauaaaugcaaau

SEQ ID NO: 1736941 - RNA, 14 nt, Homo sapiens
uggaacaagcacag

SEQ ID NO: 1736942 - RNA, 14 nt, Homo sapiens
uggaacucuacuca

SEQ ID NO: 1736943 - RNA, 17 nt, Homo sapiens
uggaagcauauuguuau

SEQ ID NO: 1736944 - RNA, 12 nt, Homo sapiens
uggacagaagca

SEQ ID NO: 1736945 - RNA, 19 nt, Homo sapiens
uggagaggcccggccucuc

SEQ ID NO: 1736946 - RNA, 23 nt, Homo sapiens
uggagagucagaucuuucuccuu

SEQ ID NO: 1736947 - RNA, 19 nt, Homo sapiens
uggagcuugaaauaguguc

SEQ ID NO: 1736948 - RNA, 22 nt, Homo sapiens
uggaguccccucaccuccucua

SEQ ID NO: 1736949 - RNA, 10 nt, Homo sapiens
uggcacuuug

SEQ ID NO: 1736950 - RNA, 19 nt, Homo sapiens
uggcacuuugaaggggccu

SEQ ID NO: 1736951 - RNA, 13 nt, Homo sapiens
uggcagagccaug

SEQ ID NO: 1736952 - RNA, 18 nt, Homo sapiens
uggccacggccacagcca

SEQ ID NO: 1736953 - RNA, 21 nt, Homo sapiens
uggccacggccacggccacag

SEQ ID NO: 1736954 - RNA, 22 nt, Homo sapiens
uggccacgugggcaaacaggca

SEQ ID NO: 1736955 - RNA, 21 nt, Homo sapiens
uggccaggccucuuggcaguc

SEQ ID NO: 1736956 - RNA, 14 nt, Homo sapiens
uggccccacuuuga

SEQ ID NO: 1736957 - RNA, 22 nt, Homo sapiens
uggccuccuuccccguacuuug

SEQ ID NO: 1736958 - RNA, 13 nt, Homo sapiens
uggcucugggaau

SEQ ID NO: 1736959 - RNA, 12 nt, Homo sapiens
uggcucugggcc

SEQ ID NO: 1736960 - RNA, 17 nt, Homo sapiens
uggcugaaggacuguga

SEQ ID NO: 1736961 - RNA, 15 nt, Homo sapiens
ugggagcaccgccug

SEQ ID NO: 1736962 - RNA, 17 nt, Homo sapiens
uggggagcccgucucag

SEQ ID NO: 1736963 - RNA, 18 nt, Homo sapiens
ugggucucaguguccuca

SEQ ID NO: 1736964 - RNA, 12 nt, Homo sapiens
uggguuuuacca

SEQ ID NO: 1736965 - RNA, 16 nt, Homo sapiens
uguaaaauggagacac

SEQ ID NO: 1736966 - RNA, 12 nt, Homo sapiens
uguacauuucac

SEQ ID NO: 1736967 - RNA, 16 nt, Homo sapiens
uguaugugugugcaug

SEQ ID NO: 1736968 - RNA, 18 nt, Homo sapiens
uguauguugaagccuuug

SEQ ID NO: 1736969 - RNA, 16 nt, Homo sapiens
uguauuucaagaccuc

SEQ ID NO: 1736970 - RNA, 19 nt, Homo sapiens
ugucaguaguggacauugu

SEQ ID NO: 1736971 - RNA, 18 nt, Homo sapiens
ugucuacacacccugcau

SEQ ID NO: 1736972 - RNA, 15 nt, Homo sapiens
ugucucaccuaccca

SEQ ID NO: 1736973 - RNA, 21 nt, Homo sapiens
ugucuccaugugcguccauau

SEQ ID NO: 1736974 - RNA, 19 nt, Homo sapiens
ugugaacuaaacuuucaca

SEQ ID NO: 1736975 - RNA, 13 nt, Homo sapiens
ugugcccugacca

SEQ ID NO: 1736976 - RNA, 11 nt, Homo sapiens
ugugcugugac

SEQ ID NO: 1736977 - RNA, 18 nt, Homo sapiens
ugugcuuguuaacugagu

SEQ ID NO: 1736978 - RNA, 17 nt, Homo sapiens
uguggcaucuugccaag

SEQ ID NO: 1736979 - RNA, 23 nt, Homo sapiens
ugugucagaaaaaggaaaccaca

SEQ ID NO: 1736980 - RNA, 19 nt, Homo sapiens
uguuaugucaaacugucuu

SEQ ID NO: 1736981 - RNA, 21 nt, Homo sapiens
uguugacauuagucucaguga

SEQ ID NO: 1736982 - RNA, 18 nt, Homo sapiens
uguugacauucugaaugc

SEQ ID NO: 1736983 - RNA, 13 nt, Homo sapiens
uguuggcaauuau

SEQ ID NO: 1736984 - RNA, 14 nt, Homo sapiens
uguuguacauuuca

SEQ ID NO: 1736985 - RNA, 15 nt, Homo sapiens
uguuguacauuucac

SEQ ID NO: 1736986 - RNA, 20 nt, Homo sapiens
uguuuauccuuucauauagu

SEQ ID NO: 1736987 - RNA, 20 nt, Homo sapiens
uguuugguguuugucugugu

SEQ ID NO: 1736988 - RNA, 14 nt, Homo sapiens
uuaaacaccuccuc

SEQ ID NO: 1736989 - RNA, 16 nt, Homo sapiens
uuaaauaaaagcacaa

SEQ ID NO: 1736990 - RNA, 23 nt, Homo sapiens
uuaacugaauaccacucuguaau

SEQ ID NO: 1736991 - RNA, 17 nt, Homo sapiens
uuaacugcauuuuacca

SEQ ID NO: 1736992 - RNA, 12 nt, Homo sapiens
uuaagccuuaaa

SEQ ID NO: 1736993 - RNA, 18 nt, Homo sapiens
uuaauaaagacgauuugu

SEQ ID NO: 1736994 - RNA, 19 nt, Homo sapiens
uuaauaucaucaguauuga

SEQ ID NO: 1736995 - RNA, 21 nt, Homo sapiens
uuacaguaaucccauuuccca

SEQ ID NO: 1736996 - RNA, 20 nt, Homo sapiens
uuacauacauugauucaugu

SEQ ID NO: 1736997 - RNA, 12 nt, Homo sapiens
uuacauuuacaa

SEQ ID NO: 1736998 - RNA, 19 nt, Homo sapiens
uuacauuuacaaacugaag

SEQ ID NO: 1736999 - RNA, 18 nt, Homo sapiens
uuacauuucauacaacag

SEQ ID NO: 1737000 - RNA, 20 nt, Homo sapiens
uuacccccugggagccccaa

SEQ ID NO: 1737001 - RNA, 14 nt, Homo sapiens
uuagauguuucaca

SEQ ID NO: 1737002 - RNA, 16 nt, Homo sapiens
uuagcaucaaguucuc

SEQ ID NO: 1737003 - RNA, 15 nt, Homo sapiens
uuaguauuguugucc

SEQ ID NO: 1737004 - RNA, 13 nt, Homo sapiens
uuauaacaagugu

SEQ ID NO: 1737005 - RNA, 16 nt, Homo sapiens
uuauauaauuacauau

SEQ ID NO: 1737006 - RNA, 21 nt, Homo sapiens
uuauauauggggaugguaguu

SEQ ID NO: 1737007 - RNA, 17 nt, Homo sapiens
uuauauuaauguacuug

SEQ ID NO: 1737008 - RNA, 16 nt, Homo sapiens
uuauguaauaauguga

SEQ ID NO: 1737009 - RNA, 12 nt, Homo sapiens
uucaaaugggcu

SEQ ID NO: 1737010 - RNA, 21 nt, Homo sapiens
uucaauuuauuugaaugauuu

SEQ ID NO: 1737011 - RNA, 21 nt, Homo sapiens
uucacagagauggaugcaugu

SEQ ID NO: 1737012 - RNA, 22 nt, Homo sapiens
uucacauuuuuaaaagaacaau

SEQ ID NO: 1737013 - RNA, 22 nt, Homo sapiens
uucaggaagcagcuuuccccau

SEQ ID NO: 1737014 - RNA, 15 nt, Homo sapiens
uucagggaacugcau

SEQ ID NO: 1737015 - RNA, 13 nt, Homo sapiens
uucauacaacaga

SEQ ID NO: 1737016 - RNA, 12 nt, Homo sapiens
uucaugccagcu

SEQ ID NO: 1737017 - RNA, 13 nt, Homo sapiens
uucauugcacuuu

SEQ ID NO: 1737018 - RNA, 16 nt, Homo sapiens
uucauugcacuuugau

SEQ ID NO: 1737019 - RNA, 21 nt, Homo sapiens
uuccaaagcuuuauuaccagu

SEQ ID NO: 1737020 - RNA, 22 nt, Homo sapiens
uuccaacagcaacacagccacu

SEQ ID NO: 1737021 - RNA, 18 nt, Homo sapiens
uuccauuuccaagcacuu

SEQ ID NO: 1737022 - RNA, 15 nt, Homo sapiens
uucccacugccaggg

SEQ ID NO: 1737023 - RNA, 17 nt, Homo sapiens
uucccagagucaucuga

SEQ ID NO: 1737024 - RNA, 19 nt, Homo sapiens
uucccaucgcugucacagg

SEQ ID NO: 1737025 - RNA, 14 nt, Homo sapiens
uuccccaagacauu

SEQ ID NO: 1737026 - RNA, 16 nt, Homo sapiens
uuccccaagacauucu

SEQ ID NO: 1737027 - RNA, 18 nt, Homo sapiens
uucuaaggaauaugagcu

SEQ ID NO: 1737028 - RNA, 14 nt, Homo sapiens
uucuccuugaauau

SEQ ID NO: 1737029 - RNA, 13 nt, Homo sapiens
uucugaaacacac

SEQ ID NO: 1737030 - RNA, 16 nt, Homo sapiens
uucugagguaaccuca

SEQ ID NO: 1737031 - RNA, 22 nt, Homo sapiens
uucuguuuuguuguuugauuca

SEQ ID NO: 1737032 - RNA, 16 nt, Homo sapiens
uucuuagcucaaugag

SEQ ID NO: 1737033 - RNA, 16 nt, Homo sapiens
uucuuugcaccaaaga

SEQ ID NO: 1737034 - RNA, 20 nt, Homo sapiens
uugagaaauuaaguaucuga

SEQ ID NO: 1737035 - RNA, 22 nt, Homo sapiens
uugagcgugaaucuguaucuug

SEQ ID NO: 1737036 - RNA, 16 nt, Homo sapiens
uugauauuucacuuac

SEQ ID NO: 1737037 - RNA, 22 nt, Homo sapiens
aagggaacuugagcgugaaucu

SEQ ID NO: 1737038 - RNA, 12 nt, Homo sapiens
aagggccauuua

SEQ ID NO: 1737039 - RNA, 21 nt, Homo sapiens
aagggucucccucuguugcca

SEQ ID NO: 1737040 - RNA, 18 nt, Homo sapiens
aagguauuuauugagcac

SEQ ID NO: 1737041 - RNA, 19 nt, Homo sapiens
aagguggaacaagcacaga

SEQ ID NO: 1737042 - RNA, 13 nt, Homo sapiens
aauaaaagcacaa

SEQ ID NO: 1737043 - RNA, 13 nt, Homo sapiens
aauaaaagcacuu

SEQ ID NO: 1737044 - RNA, 13 nt, Homo sapiens
aauaaacuacucu

SEQ ID NO: 1737045 - RNA, 18 nt, Homo sapiens
aauaaauucccaacuucu

SEQ ID NO: 1737046 - RNA, 15 nt, Homo sapiens
aauaaggcccagagc

SEQ ID NO: 1737047 - RNA, 17 nt, Homo sapiens
aauaauucuucaccuaa

SEQ ID NO: 1737048 - RNA, 18 nt, Homo sapiens
aauacaaacaccuggacu

SEQ ID NO: 1737049 - RNA, 15 nt, Homo sapiens
aauagugucugauga

SEQ ID NO: 1737050 - RNA, 16 nt, Homo sapiens
aauagugucugaugaa

SEQ ID NO: 1737051 - RNA, 13 nt, Homo sapiens
aauauccugugua

SEQ ID NO: 1737052 - RNA, 19 nt, Homo sapiens
aauauuuuguuuugugcag

SEQ ID NO: 1737053 - RNA, 20 nt, Homo sapiens
aaucagagcuccaguuugca

SEQ ID NO: 1737054 - RNA, 18 nt, Homo sapiens
aaucagcgauguauauaa

SEQ ID NO: 1737055 - RNA, 19 nt, Homo sapiens
aaucucaaugaagccagcu

SEQ ID NO: 1737056 - RNA, 18 nt, Homo sapiens
aaugauuuuucuuuacaa

SEQ ID NO: 1737057 - RNA, 13 nt, Homo sapiens
aaugcagcuuuaa

SEQ ID NO: 1737058 - RNA, 17 nt, Homo sapiens
aaugcuuuaggauguac

SEQ ID NO: 1737059 - RNA, 21 nt, Homo sapiens
aauguuuuacauuccauuuca

SEQ ID NO: 1737060 - RNA, 21 nt, Homo sapiens
aauuacaguaaucccauuucc

SEQ ID NO: 1737061 - RNA, 22 nt, Homo sapiens
acaacauggccgugaacuuuau

SEQ ID NO: 1737062 - RNA, 23 nt, Homo sapiens
acaauuuuuuuuauuaguauugu

SEQ ID NO: 1737063 - RNA, 19 nt, Homo sapiens
acacacgagcaaacccaga

SEQ ID NO: 1737064 - RNA, 22 nt, Homo sapiens
acacagagcaggacugcacagc

SEQ ID NO: 1737065 - RNA, 17 nt, Homo sapiens
acacagggcccggccac

SEQ ID NO: 1737066 - RNA, 14 nt, Homo sapiens
acacauaauucagg

SEQ ID NO: 1737067 - RNA, 14 nt, Homo sapiens
acaccguucauuca

SEQ ID NO: 1737068 - RNA, 21 nt, Homo sapiens
acagccacuaaaacacaaaaa

SEQ ID NO: 1737069 - RNA, 16 nt, Homo sapiens
acaggaaguaguucua

SEQ ID NO: 1737070 - RNA, 21 nt, Homo sapiens
acaggcccccuugaguggggu

SEQ ID NO: 1737071 - RNA, 14 nt, Homo sapiens
acauaaagccuugg

SEQ ID NO: 1737072 - RNA, 15 nt, Homo sapiens
acauagaagagccaa

SEQ ID NO: 1737073 - RNA, 12 nt, Homo sapiens
acauauuugcau

SEQ ID NO: 1737074 - RNA, 19 nt, Homo sapiens
acaucaggagacugggcuc

SEQ ID NO: 1737075 - RNA, 23 nt, Homo sapiens
acaucucugcaguuuuucccaag

SEQ ID NO: 1737076 - RNA, 18 nt, Homo sapiens
acaugcccuguguggcug

SEQ ID NO: 1737077 - RNA, 21 nt, Homo sapiens
acauguguuggcagccucuuc

SEQ ID NO: 1737078 - RNA, 18 nt, Homo sapiens
acauguuguacauuucac

SEQ ID NO: 1737079 - RNA, 17 nt, Homo sapiens
acauuuacaaacugaag

SEQ ID NO: 1737080 - RNA, 20 nt, Homo sapiens
accaaacccggccugauuaa

SEQ ID NO: 1737081 - RNA, 15 nt, Homo sapiens
accaaagcaucaaua

SEQ ID NO: 1737082 - RNA, 19 nt, Homo sapiens
accaagcugugcccugacc

SEQ ID NO: 1737083 - RNA, 15 nt, Homo sapiens
accaauaaagccuuc

SEQ ID NO: 1737084 - RNA, 17 nt, Homo sapiens
accaauaaagccuucaa

SEQ ID NO: 1737085 - RNA, 18 nt, Homo sapiens
accaccacccuugccaug

SEQ ID NO: 1737086 - RNA, 19 nt, Homo sapiens
accaccacccuugccaugg

SEQ ID NO: 1737087 - RNA, 12 nt, Homo sapiens
accaccuuucag

SEQ ID NO: 1737088 - RNA, 15 nt, Homo sapiens
accacugcucugaug

SEQ ID NO: 1737089 - RNA, 14 nt, Homo sapiens
accacugggugaga

SEQ ID NO: 1737090 - RNA, 13 nt, Homo sapiens
accagagcugccg

SEQ ID NO: 1737091 - RNA, 21 nt, Homo sapiens
accagccguauuuuacaugaa

SEQ ID NO: 1737092 - RNA, 9 nt, Homo sapiens
accaugcug

SEQ ID NO: 1737093 - RNA, 22 nt, Homo sapiens
acccagugaggaugcugcagug

SEQ ID NO: 1737094 - RNA, 23 nt, Homo sapiens
ggaugccaaccggucacccagga

SEQ ID NO: 1737095 - RNA, 17 nt, Homo sapiens
ggauuuuaccaaagcau

SEQ ID NO: 1737096 - RNA, 12 nt, Homo sapiens
ggcaaacaggca

SEQ ID NO: 1737097 - RNA, 16 nt, Homo sapiens
ggcaacgcacaaaaca

SEQ ID NO: 1737098 - RNA, 21 nt, Homo sapiens
ggcaauguucccccucuccuc

SEQ ID NO: 1737099 - RNA, 11 nt, Homo sapiens
ggcacuuugaa

SEQ ID NO: 1737100 - RNA, 10 nt, Homo sapiens
ggcagccacc

SEQ ID NO: 1737101 - RNA, 18 nt, Homo sapiens
ggcaggacacacauggug

SEQ ID NO: 1737102 - RNA, 15 nt, Homo sapiens
ggcaguuccauuuca

SEQ ID NO: 1737103 - RNA, 22 nt, Homo sapiens
ggccaaggugggauuuguaaag

SEQ ID NO: 1737104 - RNA, 22 nt, Homo sapiens
ggccaaugcuuauacccaguga

SEQ ID NO: 1737105 - RNA, 16 nt, Homo sapiens
ggccacccugccucua

SEQ ID NO: 1737106 - RNA, 17 nt, Homo sapiens
ggccagaugcacauccc

SEQ ID NO: 1737107 - RNA, 21 nt, Homo sapiens
ggccagccuuucccccuguga

SEQ ID NO: 1737108 - RNA, 17 nt, Homo sapiens
ggccucagugugcccau

SEQ ID NO: 1737109 - RNA, 16 nt, Homo sapiens
ggccucucacaaaaga

SEQ ID NO: 1737110 - RNA, 19 nt, Homo sapiens
ggcuaggggcuggggccaa

SEQ ID NO: 1737111 - RNA, 16 nt, Homo sapiens
ggcuccaacacugcug

SEQ ID NO: 1737112 - RNA, 17 nt, Homo sapiens
ggcuccuucccaucgcu

SEQ ID NO: 1737113 - RNA, 15 nt, Homo sapiens
ggcugagggugcccu

SEQ ID NO: 1737114 - RNA, 18 nt, Homo sapiens
ggcugcacccacccagga

SEQ ID NO: 1737115 - RNA, 19 nt, Homo sapiens
ggcuuuaaaacuuauccuc

SEQ ID NO: 1737116 - RNA, 24 nt, Homo sapiens
ggcuuuaaaacuuauccuccauga

SEQ ID NO: 1737117 - RNA, 13 nt, Homo sapiens
gggaaaaccagac

SEQ ID NO: 1737118 - RNA, 14 nt, Homo sapiens
gggaccacaaggaa

SEQ ID NO: 1737119 - RNA, 22 nt, Homo sapiens
gggccccugucgucaggaccuc

SEQ ID NO: 1737120 - RNA, 22 nt, Homo sapiens
gggcuuggcugugcccucagau

SEQ ID NO: 1737121 - RNA, 15 nt, Homo sapiens
gggucucaguguccu

SEQ ID NO: 1737122 - RNA, 23 nt, Homo sapiens
gguaguuuguuuuagaaccagcc

SEQ ID NO: 1737123 - RNA, 15 nt, Homo sapiens
ggucacuggaacuca

SEQ ID NO: 1737124 - RNA, 18 nt, Homo sapiens
ggucccaggcuucccaaa

SEQ ID NO: 1737125 - RNA, 13 nt, Homo sapiens
ggucuuucugugc

SEQ ID NO: 1737126 - RNA, 14 nt, Homo sapiens
gguggucacuggaa

SEQ ID NO: 1737127 - RNA, 18 nt, Homo sapiens
guaaaaaugcugcucuca

SEQ ID NO: 1737128 - RNA, 20 nt, Homo sapiens
guaaacagauggcacuuuga

SEQ ID NO: 1737129 - RNA, 17 nt, Homo sapiens
guaaagcuuugugcaga

SEQ ID NO: 1737130 - RNA, 23 nt, Homo sapiens
guaacauacuggccuggacuguu

SEQ ID NO: 1737131 - RNA, 18 nt, Homo sapiens
guaaucccauuucccaaa

SEQ ID NO: 1737132 - RNA, 11 nt, Homo sapiens
guacauuucac

SEQ ID NO: 1737133 - RNA, 14 nt, Homo sapiens
guacuuguuugcaa

SEQ ID NO: 1737134 - RNA, 18 nt, Homo sapiens
gucacauagagugaucuu

SEQ ID NO: 1737135 - RNA, 20 nt, Homo sapiens
gucagaaaaaggaaaccaca

SEQ ID NO: 1737136 - RNA, 15 nt, Homo sapiens
gucccaggcuuccca

SEQ ID NO: 1737137 - RNA, 17 nt, Homo sapiens
gucccuauggaagcaua

SEQ ID NO: 1737138 - RNA, 23 nt, Homo sapiens
guccuuucccuucaguacccucu

SEQ ID NO: 1737139 - RNA, 18 nt, Homo sapiens
guccuuuuucacuuugaa

SEQ ID NO: 1737140 - RNA, 19 nt, Homo sapiens
gucuacauugagcauuuga

SEQ ID NO: 1737141 - RNA, 15 nt, Homo sapiens
gucuaggacugcagu

SEQ ID NO: 1737142 - RNA, 22 nt, Homo sapiens
gucucacugugggaaggccagc

SEQ ID NO: 1737143 - RNA, 13 nt, Homo sapiens
gucucccuaaaaa

SEQ ID NO: 1737144 - RNA, 16 nt, Homo sapiens
gucucugaugcagcuu

SEQ ID NO: 1737145 - RNA, 17 nt, Homo sapiens
gucuguccuugaaggac

SEQ ID NO: 1737146 - RNA, 20 nt, Homo sapiens
gucuuucacagcuccuccca

SEQ ID NO: 1737147 - RNA, 14 nt, Homo sapiens
gugaggcuguaaag

SEQ ID NO: 1737148 - RNA, 19 nt, Homo sapiens
gugauuucuuucuuugcac

SEQ ID NO: 1737149 - RNA, 20 nt, Homo sapiens
gugcaaagauuugcuuuaau

SEQ ID NO: 1737150 - RNA, 20 nt, Homo sapiens
gugcugggaauuacaggcgu

SEQ ID NO: 1737151 - RNA, 13 nt, Homo sapiens
gugcugugacucg

SEQ ID NO: 1737152 - RNA, 15 nt, Homo sapiens
guggcaucuugccaa

SEQ ID NO: 1737153 - RNA, 22 nt, Homo sapiens
guggcguuguugcauguuugaa

SEQ ID NO: 1737154 - RNA, 17 nt, Homo sapiens
gugggcaaacaggcagu

SEQ ID NO: 1737155 - RNA, 17 nt, Homo sapiens
gugucuuacgugccacc

SEQ ID NO: 1737156 - RNA, 22 nt, Homo sapiens
gugugaucuuaauauauuugaa

SEQ ID NO: 1737157 - RNA, 15 nt, Homo sapiens
ucccccaaacauguu

SEQ ID NO: 1737158 - RNA, 15 nt, Homo sapiens
ucccccaaagccgga

SEQ ID NO: 1737159 - RNA, 15 nt, Homo sapiens
ucccucaucaaggac

SEQ ID NO: 1737160 - RNA, 19 nt, Homo sapiens
ucccuuuuuuuacauuuca

SEQ ID NO: 1737161 - RNA, 13 nt, Homo sapiens
uccgaggccagua

SEQ ID NO: 1737162 - RNA, 13 nt, Homo sapiens
uccgggaucaaag

SEQ ID NO: 1737163 - RNA, 19 nt, Homo sapiens
uccgucccccaaacauguu

SEQ ID NO: 1737164 - RNA, 19 nt, Homo sapiens
uccuacgauacgcuacuau

SEQ ID NO: 1737165 - RNA, 21 nt, Homo sapiens
uccuagcgcagccaugugauu

SEQ ID NO: 1737166 - RNA, 19 nt, Homo sapiens
uccucuagcugugggggug

SEQ ID NO: 1737167 - RNA, 16 nt, Homo sapiens
uccucuuugguggcau

SEQ ID NO: 1737168 - RNA, 19 nt, Homo sapiens
uccugccugugcugugacu

SEQ ID NO: 1737169 - RNA, 18 nt, Homo sapiens
uccuggaucucccugaga

SEQ ID NO: 1737170 - RNA, 13 nt, Homo sapiens
uccuggcacuaac

SEQ ID NO: 1737171 - RNA, 15 nt, Homo sapiens
uccuguguaacacuu

SEQ ID NO: 1737172 - RNA, 17 nt, Homo sapiens
uccuuuuucacuuugaa

SEQ ID NO: 1737173 - RNA, 22 nt, Homo sapiens
ucgagagcuggccaaagagccu

SEQ ID NO: 1737174 - RNA, 19 nt, Homo sapiens
ucgagaucaucacuuccuu

SEQ ID NO: 1737175 - RNA, 19 nt, Homo sapiens
ucggcaggacacccugaua

SEQ ID NO: 1737176 - RNA, 20 nt, Homo sapiens
ucggcuccccauguguccug

SEQ ID NO: 1737177 - RNA, 18 nt, Homo sapiens
ucgggcugagaaggcagu

SEQ ID NO: 1737178 - RNA, 15 nt, Homo sapiens
ucgugagucauuuaa

SEQ ID NO: 1737179 - RNA, 19 nt, Homo sapiens
ucuaaaugggaauucucag

SEQ ID NO: 1737180 - RNA, 18 nt, Homo sapiens
ucuaaggaauaugagcuu

SEQ ID NO: 1737181 - RNA, 19 nt, Homo sapiens
ucuaaggaauaugagcuuu

SEQ ID NO: 1737182 - RNA, 15 nt, Homo sapiens
ucuagcugugggggu

SEQ ID NO: 1737183 - RNA, 22 nt, Homo sapiens
ucucacugugggaaggccagcu

SEQ ID NO: 1737184 - RNA, 13 nt, Homo sapiens
ucucagaugcagu

SEQ ID NO: 1737185 - RNA, 12 nt, Homo sapiens
ucucagugcagg

SEQ ID NO: 1737186 - RNA, 13 nt, Homo sapiens
ucucagugcugua

SEQ ID NO: 1737187 - RNA, 16 nt, Homo sapiens
ucucaucagacucuga

SEQ ID NO: 1737188 - RNA, 21 nt, Homo sapiens
ucucccagugacaacaucgca

SEQ ID NO: 1737189 - RNA, 17 nt, Homo sapiens
ucuccccaggcauuugc

SEQ ID NO: 1737190 - RNA, 20 nt, Homo sapiens
ucucucggcuccccaugugu

SEQ ID NO: 1737191 - RNA, 12 nt, Homo sapiens
ucucucugggcu

SEQ ID NO: 1737192 - RNA, 18 nt, Homo sapiens
ucucugacgcuugugaca

SEQ ID NO: 1737193 - RNA, 12 nt, Homo sapiens
ucucuguacuuu

SEQ ID NO: 1737194 - RNA, 21 nt, Homo sapiens
ucucuuacaaaagcuuugaau

SEQ ID NO: 1737195 - RNA, 17 nt, Homo sapiens
ucugaggaugcauucga

SEQ ID NO: 1737196 - RNA, 22 nt, Homo sapiens
ucugccugcaccccugcaguuu

SEQ ID NO: 1737197 - RNA, 15 nt, Homo sapiens
ucuggaccuagggug

SEQ ID NO: 1737198 - RNA, 23 nt, Homo sapiens
ucuggagggguguggcuccuucc

SEQ ID NO: 1737199 - RNA, 22 nt, Homo sapiens
ucuggcagaggagggagcauca

SEQ ID NO: 1737200 - RNA, 13 nt, Homo sapiens
ucuggugugaacu

SEQ ID NO: 1737201 - RNA, 15 nt, Homo sapiens
ucuguguuaggggua

SEQ ID NO: 1737202 - RNA, 14 nt, Homo sapiens
ucuguuauguacua

SEQ ID NO: 1737203 - RNA, 19 nt, Homo sapiens
ucuucaguugucucugaug

SEQ ID NO: 1737204 - RNA, 23 nt, Homo sapiens
ucuuccuccgaggccaguaccuu

SEQ ID NO: 1737205 - RNA, 16 nt, Homo sapiens
uguuaauuacaccaua

SEQ ID NO: 1737206 - RNA, 23 nt, Homo sapiens
uguuauuauauuccguagguaga

SEQ ID NO: 1737207 - RNA, 12 nt, Homo sapiens
uguucuugugaa

SEQ ID NO: 1737208 - RNA, 14 nt, Homo sapiens
uguugaagccuuug

SEQ ID NO: 1737209 - RNA, 20 nt, Homo sapiens
uguuguuuuaggaauacaua

SEQ ID NO: 1737210 - RNA, 18 nt, Homo sapiens
uguuucacaauaccucau

SEQ ID NO: 1737211 - RNA, 19 nt, Homo sapiens
uguuuccuagcacacacuu

SEQ ID NO: 1737212 - RNA, 14 nt, Homo sapiens
uguuuuacauucca

SEQ ID NO: 1737213 - RNA, 19 nt, Homo sapiens
uuaaaaaagauaaacacaa

SEQ ID NO: 1737214 - RNA, 13 nt, Homo sapiens
uuaaaacagucua

SEQ ID NO: 1737215 - RNA, 15 nt, Homo sapiens
uuaaacaaaaacuag

SEQ ID NO: 1737216 - RNA, 17 nt, Homo sapiens
uuaaacauuaugaugug

SEQ ID NO: 1737217 - RNA, 14 nt, Homo sapiens
uuaaagccuccuca

SEQ ID NO: 1737218 - RNA, 15 nt, Homo sapiens
uuaagauaugauguc

SEQ ID NO: 1737219 - RNA, 17 nt, Homo sapiens
uuaagugagcagaacag

SEQ ID NO: 1737220 - RNA, 22 nt, Homo sapiens
uuaauauuuauaggucacuuug

SEQ ID NO: 1737221 - RNA, 18 nt, Homo sapiens
uuaaucuguuauguacua

SEQ ID NO: 1737222 - RNA, 23 nt, Homo sapiens
uuacaaaacaaacucauucauua

SEQ ID NO: 1737223 - RNA, 21 nt, Homo sapiens
uuacaauaaucauucuggaua

SEQ ID NO: 1737224 - RNA, 20 nt, Homo sapiens
uuacaaugcauucugaggua

SEQ ID NO: 1737225 - RNA, 18 nt, Homo sapiens
uuaccaccgucugucuca

SEQ ID NO: 1737226 - RNA, 13 nt, Homo sapiens
uuagaacagucca

SEQ ID NO: 1737227 - RNA, 22 nt, Homo sapiens
uuaguucugguugauucacuca

SEQ ID NO: 1737228 - RNA, 15 nt, Homo sapiens
uuauaaaucgcuuuu

SEQ ID NO: 1737229 - RNA, 12 nt, Homo sapiens
uuauuauauucc

SEQ ID NO: 1737230 - RNA, 18 nt, Homo sapiens
uuauucaaaaugauguau

SEQ ID NO: 1737231 - RNA, 20 nt, Homo sapiens
uuauuuccagugaaaucagu

SEQ ID NO: 1737232 - RNA, 19 nt, Homo sapiens
uuauuuuuguuagcaaaga

SEQ ID NO: 1737233 - RNA, 14 nt, Homo sapiens
uucaaucccaggau

SEQ ID NO: 1737234 - RNA, 19 nt, Homo sapiens
uucaccuaagucucuguga

SEQ ID NO: 1737235 - RNA, 22 nt, Homo sapiens
uucaccuaagucucugugaauu

SEQ ID NO: 1737236 - RNA, 17 nt, Homo sapiens
uucagauaacuguuauu

SEQ ID NO: 1737237 - RNA, 15 nt, Homo sapiens
uucaggaagcagcuu

SEQ ID NO: 1737238 - RNA, 18 nt, Homo sapiens
uucaggcaacgcacaaaa

SEQ ID NO: 1737239 - RNA, 17 nt, Homo sapiens
uucauaccuacauguau

SEQ ID NO: 1737240 - RNA, 13 nt, Homo sapiens
uucaugucucacg

SEQ ID NO: 1737241 - RNA, 16 nt, Homo sapiens
uuccaucucugacuua

SEQ ID NO: 1737242 - RNA, 12 nt, Homo sapiens
uucccacugcca

SEQ ID NO: 1737243 - RNA, 12 nt, Homo sapiens
uuccccucugcu

SEQ ID NO: 1737244 - RNA, 13 nt, Homo sapiens
uuccgcaccaaua

SEQ ID NO: 1737245 - RNA, 20 nt, Homo sapiens
uuccuggcuccaacacugcu

SEQ ID NO: 1737246 - RNA, 21 nt, Homo sapiens
uuccuguaaagaaacauuucc

SEQ ID NO: 1737247 - RNA, 11 nt, Homo sapiens
uuccuuugaac

SEQ ID NO: 1737248 - RNA, 23 nt, Homo sapiens
uucuaugcuguuuguagugaaau

SEQ ID NO: 1737249 - RNA, 14 nt, Homo sapiens
uucuccacaaagua

SEQ ID NO: 1737250 - RNA, 15 nt, Homo sapiens
uucuccccaggguag

SEQ ID NO: 1737251 - RNA, 18 nt, Homo sapiens
uucuggacggaaccacgu

SEQ ID NO: 1737252 - RNA, 19 nt, Homo sapiens
uucugguugaugccuguga

SEQ ID NO: 1737253 - RNA, 22 nt, Homo sapiens
uucuucaccuaagucucuguga

SEQ ID NO: 1737254 - RNA, 22 nt, Homo sapiens
uucuuugcaccaaagacaucag

SEQ ID NO: 1737255 - RNA, 21 nt, Homo sapiens
uugaaaaaaacuucauucucg

SEQ ID NO: 1737256 - RNA, 14 nt, Homo sapiens
uugaauacugugaa

SEQ ID NO: 1737257 - RNA, 17 nt, Homo sapiens
uugaaucacaugaauua

SEQ ID NO: 1737258 - RNA, 20 nt, Homo sapiens
uugauaaucaacugggcuga

SEQ ID NO: 1737259 - RNA, 21 nt, Homo sapiens
uugaucuucagggaacugcau

SEQ ID NO: 1737260 - RNA, 20 nt, Homo sapiens
uugcagcuguuuuguugaca

SEQ ID NO: 1737261 - RNA, 20 nt, Homo sapiens
uugcaucucaguaugaauua

SEQ ID NO: 1737262 - RNA, 23 nt, Homo sapiens
uugcaucucaguaugaauuauuc

SEQ ID NO: 1737263 - RNA, 23 nt, Homo sapiens
uugcauuuaauuuauugaggcuu

SEQ ID NO: 1737264 - RNA, 15 nt, Homo sapiens
uugccauugacuucu

SEQ ID NO: 1737265 - RNA, 14 nt, Homo sapiens
uugccccacucugc

SEQ ID NO: 1737266 - RNA, 15 nt, Homo sapiens
uugccuucucugccc

SEQ ID NO: 1737267 - RNA, 20 nt, Homo sapiens
uugcuccagauucugaugca

SEQ ID NO: 1737268 - RNA, 21 nt, Homo sapiens
uuggcgggggcuuggcugugc

SEQ ID NO: 1737269 - RNA, 21 nt, Homo sapiens
uugggauauucugaaacuuga

SEQ ID NO: 1737270 - RNA, 21 nt, Homo sapiens
uuggggaaaauggccaugcag

SEQ ID NO: 1737271 - RNA, 14 nt, Homo sapiens
uuguagugcuuuga

SEQ ID NO: 1737272 - RNA, 13 nt, Homo sapiens
uugucucugucac

SEQ ID NO: 1737273 - RNA, 17 nt, Homo sapiens
uuguuccccaagacauu

SEQ ID NO: 1737274 - RNA, 20 nt, Homo sapiens
uuguuccccaagacauucua

SEQ ID NO: 1737275 - RNA, 13 nt, Homo sapiens
uuguucuugugaa

SEQ ID NO: 1737276 - RNA, 16 nt, Homo sapiens
uuguuguccuuuucau

SEQ ID NO: 1737277 - RNA, 14 nt, Homo sapiens
uuuaaagccuccuc

SEQ ID NO: 1737278 - RNA, 18 nt, Homo sapiens
uuuaaauaaaagcacaag

SEQ ID NO: 1737279 - RNA, 15 nt, Homo sapiens
uuuaaucuuccaugg

SEQ ID NO: 1737280 - RNA, 16 nt, Homo sapiens
uuuacauuucauacaa

SEQ ID NO: 1737281 - RNA, 13 nt, Homo sapiens
uuuagaaccagcc

SEQ ID NO: 1737282 - RNA, 13 nt, Homo sapiens
uuuauuauauaua

SEQ ID NO: 1737283 - RNA, 16 nt, Homo sapiens
uuuauugcauugcugg

SEQ ID NO: 1737284 - RNA, 16 nt, Homo sapiens
uuucacaauaccucau

SEQ ID NO: 1737285 - RNA, 21 nt, Homo sapiens
uuucacauuguuugcugcuau

SEQ ID NO: 1737286 - RNA, 23 nt, Homo sapiens
uuucaucuucaguugucucugau

SEQ ID NO: 1737287 - RNA, 12 nt, Homo sapiens
uuuccuccugag

SEQ ID NO: 1737288 - RNA, 15 nt, Homo sapiens
uuugaauacugugaa

SEQ ID NO: 1737289 - RNA, 20 nt, Homo sapiens
uuugauucagcaaaaaucuc

SEQ ID NO: 1737290 - RNA, 10 nt, Homo sapiens
uuugccaugc

SEQ ID NO: 1737291 - RNA, 19 nt, Homo sapiens
uuuggaguccccucaccuc

SEQ ID NO: 1737292 - RNA, 18 nt, Homo sapiens
uuuguuccccaagacauu

SEQ ID NO: 1737293 - RNA, 17 nt, Homo sapiens
uuuuacauuucauacaa

SEQ ID NO: 1737294 - RNA, 21 nt, Homo sapiens
uuuuaccaaagcaucaauaca

SEQ ID NO: 1737295 - RNA, 23 nt, Homo sapiens
uuuuagguagaaaaacauauucu

SEQ ID NO: 1737296 - RNA, 13 nt, Homo sapiens
uuuucacuuugaa

SEQ ID NO: 1737297 - RNA, 12 nt, Homo sapiens
uuuucauuugag

SEQ ID NO: 1737298 - RNA, 13 nt, Homo sapiens
uuuuucuccagcu

SEQ ID NO: 1737299 - RNA, 16 nt, Homo sapiens
ccucgcccuccacaaa

SEQ ID NO: 1737300 - RNA, 15 nt, Homo sapiens
ccucuccaacugccu

SEQ ID NO: 1737301 - RNA, 19 nt, Homo sapiens
ccucucucccggagguugg

SEQ ID NO: 1737302 - RNA, 22 nt, Homo sapiens
ccucugucuaggacugcagugu

SEQ ID NO: 1737303 - RNA, 22 nt, Homo sapiens
ccugaauucuuuuucauuugag

SEQ ID NO: 1737304 - RNA, 17 nt, Homo sapiens
ccugcaccccugcaguu

SEQ ID NO: 1737305 - RNA, 19 nt, Homo sapiens
ccugcaggcgugaccugac

SEQ ID NO: 1737306 - RNA, 17 nt, Homo sapiens
ccugcuguugguccucu

SEQ ID NO: 1737307 - RNA, 20 nt, Homo sapiens
ccuggcacuggaugcagaaa

SEQ ID NO: 1737308 - RNA, 19 nt, Homo sapiens
ccuggcugaaggacuguga

SEQ ID NO: 1737309 - RNA, 13 nt, Homo sapiens
ccuggugcugcug

SEQ ID NO: 1737310 - RNA, 18 nt, Homo sapiens
ccuucaaagcaaaugucu

SEQ ID NO: 1737311 - RNA, 20 nt, Homo sapiens
ccuuccccacuucugugcca

SEQ ID NO: 1737312 - RNA, 21 nt, Homo sapiens
ccuuggaagggcguucuaggu

SEQ ID NO: 1737313 - RNA, 12 nt, Homo sapiens
ccuugucugcua

SEQ ID NO: 1737314 - RNA, 13 nt, Homo sapiens
ccuuuccauuuau

SEQ ID NO: 1737315 - RNA, 14 nt, Homo sapiens
ccuuuuaacaccuu

SEQ ID NO: 1737316 - RNA, 18 nt, Homo sapiens
ccuuuuuuuacauuucau

SEQ ID NO: 1737317 - RNA, 13 nt, Homo sapiens
cgaaugugucuuu

SEQ ID NO: 1737318 - RNA, 23 nt, Homo sapiens
cgagccccucggcucuggaggca

SEQ ID NO: 1737319 - RNA, 15 nt, Homo sapiens
cgagucacacucaag

SEQ ID NO: 1737320 - RNA, 17 nt, Homo sapiens
cgcaccaauaaagccuu

SEQ ID NO: 1737321 - RNA, 15 nt, Homo sapiens
cgcaucucagugcag

SEQ ID NO: 1737322 - RNA, 18 nt, Homo sapiens
cgcugcccgcucagccca

SEQ ID NO: 1737323 - RNA, 14 nt, Homo sapiens
cgggaccccgagcc

SEQ ID NO: 1737324 - RNA, 21 nt, Homo sapiens
cgggcaccaacuccauguuug

SEQ ID NO: 1737325 - RNA, 14 nt, Homo sapiens
cgggguuugccaug

SEQ ID NO: 1737326 - RNA, 14 nt, Homo sapiens
cgugacagccguuu

SEQ ID NO: 1737327 - RNA, 18 nt, Homo sapiens
cgugggcaaacaggcagu

SEQ ID NO: 1737328 - RNA, 21 nt, Homo sapiens
cguuucauuuuuacaccaauu

SEQ ID NO: 1737329 - RNA, 22 nt, Homo sapiens
cguuucuccaccuagacuguaa

SEQ ID NO: 1737330 - RNA, 19 nt, Homo sapiens
cguuuguuccccaagacau

SEQ ID NO: 1737331 - RNA, 19 nt, Homo sapiens
cuaaggaauaugagcuuua

SEQ ID NO: 1737332 - RNA, 15 nt, Homo sapiens
cuaagucucugugaa

SEQ ID NO: 1737333 - RNA, 22 nt, Homo sapiens
cuaauuuguuuucccuucuuac

SEQ ID NO: 1737334 - RNA, 21 nt, Homo sapiens
cuacacagagcaggacugcac

SEQ ID NO: 1737335 - RNA, 12 nt, Homo sapiens
cuacucuuugau

SEQ ID NO: 1737336 - RNA, 17 nt, Homo sapiens
cuaggggcuggggccaa

SEQ ID NO: 1737337 - RNA, 18 nt, Homo sapiens
cuaguguucuguuuguua

SEQ ID NO: 1737338 - RNA, 23 nt, Homo sapiens
cuaguuguaauuuuuuuguggga

SEQ ID NO: 1737339 - RNA, 15 nt, Homo sapiens
cuaugcagaggccug

SEQ ID NO: 1737340 - RNA, 19 nt, Homo sapiens
cuauuuuuuuucuguuaua

SEQ ID NO: 1737341 - RNA, 20 nt, Homo sapiens
cucaaaagaaggccacuguu

SEQ ID NO: 1737342 - RNA, 19 nt, Homo sapiens
cucaauaaaugauucuuag

SEQ ID NO: 1737343 - RNA, 14 nt, Homo sapiens
cucaaugagcaugu

SEQ ID NO: 1737344 - RNA, 12 nt, Homo sapiens
cucagaccugaa

SEQ ID NO: 1737345 - RNA, 22 nt, Homo sapiens
cucagcucugguccaggcccug

SEQ ID NO: 1737346 - RNA, 20 nt, Homo sapiens
cucaguguccucaucuguaa

SEQ ID NO: 1737347 - RNA, 17 nt, Homo sapiens
cucagugugacuccuca

SEQ ID NO: 1737348 - RNA, 14 nt, Homo sapiens
cucauacacagaaa

SEQ ID NO: 1737349 - RNA, 21 nt, Homo sapiens
cucaucauagcaauaacauuc

SEQ ID NO: 1737350 - RNA, 22 nt, Homo sapiens
cucaucauagcaauaacauucc

SEQ ID NO: 1737351 - RNA, 22 nt, Homo sapiens
auuaaggauuuuaugcuuuaaa

SEQ ID NO: 1737352 - RNA, 17 nt, Homo sapiens
auuaauugucauuauuu

SEQ ID NO: 1737353 - RNA, 18 nt, Homo sapiens
auuaugaugugugaaaac

SEQ ID NO: 1737354 - RNA, 16 nt, Homo sapiens
auuauuccccuaggcu

SEQ ID NO: 1737355 - RNA, 20 nt, Homo sapiens
auuauuuuuguuagcaaaga

SEQ ID NO: 1737356 - RNA, 14 nt, Homo sapiens
auucaaaaugaugu

SEQ ID NO: 1737357 - RNA, 16 nt, Homo sapiens
auucaaauugcugcuu

SEQ ID NO: 1737358 - RNA, 19 nt, Homo sapiens
auucacucaagaguucagu

SEQ ID NO: 1737359 - RNA, 19 nt, Homo sapiens
auucagagcaaguuccuga

SEQ ID NO: 1737360 - RNA, 21 nt, Homo sapiens
auucugagguaaccucauuau

SEQ ID NO: 1737361 - RNA, 15 nt, Homo sapiens
auucuuagugacuuu

SEQ ID NO: 1737362 - RNA, 13 nt, Homo sapiens
auugagcauuuga

SEQ ID NO: 1737363 - RNA, 19 nt, Homo sapiens
auugaggcuuuaaaacuua

SEQ ID NO: 1737364 - RNA, 19 nt, Homo sapiens
auugagggagcugggagac

SEQ ID NO: 1737365 - RNA, 13 nt, Homo sapiens
auuggcucagccc

SEQ ID NO: 1737366 - RNA, 15 nt, Homo sapiens
auuuacaaacugaag

SEQ ID NO: 1737367 - RNA, 14 nt, Homo sapiens
auuuauugagcacc

SEQ ID NO: 1737368 - RNA, 16 nt, Homo sapiens
auuucaauuccuggcc

SEQ ID NO: 1737369 - RNA, 20 nt, Homo sapiens
auuugguaaaaaugcugcuc

SEQ ID NO: 1737370 - RNA, 23 nt, Homo sapiens
auuuguucauuaaacgucauuca

SEQ ID NO: 1737371 - RNA, 14 nt, Homo sapiens
auuuuaaaaacaua

SEQ ID NO: 1737372 - RNA, 17 nt, Homo sapiens
auuuugacaaagugccu

SEQ ID NO: 1737373 - RNA, 14 nt, Homo sapiens
auuuuucaagagau

SEQ ID NO: 1737374 - RNA, 22 nt, Homo sapiens
auuuuuuugugggaaauccaca

SEQ ID NO: 1737375 - RNA, 17 nt, Homo sapiens
auuuuuuuucuguuaua

SEQ ID NO: 1737376 - RNA, 19 nt, Homo sapiens
caaaaacuacauuuugcaa

SEQ ID NO: 1737377 - RNA, 13 nt, Homo sapiens
caaaaacuuugga

SEQ ID NO: 1737378 - RNA, 15 nt, Homo sapiens
caaaacacauaguua

SEQ ID NO: 1737379 - RNA, 16 nt, Homo sapiens
caaaacaucucugcag

SEQ ID NO: 1737380 - RNA, 18 nt, Homo sapiens
caaaacaucucugcaguu

SEQ ID NO: 1737381 - RNA, 23 nt, Homo sapiens
caaaagcuuugaauacugugaaa

SEQ ID NO: 1737382 - RNA, 13 nt, Homo sapiens
caaacaggcaguu

SEQ ID NO: 1737383 - RNA, 22 nt, Homo sapiens
caaacaggcaguuggccagaga

SEQ ID NO: 1737384 - RNA, 20 nt, Homo sapiens
caaacauguuguacauuuca

SEQ ID NO: 1737385 - RNA, 17 nt, Homo sapiens
caaaccucugugagcau

SEQ ID NO: 1737386 - RNA, 20 nt, Homo sapiens
caaaccugccucccauucua

SEQ ID NO: 1737387 - RNA, 17 nt, Homo sapiens
caaagauuugcuuuaau

SEQ ID NO: 1737388 - RNA, 17 nt, Homo sapiens
caaaucacgaccacuga

SEQ ID NO: 1737389 - RNA, 22 nt, Homo sapiens
caaaucguccagcgaccuuccu

SEQ ID NO: 1737390 - RNA, 18 nt, Homo sapiens
caaaugggaaaaccagac

SEQ ID NO: 1737391 - RNA, 13 nt, Homo sapiens
caaauguuauuau

SEQ ID NO: 1737392 - RNA, 16 nt, Homo sapiens
caacaucgcaauaguu

SEQ ID NO: 1737393 - RNA, 14 nt, Homo sapiens
caaccugaagacac

SEQ ID NO: 1737394 - RNA, 19 nt, Homo sapiens
caaccugggggcuuuaggg

SEQ ID NO: 1737395 - RNA, 19 nt, Homo sapiens
caacuccauguuugguguu

SEQ ID NO: 1737396 - RNA, 20 nt, Homo sapiens
caagaaacuucggggcugca

SEQ ID NO: 1737397 - RNA, 20 nt, Homo sapiens
caagcaggaaccccaggaga

SEQ ID NO: 1737398 - RNA, 17 nt, Homo sapiens
caaggccagaugcacau

SEQ ID NO: 1737399 - RNA, 17 nt, Homo sapiens
caaggcuggagugcagu

SEQ ID NO: 1737400 - RNA, 21 nt, Homo sapiens
caagggaacuugagcgugaau

SEQ ID NO: 1737401 - RNA, 22 nt, Homo sapiens
caagguggugugaucuuaauau

SEQ ID NO: 1737402 - RNA, 17 nt, Homo sapiens
caagugauccgcccauc

SEQ ID NO: 1737403 - RNA, 19 nt, Homo sapiens
caauaaagccuucaaacuc

SEQ ID NO: 1737404 - RNA, 13 nt, Homo sapiens
caaucuucucaga

SEQ ID NO: 1737405 - RNA, 21 nt, Homo sapiens
caaugagcauguuuagacuuu

SEQ ID NO: 1737406 - RNA, 18 nt, Homo sapiens
augcuguuuguagugaaa

SEQ ID NO: 1737407 - RNA, 17 nt, Homo sapiens
auguacaguuauggauu

SEQ ID NO: 1737408 - RNA, 23 nt, Homo sapiens
auguauauaagccaguucacuua

SEQ ID NO: 1737409 - RNA, 20 nt, Homo sapiens
auguaucaauauucacuuga

SEQ ID NO: 1737410 - RNA, 19 nt, Homo sapiens
augucacagauuccuggca

SEQ ID NO: 1737411 - RNA, 21 nt, Homo sapiens
augugcuuguuaacugagugc

SEQ ID NO: 1737412 - RNA, 18 nt, Homo sapiens
augugugaaaacugguua

SEQ ID NO: 1737413 - RNA, 17 nt, Homo sapiens
auguuccgagaagaaca

SEQ ID NO: 1737414 - RNA, 17 nt, Homo sapiens
auuacaggcgugagcca

SEQ ID NO: 1737415 - RNA, 19 nt, Homo sapiens
auuaucacauuaaucucaa

SEQ ID NO: 1737416 - RNA, 14 nt, Homo sapiens
auuauucaaaauga

SEQ ID NO: 1737417 - RNA, 19 nt, Homo sapiens
auuauuuuaaacauuauga

SEQ ID NO: 1737418 - RNA, 14 nt, Homo sapiens
auuauuuuaaucua

SEQ ID NO: 1737419 - RNA, 14 nt, Homo sapiens
auucaaucccagga

SEQ ID NO: 1737420 - RNA, 22 nt, Homo sapiens
auucagcaaaaaucucccagug

SEQ ID NO: 1737421 - RNA, 23 nt, Homo sapiens
auucgaaugacgguaaguguucu

SEQ ID NO: 1737422 - RNA, 16 nt, Homo sapiens
auucgauccccuguca

SEQ ID NO: 1737423 - RNA, 16 nt, Homo sapiens
auucuacacagagcag

SEQ ID NO: 1737424 - RNA, 23 nt, Homo sapiens
auucugagguaaccucauuauca

SEQ ID NO: 1737425 - RNA, 15 nt, Homo sapiens
auuguauuacagaug

SEQ ID NO: 1737426 - RNA, 15 nt, Homo sapiens
auuuaaagccuccuc

SEQ ID NO: 1737427 - RNA, 23 nt, Homo sapiens
auuuaaauguguacaauguacac

SEQ ID NO: 1737428 - RNA, 14 nt, Homo sapiens
auuuaaucuuccau

SEQ ID NO: 1737429 - RNA, 17 nt, Homo sapiens
auuuauaaucacuuuuu

SEQ ID NO: 1737430 - RNA, 18 nt, Homo sapiens
auuuauugagcaccugca

SEQ ID NO: 1737431 - RNA, 17 nt, Homo sapiens
agaggcccggccucuca

SEQ ID NO: 1737432 - RNA, 18 nt, Homo sapiens
agaguauaaauaaccaau

SEQ ID NO: 1737433 - RNA, 17 nt, Homo sapiens
agauacuucccaaagcc

SEQ ID NO: 1737434 - RNA, 15 nt, Homo sapiens
agauaugaugucccu

SEQ ID NO: 1737435 - RNA, 21 nt, Homo sapiens
agaugcaggaggcucagguga

SEQ ID NO: 1737436 - RNA, 14 nt, Homo sapiens
agauggaugcaugu

SEQ ID NO: 1737437 - RNA, 17 nt, Homo sapiens
agauucaaucccaggau

SEQ ID NO: 1737438 - RNA, 21 nt, Homo sapiens
agauucaaucccaggauguac

SEQ ID NO: 1737439 - RNA, 17 nt, Homo sapiens
agauuccgcaccaauaa

SEQ ID NO: 1737440 - RNA, 19 nt, Homo sapiens
agcaaagauuaaauguguc

SEQ ID NO: 1737441 - RNA, 16 nt, Homo sapiens
agcacaaggccuugcc

SEQ ID NO: 1737442 - RNA, 23 nt, Homo sapiens
agcagcucuccccaggcauuugc

SEQ ID NO: 1737443 - RNA, 18 nt, Homo sapiens
agcaggaaccccaggaga

SEQ ID NO: 1737444 - RNA, 18 nt, Homo sapiens
agcaggauagagugggac

SEQ ID NO: 1737445 - RNA, 13 nt, Homo sapiens
agcaucaauacaa

SEQ ID NO: 1737446 - RNA, 20 nt, Homo sapiens
agcaucagugcccuccagga

SEQ ID NO: 1737447 - RNA, 16 nt, Homo sapiens
agcaugggaggugagg

SEQ ID NO: 1737448 - RNA, 16 nt, Homo sapiens
agcauuguagugcuuu

SEQ ID NO: 1737449 - RNA, 17 nt, Homo sapiens
agcauuuccacaccaag

SEQ ID NO: 1737450 - RNA, 19 nt, Homo sapiens
agccacccguggggugcug

SEQ ID NO: 1737451 - RNA, 15 nt, Homo sapiens
agccacuaaaacaca

SEQ ID NO: 1737452 - RNA, 14 nt, Homo sapiens
agccccaauucgau

SEQ ID NO: 1737453 - RNA, 15 nt, Homo sapiens
agcccgaacaccauu

SEQ ID NO: 1737454 - RNA, 16 nt, Homo sapiens
agccucuggcauuaga

SEQ ID NO: 1737455 - RNA, 14 nt, Homo sapiens
cagggggaaggugg

SEQ ID NO: 1737456 - RNA, 17 nt, Homo sapiens
caggguaaaaggugcag

SEQ ID NO: 1737457 - RNA, 22 nt, Homo sapiens
caggugcugcucagcagaggau

SEQ ID NO: 1737458 - RNA, 18 nt, Homo sapiens
caguacccucucagcucc

SEQ ID NO: 1737459 - RNA, 14 nt, Homo sapiens
cagugacaacaucg

SEQ ID NO: 1737460 - RNA, 19 nt, Homo sapiens
cagugccacccaugcagcu

SEQ ID NO: 1737461 - RNA, 15 nt, Homo sapiens
cagugugacuccuca

SEQ ID NO: 1737462 - RNA, 17 nt, Homo sapiens
caguuaagccuuuggaa

SEQ ID NO: 1737463 - RNA, 14 nt, Homo sapiens
caguuccauuucau

SEQ ID NO: 1737464 - RNA, 14 nt, Homo sapiens
caguuuguggcauc

SEQ ID NO: 1737465 - RNA, 21 nt, Homo sapiens
cauaaagccuuggauguauau

SEQ ID NO: 1737466 - RNA, 17 nt, Homo sapiens
cauaacugaacauccaa

SEQ ID NO: 1737467 - RNA, 16 nt, Homo sapiens
cauacaacagaaacca

SEQ ID NO: 1737468 - RNA, 13 nt, Homo sapiens
cauaggucugaaa

SEQ ID NO: 1737469 - RNA, 23 nt, Homo sapiens
cauauacugccauguacuaguuu

SEQ ID NO: 1737470 - RNA, 15 nt, Homo sapiens
cauauucuaaaacca

SEQ ID NO: 1737471 - RNA, 13 nt, Homo sapiens
caucaaguucucc

SEQ ID NO: 1737472 - RNA, 13 nt, Homo sapiens
caucacaguuuug

SEQ ID NO: 1737473 - RNA, 18 nt, Homo sapiens
caucaguauugaagcauu

SEQ ID NO: 1737474 - RNA, 13 nt, Homo sapiens
cauccagugacaa

SEQ ID NO: 1737475 - RNA, 16 nt, Homo sapiens
cauccauaacugaaca

SEQ ID NO: 1737476 - RNA, 11 nt, Homo sapiens
caucucugcaa

SEQ ID NO: 1737477 - RNA, 16 nt, Homo sapiens
caucuguaaaauggag

SEQ ID NO: 1737478 - RNA, 16 nt, Homo sapiens
caugaauaucaguuau

SEQ ID NO: 1737479 - RNA, 19 nt, Homo sapiens
caugaggacucuauucuuu

SEQ ID NO: 1737480 - RNA, 17 nt, Homo sapiens
cauggaaagacugggac

SEQ ID NO: 1737481 - RNA, 12 nt, Homo sapiens
cauggaugccaa

SEQ ID NO: 1737482 - RNA, 19 nt, Homo sapiens
aaaucacgaccacugauag

SEQ ID NO: 1737483 - RNA, 22 nt, Homo sapiens
aaaucucaaugaagccagcuca

SEQ ID NO: 1737484 - RNA, 17 nt, Homo sapiens
aaaugggaaaaccagac

SEQ ID NO: 1737485 - RNA, 18 nt, Homo sapiens
aaaugggaaaaccagacu

SEQ ID NO: 1737486 - RNA, 22 nt, Homo sapiens
aacaagguggugugaucuuaau

SEQ ID NO: 1737487 - RNA, 13 nt, Homo sapiens
aacagcaaaucac

SEQ ID NO: 1737488 - RNA, 12 nt, Homo sapiens
aacauaaagccu

SEQ ID NO: 1737489 - RNA, 13 nt, Homo sapiens
aacauaaagccuu

SEQ ID NO: 1737490 - RNA, 17 nt, Homo sapiens
aaccacacaaagacauu

SEQ ID NO: 1737491 - RNA, 21 nt, Homo sapiens
aaccagagccugaguguugcc

SEQ ID NO: 1737492 - RNA, 15 nt, Homo sapiens
aaccagcccaaccau

SEQ ID NO: 1737493 - RNA, 11 nt, Homo sapiens
aacccaaagug

SEQ ID NO: 1737494 - RNA, 22 nt, Homo sapiens
aacccggccugauuaaaguuaa

SEQ ID NO: 1737495 - RNA, 15 nt, Homo sapiens
aaccucauuaucagu

SEQ ID NO: 1737496 - RNA, 20 nt, Homo sapiens
aaccuccaccuucuggguuc

SEQ ID NO: 1737497 - RNA, 12 nt, Homo sapiens
aaccugccuccc

SEQ ID NO: 1737498 - RNA, 16 nt, Homo sapiens
aacuacauuuugcaac

SEQ ID NO: 1737499 - RNA, 14 nt, Homo sapiens
aacucagugugacu

SEQ ID NO: 1737500 - RNA, 19 nt, Homo sapiens
aacucagugugacuccuca

SEQ ID NO: 1737501 - RNA, 18 nt, Homo sapiens
aacucauugcaaccucca

SEQ ID NO: 1737502 - RNA, 17 nt, Homo sapiens
aacugaaaacaagccau

SEQ ID NO: 1737503 - RNA, 14 nt, Homo sapiens
aacugaacauccaa

SEQ ID NO: 1737504 - RNA, 23 nt, Homo sapiens
aacuggucagggcaaaccugccu

SEQ ID NO: 1737505 - RNA, 13 nt, Homo sapiens
aacuguacagugu

SEQ ID NO: 1737506 - RNA, 17 nt, Homo sapiens
aacuguacagugucuuu

SEQ ID NO: 1737507 - RNA, 22 nt, Homo sapiens
aacuguuauuuauaaucacuuu

SEQ ID NO: 1737508 - RNA, 18 nt, Homo sapiens
aacuuguauuaaagacag

SEQ ID NO: 1737509 - RNA, 21 nt, Homo sapiens
aacuuuuccuuucauacgucu

SEQ ID NO: 1737510 - RNA, 19 nt, Homo sapiens
aagaaacuucggggcugca

SEQ ID NO: 1737511 - RNA, 19 nt, Homo sapiens
aagaccugagaauguaucc

SEQ ID NO: 1737512 - RNA, 21 nt, Homo sapiens
aagacgauuugucaguuauuu

SEQ ID NO: 1737513 - RNA, 16 nt, Homo sapiens
aagagaagcauucuca

SEQ ID NO: 1737514 - RNA, 17 nt, Homo sapiens
aagagagucgcaucuca

SEQ ID NO: 1737515 - RNA, 23 nt, Homo sapiens
aagagagucgcaucucagugcag

SEQ ID NO: 1737516 - RNA, 15 nt, Homo sapiens
aagagcuugcuccag

SEQ ID NO: 1737517 - RNA, 16 nt, Homo sapiens
aagcaauacuguuucc

SEQ ID NO: 1737518 - RNA, 15 nt, Homo sapiens
aagcacaaguacuuu

SEQ ID NO: 1737519 - RNA, 19 nt, Homo sapiens
aagcaccaccaaacacagu

SEQ ID NO: 1737520 - RNA, 16 nt, Homo sapiens
aagcagcaacagcaaa

SEQ ID NO: 1737521 - RNA, 23 nt, Homo sapiens
aagcauuuuauaaaucgcuuuug

SEQ ID NO: 1737522 - RNA, 17 nt, Homo sapiens
aagcugccgguucuuaa

SEQ ID NO: 1737523 - RNA, 21 nt, Homo sapiens
aagcugugcccugaccacccu

SEQ ID NO: 1737524 - RNA, 13 nt, Homo sapiens
aaggaagguucug

SEQ ID NO: 1737525 - RNA, 23 nt, Homo sapiens
aaggaagguucuggugugaacua

SEQ ID NO: 1737526 - RNA, 13 nt, Homo sapiens
aaggacugugaca

SEQ ID NO: 1737527 - RNA, 17 nt, Homo sapiens
aaggauuuuaccaaagc

SEQ ID NO: 1737528 - RNA, 18 nt, Homo sapiens
aaggauuuuaccaaagca

SEQ ID NO: 1737529 - RNA, 19 nt, Homo sapiens
aaggauuuuaccaaagcau

SEQ ID NO: 1737530 - RNA, 22 nt, Homo sapiens
aaggauuuuaccaaagcaucaa

SEQ ID NO: 1737531 - RNA, 13 nt, Homo sapiens
aagucucugugaa

SEQ ID NO: 1737532 - RNA, 21 nt, Homo sapiens
aagucuguuuuaugacuucau

SEQ ID NO: 1737533 - RNA, 23 nt, Homo sapiens
aagucuucucccguccauuccag

SEQ ID NO: 1737534 - RNA, 13 nt, Homo sapiens
aagugaaacugcu

SEQ ID NO: 1737535 - RNA, 15 nt, Homo sapiens
aagugcugggaauua

SEQ ID NO: 1737536 - RNA, 20 nt, Homo sapiens
aaguguuuguuggcaauuau

SEQ ID NO: 1737537 - RNA, 12 nt, Homo sapiens
aaguugcagcug

SEQ ID NO: 1737538 - RNA, 23 nt, Homo sapiens
aaguugcagcuguuuuguugaca

SEQ ID NO: 1737539 - RNA, 18 nt, Homo sapiens
aauaacaaaugccaaauu

SEQ ID NO: 1737540 - RNA, 17 nt, Homo sapiens
aauaaucauucuggaua

SEQ ID NO: 1737541 - RNA, 13 nt, Homo sapiens
aauacaaccagcc

SEQ ID NO: 1737542 - RNA, 16 nt, Homo sapiens
aauaugggcacuuuaa

SEQ ID NO: 1737543 - RNA, 23 nt, Homo sapiens
aaucccauuucccaaaccuaaaa

SEQ ID NO: 1737544 - RNA, 17 nt, Homo sapiens
aaucugaaucagccagu

SEQ ID NO: 1737545 - RNA, 16 nt, Homo sapiens
aaugucuuccuggauu

SEQ ID NO: 1737546 - RNA, 23 nt, Homo sapiens
aaugugauuacugcucuauucca

SEQ ID NO: 1737547 - RNA, 20 nt, Homo sapiens
aauguggagcagcagccacu

SEQ ID NO: 1737548 - RNA, 23 nt, Homo sapiens
aauuaauugggccagcuuuucaa

SEQ ID NO: 1737549 - RNA, 21 nt, Homo sapiens
aauuacaggcgugagccacca

SEQ ID NO: 1737550 - RNA, 14 nt, Homo sapiens
aauuauuacagugu

SEQ ID NO: 1737551 - RNA, 18 nt, Homo sapiens
aauucccuggccuuucau

SEQ ID NO: 1737552 - RNA, 18 nt, Homo sapiens
aauugcuagucaggguga

SEQ ID NO: 1737553 - RNA, 17 nt, Homo sapiens
aauuguuguucuguuaa

SEQ ID NO: 1737554 - RNA, 19 nt, Homo sapiens
aauuuaaucuuccauggau

SEQ ID NO: 1737555 - RNA, 17 nt, Homo sapiens
aauuucagaaccaaaag

SEQ ID NO: 1737556 - RNA, 19 nt, Homo sapiens
acaaaauagacaauuugca

SEQ ID NO: 1737557 - RNA, 19 nt, Homo sapiens
acaaacucauucauuaguc

SEQ ID NO: 1737558 - RNA, 14 nt, Homo sapiens
acaacaucgcaaua

SEQ ID NO: 1737559 - RNA, 17 nt, Homo sapiens
acaauaugggcacuuua

SEQ ID NO: 1737560 - RNA, 18 nt, Homo sapiens
acacaaagacauugauuc

SEQ ID NO: 1737561 - RNA, 20 nt, Homo sapiens
acacacuaccgaaugugucu

SEQ ID NO: 1737562 - RNA, 16 nt, Homo sapiens
acacauuuacccuuug

SEQ ID NO: 1737563 - RNA, 21 nt, Homo sapiens
acaccauaggucaccuuuauu

SEQ ID NO: 1737564 - RNA, 18 nt, Homo sapiens
acacugcugcuccagugc

SEQ ID NO: 1737565 - RNA, 21 nt, Homo sapiens
acacugcugcuccagugcagg

SEQ ID NO: 1737566 - RNA, 22 nt, Homo sapiens
acacugcugcuccagugcagga

SEQ ID NO: 1737567 - RNA, 19 nt, Homo sapiens
acacugggugcgucuccag

SEQ ID NO: 1737568 - RNA, 20 nt, Homo sapiens
acagaaaccagaaaagcaau

SEQ ID NO: 1737569 - RNA, 14 nt, Homo sapiens
acagauuccuggca

SEQ ID NO: 1737570 - RNA, 22 nt, Homo sapiens
acagcaugggccucaccuccuc

SEQ ID NO: 1737571 - RNA, 17 nt, Homo sapiens
acagccacuaaaacaca

SEQ ID NO: 1737572 - RNA, 19 nt, Homo sapiens
acagccaggcggcuggaau

SEQ ID NO: 1737573 - RNA, 13 nt, Homo sapiens
acagggcauucaa

SEQ ID NO: 1737574 - RNA, 21 nt, Homo sapiens
acagucuacauugagcauuug

SEQ ID NO: 1737575 - RNA, 15 nt, Homo sapiens
acaguuccugagacc

SEQ ID NO: 1737576 - RNA, 23 nt, Homo sapiens
acauacauugauucaugucucac

SEQ ID NO: 1737577 - RNA, 18 nt, Homo sapiens
acauagagugaucuuucc

SEQ ID NO: 1737578 - RNA, 22 nt, Homo sapiens
acauaguagguacccaauucaa

SEQ ID NO: 1737579 - RNA, 17 nt, Homo sapiens
acaucagcaauuucaga

SEQ ID NO: 1737580 - RNA, 14 nt, Homo sapiens
acaucagucuccaa

SEQ ID NO: 1737581 - RNA, 15 nt, Homo sapiens
acauccauguuccga

SEQ ID NO: 1737582 - RNA, 17 nt, Homo sapiens
acaugcccuguguggcu

SEQ ID NO: 1737583 - RNA, 19 nt, Homo sapiens
acauuaugaugugugaaaa

SEQ ID NO: 1737584 - RNA, 23 nt, Homo sapiens
acauuaugaugugugaaaacugg

SEQ ID NO: 1737585 - RNA, 18 nt, Homo sapiens
acauugauucaugucuca

SEQ ID NO: 1737586 - RNA, 13 nt, Homo sapiens
acauuucaccaug

SEQ ID NO: 1737587 - RNA, 20 nt, Homo sapiens
accaaagacaucagucucca

SEQ ID NO: 1737588 - RNA, 13 nt, Homo sapiens
accaauuccucau

SEQ ID NO: 1737589 - RNA, 23 nt, Homo sapiens
accaauuugguaaaaaugcugcu

SEQ ID NO: 1737590 - RNA, 18 nt, Homo sapiens
accaccgucugucucaga

SEQ ID NO: 1737591 - RNA, 16 nt, Homo sapiens
accagaaaagcaauac

SEQ ID NO: 1737592 - RNA, 17 nt, Homo sapiens
accagaaaagcaauacu

SEQ ID NO: 1737593 - RNA, 15 nt, Homo sapiens
accagaaacaccccu

SEQ ID NO: 1737594 - RNA, 17 nt, Homo sapiens
accagcacggugacucu

SEQ ID NO: 1737595 - RNA, 17 nt, Homo sapiens
accagccguauuuuaca

SEQ ID NO: 1737596 - RNA, 20 nt, Homo sapiens
accagccguauuuuacauga

SEQ ID NO: 1737597 - RNA, 18 nt, Homo sapiens
accauuuuugaaaccaaa

SEQ ID NO: 1737598 - RNA, 12 nt, Homo sapiens
acccacccagga

SEQ ID NO: 1737599 - RNA, 18 nt, Homo sapiens
acccauucuacacagagc

SEQ ID NO: 1737600 - RNA, 20 nt, Homo sapiens
acccccacccccagcucaau

SEQ ID NO: 1737601 - RNA, 14 nt, Homo sapiens
acccccagcucaau

SEQ ID NO: 1737602 - RNA, 17 nt, Homo sapiens
accccgcugauggagcc

SEQ ID NO: 1737603 - RNA, 20 nt, Homo sapiens
accccggaagccaaaccucu

SEQ ID NO: 1737604 - RNA, 17 nt, Homo sapiens
acccgccgccucccacg

SEQ ID NO: 1737605 - RNA, 14 nt, Homo sapiens
acccucauacacag

SEQ ID NO: 1737606 - RNA, 17 nt, Homo sapiens
acccugccccuugccau

SEQ ID NO: 1737607 - RNA, 21 nt, Homo sapiens
acccuguccggcccagugcca

SEQ ID NO: 1737608 - RNA, 22 nt, Homo sapiens
acccuguccggcccagugccac

SEQ ID NO: 1737609 - RNA, 19 nt, Homo sapiens
accuaagucucugugaauu

SEQ ID NO: 1737610 - RNA, 22 nt, Homo sapiens
accucauggggguauuguauaa

SEQ ID NO: 1737611 - RNA, 13 nt, Homo sapiens
accuugucugcua

SEQ ID NO: 1737612 - RNA, 20 nt, Homo sapiens
accuuuccauuuauucuuug

SEQ ID NO: 1737613 - RNA, 14 nt, Homo sapiens
acgcuugugacagu

SEQ ID NO: 1737614 - RNA, 12 nt, Homo sapiens
acggccacaguc

SEQ ID NO: 1737615 - RNA, 16 nt, Homo sapiens
acgguggucacuggaa

SEQ ID NO: 1737616 - RNA, 20 nt, Homo sapiens
acgugacuggccugcuggau

SEQ ID NO: 1737617 - RNA, 23 nt, Homo sapiens
acguuuguccuuuuucacuuuga

SEQ ID NO: 1737618 - RNA, 21 nt, Homo sapiens
acuauuuaaagccuccucauc

SEQ ID NO: 1737619 - RNA, 19 nt, Homo sapiens
acucaacccauuguuguca

SEQ ID NO: 1737620 - RNA, 15 nt, Homo sapiens
acucauccauccagg

SEQ ID NO: 1737621 - RNA, 12 nt, Homo sapiens
acucauugcaac

SEQ ID NO: 1737622 - RNA, 17 nt, Homo sapiens
acucuacucaacccauu

SEQ ID NO: 1737623 - RNA, 17 nt, Homo sapiens
acugaaaacaagccaug

SEQ ID NO: 1737624 - RNA, 15 nt, Homo sapiens
acugauagaugucua

SEQ ID NO: 1737625 - RNA, 18 nt, Homo sapiens
acuggaacucagugugac

SEQ ID NO: 1737626 - RNA, 16 nt, Homo sapiens
acugggacagcccagg

SEQ ID NO: 1737627 - RNA, 22 nt, Homo sapiens
acugggacagcccaggaaacaa

SEQ ID NO: 1737628 - RNA, 18 nt, Homo sapiens
acugggcugggccucgug

SEQ ID NO: 1737629 - RNA, 20 nt, Homo sapiens
acugucaguguacacgucug

SEQ ID NO: 1737630 - RNA, 13 nt, Homo sapiens
acuguuugucuca

SEQ ID NO: 1737631 - RNA, 22 nt, Homo sapiens
acuguuugucucaccuacccau

SEQ ID NO: 1737632 - RNA, 12 nt, Homo sapiens
acuuagugacaa

SEQ ID NO: 1737633 - RNA, 12 nt, Homo sapiens
acuucauucucg

SEQ ID NO: 1737634 - RNA, 19 nt, Homo sapiens
acuucauucucgugaguca

SEQ ID NO: 1737635 - RNA, 17 nt, Homo sapiens
acuugucaggagugugu

SEQ ID NO: 1737636 - RNA, 14 nt, Homo sapiens
acuuuaacacagug

SEQ ID NO: 1737637 - RNA, 14 nt, Homo sapiens
acuuugcaucucag

SEQ ID NO: 1737638 - RNA, 14 nt, Homo sapiens
acuuuuauuuccag

SEQ ID NO: 1737639 - RNA, 17 nt, Homo sapiens
agaaaagcaauacuguu

SEQ ID NO: 1737640 - RNA, 22 nt, Homo sapiens
agaaaauuggaacucuacucaa

SEQ ID NO: 1737641 - RNA, 23 nt, Homo sapiens
agaaacaccccucugucuaggac

SEQ ID NO: 1737642 - RNA, 19 nt, Homo sapiens
agaaaccagaaaagcaaua

SEQ ID NO: 1737643 - RNA, 19 nt, Homo sapiens
agaaaucuuucucccucaa

SEQ ID NO: 1737644 - RNA, 16 nt, Homo sapiens
agaaauuaaguaucug

SEQ ID NO: 1737645 - RNA, 18 nt, Homo sapiens
agaacacauaauucagga

SEQ ID NO: 1737646 - RNA, 15 nt, Homo sapiens
agaagacaaacuuug

SEQ ID NO: 1737647 - RNA, 22 nt, Homo sapiens
agaagacaaacuuugcaucuca

SEQ ID NO: 1737648 - RNA, 16 nt, Homo sapiens
agaagcaagaaacuuc

SEQ ID NO: 1737649 - RNA, 13 nt, Homo sapiens
agaagcagcucuu

SEQ ID NO: 1737650 - RNA, 18 nt, Homo sapiens
agaaggcaguaguuuuca

SEQ ID NO: 1737651 - RNA, 23 nt, Homo sapiens
agaaggccacuguuugucucacc

SEQ ID NO: 1737652 - RNA, 22 nt, Homo sapiens
agaauaaauucccaacuucucu

SEQ ID NO: 1737653 - RNA, 24 nt, Homo sapiens
agacaagugacuguaucuguguag

SEQ ID NO: 1737654 - RNA, 16 nt, Homo sapiens
agaccucugugcacuu

SEQ ID NO: 1737655 - RNA, 17 nt, Homo sapiens
agacgaaauagugacau

SEQ ID NO: 1737656 - RNA, 18 nt, Homo sapiens
agacgggguuugccaugc

SEQ ID NO: 1737657 - RNA, 23 nt, Homo sapiens
agacucuuuuuuugagugacagc

SEQ ID NO: 1737658 - RNA, 14 nt, Homo sapiens
agacuuuacaugga

SEQ ID NO: 1737659 - RNA, 20 nt, Homo sapiens
agacuuuacauggaugccaa

SEQ ID NO: 1737660 - RNA, 16 nt, Homo sapiens
agacuuuccauuacaa

SEQ ID NO: 1737661 - RNA, 14 nt, Homo sapiens
agagaagcauucuc

SEQ ID NO: 1737662 - RNA, 20 nt, Homo sapiens
agagacgggguuugccaugc

SEQ ID NO: 1737663 - RNA, 20 nt, Homo sapiens
agagacuugggacauugccu

SEQ ID NO: 1737664 - RNA, 19 nt, Homo sapiens
agagagguuugcaguccca

SEQ ID NO: 1737665 - RNA, 22 nt, Homo sapiens
agagaucuuucuuuccaaaaca

SEQ ID NO: 1737666 - RNA, 16 nt, Homo sapiens
agagcaggacugcaca

SEQ ID NO: 1737667 - RNA, 19 nt, Homo sapiens
agagccagcagcaaaaacu

SEQ ID NO: 1737668 - RNA, 17 nt, Homo sapiens
agagccuggugcugcug

SEQ ID NO: 1737669 - RNA, 21 nt, Homo sapiens
agagucgcaucucagugcagg

SEQ ID NO: 1737670 - RNA, 21 nt, Homo sapiens
agaguuucaaaagcaaaacau

SEQ ID NO: 1737671 - RNA, 14 nt, Homo sapiens
agaugacaaccucc

SEQ ID NO: 1737672 - RNA, 15 nt, Homo sapiens
agaugccacauucaa

SEQ ID NO: 1737673 - RNA, 20 nt, Homo sapiens
agaugcugguuuucuaccca

SEQ ID NO: 1737674 - RNA, 12 nt, Homo sapiens
agauuacccaaa

SEQ ID NO: 1737675 - RNA, 14 nt, Homo sapiens
agauucuguuaacu

SEQ ID NO: 1737676 - RNA, 15 nt, Homo sapiens
agcaaaucacgacca

SEQ ID NO: 1737677 - RNA, 15 nt, Homo sapiens
agcaauaacauuccc

SEQ ID NO: 1737678 - RNA, 9 nt, Homo sapiens
agcaauacu

SEQ ID NO: 1737679 - RNA, 16 nt, Homo sapiens
agcaauacuguuucca

SEQ ID NO: 1737680 - RNA, 14 nt, Homo sapiens
agcacacacuuuug

SEQ ID NO: 1737681 - RNA, 14 nt, Homo sapiens
agcacccauuccaa

SEQ ID NO: 1737682 - RNA, 20 nt, Homo sapiens
agcacggugacucuguccag

SEQ ID NO: 1737683 - RNA, 17 nt, Homo sapiens
agcagagacuugggaca

SEQ ID NO: 1737684 - RNA, 15 nt, Homo sapiens
agcaggacugcacag

SEQ ID NO: 1737685 - RNA, 19 nt, Homo sapiens
agcaucaauacaaccagcc

SEQ ID NO: 1737686 - RNA, 15 nt, Homo sapiens
agcaucacaguuuug

SEQ ID NO: 1737687 - RNA, 16 nt, Homo sapiens
agcauguuuagacuuu

SEQ ID NO: 1737688 - RNA, 23 nt, Homo sapiens
agccaaccugggggcuuuaggga

SEQ ID NO: 1737689 - RNA, 15 nt, Homo sapiens
agccaccaaacccgg

SEQ ID NO: 1737690 - RNA, 20 nt, Homo sapiens
agccaucccuuuuuuuacau

SEQ ID NO: 1737691 - RNA, 21 nt, Homo sapiens
agccauguaucaauauucacu

SEQ ID NO: 1737692 - RNA, 18 nt, Homo sapiens
agcccauccagucuccca

SEQ ID NO: 1737693 - RNA, 13 nt, Homo sapiens
agcccgucucagu

SEQ ID NO: 1737694 - RNA, 16 nt, Homo sapiens
agcccuggcugaagga

SEQ ID NO: 1737695 - RNA, 21 nt, Homo sapiens
agccugcucauguaccucuga

SEQ ID NO: 1737696 - RNA, 19 nt, Homo sapiens
agcuccaaaugcagcuuua

SEQ ID NO: 1737697 - RNA, 16 nt, Homo sapiens
agcugugcccugacca

SEQ ID NO: 1737698 - RNA, 22 nt, Homo sapiens
agcuugaaauagugucugauga

SEQ ID NO: 1737699 - RNA, 14 nt, Homo sapiens
agcuuggaccccuu

SEQ ID NO: 1737700 - RNA, 22 nt, Homo sapiens
aggaaacuggguuccugcaaug

SEQ ID NO: 1737701 - RNA, 19 nt, Homo sapiens
aggaagagccaggugcugc

SEQ ID NO: 1737702 - RNA, 15 nt, Homo sapiens
aggaauacugaacau

SEQ ID NO: 1737703 - RNA, 20 nt, Homo sapiens
aggacguguuacccacugcc

SEQ ID NO: 1737704 - RNA, 20 nt, Homo sapiens
aggagaccuggcacuggaug

SEQ ID NO: 1737705 - RNA, 14 nt, Homo sapiens
aggauuuuaccaaa

SEQ ID NO: 1737706 - RNA, 12 nt, Homo sapiens
aggcagcucaag

SEQ ID NO: 1737707 - RNA, 15 nt, Homo sapiens
aggcaguuccauuuc

SEQ ID NO: 1737708 - RNA, 16 nt, Homo sapiens
aggcauuaacacaaag

SEQ ID NO: 1737709 - RNA, 22 nt, Homo sapiens
aggccacacuucaaacuacuuu

SEQ ID NO: 1737710 - RNA, 18 nt, Homo sapiens
aggccacuguuugucuca

SEQ ID NO: 1737711 - RNA, 21 nt, Homo sapiens
aggccauugggauauucugaa

SEQ ID NO: 1737712 - RNA, 15 nt, Homo sapiens
aggcccgcucuacau

SEQ ID NO: 1737713 - RNA, 15 nt, Homo sapiens
aggcugggcagcaca

SEQ ID NO: 1737714 - RNA, 23 nt, Homo sapiens
aggcuggucucgaacugcuggau

SEQ ID NO: 1737715 - RNA, 19 nt, Homo sapiens
agggaaaggauggggacca

SEQ ID NO: 1737716 - RNA, 21 nt, Homo sapiens
agggaccacacccuguacugu

SEQ ID NO: 1737717 - RNA, 13 nt, Homo sapiens
agggccccggggc

SEQ ID NO: 1737718 - RNA, 18 nt, Homo sapiens
aggggagggcaggcuugg

SEQ ID NO: 1737719 - RNA, 14 nt, Homo sapiens
aggggcuggcacug

SEQ ID NO: 1737720 - RNA, 19 nt, Homo sapiens
aggugcguguucagcagaa

SEQ ID NO: 1737721 - RNA, 19 nt, Homo sapiens
aggugucuuaauacugucc

SEQ ID NO: 1737722 - RNA, 18 nt, Homo sapiens
agguuuuuaagccuuaaa

SEQ ID NO: 1737723 - RNA, 19 nt, Homo sapiens
aguaaucccauuucccaaa

SEQ ID NO: 1737724 - RNA, 19 nt, Homo sapiens
aguaguuuucaaaacacau

SEQ ID NO: 1737725 - RNA, 13 nt, Homo sapiens
aguaugugcauau

SEQ ID NO: 1737726 - RNA, 17 nt, Homo sapiens
agucacaucucuuccuc

SEQ ID NO: 1737727 - RNA, 18 nt, Homo sapiens
agucacuaguuguaauuu

SEQ ID NO: 1737728 - RNA, 20 nt, Homo sapiens
aguccaauuccuugcacaua

SEQ ID NO: 1737729 - RNA, 20 nt, Homo sapiens
aguccccucaccuccucuaa

SEQ ID NO: 1737730 - RNA, 15 nt, Homo sapiens
agucucugugaauug

SEQ ID NO: 1737731 - RNA, 17 nt, Homo sapiens
agucuguuuuaugacuu

SEQ ID NO: 1737732 - RNA, 22 nt, Homo sapiens
agugaaauaauagaaugagcac

SEQ ID NO: 1737733 - RNA, 19 nt, Homo sapiens
agugacauaauauauucua

SEQ ID NO: 1737734 - RNA, 21 nt, Homo sapiens
agugaggcugcacccacccag

SEQ ID NO: 1737735 - RNA, 18 nt, Homo sapiens
agugcaggagagacagug

SEQ ID NO: 1737736 - RNA, 23 nt, Homo sapiens
agugcagggaggaaaagugcaag

SEQ ID NO: 1737737 - RNA, 18 nt, Homo sapiens
agugccacccaugcagcu

SEQ ID NO: 1737738 - RNA, 14 nt, Homo sapiens
aguggcauguauga

SEQ ID NO: 1737739 - RNA, 17 nt, Homo sapiens
aguggggcccauggaug

SEQ ID NO: 1737740 - RNA, 15 nt, Homo sapiens
agugugacucauuaa

SEQ ID NO: 1737741 - RNA, 13 nt, Homo sapiens
agugugagugugc

SEQ ID NO: 1737742 - RNA, 17 nt, Homo sapiens
aguucagugcucauacg

SEQ ID NO: 1737743 - RNA, 21 nt, Homo sapiens
aguucugguugauucacucaa

SEQ ID NO: 1737744 - RNA, 19 nt, Homo sapiens
aguuucaaaagcaaaacau

SEQ ID NO: 1737745 - RNA, 13 nt, Homo sapiens
aguuugagacagg

SEQ ID NO: 1737746 - RNA, 19 nt, Homo sapiens
aguuuguggcaucuugcca

SEQ ID NO: 1737747 - RNA, 15 nt, Homo sapiens
aguuuucaaaacaca

SEQ ID NO: 1737748 - RNA, 13 nt, Homo sapiens
aguuuuucccaag

SEQ ID NO: 1737749 - RNA, 20 nt, Homo sapiens
auaaaaauaaaucaguucau

SEQ ID NO: 1737750 - RNA, 22 nt, Homo sapiens
auaaaucgcuuuugauaaucaa

SEQ ID NO: 1737751 - RNA, 12 nt, Homo sapiens
auaaauucccaa

SEQ ID NO: 1737752 - RNA, 13 nt, Homo sapiens
auaaucacuuuuu

SEQ ID NO: 1737753 - RNA, 17 nt, Homo sapiens
auaauuacauauuugca

SEQ ID NO: 1737754 - RNA, 12 nt, Homo sapiens
auacaaccagcc

SEQ ID NO: 1737755 - RNA, 21 nt, Homo sapiens
auacauugauucaugucucac

SEQ ID NO: 1737756 - RNA, 22 nt, Homo sapiens
auaccaaccugaagacaccguu

SEQ ID NO: 1737757 - RNA, 22 nt, Homo sapiens
auacuauuuaaagccuccucau

SEQ ID NO: 1737758 - RNA, 13 nt, Homo sapiens
auacuguuuccau

SEQ ID NO: 1737759 - RNA, 15 nt, Homo sapiens
auagacaauuugcac

SEQ ID NO: 1737760 - RNA, 18 nt, Homo sapiens
auaggcauuaacacaaag

SEQ ID NO: 1737761 - RNA, 17 nt, Homo sapiens
auaguuuuuuacuucuc

SEQ ID NO: 1737762 - RNA, 19 nt, Homo sapiens
auauacagcaggugcucaa

SEQ ID NO: 1737763 - RNA, 14 nt, Homo sapiens
auauuuaacaugua

SEQ ID NO: 1737764 - RNA, 16 nt, Homo sapiens
aucaaagaaauucaga

SEQ ID NO: 1737765 - RNA, 12 nt, Homo sapiens
aucacgaccacu

SEQ ID NO: 1737766 - RNA, 13 nt, Homo sapiens
aucaguccaaagg

SEQ ID NO: 1737767 - RNA, 15 nt, Homo sapiens
aucaguuacucuuca

SEQ ID NO: 1737768 - RNA, 21 nt, Homo sapiens
aucaugguuuuucuuaguaga

SEQ ID NO: 1737769 - RNA, 19 nt, Homo sapiens
aucccucuccaacugccua

SEQ ID NO: 1737770 - RNA, 16 nt, Homo sapiens
aucccuuuuuuuacau

SEQ ID NO: 1737771 - RNA, 15 nt, Homo sapiens
aucucacaagcacuu

SEQ ID NO: 1737772 - RNA, 16 nt, Homo sapiens
aucucacaagcacuuu

SEQ ID NO: 1737773 - RNA, 17 nt, Homo sapiens
aucucauuuaauccucu

SEQ ID NO: 1737774 - RNA, 18 nt, Homo sapiens
aucucccagugacaacau

SEQ ID NO: 1737775 - RNA, 19 nt, Homo sapiens
aucuccgucucccaaagug

SEQ ID NO: 1737776 - RNA, 21 nt, Homo sapiens
aucuguaagagcuugcuccag

SEQ ID NO: 1737777 - RNA, 21 nt, Homo sapiens
aucuucagggaacugcauaga

SEQ ID NO: 1737778 - RNA, 23 nt, Homo sapiens
aucuuucuuuccaaaacauuucu

SEQ ID NO: 1737779 - RNA, 20 nt, Homo sapiens
aucuuuggacagaagcagcu

SEQ ID NO: 1737780 - RNA, 23 nt, Homo sapiens
aucuuuggacagaagcagcucuu

SEQ ID NO: 1737781 - RNA, 23 nt, Homo sapiens
augaaccugcccugcucccacag

SEQ ID NO: 1737782 - RNA, 12 nt, Homo sapiens
augaagccagcu

SEQ ID NO: 1737783 - RNA, 18 nt, Homo sapiens
augaagguggaacaagca

SEQ ID NO: 1737784 - RNA, 19 nt, Homo sapiens
augacaaccuccauucuau

SEQ ID NO: 1737785 - RNA, 16 nt, Homo sapiens
augagcgccaccucuu

SEQ ID NO: 1737786 - RNA, 15 nt, Homo sapiens
augaggucuguuuaa

SEQ ID NO: 1737787 - RNA, 18 nt, Homo sapiens
augauacuucgacacugu

SEQ ID NO: 1737788 - RNA, 20 nt, Homo sapiens
augaugaaaacuaaggauuu

SEQ ID NO: 1737789 - RNA, 14 nt, Homo sapiens
augauguauguuga

SEQ ID NO: 1737790 - RNA, 19 nt, Homo sapiens
augaugugugaaaacuggu

SEQ ID NO: 1737791 - RNA, 19 nt, Homo sapiens
augauucaaauugcugcuu

SEQ ID NO: 1737792 - RNA, 21 nt, Homo sapiens
augcaaauaacaaaugccaaa

SEQ ID NO: 1737793 - RNA, 16 nt, Homo sapiens
augcagcuuauacgaa

SEQ ID NO: 1737794 - RNA, 21 nt, Homo sapiens
augccaaccggucacccagga

SEQ ID NO: 1737795 - RNA, 11 nt, Homo sapiens
augcuggccag

SEQ ID NO: 1737796 - RNA, 17 nt, Homo sapiens
augcugugcaaauguua

SEQ ID NO: 1737797 - RNA, 19 nt, Homo sapiens
auggaaacagacucauacc

SEQ ID NO: 1737798 - RNA, 17 nt, Homo sapiens
auguacagggguaguuu

SEQ ID NO: 1737799 - RNA, 14 nt, Homo sapiens
auguauaugucauc

SEQ ID NO: 1737800 - RNA, 14 nt, Homo sapiens
augucacagauucc

SEQ ID NO: 1737801 - RNA, 15 nt, Homo sapiens
augucacagauuccu

SEQ ID NO: 1737802 - RNA, 16 nt, Homo sapiens
augugaaucaugguuu

SEQ ID NO: 1737803 - RNA, 17 nt, Homo sapiens
augugacaugcccaagg

SEQ ID NO: 1737804 - RNA, 14 nt, Homo sapiens
augugaugaucuac

SEQ ID NO: 1737805 - RNA, 13 nt, Homo sapiens
auguugaagccuu

SEQ ID NO: 1737806 - RNA, 14 nt, Homo sapiens
auuaaaugugucau

SEQ ID NO: 1737807 - RNA, 20 nt, Homo sapiens
auuaagaauugguugccaua

SEQ ID NO: 1737808 - RNA, 22 nt, Homo sapiens
auuaauuucuucccccaaagcc

SEQ ID NO: 1737809 - RNA, 20 nt, Homo sapiens
auuagucucagugaagacua

SEQ ID NO: 1737810 - RNA, 15 nt, Homo sapiens
auucaauuuauuuga

SEQ ID NO: 1737811 - RNA, 18 nt, Homo sapiens
auucagcaaaaaucuccc

SEQ ID NO: 1737812 - RNA, 17 nt, Homo sapiens
auucaggcaacgcacaa

SEQ ID NO: 1737813 - RNA, 20 nt, Homo sapiens
auuccagucaaaucugggcu

SEQ ID NO: 1737814 - RNA, 13 nt, Homo sapiens
auucccacugccg

SEQ ID NO: 1737815 - RNA, 22 nt, Homo sapiens
auucuaaggaauaugagcuuua

SEQ ID NO: 1737816 - RNA, 11 nt, Homo sapiens
auucuacucaa

SEQ ID NO: 1737817 - RNA, 14 nt, Homo sapiens
auucugaugcauac

SEQ ID NO: 1737818 - RNA, 17 nt, Homo sapiens
auucuuaauucucugca

SEQ ID NO: 1737819 - RNA, 20 nt, Homo sapiens
auucuuuuuuaauaaacuac

SEQ ID NO: 1737820 - RNA, 20 nt, Homo sapiens
auugagcaccugcaggcgug

SEQ ID NO: 1737821 - RNA, 20 nt, Homo sapiens
auugucagaugcugugcaaa

SEQ ID NO: 1737822 - RNA, 22 nt, Homo sapiens
auuguuguucuguuaacugaau

SEQ ID NO: 1737823 - RNA, 18 nt, Homo sapiens
auuuaaacaccuccucau

SEQ ID NO: 1737824 - RNA, 15 nt, Homo sapiens
auuuaauccucucaa

SEQ ID NO: 1737825 - RNA, 19 nt, Homo sapiens
auuucaggaggaauacuga

SEQ ID NO: 1737826 - RNA, 23 nt, Homo sapiens
auuucauacaacagaaaccagaa

SEQ ID NO: 1737827 - RNA, 23 nt, Homo sapiens
auuuccaagcacuuucaguccaa

SEQ ID NO: 1737828 - RNA, 24 nt, Homo sapiens
auuucuuucuuugcaccaaagaca

SEQ ID NO: 1737829 - RNA, 14 nt, Homo sapiens
auuugagacaggga

SEQ ID NO: 1737830 - RNA, 18 nt, Homo sapiens
auuuuaccaaagcaucaa

SEQ ID NO: 1737831 - RNA, 19 nt, Homo sapiens
auuuuagaacaguccagca

SEQ ID NO: 1737832 - RNA, 23 nt, Homo sapiens
auuuugacaaagugccucaugca

SEQ ID NO: 1737833 - RNA, 23 nt, Homo sapiens
auuuugguggguuuugaacauaa

SEQ ID NO: 1737834 - RNA, 17 nt, Homo sapiens
caaaacagaaaaugaag

SEQ ID NO: 1737835 - RNA, 18 nt, Homo sapiens
caaaauagacaauuugca

SEQ ID NO: 1737836 - RNA, 23 nt, Homo sapiens
caaacaaacgaaaaacauuucaa

SEQ ID NO: 1737837 - RNA, 14 nt, Homo sapiens
caaaccauuuccaa

SEQ ID NO: 1737838 - RNA, 18 nt, Homo sapiens
caaagacaucagucucca

SEQ ID NO: 1737839 - RNA, 21 nt, Homo sapiens
caaagcccuuauguuuaauca

SEQ ID NO: 1737840 - RNA, 14 nt, Homo sapiens
caaaguaucuaaca

SEQ ID NO: 1737841 - RNA, 11 nt, Homo sapiens
caaaguuggcg

SEQ ID NO: 1737842 - RNA, 17 nt, Homo sapiens
caaauauuauucuuaau

SEQ ID NO: 1737843 - RNA, 19 nt, Homo sapiens
caacaaaccauccagugac

SEQ ID NO: 1737844 - RNA, 14 nt, Homo sapiens
caacacugcugcuc

SEQ ID NO: 1737845 - RNA, 23 nt, Homo sapiens
caacacugcugcuccagugcagg

SEQ ID NO: 1737846 - RNA, 15 nt, Homo sapiens
caacagaaaccagaa

SEQ ID NO: 1737847 - RNA, 14 nt, Homo sapiens
caacagacaaguga

SEQ ID NO: 1737848 - RNA, 18 nt, Homo sapiens
caacagacuucugaaaua

SEQ ID NO: 1737849 - RNA, 15 nt, Homo sapiens
caagaaucagugcaa

SEQ ID NO: 1737850 - RNA, 16 nt, Homo sapiens
caagaaucagugcaaa

SEQ ID NO: 1737851 - RNA, 18 nt, Homo sapiens
caagaccucugugcacuu

SEQ ID NO: 1737852 - RNA, 22 nt, Homo sapiens
caagcagugccugccuaugaaa

SEQ ID NO: 1737853 - RNA, 14 nt, Homo sapiens
caaggccuugccug

SEQ ID NO: 1737854 - RNA, 18 nt, Homo sapiens
caagguggugugaucuua

SEQ ID NO: 1737855 - RNA, 14 nt, Homo sapiens
caagugugucuuac

SEQ ID NO: 1737856 - RNA, 15 nt, Homo sapiens
caauacuguuuccau

SEQ ID NO: 1737857 - RNA, 20 nt, Homo sapiens
caauacuguuuccauuuuaa

SEQ ID NO: 1737858 - RNA, 19 nt, Homo sapiens
caaucccaggauguacaag

SEQ ID NO: 1737859 - RNA, 20 nt, Homo sapiens
caaugcuuauacccagugag

SEQ ID NO: 1737860 - RNA, 19 nt, Homo sapiens
caauuaaaccgcaugugau

SEQ ID NO: 1737861 - RNA, 22 nt, Homo sapiens
caauuaaggauuuuaugcuuua

SEQ ID NO: 1737862 - RNA, 12 nt, Homo sapiens
cacaaaacagaa

SEQ ID NO: 1737863 - RNA, 20 nt, Homo sapiens
cacaauaugggcacuuuaaa

SEQ ID NO: 1737864 - RNA, 14 nt, Homo sapiens
cacaaugcugaaua

SEQ ID NO: 1737865 - RNA, 10 nt, Homo sapiens
cacacacaaa

SEQ ID NO: 1737866 - RNA, 22 nt, Homo sapiens
cacaccccagacgaugucuuca

SEQ ID NO: 1737867 - RNA, 17 nt, Homo sapiens
cacacugagcugagggg

SEQ ID NO: 1737868 - RNA, 22 nt, Homo sapiens
cacacugggugcgucuccaguc

SEQ ID NO: 1737869 - RNA, 14 nt, Homo sapiens
cacacugguacuua

SEQ ID NO: 1737870 - RNA, 21 nt, Homo sapiens
cacaguauugcucacccagug

SEQ ID NO: 1737871 - RNA, 16 nt, Homo sapiens
cacagugccacccaug

SEQ ID NO: 1737872 - RNA, 16 nt, Homo sapiens
cacaucagcaauuuca

SEQ ID NO: 1737873 - RNA, 15 nt, Homo sapiens
caccaaagacaucag

SEQ ID NO: 1737874 - RNA, 19 nt, Homo sapiens
caccacccuugccauggag

SEQ ID NO: 1737875 - RNA, 14 nt, Homo sapiens
cacccacccaggag

SEQ ID NO: 1737876 - RNA, 21 nt, Homo sapiens
cacccugccaagacuccucag

SEQ ID NO: 1737877 - RNA, 15 nt, Homo sapiens
caccuagacuguaaa

SEQ ID NO: 1737878 - RNA, 11 nt, Homo sapiens
caccuccucau

SEQ ID NO: 1737879 - RNA, 13 nt, Homo sapiens
caccuugucacau

SEQ ID NO: 1737880 - RNA, 16 nt, Homo sapiens
caccuugucugcuaaa

SEQ ID NO: 1737881 - RNA, 15 nt, Homo sapiens
cacgcccagcuaauu

SEQ ID NO: 1737882 - RNA, 18 nt, Homo sapiens
cacggcguuguaccugua

SEQ ID NO: 1737883 - RNA, 19 nt, Homo sapiens
cacgguuuggaaauauuca

SEQ ID NO: 1737884 - RNA, 15 nt, Homo sapiens
cacucaccccagcga

SEQ ID NO: 1737885 - RNA, 15 nt, Homo sapiens
cacugccugcuccca

SEQ ID NO: 1737886 - RNA, 14 nt, Homo sapiens
cacuguuugucuca

SEQ ID NO: 1737887 - RNA, 15 nt, Homo sapiens
cacuuacauuuacaa

SEQ ID NO: 1737888 - RNA, 19 nt, Homo sapiens
cacuuacauuuacaaacug

SEQ ID NO: 1737889 - RNA, 16 nt, Homo sapiens
cacuuugaggacauuu

SEQ ID NO: 1737890 - RNA, 20 nt, Homo sapiens
cagaaagugauaagugcagg

SEQ ID NO: 1737891 - RNA, 14 nt, Homo sapiens
cagaagacaaaaag

SEQ ID NO: 1737892 - RNA, 15 nt, Homo sapiens
cagacaagugacugu

SEQ ID NO: 1737893 - RNA, 21 nt, Homo sapiens
cagaugcugugcaaauguuau

SEQ ID NO: 1737894 - RNA, 14 nt, Homo sapiens
cagauggcacuuug

SEQ ID NO: 1737895 - RNA, 16 nt, Homo sapiens
cagauggcacuuugaa

SEQ ID NO: 1737896 - RNA, 22 nt, Homo sapiens
cagcaaaaaucucccagugaca

SEQ ID NO: 1737897 - RNA, 21 nt, Homo sapiens
cagcaacacagccacuaaaac

SEQ ID NO: 1737898 - RNA, 17 nt, Homo sapiens
cagcaacagcaaaucac

SEQ ID NO: 1737899 - RNA, 17 nt, Homo sapiens
cagcaauuucagaacca

SEQ ID NO: 1737900 - RNA, 14 nt, Homo sapiens
cagcauuuccacac

SEQ ID NO: 1737901 - RNA, 20 nt, Homo sapiens
cagccggcuaugaaagggag

SEQ ID NO: 1737902 - RNA, 13 nt, Homo sapiens
cagccguuuguuc

SEQ ID NO: 1737903 - RNA, 16 nt, Homo sapiens
cagcucccgcuguggc

SEQ ID NO: 1737904 - RNA, 18 nt, Homo sapiens
caggacacacauggugag

SEQ ID NO: 1737905 - RNA, 17 nt, Homo sapiens
caggagaccuggcacug

SEQ ID NO: 1737906 - RNA, 22 nt, Homo sapiens
caggagaccuggcacuggaugc

SEQ ID NO: 1737907 - RNA, 18 nt, Homo sapiens
caggaggaauacugaaca

SEQ ID NO: 1737908 - RNA, 20 nt, Homo sapiens
caggcaacgcacaaaacaga

SEQ ID NO: 1737909 - RNA, 13 nt, Homo sapiens
caggcagcucaag

SEQ ID NO: 1737910 - RNA, 12 nt, Homo sapiens
caggcccugugg

SEQ ID NO: 1737911 - RNA, 13 nt, Homo sapiens
caggcccuguggc

SEQ ID NO: 1737912 - RNA, 22 nt, Homo sapiens
caggccucuuggcagucacauc

SEQ ID NO: 1737913 - RNA, 19 nt, Homo sapiens
caggguugagguccagccc

SEQ ID NO: 1737914 - RNA, 17 nt, Homo sapiens
caguaugaaaaugucau

SEQ ID NO: 1737915 - RNA, 22 nt, Homo sapiens
caguccaaccagaaacaccccu

SEQ ID NO: 1737916 - RNA, 15 nt, Homo sapiens
cagugaacauuccca

SEQ ID NO: 1737917 - RNA, 13 nt, Homo sapiens
cagugcauaugca

SEQ ID NO: 1737918 - RNA, 12 nt, Homo sapiens
caguuaagccuu

SEQ ID NO: 1737919 - RNA, 20 nt, Homo sapiens
caguuauuuuuaaacuguaa

SEQ ID NO: 1737920 - RNA, 16 nt, Homo sapiens
caguucccacauuaaa

SEQ ID NO: 1737921 - RNA, 18 nt, Homo sapiens
caguuccugagaccagcc

SEQ ID NO: 1737922 - RNA, 20 nt, Homo sapiens
cauaaaaauaaaucaguuca

SEQ ID NO: 1737923 - RNA, 21 nt, Homo sapiens
cauaaaaauaaaucaguucau

SEQ ID NO: 1737924 - RNA, 18 nt, Homo sapiens
cauaaagccuuggaugua

SEQ ID NO: 1737925 - RNA, 17 nt, Homo sapiens
cauaaaguaugugcaua

SEQ ID NO: 1737926 - RNA, 20 nt, Homo sapiens
cauaauucaggaagcagcuu

SEQ ID NO: 1737927 - RNA, 15 nt, Homo sapiens
cauacacagaaacca

SEQ ID NO: 1737928 - RNA, 23 nt, Homo sapiens
cauacauugauucaugucucacg

SEQ ID NO: 1737929 - RNA, 23 nt, Homo sapiens
cauagaaaaauucagcaaaccau

SEQ ID NO: 1737930 - RNA, 14 nt, Homo sapiens
cauauguaugacuc

SEQ ID NO: 1737931 - RNA, 14 nt, Homo sapiens
cauauuguuauuau

SEQ ID NO: 1737932 - RNA, 14 nt, Homo sapiens
caucaauacaacca

SEQ ID NO: 1737933 - RNA, 18 nt, Homo sapiens
caucagucuccaacaugu

SEQ ID NO: 1737934 - RNA, 18 nt, Homo sapiens
caucaucaaaaacuuugg

SEQ ID NO: 1737935 - RNA, 19 nt, Homo sapiens
caucauuauuuauguauug

SEQ ID NO: 1737936 - RNA, 15 nt, Homo sapiens
cauccauaacugaac

SEQ ID NO: 1737937 - RNA, 24 nt, Homo sapiens
cauccauguuccgagaagaacaga

SEQ ID NO: 1737938 - RNA, 15 nt, Homo sapiens
caucccucuguucac

SEQ ID NO: 1737939 - RNA, 16 nt, Homo sapiens
caucccucuguucaca

SEQ ID NO: 1737940 - RNA, 22 nt, Homo sapiens
cauccuugucuuauucccuucc

SEQ ID NO: 1737941 - RNA, 15 nt, Homo sapiens
caucucagugcugua

SEQ ID NO: 1737942 - RNA, 18 nt, Homo sapiens
caucucagugcuguaaaa

SEQ ID NO: 1737943 - RNA, 12 nt, Homo sapiens
caugcccugugu

SEQ ID NO: 1737944 - RNA, 16 nt, Homo sapiens
caugcccuguguggcu

SEQ ID NO: 1737945 - RNA, 16 nt, Homo sapiens
cauguauuuguuugca

SEQ ID NO: 1737946 - RNA, 16 nt, Homo sapiens
cauguuguacauuuca

SEQ ID NO: 1737947 - RNA, 16 nt, Homo sapiens
cauucuagguuugcaa

SEQ ID NO: 1737948 - RNA, 12 nt, Homo sapiens
cauugagcauuu

SEQ ID NO: 1737949 - RNA, 16 nt, Homo sapiens
cauuuaauccucucaa

SEQ ID NO: 1737950 - RNA, 18 nt, Homo sapiens
cauuucauacaacagaaa

SEQ ID NO: 1737951 - RNA, 13 nt, Homo sapiens
ccaaaacauuucu

SEQ ID NO: 1737952 - RNA, 16 nt, Homo sapiens
ccaaaugcagcuuuaa

SEQ ID NO: 1737953 - RNA, 11 nt, Homo sapiens
ccaagacauuc

SEQ ID NO: 1737954 - RNA, 22 nt, Homo sapiens
ccaagcaccaccaaacacagug

SEQ ID NO: 1737955 - RNA, 18 nt, Homo sapiens
ccaagcaggaaccccagg

SEQ ID NO: 1737956 - RNA, 23 nt, Homo sapiens
ccaagcugugcccugaccacccu

SEQ ID NO: 1737957 - RNA, 11 nt, Homo sapiens
ccaauuccuca

SEQ ID NO: 1737958 - RNA, 15 nt, Homo sapiens
ccacacccagcucag

SEQ ID NO: 1737959 - RNA, 23 nt, Homo sapiens
ccacagaacacagcaauuccuca

SEQ ID NO: 1737960 - RNA, 17 nt, Homo sapiens
ccacccccgccaugcaa

SEQ ID NO: 1737961 - RNA, 14 nt, Homo sapiens
ccacccuugccaug

SEQ ID NO: 1737962 - RNA, 14 nt, Homo sapiens
ccaccugucccacu

SEQ ID NO: 1737963 - RNA, 16 nt, Homo sapiens
ccacgcccagcuaauu

SEQ ID NO: 1737964 - RNA, 15 nt, Homo sapiens
ccacggccacaguca

SEQ ID NO: 1737965 - RNA, 20 nt, Homo sapiens
ccacgugggcaaacaggcag

SEQ ID NO: 1737966 - RNA, 21 nt, Homo sapiens
ccacgugggcaaacaggcagu

SEQ ID NO: 1737967 - RNA, 14 nt, Homo sapiens
ccagaaaagcaaua

SEQ ID NO: 1737968 - RNA, 23 nt, Homo sapiens
ccagcuccacaguguugccagag

SEQ ID NO: 1737969 - RNA, 14 nt, Homo sapiens
ccagcugccgcacc

SEQ ID NO: 1737970 - RNA, 22 nt, Homo sapiens
ccaggaggcccugguccuggcc

SEQ ID NO: 1737971 - RNA, 14 nt, Homo sapiens
ccaggauagacuuu

SEQ ID NO: 1737972 - RNA, 12 nt, Homo sapiens
ccaggugcugcu

SEQ ID NO: 1737973 - RNA, 22 nt, Homo sapiens
ccauaaaaauaaaucaguucau

SEQ ID NO: 1737974 - RNA, 19 nt, Homo sapiens
ccauagggacccauucuac

SEQ ID NO: 1737975 - RNA, 16 nt, Homo sapiens
ccauauuuaacaugua

SEQ ID NO: 1737976 - RNA, 13 nt, Homo sapiens
ccauccaguggag

SEQ ID NO: 1737977 - RNA, 13 nt, Homo sapiens
ccaucugcuccug

SEQ ID NO: 1737978 - RNA, 18 nt, Homo sapiens
ccauguaucaauauucac

SEQ ID NO: 1737979 - RNA, 18 nt, Homo sapiens
ccaugucucgacucaucc

SEQ ID NO: 1737980 - RNA, 17 nt, Homo sapiens
ccaugugauuacccucu

SEQ ID NO: 1737981 - RNA, 17 nt, Homo sapiens
ccauuucauuugugcca

SEQ ID NO: 1737982 - RNA, 23 nt, Homo sapiens
ccauuuucuuauugcgcugcuac

SEQ ID NO: 1737983 - RNA, 16 nt, Homo sapiens
ccauuuuugaaaccaa

SEQ ID NO: 1737984 - RNA, 23 nt, Homo sapiens
cccaaacauguuguacauuucac

SEQ ID NO: 1737985 - RNA, 17 nt, Homo sapiens
cccaaagugugacucau

SEQ ID NO: 1737986 - RNA, 19 nt, Homo sapiens
cccacggcaccucggggac

SEQ ID NO: 1737987 - RNA, 15 nt, Homo sapiens
cccacuuugaagggc

SEQ ID NO: 1737988 - RNA, 15 nt, Homo sapiens
cccagagguggaugu

SEQ ID NO: 1737989 - RNA, 13 nt, Homo sapiens
cccagccucuggc

SEQ ID NO: 1737990 - RNA, 15 nt, Homo sapiens
cccagcgagcucuca

SEQ ID NO: 1737991 - RNA, 18 nt, Homo sapiens
cccauggggagacaguug

SEQ ID NO: 1737992 - RNA, 15 nt, Homo sapiens
cccauuucacccaug

SEQ ID NO: 1737993 - RNA, 20 nt, Homo sapiens
ccccaacaaaccauccagug

SEQ ID NO: 1737994 - RNA, 11 nt, Homo sapiens
ccccacuuuga

SEQ ID NO: 1737995 - RNA, 16 nt, Homo sapiens
ccccaggccuguccac

SEQ ID NO: 1737996 - RNA, 17 nt, Homo sapiens
ccccucugucuugugaa

SEQ ID NO: 1737997 - RNA, 13 nt, Homo sapiens
cccgaacaccauu

SEQ ID NO: 1737998 - RNA, 15 nt, Homo sapiens
cccguggcauuucaa

SEQ ID NO: 1737999 - RNA, 13 nt, Homo sapiens
cccucaucauagc

SEQ ID NO: 1738000 - RNA, 18 nt, Homo sapiens
cccuccuggcucuugaua

SEQ ID NO: 1738001 - RNA, 18 nt, Homo sapiens
cccucuccaacugccuaa

SEQ ID NO: 1738002 - RNA, 18 nt, Homo sapiens
cccuggaaggacauccau

SEQ ID NO: 1738003 - RNA, 16 nt, Homo sapiens
cccugggccucagugu

SEQ ID NO: 1738004 - RNA, 21 nt, Homo sapiens
cccuguggcaggacacacaug

SEQ ID NO: 1738005 - RNA, 11 nt, Homo sapiens
cccuugccaug

SEQ ID NO: 1738006 - RNA, 17 nt, Homo sapiens
cccuuuaacucaugagg

SEQ ID NO: 1738007 - RNA, 12 nt, Homo sapiens
ccgaacaccauu

SEQ ID NO: 1738008 - RNA, 18 nt, Homo sapiens
ccgagccuggcuccaaac

SEQ ID NO: 1738009 - RNA, 15 nt, Homo sapiens
ccgccugccugccac

SEQ ID NO: 1738010 - RNA, 16 nt, Homo sapiens
ccgcugcgggcccacg

SEQ ID NO: 1738011 - RNA, 12 nt, Homo sapiens
ccggaagccaaa

SEQ ID NO: 1738012 - RNA, 23 nt, Homo sapiens
ccgggcaccaacuccauguuugg

SEQ ID NO: 1738013 - RNA, 17 nt, Homo sapiens
ccuaagucucugugaau

SEQ ID NO: 1738014 - RNA, 15 nt, Homo sapiens
ccuaugaaauuucaa

SEQ ID NO: 1738015 - RNA, 23 nt, Homo sapiens
ccuauggaagcauauuguuauua

SEQ ID NO: 1738016 - RNA, 12 nt, Homo sapiens
ccucagauuccg

SEQ ID NO: 1738017 - RNA, 21 nt, Homo sapiens
ccucagauuccgcaccaauaa

SEQ ID NO: 1738018 - RNA, 14 nt, Homo sapiens
ccucaggcagcuca

SEQ ID NO: 1738019 - RNA, 21 nt, Homo sapiens
ccucaguuuccugaccuauga

SEQ ID NO: 1738020 - RNA, 20 nt, Homo sapiens
ccucaucuguaaaauggaga

SEQ ID NO: 1738021 - RNA, 22 nt, Homo sapiens
ccucaucuguaaaauggagaca

SEQ ID NO: 1738022 - RNA, 19 nt, Homo sapiens
ccuccaugaauaucaguua

SEQ ID NO: 1738023 - RNA, 12 nt, Homo sapiens
ccucccacaauu

SEQ ID NO: 1738024 - RNA, 15 nt, Homo sapiens
ccuccccacagugcc

SEQ ID NO: 1738025 - RNA, 16 nt, Homo sapiens
ccucccugaguggucc

SEQ ID NO: 1738026 - RNA, 19 nt, Homo sapiens
ccucucagaacauacugau

SEQ ID NO: 1738027 - RNA, 13 nt, Homo sapiens
ccucuguugccaa

SEQ ID NO: 1738028 - RNA, 14 nt, Homo sapiens
ccucuguugccaag

SEQ ID NO: 1738029 - RNA, 14 nt, Homo sapiens
ccucuucaaaauga

SEQ ID NO: 1738030 - RNA, 21 nt, Homo sapiens
ccugaauucuuuuucauuuga

SEQ ID NO: 1738031 - RNA, 18 nt, Homo sapiens
ccugcaccccugcaguuu

SEQ ID NO: 1738032 - RNA, 23 nt, Homo sapiens
ccugcacuggggagcccgucuca

SEQ ID NO: 1738033 - RNA, 20 nt, Homo sapiens
ccuggcugaaggacugugac

SEQ ID NO: 1738034 - RNA, 13 nt, Homo sapiens
ccugggacaucag

SEQ ID NO: 1738035 - RNA, 15 nt, Homo sapiens
ccuggugcugcugcu

SEQ ID NO: 1738036 - RNA, 16 nt, Homo sapiens
ccuguccacacccagc

SEQ ID NO: 1738037 - RNA, 18 nt, Homo sapiens
ccuguccugccuaaggcu

SEQ ID NO: 1738038 - RNA, 15 nt, Homo sapiens
ccuguguaacacuug

SEQ ID NO: 1738039 - RNA, 22 nt, Homo sapiens
ccuucaaguugagaacugguca

SEQ ID NO: 1738040 - RNA, 16 nt, Homo sapiens
ccuucccuccaagaag

SEQ ID NO: 1738041 - RNA, 15 nt, Homo sapiens
ccuuuauucuggcag

SEQ ID NO: 1738042 - RNA, 18 nt, Homo sapiens
ccuuuccuuuucuuuaaa

SEQ ID NO: 1738043 - RNA, 18 nt, Homo sapiens
ccuuuggccccacuuuga

SEQ ID NO: 1738044 - RNA, 19 nt, Homo sapiens
ccuuuggccccacuuugaa

SEQ ID NO: 1738045 - RNA, 15 nt, Homo sapiens
ccuuuuucacuuuga

SEQ ID NO: 1738046 - RNA, 18 nt, Homo sapiens
cgcaccaauaaagccuuc

SEQ ID NO: 1738047 - RNA, 13 nt, Homo sapiens
cgcccuccacaaa

SEQ ID NO: 1738048 - RNA, 15 nt, Homo sapiens
cgccugccugccacc

SEQ ID NO: 1738049 - RNA, 20 nt, Homo sapiens
cggacuuagaaaaccagcuc

SEQ ID NO: 1738050 - RNA, 22 nt, Homo sapiens
cgugaacuuuaugcuguaaaua

SEQ ID NO: 1738051 - RNA, 18 nt, Homo sapiens
cgugaaucuguaucuugc

SEQ ID NO: 1738052 - RNA, 13 nt, Homo sapiens
cguggcauuucaa

SEQ ID NO: 1738053 - RNA, 21 nt, Homo sapiens
cguuucccagagucaucugau

SEQ ID NO: 1738054 - RNA, 22 nt, Homo sapiens
cguuuguccuuuuucacuuuga

SEQ ID NO: 1738055 - RNA, 18 nt, Homo sapiens
cuaaacuuucacacccca

SEQ ID NO: 1738056 - RNA, 20 nt, Homo sapiens
cuaagcugccgguucuuaaa

SEQ ID NO: 1738057 - RNA, 21 nt, Homo sapiens
cuaaggaauaugagcuuuaug

SEQ ID NO: 1738058 - RNA, 19 nt, Homo sapiens
cuacacacccugcauauca

SEQ ID NO: 1738059 - RNA, 23 nt, Homo sapiens
cuacaucuucugccuuagucuca

SEQ ID NO: 1738060 - RNA, 14 nt, Homo sapiens
cuacccaugaccug

SEQ ID NO: 1738061 - RNA, 18 nt, Homo sapiens
cuaccucaggcagcucaa

SEQ ID NO: 1738062 - RNA, 14 nt, Homo sapiens
cuagcccugggaca

SEQ ID NO: 1738063 - RNA, 18 nt, Homo sapiens
cuaguggccgaaccagaa

SEQ ID NO: 1738064 - RNA, 13 nt, Homo sapiens
cuaguucuaccuc

SEQ ID NO: 1738065 - RNA, 13 nt, Homo sapiens
cuauauugguuua

SEQ ID NO: 1738066 - RNA, 21 nt, Homo sapiens
cuaugaaauuucaacuuuucc

SEQ ID NO: 1738067 - RNA, 14 nt, Homo sapiens
cuauuccaaaaagg

SEQ ID NO: 1738068 - RNA, 23 nt, Homo sapiens
cucaggaaacgagacuuuccauu

SEQ ID NO: 1738069 - RNA, 13 nt, Homo sapiens
cucagugcuguaa

SEQ ID NO: 1738070 - RNA, 18 nt, Homo sapiens
cucaucagaaacucaaaa

SEQ ID NO: 1738071 - RNA, 17 nt, Homo sapiens
cuccaccuagacuguaa

SEQ ID NO: 1738072 - RNA, 18 nt, Homo sapiens
cuccaccuagacuguaaa

SEQ ID NO: 1738073 - RNA, 20 nt, Homo sapiens
cuccagcugggcucugcaau

SEQ ID NO: 1738074 - RNA, 20 nt, Homo sapiens
cuccccacuuguccgcuggg

SEQ ID NO: 1738075 - RNA, 21 nt, Homo sapiens
cuccccaguucauugcacuuu

SEQ ID NO: 1738076 - RNA, 23 nt, Homo sapiens
cuccccugccugcccuggugaca

SEQ ID NO: 1738077 - RNA, 20 nt, Homo sapiens
cuccuugaauaucuuucgau

SEQ ID NO: 1738078 - RNA, 12 nt, Homo sapiens
cucgugugcaac

SEQ ID NO: 1738079 - RNA, 14 nt, Homo sapiens
cucucagaacauac

SEQ ID NO: 1738080 - RNA, 23 nt, Homo sapiens
cucucugacgcuugugacagugc

SEQ ID NO: 1738081 - RNA, 14 nt, Homo sapiens
cucugacaacagac

SEQ ID NO: 1738082 - RNA, 21 nt, Homo sapiens
cucugacgcuugugacagugc

SEQ ID NO: 1738083 - RNA, 16 nt, Homo sapiens
cucugaggcugaaauu

SEQ ID NO: 1738084 - RNA, 14 nt, Homo sapiens
cucugcaacacuuu

SEQ ID NO: 1738085 - RNA, 20 nt, Homo sapiens
cucugcaacugcucagcucu

SEQ ID NO: 1738086 - RNA, 22 nt, Homo sapiens
cucuuuggcuccccuguaccuu

SEQ ID NO: 1738087 - RNA, 16 nt, Homo sapiens
cugaaaacaagccaug

SEQ ID NO: 1738088 - RNA, 20 nt, Homo sapiens
cugaaauagacccacaagag

SEQ ID NO: 1738089 - RNA, 14 nt, Homo sapiens
cugaacucugacaa

SEQ ID NO: 1738090 - RNA, 16 nt, Homo sapiens
cugaaggacugugaca

SEQ ID NO: 1738091 - RNA, 20 nt, Homo sapiens
cugaauucuuuuucauuuga

SEQ ID NO: 1738092 - RNA, 22 nt, Homo sapiens
cugacagggacaugcccugugu

SEQ ID NO: 1738093 - RNA, 16 nt, Homo sapiens
cugaggcugaaauuca

SEQ ID NO: 1738094 - RNA, 19 nt, Homo sapiens
cugcaccccugcaguuuga

SEQ ID NO: 1738095 - RNA, 21 nt, Homo sapiens
cugcagccagcucacguccag

SEQ ID NO: 1738096 - RNA, 14 nt, Homo sapiens
cugcuccagugcag

SEQ ID NO: 1738097 - RNA, 16 nt, Homo sapiens
cugcugcuccagugca

SEQ ID NO: 1738098 - RNA, 18 nt, Homo sapiens
cugcuggauucaagugau

SEQ ID NO: 1738099 - RNA, 22 nt, Homo sapiens
cuggaacucagugugacuccuc

SEQ ID NO: 1738100 - RNA, 23 nt, Homo sapiens
cuggaagaaaaaaaccacacaaa

SEQ ID NO: 1738101 - RNA, 17 nt, Homo sapiens
cuggacggaaccacgua

SEQ ID NO: 1738102 - RNA, 20 nt, Homo sapiens
cuggagcccauccagucucc

SEQ ID NO: 1738103 - RNA, 20 nt, Homo sapiens
cuggagugcaguggcgcaau

SEQ ID NO: 1738104 - RNA, 19 nt, Homo sapiens
cuggaucucacaagcacuu

SEQ ID NO: 1738105 - RNA, 20 nt, Homo sapiens
cuggaucucacaagcacuuu

SEQ ID NO: 1738106 - RNA, 12 nt, Homo sapiens
cuggcacugacu

SEQ ID NO: 1738107 - RNA, 17 nt, Homo sapiens
cugggacagcccaggaa

SEQ ID NO: 1738108 - RNA, 21 nt, Homo sapiens
cugggcauuuggugagaguca

SEQ ID NO: 1738109 - RNA, 12 nt, Homo sapiens
cuggggccaaau

SEQ ID NO: 1738110 - RNA, 17 nt, Homo sapiens
cugggucucaguguccu

SEQ ID NO: 1738111 - RNA, 18 nt, Homo sapiens
cugguacaguaugggggu

SEQ ID NO: 1738112 - RNA, 17 nt, Homo sapiens
cuggucagggcaaaccu

SEQ ID NO: 1738113 - RNA, 22 nt, Homo sapiens
cuggucugugaagagccggugg

SEQ ID NO: 1738114 - RNA, 18 nt, Homo sapiens
cuguaaaaacugugggau

SEQ ID NO: 1738115 - RNA, 22 nt, Homo sapiens
cugugacucgagucacacucaa

SEQ ID NO: 1738116 - RNA, 14 nt, Homo sapiens
cugugcccucagau

SEQ ID NO: 1738117 - RNA, 18 nt, Homo sapiens
cugugcccucagauuccg

SEQ ID NO: 1738118 - RNA, 21 nt, Homo sapiens
cuguggggcugaauugccagg

SEQ ID NO: 1738119 - RNA, 13 nt, Homo sapiens
cuguucuuagcuc

SEQ ID NO: 1738120 - RNA, 17 nt, Homo sapiens
cuguuuaaaguggcaau

SEQ ID NO: 1738121 - RNA, 14 nt, Homo sapiens
cuguuugucucacc

SEQ ID NO: 1738122 - RNA, 14 nt, Homo sapiens
cuguuuuguuguuu

SEQ ID NO: 1738123 - RNA, 14 nt, Homo sapiens
cuuaaauccauccu

SEQ ID NO: 1738124 - RNA, 15 nt, Homo sapiens
cuuaacucauugcaa

SEQ ID NO: 1738125 - RNA, 17 nt, Homo sapiens
cuuauagacaacauggc

SEQ ID NO: 1738126 - RNA, 15 nt, Homo sapiens
cuuauccuccaugaa

SEQ ID NO: 1738127 - RNA, 17 nt, Homo sapiens
cuucaccuaagucucug

SEQ ID NO: 1738128 - RNA, 17 nt, Homo sapiens
cuucagggaacugcaua

SEQ ID NO: 1738129 - RNA, 22 nt, Homo sapiens
cuucucagaaggcaaaugacuu

SEQ ID NO: 1738130 - RNA, 20 nt, Homo sapiens
cuugagccagccaggcccug

SEQ ID NO: 1738131 - RNA, 15 nt, Homo sapiens
cuugagcgugaaucu

SEQ ID NO: 1738132 - RNA, 21 nt, Homo sapiens
cuuggaaauuggaagagcaca

SEQ ID NO: 1738133 - RNA, 14 nt, Homo sapiens
cuuggagacuccug

SEQ ID NO: 1738134 - RNA, 15 nt, Homo sapiens
cuugggcgggacaca

SEQ ID NO: 1738135 - RNA, 22 nt, Homo sapiens
cuuggggaaaauggccaugcag

SEQ ID NO: 1738136 - RNA, 14 nt, Homo sapiens
cuugucugcuaaau

SEQ ID NO: 1738137 - RNA, 14 nt, Homo sapiens
cuuucaacuagaaa

SEQ ID NO: 1738138 - RNA, 19 nt, Homo sapiens
cuuucagauaacuguuauu

SEQ ID NO: 1738139 - RNA, 22 nt, Homo sapiens
cuuucuaggagggagacacugg

SEQ ID NO: 1738140 - RNA, 22 nt, Homo sapiens
cuuucugggaugucacagucca

SEQ ID NO: 1738141 - RNA, 20 nt, Homo sapiens
cuuucuuuccaaaacauuuc

SEQ ID NO: 1738142 - RNA, 14 nt, Homo sapiens
cuuugcaccaaaga

SEQ ID NO: 1738143 - RNA, 16 nt, Homo sapiens
cuuuggaaauacacag

SEQ ID NO: 1738144 - RNA, 19 nt, Homo sapiens
cuuuggacagaagcagcuc

SEQ ID NO: 1738145 - RNA, 22 nt, Homo sapiens
cuuuggcaaauaaaccuccuaa

SEQ ID NO: 1738146 - RNA, 17 nt, Homo sapiens
cuuuggccccacuuuga

SEQ ID NO: 1738147 - RNA, 19 nt, Homo sapiens
cuuugugcagauucuuuac

SEQ ID NO: 1738148 - RNA, 22 nt, Homo sapiens
cuuuuccaugcacccucauaca

SEQ ID NO: 1738149 - RNA, 14 nt, Homo sapiens
cuuuuuuauacuca

SEQ ID NO: 1738150 - RNA, 16 nt, Homo sapiens
gaaaauaaaagcacuu

SEQ ID NO: 1738151 - RNA, 16 nt, Homo sapiens
gaaaauggccaugcag

SEQ ID NO: 1738152 - RNA, 20 nt, Homo sapiens
gaaaauuggaacucuacuca

SEQ ID NO: 1738153 - RNA, 18 nt, Homo sapiens
gaaacaccccucugucua

SEQ ID NO: 1738154 - RNA, 20 nt, Homo sapiens
gaaagaagacaaacuuugca

SEQ ID NO: 1738155 - RNA, 14 nt, Homo sapiens
gaaagggucucccu

SEQ ID NO: 1738156 - RNA, 13 nt, Homo sapiens
gaaauagugucug

SEQ ID NO: 1738157 - RNA, 17 nt, Homo sapiens
gaaauagugucugauga

SEQ ID NO: 1738158 - RNA, 18 nt, Homo sapiens
gaacacauaauucaggaa

SEQ ID NO: 1738159 - RNA, 19 nt, Homo sapiens
gaacagcugugucugccaa

SEQ ID NO: 1738160 - RNA, 21 nt, Homo sapiens
gaaccugcccugcucccacag

SEQ ID NO: 1738161 - RNA, 18 nt, Homo sapiens
gaacugaaaacaagccau

SEQ ID NO: 1738162 - RNA, 22 nt, Homo sapiens
gaacuugagcgugaaucuguau

SEQ ID NO: 1738163 - RNA, 19 nt, Homo sapiens
gaagaaaucuuucucccuc

SEQ ID NO: 1738164 - RNA, 22 nt, Homo sapiens
gaagaacagauaaucccuguau

SEQ ID NO: 1738165 - RNA, 20 nt, Homo sapiens
gaagacuccaguaugaaaau

SEQ ID NO: 1738166 - RNA, 19 nt, Homo sapiens
gaagccuuuguaaauuguc

SEQ ID NO: 1738167 - RNA, 14 nt, Homo sapiens
gaauaaauucccaa

SEQ ID NO: 1738168 - RNA, 19 nt, Homo sapiens
gaauacaaacaccuggacu

SEQ ID NO: 1738169 - RNA, 19 nt, Homo sapiens
gaauucuuuuucauuugag

SEQ ID NO: 1738170 - RNA, 13 nt, Homo sapiens
gaauuucccacau

SEQ ID NO: 1738171 - RNA, 11 nt, Homo sapiens
gaauuugcacc

SEQ ID NO: 1738172 - RNA, 21 nt, Homo sapiens
gacaagugacuguaucugugu

SEQ ID NO: 1738173 - RNA, 21 nt, Homo sapiens
gacacaggcuccaaacuggag

SEQ ID NO: 1738174 - RNA, 21 nt, Homo sapiens
gaccacaguggccaagaucac

SEQ ID NO: 1738175 - RNA, 14 nt, Homo sapiens
gaccccgagccugg

SEQ ID NO: 1738176 - RNA, 16 nt, Homo sapiens
gacccuguccggccca

SEQ ID NO: 1738177 - RNA, 21 nt, Homo sapiens
gaccucagcuuugauauuuca

SEQ ID NO: 1738178 - RNA, 12 nt, Homo sapiens
gaccuggcacug

SEQ ID NO: 1738179 - RNA, 21 nt, Homo sapiens
gaccuguuuaugagaugcugg

SEQ ID NO: 1738180 - RNA, 17 nt, Homo sapiens
gacgguaaguguucuca

SEQ ID NO: 1738181 - RNA, 17 nt, Homo sapiens
gacuaugcagaggccug

SEQ ID NO: 1738182 - RNA, 18 nt, Homo sapiens
gacuauuugcuuauuuaa

SEQ ID NO: 1738183 - RNA, 16 nt, Homo sapiens
gacuccuggucuguga

SEQ ID NO: 1738184 - RNA, 13 nt, Homo sapiens
gacuucuucccaa

SEQ ID NO: 1738185 - RNA, 14 nt, Homo sapiens
gacuucuucccaag

SEQ ID NO: 1738186 - RNA, 17 nt, Homo sapiens
gagacgggguuugccau

SEQ ID NO: 1738187 - RNA, 17 nt, Homo sapiens
gagacuuuacauggaug

SEQ ID NO: 1738188 - RNA, 22 nt, Homo sapiens
gagauuauuuuaaucuaauucu

SEQ ID NO: 1738189 - RNA, 23 nt, Homo sapiens
gagcaucacaguuuugguugcuu

SEQ ID NO: 1738190 - RNA, 17 nt, Homo sapiens
gagcccauccagucucc

SEQ ID NO: 1738191 - RNA, 16 nt, Homo sapiens
gagccccagcuacccu

SEQ ID NO: 1738192 - RNA, 13 nt, Homo sapiens
gagccgguggugc

SEQ ID NO: 1738193 - RNA, 19 nt, Homo sapiens
gagccuggcuccaaacccu

SEQ ID NO: 1738194 - RNA, 20 nt, Homo sapiens
gaggaaaagugcaaguccau

SEQ ID NO: 1738195 - RNA, 15 nt, Homo sapiens
gaggaggugacaaac

SEQ ID NO: 1738196 - RNA, 20 nt, Homo sapiens
gaggauaugggugggagcga

SEQ ID NO: 1738197 - RNA, 14 nt, Homo sapiens
gaggcggaucuuug

SEQ ID NO: 1738198 - RNA, 15 nt, Homo sapiens
gaggcggauuucccu

SEQ ID NO: 1738199 - RNA, 16 nt, Homo sapiens
gagucagaucuuucuc

SEQ ID NO: 1738200 - RNA, 15 nt, Homo sapiens
gagugcaguggcgca

SEQ ID NO: 1738201 - RNA, 19 nt, Homo sapiens
gauacuucgacacuguucu

SEQ ID NO: 1738202 - RNA, 14 nt, Homo sapiens
gauagagugggaca

SEQ ID NO: 1738203 - RNA, 19 nt, Homo sapiens
gauaugaugucccuaugga

SEQ ID NO: 1738204 - RNA, 18 nt, Homo sapiens
gaucaaagaaauucagaa

SEQ ID NO: 1738205 - RNA, 17 nt, Homo sapiens
gaucacaguggccacgg

SEQ ID NO: 1738206 - RNA, 17 nt, Homo sapiens
gaucucacaagcacuuu

SEQ ID NO: 1738207 - RNA, 19 nt, Homo sapiens
gaucuuucuuuccaaaaca

SEQ ID NO: 1738208 - RNA, 13 nt, Homo sapiens
gaugacaaccucc

SEQ ID NO: 1738209 - RNA, 20 nt, Homo sapiens
gauggcagauucccacugcc

SEQ ID NO: 1738210 - RNA, 21 nt, Homo sapiens
gauggcagauucccacugccg

SEQ ID NO: 1738211 - RNA, 20 nt, Homo sapiens
gauguauguugaagccuuug

SEQ ID NO: 1738212 - RNA, 15 nt, Homo sapiens
gauuauuuuaaucua

SEQ ID NO: 1738213 - RNA, 15 nt, Homo sapiens
gauucaaauugcugc

SEQ ID NO: 1738214 - RNA, 21 nt, Homo sapiens
gauuuguuuuuaaacuguaca

SEQ ID NO: 1738215 - RNA, 15 nt, Homo sapiens
gauuuuaugcuuuaa

SEQ ID NO: 1738216 - RNA, 13 nt, Homo sapiens
gcaaacaggcagu

SEQ ID NO: 1738217 - RNA, 14 nt, Homo sapiens
gcaaaccauuuuua

SEQ ID NO: 1738218 - RNA, 14 nt, Homo sapiens
gcaaaccugccucc

SEQ ID NO: 1738219 - RNA, 17 nt, Homo sapiens
gcaaagaugaucaguau

SEQ ID NO: 1738220 - RNA, 20 nt, Homo sapiens
gcaaucuucucagaaggcaa

SEQ ID NO: 1738221 - RNA, 13 nt, Homo sapiens
gcacaaggccuug

SEQ ID NO: 1738222 - RNA, 12 nt, Homo sapiens
gcacaaguacuu

SEQ ID NO: 1738223 - RNA, 17 nt, Homo sapiens
gcaccaaagacaucagu

SEQ ID NO: 1738224 - RNA, 23 nt, Homo sapiens
gcaccaaagacaucagucuccaa

SEQ ID NO: 1738225 - RNA, 18 nt, Homo sapiens
gcaccaauaaagccuuca

SEQ ID NO: 1738226 - RNA, 19 nt, Homo sapiens
gcacccuaguucuaccuca

SEQ ID NO: 1738227 - RNA, 15 nt, Homo sapiens
gcacugacugggcau

SEQ ID NO: 1738228 - RNA, 17 nt, Homo sapiens
gcacuuuaaaugaagcu

SEQ ID NO: 1738229 - RNA, 21 nt, Homo sapiens
gcacuuugaaggggccucacc

SEQ ID NO: 1738230 - RNA, 14 nt, Homo sapiens
gcagaccucaugcc

SEQ ID NO: 1738231 - RNA, 16 nt, Homo sapiens
gcagagagguuugcag

SEQ ID NO: 1738232 - RNA, 20 nt, Homo sapiens
gcagccucuucaaaaugagc

SEQ ID NO: 1738233 - RNA, 13 nt, Homo sapiens
gcaggacugcaca

SEQ ID NO: 1738234 - RNA, 13 nt, Homo sapiens
gcaguuuuuccca

SEQ ID NO: 1738235 - RNA, 21 nt, Homo sapiens
gcauauuuauugcauugcugg

SEQ ID NO: 1738236 - RNA, 18 nt, Homo sapiens
gcaucaauacaaccagcc

SEQ ID NO: 1738237 - RNA, 15 nt, Homo sapiens
gcaucaucaaaaacu

SEQ ID NO: 1738238 - RNA, 19 nt, Homo sapiens
gcaucaucaaaaacuuugg

SEQ ID NO: 1738239 - RNA, 19 nt, Homo sapiens
gcauguaugacgugacugg

SEQ ID NO: 1738240 - RNA, 13 nt, Homo sapiens
gcaugugaucucc

SEQ ID NO: 1738241 - RNA, 13 nt, Homo sapiens
gccaagacuccuc

SEQ ID NO: 1738242 - RNA, 21 nt, Homo sapiens
gccaagaguccaggaggcccu

SEQ ID NO: 1738243 - RNA, 16 nt, Homo sapiens
gccaagaucacagugg

SEQ ID NO: 1738244 - RNA, 19 nt, Homo sapiens
gccaagaucacaguggcca

SEQ ID NO: 1738245 - RNA, 19 nt, Homo sapiens
gccacagucaugguggcca

SEQ ID NO: 1738246 - RNA, 20 nt, Homo sapiens
gccaccggaggucacuccac

SEQ ID NO: 1738247 - RNA, 18 nt, Homo sapiens
gccacgcuccaaacccca

SEQ ID NO: 1738248 - RNA, 16 nt, Homo sapiens
gccacggccacaguca

SEQ ID NO: 1738249 - RNA, 17 nt, Homo sapiens
gccacggccacagucau

SEQ ID NO: 1738250 - RNA, 16 nt, Homo sapiens
gccacuguuugucuca

SEQ ID NO: 1738251 - RNA, 20 nt, Homo sapiens
gccacuguuugucucaccua

SEQ ID NO: 1738252 - RNA, 21 nt, Homo sapiens
gccaugcaacgggauugaagg

SEQ ID NO: 1738253 - RNA, 22 nt, Homo sapiens
gccaugcagaccucaugcccag

SEQ ID NO: 1738254 - RNA, 22 nt, Homo sapiens
gccaugugauuacccucugggu

SEQ ID NO: 1738255 - RNA, 18 nt, Homo sapiens
gcccaucuccgucuccca

SEQ ID NO: 1738256 - RNA, 13 nt, Homo sapiens
gcccauggaugug

SEQ ID NO: 1738257 - RNA, 15 nt, Homo sapiens
gccccaauucgaucc

SEQ ID NO: 1738258 - RNA, 19 nt, Homo sapiens
gccccaccuugucugcuaa

SEQ ID NO: 1738259 - RNA, 14 nt, Homo sapiens
gccccucugaccug

SEQ ID NO: 1738260 - RNA, 19 nt, Homo sapiens
gcccucagauuccgcacca

SEQ ID NO: 1738261 - RNA, 14 nt, Homo sapiens
gccgacuuggagac

SEQ ID NO: 1738262 - RNA, 18 nt, Homo sapiens
gccguuuguuccccaaga

SEQ ID NO: 1738263 - RNA, 20 nt, Homo sapiens
gccucaccuccucugugauu

SEQ ID NO: 1738264 - RNA, 19 nt, Homo sapiens
gccugcuggcugcggcccc

SEQ ID NO: 1738265 - RNA, 18 nt, Homo sapiens
gccugugcugugacucga

SEQ ID NO: 1738266 - RNA, 18 nt, Homo sapiens
gccuuagucucaguuugu

SEQ ID NO: 1738267 - RNA, 21 nt, Homo sapiens
gcgcaaucuuaacucauugca

SEQ ID NO: 1738268 - RNA, 16 nt, Homo sapiens
gcgcagccaugugauu

SEQ ID NO: 1738269 - RNA, 19 nt, Homo sapiens
gcggagucuguccugugac

SEQ ID NO: 1738270 - RNA, 15 nt, Homo sapiens
gcgugaaucuguauc

SEQ ID NO: 1738271 - RNA, 19 nt, Homo sapiens
gcguuguugcauguuugaa

SEQ ID NO: 1738272 - RNA, 15 nt, Homo sapiens
gcuaauuuguguauu

SEQ ID NO: 1738273 - RNA, 14 nt, Homo sapiens
gcucuacaucuucu

SEQ ID NO: 1738274 - RNA, 22 nt, Homo sapiens
gcucucuaaaugggaauucuca

SEQ ID NO: 1738275 - RNA, 21 nt, Homo sapiens
gcucugcaauuccccucugcu

SEQ ID NO: 1738276 - RNA, 20 nt, Homo sapiens
gcucuuuguuuugugucucu

SEQ ID NO: 1738277 - RNA, 16 nt, Homo sapiens
gcugcacccacccagg

SEQ ID NO: 1738278 - RNA, 15 nt, Homo sapiens
gcuguuuguagugaa

SEQ ID NO: 1738279 - RNA, 22 nt, Homo sapiens
gcuuaguccaauuccuugcaca

SEQ ID NO: 1738280 - RNA, 21 nt, Homo sapiens
gcuucccagcaccaacaugua

SEQ ID NO: 1738281 - RNA, 13 nt, Homo sapiens
gcuuggcugugcc

SEQ ID NO: 1738282 - RNA, 16 nt, Homo sapiens
gcuuggcugugcccuc

SEQ ID NO: 1738283 - RNA, 23 nt, Homo sapiens
gcuuucuaugcuguuuguaguga

SEQ ID NO: 1738284 - RNA, 20 nt, Homo sapiens
gcuuuucaugcaaacucuuu

SEQ ID NO: 1738285 - RNA, 19 nt, Homo sapiens
ggaaacagcucgacuuuaa

SEQ ID NO: 1738286 - RNA, 21 nt, Homo sapiens
ggaagccaaaccucugugagc

SEQ ID NO: 1738287 - RNA, 10 nt, Homo sapiens
ggacaugccc

SEQ ID NO: 1738288 - RNA, 22 nt, Homo sapiens
ggaccccgagccuggcuccaaa

SEQ ID NO: 1738289 - RNA, 20 nt, Homo sapiens
ggacuggaaggggaagggac

SEQ ID NO: 1738290 - RNA, 18 nt, Homo sapiens
ggacuugggcgggacaca

SEQ ID NO: 1738291 - RNA, 24 nt, Homo sapiens
ggacuugggcgggacacaggcucc

SEQ ID NO: 1738292 - RNA, 19 nt, Homo sapiens
ggagacacuggccccucaa

SEQ ID NO: 1738293 - RNA, 15 nt, Homo sapiens
ggagaccuggcacug

SEQ ID NO: 1738294 - RNA, 17 nt, Homo sapiens
ggagaccuggcacugga

SEQ ID NO: 1738295 - RNA, 12 nt, Homo sapiens
ggaggaggugac

SEQ ID NO: 1738296 - RNA, 17 nt, Homo sapiens
ggaggauguucgucuca

SEQ ID NO: 1738297 - RNA, 13 nt, Homo sapiens
ggaucuuuggaca

SEQ ID NO: 1738298 - RNA, 22 nt, Homo sapiens
ggcaaagagagucgcaucucag

SEQ ID NO: 1738299 - RNA, 19 nt, Homo sapiens
ggcaauuauuccccuaggc

SEQ ID NO: 1738300 - RNA, 21 nt, Homo sapiens
ggcacaauaugggcacuuuaa

SEQ ID NO: 1738301 - RNA, 12 nt, Homo sapiens
ggcaucauggaa

SEQ ID NO: 1738302 - RNA, 12 nt, Homo sapiens
ggcaucuugcca

SEQ ID NO: 1738303 - RNA, 20 nt, Homo sapiens
ggccaagaucacaguggcca

SEQ ID NO: 1738304 - RNA, 17 nt, Homo sapiens
ggccacagccacuaauc

SEQ ID NO: 1738305 - RNA, 20 nt, Homo sapiens
ggccacagucaugguggcca

SEQ ID NO: 1738306 - RNA, 23 nt, Homo sapiens
ggccacagucaugguggccacgg

SEQ ID NO: 1738307 - RNA, 19 nt, Homo sapiens
ggccacuguuugucucacc

SEQ ID NO: 1738308 - RNA, 17 nt, Homo sapiens
ggcccagugcauaugca

SEQ ID NO: 1738309 - RNA, 22 nt, Homo sapiens
ggcggaucuuuggacagaagca

SEQ ID NO: 1738310 - RNA, 17 nt, Homo sapiens
ggcugaaggacugugac

SEQ ID NO: 1738311 - RNA, 19 nt, Homo sapiens
ggcugaaggacugugacag

SEQ ID NO: 1738312 - RNA, 17 nt, Homo sapiens
ggcugcacccacccagg

SEQ ID NO: 1738313 - RNA, 22 nt, Homo sapiens
ggcugccgagacagacccucug

SEQ ID NO: 1738314 - RNA, 20 nt, Homo sapiens
ggcuggagugcaguggcgca

SEQ ID NO: 1738315 - RNA, 19 nt, Homo sapiens
ggcuuaagugagcagaaca

SEQ ID NO: 1738316 - RNA, 23 nt, Homo sapiens
ggcuucugguugaugccugugaa

SEQ ID NO: 1738317 - RNA, 20 nt, Homo sapiens
gggagacacuggccccucaa

SEQ ID NO: 1738318 - RNA, 14 nt, Homo sapiens
gggagcugggagac

SEQ ID NO: 1738319 - RNA, 17 nt, Homo sapiens
gggaugugacaugccca

SEQ ID NO: 1738320 - RNA, 20 nt, Homo sapiens
gggcaggguggggagggagc

SEQ ID NO: 1738321 - RNA, 24 nt, Homo sapiens
gggccaugcagaccucaugcccag

SEQ ID NO: 1738322 - RNA, 22 nt, Homo sapiens
gggccuguuaugucaaacuguc

SEQ ID NO: 1738323 - RNA, 11 nt, Homo sapiens
gggcugagggu

SEQ ID NO: 1738324 - RNA, 16 nt, Homo sapiens
gggcuggcacugacug

SEQ ID NO: 1738325 - RNA, 14 nt, Homo sapiens
ggggaugugacaug

SEQ ID NO: 1738326 - RNA, 20 nt, Homo sapiens
gggggcuuggcugugcccuc

SEQ ID NO: 1738327 - RNA, 18 nt, Homo sapiens
gggugacccugaagugag

SEQ ID NO: 1738328 - RNA, 21 nt, Homo sapiens
ggguucuugagccagccaggc

SEQ ID NO: 1738329 - RNA, 19 nt, Homo sapiens
gguauuuauugagcaccug

SEQ ID NO: 1738330 - RNA, 12 nt, Homo sapiens
ggucacccagga

SEQ ID NO: 1738331 - RNA, 14 nt, Homo sapiens
ggucucgaacugcu

SEQ ID NO: 1738332 - RNA, 14 nt, Homo sapiens
gguucuugagccag

SEQ ID NO: 1738333 - RNA, 19 nt, Homo sapiens
gguugcuuuaauaucauca

SEQ ID NO: 1738334 - RNA, 21 nt, Homo sapiens
guaaacagauggcacuuugaa

SEQ ID NO: 1738335 - RNA, 13 nt, Homo sapiens
guacagugucuuu

SEQ ID NO: 1738336 - RNA, 14 nt, Homo sapiens
guauaaauaaccaa

SEQ ID NO: 1738337 - RNA, 20 nt, Homo sapiens
guauacccuguccuuucuca

SEQ ID NO: 1738338 - RNA, 13 nt, Homo sapiens
guauagugucuau

SEQ ID NO: 1738339 - RNA, 16 nt, Homo sapiens
guaugaaaaucagcau

SEQ ID NO: 1738340 - RNA, 16 nt, Homo sapiens
guauguugaagccuuu

SEQ ID NO: 1738341 - RNA, 13 nt, Homo sapiens
guauuaaagacag

SEQ ID NO: 1738342 - RNA, 18 nt, Homo sapiens
guauuuauugagcaccug

SEQ ID NO: 1738343 - RNA, 23 nt, Homo sapiens
gucaagaagaaaaagguuugcau

SEQ ID NO: 1738344 - RNA, 18 nt, Homo sapiens
gucacaucagcaauuuca

SEQ ID NO: 1738345 - RNA, 19 nt, Homo sapiens
gucaucucagugcuguaaa

SEQ ID NO: 1738346 - RNA, 14 nt, Homo sapiens
gucauuguauguua

SEQ ID NO: 1738347 - RNA, 15 nt, Homo sapiens
guccaaccagaaaca

SEQ ID NO: 1738348 - RNA, 18 nt, Homo sapiens
gucccaagcggugucucu

SEQ ID NO: 1738349 - RNA, 16 nt, Homo sapiens
gucccccaaacauguu

SEQ ID NO: 1738350 - RNA, 17 nt, Homo sapiens
gucuacauugagcauuu

SEQ ID NO: 1738351 - RNA, 17 nt, Homo sapiens
gucucaccuacccauga

SEQ ID NO: 1738352 - RNA, 16 nt, Homo sapiens
gucucgacucauccau

SEQ ID NO: 1738353 - RNA, 17 nt, Homo sapiens
gucucggggcuugcccc

SEQ ID NO: 1738354 - RNA, 19 nt, Homo sapiens
gugaacauucccagcccag

SEQ ID NO: 1738355 - RNA, 18 nt, Homo sapiens
gugacagcuuucugggau

SEQ ID NO: 1738356 - RNA, 23 nt, Homo sapiens
gugacagcuuucugggaugucac

SEQ ID NO: 1738357 - RNA, 16 nt, Homo sapiens
gugacauguguuggca

SEQ ID NO: 1738358 - RNA, 22 nt, Homo sapiens
gugagcuggauagacuugggau

SEQ ID NO: 1738359 - RNA, 22 nt, Homo sapiens
gugcagggaggaaaagugcaag

SEQ ID NO: 1738360 - RNA, 21 nt, Homo sapiens
gugcuugcuuuucaugcaaac

SEQ ID NO: 1738361 - RNA, 18 nt, Homo sapiens
guggggaaggaggccaag

SEQ ID NO: 1738362 - RNA, 15 nt, Homo sapiens
guggguuuugaacau

SEQ ID NO: 1738363 - RNA, 20 nt, Homo sapiens
gugucuggcacuugggacaa

SEQ ID NO: 1738364 - RNA, 18 nt, Homo sapiens
gugucuuucacagcuccu

SEQ ID NO: 1738365 - RNA, 21 nt, Homo sapiens
gugugaucuuaauauauuuga

SEQ ID NO: 1738366 - RNA, 19 nt, Homo sapiens
guuauuacagggcauucaa

SEQ ID NO: 1738367 - RNA, 20 nt, Homo sapiens
guuauuuauaaucacuuuuu

SEQ ID NO: 1738368 - RNA, 15 nt, Homo sapiens
guuccgagaagaaca

SEQ ID NO: 1738369 - RNA, 21 nt, Homo sapiens
guucuaccucaggcagcucaa

SEQ ID NO: 1738370 - RNA, 23 nt, Homo sapiens
guugaauuucccacauacccucc

SEQ ID NO: 1738371 - RNA, 22 nt, Homo sapiens
guuggcgggggcuuggcugugc

SEQ ID NO: 1738372 - RNA, 21 nt, Homo sapiens
guugguuguuuuuuccuuugc

SEQ ID NO: 1738373 - RNA, 19 nt, Homo sapiens
guuuaaaguggcaaucuca

SEQ ID NO: 1738374 - RNA, 15 nt, Homo sapiens
guuugauucagcaaa

SEQ ID NO: 1738375 - RNA, 21 nt, Homo sapiens
guuuguccuuuuucacuuuga

SEQ ID NO: 1738376 - RNA, 22 nt, Homo sapiens
guuuguccuuuuucacuuugaa

SEQ ID NO: 1738377 - RNA, 20 nt, Homo sapiens
guuuuuauauuaauguacuu

SEQ ID NO: 1738378 - RNA, 17 nt, Homo sapiens
uaaaagcacaaguacuu

SEQ ID NO: 1738379 - RNA, 20 nt, Homo sapiens
uaaaagcacaaguacuuuug

SEQ ID NO: 1738380 - RNA, 22 nt, Homo sapiens
uaaacauugguucuuguauuaa

SEQ ID NO: 1738381 - RNA, 14 nt, Homo sapiens
uaaacuacucuuug

SEQ ID NO: 1738382 - RNA, 15 nt, Homo sapiens
uaaacuguacagugu

SEQ ID NO: 1738383 - RNA, 18 nt, Homo sapiens
uaaagcaagggccauuua

SEQ ID NO: 1738384 - RNA, 13 nt, Homo sapiens
aaaaaaacuucau

SEQ ID NO: 1738385 - RNA, 21 nt, Homo sapiens
aaaaacauagaaaaauucagc

SEQ ID NO: 1738386 - RNA, 14 nt, Homo sapiens
aaaaacguauugca

SEQ ID NO: 1738387 - RNA, 15 nt, Homo sapiens
aaaaacguauugcau

SEQ ID NO: 1738388 - RNA, 13 nt, Homo sapiens
aaaaacucacuua

SEQ ID NO: 1738389 - RNA, 19 nt, Homo sapiens
aaaaauaugaccacacucc

SEQ ID NO: 1738390 - RNA, 12 nt, Homo sapiens
aaaaaugcugcu

SEQ ID NO: 1738391 - RNA, 20 nt, Homo sapiens
aaaacagucuacauugagca

SEQ ID NO: 1738392 - RNA, 12 nt, Homo sapiens
aaaaucacucaa

SEQ ID NO: 1738393 - RNA, 23 nt, Homo sapiens
aaaaugaagguggaacaagcaca

SEQ ID NO: 1738394 - RNA, 23 nt, Homo sapiens
aaaaugucauuguucuugugaac

SEQ ID NO: 1738395 - RNA, 19 nt, Homo sapiens
aaacagauggcacuuugaa

SEQ ID NO: 1738396 - RNA, 14 nt, Homo sapiens
aaacaugugcccuc

SEQ ID NO: 1738397 - RNA, 13 nt, Homo sapiens
aaacgagacuuuc

SEQ ID NO: 1738398 - RNA, 17 nt, Homo sapiens
aaacguauugcauuuaa

SEQ ID NO: 1738399 - RNA, 15 nt, Homo sapiens
aaacguccacagagu

SEQ ID NO: 1738400 - RNA, 16 nt, Homo sapiens
aaacuacauuuugcaa

SEQ ID NO: 1738401 - RNA, 19 nt, Homo sapiens
aaacuuagugacaaaauag

SEQ ID NO: 1738402 - RNA, 20 nt, Homo sapiens
aaacuuauccuccaugaaua

SEQ ID NO: 1738403 - RNA, 16 nt, Homo sapiens
aaacuuugcaucucag

SEQ ID NO: 1738404 - RNA, 16 nt, Homo sapiens
aaagaagaccugagaa

SEQ ID NO: 1738405 - RNA, 17 nt, Homo sapiens
aaagacaucagucucca

SEQ ID NO: 1738406 - RNA, 18 nt, Homo sapiens
aaagagagucgcaucuca

SEQ ID NO: 1738407 - RNA, 20 nt, Homo sapiens
aaagcaucaauacaaccagc

SEQ ID NO: 1738408 - RNA, 21 nt, Homo sapiens
aaagcaucaauacaaccagcc

SEQ ID NO: 1738409 - RNA, 18 nt, Homo sapiens
aaaggauuuuaccaaagc

SEQ ID NO: 1738410 - RNA, 20 nt, Homo sapiens
aaaggauuuuaccaaagcau

SEQ ID NO: 1738411 - RNA, 13 nt, Homo sapiens
acccauucuacac

SEQ ID NO: 1738412 - RNA, 15 nt, Homo sapiens
acccccagcucaaug

SEQ ID NO: 1738413 - RNA, 12 nt, Homo sapiens
acccggugcucc

SEQ ID NO: 1738414 - RNA, 18 nt, Homo sapiens
acccuccccacagugcca

SEQ ID NO: 1738415 - RNA, 16 nt, Homo sapiens
acccugccccuugcca

SEQ ID NO: 1738416 - RNA, 17 nt, Homo sapiens
acccuucgagaucauca

SEQ ID NO: 1738417 - RNA, 21 nt, Homo sapiens
acccuuuggccccacuuugaa

SEQ ID NO: 1738418 - RNA, 18 nt, Homo sapiens
accuaagucucugugaau

SEQ ID NO: 1738419 - RNA, 14 nt, Homo sapiens
accuacccaugacc

SEQ ID NO: 1738420 - RNA, 16 nt, Homo sapiens
accuacccaugaccug

SEQ ID NO: 1738421 - RNA, 12 nt, Homo sapiens
accucauuauca

SEQ ID NO: 1738422 - RNA, 13 nt, Homo sapiens
accuccucuguga

SEQ ID NO: 1738423 - RNA, 13 nt, Homo sapiens
accugaagacacc

SEQ ID NO: 1738424 - RNA, 17 nt, Homo sapiens
accugccucccauucua

SEQ ID NO: 1738425 - RNA, 15 nt, Homo sapiens
accuucagagccagc

SEQ ID NO: 1738426 - RNA, 19 nt, Homo sapiens
accuuccagcuccuguaac

SEQ ID NO: 1738427 - RNA, 12 nt, Homo sapiens
accuuccucauc

SEQ ID NO: 1738428 - RNA, 19 nt, Homo sapiens
accuugaagaaccucucac

SEQ ID NO: 1738429 - RNA, 21 nt, Homo sapiens
accuuucagauaacuguuauu

SEQ ID NO: 1738430 - RNA, 15 nt, Homo sapiens
acgaaaaacauuuca

SEQ ID NO: 1738431 - RNA, 15 nt, Homo sapiens
acgaucuuccuggcu

SEQ ID NO: 1738432 - RNA, 18 nt, Homo sapiens
acuaauagaaaaguaugu

SEQ ID NO: 1738433 - RNA, 14 nt, Homo sapiens
acucaaucauuucu

SEQ ID NO: 1738434 - RNA, 23 nt, Homo sapiens
acucauugcaaccuccaccuucu

SEQ ID NO: 1738435 - RNA, 19 nt, Homo sapiens
acuccucaggcagcgugug

SEQ ID NO: 1738436 - RNA, 13 nt, Homo sapiens
acuccucaggguu

SEQ ID NO: 1738437 - RNA, 19 nt, Homo sapiens
acucuucaguuaagccuuu

SEQ ID NO: 1738438 - RNA, 18 nt, Homo sapiens
acugaaaacaagccauga

SEQ ID NO: 1738439 - RNA, 21 nt, Homo sapiens
acugauagaugucuauucuug

SEQ ID NO: 1738440 - RNA, 14 nt, Homo sapiens
acugccugcuccca

SEQ ID NO: 1738441 - RNA, 20 nt, Homo sapiens
acugggugcgucuccaguca

SEQ ID NO: 1738442 - RNA, 21 nt, Homo sapiens
acuguaaagcuuugugcagau

SEQ ID NO: 1738443 - RNA, 19 nt, Homo sapiens
acuuacauuuacaaacuga

SEQ ID NO: 1738444 - RNA, 16 nt, Homo sapiens
acuuguuuucugggaa

SEQ ID NO: 1738445 - RNA, 22 nt, Homo sapiens
acuuugucccguggcauuucaa

SEQ ID NO: 1738446 - RNA, 18 nt, Homo sapiens
acuuuuauuuccagugaa

SEQ ID NO: 1738447 - RNA, 17 nt, Homo sapiens
acuuuugccauugacuu

SEQ ID NO: 1738448 - RNA, 22 nt, Homo sapiens
acuuuugccauugacuucuucc

SEQ ID NO: 1738449 - RNA, 21 nt, Homo sapiens
agaaaaauaugaccacacucc

SEQ ID NO: 1738450 - RNA, 19 nt, Homo sapiens
agaaaagcaauacuguuuc

SEQ ID NO: 1738451 - RNA, 17 nt, Homo sapiens
agaaaauaaaagcacuu

SEQ ID NO: 1738452 - RNA, 17 nt, Homo sapiens
agaaacuucggggcugc

SEQ ID NO: 1738453 - RNA, 14 nt, Homo sapiens
agaaauagcuuaug

SEQ ID NO: 1738454 - RNA, 12 nt, Homo sapiens
agaaaugauuca

SEQ ID NO: 1738455 - RNA, 22 nt, Homo sapiens
agaaaugauucaaauugcugcu

SEQ ID NO: 1738456 - RNA, 15 nt, Homo sapiens
agaauaaauucccaa

SEQ ID NO: 1738457 - RNA, 16 nt, Homo sapiens
agaauugguugccaua

SEQ ID NO: 1738458 - RNA, 11 nt, Homo sapiens
agaauuugcac

SEQ ID NO: 1738459 - RNA, 13 nt, Homo sapiens
agacaauuugcac

SEQ ID NO: 1738460 - RNA, 21 nt, Homo sapiens
agacaccaccacccuugccau

SEQ ID NO: 1738461 - RNA, 12 nt, Homo sapiens
agaccugaggga

SEQ ID NO: 1738462 - RNA, 21 nt, Homo sapiens
agaccuggcacuggaugcaga

SEQ ID NO: 1738463 - RNA, 14 nt, Homo sapiens
agacucauaccaca

SEQ ID NO: 1738464 - RNA, 13 nt, Homo sapiens
agacuugggaugg

SEQ ID NO: 1738465 - RNA, 13 nt, Homo sapiens
agacuuuucccaa

SEQ ID NO: 1738466 - RNA, 13 nt, Homo sapiens
agagagccuggug

SEQ ID NO: 1738467 - RNA, 19 nt, Homo sapiens
agagagccuggugcugcug

SEQ ID NO: 1738468 - RNA, 21 nt, Homo sapiens
gccaggccacccugccucuac

SEQ ID NO: 1738469 - RNA, 21 nt, Homo sapiens
gccaugcagaccucaugccca

SEQ ID NO: 1738470 - RNA, 20 nt, Homo sapiens
gccauggagguuaagcacuu

SEQ ID NO: 1738471 - RNA, 18 nt, Homo sapiens
gccauguaucaauauuca

SEQ ID NO: 1738472 - RNA, 19 nt, Homo sapiens
gcccagugcauaugcaaug

SEQ ID NO: 1738473 - RNA, 13 nt, Homo sapiens
gccccaauucgau

SEQ ID NO: 1738474 - RNA, 12 nt, Homo sapiens
gccccacuuuga

SEQ ID NO: 1738475 - RNA, 17 nt, Homo sapiens
gcccccucacaguauug

SEQ ID NO: 1738476 - RNA, 16 nt, Homo sapiens
gcccccuccucuagcu

SEQ ID NO: 1738477 - RNA, 19 nt, Homo sapiens
gccccugucucggggcuug

SEQ ID NO: 1738478 - RNA, 18 nt, Homo sapiens
gcccggcgccgggcacca

SEQ ID NO: 1738479 - RNA, 14 nt, Homo sapiens
gcccucagauuccg

SEQ ID NO: 1738480 - RNA, 15 nt, Homo sapiens
gcccugcagccagcu

SEQ ID NO: 1738481 - RNA, 21 nt, Homo sapiens
gccucccauucuacucaaagu

SEQ ID NO: 1738482 - RNA, 14 nt, Homo sapiens
gccugccuaugaaa

SEQ ID NO: 1738483 - RNA, 17 nt, Homo sapiens
gccugcuggauguggag

SEQ ID NO: 1738484 - RNA, 21 nt, Homo sapiens
gccuggaucucacaagcacuu

SEQ ID NO: 1738485 - RNA, 15 nt, Homo sapiens
gccuggcuccaaacc

SEQ ID NO: 1738486 - RNA, 14 nt, Homo sapiens
gccugugauuuccu

SEQ ID NO: 1738487 - RNA, 13 nt, Homo sapiens
gcgcagccaugug

SEQ ID NO: 1738488 - RNA, 18 nt, Homo sapiens
gcggaucuuuggacagaa

SEQ ID NO: 1738489 - RNA, 15 nt, Homo sapiens
gcgugagccaccaaa

SEQ ID NO: 1738490 - RNA, 13 nt, Homo sapiens
gcgugcaggcagc

SEQ ID NO: 1738491 - RNA, 15 nt, Homo sapiens
gcucagcauuuccac

SEQ ID NO: 1738492 - RNA, 16 nt, Homo sapiens
gcucauuuugacaaag

SEQ ID NO: 1738493 - RNA, 18 nt, Homo sapiens
gcuccaaaugcagcuuua

SEQ ID NO: 1738494 - RNA, 13 nt, Homo sapiens
gcuccagugcagg

SEQ ID NO: 1738495 - RNA, 21 nt, Homo sapiens
gcugaacuuguuuucugggaa

SEQ ID NO: 1738496 - RNA, 20 nt, Homo sapiens
gcugacaccuaacucuucuu

SEQ ID NO: 1738497 - RNA, 19 nt, Homo sapiens
gcugacaguuuguggcauc

SEQ ID NO: 1738498 - RNA, 17 nt, Homo sapiens
gcugaggcccagugcau

SEQ ID NO: 1738499 - RNA, 16 nt, Homo sapiens
gcugcuccagugcagg

SEQ ID NO: 1738500 - RNA, 12 nt, Homo sapiens
gcuggggccaaa

SEQ ID NO: 1738501 - RNA, 23 nt, Homo sapiens
gcuuaguccaauuccuugcacau

SEQ ID NO: 1738502 - RNA, 18 nt, Homo sapiens
gcuuggcugugcccucag

SEQ ID NO: 1738503 - RNA, 13 nt, Homo sapiens
gcuuuccccaugu

SEQ ID NO: 1738504 - RNA, 13 nt, Homo sapiens
gcuuugauauuuc

SEQ ID NO: 1738505 - RNA, 16 nt, Homo sapiens
ggaaaauggccaugca

SEQ ID NO: 1738506 - RNA, 14 nt, Homo sapiens
ggaacucaguguga

SEQ ID NO: 1738507 - RNA, 17 nt, Homo sapiens
ggaaggacauccauguu

SEQ ID NO: 1738508 - RNA, 22 nt, Homo sapiens
ggaaggaggccaagcagugccu

SEQ ID NO: 1738509 - RNA, 12 nt, Homo sapiens
ggacacaggcca

SEQ ID NO: 1738510 - RNA, 16 nt, Homo sapiens
ggacagaagcagcucu

SEQ ID NO: 1738511 - RNA, 16 nt, Homo sapiens
ggagacuuuacaugga

SEQ ID NO: 1738512 - RNA, 21 nt, Homo sapiens
ggagcuugaaauagugucuga

SEQ ID NO: 1738513 - RNA, 16 nt, Homo sapiens
ggaguggcauguauga

SEQ ID NO: 1738514 - RNA, 17 nt, Homo sapiens
ggauagacuuuucccaa

SEQ ID NO: 1738515 - RNA, 20 nt, Homo sapiens
ggaugauuauuuucuguucu

SEQ ID NO: 1738516 - RNA, 21 nt, Homo sapiens
ggaugccaaccggucacccag

SEQ ID NO: 1738517 - RNA, 22 nt, Homo sapiens
ggaugccaaccggucacccagg

SEQ ID NO: 1738518 - RNA, 13 nt, Homo sapiens
uagacaauuugca

SEQ ID NO: 1738519 - RNA, 15 nt, Homo sapiens
uagacaauuugcaca

SEQ ID NO: 1738520 - RNA, 17 nt, Homo sapiens
uagaguuucuguuugau

SEQ ID NO: 1738521 - RNA, 13 nt, Homo sapiens
uagaucuuucuag

SEQ ID NO: 1738522 - RNA, 22 nt, Homo sapiens
uagaugacaaccuccauucuau

SEQ ID NO: 1738523 - RNA, 14 nt, Homo sapiens
uagaugucuuuucc

SEQ ID NO: 1738524 - RNA, 19 nt, Homo sapiens
uagcgcagccaugugauua

SEQ ID NO: 1738525 - RNA, 16 nt, Homo sapiens
uagcuugcaccuuguc

SEQ ID NO: 1738526 - RNA, 13 nt, Homo sapiens
uagggaccugcug

SEQ ID NO: 1738527 - RNA, 15 nt, Homo sapiens
uaguugucuuuccug

SEQ ID NO: 1738528 - RNA, 13 nt, Homo sapiens
uauaggucacuuu

SEQ ID NO: 1738529 - RNA, 13 nt, Homo sapiens
uauauaagccagu

SEQ ID NO: 1738530 - RNA, 17 nt, Homo sapiens
uauaugucaucucagug

SEQ ID NO: 1738531 - RNA, 22 nt, Homo sapiens
uauauuugaaaaaaacuucauu

SEQ ID NO: 1738532 - RNA, 18 nt, Homo sapiens
uaucuuucgauaaacaac

SEQ ID NO: 1738533 - RNA, 16 nt, Homo sapiens
uaugaugucccuaugg

SEQ ID NO: 1738534 - RNA, 16 nt, Homo sapiens
uauggacugcucagga

SEQ ID NO: 1738535 - RNA, 23 nt, Homo sapiens
uaugucgagagcuggccaaagag

SEQ ID NO: 1738536 - RNA, 17 nt, Homo sapiens
uauucaaaaugauguau

SEQ ID NO: 1738537 - RNA, 16 nt, Homo sapiens
uauugagcaccugcag

SEQ ID NO: 1738538 - RNA, 19 nt, Homo sapiens
uauuuauugagcaccugca

SEQ ID NO: 1738539 - RNA, 20 nt, Homo sapiens
uauuugcauauguaugacuc

SEQ ID NO: 1738540 - RNA, 18 nt, Homo sapiens
ucaaacuacuuugcugcu

SEQ ID NO: 1738541 - RNA, 12 nt, Homo sapiens
ucaaaugggcug

SEQ ID NO: 1738542 - RNA, 18 nt, Homo sapiens
ucaaaugggcugcugcuu

SEQ ID NO: 1738543 - RNA, 23 nt, Homo sapiens
ucaagcagacauagaagagccaa

SEQ ID NO: 1738544 - RNA, 19 nt, Homo sapiens
ucaauacaaccagcccaac

SEQ ID NO: 1738545 - RNA, 22 nt, Homo sapiens
ucaaugagcauguuuagacuuu

SEQ ID NO: 1738546 - RNA, 15 nt, Homo sapiens
ucaauuuugacuuaa

SEQ ID NO: 1738547 - RNA, 13 nt, Homo sapiens
ucacaagcacuuu

SEQ ID NO: 1738548 - RNA, 17 nt, Homo sapiens
ucacauagagugaucuu

SEQ ID NO: 1738549 - RNA, 22 nt, Homo sapiens
ucaccauggcccccucaucaua

SEQ ID NO: 1738550 - RNA, 14 nt, Homo sapiens
ucacccaggaggau

SEQ ID NO: 1738551 - RNA, 20 nt, Homo sapiens
ucaccuaagucucugugaau

SEQ ID NO: 1738552 - RNA, 21 nt, Homo sapiens
ucaccuaagucucugugaauu

SEQ ID NO: 1738553 - RNA, 17 nt, Homo sapiens
ucaccuccucugugauu

SEQ ID NO: 1738554 - RNA, 12 nt, Homo sapiens
ucaccuuauuca

SEQ ID NO: 1738555 - RNA, 13 nt, Homo sapiens
ucacuggaacuca

SEQ ID NO: 1738556 - RNA, 23 nt, Homo sapiens
ucagaaaaaggaaaccacaguga

SEQ ID NO: 1738557 - RNA, 22 nt, Homo sapiens
ucagagccagccggcuaugaaa

SEQ ID NO: 1738558 - RNA, 23 nt, Homo sapiens
ucagagcuccaguuugcauuugg

SEQ ID NO: 1738559 - RNA, 15 nt, Homo sapiens
ucagccagucucaga

SEQ ID NO: 1738560 - RNA, 21 nt, Homo sapiens
ucaggcagcaccacacugggu

SEQ ID NO: 1738561 - RNA, 13 nt, Homo sapiens
ucaggcagcucaa

SEQ ID NO: 1738562 - RNA, 21 nt, Homo sapiens
ucagugcaaagauuugcuuua

SEQ ID NO: 1738563 - RNA, 14 nt, Homo sapiens
ucagugcaggagag

SEQ ID NO: 1738564 - RNA, 15 nt, Homo sapiens
ucaguuaagccuuug

SEQ ID NO: 1738565 - RNA, 17 nt, Homo sapiens
ucaucaaaaacuuugga

SEQ ID NO: 1738566 - RNA, 13 nt, Homo sapiens
ucauccaccccau

SEQ ID NO: 1738567 - RNA, 21 nt, Homo sapiens
ucaucuguaaaauggagacac

SEQ ID NO: 1738568 - RNA, 14 nt, Homo sapiens
ucauugcacuuuga

SEQ ID NO: 1738569 - RNA, 17 nt, Homo sapiens
ucauuguucuugugaac

SEQ ID NO: 1738570 - RNA, 15 nt, Homo sapiens
ucauuuguucauuaa

SEQ ID NO: 1738571 - RNA, 17 nt, Homo sapiens
uccaauuccuugcacau

SEQ ID NO: 1738572 - RNA, 18 nt, Homo sapiens
uccaauuccuugcacaua

SEQ ID NO: 1738573 - RNA, 19 nt, Homo sapiens
uccaauuccuugcacauag

SEQ ID NO: 1738574 - RNA, 15 nt, Homo sapiens
uccacaccugggcau

SEQ ID NO: 1738575 - RNA, 14 nt, Homo sapiens
uccacagaguauaa

SEQ ID NO: 1738576 - RNA, 16 nt, Homo sapiens
uccaccuagacuguaa

SEQ ID NO: 1738577 - RNA, 14 nt, Homo sapiens
uccagaacacggcu

SEQ ID NO: 1738578 - RNA, 16 nt, Homo sapiens
uccaggauagacuuuu

SEQ ID NO: 1738579 - RNA, 13 nt, Homo sapiens
uccagugcaggag

SEQ ID NO: 1738580 - RNA, 16 nt, Homo sapiens
uccaucucugacuuaa

SEQ ID NO: 1738581 - RNA, 20 nt, Homo sapiens
uccauuccagucaaaucugg

SEQ ID NO: 1738582 - RNA, 18 nt, Homo sapiens
ucccaaauuuucacauaa

SEQ ID NO: 1738583 - RNA, 17 nt, Homo sapiens
uggaaggggacacguga

SEQ ID NO: 1738584 - RNA, 15 nt, Homo sapiens
uggacagaagcagcu

SEQ ID NO: 1738585 - RNA, 20 nt, Homo sapiens
uggacuccugcacacgcucc

SEQ ID NO: 1738586 - RNA, 22 nt, Homo sapiens
uggacuuuuauuuccagugaaa

SEQ ID NO: 1738587 - RNA, 22 nt, Homo sapiens
uggagaggcccggccucucaca

SEQ ID NO: 1738588 - RNA, 19 nt, Homo sapiens
uggagagucagaucuuucu

SEQ ID NO: 1738589 - RNA, 16 nt, Homo sapiens
uggagcagcagccacu

SEQ ID NO: 1738590 - RNA, 19 nt, Homo sapiens
uggagcccauccagucucc

SEQ ID NO: 1738591 - RNA, 21 nt, Homo sapiens
uggaggcacugaagugcuuag

SEQ ID NO: 1738592 - RNA, 16 nt, Homo sapiens
uggaguauuggggucu

SEQ ID NO: 1738593 - RNA, 18 nt, Homo sapiens
uggaucucacaagcacuu

SEQ ID NO: 1738594 - RNA, 19 nt, Homo sapiens
uggaucucacaagcacuuu

SEQ ID NO: 1738595 - RNA, 19 nt, Homo sapiens
uggaugcagaaacaguuca

SEQ ID NO: 1738596 - RNA, 22 nt, Homo sapiens
uggaugccaaccggucacccag

SEQ ID NO: 1738597 - RNA, 13 nt, Homo sapiens
uggauucaaguga

SEQ ID NO: 1738598 - RNA, 19 nt, Homo sapiens
uggcaaagaugaucaguau

SEQ ID NO: 1738599 - RNA, 11 nt, Homo sapiens
uggcacuuuga

SEQ ID NO: 1738600 - RNA, 12 nt, Homo sapiens
uggcacuuugaa

SEQ ID NO: 1738601 - RNA, 17 nt, Homo sapiens
uggccacggccacggcc

SEQ ID NO: 1738602 - RNA, 13 nt, Homo sapiens
uggccugcuggau

SEQ ID NO: 1738603 - RNA, 17 nt, Homo sapiens
uggcgcgcgccaccacg

SEQ ID NO: 1738604 - RNA, 16 nt, Homo sapiens
ugggcacuucaucuga

SEQ ID NO: 1738605 - RNA, 18 nt, Homo sapiens
ugggcagggugacccuga

SEQ ID NO: 1738606 - RNA, 16 nt, Homo sapiens
ugggugggugggauga

SEQ ID NO: 1738607 - RNA, 23 nt, Homo sapiens
ugguacuuagaguuucuguuuga

SEQ ID NO: 1738608 - RNA, 12 nt, Homo sapiens
uggucacuggaa

SEQ ID NO: 1738609 - RNA, 17 nt, Homo sapiens
uggucccaggcuuccca

SEQ ID NO: 1738610 - RNA, 13 nt, Homo sapiens
uguacauuucacc

SEQ ID NO: 1738611 - RNA, 15 nt, Homo sapiens
uguagacuauuugcu

SEQ ID NO: 1738612 - RNA, 17 nt, Homo sapiens
uguagaugacaaccucc

SEQ ID NO: 1738613 - RNA, 17 nt, Homo sapiens
uguauaaguccuugcaa

SEQ ID NO: 1738614 - RNA, 23 nt, Homo sapiens
uguaugacucccaaauuuucaca

SEQ ID NO: 1738615 - RNA, 17 nt, Homo sapiens
uguaugugugugcaugu

SEQ ID NO: 1738616 - RNA, 18 nt, Homo sapiens
uguauuaaagacagaggc

SEQ ID NO: 1738617 - RNA, 22 nt, Homo sapiens
ugucacaucagcaauuucagaa

SEQ ID NO: 1738618 - RNA, 18 nt, Homo sapiens
uguccuuuuucacuuuga

SEQ ID NO: 1738619 - RNA, 19 nt, Homo sapiens
uguccuuuuucacuuugaa

SEQ ID NO: 1738620 - RNA, 23 nt, Homo sapiens
ugucuacacacccugcauaucau

SEQ ID NO: 1738621 - RNA, 18 nt, Homo sapiens
ugucuauuaucacauuaa

SEQ ID NO: 1738622 - RNA, 15 nt, Homo sapiens
ugucuggccaggccu

SEQ ID NO: 1738623 - RNA, 19 nt, Homo sapiens
ugugaaauaccaaccugaa

SEQ ID NO: 1738624 - RNA, 19 nt, Homo sapiens
ugugacuccucaggguuga

SEQ ID NO: 1738625 - RNA, 14 nt, Homo sapiens
ugugcccucagauu

SEQ ID NO: 1738626 - RNA, 12 nt, Homo sapiens
ugugcugugacu

SEQ ID NO: 1738627 - RNA, 15 nt, Homo sapiens
ugugggucucuggaa

SEQ ID NO: 1738628 - RNA, 17 nt, Homo sapiens
uguuauauaauuuagac

SEQ ID NO: 1738629 - RNA, 16 nt, Homo sapiens
uguuaucaccuagcug

SEQ ID NO: 1738630 - RNA, 11 nt, Homo sapiens
uguuaugucaa

SEQ ID NO: 1738631 - RNA, 13 nt, Homo sapiens
uacugccauguac

SEQ ID NO: 1738632 - RNA, 15 nt, Homo sapiens
uagaauaaauuccca

SEQ ID NO: 1738633 - RNA, 16 nt, Homo sapiens
uagaauaaauucccaa

SEQ ID NO: 1738634 - RNA, 21 nt, Homo sapiens
uagaaugagcacccauuccaa

SEQ ID NO: 1738635 - RNA, 23 nt, Homo sapiens
uagacaacauggccgugaacuuu

SEQ ID NO: 1738636 - RNA, 19 nt, Homo sapiens
uagacuuuucccaagccua

SEQ ID NO: 1738637 - RNA, 16 nt, Homo sapiens
uaggcauuaacacaaa

SEQ ID NO: 1738638 - RNA, 16 nt, Homo sapiens
uaggccguuccuucaa

SEQ ID NO: 1738639 - RNA, 20 nt, Homo sapiens
uaguaugggacuggccucug

SEQ ID NO: 1738640 - RNA, 14 nt, Homo sapiens
uaguguacuuggag

SEQ ID NO: 1738641 - RNA, 18 nt, Homo sapiens
uagugucuauuaucacau

SEQ ID NO: 1738642 - RNA, 17 nt, Homo sapiens
uagugucugaugaaugu

SEQ ID NO: 1738643 - RNA, 21 nt, Homo sapiens
uaguuuguuuuagaaccagcc

SEQ ID NO: 1738644 - RNA, 16 nt, Homo sapiens
uaguuuucaaaacaca

SEQ ID NO: 1738645 - RNA, 14 nt, Homo sapiens
uauaagccaguuca

SEQ ID NO: 1738646 - RNA, 16 nt, Homo sapiens
uauaauuaauugucau

SEQ ID NO: 1738647 - RNA, 19 nt, Homo sapiens
uauaauuuagacuuggauu

SEQ ID NO: 1738648 - RNA, 17 nt, Homo sapiens
uauauaugugaugaucu

SEQ ID NO: 1738649 - RNA, 13 nt, Homo sapiens
uaucaguccaaag

SEQ ID NO: 1738650 - RNA, 15 nt, Homo sapiens
uaugaaaaugucauu

SEQ ID NO: 1738651 - RNA, 18 nt, Homo sapiens
uaugaugucccuauggaa

SEQ ID NO: 1738652 - RNA, 21 nt, Homo sapiens
uauguauugugcaauguguau

SEQ ID NO: 1738653 - RNA, 20 nt, Homo sapiens
uaugucaucucagugcugua

SEQ ID NO: 1738654 - RNA, 21 nt, Homo sapiens
uaugugaucaauuuugacuua

SEQ ID NO: 1738655 - RNA, 15 nt, Homo sapiens
uauucuugugcuuuu

SEQ ID NO: 1738656 - RNA, 14 nt, Homo sapiens
uauugcgcugcuac

SEQ ID NO: 1738657 - RNA, 18 nt, Homo sapiens
uauuguuguccuuuucau

SEQ ID NO: 1738658 - RNA, 18 nt, Homo sapiens
uauuuaaagccuccucau

SEQ ID NO: 1738659 - RNA, 15 nt, Homo sapiens
uauuuauaaucacuu

SEQ ID NO: 1738660 - RNA, 12 nt, Homo sapiens
uauuugaaugau

SEQ ID NO: 1738661 - RNA, 20 nt, Homo sapiens
uauuuuaauuuaaucuucca

SEQ ID NO: 1738662 - RNA, 23 nt, Homo sapiens
ucaaacuacuuugcugcuaauau

SEQ ID NO: 1738663 - RNA, 15 nt, Homo sapiens
ucaaaucguccagcg

SEQ ID NO: 1738664 - RNA, 14 nt, Homo sapiens
ucaaauugcugcuu

SEQ ID NO: 1738665 - RNA, 15 nt, Homo sapiens
ucaaauugcugcuug

SEQ ID NO: 1738666 - RNA, 16 nt, Homo sapiens
ucaacuuuuccuuuca

SEQ ID NO: 1738667 - RNA, 22 nt, Homo sapiens
ucaagagaucuuucuuuccaaa

SEQ ID NO: 1738668 - RNA, 23 nt, Homo sapiens
ucaagagaucuuucuuuccaaaa

SEQ ID NO: 1738669 - RNA, 13 nt, Homo sapiens
ucaagaguucagu

SEQ ID NO: 1738670 - RNA, 22 nt, Homo sapiens
ucaagcagacauagaagagcca

SEQ ID NO: 1738671 - RNA, 21 nt, Homo sapiens
ucaagguuuuaaaacagucua

SEQ ID NO: 1738672 - RNA, 15 nt, Homo sapiens
ucaauacaaccagcc

SEQ ID NO: 1738673 - RNA, 21 nt, Homo sapiens
ucacaguuuugguugcuuuaa

SEQ ID NO: 1738674 - RNA, 20 nt, Homo sapiens
ucaccccagcgagcucucaa

SEQ ID NO: 1738675 - RNA, 15 nt, Homo sapiens
ucaccuccucuguga

SEQ ID NO: 1738676 - RNA, 22 nt, Homo sapiens
ucacucaagaguucagugcuca

SEQ ID NO: 1738677 - RNA, 19 nt, Homo sapiens
ucacuggaacucaguguga

SEQ ID NO: 1738678 - RNA, 12 nt, Homo sapiens
ucagaacagccu

SEQ ID NO: 1738679 - RNA, 19 nt, Homo sapiens
ucagcauuuccacaccaag

SEQ ID NO: 1738680 - RNA, 13 nt, Homo sapiens
ucagccucccaca

SEQ ID NO: 1738681 - RNA, 16 nt, Homo sapiens
ucaguugcauucauua

SEQ ID NO: 1738682 - RNA, 22 nt, Homo sapiens
ucaucauuucacuugucaggag

SEQ ID NO: 1738683 - RNA, 13 nt, Homo sapiens
ucaucucagugcu

SEQ ID NO: 1738684 - RNA, 15 nt, Homo sapiens
ucauugcacuuugau

SEQ ID NO: 1738685 - RNA, 13 nt, Homo sapiens
ucauuucuucuac

SEQ ID NO: 1738686 - RNA, 20 nt, Homo sapiens
ucauuucuucuacaacucau

SEQ ID NO: 1738687 - RNA, 14 nt, Homo sapiens
uccaaaacauuucu

SEQ ID NO: 1738688 - RNA, 23 nt, Homo sapiens
uccaaaccccaggguagccaugg

SEQ ID NO: 1738689 - RNA, 17 nt, Homo sapiens
uccacaguguugccaga

SEQ ID NO: 1738690 - RNA, 15 nt, Homo sapiens
uccaccuagacugua

SEQ ID NO: 1738691 - RNA, 19 nt, Homo sapiens
uccagcagaagacaaaaag

SEQ ID NO: 1738692 - RNA, 14 nt, Homo sapiens
uccagcuccuguaa

SEQ ID NO: 1738693 - RNA, 18 nt, Homo sapiens
uccauaacugaacaucca

SEQ ID NO: 1738694 - RNA, 12 nt, Homo sapiens
uccauguacuug

SEQ ID NO: 1738695 - RNA, 21 nt, Homo sapiens
ucccaaagugcugggaauuac

SEQ ID NO: 1738696 - RNA, 20 nt, Homo sapiens
ucccaaguacccugagauac

SEQ ID NO: 1738697 - RNA, 13 nt, Homo sapiens
ucccacacaggcu

SEQ ID NO: 1738698 - RNA, 21 nt, Homo sapiens
ucccacagcgcuggccgggac

SEQ ID NO: 1738699 - RNA, 16 nt, Homo sapiens
ucccagagucaucuga

SEQ ID NO: 1738700 - RNA, 12 nt, Homo sapiens
ucccagcccagc

SEQ ID NO: 1738701 - RNA, 16 nt, Homo sapiens
ucccaucgcugucaca

SEQ ID NO: 1738702 - RNA, 23 nt, Homo sapiens
ucccauuaccauguaauggcagu

SEQ ID NO: 1738703 - RNA, 14 nt, Homo sapiens
ucccauuucccaaa

SEQ ID NO: 1738704 - RNA, 21 nt, Homo sapiens
uccccaguucauugcacuuug

SEQ ID NO: 1738705 - RNA, 14 nt, Homo sapiens
ucccccugugaaag

SEQ ID NO: 1738706 - RNA, 14 nt, Homo sapiens
uccccucaccuccu

SEQ ID NO: 1738707 - RNA, 20 nt, Homo sapiens
uccccugccugcccugguga

SEQ ID NO: 1738708 - RNA, 15 nt, Homo sapiens
uccccuucccuccaa

SEQ ID NO: 1738709 - RNA, 22 nt, Homo sapiens
ucccuauuuuuuuucuguuaua

SEQ ID NO: 1738710 - RNA, 15 nt, Homo sapiens
uccgaggccaguacc

SEQ ID NO: 1738711 - RNA, 20 nt, Homo sapiens
uccuagcgcagccaugugau

SEQ ID NO: 1738712 - RNA, 22 nt, Homo sapiens
uccuagcgcagccaugugauua

SEQ ID NO: 1738713 - RNA, 23 nt, Homo sapiens
uccucucaaccaccuuucagaua

SEQ ID NO: 1738714 - RNA, 16 nt, Homo sapiens
cuuugguggcauggaa

SEQ ID NO: 1738715 - RNA, 23 nt, Homo sapiens
cuuuuauaggugagaaaaaaaca

SEQ ID NO: 1738716 - RNA, 16 nt, Homo sapiens
cuuuuauuuccaguga

SEQ ID NO: 1738717 - RNA, 20 nt, Homo sapiens
cuuuugcccauuuugaauca

SEQ ID NO: 1738718 - RNA, 18 nt, Homo sapiens
cuuuuuuauacucaauca

SEQ ID NO: 1738719 - RNA, 18 nt, Homo sapiens
gaaaaaaaccacacaaag

SEQ ID NO: 1738720 - RNA, 18 nt, Homo sapiens
gaaaaaaacuucauucuc

SEQ ID NO: 1738721 - RNA, 20 nt, Homo sapiens
gaaaaccagcucagcacugc

SEQ ID NO: 1738722 - RNA, 14 nt, Homo sapiens
gaaaauggccaugc

SEQ ID NO: 1738723 - RNA, 19 nt, Homo sapiens
gaaaauuggaacucuacuc

SEQ ID NO: 1738724 - RNA, 17 nt, Homo sapiens
gaaacuucggggcugca

SEQ ID NO: 1738725 - RNA, 19 nt, Homo sapiens
gaaaggauuuuaccaaagc

SEQ ID NO: 1738726 - RNA, 21 nt, Homo sapiens
gaaauaauuguuguucuguua

SEQ ID NO: 1738727 - RNA, 23 nt, Homo sapiens
gaaauacacagugcugaccagac

SEQ ID NO: 1738728 - RNA, 16 nt, Homo sapiens
gaaaucuuucucccuc

SEQ ID NO: 1738729 - RNA, 22 nt, Homo sapiens
gaaaucuuucucccucaacuga

SEQ ID NO: 1738730 - RNA, 23 nt, Homo sapiens
gaaauuuagcauuguagugcuuu

SEQ ID NO: 1738731 - RNA, 14 nt, Homo sapiens
gaacaaugacaaac

SEQ ID NO: 1738732 - RNA, 16 nt, Homo sapiens
gaacaccauugaggga

SEQ ID NO: 1738733 - RNA, 19 nt, Homo sapiens
gaacaccauugagggagcu

SEQ ID NO: 1738734 - RNA, 18 nt, Homo sapiens
gaacagguaguauuacac

SEQ ID NO: 1738735 - RNA, 14 nt, Homo sapiens
gaacauaaagccuu

SEQ ID NO: 1738736 - RNA, 23 nt, Homo sapiens
gaacauaaagccuuggauguaua

SEQ ID NO: 1738737 - RNA, 18 nt, Homo sapiens
gaaccugcccugcuccca

SEQ ID NO: 1738738 - RNA, 13 nt, Homo sapiens
gaacucaguguga

SEQ ID NO: 1738739 - RNA, 22 nt, Homo sapiens
gaacucaguuaaaucuuugaag

SEQ ID NO: 1738740 - RNA, 19 nt, Homo sapiens
gaacugaaaacaagccaug

SEQ ID NO: 1738741 - RNA, 19 nt, Homo sapiens
gcuuuaaaacuuauccucc

SEQ ID NO: 1738742 - RNA, 23 nt, Homo sapiens
gcuuuaauuguuaagauaugaug

SEQ ID NO: 1738743 - RNA, 19 nt, Homo sapiens
ggaagguucuggugugaac

SEQ ID NO: 1738744 - RNA, 16 nt, Homo sapiens
ggaauaugagcuuuau

SEQ ID NO: 1738745 - RNA, 20 nt, Homo sapiens
ggaauccuuuggugccaacu

SEQ ID NO: 1738746 - RNA, 14 nt, Homo sapiens
ggacuugggcggga

SEQ ID NO: 1738747 - RNA, 23 nt, Homo sapiens
ggagaaaauuggaacucuacuca

SEQ ID NO: 1738748 - RNA, 16 nt, Homo sapiens
ggagcagcagccacug

SEQ ID NO: 1738749 - RNA, 15 nt, Homo sapiens
ggaggaucaguuuuu

SEQ ID NO: 1738750 - RNA, 16 nt, Homo sapiens
ggaggcucaggugauc

SEQ ID NO: 1738751 - RNA, 14 nt, Homo sapiens
ggagggcaguuuuc

SEQ ID NO: 1738752 - RNA, 18 nt, Homo sapiens
ggaguguggccacguggg

SEQ ID NO: 1738753 - RNA, 15 nt, Homo sapiens
ggauagagugggaca

SEQ ID NO: 1738754 - RNA, 22 nt, Homo sapiens
ggaugauuauuuucuguucuau

SEQ ID NO: 1738755 - RNA, 14 nt, Homo sapiens
ggauuuuaccaaag

SEQ ID NO: 1738756 - RNA, 16 nt, Homo sapiens
ggcaaucucagaugca

SEQ ID NO: 1738757 - RNA, 14 nt, Homo sapiens
ggcacuugggacaa

SEQ ID NO: 1738758 - RNA, 22 nt, Homo sapiens
ggcagcaggauagagugggaca

SEQ ID NO: 1738759 - RNA, 16 nt, Homo sapiens
ggcagccacccaagcc

SEQ ID NO: 1738760 - RNA, 22 nt, Homo sapiens
ggcagcugacaguuuguggcau

SEQ ID NO: 1738761 - RNA, 17 nt, Homo sapiens
ggccaacggcaacagca

SEQ ID NO: 1738762 - RNA, 22 nt, Homo sapiens
ggccacagccacuaaucaggag

SEQ ID NO: 1738763 - RNA, 18 nt, Homo sapiens
ggccacggagcaguucag

SEQ ID NO: 1738764 - RNA, 17 nt, Homo sapiens
ggccaguaccuuuccau

SEQ ID NO: 1738765 - RNA, 23 nt, Homo sapiens
ggcccuuccucuuugguggcaug

SEQ ID NO: 1738766 - RNA, 24 nt, Homo sapiens
ggccuguccacccugccaagacuc

SEQ ID NO: 1738767 - RNA, 11 nt, Homo sapiens
ggcuggcacug

SEQ ID NO: 1738768 - RNA, 15 nt, Homo sapiens
ggcugggaguggcau

SEQ ID NO: 1738769 - RNA, 17 nt, Homo sapiens
ggcuuuagggaccugcu

SEQ ID NO: 1738770 - RNA, 21 nt, Homo sapiens
gggaaggaggccaagcagugc

SEQ ID NO: 1738771 - RNA, 21 nt, Homo sapiens
gggcgccaccgccacccgcag

SEQ ID NO: 1738772 - RNA, 17 nt, Homo sapiens
gggcuuuagggaccugc

SEQ ID NO: 1738773 - RNA, 22 nt, Homo sapiens
ggggaccuuaagugauuugccu

SEQ ID NO: 1738774 - RNA, 16 nt, Homo sapiens
ggguuuugaacauaaa

SEQ ID NO: 1738775 - RNA, 17 nt, Homo sapiens
ggugaggggcuggcacu

SEQ ID NO: 1738776 - RNA, 13 nt, Homo sapiens
ggugggugggaug

SEQ ID NO: 1738777 - RNA, 20 nt, Homo sapiens
gguggguuuugaacauaaag

SEQ ID NO: 1738778 - RNA, 15 nt, Homo sapiens
gguguuugucugugu

SEQ ID NO: 1738779 - RNA, 23 nt, Homo sapiens
gguuugucgggcaccagccagcg

SEQ ID NO: 1738780 - RNA, 16 nt, Homo sapiens
guaaaauggagacacc

SEQ ID NO: 1738781 - RNA, 14 nt, Homo sapiens
guaaguguucucau

SEQ ID NO: 1738782 - RNA, 14 nt, Homo sapiens
guacccucucagcu

SEQ ID NO: 1738783 - RNA, 13 nt, Homo sapiens
guaguuuguuuua

SEQ ID NO: 1738784 - RNA, 22 nt, Homo sapiens
guaguuuguuuuagaaccagcc

SEQ ID NO: 1738785 - RNA, 17 nt, Homo sapiens
guaguuuucaaaacaca

SEQ ID NO: 1738786 - RNA, 21 nt, Homo sapiens
guaguuuuuacagcuguguua

SEQ ID NO: 1738787 - RNA, 16 nt, Homo sapiens
guauaaguccuugcaa

SEQ ID NO: 1738788 - RNA, 15 nt, Homo sapiens
guauaugucaucuca

SEQ ID NO: 1738789 - RNA, 22 nt, Homo sapiens
guaucugcucauuuugacaaag

SEQ ID NO: 1738790 - RNA, 11 nt, Homo sapiens
gucaaacuguc

SEQ ID NO: 1738791 - RNA, 16 nt, Homo sapiens
gucacaucagcaauuu

SEQ ID NO: 1738792 - RNA, 21 nt, Homo sapiens
gucagaaaaaggaaaccacag

SEQ ID NO: 1738793 - RNA, 21 nt, Homo sapiens
gucauuauuuuuguuagcaaa

SEQ ID NO: 1738794 - RNA, 20 nt, Homo sapiens
guccaaccagaaacaccccu

SEQ ID NO: 1738795 - RNA, 13 nt, Homo sapiens
gucccguggcauu

SEQ ID NO: 1738796 - RNA, 13 nt, Homo sapiens
guccugccggugg

SEQ ID NO: 1738797 - RNA, 15 nt, Homo sapiens
guccuuuuucacuuu

SEQ ID NO: 1738798 - RNA, 22 nt, Homo sapiens
gucuacauugagcauuugaaag

SEQ ID NO: 1738799 - RNA, 22 nt, Homo sapiens
gucucaguguccucaucuguaa

SEQ ID NO: 1738800 - RNA, 18 nt, Homo sapiens
gucuccagucaucuguaa

SEQ ID NO: 1738801 - RNA, 15 nt, Homo sapiens
gugaaaacugguuaa

SEQ ID NO: 1738802 - RNA, 16 nt, Homo sapiens
gugaccucagcuuuga

SEQ ID NO: 1738803 - RNA, 21 nt, Homo sapiens
gugaccugacagcccaagggu

SEQ ID NO: 1738804 - RNA, 20 nt, Homo sapiens
gugacucgagucacacucaa

SEQ ID NO: 1738805 - RNA, 13 nt, Homo sapiens
gugacuggccugc

SEQ ID NO: 1738806 - RNA, 20 nt, Homo sapiens
gugauuacccucugggucuc

SEQ ID NO: 1738807 - RNA, 16 nt, Homo sapiens
gugcugggcauuuuua

SEQ ID NO: 1738808 - RNA, 21 nt, Homo sapiens
gugggauggcauuuggucuca

SEQ ID NO: 1738809 - RNA, 13 nt, Homo sapiens
guggucacuggaa

SEQ ID NO: 1738810 - RNA, 18 nt, Homo sapiens
gugucauuggaagccauc

SEQ ID NO: 1738811 - RNA, 17 nt, Homo sapiens
gugucugccaaacacau

SEQ ID NO: 1738812 - RNA, 15 nt, Homo sapiens
gugucuuaauuauua

SEQ ID NO: 1738813 - RNA, 18 nt, Homo sapiens
guguugccagagccuuaa

SEQ ID NO: 1738814 - RNA, 17 nt, Homo sapiens
guuauuauauaauuaca

SEQ ID NO: 1738815 - RNA, 16 nt, Homo sapiens
guucauugcacuuuga

SEQ ID NO: 1738816 - RNA, 18 nt, Homo sapiens
guucuguuaacugaauac

SEQ ID NO: 1738817 - RNA, 10 nt, Homo sapiens
guugcagcug

SEQ ID NO: 1738818 - RNA, 13 nt, Homo sapiens
guuggaacauccu

SEQ ID NO: 1738819 - RNA, 15 nt, Homo sapiens
guuuauguagucagu

SEQ ID NO: 1738820 - RNA, 22 nt, Homo sapiens
guuugggaauauccauguacuu

SEQ ID NO: 1738821 - RNA, 14 nt, Homo sapiens
guuuguagugaaau

SEQ ID NO: 1738822 - RNA, 15 nt, Homo sapiens
guuuuuaagccuuaa

SEQ ID NO: 1738823 - RNA, 14 nt, Homo sapiens
uaaaaaugcugcuc

SEQ ID NO: 1738824 - RNA, 12 nt, Homo sapiens
uaaaagcacuua

SEQ ID NO: 1738825 - RNA, 18 nt, Homo sapiens
uaaaauacaagacugcca

SEQ ID NO: 1738826 - RNA, 14 nt, Homo sapiens
accaauaaagccuu

SEQ ID NO: 1738827 - RNA, 11 nt, Homo sapiens
accacacaaag

SEQ ID NO: 1738828 - RNA, 14 nt, Homo sapiens
accagcccaaccau

SEQ ID NO: 1738829 - RNA, 20 nt, Homo sapiens
accauagggacccauucuac

SEQ ID NO: 1738830 - RNA, 15 nt, Homo sapiens
accauccagugacaa

SEQ ID NO: 1738831 - RNA, 15 nt, Homo sapiens
acccagagguggaug

SEQ ID NO: 1738832 - RNA, 17 nt, Homo sapiens
acccauucuacacagag

SEQ ID NO: 1738833 - RNA, 15 nt, Homo sapiens
accccaagcaggaac

SEQ ID NO: 1738834 - RNA, 20 nt, Homo sapiens
accccagacgaugucuucau

SEQ ID NO: 1738835 - RNA, 20 nt, Homo sapiens
accccgagccuggcuccaaa

SEQ ID NO: 1738836 - RNA, 20 nt, Homo sapiens
acccuaguucuaccucaggc

SEQ ID NO: 1738837 - RNA, 21 nt, Homo sapiens
acccuggagcccauccagucu

SEQ ID NO: 1738838 - RNA, 13 nt, Homo sapiens
acccuugccaugg

SEQ ID NO: 1738839 - RNA, 20 nt, Homo sapiens
acccuuuggccccacuuuga

SEQ ID NO: 1738840 - RNA, 23 nt, Homo sapiens
accguucauucaggcaacgcaca

SEQ ID NO: 1738841 - RNA, 23 nt, Homo sapiens
accuaagucucugugaauugaaa

SEQ ID NO: 1738842 - RNA, 13 nt, Homo sapiens
accuacccaugac

SEQ ID NO: 1738843 - RNA, 15 nt, Homo sapiens
accuacccaugaccu

SEQ ID NO: 1738844 - RNA, 14 nt, Homo sapiens
accuagacuguaaa

SEQ ID NO: 1738845 - RNA, 16 nt, Homo sapiens
accucaggcagcucaa

SEQ ID NO: 1738846 - RNA, 11 nt, Homo sapiens
accuccucaug

SEQ ID NO: 1738847 - RNA, 14 nt, Homo sapiens
accuucagagccag

SEQ ID NO: 1738848 - RNA, 23 nt, Homo sapiens
accuuggaagggcguucuaggua

SEQ ID NO: 1738849 - RNA, 13 nt, Homo sapiens
acggcaccucggg

SEQ ID NO: 1738850 - RNA, 14 nt, Homo sapiens
acggccacagucau

SEQ ID NO: 1738851 - RNA, 13 nt, Homo sapiens
acucaacccauug

SEQ ID NO: 1738852 - RNA, 17 nt, Homo sapiens
acucgagucacacucaa

SEQ ID NO: 1738853 - RNA, 17 nt, Homo sapiens
acucugacaacagacuu

SEQ ID NO: 1738854 - RNA, 13 nt, Homo sapiens
acugaacauccaa

SEQ ID NO: 1738855 - RNA, 14 nt, Homo sapiens
acugaacauccaaa

SEQ ID NO: 1738856 - RNA, 12 nt, Homo sapiens
acugcauuuuac

SEQ ID NO: 1738857 - RNA, 17 nt, Homo sapiens
acugcugcuccagugca

SEQ ID NO: 1738858 - RNA, 20 nt, Homo sapiens
acuguuugucucaccuaccc

SEQ ID NO: 1738859 - RNA, 18 nt, Homo sapiens
acuuacauuuacaaacug

SEQ ID NO: 1738860 - RNA, 15 nt, Homo sapiens
acuugggacauugcc

SEQ ID NO: 1738861 - RNA, 19 nt, Homo sapiens
acuugggcgggacacaggc

SEQ ID NO: 1738862 - RNA, 19 nt, Homo sapiens
acuuuaacacagugucugg

SEQ ID NO: 1738863 - RNA, 20 nt, Homo sapiens
acuuugcuugcucauaugca

SEQ ID NO: 1738864 - RNA, 19 nt, Homo sapiens
agaaaaaaaccacacaaag

SEQ ID NO: 1738865 - RNA, 19 nt, Homo sapiens
agaaaagaugcacuuugcu

SEQ ID NO: 1738866 - RNA, 22 nt, Homo sapiens
agaaacaccccucugucuagga

SEQ ID NO: 1738867 - RNA, 19 nt, Homo sapiens
agaaauccaagcaccacca

SEQ ID NO: 1738868 - RNA, 23 nt, Homo sapiens
agaaaugauucaaauugcugcuu

SEQ ID NO: 1738869 - RNA, 21 nt, Homo sapiens
agaaggccacuguuugucuca

SEQ ID NO: 1738870 - RNA, 10 nt, Homo sapiens
agaauuugca

SEQ ID NO: 1738871 - RNA, 17 nt, Homo sapiens
agacaagugacuguauc

SEQ ID NO: 1738872 - RNA, 21 nt, Homo sapiens
agacaagugacuguaucugug

SEQ ID NO: 1738873 - RNA, 23 nt, Homo sapiens
agacaccaccacccuugccaugg

SEQ ID NO: 1738874 - RNA, 18 nt, Homo sapiens
agaccaagcugugcccug

SEQ ID NO: 1738875 - RNA, 19 nt, Homo sapiens
agacccauagcagcuuugu

SEQ ID NO: 1738876 - RNA, 21 nt, Homo sapiens
agaccugagaauguaucccca

SEQ ID NO: 1738877 - RNA, 15 nt, Homo sapiens
agaccuggcacugga

SEQ ID NO: 1738878 - RNA, 15 nt, Homo sapiens
agagaagcauucuca

SEQ ID NO: 1738879 - RNA, 17 nt, Homo sapiens
agagacgggguuugcca

SEQ ID NO: 1738880 - RNA, 18 nt, Homo sapiens
agagagguuugcaguccc

SEQ ID NO: 1738881 - RNA, 16 nt, Homo sapiens
agagagucgcaucuca

SEQ ID NO: 1738882 - RNA, 19 nt, Homo sapiens
agagaucuuucuuuccaaa

SEQ ID NO: 1738883 - RNA, 21 nt, Homo sapiens
agagccugaguguugccuaau

SEQ ID NO: 1738884 - RNA, 13 nt, Homo sapiens
agagccuuuccaa

SEQ ID NO: 1738885 - RNA, 22 nt, Homo sapiens
agaggacguguuacccacugcc

SEQ ID NO: 1738886 - RNA, 13 nt, Homo sapiens
agauaaagaccuu

SEQ ID NO: 1738887 - RNA, 23 nt, Homo sapiens
agauaacuguuauuuauaaucac

SEQ ID NO: 1738888 - RNA, 14 nt, Homo sapiens
agauacuucccaaa

SEQ ID NO: 1738889 - RNA, 22 nt, Homo sapiens
agaucacaguggccacggccac

SEQ ID NO: 1738890 - RNA, 20 nt, Homo sapiens
agaugacaaccuccauucua

SEQ ID NO: 1738891 - RNA, 14 nt, Homo sapiens
agauggcacuuuga

SEQ ID NO: 1738892 - RNA, 13 nt, Homo sapiens
agaugucacagau

SEQ ID NO: 1738893 - RNA, 12 nt, Homo sapiens
agauucccacug

SEQ ID NO: 1738894 - RNA, 19 nt, Homo sapiens
agauuccuggcagagccau

SEQ ID NO: 1738895 - RNA, 20 nt, Homo sapiens
agauucuguuaacucuugaa

SEQ ID NO: 1738896 - RNA, 23 nt, Homo sapiens
agauugaucaaaguguaaacacc

SEQ ID NO: 1738897 - RNA, 23 nt, Homo sapiens
agauuuguuuuuaaacuguacag

SEQ ID NO: 1738898 - RNA, 16 nt, Homo sapiens
agcaaagauuaaaugu

SEQ ID NO: 1738899 - RNA, 22 nt, Homo sapiens
agcacuuucccucuuggugccu

SEQ ID NO: 1738900 - RNA, 23 nt, Homo sapiens
agcagaccaccccgccugcccuc

SEQ ID NO: 1738901 - RNA, 22 nt, Homo sapiens
agcagagacgggguuugccaug

SEQ ID NO: 1738902 - RNA, 19 nt, Homo sapiens
agcaggacuuugaggcaag

SEQ ID NO: 1738903 - RNA, 14 nt, Homo sapiens
agcaggcugugagu

SEQ ID NO: 1738904 - RNA, 17 nt, Homo sapiens
agcauauuguuauuaua

SEQ ID NO: 1738905 - RNA, 18 nt, Homo sapiens
agccacccaagccugcug

SEQ ID NO: 1738906 - RNA, 13 nt, Homo sapiens
agccagucucaga

SEQ ID NO: 1738907 - RNA, 16 nt, Homo sapiens
agcccauccagucucc

SEQ ID NO: 1738908 - RNA, 18 nt, Homo sapiens
agccccgccccguuguga

SEQ ID NO: 1738909 - RNA, 17 nt, Homo sapiens
agccccgggaguggcgc

SEQ ID NO: 1738910 - RNA, 17 nt, Homo sapiens
agccguuuguuccccaa

SEQ ID NO: 1738911 - RNA, 22 nt, Homo sapiens
agccugccuggcaggcugucug

SEQ ID NO: 1738912 - RNA, 18 nt, Homo sapiens
agccuggcuccaaacccu

SEQ ID NO: 1738913 - RNA, 20 nt, Homo sapiens
agccuggcuccaaacccucg

SEQ ID NO: 1738914 - RNA, 21 nt, Homo sapiens
agccuuggauguauaugucau

SEQ ID NO: 1738915 - RNA, 14 nt, Homo sapiens
agccuuuguuuuuc

SEQ ID NO: 1738916 - RNA, 16 nt, Homo sapiens
agcucagcauuuccac

SEQ ID NO: 1738917 - RNA, 18 nt, Homo sapiens
agcucagcauuuccacac

SEQ ID NO: 1738918 - RNA, 13 nt, Homo sapiens
agcuccacagugu

SEQ ID NO: 1738919 - RNA, 21 nt, Homo sapiens
agcuggauagacuugggaugg

SEQ ID NO: 1738920 - RNA, 17 nt, Homo sapiens
agcugggcucugcaauu

SEQ ID NO: 1738921 - RNA, 22 nt, Homo sapiens
agcuggggaccugguacccucc

SEQ ID NO: 1738922 - RNA, 14 nt, Homo sapiens
aggaaaagugcaag

SEQ ID NO: 1738923 - RNA, 15 nt, Homo sapiens
aggaaaccacaguga

SEQ ID NO: 1738924 - RNA, 16 nt, Homo sapiens
aggaaaggauuuuacc

SEQ ID NO: 1738925 - RNA, 22 nt, Homo sapiens
aggaaaggauuuuaccaaagca

SEQ ID NO: 1738926 - RNA, 16 nt, Homo sapiens
aggaaccccaggagau

SEQ ID NO: 1738927 - RNA, 23 nt, Homo sapiens
aggaaggguaagggaaaggaugg

SEQ ID NO: 1738928 - RNA, 21 nt, Homo sapiens
aggagacuuuacauggaugcc

SEQ ID NO: 1738929 - RNA, 23 nt, Homo sapiens
aggagacuuuacauggaugccaa

SEQ ID NO: 1738930 - RNA, 17 nt, Homo sapiens
aggauuuuaugcuuuaa

SEQ ID NO: 1738931 - RNA, 22 nt, Homo sapiens
aggcagcaggauagagugggac

SEQ ID NO: 1738932 - RNA, 17 nt, Homo sapiens
aggcaucucuguacuuu

SEQ ID NO: 1738933 - RNA, 19 nt, Homo sapiens
aggcauugccuucucugcc

SEQ ID NO: 1738934 - RNA, 15 nt, Homo sapiens
aggccagaugcacau

SEQ ID NO: 1738935 - RNA, 17 nt, Homo sapiens
aggccaguaugauuuau

SEQ ID NO: 1738936 - RNA, 18 nt, Homo sapiens
aggccauuccccgucucu

SEQ ID NO: 1738937 - RNA, 22 nt, Homo sapiens
aggccauuccccgucucugguu

SEQ ID NO: 1738938 - RNA, 13 nt, Homo sapiens
ccuacuuuugcca

SEQ ID NO: 1738939 - RNA, 17 nt, Homo sapiens
ccucaacugaaggggug

SEQ ID NO: 1738940 - RNA, 20 nt, Homo sapiens
ccuccaccuucuggguucaa

SEQ ID NO: 1738941 - RNA, 18 nt, Homo sapiens
ccuccaggauagacuuuu

SEQ ID NO: 1738942 - RNA, 18 nt, Homo sapiens
ccuccuuagaccugaggg

SEQ ID NO: 1738943 - RNA, 15 nt, Homo sapiens
ccucgcccuccacaa

SEQ ID NO: 1738944 - RNA, 13 nt, Homo sapiens
ccucuaagguugg

SEQ ID NO: 1738945 - RNA, 14 nt, Homo sapiens
ccucucacaaaaga

SEQ ID NO: 1738946 - RNA, 15 nt, Homo sapiens
ccucuguugccaagg

SEQ ID NO: 1738947 - RNA, 12 nt, Homo sapiens
ccucuucaaaau

SEQ ID NO: 1738948 - RNA, 17 nt, Homo sapiens
ccucuucaccuuauuca

SEQ ID NO: 1738949 - RNA, 21 nt, Homo sapiens
ccugcaccccugcaguuugag

SEQ ID NO: 1738950 - RNA, 20 nt, Homo sapiens
ccugccagccccugccauug

SEQ ID NO: 1738951 - RNA, 21 nt, Homo sapiens
ccugcucauguaccucugauu

SEQ ID NO: 1738952 - RNA, 14 nt, Homo sapiens
ccugcucccacaga

SEQ ID NO: 1738953 - RNA, 16 nt, Homo sapiens
ccuggacacucagacc

SEQ ID NO: 1738954 - RNA, 19 nt, Homo sapiens
ccuggagcccauccagucu

SEQ ID NO: 1738955 - RNA, 18 nt, Homo sapiens
ccuguaaagaaacauuuc

SEQ ID NO: 1738956 - RNA, 21 nt, Homo sapiens
ccugugaacugaacucugaca

SEQ ID NO: 1738957 - RNA, 19 nt, Homo sapiens
ccuuaccacugcucugaug

SEQ ID NO: 1738958 - RNA, 16 nt, Homo sapiens
ccuucuuacaaugcau

SEQ ID NO: 1738959 - RNA, 23 nt, Homo sapiens
ccuugacucugccguuuccuaau

SEQ ID NO: 1738960 - RNA, 23 nt, Homo sapiens
ccuuuccgguguuuaagacauuu

SEQ ID NO: 1738961 - RNA, 11 nt, Homo sapiens
ccuuuucauag

SEQ ID NO: 1738962 - RNA, 23 nt, Homo sapiens
cgaggaaaggauuuuaccaaagc

SEQ ID NO: 1738963 - RNA, 14 nt, Homo sapiens
cgcagccaugugau

SEQ ID NO: 1738964 - RNA, 22 nt, Homo sapiens
cgcugggauccgggaucaaagu

SEQ ID NO: 1738965 - RNA, 13 nt, Homo sapiens
cgcuuauguuaau

SEQ ID NO: 1738966 - RNA, 11 nt, Homo sapiens
cggaagccaaa

SEQ ID NO: 1738967 - RNA, 12 nt, Homo sapiens
cggccacggcca

SEQ ID NO: 1738968 - RNA, 16 nt, Homo sapiens
cgguguuuaagacauu

SEQ ID NO: 1738969 - RNA, 16 nt, Homo sapiens
cgugugggcaauguuc

SEQ ID NO: 1738970 - RNA, 20 nt, Homo sapiens
cguuuguuccccaagacauu

SEQ ID NO: 1738971 - RNA, 21 nt, Homo sapiens
cuaaaaaaaaugcauauuaau

SEQ ID NO: 1738972 - RNA, 22 nt, Homo sapiens
cuaaauauggacugcucaggaa

SEQ ID NO: 1738973 - RNA, 20 nt, Homo sapiens
cuaaggaauaugagcuuuau

SEQ ID NO: 1738974 - RNA, 22 nt, Homo sapiens
cuaccucauggggguauuguau

SEQ ID NO: 1738975 - RNA, 14 nt, Homo sapiens
cuacuugggagcac

SEQ ID NO: 1738976 - RNA, 14 nt, Homo sapiens
cuagcugugggggu

SEQ ID NO: 1738977 - RNA, 21 nt, Homo sapiens
cuaggggcuggggccaaauaa

SEQ ID NO: 1738978 - RNA, 14 nt, Homo sapiens
cuauggaagcauau

SEQ ID NO: 1738979 - RNA, 16 nt, Homo sapiens
cucaaccaccuuucag

SEQ ID NO: 1738980 - RNA, 13 nt, Homo sapiens
cucacaagcacuu

SEQ ID NO: 1738981 - RNA, 14 nt, Homo sapiens
cucacaagcacuuu

SEQ ID NO: 1738982 - RNA, 18 nt, Homo sapiens
cucaccuacccaugaccu

SEQ ID NO: 1738983 - RNA, 15 nt, Homo sapiens
cucacgucucccuaa

SEQ ID NO: 1738984 - RNA, 21 nt, Homo sapiens
cucacugugggaaggccagcu

SEQ ID NO: 1738985 - RNA, 13 nt, Homo sapiens
cucagaaggcaaa

SEQ ID NO: 1738986 - RNA, 14 nt, Homo sapiens
cucagcauuuccac

SEQ ID NO: 1738987 - RNA, 11 nt, Homo sapiens
cucagcccagc

SEQ ID NO: 1738988 - RNA, 18 nt, Homo sapiens
cucagccuacuccgcuca

SEQ ID NO: 1738989 - RNA, 13 nt, Homo sapiens
cucagcuuugaua

SEQ ID NO: 1738990 - RNA, 15 nt, Homo sapiens
cucaguguccucauc

SEQ ID NO: 1738991 - RNA, 18 nt, Homo sapiens
cucaguuugugugucuua

SEQ ID NO: 1738992 - RNA, 13 nt, Homo sapiens
cucauacacagaa

SEQ ID NO: 1738993 - RNA, 19 nt, Homo sapiens
cucauaugcauguagucac

SEQ ID NO: 1738994 - RNA, 18 nt, Homo sapiens
cucaucagacucugagua

SEQ ID NO: 1738995 - RNA, 16 nt, Homo sapiens
cucaugcuucacuuag

SEQ ID NO: 1738996 - RNA, 22 nt, Homo sapiens
cucauuggaaauuuagcauugu

SEQ ID NO: 1738997 - RNA, 13 nt, Homo sapiens
cuccaaacccucg

SEQ ID NO: 1738998 - RNA, 16 nt, Homo sapiens
cuccaauuaaggauuu

SEQ ID NO: 1738999 - RNA, 20 nt, Homo sapiens
cuccacaaaugggaaaacca

SEQ ID NO: 1739000 - RNA, 13 nt, Homo sapiens
cuccacaguguug

SEQ ID NO: 1739001 - RNA, 16 nt, Homo sapiens
cuccaccuagacugua

SEQ ID NO: 1739002 - RNA, 15 nt, Homo sapiens
cuccaguuugcauuu

SEQ ID NO: 1739003 - RNA, 12 nt, Homo sapiens
cucccacagaac

SEQ ID NO: 1739004 - RNA, 15 nt, Homo sapiens
cuccccuguaccuuu

SEQ ID NO: 1739005 - RNA, 15 nt, Homo sapiens
cucccguccauucca

SEQ ID NO: 1739006 - RNA, 22 nt, Homo sapiens
cucccugagugguccccaccuu

SEQ ID NO: 1739007 - RNA, 14 nt, Homo sapiens
cuccuggucuguga

SEQ ID NO: 1739008 - RNA, 22 nt, Homo sapiens
cucgaggcggaucuuuggacag

SEQ ID NO: 1739009 - RNA, 15 nt, Homo sapiens
cucgugagucauuua

SEQ ID NO: 1739010 - RNA, 19 nt, Homo sapiens
cucuacaucuucugccuua

SEQ ID NO: 1739011 - RNA, 24 nt, Homo sapiens
cucuaugaccucgcccuccacaaa

SEQ ID NO: 1739012 - RNA, 15 nt, Homo sapiens
cucuauuccaaaaag

SEQ ID NO: 1739013 - RNA, 22 nt, Homo sapiens
cucugacaacagacuucugaaa

SEQ ID NO: 1739014 - RNA, 17 nt, Homo sapiens
cucugacgcuugugaca

SEQ ID NO: 1739015 - RNA, 18 nt, Homo sapiens
cucugugaauugaaaugu

SEQ ID NO: 1739016 - RNA, 14 nt, Homo sapiens
cucuuggcagucac

SEQ ID NO: 1739017 - RNA, 18 nt, Homo sapiens
cugaaaaaaaaccugaga

SEQ ID NO: 1739018 - RNA, 20 nt, Homo sapiens
cugaacugaaaacaagccau

SEQ ID NO: 1739019 - RNA, 15 nt, Homo sapiens
cugaaggacugugac

SEQ ID NO: 1739020 - RNA, 12 nt, Homo sapiens
cugaagugcuua

SEQ ID NO: 1739021 - RNA, 22 nt, Homo sapiens
cugacaacagacuucugaaaua

SEQ ID NO: 1739022 - RNA, 16 nt, Homo sapiens
cugacaguuuguggca

SEQ ID NO: 1739023 - RNA, 15 nt, Homo sapiens
cugcacacaggacag

SEQ ID NO: 1739024 - RNA, 16 nt, Homo sapiens
cugcacccacccagga

SEQ ID NO: 1739025 - RNA, 15 nt, Homo sapiens
cugcagccucaggau

SEQ ID NO: 1739026 - RNA, 13 nt, Homo sapiens
cugccauguacua

SEQ ID NO: 1739027 - RNA, 16 nt, Homo sapiens
cugccugcccugguga

SEQ ID NO: 1739028 - RNA, 18 nt, Homo sapiens
cugcucagcagaggauau

SEQ ID NO: 1739029 - RNA, 16 nt, Homo sapiens
cugcuccagugcagga

SEQ ID NO: 1739030 - RNA, 19 nt, Homo sapiens
cugcuggauucaagugauc

SEQ ID NO: 1739031 - RNA, 16 nt, Homo sapiens
cuggaagaggaaccag

SEQ ID NO: 1739032 - RNA, 17 nt, Homo sapiens
cuggcacuugggacaaa

SEQ ID NO: 1739033 - RNA, 13 nt, Homo sapiens
cuggccgggaccc

SEQ ID NO: 1739034 - RNA, 12 nt, Homo sapiens
cuggcuccaaac

SEQ ID NO: 1739035 - RNA, 18 nt, Homo sapiens
cuggcugaaggacuguga

SEQ ID NO: 1739036 - RNA, 23 nt, Homo sapiens
cuggcugggaguggcauguauga

SEQ ID NO: 1739037 - RNA, 13 nt, Homo sapiens
cugggcucacuca

SEQ ID NO: 1739038 - RNA, 14 nt, Homo sapiens
cuggguuccugcaa

SEQ ID NO: 1739039 - RNA, 13 nt, Homo sapiens
cuguaucugugua

SEQ ID NO: 1739040 - RNA, 16 nt, Homo sapiens
cugucauccucaggaa

SEQ ID NO: 1739041 - RNA, 17 nt, Homo sapiens
cugucuuaaguuuauac

SEQ ID NO: 1739042 - RNA, 23 nt, Homo sapiens
cugugcugugacucgagucacac

SEQ ID NO: 1739043 - RNA, 16 nt, Homo sapiens
cugugggggugagggu

SEQ ID NO: 1739044 - RNA, 18 nt, Homo sapiens
cuguguagacuauuugcu

SEQ ID NO: 1739045 - RNA, 13 nt, Homo sapiens
cuguguuaggggu

SEQ ID NO: 1739046 - RNA, 13 nt, Homo sapiens
cuguuaacugaau

SEQ ID NO: 1739047 - RNA, 12 nt, Homo sapiens
cuguuaugucaa

SEQ ID NO: 1739048 - RNA, 12 nt, Homo sapiens
cuguucacagag

SEQ ID NO: 1739049 - RNA, 15 nt, Homo sapiens
cuguuuucucucggc

SEQ ID NO: 1739050 - RNA, 18 nt, Homo sapiens
cuguuuucugaaacacac

SEQ ID NO: 1739051 - RNA, 14 nt, Homo sapiens
cuuaagcaaaagaa

SEQ ID NO: 1739052 - RNA, 16 nt, Homo sapiens
guaguuuucaaaacac

SEQ ID NO: 1739053 - RNA, 15 nt, Homo sapiens
guaugaauuauucaa

SEQ ID NO: 1739054 - RNA, 23 nt, Homo sapiens
guaugacucccaaauuuucacau

SEQ ID NO: 1739055 - RNA, 19 nt, Homo sapiens
guauguucuaaccuuuaca

SEQ ID NO: 1739056 - RNA, 20 nt, Homo sapiens
guauuguauaaguccuugca

SEQ ID NO: 1739057 - RNA, 16 nt, Homo sapiens
gucaaacugaaauuca

SEQ ID NO: 1739058 - RNA, 21 nt, Homo sapiens
gucacuuuguuuuacugucuu

SEQ ID NO: 1739059 - RNA, 16 nt, Homo sapiens
gucauuauuuuuguua

SEQ ID NO: 1739060 - RNA, 23 nt, Homo sapiens
gucauuauuuuuguuagcaaaga

SEQ ID NO: 1739061 - RNA, 13 nt, Homo sapiens
guccacacccagc

SEQ ID NO: 1739062 - RNA, 17 nt, Homo sapiens
guccccucaccuccucu

SEQ ID NO: 1739063 - RNA, 17 nt, Homo sapiens
gucccguggcauuucaa

SEQ ID NO: 1739064 - RNA, 14 nt, Homo sapiens
gucgcaucucagug

SEQ ID NO: 1739065 - RNA, 18 nt, Homo sapiens
gucgcaucucagugcagg

SEQ ID NO: 1739066 - RNA, 20 nt, Homo sapiens
gucucacgucucccuaaaaa

SEQ ID NO: 1739067 - RNA, 14 nt, Homo sapiens
gucucccaaagugc

SEQ ID NO: 1739068 - RNA, 21 nt, Homo sapiens
gucucugaagugaaacugcuu

SEQ ID NO: 1739069 - RNA, 22 nt, Homo sapiens
gucugugcauuucugguugcac

SEQ ID NO: 1739070 - RNA, 15 nt, Homo sapiens
gucuugugaaggcag

SEQ ID NO: 1739071 - RNA, 22 nt, Homo sapiens
gugacagccguuuguuccccaa

SEQ ID NO: 1739072 - RNA, 13 nt, Homo sapiens
gugauggggcaag

SEQ ID NO: 1739073 - RNA, 21 nt, Homo sapiens
gugauuacccucugggucuca

SEQ ID NO: 1739074 - RNA, 18 nt, Homo sapiens
gugauuucuuucuuugca

SEQ ID NO: 1739075 - RNA, 18 nt, Homo sapiens
gugcaaagauuugcuuua

SEQ ID NO: 1739076 - RNA, 17 nt, Homo sapiens
gugccacccaugcagcu

SEQ ID NO: 1739077 - RNA, 22 nt, Homo sapiens
gugcucauacguaucugcucau

SEQ ID NO: 1739078 - RNA, 22 nt, Homo sapiens
gugcucuuuguuuugugucucu

SEQ ID NO: 1739079 - RNA, 15 nt, Homo sapiens
gugcugugcagcucu

SEQ ID NO: 1739080 - RNA, 15 nt, Homo sapiens
guggaacaagcacag

SEQ ID NO: 1739081 - RNA, 18 nt, Homo sapiens
gugucauaacuucauaga

SEQ ID NO: 1739082 - RNA, 14 nt, Homo sapiens
gugugacucauuaa

SEQ ID NO: 1739083 - RNA, 21 nt, Homo sapiens
gugugcaacagacaagugacu

SEQ ID NO: 1739084 - RNA, 17 nt, Homo sapiens
guguuggcagccucuuc

SEQ ID NO: 1739085 - RNA, 14 nt, Homo sapiens
guguuuguuggcaa

SEQ ID NO: 1739086 - RNA, 22 nt, Homo sapiens
guuaagcacuuuaacacagugu

SEQ ID NO: 1739087 - RNA, 12 nt, Homo sapiens
guucagcagaac

SEQ ID NO: 1739088 - RNA, 15 nt, Homo sapiens
guugaugccugugaa

SEQ ID NO: 1739089 - RNA, 14 nt, Homo sapiens
guugcuguuucaca

SEQ ID NO: 1739090 - RNA, 17 nt, Homo sapiens
guuuaggaauccuuugg

SEQ ID NO: 1739091 - RNA, 19 nt, Homo sapiens
guuugucucaccuacccau

SEQ ID NO: 1739092 - RNA, 18 nt, Homo sapiens
guuuuacaaugucauaua

SEQ ID NO: 1739093 - RNA, 12 nt, Homo sapiens
guuuuagaacca

SEQ ID NO: 1739094 - RNA, 16 nt, Homo sapiens
guuuuagaaccagccg

SEQ ID NO: 1739095 - RNA, 16 nt, Homo sapiens
guuuugguugcuuuaa

SEQ ID NO: 1739096 - RNA, 21 nt, Homo sapiens
guuuuucuaaaggaguuuaug

SEQ ID NO: 1739097 - RNA, 22 nt, Homo sapiens
uaaaaaaaaaacguauugcauu

SEQ ID NO: 1739098 - RNA, 12 nt, Homo sapiens
uaaaaagcucca

SEQ ID NO: 1739099 - RNA, 19 nt, Homo sapiens
uaaaaaugcugcucucagc

SEQ ID NO: 1739100 - RNA, 13 nt, Homo sapiens
uaaaaucacucaa

SEQ ID NO: 1739101 - RNA, 21 nt, Homo sapiens
uaaacaccauagggacccauu

SEQ ID NO: 1739102 - RNA, 15 nt, Homo sapiens
uaaacaccuccucau

SEQ ID NO: 1739103 - RNA, 20 nt, Homo sapiens
uaaacagauggcacuuugaa

SEQ ID NO: 1739104 - RNA, 19 nt, Homo sapiens
uaaaccgcaugugaucucc

SEQ ID NO: 1739105 - RNA, 15 nt, Homo sapiens
uaaagcuuugugcag

SEQ ID NO: 1739106 - RNA, 16 nt, Homo sapiens
uaaauaaaagcacaag

SEQ ID NO: 1739107 - RNA, 18 nt, Homo sapiens
uaaauaaccaauuccuca

SEQ ID NO: 1739108 - RNA, 20 nt, Homo sapiens
uaaauauggacugcucagga

SEQ ID NO: 1739109 - RNA, 13 nt, Homo sapiens
uaaaugaacaaga

SEQ ID NO: 1739110 - RNA, 17 nt, Homo sapiens
uaaauuuuuuguugaca

SEQ ID NO: 1739111 - RNA, 14 nt, Homo sapiens
uaaggaaacugggu

SEQ ID NO: 1739112 - RNA, 19 nt, Homo sapiens
uaagucuguuuuaugacuu

SEQ ID NO: 1739113 - RNA, 14 nt, Homo sapiens
uaauaucaucagua

SEQ ID NO: 1739114 - RNA, 13 nt, Homo sapiens
uaaucaacugggc

SEQ ID NO: 1739115 - RNA, 13 nt, Homo sapiens
uaaucccauuucc

SEQ ID NO: 1739116 - RNA, 17 nt, Homo sapiens
uaauuuaaacaccuccu

SEQ ID NO: 1739117 - RNA, 12 nt, Homo sapiens
uaauuuaaucuu

SEQ ID NO: 1739118 - RNA, 22 nt, Homo sapiens
uacaaaacaaacucauucauua

SEQ ID NO: 1739119 - RNA, 16 nt, Homo sapiens
uacagcaggugcucaa

SEQ ID NO: 1739120 - RNA, 15 nt, Homo sapiens
uacaguguuuauccu

SEQ ID NO: 1739121 - RNA, 15 nt, Homo sapiens
uacauaaaguaugug

SEQ ID NO: 1739122 - RNA, 16 nt, Homo sapiens
uacauauuugcauaug

SEQ ID NO: 1739123 - RNA, 16 nt, Homo sapiens
uacauugagcauuuga

SEQ ID NO: 1739124 - RNA, 14 nt, Homo sapiens
uaccaaagcaucaa

SEQ ID NO: 1739125 - RNA, 19 nt, Homo sapiens
uaccaaagcaucaauacaa

SEQ ID NO: 1739126 - RNA, 17 nt, Homo sapiens
uaccaaccugaagacac

SEQ ID NO: 1739127 - RNA, 19 nt, Homo sapiens
uaccacucuguaauugcaa

SEQ ID NO: 1739128 - RNA, 12 nt, Homo sapiens
uaccaugcugaa

SEQ ID NO: 1739129 - RNA, 14 nt, Homo sapiens
uacccacugccaug

SEQ ID NO: 1739130 - RNA, 19 nt, Homo sapiens
uacccugagauacuuccca

SEQ ID NO: 1739131 - RNA, 18 nt, Homo sapiens
uacccuuuuucuccagcu

SEQ ID NO: 1739132 - RNA, 22 nt, Homo sapiens
uacuaguuuuaguuuucucuua

SEQ ID NO: 1739133 - RNA, 12 nt, Homo sapiens
uacuguuuccau

SEQ ID NO: 1739134 - RNA, 15 nt, Homo sapiens
uagaaaaccagcuca

SEQ ID NO: 1739135 - RNA, 11 nt, Homo sapiens
uagaaccagcc

SEQ ID NO: 1739136 - RNA, 15 nt, Homo sapiens
uagacuauuugcuua

SEQ ID NO: 1739137 - RNA, 21 nt, Homo sapiens
uagacuuuaacauaagcuauu

SEQ ID NO: 1739138 - RNA, 16 nt, Homo sapiens
uagacuuuucccaagc

SEQ ID NO: 1739139 - RNA, 16 nt, Homo sapiens
uagagugggacaguuc

SEQ ID NO: 1739140 - RNA, 12 nt, Homo sapiens
uagaugcaggag

SEQ ID NO: 1739141 - RNA, 19 nt, Homo sapiens
uagcuugcaccuugucaca

SEQ ID NO: 1739142 - RNA, 17 nt, Homo sapiens
uaggauucuaaucucau

SEQ ID NO: 1739143 - RNA, 14 nt, Homo sapiens
uaguccaauuccuu

SEQ ID NO: 1739144 - RNA, 12 nt, Homo sapiens
uagucucaguga

SEQ ID NO: 1739145 - RNA, 17 nt, Homo sapiens
uaguuauauauggggau

SEQ ID NO: 1739146 - RNA, 13 nt, Homo sapiens
uaguucuaccuca

SEQ ID NO: 1739147 - RNA, 21 nt, Homo sapiens
uaucuguguagacuauuugcu

SEQ ID NO: 1739148 - RNA, 21 nt, Homo sapiens
uaugaacagcugugucugcca

SEQ ID NO: 1739149 - RNA, 16 nt, Homo sapiens
uauucuaaaaccauuc

SEQ ID NO: 1739150 - RNA, 21 nt, Homo sapiens
uauugcucacccagugcccuc

SEQ ID NO: 1739151 - RNA, 13 nt, Homo sapiens
uauuuaacaugua

SEQ ID NO: 1739152 - RNA, 18 nt, Homo sapiens
uauuuuaaucuaauucua

SEQ ID NO: 1739153 - RNA, 20 nt, Homo sapiens
ucaaaguguaaacaccauag

SEQ ID NO: 1739154 - RNA, 19 nt, Homo sapiens
ucaacucguuuuuauauua

SEQ ID NO: 1739155 - RNA, 18 nt, Homo sapiens
ucaacuuuuccuuucaua

SEQ ID NO: 1739156 - RNA, 21 nt, Homo sapiens
ucaagggaacuugagcgugaa

SEQ ID NO: 1739157 - RNA, 24 nt, Homo sapiens
ucaaugaagccagcucacagugcu

SEQ ID NO: 1739158 - RNA, 16 nt, Homo sapiens
ucacagcuccucccac

SEQ ID NO: 1739159 - RNA, 17 nt, Homo sapiens
ucacaucagcaauuuca

SEQ ID NO: 1739160 - RNA, 17 nt, Homo sapiens
ucacauguggacuuuua

SEQ ID NO: 1739161 - RNA, 21 nt, Homo sapiens
ucacauuuuuaaaagaacaau

SEQ ID NO: 1739162 - RNA, 19 nt, Homo sapiens
ucaccuaagucucugugaa

SEQ ID NO: 1739163 - RNA, 16 nt, Homo sapiens
ucaccuacccaugacc

SEQ ID NO: 1739164 - RNA, 18 nt, Homo sapiens
ucaccuccucugugauuu

SEQ ID NO: 1739165 - RNA, 13 nt, Homo sapiens
uugauucacucaa

SEQ ID NO: 1739166 - RNA, 22 nt, Homo sapiens
uugcacauaguagguacccaau

SEQ ID NO: 1739167 - RNA, 17 nt, Homo sapiens
uugcaguucccacauua

SEQ ID NO: 1739168 - RNA, 21 nt, Homo sapiens
uugccaaggcuggagugcagu

SEQ ID NO: 1739169 - RNA, 15 nt, Homo sapiens
uugccagagccuuaa

SEQ ID NO: 1739170 - RNA, 14 nt, Homo sapiens
uugcccccauuuca

SEQ ID NO: 1739171 - RNA, 17 nt, Homo sapiens
uuggacagaagcagcuc

SEQ ID NO: 1739172 - RNA, 19 nt, Homo sapiens
uuggacagaagcagcucuu

SEQ ID NO: 1739173 - RNA, 21 nt, Homo sapiens
uuggagagucagaucuuucuc

SEQ ID NO: 1739174 - RNA, 17 nt, Homo sapiens
uugggccagcuuuucaa

SEQ ID NO: 1739175 - RNA, 11 nt, Homo sapiens
uugguggcaug

SEQ ID NO: 1739176 - RNA, 14 nt, Homo sapiens
uugguggguuuuga

SEQ ID NO: 1739177 - RNA, 14 nt, Homo sapiens
uugucagaugcugu

SEQ ID NO: 1739178 - RNA, 20 nt, Homo sapiens
uuguccuuuuucacuuugaa

SEQ ID NO: 1739179 - RNA, 17 nt, Homo sapiens
uugucucugaugcagcu

SEQ ID NO: 1739180 - RNA, 23 nt, Homo sapiens
uugugcaauguguauaaacaaga

SEQ ID NO: 1739181 - RNA, 23 nt, Homo sapiens
uugugcuuaguccaauuccuugc

SEQ ID NO: 1739182 - RNA, 17 nt, Homo sapiens
uuguuaagauaugaugu

SEQ ID NO: 1739183 - RNA, 20 nt, Homo sapiens
uuguucuuuggaaauacaca

SEQ ID NO: 1739184 - RNA, 14 nt, Homo sapiens
uuguuuuucuccac

SEQ ID NO: 1739185 - RNA, 16 nt, Homo sapiens
uuuaaaaaaaagcaua

SEQ ID NO: 1739186 - RNA, 15 nt, Homo sapiens
uuuaaaauauccugu

SEQ ID NO: 1739187 - RNA, 13 nt, Homo sapiens
uuuaaacuguaca

SEQ ID NO: 1739188 - RNA, 14 nt, Homo sapiens
uuuaaaguggcaau

SEQ ID NO: 1739189 - RNA, 18 nt, Homo sapiens
uuuaaaguggcaaucuca

SEQ ID NO: 1739190 - RNA, 11 nt, Homo sapiens
uuuaagacauu

SEQ ID NO: 1739191 - RNA, 14 nt, Homo sapiens
uuuaauuuaaucuu

SEQ ID NO: 1739192 - RNA, 11 nt, Homo sapiens
uuuacauuuca

SEQ ID NO: 1739193 - RNA, 13 nt, Homo sapiens
uuuaucauaugcu

SEQ ID NO: 1739194 - RNA, 21 nt, Homo sapiens
uuucagguccagaguaguuuc

SEQ ID NO: 1739195 - RNA, 13 nt, Homo sapiens
uuucauacaacag

SEQ ID NO: 1739196 - RNA, 14 nt, Homo sapiens
uuucauacaacaga

SEQ ID NO: 1739197 - RNA, 16 nt, Homo sapiens
uuuccaaaacauuucu

SEQ ID NO: 1739198 - RNA, 22 nt, Homo sapiens
uuuccaugcacccucauacaca

SEQ ID NO: 1739199 - RNA, 15 nt, Homo sapiens
uuucccauuuaucua

SEQ ID NO: 1739200 - RNA, 19 nt, Homo sapiens
uuucccccugugaaagcaa

SEQ ID NO: 1739201 - RNA, 20 nt, Homo sapiens
uuuccgguguuuaagacauu

SEQ ID NO: 1739202 - RNA, 19 nt, Homo sapiens
uuucucuguuguaagaaua

SEQ ID NO: 1739203 - RNA, 16 nt, Homo sapiens
uuucugcagauggaaa

SEQ ID NO: 1739204 - RNA, 20 nt, Homo sapiens
uuucuugucuauaaagcauu

SEQ ID NO: 1739205 - RNA, 17 nt, Homo sapiens
uuucuuugcaccaaaga

SEQ ID NO: 1739206 - RNA, 17 nt, Homo sapiens
uuucuuuuuuauacuca

SEQ ID NO: 1739207 - RNA, 17 nt, Homo sapiens
uuugcagcugugccaua

SEQ ID NO: 1739208 - RNA, 18 nt, Homo sapiens
uuugcaucucaguaugaa

SEQ ID NO: 1739209 - RNA, 14 nt, Homo sapiens
uuugccaagggagg

SEQ ID NO: 1739210 - RNA, 22 nt, Homo sapiens
uuugugcagagauaaagaccuu

SEQ ID NO: 1739211 - RNA, 15 nt, Homo sapiens
uuuguuagcaaagau

SEQ ID NO: 1739212 - RNA, 11 nt, Homo sapiens
uuuguugacau

SEQ ID NO: 1739213 - RNA, 17 nt, Homo sapiens
uuuguugacauuagucu

SEQ ID NO: 1739214 - RNA, 12 nt, Homo sapiens
uuuuacauuuca

SEQ ID NO: 1739215 - RNA, 22 nt, Homo sapiens
uuuuaccaaagcaucaauacaa

SEQ ID NO: 1739216 - RNA, 13 nt, Homo sapiens
uuuuagaacaguc

SEQ ID NO: 1739217 - RNA, 13 nt, Homo sapiens
uuuucaaaacaca

SEQ ID NO: 1739218 - RNA, 16 nt, Homo sapiens
uuuugguugcuuuaau

SEQ ID NO: 1739219 - RNA, 21 nt, Homo sapiens
uuuuucccaaguacccugaga

SEQ ID NO: 1739220 - RNA, 15 nt, Homo sapiens
aaaaaacaaucugga

SEQ ID NO: 1739221 - RNA, 20 nt, Homo sapiens
aaaaaacguauugcauuuaa

SEQ ID NO: 1739222 - RNA, 16 nt, Homo sapiens
aaaaaucucccaguga

SEQ ID NO: 1739223 - RNA, 23 nt, Homo sapiens
aaaaaugcguaagaccaagcugu

SEQ ID NO: 1739224 - RNA, 14 nt, Homo sapiens
aaaaauuaggccgu

SEQ ID NO: 1739225 - RNA, 11 nt, Homo sapiens
aaaacaaacuc

SEQ ID NO: 1739226 - RNA, 11 nt, Homo sapiens
aaaacauuucu

SEQ ID NO: 1739227 - RNA, 16 nt, Homo sapiens
aaaacuuagugacaaa

SEQ ID NO: 1739228 - RNA, 11 nt, Homo sapiens
aaaagaacaau

SEQ ID NO: 1739229 - RNA, 16 nt, Homo sapiens
aaaagcacaaguacuu

SEQ ID NO: 1739230 - RNA, 11 nt, Homo sapiens
aaaagcacuua

SEQ ID NO: 1739231 - RNA, 17 nt, Homo sapiens
aaaagggaggcucucug

SEQ ID NO: 1739232 - RNA, 23 nt, Homo sapiens
aaaaugagcccuguccugccuaa

SEQ ID NO: 1739233 - RNA, 11 nt, Homo sapiens
aaaaugcugcu

SEQ ID NO: 1739234 - RNA, 21 nt, Homo sapiens
aaacaaagaugccacauucaa

SEQ ID NO: 1739235 - RNA, 12 nt, Homo sapiens
aaacaagccaug

SEQ ID NO: 1739236 - RNA, 13 nt, Homo sapiens
aaacacauuuacc

SEQ ID NO: 1739237 - RNA, 21 nt, Homo sapiens
aaacauugguucuuguauuaa

SEQ ID NO: 1739238 - RNA, 15 nt, Homo sapiens
aaaccagaaaagcaa

SEQ ID NO: 1739239 - RNA, 17 nt, Homo sapiens
aaaccagaaaagcaaua

SEQ ID NO: 1739240 - RNA, 13 nt, Homo sapiens
aaaccccagggua

SEQ ID NO: 1739241 - RNA, 17 nt, Homo sapiens
aaacccggccugauuaa

SEQ ID NO: 1739242 - RNA, 12 nt, Homo sapiens
aaacuaaggauu

SEQ ID NO: 1739243 - RNA, 13 nt, Homo sapiens
aaacuacuuugcu

SEQ ID NO: 1739244 - RNA, 14 nt, Homo sapiens
aaacuguacagugu

SEQ ID NO: 1739245 - RNA, 13 nt, Homo sapiens
aaagaauuugcac

SEQ ID NO: 1739246 - RNA, 12 nt, Homo sapiens
aaagacaucagu

SEQ ID NO: 1739247 - RNA, 19 nt, Homo sapiens
aaagauuaaaugugucauu

SEQ ID NO: 1739248 - RNA, 19 nt, Homo sapiens
aaagauuugcuuuaauugu

SEQ ID NO: 1739249 - RNA, 17 nt, Homo sapiens
aaagccuucaaacuccc

SEQ ID NO: 1739250 - RNA, 14 nt, Homo sapiens
aaagcuuugugcag

SEQ ID NO: 1739251 - RNA, 16 nt, Homo sapiens
aaagcuuugugcagau

SEQ ID NO: 1739252 - RNA, 17 nt, Homo sapiens
aaaggaaaccacaguga

SEQ ID NO: 1739253 - RNA, 15 nt, Homo sapiens
aaaggauuuuaccaa

SEQ ID NO: 1739254 - RNA, 22 nt, Homo sapiens
aaagggucucccucuguugcca

SEQ ID NO: 1739255 - RNA, 14 nt, Homo sapiens
aaagguccuggcaa

SEQ ID NO: 1739256 - RNA, 15 nt, Homo sapiens
aaaguggcaaucuca

SEQ ID NO: 1739257 - RNA, 13 nt, Homo sapiens
aaauaaacaugug

SEQ ID NO: 1739258 - RNA, 17 nt, Homo sapiens
aaauaaagucucuuccu

SEQ ID NO: 1739259 - RNA, 23 nt, Homo sapiens
aaauacacagugcugaccagaca

SEQ ID NO: 1739260 - RNA, 13 nt, Homo sapiens
aaauagugucuga

SEQ ID NO: 1739261 - RNA, 16 nt, Homo sapiens
aaauauggacugcuca

SEQ ID NO: 1739262 - RNA, 22 nt, Homo sapiens
agagagucgcaucucagugcag

SEQ ID NO: 1739263 - RNA, 23 nt, Homo sapiens
agagagucgcaucucagugcagg

SEQ ID NO: 1739264 - RNA, 21 nt, Homo sapiens
agagaucuuucuuuccaaaac

SEQ ID NO: 1739265 - RNA, 17 nt, Homo sapiens
agagccagcagcaaaaa

SEQ ID NO: 1739266 - RNA, 20 nt, Homo sapiens
agagccagccggcuaugaaa

SEQ ID NO: 1739267 - RNA, 18 nt, Homo sapiens
agagcgaggaaaggauuu

SEQ ID NO: 1739268 - RNA, 12 nt, Homo sapiens
agagucaucuga

SEQ ID NO: 1739269 - RNA, 14 nt, Homo sapiens
agagucgcaucuca

SEQ ID NO: 1739270 - RNA, 15 nt, Homo sapiens
agaguuucaaaagca

SEQ ID NO: 1739271 - RNA, 12 nt, Homo sapiens
agaucacagugg

SEQ ID NO: 1739272 - RNA, 20 nt, Homo sapiens
agauccuaagucucuuacaa

SEQ ID NO: 1739273 - RNA, 16 nt, Homo sapiens
agauggacuccagccu

SEQ ID NO: 1739274 - RNA, 21 nt, Homo sapiens
agauggcagauucccacugcc

SEQ ID NO: 1739275 - RNA, 15 nt, Homo sapiens
agauucccacugccg

SEQ ID NO: 1739276 - RNA, 16 nt, Homo sapiens
agauuccgcaccaaua

SEQ ID NO: 1739277 - RNA, 17 nt, Homo sapiens
agcaaaacaucucugca

SEQ ID NO: 1739278 - RNA, 20 nt, Homo sapiens
agcaaguuccugagugcgug

SEQ ID NO: 1739279 - RNA, 13 nt, Homo sapiens
agcacccauucca

SEQ ID NO: 1739280 - RNA, 21 nt, Homo sapiens
agcacuuuaacacagugucug

SEQ ID NO: 1739281 - RNA, 17 nt, Homo sapiens
agcagcaaaaacuacau

SEQ ID NO: 1739282 - RNA, 17 nt, Homo sapiens
agcaugggauuauuaga

SEQ ID NO: 1739283 - RNA, 20 nt, Homo sapiens
agcauuugaaaggugugcua

SEQ ID NO: 1739284 - RNA, 23 nt, Homo sapiens
agccaucccuuuuuuuacauuuc

SEQ ID NO: 1739285 - RNA, 20 nt, Homo sapiens
agccauggucccaggcuucc

SEQ ID NO: 1739286 - RNA, 17 nt, Homo sapiens
agcccuuauguuuaauc

SEQ ID NO: 1739287 - RNA, 20 nt, Homo sapiens
agccgguggugcccgugccc

SEQ ID NO: 1739288 - RNA, 15 nt, Homo sapiens
agccguauuuuacau

SEQ ID NO: 1739289 - RNA, 22 nt, Homo sapiens
agccguuuguuccccaagacau

SEQ ID NO: 1739290 - RNA, 14 nt, Homo sapiens
agccuggcuccaaa

SEQ ID NO: 1739291 - RNA, 15 nt, Homo sapiens
agccuggugcugcug

SEQ ID NO: 1739292 - RNA, 16 nt, Homo sapiens
agccuggugcugcugc

SEQ ID NO: 1739293 - RNA, 22 nt, Homo sapiens
agcggccccccgcacagccacc

SEQ ID NO: 1739294 - RNA, 15 nt, Homo sapiens
agcgugaaucuguau

SEQ ID NO: 1739295 - RNA, 19 nt, Homo sapiens
agcucagcauuuccacacc

SEQ ID NO: 1739296 - RNA, 20 nt, Homo sapiens
agcucagcauuuccacacca

SEQ ID NO: 1739297 - RNA, 19 nt, Homo sapiens
agcucucugacgcuuguga

SEQ ID NO: 1739298 - RNA, 23 nt, Homo sapiens
agcuguauaauuaauugucauua

SEQ ID NO: 1739299 - RNA, 14 nt, Homo sapiens
agcuguugggaaca

SEQ ID NO: 1739300 - RNA, 22 nt, Homo sapiens
agcuuugucucugucacaucag

SEQ ID NO: 1739301 - RNA, 22 nt, Homo sapiens
aggaaacaaggggucugaggau

SEQ ID NO: 1739302 - RNA, 21 nt, Homo sapiens
aggaagaaagaagacaaacuu

SEQ ID NO: 1739303 - RNA, 22 nt, Homo sapiens
aggagaccuggcacuggaugca

SEQ ID NO: 1739304 - RNA, 20 nt, Homo sapiens
aggaggcucccgaggggaag

SEQ ID NO: 1739305 - RNA, 19 nt, Homo sapiens
aggauagacuuuucccaag

SEQ ID NO: 1739306 - RNA, 18 nt, Homo sapiens
aggauggcaaagagaguc

SEQ ID NO: 1739307 - RNA, 15 nt, Homo sapiens
aggcaugggugcaag

SEQ ID NO: 1739308 - RNA, 21 nt, Homo sapiens
aggccacccugccucuaccca

SEQ ID NO: 1739309 - RNA, 15 nt, Homo sapiens
aggcuccaaacugga

SEQ ID NO: 1739310 - RNA, 17 nt, Homo sapiens
aggcugagccugcucau

SEQ ID NO: 1739311 - RNA, 10 nt, Homo sapiens
aggcugcaaa

SEQ ID NO: 1739312 - RNA, 18 nt, Homo sapiens
agggaggcggauuucccu

SEQ ID NO: 1739313 - RNA, 20 nt, Homo sapiens
aggggaauaaacuguugagu

SEQ ID NO: 1739314 - RNA, 23 nt, Homo sapiens
aggggcuguugaauuucccacau

SEQ ID NO: 1739315 - RNA, 18 nt, Homo sapiens
agggguucuugagccagc

SEQ ID NO: 1739316 - RNA, 23 nt, Homo sapiens
agggugacccugaagugagcaca

SEQ ID NO: 1739317 - RNA, 19 nt, Homo sapiens
agguauuuauugagcaccu

SEQ ID NO: 1739318 - RNA, 23 nt, Homo sapiens
agguccuggcaaagaugaucagu

SEQ ID NO: 1739319 - RNA, 21 nt, Homo sapiens
aggugaggauuccaaaaacau

SEQ ID NO: 1739320 - RNA, 16 nt, Homo sapiens
aguagaggcuauggac

SEQ ID NO: 1739321 - RNA, 18 nt, Homo sapiens
aguagauaugaggcauuu

SEQ ID NO: 1739322 - RNA, 14 nt, Homo sapiens
aguccaauuccuug

SEQ ID NO: 1739323 - RNA, 18 nt, Homo sapiens
aguccuggaugauacuaa

SEQ ID NO: 1739324 - RNA, 19 nt, Homo sapiens
agucucagugaagacuaug

SEQ ID NO: 1739325 - RNA, 21 nt, Homo sapiens
agucucuuacaaaagcuuuga

SEQ ID NO: 1739326 - RNA, 18 nt, Homo sapiens
agugacaacaucgcaaua

SEQ ID NO: 1739327 - RNA, 20 nt, Homo sapiens
agugaucuuucccaagagaa

SEQ ID NO: 1739328 - RNA, 15 nt, Homo sapiens
agugcugaccagaca

SEQ ID NO: 1739329 - RNA, 14 nt, Homo sapiens
agugggacaguucc

SEQ ID NO: 1739330 - RNA, 23 nt, Homo sapiens
aguguccucaucuguaaaaugga

SEQ ID NO: 1739331 - RNA, 16 nt, Homo sapiens
agugucugaugaaugu

SEQ ID NO: 1739332 - RNA, 15 nt, Homo sapiens
aguucugguugauuc

SEQ ID NO: 1739333 - RNA, 17 nt, Homo sapiens
aguugucuuuccuggca

SEQ ID NO: 1739334 - RNA, 20 nt, Homo sapiens
aguuugagacaggagaccug

SEQ ID NO: 1739335 - RNA, 15 nt, Homo sapiens
auaaaaauaaaucag

SEQ ID NO: 1739336 - RNA, 16 nt, Homo sapiens
auaacugaacauccaa

SEQ ID NO: 1739337 - RNA, 12 nt, Homo sapiens
auaacuguuauu

SEQ ID NO: 1739338 - RNA, 13 nt, Homo sapiens
auaaggcccagag

SEQ ID NO: 1739339 - RNA, 20 nt, Homo sapiens
auacaauuuuuuuuauuagu

SEQ ID NO: 1739340 - RNA, 18 nt, Homo sapiens
auacggaagagcagguga

SEQ ID NO: 1739341 - RNA, 22 nt, Homo sapiens
auagaaugagcacccauuccaa

SEQ ID NO: 1739342 - RNA, 15 nt, Homo sapiens
auaugggcacuuuaa

SEQ ID NO: 1739343 - RNA, 23 nt, Homo sapiens
auauucacuugacuaaaaucacu

SEQ ID NO: 1739344 - RNA, 19 nt, Homo sapiens
auauuuuauuauagucacu

SEQ ID NO: 1739345 - RNA, 16 nt, Homo sapiens
aucaauacaaccagcc

SEQ ID NO: 1739346 - RNA, 14 nt, Homo sapiens
auccaaaaucuuga

SEQ ID NO: 1739347 - RNA, 16 nt, Homo sapiens
auccagucucccaacu

SEQ ID NO: 1739348 - RNA, 20 nt, Homo sapiens
aucccuuuuuuuacauuuca

SEQ ID NO: 1739349 - RNA, 22 nt, Homo sapiens
aucguccagcgaccuuccucau

SEQ ID NO: 1739350 - RNA, 15 nt, Homo sapiens
aucucagaugcaguu

SEQ ID NO: 1739351 - RNA, 13 nt, Homo sapiens
aucucaguaugaa

SEQ ID NO: 1739352 - RNA, 12 nt, Homo sapiens
aucucagugcag

SEQ ID NO: 1739353 - RNA, 21 nt, Homo sapiens
aucucuuccuccgaggccagu

SEQ ID NO: 1739354 - RNA, 23 nt, Homo sapiens
aucugaucgggggcguagcauca

SEQ ID NO: 1739355 - RNA, 14 nt, Homo sapiens
aucuguaucuugcc

SEQ ID NO: 1739356 - RNA, 22 nt, Homo sapiens
aucuucagggaacugcauagau

SEQ ID NO: 1739357 - RNA, 15 nt, Homo sapiens
aucuucugccuuagu

SEQ ID NO: 1739358 - RNA, 13 nt, Homo sapiens
aucuuucuaggag

SEQ ID NO: 1739359 - RNA, 13 nt, Homo sapiens
augcugcagugag

SEQ ID NO: 1739360 - RNA, 19 nt, Homo sapiens
augcuguuuguagugaaau

SEQ ID NO: 1739361 - RNA, 20 nt, Homo sapiens
augcuuuaaacauugguucu

SEQ ID NO: 1739362 - RNA, 16 nt, Homo sapiens
auggaaacagacucau

SEQ ID NO: 1739363 - RNA, 19 nt, Homo sapiens
auggcauuuggucucaggc

SEQ ID NO: 1739364 - RNA, 12 nt, Homo sapiens
auggccaugcag

SEQ ID NO: 1739365 - RNA, 13 nt, Homo sapiens
auggcgucugcuc

SEQ ID NO: 1739366 - RNA, 23 nt, Homo sapiens
auggucccaggcuucccaaaagu

SEQ ID NO: 1739367 - RNA, 17 nt, Homo sapiens
auguaauaaugugaauc

SEQ ID NO: 1739368 - RNA, 19 nt, Homo sapiens
augucaaacugucuuggcu

SEQ ID NO: 1739369 - RNA, 22 nt, Homo sapiens
augucccuauggaagcauauug

SEQ ID NO: 1739370 - RNA, 23 nt, Homo sapiens
augucucacgucucccuaaaaau

SEQ ID NO: 1739371 - RNA, 12 nt, Homo sapiens
auguuacagauu

SEQ ID NO: 1739372 - RNA, 16 nt, Homo sapiens
auuaaagaagaccuga

SEQ ID NO: 1739373 - RNA, 14 nt, Homo sapiens
auuaaagacagagg

SEQ ID NO: 1739374 - RNA, 14 nt, Homo sapiens
ccugugaaauacca

SEQ ID NO: 1739375 - RNA, 13 nt, Homo sapiens
ccuucagagccag

SEQ ID NO: 1739376 - RNA, 17 nt, Homo sapiens
ccuuccagcuccuguaa

SEQ ID NO: 1739377 - RNA, 16 nt, Homo sapiens
ccuugcccccauuuca

SEQ ID NO: 1739378 - RNA, 18 nt, Homo sapiens
ccuugcccccauuucacc

SEQ ID NO: 1739379 - RNA, 13 nt, Homo sapiens
ccuuuuucacuuu

SEQ ID NO: 1739380 - RNA, 16 nt, Homo sapiens
ccuuuuucacuuugaa

SEQ ID NO: 1739381 - RNA, 18 nt, Homo sapiens
cgaccgcccccuccucua

SEQ ID NO: 1739382 - RNA, 15 nt, Homo sapiens
cgagccuggcuccaa

SEQ ID NO: 1739383 - RNA, 17 nt, Homo sapiens
cgagccuggcuccaaac

SEQ ID NO: 1739384 - RNA, 17 nt, Homo sapiens
cgaggcggaucuuugga

SEQ ID NO: 1739385 - RNA, 14 nt, Homo sapiens
cgauccccugucac

SEQ ID NO: 1739386 - RNA, 15 nt, Homo sapiens
cgcagggccaugcag

SEQ ID NO: 1739387 - RNA, 16 nt, Homo sapiens
cgcaucucagugcagg

SEQ ID NO: 1739388 - RNA, 14 nt, Homo sapiens
cgcugggugguacc

SEQ ID NO: 1739389 - RNA, 14 nt, Homo sapiens
cggaucuuuggaca

SEQ ID NO: 1739390 - RNA, 19 nt, Homo sapiens
cggaucuuuggacagaagc

SEQ ID NO: 1739391 - RNA, 23 nt, Homo sapiens
cgggggcuuggcugugcccucag

SEQ ID NO: 1739392 - RNA, 15 nt, Homo sapiens
cgguggucacuggaa

SEQ ID NO: 1739393 - RNA, 16 nt, Homo sapiens
cguauuuuacaugaag

SEQ ID NO: 1739394 - RNA, 19 nt, Homo sapiens
cguccauauuuaacaugua

SEQ ID NO: 1739395 - RNA, 17 nt, Homo sapiens
cgucccccaaacauguu

SEQ ID NO: 1739396 - RNA, 15 nt, Homo sapiens
cgugagccaccaaac

SEQ ID NO: 1739397 - RNA, 18 nt, Homo sapiens
cgugcccgugugcauguc

SEQ ID NO: 1739398 - RNA, 16 nt, Homo sapiens
cuaagucucugugaau

SEQ ID NO: 1739399 - RNA, 17 nt, Homo sapiens
cuagcccugggacauca

SEQ ID NO: 1739400 - RNA, 23 nt, Homo sapiens
cuagguuugcaagaaaaauauga

SEQ ID NO: 1739401 - RNA, 16 nt, Homo sapiens
cauggccgugaacuuu

SEQ ID NO: 1739402 - RNA, 17 nt, Homo sapiens
cauggucccaggcuucc

SEQ ID NO: 1739403 - RNA, 23 nt, Homo sapiens
cauggugagccuagcccugggac

SEQ ID NO: 1739404 - RNA, 16 nt, Homo sapiens
cauguacauacccugg

SEQ ID NO: 1739405 - RNA, 20 nt, Homo sapiens
cauuaauaauaaauucccug

SEQ ID NO: 1739406 - RNA, 16 nt, Homo sapiens
cauugauucaugucuc

SEQ ID NO: 1739407 - RNA, 15 nt, Homo sapiens
cauugccuucucugc

SEQ ID NO: 1739408 - RNA, 20 nt, Homo sapiens
cauuguucuugugaacccaa

SEQ ID NO: 1739409 - RNA, 17 nt, Homo sapiens
cauuuaaauguguacaa

SEQ ID NO: 1739410 - RNA, 22 nt, Homo sapiens
cauuucaaaagguauuuauuga

SEQ ID NO: 1739411 - RNA, 20 nt, Homo sapiens
cauuucuggacaguaccuga

SEQ ID NO: 1739412 - RNA, 13 nt, Homo sapiens
cauuuuaaaaaca

SEQ ID NO: 1739413 - RNA, 11 nt, Homo sapiens
ccaaacauguu

SEQ ID NO: 1739414 - RNA, 12 nt, Homo sapiens
ccaaacuggagc

SEQ ID NO: 1739415 - RNA, 21 nt, Homo sapiens
ccaaagagccuuuccaaagag

SEQ ID NO: 1739416 - RNA, 13 nt, Homo sapiens
ccaaagcaucaau

SEQ ID NO: 1739417 - RNA, 22 nt, Homo sapiens
ccaaagcaucaauacaaccagc

SEQ ID NO: 1739418 - RNA, 13 nt, Homo sapiens
ccaacaaaccauc

SEQ ID NO: 1739419 - RNA, 17 nt, Homo sapiens
ccaaccggucacccagg

SEQ ID NO: 1739420 - RNA, 15 nt, Homo sapiens
ccaacggcaacagca

SEQ ID NO: 1739421 - RNA, 23 nt, Homo sapiens
ccaagcagugccugccuaugaaa

SEQ ID NO: 1739422 - RNA, 19 nt, Homo sapiens
ccaagcugugcccugacca

SEQ ID NO: 1739423 - RNA, 21 nt, Homo sapiens
ccaaggccacggagcaguuca

SEQ ID NO: 1739424 - RNA, 16 nt, Homo sapiens
ccaauuccuugcacau

SEQ ID NO: 1739425 - RNA, 14 nt, Homo sapiens
ccacaccaagcagc

SEQ ID NO: 1739426 - RNA, 16 nt, Homo sapiens
ccacaccugggcauuu

SEQ ID NO: 1739427 - RNA, 18 nt, Homo sapiens
ccacccugccucuaccca

SEQ ID NO: 1739428 - RNA, 18 nt, Homo sapiens
ccaccuugucugcuaaau

SEQ ID NO: 1739429 - RNA, 19 nt, Homo sapiens
ccacgugggcaaacaggca

SEQ ID NO: 1739430 - RNA, 20 nt, Homo sapiens
ccacugugguggcaguggag

SEQ ID NO: 1739431 - RNA, 15 nt, Homo sapiens
ccacuguuugucuca

SEQ ID NO: 1739432 - RNA, 20 nt, Homo sapiens
ccagagagccuggugcugcu

SEQ ID NO: 1739433 - RNA, 15 nt, Homo sapiens
ccagauggacuccag

SEQ ID NO: 1739434 - RNA, 20 nt, Homo sapiens
ccagccguauuuuacaugaa

SEQ ID NO: 1739435 - RNA, 15 nt, Homo sapiens
ccagcucagcacugc

SEQ ID NO: 1739436 - RNA, 23 nt, Homo sapiens
ccaggaaacaaggggucugagga

SEQ ID NO: 1739437 - RNA, 20 nt, Homo sapiens
ccaggauagacuuuucccaa

SEQ ID NO: 1739438 - RNA, 12 nt, Homo sapiens
ccaggcauuugc

SEQ ID NO: 1739439 - RNA, 15 nt, Homo sapiens
ccaggugcugcucag

SEQ ID NO: 1739440 - RNA, 21 nt, Homo sapiens
ccaguccccgaggagcugggc

SEQ ID NO: 1739441 - RNA, 14 nt, Homo sapiens
ccagugacaacauc

SEQ ID NO: 1739442 - RNA, 20 nt, Homo sapiens
ccagugaggaugcugcagug

SEQ ID NO: 1739443 - RNA, 20 nt, Homo sapiens
ccauaaccccggaagccaaa

SEQ ID NO: 1739444 - RNA, 14 nt, Homo sapiens
ccauaacugaacau

SEQ ID NO: 1739445 - RNA, 14 nt, Homo sapiens
ccauugacuucuuc

SEQ ID NO: 1739446 - RNA, 16 nt, Homo sapiens
cccaacaaaccaucca

SEQ ID NO: 1739447 - RNA, 12 nt, Homo sapiens
cccacggcaccu

SEQ ID NO: 1739448 - RNA, 10 nt, Homo sapiens
cccacuuuga

SEQ ID NO: 1739449 - RNA, 23 nt, Homo sapiens
cccagagcgaggaaaggauuuua

SEQ ID NO: 1739450 - RNA, 12 nt, Homo sapiens
ccccacuuugaa

SEQ ID NO: 1739451 - RNA, 20 nt, Homo sapiens
ccccauuuccccgauguccc

SEQ ID NO: 1739452 - RNA, 20 nt, Homo sapiens
ccccugcugucucucugggc

SEQ ID NO: 1739453 - RNA, 19 nt, Homo sapiens
cccggagguugggugggcc

SEQ ID NO: 1739454 - RNA, 16 nt, Homo sapiens
cccucaacugaagggg

SEQ ID NO: 1739455 - RNA, 22 nt, Homo sapiens
cccucgaggcggaucuuuggac

SEQ ID NO: 1739456 - RNA, 20 nt, Homo sapiens
cccucugggucucagugucc

SEQ ID NO: 1739457 - RNA, 17 nt, Homo sapiens
cccugcacaggcacaca

SEQ ID NO: 1739458 - RNA, 17 nt, Homo sapiens
cccugcaguuugagaca

SEQ ID NO: 1739459 - RNA, 13 nt, Homo sapiens
cccugcucccaca

SEQ ID NO: 1739460 - RNA, 19 nt, Homo sapiens
cccuggagaugucacagau

SEQ ID NO: 1739461 - RNA, 20 nt, Homo sapiens
cccuggagcccauccagucu

SEQ ID NO: 1739462 - RNA, 20 nt, Homo sapiens
cccuggcugaaggacuguga

SEQ ID NO: 1739463 - RNA, 20 nt, Homo sapiens
cccuucaguacccucucagc

SEQ ID NO: 1739464 - RNA, 12 nt, Homo sapiens
ccgagaagaaca

SEQ ID NO: 1739465 - RNA, 14 nt, Homo sapiens
ccgcaugugaucuc

SEQ ID NO: 1739466 - RNA, 17 nt, Homo sapiens
ccgguguuuaagacauu

SEQ ID NO: 1739467 - RNA, 17 nt, Homo sapiens
ccuagcacacacuuuug

SEQ ID NO: 1739468 - RNA, 14 nt, Homo sapiens
ccucagcuuugaua

SEQ ID NO: 1739469 - RNA, 19 nt, Homo sapiens
ccuccaggauagacuuuuc

SEQ ID NO: 1739470 - RNA, 13 nt, Homo sapiens
ccuccccaguuca

SEQ ID NO: 1739471 - RNA, 14 nt, Homo sapiens
ccuccucuagcugu

SEQ ID NO: 1739472 - RNA, 14 nt, Homo sapiens
ccucucaaccaccu

SEQ ID NO: 1739473 - RNA, 17 nt, Homo sapiens
ccucugaccugcacugg

SEQ ID NO: 1739474 - RNA, 11 nt, Homo sapiens
ccucuuuggag

SEQ ID NO: 1739475 - RNA, 16 nt, Homo sapiens
ccugagugguccccac

SEQ ID NO: 1739476 - RNA, 23 nt, Homo sapiens
ccugcacucccuccuggagcucu

SEQ ID NO: 1739477 - RNA, 23 nt, Homo sapiens
ccugcgggcgcgggcagccaccc

SEQ ID NO: 1739478 - RNA, 15 nt, Homo sapiens
ccuggaggcacugaa

SEQ ID NO: 1739479 - RNA, 20 nt, Homo sapiens
ccuggaucucacaagcacuu

SEQ ID NO: 1739480 - RNA, 21 nt, Homo sapiens
ccuggcaaagaugaucaguau

SEQ ID NO: 1739481 - RNA, 18 nt, Homo sapiens
ccuggcacuaacguugag

SEQ ID NO: 1739482 - RNA, 16 nt, Homo sapiens
ccuggcagagccaugg

SEQ ID NO: 1739483 - RNA, 21 nt, Homo sapiens
ccuggcuccaacacugcugcu

SEQ ID NO: 1739484 - RNA, 18 nt, Homo sapiens
ccuggcugggaguggcau

SEQ ID NO: 1739485 - RNA, 22 nt, Homo sapiens
ccuggcugggaguggcauguau

SEQ ID NO: 1739486 - RNA, 13 nt, Homo sapiens
ccugguuccacau

SEQ ID NO: 1739487 - RNA, 21 nt, Homo sapiens
ccugucaguaguggacauugu

SEQ ID NO: 1739488 - RNA, 14 nt, Homo sapiens
auuuccacaccaag

SEQ ID NO: 1739489 - RNA, 17 nt, Homo sapiens
auuucccugguagugua

SEQ ID NO: 1739490 - RNA, 17 nt, Homo sapiens
auuucuucuacaacuca

SEQ ID NO: 1739491 - RNA, 23 nt, Homo sapiens
auuucuuucuuugcaccaaagac

SEQ ID NO: 1739492 - RNA, 22 nt, Homo sapiens
auuugaaaaaaacuucauucuc

SEQ ID NO: 1739493 - RNA, 11 nt, Homo sapiens
auuugagacag

SEQ ID NO: 1739494 - RNA, 16 nt, Homo sapiens
auuuuaaggauaugau

SEQ ID NO: 1739495 - RNA, 13 nt, Homo sapiens
auuuuaccaaagc

SEQ ID NO: 1739496 - RNA, 20 nt, Homo sapiens
auuuuagaauaaauucccaa

SEQ ID NO: 1739497 - RNA, 15 nt, Homo sapiens
auuuuaugcuuuaaa

SEQ ID NO: 1739498 - RNA, 22 nt, Homo sapiens
caaacaaagaugccacauucaa

SEQ ID NO: 1739499 - RNA, 14 nt, Homo sapiens
caaacaccuggacu

SEQ ID NO: 1739500 - RNA, 19 nt, Homo sapiens
caaacgaaaaacauuucaa

SEQ ID NO: 1739501 - RNA, 11 nt, Homo sapiens
caaacugaaga

SEQ ID NO: 1739502 - RNA, 22 nt, Homo sapiens
caaacuuugcaucucaguauga

SEQ ID NO: 1739503 - RNA, 18 nt, Homo sapiens
caaagaugccacauucaa

SEQ ID NO: 1739504 - RNA, 16 nt, Homo sapiens
caaagauuaaaugugu

SEQ ID NO: 1739505 - RNA, 22 nt, Homo sapiens
caaagucaucccucuguucaca

SEQ ID NO: 1739506 - RNA, 11 nt, Homo sapiens
caaagugugac

SEQ ID NO: 1739507 - RNA, 17 nt, Homo sapiens
caaauaauuuguauacc

SEQ ID NO: 1739508 - RNA, 14 nt, Homo sapiens
caaaugcagcuuua

SEQ ID NO: 1739509 - RNA, 20 nt, Homo sapiens
caaaugucuuccuggauuau

SEQ ID NO: 1739510 - RNA, 13 nt, Homo sapiens
caaauugcugcuu

SEQ ID NO: 1739511 - RNA, 11 nt, Homo sapiens
caacaaaccau

SEQ ID NO: 1739512 - RNA, 22 nt, Homo sapiens
caacacugcugcuccagugcag

SEQ ID NO: 1739513 - RNA, 18 nt, Homo sapiens
caaccggucacccaggag

SEQ ID NO: 1739514 - RNA, 18 nt, Homo sapiens
caaccuccaccuucuggg

SEQ ID NO: 1739515 - RNA, 15 nt, Homo sapiens
caagaaaaauaugac

SEQ ID NO: 1739516 - RNA, 16 nt, Homo sapiens
caagaccucugugcac

SEQ ID NO: 1739517 - RNA, 17 nt, Homo sapiens
caagagaagcauucuca

SEQ ID NO: 1739518 - RNA, 21 nt, Homo sapiens
caagcugccgaaccaaaagaa

SEQ ID NO: 1739519 - RNA, 13 nt, Homo sapiens
caaguucucccca

SEQ ID NO: 1739520 - RNA, 13 nt, Homo sapiens
caauaaagccuuc

SEQ ID NO: 1739521 - RNA, 14 nt, Homo sapiens
caauacaaccagcc

SEQ ID NO: 1739522 - RNA, 20 nt, Homo sapiens
caaucuucucagaaggcaaa

SEQ ID NO: 1739523 - RNA, 16 nt, Homo sapiens
caaugaagucucugaa

SEQ ID NO: 1739524 - RNA, 16 nt, Homo sapiens
caaugcauucugaggu

SEQ ID NO: 1739525 - RNA, 19 nt, Homo sapiens
cacagaacacauaauucag

SEQ ID NO: 1739526 - RNA, 17 nt, Homo sapiens
cacagcggagucugucc

SEQ ID NO: 1739527 - RNA, 18 nt, Homo sapiens
cacaguggccaagaucac

SEQ ID NO: 1739528 - RNA, 20 nt, Homo sapiens
cacaguggccaagaucacag

SEQ ID NO: 1739529 - RNA, 21 nt, Homo sapiens
cacaguguugccagagccuua

SEQ ID NO: 1739530 - RNA, 19 nt, Homo sapiens
cacaguuuugguugcuuua

SEQ ID NO: 1739531 - RNA, 22 nt, Homo sapiens
cacauaguagguacccaauuca

SEQ ID NO: 1739532 - RNA, 23 nt, Homo sapiens
cacauaguagguacccaauucaa

SEQ ID NO: 1739533 - RNA, 22 nt, Homo sapiens
cacauaguuaaaaaagaaacaa

SEQ ID NO: 1739534 - RNA, 23 nt, Homo sapiens
cacaucccuggaaggacauccau

SEQ ID NO: 1739535 - RNA, 14 nt, Homo sapiens
cacauguggccaug

SEQ ID NO: 1739536 - RNA, 16 nt, Homo sapiens
cacauuaaucucaaag

SEQ ID NO: 1739537 - RNA, 19 nt, Homo sapiens
cacauuuuuaaaagaacaa

SEQ ID NO: 1739538 - RNA, 16 nt, Homo sapiens
caccaauaaagccuuc

SEQ ID NO: 1739539 - RNA, 16 nt, Homo sapiens
caccagggccuggcug

SEQ ID NO: 1739540 - RNA, 14 nt, Homo sapiens
cacccccagcucaa

SEQ ID NO: 1739541 - RNA, 14 nt, Homo sapiens
cacccuugccaugg

SEQ ID NO: 1739542 - RNA, 17 nt, Homo sapiens
caccuccucugugauuu

SEQ ID NO: 1739543 - RNA, 17 nt, Homo sapiens
cacuaucacgagccuuu

SEQ ID NO: 1739544 - RNA, 21 nt, Homo sapiens
cacugccagggguucuugagc

SEQ ID NO: 1739545 - RNA, 21 nt, Homo sapiens
cacugggugagagaggaauaa

SEQ ID NO: 1739546 - RNA, 23 nt, Homo sapiens
cacugugggaaggccagcugccc

SEQ ID NO: 1739547 - RNA, 15 nt, Homo sapiens
cacuguuugucucac

SEQ ID NO: 1739548 - RNA, 19 nt, Homo sapiens
cacuguuugucucaccuac

SEQ ID NO: 1739549 - RNA, 12 nt, Homo sapiens
cacuucaucuga

SEQ ID NO: 1739550 - RNA, 13 nt, Homo sapiens
cacuucaucugau

SEQ ID NO: 1739551 - RNA, 20 nt, Homo sapiens
cacuuugaaggggccucacc

SEQ ID NO: 1739552 - RNA, 18 nt, Homo sapiens
cacuuuguuuuacugucu

SEQ ID NO: 1739553 - RNA, 22 nt, Homo sapiens
cagaaaagcaauacuguuucca

SEQ ID NO: 1739554 - RNA, 23 nt, Homo sapiens
cagaaagugauaagugcagggag

SEQ ID NO: 1739555 - RNA, 21 nt, Homo sapiens
cagagaaaauaaaagcacuua

SEQ ID NO: 1739556 - RNA, 16 nt, Homo sapiens
cagagauaaagaccuu

SEQ ID NO: 1739557 - RNA, 13 nt, Homo sapiens
cagagucaucuga

SEQ ID NO: 1739558 - RNA, 22 nt, Homo sapiens
cagagucugccccacauguggc

SEQ ID NO: 1739559 - RNA, 21 nt, Homo sapiens
cagauggacuccagccugccu

SEQ ID NO: 1739560 - RNA, 19 nt, Homo sapiens
cagauuccuggcagagcca

SEQ ID NO: 1739561 - RNA, 14 nt, Homo sapiens
cagcaaaucacgac

SEQ ID NO: 1739562 - RNA, 12 nt, Homo sapiens
cagccaaccugg

SEQ ID NO: 1739563 - RNA, 22 nt, Homo sapiens
cagccacccguggggugcugcc

SEQ ID NO: 1739564 - RNA, 19 nt, Homo sapiens
cagcucuccccaggcauuu

SEQ ID NO: 1739565 - RNA, 23 nt, Homo sapiens
cagcucuccccaggcauuugcca

SEQ ID NO: 1739566 - RNA, 19 nt, Homo sapiens
cagcugggaucacaugugg

SEQ ID NO: 1739567 - RNA, 13 nt, Homo sapiens
cagcuuucuggga

SEQ ID NO: 1739568 - RNA, 19 nt, Homo sapiens
caggaaacgagacuuucca

SEQ ID NO: 1739569 - RNA, 14 nt, Homo sapiens
caggaagcagcuuu

SEQ ID NO: 1739570 - RNA, 18 nt, Homo sapiens
caggagaccuggcacugg

SEQ ID NO: 1739571 - RNA, 22 nt, Homo sapiens
caggauagagugggacaguucc

SEQ ID NO: 1739572 - RNA, 23 nt, Homo sapiens
caggccaccccgcugauggagcc

SEQ ID NO: 1739573 - RNA, 16 nt, Homo sapiens
caggcuccaaacugga

SEQ ID NO: 1739574 - RNA, 13 nt, Homo sapiens
cagggccaugcag

SEQ ID NO: 1739575 - RNA, 16 nt, Homo sapiens
agccugcccuccuuuc

SEQ ID NO: 1739576 - RNA, 20 nt, Homo sapiens
agccugcucauguaccucug

SEQ ID NO: 1739577 - RNA, 22 nt, Homo sapiens
agcgaccgcccccuccucuagc

SEQ ID NO: 1739578 - RNA, 12 nt, Homo sapiens
agcggugucucu

SEQ ID NO: 1739579 - RNA, 21 nt, Homo sapiens
agcuccucccacaaugcugaa

SEQ ID NO: 1739580 - RNA, 14 nt, Homo sapiens
agcugggagacccu

SEQ ID NO: 1739581 - RNA, 13 nt, Homo sapiens
agcugugucugcc

SEQ ID NO: 1739582 - RNA, 19 nt, Homo sapiens
agcuugaaauagugucuga

SEQ ID NO: 1739583 - RNA, 20 nt, Homo sapiens
agcuuuauuaccaguggcgu

SEQ ID NO: 1739584 - RNA, 23 nt, Homo sapiens
aggaaaggaugguagauucuguu

SEQ ID NO: 1739585 - RNA, 19 nt, Homo sapiens
aggaauacauaaaguaugu

SEQ ID NO: 1739586 - RNA, 16 nt, Homo sapiens
aggaggguugugcuac

SEQ ID NO: 1739587 - RNA, 17 nt, Homo sapiens
aggauagagugggacag

SEQ ID NO: 1739588 - RNA, 14 nt, Homo sapiens
aggauggcaaagag

SEQ ID NO: 1739589 - RNA, 15 nt, Homo sapiens
aggauguucgucuca

SEQ ID NO: 1739590 - RNA, 21 nt, Homo sapiens
aggauuccaaaaacauuuuau

SEQ ID NO: 1739591 - RNA, 16 nt, Homo sapiens
aggauuuuaccaaagc

SEQ ID NO: 1739592 - RNA, 17 nt, Homo sapiens
aggcaguuggccagaga

SEQ ID NO: 1739593 - RNA, 20 nt, Homo sapiens
aggccacccugccucuaccc

SEQ ID NO: 1739594 - RNA, 15 nt, Homo sapiens
aggcggaucuuugga

SEQ ID NO: 1739595 - RNA, 22 nt, Homo sapiens
aggcggaucuuuggacagaagc

SEQ ID NO: 1739596 - RNA, 15 nt, Homo sapiens
agggagcugggagac

SEQ ID NO: 1739597 - RNA, 14 nt, Homo sapiens
agggagguggcaag

SEQ ID NO: 1739598 - RNA, 17 nt, Homo sapiens
agggguucuugagccag

SEQ ID NO: 1739599 - RNA, 21 nt, Homo sapiens
agggucucccucuguugccaa

SEQ ID NO: 1739600 - RNA, 20 nt, Homo sapiens
aggucaccuuuauucuggca

SEQ ID NO: 1739601 - RNA, 20 nt, Homo sapiens
aggucuguuuaaaguggcaa

SEQ ID NO: 1739602 - RNA, 13 nt, Homo sapiens
agguuaagcacuu

SEQ ID NO: 1739603 - RNA, 16 nt, Homo sapiens
agguuugccugugauu

SEQ ID NO: 1739604 - RNA, 23 nt, Homo sapiens
aguaguuuuuacagcuguguuau

SEQ ID NO: 1739605 - RNA, 19 nt, Homo sapiens
aguaucuaacaaaaccaau

SEQ ID NO: 1739606 - RNA, 16 nt, Homo sapiens
aguaugaaaaugucau

SEQ ID NO: 1739607 - RNA, 16 nt, Homo sapiens
agucaaaucugggcuc

SEQ ID NO: 1739608 - RNA, 14 nt, Homo sapiens
agucacaucucuuc

SEQ ID NO: 1739609 - RNA, 14 nt, Homo sapiens
agucaguugcauuc

SEQ ID NO: 1739610 - RNA, 19 nt, Homo sapiens
agucggcuuguucuugcag

SEQ ID NO: 1739611 - RNA, 23 nt, Homo sapiens
agucucacugugggaaggccagc

SEQ ID NO: 1739612 - RNA, 12 nt, Homo sapiens
agucucugugaa

SEQ ID NO: 1739613 - RNA, 16 nt, Homo sapiens
agugacaaaccaucca

SEQ ID NO: 1739614 - RNA, 19 nt, Homo sapiens
agugacagcuuucugggau

SEQ ID NO: 1739615 - RNA, 21 nt, Homo sapiens
agugauccuguccuuuuaaca

SEQ ID NO: 1739616 - RNA, 17 nt, Homo sapiens
agugcuuaguguacuug

SEQ ID NO: 1739617 - RNA, 15 nt, Homo sapiens
aguguaaacaccaua

SEQ ID NO: 1739618 - RNA, 13 nt, Homo sapiens
aguucagugcuca

SEQ ID NO: 1739619 - RNA, 17 nt, Homo sapiens
aguugagaacuggucag

SEQ ID NO: 1739620 - RNA, 11 nt, Homo sapiens
aguugcagcug

SEQ ID NO: 1739621 - RNA, 14 nt, Homo sapiens
aguuucuuccugua

SEQ ID NO: 1739622 - RNA, 20 nt, Homo sapiens
aguuuguuuuagaaccagcc

SEQ ID NO: 1739623 - RNA, 12 nt, Homo sapiens
auaaauaaccaa

SEQ ID NO: 1739624 - RNA, 20 nt, Homo sapiens
auaacccaagguaccauccu

SEQ ID NO: 1739625 - RNA, 12 nt, Homo sapiens
auaaguccuugc

SEQ ID NO: 1739626 - RNA, 17 nt, Homo sapiens
auaauaaugaugaugau

SEQ ID NO: 1739627 - RNA, 14 nt, Homo sapiens
auaaucaacugggc

SEQ ID NO: 1739628 - RNA, 18 nt, Homo sapiens
auacaacagaaaccagaa

SEQ ID NO: 1739629 - RNA, 20 nt, Homo sapiens
auacauugauucaugucuca

SEQ ID NO: 1739630 - RNA, 15 nt, Homo sapiens
auacccuguccuuuc

SEQ ID NO: 1739631 - RNA, 17 nt, Homo sapiens
auagaaaaguauguucu

SEQ ID NO: 1739632 - RNA, 18 nt, Homo sapiens
auagcagcuuugucucug

SEQ ID NO: 1739633 - RNA, 18 nt, Homo sapiens
auaggguauauuuuccua

SEQ ID NO: 1739634 - RNA, 18 nt, Homo sapiens
aucacaguuuugguugcu

SEQ ID NO: 1739635 - RNA, 20 nt, Homo sapiens
aucacauguggacuuuuauu

SEQ ID NO: 1739636 - RNA, 21 nt, Homo sapiens
aucagcaauuucagaaccaaa

SEQ ID NO: 1739637 - RNA, 14 nt, Homo sapiens
aucagccagucuca

SEQ ID NO: 1739638 - RNA, 15 nt, Homo sapiens
aucagccagucucag

SEQ ID NO: 1739639 - RNA, 13 nt, Homo sapiens
aucaggaggccag

SEQ ID NO: 1739640 - RNA, 21 nt, Homo sapiens
aucaguuacucuucaguuaag

SEQ ID NO: 1739641 - RNA, 12 nt, Homo sapiens
auccagugacaa

SEQ ID NO: 1739642 - RNA, 14 nt, Homo sapiens
auccauaacugaac

SEQ ID NO: 1739643 - RNA, 19 nt, Homo sapiens
aucccuuuuuuuacauuuc

SEQ ID NO: 1739644 - RNA, 23 nt, Homo sapiens
auccuaggcugacaccuaacucu

SEQ ID NO: 1739645 - RNA, 11 nt, Homo sapiens
auccugggcug

SEQ ID NO: 1739646 - RNA, 24 nt, Homo sapiens
auccuuggaaauuggaagagcaca

SEQ ID NO: 1739647 - RNA, 18 nt, Homo sapiens
aucgcuuuugauaaucaa

SEQ ID NO: 1739648 - RNA, 17 nt, Homo sapiens
aucuuucuuuccaaaac

SEQ ID NO: 1739649 - RNA, 12 nt, Homo sapiens
aucuuuggacag

SEQ ID NO: 1739650 - RNA, 14 nt, Homo sapiens
aucuuuggacagaa

SEQ ID NO: 1739651 - RNA, 21 nt, Homo sapiens
aucuuuggacagaagcagcuc

SEQ ID NO: 1739652 - RNA, 13 nt, Homo sapiens
augaauuauuaca

SEQ ID NO: 1739653 - RNA, 17 nt, Homo sapiens
augaauuauuacagugu

SEQ ID NO: 1739654 - RNA, 13 nt, Homo sapiens
augaauuauucaa

SEQ ID NO: 1739655 - RNA, 17 nt, Homo sapiens
augagcacccauuccaa

SEQ ID NO: 1739656 - RNA, 18 nt, Homo sapiens
augagcacccauuccaaa

SEQ ID NO: 1739657 - RNA, 24 nt, Homo sapiens
augaggucuguuuaaaguggcaau

SEQ ID NO: 1739658 - RNA, 21 nt, Homo sapiens
augauguauguugaagccuuu

SEQ ID NO: 1739659 - RNA, 22 nt, Homo sapiens
augcaaccgggcccucucucug

SEQ ID NO: 1739660 - RNA, 19 nt, Homo sapiens
augcagaccucaugcccag

SEQ ID NO: 1739661 - RNA, 12 nt, Homo sapiens
augcauucugag

SEQ ID NO: 1739662 - RNA, 13 nt, Homo sapiens
augccacauucaa

SEQ ID NO: 1739663 - RNA, 21 nt, Homo sapiens
augccagcuacuuccuccucc

SEQ ID NO: 1739664 - RNA, 16 nt, Homo sapiens
acagcucgacuuuaaa

SEQ ID NO: 1739665 - RNA, 22 nt, Homo sapiens
acaggaagccugcaguccugga

SEQ ID NO: 1739666 - RNA, 15 nt, Homo sapiens
acaggacagcgggaa

SEQ ID NO: 1739667 - RNA, 15 nt, Homo sapiens
acaggagaccuggca

SEQ ID NO: 1739668 - RNA, 19 nt, Homo sapiens
acagggacaugcccugugu

SEQ ID NO: 1739669 - RNA, 20 nt, Homo sapiens
acagggacaugcccugugug

SEQ ID NO: 1739670 - RNA, 12 nt, Homo sapiens
acaguaccugau

SEQ ID NO: 1739671 - RNA, 23 nt, Homo sapiens
acagucaugguggccacggccac

SEQ ID NO: 1739672 - RNA, 14 nt, Homo sapiens
acagugaggcugca

SEQ ID NO: 1739673 - RNA, 14 nt, Homo sapiens
acagugccucuucc

SEQ ID NO: 1739674 - RNA, 21 nt, Homo sapiens
acaguguugccagagccuuaa

SEQ ID NO: 1739675 - RNA, 19 nt, Homo sapiens
acaguuuugguugcuuuaa

SEQ ID NO: 1739676 - RNA, 20 nt, Homo sapiens
acaguuuugguugcuuuaau

SEQ ID NO: 1739677 - RNA, 15 nt, Homo sapiens
acauaaaauagauuu

SEQ ID NO: 1739678 - RNA, 17 nt, Homo sapiens
acauaaggaaacugggu

SEQ ID NO: 1739679 - RNA, 18 nt, Homo sapiens
acauacuggccuggacug

SEQ ID NO: 1739680 - RNA, 21 nt, Homo sapiens
acaucaaguaugguaggggag

SEQ ID NO: 1739681 - RNA, 17 nt, Homo sapiens
acaucagucuccaacau

SEQ ID NO: 1739682 - RNA, 23 nt, Homo sapiens
acaucucuuccuccgaggccagu

SEQ ID NO: 1739683 - RNA, 23 nt, Homo sapiens
acaucuucugccuuagucucagu

SEQ ID NO: 1739684 - RNA, 13 nt, Homo sapiens
acaugcccugugu

SEQ ID NO: 1739685 - RNA, 15 nt, Homo sapiens
acauggaugccaacc

SEQ ID NO: 1739686 - RNA, 16 nt, Homo sapiens
acauuagucucaguga

SEQ ID NO: 1739687 - RNA, 12 nt, Homo sapiens
acauuaugaugu

SEQ ID NO: 1739688 - RNA, 22 nt, Homo sapiens
acauuuuuaaaagaacaaugac

SEQ ID NO: 1739689 - RNA, 14 nt, Homo sapiens
accaaagacaucag

SEQ ID NO: 1739690 - RNA, 21 nt, Homo sapiens
accaccccaacaaaccaucca

SEQ ID NO: 1739691 - RNA, 14 nt, Homo sapiens
accagccaaccugg

SEQ ID NO: 1739692 - RNA, 21 nt, Homo sapiens
accauguaauggcaguuauau

SEQ ID NO: 1739693 - RNA, 22 nt, Homo sapiens
accauuccauuuccaagcacuu

SEQ ID NO: 1739694 - RNA, 19 nt, Homo sapiens
accauuuuugaaaccaaac

SEQ ID NO: 1739695 - RNA, 17 nt, Homo sapiens
acccaggaguguggcca

SEQ ID NO: 1739696 - RNA, 15 nt, Homo sapiens
acccaugcagcugcu

SEQ ID NO: 1739697 - RNA, 13 nt, Homo sapiens
acccccagcucaa

SEQ ID NO: 1739698 - RNA, 15 nt, Homo sapiens
acccuccccacagug

SEQ ID NO: 1739699 - RNA, 13 nt, Homo sapiens
acccucucagcuc

SEQ ID NO: 1739700 - RNA, 22 nt, Homo sapiens
acccucugggucucaguguccu

SEQ ID NO: 1739701 - RNA, 16 nt, Homo sapiens
acccugccucuaccca

SEQ ID NO: 1739702 - RNA, 23 nt, Homo sapiens
acccuggagcccauccagucucc

SEQ ID NO: 1739703 - RNA, 17 nt, Homo sapiens
accuaagucucugugaa

SEQ ID NO: 1739704 - RNA, 19 nt, Homo sapiens
accucagcuuugauauuuc

SEQ ID NO: 1739705 - RNA, 19 nt, Homo sapiens
accugguacccuccuggcu

SEQ ID NO: 1739706 - RNA, 14 nt, Homo sapiens
accuuuccauuuau

SEQ ID NO: 1739707 - RNA, 22 nt, Homo sapiens
accuuuugaggagccccagcua

SEQ ID NO: 1739708 - RNA, 13 nt, Homo sapiens
acgauuugucagu

SEQ ID NO: 1739709 - RNA, 20 nt, Homo sapiens
acggcucacgcuuaccucaa

SEQ ID NO: 1739710 - RNA, 16 nt, Homo sapiens
acgguaaguguucuca

SEQ ID NO: 1739711 - RNA, 23 nt, Homo sapiens
acgguaaguguucucaugaagca

SEQ ID NO: 1739712 - RNA, 15 nt, Homo sapiens
acggugacucugucc

SEQ ID NO: 1739713 - RNA, 12 nt, Homo sapiens
acgucauucagu

SEQ ID NO: 1739714 - RNA, 19 nt, Homo sapiens
acgugggcaaacaggcagu

SEQ ID NO: 1739715 - RNA, 18 nt, Homo sapiens
acuauuuaaagccuccuc

SEQ ID NO: 1739716 - RNA, 16 nt, Homo sapiens
acucaagaguucagug

SEQ ID NO: 1739717 - RNA, 13 nt, Homo sapiens
acucgugugcaac

SEQ ID NO: 1739718 - RNA, 21 nt, Homo sapiens
acugccccccgaggcugcuag

SEQ ID NO: 1739719 - RNA, 15 nt, Homo sapiens
acugcucugaugaag

SEQ ID NO: 1739720 - RNA, 19 nt, Homo sapiens
acugcugcuccagugcagg

SEQ ID NO: 1739721 - RNA, 23 nt, Homo sapiens
acuggucagggcaaaccugccuc

SEQ ID NO: 1739722 - RNA, 16 nt, Homo sapiens
acuguacagugucuuu

SEQ ID NO: 1739723 - RNA, 16 nt, Homo sapiens
acugugcugugcagcu

SEQ ID NO: 1739724 - RNA, 17 nt, Homo sapiens
acugugggaaggccagc

SEQ ID NO: 1739725 - RNA, 18 nt, Homo sapiens
acuguuauuuauaaucac

SEQ ID NO: 1739726 - RNA, 15 nt, Homo sapiens
acuguugagucaaaa

SEQ ID NO: 1739727 - RNA, 21 nt, Homo sapiens
acuuccuugcccccauuucac

SEQ ID NO: 1739728 - RNA, 13 nt, Homo sapiens
acuucugugccac

SEQ ID NO: 1739729 - RNA, 17 nt, Homo sapiens
acuugagcgugaaucug

SEQ ID NO: 1739730 - RNA, 15 nt, Homo sapiens
acuuuaucauaugcu

SEQ ID NO: 1739731 - RNA, 13 nt, Homo sapiens
acuuugcugcuaa

SEQ ID NO: 1739732 - RNA, 21 nt, Homo sapiens
acuuuggaguccccucaccuc

SEQ ID NO: 1739733 - RNA, 18 nt, Homo sapiens
acuuuguuuuacugucuu

SEQ ID NO: 1739734 - RNA, 19 nt, Homo sapiens
agaaagugauaagugcagg

SEQ ID NO: 1739735 - RNA, 18 nt, Homo sapiens
agaaauggcgucugcucu

SEQ ID NO: 1739736 - RNA, 22 nt, Homo sapiens
agaaauuaaguaucugacaucu

SEQ ID NO: 1739737 - RNA, 19 nt, Homo sapiens
agaaggggaagcacucgug

SEQ ID NO: 1739738 - RNA, 14 nt, Homo sapiens
agaauaaauuccca

SEQ ID NO: 1739739 - RNA, 17 nt, Homo sapiens
agaauauuagugaccuc

SEQ ID NO: 1739740 - RNA, 20 nt, Homo sapiens
agaaucagugcaaagauuug

SEQ ID NO: 1739741 - RNA, 20 nt, Homo sapiens
agaaugagcacccauuccaa

SEQ ID NO: 1739742 - RNA, 19 nt, Homo sapiens
agacaaacuuugcaucuca

SEQ ID NO: 1739743 - RNA, 16 nt, Homo sapiens
agacaagugacuguau

SEQ ID NO: 1739744 - RNA, 20 nt, Homo sapiens
agacaccaccacccuugcca

SEQ ID NO: 1739745 - RNA, 22 nt, Homo sapiens
agacaucagucuccaacauguu

SEQ ID NO: 1739746 - RNA, 21 nt, Homo sapiens
agaccaagcugugcccugacc

SEQ ID NO: 1739747 - RNA, 15 nt, Homo sapiens
agacgggguuugcca

SEQ ID NO: 1739748 - RNA, 18 nt, Homo sapiens
agacuuuucccaagccua

SEQ ID NO: 1739749 - RNA, 13 nt, Homo sapiens
agagccagcagca

SEQ ID NO: 1739750 - RNA, 17 nt, Homo sapiens
agagcccgcagggccau

SEQ ID NO: 1739751 - RNA, 17 nt, Homo sapiens
agagcgaggaaaggauu

SEQ ID NO: 1739752 - RNA, 20 nt, Homo sapiens
agagcuuaggauucuaaucu

SEQ ID NO: 1739753 - RNA, 14 nt, Homo sapiens
aauuuaauuccucu

SEQ ID NO: 1739754 - RNA, 13 nt, Homo sapiens
acaaaaaauacuu

SEQ ID NO: 1739755 - RNA, 19 nt, Homo sapiens
acaaagcaguuacuaauau

SEQ ID NO: 1739756 - RNA, 17 nt, Homo sapiens
acagggaacacauuccu

SEQ ID NO: 1739757 - RNA, 14 nt, Homo sapiens
acaguauccacaau

SEQ ID NO: 1739758 - RNA, 12 nt, Homo sapiens
acaucugcaaua

SEQ ID NO: 1739759 - RNA, 21 nt, Homo sapiens
accacaccuggcccuugcaau

SEQ ID NO: 1739760 - RNA, 20 nt, Homo sapiens
acccaggcuggagugcagug

SEQ ID NO: 1739761 - RNA, 16 nt, Homo sapiens
accuagaguuuuauca

SEQ ID NO: 1739762 - RNA, 20 nt, Homo sapiens
acucuccaauguucuauuaa

SEQ ID NO: 1739763 - RNA, 19 nt, Homo sapiens
acuucuggaagucaucuca

SEQ ID NO: 1739764 - RNA, 12 nt, Homo sapiens
acuugccaagaa

SEQ ID NO: 1739765 - RNA, 17 nt, Homo sapiens
acuuuauuucugaucua

SEQ ID NO: 1739766 - RNA, 22 nt, Homo sapiens
acuuuauuucugaucuauacaa

SEQ ID NO: 1739767 - RNA, 14 nt, Homo sapiens
agauaaaccaauaa

SEQ ID NO: 1739768 - RNA, 20 nt, Homo sapiens
agauaaaccaauaaauccac

SEQ ID NO: 1739769 - RNA, 21 nt, Homo sapiens
agccaucuaaugcuuguuuau

SEQ ID NO: 1739770 - RNA, 19 nt, Homo sapiens
agcccaacaucuccagcug

SEQ ID NO: 1739771 - RNA, 16 nt, Homo sapiens
agccuggggcaaagcu

SEQ ID NO: 1739772 - RNA, 16 nt, Homo sapiens
agcgccucuccugggg

SEQ ID NO: 1739773 - RNA, 15 nt, Homo sapiens
aguuuuggcauaaua

SEQ ID NO: 1739774 - RNA, 18 nt, Homo sapiens
auagucaauuucuacuuc

SEQ ID NO: 1739775 - RNA, 14 nt, Homo sapiens
auaugauaaaacac

SEQ ID NO: 1739776 - RNA, 17 nt, Homo sapiens
auauuucuugcuuucaa

SEQ ID NO: 1739777 - RNA, 16 nt, Homo sapiens
aucauucaacucucca

SEQ ID NO: 1739778 - RNA, 12 nt, Homo sapiens
aucccagggaaa

SEQ ID NO: 1739779 - RNA, 18 nt, Homo sapiens
augaauucaagaaaggaa

SEQ ID NO: 1739780 - RNA, 16 nt, Homo sapiens
augaccuugggguaca

SEQ ID NO: 1739781 - RNA, 15 nt, Homo sapiens
augagaaaugaugaa

SEQ ID NO: 1739782 - RNA, 14 nt, Homo sapiens
auggcagaagggaa

SEQ ID NO: 1739783 - RNA, 16 nt, Homo sapiens
auucaacucuccaaug

SEQ ID NO: 1739784 - RNA, 20 nt, Homo sapiens
auucgugcauuuuuggauca

SEQ ID NO: 1739785 - RNA, 17 nt, Homo sapiens
auugcucagagaaggaa

SEQ ID NO: 1739786 - RNA, 21 nt, Homo sapiens
caaaucuggguaucuuuccag

SEQ ID NO: 1739787 - RNA, 18 nt, Homo sapiens
caacucuccaauguucua

SEQ ID NO: 1739788 - RNA, 18 nt, Homo sapiens
caacugcagugaccaggg

SEQ ID NO: 1739789 - RNA, 15 nt, Homo sapiens
caaggagaauaugau

SEQ ID NO: 1739790 - RNA, 22 nt, Homo sapiens
cagcaauucuccugccucagcc

SEQ ID NO: 1739791 - RNA, 17 nt, Homo sapiens
cagcccaacaucuccag

SEQ ID NO: 1739792 - RNA, 18 nt, Homo sapiens
caggugauccgccuaccu

SEQ ID NO: 1739793 - RNA, 14 nt, Homo sapiens
cauauaaccaaaau

SEQ ID NO: 1739794 - RNA, 22 nt, Homo sapiens
caucuccagcuggaucccaggg

SEQ ID NO: 1739795 - RNA, 17 nt, Homo sapiens
caucuucacugcaauuu

SEQ ID NO: 1739796 - RNA, 22 nt, Homo sapiens
cauguuggccaggcuggucuca

SEQ ID NO: 1739797 - RNA, 17 nt, Homo sapiens
cauugcuaaacugauga

SEQ ID NO: 1739798 - RNA, 23 nt, Homo sapiens
ccacuguugguauuauauaauuc

SEQ ID NO: 1739799 - RNA, 20 nt, Homo sapiens
ccaggcuggagugcaguggu

SEQ ID NO: 1739800 - RNA, 17 nt, Homo sapiens
cccaggcuggagugcag

SEQ ID NO: 1739801 - RNA, 17 nt, Homo sapiens
ccguacaucugcaauau

SEQ ID NO: 1739802 - RNA, 13 nt, Homo sapiens
cgacugggcucaa

SEQ ID NO: 1739803 - RNA, 15 nt, Homo sapiens
cgggagaacgcagua

SEQ ID NO: 1739804 - RNA, 20 nt, Homo sapiens
cgugcauuuuuggaucauuu

SEQ ID NO: 1739805 - RNA, 18 nt, Homo sapiens
cucucgacaguauccaca

SEQ ID NO: 1739806 - RNA, 13 nt, Homo sapiens
cugaucuauacaa

SEQ ID NO: 1739807 - RNA, 14 nt, Homo sapiens
cugccucagccucc

SEQ ID NO: 1739808 - RNA, 20 nt, Homo sapiens
cuguguuucagccacacuga

SEQ ID NO: 1739809 - RNA, 13 nt, Homo sapiens
cuguuacccaggc

SEQ ID NO: 1739810 - RNA, 13 nt, Homo sapiens
cuucaauacuuaa

SEQ ID NO: 1739811 - RNA, 18 nt, Homo sapiens
cuugggcaacugcaguga

SEQ ID NO: 1739812 - RNA, 14 nt, Homo sapiens
cuuuaucauugcua

SEQ ID NO: 1739813 - RNA, 16 nt, Homo sapiens
cuuuauuucugaucua

SEQ ID NO: 1739814 - RNA, 21 nt, Homo sapiens
cuuucaauuacaaagcaguua

SEQ ID NO: 1739815 - RNA, 13 nt, Homo sapiens
cuuuuuccacaag

SEQ ID NO: 1739816 - RNA, 15 nt, Homo sapiens
gaaaagguugccuga

SEQ ID NO: 1739817 - RNA, 21 nt, Homo sapiens
gaaaauauuuuguugccuuca

SEQ ID NO: 1739818 - RNA, 16 nt, Homo sapiens
gaaauaguaccuucaa

SEQ ID NO: 1739819 - RNA, 21 nt, Homo sapiens
gaagucaucucauuccacugu

SEQ ID NO: 1739820 - RNA, 22 nt, Homo sapiens
gaccaggggcaccggcugccca

SEQ ID NO: 1739821 - RNA, 23 nt, Homo sapiens
gacuuacuaugggauggggucca

SEQ ID NO: 1739822 - RNA, 16 nt, Homo sapiens
gcaucuacacaauuua

SEQ ID NO: 1739823 - RNA, 21 nt, Homo sapiens
gccaggcuggucucaaacucc

SEQ ID NO: 1739824 - RNA, 16 nt, Homo sapiens
gccaucaugccugacu

SEQ ID NO: 1739825 - RNA, 20 nt, Homo sapiens
gcccacagggaacacauucc

SEQ ID NO: 1739826 - RNA, 21 nt, Homo sapiens
gccuucaucuucacugcaauu

SEQ ID NO: 1739827 - RNA, 21 nt, Homo sapiens
gcgccugccaucaugccugac

SEQ ID NO: 1739828 - RNA, 14 nt, Homo sapiens
gcuggaagugccaa

SEQ ID NO: 1739829 - RNA, 23 nt, Homo sapiens
ggaaauaguaccuucaauacuua

SEQ ID NO: 1739830 - RNA, 21 nt, Homo sapiens
ggaaauaucagccuugggcaa

SEQ ID NO: 1739831 - RNA, 14 nt, Homo sapiens
ggaaucgacuguau

SEQ ID NO: 1739832 - RNA, 13 nt, Homo sapiens
ggaauugcucaga

SEQ ID NO: 1739833 - RNA, 16 nt, Homo sapiens
ggcauaauagucaauu

SEQ ID NO: 1739834 - RNA, 15 nt, Homo sapiens
gggcaacugcaguga

SEQ ID NO: 1739835 - RNA, 17 nt, Homo sapiens
ggugauccgccuaccuc

SEQ ID NO: 1739836 - RNA, 19 nt, Homo sapiens
gucucaaacuccugaccuc

SEQ ID NO: 1739837 - RNA, 18 nt, Homo sapiens
guucuuuaaaggcaucua

SEQ ID NO: 1739838 - RNA, 21 nt, Homo sapiens
guuugguaguuagccaucuaa

SEQ ID NO: 1739839 - RNA, 17 nt, Homo sapiens
uaaaaauagucuuccac

SEQ ID NO: 1739840 - RNA, 16 nt, Homo sapiens
uaaacagcuuucccac

SEQ ID NO: 1739841 - RNA, 13 nt, Homo sapiens
uaaaggcaucuac

SEQ ID NO: 1739842 - RNA, 13 nt, Homo sapiens
uaacauguuauca

SEQ ID NO: 1739843 - RNA, 17 nt, Homo sapiens
uaacauguuaucaaauc

SEQ ID NO: 1739844 - RNA, 19 nt, Homo sapiens
uaauagucaauuucuacuu

SEQ ID NO: 1739845 - RNA, 15 nt, Homo sapiens
uacaguacacagaua

SEQ ID NO: 1739846 - RNA, 21 nt, Homo sapiens
uacaucugcaauaugaauuca

SEQ ID NO: 1739847 - RNA, 20 nt, Homo sapiens
uacuuaaaaauagucuucca

SEQ ID NO: 1739848 - RNA, 20 nt, Homo sapiens
uacuucuggaagucaucuca

SEQ ID NO: 1739849 - RNA, 14 nt, Homo sapiens
uacuugccaagaaa

SEQ ID NO: 1739850 - RNA, 16 nt, Homo sapiens
uagccaucuaaugcuu

SEQ ID NO: 1739851 - RNA, 22 nt, Homo sapiens
uagcugacggcuggguguuuca

SEQ ID NO: 1739852 - RNA, 17 nt, Homo sapiens
uagucaauuucuacuuc

SEQ ID NO: 1739853 - RNA, 21 nt, Homo sapiens
uauucgugcauuuuuggauca

SEQ ID NO: 1739854 - RNA, 20 nt, Homo sapiens
ucaacuuuggugaacaguuu

SEQ ID NO: 1739855 - RNA, 11 nt, Homo sapiens
ucauggcauau

SEQ ID NO: 1739856 - RNA, 21 nt, Homo sapiens
ucauugcuaaacugaugacuu

SEQ ID NO: 1739857 - RNA, 13 nt, Homo sapiens
uccugaccucagg

SEQ ID NO: 1739858 - RNA, 13 nt, Homo sapiens
ucggcucacugca

SEQ ID NO: 1739859 - RNA, 16 nt, Homo sapiens
ucuaacauguuaucaa

SEQ ID NO: 1739860 - RNA, 22 nt, Homo sapiens
ucuacuucuggaagucaucuca

SEQ ID NO: 1739861 - RNA, 20 nt, Homo sapiens
ucucaaacuccugaccucag

SEQ ID NO: 1739862 - RNA, 23 nt, Homo sapiens
ucugcaauaugaauucaagaaag

SEQ ID NO: 1739863 - RNA, 19 nt, Homo sapiens
ucuuccacaaaaaauacuu

SEQ ID NO: 1739864 - RNA, 14 nt, Homo sapiens
ucuuuaaaggcauc

SEQ ID NO: 1739865 - RNA, 20 nt, Homo sapiens
ugaaaauauuuuguugccuu

SEQ ID NO: 1739866 - RNA, 15 nt, Homo sapiens
ugaagcagucuugcu

SEQ ID NO: 1739867 - RNA, 19 nt, Homo sapiens
ugaccuugggguacaauug

SEQ ID NO: 1739868 - RNA, 15 nt, Homo sapiens
ugauaaaacacugcc

SEQ ID NO: 1739869 - RNA, 14 nt, Homo sapiens
ugaugacuuacuau

SEQ ID NO: 1739870 - RNA, 16 nt, Homo sapiens
ugcaauaugaauucaa

SEQ ID NO: 1739871 - RNA, 11 nt, Homo sapiens
aaaaauacuuu

SEQ ID NO: 1739872 - RNA, 22 nt, Homo sapiens
aaaaugggagacagccucuuac

SEQ ID NO: 1739873 - RNA, 15 nt, Homo sapiens
aaacagcuuucccac

SEQ ID NO: 1739874 - RNA, 23 nt, Homo sapiens
aaagaagagaugagaaaugauga

SEQ ID NO: 1739875 - RNA, 19 nt, Homo sapiens
aaaucuggguaucuuucca

SEQ ID NO: 1739876 - RNA, 14 nt, Homo sapiens
aaccuccuuuacca

SEQ ID NO: 1739877 - RNA, 14 nt, Homo sapiens
aacuccugaccuca

SEQ ID NO: 1739878 - RNA, 21 nt, Homo sapiens
aacucuccaauguucuauuaa

SEQ ID NO: 1739879 - RNA, 14 nt, Homo sapiens
aacugcagugacca

SEQ ID NO: 1739880 - RNA, 13 nt, Homo sapiens
aagagcuaauaaa

SEQ ID NO: 1739881 - RNA, 19 nt, Homo sapiens
aagcagucuugcucuguua

SEQ ID NO: 1739882 - RNA, 20 nt, Homo sapiens
aaggaaaagacugaaucuac

SEQ ID NO: 1739883 - RNA, 15 nt, Homo sapiens
aagggaauugcucag

SEQ ID NO: 1739884 - RNA, 23 nt, Homo sapiens
aauaaaugagagggaaucgacug

SEQ ID NO: 1739885 - RNA, 20 nt, Homo sapiens
aaucuaccugcccuaaggga

SEQ ID NO: 1739886 - RNA, 22 nt, Homo sapiens
aaucucuucuuugcugcaguca

SEQ ID NO: 1739887 - RNA, 14 nt, Homo sapiens
aauugcucagagaa

SEQ ID NO: 1739888 - RNA, 19 nt, Homo sapiens
acaccguacaucugcaaua

SEQ ID NO: 1739889 - RNA, 20 nt, Homo sapiens
acaccuggcccuugcaaucu

SEQ ID NO: 1739890 - RNA, 16 nt, Homo sapiens
acagggaacacauucc

SEQ ID NO: 1739891 - RNA, 15 nt, Homo sapiens
acauguuaucaaauc

SEQ ID NO: 1739892 - RNA, 19 nt, Homo sapiens
accggcugcccacagggaa

SEQ ID NO: 1739893 - RNA, 16 nt, Homo sapiens
accguacaucugcaau

SEQ ID NO: 1739894 - RNA, 16 nt, Homo sapiens
acucuccaauguucua

SEQ ID NO: 1739895 - RNA, 16 nt, Homo sapiens
acugaaucuaccugcc

SEQ ID NO: 1739896 - RNA, 16 nt, Homo sapiens
acuguauucgugcauu

SEQ ID NO: 1739897 - RNA, 22 nt, Homo sapiens
acuguugguauuauauaauuca

SEQ ID NO: 1739898 - RNA, 17 nt, Homo sapiens
agacugaaucuaccugc

SEQ ID NO: 1739899 - RNA, 16 nt, Homo sapiens
agcaauucuccugccu

SEQ ID NO: 1739900 - RNA, 15 nt, Homo sapiens
agccaucuaaugcuu

SEQ ID NO: 1739901 - RNA, 15 nt, Homo sapiens
agcccaacaucucca

SEQ ID NO: 1739902 - RNA, 20 nt, Homo sapiens
agcccaacaucuccagcugg

SEQ ID NO: 1739903 - RNA, 15 nt, Homo sapiens
agcuggaaaaccucc

SEQ ID NO: 1739904 - RNA, 20 nt, Homo sapiens
aggcgccugccaucaugccu

SEQ ID NO: 1739905 - RNA, 16 nt, Homo sapiens
agggaacacauuccuu

SEQ ID NO: 1739906 - RNA, 19 nt, Homo sapiens
aggggcaccggcugcccac

SEQ ID NO: 1739907 - RNA, 19 nt, Homo sapiens
aggugauccgccuaccuca

SEQ ID NO: 1739908 - RNA, 15 nt, Homo sapiens
aguacacagauaccu

SEQ ID NO: 1739909 - RNA, 16 nt, Homo sapiens
agucaucucauuccac

SEQ ID NO: 1739910 - RNA, 12 nt, Homo sapiens
auaauagucaau

SEQ ID NO: 1739911 - RNA, 19 nt, Homo sapiens
auacuuuauuucugaucua

SEQ ID NO: 1739912 - RNA, 15 nt, Homo sapiens
auaugaauucaagaa

SEQ ID NO: 1739913 - RNA, 16 nt, Homo sapiens
auccacaauagcugac

SEQ ID NO: 1739914 - RNA, 15 nt, Homo sapiens
auccgccuaccucag

SEQ ID NO: 1739915 - RNA, 15 nt, Homo sapiens
aucucauuccacugu

SEQ ID NO: 1739916 - RNA, 22 nt, Homo sapiens
aucucuucuuugcugcagucau

SEQ ID NO: 1739917 - RNA, 15 nt, Homo sapiens
aucuucacugcaauu

SEQ ID NO: 1739918 - RNA, 21 nt, Homo sapiens
auucaaggagaauaugauaaa

SEQ ID NO: 1739919 - RNA, 21 nt, Homo sapiens
auuuuguugccuucaucuuca

SEQ ID NO: 1739920 - RNA, 15 nt, Homo sapiens
caaacuccugaccuc

SEQ ID NO: 1739921 - RNA, 14 nt, Homo sapiens
caaccucugccucc

SEQ ID NO: 1739922 - RNA, 16 nt, Homo sapiens
caaucuucuacuuuaa

SEQ ID NO: 1739923 - RNA, 13 nt, Homo sapiens
caauguucuauua

SEQ ID NO: 1739924 - RNA, 15 nt, Homo sapiens
caccauguuggccag

SEQ ID NO: 1739925 - RNA, 17 nt, Homo sapiens
caccuggcccuugcaau

SEQ ID NO: 1739926 - RNA, 17 nt, Homo sapiens
cacugaacccaauuaca

SEQ ID NO: 1739927 - RNA, 21 nt, Homo sapiens
cagagaaggaaaagacugaau

SEQ ID NO: 1739928 - RNA, 20 nt, Homo sapiens
cagcaauucuccugccucag

SEQ ID NO: 1739929 - RNA, 19 nt, Homo sapiens
cagccucccuaguagcugg

SEQ ID NO: 1739930 - RNA, 19 nt, Homo sapiens
cagccuugggcaacugcag

SEQ ID NO: 1739931 - RNA, 13 nt, Homo sapiens
caggcgugaucca

SEQ ID NO: 1739932 - RNA, 12 nt, Homo sapiens
aaaaauguucuu

SEQ ID NO: 1739933 - RNA, 12 nt, Homo sapiens
aaaagacugaau

SEQ ID NO: 1739934 - RNA, 13 nt, Homo sapiens
aaaauucauuucu

SEQ ID NO: 1739935 - RNA, 14 nt, Homo sapiens
aaacugaugacuua

SEQ ID NO: 1739936 - RNA, 19 nt, Homo sapiens
aaagcaguuacuaauaugc

SEQ ID NO: 1739937 - RNA, 14 nt, Homo sapiens
aaagguugccugaa

SEQ ID NO: 1739938 - RNA, 21 nt, Homo sapiens
aaaguuuuaggguacaguuug

SEQ ID NO: 1739939 - RNA, 21 nt, Homo sapiens
aaauaguaccuucaauacuua

SEQ ID NO: 1739940 - RNA, 17 nt, Homo sapiens
aaaugggagacagccuc

SEQ ID NO: 1739941 - RNA, 14 nt, Homo sapiens
aacacugcccucuu

SEQ ID NO: 1739942 - RNA, 22 nt, Homo sapiens
aacuuguuugguaguuagccau

SEQ ID NO: 1739943 - RNA, 21 nt, Homo sapiens
aaggaaauaguaccuucaaua

SEQ ID NO: 1739944 - RNA, 19 nt, Homo sapiens
aaggcaucuacacaauuua

SEQ ID NO: 1739945 - RNA, 18 nt, Homo sapiens
aagugccaaagccugggg

SEQ ID NO: 1739946 - RNA, 22 nt, Homo sapiens
aauaaaugagagggaaucgacu

SEQ ID NO: 1739947 - RNA, 17 nt, Homo sapiens
aauaguaccuucaauac

SEQ ID NO: 1739948 - RNA, 20 nt, Homo sapiens
aauaguaccuucaauacuua

SEQ ID NO: 1739949 - RNA, 19 nt, Homo sapiens
aaucuggguaucuuuccag

SEQ ID NO: 1739950 - RNA, 12 nt, Homo sapiens
aaucuucuacuu

SEQ ID NO: 1739951 - RNA, 13 nt, Homo sapiens
aauuacacacagc

SEQ ID NO: 1739952 - RNA, 20 nt, Homo sapiens
acaccguacaucugcaauau

SEQ ID NO: 1739953 - RNA, 17 nt, Homo sapiens
acagccucuuacuugcc

SEQ ID NO: 1739954 - RNA, 20 nt, Homo sapiens
acaggcgccugccaucaugc

SEQ ID NO: 1739955 - RNA, 22 nt, Homo sapiens
acaggcgugauccaccacaccu

SEQ ID NO: 1739956 - RNA, 20 nt, Homo sapiens
acaucuccagcuggauccca

SEQ ID NO: 1739957 - RNA, 13 nt, Homo sapiens
acaucugcaauau

SEQ ID NO: 1739958 - RNA, 20 nt, Homo sapiens
acaucugcaauaugaauuca

SEQ ID NO: 1739959 - RNA, 17 nt, Homo sapiens
accaggggcaccggcug

SEQ ID NO: 1739960 - RNA, 13 nt, Homo sapiens
accuucaauacuu

SEQ ID NO: 1739961 - RNA, 19 nt, Homo sapiens
acggcguuucaccauguug

SEQ ID NO: 1739962 - RNA, 16 nt, Homo sapiens
acugcaaccucugccu

SEQ ID NO: 1739963 - RNA, 23 nt, Homo sapiens
acugcaaccucugccucccaggu

SEQ ID NO: 1739964 - RNA, 15 nt, Homo sapiens
acuucuggaagucau

SEQ ID NO: 1739965 - RNA, 14 nt, Homo sapiens
agaguuuuaucaac

SEQ ID NO: 1739966 - RNA, 21 nt, Homo sapiens
agaugcuagaaaaauguucuu

SEQ ID NO: 1739967 - RNA, 13 nt, Homo sapiens
agcagucuugcuc

SEQ ID NO: 1739968 - RNA, 14 nt, Homo sapiens
agcccaacaucucc

SEQ ID NO: 1739969 - RNA, 23 nt, Homo sapiens
agcuguguuucagccacacugaa

SEQ ID NO: 1739970 - RNA, 23 nt, Homo sapiens
aggaaauaguaccuucaauacuu

SEQ ID NO: 1739971 - RNA, 16 nt, Homo sapiens
aggcgccugccaucau

SEQ ID NO: 1739972 - RNA, 20 nt, Homo sapiens
aggcuggagugcaguggugu

SEQ ID NO: 1739973 - RNA, 22 nt, Homo sapiens
aggcuucccugacuugcuuuag

SEQ ID NO: 1739974 - RNA, 14 nt, Homo sapiens
agggaauugcucag

SEQ ID NO: 1739975 - RNA, 13 nt, Homo sapiens
agucaauuucuac

SEQ ID NO: 1739976 - RNA, 15 nt, Homo sapiens
agucaauuucuacuu

SEQ ID NO: 1739977 - RNA, 15 nt, Homo sapiens
agucaucucauucca

SEQ ID NO: 1739978 - RNA, 15 nt, Homo sapiens
aucauucaacucucc

SEQ ID NO: 1739979 - RNA, 22 nt, Homo sapiens
aucucggcucacugcaaccucu

SEQ ID NO: 1739980 - RNA, 12 nt, Homo sapiens
aucuucuacuuu

SEQ ID NO: 1739981 - RNA, 19 nt, Homo sapiens
augaccuugggguacaauu

SEQ ID NO: 1739982 - RNA, 14 nt, Homo sapiens
auuaaucaccucuc

SEQ ID NO: 1739983 - RNA, 15 nt, Homo sapiens
auuacuaucauggca

SEQ ID NO: 1739984 - RNA, 19 nt, Homo sapiens
auucuuaugauuacuauca

SEQ ID NO: 1739985 - RNA, 19 nt, Homo sapiens
auuucugaucuauacaaau

SEQ ID NO: 1739986 - RNA, 16 nt, Homo sapiens
auuuuuuuuugaagca

SEQ ID NO: 1739987 - RNA, 20 nt, Homo sapiens
cacagcgggagaacgcagua

SEQ ID NO: 1739988 - RNA, 18 nt, Homo sapiens
caccucucuguaguuuau

SEQ ID NO: 1739989 - RNA, 19 nt, Homo sapiens
cagcuuuuguuguuuauau

SEQ ID NO: 1739990 - RNA, 20 nt, Homo sapiens
caguauccacaauagcugac

SEQ ID NO: 1739991 - RNA, 16 nt, Homo sapiens
caguggugugaucucg

SEQ ID NO: 1739992 - RNA, 22 nt, Homo sapiens
caucuacuuuuuuuuuaauuaa

SEQ ID NO: 1739993 - RNA, 11 nt, Homo sapiens
caucugcaaua

SEQ ID NO: 1739994 - RNA, 17 nt, Homo sapiens
cauucaacucuccaaug

SEQ ID NO: 1739995 - RNA, 16 nt, Homo sapiens
ccacaaaaaauacuuu

SEQ ID NO: 1739996 - RNA, 11 nt, Homo sapiens
ccacagggaac

SEQ ID NO: 1739997 - RNA, 21 nt, Homo sapiens
ccaucuaaugcuuguuuauga

SEQ ID NO: 1739998 - RNA, 19 nt, Homo sapiens
cccaggcuggagugcagug

SEQ ID NO: 1739999 - RNA, 11 nt, Homo sapiens
ccuaccucagc

SEQ ID NO: 1740000 - RNA, 21 nt, Homo sapiens
ccuugcaaucuucuacuuuaa

SEQ ID NO: 1740001 - RNA, 16 nt, Homo sapiens
cguacaucugcaauau

SEQ ID NO: 1740002 - RNA, 21 nt, Homo sapiens
cuagaaaaauguucuuuaaag

SEQ ID NO: 1740003 - RNA, 20 nt, Homo sapiens
cuauuaaucaccucucugua

SEQ ID NO: 1740004 - RNA, 20 nt, Homo sapiens
cucaaacuccugaccucagg

SEQ ID NO: 1740005 - RNA, 15 nt, Homo sapiens
cucaaagaucugaau

SEQ ID NO: 1740006 - RNA, 15 nt, Homo sapiens
cucucgacaguaucc

SEQ ID NO: 1740007 - RNA, 19 nt, Homo sapiens
cugaccucaggugauccgc

SEQ ID NO: 1740008 - RNA, 17 nt, Homo sapiens
cugcagucaucuacuuu

SEQ ID NO: 1740009 - RNA, 20 nt, Homo sapiens
cuggagugcaguggugugau

SEQ ID NO: 1740010 - RNA, 21 nt, Homo sapiens
cuguguuucagccacacugaa

SEQ ID NO: 1740011 - RNA, 14 nt, Homo sapiens
cuucaauacuuaaa

SEQ ID NO: 1740012 - RNA, 19 nt, Homo sapiens
cuucaucuucacugcaauu

SEQ ID NO: 1740013 - RNA, 17 nt, Homo sapiens
cuugggcaacugcagug

SEQ ID NO: 1740014 - RNA, 22 nt, Homo sapiens
gaaauaguaccuucaauacuua

SEQ ID NO: 1740015 - RNA, 23 nt, Homo sapiens
gaacgcaguaaacagcuuuccca

SEQ ID NO: 1740016 - RNA, 17 nt, Homo sapiens
gaagcagucuugcucug

SEQ ID NO: 1740017 - RNA, 16 nt, Homo sapiens
gaagucaucucauucc

SEQ ID NO: 1740018 - RNA, 15 nt, Homo sapiens
gacaguauccacaau

SEQ ID NO: 1740019 - RNA, 18 nt, Homo sapiens
gaccaggggcaccggcug

SEQ ID NO: 1740020 - RNA, 14 nt, Homo sapiens
uggaagucaucuca

SEQ ID NO: 1740021 - RNA, 20 nt, Homo sapiens
uggaagucaucucauuccac

SEQ ID NO: 1740022 - RNA, 23 nt, Homo sapiens
uggugugaucucggcucacugca

SEQ ID NO: 1740023 - RNA, 17 nt, Homo sapiens
uguugccuucaucuuca

SEQ ID NO: 1740024 - RNA, 14 nt, Homo sapiens
uuauauaauucaag

SEQ ID NO: 1740025 - RNA, 22 nt, Homo sapiens
uuaugauuacuaucauggcaua

SEQ ID NO: 1740026 - RNA, 20 nt, Homo sapiens
uuauuucugaucuauacaaa

SEQ ID NO: 1740027 - RNA, 20 nt, Homo sapiens
uucuugcuuucaauuacaaa

SEQ ID NO: 1740028 - RNA, 13 nt, Homo sapiens
uucuuuuuccaca

SEQ ID NO: 1740029 - RNA, 22 nt, Homo sapiens
uugccuucaucuucacugcaau

SEQ ID NO: 1740030 - RNA, 19 nt, Homo sapiens
uugcucucgacaguaucca

SEQ ID NO: 1740031 - RNA, 17 nt, Homo sapiens
uuugcugcagucaucua

SEQ ID NO: 1740032 - RNA, 19 nt, Homo sapiens
uuuggcuagguaucauuca

SEQ ID NO: 1740033 - RNA, 17 nt, Homo sapiens
uaguaccuucaauacuu

SEQ ID NO: 1740034 - RNA, 20 nt, Homo sapiens
uagucaauuucuacuucugg

SEQ ID NO: 1740035 - RNA, 14 nt, Homo sapiens
uauacaguacacag

SEQ ID NO: 1740036 - RNA, 23 nt, Homo sapiens
ucaacucuccaauguucuauuaa

SEQ ID NO: 1740037 - RNA, 12 nt, Homo sapiens
ucacugcaauuu

SEQ ID NO: 1740038 - RNA, 23 nt, Homo sapiens
ucagcuuuuguuguuuauauaca

SEQ ID NO: 1740039 - RNA, 18 nt, Homo sapiens
ucaucuucacugcaauuu

SEQ ID NO: 1740040 - RNA, 20 nt, Homo sapiens
uccagcuggaucccagggaa

SEQ ID NO: 1740041 - RNA, 20 nt, Homo sapiens
ucuauacaaauuuucagaag

SEQ ID NO: 1740042 - RNA, 22 nt, Homo sapiens
ucuccagcuggaucccagggaa

SEQ ID NO: 1740043 - RNA, 14 nt, Homo sapiens
ucuggaagucaucu

SEQ ID NO: 1740044 - RNA, 22 nt, Homo sapiens
ucuuaugauuacuaucauggca

SEQ ID NO: 1740045 - RNA, 14 nt, Homo sapiens
ucuucuacuuuaag

SEQ ID NO: 1740046 - RNA, 14 nt, Homo sapiens
ucuucuuugcugca

SEQ ID NO: 1740047 - RNA, 14 nt, Homo sapiens
ucuuguggugcauu

SEQ ID NO: 1740048 - RNA, 20 nt, Homo sapiens
ucuuuaaaggcaucuacaca

SEQ ID NO: 1740049 - RNA, 16 nt, Homo sapiens
ucuuuaucauugcuaa

SEQ ID NO: 1740050 - RNA, 22 nt, Homo sapiens
ucuuuccaggcuucccugacuu

SEQ ID NO: 1740051 - RNA, 17 nt, Homo sapiens
ugaacccaauuacacac

SEQ ID NO: 1740052 - RNA, 16 nt, Homo sapiens
ugaagcagucuugcuc

SEQ ID NO: 1740053 - RNA, 13 nt, Homo sapiens
ugaucuauacaaa

SEQ ID NO: 1740054 - RNA, 19 nt, Homo sapiens
ugaucucggcucacugcaa

SEQ ID NO: 1740055 - RNA, 19 nt, Homo sapiens
ugauuacuaucauggcaua

SEQ ID NO: 1740056 - RNA, 13 nt, Homo sapiens
ugcaaccucugcc

SEQ ID NO: 1740057 - RNA, 14 nt, Homo sapiens
ugcaaccucugccu

SEQ ID NO: 1740058 - RNA, 16 nt, Homo sapiens
ugccucccagguucca

SEQ ID NO: 1740059 - RNA, 14 nt, Homo sapiens
ugcucuguuaccca

SEQ ID NO: 1740060 - RNA, 23 nt, Homo sapiens
ugcugggauuacaggcgugaucc

SEQ ID NO: 1740061 - RNA, 19 nt, Homo sapiens
uggaaaaccuccuuuacca

SEQ ID NO: 1740062 - RNA, 15 nt, Homo sapiens
uggaagucaucucau

SEQ ID NO: 1740063 - RNA, 18 nt, Homo sapiens
uggccaggcuggucucaa

SEQ ID NO: 1740064 - RNA, 21 nt, Homo sapiens
uggguguuucaguuugaaaau

SEQ ID NO: 1740065 - RNA, 18 nt, Homo sapiens
ugguauuauauaauucaa

SEQ ID NO: 1740066 - RNA, 13 nt, Homo sapiens
uggugugaucucg

SEQ ID NO: 1740067 - RNA, 21 nt, Homo sapiens
uguaaaccuagaguuuuauca

SEQ ID NO: 1740068 - RNA, 14 nt, Homo sapiens
uguauucgugcauu

SEQ ID NO: 1740069 - RNA, 20 nt, Homo sapiens
uguugguauuauauaauuca

SEQ ID NO: 1740070 - RNA, 23 nt, Homo sapiens
uguuugguaguuagccaucuaau

SEQ ID NO: 1740071 - RNA, 18 nt, Homo sapiens
uuaaaggcaucuacacaa

SEQ ID NO: 1740072 - RNA, 22 nt, Homo sapiens
uuaccagaugcugacuggcacu

SEQ ID NO: 1740073 - RNA, 16 nt, Homo sapiens
uuacuaucauggcaua

SEQ ID NO: 1740074 - RNA, 12 nt, Homo sapiens
uuauauaauuca

SEQ ID NO: 1740075 - RNA, 13 nt, Homo sapiens
uuaucauugcuaa

SEQ ID NO: 1740076 - RNA, 19 nt, Homo sapiens
uuauuucugaucuauacaa

SEQ ID NO: 1740077 - RNA, 13 nt, Homo sapiens
uucuccugccuca

SEQ ID NO: 1740078 - RNA, 17 nt, Homo sapiens
uucuggaagucaucuca

SEQ ID NO: 1740079 - RNA, 15 nt, Homo sapiens
uucuuuaaaggcauc

SEQ ID NO: 1740080 - RNA, 16 nt, Homo sapiens
uucuuugcugcaguca

SEQ ID NO: 1740081 - RNA, 11 nt, Homo sapiens
uugaaagaaga

SEQ ID NO: 1740082 - RNA, 16 nt, Homo sapiens
uugcaaucuucuacuu

SEQ ID NO: 1740083 - RNA, 17 nt, Homo sapiens
uuggcauaauagucaau

SEQ ID NO: 1740084 - RNA, 15 nt, Homo sapiens
uuucaauuacaaagc

SEQ ID NO: 1740085 - RNA, 14 nt, Homo sapiens
uuucuuuaucauug

SEQ ID NO: 1740086 - RNA, 14 nt, Homo sapiens
aaucaccucucugu

SEQ ID NO: 1740087 - RNA, 15 nt, Homo sapiens
aaucuucuacuuuaa

SEQ ID NO: 1740088 - RNA, 21 nt, Homo sapiens
aauuucuacuucuggaaguca

SEQ ID NO: 1740089 - RNA, 15 nt, Homo sapiens
acaaaaaauacuuua

SEQ ID NO: 1740090 - RNA, 21 nt, Homo sapiens
acaaguaccacucuuggucag

SEQ ID NO: 1740091 - RNA, 19 nt, Homo sapiens
acaguacacagauaccuug

SEQ ID NO: 1740092 - RNA, 15 nt, Homo sapiens
accaaaauccgacug

SEQ ID NO: 1740093 - RNA, 20 nt, Homo sapiens
accacaccuggcccuugcaa

SEQ ID NO: 1740094 - RNA, 18 nt, Homo sapiens
acccaauuacacacagcg

SEQ ID NO: 1740095 - RNA, 19 nt, Homo sapiens
accucagccucccaaagug

SEQ ID NO: 1740096 - RNA, 14 nt, Homo sapiens
accuccuuuaccag

SEQ ID NO: 1740097 - RNA, 16 nt, Homo sapiens
accuggcccuugcaau

SEQ ID NO: 1740098 - RNA, 19 nt, Homo sapiens
accuggcccuugcaaucuu

SEQ ID NO: 1740099 - RNA, 15 nt, Homo sapiens
accuucaauacuuaa

SEQ ID NO: 1740100 - RNA, 22 nt, Homo sapiens
acgcaguaaacagcuuucccac

SEQ ID NO: 1740101 - RNA, 15 nt, Homo sapiens
acugcaaccucugcc

SEQ ID NO: 1740102 - RNA, 16 nt, Homo sapiens
acugcagugaccaggg

SEQ ID NO: 1740103 - RNA, 14 nt, Homo sapiens
acugggcucaagag

SEQ ID NO: 1740104 - RNA, 17 nt, Homo sapiens
agcaauucuccugccuc

SEQ ID NO: 1740105 - RNA, 14 nt, Homo sapiens
agcuggaaaaccuc

SEQ ID NO: 1740106 - RNA, 15 nt, Homo sapiens
aggagaauaugauaa

SEQ ID NO: 1740107 - RNA, 16 nt, Homo sapiens
agguugccugaaaaau

SEQ ID NO: 1740108 - RNA, 14 nt, Homo sapiens
aguaccuucaauac

SEQ ID NO: 1740109 - RNA, 17 nt, Homo sapiens
aguaccuucaauacuua

SEQ ID NO: 1740110 - RNA, 12 nt, Homo sapiens
aguauccacaau

SEQ ID NO: 1740111 - RNA, 20 nt, Homo sapiens
agugcaguggugugaucucg

SEQ ID NO: 1740112 - RNA, 15 nt, Homo sapiens
aguggugugaucucg

SEQ ID NO: 1740113 - RNA, 20 nt, Homo sapiens
aguggugugaucucggcuca

SEQ ID NO: 1740114 - RNA, 16 nt, Homo sapiens
auaaaacacugcccuc

SEQ ID NO: 1740115 - RNA, 22 nt, Homo sapiens
auaaaucucuucuuugcugcag

SEQ ID NO: 1740116 - RNA, 19 nt, Homo sapiens
auaguaccuucaauacuua

SEQ ID NO: 1740117 - RNA, 21 nt, Homo sapiens
auccacaccguacaucugcaa

SEQ ID NO: 1740118 - RNA, 17 nt, Homo sapiens
aucucggcucacugcaa

SEQ ID NO: 1740119 - RNA, 17 nt, Homo sapiens
aucuggguaucuuucca

SEQ ID NO: 1740120 - RNA, 13 nt, Homo sapiens
aucuucacugcaa

SEQ ID NO: 1740121 - RNA, 21 nt, Homo sapiens
auggcagaagggaauugcuca

SEQ ID NO: 1740122 - RNA, 19 nt, Homo sapiens
auguucuuuaaaggcaucu

SEQ ID NO: 1740123 - RNA, 17 nt, Homo sapiens
auuacaggcgugaucca

SEQ ID NO: 1740124 - RNA, 21 nt, Homo sapiens
auuacaggcgugauccaccac

SEQ ID NO: 1740125 - RNA, 21 nt, Homo sapiens
auucaacucuccaauguucua

SEQ ID NO: 1740126 - RNA, 15 nt, Homo sapiens
auucuccugccucag

SEQ ID NO: 1740127 - RNA, 23 nt, Homo sapiens
auuucuacuucuggaagucaucu

SEQ ID NO: 1740128 - RNA, 18 nt, Homo sapiens
auuucugaucuauacaaa

SEQ ID NO: 1740129 - RNA, 16 nt, Homo sapiens
caacucuccaauguuc

SEQ ID NO: 1740130 - RNA, 15 nt, Homo sapiens
caaggaauaaaugag

SEQ ID NO: 1740131 - RNA, 14 nt, Homo sapiens
caaucuucuacuuu

SEQ ID NO: 1740132 - RNA, 21 nt, Homo sapiens
cacaccuggcccuugcaaucu

SEQ ID NO: 1740133 - RNA, 17 nt, Homo sapiens
cacagggaacacauucc

SEQ ID NO: 1740134 - RNA, 17 nt, Homo sapiens
caccguacaucugcaau

SEQ ID NO: 1740135 - RNA, 18 nt, Homo sapiens
caccguacaucugcaaua

SEQ ID NO: 1740136 - RNA, 22 nt, Homo sapiens
caccguacaucugcaauaugaa

SEQ ID NO: 1740137 - RNA, 23 nt, Homo sapiens
cacugcccucuuguggugcauug

SEQ ID NO: 1740138 - RNA, 16 nt, Homo sapiens
cagaagggaauugcuc

SEQ ID NO: 1740139 - RNA, 16 nt, Homo sapiens
cagagauaaaccaaua

SEQ ID NO: 1740140 - RNA, 15 nt, Homo sapiens
cauaauagucaauuu

SEQ ID NO: 1740141 - RNA, 22 nt, Homo sapiens
cauaauagucaauuucuacuuc

SEQ ID NO: 1740142 - RNA, 13 nt, Homo sapiens
ccaaaauccgacu

SEQ ID NO: 1740143 - RNA, 23 nt, Homo sapiens
ccaauguucuauuaaucaccucu

SEQ ID NO: 1740144 - RNA, 16 nt, Homo sapiens
ccagcccaacaucucc

SEQ ID NO: 1740145 - RNA, 19 nt, Homo sapiens
cccacagggaacacauucc

SEQ ID NO: 1740146 - RNA, 21 nt, Homo sapiens
cccuugcaaucuucuacuuua

SEQ ID NO: 1740147 - RNA, 15 nt, Homo sapiens
ccuucaauacuuaaa

SEQ ID NO: 1740148 - RNA, 20 nt, Homo sapiens
ccuucaucuucacugcaauu

SEQ ID NO: 1740149 - RNA, 12 nt, Homo sapiens
cuaaaguuuuag

SEQ ID NO: 1740150 - RNA, 18 nt, Homo sapiens
cuaauaugccuagcacaa

SEQ ID NO: 1740151 - RNA, 14 nt, Homo sapiens
cuacacaauuuaau

SEQ ID NO: 1740152 - RNA, 22 nt, Homo sapiens
cuagguaucauucaacucucca

SEQ ID NO: 1740153 - RNA, 22 nt, Homo sapiens
cuccagcuggaucccagggaaa

SEQ ID NO: 1740154 - RNA, 20 nt, Homo sapiens
cuccugaccucaggugaucc

SEQ ID NO: 1740155 - RNA, 16 nt, Homo sapiens
cucucgacaguaucca

SEQ ID NO: 1740156 - RNA, 17 nt, Homo sapiens
cucuuguggugcauuga

SEQ ID NO: 1740157 - RNA, 12 nt, Homo sapiens
cugaaucuaccu

SEQ ID NO: 1740158 - RNA, 23 nt, Homo sapiens
cugacuaauuuuuguauuuuuag

SEQ ID NO: 1740159 - RNA, 20 nt, Homo sapiens
cugauucuuaugauuacuau

SEQ ID NO: 1740160 - RNA, 18 nt, Homo sapiens
cugcaauaugaauucaag

SEQ ID NO: 1740161 - RNA, 17 nt, Homo sapiens
cugccaucaugccugac

SEQ ID NO: 1740162 - RNA, 15 nt, Homo sapiens
cugcccacagggaac

SEQ ID NO: 1740163 - RNA, 18 nt, Homo sapiens
cuggaagucaucucauuc

SEQ ID NO: 1740164 - RNA, 21 nt, Homo sapiens
cugggauuacaggcgugaucc

SEQ ID NO: 1740165 - RNA, 18 nt, Homo sapiens
cuucaucuucacugcaau

SEQ ID NO: 1740166 - RNA, 21 nt, Homo sapiens
cuugaaaggaagagcuaauaa

SEQ ID NO: 1740167 - RNA, 20 nt, Homo sapiens
cuuguuugguaguuagccau

SEQ ID NO: 1740168 - RNA, 17 nt, Homo sapiens
gaacaguuuuggcauaa

SEQ ID NO: 1740169 - RNA, 13 nt, Homo sapiens
gaagucaucucau

SEQ ID NO: 1740170 - RNA, 20 nt, Homo sapiens
gaagucaucucauuccacug

SEQ ID NO: 1740171 - RNA, 21 nt, Homo sapiens
gaauaugauaaaacacugccc

SEQ ID NO: 1740172 - RNA, 19 nt, Homo sapiens
gagugcaguggugugaucu

SEQ ID NO: 1740173 - RNA, 18 nt, Homo sapiens
gaucucggcucacugcaa

SEQ ID NO: 1740174 - RNA, 20 nt, Homo sapiens
gauuacuaucauggcauaua

SEQ ID NO: 1740175 - RNA, 17 nt, Homo sapiens
gcaauuuuguguaaauu

SEQ ID NO: 1740176 - RNA, 15 nt, Homo sapiens
gcaucuacacaauuu

SEQ ID NO: 1740177 - RNA, 12 nt, Homo sapiens
gccaucaugccu

SEQ ID NO: 1740178 - RNA, 19 nt, Homo sapiens
gccucccagcccaacaucu

SEQ ID NO: 1740179 - RNA, 14 nt, Homo sapiens
gccuucaucuucac

SEQ ID NO: 1740180 - RNA, 16 nt, Homo sapiens
gcuagguaucauucaa

SEQ ID NO: 1740181 - RNA, 17 nt, Homo sapiens
gcucaagaggccacuua

SEQ ID NO: 1740182 - RNA, 13 nt, Homo sapiens
gcucucgacagua

SEQ ID NO: 1740183 - RNA, 20 nt, Homo sapiens
gcuggagugcagugguguga

SEQ ID NO: 1740184 - RNA, 18 nt, Homo sapiens
gcuggucucaaacuccug

SEQ ID NO: 1740185 - RNA, 23 nt, Homo sapiens
ggaagugccaaagccuggggcaa

SEQ ID NO: 1740186 - RNA, 13 nt, Homo sapiens
ggaucccagggaa

SEQ ID NO: 1740187 - RNA, 16 nt, Homo sapiens
ggcuagguaucauuca

SEQ ID NO: 1740188 - RNA, 20 nt, Homo sapiens
ggucucaaacuccugaccuc

SEQ ID NO: 1740189 - RNA, 15 nt, Homo sapiens
guacaucugcaauau

SEQ ID NO: 1740190 - RNA, 17 nt, Homo sapiens
guauuauauaauucaag

SEQ ID NO: 1740191 - RNA, 21 nt, Homo sapiens
gucccaugaccuugggguaca

SEQ ID NO: 1740192 - RNA, 19 nt, Homo sapiens
guuuaugauauuucuugcu

SEQ ID NO: 1740193 - RNA, 21 nt, Homo sapiens
guuugaaaauauuuuguugcc

SEQ ID NO: 1740194 - RNA, 21 nt, Homo sapiens
guuuggcuagguaucauucaa

SEQ ID NO: 1740195 - RNA, 17 nt, Homo sapiens
guuuuaggguacaguuu

SEQ ID NO: 1740196 - RNA, 12 nt, Homo sapiens
uaaaauucauuu

SEQ ID NO: 1740197 - RNA, 21 nt, Homo sapiens
uaaaguuuuaggguacaguuu

SEQ ID NO: 1740198 - RNA, 21 nt, Homo sapiens
uaaauaaaauucauuucuaca

SEQ ID NO: 1740199 - RNA, 22 nt, Homo sapiens
uaacuuguuugguaguuagcca

SEQ ID NO: 1740200 - RNA, 24 nt, Homo sapiens
uaauaaaucucuucuuugcugcag

SEQ ID NO: 1740201 - RNA, 15 nt, Homo sapiens
uaaucaccucucugu

SEQ ID NO: 1740202 - RNA, 15 nt, Homo sapiens
uacaucugcaauaug

SEQ ID NO: 1740203 - RNA, 16 nt, Homo sapiens
uacuaucauggcauau

SEQ ID NO: 1740204 - RNA, 13 nt, Homo sapiens
caggcuggucuca

SEQ ID NO: 1740205 - RNA, 14 nt, Homo sapiens
cagucaucuacuuu

SEQ ID NO: 1740206 - RNA, 15 nt, Homo sapiens
cagucccaugaccuu

SEQ ID NO: 1740207 - RNA, 16 nt, Homo sapiens
caucuucacugcaauu

SEQ ID NO: 1740208 - RNA, 21 nt, Homo sapiens
cauugcuaaacugaugacuua

SEQ ID NO: 1740209 - RNA, 15 nt, Homo sapiens
ccaauuacacacagc

SEQ ID NO: 1740210 - RNA, 22 nt, Homo sapiens
ccacaccuggcccuugcaaucu

SEQ ID NO: 1740211 - RNA, 20 nt, Homo sapiens
ccagcuggaucccagggaaa

SEQ ID NO: 1740212 - RNA, 16 nt, Homo sapiens
cccaauuacacacagc

SEQ ID NO: 1740213 - RNA, 17 nt, Homo sapiens
cccagcccaacaucucc

SEQ ID NO: 1740214 - RNA, 17 nt, Homo sapiens
cccagggaaauaucagc

SEQ ID NO: 1740215 - RNA, 20 nt, Homo sapiens
ccuaguagcugggaugacag

SEQ ID NO: 1740216 - RNA, 17 nt, Homo sapiens
ccucuuuuuagggcuaa

SEQ ID NO: 1740217 - RNA, 19 nt, Homo sapiens
ccuucaucuucacugcaau

SEQ ID NO: 1740218 - RNA, 14 nt, Homo sapiens
cggcucacugcaac

SEQ ID NO: 1740219 - RNA, 13 nt, Homo sapiens
cuaauaugccuag

SEQ ID NO: 1740220 - RNA, 10 nt, Homo sapiens
cuaccucagc

SEQ ID NO: 1740221 - RNA, 14 nt, Homo sapiens
cuaccucagccucc

SEQ ID NO: 1740222 - RNA, 12 nt, Homo sapiens
cuagaguuuuau

SEQ ID NO: 1740223 - RNA, 13 nt, Homo sapiens
cuagguaucauuc

SEQ ID NO: 1740224 - RNA, 16 nt, Homo sapiens
cuaucauggcauauaa

SEQ ID NO: 1740225 - RNA, 18 nt, Homo sapiens
cucaaacuccugaccuca

SEQ ID NO: 1740226 - RNA, 15 nt, Homo sapiens
cugccaucaugccug

SEQ ID NO: 1740227 - RNA, 15 nt, Homo sapiens
cuggaagucaucuca

SEQ ID NO: 1740228 - RNA, 21 nt, Homo sapiens
cuggagugcaguggugugauc

SEQ ID NO: 1740229 - RNA, 13 nt, Homo sapiens
cuggcccuugcaa

SEQ ID NO: 1740230 - RNA, 20 nt, Homo sapiens
cuuaacuuguuugguaguua

SEQ ID NO: 1740231 - RNA, 16 nt, Homo sapiens
cuuuaaaggcaucuac

SEQ ID NO: 1740232 - RNA, 17 nt, Homo sapiens
cuuugcugcagucaucu

SEQ ID NO: 1740233 - RNA, 16 nt, Homo sapiens
gaaaagguugccugaa

SEQ ID NO: 1740234 - RNA, 21 nt, Homo sapiens
gaaaggaaauaguaccuucaa

SEQ ID NO: 1740235 - RNA, 22 nt, Homo sapiens
gaaaugaugaaaagguugccug

SEQ ID NO: 1740236 - RNA, 15 nt, Homo sapiens
gaagggaauugcuca

SEQ ID NO: 1740237 - RNA, 17 nt, Homo sapiens
gaagggaauugcucaga

SEQ ID NO: 1740238 - RNA, 17 nt, Homo sapiens
gaccuugggguacaauu

SEQ ID NO: 1740239 - RNA, 18 nt, Homo sapiens
gagaaggaaaagacugaa

SEQ ID NO: 1740240 - RNA, 16 nt, Homo sapiens
gagauaaaccaauaaa

SEQ ID NO: 1740241 - RNA, 21 nt, Homo sapiens
gaucauuuuuaacugauucuu

SEQ ID NO: 1740242 - RNA, 13 nt, Homo sapiens
gaucccagggaaa

SEQ ID NO: 1740243 - RNA, 17 nt, Homo sapiens
gcaaucuucuacuuuaa

SEQ ID NO: 1740244 - RNA, 21 nt, Homo sapiens
gcacuggugguuuuugcucuc

SEQ ID NO: 1740245 - RNA, 17 nt, Homo sapiens
gccaucaugccugacua

SEQ ID NO: 1740246 - RNA, 13 nt, Homo sapiens
gcccaacaucucc

SEQ ID NO: 1740247 - RNA, 16 nt, Homo sapiens
gccuaccucagccucc

SEQ ID NO: 1740248 - RNA, 19 nt, Homo sapiens
gcgugauccaccacaccug

SEQ ID NO: 1740249 - RNA, 17 nt, Homo sapiens
gcuaaacugaugacuua

SEQ ID NO: 1740250 - RNA, 14 nt, Homo sapiens
gcugcagucaucua

SEQ ID NO: 1740251 - RNA, 15 nt, Homo sapiens
gcugcagucaucuac

SEQ ID NO: 1740252 - RNA, 13 nt, Homo sapiens
ggagaacgcagua

SEQ ID NO: 1740253 - RNA, 22 nt, Homo sapiens
ggcaccggcugcccacagggaa

SEQ ID NO: 1740254 - RNA, 16 nt, Homo sapiens
ggcugcccacagggaa

SEQ ID NO: 1740255 - RNA, 18 nt, Homo sapiens
gguaguuagccaucuaau

SEQ ID NO: 1740256 - RNA, 23 nt, Homo sapiens
gucuuccacaaaaaauacuuuau

SEQ ID NO: 1740257 - RNA, 18 nt, Homo sapiens
gugauccgccuaccucag

SEQ ID NO: 1740258 - RNA, 21 nt, Homo sapiens
guuguuuauauacaguacaca

SEQ ID NO: 1740259 - RNA, 16 nt, Homo sapiens
guuucagccacacuga

SEQ ID NO: 1740260 - RNA, 19 nt, Homo sapiens
uaaaccuagaguuuuauca

SEQ ID NO: 1740261 - RNA, 22 nt, Homo sapiens
uaaaugagagggaaucgacugu

SEQ ID NO: 1740262 - RNA, 17 nt, Homo sapiens
uaauaugccuagcacaa

SEQ ID NO: 1740263 - RNA, 14 nt, Homo sapiens
uacacacagcggga

SEQ ID NO: 1740264 - RNA, 14 nt, Homo sapiens
uaccagaugcugac

SEQ ID NO: 1740265 - RNA, 20 nt, Homo sapiens
uacccaggcuggagugcagu

SEQ ID NO: 1740266 - RNA, 19 nt, Homo sapiens
uacuuaaaaauagucuucc

SEQ ID NO: 1740267 - RNA, 20 nt, Homo sapiens
uacuuuauuucugaucuaua

SEQ ID NO: 1740268 - RNA, 22 nt, Homo sapiens
uacuuuauuucugaucuauaca

SEQ ID NO: 1740269 - RNA, 20 nt, Homo sapiens
uagaguuuuaucaacuuugg

SEQ ID NO: 1740270 - RNA, 14 nt, Homo sapiens
uagguaucauucaa

SEQ ID NO: 1740271 - RNA, 15 nt, Homo sapiens
uaguuagccaucuaa

SEQ ID NO: 1740272 - RNA, 13 nt, Homo sapiens
uaucauugcuaaa

SEQ ID NO: 1740273 - RNA, 19 nt, Homo sapiens
uaugauaaaacacugcccu

SEQ ID NO: 1740274 - RNA, 13 nt, Homo sapiens
uauuaaucaccuc

SEQ ID NO: 1740275 - RNA, 15 nt, Homo sapiens
uauuucuugcuuuca

SEQ ID NO: 1740276 - RNA, 14 nt, Homo sapiens
uauuuucuuuauca

SEQ ID NO: 1740277 - RNA, 16 nt, Homo sapiens
uauuuuguugccuuca

SEQ ID NO: 1740278 - RNA, 13 nt, Homo sapiens
ucaauuacaaagc

SEQ ID NO: 1740279 - RNA, 19 nt, Homo sapiens
ucagccuugggcaacugca

SEQ ID NO: 1740280 - RNA, 21 nt, Homo sapiens
ucaggugauccgccuaccuca

SEQ ID NO: 1740281 - RNA, 13 nt, Homo sapiens
ucaucucauucca

SEQ ID NO: 1740282 - RNA, 18 nt, Homo sapiens
ucauucaacucuccaaug

SEQ ID NO: 1740283 - RNA, 11 nt, Homo sapiens
uccacaaggaa

SEQ ID NO: 1740284 - RNA, 16 nt, Homo sapiens
uccagucccaugaccu

SEQ ID NO: 1740285 - RNA, 13 nt, Homo sapiens
uccgccuaccuca

SEQ ID NO: 1740286 - RNA, 14 nt, Homo sapiens
uccuuuaccagaug

SEQ ID NO: 1740287 - RNA, 19 nt, Homo sapiens
ucgacuguauucgugcauu

SEQ ID NO: 1740288 - RNA, 21 nt, Homo sapiens
ucuggaagucaucucauucca

SEQ ID NO: 1740289 - RNA, 15 nt, Homo sapiens
ucuuuccaggcuucc

SEQ ID NO: 1740290 - RNA, 15 nt, Homo sapiens
ugaaaagguugccug

SEQ ID NO: 1740291 - RNA, 17 nt, Homo sapiens
ugaagcagucuugcucu

SEQ ID NO: 1740292 - RNA, 13 nt, Homo sapiens
ugaauucaagaaa

SEQ ID NO: 1740293 - RNA, 18 nt, Homo sapiens
ugaccuugggguacaauu

SEQ ID NO: 1740294 - RNA, 15 nt, Homo sapiens
ugauauuucuugcuu

SEQ ID NO: 1740295 - RNA, 13 nt, Homo sapiens
ugauccgccuacc

SEQ ID NO: 1740296 - RNA, 15 nt, Homo sapiens
ugaucuauacaaauu

SEQ ID NO: 1740297 - RNA, 17 nt, Homo sapiens
ugcaaccucugccuccc

SEQ ID NO: 1740298 - RNA, 19 nt, Homo sapiens
ugcaaucuucuacuuuaag

SEQ ID NO: 1740299 - RNA, 13 nt, Homo sapiens
ugccaucaugccu

SEQ ID NO: 1740300 - RNA, 22 nt, Homo sapiens
ugcccacagggaacacauuccu

SEQ ID NO: 1740301 - RNA, 19 nt, Homo sapiens
ugccucccagguuccagca

SEQ ID NO: 1740302 - RNA, 15 nt, Homo sapiens
ugcuuucaauuacaa

SEQ ID NO: 1740303 - RNA, 21 nt, Homo sapiens
uggcagaagggaauugcucag

SEQ ID NO: 1740304 - RNA, 19 nt, Homo sapiens
uggccaggcuggucucaaa

SEQ ID NO: 1740305 - RNA, 22 nt, Homo sapiens
uggucucaaacuccugaccuca

SEQ ID NO: 1740306 - RNA, 15 nt, Homo sapiens
uguauucgugcauuu

SEQ ID NO: 1740307 - RNA, 15 nt, Homo sapiens
uguguaaauuucuca

SEQ ID NO: 1740308 - RNA, 23 nt, Homo sapiens
uuauggcagaagggaauugcuca

SEQ ID NO: 1740309 - RNA, 23 nt, Homo sapiens
uucuacuucuggaagucaucuca

SEQ ID NO: 1740310 - RNA, 21 nt, Homo sapiens
uucuacuuuaagguuugcaga

SEQ ID NO: 1740311 - RNA, 20 nt, Homo sapiens
uucuuugcugcagucaucua

SEQ ID NO: 1740312 - RNA, 20 nt, Homo sapiens
uucuuuuuccacaaggaaua

SEQ ID NO: 1740313 - RNA, 19 nt, Homo sapiens
uugaaaauauuuuguugcc

SEQ ID NO: 1740314 - RNA, 14 nt, Homo sapiens
uuguggugcauuga

SEQ ID NO: 1740315 - RNA, 18 nt, Homo sapiens
uuguugccuucaucuuca

SEQ ID NO: 1740316 - RNA, 13 nt, Homo sapiens
uuucaauuacaaa

SEQ ID NO: 1740317 - RNA, 13 nt, Homo sapiens
uuucuugcuuuca

SEQ ID NO: 1740318 - RNA, 20 nt, Homo sapiens
uuugaagcagucuugcucug

SEQ ID NO: 1740319 - RNA, 18 nt, Homo sapiens
uuuggcuagguaucauuc

SEQ ID NO: 1740320 - RNA, 14 nt, Homo sapiens
uuuuguugccuuca

SEQ ID NO: 1740321 - RNA, 15 nt, Homo sapiens
uuuuuaacugauucu

SEQ ID NO: 1740322 - RNA, 11 nt, Homo sapiens
uuuuugcucuc

SEQ ID NO: 1740323 - RNA, 12 nt, Homo sapiens
ugcaaucuucua

SEQ ID NO: 1740324 - RNA, 15 nt, Homo sapiens
ugcagucaucuacuu

SEQ ID NO: 1740325 - RNA, 18 nt, Homo sapiens
ugcaguggugugaucucg

SEQ ID NO: 1740326 - RNA, 13 nt, Homo sapiens
ugcccacagggaa

SEQ ID NO: 1740327 - RNA, 14 nt, Homo sapiens
ugcccacagggaac

SEQ ID NO: 1740328 - RNA, 20 nt, Homo sapiens
ugcccucuuguggugcauug

SEQ ID NO: 1740329 - RNA, 20 nt, Homo sapiens
ugccuucaucuucacugcaa

SEQ ID NO: 1740330 - RNA, 15 nt, Homo sapiens
ugcugcagucaucua

SEQ ID NO: 1740331 - RNA, 20 nt, Homo sapiens
uggcagaagggaauugcuca

SEQ ID NO: 1740332 - RNA, 15 nt, Homo sapiens
uguaaauuucucaaa

SEQ ID NO: 1740333 - RNA, 17 nt, Homo sapiens
uguugguauuauauaau

SEQ ID NO: 1740334 - RNA, 20 nt, Homo sapiens
uguuuuucuuuuuccacaag

SEQ ID NO: 1740335 - RNA, 17 nt, Homo sapiens
uuacaggcgugauccac

SEQ ID NO: 1740336 - RNA, 19 nt, Homo sapiens
uuacccaggcuggagugca

SEQ ID NO: 1740337 - RNA, 16 nt, Homo sapiens
uuauauacaguacaca

SEQ ID NO: 1740338 - RNA, 14 nt, Homo sapiens
uuauuucugaucua

SEQ ID NO: 1740339 - RNA, 18 nt, Homo sapiens
uucaucuucacugcaauu

SEQ ID NO: 1740340 - RNA, 17 nt, Homo sapiens
uucccugacuugcuuua

SEQ ID NO: 1740341 - RNA, 18 nt, Homo sapiens
uugccaagaaaaugaagg

SEQ ID NO: 1740342 - RNA, 20 nt, Homo sapiens
uuguugccuucaucuucacu

SEQ ID NO: 1740343 - RNA, 15 nt, Homo sapiens
uuuauuucugaucua

SEQ ID NO: 1740344 - RNA, 16 nt, Homo sapiens
uuuauuucugaucuau

SEQ ID NO: 1740345 - RNA, 17 nt, Homo sapiens
uuugaagcagucuugcu

SEQ ID NO: 1740346 - RNA, 15 nt, Homo sapiens
uuuuucuuuuuccac

SEQ ID NO: 1740347 - RNA, 18 nt, Homo sapiens
aaaacacugcccucuugu

SEQ ID NO: 1740348 - RNA, 20 nt, Homo sapiens
aaaagacugaaucuaccugc

SEQ ID NO: 1740349 - RNA, 14 nt, Homo sapiens
aaaauagucuucca

SEQ ID NO: 1740350 - RNA, 13 nt, Homo sapiens
aaauagucuucca

SEQ ID NO: 1740351 - RNA, 16 nt, Homo sapiens
aaauagucuuccacaa

SEQ ID NO: 1740352 - RNA, 17 nt, Homo sapiens
aaauagucuuccacaaa

SEQ ID NO: 1740353 - RNA, 23 nt, Homo sapiens
aaaucucuucuuugcugcaguca

SEQ ID NO: 1740354 - RNA, 10 nt, Homo sapiens
aacaucucca

SEQ ID NO: 1740355 - RNA, 17 nt, Homo sapiens
aacgcaguaaacagcuu

SEQ ID NO: 1740356 - RNA, 19 nt, Homo sapiens
aacuuuggugaacaguuuu

SEQ ID NO: 1740357 - RNA, 14 nt, Homo sapiens
aagggaauugcuca

SEQ ID NO: 1740358 - RNA, 22 nt, Homo sapiens
aagucaucucauuccacuguug

SEQ ID NO: 1740359 - RNA, 13 nt, Homo sapiens
aauagucaauuuc

SEQ ID NO: 1740360 - RNA, 22 nt, Homo sapiens
aauaugccuagcacaaguacca

SEQ ID NO: 1740361 - RNA, 22 nt, Homo sapiens
aaucgacuguauucgugcauuu

SEQ ID NO: 1740362 - RNA, 19 nt, Homo sapiens
aauucuccugccucagccu

SEQ ID NO: 1740363 - RNA, 22 nt, Homo sapiens
gcaccggcugcccacagggaac

SEQ ID NO: 1740364 - RNA, 14 nt, Homo sapiens
gcauaauagucaau

SEQ ID NO: 1740365 - RNA, 16 nt, Homo sapiens
gcccuaagggacuuaa

SEQ ID NO: 1740366 - RNA, 16 nt, Homo sapiens
gcuaaacugaugacuu

SEQ ID NO: 1740367 - RNA, 14 nt, Homo sapiens
gcucucgacaguau

SEQ ID NO: 1740368 - RNA, 19 nt, Homo sapiens
gcugcccacagggaacaca

SEQ ID NO: 1740369 - RNA, 23 nt, Homo sapiens
gcuggaaaaccuccuuuaccaga

SEQ ID NO: 1740370 - RNA, 20 nt, Homo sapiens
gcuggucucaaacuccugac

SEQ ID NO: 1740371 - RNA, 12 nt, Homo sapiens
ggaagagcuaau

SEQ ID NO: 1740372 - RNA, 13 nt, Homo sapiens
ggaagucaucuca

SEQ ID NO: 1740373 - RNA, 23 nt, Homo sapiens
ggaagucaucucauuccacuguu

SEQ ID NO: 1740374 - RNA, 14 nt, Homo sapiens
gguacaauuguaaa

SEQ ID NO: 1740375 - RNA, 20 nt, Homo sapiens
ggucagcuuuuguuguuuau

SEQ ID NO: 1740376 - RNA, 16 nt, Homo sapiens
ggucucaaacuccuga

SEQ ID NO: 1740377 - RNA, 16 nt, Homo sapiens
ggugguuuuugcucuc

SEQ ID NO: 1740378 - RNA, 16 nt, Homo sapiens
guaguuagccaucuaa

SEQ ID NO: 1740379 - RNA, 12 nt, Homo sapiens
guaucauucaac

SEQ ID NO: 1740380 - RNA, 16 nt, Homo sapiens
gugauccgccuaccuc

SEQ ID NO: 1740381 - RNA, 21 nt, Homo sapiens
guguuuuucuuuuuccacaag

SEQ ID NO: 1740382 - RNA, 20 nt, Homo sapiens
uaaaccuagaguuuuaucaa

SEQ ID NO: 1740383 - RNA, 20 nt, Homo sapiens
uacaggcgugauccaccaca

SEQ ID NO: 1740384 - RNA, 23 nt, Homo sapiens
uacaucugcaauaugaauucaag

SEQ ID NO: 1740385 - RNA, 20 nt, Homo sapiens
uacuaauaugccuagcacaa

SEQ ID NO: 1740386 - RNA, 17 nt, Homo sapiens
uagguaucauucaacuc

SEQ ID NO: 1740387 - RNA, 16 nt, Homo sapiens
uaucauggcauauaac

SEQ ID NO: 1740388 - RNA, 23 nt, Homo sapiens
uaucauugcuaaacugaugacuu

SEQ ID NO: 1740389 - RNA, 17 nt, Homo sapiens
uaugauaaaacacugcc

SEQ ID NO: 1740390 - RNA, 22 nt, Homo sapiens
uauuuuguugccuucaucuuca

SEQ ID NO: 1740391 - RNA, 21 nt, Homo sapiens
ucaauacuuaaaaauagucuu

SEQ ID NO: 1740392 - RNA, 14 nt, Homo sapiens
ucaauuucuacuuc

SEQ ID NO: 1740393 - RNA, 13 nt, Homo sapiens
ucagccacacuga

SEQ ID NO: 1740394 - RNA, 22 nt, Homo sapiens
ucagccuugggcaacugcagug

SEQ ID NO: 1740395 - RNA, 14 nt, Homo sapiens
ucaucuucacugca

SEQ ID NO: 1740396 - RNA, 15 nt, Homo sapiens
ucaucuucacugcaa

SEQ ID NO: 1740397 - RNA, 23 nt, Homo sapiens
ucauucaacucuccaauguucua

SEQ ID NO: 1740398 - RNA, 14 nt, Homo sapiens
ucuauuaaucaccu

SEQ ID NO: 1740399 - RNA, 15 nt, Homo sapiens
ucucgacaguaucca

SEQ ID NO: 1740400 - RNA, 16 nt, Homo sapiens
ucuggaagucaucuca

SEQ ID NO: 1740401 - RNA, 17 nt, Homo sapiens
ucuuaugauuacuauca

SEQ ID NO: 1740402 - RNA, 18 nt, Homo sapiens
ucuuuaaaggcaucuaca

SEQ ID NO: 1740403 - RNA, 15 nt, Homo sapiens
ucuuugcugcaguca

SEQ ID NO: 1740404 - RNA, 17 nt, Homo sapiens
ugaaaagguugccugaa

SEQ ID NO: 1740405 - RNA, 19 nt, Homo sapiens
ugaaaauauuuuguugccu

SEQ ID NO: 1740406 - RNA, 22 nt, Homo sapiens
ugaaagaagagaugagaaauga

SEQ ID NO: 1740407 - RNA, 19 nt, Homo sapiens
ugagagggaaucgacugua

SEQ ID NO: 1740408 - RNA, 15 nt, Homo sapiens
ugcaaucuucuacuu

SEQ ID NO: 1740409 - RNA, 17 nt, Homo sapiens
ugcaguggugugaucuc

SEQ ID NO: 1740410 - RNA, 14 nt, Homo sapiens
ugccucagccuccc

SEQ ID NO: 1740411 - RNA, 18 nt, Homo sapiens
ugcuagaaaaauguucuu

SEQ ID NO: 1740412 - RNA, 20 nt, Homo sapiens
ugcucagagaaggaaaagac

SEQ ID NO: 1740413 - RNA, 15 nt, Homo sapiens
aaaagacugaaucua

SEQ ID NO: 1740414 - RNA, 23 nt, Homo sapiens
aaagacugaaucuaccugcccua

SEQ ID NO: 1740415 - RNA, 22 nt, Homo sapiens
aaagcaguuacuaauaugccua

SEQ ID NO: 1740416 - RNA, 19 nt, Homo sapiens
aaagccuggggcaaagcug

SEQ ID NO: 1740417 - RNA, 19 nt, Homo sapiens
aaaugggagacagccucuu

SEQ ID NO: 1740418 - RNA, 17 nt, Homo sapiens
aagacugaaucuaccug

SEQ ID NO: 1740419 - RNA, 23 nt, Homo sapiens
aagacugaaucuaccugcccuaa

SEQ ID NO: 1740420 - RNA, 16 nt, Homo sapiens
aagcagucuugcucug

SEQ ID NO: 1740421 - RNA, 16 nt, Homo sapiens
aagcaguuacuaauau

SEQ ID NO: 1740422 - RNA, 20 nt, Homo sapiens
aagcaguuacuaauaugccu

SEQ ID NO: 1740423 - RNA, 18 nt, Homo sapiens
aagggaauugcucagaga

SEQ ID NO: 1740424 - RNA, 16 nt, Homo sapiens
aauagucuuccacaaa

SEQ ID NO: 1740425 - RNA, 20 nt, Homo sapiens
aaaacggguggugugucuca

SEQ ID NO: 1740426 - RNA, 23 nt, Homo sapiens
aaaagcaaucuggaagaaagccc

SEQ ID NO: 1740427 - RNA, 16 nt, Homo sapiens
aaacaaaaucacagca

SEQ ID NO: 1740428 - RNA, 12 nt, Homo sapiens
aaaccaaacucu

SEQ ID NO: 1740429 - RNA, 23 nt, Homo sapiens
aaacgccuccuucaaaaagcaau

SEQ ID NO: 1740430 - RNA, 17 nt, Homo sapiens
aaacuagaaagaugaaa

SEQ ID NO: 1740431 - RNA, 12 nt, Homo sapiens
aaacugugaacc

SEQ ID NO: 1740432 - RNA, 12 nt, Homo sapiens
aaacuuauuuca

SEQ ID NO: 1740433 - RNA, 16 nt, Homo sapiens
aaaggaaaaagcacaa

SEQ ID NO: 1740434 - RNA, 17 nt, Homo sapiens
aaaggaggcucuucuca

SEQ ID NO: 1740435 - RNA, 22 nt, Homo sapiens
aaagugccuucagccaagacca

SEQ ID NO: 1740436 - RNA, 21 nt, Homo sapiens
aaauucuguuagcugcucacu

SEQ ID NO: 1740437 - RNA, 22 nt, Homo sapiens
aacaucaguugggaucccuccu

SEQ ID NO: 1740438 - RNA, 15 nt, Homo sapiens
aacaucuuuauuuuc

SEQ ID NO: 1740439 - RNA, 14 nt, Homo sapiens
aaccacacacaccu

SEQ ID NO: 1740440 - RNA, 14 nt, Homo sapiens
aaccauucuggaca

SEQ ID NO: 1740441 - RNA, 17 nt, Homo sapiens
aacgagaagacaaacuc

SEQ ID NO: 1740442 - RNA, 21 nt, Homo sapiens
aacuccggcacuggguuugcu

SEQ ID NO: 1740443 - RNA, 18 nt, Homo sapiens
aacucugugucagcaucu

SEQ ID NO: 1740444 - RNA, 19 nt, Homo sapiens
aacucugugucagcaucuu

SEQ ID NO: 1740445 - RNA, 19 nt, Homo sapiens
aacuuggauauucaagccu

SEQ ID NO: 1740446 - RNA, 22 nt, Homo sapiens
aagacaaacuccggcacugggu

SEQ ID NO: 1740447 - RNA, 13 nt, Homo sapiens
aagagauacccac

SEQ ID NO: 1740448 - RNA, 18 nt, Homo sapiens
aagagccaucugaagcca

SEQ ID NO: 1740449 - RNA, 22 nt, Homo sapiens
aagcaaacuuauaaaucauauu

SEQ ID NO: 1740450 - RNA, 17 nt, Homo sapiens
aagcaguuugcacuuaa

SEQ ID NO: 1740451 - RNA, 23 nt, Homo sapiens
aagcugaccugcaccccugaugu

SEQ ID NO: 1740452 - RNA, 17 nt, Homo sapiens
aaggcaggaaggaacuc

SEQ ID NO: 1740453 - RNA, 18 nt, Homo sapiens
aaggcaggaaggaacuca

SEQ ID NO: 1740454 - RNA, 19 nt, Homo sapiens
aagucucacauauucauca

SEQ ID NO: 1740455 - RNA, 12 nt, Homo sapiens
aagugugcagua

SEQ ID NO: 1740456 - RNA, 13 nt, Homo sapiens
aaguugcucugua

SEQ ID NO: 1740457 - RNA, 19 nt, Homo sapiens
aaucaccucuaaaaaccaa

SEQ ID NO: 1740458 - RNA, 12 nt, Homo sapiens
aaucauauucuc

SEQ ID NO: 1740459 - RNA, 16 nt, Homo sapiens
aaucccaaagugccuu

SEQ ID NO: 1740460 - RNA, 14 nt, Homo sapiens
aaucuacacugccu

SEQ ID NO: 1740461 - RNA, 19 nt, Homo sapiens
aaucuuuuagcacaugugu

SEQ ID NO: 1740462 - RNA, 20 nt, Homo sapiens
aaugauuuagcucccuccau

SEQ ID NO: 1740463 - RNA, 13 nt, Homo sapiens
aauuaguuugcac

SEQ ID NO: 1740464 - RNA, 16 nt, Homo sapiens
aauucauacucagaca

SEQ ID NO: 1740465 - RNA, 17 nt, Homo sapiens
acaauaaaaaccaaacu

SEQ ID NO: 1740466 - RNA, 18 nt, Homo sapiens
acaauaauuggaguucau

SEQ ID NO: 1740467 - RNA, 17 nt, Homo sapiens
acaaucuacacugccuu

SEQ ID NO: 1740468 - RNA, 19 nt, Homo sapiens
acagagcacuguagcacuu

SEQ ID NO: 1740469 - RNA, 22 nt, Homo sapiens
acagaguguggucccuccacua

SEQ ID NO: 1740470 - RNA, 21 nt, Homo sapiens
acauggcguaccguacacaga

SEQ ID NO: 1740471 - RNA, 19 nt, Homo sapiens
accaggugucuagaggcaa

SEQ ID NO: 1740472 - RNA, 20 nt, Homo sapiens
accauuccuggaaaccacag

SEQ ID NO: 1740473 - RNA, 17 nt, Homo sapiens
accauucuggacacugu

SEQ ID NO: 1740474 - RNA, 15 nt, Homo sapiens
accccccugagagca

SEQ ID NO: 1740475 - RNA, 16 nt, Homo sapiens
accccugauguggcau

SEQ ID NO: 1740476 - RNA, 15 nt, Homo sapiens
accguacacagaggg

SEQ ID NO: 1740477 - RNA, 14 nt, Homo sapiens
accucacugccuca

SEQ ID NO: 1740478 - RNA, 12 nt, Homo sapiens
accuucacuuaa

SEQ ID NO: 1740479 - RNA, 17 nt, Homo sapiens
acguggagcugcucaac

SEQ ID NO: 1740480 - RNA, 18 nt, Homo sapiens
acuaccauacagacagca

SEQ ID NO: 1740481 - RNA, 14 nt, Homo sapiens
acuaugaacuugga

SEQ ID NO: 1740482 - RNA, 22 nt, Homo sapiens
acucagacccaaucaccucuaa

SEQ ID NO: 1740483 - RNA, 19 nt, Homo sapiens
acucuggaccccaggccau

SEQ ID NO: 1740484 - RNA, 20 nt, Homo sapiens
acugccuuaccuucacuuaa

SEQ ID NO: 1740485 - RNA, 22 nt, Homo sapiens
acuuaaaccacacacacaaggu

SEQ ID NO: 1740486 - RNA, 22 nt, Homo sapiens
agaaaaccauucuggacacugu

SEQ ID NO: 1740487 - RNA, 19 nt, Homo sapiens
agaaaagcaguuugcacuu

SEQ ID NO: 1740488 - RNA, 18 nt, Homo sapiens
agaacacuagacaugcca

SEQ ID NO: 1740489 - RNA, 20 nt, Homo sapiens
agacaaacuccggcacuggg

SEQ ID NO: 1740490 - RNA, 12 nt, Homo sapiens
agaccaucucuc

SEQ ID NO: 1740491 - RNA, 17 nt, Homo sapiens
agagcaucugcucugag

SEQ ID NO: 1740492 - RNA, 16 nt, Homo sapiens
agaggagaguaccccc

SEQ ID NO: 1740493 - RNA, 18 nt, Homo sapiens
agaguaacgagaagacaa

SEQ ID NO: 1740494 - RNA, 20 nt, Homo sapiens
agaguaccccccugagagca

SEQ ID NO: 1740495 - RNA, 18 nt, Homo sapiens
agaguggcagccaagagc

SEQ ID NO: 1740496 - RNA, 15 nt, Homo sapiens
agauggcugcugcuc

SEQ ID NO: 1740497 - RNA, 18 nt, Homo sapiens
agauggcugcugcucacc

SEQ ID NO: 1740498 - RNA, 11 nt, Homo sapiens
agcaauacuuu

SEQ ID NO: 1740499 - RNA, 16 nt, Homo sapiens
agccaucugaagccac

SEQ ID NO: 1740500 - RNA, 23 nt, Homo sapiens
agccuccguucccaccucugagg

SEQ ID NO: 1740501 - RNA, 22 nt, Homo sapiens
agccuuggaagcaaacuuauaa

SEQ ID NO: 1740502 - RNA, 20 nt, Homo sapiens
agcuccuuucccuuuuccau

SEQ ID NO: 1740503 - RNA, 13 nt, Homo sapiens
agcuuucuaacuc

SEQ ID NO: 1740504 - RNA, 20 nt, Homo sapiens
aggacuuuagggaucugggg

SEQ ID NO: 1740505 - RNA, 21 nt, Homo sapiens
aggagaacacuagacaugcca

SEQ ID NO: 1740506 - RNA, 20 nt, Homo sapiens
aggagaguaccccccugaga

SEQ ID NO: 1740507 - RNA, 15 nt, Homo sapiens
aggagccaccugggc

SEQ ID NO: 1740508 - RNA, 18 nt, Homo sapiens
aggccauaccaggugcua

SEQ ID NO: 1740509 - RNA, 15 nt, Homo sapiens
agggagggacuggga

SEQ ID NO: 1740510 - RNA, 17 nt, Homo sapiens
aggggagggguugccac

SEQ ID NO: 1740511 - RNA, 21 nt, Homo sapiens
agggucauggcagugccugaa

SEQ ID NO: 1740512 - RNA, 17 nt, Homo sapiens
agggugaacaauccccu

SEQ ID NO: 1740513 - RNA, 11 nt, Homo sapiens
aggugcucaga

SEQ ID NO: 1740514 - RNA, 22 nt, Homo sapiens
aggugcuggccucaaacagcca

SEQ ID NO: 1740515 - RNA, 13 nt, Homo sapiens
agguguccggggg

SEQ ID NO: 1740516 - RNA, 20 nt, Homo sapiens
aguccaguccucacaugccc

SEQ ID NO: 1740517 - RNA, 15 nt, Homo sapiens
aguccucacaugccc

SEQ ID NO: 1740518 - RNA, 16 nt, Homo sapiens
agugauggucauucau

SEQ ID NO: 1740519 - RNA, 17 nt, Homo sapiens
agugccuuacuauaugu

SEQ ID NO: 1740520 - RNA, 18 nt, Homo sapiens
agugccuucagccaagac

SEQ ID NO: 1740521 - RNA, 14 nt, Homo sapiens
aguuacauugugcu

SEQ ID NO: 1740522 - RNA, 22 nt, Homo sapiens
aguuaccuuugcugucacuuuc

SEQ ID NO: 1740523 - RNA, 20 nt, Homo sapiens
aguucugcacccagccaaac

SEQ ID NO: 1740524 - RNA, 13 nt, Homo sapiens
aguuugcacuuaa

SEQ ID NO: 1740525 - RNA, 12 nt, Homo sapiens
auaaaaaccaaa

SEQ ID NO: 1740526 - RNA, 19 nt, Homo sapiens
auaaaggcucugugcuuga

SEQ ID NO: 1740527 - RNA, 14 nt, Homo sapiens
auaauuuucuaauu

SEQ ID NO: 1740528 - RNA, 11 nt, Homo sapiens
auaccaggugc

SEQ ID NO: 1740529 - RNA, 18 nt, Homo sapiens
auaccucgaacaucaguu

SEQ ID NO: 1740530 - RNA, 15 nt, Homo sapiens
agugaccuuuuaauc

SEQ ID NO: 1740531 - RNA, 16 nt, Homo sapiens
agugcacuaaccccag

SEQ ID NO: 1740532 - RNA, 14 nt, Homo sapiens
agugggaccuggug

SEQ ID NO: 1740533 - RNA, 19 nt, Homo sapiens
aguuacauugugcuuggua

SEQ ID NO: 1740534 - RNA, 17 nt, Homo sapiens
auaaaucauauucucau

SEQ ID NO: 1740535 - RNA, 22 nt, Homo sapiens
auaacaauaaaaaccaaacucu

SEQ ID NO: 1740536 - RNA, 13 nt, Homo sapiens
auacucagacaaa

SEQ ID NO: 1740537 - RNA, 17 nt, Homo sapiens
auauuaggaaacuggga

SEQ ID NO: 1740538 - RNA, 20 nt, Homo sapiens
aucaucucuuuucccacucc

SEQ ID NO: 1740539 - RNA, 14 nt, Homo sapiens
aucauucagcaaau

SEQ ID NO: 1740540 - RNA, 14 nt, Homo sapiens
auccagcagucaau

SEQ ID NO: 1740541 - RNA, 19 nt, Homo sapiens
auccauucucucugcccaa

SEQ ID NO: 1740542 - RNA, 20 nt, Homo sapiens
aucucugcugcuucugggcc

SEQ ID NO: 1740543 - RNA, 18 nt, Homo sapiens
augaacuuggauauucaa

SEQ ID NO: 1740544 - RNA, 16 nt, Homo sapiens
augagugucaacucca

SEQ ID NO: 1740545 - RNA, 15 nt, Homo sapiens
augggggcaagaaga

SEQ ID NO: 1740546 - RNA, 14 nt, Homo sapiens
auggguucaugucu

SEQ ID NO: 1740547 - RNA, 16 nt, Homo sapiens
auguguaagacacugu

SEQ ID NO: 1740548 - RNA, 20 nt, Homo sapiens
auguguaagacacugugcaa

SEQ ID NO: 1740549 - RNA, 22 nt, Homo sapiens
auguguucgucaguguucaugc

SEQ ID NO: 1740550 - RNA, 15 nt, Homo sapiens
auuaacucuccaguu

SEQ ID NO: 1740551 - RNA, 15 nt, Homo sapiens
auucagcuaaauuca

SEQ ID NO: 1740552 - RNA, 19 nt, Homo sapiens
auucuguuagcugcucacu

SEQ ID NO: 1740553 - RNA, 15 nt, Homo sapiens
auucuugcuugagga

SEQ ID NO: 1740554 - RNA, 17 nt, Homo sapiens
auuuugugaauugccag

SEQ ID NO: 1740555 - RNA, 14 nt, Homo sapiens
auuuugugugaugc

SEQ ID NO: 1740556 - RNA, 20 nt, Homo sapiens
caagggaggcccaugugacu

SEQ ID NO: 1740557 - RNA, 14 nt, Homo sapiens
caagggucauggca

SEQ ID NO: 1740558 - RNA, 22 nt, Homo sapiens
caagugauggucauucauauca

SEQ ID NO: 1740559 - RNA, 14 nt, Homo sapiens
caaguugcucugua

SEQ ID NO: 1740560 - RNA, 17 nt, Homo sapiens
caaucuacacugccuua

SEQ ID NO: 1740561 - RNA, 22 nt, Homo sapiens
caaucuuuuagcacauguguaa

SEQ ID NO: 1740562 - RNA, 16 nt, Homo sapiens
cacacacacaaggugc

SEQ ID NO: 1740563 - RNA, 16 nt, Homo sapiens
cacaggcauagaguga

SEQ ID NO: 1740564 - RNA, 21 nt, Homo sapiens
cacauaacaauaaaaaccaaa

SEQ ID NO: 1740565 - RNA, 23 nt, Homo sapiens
caccauuccuggaaaccacaguc

SEQ ID NO: 1740566 - RNA, 16 nt, Homo sapiens
cacccacuaccauaca

SEQ ID NO: 1740567 - RNA, 20 nt, Homo sapiens
caccccugauguggcauaug

SEQ ID NO: 1740568 - RNA, 21 nt, Homo sapiens
cacuaugaacuuggauauuca

SEQ ID NO: 1740569 - RNA, 18 nt, Homo sapiens
cacuuaaacaauguccuc

SEQ ID NO: 1740570 - RNA, 17 nt, Homo sapiens
cagaauucuaggcagca

SEQ ID NO: 1740571 - RNA, 18 nt, Homo sapiens
cagagcacuguagcacuu

SEQ ID NO: 1740572 - RNA, 18 nt, Homo sapiens
cagaggcagcuaaggggc

SEQ ID NO: 1740573 - RNA, 16 nt, Homo sapiens
cagcaagcaauucugc

SEQ ID NO: 1740574 - RNA, 13 nt, Homo sapiens
cagcaucuuugcc

SEQ ID NO: 1740575 - RNA, 15 nt, Homo sapiens
cagcaucuuugcccu

SEQ ID NO: 1740576 - RNA, 11 nt, Homo sapiens
cagccaagacc

SEQ ID NO: 1740577 - RNA, 22 nt, Homo sapiens
cagccacacucacccagccucu

SEQ ID NO: 1740578 - RNA, 15 nt, Homo sapiens
cagccccaggaccaa

SEQ ID NO: 1740579 - RNA, 21 nt, Homo sapiens
cagcuccuuucccuuuuccau

SEQ ID NO: 1740580 - RNA, 16 nt, Homo sapiens
caggugucaccaucau

SEQ ID NO: 1740581 - RNA, 22 nt, Homo sapiens
caguucugcacccagccaaaca

SEQ ID NO: 1740582 - RNA, 15 nt, Homo sapiens
cauaucacuaugaac

SEQ ID NO: 1740583 - RNA, 15 nt, Homo sapiens
cauguaguagccuuu

SEQ ID NO: 1740584 - RNA, 23 nt, Homo sapiens
cauguaguagccuuuccugauga

SEQ ID NO: 1740585 - RNA, 22 nt, Homo sapiens
cauucucucugcccaaguugcu

SEQ ID NO: 1740586 - RNA, 18 nt, Homo sapiens
cauuucagguugugcauu

SEQ ID NO: 1740587 - RNA, 18 nt, Homo sapiens
ccaaaggaaaaagcacaa

SEQ ID NO: 1740588 - RNA, 20 nt, Homo sapiens
ccaagagccaucugaagcca

SEQ ID NO: 1740589 - RNA, 14 nt, Homo sapiens
ccaaguugcucugu

SEQ ID NO: 1740590 - RNA, 21 nt, Homo sapiens
ccacacacaccugucugugca

SEQ ID NO: 1740591 - RNA, 17 nt, Homo sapiens
aaaaguuacauugugcu

SEQ ID NO: 1740592 - RNA, 22 nt, Homo sapiens
aaaccacacacacaaggugcuc

SEQ ID NO: 1740593 - RNA, 20 nt, Homo sapiens
aaacggguggugugucucag

SEQ ID NO: 1740594 - RNA, 21 nt, Homo sapiens
aaacucugugucagcaucuuu

SEQ ID NO: 1740595 - RNA, 11 nt, Homo sapiens
aaagugccuuc

SEQ ID NO: 1740596 - RNA, 23 nt, Homo sapiens
aaagugccuucagccaagaccau

SEQ ID NO: 1740597 - RNA, 14 nt, Homo sapiens
aaaguuacauugug

SEQ ID NO: 1740598 - RNA, 16 nt, Homo sapiens
aaauaaaggcucugug

SEQ ID NO: 1740599 - RNA, 20 nt, Homo sapiens
aaauagugccuuacuauaug

SEQ ID NO: 1740600 - RNA, 19 nt, Homo sapiens
aacaauaaaaaccaaacuc

SEQ ID NO: 1740601 - RNA, 16 nt, Homo sapiens
aacaauccccuaacac

SEQ ID NO: 1740602 - RNA, 22 nt, Homo sapiens
aacacauaacaauaaaaaccaa

SEQ ID NO: 1740603 - RNA, 22 nt, Homo sapiens
aacaucuuuauuuucuuuaugu

SEQ ID NO: 1740604 - RNA, 13 nt, Homo sapiens
aacuccggcacug

SEQ ID NO: 1740605 - RNA, 19 nt, Homo sapiens
aacuuauaaaucauauucu

SEQ ID NO: 1740606 - RNA, 15 nt, Homo sapiens
aacuucccucuaguu

SEQ ID NO: 1740607 - RNA, 16 nt, Homo sapiens
aacuucgguugcagau

SEQ ID NO: 1740608 - RNA, 18 nt, Homo sapiens
aagaaugugugugcagaa

SEQ ID NO: 1740609 - RNA, 14 nt, Homo sapiens
aagaugauccuucu

SEQ ID NO: 1740610 - RNA, 12 nt, Homo sapiens
aagcaauucugc

SEQ ID NO: 1740611 - RNA, 16 nt, Homo sapiens
aagcauuucagguugu

SEQ ID NO: 1740612 - RNA, 21 nt, Homo sapiens
aagccugcccuugucugagau

SEQ ID NO: 1740613 - RNA, 16 nt, Homo sapiens
aaggaggcucuucuca

SEQ ID NO: 1740614 - RNA, 11 nt, Homo sapiens
aaggguccuac

SEQ ID NO: 1740615 - RNA, 21 nt, Homo sapiens
aagugauggucauucauauca

SEQ ID NO: 1740616 - RNA, 12 nt, Homo sapiens
aaguugcucugu

SEQ ID NO: 1740617 - RNA, 22 nt, Homo sapiens
aaguuuacuugucuuugauuau

SEQ ID NO: 1740618 - RNA, 17 nt, Homo sapiens
aauacuuuuuguggaau

SEQ ID NO: 1740619 - RNA, 21 nt, Homo sapiens
aaucacagcacccacuaccau

SEQ ID NO: 1740620 - RNA, 21 nt, Homo sapiens
aauguaaaauaaaggcucugu

SEQ ID NO: 1740621 - RNA, 14 nt, Homo sapiens
aauguccucuuuga

SEQ ID NO: 1740622 - RNA, 14 nt, Homo sapiens
aauucacauuugcc

SEQ ID NO: 1740623 - RNA, 22 nt, Homo sapiens
aauucuguuagcugcucacuua

SEQ ID NO: 1740624 - RNA, 13 nt, Homo sapiens
aauucuugcuuga

SEQ ID NO: 1740625 - RNA, 21 nt, Homo sapiens
aauuggaguucauacugaugc

SEQ ID NO: 1740626 - RNA, 14 nt, Homo sapiens
aauuucucugcucu

SEQ ID NO: 1740627 - RNA, 23 nt, Homo sapiens
aauuuucuaauuuauuuucucaa

SEQ ID NO: 1740628 - RNA, 15 nt, Homo sapiens
acaaaaucacagcac

SEQ ID NO: 1740629 - RNA, 15 nt, Homo sapiens
acaaucuacacugcc

SEQ ID NO: 1740630 - RNA, 15 nt, Homo sapiens
acaauucugaugaaa

SEQ ID NO: 1740631 - RNA, 19 nt, Homo sapiens
acacacaccugucugugca

SEQ ID NO: 1740632 - RNA, 22 nt, Homo sapiens
acacacaccugucugugcagau

SEQ ID NO: 1740633 - RNA, 19 nt, Homo sapiens
acaccaguugcgaagggaa

SEQ ID NO: 1740634 - RNA, 14 nt, Homo sapiens
acaccugucugugc

SEQ ID NO: 1740635 - RNA, 21 nt, Homo sapiens
acauaacaauaaaaaccaaac

SEQ ID NO: 1740636 - RNA, 15 nt, Homo sapiens
acaugagugucaacu

SEQ ID NO: 1740637 - RNA, 21 nt, Homo sapiens
accacacacacaaggugcuca

SEQ ID NO: 1740638 - RNA, 16 nt, Homo sapiens
acccacuaccauacag

SEQ ID NO: 1740639 - RNA, 18 nt, Homo sapiens
acccuacaccucugggcc

SEQ ID NO: 1740640 - RNA, 20 nt, Homo sapiens
accugcaccccugauguggc

SEQ ID NO: 1740641 - RNA, 20 nt, Homo sapiens
accuggugggcucaaccaca

SEQ ID NO: 1740642 - RNA, 16 nt, Homo sapiens
accugucaucugggcc

SEQ ID NO: 1740643 - RNA, 18 nt, Homo sapiens
acgagaagacaaacuccg

SEQ ID NO: 1740644 - RNA, 15 nt, Homo sapiens
acguggagcugcuca

SEQ ID NO: 1740645 - RNA, 20 nt, Homo sapiens
acuccaaacaauucugauga

SEQ ID NO: 1740646 - RNA, 23 nt, Homo sapiens
acugaaaaaaaaaaaaaucccaa

SEQ ID NO: 1740647 - RNA, 13 nt, Homo sapiens
acugccuuaccuu

SEQ ID NO: 1740648 - RNA, 15 nt, Homo sapiens
acuguagcacuuaac

SEQ ID NO: 1740649 - RNA, 18 nt, Homo sapiens
acuugagccaguuaccuu

SEQ ID NO: 1740650 - RNA, 14 nt, Homo sapiens
agaaggcucagccu

SEQ ID NO: 1740651 - RNA, 22 nt, Homo sapiens
agacacguggcagccacacuca

SEQ ID NO: 1740652 - RNA, 12 nt, Homo sapiens
agacacugugca

SEQ ID NO: 1740653 - RNA, 14 nt, Homo sapiens
agacgccaccauuc

SEQ ID NO: 1740654 - RNA, 20 nt, Homo sapiens
agacucccggagucuucucg

SEQ ID NO: 1740655 - RNA, 21 nt, Homo sapiens
agaguggcagccaagagccau

SEQ ID NO: 1740656 - RNA, 12 nt, Homo sapiens
agcacaagaagc

SEQ ID NO: 1740657 - RNA, 20 nt, Homo sapiens
agcacuuaacagauugccau

SEQ ID NO: 1740658 - RNA, 14 nt, Homo sapiens
agcagcaucauuca

SEQ ID NO: 1740659 - RNA, 16 nt, Homo sapiens
agcaucugcucugaga

SEQ ID NO: 1740660 - RNA, 15 nt, Homo sapiens
agcaugugggggaag

SEQ ID NO: 1740661 - RNA, 16 nt, Homo sapiens
agccaagaccaucucu

SEQ ID NO: 1740662 - RNA, 14 nt, Homo sapiens
agccaccucucugc

SEQ ID NO: 1740663 - RNA, 17 nt, Homo sapiens
agccaucugaagccacc

SEQ ID NO: 1740664 - RNA, 17 nt, Homo sapiens
agccuccugcccagucc

SEQ ID NO: 1740665 - RNA, 19 nt, Homo sapiens
agccuggagccccugugug

SEQ ID NO: 1740666 - RNA, 21 nt, Homo sapiens
agccuuuggauggcuauggag

SEQ ID NO: 1740667 - RNA, 22 nt, Homo sapiens
agcguuguguguuuucugggag

SEQ ID NO: 1740668 - RNA, 22 nt, Homo sapiens
agcugaccugcaccccugaugu

SEQ ID NO: 1740669 - RNA, 15 nt, Homo sapiens
agcugcucaacuuag

SEQ ID NO: 1740670 - RNA, 11 nt, Homo sapiens
agcugcucacu

SEQ ID NO: 1740671 - RNA, 15 nt, Homo sapiens
agcugcucacuuaaa

SEQ ID NO: 1740672 - RNA, 13 nt, Homo sapiens
agcuuuccgggga

SEQ ID NO: 1740673 - RNA, 17 nt, Homo sapiens
agcuuuccggggaggag

SEQ ID NO: 1740674 - RNA, 19 nt, Homo sapiens
aggaccaacccaugcccug

SEQ ID NO: 1740675 - RNA, 13 nt, Homo sapiens
gugucaccaucau

SEQ ID NO: 1740676 - RNA, 19 nt, Homo sapiens
gugucagcaucuuugcccu

SEQ ID NO: 1740677 - RNA, 21 nt, Homo sapiens
guuaaacuuauuucaagugau

SEQ ID NO: 1740678 - RNA, 22 nt, Homo sapiens
guucaugcgaauucuugcuuga

SEQ ID NO: 1740679 - RNA, 23 nt, Homo sapiens
guucgcacaaucuacacugccuu

SEQ ID NO: 1740680 - RNA, 12 nt, Homo sapiens
guugcucuguau

SEQ ID NO: 1740681 - RNA, 18 nt, Homo sapiens
uaaacaauguccucuuug

SEQ ID NO: 1740682 - RNA, 19 nt, Homo sapiens
uaaaccacacacacaaggu

SEQ ID NO: 1740683 - RNA, 16 nt, Homo sapiens
uaaaggcucugugcuu

SEQ ID NO: 1740684 - RNA, 21 nt, Homo sapiens
uaacaaaauugacagcuuucu

SEQ ID NO: 1740685 - RNA, 14 nt, Homo sapiens
uaacuaauucuguc

SEQ ID NO: 1740686 - RNA, 21 nt, Homo sapiens
uaaucauuucugauauuugcu

SEQ ID NO: 1740687 - RNA, 20 nt, Homo sapiens
uaauggucacagagcacugu

SEQ ID NO: 1740688 - RNA, 22 nt, Homo sapiens
uacccccuucugggcaucuguu

SEQ ID NO: 1740689 - RNA, 14 nt, Homo sapiens
uaccuucacuuaaa

SEQ ID NO: 1740690 - RNA, 11 nt, Homo sapiens
uagcugcucac

SEQ ID NO: 1740691 - RNA, 14 nt, Homo sapiens
uagcugcucacuua

SEQ ID NO: 1740692 - RNA, 20 nt, Homo sapiens
uaguguuaagugugcaguau

SEQ ID NO: 1740693 - RNA, 16 nt, Homo sapiens
ucaaaugcagcaaucc

SEQ ID NO: 1740694 - RNA, 21 nt, Homo sapiens
ucaaucuuuuagcacaugugu

SEQ ID NO: 1740695 - RNA, 14 nt, Homo sapiens
ucacagagcacugu

SEQ ID NO: 1740696 - RNA, 15 nt, Homo sapiens
ucacauauucaucag

SEQ ID NO: 1740697 - RNA, 18 nt, Homo sapiens
ucaccaucauuucuagua

SEQ ID NO: 1740698 - RNA, 16 nt, Homo sapiens
ucacugccucauggca

SEQ ID NO: 1740699 - RNA, 13 nt, Homo sapiens
ucacuuaaaccac

SEQ ID NO: 1740700 - RNA, 17 nt, Homo sapiens
ucacuuucucucuuaua

SEQ ID NO: 1740701 - RNA, 14 nt, Homo sapiens
ucagucagugcacu

SEQ ID NO: 1740702 - RNA, 15 nt, Homo sapiens
ucagucagugcacua

SEQ ID NO: 1740703 - RNA, 15 nt, Homo sapiens
ucaguccaguccuca

SEQ ID NO: 1740704 - RNA, 21 nt, Homo sapiens
ucaguugggaucccuccucca

SEQ ID NO: 1740705 - RNA, 21 nt, Homo sapiens
ucaucucuuuucccacucccu

SEQ ID NO: 1740706 - RNA, 22 nt, Homo sapiens
ucaucuuugacguggagcugcu

SEQ ID NO: 1740707 - RNA, 14 nt, Homo sapiens
ucaugucucugauu

SEQ ID NO: 1740708 - RNA, 20 nt, Homo sapiens
uccaacagaguggugucuag

SEQ ID NO: 1740709 - RNA, 11 nt, Homo sapiens
uccacuggccu

SEQ ID NO: 1740710 - RNA, 12 nt, Homo sapiens
uccaucaucucu

SEQ ID NO: 1740711 - RNA, 14 nt, Homo sapiens
ucccaaagugccuu

SEQ ID NO: 1740712 - RNA, 19 nt, Homo sapiens
ucccaagaggccagggugg

SEQ ID NO: 1740713 - RNA, 18 nt, Homo sapiens
ucccaagggaggcccaug

SEQ ID NO: 1740714 - RNA, 15 nt, Homo sapiens
uccccuaacacaagu

SEQ ID NO: 1740715 - RNA, 13 nt, Homo sapiens
ucccuccauaccu

SEQ ID NO: 1740716 - RNA, 22 nt, Homo sapiens
ucccuccauaccucgaacauca

SEQ ID NO: 1740717 - RNA, 18 nt, Homo sapiens
ucccuccuggugaagugu

SEQ ID NO: 1740718 - RNA, 18 nt, Homo sapiens
ucccugauuaaagugccu

SEQ ID NO: 1740719 - RNA, 19 nt, Homo sapiens
uccguucccaccucugagg

SEQ ID NO: 1740720 - RNA, 18 nt, Homo sapiens
uccuucaaaaagcaaucu

SEQ ID NO: 1740721 - RNA, 23 nt, Homo sapiens
ucucugcccaaguugcucuguau

SEQ ID NO: 1740722 - RNA, 16 nt, Homo sapiens
ucucuguagcugcuag

SEQ ID NO: 1740723 - RNA, 17 nt, Homo sapiens
ucugagaugcugguaau

SEQ ID NO: 1740724 - RNA, 19 nt, Homo sapiens
ucugaugaaaacaaaauca

SEQ ID NO: 1740725 - RNA, 16 nt, Homo sapiens
ucugcacccagccaaa

SEQ ID NO: 1740726 - RNA, 20 nt, Homo sapiens
ucugcacccagccaaacaca

SEQ ID NO: 1740727 - RNA, 16 nt, Homo sapiens
ucuggaccccaggcca

SEQ ID NO: 1740728 - RNA, 20 nt, Homo sapiens
ucugugucagcaucuuugcc

SEQ ID NO: 1740729 - RNA, 22 nt, Homo sapiens
ucuucucgagcuacgagaccuu

SEQ ID NO: 1740730 - RNA, 23 nt, Homo sapiens
ucuugaucagugugcuaaccuca

SEQ ID NO: 1740731 - RNA, 19 nt, Homo sapiens
ucuuugacguggagcugcu

SEQ ID NO: 1740732 - RNA, 13 nt, Homo sapiens
ucuuuuagcacau

SEQ ID NO: 1740733 - RNA, 22 nt, Homo sapiens
ugaacaauccccuaacacaagu

SEQ ID NO: 1740734 - RNA, 22 nt, Homo sapiens
ugaagcauuucagguugugcau

SEQ ID NO: 1740735 - RNA, 16 nt, Homo sapiens
ugacguggagcugcuc

SEQ ID NO: 1740736 - RNA, 13 nt, Homo sapiens
ugaucagugugcu

SEQ ID NO: 1740737 - RNA, 15 nt, Homo sapiens
ugauuaaagugccuu

SEQ ID NO: 1740738 - RNA, 24 nt, Homo sapiens
ugauugggucagcuggcuuccuag

SEQ ID NO: 1740739 - RNA, 14 nt, Homo sapiens
ugauuugcucucua

SEQ ID NO: 1740740 - RNA, 16 nt, Homo sapiens
ugcagaugcuuugccc

SEQ ID NO: 1740741 - RNA, 20 nt, Homo sapiens
ugcagauugaagcauuucag

SEQ ID NO: 1740742 - RNA, 18 nt, Homo sapiens
ugccacccucaucuuuga

SEQ ID NO: 1740743 - RNA, 17 nt, Homo sapiens
ugcccugaggcacugaa

SEQ ID NO: 1740744 - RNA, 13 nt, Homo sapiens
ugcccugggccag

SEQ ID NO: 1740745 - RNA, 17 nt, Homo sapiens
ugccuuaccuucacuua

SEQ ID NO: 1740746 - RNA, 19 nt, Homo sapiens
ugccuucagccaagaccau

SEQ ID NO: 1740747 - RNA, 14 nt, Homo sapiens
ugcgguaggugcug

SEQ ID NO: 1740748 - RNA, 21 nt, Homo sapiens
ugcgucaggagcagcaucauu

SEQ ID NO: 1740749 - RNA, 18 nt, Homo sapiens
ugcuaaccucacugccuc

SEQ ID NO: 1740750 - RNA, 19 nt, Homo sapiens
ugcuuuauccagcagucaa

SEQ ID NO: 1740751 - RNA, 21 nt, Homo sapiens
ugcuuugcccaggcuucucac

SEQ ID NO: 1740752 - RNA, 18 nt, Homo sapiens
ugcuuuuggggcucuuga

SEQ ID NO: 1740753 - RNA, 21 nt, Homo sapiens
uggaagaaagcccugugcuuu

SEQ ID NO: 1740754 - RNA, 14 nt, Homo sapiens
uggagccccugugu

SEQ ID NO: 1740755 - RNA, 15 nt, Homo sapiens
uggagccccugugug

SEQ ID NO: 1740756 - RNA, 17 nt, Homo sapiens
uggcagccaagagccau

SEQ ID NO: 1740757 - RNA, 15 nt, Homo sapiens
uggcagugccugaac

SEQ ID NO: 1740758 - RNA, 16 nt, Homo sapiens
uggccucaaacagcca

SEQ ID NO: 1740759 - RNA, 18 nt, Homo sapiens
ugggaugagagaaagugg

SEQ ID NO: 1740760 - RNA, 22 nt, Homo sapiens
ugggaugggagguugauuugcu

SEQ ID NO: 1740761 - RNA, 17 nt, Homo sapiens
uggucacagagcacugu

SEQ ID NO: 1740762 - RNA, 18 nt, Homo sapiens
uggucacagagcacugua

SEQ ID NO: 1740763 - RNA, 19 nt, Homo sapiens
uguacaggugucaccauca

SEQ ID NO: 1740764 - RNA, 20 nt, Homo sapiens
ugucaacuccaggacuugcu

SEQ ID NO: 1740765 - RNA, 20 nt, Homo sapiens
ugugcauuuugugugaugca

SEQ ID NO: 1740766 - RNA, 13 nt, Homo sapiens
uguguaagacacu

SEQ ID NO: 1740767 - RNA, 21 nt, Homo sapiens
uguguaagacacugugcaaau

SEQ ID NO: 1740768 - RNA, 15 nt, Homo sapiens
uguucgcacaaucua

SEQ ID NO: 1740769 - RNA, 23 nt, Homo sapiens
uuaaacaauguccucuuugagaa

SEQ ID NO: 1740770 - RNA, 15 nt, Homo sapiens
uuaacucuccaguua

SEQ ID NO: 1740771 - RNA, 21 nt, Homo sapiens
uuacuuugagacuaaagacug

SEQ ID NO: 1740772 - RNA, 17 nt, Homo sapiens
uuagauguugguggugc

SEQ ID NO: 1740773 - RNA, 14 nt, Homo sapiens
uuagcugcucacuu

SEQ ID NO: 1740774 - RNA, 16 nt, Homo sapiens
uuagcugcucacuuaa

SEQ ID NO: 1740775 - RNA, 17 nt, Homo sapiens
uuagcugcucacuuaaa

SEQ ID NO: 1740776 - RNA, 18 nt, Homo sapiens
uuauaaaucauauucuca

SEQ ID NO: 1740777 - RNA, 15 nt, Homo sapiens
uucacagagacacgu

SEQ ID NO: 1740778 - RNA, 18 nt, Homo sapiens
uucacagagacacguggc

SEQ ID NO: 1740779 - RNA, 21 nt, Homo sapiens
uucagggcugggcagguccug

SEQ ID NO: 1740780 - RNA, 19 nt, Homo sapiens
gcccuccuucuugcccuga

SEQ ID NO: 1740781 - RNA, 17 nt, Homo sapiens
gcccuugucugagaugc

SEQ ID NO: 1740782 - RNA, 20 nt, Homo sapiens
gcccuugucugagaugcugg

SEQ ID NO: 1740783 - RNA, 14 nt, Homo sapiens
gccugaacauggca

SEQ ID NO: 1740784 - RNA, 20 nt, Homo sapiens
gccuuggaagcaaacuuaua

SEQ ID NO: 1740785 - RNA, 18 nt, Homo sapiens
gcuaaauucacauuugcc

SEQ ID NO: 1740786 - RNA, 16 nt, Homo sapiens
gcuaaccucacugccu

SEQ ID NO: 1740787 - RNA, 23 nt, Homo sapiens
gcuaaccucacugccucauggca

SEQ ID NO: 1740788 - RNA, 18 nt, Homo sapiens
gcucaaccacacacaccu

SEQ ID NO: 1740789 - RNA, 12 nt, Homo sapiens
gcucaacuuaga

SEQ ID NO: 1740790 - RNA, 19 nt, Homo sapiens
gcucacuuaaacaaugucc

SEQ ID NO: 1740791 - RNA, 14 nt, Homo sapiens
gcucagacaugaaa

SEQ ID NO: 1740792 - RNA, 19 nt, Homo sapiens
gcucagucagugcacuaac

SEQ ID NO: 1740793 - RNA, 16 nt, Homo sapiens
gcucuccuugcccugg

SEQ ID NO: 1740794 - RNA, 15 nt, Homo sapiens
gcucuguauguguuc

SEQ ID NO: 1740795 - RNA, 21 nt, Homo sapiens
gcugcucacuuaaacaauguc

SEQ ID NO: 1740796 - RNA, 13 nt, Homo sapiens
gcugcugcucacc

SEQ ID NO: 1740797 - RNA, 13 nt, Homo sapiens
gcuucucaccacg

SEQ ID NO: 1740798 - RNA, 13 nt, Homo sapiens
ggaaacugggaug

SEQ ID NO: 1740799 - RNA, 17 nt, Homo sapiens
ggacuugcuuccaagcc

SEQ ID NO: 1740800 - RNA, 11 nt, Homo sapiens
ggaggggcccc

SEQ ID NO: 1740801 - RNA, 14 nt, Homo sapiens
ggcacaugcugagu

SEQ ID NO: 1740802 - RNA, 19 nt, Homo sapiens
ggcagcaagcaauucugcc

SEQ ID NO: 1740803 - RNA, 16 nt, Homo sapiens
ggcagccaagagccau

SEQ ID NO: 1740804 - RNA, 20 nt, Homo sapiens
ggcagccaagagccaucuga

SEQ ID NO: 1740805 - RNA, 21 nt, Homo sapiens
ggcaggaaggaacucaaggug

SEQ ID NO: 1740806 - RNA, 15 nt, Homo sapiens
ggcucaaccacacac

SEQ ID NO: 1740807 - RNA, 23 nt, Homo sapiens
ggcucaaccacacacaccugucu

SEQ ID NO: 1740808 - RNA, 17 nt, Homo sapiens
ggcuggagauggcugcu

SEQ ID NO: 1740809 - RNA, 15 nt, Homo sapiens
ggcugggagaaggug

SEQ ID NO: 1740810 - RNA, 18 nt, Homo sapiens
ggcugggagaaggugcuu

SEQ ID NO: 1740811 - RNA, 12 nt, Homo sapiens
gggacugggaug

SEQ ID NO: 1740812 - RNA, 13 nt, Homo sapiens
gggaggagccuug

SEQ ID NO: 1740813 - RNA, 16 nt, Homo sapiens
gggaucccuccuccag

SEQ ID NO: 1740814 - RNA, 21 nt, Homo sapiens
gggcaugggggaggcucugaa

SEQ ID NO: 1740815 - RNA, 20 nt, Homo sapiens
gggcgaggcgggggagccug

SEQ ID NO: 1740816 - RNA, 21 nt, Homo sapiens
ggggcaaggugggggagccug

SEQ ID NO: 1740817 - RNA, 21 nt, Homo sapiens
ggucauucauaucacuaugaa

SEQ ID NO: 1740818 - RNA, 19 nt, Homo sapiens
guacaggugucaccaucau

SEQ ID NO: 1740819 - RNA, 23 nt, Homo sapiens
guagcacuuaacagauugccaug

SEQ ID NO: 1740820 - RNA, 21 nt, Homo sapiens
guauauuaggaaacugggaug

SEQ ID NO: 1740821 - RNA, 17 nt, Homo sapiens
gucaguguucaugcgaa

SEQ ID NO: 1740822 - RNA, 20 nt, Homo sapiens
gucaucugggccaccagcuc

SEQ ID NO: 1740823 - RNA, 16 nt, Homo sapiens
gucauggcagugccug

SEQ ID NO: 1740824 - RNA, 13 nt, Homo sapiens
gucauucauauca

SEQ ID NO: 1740825 - RNA, 20 nt, Homo sapiens
auagauuuucuucugagacu

SEQ ID NO: 1740826 - RNA, 19 nt, Homo sapiens
aucaccucuaaaaaccaaa

SEQ ID NO: 1740827 - RNA, 15 nt, Homo sapiens
aucagagcccaggga

SEQ ID NO: 1740828 - RNA, 22 nt, Homo sapiens
aucagagcccagggaagacaca

SEQ ID NO: 1740829 - RNA, 22 nt, Homo sapiens
aucaguugggaucccuccucca

SEQ ID NO: 1740830 - RNA, 16 nt, Homo sapiens
aucauauucucauggc

SEQ ID NO: 1740831 - RNA, 11 nt, Homo sapiens
auccagcaguc

SEQ ID NO: 1740832 - RNA, 16 nt, Homo sapiens
aucccuccuccagcca

SEQ ID NO: 1740833 - RNA, 14 nt, Homo sapiens
auccuggaaggaaa

SEQ ID NO: 1740834 - RNA, 18 nt, Homo sapiens
auccuggagccccugugu

SEQ ID NO: 1740835 - RNA, 14 nt, Homo sapiens
aucuacacugccuu

SEQ ID NO: 1740836 - RNA, 15 nt, Homo sapiens
aucuacacugccuua

SEQ ID NO: 1740837 - RNA, 17 nt, Homo sapiens
aucuggggaaggaccaa

SEQ ID NO: 1740838 - RNA, 18 nt, Homo sapiens
aucuuuuagcacaugugu

SEQ ID NO: 1740839 - RNA, 14 nt, Homo sapiens
augacagaacacag

SEQ ID NO: 1740840 - RNA, 13 nt, Homo sapiens
augagcaguccag

SEQ ID NO: 1740841 - RNA, 15 nt, Homo sapiens
augccacccucaucu

SEQ ID NO: 1740842 - RNA, 15 nt, Homo sapiens
auggcugcugcucac

SEQ ID NO: 1740843 - RNA, 16 nt, Homo sapiens
auggcugcugcucacc

SEQ ID NO: 1740844 - RNA, 22 nt, Homo sapiens
auguggguugagcuaugcagaa

SEQ ID NO: 1740845 - RNA, 21 nt, Homo sapiens
auguguaagacacugugcaaa

SEQ ID NO: 1740846 - RNA, 23 nt, Homo sapiens
auuaaagauugcuuuauccagca

SEQ ID NO: 1740847 - RNA, 16 nt, Homo sapiens
auuaacucuccaguua

SEQ ID NO: 1740848 - RNA, 14 nt, Homo sapiens
auuaaugauuuagc

SEQ ID NO: 1740849 - RNA, 22 nt, Homo sapiens
auuaaugauuuagcucccucca

SEQ ID NO: 1740850 - RNA, 13 nt, Homo sapiens
auucauacucaga

SEQ ID NO: 1740851 - RNA, 22 nt, Homo sapiens
auucauaucacuaugaacuugg

SEQ ID NO: 1740852 - RNA, 17 nt, Homo sapiens
auucuaggcagcaccuu

SEQ ID NO: 1740853 - RNA, 14 nt, Homo sapiens
auucucucugccca

SEQ ID NO: 1740854 - RNA, 19 nt, Homo sapiens
auucuggaaagaaaaccau

SEQ ID NO: 1740855 - RNA, 15 nt, Homo sapiens
auucuggacacuguc

SEQ ID NO: 1740856 - RNA, 17 nt, Homo sapiens
auucuguuagcugcuca

SEQ ID NO: 1740857 - RNA, 19 nt, Homo sapiens
auuggccagggcaacaaua

SEQ ID NO: 1740858 - RNA, 20 nt, Homo sapiens
auuguacgugggagaggcag

SEQ ID NO: 1740859 - RNA, 19 nt, Homo sapiens
auugucuuguucugugaug

SEQ ID NO: 1740860 - RNA, 19 nt, Homo sapiens
caaaaggaggcucuucuca

SEQ ID NO: 1740861 - RNA, 16 nt, Homo sapiens
caaaugcagcaauccc

SEQ ID NO: 1740862 - RNA, 20 nt, Homo sapiens
caacuccaaacaauucugau

SEQ ID NO: 1740863 - RNA, 13 nt, Homo sapiens
caagcaauucugc

SEQ ID NO: 1740864 - RNA, 12 nt, Homo sapiens
caaggugcucag

SEQ ID NO: 1740865 - RNA, 19 nt, Homo sapiens
caaggugcucagacaugaa

SEQ ID NO: 1740866 - RNA, 18 nt, Homo sapiens
caagugauggucauucau

SEQ ID NO: 1740867 - RNA, 17 nt, Homo sapiens
caauaaaaaccaaacuc

SEQ ID NO: 1740868 - RNA, 23 nt, Homo sapiens
caaucuuuuagcacauguguaag

SEQ ID NO: 1740869 - RNA, 19 nt, Homo sapiens
caaugccacccucaucuuu

SEQ ID NO: 1740870 - RNA, 14 nt, Homo sapiens
cacaaggugcucag

SEQ ID NO: 1740871 - RNA, 21 nt, Homo sapiens
cacaaggugcucagacaugaa

SEQ ID NO: 1740872 - RNA, 18 nt, Homo sapiens
cacaaucuacacugccuu

SEQ ID NO: 1740873 - RNA, 14 nt, Homo sapiens
cacacacaaggugc

SEQ ID NO: 1740874 - RNA, 20 nt, Homo sapiens
cacacaccugucugugcaga

SEQ ID NO: 1740875 - RNA, 14 nt, Homo sapiens
cacagagacacgug

SEQ ID NO: 1740876 - RNA, 13 nt, Homo sapiens
cacaugcugaguc

SEQ ID NO: 1740877 - RNA, 17 nt, Homo sapiens
cacauguguaagacacu

SEQ ID NO: 1740878 - RNA, 20 nt, Homo sapiens
caccucucugccuguuccuc

SEQ ID NO: 1740879 - RNA, 16 nt, Homo sapiens
caccugucugugcaga

SEQ ID NO: 1740880 - RNA, 22 nt, Homo sapiens
cacugaaaaaaaaaaaaauccc

SEQ ID NO: 1740881 - RNA, 12 nt, Homo sapiens
cacugccucaug

SEQ ID NO: 1740882 - RNA, 21 nt, Homo sapiens
cacugccuuaccuucacuuaa

SEQ ID NO: 1740883 - RNA, 21 nt, Homo sapiens
cagagcacuguagcacuuaac

SEQ ID NO: 1740884 - RNA, 15 nt, Homo sapiens
cagauugaagcauuu

SEQ ID NO: 1740885 - RNA, 13 nt, Homo sapiens
cagcaucauucag

SEQ ID NO: 1740886 - RNA, 14 nt, Homo sapiens
cagcaucuuugccc

SEQ ID NO: 1740887 - RNA, 13 nt, Homo sapiens
cagccaagaccau

SEQ ID NO: 1740888 - RNA, 23 nt, Homo sapiens
cagcguuguguguuuucugggag

SEQ ID NO: 1740889 - RNA, 17 nt, Homo sapiens
caggagaaaaauuauuc

SEQ ID NO: 1740890 - RNA, 17 nt, Homo sapiens
caggagcagcaucauuc

SEQ ID NO: 1740891 - RNA, 18 nt, Homo sapiens
caggagcagcaucauuca

SEQ ID NO: 1740892 - RNA, 20 nt, Homo sapiens
caggccucaugccucgcuca

SEQ ID NO: 1740893 - RNA, 21 nt, Homo sapiens
caggggcuuuggaagcucugu

SEQ ID NO: 1740894 - RNA, 21 nt, Homo sapiens
caguccaguccucacaugccc

SEQ ID NO: 1740895 - RNA, 21 nt, Homo sapiens
cagucuagggugaacaauccc

SEQ ID NO: 1740896 - RNA, 18 nt, Homo sapiens
cagugugcuaaccucacu

SEQ ID NO: 1740897 - RNA, 14 nt, Homo sapiens
caguuugcacuuaa

SEQ ID NO: 1740898 - RNA, 14 nt, Homo sapiens
cauaccaggugcua

SEQ ID NO: 1740899 - RNA, 14 nt, Homo sapiens
cauagagugaccuu

SEQ ID NO: 1740900 - RNA, 22 nt, Homo sapiens
cauagagugaccuuuuaaucag

SEQ ID NO: 1740901 - RNA, 17 nt, Homo sapiens
cauaucacuaugaacuu

SEQ ID NO: 1740902 - RNA, 15 nt, Homo sapiens
cauauucaucagcag

SEQ ID NO: 1740903 - RNA, 14 nt, Homo sapiens
cauauucucauggc

SEQ ID NO: 1740904 - RNA, 20 nt, Homo sapiens
caucauucagcaaaugccuu

SEQ ID NO: 1740905 - RNA, 20 nt, Homo sapiens
caucccaugagcaguccaga

SEQ ID NO: 1740906 - RNA, 14 nt, Homo sapiens
caucugcucugaga

SEQ ID NO: 1740907 - RNA, 17 nt, Homo sapiens
caugaaauguacauggc

SEQ ID NO: 1740908 - RNA, 17 nt, Homo sapiens
caugagcaguccagagc

SEQ ID NO: 1740909 - RNA, 22 nt, Homo sapiens
cauugugcuugguagauuuagu

SEQ ID NO: 1740910 - RNA, 16 nt, Homo sapiens
cauuuugugugaugca

SEQ ID NO: 1740911 - RNA, 12 nt, Homo sapiens
ccaagagccauc

SEQ ID NO: 1740912 - RNA, 21 nt, Homo sapiens
ccacgaggugguagcucugag

SEQ ID NO: 1740913 - RNA, 10 nt, Homo sapiens
ccagaggcag

SEQ ID NO: 1740914 - RNA, 15 nt, Homo sapiens
ccagcuuugcccaac

SEQ ID NO: 1740915 - RNA, 15 nt, Homo sapiens
ccaucugaagccacc

SEQ ID NO: 1740916 - RNA, 15 nt, Homo sapiens
ccauucuggacacug

SEQ ID NO: 1740917 - RNA, 17 nt, Homo sapiens
cccaagaggccagggug

SEQ ID NO: 1740918 - RNA, 16 nt, Homo sapiens
cccacuuagcagggac

SEQ ID NO: 1740919 - RNA, 23 nt, Homo sapiens
ccccagcuuugcccaacaccagc

SEQ ID NO: 1740920 - RNA, 16 nt, Homo sapiens
ccccugauguggcaua

SEQ ID NO: 1740921 - RNA, 21 nt, Homo sapiens
cccgaggccuagaguggcagc

SEQ ID NO: 1740922 - RNA, 15 nt, Homo sapiens
cccugauguggcaua

SEQ ID NO: 1740923 - RNA, 21 nt, Homo sapiens
ccuacggagggaccagguguc

SEQ ID NO: 1740924 - RNA, 21 nt, Homo sapiens
ccuccuagccugcucugccac

SEQ ID NO: 1740925 - RNA, 16 nt, Homo sapiens
ccuccuucaaaaagca

SEQ ID NO: 1740926 - RNA, 20 nt, Homo sapiens
ccucucuuuguucucagcuc

SEQ ID NO: 1740927 - RNA, 17 nt, Homo sapiens
ccugauuaaagugccuu

SEQ ID NO: 1740928 - RNA, 17 nt, Homo sapiens
ccugcuuuuggggcucu

SEQ ID NO: 1740929 - RNA, 17 nt, Homo sapiens
ccuggaaaccacagucc

SEQ ID NO: 1740930 - RNA, 18 nt, Homo sapiens
gcauuucagguugugcau

SEQ ID NO: 1740931 - RNA, 21 nt, Homo sapiens
gccagggguggugagggcagu

SEQ ID NO: 1740932 - RNA, 14 nt, Homo sapiens
gccauaccaggugc

SEQ ID NO: 1740933 - RNA, 16 nt, Homo sapiens
gccauaccaggugcua

SEQ ID NO: 1740934 - RNA, 17 nt, Homo sapiens
gccaucugaagccaccu

SEQ ID NO: 1740935 - RNA, 22 nt, Homo sapiens
gcccagggaagacacaugauua

SEQ ID NO: 1740936 - RNA, 14 nt, Homo sapiens
gcccuugucugaga

SEQ ID NO: 1740937 - RNA, 19 nt, Homo sapiens
gccgucgaguugaccuucu

SEQ ID NO: 1740938 - RNA, 20 nt, Homo sapiens
gccuagaguggcagccaaga

SEQ ID NO: 1740939 - RNA, 18 nt, Homo sapiens
gccucauggcaucaucca

SEQ ID NO: 1740940 - RNA, 16 nt, Homo sapiens
gccuccugcccagucc

SEQ ID NO: 1740941 - RNA, 16 nt, Homo sapiens
gccuuuccugaugaca

SEQ ID NO: 1740942 - RNA, 17 nt, Homo sapiens
gcguaccguacacagag

SEQ ID NO: 1740943 - RNA, 20 nt, Homo sapiens
gcuauggagagggcuugaaa

SEQ ID NO: 1740944 - RNA, 12 nt, Homo sapiens
gcucaaccacac

SEQ ID NO: 1740945 - RNA, 14 nt, Homo sapiens
gcucaaccacacac

SEQ ID NO: 1740946 - RNA, 12 nt, Homo sapiens
gcucccaccagc

SEQ ID NO: 1740947 - RNA, 13 nt, Homo sapiens
gcucccccugucc

SEQ ID NO: 1740948 - RNA, 22 nt, Homo sapiens
gcucugaagagauacccacaga

SEQ ID NO: 1740949 - RNA, 14 nt, Homo sapiens
gcucuugaucagug

SEQ ID NO: 1740950 - RNA, 20 nt, Homo sapiens
gcucuugaucagugugcuaa

SEQ ID NO: 1740951 - RNA, 14 nt, Homo sapiens
gcugcucacuuaaa

SEQ ID NO: 1740952 - RNA, 15 nt, Homo sapiens
gcugggaucugaaua

SEQ ID NO: 1740953 - RNA, 22 nt, Homo sapiens
gcuguuggcugggggcaugggg

SEQ ID NO: 1740954 - RNA, 19 nt, Homo sapiens
ggaaggccuugcugucaug

SEQ ID NO: 1740955 - RNA, 20 nt, Homo sapiens
ggaauacuagcuaacuaauu

SEQ ID NO: 1740956 - RNA, 23 nt, Homo sapiens
ggagagagguugaggaugcacug

SEQ ID NO: 1740957 - RNA, 19 nt, Homo sapiens
ggagcagcaucauucagca

SEQ ID NO: 1740958 - RNA, 13 nt, Homo sapiens
ggagcugcucaac

SEQ ID NO: 1740959 - RNA, 22 nt, Homo sapiens
ggaggcucugaagagauaccca

SEQ ID NO: 1740960 - RNA, 19 nt, Homo sapiens
ggagggaccaggugucuag

SEQ ID NO: 1740961 - RNA, 19 nt, Homo sapiens
ggaucuggggaaggaccaa

SEQ ID NO: 1740962 - RNA, 15 nt, Homo sapiens
ggccugggagggcaa

SEQ ID NO: 1740963 - RNA, 22 nt, Homo sapiens
gggaggagccuuggaguguaau

SEQ ID NO: 1740964 - RNA, 17 nt, Homo sapiens
ggguggugugucucagg

SEQ ID NO: 1740965 - RNA, 21 nt, Homo sapiens
gguugcagauugaagcauuuc

SEQ ID NO: 1740966 - RNA, 16 nt, Homo sapiens
guaagaaaagcaguuu

SEQ ID NO: 1740967 - RNA, 14 nt, Homo sapiens
guaccccccaaccc

SEQ ID NO: 1740968 - RNA, 19 nt, Homo sapiens
guauaagccccgaggccua

SEQ ID NO: 1740969 - RNA, 12 nt, Homo sapiens
gucagcaucuuu

SEQ ID NO: 1740970 - RNA, 16 nt, Homo sapiens
guccagagcuucaggg

SEQ ID NO: 1740971 - RNA, 22 nt, Homo sapiens
guccuacggagggaccaggugu

SEQ ID NO: 1740972 - RNA, 22 nt, Homo sapiens
guccucuuugagaaaauguaaa

SEQ ID NO: 1740973 - RNA, 21 nt, Homo sapiens
gucuagaggcaacaguguucu

SEQ ID NO: 1740974 - RNA, 14 nt, Homo sapiens
gucucacauauuca

SEQ ID NO: 1740975 - RNA, 14 nt, Homo sapiens
gucuuguucuguga

SEQ ID NO: 1740976 - RNA, 14 nt, Homo sapiens
guggcagcaagcaa

SEQ ID NO: 1740977 - RNA, 21 nt, Homo sapiens
guggugcagccccaggaccaa

SEQ ID NO: 1740978 - RNA, 12 nt, Homo sapiens
guguacaggugu

SEQ ID NO: 1740979 - RNA, 12 nt, Homo sapiens
guucaugucucu

SEQ ID NO: 1740980 - RNA, 19 nt, Homo sapiens
guuccucccaagaggccag

SEQ ID NO: 1740981 - RNA, 22 nt, Homo sapiens
guucgcacaaucuacacugccu

SEQ ID NO: 1740982 - RNA, 19 nt, Homo sapiens
guucugcacccagccaaac

SEQ ID NO: 1740983 - RNA, 17 nt, Homo sapiens
guuucggaagagcuguu

SEQ ID NO: 1740984 - RNA, 21 nt, Homo sapiens
uaaaauaaaggcucugugcuu

SEQ ID NO: 1740985 - RNA, 18 nt, Homo sapiens
uaaacuuauuucaaguga

SEQ ID NO: 1740986 - RNA, 13 nt, Homo sapiens
uaaaggcucugug

SEQ ID NO: 1740987 - RNA, 14 nt, Homo sapiens
uaacagauugccau

SEQ ID NO: 1740988 - RNA, 22 nt, Homo sapiens
uacacugccuuaccuucacuua

SEQ ID NO: 1740989 - RNA, 21 nt, Homo sapiens
uacagggagccuccugcccag

SEQ ID NO: 1740990 - RNA, 22 nt, Homo sapiens
uacauggcguaccguacacaga

SEQ ID NO: 1740991 - RNA, 16 nt, Homo sapiens
uacauuuuucugaugg

SEQ ID NO: 1740992 - RNA, 22 nt, Homo sapiens
uaccauacagacagcacaaggu

SEQ ID NO: 1740993 - RNA, 16 nt, Homo sapiens
uacccacagagugugg

SEQ ID NO: 1740994 - RNA, 15 nt, Homo sapiens
uacuuugagacuaaa

SEQ ID NO: 1740995 - RNA, 16 nt, Homo sapiens
uagaguggcagccaag

SEQ ID NO: 1740996 - RNA, 14 nt, Homo sapiens
uagcacauguguaa

SEQ ID NO: 1740997 - RNA, 13 nt, Homo sapiens
uagccugcucugc

SEQ ID NO: 1740998 - RNA, 14 nt, Homo sapiens
uagccugcucugcc

SEQ ID NO: 1740999 - RNA, 16 nt, Homo sapiens
uagccugcucugccac

SEQ ID NO: 1741000 - RNA, 15 nt, Homo sapiens
uagcugcucacuuaa

SEQ ID NO: 1741001 - RNA, 14 nt, Homo sapiens
uaggcagcaccuua

SEQ ID NO: 1741002 - RNA, 12 nt, Homo sapiens
uaguuugcacuu

SEQ ID NO: 1741003 - RNA, 18 nt, Homo sapiens
uaucaguacucccacaau

SEQ ID NO: 1741004 - RNA, 13 nt, Homo sapiens
ucaaaaagcaauc

SEQ ID NO: 1741005 - RNA, 18 nt, Homo sapiens
ucaaaugcagcaauccca

SEQ ID NO: 1741006 - RNA, 22 nt, Homo sapiens
ucaagggucauggcagugccug

SEQ ID NO: 1741007 - RNA, 23 nt, Homo sapiens
ucacagagcacuguagcacuuaa

SEQ ID NO: 1741008 - RNA, 23 nt, Homo sapiens
ucaccauccuggaaggaaacugu

SEQ ID NO: 1741009 - RNA, 15 nt, Homo sapiens
ucacuuaaaccacac

SEQ ID NO: 1741010 - RNA, 12 nt, Homo sapiens
ucagacaugaaa

SEQ ID NO: 1741011 - RNA, 17 nt, Homo sapiens
ucagccuuggaagcaaa

SEQ ID NO: 1741012 - RNA, 18 nt, Homo sapiens
ucaggagcagcaucauuc

SEQ ID NO: 1741013 - RNA, 19 nt, Homo sapiens
ucaugccucgcucagucag

SEQ ID NO: 1741014 - RNA, 15 nt, Homo sapiens
ucauggcagugccug

SEQ ID NO: 1741015 - RNA, 22 nt, Homo sapiens
ucauggcuuuguuaaacuuauu

SEQ ID NO: 1741016 - RNA, 13 nt, Homo sapiens
ucccaaagugccu

SEQ ID NO: 1741017 - RNA, 15 nt, Homo sapiens
ucccccaaccccagc

SEQ ID NO: 1741018 - RNA, 15 nt, Homo sapiens
ucccucccaaugcca

SEQ ID NO: 1741019 - RNA, 22 nt, Homo sapiens
ucccucuaguuggcaagucuca

SEQ ID NO: 1741020 - RNA, 18 nt, Homo sapiens
ucccuuuuccaucaucuc

SEQ ID NO: 1741021 - RNA, 13 nt, Homo sapiens
uccucacaugccc

SEQ ID NO: 1741022 - RNA, 14 nt, Homo sapiens
uccuucuugcccug

SEQ ID NO: 1741023 - RNA, 18 nt, Homo sapiens
ucgcucagucagugcacu

SEQ ID NO: 1741024 - RNA, 19 nt, Homo sapiens
ucgcucagucagugcacua

SEQ ID NO: 1741025 - RNA, 12 nt, Homo sapiens
ucuaaaaaccaa

SEQ ID NO: 1741026 - RNA, 20 nt, Homo sapiens
ucugauggguucaugucucu

SEQ ID NO: 1741027 - RNA, 19 nt, Homo sapiens
ucugcggugaggcagggga

SEQ ID NO: 1741028 - RNA, 12 nt, Homo sapiens
ucugcucugaga

SEQ ID NO: 1741029 - RNA, 20 nt, Homo sapiens
ucuggaaagaaaaccauucu

SEQ ID NO: 1741030 - RNA, 12 nt, Homo sapiens
ucuggacacugu

SEQ ID NO: 1741031 - RNA, 21 nt, Homo sapiens
ucuggcuggguuuucaggggc

SEQ ID NO: 1741032 - RNA, 22 nt, Homo sapiens
ucugggagcaucgaagcucugu

SEQ ID NO: 1741033 - RNA, 21 nt, Homo sapiens
ucugugcagaugcuuugccca

SEQ ID NO: 1741034 - RNA, 19 nt, Homo sapiens
ucuguuagcugcucacuua

SEQ ID NO: 1741035 - RNA, 15 nt, Homo sapiens
aaaaggaggcucuuc

SEQ ID NO: 1741036 - RNA, 19 nt, Homo sapiens
aaaaggaggcucuucucau

SEQ ID NO: 1741037 - RNA, 15 nt, Homo sapiens
aaaaguuacauugug

SEQ ID NO: 1741038 - RNA, 15 nt, Homo sapiens
aaaccaaaacccuac

SEQ ID NO: 1741039 - RNA, 13 nt, Homo sapiens
aaaggcucugugc

SEQ ID NO: 1741040 - RNA, 13 nt, Homo sapiens
aaaguuacauugu

SEQ ID NO: 1741041 - RNA, 15 nt, Homo sapiens
aaauagagcaauacu

SEQ ID NO: 1741042 - RNA, 13 nt, Homo sapiens
aacacauaacaau

SEQ ID NO: 1741043 - RNA, 13 nt, Homo sapiens
aacagauugccau

SEQ ID NO: 1741044 - RNA, 18 nt, Homo sapiens
aacagauugccauggaca

SEQ ID NO: 1741045 - RNA, 16 nt, Homo sapiens
aacaguguucugagcc

SEQ ID NO: 1741046 - RNA, 19 nt, Homo sapiens
aacauuuugcugauuuugu

SEQ ID NO: 1741047 - RNA, 15 nt, Homo sapiens
aaccaaacucugugu

SEQ ID NO: 1741048 - RNA, 22 nt, Homo sapiens
aaccauugucuuguucugugau

SEQ ID NO: 1741049 - RNA, 22 nt, Homo sapiens
aacucugugucagcaucuuugc

SEQ ID NO: 1741050 - RNA, 17 nt, Homo sapiens
aagaaaagcaguuugca

SEQ ID NO: 1741051 - RNA, 18 nt, Homo sapiens
aagaaagcccugugcuuu

SEQ ID NO: 1741052 - RNA, 15 nt, Homo sapiens
aagacacaugauuaa

SEQ ID NO: 1741053 - RNA, 14 nt, Homo sapiens
aagauacgugcaug

SEQ ID NO: 1741054 - RNA, 17 nt, Homo sapiens
aagauacgugcaugaaa

SEQ ID NO: 1741055 - RNA, 17 nt, Homo sapiens
aagccaccucucugccu

SEQ ID NO: 1741056 - RNA, 17 nt, Homo sapiens
aagggaggcccauguga

SEQ ID NO: 1741057 - RNA, 18 nt, Homo sapiens
aagugccuucagccaaga

SEQ ID NO: 1741058 - RNA, 16 nt, Homo sapiens
aaguugcucuguaugu

SEQ ID NO: 1741059 - RNA, 15 nt, Homo sapiens
aauaaucuaaauuca

SEQ ID NO: 1741060 - RNA, 21 nt, Homo sapiens
aauaccccuucucuguagcug

SEQ ID NO: 1741061 - RNA, 20 nt, Homo sapiens
aauucuggaaagaaaaccau

SEQ ID NO: 1741062 - RNA, 17 nt, Homo sapiens
aauucuguuagcugcuc

SEQ ID NO: 1741063 - RNA, 15 nt, Homo sapiens
acaauaaaaaccaaa

SEQ ID NO: 1741064 - RNA, 13 nt, Homo sapiens
acaauucugauga

SEQ ID NO: 1741065 - RNA, 23 nt, Homo sapiens
acacacaccugucugugcagaug

SEQ ID NO: 1741066 - RNA, 20 nt, Homo sapiens
acaccaguugcgaagggaaa

SEQ ID NO: 1741067 - RNA, 22 nt, Homo sapiens
acacugccuuaccuucacuuaa

SEQ ID NO: 1741068 - RNA, 23 nt, Homo sapiens
acacugccuuaccuucacuuaaa

SEQ ID NO: 1741069 - RNA, 15 nt, Homo sapiens
acaggcauagaguga

SEQ ID NO: 1741070 - RNA, 12 nt, Homo sapiens
accaaacucugu

SEQ ID NO: 1741071 - RNA, 22 nt, Homo sapiens
accacacacacaaggugcucag

SEQ ID NO: 1741072 - RNA, 16 nt, Homo sapiens
accagcuccacuggcc

SEQ ID NO: 1741073 - RNA, 19 nt, Homo sapiens
accauacagacagcacaag

SEQ ID NO: 1741074 - RNA, 22 nt, Homo sapiens
acccuccuagccugcucugcca

SEQ ID NO: 1741075 - RNA, 13 nt, Homo sapiens
accucacugccuc

SEQ ID NO: 1741076 - RNA, 13 nt, Homo sapiens
accucuuucccca

SEQ ID NO: 1741077 - RNA, 18 nt, Homo sapiens
accugcaccccugaugug

SEQ ID NO: 1741078 - RNA, 21 nt, Homo sapiens
acgaggugguagcucugagcc

SEQ ID NO: 1741079 - RNA, 15 nt, Homo sapiens
acuccggcacugggu

SEQ ID NO: 1741080 - RNA, 22 nt, Homo sapiens
acuccggcacuggguuugcucc

SEQ ID NO: 1741081 - RNA, 21 nt, Homo sapiens
acugccucauggcaucaucca

SEQ ID NO: 1741082 - RNA, 14 nt, Homo sapiens
acuguagcacuuaa

SEQ ID NO: 1741083 - RNA, 14 nt, Homo sapiens
acuuaaacaauguc

SEQ ID NO: 1741084 - RNA, 17 nt, Homo sapiens
acuuaacagauugccau

SEQ ID NO: 1741085 - RNA, 18 nt, Homo sapiens
acuuauaaaucauauucu

SEQ ID NO: 1741086 - RNA, 19 nt, Homo sapiens
acuugagccaguuaccuuu

SEQ ID NO: 1741087 - RNA, 17 nt, Homo sapiens
acuugcuuccaagcccu

SEQ ID NO: 1741088 - RNA, 21 nt, Homo sapiens
acuuuuacauuuuucugaugg

SEQ ID NO: 1741089 - RNA, 18 nt, Homo sapiens
agaaaaccauucuggaca

SEQ ID NO: 1741090 - RNA, 15 nt, Homo sapiens
agaaagaugaaaacu

SEQ ID NO: 1741091 - RNA, 17 nt, Homo sapiens
agaaagcccugugcuuu

SEQ ID NO: 1741092 - RNA, 23 nt, Homo sapiens
agaauaaucuaaauucauacuca

SEQ ID NO: 1741093 - RNA, 21 nt, Homo sapiens
aaaaccauucuggacacuguc

SEQ ID NO: 1741094 - RNA, 18 nt, Homo sapiens
aaaaggaggcucuucuca

SEQ ID NO: 1741095 - RNA, 16 nt, Homo sapiens
aaaauaaaggcucugu

SEQ ID NO: 1741096 - RNA, 12 nt, Homo sapiens
aaacaauucuga

SEQ ID NO: 1741097 - RNA, 16 nt, Homo sapiens
aaaccaaacucugugu

SEQ ID NO: 1741098 - RNA, 15 nt, Homo sapiens
aaaccucuuucccca

SEQ ID NO: 1741099 - RNA, 19 nt, Homo sapiens
aaacggguggugugucuca

SEQ ID NO: 1741100 - RNA, 14 nt, Homo sapiens
aaacuuauuucaag

SEQ ID NO: 1741101 - RNA, 12 nt, Homo sapiens
aaagaaaaccau

SEQ ID NO: 1741102 - RNA, 17 nt, Homo sapiens
aaaggcucugugcuuga

SEQ ID NO: 1741103 - RNA, 14 nt, Homo sapiens
aaaucauauucuca

SEQ ID NO: 1741104 - RNA, 11 nt, Homo sapiens
aaaucccaaag

SEQ ID NO: 1741105 - RNA, 10 nt, Homo sapiens
aaauguguac

SEQ ID NO: 1741106 - RNA, 16 nt, Homo sapiens
aaauguguacaggugu

SEQ ID NO: 1741107 - RNA, 21 nt, Homo sapiens
aacaaaaucacagcacccacu

SEQ ID NO: 1741108 - RNA, 21 nt, Homo sapiens
aacaaaauugacagcuuucua

SEQ ID NO: 1741109 - RNA, 16 nt, Homo sapiens
aacacuagacaugcca

SEQ ID NO: 1741110 - RNA, 13 nt, Homo sapiens
aaccauucuggac

SEQ ID NO: 1741111 - RNA, 12 nt, Homo sapiens
aaccucacugcc

SEQ ID NO: 1741112 - RNA, 15 nt, Homo sapiens
aaccucacugccuca

SEQ ID NO: 1741113 - RNA, 12 nt, Homo sapiens
aacuuauuucaa

SEQ ID NO: 1741114 - RNA, 22 nt, Homo sapiens
aagaaaagcaguuugcacuuaa

SEQ ID NO: 1741115 - RNA, 12 nt, Homo sapiens
aagaccaucucu

SEQ ID NO: 1741116 - RNA, 16 nt, Homo sapiens
aagaccaucucucccu

SEQ ID NO: 1741117 - RNA, 13 nt, Homo sapiens
aagagccaucuga

SEQ ID NO: 1741118 - RNA, 17 nt, Homo sapiens
aagaugaaaacuuuuac

SEQ ID NO: 1741119 - RNA, 21 nt, Homo sapiens
aaggccuugcugucaugugaa

SEQ ID NO: 1741120 - RNA, 19 nt, Homo sapiens
aagugauggucauucauau

SEQ ID NO: 1741121 - RNA, 20 nt, Homo sapiens
aauacuagcuaacuaauucu

SEQ ID NO: 1741122 - RNA, 22 nt, Homo sapiens
aauacuagcuaacuaauucugu

SEQ ID NO: 1741123 - RNA, 15 nt, Homo sapiens
aaucuacacugccuu

SEQ ID NO: 1741124 - RNA, 13 nt, Homo sapiens
aauggucacagag

SEQ ID NO: 1741125 - RNA, 17 nt, Homo sapiens
aauucuaggcagcaccu

SEQ ID NO: 1741126 - RNA, 20 nt, Homo sapiens
aauuggccagggcaacaaua

SEQ ID NO: 1741127 - RNA, 18 nt, Homo sapiens
acaaucuacacugccuua

SEQ ID NO: 1741128 - RNA, 12 nt, Homo sapiens
acagauugccau

SEQ ID NO: 1741129 - RNA, 15 nt, Homo sapiens
acauauucaucagca

SEQ ID NO: 1741130 - RNA, 21 nt, Homo sapiens
acaugcugagucucccaaggc

SEQ ID NO: 1741131 - RNA, 15 nt, Homo sapiens
accacacacacaagg

SEQ ID NO: 1741132 - RNA, 23 nt, Homo sapiens
accacacacacaaggugcucaga

SEQ ID NO: 1741133 - RNA, 16 nt, Homo sapiens
accagcccacauccag

SEQ ID NO: 1741134 - RNA, 17 nt, Homo sapiens
accagcuccacuggccu

SEQ ID NO: 1741135 - RNA, 14 nt, Homo sapiens
accauacagacagc

SEQ ID NO: 1741136 - RNA, 13 nt, Homo sapiens
acccagccaaaca

SEQ ID NO: 1741137 - RNA, 20 nt, Homo sapiens
acccaugcccugccaagccu

SEQ ID NO: 1741138 - RNA, 17 nt, Homo sapiens
accccggugucaucccu

SEQ ID NO: 1741139 - RNA, 20 nt, Homo sapiens
accccuucucuguagcugcu

SEQ ID NO: 1741140 - RNA, 14 nt, Homo sapiens
acccuccuagccug

SEQ ID NO: 1741141 - RNA, 21 nt, Homo sapiens
acccuccuagccugcucugcc

SEQ ID NO: 1741142 - RNA, 15 nt, Homo sapiens
accucuaaaaaccaa

SEQ ID NO: 1741143 - RNA, 21 nt, Homo sapiens
aggagagcaucugcucugaga

SEQ ID NO: 1741144 - RNA, 20 nt, Homo sapiens
aggaggccugggagggcaag

SEQ ID NO: 1741145 - RNA, 15 nt, Homo sapiens
aggaugcacuggccu

SEQ ID NO: 1741146 - RNA, 23 nt, Homo sapiens
aggcugagacugcagaggagcca

SEQ ID NO: 1741147 - RNA, 13 nt, Homo sapiens
agggacaggagaa

SEQ ID NO: 1741148 - RNA, 14 nt, Homo sapiens
agggaccagguguc

SEQ ID NO: 1741149 - RNA, 16 nt, Homo sapiens
agggaggcccauguga

SEQ ID NO: 1741150 - RNA, 18 nt, Homo sapiens
agggcuugaaauguguac

SEQ ID NO: 1741151 - RNA, 22 nt, Homo sapiens
aggggcuuuggaagcucuguug

SEQ ID NO: 1741152 - RNA, 22 nt, Homo sapiens
agguccuggggaggcugagacu

SEQ ID NO: 1741153 - RNA, 18 nt, Homo sapiens
aggugggggagccuggag

SEQ ID NO: 1741154 - RNA, 18 nt, Homo sapiens
aguagccuuuccugauga

SEQ ID NO: 1741155 - RNA, 19 nt, Homo sapiens
agugccugaacauggcagu

SEQ ID NO: 1741156 - RNA, 15 nt, Homo sapiens
agugccuucagccaa

SEQ ID NO: 1741157 - RNA, 16 nt, Homo sapiens
agugcugguucuccaa

SEQ ID NO: 1741158 - RNA, 13 nt, Homo sapiens
aguggcagccaag

SEQ ID NO: 1741159 - RNA, 15 nt, Homo sapiens
aguggcagccaagag

SEQ ID NO: 1741160 - RNA, 21 nt, Homo sapiens
agugugcuaaccucacugccu

SEQ ID NO: 1741161 - RNA, 24 nt, Homo sapiens
agugugcuaaccucacugccucau

SEQ ID NO: 1741162 - RNA, 16 nt, Homo sapiens
aguguuaagugugcag

SEQ ID NO: 1741163 - RNA, 18 nt, Homo sapiens
auaaaggcucugugcuug

SEQ ID NO: 1741164 - RNA, 18 nt, Homo sapiens
auaagccccgaggccuag

SEQ ID NO: 1741165 - RNA, 17 nt, Homo sapiens
auaccucgaacaucagu

SEQ ID NO: 1741166 - RNA, 18 nt, Homo sapiens
aucaccucuaaaaaccaa

SEQ ID NO: 1741167 - RNA, 13 nt, Homo sapiens
aucagugugcuaa

SEQ ID NO: 1741168 - RNA, 23 nt, Homo sapiens
aucaucucuuuucccacucccuu

SEQ ID NO: 1741169 - RNA, 16 nt, Homo sapiens
auccauucucucugcc

SEQ ID NO: 1741170 - RNA, 18 nt, Homo sapiens
auccauucucucugccca

SEQ ID NO: 1741171 - RNA, 22 nt, Homo sapiens
auccuggaaggaaacugucugu

SEQ ID NO: 1741172 - RNA, 14 nt, Homo sapiens
aucgaagcucuguu

SEQ ID NO: 1741173 - RNA, 15 nt, Homo sapiens
aucugcucugagacg

SEQ ID NO: 1741174 - RNA, 14 nt, Homo sapiens
aucuuuuagcacau

SEQ ID NO: 1741175 - RNA, 19 nt, Homo sapiens
augaacuuggauauucaag

SEQ ID NO: 1741176 - RNA, 12 nt, Homo sapiens
augcacuggccu

SEQ ID NO: 1741177 - RNA, 15 nt, Homo sapiens
augccucgcucaguc

SEQ ID NO: 1741178 - RNA, 23 nt, Homo sapiens
augugugugcagaauucuaggca

SEQ ID NO: 1741179 - RNA, 18 nt, Homo sapiens
auuaccugucaucugggc

SEQ ID NO: 1741180 - RNA, 17 nt, Homo sapiens
auucucauggcuuuguu

SEQ ID NO: 1741181 - RNA, 22 nt, Homo sapiens
auucuguuagcugcucacuuaa

SEQ ID NO: 1741182 - RNA, 18 nt, Homo sapiens
auuucaagugauggucau

SEQ ID NO: 1741183 - RNA, 17 nt, Homo sapiens
caacaguguucugagcc

SEQ ID NO: 1741184 - RNA, 15 nt, Homo sapiens
caaggugggggagcc

SEQ ID NO: 1741185 - RNA, 17 nt, Homo sapiens
caagugauggucauuca

SEQ ID NO: 1741186 - RNA, 21 nt, Homo sapiens
caagugauggucauucauauc

SEQ ID NO: 1741187 - RNA, 13 nt, Homo sapiens
caaucuacacugc

SEQ ID NO: 1741188 - RNA, 16 nt, Homo sapiens
caaugccacccucauc

SEQ ID NO: 1741189 - RNA, 16 nt, Homo sapiens
caauguccucuuugag

SEQ ID NO: 1741190 - RNA, 19 nt, Homo sapiens
cacaccugucugugcagau

SEQ ID NO: 1741191 - RNA, 15 nt, Homo sapiens
cacagagcacuguag

SEQ ID NO: 1741192 - RNA, 23 nt, Homo sapiens
cacauaacaauaaaaaccaaacu

SEQ ID NO: 1741193 - RNA, 22 nt, Homo sapiens
cacaugauuaaugauuuagcuc

SEQ ID NO: 1741194 - RNA, 20 nt, Homo sapiens
cacaugcugagucucccaag

SEQ ID NO: 1741195 - RNA, 16 nt, Homo sapiens
caccucuaaaaaccaa

SEQ ID NO: 1741196 - RNA, 15 nt, Homo sapiens
cacugccucauggca

SEQ ID NO: 1741197 - RNA, 16 nt, Homo sapiens
cacugccucauggcau

SEQ ID NO: 1741198 - RNA, 20 nt, Homo sapiens
cacuuaaacaauguccucuu

SEQ ID NO: 1741199 - RNA, 14 nt, Homo sapiens
cagagacacguggc

SEQ ID NO: 1741200 - RNA, 14 nt, Homo sapiens
cagagggacuugag

SEQ ID NO: 1741201 - RNA, 15 nt, Homo sapiens
cagaugcuuugccca

SEQ ID NO: 1741202 - RNA, 23 nt, Homo sapiens
cagcaucuuugcccuucugguuu

SEQ ID NO: 1741203 - RNA, 15 nt, Homo sapiens
cagcuuucuaacuca

SEQ ID NO: 1741204 - RNA, 20 nt, Homo sapiens
caggaaggaacucaaggugg

SEQ ID NO: 1741205 - RNA, 21 nt, Homo sapiens
caggcagaggagaguaccccc

SEQ ID NO: 1741206 - RNA, 13 nt, Homo sapiens
caggcuucucacc

SEQ ID NO: 1741207 - RNA, 15 nt, Homo sapiens
caggugucaccauca

SEQ ID NO: 1741208 - RNA, 12 nt, Homo sapiens
caguuaccuuug

SEQ ID NO: 1741209 - RNA, 21 nt, Homo sapiens
cauacagacagcacaaggugg

SEQ ID NO: 1741210 - RNA, 9 nt, Homo sapiens
caucaucuc

SEQ ID NO: 1741211 - RNA, 20 nt, Homo sapiens
caugagugucaacuccagga

SEQ ID NO: 1741212 - RNA, 18 nt, Homo sapiens
caugauuaaugauuuagc

SEQ ID NO: 1741213 - RNA, 12 nt, Homo sapiens
caugucucugau

SEQ ID NO: 1741214 - RNA, 14 nt, Homo sapiens
cauguugacugucu

SEQ ID NO: 1741215 - RNA, 16 nt, Homo sapiens
cauucucucugcccaa

SEQ ID NO: 1741216 - RNA, 18 nt, Homo sapiens
ccaaacucugugucagca

SEQ ID NO: 1741217 - RNA, 17 nt, Homo sapiens
ccacgcccuggggagug

SEQ ID NO: 1741218 - RNA, 20 nt, Homo sapiens
ccaggccauaccaggugcua

SEQ ID NO: 1741219 - RNA, 19 nt, Homo sapiens
ccaggggucucccugagcc

SEQ ID NO: 1741220 - RNA, 17 nt, Homo sapiens
ccaguccucacaugccc

SEQ ID NO: 1741221 - RNA, 14 nt, Homo sapiens
ccaguuaucaguac

SEQ ID NO: 1741222 - RNA, 14 nt, Homo sapiens
ccauucucucugcc

SEQ ID NO: 1741223 - RNA, 13 nt, Homo sapiens
cccaaagugccuu

SEQ ID NO: 1741224 - RNA, 21 nt, Homo sapiens
cccaacuccaaacaauucuga

SEQ ID NO: 1741225 - RNA, 15 nt, Homo sapiens
cccacauccaguggg

SEQ ID NO: 1741226 - RNA, 15 nt, Homo sapiens
cccggugucaucccu

SEQ ID NO: 1741227 - RNA, 14 nt, Homo sapiens
cccugauguggcau

SEQ ID NO: 1741228 - RNA, 15 nt, Homo sapiens
ccuagccugcucugc

SEQ ID NO: 1741229 - RNA, 16 nt, Homo sapiens
ccuagccugcucugcc

SEQ ID NO: 1741230 - RNA, 21 nt, Homo sapiens
ccucaucuuugacguggagcu

SEQ ID NO: 1741231 - RNA, 21 nt, Homo sapiens
ccucauggcaucauccauucu

SEQ ID NO: 1741232 - RNA, 20 nt, Homo sapiens
ccucgcucagucagugcacu

SEQ ID NO: 1741233 - RNA, 21 nt, Homo sapiens
ccugauguggcauauggagcc

SEQ ID NO: 1741234 - RNA, 16 nt, Homo sapiens
ccugcaccccugaugu

SEQ ID NO: 1741235 - RNA, 20 nt, Homo sapiens
ccuggugggcucaaccacac

SEQ ID NO: 1741236 - RNA, 17 nt, Homo sapiens
ccuguccccucagcucc

SEQ ID NO: 1741237 - RNA, 18 nt, Homo sapiens
ccuguuccucccaagagg

SEQ ID NO: 1741238 - RNA, 19 nt, Homo sapiens
ccuucacagagacacgugg

SEQ ID NO: 1741239 - RNA, 12 nt, Homo sapiens
ccuucacuuaaa

SEQ ID NO: 1741240 - RNA, 14 nt, Homo sapiens
ccuuuuaaucagag

SEQ ID NO: 1741241 - RNA, 14 nt, Homo sapiens
cuaacuaauucugu

SEQ ID NO: 1741242 - RNA, 16 nt, Homo sapiens
cuaacuaauucuguca

SEQ ID NO: 1741243 - RNA, 12 nt, Homo sapiens
cuacacugccuu

SEQ ID NO: 1741244 - RNA, 19 nt, Homo sapiens
cuacgagaccuucacagag

SEQ ID NO: 1741245 - RNA, 14 nt, Homo sapiens
cuagcuaacuaauu

SEQ ID NO: 1741246 - RNA, 12 nt, Homo sapiens
cucacauauuca

SEQ ID NO: 1741247 - RNA, 23 nt, Homo sapiens
cucaguccaguccucacaugccc

SEQ ID NO: 1741248 - RNA, 17 nt, Homo sapiens
cucaucuuugacgugga

SEQ ID NO: 1741249 - RNA, 21 nt, Homo sapiens
ccaccauuccuggaaaccaca

SEQ ID NO: 1741250 - RNA, 21 nt, Homo sapiens
ccaccucugaggacucuggac

SEQ ID NO: 1741251 - RNA, 13 nt, Homo sapiens
ccaccugccugac

SEQ ID NO: 1741252 - RNA, 16 nt, Homo sapiens
ccagcuccacuggccu

SEQ ID NO: 1741253 - RNA, 21 nt, Homo sapiens
ccaucaagggucauggcagug

SEQ ID NO: 1741254 - RNA, 11 nt, Homo sapiens
ccaucaucucu

SEQ ID NO: 1741255 - RNA, 18 nt, Homo sapiens
cccaccagcccacaucca

SEQ ID NO: 1741256 - RNA, 15 nt, Homo sapiens
cccagccucuuuauu

SEQ ID NO: 1741257 - RNA, 16 nt, Homo sapiens
cccauguugacugucu

SEQ ID NO: 1741258 - RNA, 15 nt, Homo sapiens
cccuacaccucuggg

SEQ ID NO: 1741259 - RNA, 13 nt, Homo sapiens
cccucccaaugcc

SEQ ID NO: 1741260 - RNA, 22 nt, Homo sapiens
cccugagccugccccagcuggg

SEQ ID NO: 1741261 - RNA, 16 nt, Homo sapiens
cccugauuaaagugcc

SEQ ID NO: 1741262 - RNA, 19 nt, Homo sapiens
cccuucugguuuaaacgcc

SEQ ID NO: 1741263 - RNA, 14 nt, Homo sapiens
ccucuaaaaaccaa

SEQ ID NO: 1741264 - RNA, 22 nt, Homo sapiens
ccugaacauggcagucuagggu

SEQ ID NO: 1741265 - RNA, 19 nt, Homo sapiens
ccugaugacagaacacaga

SEQ ID NO: 1741266 - RNA, 13 nt, Homo sapiens
ccuggaaaccaca

SEQ ID NO: 1741267 - RNA, 19 nt, Homo sapiens
ccuggugggcucaaccaca

SEQ ID NO: 1741268 - RNA, 16 nt, Homo sapiens
ccuguccccucagcuc

SEQ ID NO: 1741269 - RNA, 14 nt, Homo sapiens
ccugucugugcaga

SEQ ID NO: 1741270 - RNA, 18 nt, Homo sapiens
ccuuuggauggcuaugga

SEQ ID NO: 1741271 - RNA, 15 nt, Homo sapiens
cgaagcugaccugca

SEQ ID NO: 1741272 - RNA, 20 nt, Homo sapiens
cgaggugguagcucugagcc

SEQ ID NO: 1741273 - RNA, 17 nt, Homo sapiens
cggcacuggguuugcuc

SEQ ID NO: 1741274 - RNA, 21 nt, Homo sapiens
cguaggggagggguugccaca

SEQ ID NO: 1741275 - RNA, 22 nt, Homo sapiens
cgucaggagcagcaucauucag

SEQ ID NO: 1741276 - RNA, 16 nt, Homo sapiens
cuaaccucacugccuc

SEQ ID NO: 1741277 - RNA, 14 nt, Homo sapiens
cuaacucacaggca

SEQ ID NO: 1741278 - RNA, 20 nt, Homo sapiens
cuaggaguuaacuacccuac

SEQ ID NO: 1741279 - RNA, 22 nt, Homo sapiens
cucaaacagccacgagguggua

SEQ ID NO: 1741280 - RNA, 20 nt, Homo sapiens
cucaauaccccuaguaucug

SEQ ID NO: 1741281 - RNA, 18 nt, Homo sapiens
cucacuuaaacaaugucc

SEQ ID NO: 1741282 - RNA, 18 nt, Homo sapiens
cucagacaugaaauguac

SEQ ID NO: 1741283 - RNA, 15 nt, Homo sapiens
cucagucagugcacu

SEQ ID NO: 1741284 - RNA, 14 nt, Homo sapiens
cuccaacagagugg

SEQ ID NO: 1741285 - RNA, 20 nt, Homo sapiens
cuccguucccaccucugagg

SEQ ID NO: 1741286 - RNA, 12 nt, Homo sapiens
cucucugcccaa

SEQ ID NO: 1741287 - RNA, 23 nt, Homo sapiens
cucugugucagcaucuuugcccu

SEQ ID NO: 1741288 - RNA, 19 nt, Homo sapiens
cugaagccaccucucugcc

SEQ ID NO: 1741289 - RNA, 19 nt, Homo sapiens
cugaugacagaacacagau

SEQ ID NO: 1741290 - RNA, 22 nt, Homo sapiens
cugaugcccugaggcacugaaa

SEQ ID NO: 1741291 - RNA, 15 nt, Homo sapiens
cugcaccccugaugu

SEQ ID NO: 1741292 - RNA, 17 nt, Homo sapiens
cugcccuugucugagau

SEQ ID NO: 1741293 - RNA, 13 nt, Homo sapiens
ugauggucauuca

SEQ ID NO: 1741294 - RNA, 17 nt, Homo sapiens
ugauuuagcucccucca

SEQ ID NO: 1741295 - RNA, 17 nt, Homo sapiens
ugcacccagccaaacac

SEQ ID NO: 1741296 - RNA, 19 nt, Homo sapiens
ugcauuuugugugaugcau

SEQ ID NO: 1741297 - RNA, 14 nt, Homo sapiens
ugccccagcugggc

SEQ ID NO: 1741298 - RNA, 15 nt, Homo sapiens
ugccugaacauggca

SEQ ID NO: 1741299 - RNA, 15 nt, Homo sapiens
ugccuucagccaaga

SEQ ID NO: 1741300 - RNA, 20 nt, Homo sapiens
ugcgaauucuugcuugagga

SEQ ID NO: 1741301 - RNA, 14 nt, Homo sapiens
ugcucccugauuaa

SEQ ID NO: 1741302 - RNA, 17 nt, Homo sapiens
ugcuuccaagcccuucc

SEQ ID NO: 1741303 - RNA, 15 nt, Homo sapiens
uggaaagaaaaccau

SEQ ID NO: 1741304 - RNA, 17 nt, Homo sapiens
uggacccccagcuuugc

SEQ ID NO: 1741305 - RNA, 19 nt, Homo sapiens
uggagauggcugcugcuca

SEQ ID NO: 1741306 - RNA, 13 nt, Homo sapiens
uggagcugcucaa

SEQ ID NO: 1741307 - RNA, 22 nt, Homo sapiens
uggaguguaauuaccugucauc

SEQ ID NO: 1741308 - RNA, 13 nt, Homo sapiens
uggcaagucucac

SEQ ID NO: 1741309 - RNA, 16 nt, Homo sapiens
uggcagccaagagcca

SEQ ID NO: 1741310 - RNA, 21 nt, Homo sapiens
uggcagucuagggugaacaau

SEQ ID NO: 1741311 - RNA, 23 nt, Homo sapiens
uggccagggguggugagggcagu

SEQ ID NO: 1741312 - RNA, 15 nt, Homo sapiens
ugggggaaaacuaga

SEQ ID NO: 1741313 - RNA, 16 nt, Homo sapiens
uggucauucauaucac

SEQ ID NO: 1741314 - RNA, 19 nt, Homo sapiens
uggugagggcaguucugca

SEQ ID NO: 1741315 - RNA, 14 nt, Homo sapiens
uguacaggugucac

SEQ ID NO: 1741316 - RNA, 21 nt, Homo sapiens
uguaguagccuuuccugauga

SEQ ID NO: 1741317 - RNA, 19 nt, Homo sapiens
ugucacuuucucucuuaua

SEQ ID NO: 1741318 - RNA, 24 nt, Homo sapiens
ugucuaauggucacagagcacugu

SEQ ID NO: 1741319 - RNA, 11 nt, Homo sapiens
ugucugagaug

SEQ ID NO: 1741320 - RNA, 22 nt, Homo sapiens
ugugcuaaccucacugccucau

SEQ ID NO: 1741321 - RNA, 20 nt, Homo sapiens
uguguaagacacugugcaaa

SEQ ID NO: 1741322 - RNA, 13 nt, Homo sapiens
ugugugugcagaa

SEQ ID NO: 1741323 - RNA, 18 nt, Homo sapiens
uguuagcugcucacuuaa

SEQ ID NO: 1741324 - RNA, 22 nt, Homo sapiens
uguucgcacaaucuacacugcc

SEQ ID NO: 1741325 - RNA, 15 nt, Homo sapiens
uuaaacuuauuucaa

SEQ ID NO: 1741326 - RNA, 12 nt, Homo sapiens
uuaaagugccuu

SEQ ID NO: 1741327 - RNA, 13 nt, Homo sapiens
uuaaugauuuagc

SEQ ID NO: 1741328 - RNA, 17 nt, Homo sapiens
uuagauuaaagauugcu

SEQ ID NO: 1741329 - RNA, 16 nt, Homo sapiens
uucacagagacacgug

SEQ ID NO: 1741330 - RNA, 14 nt, Homo sapiens
uucagccaagacca

SEQ ID NO: 1741331 - RNA, 22 nt, Homo sapiens
uucgcacaaucuacacugccuu

SEQ ID NO: 1741332 - RNA, 11 nt, Homo sapiens
uucucauggcu

SEQ ID NO: 1741333 - RNA, 12 nt, Homo sapiens
uucucucugccc

SEQ ID NO: 1741334 - RNA, 21 nt, Homo sapiens
uucugauggguucaugucucu

SEQ ID NO: 1741335 - RNA, 17 nt, Homo sapiens
uucuggaaagaaaacca

SEQ ID NO: 1741336 - RNA, 14 nt, Homo sapiens
uucuggacacuguc

SEQ ID NO: 1741337 - RNA, 23 nt, Homo sapiens
uucugggagcaucgaagcucugu

SEQ ID NO: 1741338 - RNA, 17 nt, Homo sapiens
ccuggcucccaagggag

SEQ ID NO: 1741339 - RNA, 22 nt, Homo sapiens
ccugggcugggagaaggugcuu

SEQ ID NO: 1741340 - RNA, 22 nt, Homo sapiens
ccuucaaaaagcaaucuggaag

SEQ ID NO: 1741341 - RNA, 18 nt, Homo sapiens
ccuucagccaagaccauc

SEQ ID NO: 1741342 - RNA, 13 nt, Homo sapiens
ccuuuccugauga

SEQ ID NO: 1741343 - RNA, 21 nt, Homo sapiens
ccuuugcugucacuuucucuc

SEQ ID NO: 1741344 - RNA, 14 nt, Homo sapiens
ccuuuggauggcua

SEQ ID NO: 1741345 - RNA, 13 nt, Homo sapiens
cgaauucuugcuu

SEQ ID NO: 1741346 - RNA, 19 nt, Homo sapiens
cgagaccuucacagagaca

SEQ ID NO: 1741347 - RNA, 19 nt, Homo sapiens
cgaggugguagcucugagc

SEQ ID NO: 1741348 - RNA, 19 nt, Homo sapiens
cggcacuggguuugcuccc

SEQ ID NO: 1741349 - RNA, 17 nt, Homo sapiens
cguucccaccucugagg

SEQ ID NO: 1741350 - RNA, 15 nt, Homo sapiens
cuaauggucacagag

SEQ ID NO: 1741351 - RNA, 17 nt, Homo sapiens
cuaauggucacagagca

SEQ ID NO: 1741352 - RNA, 15 nt, Homo sapiens
cuagauuuaucagag

SEQ ID NO: 1741353 - RNA, 18 nt, Homo sapiens
cuagccugcucugccacu

SEQ ID NO: 1741354 - RNA, 23 nt, Homo sapiens
cuaggacuuuagggaucugggga

SEQ ID NO: 1741355 - RNA, 20 nt, Homo sapiens
cuaugcagaagauacgugca

SEQ ID NO: 1741356 - RNA, 20 nt, Homo sapiens
cucacaggcauagagugacc

SEQ ID NO: 1741357 - RNA, 21 nt, Homo sapiens
cucaccacgguguaccgggau

SEQ ID NO: 1741358 - RNA, 14 nt, Homo sapiens
cucaguguugacug

SEQ ID NO: 1741359 - RNA, 16 nt, Homo sapiens
cuccaaacaauucuga

SEQ ID NO: 1741360 - RNA, 22 nt, Homo sapiens
cucccaagggaggcccauguga

SEQ ID NO: 1741361 - RNA, 14 nt, Homo sapiens
cuccuugcccuggg

SEQ ID NO: 1741362 - RNA, 20 nt, Homo sapiens
cuccuuucccuuuuccauca

SEQ ID NO: 1741363 - RNA, 16 nt, Homo sapiens
cucucuuauaaauucu

SEQ ID NO: 1741364 - RNA, 20 nt, Homo sapiens
cucucuuuguucucagcucc

SEQ ID NO: 1741365 - RNA, 21 nt, Homo sapiens
cucugauugggucagcuggcu

SEQ ID NO: 1741366 - RNA, 21 nt, Homo sapiens
cucuguagcugcuagugagcc

SEQ ID NO: 1741367 - RNA, 14 nt, Homo sapiens
cucuugaucagugu

SEQ ID NO: 1741368 - RNA, 18 nt, Homo sapiens
cucuugaucagugugcua

SEQ ID NO: 1741369 - RNA, 19 nt, Homo sapiens
cucuugaucagugugcuaa

SEQ ID NO: 1741370 - RNA, 18 nt, Homo sapiens
cucuuuguucucagcucc

SEQ ID NO: 1741371 - RNA, 18 nt, Homo sapiens
cucuuuucccacucccuu

SEQ ID NO: 1741372 - RNA, 16 nt, Homo sapiens
cugaagagauacccac

SEQ ID NO: 1741373 - RNA, 23 nt, Homo sapiens
cugagcccuccuucuugcccuga

SEQ ID NO: 1741374 - RNA, 17 nt, Homo sapiens
cugauggguucaugucu

SEQ ID NO: 1741375 - RNA, 22 nt, Homo sapiens
cugcagcaggcagaggagagua

SEQ ID NO: 1741376 - RNA, 21 nt, Homo sapiens
cugccuguuccucccaagagg

SEQ ID NO: 1741377 - RNA, 20 nt, Homo sapiens
cuggagauggcugcugcuca

SEQ ID NO: 1741378 - RNA, 15 nt, Homo sapiens
cuggagccccugugu

SEQ ID NO: 1741379 - RNA, 14 nt, Homo sapiens
cugggccaccagcu

SEQ ID NO: 1741380 - RNA, 15 nt, Homo sapiens
cuggggaaggaccaa

SEQ ID NO: 1741381 - RNA, 13 nt, Homo sapiens
cuguagcacuuaa

SEQ ID NO: 1741382 - RNA, 16 nt, Homo sapiens
cuguccccucagcucc

SEQ ID NO: 1741383 - RNA, 14 nt, Homo sapiens
cugucugugcagau

SEQ ID NO: 1741384 - RNA, 21 nt, Homo sapiens
cuuaaacaauguccucuuuga

SEQ ID NO: 1741385 - RNA, 16 nt, Homo sapiens
cuuagauugauuuugu

SEQ ID NO: 1741386 - RNA, 20 nt, Homo sapiens
cuuauaaaucauauucucau

SEQ ID NO: 1741387 - RNA, 22 nt, Homo sapiens
cuuauaaauucuguuagcugcu

SEQ ID NO: 1741388 - RNA, 20 nt, Homo sapiens
cuuauuucaagugaugguca

SEQ ID NO: 1741389 - RNA, 22 nt, Homo sapiens
cuucgaauuaguuugcacuucc

SEQ ID NO: 1741390 - RNA, 15 nt, Homo sapiens
cuugcccugagcuuu

SEQ ID NO: 1741391 - RNA, 15 nt, Homo sapiens
cuuugacguggagcu

SEQ ID NO: 1741392 - RNA, 18 nt, Homo sapiens
cuuugacguggagcugcu

SEQ ID NO: 1741393 - RNA, 22 nt, Homo sapiens
cuuugacguggagcugcucaac

SEQ ID NO: 1741394 - RNA, 20 nt, Homo sapiens
cuuuguuaaacuuauuucaa

SEQ ID NO: 1741395 - RNA, 12 nt, Homo sapiens
cuuuuagcacau

SEQ ID NO: 1741396 - RNA, 18 nt, Homo sapiens
gaaaauguaaaauaaagg

SEQ ID NO: 1741397 - RNA, 17 nt, Homo sapiens
gaaacauuuugcugauu

SEQ ID NO: 1741398 - RNA, 14 nt, Homo sapiens
gaaagaaaaccauu

SEQ ID NO: 1741399 - RNA, 17 nt, Homo sapiens
gaaagcccugugcuuug

SEQ ID NO: 1741400 - RNA, 17 nt, Homo sapiens
gaacacuagacaugcca

SEQ ID NO: 1741401 - RNA, 22 nt, Homo sapiens
gaagcaaacuuauaaaucauau

SEQ ID NO: 1741402 - RNA, 22 nt, Homo sapiens
gaagcauuucagguugugcauu

SEQ ID NO: 1741403 - RNA, 14 nt, Homo sapiens
gaagccaccucucu

SEQ ID NO: 1741404 - RNA, 22 nt, Homo sapiens
gaagccugcccuugucugagau

SEQ ID NO: 1741405 - RNA, 20 nt, Homo sapiens
gaaggaacucaagguggcug

SEQ ID NO: 1741406 - RNA, 22 nt, Homo sapiens
gaaggccuugcugucaugugaa

SEQ ID NO: 1741407 - RNA, 21 nt, Homo sapiens
gaagguagagcccacugcuca

SEQ ID NO: 1741408 - RNA, 17 nt, Homo sapiens
gaauaccccuucucugu

SEQ ID NO: 1741409 - RNA, 21 nt, Homo sapiens
gaauucuaggcagcaccuuag

SEQ ID NO: 1741410 - RNA, 20 nt, Homo sapiens
gacaaacuccggcacugggu

SEQ ID NO: 1741411 - RNA, 18 nt, Homo sapiens
gacguggagcugcucaac

SEQ ID NO: 1741412 - RNA, 23 nt, Homo sapiens
gacugcagaggagccaccugggc

SEQ ID NO: 1741413 - RNA, 18 nt, Homo sapiens
gacuuuagggaucugggg

SEQ ID NO: 1741414 - RNA, 14 nt, Homo sapiens
gagacuaaagacug

SEQ ID NO: 1741415 - RNA, 18 nt, Homo sapiens
gagcacuguagcacuuaa

SEQ ID NO: 1741416 - RNA, 16 nt, Homo sapiens
gagcaucgaagcucug

SEQ ID NO: 1741417 - RNA, 17 nt, Homo sapiens
gagcaucgaagcucugu

SEQ ID NO: 1741418 - RNA, 22 nt, Homo sapiens
gagcuuggugcgguaggugcug

SEQ ID NO: 1741419 - RNA, 22 nt, Homo sapiens
gaggagaacacuagacaugcca

SEQ ID NO: 1741420 - RNA, 14 nt, Homo sapiens
gaggcccaugugac

SEQ ID NO: 1741421 - RNA, 20 nt, Homo sapiens
gagggcgaagcugaccugca

SEQ ID NO: 1741422 - RNA, 18 nt, Homo sapiens
gaguugaccuucugaaca

SEQ ID NO: 1741423 - RNA, 13 nt, Homo sapiens
gaugcacuggccu

SEQ ID NO: 1741424 - RNA, 20 nt, Homo sapiens
gaugcauguaguagccuuuc

SEQ ID NO: 1741425 - RNA, 22 nt, Homo sapiens
gaugggccaccgccgacuuugu

SEQ ID NO: 1741426 - RNA, 11 nt, Homo sapiens
gauguggcaua

SEQ ID NO: 1741427 - RNA, 15 nt, Homo sapiens
gauuaaagauugcuu

SEQ ID NO: 1741428 - RNA, 16 nt, Homo sapiens
gcaaucuggaagaaag

SEQ ID NO: 1741429 - RNA, 20 nt, Homo sapiens
gcaauucugccccacaccca

SEQ ID NO: 1741430 - RNA, 17 nt, Homo sapiens
gcacaaucuacacugcc

SEQ ID NO: 1741431 - RNA, 20 nt, Homo sapiens
gcacaaucuacacugccuua

SEQ ID NO: 1741432 - RNA, 21 nt, Homo sapiens
gcacuggguuugcucccugau

SEQ ID NO: 1741433 - RNA, 18 nt, Homo sapiens
gcagaagauacgugcaug

SEQ ID NO: 1741434 - RNA, 13 nt, Homo sapiens
gcagcaagcaauu

SEQ ID NO: 1741435 - RNA, 13 nt, Homo sapiens
gcagcaucauuca

SEQ ID NO: 1741436 - RNA, 15 nt, Homo sapiens
gcagccccaggacca

SEQ ID NO: 1741437 - RNA, 20 nt, Homo sapiens
gcagccccaggaccaagcuu

SEQ ID NO: 1741438 - RNA, 18 nt, Homo sapiens
gcaguucugcacccagcc

SEQ ID NO: 1741439 - RNA, 22 nt, Homo sapiens
gcaguucugcacccagccaaac

SEQ ID NO: 1741440 - RNA, 15 nt, Homo sapiens
gcaucauucagcaaa

SEQ ID NO: 1741441 - RNA, 13 nt, Homo sapiens
gcaucuuugcccu

SEQ ID NO: 1741442 - RNA, 22 nt, Homo sapiens
ucuuugacguggagcugcucaa

SEQ ID NO: 1741443 - RNA, 17 nt, Homo sapiens
ugaaaauagagcaauac

SEQ ID NO: 1741444 - RNA, 15 nt, Homo sapiens
ugacagaacacagau

SEQ ID NO: 1741445 - RNA, 20 nt, Homo sapiens
ugacagcuuucuaacucaca

SEQ ID NO: 1741446 - RNA, 16 nt, Homo sapiens
ugaccuuuuaaucaga

SEQ ID NO: 1741447 - RNA, 21 nt, Homo sapiens
ugacuguaggcgccccugggg

SEQ ID NO: 1741448 - RNA, 12 nt, Homo sapiens
ugaggacucugg

SEQ ID NO: 1741449 - RNA, 21 nt, Homo sapiens
ugagggcaguucugcacccag

SEQ ID NO: 1741450 - RNA, 16 nt, Homo sapiens
ugauuaaagugccuuc

SEQ ID NO: 1741451 - RNA, 21 nt, Homo sapiens
ugauuaaugauuuagcucccu

SEQ ID NO: 1741452 - RNA, 20 nt, Homo sapiens
ugcaccccugauguggcaua

SEQ ID NO: 1741453 - RNA, 20 nt, Homo sapiens
ugcauuuugugugaugcaug

SEQ ID NO: 1741454 - RNA, 23 nt, Homo sapiens
ugccaagccuggagccccugugu

SEQ ID NO: 1741455 - RNA, 18 nt, Homo sapiens
ugccucauggcaucaucc

SEQ ID NO: 1741456 - RNA, 11 nt, Homo sapiens
ugccuuaccuu

SEQ ID NO: 1741457 - RNA, 18 nt, Homo sapiens
ugccuucugagcugucua

SEQ ID NO: 1741458 - RNA, 15 nt, Homo sapiens
ugcgguaggugcugg

SEQ ID NO: 1741459 - RNA, 18 nt, Homo sapiens
ugcuagugagccuuccca

SEQ ID NO: 1741460 - RNA, 22 nt, Homo sapiens
ugcucagacaugaaauguacau

SEQ ID NO: 1741461 - RNA, 16 nt, Homo sapiens
uggaagcaaacuuaua

SEQ ID NO: 1741462 - RNA, 21 nt, Homo sapiens
uggaauacuagcuaacuaauu

SEQ ID NO: 1741463 - RNA, 12 nt, Homo sapiens
uggacacuguca

SEQ ID NO: 1741464 - RNA, 14 nt, Homo sapiens
uggagcugcucaac

SEQ ID NO: 1741465 - RNA, 14 nt, Homo sapiens
uggcugcugcucac

SEQ ID NO: 1741466 - RNA, 19 nt, Homo sapiens
uggcuuuguuaaacuuauu

SEQ ID NO: 1741467 - RNA, 15 nt, Homo sapiens
ugggagaaggugcuu

SEQ ID NO: 1741468 - RNA, 23 nt, Homo sapiens
ugggggaaggccuugcugucaug

SEQ ID NO: 1741469 - RNA, 15 nt, Homo sapiens
ugggggaggcucuga

SEQ ID NO: 1741470 - RNA, 14 nt, Homo sapiens
ugguagcucugagc

SEQ ID NO: 1741471 - RNA, 15 nt, Homo sapiens
uggucauucauauca

SEQ ID NO: 1741472 - RNA, 12 nt, Homo sapiens
uguagcacuuaa

SEQ ID NO: 1741473 - RNA, 23 nt, Homo sapiens
uguauguguucgucaguguucau

SEQ ID NO: 1741474 - RNA, 17 nt, Homo sapiens
ugucagcaucuuugccc

SEQ ID NO: 1741475 - RNA, 13 nt, Homo sapiens
ugugaauugccag

SEQ ID NO: 1741476 - RNA, 22 nt, Homo sapiens
ugugcaguauaauuuucuaauu

SEQ ID NO: 1741477 - RNA, 17 nt, Homo sapiens
uguuaaacuuauuucaa

SEQ ID NO: 1741478 - RNA, 14 nt, Homo sapiens
uguuagcugcucac

SEQ ID NO: 1741479 - RNA, 18 nt, Homo sapiens
uguucgcacaaucuacac

SEQ ID NO: 1741480 - RNA, 21 nt, Homo sapiens
uguugacugucuugacuguca

SEQ ID NO: 1741481 - RNA, 21 nt, Homo sapiens
uguuuacagggagccuccugc

SEQ ID NO: 1741482 - RNA, 22 nt, Homo sapiens
uuaaaccacacacacaaggugc

SEQ ID NO: 1741483 - RNA, 16 nt, Homo sapiens
uuaaagauugcuuuau

SEQ ID NO: 1741484 - RNA, 12 nt, Homo sapiens
uuaagugugcag

SEQ ID NO: 1741485 - RNA, 13 nt, Homo sapiens
uuaccuucacuua

SEQ ID NO: 1741486 - RNA, 15 nt, Homo sapiens
uuaccuucacuuaaa

SEQ ID NO: 1741487 - RNA, 19 nt, Homo sapiens
uuagagaaggcucagccuu

SEQ ID NO: 1741488 - RNA, 13 nt, Homo sapiens
uuaggaaacuggg

SEQ ID NO: 1741489 - RNA, 19 nt, Homo sapiens
uuaguguuaagugugcagu

SEQ ID NO: 1741490 - RNA, 15 nt, Homo sapiens
uucagcaaaugccuu

SEQ ID NO: 1741491 - RNA, 15 nt, Homo sapiens
uucagguugugcauu

SEQ ID NO: 1741492 - RNA, 12 nt, Homo sapiens
uuccugaugaca

SEQ ID NO: 1741493 - RNA, 21 nt, Homo sapiens
uucgcacaaucuacacugccu

SEQ ID NO: 1741494 - RNA, 17 nt, Homo sapiens
uucucugcucucuugga

SEQ ID NO: 1741495 - RNA, 20 nt, Homo sapiens
uucucuguagcugcuaguga

SEQ ID NO: 1741496 - RNA, 21 nt, Homo sapiens
uucuggaaagaaaaccauucu

SEQ ID NO: 1741497 - RNA, 21 nt, Homo sapiens
uucuguuagcugcucacuuaa

SEQ ID NO: 1741498 - RNA, 22 nt, Homo sapiens
uugcagguguccgggggucuag

SEQ ID NO: 1741499 - RNA, 23 nt, Homo sapiens
uugcucccugauuaaagugccuu

SEQ ID NO: 1741500 - RNA, 17 nt, Homo sapiens
uuuacauuuuucugaug

SEQ ID NO: 1741501 - RNA, 15 nt, Homo sapiens
uuuagcucccuccau

SEQ ID NO: 1741502 - RNA, 15 nt, Homo sapiens
uuuauccagcaguca

SEQ ID NO: 1741503 - RNA, 20 nt, Homo sapiens
cucauggcaucauccauucu

SEQ ID NO: 1741504 - RNA, 14 nt, Homo sapiens
cuccacgcccuggg

SEQ ID NO: 1741505 - RNA, 19 nt, Homo sapiens
cuccauaccucgaacauca

SEQ ID NO: 1741506 - RNA, 17 nt, Homo sapiens
cuccccgccuguucccc

SEQ ID NO: 1741507 - RNA, 20 nt, Homo sapiens
cucccugauuaaagugccuu

SEQ ID NO: 1741508 - RNA, 13 nt, Homo sapiens
cuccuagccugcu

SEQ ID NO: 1741509 - RNA, 15 nt, Homo sapiens
cuccuucuugcccug

SEQ ID NO: 1741510 - RNA, 22 nt, Homo sapiens
cugaacauggcagucuagggug

SEQ ID NO: 1741511 - RNA, 22 nt, Homo sapiens
cugaagaauaaucuaaauucau

SEQ ID NO: 1741512 - RNA, 20 nt, Homo sapiens
cugagcccccaccugccuga

SEQ ID NO: 1741513 - RNA, 22 nt, Homo sapiens
cugcacccagccaaacacauaa

SEQ ID NO: 1741514 - RNA, 12 nt, Homo sapiens
cugccacuggga

SEQ ID NO: 1741515 - RNA, 18 nt, Homo sapiens
cugcccuugucugagaug

SEQ ID NO: 1741516 - RNA, 12 nt, Homo sapiens
cugcucacuuaa

SEQ ID NO: 1741517 - RNA, 17 nt, Homo sapiens
cugcucacuuaaacaau

SEQ ID NO: 1741518 - RNA, 23 nt, Homo sapiens
cugcucacuuaaacaauguccuc

SEQ ID NO: 1741519 - RNA, 17 nt, Homo sapiens
cugcucuccuugcccug

SEQ ID NO: 1741520 - RNA, 13 nt, Homo sapiens
cugcuucuccagc

SEQ ID NO: 1741521 - RNA, 20 nt, Homo sapiens
cugcuuuuggggcucuugau

SEQ ID NO: 1741522 - RNA, 16 nt, Homo sapiens
cuggaccaucaagggu

SEQ ID NO: 1741523 - RNA, 21 nt, Homo sapiens
cuggacccccagcuuugccca

SEQ ID NO: 1741524 - RNA, 16 nt, Homo sapiens
cuggggagugagcuug

SEQ ID NO: 1741525 - RNA, 15 nt, Homo sapiens
cugucauuaaacuca

SEQ ID NO: 1741526 - RNA, 14 nt, Homo sapiens
cuucaaaaagcaau

SEQ ID NO: 1741527 - RNA, 15 nt, Homo sapiens
cuugaucagugugcu

SEQ ID NO: 1741528 - RNA, 18 nt, Homo sapiens
cuugaucagugugcuaac

SEQ ID NO: 1741529 - RNA, 19 nt, Homo sapiens
cuugaucagugugcuaacc

SEQ ID NO: 1741530 - RNA, 19 nt, Homo sapiens
cuuuccucucuuuguucuc

SEQ ID NO: 1741531 - RNA, 16 nt, Homo sapiens
cuuugcccaacaccag

SEQ ID NO: 1741532 - RNA, 16 nt, Homo sapiens
cuuugcugucacuuuc

SEQ ID NO: 1741533 - RNA, 18 nt, Homo sapiens
gaaaauagagcaauacuu

SEQ ID NO: 1741534 - RNA, 15 nt, Homo sapiens
gaaauguacauggcg

SEQ ID NO: 1741535 - RNA, 16 nt, Homo sapiens
gaagauacgugcauga

SEQ ID NO: 1741536 - RNA, 21 nt, Homo sapiens
gaagcauuucagguugugcau

SEQ ID NO: 1741537 - RNA, 22 nt, Homo sapiens
gacaccaguugcgaagggaaau

SEQ ID NO: 1741538 - RNA, 13 nt, Homo sapiens
gacucaguguuga

SEQ ID NO: 1741539 - RNA, 14 nt, Homo sapiens
gagaacacuagaca

SEQ ID NO: 1741540 - RNA, 17 nt, Homo sapiens
gagauggcugcugcuca

SEQ ID NO: 1741541 - RNA, 18 nt, Homo sapiens
gagcccagggaagacaca

SEQ ID NO: 1741542 - RNA, 18 nt, Homo sapiens
gagcuuggggcagagggc

SEQ ID NO: 1741543 - RNA, 19 nt, Homo sapiens
gaggcgggggagccuggag

SEQ ID NO: 1741544 - RNA, 19 nt, Homo sapiens
gaggcgggggauccuggag

SEQ ID NO: 1741545 - RNA, 18 nt, Homo sapiens
gagggaccaggugucuag

SEQ ID NO: 1741546 - RNA, 19 nt, Homo sapiens
gagggcuugaaauguguac

SEQ ID NO: 1741547 - RNA, 18 nt, Homo sapiens
gaguaacgagaagacaaa

SEQ ID NO: 1741548 - RNA, 21 nt, Homo sapiens
gauagauuuucuucugagacu

SEQ ID NO: 1741549 - RNA, 15 nt, Homo sapiens
gauuaaagugccuuc

SEQ ID NO: 1741550 - RNA, 17 nt, Homo sapiens
gauuguacgugggagag

SEQ ID NO: 1741551 - RNA, 17 nt, Homo sapiens
gauuuaguguuaagugu

SEQ ID NO: 1741552 - RNA, 12 nt, Homo sapiens
gcaaaugccuuu

SEQ ID NO: 1741553 - RNA, 18 nt, Homo sapiens
gcacauguguaagacacu

SEQ ID NO: 1741554 - RNA, 21 nt, Homo sapiens
gcacauguguaagacacugug

SEQ ID NO: 1741555 - RNA, 22 nt, Homo sapiens
gcaccuuagggagggacuggga

SEQ ID NO: 1741556 - RNA, 19 nt, Homo sapiens
gcacuuaacagauugccau

SEQ ID NO: 1741557 - RNA, 21 nt, Homo sapiens
gcagaauucuaggcagcaccu

SEQ ID NO: 1741558 - RNA, 19 nt, Homo sapiens
gcagagggcgaagcugacc

SEQ ID NO: 1741559 - RNA, 14 nt, Homo sapiens
gcagcaucauucag

SEQ ID NO: 1741560 - RNA, 15 nt, Homo sapiens
gcagccaagagccau

SEQ ID NO: 1741561 - RNA, 20 nt, Homo sapiens
gcagccacacucacccagcc

SEQ ID NO: 1741562 - RNA, 21 nt, Homo sapiens
gcaggccucaugccucgcuca

SEQ ID NO: 1741563 - RNA, 15 nt, Homo sapiens
gcaguuugcacuuaa

SEQ ID NO: 1741564 - RNA, 16 nt, Homo sapiens
gcauagagugaccuuu

SEQ ID NO: 1741565 - RNA, 17 nt, Homo sapiens
gcaucugcucugagacg

SEQ ID NO: 1741566 - RNA, 15 nt, Homo sapiens
gcaucuuugcccuuc

SEQ ID NO: 1741567 - RNA, 15 nt, Homo sapiens
gcaugaaaaaacauc

SEQ ID NO: 1741568 - RNA, 19 nt, Homo sapiens
gccaccccggugucauccc

SEQ ID NO: 1741569 - RNA, 20 nt, Homo sapiens
gcccagggaagacacaugau

SEQ ID NO: 1741570 - RNA, 15 nt, Homo sapiens
gccuaagcugggauc

SEQ ID NO: 1741571 - RNA, 16 nt, Homo sapiens
gccucgcucagucagu

SEQ ID NO: 1741572 - RNA, 14 nt, Homo sapiens
gccugggagggcaa

SEQ ID NO: 1741573 - RNA, 20 nt, Homo sapiens
gcguuguguguuuucuggga

SEQ ID NO: 1741574 - RNA, 17 nt, Homo sapiens
gcuaaccucacugccuc

SEQ ID NO: 1741575 - RNA, 20 nt, Homo sapiens
gcucaaccacacacaccugu

SEQ ID NO: 1741576 - RNA, 16 nt, Homo sapiens
gcucagucagugcacu

SEQ ID NO: 1741577 - RNA, 17 nt, Homo sapiens
gcuggguuuucaggggc

SEQ ID NO: 1741578 - RNA, 11 nt, Homo sapiens
ggaaaccacag

SEQ ID NO: 1741579 - RNA, 13 nt, Homo sapiens
ggaaggaacucaa

SEQ ID NO: 1741580 - RNA, 22 nt, Homo sapiens
ggaccaucaagggucauggcag

SEQ ID NO: 1741581 - RNA, 13 nt, Homo sapiens
ggagagcaucugc

SEQ ID NO: 1741582 - RNA, 12 nt, Homo sapiens
ggagcugcucaa

SEQ ID NO: 1741583 - RNA, 20 nt, Homo sapiens
ggaggagccuuggaguguaa

SEQ ID NO: 1741584 - RNA, 14 nt, Homo sapiens
ggagggaccaggug

SEQ ID NO: 1741585 - RNA, 15 nt, Homo sapiens
ggaguuaacuacccu

SEQ ID NO: 1741586 - RNA, 19 nt, Homo sapiens
ggcaagucucacauauuca

SEQ ID NO: 1741587 - RNA, 22 nt, Homo sapiens
ggcaggaaggaacucaaggugg

SEQ ID NO: 1741588 - RNA, 14 nt, Homo sapiens
ggcucaaccacaca

SEQ ID NO: 1741589 - RNA, 17 nt, Homo sapiens
ggcuccacgcccugggg

SEQ ID NO: 1741590 - RNA, 13 nt, Homo sapiens
ggcugcugcucac

SEQ ID NO: 1741591 - RNA, 14 nt, Homo sapiens
gggacuugagccag

SEQ ID NO: 1741592 - RNA, 12 nt, Homo sapiens
gggaugggccac

SEQ ID NO: 1741593 - RNA, 19 nt, Homo sapiens
gggcugggagaaggugcuu

SEQ ID NO: 1741594 - RNA, 13 nt, Homo sapiens
ggggggcaaggug

SEQ ID NO: 1741595 - RNA, 18 nt, Homo sapiens
ggggucucccugagccug

SEQ ID NO: 1741596 - RNA, 15 nt, Homo sapiens
gggugaacaaucccc

SEQ ID NO: 1741597 - RNA, 14 nt, Homo sapiens
ggucauucauauca

SEQ ID NO: 1741598 - RNA, 22 nt, Homo sapiens
gguggugcagccccaggaccaa

SEQ ID NO: 1741599 - RNA, 14 nt, Homo sapiens
gguguaccgggaua

SEQ ID NO: 1741600 - RNA, 16 nt, Homo sapiens
guaacgagaagacaaa

SEQ ID NO: 1741601 - RNA, 19 nt, Homo sapiens
guaagaaaagcaguuugca

SEQ ID NO: 1741602 - RNA, 15 nt, Homo sapiens
guaagacacugugca

SEQ ID NO: 1741603 - RNA, 21 nt, Homo sapiens
guaccgggauauuaaaccucu

SEQ ID NO: 1741604 - RNA, 19 nt, Homo sapiens
gucaucccucccaaugcca

SEQ ID NO: 1741605 - RNA, 14 nt, Homo sapiens
guccucacaugccc

SEQ ID NO: 1741606 - RNA, 13 nt, Homo sapiens
gucuaauggucac

SEQ ID NO: 1741607 - RNA, 14 nt, Homo sapiens
guggagcugcucaa

SEQ ID NO: 1741608 - RNA, 16 nt, Homo sapiens
guggccgucgaguuga

SEQ ID NO: 1741609 - RNA, 22 nt, Homo sapiens
accugggcugggagaaggugcu

SEQ ID NO: 1741610 - RNA, 18 nt, Homo sapiens
accuggugggcucaacca

SEQ ID NO: 1741611 - RNA, 21 nt, Homo sapiens
accuggugggcucaaccacac

SEQ ID NO: 1741612 - RNA, 13 nt, Homo sapiens
accuucacuuaaa

SEQ ID NO: 1741613 - RNA, 19 nt, Homo sapiens
accuuuuguauuuacuuug

SEQ ID NO: 1741614 - RNA, 15 nt, Homo sapiens
acgagaccuucacag

SEQ ID NO: 1741615 - RNA, 20 nt, Homo sapiens
acgaggugguagcucugagc

SEQ ID NO: 1741616 - RNA, 13 nt, Homo sapiens
acuagacaugcca

SEQ ID NO: 1741617 - RNA, 20 nt, Homo sapiens
acugccucauggcaucaucc

SEQ ID NO: 1741618 - RNA, 22 nt, Homo sapiens
acuugucuuugauuaugacagu

SEQ ID NO: 1741619 - RNA, 12 nt, Homo sapiens
acuuucucucuu

SEQ ID NO: 1741620 - RNA, 23 nt, Homo sapiens
acuuuguaccccccaaccccuga

SEQ ID NO: 1741621 - RNA, 20 nt, Homo sapiens
agagcacuguagcacuuaac

SEQ ID NO: 1741622 - RNA, 15 nt, Homo sapiens
agagcccacugcuca

SEQ ID NO: 1741623 - RNA, 22 nt, Homo sapiens
agagguugaggaugcacuggcc

SEQ ID NO: 1741624 - RNA, 20 nt, Homo sapiens
agaguggcagccaagagcca

SEQ ID NO: 1741625 - RNA, 21 nt, Homo sapiens
agauggcugcugcucacccuc

SEQ ID NO: 1741626 - RNA, 22 nt, Homo sapiens
agauggcugcugcucacccucc

SEQ ID NO: 1741627 - RNA, 23 nt, Homo sapiens
agcaaacuuauaaaucauauucu

SEQ ID NO: 1741628 - RNA, 13 nt, Homo sapiens
agcacauguguaa

SEQ ID NO: 1741629 - RNA, 19 nt, Homo sapiens
agcacauguguaagacacu

SEQ ID NO: 1741630 - RNA, 12 nt, Homo sapiens
agcaucauucag

SEQ ID NO: 1741631 - RNA, 12 nt, Homo sapiens
agcccacaucca

SEQ ID NO: 1741632 - RNA, 15 nt, Homo sapiens
agcccccaccugccu

SEQ ID NO: 1741633 - RNA, 15 nt, Homo sapiens
agccugcucugccac

SEQ ID NO: 1741634 - RNA, 18 nt, Homo sapiens
agccuggagccccugugu

SEQ ID NO: 1741635 - RNA, 15 nt, Homo sapiens
agccuuggaagcaaa

SEQ ID NO: 1741636 - RNA, 19 nt, Homo sapiens
agccuuggaagcaaacuua

SEQ ID NO: 1741637 - RNA, 21 nt, Homo sapiens
agcuacgagaccuucacagag

SEQ ID NO: 1741638 - RNA, 18 nt, Homo sapiens
agcucuguugcagguguc

SEQ ID NO: 1741639 - RNA, 14 nt, Homo sapiens
agcugcucacuuaa

SEQ ID NO: 1741640 - RNA, 17 nt, Homo sapiens
agcuggcuuccuagccu

SEQ ID NO: 1741641 - RNA, 17 nt, Homo sapiens
aggagcagcaucauuca

SEQ ID NO: 1741642 - RNA, 13 nt, Homo sapiens
aggccccaaagga

SEQ ID NO: 1741643 - RNA, 22 nt, Homo sapiens
aggccuagaguggcagccaaga

SEQ ID NO: 1741644 - RNA, 13 nt, Homo sapiens
aggcgggggagcc

SEQ ID NO: 1741645 - RNA, 16 nt, Homo sapiens
aggcgggggagccugg

SEQ ID NO: 1741646 - RNA, 22 nt, Homo sapiens
agggcugggcagguccugggga

SEQ ID NO: 1741647 - RNA, 20 nt, Homo sapiens
aggguccuacggagggacca

SEQ ID NO: 1741648 - RNA, 22 nt, Homo sapiens
agguagagcccacugcucauug

SEQ ID NO: 1741649 - RNA, 13 nt, Homo sapiens
aggugggggagcc

SEQ ID NO: 1741650 - RNA, 16 nt, Homo sapiens
aggugggggagccugg

SEQ ID NO: 1741651 - RNA, 19 nt, Homo sapiens
aguauauuaggaaacuggg

SEQ ID NO: 1741652 - RNA, 14 nt, Homo sapiens
agucagugcacuaa

SEQ ID NO: 1741653 - RNA, 19 nt, Homo sapiens
cugccuuaccuucacuuaa

SEQ ID NO: 1741654 - RNA, 21 nt, Homo sapiens
cugcggugaggcaggggaguc

SEQ ID NO: 1741655 - RNA, 22 nt, Homo sapiens
cugcuuuuggggcucuugauca

SEQ ID NO: 1741656 - RNA, 21 nt, Homo sapiens
cuggaagaaagcccugugcuu

SEQ ID NO: 1741657 - RNA, 17 nt, Homo sapiens
cugguucuccaacagag

SEQ ID NO: 1741658 - RNA, 23 nt, Homo sapiens
cuguauguguucgucaguguuca

SEQ ID NO: 1741659 - RNA, 20 nt, Homo sapiens
cugugcagaugcuuugccca

SEQ ID NO: 1741660 - RNA, 15 nt, Homo sapiens
cuguuagcugcucac

SEQ ID NO: 1741661 - RNA, 16 nt, Homo sapiens
cuguuagcugcucacu

SEQ ID NO: 1741662 - RNA, 22 nt, Homo sapiens
cuuaaaccacacacacaaggug

SEQ ID NO: 1741663 - RNA, 22 nt, Homo sapiens
cuuaaggagaggagagcaucug

SEQ ID NO: 1741664 - RNA, 24 nt, Homo sapiens
cuuauaaauucuguuagcugcuca

SEQ ID NO: 1741665 - RNA, 11 nt, Homo sapiens
cuucagccaag

SEQ ID NO: 1741666 - RNA, 22 nt, Homo sapiens
cuucagggcugggcagguccug

SEQ ID NO: 1741667 - RNA, 21 nt, Homo sapiens
cuucuccagccuggaccccca

SEQ ID NO: 1741668 - RNA, 14 nt, Homo sapiens
cuucugagcugucu

SEQ ID NO: 1741669 - RNA, 15 nt, Homo sapiens
cuugguagauuuagu

SEQ ID NO: 1741670 - RNA, 20 nt, Homo sapiens
cuuucucucuuauaaauucu

SEQ ID NO: 1741671 - RNA, 16 nt, Homo sapiens
cuuuucaaaugcagca

SEQ ID NO: 1741672 - RNA, 19 nt, Homo sapiens
cuuuuggggcucuugauca

SEQ ID NO: 1741673 - RNA, 21 nt, Homo sapiens
gaaaaccauucuggacacugu

SEQ ID NO: 1741674 - RNA, 14 nt, Homo sapiens
gaaauguacauggc

SEQ ID NO: 1741675 - RNA, 18 nt, Homo sapiens
gaagagauacccacagag

SEQ ID NO: 1741676 - RNA, 18 nt, Homo sapiens
gaagcauuucagguugug

SEQ ID NO: 1741677 - RNA, 17 nt, Homo sapiens
gaaggccuugcugucau

SEQ ID NO: 1741678 - RNA, 22 nt, Homo sapiens
gaauaaucuaaauucauacuca

SEQ ID NO: 1741679 - RNA, 18 nt, Homo sapiens
gaauucuaggcagcaccu

SEQ ID NO: 1741680 - RNA, 17 nt, Homo sapiens
gacaccaguugcgaagg

SEQ ID NO: 1741681 - RNA, 13 nt, Homo sapiens
gacacugugcaaa

SEQ ID NO: 1741682 - RNA, 14 nt, Homo sapiens
gacaggagaaaaau

SEQ ID NO: 1741683 - RNA, 17 nt, Homo sapiens
gaccaucucucccuccu

SEQ ID NO: 1741684 - RNA, 23 nt, Homo sapiens
gaccaucucucccuccuggugaa

SEQ ID NO: 1741685 - RNA, 16 nt, Homo sapiens
gacguggagcugcuca

SEQ ID NO: 1741686 - RNA, 20 nt, Homo sapiens
gacuguaggcgccccugggg

SEQ ID NO: 1741687 - RNA, 22 nt, Homo sapiens
gagacucccggagucuucucga

SEQ ID NO: 1741688 - RNA, 20 nt, Homo sapiens
gagaugcugguaauggccau

SEQ ID NO: 1741689 - RNA, 15 nt, Homo sapiens
gagcagcaucauuca

SEQ ID NO: 1741690 - RNA, 21 nt, Homo sapiens
gagcccccaccugccugacca

SEQ ID NO: 1741691 - RNA, 12 nt, Homo sapiens
gaggcugagacu

SEQ ID NO: 1741692 - RNA, 14 nt, Homo sapiens
gagggagugucugu

SEQ ID NO: 1741693 - RNA, 13 nt, Homo sapiens
gaucccuccucca

SEQ ID NO: 1741694 - RNA, 20 nt, Homo sapiens
gaugaggggaggggggcaca

SEQ ID NO: 1741695 - RNA, 17 nt, Homo sapiens
gauggucauucauauca

SEQ ID NO: 1741696 - RNA, 18 nt, Homo sapiens
gauugggucagcuggcuu

SEQ ID NO: 1741697 - RNA, 17 nt, Homo sapiens
gauuuucuucugagacu

SEQ ID NO: 1741698 - RNA, 21 nt, Homo sapiens
gcaaaugccuuuucaaaugca

SEQ ID NO: 1741699 - RNA, 22 nt, Homo sapiens
gcaaucccacuuagcagggaca

SEQ ID NO: 1741700 - RNA, 20 nt, Homo sapiens
gcaaucuggaagaaagcccu

SEQ ID NO: 1741701 - RNA, 16 nt, Homo sapiens
gcacaaucuacacugc

SEQ ID NO: 1741702 - RNA, 15 nt, Homo sapiens
gcacuaaccccagcu

SEQ ID NO: 1741703 - RNA, 16 nt, Homo sapiens
gcacuggguuugcucc

SEQ ID NO: 1741704 - RNA, 18 nt, Homo sapiens
gcacuggguuugcucccu

SEQ ID NO: 1741705 - RNA, 16 nt, Homo sapiens
gcagaugcuuugccca

SEQ ID NO: 1741706 - RNA, 18 nt, Homo sapiens
gcagcaucauucagcaaa

SEQ ID NO: 1741707 - RNA, 13 nt, Homo sapiens
gcagccacacuca

SEQ ID NO: 1741708 - RNA, 16 nt, Homo sapiens
gcaguucugcacccag

SEQ ID NO: 1741709 - RNA, 14 nt, Homo sapiens
gcaucugcucugag

SEQ ID NO: 1741710 - RNA, 12 nt, Homo sapiens
gccacgaggugg

SEQ ID NO: 1741711 - RNA, 18 nt, Homo sapiens
gccagcuccuuucccuuu

SEQ ID NO: 1741712 - RNA, 16 nt, Homo sapiens
gccccagcccaagucc

SEQ ID NO: 1741713 - RNA, 15 nt, Homo sapiens
uucuguuagcugcuc

SEQ ID NO: 1741714 - RNA, 16 nt, Homo sapiens
uugaucagugugcuaa

SEQ ID NO: 1741715 - RNA, 20 nt, Homo sapiens
uugaucagugugcuaaccuc

SEQ ID NO: 1741716 - RNA, 20 nt, Homo sapiens
uugcgucaggagcagcauca

SEQ ID NO: 1741717 - RNA, 21 nt, Homo sapiens
uugcuuuauccagcagucaau

SEQ ID NO: 1741718 - RNA, 21 nt, Homo sapiens
uuucaagugauggucauucau

SEQ ID NO: 1741719 - RNA, 17 nt, Homo sapiens
uuucuaacucacaggca

SEQ ID NO: 1741720 - RNA, 15 nt, Homo sapiens
uuugugaauugccag

SEQ ID NO: 1741721 - RNA, 17 nt, Homo sapiens
uuuuggggcucuugauc

SEQ ID NO: 1741722 - RNA, 17 nt, Homo sapiens
gucuagggugaacaauc

SEQ ID NO: 1741723 - RNA, 16 nt, Homo sapiens
gucucccugagccugc

SEQ ID NO: 1741724 - RNA, 22 nt, Homo sapiens
gucugugcagaugcuuugccca

SEQ ID NO: 1741725 - RNA, 11 nt, Homo sapiens
gucuuguucug

SEQ ID NO: 1741726 - RNA, 17 nt, Homo sapiens
gucuuguucugugauga

SEQ ID NO: 1741727 - RNA, 18 nt, Homo sapiens
gugaauugccagcguugu

SEQ ID NO: 1741728 - RNA, 17 nt, Homo sapiens
gugcucagacaugaaau

SEQ ID NO: 1741729 - RNA, 13 nt, Homo sapiens
gugguagcucuga

SEQ ID NO: 1741730 - RNA, 14 nt, Homo sapiens
gugguagcucugag

SEQ ID NO: 1741731 - RNA, 21 nt, Homo sapiens
gugugcuaaccucacugccuc

SEQ ID NO: 1741732 - RNA, 13 nt, Homo sapiens
guucugcacccag

SEQ ID NO: 1741733 - RNA, 23 nt, Homo sapiens
guucugcacccagccaaacacau

SEQ ID NO: 1741734 - RNA, 20 nt, Homo sapiens
guucugguuuuuaaccauug

SEQ ID NO: 1741735 - RNA, 13 nt, Homo sapiens
guuggggggcaag

SEQ ID NO: 1741736 - RNA, 19 nt, Homo sapiens
guugugcauuuugugugau

SEQ ID NO: 1741737 - RNA, 15 nt, Homo sapiens
guuucggaagagcug

SEQ ID NO: 1741738 - RNA, 12 nt, Homo sapiens
guuugcacuuaa

SEQ ID NO: 1741739 - RNA, 13 nt, Homo sapiens
guuugcacuuaaa

SEQ ID NO: 1741740 - RNA, 14 nt, Homo sapiens
uaaaaaacugugaa

SEQ ID NO: 1741741 - RNA, 20 nt, Homo sapiens
uaaaaguuacauugugcuug

SEQ ID NO: 1741742 - RNA, 15 nt, Homo sapiens
uaacacaaguuuacu

SEQ ID NO: 1741743 - RNA, 16 nt, Homo sapiens
uaaucuaaauucauac

SEQ ID NO: 1741744 - RNA, 14 nt, Homo sapiens
uacaccucugggcc

SEQ ID NO: 1741745 - RNA, 21 nt, Homo sapiens
uacaggugucaccaucauuuc

SEQ ID NO: 1741746 - RNA, 21 nt, Homo sapiens
uaccccccugagagcaugugg

SEQ ID NO: 1741747 - RNA, 17 nt, Homo sapiens
uagagugaccuuuuaau

SEQ ID NO: 1741748 - RNA, 16 nt, Homo sapiens
uagcugcucacuuaaa

SEQ ID NO: 1741749 - RNA, 16 nt, Homo sapiens
uaggacuuuagggauc

SEQ ID NO: 1741750 - RNA, 16 nt, Homo sapiens
uaggagagacuggcca

SEQ ID NO: 1741751 - RNA, 19 nt, Homo sapiens
uaggggagggguugccaca

SEQ ID NO: 1741752 - RNA, 20 nt, Homo sapiens
uaggugaccccaucucugcu

SEQ ID NO: 1741753 - RNA, 19 nt, Homo sapiens
uaguauauuaggaaacugg

SEQ ID NO: 1741754 - RNA, 22 nt, Homo sapiens
uauaaauucuguuagcugcuca

SEQ ID NO: 1741755 - RNA, 23 nt, Homo sapiens
uaucagaguaacgagaagacaaa

SEQ ID NO: 1741756 - RNA, 13 nt, Homo sapiens
uauucucauggcu

SEQ ID NO: 1741757 - RNA, 17 nt, Homo sapiens
ucacauauucaucagca

SEQ ID NO: 1741758 - RNA, 18 nt, Homo sapiens
ucacccagccucuuuauu

SEQ ID NO: 1741759 - RNA, 17 nt, Homo sapiens
ucacugccucauggcau

SEQ ID NO: 1741760 - RNA, 17 nt, Homo sapiens
ucacuuaaacaaugucc

SEQ ID NO: 1741761 - RNA, 21 nt, Homo sapiens
ucagagcccagggaagacaca

SEQ ID NO: 1741762 - RNA, 19 nt, Homo sapiens
ucagcaaaugccuuuucaa

SEQ ID NO: 1741763 - RNA, 19 nt, Homo sapiens
ucaggagcagcaucauuca

SEQ ID NO: 1741764 - RNA, 14 nt, Homo sapiens
ucagguugugcauu

SEQ ID NO: 1741765 - RNA, 15 nt, Homo sapiens
ucaguguucaugcga

SEQ ID NO: 1741766 - RNA, 21 nt, Homo sapiens
ucauggcaucauccauucucu

SEQ ID NO: 1741767 - RNA, 18 nt, Homo sapiens
uccaaacaauucugauga

SEQ ID NO: 1741768 - RNA, 20 nt, Homo sapiens
uccuccagccaagaugaucc

SEQ ID NO: 1741769 - RNA, 20 nt, Homo sapiens
uccugaugacagaacacaga

SEQ ID NO: 1741770 - RNA, 13 nt, Homo sapiens
uccuucuugcccu

SEQ ID NO: 1741771 - RNA, 20 nt, Homo sapiens
uccuuuagucuuuucuuuag

SEQ ID NO: 1741772 - RNA, 18 nt, Homo sapiens
ucgaauuaguuugcacuu

SEQ ID NO: 1741773 - RNA, 13 nt, Homo sapiens
ucuacacugccuu

SEQ ID NO: 1741774 - RNA, 18 nt, Homo sapiens
ucuaguuggcaagucuca

SEQ ID NO: 1741775 - RNA, 21 nt, Homo sapiens
ucugcacccagccaaacacau

SEQ ID NO: 1741776 - RNA, 15 nt, Homo sapiens
ucuguuagcugcuca

SEQ ID NO: 1741777 - RNA, 16 nt, Homo sapiens
ucuuugacguggagcu

SEQ ID NO: 1741778 - RNA, 19 nt, Homo sapiens
ugaacaauccccuaacaca

SEQ ID NO: 1741779 - RNA, 14 nt, Homo sapiens
ugaagugugacuuc

SEQ ID NO: 1741780 - RNA, 15 nt, Homo sapiens
ugacaguaacaaaau

SEQ ID NO: 1741781 - RNA, 16 nt, Homo sapiens
ugaucagugugcuaac

SEQ ID NO: 1741782 - RNA, 16 nt, Homo sapiens
agaaugugugugcaga

SEQ ID NO: 1741783 - RNA, 14 nt, Homo sapiens
agacacugugcaaa

SEQ ID NO: 1741784 - RNA, 22 nt, Homo sapiens
agacaugccaacucgggagcau

SEQ ID NO: 1741785 - RNA, 22 nt, Homo sapiens
agaccaucucucccuccuggug

SEQ ID NO: 1741786 - RNA, 12 nt, Homo sapiens
agagacuggcca

SEQ ID NO: 1741787 - RNA, 20 nt, Homo sapiens
agagcaucugcucugagacg

SEQ ID NO: 1741788 - RNA, 19 nt, Homo sapiens
agagcccagggaagacaca

SEQ ID NO: 1741789 - RNA, 22 nt, Homo sapiens
agaggagaguaccccccugaga

SEQ ID NO: 1741790 - RNA, 16 nt, Homo sapiens
agaguggcagccaaga

SEQ ID NO: 1741791 - RNA, 21 nt, Homo sapiens
agauagauuuucuucugagac

SEQ ID NO: 1741792 - RNA, 21 nt, Homo sapiens
agaucacgcuccccgccuguu

SEQ ID NO: 1741793 - RNA, 23 nt, Homo sapiens
agauggcugcugcucacccuccu

SEQ ID NO: 1741794 - RNA, 16 nt, Homo sapiens
agauugccauggacac

SEQ ID NO: 1741795 - RNA, 15 nt, Homo sapiens
agcaagcaauucugc

SEQ ID NO: 1741796 - RNA, 18 nt, Homo sapiens
agcacuguagcacuuaac

SEQ ID NO: 1741797 - RNA, 20 nt, Homo sapiens
agcacuguagcacuuaacag

SEQ ID NO: 1741798 - RNA, 14 nt, Homo sapiens
agcaguuugcacuu

SEQ ID NO: 1741799 - RNA, 17 nt, Homo sapiens
agcaguuugcacuuaaa

SEQ ID NO: 1741800 - RNA, 15 nt, Homo sapiens
agccaagaccaucuc

SEQ ID NO: 1741801 - RNA, 13 nt, Homo sapiens
agccacgggccac

SEQ ID NO: 1741802 - RNA, 17 nt, Homo sapiens
agcccagggaagacaca

SEQ ID NO: 1741803 - RNA, 20 nt, Homo sapiens
agccuggagccccuguguug

SEQ ID NO: 1741804 - RNA, 15 nt, Homo sapiens
agccuuuccugauga

SEQ ID NO: 1741805 - RNA, 20 nt, Homo sapiens
agccuuuggauggcuaugga

SEQ ID NO: 1741806 - RNA, 14 nt, Homo sapiens
agcucccccugucc

SEQ ID NO: 1741807 - RNA, 19 nt, Homo sapiens
agcucccuccauaccucga

SEQ ID NO: 1741808 - RNA, 12 nt, Homo sapiens
agcuucagggcu

SEQ ID NO: 1741809 - RNA, 17 nt, Homo sapiens
aggaagaugggggcaag

SEQ ID NO: 1741810 - RNA, 23 nt, Homo sapiens
aggacaaaaggaggcucuucuca

SEQ ID NO: 1741811 - RNA, 14 nt, Homo sapiens
aggagaacacuaga

SEQ ID NO: 1741812 - RNA, 15 nt, Homo sapiens
aggagagacuggcca

SEQ ID NO: 1741813 - RNA, 21 nt, Homo sapiens
aggccuagaguggcagccaag

SEQ ID NO: 1741814 - RNA, 13 nt, Homo sapiens
uuccaucaucucu

SEQ ID NO: 1741815 - RNA, 21 nt, Homo sapiens
uucccauguugacugucuuga

SEQ ID NO: 1741816 - RNA, 21 nt, Homo sapiens
uuccugaugacagaacacaga

SEQ ID NO: 1741817 - RNA, 16 nt, Homo sapiens
uucuccaacagagugg

SEQ ID NO: 1741818 - RNA, 22 nt, Homo sapiens
uucucgagcuacgagaccuuca

SEQ ID NO: 1741819 - RNA, 14 nt, Homo sapiens
uucucucugcccaa

SEQ ID NO: 1741820 - RNA, 18 nt, Homo sapiens
uucuggaaagaaaaccau

SEQ ID NO: 1741821 - RNA, 13 nt, Homo sapiens
uucuggacacugu

SEQ ID NO: 1741822 - RNA, 18 nt, Homo sapiens
uucuggacacugucauaa

SEQ ID NO: 1741823 - RNA, 13 nt, Homo sapiens
uugccauggacac

SEQ ID NO: 1741824 - RNA, 17 nt, Homo sapiens
uuggaaauugggugugc

SEQ ID NO: 1741825 - RNA, 17 nt, Homo sapiens
uuggauauucaagccuu

SEQ ID NO: 1741826 - RNA, 17 nt, Homo sapiens
uugucuuguucugugau

SEQ ID NO: 1741827 - RNA, 17 nt, Homo sapiens
uugucuuugauuaugac

SEQ ID NO: 1741828 - RNA, 15 nt, Homo sapiens
uuuacuugucuuuga

SEQ ID NO: 1741829 - RNA, 21 nt, Homo sapiens
uuugcugucacuuucucucuu

SEQ ID NO: 1741830 - RNA, 18 nt, Homo sapiens
caucugaagccaccucuc

SEQ ID NO: 1741831 - RNA, 13 nt, Homo sapiens
caucugcucugag

SEQ ID NO: 1741832 - RNA, 19 nt, Homo sapiens
cauggcuuuguuaaacuua

SEQ ID NO: 1741833 - RNA, 18 nt, Homo sapiens
caugggggaggcucugaa

SEQ ID NO: 1741834 - RNA, 15 nt, Homo sapiens
cauguugacugucuu

SEQ ID NO: 1741835 - RNA, 17 nt, Homo sapiens
ccaaacacauaacaaua

SEQ ID NO: 1741836 - RNA, 17 nt, Homo sapiens
ccaaaggaaaaagcaca

SEQ ID NO: 1741837 - RNA, 15 nt, Homo sapiens
ccaaugccacccuca

SEQ ID NO: 1741838 - RNA, 23 nt, Homo sapiens
ccaaugccacccucaucuuugac

SEQ ID NO: 1741839 - RNA, 20 nt, Homo sapiens
ccacaauuggccagggcaac

SEQ ID NO: 1741840 - RNA, 14 nt, Homo sapiens
ccagagcuucaggg

SEQ ID NO: 1741841 - RNA, 17 nt, Homo sapiens
ccagaggcagcuaaggg

SEQ ID NO: 1741842 - RNA, 16 nt, Homo sapiens
ccagcuccuuucccuu

SEQ ID NO: 1741843 - RNA, 14 nt, Homo sapiens
ccagcuuugcccaa

SEQ ID NO: 1741844 - RNA, 18 nt, Homo sapiens
ccaggaccaagcuuaagg

SEQ ID NO: 1741845 - RNA, 13 nt, Homo sapiens
ccaggugcuaggg

SEQ ID NO: 1741846 - RNA, 18 nt, Homo sapiens
ccaggugucuagaggcaa

SEQ ID NO: 1741847 - RNA, 20 nt, Homo sapiens
ccauaccucgaacaucaguu

SEQ ID NO: 1741848 - RNA, 14 nt, Homo sapiens
ccccagcccaaguc

SEQ ID NO: 1741849 - RNA, 15 nt, Homo sapiens
ccccagcugggcugu

SEQ ID NO: 1741850 - RNA, 14 nt, Homo sapiens
cccucaucuuugac

SEQ ID NO: 1741851 - RNA, 14 nt, Homo sapiens
ccggagucuucucg

SEQ ID NO: 1741852 - RNA, 14 nt, Homo sapiens
ccggcacuggguuu

SEQ ID NO: 1741853 - RNA, 21 nt, Homo sapiens
ccuccuggugaagugugacuu

SEQ ID NO: 1741854 - RNA, 20 nt, Homo sapiens
ccugaugacagaacacagau

SEQ ID NO: 1741855 - RNA, 12 nt, Homo sapiens
ccuggaaaccac

SEQ ID NO: 1741856 - RNA, 22 nt, Homo sapiens
ccuguguuggggggcaaggugg

SEQ ID NO: 1741857 - RNA, 21 nt, Homo sapiens
ccuucugaacaugagugucaa

SEQ ID NO: 1741858 - RNA, 15 nt, Homo sapiens
ccuuucuuuucuuag

SEQ ID NO: 1741859 - RNA, 15 nt, Homo sapiens
cgagaagacaaacuc

SEQ ID NO: 1741860 - RNA, 15 nt, Homo sapiens
cgaggcgggggagcc

SEQ ID NO: 1741861 - RNA, 17 nt, Homo sapiens
cgcucagucagugcacu

SEQ ID NO: 1741862 - RNA, 13 nt, Homo sapiens
cggagucuucucg

SEQ ID NO: 1741863 - RNA, 15 nt, Homo sapiens
cggauggaaggagag

SEQ ID NO: 1741864 - RNA, 23 nt, Homo sapiens
cggugucaucccucccaaugcca

SEQ ID NO: 1741865 - RNA, 16 nt, Homo sapiens
cguaccguacacagag

SEQ ID NO: 1741866 - RNA, 15 nt, Homo sapiens
cguggagcugcucaa

SEQ ID NO: 1741867 - RNA, 21 nt, Homo sapiens
cuaacacaaguuuacuugucu

SEQ ID NO: 1741868 - RNA, 20 nt, Homo sapiens
cuagaguggcagccaagagc

SEQ ID NO: 1741869 - RNA, 18 nt, Homo sapiens
cuagcuaacuaauucugu

SEQ ID NO: 1741870 - RNA, 15 nt, Homo sapiens
cuaugaacuuggaua

SEQ ID NO: 1741871 - RNA, 20 nt, Homo sapiens
cuaugaacuuggauauucaa

SEQ ID NO: 1741872 - RNA, 10 nt, Homo sapiens
cucaaggugg

SEQ ID NO: 1741873 - RNA, 13 nt, Homo sapiens
cucacugccucau

SEQ ID NO: 1741874 - RNA, 14 nt, Homo sapiens
cucauggcaucauc

SEQ ID NO: 1741875 - RNA, 17 nt, Homo sapiens
cucauggcaucauccau

SEQ ID NO: 1741876 - RNA, 19 nt, Homo sapiens
cucauucagcuaaauucac

SEQ ID NO: 1741877 - RNA, 18 nt, Homo sapiens
cuccagccaagaugaucc

SEQ ID NO: 1741878 - RNA, 18 nt, Homo sapiens
cuccuccagccaagauga

SEQ ID NO: 1741879 - RNA, 19 nt, Homo sapiens
cuccuggugaagugugacu

SEQ ID NO: 1741880 - RNA, 20 nt, Homo sapiens
cucgcucagucagugcacua

SEQ ID NO: 1741881 - RNA, 13 nt, Homo sapiens
cucuaaaaaccaa

SEQ ID NO: 1741882 - RNA, 21 nt, Homo sapiens
cucucugcccaaguugcucug

SEQ ID NO: 1741883 - RNA, 13 nt, Homo sapiens
cucuguagcugcu

SEQ ID NO: 1741884 - RNA, 22 nt, Homo sapiens
cucuguauguguucgucagugu

SEQ ID NO: 1741885 - RNA, 16 nt, Homo sapiens
cugagcuuuccgggga

SEQ ID NO: 1741886 - RNA, 20 nt, Homo sapiens
cugauuuugugaauugccag

SEQ ID NO: 1741887 - RNA, 23 nt, Homo sapiens
cugcccagucccccaaccccagc

SEQ ID NO: 1741888 - RNA, 23 nt, Homo sapiens
cugcuuuuggggcucuugaucag

SEQ ID NO: 1741889 - RNA, 16 nt, Homo sapiens
cuggaaagaaaaccau

SEQ ID NO: 1741890 - RNA, 21 nt, Homo sapiens
cuggagauggcugcugcucac

SEQ ID NO: 1741891 - RNA, 16 nt, Homo sapiens
cugggagaaggugcuu

SEQ ID NO: 1741892 - RNA, 17 nt, Homo sapiens
cuggggaggcugagacu

SEQ ID NO: 1741893 - RNA, 16 nt, Homo sapiens
cuggguuuucaggggc

SEQ ID NO: 1741894 - RNA, 18 nt, Homo sapiens
cugugcagaugcuuugcc

SEQ ID NO: 1741895 - RNA, 14 nt, Homo sapiens
cuguuagcugcuca

SEQ ID NO: 1741896 - RNA, 18 nt, Homo sapiens
cuguuagcugcucacuua

SEQ ID NO: 1741897 - RNA, 17 nt, Homo sapiens
cuguuccucccaagagg

SEQ ID NO: 1741898 - RNA, 14 nt, Homo sapiens
cuguugcagguguc

SEQ ID NO: 1741899 - RNA, 19 nt, Homo sapiens
cuuagggagggacugggau

SEQ ID NO: 1741900 - RNA, 18 nt, Homo sapiens
cuuccgcucccaccagcc

SEQ ID NO: 1741901 - RNA, 14 nt, Homo sapiens
cuuccuguuggaag

SEQ ID NO: 1741902 - RNA, 17 nt, Homo sapiens
cuugaucagugugcuaa

SEQ ID NO: 1741903 - RNA, 19 nt, Homo sapiens
cuuggugcgguaggugcug

SEQ ID NO: 1741904 - RNA, 23 nt, Homo sapiens
cuuguucuuugcuggaccaucaa

SEQ ID NO: 1741905 - RNA, 17 nt, Homo sapiens
cuuucccuuuuccauca

SEQ ID NO: 1741906 - RNA, 20 nt, Homo sapiens
cuuucccuuuuccaucaucu

SEQ ID NO: 1741907 - RNA, 20 nt, Homo sapiens
cuuuccucucuuuguucuca

SEQ ID NO: 1741908 - RNA, 20 nt, Homo sapiens
cuuugacguggagcugcuca

SEQ ID NO: 1741909 - RNA, 23 nt, Homo sapiens
cuuugacguggagcugcucaacu

SEQ ID NO: 1741910 - RNA, 14 nt, Homo sapiens
cuuuguacccccca

SEQ ID NO: 1741911 - RNA, 15 nt, Homo sapiens
gaaaaccauucugga

SEQ ID NO: 1741912 - RNA, 17 nt, Homo sapiens
gaaaaccauucuggaca

SEQ ID NO: 1741913 - RNA, 22 nt, Homo sapiens
gaaaaccauucuggacacuguc

SEQ ID NO: 1741914 - RNA, 23 nt, Homo sapiens
gaaaaccauucuggacacuguca

SEQ ID NO: 1741915 - RNA, 15 nt, Homo sapiens
gaaaagcaguuugca

SEQ ID NO: 1741916 - RNA, 14 nt, Homo sapiens
gaaaauagagcaau

SEQ ID NO: 1741917 - RNA, 15 nt, Homo sapiens
gaaacauuuugcuga

SEQ ID NO: 1741918 - RNA, 14 nt, Homo sapiens
gaaauagugccuua

SEQ ID NO: 1741919 - RNA, 15 nt, Homo sapiens
gaaauagugccuuac

SEQ ID NO: 1741920 - RNA, 20 nt, Homo sapiens
gaauucuaggcagcaccuua

SEQ ID NO: 1741921 - RNA, 10 nt, Homo sapiens
gaauugccag

SEQ ID NO: 1741922 - RNA, 21 nt, Homo sapiens
gacaaaaaaaggaauucugga

SEQ ID NO: 1741923 - RNA, 22 nt, Homo sapiens
gaccuucugaacaugaguguca

SEQ ID NO: 1741924 - RNA, 19 nt, Homo sapiens
gacugucacggaacagauc

SEQ ID NO: 1741925 - RNA, 18 nt, Homo sapiens
gagaccuucacagagaca

SEQ ID NO: 1741926 - RNA, 24 nt, Homo sapiens
gagaccuucacagagacacguggc

SEQ ID NO: 1741927 - RNA, 17 nt, Homo sapiens
gagagcaucugcucuga

SEQ ID NO: 1741928 - RNA, 16 nt, Homo sapiens
gagcacuguagcacuu

SEQ ID NO: 1741929 - RNA, 17 nt, Homo sapiens
gagcacuguagcacuua

SEQ ID NO: 1741930 - RNA, 19 nt, Homo sapiens
gagcacuguagcacuuaac

SEQ ID NO: 1741931 - RNA, 22 nt, Homo sapiens
gagcugcucaacuuagagugaa

SEQ ID NO: 1741932 - RNA, 20 nt, Homo sapiens
gagcugucuaaaaguuacau

SEQ ID NO: 1741933 - RNA, 19 nt, Homo sapiens
gaggaaacuucgguugcag

SEQ ID NO: 1741934 - RNA, 22 nt, Homo sapiens
gaggcucuucucauucagcuaa

SEQ ID NO: 1741935 - RNA, 21 nt, Homo sapiens
ucgcacaaucuacacugccuu

SEQ ID NO: 1741936 - RNA, 22 nt, Homo sapiens
ucuaacucacaggcauagagug

SEQ ID NO: 1741937 - RNA, 16 nt, Homo sapiens
ucuacacugccuuacc

SEQ ID NO: 1741938 - RNA, 14 nt, Homo sapiens
ucuaggcagcaccu

SEQ ID NO: 1741939 - RNA, 17 nt, Homo sapiens
ucuaggcagcaccuuag

SEQ ID NO: 1741940 - RNA, 12 nt, Homo sapiens
ucuccuugcccu

SEQ ID NO: 1741941 - RNA, 13 nt, Homo sapiens
ucuccuugcccug

SEQ ID NO: 1741942 - RNA, 17 nt, Homo sapiens
ucucugcucucuuggaa

SEQ ID NO: 1741943 - RNA, 12 nt, Homo sapiens
ucugaagccacc

SEQ ID NO: 1741944 - RNA, 23 nt, Homo sapiens
ucugagcugucuaaaaguuacau

SEQ ID NO: 1741945 - RNA, 21 nt, Homo sapiens
ucugcccaaguugcucuguau

SEQ ID NO: 1741946 - RNA, 21 nt, Homo sapiens
ucugcucucuuggaaacauuu

SEQ ID NO: 1741947 - RNA, 16 nt, Homo sapiens
ucuggaagaaagcccu

SEQ ID NO: 1741948 - RNA, 19 nt, Homo sapiens
ucugugcagaugcuuugcc

SEQ ID NO: 1741949 - RNA, 13 nt, Homo sapiens
ucuguuagcugcu

SEQ ID NO: 1741950 - RNA, 17 nt, Homo sapiens
ucuguuagcugcucacu

SEQ ID NO: 1741951 - RNA, 23 nt, Homo sapiens
ucuuauaaauucuguuagcugcu

SEQ ID NO: 1741952 - RNA, 16 nt, Homo sapiens
ucuugaucagugugcu

SEQ ID NO: 1741953 - RNA, 17 nt, Homo sapiens
ucuugaucagugugcua

SEQ ID NO: 1741954 - RNA, 23 nt, Homo sapiens
ucuugcccugagcuuuccgggga

SEQ ID NO: 1741955 - RNA, 17 nt, Homo sapiens
ucuuguucgcacaaucu

SEQ ID NO: 1741956 - RNA, 14 nt, Homo sapiens
ucuuguucugugau

SEQ ID NO: 1741957 - RNA, 14 nt, Homo sapiens
ucuuuuagcacaug

SEQ ID NO: 1741958 - RNA, 17 nt, Homo sapiens
ugaacuuggauauucaa

SEQ ID NO: 1741959 - RNA, 19 nt, Homo sapiens
ugacagaacacagaucucu

SEQ ID NO: 1741960 - RNA, 18 nt, Homo sapiens
ugacguggagcugcucaa

SEQ ID NO: 1741961 - RNA, 10 nt, Homo sapiens
ugagugucaa

SEQ ID NO: 1741962 - RNA, 15 nt, Homo sapiens
ugaucagugugcuaa

SEQ ID NO: 1741963 - RNA, 12 nt, Homo sapiens
ugauguggcaua

SEQ ID NO: 1741964 - RNA, 23 nt, Homo sapiens
ugauugggucagcuggcuuccua

SEQ ID NO: 1741965 - RNA, 15 nt, Homo sapiens
ugcacccagccaaac

SEQ ID NO: 1741966 - RNA, 11 nt, Homo sapiens
ugcacuggccu

SEQ ID NO: 1741967 - RNA, 22 nt, Homo sapiens
ugcaugaaaaaacaucuuuauu

SEQ ID NO: 1741968 - RNA, 18 nt, Homo sapiens
ugcccguugccgggccug

SEQ ID NO: 1741969 - RNA, 14 nt, Homo sapiens
ugcccugaggcacu

SEQ ID NO: 1741970 - RNA, 16 nt, Homo sapiens
ugcccuugucugagau

SEQ ID NO: 1741971 - RNA, 17 nt, Homo sapiens
ugccucgcucagucagu

SEQ ID NO: 1741972 - RNA, 20 nt, Homo sapiens
ugccugaccaucccaugagc

SEQ ID NO: 1741973 - RNA, 14 nt, Homo sapiens
ugccuucagccaag

SEQ ID NO: 1741974 - RNA, 15 nt, Homo sapiens
ugcucuguauguguu

SEQ ID NO: 1741975 - RNA, 21 nt, Homo sapiens
ugcuggcuccacgcccugggg

SEQ ID NO: 1741976 - RNA, 13 nt, Homo sapiens
ugcugguucucca

SEQ ID NO: 1741977 - RNA, 22 nt, Homo sapiens
uggaccaucaagggucauggca

SEQ ID NO: 1741978 - RNA, 16 nt, Homo sapiens
uggagccccuguguug

SEQ ID NO: 1741979 - RNA, 15 nt, Homo sapiens
ugggaucugaauacc

SEQ ID NO: 1741980 - RNA, 12 nt, Homo sapiens
ugguagcucuga

SEQ ID NO: 1741981 - RNA, 23 nt, Homo sapiens
uguagcacuuaacagauugccau

SEQ ID NO: 1741982 - RNA, 14 nt, Homo sapiens
uguaguagccuuuc

SEQ ID NO: 1741983 - RNA, 13 nt, Homo sapiens
ugucaccaucauu

SEQ ID NO: 1741984 - RNA, 20 nt, Homo sapiens
ugucaucccucccaaugcca

SEQ ID NO: 1741985 - RNA, 19 nt, Homo sapiens
ugucaucugggccaccagc

SEQ ID NO: 1741986 - RNA, 16 nt, Homo sapiens
ugugaugcauguagua

SEQ ID NO: 1741987 - RNA, 19 nt, Homo sapiens
ugugcagaauucuaggcag

SEQ ID NO: 1741988 - RNA, 18 nt, Homo sapiens
ugugcuaaccucacugcc

SEQ ID NO: 1741989 - RNA, 20 nt, Homo sapiens
ugugcuaaccucacugccuc

SEQ ID NO: 1741990 - RNA, 22 nt, Homo sapiens
ugugucagcaucuuugcccuuc

SEQ ID NO: 1741991 - RNA, 17 nt, Homo sapiens
uguuagcugcucacuua

SEQ ID NO: 1741992 - RNA, 14 nt, Homo sapiens
uuaaugauuuagcu

SEQ ID NO: 1741993 - RNA, 14 nt, Homo sapiens
uuaccuucacuuaa

SEQ ID NO: 1741994 - RNA, 15 nt, Homo sapiens
uuagcacauguguaa

SEQ ID NO: 1741995 - RNA, 15 nt, Homo sapiens
uuagcugcucacuua

SEQ ID NO: 1741996 - RNA, 19 nt, Homo sapiens
uuaucagaguaacgagaag

SEQ ID NO: 1741997 - RNA, 20 nt, Homo sapiens
uucaagugauggucauucau

SEQ ID NO: 1741998 - RNA, 11 nt, Homo sapiens
uuccaucaucu

SEQ ID NO: 1741999 - RNA, 16 nt, Homo sapiens
uucuaacucacaggca

SEQ ID NO: 1742000 - RNA, 23 nt, Homo sapiens
uucugauggguucaugucucuga

SEQ ID NO: 1742001 - RNA, 17 nt, Homo sapiens
uucugcacccagccaaa

SEQ ID NO: 1742002 - RNA, 16 nt, Homo sapiens
uucuggacacugucau

SEQ ID NO: 1742003 - RNA, 13 nt, Homo sapiens
uugacagcuuucu

SEQ ID NO: 1742004 - RNA, 11 nt, Homo sapiens
uugcacuuaaa

SEQ ID NO: 1742005 - RNA, 17 nt, Homo sapiens
uuguguguuuucuggga

SEQ ID NO: 1742006 - RNA, 13 nt, Homo sapiens
uuucccacucccu

SEQ ID NO: 1742007 - RNA, 22 nt, Homo sapiens
uuucuaacucacaggcauagag

SEQ ID NO: 1742008 - RNA, 20 nt, Homo sapiens
uuugacguggagcugcucaa

SEQ ID NO: 1742009 - RNA, 15 nt, Homo sapiens
uuugcgucaggagca

SEQ ID NO: 1742010 - RNA, 20 nt, Homo sapiens
uuuuugaaaauagagcaaua

SEQ ID NO: 1742011 - RNA, 20 nt, Homo sapiens
gagggacuugagccaguuac

SEQ ID NO: 1742012 - RNA, 17 nt, Homo sapiens
gagggcgaggcggggga

SEQ ID NO: 1742013 - RNA, 17 nt, Homo sapiens
gaguaacgagaagacaa

SEQ ID NO: 1742014 - RNA, 21 nt, Homo sapiens
gaguaccccccugagagcaug

SEQ ID NO: 1742015 - RNA, 13 nt, Homo sapiens
gaguggcagccaa

SEQ ID NO: 1742016 - RNA, 19 nt, Homo sapiens
gaucuggggaaggaccaac

SEQ ID NO: 1742017 - RNA, 22 nt, Homo sapiens
gauuaaagugccuucagccaag

SEQ ID NO: 1742018 - RNA, 17 nt, Homo sapiens
gcaagucucacauauuc

SEQ ID NO: 1742019 - RNA, 16 nt, Homo sapiens
gcacccagccaaacac

SEQ ID NO: 1742020 - RNA, 23 nt, Homo sapiens
gcaccuuagggagggacugggau

SEQ ID NO: 1742021 - RNA, 12 nt, Homo sapiens
gcagccaagagc

SEQ ID NO: 1742022 - RNA, 19 nt, Homo sapiens
gcagccccaggaccaagcu

SEQ ID NO: 1742023 - RNA, 20 nt, Homo sapiens
gcaguucugcacccagccaa

SEQ ID NO: 1742024 - RNA, 21 nt, Homo sapiens
gcaguucugcacccagccaaa

SEQ ID NO: 1742025 - RNA, 11 nt, Homo sapiens
gccaagaccau

SEQ ID NO: 1742026 - RNA, 15 nt, Homo sapiens
gccaagaccaucucu

SEQ ID NO: 1742027 - RNA, 20 nt, Homo sapiens
gccaccagcuccacuggccu

SEQ ID NO: 1742028 - RNA, 17 nt, Homo sapiens
gccaccccggugucauc

SEQ ID NO: 1742029 - RNA, 16 nt, Homo sapiens
gccagcguuguguguu

SEQ ID NO: 1742030 - RNA, 11 nt, Homo sapiens
gcccagggaag

SEQ ID NO: 1742031 - RNA, 14 nt, Homo sapiens
gcccugagcuuucc

SEQ ID NO: 1742032 - RNA, 16 nt, Homo sapiens
gccuccuucaaaaagc

SEQ ID NO: 1742033 - RNA, 15 nt, Homo sapiens
gccugaacauggcag

SEQ ID NO: 1742034 - RNA, 14 nt, Homo sapiens
gccuuggaagcaaa

SEQ ID NO: 1742035 - RNA, 21 nt, Homo sapiens
gcguaccguacacagagggac

SEQ ID NO: 1742036 - RNA, 15 nt, Homo sapiens
gcuacgagaccuuca

SEQ ID NO: 1742037 - RNA, 19 nt, Homo sapiens
gcucaacuuagagugaagg

SEQ ID NO: 1742038 - RNA, 19 nt, Homo sapiens
gcuuuauccagcagucaau

SEQ ID NO: 1742039 - RNA, 21 nt, Homo sapiens
ggaaggaacucaagguggcug

SEQ ID NO: 1742040 - RNA, 20 nt, Homo sapiens
ggacccccagcuuugcccaa

SEQ ID NO: 1742041 - RNA, 18 nt, Homo sapiens
ggagagcaucugcucuga

SEQ ID NO: 1742042 - RNA, 14 nt, Homo sapiens
ggauggcuauggag

SEQ ID NO: 1742043 - RNA, 14 nt, Homo sapiens
ggcaagaagaucac

SEQ ID NO: 1742044 - RNA, 19 nt, Homo sapiens
ggcagccaagagccaucug

SEQ ID NO: 1742045 - RNA, 16 nt, Homo sapiens
ggcauauggagccacg

SEQ ID NO: 1742046 - RNA, 22 nt, Homo sapiens
ggccagggguggugagggcagu

SEQ ID NO: 1742047 - RNA, 19 nt, Homo sapiens
ggccugauggagaggagaa

SEQ ID NO: 1742048 - RNA, 22 nt, Homo sapiens
ggcucuugaucagugugcuaac

SEQ ID NO: 1742049 - RNA, 23 nt, Homo sapiens
ggcuggagauggcugcugcucac

SEQ ID NO: 1742050 - RNA, 20 nt, Homo sapiens
ggcuggguuuucaggggcuu

SEQ ID NO: 1742051 - RNA, 22 nt, Homo sapiens
gggcucuugaucagugugcuaa

SEQ ID NO: 1742052 - RNA, 14 nt, Homo sapiens
ggggcacaugcuga

SEQ ID NO: 1742053 - RNA, 23 nt, Homo sapiens
ggggcucuugaucagugugcuaa

SEQ ID NO: 1742054 - RNA, 23 nt, Homo sapiens
gggggaguaagaaugugugugca

SEQ ID NO: 1742055 - RNA, 20 nt, Homo sapiens
ggguggacgagggagugucu

SEQ ID NO: 1742056 - RNA, 19 nt, Homo sapiens
ggguggccaggggugguga

SEQ ID NO: 1742057 - RNA, 21 nt, Homo sapiens
ggugucaucccucccaaugcc

SEQ ID NO: 1742058 - RNA, 18 nt, Homo sapiens
guacccccuucugggcau

SEQ ID NO: 1742059 - RNA, 17 nt, Homo sapiens
guagagcccacugcuca

SEQ ID NO: 1742060 - RNA, 19 nt, Homo sapiens
gucaucugggccaccagcu

SEQ ID NO: 1742061 - RNA, 12 nt, Homo sapiens
gucccccaaccc

SEQ ID NO: 1742062 - RNA, 12 nt, Homo sapiens
gugaauugccag

SEQ ID NO: 1742063 - RNA, 13 nt, Homo sapiens
gugaggcagggga

SEQ ID NO: 1742064 - RNA, 13 nt, Homo sapiens
gugaugcauguag

SEQ ID NO: 1742065 - RNA, 19 nt, Homo sapiens
gugcauuuugugugaugca

SEQ ID NO: 1742066 - RNA, 16 nt, Homo sapiens
gugccuuacuauaugu

SEQ ID NO: 1742067 - RNA, 23 nt, Homo sapiens
gugccuucagccaagaccaucuc

SEQ ID NO: 1742068 - RNA, 14 nt, Homo sapiens
gugcucagacauga

SEQ ID NO: 1742069 - RNA, 20 nt, Homo sapiens
gugcuggccucaaacagcca

SEQ ID NO: 1742070 - RNA, 12 nt, Homo sapiens
guggacgaggga

SEQ ID NO: 1742071 - RNA, 17 nt, Homo sapiens
guggccaggggugguga

SEQ ID NO: 1742072 - RNA, 23 nt, Homo sapiens
guggugcagccccaggaccaagc

SEQ ID NO: 1742073 - RNA, 19 nt, Homo sapiens
guggugugucucaggacaa

SEQ ID NO: 1742074 - RNA, 18 nt, Homo sapiens
guguuaagugugcaguau

SEQ ID NO: 1742075 - RNA, 14 nt, Homo sapiens
guguucaugcgaau

SEQ ID NO: 1742076 - RNA, 18 nt, Homo sapiens
guuaccuuugcugucacu

SEQ ID NO: 1742077 - RNA, 13 nt, Homo sapiens
guuagcugcucac

SEQ ID NO: 1742078 - RNA, 14 nt, Homo sapiens
guucuccaacagag

SEQ ID NO: 1742079 - RNA, 20 nt, Homo sapiens
guucuuugcuggaccaucaa

SEQ ID NO: 1742080 - RNA, 16 nt, Homo sapiens
guugaggaugcacugg

SEQ ID NO: 1742081 - RNA, 19 nt, Homo sapiens
guugggaucccuccuccag

SEQ ID NO: 1742082 - RNA, 21 nt, Homo sapiens
uaaagauugcuuuauccagca

SEQ ID NO: 1742083 - RNA, 19 nt, Homo sapiens
uaacacacauagauagauu

SEQ ID NO: 1742084 - RNA, 14 nt, Homo sapiens
uaaccucacugccu

SEQ ID NO: 1742085 - RNA, 15 nt, Homo sapiens
uaaccucacugccuc

SEQ ID NO: 1742086 - RNA, 19 nt, Homo sapiens
uaagaaugugugugcagaa

SEQ ID NO: 1742087 - RNA, 13 nt, Homo sapiens
uaagacacugugc

SEQ ID NO: 1742088 - RNA, 12 nt, Homo sapiens
uaagcugggauc

SEQ ID NO: 1742089 - RNA, 16 nt, Homo sapiens
uacacugccuuaccuu

SEQ ID NO: 1742090 - RNA, 18 nt, Homo sapiens
uacccuacaccucugggc

SEQ ID NO: 1742091 - RNA, 20 nt, Homo sapiens
uacuagcuaacuaauucugu

SEQ ID NO: 1742092 - RNA, 22 nt, Homo sapiens
uagagcaauacuuuuuguggaa

SEQ ID NO: 1742093 - RNA, 19 nt, Homo sapiens
uaggaguuaacuacccuac

SEQ ID NO: 1742094 - RNA, 13 nt, Homo sapiens
uaguuugcacuuc

SEQ ID NO: 1742095 - RNA, 15 nt, Homo sapiens
ucaagggucauggca

SEQ ID NO: 1742096 - RNA, 12 nt, Homo sapiens
ucaagguggcug

SEQ ID NO: 1742097 - RNA, 21 nt, Homo sapiens
ucacagagcacuguagcacuu

SEQ ID NO: 1742098 - RNA, 16 nt, Homo sapiens
ucaccauccuggaagg

SEQ ID NO: 1742099 - RNA, 15 nt, Homo sapiens
ucacuuucucucuua

SEQ ID NO: 1742100 - RNA, 17 nt, Homo sapiens
ucagcaucuuugcccuu

SEQ ID NO: 1742101 - RNA, 18 nt, Homo sapiens
ucagccaagaccaucucu

SEQ ID NO: 1742102 - RNA, 12 nt, Homo sapiens
ucagccuuggaa

SEQ ID NO: 1742103 - RNA, 18 nt, Homo sapiens
ucagugugcuaaccucac

SEQ ID NO: 1742104 - RNA, 13 nt, Homo sapiens
ucauacugaugcc

SEQ ID NO: 1742105 - RNA, 19 nt, Homo sapiens
ucaucccucccaaugccac

SEQ ID NO: 1742106 - RNA, 20 nt, Homo sapiens
ucaucccucccaaugccacc

SEQ ID NO: 1742107 - RNA, 16 nt, Homo sapiens
uccaaacaauucugau

SEQ ID NO: 1742108 - RNA, 19 nt, Homo sapiens
uccauaccucgaacaucag

SEQ ID NO: 1742109 - RNA, 21 nt, Homo sapiens
ucccaaagugccuucugagcu

SEQ ID NO: 1742110 - RNA, 21 nt, Homo sapiens
ucccaagggaggcccauguga

SEQ ID NO: 1742111 - RNA, 14 nt, Homo sapiens
ucccaccucugagg

SEQ ID NO: 1742112 - RNA, 15 nt, Homo sapiens
ucccuuuuccaucau

SEQ ID NO: 1742113 - RNA, 15 nt, Homo sapiens
uccuccagccaagau

SEQ ID NO: 1742114 - RNA, 21 nt, Homo sapiens
uccucuuugagaaaauguaaa

SEQ ID NO: 1742115 - RNA, 15 nt, Homo sapiens
uccuuuagucuuuuc

SEQ ID NO: 1742116 - RNA, 16 nt, Homo sapiens
aggccugggagggcaa

SEQ ID NO: 1742117 - RNA, 12 nt, Homo sapiens
agggaagacaca

SEQ ID NO: 1742118 - RNA, 13 nt, Homo sapiens
agggaccaggugu

SEQ ID NO: 1742119 - RNA, 15 nt, Homo sapiens
agggaucuggggaag

SEQ ID NO: 1742120 - RNA, 16 nt, Homo sapiens
aggugcuagggugccu

SEQ ID NO: 1742121 - RNA, 17 nt, Homo sapiens
aggugcucagacaugaa

SEQ ID NO: 1742122 - RNA, 18 nt, Homo sapiens
agguggcagcaagcaauu

SEQ ID NO: 1742123 - RNA, 15 nt, Homo sapiens
agugauggucauuca

SEQ ID NO: 1742124 - RNA, 21 nt, Homo sapiens
agugccuucugagcugucuaa

SEQ ID NO: 1742125 - RNA, 15 nt, Homo sapiens
aguguggucccucca

SEQ ID NO: 1742126 - RNA, 16 nt, Homo sapiens
aguuacauugugcuug

SEQ ID NO: 1742127 - RNA, 19 nt, Homo sapiens
aguucugcacccagccaaa

SEQ ID NO: 1742128 - RNA, 18 nt, Homo sapiens
auaccccuaguaucuggc

SEQ ID NO: 1742129 - RNA, 22 nt, Homo sapiens
auagagugaccuuuuaaucaga

SEQ ID NO: 1742130 - RNA, 19 nt, Homo sapiens
auauguggguugagcuaug

SEQ ID NO: 1742131 - RNA, 13 nt, Homo sapiens
auauuaaaccucu

SEQ ID NO: 1742132 - RNA, 17 nt, Homo sapiens
aucauccauucucucug

SEQ ID NO: 1742133 - RNA, 14 nt, Homo sapiens
aucauuucuaguau

SEQ ID NO: 1742134 - RNA, 21 nt, Homo sapiens
auccaguggggucucagucca

SEQ ID NO: 1742135 - RNA, 18 nt, Homo sapiens
aucccacuuagcagggac

SEQ ID NO: 1742136 - RNA, 17 nt, Homo sapiens
auccccuaacacaaguu

SEQ ID NO: 1742137 - RNA, 24 nt, Homo sapiens
aucucuuguucgcacaaucuacac

SEQ ID NO: 1742138 - RNA, 14 nt, Homo sapiens
aucucuuuucccac

SEQ ID NO: 1742139 - RNA, 21 nt, Homo sapiens
aucugaagccaccucucugcc

SEQ ID NO: 1742140 - RNA, 17 nt, Homo sapiens
augaacuuggauauuca

SEQ ID NO: 1742141 - RNA, 22 nt, Homo sapiens
augaggggaggggggcacaugc

SEQ ID NO: 1742142 - RNA, 17 nt, Homo sapiens
augagugucaacuccag

SEQ ID NO: 1742143 - RNA, 13 nt, Homo sapiens
auggcagugccug

SEQ ID NO: 1742144 - RNA, 19 nt, Homo sapiens
auggcaucauccauucucu

SEQ ID NO: 1742145 - RNA, 15 nt, Homo sapiens
augugaaucccucaa

SEQ ID NO: 1742146 - RNA, 14 nt, Homo sapiens
auguguaagacacu

SEQ ID NO: 1742147 - RNA, 18 nt, Homo sapiens
auuaaaccucuuucccca

SEQ ID NO: 1742148 - RNA, 19 nt, Homo sapiens
auuaccugucaucugggcc

SEQ ID NO: 1742149 - RNA, 16 nt, Homo sapiens
auucuaggcagcaccu

SEQ ID NO: 1742150 - RNA, 16 nt, Homo sapiens
auucugccccacaccc

SEQ ID NO: 1742151 - RNA, 14 nt, Homo sapiens
auugaagcauuuca

SEQ ID NO: 1742152 - RNA, 17 nt, Homo sapiens
auugacagcuuucuaac

SEQ ID NO: 1742153 - RNA, 16 nt, Homo sapiens
auuuucuucugagacu

SEQ ID NO: 1742154 - RNA, 14 nt, Homo sapiens
caaacaauucugau

SEQ ID NO: 1742155 - RNA, 19 nt, Homo sapiens
caaaggaaaaagcacaaga

SEQ ID NO: 1742156 - RNA, 17 nt, Homo sapiens
caacucgggagcauucu

SEQ ID NO: 1742157 - RNA, 20 nt, Homo sapiens
caagccuggagccccugugu

SEQ ID NO: 1742158 - RNA, 17 nt, Homo sapiens
caagucucacauauuca

SEQ ID NO: 1742159 - RNA, 15 nt, Homo sapiens
caaucuggaagaaag

SEQ ID NO: 1742160 - RNA, 16 nt, Homo sapiens
cacacacaaggugcuc

SEQ ID NO: 1742161 - RNA, 16 nt, Homo sapiens
cacagagggacuugag

SEQ ID NO: 1742162 - RNA, 16 nt, Homo sapiens
cacaugcugagucucc

SEQ ID NO: 1742163 - RNA, 20 nt, Homo sapiens
cacauguguaagacacugug

SEQ ID NO: 1742164 - RNA, 16 nt, Homo sapiens
caccagcuccacuggc

SEQ ID NO: 1742165 - RNA, 20 nt, Homo sapiens
cacgaggugguagcucugag

SEQ ID NO: 1742166 - RNA, 20 nt, Homo sapiens
cacugccuuaccuucacuua

SEQ ID NO: 1742167 - RNA, 14 nt, Homo sapiens
cagagcacuguagc

SEQ ID NO: 1742168 - RNA, 19 nt, Homo sapiens
cagaguaacgagaagacaa

SEQ ID NO: 1742169 - RNA, 14 nt, Homo sapiens
cagaugcuuugccc

SEQ ID NO: 1742170 - RNA, 12 nt, Homo sapiens
cagcaagcaauu

SEQ ID NO: 1742171 - RNA, 17 nt, Homo sapiens
cagcaagcaauucugcc

SEQ ID NO: 1742172 - RNA, 18 nt, Homo sapiens
cagccaagagccaucuga

SEQ ID NO: 1742173 - RNA, 23 nt, Homo sapiens
cagccaagagccaucugaagcca

SEQ ID NO: 1742174 - RNA, 14 nt, Homo sapiens
caggagcagcauca

SEQ ID NO: 1742175 - RNA, 19 nt, Homo sapiens
caggccauaccaggugcua

SEQ ID NO: 1742176 - RNA, 13 nt, Homo sapiens
cagggaagacaca

SEQ ID NO: 1742177 - RNA, 18 nt, Homo sapiens
caggggucucccugagcc

SEQ ID NO: 1742178 - RNA, 21 nt, Homo sapiens
caguaacaaaauugacagcuu

SEQ ID NO: 1742179 - RNA, 20 nt, Homo sapiens
caguacucccacaauuggcc

SEQ ID NO: 1742180 - RNA, 17 nt, Homo sapiens
cagugugcuaaccucac

SEQ ID NO: 1742181 - RNA, 22 nt, Homo sapiens
cagugugcuaaccucacugccu

SEQ ID NO: 1742182 - RNA, 23 nt, Homo sapiens
cagugugcuaaccucacugccuc

SEQ ID NO: 1742183 - RNA, 23 nt, Homo sapiens
caguucugcacccagccaaacac

SEQ ID NO: 1742184 - RNA, 17 nt, Homo sapiens
cauaacaauaaaaacca

SEQ ID NO: 1742185 - RNA, 15 nt, Homo sapiens
cauacagacagcaca

SEQ ID NO: 1742186 - RNA, 13 nt, Homo sapiens
cauaucacuauga

SEQ ID NO: 1742187 - RNA, 10 nt, Homo sapiens
caucaucucu

SEQ ID NO: 1742188 - RNA, 17 nt, Homo sapiens
caucccaugagcagucc

SEQ ID NO: 1742189 - RNA, 15 nt, Homo sapiens
ucaaaaacauucuua

SEQ ID NO: 1742190 - RNA, 22 nt, Homo sapiens
ucaagugauucuccugccucag

SEQ ID NO: 1742191 - RNA, 15 nt, Homo sapiens
ucguucucugccuca

SEQ ID NO: 1742192 - RNA, 18 nt, Homo sapiens
ucuuggguucaagugauu

SEQ ID NO: 1742193 - RNA, 13 nt, Homo sapiens
ucuuuuugcuuca

SEQ ID NO: 1742194 - RNA, 20 nt, Homo sapiens
ugaguagcuggauuacaggc

SEQ ID NO: 1742195 - RNA, 16 nt, Homo sapiens
ugcaaugacacagucu

SEQ ID NO: 1742196 - RNA, 18 nt, Homo sapiens
ugcaaugacacagucuug

SEQ ID NO: 1742197 - RNA, 12 nt, Homo sapiens
uggcucaucucu

SEQ ID NO: 1742198 - RNA, 23 nt, Homo sapiens
uguaagaucguucucugccucac

SEQ ID NO: 1742199 - RNA, 20 nt, Homo sapiens
uguguuuuuaauaaagacag

SEQ ID NO: 1742200 - RNA, 19 nt, Homo sapiens
uuacuuuuuccuggcucau

SEQ ID NO: 1742201 - RNA, 11 nt, Homo sapiens
uucaagugauu

SEQ ID NO: 1742202 - RNA, 12 nt, Homo sapiens
uucucugccuca

SEQ ID NO: 1742203 - RNA, 11 nt, Homo sapiens
uuuaaagacag

SEQ ID NO: 1742204 - RNA, 19 nt, Homo sapiens
uuugcuucaaaaacauucu

SEQ ID NO: 1742205 - RNA, 18 nt, Homo sapiens
aaagacaggguuucacca

SEQ ID NO: 1742206 - RNA, 12 nt, Homo sapiens
aacuucugccuc

SEQ ID NO: 1742207 - RNA, 17 nt, Homo sapiens
aagaucguucucugccu

SEQ ID NO: 1742208 - RNA, 20 nt, Homo sapiens
aaucuuucugcagaaacaga

SEQ ID NO: 1742209 - RNA, 21 nt, Homo sapiens
aguagcuggauuacaggcaug

SEQ ID NO: 1742210 - RNA, 17 nt, Homo sapiens
aucguucucugccucac

SEQ ID NO: 1742211 - RNA, 21 nt, Homo sapiens
auuuuacuuuuuccuggcuca

SEQ ID NO: 1742212 - RNA, 19 nt, Homo sapiens
caaagugcugggauuacag

SEQ ID NO: 1742213 - RNA, 14 nt, Homo sapiens
caauagauauuuac

SEQ ID NO: 1742214 - RNA, 20 nt, Homo sapiens
cagagucucgcucuguugcc

SEQ ID NO: 1742215 - RNA, 20 nt, Homo sapiens
caggcuggagugcaaugaca

SEQ ID NO: 1742216 - RNA, 20 nt, Homo sapiens
caggguuucaccauguuggc

SEQ ID NO: 1742217 - RNA, 24 nt, Homo sapiens
cauguuggccaggcuggucucaaa

SEQ ID NO: 1742218 - RNA, 15 nt, Homo sapiens
cccacccaacuaauu

SEQ ID NO: 1742219 - RNA, 14 nt, Homo sapiens
ccuggcucaucucu

SEQ ID NO: 1742220 - RNA, 16 nt, Homo sapiens
cugcuucugauaugca

SEQ ID NO: 1742221 - RNA, 13 nt, Homo sapiens
cuggcucaucucu

SEQ ID NO: 1742222 - RNA, 17 nt, Homo sapiens
cuuggguucaagugauu

SEQ ID NO: 1742223 - RNA, 15 nt, Homo sapiens
cuuuuuauacuauua

SEQ ID NO: 1742224 - RNA, 20 nt, Homo sapiens
cuuuuuccuggcucaucucu

SEQ ID NO: 1742225 - RNA, 16 nt, Homo sapiens
gcccagccucaucucu

SEQ ID NO: 1742226 - RNA, 20 nt, Homo sapiens
gcccaggcuggagugcaaug

SEQ ID NO: 1742227 - RNA, 22 nt, Homo sapiens
gcuggauuacaggcaugugcca

SEQ ID NO: 1742228 - RNA, 13 nt, Homo sapiens
ggauuacaggcau

SEQ ID NO: 1742229 - RNA, 15 nt, Homo sapiens
ggcuggagugcaaug

SEQ ID NO: 1742230 - RNA, 20 nt, Homo sapiens
ggcuggagugcaaugacaca

SEQ ID NO: 1742231 - RNA, 14 nt, Homo sapiens
ggguucaagugauu

SEQ ID NO: 1742232 - RNA, 22 nt, Homo sapiens
gucuuggcucacugcaacuucu

SEQ ID NO: 1742233 - RNA, 19 nt, Homo sapiens
guuucaccauguuggccag

SEQ ID NO: 1742234 - RNA, 21 nt, Homo sapiens
uaagaucguucucugccucac

SEQ ID NO: 1742235 - RNA, 16 nt, Homo sapiens
uacuauuuuuacuaau

SEQ ID NO: 1742236 - RNA, 21 nt, Homo sapiens
uacuauuuuuacuaaucuuuc

SEQ ID NO: 1742237 - RNA, 15 nt, Homo sapiens
uaucuaaaaucugcu

SEQ ID NO: 1742238 - RNA, 13 nt, Homo sapiens
aaaaacauucuua

SEQ ID NO: 1742239 - RNA, 18 nt, Homo sapiens
aaaaguauccugcuucug

SEQ ID NO: 1742240 - RNA, 10 nt, Homo sapiens
aaaagugaug

SEQ ID NO: 1742241 - RNA, 18 nt, Homo sapiens
aaguaauccaccugccuc

SEQ ID NO: 1742242 - RNA, 15 nt, Homo sapiens
aaugacacagucuug

SEQ ID NO: 1742243 - RNA, 20 nt, Homo sapiens
aaugacacagucuuggcuca

SEQ ID NO: 1742244 - RNA, 19 nt, Homo sapiens
acacagucuuggcucacug

SEQ ID NO: 1742245 - RNA, 23 nt, Homo sapiens
acauuuuacuuuuuccuggcuca

SEQ ID NO: 1742246 - RNA, 21 nt, Homo sapiens
accgcgcccagccucaucucu

SEQ ID NO: 1742247 - RNA, 16 nt, Homo sapiens
acugcaacuucugccu

SEQ ID NO: 1742248 - RNA, 19 nt, Homo sapiens
agaucguucucugccucac

SEQ ID NO: 1742249 - RNA, 23 nt, Homo sapiens
agccaccgcgcccagccucaucu

SEQ ID NO: 1742250 - RNA, 13 nt, Homo sapiens
agccucaucucuu

SEQ ID NO: 1742251 - RNA, 16 nt, Homo sapiens
aguagcuggauuacag

SEQ ID NO: 1742252 - RNA, 19 nt, Homo sapiens
agugauucuccugccucag

SEQ ID NO: 1742253 - RNA, 11 nt, Homo sapiens
auaaagacagg

SEQ ID NO: 1742254 - RNA, 20 nt, Homo sapiens
aucugcuagggaauaucaau

SEQ ID NO: 1742255 - RNA, 19 nt, Homo sapiens
auuaucuaaaaucugcuag

SEQ ID NO: 1742256 - RNA, 16 nt, Homo sapiens
auuuuaauguuuccuu

SEQ ID NO: 1742257 - RNA, 22 nt, Homo sapiens
caaaaacauucuuacauuuuac

SEQ ID NO: 1742258 - RNA, 22 nt, Homo sapiens
caaucaauucauaucuauuuau

SEQ ID NO: 1742259 - RNA, 15 nt, Homo sapiens
caaugacacagucuu

SEQ ID NO: 1742260 - RNA, 22 nt, Homo sapiens
caccgcgcccagccucaucucu

SEQ ID NO: 1742261 - RNA, 21 nt, Homo sapiens
cagagucucgcucuguugccc

SEQ ID NO: 1742262 - RNA, 20 nt, Homo sapiens
cagccuccugaguagcugga

SEQ ID NO: 1742263 - RNA, 17 nt, Homo sapiens
ccaggcuggagugcaau

SEQ ID NO: 1742264 - RNA, 20 nt, Homo sapiens
ccaggcuggagugcaaugac

SEQ ID NO: 1742265 - RNA, 22 nt, Homo sapiens
ccugaccucaaguaauccaccu

SEQ ID NO: 1742266 - RNA, 13 nt, Homo sapiens
cucuuggguucaa

SEQ ID NO: 1742267 - RNA, 19 nt, Homo sapiens
cugaguagcuggauuacag

SEQ ID NO: 1742268 - RNA, 19 nt, Homo sapiens
cuuuaauuuuuuacuauuu

SEQ ID NO: 1742269 - RNA, 23 nt, Homo sapiens
cuuuuuuuuuuuuuaaagacaga

SEQ ID NO: 1742270 - RNA, 18 nt, Homo sapiens
gcgcccagccucaucucu

SEQ ID NO: 1742271 - RNA, 15 nt, Homo sapiens
gcuagggaauaucaa

SEQ ID NO: 1742272 - RNA, 13 nt, Homo sapiens
gcugggauuacag

SEQ ID NO: 1742273 - RNA, 22 nt, Homo sapiens
ggagaaauaugguacucauuaa

SEQ ID NO: 1742274 - RNA, 18 nt, Homo sapiens
ggguuucaccauguuggc

SEQ ID NO: 1742275 - RNA, 22 nt, Homo sapiens
guaagaucguucucugccucac

SEQ ID NO: 1742276 - RNA, 23 nt, Homo sapiens
uaaaaaaaaaaaaaaaagugaug

SEQ ID NO: 1742277 - RNA, 15 nt, Homo sapiens
uaauaaagacagggu

SEQ ID NO: 1742278 - RNA, 22 nt, Homo sapiens
uaccuuuuauuuuaauguuucc

SEQ ID NO: 1742279 - RNA, 22 nt, Homo sapiens
uacuuuuuccuggcucaucucu

SEQ ID NO: 1742280 - RNA, 13 nt, Homo sapiens
ucaaaaacauucu

SEQ ID NO: 1742281 - RNA, 14 nt, Homo sapiens
ucaaaaacauucuu

SEQ ID NO: 1742282 - RNA, 17 nt, Homo sapiens
ucaaacuccugaccuca

SEQ ID NO: 1742283 - RNA, 22 nt, Homo sapiens
ucuaaagauggaaaaaccaccc

SEQ ID NO: 1742284 - RNA, 20 nt, Homo sapiens
ucucaaacuccugaccucaa

SEQ ID NO: 1742285 - RNA, 22 nt, Homo sapiens
ucugauaugcaguuuuccuuaa

SEQ ID NO: 1742286 - RNA, 13 nt, Homo sapiens
ugggauuacaggg

SEQ ID NO: 1742287 - RNA, 22 nt, Homo sapiens
uguuuccuuuaauuuuuuacua

SEQ ID NO: 1742288 - RNA, 22 nt, Homo sapiens
uuaccuuuuauuuuaauguuuc

SEQ ID NO: 1742289 - RNA, 13 nt, Homo sapiens
uucuccugccuca

SEQ ID NO: 1742290 - RNA, 15 nt, Homo sapiens
uucugaaaaaguauc

SEQ ID NO: 1742291 - RNA, 21 nt, Homo sapiens
uugcccaggcuggagugcaau

SEQ ID NO: 1742292 - RNA, 9 nt, Homo sapiens
aaagugaug

SEQ ID NO: 1742293 - RNA, 23 nt, Homo sapiens
aaauuuucuuuuuauacuauuaa

SEQ ID NO: 1742294 - RNA, 12 nt, Homo sapiens
aauaaagacagg

SEQ ID NO: 1742295 - RNA, 17 nt, Homo sapiens
acuuuuuccuggcucau

SEQ ID NO: 1742296 - RNA, 21 nt, Homo sapiens
acuuuuuccuggcucaucucu

SEQ ID NO: 1742297 - RNA, 17 nt, Homo sapiens
agcuggauuacaggcau

SEQ ID NO: 1742298 - RNA, 16 nt, Homo sapiens
agugauucuccugccu

SEQ ID NO: 1742299 - RNA, 15 nt, Homo sapiens
aucuaaaaucugcua

SEQ ID NO: 1742300 - RNA, 12 nt, Homo sapiens
augacacagucu

SEQ ID NO: 1742301 - RNA, 18 nt, Homo sapiens
auguaagaucguucucug

SEQ ID NO: 1742302 - RNA, 17 nt, Homo sapiens
auucuuacauuuuacuu

SEQ ID NO: 1742303 - RNA, 17 nt, Homo sapiens
auuuucuuuuuauacua

SEQ ID NO: 1742304 - RNA, 17 nt, Homo sapiens
caaacuccugaccucaa

SEQ ID NO: 1742305 - RNA, 17 nt, Homo sapiens
caggcuggagugcaaug

SEQ ID NO: 1742306 - RNA, 21 nt, Homo sapiens
caggguuucaccauguuggcc

SEQ ID NO: 1742307 - RNA, 19 nt, Homo sapiens
cagucuuggcucacugcaa

SEQ ID NO: 1742308 - RNA, 18 nt, Homo sapiens
ccaggcuggagugcaaug

SEQ ID NO: 1742309 - RNA, 19 nt, Homo sapiens
cccaggcuggagugcaaug

SEQ ID NO: 1742310 - RNA, 20 nt, Homo sapiens
cccaggcuggagugcaauga

SEQ ID NO: 1742311 - RNA, 20 nt, Homo sapiens
cuccugaccucaaguaaucc

SEQ ID NO: 1742312 - RNA, 20 nt, Homo sapiens
cuggauuacaggcaugugcc

SEQ ID NO: 1742313 - RNA, 16 nt, Homo sapiens
cuucuuuuugcuucaa

SEQ ID NO: 1742314 - RNA, 12 nt, Homo sapiens
gaguagcuggau

SEQ ID NO: 1742315 - RNA, 18 nt, Homo sapiens
gaucguucucugccucac

SEQ ID NO: 1742316 - RNA, 11 nt, Homo sapiens
gccucaucucu

SEQ ID NO: 1742317 - RNA, 12 nt, Homo sapiens
gcuggagugcaa

SEQ ID NO: 1742318 - RNA, 13 nt, Homo sapiens
gguucaagugauu

SEQ ID NO: 1742319 - RNA, 21 nt, Homo sapiens
gucucaaacuccugaccucaa

SEQ ID NO: 1742320 - RNA, 12 nt, Homo sapiens
gucuuggcucac

SEQ ID NO: 1742321 - RNA, 13 nt, Homo sapiens
guucucugccuca

SEQ ID NO: 1742322 - RNA, 10 nt, Homo sapiens
uaaagacaga

SEQ ID NO: 1742323 - RNA, 13 nt, Homo sapiens
uaauaaagacagg

SEQ ID NO: 1742324 - RNA, 13 nt, Homo sapiens
uacuaaucuuucu

SEQ ID NO: 1742325 - RNA, 13 nt, Homo sapiens
ucaaguaauccac

SEQ ID NO: 1742326 - RNA, 21 nt, Homo sapiens
ucaaguaauccaccugccucg

SEQ ID NO: 1742327 - RNA, 19 nt, Homo sapiens
ucaagugauucuccugccu

SEQ ID NO: 1742328 - RNA, 21 nt, Homo sapiens
ucaagugauucuccugccuca

SEQ ID NO: 1742329 - RNA, 18 nt, Homo sapiens
uccugaccucaaguaauc

SEQ ID NO: 1742330 - RNA, 15 nt, Homo sapiens
uccugcuucugauau

SEQ ID NO: 1742331 - RNA, 15 nt, Homo sapiens
ucuaaaaucugcuag

SEQ ID NO: 1742332 - RNA, 12 nt, Homo sapiens
ucugcuagggaa

SEQ ID NO: 1742333 - RNA, 18 nt, Homo sapiens
uggccaggcuggucucaa

SEQ ID NO: 1742334 - RNA, 21 nt, Homo sapiens
uguguuuuuaauaaagacagg

SEQ ID NO: 1742335 - RNA, 19 nt, Homo sapiens
uguuuuuaauaaagacagg

SEQ ID NO: 1742336 - RNA, 16 nt, Homo sapiens
uuaauaaagacagggu

SEQ ID NO: 1742337 - RNA, 13 nt, Homo sapiens
uuacuaaucuuuc

SEQ ID NO: 1742338 - RNA, 13 nt, Homo sapiens
uucuucuuuuugc

SEQ ID NO: 1742339 - RNA, 20 nt, Homo sapiens
uugcccaggcuggagugcaa

SEQ ID NO: 1742340 - RNA, 12 nt, Homo sapiens
uuuaaagacaga

SEQ ID NO: 1742341 - RNA, 16 nt, Homo sapiens
uuuaauguuuccuuua

SEQ ID NO: 1742342 - RNA, 18 nt, Homo sapiens
uuuuccuggcucaucucu

SEQ ID NO: 1742343 - RNA, 19 nt, Homo sapiens
uuuucuucuuuuugcuuca

SEQ ID NO: 1742344 - RNA, 20 nt, Homo sapiens
uuuuuacuaaucuuucugca

SEQ ID NO: 1742345 - RNA, 9 nt, Homo sapiens
aaagacaga

SEQ ID NO: 1742346 - RNA, 23 nt, Homo sapiens
aauguaagaucguucucugccuc

SEQ ID NO: 1742347 - RNA, 12 nt, Homo sapiens
agccucaucucu

SEQ ID NO: 1742348 - RNA, 14 nt, Homo sapiens
agccucaucucuuu

SEQ ID NO: 1742349 - RNA, 20 nt, Homo sapiens
agcuuacaagccagcuggag

SEQ ID NO: 1742350 - RNA, 16 nt, Homo sapiens
aggcuggagugcaaug

SEQ ID NO: 1742351 - RNA, 19 nt, Homo sapiens
aguauccugcuucugauau

SEQ ID NO: 1742352 - RNA, 15 nt, Homo sapiens
auaaagacaggguuu

SEQ ID NO: 1742353 - RNA, 22 nt, Homo sapiens
augaaucaaucaauucauaucu

SEQ ID NO: 1742354 - RNA, 16 nt, Homo sapiens
augcaguuuuccuuaa

SEQ ID NO: 1742355 - RNA, 15 nt, Homo sapiens
auucuccugccucag

SEQ ID NO: 1742356 - RNA, 15 nt, Homo sapiens
cacagucuuggcuca

SEQ ID NO: 1742357 - RNA, 13 nt, Homo sapiens
cagccucaucucu

SEQ ID NO: 1742358 - RNA, 22 nt, Homo sapiens
caggcaugugccacccacccaa

SEQ ID NO: 1742359 - RNA, 16 nt, Homo sapiens
caggcuggagugcaau

SEQ ID NO: 1742360 - RNA, 23 nt, Homo sapiens
ccacccccaaauuuucuuuuuau

SEQ ID NO: 1742361 - RNA, 14 nt, Homo sapiens
ccagccucaucucu

SEQ ID NO: 1742362 - RNA, 16 nt, Homo sapiens
ccaggcuggagugcaa

SEQ ID NO: 1742363 - RNA, 15 nt, Homo sapiens
cccagccucaucucu

SEQ ID NO: 1742364 - RNA, 19 nt, Homo sapiens
cuccugaguagcuggauua

SEQ ID NO: 1742365 - RNA, 20 nt, Homo sapiens
cucuuggguucaagugauuc

SEQ ID NO: 1742366 - RNA, 17 nt, Homo sapiens
cugcuagggaauaucaa

SEQ ID NO: 1742367 - RNA, 22 nt, Homo sapiens
cugggauuacagggaugagcca

SEQ ID NO: 1742368 - RNA, 17 nt, Homo sapiens
cuucugaaaaaguaucc

SEQ ID NO: 1742369 - RNA, 17 nt, Homo sapiens
cuucuuuuugcuucaaa

SEQ ID NO: 1742370 - RNA, 15 nt, Homo sapiens
gauucuccugccuca

SEQ ID NO: 1742371 - RNA, 16 nt, Homo sapiens
gauucuccugccucag

SEQ ID NO: 1742372 - RNA, 18 nt, Homo sapiens
gcccaggcuggagugcaa

SEQ ID NO: 1742373 - RNA, 19 nt, Homo sapiens
gcccaggcuggagugcaau

SEQ ID NO: 1742374 - RNA, 14 nt, Homo sapiens
gcuucugauaugca

SEQ ID NO: 1742375 - RNA, 13 nt, Homo sapiens
ggauuacagggau

SEQ ID NO: 1742376 - RNA, 11 nt, Homo sapiens
ggcucaucucu

SEQ ID NO: 1742377 - RNA, 19 nt, Homo sapiens
gugcugggauuacagggau

SEQ ID NO: 1742378 - RNA, 22 nt, Homo sapiens
guguuuuuaauaaagacagggu

SEQ ID NO: 1742379 - RNA, 12 nt, Homo sapiens
uauuuuuacuaa

SEQ ID NO: 1742380 - RNA, 18 nt, Homo sapiens
ucacugcaacuucugccu

SEQ ID NO: 1742381 - RNA, 14 nt, Homo sapiens
ucaucucuuuauuc

SEQ ID NO: 1742382 - RNA, 23 nt, Homo sapiens
uccugaccucaaguaauccaccu

SEQ ID NO: 1742383 - RNA, 19 nt, Homo sapiens
uccugaguagcuggauuac

SEQ ID NO: 1742384 - RNA, 20 nt, Homo sapiens
ucuaaagauggaaaaaccac

SEQ ID NO: 1742385 - RNA, 20 nt, Homo sapiens
ucugaaaaaguauccugcuu

SEQ ID NO: 1742386 - RNA, 13 nt, Homo sapiens
ugacacagucuug

SEQ ID NO: 1742387 - RNA, 22 nt, Homo sapiens
ugaguagcuggauuacaggcau

SEQ ID NO: 1742388 - RNA, 20 nt, Homo sapiens
ugcccaggcuggagugcaau

SEQ ID NO: 1742389 - RNA, 21 nt, Homo sapiens
ugcccaggcuggagugcaaug

SEQ ID NO: 1742390 - RNA, 19 nt, Homo sapiens
ugcuucaaaaacauucuua

SEQ ID NO: 1742391 - RNA, 21 nt, Homo sapiens
uggauuacaggcaugugccac

SEQ ID NO: 1742392 - RNA, 13 nt, Homo sapiens
uggcucaucucuu

SEQ ID NO: 1742393 - RNA, 14 nt, Homo sapiens
uggcucaucucuuu

SEQ ID NO: 1742394 - RNA, 14 nt, Homo sapiens
ugggauuacaggga

SEQ ID NO: 1742395 - RNA, 15 nt, Homo sapiens
ugggauuacagggau

SEQ ID NO: 1742396 - RNA, 14 nt, Homo sapiens
uguguuuuuaauaa

SEQ ID NO: 1742397 - RNA, 23 nt, Homo sapiens
uuacuuuuuccuggcucaucucu

SEQ ID NO: 1742398 - RNA, 23 nt, Homo sapiens
uucuaaagauggaaaaaccaccc

SEQ ID NO: 1742399 - RNA, 17 nt, Homo sapiens
uuuaauguuuccuuuaa

SEQ ID NO: 1742400 - RNA, 14 nt, Homo sapiens
ccagcccacacagc

SEQ ID NO: 1742401 - RNA, 14 nt, Homo sapiens
aaaggacaaccaca

SEQ ID NO: 1742402 - RNA, 13 nt, Homo sapiens
ccaucuugcugac

SEQ ID NO: 1742403 - RNA, 22 nt, Homo sapiens
gcuaugcaggguagcacuggga

SEQ ID NO: 1742404 - RNA, 13 nt, Homo sapiens
guucccuccugcc

SEQ ID NO: 1742405 - RNA, 21 nt, Homo sapiens
uccugcugcuguaacugcuga

SEQ ID NO: 1742406 - RNA, 22 nt, Homo sapiens
ugaacucuuucuggccugccuu

SEQ ID NO: 1742407 - RNA, 17 nt, Homo sapiens
acacagugcuauuugca

SEQ ID NO: 1742408 - RNA, 20 nt, Homo sapiens
ucucaaaugaaaauuuaauu

SEQ ID NO: 1742409 - RNA, 15 nt, Homo sapiens
gcaccaagacugaga

SEQ ID NO: 1742410 - RNA, 14 nt, Homo sapiens
cucucagccuccac

SEQ ID NO: 1742411 - RNA, 13 nt, Homo sapiens
uugauucucaugc

SEQ ID NO: 1742412 - RNA, 22 nt, Homo sapiens
aaugggauggucggaucucaca

SEQ ID NO: 1742413 - RNA, 15 nt, Homo sapiens
cagagcuccaugcau

SEQ ID NO: 1742414 - RNA, 14 nt, Homo sapiens
auugugagcacuga

SEQ ID NO: 1742415 - RNA, 17 nt, Homo sapiens
guacugauucaagaaca

SEQ ID NO: 1742416 - RNA, 14 nt, Homo sapiens
caauaagcuggacu

SEQ ID NO: 1742417 - RNA, 17 nt, Homo sapiens
acuugguugguccuugu

SEQ ID NO: 1742418 - RNA, 22 nt, Homo sapiens
uuccauauuuauguaccauauu

SEQ ID NO: 1742419 - RNA, 16 nt, Homo sapiens
ccugucacacacugga

SEQ ID NO: 1742420 - RNA, 20 nt, Homo sapiens
gucuuuguuaagacugcuga

SEQ ID NO: 1742421 - RNA, 23 nt, Homo sapiens
auaucuguccccugcuacuagau

SEQ ID NO: 1742422 - RNA, 15 nt, Homo sapiens
uaaagcacauuccaa

SEQ ID NO: 1742423 - RNA, 22 nt, Homo sapiens
uuagauacagagacuuggggaa

SEQ ID NO: 1742424 - RNA, 20 nt, Homo sapiens
caaacauguuguacauuuca

SEQ ID NO: 1742425 - RNA, 20 nt, Homo sapiens
uaccaagugcuuugcucuag

SEQ ID NO: 1742426 - RNA, 22 nt, Homo sapiens
uaguggcauaccaaauggcacu

SEQ ID NO: 1742427 - RNA, 22 nt, Homo sapiens
acacacguaccuucaugugauu

SEQ ID NO: 1742428 - RNA, 23 nt, Homo sapiens
aguacuugggaggccaaggcagg

SEQ ID NO: 1742429 - RNA, 19 nt, Homo sapiens
uaguuucacccugcacuac

SEQ ID NO: 1742430 - RNA, 14 nt, Homo sapiens
ugacugccaaaaag

SEQ ID NO: 1742431 - RNA, 22 nt, Homo sapiens
aguuuauggauaugcugcuuua

SEQ ID NO: 1742432 - RNA, 16 nt, Homo sapiens
ucucuucuaagcaaaa

SEQ ID NO: 1742433 - RNA, 18 nt, Homo sapiens
aggcgcuuggcaucacac

SEQ ID NO: 1742434 - RNA, 15 nt, Homo sapiens
aaccagcccagccug

SEQ ID NO: 1742435 - RNA, 21 nt, Homo sapiens
ccuuucuguugccagucagca

SEQ ID NO: 1742436 - RNA, 15 nt, Homo sapiens
aaaucuugacuacag

SEQ ID NO: 1742437 - RNA, 19 nt, Homo sapiens
cgaaccaucucaauguaag

SEQ ID NO: 1742438 - RNA, 21 nt, Homo sapiens
uccuggcaucuauuuccucug

SEQ ID NO: 1742439 - RNA, 14 nt, Homo sapiens
aagggaguugcuca

SEQ ID NO: 1742440 - RNA, 13 nt, Homo sapiens
auaacagaauuaa

SEQ ID NO: 1742441 - RNA, 17 nt, Homo sapiens
gcugcaguuccaaaaga

SEQ ID NO: 1742442 - RNA, 22 nt, Homo sapiens
ccacgauuuucuccagcucaga

SEQ ID NO: 1742443 - RNA, 17 nt, Homo sapiens
gcugaugccuccuuggc

SEQ ID NO: 1742444 - RNA, 23 nt, Homo sapiens
gucgaauggggucccccucccac

SEQ ID NO: 1742445 - RNA, 22 nt, Homo sapiens
uguccuggugcucucugccacu

SEQ ID NO: 1742446 - RNA, 15 nt, Homo sapiens
aagcuauaacauauu

SEQ ID NO: 1742447 - RNA, 14 nt, Homo sapiens
aauaaauuaugcaa

SEQ ID NO: 1742448 - RNA, 14 nt, Homo sapiens
aucucuaccugggu

SEQ ID NO: 1742449 - RNA, 14 nt, Homo sapiens
ugaaaaaaauuguc

SEQ ID NO: 1742450 - RNA, 19 nt, Homo sapiens
ccacucugcauacccucau

SEQ ID NO: 1742451 - RNA, 18 nt, Homo sapiens
gcccagauggcacucagc

SEQ ID NO: 1742452 - RNA, 19 nt, Homo sapiens
gagaaaguuuaaaauggaa

SEQ ID NO: 1742453 - RNA, 16 nt, Homo sapiens
gagcgccucaccugca

SEQ ID NO: 1742454 - RNA, 15 nt, Homo sapiens
uguucccuguucugg

SEQ ID NO: 1742455 - RNA, 16 nt, Homo sapiens
acaaauacauuccuuu

SEQ ID NO: 1742456 - RNA, 23 nt, Homo sapiens
gcugaggacccucagccccagga

SEQ ID NO: 1742457 - RNA, 12 nt, Homo sapiens
acuuuaucucac

SEQ ID NO: 1742458 - RNA, 20 nt, Homo sapiens
uuccuguacuacugccuugu

SEQ ID NO: 1742459 - RNA, 23 nt, Homo sapiens
aauacuaggaaguaaagugaaga

SEQ ID NO: 1742460 - RNA, 22 nt, Homo sapiens
guuagggacauuuccaagcugu

SEQ ID NO: 1742461 - RNA, 24 nt, Homo sapiens
ucaggcuacuguucuugacaauca

SEQ ID NO: 1742462 - RNA, 21 nt, Homo sapiens
cugacaauaaagauauuucca

SEQ ID NO: 1742463 - RNA, 13 nt, Homo sapiens
uaggcaaagaagg

SEQ ID NO: 1742464 - RNA, 14 nt, Homo sapiens
ucucggcacuccca

SEQ ID NO: 1742465 - RNA, 12 nt, Homo sapiens
cacucauuccuu

SEQ ID NO: 1742466 - RNA, 21 nt, Homo sapiens
aucacaagucagcacuaccuc

SEQ ID NO: 1742467 - RNA, 23 nt, Homo sapiens
auucugggcuccuggaaccaauc

SEQ ID NO: 1742468 - RNA, 23 nt, Homo sapiens
aacucccugccccccagcccucc

SEQ ID NO: 1742469 - RNA, 12 nt, Homo sapiens
cauuucauauaa

SEQ ID NO: 1742470 - RNA, 13 nt, Homo sapiens
ggcagggacaccc

SEQ ID NO: 1742471 - RNA, 23 nt, Homo sapiens
cgaggaagaagaaacccuaggca

SEQ ID NO: 1742472 - RNA, 17 nt, Homo sapiens
uggccaaggagcugcua

SEQ ID NO: 1742473 - RNA, 14 nt, Homo sapiens
aaacuuuaucucac

SEQ ID NO: 1742474 - RNA, 22 nt, Homo sapiens
ugccaagucucccaauauccaa

SEQ ID NO: 1742475 - RNA, 17 nt, Homo sapiens
cgagaaaacaaacccag

SEQ ID NO: 1742476 - RNA, 17 nt, Homo sapiens
gcuuuuccaacccauga

SEQ ID NO: 1742477 - RNA, 18 nt, Homo sapiens
caggacagucagcucucu

SEQ ID NO: 1742478 - RNA, 14 nt, Homo sapiens
cacucuuuccagau

SEQ ID NO: 1742479 - RNA, 13 nt, Homo sapiens
aucagacauacag

SEQ ID NO: 1742480 - RNA, 13 nt, Homo sapiens
aagacacauugac

SEQ ID NO: 1742481 - RNA, 13 nt, Homo sapiens
uaauaacaauaua

SEQ ID NO: 1742482 - RNA, 22 nt, Homo sapiens
auugaguggcugcccugcagaa

SEQ ID NO: 1742483 - RNA, 19 nt, Homo sapiens
gaucccaggggaguguuca

SEQ ID NO: 1742484 - RNA, 15 nt, Homo sapiens
uaaacuuaaguccag

SEQ ID NO: 1742485 - RNA, 13 nt, Homo sapiens
cuggaauugcuca

SEQ ID NO: 1742486 - RNA, 14 nt, Homo sapiens
guaugaaugcagug

SEQ ID NO: 1742487 - RNA, 14 nt, Homo sapiens
agcaugguauugaa

SEQ ID NO: 1742488 - RNA, 13 nt, Homo sapiens
gaugauuuuggcc

SEQ ID NO: 1742489 - RNA, 18 nt, Homo sapiens
uuccuucucugaaagugg

SEQ ID NO: 1742490 - RNA, 21 nt, Homo sapiens
uaggcucugggugcaguagug

SEQ ID NO: 1742491 - RNA, 18 nt, Homo sapiens
ucaaccucucuacuagca

SEQ ID NO: 1742492 - RNA, 20 nt, Homo sapiens
ugcacuccagccugggcaac

SEQ ID NO: 1742493 - RNA, 15 nt, Homo sapiens
ggcccauacugguug

SEQ ID NO: 1742494 - RNA, 15 nt, Homo sapiens
gcagguccagugcag

SEQ ID NO: 1742495 - RNA, 19 nt, Homo sapiens
auaacauuuaaauuccaca

SEQ ID NO: 1742496 - RNA, 18 nt, Homo sapiens
agacuugaaaccagaaga

SEQ ID NO: 1742497 - RNA, 12 nt, Homo sapiens
ccagcacagggc

SEQ ID NO: 1742498 - RNA, 14 nt, Homo sapiens
uggcaucagucaac

SEQ ID NO: 1742499 - RNA, 19 nt, Homo sapiens
acuaaccucuaacaacaaa

SEQ ID NO: 1742500 - RNA, 22 nt, Homo sapiens
ugguguuaccuuagcuaacuaa

SEQ ID NO: 1742501 - RNA, 20 nt, Homo sapiens
aaagacauucugacaucuua

SEQ ID NO: 1742502 - RNA, 15 nt, Homo sapiens
uugcccccuugccca

SEQ ID NO: 1742503 - RNA, 15 nt, Homo sapiens
augugaccaugugaa

SEQ ID NO: 1742504 - RNA, 23 nt, Homo sapiens
aggggucuuguuaagugcagucu

SEQ ID NO: 1742505 - RNA, 18 nt, Homo sapiens
cacagugggugaggagau

SEQ ID NO: 1742506 - RNA, 15 nt, Homo sapiens
aaacaggugcuaaca

SEQ ID NO: 1742507 - RNA, 16 nt, Homo sapiens
acccuccuccugucaa

SEQ ID NO: 1742508 - RNA, 14 nt, Homo sapiens
gggacuuacaugau

SEQ ID NO: 1742509 - RNA, 22 nt, Homo sapiens
agacaucagucuccaacauguu

SEQ ID NO: 1742510 - RNA, 15 nt, Homo sapiens
acuccacaacucaag

SEQ ID NO: 1742511 - RNA, 18 nt, Homo sapiens
cugggaacacaucuggcu

SEQ ID NO: 1742512 - RNA, 20 nt, Homo sapiens
ugcaaaaguucugacuugac

SEQ ID NO: 1742513 - RNA, 14 nt, Homo sapiens
aacuaauaagcaag

SEQ ID NO: 1742514 - RNA, 13 nt, Homo sapiens
gcuggcgccuagg

SEQ ID NO: 1742515 - RNA, 16 nt, Homo sapiens
cuucgcaucaaaagac

SEQ ID NO: 1742516 - RNA, 20 nt, Homo sapiens
ugccuggacucagcaacuca

SEQ ID NO: 1742517 - RNA, 17 nt, Homo sapiens
ucuuucuuggugucugu

SEQ ID NO: 1742518 - RNA, 16 nt, Homo sapiens
cccaacugacuuguau

SEQ ID NO: 1742519 - RNA, 18 nt, Homo sapiens
cuuauaacucaacauuug

SEQ ID NO: 1742520 - RNA, 13 nt, Homo sapiens
cuuuuuccaaaag

SEQ ID NO: 1742521 - RNA, 21 nt, Homo sapiens
ccaaagagaagggcacuguaa

SEQ ID NO: 1742522 - RNA, 19 nt, Homo sapiens
gagagaacugagcaucucc

SEQ ID NO: 1742523 - RNA, 16 nt, Homo sapiens
augacuuucauaauaa

SEQ ID NO: 1742524 - RNA, 21 nt, Homo sapiens
caaguacaccagccaccucca

SEQ ID NO: 1742525 - RNA, 16 nt, Homo sapiens
guuuccaaaaaccaug

SEQ ID NO: 1742526 - RNA, 12 nt, Homo sapiens
uuucccaaagag

SEQ ID NO: 1742527 - RNA, 15 nt, Homo sapiens
ucauggagaccucau

SEQ ID NO: 1742528 - RNA, 20 nt, Homo sapiens
uauuaauuguuuugcacuuu

SEQ ID NO: 1742529 - RNA, 12 nt, Homo sapiens
cacacugaucug

SEQ ID NO: 1742530 - RNA, 20 nt, Homo sapiens
cuuuugcuucaguugcauau

SEQ ID NO: 1742531 - RNA, 16 nt, Homo sapiens
cuccagagucaaaagg

SEQ ID NO: 1742532 - RNA, 21 nt, Homo sapiens
gcagugcucgcuguugcugaa

SEQ ID NO: 1742533 - RNA, 15 nt, Homo sapiens
agucuagcauucugc

SEQ ID NO: 1742534 - RNA, 17 nt, Homo sapiens
agggaaagcuuccuccu

SEQ ID NO: 1742535 - RNA, 21 nt, Homo sapiens
accuuuauuaaugaacuguga

SEQ ID NO: 1742536 - RNA, 16 nt, Homo sapiens
caguguaauccagggg

SEQ ID NO: 1742537 - RNA, 17 nt, Homo sapiens
ucaugaagaagcucuug

SEQ ID NO: 1742538 - RNA, 21 nt, Homo sapiens
cacuguggccaucaggacuuu

SEQ ID NO: 1742539 - RNA, 20 nt, Homo sapiens
ggagccaucacccucaccca

SEQ ID NO: 1742540 - RNA, 23 nt, Homo sapiens
ucucuuguugauuuccgugaaaa

SEQ ID NO: 1742541 - RNA, 16 nt, Homo sapiens
aggcaggagaaucacu

SEQ ID NO: 1742542 - RNA, 13 nt, Homo sapiens
auaucaacaacaa

SEQ ID NO: 1742543 - RNA, 13 nt, Homo sapiens
gagagagcuccug

SEQ ID NO: 1742544 - RNA, 22 nt, Homo sapiens
gaguguucauuuuagugacugu

SEQ ID NO: 1742545 - RNA, 13 nt, Homo sapiens
uugggggauucaa

SEQ ID NO: 1742546 - RNA, 19 nt, Homo sapiens
ugcaagcaagaaacacugg

SEQ ID NO: 1742547 - RNA, 17 nt, Homo sapiens
gccuaaagccagcauuu

SEQ ID NO: 1742548 - RNA, 18 nt, Homo sapiens
cuguuacuugaaauacca

SEQ ID NO: 1742549 - RNA, 22 nt, Homo sapiens
uucuagagagcuuaguguauac

SEQ ID NO: 1742550 - RNA, 20 nt, Homo sapiens
caacuaucaaaauugccuuu

SEQ ID NO: 1742551 - RNA, 14 nt, Homo sapiens
aaaucauacugcau

SEQ ID NO: 1742552 - RNA, 20 nt, Homo sapiens
acugcuaggcgagugccagg

SEQ ID NO: 1742553 - RNA, 18 nt, Homo sapiens
ugcccuguucucuucaca

SEQ ID NO: 1742554 - RNA, 16 nt, Homo sapiens
accgacaaaauuccag

SEQ ID NO: 1742555 - RNA, 21 nt, Homo sapiens
cacugaucugcuagugcugua

SEQ ID NO: 1742556 - RNA, 17 nt, Homo sapiens
aaggcauuuuauaugaa

SEQ ID NO: 1742557 - RNA, 15 nt, Homo sapiens
aagaaacgucuucua

SEQ ID NO: 1742558 - RNA, 23 nt, Homo sapiens
caccugcucccaguccugccuga

SEQ ID NO: 1742559 - RNA, 21 nt, Homo sapiens
aagagagcucguuccuaccug

SEQ ID NO: 1742560 - RNA, 14 nt, Homo sapiens
auuuuaaagcacuu

SEQ ID NO: 1742561 - RNA, 17 nt, Homo sapiens
agcuuuugguguuugag

SEQ ID NO: 1742562 - RNA, 16 nt, Homo sapiens
uccuaauggauucaau

SEQ ID NO: 1742563 - RNA, 14 nt, Homo sapiens
acugaaaaugugcu

SEQ ID NO: 1742564 - RNA, 12 nt, Homo sapiens
aaauuccagagc

SEQ ID NO: 1742565 - RNA, 14 nt, Homo sapiens
ucaucaaguaauac

SEQ ID NO: 1742566 - RNA, 15 nt, Homo sapiens
aauacucauguguau

SEQ ID NO: 1742567 - RNA, 16 nt, Homo sapiens
ucaaacuucuguguac

SEQ ID NO: 1742568 - RNA, 20 nt, Homo sapiens
gcucaugaccuggaaauaaa

SEQ ID NO: 1742569 - RNA, 15 nt, Homo sapiens
agcuaacacacagcu

SEQ ID NO: 1742570 - RNA, 14 nt, Homo sapiens
uaucaggugcugcc

SEQ ID NO: 1742571 - RNA, 14 nt, Homo sapiens
uccacacuaugugu

SEQ ID NO: 1742572 - RNA, 22 nt, Homo sapiens
cugggauuacaggcgugagcca

SEQ ID NO: 1742573 - RNA, 17 nt, Homo sapiens
gaucaguguuacugccu

SEQ ID NO: 1742574 - RNA, 23 nt, Homo sapiens
agucuccucucugagacugcuaa

SEQ ID NO: 1742575 - RNA, 24 nt, Homo sapiens
uaaaauccaauauuguaauccuag

SEQ ID NO: 1742576 - RNA, 21 nt, Homo sapiens
agauaacagugugcucauaga

SEQ ID NO: 1742577 - RNA, 16 nt, Homo sapiens
accaugaagacaggau

SEQ ID NO: 1742578 - RNA, 16 nt, Homo sapiens
guggggcugaggggug

SEQ ID NO: 1742579 - RNA, 21 nt, Homo sapiens
aggccuuuccccaguguggcc

SEQ ID NO: 1742580 - RNA, 18 nt, Homo sapiens
gaaauugauuaaggcuuu

SEQ ID NO: 1742581 - RNA, 22 nt, Homo sapiens
cuugaaagucgcuccgccuccc

SEQ ID NO: 1742582 - RNA, 18 nt, Homo sapiens
cucgccgguuaagacagg

SEQ ID NO: 1742583 - RNA, 21 nt, Homo sapiens
cacaacuauggaauagauuau

SEQ ID NO: 1742584 - RNA, 16 nt, Homo sapiens
augaagauaaacuguu

SEQ ID NO: 1742585 - RNA, 19 nt, Homo sapiens
ucaaaccaaauaagauauu

SEQ ID NO: 1742586 - RNA, 13 nt, Homo sapiens
uaaaaaauaucuu

SEQ ID NO: 1742587 - RNA, 16 nt, Homo sapiens
cuggaaguucauaccu

SEQ ID NO: 1742588 - RNA, 14 nt, Homo sapiens
cagacccccagugu

SEQ ID NO: 1742589 - RNA, 16 nt, Homo sapiens
cuuugucucaaaauaa

SEQ ID NO: 1742590 - RNA, 17 nt, Homo sapiens
gcacuucuguuccaggu

SEQ ID NO: 1742591 - RNA, 20 nt, Homo sapiens
cuucccagcccucaucccac

SEQ ID NO: 1742592 - RNA, 21 nt, Homo sapiens
auaugaacaaacuaugaucac

SEQ ID NO: 1742593 - RNA, 13 nt, Homo sapiens
agguuucaccucc

SEQ ID NO: 1742594 - RNA, 23 nt, Homo sapiens
caucuugccucauuuugcuuccc

SEQ ID NO: 1742595 - RNA, 21 nt, Homo sapiens
ugaaccauucccuagucauuu

SEQ ID NO: 1742596 - RNA, 20 nt, Homo sapiens
ugggacuugaacaaagacau

SEQ ID NO: 1742597 - RNA, 16 nt, Homo sapiens
ucauacacaugugcac

SEQ ID NO: 1742598 - RNA, 14 nt, Homo sapiens
auuaagauucuuga

SEQ ID NO: 1742599 - RNA, 20 nt, Homo sapiens
uuuuaaacacuaaucacaaa

SEQ ID NO: 1742600 - RNA, 19 nt, Homo sapiens
ccagaagauccccucagga

SEQ ID NO: 1742601 - RNA, 21 nt, Homo sapiens
cuacuggggaaacuggccaug

SEQ ID NO: 1742602 - RNA, 14 nt, Homo sapiens
accagccucacccc

SEQ ID NO: 1742603 - RNA, 16 nt, Homo sapiens
uaagacccagcauuuu

SEQ ID NO: 1742604 - RNA, 18 nt, Homo sapiens
ccacauuccaaacagagu

SEQ ID NO: 1742605 - RNA, 20 nt, Homo sapiens
ccuugcagaaccagugacaa

SEQ ID NO: 1742606 - RNA, 22 nt, Homo sapiens
cauuguggccgccaugagcaac

SEQ ID NO: 1742607 - RNA, 13 nt, Homo sapiens
ucucagcacuugg

SEQ ID NO: 1742608 - RNA, 17 nt, Homo sapiens
ugagcuuucugugcaug

SEQ ID NO: 1742609 - RNA, 15 nt, Homo sapiens
aauauuuguauacac

SEQ ID NO: 1742610 - RNA, 14 nt, Homo sapiens
gcuuucuguugcca

SEQ ID NO: 1742611 - RNA, 18 nt, Homo sapiens
guagguaaguuggcucac

SEQ ID NO: 1742612 - RNA, 15 nt, Homo sapiens
aguuauaaucugaug

SEQ ID NO: 1742613 - RNA, 14 nt, Homo sapiens
uauugcccuaauua

SEQ ID NO: 1742614 - RNA, 15 nt, Homo sapiens
aacgcaucacugggg

SEQ ID NO: 1742615 - RNA, 22 nt, Homo sapiens
gagcucagagagggcaggcaug

SEQ ID NO: 1742616 - RNA, 14 nt, Homo sapiens
cguguggacugugc

SEQ ID NO: 1742617 - RNA, 14 nt, Homo sapiens
ggcuuuaugcaaau

SEQ ID NO: 1742618 - RNA, 14 nt, Homo sapiens
ugagaaguaccuuu

SEQ ID NO: 1742619 - RNA, 16 nt, Homo sapiens
uccaucuucaauaaag

SEQ ID NO: 1742620 - RNA, 16 nt, Homo sapiens
cagauaaguuggagca

SEQ ID NO: 1742621 - RNA, 19 nt, Homo sapiens
aucauccacugugccaugu

SEQ ID NO: 1742622 - RNA, 12 nt, Homo sapiens
ugcugugugaaa

SEQ ID NO: 1742623 - RNA, 15 nt, Homo sapiens
uccaugugcauauaa

SEQ ID NO: 1742624 - RNA, 16 nt, Homo sapiens
auggcuaacugaugaa

SEQ ID NO: 1742625 - RNA, 15 nt, Homo sapiens
cuuagagacuaucaa

SEQ ID NO: 1742626 - RNA, 16 nt, Homo sapiens
auauugaaguacuugc

SEQ ID NO: 1742627 - RNA, 20 nt, Homo sapiens
acucauacacaugugcacac

SEQ ID NO: 1742628 - RNA, 21 nt, Homo sapiens
auucugagguaaccucauuau

SEQ ID NO: 1742629 - RNA, 16 nt, Homo sapiens
ugaaacagaacuugac

SEQ ID NO: 1742630 - RNA, 18 nt, Homo sapiens
ucaagcugguggccucug

SEQ ID NO: 1742631 - RNA, 19 nt, Homo sapiens
cauagaaacaugacacuga

SEQ ID NO: 1742632 - RNA, 19 nt, Homo sapiens
ccuucugacugagcaauau

SEQ ID NO: 1742633 - RNA, 17 nt, Homo sapiens
aagauguguaaacaggu

SEQ ID NO: 1742634 - RNA, 14 nt, Homo sapiens
ggcaugacccagug

SEQ ID NO: 1742635 - RNA, 14 nt, Homo sapiens
cagggucugggaca

SEQ ID NO: 1742636 - RNA, 21 nt, Homo sapiens
ccacaauaagccacugguauc

SEQ ID NO: 1742637 - RNA, 21 nt, Homo sapiens
cugaaauauuuaggugucuau

SEQ ID NO: 1742638 - RNA, 18 nt, Homo sapiens
gaacagccuuagagcucu

SEQ ID NO: 1742639 - RNA, 16 nt, Homo sapiens
agucccauugauguac

SEQ ID NO: 1742640 - RNA, 16 nt, Homo sapiens
cacucuuuuauacaag

SEQ ID NO: 1742641 - RNA, 18 nt, Homo sapiens
gcauuuaugaugcaguuu

SEQ ID NO: 1742642 - RNA, 13 nt, Homo sapiens
ggacagugccuaa

SEQ ID NO: 1742643 - RNA, 16 nt, Homo sapiens
acccuggagggccagg

SEQ ID NO: 1742644 - RNA, 19 nt, Homo sapiens
cagaugaguccauuugaag

SEQ ID NO: 1742645 - RNA, 21 nt, Homo sapiens
ugaaaauagccaaccagcagc

SEQ ID NO: 1742646 - RNA, 18 nt, Homo sapiens
uguuaccacugguaacau

SEQ ID NO: 1742647 - RNA, 16 nt, Homo sapiens
agaaucacaguacuuu

SEQ ID NO: 1742648 - RNA, 21 nt, Homo sapiens
ugugaccaaaaguuacauguu

SEQ ID NO: 1742649 - RNA, 22 nt, Homo sapiens
caggaguccacugccuccauga

SEQ ID NO: 1742650 - RNA, 14 nt, Homo sapiens
uuagagagucucaa

SEQ ID NO: 1742651 - RNA, 22 nt, Homo sapiens
gaaguuaccuuuuauaagacaa

SEQ ID NO: 1742652 - RNA, 18 nt, Homo sapiens
aucagggccuuucuccuc

SEQ ID NO: 1742653 - RNA, 13 nt, Homo sapiens
cuuaaauaagucu

SEQ ID NO: 1742654 - RNA, 22 nt, Homo sapiens
cacugcuuggcccuucaagggu

SEQ ID NO: 1742655 - RNA, 11 nt, Homo sapiens
uagcuguucug

SEQ ID NO: 1742656 - RNA, 17 nt, Homo sapiens
auccugucucuaaaaag

SEQ ID NO: 1742657 - RNA, 23 nt, Homo sapiens
gaccccgucacagccucaaguca

SEQ ID NO: 1742658 - RNA, 21 nt, Homo sapiens
ccuggccgcguuuagaccaag

SEQ ID NO: 1742659 - RNA, 13 nt, Homo sapiens
auaguggaccacu

SEQ ID NO: 1742660 - RNA, 15 nt, Homo sapiens
auauacacacagugg

SEQ ID NO: 1742661 - RNA, 20 nt, Homo sapiens
cagaacugcuaccuuccuag

SEQ ID NO: 1742662 - RNA, 17 nt, Homo sapiens
uaaucaagauaagcacg

SEQ ID NO: 1742663 - RNA, 17 nt, Homo sapiens
aggccaggcuugagaga

SEQ ID NO: 1742664 - RNA, 15 nt, Homo sapiens
aauucugagccugau

SEQ ID NO: 1742665 - RNA, 18 nt, Homo sapiens
ugucuacauuaaaucacu

SEQ ID NO: 1742666 - RNA, 20 nt, Homo sapiens
gggaugagucaguccuugcc

SEQ ID NO: 1742667 - RNA, 18 nt, Homo sapiens
ccagcggggcuucugggc

SEQ ID NO: 1742668 - RNA, 17 nt, Homo sapiens
auuaaauucacuuucaa

SEQ ID NO: 1742669 - RNA, 15 nt, Homo sapiens
aauuacauuaugccc

SEQ ID NO: 1742670 - RNA, 19 nt, Homo sapiens
agacaaguuccaugggaua

SEQ ID NO: 1742671 - RNA, 14 nt, Homo sapiens
acgauuaacuguga

SEQ ID NO: 1742672 - RNA, 17 nt, Homo sapiens
gaaccucacucuugcca

SEQ ID NO: 1742673 - RNA, 22 nt, Homo sapiens
uccccaaucccggucaugcuuu

SEQ ID NO: 1742674 - RNA, 21 nt, Homo sapiens
uaaaaugggaauucugacuua

SEQ ID NO: 1742675 - RNA, 22 nt, Homo sapiens
gaauauacacauuuuguaaauc

SEQ ID NO: 1742676 - RNA, 18 nt, Homo sapiens
caggguacaaaaaauuca

SEQ ID NO: 1742677 - RNA, 22 nt, Homo sapiens
agacucugccuccugguuuccu

SEQ ID NO: 1742678 - RNA, 16 nt, Homo sapiens
uauuuuaaguauugca

SEQ ID NO: 1742679 - RNA, 23 nt, Homo sapiens
ccuaccaguuggccaugaugucu

SEQ ID NO: 1742680 - RNA, 20 nt, Homo sapiens
cuggaaaggcucagucucag

SEQ ID NO: 1742681 - RNA, 18 nt, Homo sapiens
uccaagugccacgugaac

SEQ ID NO: 1742682 - RNA, 18 nt, Homo sapiens
aauaccugaccucacaga

SEQ ID NO: 1742683 - RNA, 22 nt, Homo sapiens
ucucaaaaccgaguugccagcu

SEQ ID NO: 1742684 - RNA, 14 nt, Homo sapiens
gccuauaucuucau

SEQ ID NO: 1742685 - RNA, 18 nt, Homo sapiens
ucagggcugagaggagaa

SEQ ID NO: 1742686 - RNA, 22 nt, Homo sapiens
uauaaaaauaaaaaacacuggg

SEQ ID NO: 1742687 - RNA, 14 nt, Homo sapiens
guauggauuuccag

SEQ ID NO: 1742688 - RNA, 13 nt, Homo sapiens
ugugccuacuccc

SEQ ID NO: 1742689 - RNA, 19 nt, Homo sapiens
aaagauuugcuuuaauugu

SEQ ID NO: 1742690 - RNA, 16 nt, Homo sapiens
caacaagaacugcauc

SEQ ID NO: 1742691 - RNA, 12 nt, Homo sapiens
agaccagcuuug

SEQ ID NO: 1742692 - RNA, 13 nt, Homo sapiens
uccucuuaccaga

SEQ ID NO: 1742693 - RNA, 22 nt, Homo sapiens
aucuccagggaguccccucccc

SEQ ID NO: 1742694 - RNA, 19 nt, Homo sapiens
agggugaauaaagcaggga

SEQ ID NO: 1742695 - RNA, 14 nt, Homo sapiens
agagcuuccacugu

SEQ ID NO: 1742696 - RNA, 15 nt, Homo sapiens
augagacuacuucag

SEQ ID NO: 1742697 - RNA, 16 nt, Homo sapiens
aauuagggaugcucaa

SEQ ID NO: 1742698 - RNA, 16 nt, Homo sapiens
aaaaauucccuuccug

SEQ ID NO: 1742699 - RNA, 12 nt, Homo sapiens
cuuacuuuccca

SEQ ID NO: 1742700 - RNA, 18 nt, Homo sapiens
ucuuguuccugugcauug

SEQ ID NO: 1742701 - RNA, 15 nt, Homo sapiens
cguacaccccagcuc

SEQ ID NO: 1742702 - RNA, 17 nt, Homo sapiens
uguaacccagauuuugc

SEQ ID NO: 1742703 - RNA, 15 nt, Homo sapiens
caguguauaggaaga

SEQ ID NO: 1742704 - RNA, 15 nt, Homo sapiens
aaugggaaaaccaga

SEQ ID NO: 1742705 - RNA, 19 nt, Homo sapiens
uccucaaaccacuugccug

SEQ ID NO: 1742706 - RNA, 22 nt, Homo sapiens
uagcucucucuagaaugagcaa

SEQ ID NO: 1742707 - RNA, 17 nt, Homo sapiens
caauaugacacagcuug

SEQ ID NO: 1742708 - RNA, 13 nt, Homo sapiens
cagcuucagguua

SEQ ID NO: 1742709 - RNA, 13 nt, Homo sapiens
auccaaugguguu

SEQ ID NO: 1742710 - RNA, 14 nt, Homo sapiens
gcuuugguggcacg

SEQ ID NO: 1742711 - RNA, 21 nt, Homo sapiens
ccccaugggaucuugagggac

SEQ ID NO: 1742712 - RNA, 18 nt, Homo sapiens
uccauuacgugcauuuaa

SEQ ID NO: 1742713 - RNA, 13 nt, Homo sapiens
caggaagcugccc

SEQ ID NO: 1742714 - RNA, 23 nt, Homo sapiens
acguguggaauuuuccacuucug

SEQ ID NO: 1742715 - RNA, 16 nt, Homo sapiens
gaagccccaacuguga

SEQ ID NO: 1742716 - RNA, 16 nt, Homo sapiens
ugaggcccauucuuca

SEQ ID NO: 1742717 - RNA, 15 nt, Homo sapiens
uggcaguuacagggc

SEQ ID NO: 1742718 - RNA, 19 nt, Homo sapiens
auaaacuaguuuccagugg

SEQ ID NO: 1742719 - RNA, 16 nt, Homo sapiens
agugacgugguucauc

SEQ ID NO: 1742720 - RNA, 19 nt, Homo sapiens
acuuaaagcccgccugaca

SEQ ID NO: 1742721 - RNA, 20 nt, Homo sapiens
aucagcaaacuuugcauuac

SEQ ID NO: 1742722 - RNA, 11 nt, Homo sapiens
acuacacucca

SEQ ID NO: 1742723 - RNA, 13 nt, Homo sapiens
gugucuucugccc

SEQ ID NO: 1742724 - RNA, 18 nt, Homo sapiens
uuaguauuuaacuacauc

SEQ ID NO: 1742725 - RNA, 24 nt, Homo sapiens
cuucaacugaaaaaaacauaucca

SEQ ID NO: 1742726 - RNA, 19 nt, Homo sapiens
uaugcuuuccaaaccuuau

SEQ ID NO: 1742727 - RNA, 13 nt, Homo sapiens
cuugguugauuua

SEQ ID NO: 1742728 - RNA, 11 nt, Homo sapiens
acucucuaggg

SEQ ID NO: 1742729 - RNA, 15 nt, Homo sapiens
caggagucaccaugc

SEQ ID NO: 1742730 - RNA, 16 nt, Homo sapiens
uccaaacaauucugau

SEQ ID NO: 1742731 - RNA, 12 nt, Homo sapiens
ugcuacugcacu

SEQ ID NO: 1742732 - RNA, 15 nt, Homo sapiens
ucuacuuuccaggcu

SEQ ID NO: 1742733 - RNA, 17 nt, Homo sapiens
aacagaauuaaguggau

SEQ ID NO: 1742734 - RNA, 15 nt, Homo sapiens
ugcuguucguucaaa

SEQ ID NO: 1742735 - RNA, 13 nt, Homo sapiens
auugaacuguauu

SEQ ID NO: 1742736 - RNA, 18 nt, Homo sapiens
aucuuuguuuaaaugcca

SEQ ID NO: 1742737 - RNA, 16 nt, Homo sapiens
agcguuaugugcagua

SEQ ID NO: 1742738 - RNA, 14 nt, Homo sapiens
acagagccuugaga

SEQ ID NO: 1742739 - RNA, 20 nt, Homo sapiens
gauaucuguuagaugcuacu

SEQ ID NO: 1742740 - RNA, 12 nt, Homo sapiens
cacggggcacag

SEQ ID NO: 1742741 - RNA, 16 nt, Homo sapiens
uccagaaggcaaaaag

SEQ ID NO: 1742742 - RNA, 22 nt, Homo sapiens
ucugaucucccuuggucuucca

SEQ ID NO: 1742743 - RNA, 13 nt, Homo sapiens
caugaaguggaaa

SEQ ID NO: 1742744 - RNA, 20 nt, Homo sapiens
aucuuuucuaaucacagugu

SEQ ID NO: 1742745 - RNA, 13 nt, Homo sapiens
gccuguaguccca

SEQ ID NO: 1742746 - RNA, 21 nt, Homo sapiens
ugccuucaaacaaaggcaguu

SEQ ID NO: 1742747 - RNA, 14 nt, Homo sapiens
gaucaugaaaccaa

SEQ ID NO: 1742748 - RNA, 23 nt, Homo sapiens
aacauucucucauagaacauuga

SEQ ID NO: 1742749 - RNA, 17 nt, Homo sapiens
ucaaauguuacaguuua

SEQ ID NO: 1742750 - RNA, 22 nt, Homo sapiens
gcccccaaccccuccucccuca

SEQ ID NO: 1742751 - RNA, 22 nt, Homo sapiens
cuauuaaagauauuucuuuaaa

SEQ ID NO: 1742752 - RNA, 22 nt, Homo sapiens
auaaaagccucugguggaaccu

SEQ ID NO: 1742753 - RNA, 23 nt, Homo sapiens
acugaguuuggguucucugcugu

SEQ ID NO: 1742754 - RNA, 12 nt, Homo sapiens
gcagaaagcaaa

SEQ ID NO: 1742755 - RNA, 19 nt, Homo sapiens
cacugacuggaaggcaguc

SEQ ID NO: 1742756 - RNA, 15 nt, Homo sapiens
cuuucugaacuguaa

SEQ ID NO: 1742757 - RNA, 23 nt, Homo sapiens
aaccaucucugugauuaccucuc

SEQ ID NO: 1742758 - RNA, 19 nt, Homo sapiens
cuguacuucugugugcaau

SEQ ID NO: 1742759 - RNA, 15 nt, Homo sapiens
uccaucucaaaaaag

SEQ ID NO: 1742760 - RNA, 16 nt, Homo sapiens
caccagaaugcuaaag

SEQ ID NO: 1742761 - RNA, 19 nt, Homo sapiens
ggccacaccccagacucca

SEQ ID NO: 1742762 - RNA, 15 nt, Homo sapiens
acccuagcuguguca

SEQ ID NO: 1742763 - RNA, 21 nt, Homo sapiens
agacagcgcaugcuggugcag

SEQ ID NO: 1742764 - RNA, 12 nt, Homo sapiens
cuucagcccuaa

SEQ ID NO: 1742765 - RNA, 17 nt, Homo sapiens
uaaucuugcuucauugu

SEQ ID NO: 1742766 - RNA, 22 nt, Homo sapiens
auagcgaagaccaguauggcaa

SEQ ID NO: 1742767 - RNA, 21 nt, Homo sapiens
auggaacuguaauaacuucua

SEQ ID NO: 1742768 - RNA, 15 nt, Homo sapiens
ccuuuuuguuauuag

SEQ ID NO: 1742769 - RNA, 13 nt, Homo sapiens
uagagauaugcac

SEQ ID NO: 1742770 - RNA, 22 nt, Homo sapiens
auuucauugcucagaaauguca

SEQ ID NO: 1742771 - RNA, 13 nt, Homo sapiens
ucccugcucuaac

SEQ ID NO: 1742772 - RNA, 14 nt, Homo sapiens
ugacuggacugugu

SEQ ID NO: 1742773 - RNA, 17 nt, Homo sapiens
acuucauucucucucau

SEQ ID NO: 1742774 - RNA, 13 nt, Homo sapiens
ccagagugcugcc

SEQ ID NO: 1742775 - RNA, 16 nt, Homo sapiens
acugcaccaagucuca

SEQ ID NO: 1742776 - RNA, 16 nt, Homo sapiens
ugcauuuaugaugcag

SEQ ID NO: 1742777 - RNA, 12 nt, Homo sapiens
cucuacuuugag

SEQ ID NO: 1742778 - RNA, 12 nt, Homo sapiens
acaucuuaccuc

SEQ ID NO: 1742779 - RNA, 17 nt, Homo sapiens
aauuuguaacuuugcag

SEQ ID NO: 1742780 - RNA, 18 nt, Homo sapiens
gucccuccaccccacaga

SEQ ID NO: 1742781 - RNA, 20 nt, Homo sapiens
agcacugcugccucagcuca

SEQ ID NO: 1742782 - RNA, 17 nt, Homo sapiens
aggcccagcugcucagu

SEQ ID NO: 1742783 - RNA, 18 nt, Homo sapiens
ugaaaacaaguuccaaau

SEQ ID NO: 1742784 - RNA, 16 nt, Homo sapiens
agaauaugaaguucua

SEQ ID NO: 1742785 - RNA, 16 nt, Homo sapiens
auuuaccucuuaccug

SEQ ID NO: 1742786 - RNA, 14 nt, Homo sapiens
cccugccucaagcu

SEQ ID NO: 1742787 - RNA, 14 nt, Homo sapiens
gaagagacacucag

SEQ ID NO: 1742788 - RNA, 20 nt, Homo sapiens
aaaauagaaauauagccaaa

SEQ ID NO: 1742789 - RNA, 16 nt, Homo sapiens
ggaaggcaacauacac

SEQ ID NO: 1742790 - RNA, 16 nt, Homo sapiens
accuauuugucaugua

SEQ ID NO: 1742791 - RNA, 17 nt, Homo sapiens
uucccaguuuaggugau

SEQ ID NO: 1742792 - RNA, 15 nt, Homo sapiens
aaacaguuccauuca

SEQ ID NO: 1742793 - RNA, 15 nt, Homo sapiens
auccuucaucuggau

SEQ ID NO: 1742794 - RNA, 15 nt, Homo sapiens
ugucucugcaucuga

SEQ ID NO: 1742795 - RNA, 16 nt, Homo sapiens
ugaguguugugccuac

SEQ ID NO: 1742796 - RNA, 17 nt, Homo sapiens
ccaacaaggaaacuuuc

SEQ ID NO: 1742797 - RNA, 22 nt, Homo sapiens
ucuguaguuuuaucacauguau

SEQ ID NO: 1742798 - RNA, 22 nt, Homo sapiens
aagcuguuccuccuaaaacaau

SEQ ID NO: 1742799 - RNA, 21 nt, Homo sapiens
uccauucugucuuccuaggaa

SEQ ID NO: 1742800 - RNA, 22 nt, Homo sapiens
ucuccaaagcccucccuaccua

SEQ ID NO: 1742801 - RNA, 21 nt, Homo sapiens
agguuaaaggaaaagcacaag

SEQ ID NO: 1742802 - RNA, 17 nt, Homo sapiens
caaugcaugcuuuggaa

SEQ ID NO: 1742803 - RNA, 22 nt, Homo sapiens
gaaucuuuuucagaaacaguga

SEQ ID NO: 1742804 - RNA, 17 nt, Homo sapiens
cacuaucacgagccuuu

SEQ ID NO: 1742805 - RNA, 21 nt, Homo sapiens
auaaaaauguuuugaggcuuu

SEQ ID NO: 1742806 - RNA, 19 nt, Homo sapiens
agugaagucaugaccucca

SEQ ID NO: 1742807 - RNA, 19 nt, Homo sapiens
uuaauaaaacaacaacaaa

SEQ ID NO: 1742808 - RNA, 14 nt, Homo sapiens
aggacaucagucug

SEQ ID NO: 1742809 - RNA, 13 nt, Homo sapiens
cccagccaaucac

SEQ ID NO: 1742810 - RNA, 13 nt, Homo sapiens
cagccuaguuccu

SEQ ID NO: 1742811 - RNA, 20 nt, Homo sapiens
aguuccuccaagaggucucc

SEQ ID NO: 1742812 - RNA, 18 nt, Homo sapiens
caaggugugcucugagcc

SEQ ID NO: 1742813 - RNA, 13 nt, Homo sapiens
ugacacuguguaa

SEQ ID NO: 1742814 - RNA, 13 nt, Homo sapiens
auuuaaaccagca

SEQ ID NO: 1742815 - RNA, 18 nt, Homo sapiens
agacauaaccacugcuuc

SEQ ID NO: 1742816 - RNA, 18 nt, Homo sapiens
uguucagcuggacaauau

SEQ ID NO: 1742817 - RNA, 16 nt, Homo sapiens
ccugcaggguaggggg

SEQ ID NO: 1742818 - RNA, 17 nt, Homo sapiens
gccuggagcaagugcuc

SEQ ID NO: 1742819 - RNA, 16 nt, Homo sapiens
aacaaaaguacauugc

SEQ ID NO: 1742820 - RNA, 19 nt, Homo sapiens
acccucugccaccagagac

SEQ ID NO: 1742821 - RNA, 20 nt, Homo sapiens
gacccaguggacucuuccac

SEQ ID NO: 1742822 - RNA, 21 nt, Homo sapiens
ucccugcacacacaugcauac

SEQ ID NO: 1742823 - RNA, 14 nt, Homo sapiens
aaaccuuccauguc

SEQ ID NO: 1742824 - RNA, 13 nt, Homo sapiens
uuaucauugcuaa

SEQ ID NO: 1742825 - RNA, 14 nt, Homo sapiens
uugguaugugcuag

SEQ ID NO: 1742826 - RNA, 20 nt, Homo sapiens
cgcgugugacagucuugcau

SEQ ID NO: 1742827 - RNA, 12 nt, Homo sapiens
caaaaaaaccuu

SEQ ID NO: 1742828 - RNA, 16 nt, Homo sapiens
agcagagcuuccucag

SEQ ID NO: 1742829 - RNA, 14 nt, Homo sapiens
auuuagugacaaaa

SEQ ID NO: 1742830 - RNA, 19 nt, Homo sapiens
auaccauuuuuuaaggaaa

SEQ ID NO: 1742831 - RNA, 17 nt, Homo sapiens
agcuggacuaguguccu

SEQ ID NO: 1742832 - RNA, 17 nt, Homo sapiens
caauaauacaaagcaaa

SEQ ID NO: 1742833 - RNA, 13 nt, Homo sapiens
cagaugggccacg

SEQ ID NO: 1742834 - RNA, 17 nt, Homo sapiens
cuccaagccacugagca

SEQ ID NO: 1742835 - RNA, 21 nt, Homo sapiens
ugguguuacauuaaagcccug

SEQ ID NO: 1742836 - RNA, 15 nt, Homo sapiens
cugcauuuagcugua

SEQ ID NO: 1742837 - RNA, 22 nt, Homo sapiens
ucugcugagaggcaccagucca

SEQ ID NO: 1742838 - RNA, 15 nt, Homo sapiens
auggaugcacgcaca

SEQ ID NO: 1742839 - RNA, 21 nt, Homo sapiens
auauauaucaguuugaucaca

SEQ ID NO: 1742840 - RNA, 16 nt, Homo sapiens
agaauuuguguugaag

SEQ ID NO: 1742841 - RNA, 18 nt, Homo sapiens
uaaaauuucacuuaauaa

SEQ ID NO: 1742842 - RNA, 14 nt, Homo sapiens
aauggacuguuaca

SEQ ID NO: 1742843 - RNA, 23 nt, Homo sapiens
ugugucccuggcgcugugcuagc

SEQ ID NO: 1742844 - RNA, 14 nt, Homo sapiens
cuaggugacauaua

SEQ ID NO: 1742845 - RNA, 20 nt, Homo sapiens
guauccgacucuaagcugug

SEQ ID NO: 1742846 - RNA, 16 nt, Homo sapiens
auggaacuuagccauu

SEQ ID NO: 1742847 - RNA, 15 nt, Homo sapiens
gauguagacauuuua

SEQ ID NO: 1742848 - RNA, 19 nt, Homo sapiens
uugcauauaaaaugcuuua

SEQ ID NO: 1742849 - RNA, 22 nt, Homo sapiens
ggagaucagguaccaaggaaau

SEQ ID NO: 1742850 - RNA, 13 nt, Homo sapiens
uguaugugugaau

SEQ ID NO: 1742851 - RNA, 13 nt, Homo sapiens
auuuagugauaua

SEQ ID NO: 1742852 - RNA, 11 nt, Homo sapiens
ccugaagggaa

SEQ ID NO: 1742853 - RNA, 16 nt, Homo sapiens
agcacagaucucuaga

SEQ ID NO: 1742854 - RNA, 19 nt, Homo sapiens
uccaagguguaacucuaau

SEQ ID NO: 1742855 - RNA, 14 nt, Homo sapiens
ccuugcccagagau

SEQ ID NO: 1742856 - RNA, 20 nt, Homo sapiens
acuauguuuagugugauugu

SEQ ID NO: 1742857 - RNA, 15 nt, Homo sapiens
gggacugcaugcaag

SEQ ID NO: 1742858 - RNA, 23 nt, Homo sapiens
cccgcuaaggugaaaaggggugu

SEQ ID NO: 1742859 - RNA, 21 nt, Homo sapiens
uaacaauaacuacuguguucc

SEQ ID NO: 1742860 - RNA, 16 nt, Homo sapiens
aggcaugggccaccac

SEQ ID NO: 1742861 - RNA, 19 nt, Homo sapiens
uguuuauuuuuaacucuug

SEQ ID NO: 1742862 - RNA, 13 nt, Homo sapiens
aaaaguuauacuc

SEQ ID NO: 1742863 - RNA, 15 nt, Homo sapiens
guuuuguauucaucu

SEQ ID NO: 1742864 - RNA, 16 nt, Homo sapiens
cuaaaaagaagccaca

SEQ ID NO: 1742865 - RNA, 15 nt, Homo sapiens
auaaaccacuuucua

SEQ ID NO: 1742866 - RNA, 15 nt, Homo sapiens
caaaaucaaauucca

SEQ ID NO: 1742867 - RNA, 18 nt, Homo sapiens
ucugaacccaggcagcug

SEQ ID NO: 1742868 - RNA, 21 nt, Homo sapiens
acuucugucuuccuucauuau

SEQ ID NO: 1742869 - RNA, 15 nt, Homo sapiens
ccacuggcuccacau

SEQ ID NO: 1742870 - RNA, 21 nt, Homo sapiens
gaauuugaagaauuaaugaca

SEQ ID NO: 1742871 - RNA, 23 nt, Homo sapiens
ugcacccagcccagauugucuua

SEQ ID NO: 1742872 - RNA, 14 nt, Homo sapiens
aaagugacccuguu

SEQ ID NO: 1742873 - RNA, 14 nt, Homo sapiens
ucagcacuguuaca

SEQ ID NO: 1742874 - RNA, 15 nt, Homo sapiens
gucugcagcaaugaa

SEQ ID NO: 1742875 - RNA, 18 nt, Homo sapiens
gaaggaaggacuaugaca

SEQ ID NO: 1742876 - RNA, 14 nt, Homo sapiens
auccccucuacucu

SEQ ID NO: 1742877 - RNA, 14 nt, Homo sapiens
aggcuuucaagaag

SEQ ID NO: 1742878 - RNA, 19 nt, Homo sapiens
gcucuugggaagaccagcu

SEQ ID NO: 1742879 - RNA, 22 nt, Homo sapiens
uccgacaacaccguguccaaaa

SEQ ID NO: 1742880 - RNA, 12 nt, Homo sapiens
cucuuuagccag

SEQ ID NO: 1742881 - RNA, 14 nt, Homo sapiens
ggaacuuagccauu

SEQ ID NO: 1742882 - RNA, 19 nt, Homo sapiens
cuccucugauuucaguuca

SEQ ID NO: 1742883 - RNA, 14 nt, Homo sapiens
ggagugauucccaa

SEQ ID NO: 1742884 - RNA, 19 nt, Homo sapiens
ucccgggagaggagaucag

SEQ ID NO: 1742885 - RNA, 15 nt, Homo sapiens
uaccugugacucuua

SEQ ID NO: 1742886 - RNA, 16 nt, Homo sapiens
acccugcccucaugcu

SEQ ID NO: 1742887 - RNA, 21 nt, Homo sapiens
ccuucauaugugcaguauuua

SEQ ID NO: 1742888 - RNA, 17 nt, Homo sapiens
aacuguuguuacuggaa

SEQ ID NO: 1742889 - RNA, 17 nt, Homo sapiens
gccgauauaagccauag

SEQ ID NO: 1742890 - RNA, 18 nt, Homo sapiens
uuuguuaaagaaacaucu

SEQ ID NO: 1742891 - RNA, 19 nt, Homo sapiens
cugaaaagacucaguguuc

SEQ ID NO: 1742892 - RNA, 23 nt, Homo sapiens
ugcuaauauaauagaugacagug

SEQ ID NO: 1742893 - RNA, 17 nt, Homo sapiens
ucagaaccaagaugcca

SEQ ID NO: 1742894 - RNA, 15 nt, Homo sapiens
agaucagaacaugaa

SEQ ID NO: 1742895 - RNA, 19 nt, Homo sapiens
cuuacagaaccaauucacu

SEQ ID NO: 1742896 - RNA, 19 nt, Homo sapiens
gagcauccccagccacaac

SEQ ID NO: 1742897 - RNA, 15 nt, Homo sapiens
uuucggaaaugauug

SEQ ID NO: 1742898 - RNA, 19 nt, Homo sapiens
ccauccuucagugaacuaa

SEQ ID NO: 1742899 - RNA, 15 nt, Homo sapiens
uuuaaguaugugaag

SEQ ID NO: 1742900 - RNA, 17 nt, Homo sapiens
cauccuggaauaucucc

SEQ ID NO: 1742901 - RNA, 17 nt, Homo sapiens
cucuaagcucagugcuc

SEQ ID NO: 1742902 - RNA, 21 nt, Homo sapiens
aucugaacuuuuaaugaacuu

SEQ ID NO: 1742903 - RNA, 16 nt, Homo sapiens
ugucaaggggcccuag

SEQ ID NO: 1742904 - RNA, 22 nt, Homo sapiens
caacccuuugccccaccuuuau

SEQ ID NO: 1742905 - RNA, 22 nt, Homo sapiens
gaaaaaugggaaauagucugau

SEQ ID NO: 1742906 - RNA, 17 nt, Homo sapiens
cuuauuuugcauuccag

SEQ ID NO: 1742907 - RNA, 17 nt, Homo sapiens
caaggcgcucaauggga

SEQ ID NO: 1742908 - RNA, 13 nt, Homo sapiens
uauacacuguaag

SEQ ID NO: 1742909 - RNA, 12 nt, Homo sapiens
caggaccaaggg

SEQ ID NO: 1742910 - RNA, 18 nt, Homo sapiens
aagaguugcuucccauuu

SEQ ID NO: 1742911 - RNA, 12 nt, Homo sapiens
uguucaaaaagg

SEQ ID NO: 1742912 - RNA, 18 nt, Homo sapiens
gauuuggucacacucuca

SEQ ID NO: 1742913 - RNA, 14 nt, Homo sapiens
cggaucccacugau

SEQ ID NO: 1742914 - RNA, 15 nt, Homo sapiens
uagauaauauaccgu

SEQ ID NO: 1742915 - RNA, 15 nt, Homo sapiens
aucugggauucccac

SEQ ID NO: 1742916 - RNA, 21 nt, Homo sapiens
gaaguugacaggcagugccau

SEQ ID NO: 1742917 - RNA, 15 nt, Homo sapiens
cacuauauguuuaca

SEQ ID NO: 1742918 - RNA, 15 nt, Homo sapiens
ucuucacugugguca

SEQ ID NO: 1742919 - RNA, 18 nt, Homo sapiens
cugccaaaacauuuauga

SEQ ID NO: 1742920 - RNA, 23 nt, Homo sapiens
gaauuaaguuagggaauggcaca

SEQ ID NO: 1742921 - RNA, 18 nt, Homo sapiens
ugaguuuuguuucacuuu

SEQ ID NO: 1742922 - RNA, 14 nt, Homo sapiens
aagaauuaaugaca

SEQ ID NO: 1742923 - RNA, 14 nt, Homo sapiens
cuuucauacauuau

SEQ ID NO: 1742924 - RNA, 15 nt, Homo sapiens
gugacucuucucuca

SEQ ID NO: 1742925 - RNA, 20 nt, Homo sapiens
uguagccuaaacuccaaaca

SEQ ID NO: 1742926 - RNA, 14 nt, Homo sapiens
agcaaagaacccau

SEQ ID NO: 1742927 - RNA, 18 nt, Homo sapiens
cuuagcagcccagcauuu

SEQ ID NO: 1742928 - RNA, 12 nt, Homo sapiens
agagaagccagc

SEQ ID NO: 1742929 - RNA, 23 nt, Homo sapiens
cuacuucugaaacugcagcagug

SEQ ID NO: 1742930 - RNA, 21 nt, Homo sapiens
uucugaugaucauugcuggca

SEQ ID NO: 1742931 - RNA, 19 nt, Homo sapiens
gauggggagucccaaagcg

SEQ ID NO: 1742932 - RNA, 13 nt, Homo sapiens
acuucucucagga

SEQ ID NO: 1742933 - RNA, 17 nt, Homo sapiens
uauuuuaagaauuucac

SEQ ID NO: 1742934 - RNA, 16 nt, Homo sapiens
uuacucuaacaaacaa

SEQ ID NO: 1742935 - RNA, 13 nt, Homo sapiens
agaaccuggaaaa

SEQ ID NO: 1742936 - RNA, 16 nt, Homo sapiens
ccuugguucuggccac

SEQ ID NO: 1742937 - RNA, 20 nt, Homo sapiens
agccauaccugguaagcaaa

SEQ ID NO: 1742938 - RNA, 17 nt, Homo sapiens
aagacaaagcaaagcca

SEQ ID NO: 1742939 - RNA, 22 nt, Homo sapiens
cuggaaaccacacuucuugaaa

SEQ ID NO: 1742940 - RNA, 18 nt, Homo sapiens
agacaggguuuugccaug

SEQ ID NO: 1742941 - RNA, 14 nt, Homo sapiens
uguacaaagaaaua

SEQ ID NO: 1742942 - RNA, 15 nt, Homo sapiens
ucacuauccaugcac

SEQ ID NO: 1742943 - RNA, 19 nt, Homo sapiens
acccaccugcugcuguaug

SEQ ID NO: 1742944 - RNA, 13 nt, Homo sapiens
acaagcauucucc

SEQ ID NO: 1742945 - RNA, 13 nt, Homo sapiens
caaugacacauag

SEQ ID NO: 1742946 - RNA, 18 nt, Homo sapiens
gucacauuguaacugaac

SEQ ID NO: 1742947 - RNA, 18 nt, Homo sapiens
cuuguauagcaugaaaua

SEQ ID NO: 1742948 - RNA, 15 nt, Homo sapiens
agaggcuguucccac

SEQ ID NO: 1742949 - RNA, 16 nt, Homo sapiens
ucccacugaaauggac

SEQ ID NO: 1742950 - RNA, 21 nt, Homo sapiens
cugaaaaccucacaugcauac

SEQ ID NO: 1742951 - RNA, 19 nt, Homo sapiens
gccaggccucgccugcccu

SEQ ID NO: 1742952 - RNA, 13 nt, Homo sapiens
gcagaaaugcaag

SEQ ID NO: 1742953 - RNA, 17 nt, Homo sapiens
cuugauguuggaucuca

SEQ ID NO: 1742954 - RNA, 19 nt, Homo sapiens
uaaaggaagucaccaaaau

SEQ ID NO: 1742955 - RNA, 14 nt, Homo sapiens
uuuuguacugugcu

SEQ ID NO: 1742956 - RNA, 14 nt, Homo sapiens
aggauuugaugcuu

SEQ ID NO: 1742957 - RNA, 15 nt, Homo sapiens
augcuaaaacaugau

SEQ ID NO: 1742958 - RNA, 17 nt, Homo sapiens
caccauguaaggucaca

SEQ ID NO: 1742959 - RNA, 16 nt, Homo sapiens
uaaguaucagcuacaa

SEQ ID NO: 1742960 - RNA, 14 nt, Homo sapiens
guucuuagcccuug

SEQ ID NO: 1742961 - RNA, 13 nt, Homo sapiens
accccuacacaca

SEQ ID NO: 1742962 - RNA, 19 nt, Homo sapiens
auaauaacucggauuccag

SEQ ID NO: 1742963 - RNA, 13 nt, Homo sapiens
gugacucuugggg

SEQ ID NO: 1742964 - RNA, 12 nt, Homo sapiens
ccugccccggga

SEQ ID NO: 1742965 - RNA, 16 nt, Homo sapiens
gucaguauuuuugccg

SEQ ID NO: 1742966 - RNA, 14 nt, Homo sapiens
acguguagcuauau

SEQ ID NO: 1742967 - RNA, 14 nt, Homo sapiens
uggugggggcuccu

SEQ ID NO: 1742968 - RNA, 22 nt, Homo sapiens
acagaagcacagcacccauggg

SEQ ID NO: 1742969 - RNA, 14 nt, Homo sapiens
auuuuucugugaaa

SEQ ID NO: 1742970 - RNA, 14 nt, Homo sapiens
ggucuacagugaua

SEQ ID NO: 1742971 - RNA, 23 nt, Homo sapiens
cccacaaaagaaggcucacagau

SEQ ID NO: 1742972 - RNA, 21 nt, Homo sapiens
ugauagacugcuacagguaau

SEQ ID NO: 1742973 - RNA, 15 nt, Homo sapiens
aaauaucuacauuaa

SEQ ID NO: 1742974 - RNA, 20 nt, Homo sapiens
uagcacauggcagauuugca

SEQ ID NO: 1742975 - RNA, 22 nt, Homo sapiens
ugaaccuggcaagucacaggac

SEQ ID NO: 1742976 - RNA, 20 nt, Homo sapiens
ggcccucuugaaucucugaa

SEQ ID NO: 1742977 - RNA, 16 nt, Homo sapiens
gcaauccuacuucuau

SEQ ID NO: 1742978 - RNA, 14 nt, Homo sapiens
agcaggagccagcc

SEQ ID NO: 1742979 - RNA, 17 nt, Homo sapiens
auccucagaaccauuca

SEQ ID NO: 1742980 - RNA, 15 nt, Homo sapiens
aagauuaacacuaau

SEQ ID NO: 1742981 - RNA, 20 nt, Homo sapiens
gcuguaaccgauaugcacuu

SEQ ID NO: 1742982 - RNA, 20 nt, Homo sapiens
ucugcccccuuuacuccucg

SEQ ID NO: 1742983 - RNA, 20 nt, Homo sapiens
ccugguucugucuagacugg

SEQ ID NO: 1742984 - RNA, 12 nt, Homo sapiens
caauucagucug

SEQ ID NO: 1742985 - RNA, 16 nt, Homo sapiens
uaagccagaauccaga

SEQ ID NO: 1742986 - RNA, 17 nt, Homo sapiens
cugggcaccucuagugc

SEQ ID NO: 1742987 - RNA, 22 nt, Homo sapiens
aauuuuaaugauaaaauagcca

SEQ ID NO: 1742988 - RNA, 22 nt, Homo sapiens
aaaccugcccaaccuaccucac

SEQ ID NO: 1742989 - RNA, 20 nt, Homo sapiens
ugggggugcugcucucuccg

SEQ ID NO: 1742990 - RNA, 19 nt, Homo sapiens
ucuguaaagucuagcacag

SEQ ID NO: 1742991 - RNA, 23 nt, Homo sapiens
auuauaagcugcucccugucuau

SEQ ID NO: 1742992 - RNA, 11 nt, Homo sapiens
guuugucauau

SEQ ID NO: 1742993 - RNA, 20 nt, Homo sapiens
gccaucggugaaacuaacag

SEQ ID NO: 1742994 - RNA, 17 nt, Homo sapiens
ccccaaaagugucaagg

SEQ ID NO: 1742995 - RNA, 18 nt, Homo sapiens
augcaaaagaaguggcau

SEQ ID NO: 1742996 - RNA, 14 nt, Homo sapiens
ucaccagaucucag

SEQ ID NO: 1742997 - RNA, 23 nt, Homo sapiens
uaauauccuguaauaaagcucuu

SEQ ID NO: 1742998 - RNA, 15 nt, Homo sapiens
agccagcuuaaaccc

SEQ ID NO: 1742999 - RNA, 14 nt, Homo sapiens
aucaucuuuuagac

SEQ ID NO: 1743000 - RNA, 21 nt, Homo sapiens
cccucaaagugucacaaugcu

SEQ ID NO: 1743001 - RNA, 18 nt, Homo sapiens
agaaauauggacacuuaa

SEQ ID NO: 1743002 - RNA, 21 nt, Homo sapiens
acuccuugugguuuaugucau

SEQ ID NO: 1743003 - RNA, 19 nt, Homo sapiens
gcuguguuguugcuucuug

SEQ ID NO: 1743004 - RNA, 16 nt, Homo sapiens
gaagucaucucauucc

SEQ ID NO: 1743005 - RNA, 15 nt, Homo sapiens
ugucaucacuuuuac

SEQ ID NO: 1743006 - RNA, 13 nt, Homo sapiens
uagacaauuugca

SEQ ID NO: 1743007 - RNA, 17 nt, Homo sapiens
ccugccccugacugugu

SEQ ID NO: 1743008 - RNA, 21 nt, Homo sapiens
uacacacacacgcgugcacac

SEQ ID NO: 1743009 - RNA, 23 nt, Homo sapiens
ugccucugagcagagagcagcag

SEQ ID NO: 1743010 - RNA, 21 nt, Homo sapiens
uuacuuuagguggagaaucca

SEQ ID NO: 1743011 - RNA, 17 nt, Homo sapiens
cuccuucuaccacuggg

SEQ ID NO: 1743012 - RNA, 20 nt, Homo sapiens
gcaccugagggugcuuugug

SEQ ID NO: 1743013 - RNA, 21 nt, Homo sapiens
ccaccuucuucuccuacauau

SEQ ID NO: 1743014 - RNA, 19 nt, Homo sapiens
caucucuaaaaaaauacaa

SEQ ID NO: 1743015 - RNA, 16 nt, Homo sapiens
agaaauacugcucuga

SEQ ID NO: 1743016 - RNA, 21 nt, Homo sapiens
uucaguauuuauugagcaucu

SEQ ID NO: 1743017 - RNA, 16 nt, Homo sapiens
ccuagaccuugccucc

SEQ ID NO: 1743018 - RNA, 15 nt, Homo sapiens
uccacggcuggauac

SEQ ID NO: 1743019 - RNA, 15 nt, Homo sapiens
guaauaucaucucaa

SEQ ID NO: 1743020 - RNA, 15 nt, Homo sapiens
cuuggggcccagugc

SEQ ID NO: 1743021 - RNA, 22 nt, Homo sapiens
ugaagacccuauuucagaaaua

SEQ ID NO: 1743022 - RNA, 15 nt, Homo sapiens
ccuugccucugcucu

SEQ ID NO: 1743023 - RNA, 22 nt, Homo sapiens
cccucacuccugccaguugaaa

SEQ ID NO: 1743024 - RNA, 15 nt, Homo sapiens
guuuucaaugcacaa

SEQ ID NO: 1743025 - RNA, 23 nt, Homo sapiens
auggugacuaacaguuacaugaa

SEQ ID NO: 1743026 - RNA, 17 nt, Homo sapiens
gcugaaagaggccaaac

SEQ ID NO: 1743027 - RNA, 16 nt, Homo sapiens
uucgccccucugggcu

SEQ ID NO: 1743028 - RNA, 23 nt, Homo sapiens
gcagaggggccaggcccaggcag

SEQ ID NO: 1743029 - RNA, 17 nt, Homo sapiens
auucugcuuucuugcca

SEQ ID NO: 1743030 - RNA, 17 nt, Homo sapiens
ggucuccucugcagcuc

SEQ ID NO: 1743031 - RNA, 13 nt, Homo sapiens
gcaugaccauccu

SEQ ID NO: 1743032 - RNA, 22 nt, Homo sapiens
accaguuucuaucccuuaccug

SEQ ID NO: 1743033 - RNA, 23 nt, Homo sapiens
accgaaucucaauguacauagac

SEQ ID NO: 1743034 - RNA, 12 nt, Homo sapiens
cuuccuguaaca

SEQ ID NO: 1743035 - RNA, 15 nt, Homo sapiens
ugucgggacaugguu

SEQ ID NO: 1743036 - RNA, 16 nt, Homo sapiens
aucacuuucagguggc

SEQ ID NO: 1743037 - RNA, 18 nt, Homo sapiens
ggaguucucccaccaccu

SEQ ID NO: 1743038 - RNA, 16 nt, Homo sapiens
cagcucuccugcugca

SEQ ID NO: 1743039 - RNA, 14 nt, Homo sapiens
gagggugggccagc

SEQ ID NO: 1743040 - RNA, 13 nt, Homo sapiens
gcauauucauggu

SEQ ID NO: 1743041 - RNA, 23 nt, Homo sapiens
ccuugaccucauuuacaaagcaa

SEQ ID NO: 1743042 - RNA, 18 nt, Homo sapiens
uccccagcccccacccau

SEQ ID NO: 1743043 - RNA, 15 nt, Homo sapiens
ccccgugacugcaau

SEQ ID NO: 1743044 - RNA, 20 nt, Homo sapiens
gaccaggucuuguucaagca

SEQ ID NO: 1743045 - RNA, 15 nt, Homo sapiens
acguuuagcugacaa

SEQ ID NO: 1743046 - RNA, 18 nt, Homo sapiens
auaaaaguguuaaagcuu

SEQ ID NO: 1743047 - RNA, 18 nt, Homo sapiens
guuaaaugaaauuguaaa

SEQ ID NO: 1743048 - RNA, 21 nt, Homo sapiens
uuccuaaaagagaauggaaaa

SEQ ID NO: 1743049 - RNA, 21 nt, Homo sapiens
uaauacuucauucucucucau

SEQ ID NO: 1743050 - RNA, 22 nt, Homo sapiens
agugacauauauauguauauac

SEQ ID NO: 1743051 - RNA, 18 nt, Homo sapiens
ugugcacugucacuuugc

SEQ ID NO: 1743052 - RNA, 13 nt, Homo sapiens
uugcgccaccugc

SEQ ID NO: 1743053 - RNA, 13 nt, Homo sapiens
uucugacuuugaa

SEQ ID NO: 1743054 - RNA, 15 nt, Homo sapiens
caagagggcuuuauu

SEQ ID NO: 1743055 - RNA, 21 nt, Homo sapiens
cauauagagaugaaguuugua

SEQ ID NO: 1743056 - RNA, 19 nt, Homo sapiens
ucucuggcuuuauuacucc

SEQ ID NO: 1743057 - RNA, 13 nt, Homo sapiens
aacuguacagugu

SEQ ID NO: 1743058 - RNA, 19 nt, Homo sapiens
uggagguucugaaauaccu

SEQ ID NO: 1743059 - RNA, 16 nt, Homo sapiens
acagccucacuccuca

SEQ ID NO: 1743060 - RNA, 19 nt, Homo sapiens
aaacaauucuuauugacuc

SEQ ID NO: 1743061 - RNA, 14 nt, Homo sapiens
uuauuuuccaggua

SEQ ID NO: 1743062 - RNA, 15 nt, Homo sapiens
guuuuguguguauau

SEQ ID NO: 1743063 - RNA, 20 nt, Homo sapiens
ccagauagguggugccagug

SEQ ID NO: 1743064 - RNA, 13 nt, Homo sapiens
uccuguccaugcc

SEQ ID NO: 1743065 - RNA, 18 nt, Homo sapiens
uacugacugaugacaaac

SEQ ID NO: 1743066 - RNA, 17 nt, Homo sapiens
ugcauaggaauugcaca

SEQ ID NO: 1743067 - RNA, 15 nt, Homo sapiens
uguauacaugugcca

SEQ ID NO: 1743068 - RNA, 15 nt, Homo sapiens
gcaauaccaauguuc

SEQ ID NO: 1743069 - RNA, 13 nt, Homo sapiens
caugucugugcug

SEQ ID NO: 1743070 - RNA, 19 nt, Homo sapiens
acauccagauagguuacca

SEQ ID NO: 1743071 - RNA, 16 nt, Homo sapiens
uauauuuaagaagcca

SEQ ID NO: 1743072 - RNA, 20 nt, Homo sapiens
agaacuaaugauaaucccac

SEQ ID NO: 1743073 - RNA, 20 nt, Homo sapiens
agugcugcuauaucuaucca

SEQ ID NO: 1743074 - RNA, 15 nt, Homo sapiens
cuagauccacacaca

SEQ ID NO: 1743075 - RNA, 16 nt, Homo sapiens
aggagucugauugcag

SEQ ID NO: 1743076 - RNA, 21 nt, Homo sapiens
ucccauuugcccuccuccuca

SEQ ID NO: 1743077 - RNA, 18 nt, Homo sapiens
agcugaggaggugcugca

SEQ ID NO: 1743078 - RNA, 17 nt, Homo sapiens
cacaaauuucaucuccu

SEQ ID NO: 1743079 - RNA, 17 nt, Homo sapiens
gcauggaaaucagccaa

SEQ ID NO: 1743080 - RNA, 16 nt, Homo sapiens
cuuugcacuucaaaaa

SEQ ID NO: 1743081 - RNA, 17 nt, Homo sapiens
uuuguuaagacugcuga

SEQ ID NO: 1743082 - RNA, 22 nt, Homo sapiens
acaucgucucugccacuccuga

SEQ ID NO: 1743083 - RNA, 18 nt, Homo sapiens
gcuucuguugcugccuca

SEQ ID NO: 1743084 - RNA, 22 nt, Homo sapiens
acuaauuguaagguauugcaag

SEQ ID NO: 1743085 - RNA, 15 nt, Homo sapiens
ccaacaaugugauuu

SEQ ID NO: 1743086 - RNA, 15 nt, Homo sapiens
uuaauuuaauuugca

SEQ ID NO: 1743087 - RNA, 17 nt, Homo sapiens
gaaaauaauuguuccaa

SEQ ID NO: 1743088 - RNA, 14 nt, Homo sapiens
uggagacaggccau

SEQ ID NO: 1743089 - RNA, 16 nt, Homo sapiens
uguagcuaacagugaa

SEQ ID NO: 1743090 - RNA, 17 nt, Homo sapiens
aaaaagaaauuaucuuu

SEQ ID NO: 1743091 - RNA, 17 nt, Homo sapiens
ugaccacagcacagcca

SEQ ID NO: 1743092 - RNA, 18 nt, Homo sapiens
uggggaagaccuuguccc

SEQ ID NO: 1743093 - RNA, 23 nt, Homo sapiens
cuccuuacccugccccagcuggg

SEQ ID NO: 1743094 - RNA, 14 nt, Homo sapiens
uggacaucuucacg

SEQ ID NO: 1743095 - RNA, 20 nt, Homo sapiens
cagaugugagggcaccacca

SEQ ID NO: 1743096 - RNA, 14 nt, Homo sapiens
ggaaucuagcccaa

SEQ ID NO: 1743097 - RNA, 12 nt, Homo sapiens
uauuucuuuaaa

SEQ ID NO: 1743098 - RNA, 16 nt, Homo sapiens
aaaucauuuauuuaca

SEQ ID NO: 1743099 - RNA, 16 nt, Homo sapiens
uauucuuuaaauuuca

SEQ ID NO: 1743100 - RNA, 24 nt, Homo sapiens
gccauuuaauacccugcaauguaa

SEQ ID NO: 1743101 - RNA, 16 nt, Homo sapiens
acuccaaaaagacaag

SEQ ID NO: 1743102 - RNA, 17 nt, Homo sapiens
ggaagcucuucuuccca

SEQ ID NO: 1743103 - RNA, 13 nt, Homo sapiens
uccuucaccaaag

SEQ ID NO: 1743104 - RNA, 12 nt, Homo sapiens
uuuacauucaau

SEQ ID NO: 1743105 - RNA, 13 nt, Homo sapiens
aaauaacauggcc

SEQ ID NO: 1743106 - RNA, 18 nt, Homo sapiens
uggucuccuugcacuuuc

SEQ ID NO: 1743107 - RNA, 17 nt, Homo sapiens
agggaaauucacacugu

SEQ ID NO: 1743108 - RNA, 15 nt, Homo sapiens
cacccuacacaaaau

SEQ ID NO: 1743109 - RNA, 19 nt, Homo sapiens
cuuacuccucuuuccuucc

SEQ ID NO: 1743110 - RNA, 12 nt, Homo sapiens
gaaaucuugucu

SEQ ID NO: 1743111 - RNA, 23 nt, Homo sapiens
agcauuuaggaaagcagugcagu

SEQ ID NO: 1743112 - RNA, 17 nt, Homo sapiens
cguguaccucacuuuac

SEQ ID NO: 1743113 - RNA, 17 nt, Homo sapiens
ucagcaucuguccucau

SEQ ID NO: 1743114 - RNA, 19 nt, Homo sapiens
ugugaaacugaaggucaau

SEQ ID NO: 1743115 - RNA, 22 nt, Homo sapiens
ggaccacaagugugcauuacca

SEQ ID NO: 1743116 - RNA, 21 nt, Homo sapiens
caguccccaaccugcacucua

SEQ ID NO: 1743117 - RNA, 17 nt, Homo sapiens
gggcuuuuuaagaggau

SEQ ID NO: 1743118 - RNA, 16 nt, Homo sapiens
agaacucugagcagug

SEQ ID NO: 1743119 - RNA, 18 nt, Homo sapiens
gggucugugugaaugugg

SEQ ID NO: 1743120 - RNA, 21 nt, Homo sapiens
cgaacuagagaugugcaauug

SEQ ID NO: 1743121 - RNA, 21 nt, Homo sapiens
cacugacacaucagcauguuu

SEQ ID NO: 1743122 - RNA, 18 nt, Homo sapiens
aauccugauucauauuua

SEQ ID NO: 1743123 - RNA, 19 nt, Homo sapiens
ggacagggcugucucugaa

SEQ ID NO: 1743124 - RNA, 14 nt, Homo sapiens
cuggacagacccag

SEQ ID NO: 1743125 - RNA, 17 nt, Homo sapiens
gccucacggagggccgu

SEQ ID NO: 1743126 - RNA, 20 nt, Homo sapiens
gaucaucacuuccuugcccc

SEQ ID NO: 1743127 - RNA, 12 nt, Homo sapiens
gcguacacagag

SEQ ID NO: 1743128 - RNA, 17 nt, Homo sapiens
gaaguccuucaccucac

SEQ ID NO: 1743129 - RNA, 20 nt, Homo sapiens
guuagauauugcuacuauaa

SEQ ID NO: 1743130 - RNA, 23 nt, Homo sapiens
cuggaacgcagugguguuuucag

SEQ ID NO: 1743131 - RNA, 21 nt, Homo sapiens
ucuagccacaguucuaagacc

SEQ ID NO: 1743132 - RNA, 19 nt, Homo sapiens
ccgcugcgggcccagcuga

SEQ ID NO: 1743133 - RNA, 18 nt, Homo sapiens
acacuaaauugcaguuua

SEQ ID NO: 1743134 - RNA, 19 nt, Homo sapiens
guagagaaugucacuguag

SEQ ID NO: 1743135 - RNA, 21 nt, Homo sapiens
ggagacucaccucugccucaa

SEQ ID NO: 1743136 - RNA, 22 nt, Homo sapiens
uuuacuguguugaagcuaaaaa

SEQ ID NO: 1743137 - RNA, 13 nt, Homo sapiens
agccaaacaaaac

SEQ ID NO: 1743138 - RNA, 21 nt, Homo sapiens
uguuucacaacaggcauucca

SEQ ID NO: 1743139 - RNA, 23 nt, Homo sapiens
cuagagcuagaugugucuuacca

SEQ ID NO: 1743140 - RNA, 17 nt, Homo sapiens
agaagauuuuauucuua

SEQ ID NO: 1743141 - RNA, 16 nt, Homo sapiens
acccucucucugaucu

SEQ ID NO: 1743142 - RNA, 22 nt, Homo sapiens
aggcaggcacuucacacaguaa

SEQ ID NO: 1743143 - RNA, 21 nt, Homo sapiens
acuuccacaaaauuaugcugc

SEQ ID NO: 1743144 - RNA, 12 nt, Homo sapiens
ugcauuuagcuu

SEQ ID NO: 1743145 - RNA, 19 nt, Homo sapiens
auggugaagaacuagcaua

SEQ ID NO: 1743146 - RNA, 21 nt, Homo sapiens
cacauuuuaaaagugccauua

SEQ ID NO: 1743147 - RNA, 14 nt, Homo sapiens
cuuauguugcacaa

SEQ ID NO: 1743148 - RNA, 22 nt, Homo sapiens
uggagagaucauagcucacugu

SEQ ID NO: 1743149 - RNA, 23 nt, Homo sapiens
aauacuacugcacagagucagga

SEQ ID NO: 1743150 - RNA, 16 nt, Homo sapiens
aguccuucaaacuucc

SEQ ID NO: 1743151 - RNA, 19 nt, Homo sapiens
ugaaacccuaucucuacua

SEQ ID NO: 1743152 - RNA, 18 nt, Homo sapiens
aaauaauaaaaugcaaau

SEQ ID NO: 1743153 - RNA, 19 nt, Homo sapiens
uuaccaguuuuccagaaca

SEQ ID NO: 1743154 - RNA, 9 nt, Homo sapiens
auucugucc

SEQ ID NO: 1743155 - RNA, 18 nt, Homo sapiens
auuauagcacaaaaucag

SEQ ID NO: 1743156 - RNA, 15 nt, Homo sapiens
augccuauuuacugg

SEQ ID NO: 1743157 - RNA, 17 nt, Homo sapiens
uucucccauagcaaaga

SEQ ID NO: 1743158 - RNA, 12 nt, Homo sapiens
cauuuaaaacau

SEQ ID NO: 1743159 - RNA, 17 nt, Homo sapiens
gccucuggggcaggacc

SEQ ID NO: 1743160 - RNA, 18 nt, Homo sapiens
cauaugaucugucugugg

SEQ ID NO: 1743161 - RNA, 15 nt, Homo sapiens
gaacaugagugcuga

SEQ ID NO: 1743162 - RNA, 21 nt, Homo sapiens
ugcucagcccugcaccaugcu

SEQ ID NO: 1743163 - RNA, 16 nt, Homo sapiens
cuccuggaagugcuaa

SEQ ID NO: 1743164 - RNA, 22 nt, Homo sapiens
cuuccuaggcauuacccaaaag

SEQ ID NO: 1743165 - RNA, 22 nt, Homo sapiens
ccucauaaaaaucuagcacacu

SEQ ID NO: 1743166 - RNA, 22 nt, Homo sapiens
uuaaacauuaauagcagccuuu

SEQ ID NO: 1743167 - RNA, 19 nt, Homo sapiens
agaccuuccauaaugcuac

SEQ ID NO: 1743168 - RNA, 20 nt, Homo sapiens
cuuacaggaaaaccugcaga

SEQ ID NO: 1743169 - RNA, 18 nt, Homo sapiens
uguuuacguuugauacaa

SEQ ID NO: 1743170 - RNA, 21 nt, Homo sapiens
gaaacuauaaaguuuuauuug

SEQ ID NO: 1743171 - RNA, 18 nt, Homo sapiens
cagagagucccacugccu

SEQ ID NO: 1743172 - RNA, 21 nt, Homo sapiens
caggggagguguauuguguau

SEQ ID NO: 1743173 - RNA, 23 nt, Homo sapiens
uagugaccaaucgggaguagcaa

SEQ ID NO: 1743174 - RNA, 22 nt, Homo sapiens
cucagcuacuucuccugcacuu

SEQ ID NO: 1743175 - RNA, 19 nt, Homo sapiens
gaaacuuugaguacagaua

SEQ ID NO: 1743176 - RNA, 18 nt, Homo sapiens
ucagccuugggcucucuu

SEQ ID NO: 1743177 - RNA, 19 nt, Homo sapiens
uucucuaaacuuucccuau

SEQ ID NO: 1743178 - RNA, 16 nt, Homo sapiens
gccucccaaguagcug

SEQ ID NO: 1743179 - RNA, 17 nt, Homo sapiens
uaguuuuuacaaaacug

SEQ ID NO: 1743180 - RNA, 16 nt, Homo sapiens
aacgccgagugcacug

SEQ ID NO: 1743181 - RNA, 13 nt, Homo sapiens
cagcaagucccag

SEQ ID NO: 1743182 - RNA, 12 nt, Homo sapiens
cccuuuucauga

SEQ ID NO: 1743183 - RNA, 19 nt, Homo sapiens
uguccccgccuucccucac

SEQ ID NO: 1743184 - RNA, 18 nt, Homo sapiens
guagaaauaauaugcauu

SEQ ID NO: 1743185 - RNA, 23 nt, Homo sapiens
uaagaaaaaauucuuucacuuga

SEQ ID NO: 1743186 - RNA, 22 nt, Homo sapiens
gaagagggaccagggugggaga

SEQ ID NO: 1743187 - RNA, 21 nt, Homo sapiens
uaugccuuuuuccuagccugu

SEQ ID NO: 1743188 - RNA, 19 nt, Homo sapiens
cuacccgugucuagaggca

SEQ ID NO: 1743189 - RNA, 17 nt, Homo sapiens
auaacauaacaaauaac

SEQ ID NO: 1743190 - RNA, 17 nt, Homo sapiens
uuccguggcacugcaua

SEQ ID NO: 1743191 - RNA, 14 nt, Homo sapiens
uccuuuuucuuucc

SEQ ID NO: 1743192 - RNA, 20 nt, Homo sapiens
aauggguuugccaagcccuu

SEQ ID NO: 1743193 - RNA, 16 nt, Homo sapiens
uguuacuuaaacauca

SEQ ID NO: 1743194 - RNA, 12 nt, Homo sapiens
gaauaaggagcc

SEQ ID NO: 1743195 - RNA, 14 nt, Homo sapiens
cuguagucccagcu

SEQ ID NO: 1743196 - RNA, 18 nt, Homo sapiens
acacuugguguacugggu

SEQ ID NO: 1743197 - RNA, 18 nt, Homo sapiens
agacucugucuaccuggu

SEQ ID NO: 1743198 - RNA, 16 nt, Homo sapiens
gguagaaaugucuaug

SEQ ID NO: 1743199 - RNA, 18 nt, Homo sapiens
uugcaaauuauucuaguc

SEQ ID NO: 1743200 - RNA, 15 nt, Homo sapiens
ggauuggcuuugugc

SEQ ID NO: 1743201 - RNA, 24 nt, Homo sapiens
ucaugcaaaggcugggaccacgug

SEQ ID NO: 1743202 - RNA, 15 nt, Homo sapiens
uauguuacaugcauu

SEQ ID NO: 1743203 - RNA, 14 nt, Homo sapiens
ggcucagcacuuug

SEQ ID NO: 1743204 - RNA, 22 nt, Homo sapiens
ggagaaaauaacaagaguuuua

SEQ ID NO: 1743205 - RNA, 11 nt, Homo sapiens
ccaagagucug

SEQ ID NO: 1743206 - RNA, 23 nt, Homo sapiens
caggaauuaugucguaagucacu

SEQ ID NO: 1743207 - RNA, 14 nt, Homo sapiens
gaaauuagucuauu

SEQ ID NO: 1743208 - RNA, 19 nt, Homo sapiens
uguaaagacagagugaauu

SEQ ID NO: 1743209 - RNA, 21 nt, Homo sapiens
uauuugaggaaacucauacag

SEQ ID NO: 1743210 - RNA, 15 nt, Homo sapiens
caugaccacauagaa

SEQ ID NO: 1743211 - RNA, 18 nt, Homo sapiens
uugaggaauaaaugccuu

SEQ ID NO: 1743212 - RNA, 18 nt, Homo sapiens
gacugcugucuuacuaau

SEQ ID NO: 1743213 - RNA, 19 nt, Homo sapiens
cuuccggggaaggauuuug

SEQ ID NO: 1743214 - RNA, 15 nt, Homo sapiens
guuaccaaagcaaua

SEQ ID NO: 1743215 - RNA, 12 nt, Homo sapiens
agaccugucacc

SEQ ID NO: 1743216 - RNA, 17 nt, Homo sapiens
aacagguaaaacagggc

SEQ ID NO: 1743217 - RNA, 14 nt, Homo sapiens
cucaucccuguucc

SEQ ID NO: 1743218 - RNA, 15 nt, Homo sapiens
ggaacaguugcauuu

SEQ ID NO: 1743219 - RNA, 14 nt, Homo sapiens
uauaccacaauuca

SEQ ID NO: 1743220 - RNA, 21 nt, Homo sapiens
guaccauagcgcugcucuuau

SEQ ID NO: 1743221 - RNA, 13 nt, Homo sapiens
acccuacucugga

SEQ ID NO: 1743222 - RNA, 18 nt, Homo sapiens
uuguauuuuaauaaagau

SEQ ID NO: 1743223 - RNA, 16 nt, Homo sapiens
augagacucagugcag

SEQ ID NO: 1743224 - RNA, 23 nt, Homo sapiens
gcacucacaccacuaacaugccc

SEQ ID NO: 1743225 - RNA, 16 nt, Homo sapiens
accccagccacuccuc

SEQ ID NO: 1743226 - RNA, 18 nt, Homo sapiens
gacucacccuccacaaag

SEQ ID NO: 1743227 - RNA, 22 nt, Homo sapiens
cuguagaaaagggaacugaaca

SEQ ID NO: 1743228 - RNA, 14 nt, Homo sapiens
ggguuguugucuca

SEQ ID NO: 1743229 - RNA, 10 nt, Homo sapiens
acuugcacug

SEQ ID NO: 1743230 - RNA, 17 nt, Homo sapiens
ccaagagguuaggugaa

SEQ ID NO: 1743231 - RNA, 21 nt, Homo sapiens
cagugguuggcaauuguuuca

SEQ ID NO: 1743232 - RNA, 21 nt, Homo sapiens
ugugugaggacuucugcaucu

SEQ ID NO: 1743233 - RNA, 17 nt, Homo sapiens
gcuuuuaccaacccaaa

SEQ ID NO: 1743234 - RNA, 21 nt, Homo sapiens
ccugcauagcuugcacaacau

SEQ ID NO: 1743235 - RNA, 20 nt, Homo sapiens
gguucaugcuucuacuguga

SEQ ID NO: 1743236 - RNA, 15 nt, Homo sapiens
cacccuuucuugaca

SEQ ID NO: 1743237 - RNA, 20 nt, Homo sapiens
uugcacacuucaaaucagag

SEQ ID NO: 1743238 - RNA, 23 nt, Homo sapiens
cuggaggcggcaaagggugaaau

SEQ ID NO: 1743239 - RNA, 12 nt, Homo sapiens
ccaucaccacca

SEQ ID NO: 1743240 - RNA, 22 nt, Homo sapiens
acuguuuuguauaugcugcauu

SEQ ID NO: 1743241 - RNA, 16 nt, Homo sapiens
uugucgguuaccucug

SEQ ID NO: 1743242 - RNA, 19 nt, Homo sapiens
ggcaguguggcagugacca

SEQ ID NO: 1743243 - RNA, 21 nt, Homo sapiens
gacaggacagcauggugcaug

SEQ ID NO: 1743244 - RNA, 17 nt, Homo sapiens
ugcagauuauuugccca

SEQ ID NO: 1743245 - RNA, 17 nt, Homo sapiens
ucauguuccuggcguga

SEQ ID NO: 1743246 - RNA, 20 nt, Homo sapiens
aauccuuuuaaaucuugaua

SEQ ID NO: 1743247 - RNA, 16 nt, Homo sapiens
ggcccuggccagaagc

SEQ ID NO: 1743248 - RNA, 14 nt, Homo sapiens
cuaccaaaacaguu

SEQ ID NO: 1743249 - RNA, 14 nt, Homo sapiens
uucccaacaugccu

SEQ ID NO: 1743250 - RNA, 16 nt, Homo sapiens
gccgcagagaaaugcc

SEQ ID NO: 1743251 - RNA, 21 nt, Homo sapiens
ugcaaccucuuggccugauca

SEQ ID NO: 1743252 - RNA, 23 nt, Homo sapiens
guuaaaagcaaaaagauguauau

SEQ ID NO: 1743253 - RNA, 16 nt, Homo sapiens
agaauccuuacuuuug

SEQ ID NO: 1743254 - RNA, 19 nt, Homo sapiens
gcauccuagucucuaucau

SEQ ID NO: 1743255 - RNA, 20 nt, Homo sapiens
cugcaagagggggcauugau

SEQ ID NO: 1743256 - RNA, 21 nt, Homo sapiens
agcaaacgucuauuuuguaua

SEQ ID NO: 1743257 - RNA, 13 nt, Homo sapiens
cuggccgccuagg

SEQ ID NO: 1743258 - RNA, 16 nt, Homo sapiens
caaagcaaggagauca

SEQ ID NO: 1743259 - RNA, 17 nt, Homo sapiens
accuagcaggcuguucc

SEQ ID NO: 1743260 - RNA, 22 nt, Homo sapiens
uacucaguaaaucagugcagua

SEQ ID NO: 1743261 - RNA, 24 nt, Homo sapiens
uucugaagaguaaggaguaguauu

SEQ ID NO: 1743262 - RNA, 16 nt, Homo sapiens
acuuuagaagcacagu

SEQ ID NO: 1743263 - RNA, 19 nt, Homo sapiens
uaauuuuuuuuccuugccu

SEQ ID NO: 1743264 - RNA, 20 nt, Homo sapiens
agugccaugauugcuagcca

SEQ ID NO: 1743265 - RNA, 18 nt, Homo sapiens
auuagcuccacaaagcca

SEQ ID NO: 1743266 - RNA, 17 nt, Homo sapiens
ccuuuggaaugcuguau

SEQ ID NO: 1743267 - RNA, 18 nt, Homo sapiens
gaaacaugaaacaacuca

SEQ ID NO: 1743268 - RNA, 16 nt, Homo sapiens
ccacagccaugcccuu

SEQ ID NO: 1743269 - RNA, 15 nt, Homo sapiens
auccaccccauccaa

SEQ ID NO: 1743270 - RNA, 17 nt, Homo sapiens
gccugcuuuuaggucau

SEQ ID NO: 1743271 - RNA, 22 nt, Homo sapiens
cuggccauuuaacuagcacuuu

SEQ ID NO: 1743272 - RNA, 22 nt, Homo sapiens
gaccucacgugcaaagccacca

SEQ ID NO: 1743273 - RNA, 21 nt, Homo sapiens
cauugccacggaaacauacag

SEQ ID NO: 1743274 - RNA, 20 nt, Homo sapiens
ugcagucucuauaccaauaa

SEQ ID NO: 1743275 - RNA, 15 nt, Homo sapiens
cacaagagugaauuu

SEQ ID NO: 1743276 - RNA, 19 nt, Homo sapiens
cacaaccuuccagcuccau

SEQ ID NO: 1743277 - RNA, 23 nt, Homo sapiens
aaauaucccugggguauuuuaga

SEQ ID NO: 1743278 - RNA, 19 nt, Homo sapiens
ggcagaugggccuggccuu

SEQ ID NO: 1743279 - RNA, 16 nt, Homo sapiens
ucucuuuaacucagga

SEQ ID NO: 1743280 - RNA, 17 nt, Homo sapiens
ugccauagucaaagaga

SEQ ID NO: 1743281 - RNA, 21 nt, Homo sapiens
uuaagagaagaugugauuuau

SEQ ID NO: 1743282 - RNA, 21 nt, Homo sapiens
agcuugagggugacuauggag

SEQ ID NO: 1743283 - RNA, 16 nt, Homo sapiens
agaaaaugaaagacuc

SEQ ID NO: 1743284 - RNA, 18 nt, Homo sapiens
augaaggacgugucucag

SEQ ID NO: 1743285 - RNA, 22 nt, Homo sapiens
gcugccucaggaaucuccugac

SEQ ID NO: 1743286 - RNA, 21 nt, Homo sapiens
caccaauuaauguagcugcua

SEQ ID NO: 1743287 - RNA, 19 nt, Homo sapiens
ggcugccccugcguggccu

SEQ ID NO: 1743288 - RNA, 17 nt, Homo sapiens
gacuggauguaccacca

SEQ ID NO: 1743289 - RNA, 19 nt, Homo sapiens
gaaagaaugcauuccagaa

SEQ ID NO: 1743290 - RNA, 12 nt, Homo sapiens
cuucaugcuuuu

SEQ ID NO: 1743291 - RNA, 16 nt, Homo sapiens
agaaagacaucuuucu

SEQ ID NO: 1743292 - RNA, 15 nt, Homo sapiens
uguaacauaaugcac

SEQ ID NO: 1743293 - RNA, 16 nt, Homo sapiens
uauuugcuaagcauau

SEQ ID NO: 1743294 - RNA, 20 nt, Homo sapiens
gguuuuaaccgcacaugcac

SEQ ID NO: 1743295 - RNA, 23 nt, Homo sapiens
cugcagcauugccauaccauucc

SEQ ID NO: 1743296 - RNA, 22 nt, Homo sapiens
gauaagcaguuaugugaccuca

SEQ ID NO: 1743297 - RNA, 21 nt, Homo sapiens
uauaaauacacuuccugcuua

SEQ ID NO: 1743298 - RNA, 16 nt, Homo sapiens
uuaaaucauacuccua

SEQ ID NO: 1743299 - RNA, 16 nt, Homo sapiens
gcuccaggcuccucau

SEQ ID NO: 1743300 - RNA, 23 nt, Homo sapiens
gcccacucugcaagaagaaauca

SEQ ID NO: 1743301 - RNA, 21 nt, Homo sapiens
gcucagccccggccacucccu

SEQ ID NO: 1743302 - RNA, 21 nt, Homo sapiens
uucaacaaauuucauugcacu

SEQ ID NO: 1743303 - RNA, 17 nt, Homo sapiens
ucccacucuuaucuuac

SEQ ID NO: 1743304 - RNA, 19 nt, Homo sapiens
ggcuuaguauuucucagga

SEQ ID NO: 1743305 - RNA, 17 nt, Homo sapiens
ggcgcccgggauccagc

SEQ ID NO: 1743306 - RNA, 23 nt, Homo sapiens
ugcaaauuggcuaaagugcauuu

SEQ ID NO: 1743307 - RNA, 21 nt, Homo sapiens
ugcacagcuaaguguggagcu

SEQ ID NO: 1743308 - RNA, 21 nt, Homo sapiens
ccagauacacuaaaguuacaa

SEQ ID NO: 1743309 - RNA, 17 nt, Homo sapiens
ugcaaauccuaugugau

SEQ ID NO: 1743310 - RNA, 19 nt, Homo sapiens
guuuuagacaaauuugcaa

SEQ ID NO: 1743311 - RNA, 17 nt, Homo sapiens
ucgcaaaaugaugugaa

SEQ ID NO: 1743312 - RNA, 24 nt, Homo sapiens
ccaccugccugcaucugugaaaag

SEQ ID NO: 1743313 - RNA, 16 nt, Homo sapiens
auuucauuuagcuuuu

SEQ ID NO: 1743314 - RNA, 23 nt, Homo sapiens
uguauagcugugugaacguguau

SEQ ID NO: 1743315 - RNA, 18 nt, Homo sapiens
aaauauccuccaaugugu

SEQ ID NO: 1743316 - RNA, 17 nt, Homo sapiens
aaucaguuucuuacaaa

SEQ ID NO: 1743317 - RNA, 20 nt, Homo sapiens
gucuuaaggacaaagugcca

SEQ ID NO: 1743318 - RNA, 15 nt, Homo sapiens
uuugcaagaaccaga

SEQ ID NO: 1743319 - RNA, 23 nt, Homo sapiens
cacaccccuguacccccccaggg

SEQ ID NO: 1743320 - RNA, 17 nt, Homo sapiens
gccauaagaaagcacua

SEQ ID NO: 1743321 - RNA, 15 nt, Homo sapiens
uuuuccucuauugag

SEQ ID NO: 1743322 - RNA, 17 nt, Homo sapiens
gucaccaauguacccac

SEQ ID NO: 1743323 - RNA, 14 nt, Homo sapiens
auuucccccaggga

SEQ ID NO: 1743324 - RNA, 13 nt, Homo sapiens
cagaaagauucau

SEQ ID NO: 1743325 - RNA, 15 nt, Homo sapiens
cuaugaaugggcaaa

SEQ ID NO: 1743326 - RNA, 19 nt, Homo sapiens
uauugaugauguugaacaa

SEQ ID NO: 1743327 - RNA, 16 nt, Homo sapiens
uuaagaggauuuuaac

SEQ ID NO: 1743328 - RNA, 19 nt, Homo sapiens
acugaaaaugaacuguaaa

SEQ ID NO: 1743329 - RNA, 16 nt, Homo sapiens
cugcaucaagacuuca

SEQ ID NO: 1743330 - RNA, 20 nt, Homo sapiens
caguuugugcucuacuguua

SEQ ID NO: 1743331 - RNA, 23 nt, Homo sapiens
uaauaucagcaagucucuuuaua

SEQ ID NO: 1743332 - RNA, 12 nt, Homo sapiens
cagccugcacag

SEQ ID NO: 1743333 - RNA, 18 nt, Homo sapiens
caucuuggggacaucucu

SEQ ID NO: 1743334 - RNA, 18 nt, Homo sapiens
ucugcccugcccuagcuc

SEQ ID NO: 1743335 - RNA, 17 nt, Homo sapiens
augcucagcgcuuaaaa

SEQ ID NO: 1743336 - RNA, 13 nt, Homo sapiens
caggugcugugac

SEQ ID NO: 1743337 - RNA, 19 nt, Homo sapiens
uaucagacucggaaucuau

SEQ ID NO: 1743338 - RNA, 21 nt, Homo sapiens
gaugguguccugaggccucca

SEQ ID NO: 1743339 - RNA, 19 nt, Homo sapiens
uguacaguuauacauaccu

SEQ ID NO: 1743340 - RNA, 18 nt, Homo sapiens
gggccccgaaugucacug

SEQ ID NO: 1743341 - RNA, 18 nt, Homo sapiens
uguugaaucaaagugauu

SEQ ID NO: 1743342 - RNA, 11 nt, Homo sapiens
uccgcacuuuc

SEQ ID NO: 1743343 - RNA, 23 nt, Homo sapiens
aauauuuacuaacuaaauaccau

SEQ ID NO: 1743344 - RNA, 13 nt, Homo sapiens
ucauucacauuaa

SEQ ID NO: 1743345 - RNA, 18 nt, Homo sapiens
acgacacgcguccucggg

SEQ ID NO: 1743346 - RNA, 20 nt, Homo sapiens
cacgccgauauaagccauag

SEQ ID NO: 1743347 - RNA, 12 nt, Homo sapiens
cuugcagacucg

SEQ ID NO: 1743348 - RNA, 18 nt, Homo sapiens
cauaagcaauaccagcaa

SEQ ID NO: 1743349 - RNA, 21 nt, Homo sapiens
cucuucccuuccuccauugca

SEQ ID NO: 1743350 - RNA, 14 nt, Homo sapiens
augacuggcuucau

SEQ ID NO: 1743351 - RNA, 16 nt, Homo sapiens
gaaagacaagcucaag

SEQ ID NO: 1743352 - RNA, 21 nt, Homo sapiens
uaacauacuauauaagccagu

SEQ ID NO: 1743353 - RNA, 14 nt, Homo sapiens
ucagauucaugaaa

SEQ ID NO: 1743354 - RNA, 14 nt, Homo sapiens
gacacaaacacaca

SEQ ID NO: 1743355 - RNA, 16 nt, Homo sapiens
cacccagacuggagug

SEQ ID NO: 1743356 - RNA, 17 nt, Homo sapiens
uuaaaggaccucauuaa

SEQ ID NO: 1743357 - RNA, 14 nt, Homo sapiens
cucauuguagaaaa

SEQ ID NO: 1743358 - RNA, 20 nt, Homo sapiens
ugauguauguaauacauaua

SEQ ID NO: 1743359 - RNA, 21 nt, Homo sapiens
agucacggcugcgcacugugu

SEQ ID NO: 1743360 - RNA, 15 nt, Homo sapiens
ucugaguuuuacacc

SEQ ID NO: 1743361 - RNA, 17 nt, Homo sapiens
ugcacaucauauucuau

SEQ ID NO: 1743362 - RNA, 23 nt, Homo sapiens
ugcuacuccccagaccucaggga

SEQ ID NO: 1743363 - RNA, 12 nt, Homo sapiens
ugcaucagaaag

SEQ ID NO: 1743364 - RNA, 14 nt, Homo sapiens
uucaguuuccccau

SEQ ID NO: 1743365 - RNA, 19 nt, Homo sapiens
aaucccaucaggcuguuau

SEQ ID NO: 1743366 - RNA, 22 nt, Homo sapiens
uggcccuuucaacaaugucuuu

SEQ ID NO: 1743367 - RNA, 18 nt, Homo sapiens
ugggggacgugggcauuu

SEQ ID NO: 1743368 - RNA, 21 nt, Homo sapiens
auagcagaaauaaacauugag

SEQ ID NO: 1743369 - RNA, 15 nt, Homo sapiens
aggggacacuucccu

SEQ ID NO: 1743370 - RNA, 17 nt, Homo sapiens
agaugaggccagaccau

SEQ ID NO: 1743371 - RNA, 16 nt, Homo sapiens
gcuuuugcuugcaaug

SEQ ID NO: 1743372 - RNA, 19 nt, Homo sapiens
agaauguugguuuacuuuc

SEQ ID NO: 1743373 - RNA, 22 nt, Homo sapiens
accuguuuucgcaccuaccauc

SEQ ID NO: 1743374 - RNA, 22 nt, Homo sapiens
aucguccagcgaccuuccucau

SEQ ID NO: 1743375 - RNA, 22 nt, Homo sapiens
uuuuagucuaguuauuggauca

SEQ ID NO: 1743376 - RNA, 18 nt, Homo sapiens
cccaccccgccucugggc

SEQ ID NO: 1743377 - RNA, 12 nt, Homo sapiens
cagcacugugag

SEQ ID NO: 1743378 - RNA, 23 nt, Homo sapiens
cuuucuucacuacguguucacag

SEQ ID NO: 1743379 - RNA, 17 nt, Homo sapiens
cagcuucauuuccguga

SEQ ID NO: 1743380 - RNA, 21 nt, Homo sapiens
ccugggggacccaucuuccac

SEQ ID NO: 1743381 - RNA, 16 nt, Homo sapiens
aguaguaaucugucag

SEQ ID NO: 1743382 - RNA, 19 nt, Homo sapiens
uccuccacauucauguaca

SEQ ID NO: 1743383 - RNA, 21 nt, Homo sapiens
auuuccuuacagaacuacuuc

SEQ ID NO: 1743384 - RNA, 17 nt, Homo sapiens
ucagcccucaguuccuu

SEQ ID NO: 1743385 - RNA, 21 nt, Homo sapiens
aaacauaugcacauucacuua

SEQ ID NO: 1743386 - RNA, 21 nt, Homo sapiens
aagauucaguucaaauguuau

SEQ ID NO: 1743387 - RNA, 17 nt, Homo sapiens
gcaccaggcacugcugc

SEQ ID NO: 1743388 - RNA, 19 nt, Homo sapiens
uguaccaucugucuugcca

SEQ ID NO: 1743389 - RNA, 16 nt, Homo sapiens
auaucuuguaugguuu

SEQ ID NO: 1743390 - RNA, 21 nt, Homo sapiens
aauucauuucaucuacuacag

SEQ ID NO: 1743391 - RNA, 23 nt, Homo sapiens
acagauugugauaagaaaagcca

SEQ ID NO: 1743392 - RNA, 20 nt, Homo sapiens
ggauauuaacaacaauaaca

SEQ ID NO: 1743393 - RNA, 21 nt, Homo sapiens
ucuucagcaaguuggcaaaac

SEQ ID NO: 1743394 - RNA, 21 nt, Homo sapiens
ccuaauggcuuucacuuucuc

SEQ ID NO: 1743395 - RNA, 12 nt, Homo sapiens
ucugcuuaccuu

SEQ ID NO: 1743396 - RNA, 21 nt, Homo sapiens
agcagccaaaccuuuccugua

SEQ ID NO: 1743397 - RNA, 17 nt, Homo sapiens
cauuccaacuucaauuu

SEQ ID NO: 1743398 - RNA, 19 nt, Homo sapiens
aggacuggugccuggcaca

SEQ ID NO: 1743399 - RNA, 18 nt, Homo sapiens
agcucugauugcagcaca

SEQ ID NO: 1743400 - RNA, 14 nt, Homo sapiens
ccuccccaggaauu

SEQ ID NO: 1743401 - RNA, 20 nt, Homo sapiens
ucaaauagaaccacuaugaa

SEQ ID NO: 1743402 - RNA, 14 nt, Homo sapiens
cacuccugaacccc

SEQ ID NO: 1743403 - RNA, 14 nt, Homo sapiens
cagccaugaaguca

SEQ ID NO: 1743404 - RNA, 16 nt, Homo sapiens
aaugucauaaauguca

SEQ ID NO: 1743405 - RNA, 23 nt, Homo sapiens
cagaacucugccugcccuuuguc

SEQ ID NO: 1743406 - RNA, 18 nt, Homo sapiens
uugguguuugacuguaau

SEQ ID NO: 1743407 - RNA, 17 nt, Homo sapiens
cagaccggcaacaucag

SEQ ID NO: 1743408 - RNA, 15 nt, Homo sapiens
cuccccacugcucau

SEQ ID NO: 1743409 - RNA, 15 nt, Homo sapiens
uccauaggacaggaa

SEQ ID NO: 1743410 - RNA, 14 nt, Homo sapiens
cuuuguaagacaca

SEQ ID NO: 1743411 - RNA, 20 nt, Homo sapiens
aguccuuugggauucuagga

SEQ ID NO: 1743412 - RNA, 18 nt, Homo sapiens
gcaggucuagaagaacaa

SEQ ID NO: 1743413 - RNA, 17 nt, Homo sapiens
uauuaaaauuagugcug

SEQ ID NO: 1743414 - RNA, 22 nt, Homo sapiens
cguuccggagcuggguaucuca

SEQ ID NO: 1743415 - RNA, 17 nt, Homo sapiens
uaggauucuaaucucau

SEQ ID NO: 1743416 - RNA, 23 nt, Homo sapiens
cuuuugcugcgcaccaaugccca

SEQ ID NO: 1743417 - RNA, 19 nt, Homo sapiens
ccuuguaauucuaaaugaa

SEQ ID NO: 1743418 - RNA, 20 nt, Homo sapiens
ccagaaaguuguguaggcac

SEQ ID NO: 1743419 - RNA, 18 nt, Homo sapiens
aaaugagaaagcauuucu

SEQ ID NO: 1743420 - RNA, 13 nt, Homo sapiens
aacuuagagucau

SEQ ID NO: 1743421 - RNA, 15 nt, Homo sapiens
ugcacaaacaugugu

SEQ ID NO: 1743422 - RNA, 17 nt, Homo sapiens
uugcauagcagcugcua

SEQ ID NO: 1743423 - RNA, 19 nt, Homo sapiens
uggugaauugggauuugca

SEQ ID NO: 1743424 - RNA, 14 nt, Homo sapiens
uauuuuuaccuuca

SEQ ID NO: 1743425 - RNA, 16 nt, Homo sapiens
uaaaaugguucaugaa

SEQ ID NO: 1743426 - RNA, 18 nt, Homo sapiens
ccaccaaagcugcccacu

SEQ ID NO: 1743427 - RNA, 15 nt, Homo sapiens
aauuucaguaaacaa

SEQ ID NO: 1743428 - RNA, 16 nt, Homo sapiens
gcucacccagucaccu

SEQ ID NO: 1743429 - RNA, 17 nt, Homo sapiens
aagccaccucucugccu

SEQ ID NO: 1743430 - RNA, 19 nt, Homo sapiens
uguagacuuuugcuuuaug

SEQ ID NO: 1743431 - RNA, 10 nt, Homo sapiens
accucaaggu

SEQ ID NO: 1743432 - RNA, 20 nt, Homo sapiens
uuccucaaagauucugcauu

SEQ ID NO: 1743433 - RNA, 14 nt, Homo sapiens
aaaaaggccaaaga

SEQ ID NO: 1743434 - RNA, 15 nt, Homo sapiens
cuggggcaucagcca

SEQ ID NO: 1743435 - RNA, 13 nt, Homo sapiens
ccagguccuguga

SEQ ID NO: 1743436 - RNA, 17 nt, Homo sapiens
gaaacucuuucauucuu

SEQ ID NO: 1743437 - RNA, 15 nt, Homo sapiens
ccagagcaucuugca

SEQ ID NO: 1743438 - RNA, 17 nt, Homo sapiens
ugagaaugacccuguca

SEQ ID NO: 1743439 - RNA, 23 nt, Homo sapiens
uauuuaaaucauuuuaacuucua

SEQ ID NO: 1743440 - RNA, 14 nt, Homo sapiens
ccaagccuggagua

SEQ ID NO: 1743441 - RNA, 17 nt, Homo sapiens
gccucaagugagccaag

SEQ ID NO: 1743442 - RNA, 15 nt, Homo sapiens
uauauacacauacau

SEQ ID NO: 1743443 - RNA, 17 nt, Homo sapiens
uuccaucugccugccaa

SEQ ID NO: 1743444 - RNA, 18 nt, Homo sapiens
cgaucuuagauugccacu

SEQ ID NO: 1743445 - RNA, 21 nt, Homo sapiens
acacuuacuguaagacauuag

SEQ ID NO: 1743446 - RNA, 20 nt, Homo sapiens
cugagcagggcgaggaccaa

SEQ ID NO: 1743447 - RNA, 17 nt, Homo sapiens
ccuagaaguucuuugau

SEQ ID NO: 1743448 - RNA, 23 nt, Homo sapiens
acaaagagaaugagaagacaugg

SEQ ID NO: 1743449 - RNA, 20 nt, Homo sapiens
caccaauuguacauucccug

SEQ ID NO: 1743450 - RNA, 13 nt, Homo sapiens
caauuucacccau

SEQ ID NO: 1743451 - RNA, 22 nt, Homo sapiens
uauaaauaacucuuauaacaca

SEQ ID NO: 1743452 - RNA, 23 nt, Homo sapiens
uuguggcugauuucaaaugcagu

SEQ ID NO: 1743453 - RNA, 21 nt, Homo sapiens
gauaauuuucagcugcaagga

SEQ ID NO: 1743454 - RNA, 22 nt, Homo sapiens
uuagagggaaguugaaagccaa

SEQ ID NO: 1743455 - RNA, 14 nt, Homo sapiens
aagcuggagugcug

SEQ ID NO: 1743456 - RNA, 14 nt, Homo sapiens
agccacugugaugc

SEQ ID NO: 1743457 - RNA, 19 nt, Homo sapiens
uguaaaggucaacaauaaa

SEQ ID NO: 1743458 - RNA, 17 nt, Homo sapiens
uaaugccauaggugaga

SEQ ID NO: 1743459 - RNA, 15 nt, Homo sapiens
gaggguggcugccuc

SEQ ID NO: 1743460 - RNA, 18 nt, Homo sapiens
cuguauuaacugaauucu

SEQ ID NO: 1743461 - RNA, 16 nt, Homo sapiens
cuuaagccuuuugcuc

SEQ ID NO: 1743462 - RNA, 20 nt, Homo sapiens
ucauggacagauagacagug

SEQ ID NO: 1743463 - RNA, 19 nt, Homo sapiens
aagucaucaugaacuggcu

SEQ ID NO: 1743464 - RNA, 15 nt, Homo sapiens
uggugaaaccaaaca

SEQ ID NO: 1743465 - RNA, 15 nt, Homo sapiens
cucauucacuguccu

SEQ ID NO: 1743466 - RNA, 19 nt, Homo sapiens
cagaaaguggccaugccac

SEQ ID NO: 1743467 - RNA, 15 nt, Homo sapiens
ucugcuggugaauaa

SEQ ID NO: 1743468 - RNA, 15 nt, Homo sapiens
auggagacuggaaaa

SEQ ID NO: 1743469 - RNA, 14 nt, Homo sapiens
ucaucccugcaaaa

SEQ ID NO: 1743470 - RNA, 12 nt, Homo sapiens
ccacaaaugucc

SEQ ID NO: 1743471 - RNA, 18 nt, Homo sapiens
acauuuauauauuuccau

SEQ ID NO: 1743472 - RNA, 15 nt, Homo sapiens
uugcuauagagccua

SEQ ID NO: 1743473 - RNA, 14 nt, Homo sapiens
cugcacaggcuugc

SEQ ID NO: 1743474 - RNA, 19 nt, Homo sapiens
cccugguggggugugcaug

SEQ ID NO: 1743475 - RNA, 18 nt, Homo sapiens
agaaucuaggccacccca

SEQ ID NO: 1743476 - RNA, 13 nt, Homo sapiens
auuuuuauacuga

SEQ ID NO: 1743477 - RNA, 14 nt, Homo sapiens
acugaagcucuuau

SEQ ID NO: 1743478 - RNA, 14 nt, Homo sapiens
uguuaugcagugaa

SEQ ID NO: 1743479 - RNA, 14 nt, Homo sapiens
uuuugugcauugga

SEQ ID NO: 1743480 - RNA, 12 nt, Homo sapiens
accucacuguga

SEQ ID NO: 1743481 - RNA, 14 nt, Homo sapiens
uaaauaucauucuu

SEQ ID NO: 1743482 - RNA, 13 nt, Homo sapiens
aagucuaacuuug

SEQ ID NO: 1743483 - RNA, 12 nt, Homo sapiens
augccacagcca

SEQ ID NO: 1743484 - RNA, 13 nt, Homo sapiens
ucccugccuggag

SEQ ID NO: 1743485 - RNA, 18 nt, Homo sapiens
cauggcagcuguuucuca

SEQ ID NO: 1743486 - RNA, 19 nt, Homo sapiens
aaccuccaccuucuggguu

SEQ ID NO: 1743487 - RNA, 14 nt, Homo sapiens
aagacacugaagcu

SEQ ID NO: 1743488 - RNA, 17 nt, Homo sapiens
ccaucuuuuaauaugcu

SEQ ID NO: 1743489 - RNA, 20 nt, Homo sapiens
gauuguuuauacuccagugu

SEQ ID NO: 1743490 - RNA, 16 nt, Homo sapiens
gcuauuauuucugguu

SEQ ID NO: 1743491 - RNA, 17 nt, Homo sapiens
uuggugacauaaugcca

SEQ ID NO: 1743492 - RNA, 16 nt, Homo sapiens
cccaacgacccaugac

SEQ ID NO: 1743493 - RNA, 20 nt, Homo sapiens
ccaguguuuacaaggugaca

SEQ ID NO: 1743494 - RNA, 14 nt, Homo sapiens
uguaaagaucuaca

SEQ ID NO: 1743495 - RNA, 11 nt, Homo sapiens
acaugugauug

SEQ ID NO: 1743496 - RNA, 21 nt, Homo sapiens
cccugcuuuagagcuagggug

SEQ ID NO: 1743497 - RNA, 13 nt, Homo sapiens
guggggugccuga

SEQ ID NO: 1743498 - RNA, 17 nt, Homo sapiens
cuagaugagaauucagc

SEQ ID NO: 1743499 - RNA, 21 nt, Homo sapiens
cccaggcccugcucuuccuca

SEQ ID NO: 1743500 - RNA, 18 nt, Homo sapiens
aggcuuuaauaaaggcca

SEQ ID NO: 1743501 - RNA, 21 nt, Homo sapiens
aaaaugaucuaguuccugaua

SEQ ID NO: 1743502 - RNA, 19 nt, Homo sapiens
cuaccagucuauuuccacu

SEQ ID NO: 1743503 - RNA, 23 nt, Homo sapiens
ggugagaauaagagagucauaaa

SEQ ID NO: 1743504 - RNA, 22 nt, Homo sapiens
uaaacagacagcuuacagaaug

SEQ ID NO: 1743505 - RNA, 13 nt, Homo sapiens
aaugagccuuaag

SEQ ID NO: 1743506 - RNA, 20 nt, Homo sapiens
auucuaguguaaaucaugca

SEQ ID NO: 1743507 - RNA, 13 nt, Homo sapiens
aucuggaauuuaa

SEQ ID NO: 1743508 - RNA, 13 nt, Homo sapiens
uuuuagaaaucag

SEQ ID NO: 1743509 - RNA, 18 nt, Homo sapiens
auuaucaagggcacaguu

SEQ ID NO: 1743510 - RNA, 23 nt, Homo sapiens
agaauaagaaaaggcaucacuuu

SEQ ID NO: 1743511 - RNA, 19 nt, Homo sapiens
ucuggccacacugggcuca

SEQ ID NO: 1743512 - RNA, 12 nt, Homo sapiens
agcuucagggcu

SEQ ID NO: 1743513 - RNA, 12 nt, Homo sapiens
guccucagaucc

SEQ ID NO: 1743514 - RNA, 15 nt, Homo sapiens
augguagacugugac

SEQ ID NO: 1743515 - RNA, 14 nt, Homo sapiens
aauuuaaagacaaa

SEQ ID NO: 1743516 - RNA, 19 nt, Homo sapiens
guugcaguuaauucuugcc

SEQ ID NO: 1743517 - RNA, 20 nt, Homo sapiens
cuggguucccuuuccuucca

SEQ ID NO: 1743518 - RNA, 16 nt, Homo sapiens
ccuccagagacacuga

SEQ ID NO: 1743519 - RNA, 21 nt, Homo sapiens
uguguccccccuguggucugu

SEQ ID NO: 1743520 - RNA, 19 nt, Homo sapiens
ucccuggcccccgggugua

SEQ ID NO: 1743521 - RNA, 15 nt, Homo sapiens
ccaaauauucugggg

SEQ ID NO: 1743522 - RNA, 23 nt, Homo sapiens
ucccguaccucuucccaugacug

SEQ ID NO: 1743523 - RNA, 12 nt, Homo sapiens
auuuucuauuca

SEQ ID NO: 1743524 - RNA, 18 nt, Homo sapiens
uuaucauggagaacagca

SEQ ID NO: 1743525 - RNA, 16 nt, Homo sapiens
gccauuaugccuggcu

SEQ ID NO: 1743526 - RNA, 16 nt, Homo sapiens
cacauuacgugcuccc

SEQ ID NO: 1743527 - RNA, 23 nt, Homo sapiens
gacccugauaguuucccauaaca

SEQ ID NO: 1743528 - RNA, 18 nt, Homo sapiens
aauagcuaauaauaccuu

SEQ ID NO: 1743529 - RNA, 11 nt, Homo sapiens
gcuaugugcac

SEQ ID NO: 1743530 - RNA, 20 nt, Homo sapiens
guguccccugaccuguccag

SEQ ID NO: 1743531 - RNA, 20 nt, Homo sapiens
cuucaacuuggaaaugacac

SEQ ID NO: 1743532 - RNA, 18 nt, Homo sapiens
aggcugcagucccuggaa

SEQ ID NO: 1743533 - RNA, 12 nt, Homo sapiens
ucgcagccugaa

SEQ ID NO: 1743534 - RNA, 16 nt, Homo sapiens
acucagcagcagagag

SEQ ID NO: 1743535 - RNA, 20 nt, Homo sapiens
ccacugcaccugaccugcug

SEQ ID NO: 1743536 - RNA, 13 nt, Homo sapiens
guuagaauuucug

SEQ ID NO: 1743537 - RNA, 13 nt, Homo sapiens
gauauaauuacuu

SEQ ID NO: 1743538 - RNA, 18 nt, Homo sapiens
ccuuucagaaucuuuuca

SEQ ID NO: 1743539 - RNA, 16 nt, Homo sapiens
cuuuccagaaaccaaa

SEQ ID NO: 1743540 - RNA, 12 nt, Homo sapiens
cuuggaacauac

SEQ ID NO: 1743541 - RNA, 17 nt, Homo sapiens
cccuaaaagcacacuca

SEQ ID NO: 1743542 - RNA, 18 nt, Homo sapiens
aaugcuacugaaacuuac

SEQ ID NO: 1743543 - RNA, 19 nt, Homo sapiens
auucaggagaucacugcuc

SEQ ID NO: 1743544 - RNA, 18 nt, Homo sapiens
gucuuucuggaaaggaaa

SEQ ID NO: 1743545 - RNA, 17 nt, Homo sapiens
agugagcucuggaugaa

SEQ ID NO: 1743546 - RNA, 23 nt, Homo sapiens
auguuuguaauaauugcucauaa

SEQ ID NO: 1743547 - RNA, 18 nt, Homo sapiens
caccuaacucaugccauu

SEQ ID NO: 1743548 - RNA, 13 nt, Homo sapiens
ucugugucuguca

SEQ ID NO: 1743549 - RNA, 23 nt, Homo sapiens
acuuggggauuaucugucauuca

SEQ ID NO: 1743550 - RNA, 19 nt, Homo sapiens
auauguaaauagugcagaa

SEQ ID NO: 1743551 - RNA, 21 nt, Homo sapiens
aaaaccgaggcccucaaucca

SEQ ID NO: 1743552 - RNA, 11 nt, Homo sapiens
uaucucaggga

SEQ ID NO: 1743553 - RNA, 18 nt, Homo sapiens
ugggugcgugguauacau

SEQ ID NO: 1743554 - RNA, 14 nt, Homo sapiens
ucuucuuacaugca

SEQ ID NO: 1743555 - RNA, 17 nt, Homo sapiens
cuuuuauugacacagaa

SEQ ID NO: 1743556 - RNA, 16 nt, Homo sapiens
auacaaugaccacaua

SEQ ID NO: 1743557 - RNA, 15 nt, Homo sapiens
acagaaggccuugaa

SEQ ID NO: 1743558 - RNA, 19 nt, Homo sapiens
uacaggcaacaaugagcag

SEQ ID NO: 1743559 - RNA, 22 nt, Homo sapiens
cagagccagugugccaccaggc

SEQ ID NO: 1743560 - RNA, 13 nt, Homo sapiens
gucuauguacaau

SEQ ID NO: 1743561 - RNA, 15 nt, Homo sapiens
auuggaugucaauag

SEQ ID NO: 1743562 - RNA, 21 nt, Homo sapiens
ggaaauaaaaaagucucuauu

SEQ ID NO: 1743563 - RNA, 13 nt, Homo sapiens
uaccagcuaugcc

SEQ ID NO: 1743564 - RNA, 20 nt, Homo sapiens
accuuuucccugcaccacuc

SEQ ID NO: 1743565 - RNA, 22 nt, Homo sapiens
agugagaucuucaaugcuuccu

SEQ ID NO: 1743566 - RNA, 18 nt, Homo sapiens
uggaagccucuauugcca

SEQ ID NO: 1743567 - RNA, 18 nt, Homo sapiens
gcuaaaucccaagugucu

SEQ ID NO: 1743568 - RNA, 20 nt, Homo sapiens
gucccuugaugcacagagaa

SEQ ID NO: 1743569 - RNA, 19 nt, Homo sapiens
uaucacuuaaacuugcauc

SEQ ID NO: 1743570 - RNA, 20 nt, Homo sapiens
acuugaaagugaacaaucag

SEQ ID NO: 1743571 - RNA, 20 nt, Homo sapiens
uuggucaugugggucuucca

SEQ ID NO: 1743572 - RNA, 17 nt, Homo sapiens
ugcacaagcacuaucac

SEQ ID NO: 1743573 - RNA, 23 nt, Homo sapiens
acauuuguuccugggacuggcag

SEQ ID NO: 1743574 - RNA, 12 nt, Homo sapiens
uccaaggcuuuu

SEQ ID NO: 1743575 - RNA, 23 nt, Homo sapiens
aguaacaaugcaugcuuuggaaa

SEQ ID NO: 1743576 - RNA, 16 nt, Homo sapiens
gguccuggcagggcgc

SEQ ID NO: 1743577 - RNA, 19 nt, Homo sapiens
uccacacagcguuugccac

SEQ ID NO: 1743578 - RNA, 23 nt, Homo sapiens
cagacaccauucauuccaugucc

SEQ ID NO: 1743579 - RNA, 23 nt, Homo sapiens
uguggcaguguuuaaaugcucuu

SEQ ID NO: 1743580 - RNA, 21 nt, Homo sapiens
gugccucagugcugcaauuga

SEQ ID NO: 1743581 - RNA, 16 nt, Homo sapiens
gcccaacuaacaguca

SEQ ID NO: 1743582 - RNA, 19 nt, Homo sapiens
gaguggccccucaccuggg

SEQ ID NO: 1743583 - RNA, 21 nt, Homo sapiens
aaauuauuuuaaaaacuaaaa

SEQ ID NO: 1743584 - RNA, 14 nt, Homo sapiens
aacugaagguguug

SEQ ID NO: 1743585 - RNA, 18 nt, Homo sapiens
ucaccuuuguagcacuca

SEQ ID NO: 1743586 - RNA, 22 nt, Homo sapiens
cagaaaaaaauaaauguucuaa

SEQ ID NO: 1743587 - RNA, 16 nt, Homo sapiens
gcucuaguauuuccac

SEQ ID NO: 1743588 - RNA, 13 nt, Homo sapiens
aaaaauauuauaa

SEQ ID NO: 1743589 - RNA, 16 nt, Homo sapiens
uguugaaaaauguugc

SEQ ID NO: 1743590 - RNA, 14 nt, Homo sapiens
cuguccaguuccca

SEQ ID NO: 1743591 - RNA, 15 nt, Homo sapiens
cauuuagcccucaca

SEQ ID NO: 1743592 - RNA, 20 nt, Homo sapiens
gaagcuaaugaacucuuuca

SEQ ID NO: 1743593 - RNA, 20 nt, Homo sapiens
ugugaugccugacacagggg

SEQ ID NO: 1743594 - RNA, 22 nt, Homo sapiens
agugucaaauaaacacugugua

SEQ ID NO: 1743595 - RNA, 20 nt, Homo sapiens
uccuaucccuggacgcaugc

SEQ ID NO: 1743596 - RNA, 17 nt, Homo sapiens
ccugugaacacuggagu

SEQ ID NO: 1743597 - RNA, 16 nt, Homo sapiens
ggugacauuguggacu

SEQ ID NO: 1743598 - RNA, 19 nt, Homo sapiens
ggcugcacuugauguuugu

SEQ ID NO: 1743599 - RNA, 16 nt, Homo sapiens
gaccgaaucucacucu

SEQ ID NO: 1743600 - RNA, 21 nt, Homo sapiens
agugccaagcacagugccugc

SEQ ID NO: 1743601 - RNA, 22 nt, Homo sapiens
ccugacacuaaccagagucagc

SEQ ID NO: 1743602 - RNA, 17 nt, Homo sapiens
acucaguaaaagcaaaa

SEQ ID NO: 1743603 - RNA, 23 nt, Homo sapiens
uauauaguaaugcacucucagua

SEQ ID NO: 1743604 - RNA, 20 nt, Homo sapiens
acagcauuugccaagucucc

SEQ ID NO: 1743605 - RNA, 14 nt, Homo sapiens
gaaugccagggaca

SEQ ID NO: 1743606 - RNA, 13 nt, Homo sapiens
ucauuccaccuuc

SEQ ID NO: 1743607 - RNA, 17 nt, Homo sapiens
cuccucugaagcauuug

SEQ ID NO: 1743608 - RNA, 15 nt, Homo sapiens
uguuucuauauguaa

SEQ ID NO: 1743609 - RNA, 19 nt, Homo sapiens
cucccaaagugcugggaug

SEQ ID NO: 1743610 - RNA, 16 nt, Homo sapiens
auuauuugcucagggg

SEQ ID NO: 1743611 - RNA, 22 nt, Homo sapiens
uaguuuaauuaacuaugugaug

SEQ ID NO: 1743612 - RNA, 16 nt, Homo sapiens
auucucuucacagugc

SEQ ID NO: 1743613 - RNA, 13 nt, Homo sapiens
ucaaaacuucaga

SEQ ID NO: 1743614 - RNA, 24 nt, Homo sapiens
augagaaucaccccucucagugca

SEQ ID NO: 1743615 - RNA, 19 nt, Homo sapiens
cagacccuggagagcucac

SEQ ID NO: 1743616 - RNA, 14 nt, Homo sapiens
cugacccauguuca

SEQ ID NO: 1743617 - RNA, 17 nt, Homo sapiens
ucaaaaggcacugugaa

SEQ ID NO: 1743618 - RNA, 14 nt, Homo sapiens
uuuucuaaucucuu

SEQ ID NO: 1743619 - RNA, 18 nt, Homo sapiens
gcccaugugcccacuguc

SEQ ID NO: 1743620 - RNA, 20 nt, Homo sapiens
cgggcacagugguggugccc

SEQ ID NO: 1743621 - RNA, 20 nt, Homo sapiens
aauuucccaaagcagugcau

SEQ ID NO: 1743622 - RNA, 14 nt, Homo sapiens
uuaucaucauuaga

SEQ ID NO: 1743623 - RNA, 14 nt, Homo sapiens
gguucagugccuuc

SEQ ID NO: 1743624 - RNA, 13 nt, Homo sapiens
gaccucaggugau

SEQ ID NO: 1743625 - RNA, 21 nt, Homo sapiens
uuaugaaaaauaagucacuua

SEQ ID NO: 1743626 - RNA, 19 nt, Homo sapiens
caugcacuuuauguggaga

SEQ ID NO: 1743627 - RNA, 20 nt, Homo sapiens
uacagggauuacugguguga

SEQ ID NO: 1743628 - RNA, 22 nt, Homo sapiens
gaaaauugggaauaugcacaaa

SEQ ID NO: 1743629 - RNA, 11 nt, Homo sapiens
acguaucccac

SEQ ID NO: 1743630 - RNA, 18 nt, Homo sapiens
gaauauaguucuguguag

SEQ ID NO: 1743631 - RNA, 16 nt, Homo sapiens
uuucuuuuuacagcau

SEQ ID NO: 1743632 - RNA, 17 nt, Homo sapiens
ucccuuccugaaggggg

SEQ ID NO: 1743633 - RNA, 20 nt, Homo sapiens
uacagccagcagcacaguca

SEQ ID NO: 1743634 - RNA, 19 nt, Homo sapiens
cugggaaggggaacacaga

SEQ ID NO: 1743635 - RNA, 18 nt, Homo sapiens
aaauaaagcacauuccaa

SEQ ID NO: 1743636 - RNA, 12 nt, Homo sapiens
aguauuucccag

SEQ ID NO: 1743637 - RNA, 17 nt, Homo sapiens
auccuacaagacacagu

SEQ ID NO: 1743638 - RNA, 18 nt, Homo sapiens
uagaaaaguauguucuaa

SEQ ID NO: 1743639 - RNA, 14 nt, Homo sapiens
aauauuuuccauaa

SEQ ID NO: 1743640 - RNA, 13 nt, Homo sapiens
caagcagaaaaac

SEQ ID NO: 1743641 - RNA, 12 nt, Homo sapiens
cuucagcuguac

SEQ ID NO: 1743642 - RNA, 19 nt, Homo sapiens
caagggcccuucucuacug

SEQ ID NO: 1743643 - RNA, 13 nt, Homo sapiens
gcacuggucacau

SEQ ID NO: 1743644 - RNA, 22 nt, Homo sapiens
gcauaaaagacaagcacuuugg

SEQ ID NO: 1743645 - RNA, 15 nt, Homo sapiens
ucaauaaucaaugaa

SEQ ID NO: 1743646 - RNA, 17 nt, Homo sapiens
uuagaauuaccauuugu

SEQ ID NO: 1743647 - RNA, 23 nt, Homo sapiens
uuuaugaugcuaugguuugccau

SEQ ID NO: 1743648 - RNA, 19 nt, Homo sapiens
accccacacacacuggccu

SEQ ID NO: 1743649 - RNA, 16 nt, Homo sapiens
accaggaaacugcuac

SEQ ID NO: 1743650 - RNA, 16 nt, Homo sapiens
ucaagaaaacaacuuc

SEQ ID NO: 1743651 - RNA, 14 nt, Homo sapiens
ugacacaugcucuc

SEQ ID NO: 1743652 - RNA, 19 nt, Homo sapiens
cauccaacuccuggagauu

SEQ ID NO: 1743653 - RNA, 19 nt, Homo sapiens
cuaucauggugaaaagcuc

SEQ ID NO: 1743654 - RNA, 18 nt, Homo sapiens
cucucagugaacugugag

SEQ ID NO: 1743655 - RNA, 15 nt, Homo sapiens
gaacaagaaagagua

SEQ ID NO: 1743656 - RNA, 15 nt, Homo sapiens
gaaagugaaagcaaa

SEQ ID NO: 1743657 - RNA, 14 nt, Homo sapiens
auuggcaugaaggu

SEQ ID NO: 1743658 - RNA, 17 nt, Homo sapiens
ugcagccuuugccuccc

SEQ ID NO: 1743659 - RNA, 19 nt, Homo sapiens
aauuuuuauaaauauguga

SEQ ID NO: 1743660 - RNA, 12 nt, Homo sapiens
ccacaccacagc

SEQ ID NO: 1743661 - RNA, 18 nt, Homo sapiens
uaacuucuuucacugaua

SEQ ID NO: 1743662 - RNA, 20 nt, Homo sapiens
aauuaucggaagcagugccu

SEQ ID NO: 1743663 - RNA, 16 nt, Homo sapiens
ggagucagggaccugc

SEQ ID NO: 1743664 - RNA, 24 nt, Homo sapiens
ugggggaggcggcacauuggcagu

SEQ ID NO: 1743665 - RNA, 20 nt, Homo sapiens
gacuuuuaaagacuugcaca

SEQ ID NO: 1743666 - RNA, 16 nt, Homo sapiens
caguggcacucugugu

SEQ ID NO: 1743667 - RNA, 21 nt, Homo sapiens
ccuagaagucuuaauuguguu

SEQ ID NO: 1743668 - RNA, 22 nt, Homo sapiens
caggaggaaaaggcuugguguc

SEQ ID NO: 1743669 - RNA, 15 nt, Homo sapiens
aaucaugcugagaga

SEQ ID NO: 1743670 - RNA, 23 nt, Homo sapiens
cagaaauauaugcagcugugaua

SEQ ID NO: 1743671 - RNA, 12 nt, Homo sapiens
aauacugaacca

SEQ ID NO: 1743672 - RNA, 19 nt, Homo sapiens
ucuaucggggucacuugca

SEQ ID NO: 1743673 - RNA, 18 nt, Homo sapiens
auuauuacuccuugccau

SEQ ID NO: 1743674 - RNA, 20 nt, Homo sapiens
cauugcgucggaaagccaag

SEQ ID NO: 1743675 - RNA, 15 nt, Homo sapiens
ucaauacagccugaa

SEQ ID NO: 1743676 - RNA, 19 nt, Homo sapiens
uaccuggcccugugccuug

SEQ ID NO: 1743677 - RNA, 16 nt, Homo sapiens
cccaccccuagccacc

SEQ ID NO: 1743678 - RNA, 14 nt, Homo sapiens
gaaggaaauaucau

SEQ ID NO: 1743679 - RNA, 14 nt, Homo sapiens
aggcccagcugaga

SEQ ID NO: 1743680 - RNA, 20 nt, Homo sapiens
caaugugcuuucuaaucucc

SEQ ID NO: 1743681 - RNA, 18 nt, Homo sapiens
aucucggcucagugcaac

SEQ ID NO: 1743682 - RNA, 19 nt, Homo sapiens
ugucuuuuuuuacuuaugc

SEQ ID NO: 1743683 - RNA, 13 nt, Homo sapiens
accacucggggcc

SEQ ID NO: 1743684 - RNA, 22 nt, Homo sapiens
uccugucuguuuccucuguaua

SEQ ID NO: 1743685 - RNA, 16 nt, Homo sapiens
ugaaauaucaugcucc

SEQ ID NO: 1743686 - RNA, 14 nt, Homo sapiens
aacaguuguauguu

SEQ ID NO: 1743687 - RNA, 20 nt, Homo sapiens
uuaucuugcaccccaaagcu

SEQ ID NO: 1743688 - RNA, 18 nt, Homo sapiens
aaauaucuggguggcuua

SEQ ID NO: 1743689 - RNA, 12 nt, Homo sapiens
uccaaucagaac

SEQ ID NO: 1743690 - RNA, 20 nt, Homo sapiens
caauggccuguguguuacaa

SEQ ID NO: 1743691 - RNA, 19 nt, Homo sapiens
ccuugugcuccugccagcu

SEQ ID NO: 1743692 - RNA, 16 nt, Homo sapiens
uaugucgaugcacagu

SEQ ID NO: 1743693 - RNA, 22 nt, Homo sapiens
uggauaaaaaagaaaacauucc

SEQ ID NO: 1743694 - RNA, 14 nt, Homo sapiens
cugaaguggcuaaa

SEQ ID NO: 1743695 - RNA, 19 nt, Homo sapiens
cuaaagggugcccacaaaa

SEQ ID NO: 1743696 - RNA, 15 nt, Homo sapiens
cuugaaguccagugu

SEQ ID NO: 1743697 - RNA, 23 nt, Homo sapiens
uaaaaggauguuacaaguuugcu

SEQ ID NO: 1743698 - RNA, 13 nt, Homo sapiens
uauucuacuaugc

SEQ ID NO: 1743699 - RNA, 14 nt, Homo sapiens
cacaacuaacaaug

SEQ ID NO: 1743700 - RNA, 19 nt, Homo sapiens
guagcagggggagugcugg

SEQ ID NO: 1743701 - RNA, 14 nt, Homo sapiens
cuacagaggccaug

SEQ ID NO: 1743702 - RNA, 14 nt, Homo sapiens
gggcaccugaccac

SEQ ID NO: 1743703 - RNA, 22 nt, Homo sapiens
cacauugacaaugacaaaaaga

SEQ ID NO: 1743704 - RNA, 12 nt, Homo sapiens
ugagaccaaacg

SEQ ID NO: 1743705 - RNA, 19 nt, Homo sapiens
aaucagaccacauuugaag

SEQ ID NO: 1743706 - RNA, 20 nt, Homo sapiens
acauugaugacuggcuucau

SEQ ID NO: 1743707 - RNA, 16 nt, Homo sapiens
gacaaccuccauucua

SEQ ID NO: 1743708 - RNA, 17 nt, Homo sapiens
ugcagcuaugcuggaaa

SEQ ID NO: 1743709 - RNA, 21 nt, Homo sapiens
cuaagaaacauuuauauugau

SEQ ID NO: 1743710 - RNA, 13 nt, Homo sapiens
uucugaaacacac

SEQ ID NO: 1743711 - RNA, 14 nt, Homo sapiens
acucaaacugagga

SEQ ID NO: 1743712 - RNA, 18 nt, Homo sapiens
ugucuguuaaaugaacuu

SEQ ID NO: 1743713 - RNA, 20 nt, Homo sapiens
agaucugcaacuacuaucca

SEQ ID NO: 1743714 - RNA, 22 nt, Homo sapiens
ucaggaggucaucugaccuuca

SEQ ID NO: 1743715 - RNA, 11 nt, Homo sapiens
augccacugac

SEQ ID NO: 1743716 - RNA, 20 nt, Homo sapiens
ucucaggaaaaucugugauu

SEQ ID NO: 1743717 - RNA, 20 nt, Homo sapiens
ccuggcaaaaaugcaacaaa

SEQ ID NO: 1743718 - RNA, 16 nt, Homo sapiens
cucccuugccacccaa

SEQ ID NO: 1743719 - RNA, 23 nt, Homo sapiens
acaaagugaaauuaguauuuuga

SEQ ID NO: 1743720 - RNA, 18 nt, Homo sapiens
cuaugaucagaagacuuu

SEQ ID NO: 1743721 - RNA, 16 nt, Homo sapiens
aguaaaagaaaccacu

SEQ ID NO: 1743722 - RNA, 14 nt, Homo sapiens
cgcugcauacaggg

SEQ ID NO: 1743723 - RNA, 12 nt, Homo sapiens
aaaccuuucuac

SEQ ID NO: 1743724 - RNA, 18 nt, Homo sapiens
ucuguuuuuuuaagaaag

SEQ ID NO: 1743725 - RNA, 16 nt, Homo sapiens
uguaguuuucagauac

SEQ ID NO: 1743726 - RNA, 17 nt, Homo sapiens
uauaccauggugaauua

SEQ ID NO: 1743727 - RNA, 17 nt, Homo sapiens
ccucccgaacacugaga

SEQ ID NO: 1743728 - RNA, 18 nt, Homo sapiens
gaucugguuuugcuauua

SEQ ID NO: 1743729 - RNA, 20 nt, Homo sapiens
agugggugccccccuugcca

SEQ ID NO: 1743730 - RNA, 14 nt, Homo sapiens
aagugacuugccca

SEQ ID NO: 1743731 - RNA, 13 nt, Homo sapiens
uuugugcauaaau

SEQ ID NO: 1743732 - RNA, 19 nt, Homo sapiens
ucuaagguccccagcagaa

SEQ ID NO: 1743733 - RNA, 20 nt, Homo sapiens
ugggaucugucacaccagcc

SEQ ID NO: 1743734 - RNA, 16 nt, Homo sapiens
gccuggccaccagcca

SEQ ID NO: 1743735 - RNA, 18 nt, Homo sapiens
ggugcaguugacagcagg

SEQ ID NO: 1743736 - RNA, 18 nt, Homo sapiens
uugaacggauaagaaucu

SEQ ID NO: 1743737 - RNA, 13 nt, Homo sapiens
ucucugcuugcau

SEQ ID NO: 1743738 - RNA, 18 nt, Homo sapiens
cuugcuagcuaugugacc

SEQ ID NO: 1743739 - RNA, 18 nt, Homo sapiens
gcaggaagcauucagaga

SEQ ID NO: 1743740 - RNA, 16 nt, Homo sapiens
cauuugaauaaugucu

SEQ ID NO: 1743741 - RNA, 15 nt, Homo sapiens
gggacaggucccuca

SEQ ID NO: 1743742 - RNA, 20 nt, Homo sapiens
caugcuuuucuguuacuguu

SEQ ID NO: 1743743 - RNA, 11 nt, Homo sapiens
agaucugcaac

SEQ ID NO: 1743744 - RNA, 23 nt, Homo sapiens
ccauuucugaggugcacugggag

SEQ ID NO: 1743745 - RNA, 21 nt, Homo sapiens
ugugaacccuugugccucuca

SEQ ID NO: 1743746 - RNA, 13 nt, Homo sapiens
aaacaauuuaaac

SEQ ID NO: 1743747 - RNA, 13 nt, Homo sapiens
augaaauuuugcc

SEQ ID NO: 1743748 - RNA, 12 nt, Homo sapiens
ccauguccuccg

SEQ ID NO: 1743749 - RNA, 19 nt, Homo sapiens
aucuucaaagcuugaagau

SEQ ID NO: 1743750 - RNA, 10 nt, Homo sapiens
ccaagacaga

SEQ ID NO: 1743751 - RNA, 14 nt, Homo sapiens
aguggcaaagagag

SEQ ID NO: 1743752 - RNA, 15 nt, Homo sapiens
gucaucccggggcca

SEQ ID NO: 1743753 - RNA, 15 nt, Homo sapiens
uucacgccuggguga

SEQ ID NO: 1743754 - RNA, 19 nt, Homo sapiens
aaguaauuccguagguuau

SEQ ID NO: 1743755 - RNA, 20 nt, Homo sapiens
ucacuuuuagaugugguuaa

SEQ ID NO: 1743756 - RNA, 18 nt, Homo sapiens
gucauuuugaaucaucau

SEQ ID NO: 1743757 - RNA, 16 nt, Homo sapiens
ggaacacugaaacugu

SEQ ID NO: 1743758 - RNA, 14 nt, Homo sapiens
cuuuguuaggauuu

SEQ ID NO: 1743759 - RNA, 20 nt, Homo sapiens
agcuggcccugcagguggug

SEQ ID NO: 1743760 - RNA, 23 nt, Homo sapiens
aucacucggcuguggagaacaaa

SEQ ID NO: 1743761 - RNA, 14 nt, Homo sapiens
agacauauuuacaa

SEQ ID NO: 1743762 - RNA, 21 nt, Homo sapiens
uuucugcugcuuggcacauuu

SEQ ID NO: 1743763 - RNA, 18 nt, Homo sapiens
ugaacauguggcuugaau

SEQ ID NO: 1743764 - RNA, 16 nt, Homo sapiens
cauuuuuuugcaguga

SEQ ID NO: 1743765 - RNA, 19 nt, Homo sapiens
auacucaaauggugucaug

SEQ ID NO: 1743766 - RNA, 23 nt, Homo sapiens
gagaagagggggcuaaauuugau

SEQ ID NO: 1743767 - RNA, 16 nt, Homo sapiens
cuuguuugcacugugu

SEQ ID NO: 1743768 - RNA, 19 nt, Homo sapiens
acauuacaaggucagagag

SEQ ID NO: 1743769 - RNA, 15 nt, Homo sapiens
ucagacuuugcugca

SEQ ID NO: 1743770 - RNA, 19 nt, Homo sapiens
augaagauaaggaugauac

SEQ ID NO: 1743771 - RNA, 14 nt, Homo sapiens
agacaaagacucac

SEQ ID NO: 1743772 - RNA, 17 nt, Homo sapiens
uguuauuaacagauaau

SEQ ID NO: 1743773 - RNA, 13 nt, Homo sapiens
uaaauacaaaagg

SEQ ID NO: 1743774 - RNA, 19 nt, Homo sapiens
ccugcuccaguguaucuca

SEQ ID NO: 1743775 - RNA, 22 nt, Homo sapiens
gucagauuugcuguucacccac

SEQ ID NO: 1743776 - RNA, 21 nt, Homo sapiens
aauuaaagccuuaagcacaau

SEQ ID NO: 1743777 - RNA, 18 nt, Homo sapiens
aaagacaggcugagcuuu

SEQ ID NO: 1743778 - RNA, 23 nt, Homo sapiens
cuuauccaacucucgacuuuucc

SEQ ID NO: 1743779 - RNA, 16 nt, Homo sapiens
gcgagagaaagggagu

SEQ ID NO: 1743780 - RNA, 18 nt, Homo sapiens
ucacuacugaacacaugu

SEQ ID NO: 1743781 - RNA, 19 nt, Homo sapiens
uauauauuggccaaacugg

SEQ ID NO: 1743782 - RNA, 15 nt, Homo sapiens
caauggugcaaaaaa

SEQ ID NO: 1743783 - RNA, 18 nt, Homo sapiens
cuuauauuauuccaaagu

SEQ ID NO: 1743784 - RNA, 17 nt, Homo sapiens
auuuugaaaacacuuau

SEQ ID NO: 1743785 - RNA, 15 nt, Homo sapiens
gaacccuacacccca

SEQ ID NO: 1743786 - RNA, 19 nt, Homo sapiens
gacugaaggggcacaccac

SEQ ID NO: 1743787 - RNA, 23 nt, Homo sapiens
ugggggugccgcucucucugagg

SEQ ID NO: 1743788 - RNA, 16 nt, Homo sapiens
ccacaucuaaugucuc

SEQ ID NO: 1743789 - RNA, 17 nt, Homo sapiens
gaauaaaagaugauuuc

SEQ ID NO: 1743790 - RNA, 21 nt, Homo sapiens
aagaaaacacuguuaucauuu

SEQ ID NO: 1743791 - RNA, 14 nt, Homo sapiens
aauauccaccacuu

SEQ ID NO: 1743792 - RNA, 19 nt, Homo sapiens
cucuuaaaucauuugguua

SEQ ID NO: 1743793 - RNA, 20 nt, Homo sapiens
caugggggacccugugcauc

SEQ ID NO: 1743794 - RNA, 18 nt, Homo sapiens
ugacuccccagcccagca

SEQ ID NO: 1743795 - RNA, 15 nt, Homo sapiens
ccaccacucuugacu

SEQ ID NO: 1743796 - RNA, 14 nt, Homo sapiens
acugguaguguuca

SEQ ID NO: 1743797 - RNA, 15 nt, Homo sapiens
acagggaggugaccc

SEQ ID NO: 1743798 - RNA, 15 nt, Homo sapiens
gagccuggcaggugc

SEQ ID NO: 1743799 - RNA, 11 nt, Homo sapiens
uauauguauuu

SEQ ID NO: 1743800 - RNA, 17 nt, Homo sapiens
ucauuaaaguucuagug

SEQ ID NO: 1743801 - RNA, 24 nt, Homo sapiens
ugcacauuagagggacagccaaaa

SEQ ID NO: 1743802 - RNA, 17 nt, Homo sapiens
agcuugacugcuuuuaa

SEQ ID NO: 1743803 - RNA, 20 nt, Homo sapiens
uccaugauuuuaaauuguga

SEQ ID NO: 1743804 - RNA, 17 nt, Homo sapiens
gacaccuguacauucuu

SEQ ID NO: 1743805 - RNA, 16 nt, Homo sapiens
cugcuucccuguugaa

SEQ ID NO: 1743806 - RNA, 16 nt, Homo sapiens
agcgucaagacauuug

SEQ ID NO: 1743807 - RNA, 13 nt, Homo sapiens
uuauuuccaugga

SEQ ID NO: 1743808 - RNA, 17 nt, Homo sapiens
caggaggccaauaaaaa

SEQ ID NO: 1743809 - RNA, 13 nt, Homo sapiens
guucacuaccugu

SEQ ID NO: 1743810 - RNA, 15 nt, Homo sapiens
aucaauaaauguugc

SEQ ID NO: 1743811 - RNA, 22 nt, Homo sapiens
uuggggaccacagaggcugugg

SEQ ID NO: 1743812 - RNA, 21 nt, Homo sapiens
auugccauggcccugagccac

SEQ ID NO: 1743813 - RNA, 18 nt, Homo sapiens
caacuguccacgcgugcc

SEQ ID NO: 1743814 - RNA, 12 nt, Homo sapiens
gccuaggguaca

SEQ ID NO: 1743815 - RNA, 16 nt, Homo sapiens
cagggcacagaaggcu

SEQ ID NO: 1743816 - RNA, 22 nt, Homo sapiens
ggcacucaauaaauauuuuugc

SEQ ID NO: 1743817 - RNA, 15 nt, Homo sapiens
ccuguuuucugcugu

SEQ ID NO: 1743818 - RNA, 14 nt, Homo sapiens
ucauaaccaaagag

SEQ ID NO: 1743819 - RNA, 19 nt, Homo sapiens
uguccuaccaguugcccua

SEQ ID NO: 1743820 - RNA, 22 nt, Homo sapiens
agccuucacuggagaccggaau

SEQ ID NO: 1743821 - RNA, 20 nt, Homo sapiens
uaacauuccagccacuggcu

SEQ ID NO: 1743822 - RNA, 23 nt, Homo sapiens
aaauucuuaaccuggaacuggag

SEQ ID NO: 1743823 - RNA, 23 nt, Homo sapiens
uucaauauaagaagcaaucuuug

SEQ ID NO: 1743824 - RNA, 16 nt, Homo sapiens
caaagcuuacaacauu

SEQ ID NO: 1743825 - RNA, 18 nt, Homo sapiens
agauccaauaggaucucg

SEQ ID NO: 1743826 - RNA, 18 nt, Homo sapiens
cuuagcccuguguccuga

SEQ ID NO: 1743827 - RNA, 12 nt, Homo sapiens
gccgccaccagc

SEQ ID NO: 1743828 - RNA, 15 nt, Homo sapiens
ggacuauacugcuga

SEQ ID NO: 1743829 - RNA, 19 nt, Homo sapiens
uggggaacaggucuugggg

SEQ ID NO: 1743830 - RNA, 22 nt, Homo sapiens
cacugaggccugagacccagga

SEQ ID NO: 1743831 - RNA, 14 nt, Homo sapiens
aaaugauacaguau

SEQ ID NO: 1743832 - RNA, 19 nt, Homo sapiens
uuugcaacucccuggguaa

SEQ ID NO: 1743833 - RNA, 22 nt, Homo sapiens
guguugcaacauaaugaaaaag

SEQ ID NO: 1743834 - RNA, 13 nt, Homo sapiens
aguuuaucuuuca

SEQ ID NO: 1743835 - RNA, 19 nt, Homo sapiens
acaaugcagcaaggcccug

SEQ ID NO: 1743836 - RNA, 20 nt, Homo sapiens
ugugaccaacuguguuguau

SEQ ID NO: 1743837 - RNA, 20 nt, Homo sapiens
caagggaggcccaugugacu

SEQ ID NO: 1743838 - RNA, 20 nt, Homo sapiens
aaauguguuagcacugauag

SEQ ID NO: 1743839 - RNA, 20 nt, Homo sapiens
guacucauaaaggacacugg

SEQ ID NO: 1743840 - RNA, 12 nt, Homo sapiens
auaacaaggaaa

SEQ ID NO: 1743841 - RNA, 16 nt, Homo sapiens
gcagggacaagcccug

SEQ ID NO: 1743842 - RNA, 21 nt, Homo sapiens
cuauguaauaauguacagagg

SEQ ID NO: 1743843 - RNA, 13 nt, Homo sapiens
caacgugugaacu

SEQ ID NO: 1743844 - RNA, 18 nt, Homo sapiens
uauuggaggaccaaaaaa

SEQ ID NO: 1743845 - RNA, 19 nt, Homo sapiens
accacgcaugcucagugcc

SEQ ID NO: 1743846 - RNA, 22 nt, Homo sapiens
cuaaaggcagcaaccauucauc

SEQ ID NO: 1743847 - RNA, 12 nt, Homo sapiens
ugacccucucac

SEQ ID NO: 1743848 - RNA, 22 nt, Homo sapiens
ccuauuuccugaacucagcuga

SEQ ID NO: 1743849 - RNA, 15 nt, Homo sapiens
uaaauucaugcugcu

SEQ ID NO: 1743850 - RNA, 18 nt, Homo sapiens
cauccugagugugaugaa

SEQ ID NO: 1743851 - RNA, 22 nt, Homo sapiens
gcuugaucaauucccuugaaua

SEQ ID NO: 1743852 - RNA, 14 nt, Homo sapiens
cagaccacauuuga

SEQ ID NO: 1743853 - RNA, 18 nt, Homo sapiens
cucacgcccagccuccuc

SEQ ID NO: 1743854 - RNA, 14 nt, Homo sapiens
uguuuuaccagcuc

SEQ ID NO: 1743855 - RNA, 14 nt, Homo sapiens
agcuugcaacaaaa

SEQ ID NO: 1743856 - RNA, 13 nt, Homo sapiens
ggccacccacuga

SEQ ID NO: 1743857 - RNA, 16 nt, Homo sapiens
cugcuccacguucucu

SEQ ID NO: 1743858 - RNA, 16 nt, Homo sapiens
gggcuccuguuucuca

SEQ ID NO: 1743859 - RNA, 22 nt, Homo sapiens
caaacugccuauauugauaaaa

SEQ ID NO: 1743860 - RNA, 10 nt, Homo sapiens
aggaugcugc

SEQ ID NO: 1743861 - RNA, 14 nt, Homo sapiens
uccucguuugagaa

SEQ ID NO: 1743862 - RNA, 19 nt, Homo sapiens
gaugaaaaugaaucuucac

SEQ ID NO: 1743863 - RNA, 12 nt, Homo sapiens
ugguuguagaag

SEQ ID NO: 1743864 - RNA, 12 nt, Homo sapiens
gagaagcuguag

SEQ ID NO: 1743865 - RNA, 22 nt, Homo sapiens
cugggcugauggaagauggucc

SEQ ID NO: 1743866 - RNA, 16 nt, Homo sapiens
aaugccucaaugugac

SEQ ID NO: 1743867 - RNA, 18 nt, Homo sapiens
agugaaaauaagccauga

SEQ ID NO: 1743868 - RNA, 15 nt, Homo sapiens
aaacccuuuucaucc

SEQ ID NO: 1743869 - RNA, 15 nt, Homo sapiens
auuaugauugcauaa

SEQ ID NO: 1743870 - RNA, 10 nt, Homo sapiens
uucggcucua

SEQ ID NO: 1743871 - RNA, 13 nt, Homo sapiens
uuugaauggugca

SEQ ID NO: 1743872 - RNA, 14 nt, Homo sapiens
cugucucaggguga

SEQ ID NO: 1743873 - RNA, 16 nt, Homo sapiens
acccuaucugugauuc

SEQ ID NO: 1743874 - RNA, 18 nt, Homo sapiens
ccugugucugcuguagaa

SEQ ID NO: 1743875 - RNA, 21 nt, Homo sapiens
caaagaacugccccaucuccu

SEQ ID NO: 1743876 - RNA, 22 nt, Homo sapiens
cuuuccagaacuaccaaaauga

SEQ ID NO: 1743877 - RNA, 21 nt, Homo sapiens
uugcagucuguauuuuccacc

SEQ ID NO: 1743878 - RNA, 13 nt, Homo sapiens
gacucuccaggga

SEQ ID NO: 1743879 - RNA, 19 nt, Homo sapiens
aaaucaaaagggccaaaga

SEQ ID NO: 1743880 - RNA, 19 nt, Homo sapiens
uuuguauguauuucugaug

SEQ ID NO: 1743881 - RNA, 13 nt, Homo sapiens
accuauguuugcu

SEQ ID NO: 1743882 - RNA, 14 nt, Homo sapiens
ucagugcaggagag

SEQ ID NO: 1743883 - RNA, 12 nt, Homo sapiens
uucacuacauua

SEQ ID NO: 1743884 - RNA, 17 nt, Homo sapiens
ugaaaaauaaaaaccau

SEQ ID NO: 1743885 - RNA, 14 nt, Homo sapiens
gcccugaccaugca

SEQ ID NO: 1743886 - RNA, 19 nt, Homo sapiens
gcuucucuugagucacacu

SEQ ID NO: 1743887 - RNA, 15 nt, Homo sapiens
gaguucgagaccaac

SEQ ID NO: 1743888 - RNA, 23 nt, Homo sapiens
accuagucagguuagcugaaccg

SEQ ID NO: 1743889 - RNA, 11 nt, Homo sapiens
auuucuuaggg

SEQ ID NO: 1743890 - RNA, 17 nt, Homo sapiens
cuggggauuaccauuca

SEQ ID NO: 1743891 - RNA, 20 nt, Homo sapiens
uuuagcagauuuaagauaug

SEQ ID NO: 1743892 - RNA, 17 nt, Homo sapiens
cauuuuuauguuauuac

SEQ ID NO: 1743893 - RNA, 12 nt, Homo sapiens
uguuagagccau

SEQ ID NO: 1743894 - RNA, 15 nt, Homo sapiens
caagaggucuccauc

SEQ ID NO: 1743895 - RNA, 16 nt, Homo sapiens
ggcagcugccucugcu

SEQ ID NO: 1743896 - RNA, 14 nt, Homo sapiens
gauucucaugccuc

SEQ ID NO: 1743897 - RNA, 15 nt, Homo sapiens
ggaaauaaagcgucc

SEQ ID NO: 1743898 - RNA, 14 nt, Homo sapiens
auguuacugaccag

SEQ ID NO: 1743899 - RNA, 14 nt, Homo sapiens
cagcaauuccaugc

SEQ ID NO: 1743900 - RNA, 15 nt, Homo sapiens
acccagcaucuccca

SEQ ID NO: 1743901 - RNA, 18 nt, Homo sapiens
aaauucauccucuuacca

SEQ ID NO: 1743902 - RNA, 13 nt, Homo sapiens
uggcuaugcaaca

SEQ ID NO: 1743903 - RNA, 15 nt, Homo sapiens
uaaagggacuaccuc

SEQ ID NO: 1743904 - RNA, 22 nt, Homo sapiens
acuggggaggaauccuggacca

SEQ ID NO: 1743905 - RNA, 23 nt, Homo sapiens
aucucuuguauaugaugaucugg

SEQ ID NO: 1743906 - RNA, 12 nt, Homo sapiens
aauuugcucaua

SEQ ID NO: 1743907 - RNA, 16 nt, Homo sapiens
aaaguuguuugcuuau

SEQ ID NO: 1743908 - RNA, 15 nt, Homo sapiens
aacacagaacaggaa

SEQ ID NO: 1743909 - RNA, 20 nt, Homo sapiens
ccacaccacaaccaccuuca

SEQ ID NO: 1743910 - RNA, 23 nt, Homo sapiens
aguggaguuuaaaaauugucucu

SEQ ID NO: 1743911 - RNA, 23 nt, Homo sapiens
agaugucuucaucacuucuucca

SEQ ID NO: 1743912 - RNA, 15 nt, Homo sapiens
augucauaaauguca

SEQ ID NO: 1743913 - RNA, 16 nt, Homo sapiens
cuugcugauggcuuga

SEQ ID NO: 1743914 - RNA, 16 nt, Homo sapiens
aauuuuagcgugcuca

SEQ ID NO: 1743915 - RNA, 15 nt, Homo sapiens
aauuugccaccacua

SEQ ID NO: 1743916 - RNA, 16 nt, Homo sapiens
gcagaauccucaguug

SEQ ID NO: 1743917 - RNA, 13 nt, Homo sapiens
uaacauugauuua

SEQ ID NO: 1743918 - RNA, 13 nt, Homo sapiens
uccugcuguaaau

SEQ ID NO: 1743919 - RNA, 12 nt, Homo sapiens
ugaaugcuucuc

SEQ ID NO: 1743920 - RNA, 21 nt, Homo sapiens
caguaaauguauauugaugua

SEQ ID NO: 1743921 - RNA, 13 nt, Homo sapiens
ucucugccuguga

SEQ ID NO: 1743922 - RNA, 19 nt, Homo sapiens
agcccaccccucaacaccu

SEQ ID NO: 1743923 - RNA, 16 nt, Homo sapiens
aaugcuggcauuugca

SEQ ID NO: 1743924 - RNA, 16 nt, Homo sapiens
ugcacagauugcugaa

SEQ ID NO: 1743925 - RNA, 15 nt, Homo sapiens
caggcuagagugcaa

SEQ ID NO: 1743926 - RNA, 15 nt, Homo sapiens
caggcuggagugcag

SEQ ID NO: 1743927 - RNA, 18 nt, Homo sapiens
acaaaaguuaaugaauau

SEQ ID NO: 1743928 - RNA, 13 nt, Homo sapiens
gaaaacuacaguu

SEQ ID NO: 1743929 - RNA, 20 nt, Homo sapiens
aagauuauagaaguagcaaa

SEQ ID NO: 1743930 - RNA, 15 nt, Homo sapiens
ccucuggacagccag

SEQ ID NO: 1743931 - RNA, 21 nt, Homo sapiens
cuuaauggacgaagcaacaaa

SEQ ID NO: 1743932 - RNA, 13 nt, Homo sapiens
ucgcugggcucaa

SEQ ID NO: 1743933 - RNA, 22 nt, Homo sapiens
cccuugagcugguuuucucuga

SEQ ID NO: 1743934 - RNA, 21 nt, Homo sapiens
uguugaagcucuuuacuguaa

SEQ ID NO: 1743935 - RNA, 15 nt, Homo sapiens
uauuccugaacuaua

SEQ ID NO: 1743936 - RNA, 16 nt, Homo sapiens
aaccguaaagugccuu

SEQ ID NO: 1743937 - RNA, 12 nt, Homo sapiens
agaucucccaca

SEQ ID NO: 1743938 - RNA, 15 nt, Homo sapiens
uggcucccaggggcu

SEQ ID NO: 1743939 - RNA, 19 nt, Homo sapiens
cucaucuccuuccugagga

SEQ ID NO: 1743940 - RNA, 17 nt, Homo sapiens
cauaucagugaaccuuu

SEQ ID NO: 1743941 - RNA, 17 nt, Homo sapiens
uuauauaauuguugaac

SEQ ID NO: 1743942 - RNA, 20 nt, Homo sapiens
cccaaauccuuagaucuggc

SEQ ID NO: 1743943 - RNA, 20 nt, Homo sapiens
aaguuaaaauaaaaccaagg

SEQ ID NO: 1743944 - RNA, 18 nt, Homo sapiens
gaaacccucuucuucccu

SEQ ID NO: 1743945 - RNA, 20 nt, Homo sapiens
caauaaccgcuugguuugca

SEQ ID NO: 1743946 - RNA, 18 nt, Homo sapiens
uaaguaaguuugauuuca

SEQ ID NO: 1743947 - RNA, 18 nt, Homo sapiens
ggcaagccuggccaucug

SEQ ID NO: 1743948 - RNA, 21 nt, Homo sapiens
uauuuaugaccuuauaguguu

SEQ ID NO: 1743949 - RNA, 21 nt, Homo sapiens
aucgccaaauaguuccauuuu

SEQ ID NO: 1743950 - RNA, 18 nt, Homo sapiens
acccugccacucuugaca

SEQ ID NO: 1743951 - RNA, 20 nt, Homo sapiens
uaaaaucuugucauguguau

SEQ ID NO: 1743952 - RNA, 13 nt, Homo sapiens
cagggaugccaac

SEQ ID NO: 1743953 - RNA, 14 nt, Homo sapiens
ggcugagcuagccu

SEQ ID NO: 1743954 - RNA, 14 nt, Homo sapiens
auuuaaaguauucu

SEQ ID NO: 1743955 - RNA, 14 nt, Homo sapiens
ccuggccuugucag

SEQ ID NO: 1743956 - RNA, 17 nt, Homo sapiens
gaggguggggugcccca

SEQ ID NO: 1743957 - RNA, 18 nt, Homo sapiens
ggcuggaagaaccacugu

SEQ ID NO: 1743958 - RNA, 20 nt, Homo sapiens
cacucccgccucagggccag

SEQ ID NO: 1743959 - RNA, 19 nt, Homo sapiens
cauccacaugcacauguau

SEQ ID NO: 1743960 - RNA, 22 nt, Homo sapiens
uuaaauaaaacuuaaaucucac

SEQ ID NO: 1743961 - RNA, 16 nt, Homo sapiens
cagugacgugacucag

SEQ ID NO: 1743962 - RNA, 15 nt, Homo sapiens
uaggaauuacuuuau

SEQ ID NO: 1743963 - RNA, 20 nt, Homo sapiens
ugaagcaucaaccuacuuag

SEQ ID NO: 1743964 - RNA, 12 nt, Homo sapiens
uaagacagugca

SEQ ID NO: 1743965 - RNA, 15 nt, Homo sapiens
aucagugaugggagu

SEQ ID NO: 1743966 - RNA, 16 nt, Homo sapiens
aaacagauuacuagaa

SEQ ID NO: 1743967 - RNA, 19 nt, Homo sapiens
aggcucaggucccuggggc

SEQ ID NO: 1743968 - RNA, 21 nt, Homo sapiens
uuaacagcugguauggccuua

SEQ ID NO: 1743969 - RNA, 16 nt, Homo sapiens
agacuccaagccaaga

SEQ ID NO: 1743970 - RNA, 15 nt, Homo sapiens
cagcagccucugucg

SEQ ID NO: 1743971 - RNA, 15 nt, Homo sapiens
caaguugagaacaaa

SEQ ID NO: 1743972 - RNA, 16 nt, Homo sapiens
agaugaagacaacagc

SEQ ID NO: 1743973 - RNA, 17 nt, Homo sapiens
cagacuuaaagcacuga

SEQ ID NO: 1743974 - RNA, 21 nt, Homo sapiens
augcagguggugggacacugg

SEQ ID NO: 1743975 - RNA, 15 nt, Homo sapiens
cucugcuccaaagua

SEQ ID NO: 1743976 - RNA, 18 nt, Homo sapiens
aagauaaaccaguugaau

SEQ ID NO: 1743977 - RNA, 15 nt, Homo sapiens
auuccacuuugucca

SEQ ID NO: 1743978 - RNA, 15 nt, Homo sapiens
aguucugaauguuaa

SEQ ID NO: 1743979 - RNA, 22 nt, Homo sapiens
gcucagccagcacuuguccagc

SEQ ID NO: 1743980 - RNA, 23 nt, Homo sapiens
ugacagaaagcagauaccucacc

SEQ ID NO: 1743981 - RNA, 20 nt, Homo sapiens
gcucaggcuggagugcagug

SEQ ID NO: 1743982 - RNA, 22 nt, Homo sapiens
aaucaggacagguggugcaaau

SEQ ID NO: 1743983 - RNA, 14 nt, Homo sapiens
ggccagaggugaac

SEQ ID NO: 1743984 - RNA, 18 nt, Homo sapiens
ugggcugcaaaaugaaga

SEQ ID NO: 1743985 - RNA, 22 nt, Homo sapiens
ugcucggucaggagggugcagu

SEQ ID NO: 1743986 - RNA, 15 nt, Homo sapiens
caccugaccaaucag

SEQ ID NO: 1743987 - RNA, 23 nt, Homo sapiens
ccaaauauaaagaggacuugaac

SEQ ID NO: 1743988 - RNA, 19 nt, Homo sapiens
auauguacaguuauacaua

SEQ ID NO: 1743989 - RNA, 15 nt, Homo sapiens
gaccucggugggcau

SEQ ID NO: 1743990 - RNA, 17 nt, Homo sapiens
uaugaaggaaucauucc

SEQ ID NO: 1743991 - RNA, 21 nt, Homo sapiens
gaauauuuauaaaugagcaaa

SEQ ID NO: 1743992 - RNA, 17 nt, Homo sapiens
uuaauugagaugaaauu

SEQ ID NO: 1743993 - RNA, 20 nt, Homo sapiens
ucaccuuuuugacuuuucca

SEQ ID NO: 1743994 - RNA, 13 nt, Homo sapiens
caaacuaaacccu

SEQ ID NO: 1743995 - RNA, 19 nt, Homo sapiens
uccaucuuacuugcccuuc

SEQ ID NO: 1743996 - RNA, 19 nt, Homo sapiens
ucccuuggucccauuagcu

SEQ ID NO: 1743997 - RNA, 20 nt, Homo sapiens
caauguauugagcaugugau

SEQ ID NO: 1743998 - RNA, 23 nt, Homo sapiens
caucacgcggccgagacauggcu

SEQ ID NO: 1743999 - RNA, 21 nt, Homo sapiens
aacaguaaaagccuuauucua

SEQ ID NO: 1744000 - RNA, 17 nt, Homo sapiens
ugacaccaccacugugu

SEQ ID NO: 1744001 - RNA, 14 nt, Homo sapiens
caaaacuuaggcau

SEQ ID NO: 1744002 - RNA, 14 nt, Homo sapiens
ucuccugucugccc

SEQ ID NO: 1744003 - RNA, 15 nt, Homo sapiens
cuuaaaaugcaauau

SEQ ID NO: 1744004 - RNA, 19 nt, Homo sapiens
gccucaguuacacaggaac

SEQ ID NO: 1744005 - RNA, 15 nt, Homo sapiens
gaguuaacugugaaa

SEQ ID NO: 1744006 - RNA, 20 nt, Homo sapiens
gaaagauggggcauauucau

SEQ ID NO: 1744007 - RNA, 18 nt, Homo sapiens
aaccucacgacuggucac

SEQ ID NO: 1744008 - RNA, 13 nt, Homo sapiens
guagaauugcugu

SEQ ID NO: 1744009 - RNA, 16 nt, Homo sapiens
aacagauuuaagcaag

SEQ ID NO: 1744010 - RNA, 14 nt, Homo sapiens
cuaagagaugugac

SEQ ID NO: 1744011 - RNA, 23 nt, Homo sapiens
aauucuccugacuguucuuccca

SEQ ID NO: 1744012 - RNA, 11 nt, Homo sapiens
acaaugcauuc

SEQ ID NO: 1744013 - RNA, 15 nt, Homo sapiens
uaaugguugggacca

SEQ ID NO: 1744014 - RNA, 15 nt, Homo sapiens
uauaaaauaggcuua

SEQ ID NO: 1744015 - RNA, 15 nt, Homo sapiens
ccagccgugagugca

SEQ ID NO: 1744016 - RNA, 15 nt, Homo sapiens
uaagguaauguaggg

SEQ ID NO: 1744017 - RNA, 17 nt, Homo sapiens
uccugccucagccucca

SEQ ID NO: 1744018 - RNA, 12 nt, Homo sapiens
agcucauguguc

SEQ ID NO: 1744019 - RNA, 18 nt, Homo sapiens
accacacagacaggguuu

SEQ ID NO: 1744020 - RNA, 15 nt, Homo sapiens
auuuuauaagcacag

SEQ ID NO: 1744021 - RNA, 10 nt, Homo sapiens
aaacauacag

SEQ ID NO: 1744022 - RNA, 18 nt, Homo sapiens
ugcuguacugagcacuga

SEQ ID NO: 1744023 - RNA, 15 nt, Homo sapiens
acagauuuacauccc

SEQ ID NO: 1744024 - RNA, 20 nt, Homo sapiens
guccagcaaauaaagcaguc

SEQ ID NO: 1744025 - RNA, 20 nt, Homo sapiens
ggacaugaagggaugcugca

SEQ ID NO: 1744026 - RNA, 20 nt, Homo sapiens
ucugugcugaggccuuauca

SEQ ID NO: 1744027 - RNA, 17 nt, Homo sapiens
auuccaacuugaaggau

SEQ ID NO: 1744028 - RNA, 20 nt, Homo sapiens
auucccggcuggacuuuugc

SEQ ID NO: 1744029 - RNA, 12 nt, Homo sapiens
gcaggagccagc

SEQ ID NO: 1744030 - RNA, 20 nt, Homo sapiens
aggacugaucgauuugcacc

SEQ ID NO: 1744031 - RNA, 19 nt, Homo sapiens
ccucgaacccacacugcaa

SEQ ID NO: 1744032 - RNA, 15 nt, Homo sapiens
uacuugcuucucuag

SEQ ID NO: 1744033 - RNA, 12 nt, Homo sapiens
ggacguccaggu

SEQ ID NO: 1744034 - RNA, 14 nt, Homo sapiens
uuguccguuuacuu

SEQ ID NO: 1744035 - RNA, 13 nt, Homo sapiens
auacaaaaauuag

SEQ ID NO: 1744036 - RNA, 18 nt, Homo sapiens
ggauuccagcauuugcca

SEQ ID NO: 1744037 - RNA, 15 nt, Homo sapiens
agcucuauguuuaca

SEQ ID NO: 1744038 - RNA, 13 nt, Homo sapiens
uaagaaacacuca

SEQ ID NO: 1744039 - RNA, 17 nt, Homo sapiens
ugggccauguccaaaga

SEQ ID NO: 1744040 - RNA, 13 nt, Homo sapiens
aaauggaugacaa

SEQ ID NO: 1744041 - RNA, 17 nt, Homo sapiens
ccaugauggcaacagau

SEQ ID NO: 1744042 - RNA, 21 nt, Homo sapiens
gaaauauaggauagacacugg

SEQ ID NO: 1744043 - RNA, 16 nt, Homo sapiens
guccucaggagcaaaa

SEQ ID NO: 1744044 - RNA, 14 nt, Homo sapiens
ucucagguccagcu

SEQ ID NO: 1744045 - RNA, 15 nt, Homo sapiens
cuuauuuaucaguaa

SEQ ID NO: 1744046 - RNA, 16 nt, Homo sapiens
ucugccccgcccucau

SEQ ID NO: 1744047 - RNA, 19 nt, Homo sapiens
ucccacuuccuccuaccug

SEQ ID NO: 1744048 - RNA, 23 nt, Homo sapiens
uuauauuuuucuuaaaaaguaac

SEQ ID NO: 1744049 - RNA, 19 nt, Homo sapiens
gcaaccucccaacccagag

SEQ ID NO: 1744050 - RNA, 13 nt, Homo sapiens
gaagaccaaagac

SEQ ID NO: 1744051 - RNA, 14 nt, Homo sapiens
aaagcuuugugcag

SEQ ID NO: 1744052 - RNA, 18 nt, Homo sapiens
gagacgggguuugccaug

SEQ ID NO: 1744053 - RNA, 22 nt, Homo sapiens
agaauuuaaaacgcaugugcag

SEQ ID NO: 1744054 - RNA, 16 nt, Homo sapiens
uaaggaugucacaggg

SEQ ID NO: 1744055 - RNA, 18 nt, Homo sapiens
uucuaauguaugcauuca

SEQ ID NO: 1744056 - RNA, 20 nt, Homo sapiens
ucugaaagggcacaguguca

SEQ ID NO: 1744057 - RNA, 19 nt, Homo sapiens
ccaggcugcccaucagggc

SEQ ID NO: 1744058 - RNA, 14 nt, Homo sapiens
acaccaaagcuauu

SEQ ID NO: 1744059 - RNA, 15 nt, Homo sapiens
augguagcaaaacaa

SEQ ID NO: 1744060 - RNA, 20 nt, Homo sapiens
uaauuggaauuguugaagcu

SEQ ID NO: 1744061 - RNA, 23 nt, Homo sapiens
cucaaauuauuuaaaaugcauaa

SEQ ID NO: 1744062 - RNA, 16 nt, Homo sapiens
auguucugggacacag

SEQ ID NO: 1744063 - RNA, 18 nt, Homo sapiens
aauuuauuaaaaugauug

SEQ ID NO: 1744064 - RNA, 16 nt, Homo sapiens
uagguugcacacuuug

SEQ ID NO: 1744065 - RNA, 18 nt, Homo sapiens
ucaagugauucuccugcc

SEQ ID NO: 1744066 - RNA, 20 nt, Homo sapiens
gauuccccaucaacaaacac

SEQ ID NO: 1744067 - RNA, 16 nt, Homo sapiens
agacuccaucucuucu

SEQ ID NO: 1744068 - RNA, 14 nt, Homo sapiens
cagucauggccaaa

SEQ ID NO: 1744069 - RNA, 22 nt, Homo sapiens
uccauauuguuccuuaucaccu

SEQ ID NO: 1744070 - RNA, 16 nt, Homo sapiens
uucagaggaagcacau

SEQ ID NO: 1744071 - RNA, 21 nt, Homo sapiens
ggguaguauuuuuuacauuuu

SEQ ID NO: 1744072 - RNA, 22 nt, Homo sapiens
cacuggaaauguuuguccuugc

SEQ ID NO: 1744073 - RNA, 16 nt, Homo sapiens
cuugaguuaucuuuaa

SEQ ID NO: 1744074 - RNA, 19 nt, Homo sapiens
gaugcaguagacugcagug

SEQ ID NO: 1744075 - RNA, 19 nt, Homo sapiens
auauguuucacccuguccc

SEQ ID NO: 1744076 - RNA, 17 nt, Homo sapiens
uaaauauuagaagccug

SEQ ID NO: 1744077 - RNA, 12 nt, Homo sapiens
ugcauugacuua

SEQ ID NO: 1744078 - RNA, 20 nt, Homo sapiens
ugcccugggauguccacaga

SEQ ID NO: 1744079 - RNA, 16 nt, Homo sapiens
acuucaaacugagauc

SEQ ID NO: 1744080 - RNA, 16 nt, Homo sapiens
caauauauugaacuuu

SEQ ID NO: 1744081 - RNA, 18 nt, Homo sapiens
gaaaacaaauauuucacu

SEQ ID NO: 1744082 - RNA, 16 nt, Homo sapiens
ccggcgccccugccac

SEQ ID NO: 1744083 - RNA, 18 nt, Homo sapiens
cauaagugcaugacauau

SEQ ID NO: 1744084 - RNA, 20 nt, Homo sapiens
caccugggcuccugcauccu

SEQ ID NO: 1744085 - RNA, 18 nt, Homo sapiens
ugacauuaagacacaccu

SEQ ID NO: 1744086 - RNA, 21 nt, Homo sapiens
caauauugauuaagccuccuc

SEQ ID NO: 1744087 - RNA, 17 nt, Homo sapiens
acaugcuaccacuggua

SEQ ID NO: 1744088 - RNA, 20 nt, Homo sapiens
gauguccccaaaguaccaca

SEQ ID NO: 1744089 - RNA, 21 nt, Homo sapiens
caagcuauguggcugcugcug

SEQ ID NO: 1744090 - RNA, 20 nt, Homo sapiens
ucuuuaagagacucacuggu

SEQ ID NO: 1744091 - RNA, 16 nt, Homo sapiens
aaauguuuauagcauu

SEQ ID NO: 1744092 - RNA, 17 nt, Homo sapiens
gaaagcgacuucagguc

SEQ ID NO: 1744093 - RNA, 20 nt, Homo sapiens
aaauacuugaaaacuucuca

SEQ ID NO: 1744094 - RNA, 13 nt, Homo sapiens
uauaguauacucu

SEQ ID NO: 1744095 - RNA, 20 nt, Homo sapiens
uggaaugcccuucacuguca

SEQ ID NO: 1744096 - RNA, 21 nt, Homo sapiens
agguugggaaggcaccugcuc

SEQ ID NO: 1744097 - RNA, 15 nt, Homo sapiens
gccgucacgcuuuca

SEQ ID NO: 1744098 - RNA, 13 nt, Homo sapiens
acagcuaggaaau

SEQ ID NO: 1744099 - RNA, 22 nt, Homo sapiens
agccucuuuguuccagaagcug

SEQ ID NO: 1744100 - RNA, 23 nt, Homo sapiens
uugaaaauaauucuuugagacag

SEQ ID NO: 1744101 - RNA, 20 nt, Homo sapiens
accaccagugagacaagcug

SEQ ID NO: 1744102 - RNA, 21 nt, Homo sapiens
acaguaucaguauuuucacac

SEQ ID NO: 1744103 - RNA, 21 nt, Homo sapiens
accaggcagccucuggggggu

SEQ ID NO: 1744104 - RNA, 17 nt, Homo sapiens
ugagaagauggcacugu

SEQ ID NO: 1744105 - RNA, 20 nt, Homo sapiens
gcacugugacaccagaauaa

SEQ ID NO: 1744106 - RNA, 19 nt, Homo sapiens
aaacaagcagguguuuaua

SEQ ID NO: 1744107 - RNA, 22 nt, Homo sapiens
ccugggacaguuuaucaugaag

SEQ ID NO: 1744108 - RNA, 20 nt, Homo sapiens
aaacagcagcugaagccagc

SEQ ID NO: 1744109 - RNA, 19 nt, Homo sapiens
ugccuguuuuucaaucuca

SEQ ID NO: 1744110 - RNA, 17 nt, Homo sapiens
cacagccugucuuguca

SEQ ID NO: 1744111 - RNA, 20 nt, Homo sapiens
acuugaauaaaguacuacau

SEQ ID NO: 1744112 - RNA, 16 nt, Homo sapiens
accucagcugcacauu

SEQ ID NO: 1744113 - RNA, 13 nt, Homo sapiens
uucuaaaaugugu

SEQ ID NO: 1744114 - RNA, 14 nt, Homo sapiens
cgguccagaaggag

SEQ ID NO: 1744115 - RNA, 22 nt, Homo sapiens
cccccuuuccaucuguuugaua

SEQ ID NO: 1744116 - RNA, 11 nt, Homo sapiens
augaaccaugc

SEQ ID NO: 1744117 - RNA, 20 nt, Homo sapiens
gccaggucccuuucauuugc

SEQ ID NO: 1744118 - RNA, 20 nt, Homo sapiens
ugggccuugcugcugcugca

SEQ ID NO: 1744119 - RNA, 16 nt, Homo sapiens
ccuggacagcugugcc

SEQ ID NO: 1744120 - RNA, 22 nt, Homo sapiens
agugugaaccgaggggcucagg

SEQ ID NO: 1744121 - RNA, 11 nt, Homo sapiens
uuuacacuuua

SEQ ID NO: 1744122 - RNA, 22 nt, Homo sapiens
uucuaggggcuuccugccuuau

SEQ ID NO: 1744123 - RNA, 13 nt, Homo sapiens
aacugacaugccc

SEQ ID NO: 1744124 - RNA, 18 nt, Homo sapiens
uugauaguuuacaaacaa

SEQ ID NO: 1744125 - RNA, 19 nt, Homo sapiens
uaauuuuuauuuuuggcaa

SEQ ID NO: 1744126 - RNA, 14 nt, Homo sapiens
uugagcuucugggg

SEQ ID NO: 1744127 - RNA, 14 nt, Homo sapiens
cugcuaaauaucac

SEQ ID NO: 1744128 - RNA, 20 nt, Homo sapiens
uucugacugcaacuucuguc

SEQ ID NO: 1744129 - RNA, 23 nt, Homo sapiens
cuccgguuugggcugucuuacca

SEQ ID NO: 1744130 - RNA, 23 nt, Homo sapiens
ucccaugggcugaguggggagca

SEQ ID NO: 1744131 - RNA, 20 nt, Homo sapiens
ccccaacaaaccauccagug

SEQ ID NO: 1744132 - RNA, 18 nt, Homo sapiens
cacacagggaggcuguag

SEQ ID NO: 1744133 - RNA, 18 nt, Homo sapiens
agggugugggucagggag

SEQ ID NO: 1744134 - RNA, 19 nt, Homo sapiens
uaaaaauguuacgugaaga

SEQ ID NO: 1744135 - RNA, 15 nt, Homo sapiens
aucauguaugcaucc

SEQ ID NO: 1744136 - RNA, 23 nt, Homo sapiens
caguuuucaggaugauacacuau

SEQ ID NO: 1744137 - RNA, 18 nt, Homo sapiens
cucuaacaguaguugcaa

SEQ ID NO: 1744138 - RNA, 14 nt, Homo sapiens
accugggcugugau

SEQ ID NO: 1744139 - RNA, 22 nt, Homo sapiens
uggauaaaauuggguuuuaaca

SEQ ID NO: 1744140 - RNA, 17 nt, Homo sapiens
cuagagaaaagucuacc

SEQ ID NO: 1744141 - RNA, 13 nt, Homo sapiens
acauauccaaaau

SEQ ID NO: 1744142 - RNA, 15 nt, Homo sapiens
ugcaccaggcacugc

SEQ ID NO: 1744143 - RNA, 15 nt, Homo sapiens
gaucucggcucagug

SEQ ID NO: 1744144 - RNA, 21 nt, Homo sapiens
cagcaguugaaaagacuccaa

SEQ ID NO: 1744145 - RNA, 20 nt, Homo sapiens
cugccuuguuuaauguuaau

SEQ ID NO: 1744146 - RNA, 14 nt, Homo sapiens
auuuagcucugaag

SEQ ID NO: 1744147 - RNA, 14 nt, Homo sapiens
accugacaaaugga

SEQ ID NO: 1744148 - RNA, 19 nt, Homo sapiens
aaaggcagcugccucugcu

SEQ ID NO: 1744149 - RNA, 18 nt, Homo sapiens
aaggggugugacuugaua

SEQ ID NO: 1744150 - RNA, 22 nt, Homo sapiens
auaugauuguauaaugugauuu

SEQ ID NO: 1744151 - RNA, 21 nt, Homo sapiens
gaugcacacacagauauacac

SEQ ID NO: 1744152 - RNA, 17 nt, Homo sapiens
agccucacagaugcugg

SEQ ID NO: 1744153 - RNA, 17 nt, Homo sapiens
aucaccauguauuuugu

SEQ ID NO: 1744154 - RNA, 19 nt, Homo sapiens
cuucgaccuacugaaaagg

SEQ ID NO: 1744155 - RNA, 19 nt, Homo sapiens
uacuuccuacagagccaaa

SEQ ID NO: 1744156 - RNA, 19 nt, Homo sapiens
aauucuaguauuuuaucug

SEQ ID NO: 1744157 - RNA, 17 nt, Homo sapiens
auaggauuaaugaucau

SEQ ID NO: 1744158 - RNA, 23 nt, Homo sapiens
accaauuuagaaugaauauuaaa

SEQ ID NO: 1744159 - RNA, 21 nt, Homo sapiens
aaugaugauggggugggagac

SEQ ID NO: 1744160 - RNA, 19 nt, Homo sapiens
aauucugauggauucaauu

SEQ ID NO: 1744161 - RNA, 14 nt, Homo sapiens
acauucugccuugg

SEQ ID NO: 1744162 - RNA, 14 nt, Homo sapiens
uguauacacauaau

SEQ ID NO: 1744163 - RNA, 14 nt, Homo sapiens
caaaaucaugaaua

SEQ ID NO: 1744164 - RNA, 16 nt, Homo sapiens
ugacaaucaacucuaa

SEQ ID NO: 1744165 - RNA, 16 nt, Homo sapiens
aucuugaucuguguuu

SEQ ID NO: 1744166 - RNA, 15 nt, Homo sapiens
aggacugacuuugcc

SEQ ID NO: 1744167 - RNA, 18 nt, Homo sapiens
uguaaaaagaaaaaccac

SEQ ID NO: 1744168 - RNA, 21 nt, Homo sapiens
cucucuaccagauaacugagg

SEQ ID NO: 1744169 - RNA, 18 nt, Homo sapiens
uggaguggagcauuggcu

SEQ ID NO: 1744170 - RNA, 15 nt, Homo sapiens
uauaauccuugucag

SEQ ID NO: 1744171 - RNA, 20 nt, Homo sapiens
aauuuaucacugcgcauguu

SEQ ID NO: 1744172 - RNA, 23 nt, Homo sapiens
cucugaccuacucgagggacuua

SEQ ID NO: 1744173 - RNA, 20 nt, Homo sapiens
agcucuggggggcaaccugg

SEQ ID NO: 1744174 - RNA, 15 nt, Homo sapiens
uaagggcuacuuaau

SEQ ID NO: 1744175 - RNA, 19 nt, Homo sapiens
ucaccuuggcaccagacac

SEQ ID NO: 1744176 - RNA, 19 nt, Homo sapiens
agcuggaguacgugaaaug

SEQ ID NO: 1744177 - RNA, 17 nt, Homo sapiens
ccgcaaaccacacugga

SEQ ID NO: 1744178 - RNA, 16 nt, Homo sapiens
ggaucagcagggcagu

SEQ ID NO: 1744179 - RNA, 19 nt, Homo sapiens
auguccauuauucaagaaa

SEQ ID NO: 1744180 - RNA, 21 nt, Homo sapiens
guacauggaauaacauguaau

SEQ ID NO: 1744181 - RNA, 19 nt, Homo sapiens
cacuuaucaguuugcuaau

SEQ ID NO: 1744182 - RNA, 21 nt, Homo sapiens
agugacuguucaagagcacac

SEQ ID NO: 1744183 - RNA, 15 nt, Homo sapiens
guuguacaugaaauu

SEQ ID NO: 1744184 - RNA, 23 nt, Homo sapiens
aaaguuguucgccgcguggaaug

SEQ ID NO: 1744185 - RNA, 16 nt, Homo sapiens
uauucucaguguaggg

SEQ ID NO: 1744186 - RNA, 21 nt, Homo sapiens
acagugcuguugaagauuuga

SEQ ID NO: 1744187 - RNA, 18 nt, Homo sapiens
aggcauuuggucucacua

SEQ ID NO: 1744188 - RNA, 18 nt, Homo sapiens
ccccaucauccacgccaa

SEQ ID NO: 1744189 - RNA, 10 nt, Homo sapiens
uucaaugagg

SEQ ID NO: 1744190 - RNA, 16 nt, Homo sapiens
uggcuguguugcccug

SEQ ID NO: 1744191 - RNA, 16 nt, Homo sapiens
acaacaauccuucuau

SEQ ID NO: 1744192 - RNA, 15 nt, Homo sapiens
uccagaguaugcaac

SEQ ID NO: 1744193 - RNA, 15 nt, Homo sapiens
aaguauucucaaaga

SEQ ID NO: 1744194 - RNA, 23 nt, Homo sapiens
agaaccaaaaagaggcuauguga

SEQ ID NO: 1744195 - RNA, 16 nt, Homo sapiens
cagauaucugcaugug

SEQ ID NO: 1744196 - RNA, 21 nt, Homo sapiens
caacuucuacuucugcccuug

SEQ ID NO: 1744197 - RNA, 14 nt, Homo sapiens
cauauuguucuuca

SEQ ID NO: 1744198 - RNA, 15 nt, Homo sapiens
acagaagacagcagc

SEQ ID NO: 1744199 - RNA, 20 nt, Homo sapiens
gacuaugauuuaccuauaca

SEQ ID NO: 1744200 - RNA, 13 nt, Homo sapiens
acugccaucuuag

SEQ ID NO: 1744201 - RNA, 13 nt, Homo sapiens
aacaugccagaag

SEQ ID NO: 1744202 - RNA, 14 nt, Homo sapiens
cacguuugccaaau

SEQ ID NO: 1744203 - RNA, 21 nt, Homo sapiens
uaauuuccaaaggcguaugua

SEQ ID NO: 1744204 - RNA, 16 nt, Homo sapiens
caugugaaguguauau

SEQ ID NO: 1744205 - RNA, 20 nt, Homo sapiens
accugguugauguguauuca

SEQ ID NO: 1744206 - RNA, 20 nt, Homo sapiens
ccaaggagaggucuugcuca

SEQ ID NO: 1744207 - RNA, 16 nt, Homo sapiens
gcuucuguugaucuca

SEQ ID NO: 1744208 - RNA, 19 nt, Homo sapiens
cuacucauuugcugacaca

SEQ ID NO: 1744209 - RNA, 13 nt, Homo sapiens
aguggccacucag

SEQ ID NO: 1744210 - RNA, 20 nt, Homo sapiens
gagaugucauggugcucauu

SEQ ID NO: 1744211 - RNA, 20 nt, Homo sapiens
gaauuuuugcuaugcuguaa

SEQ ID NO: 1744212 - RNA, 19 nt, Homo sapiens
uguccuaaggcccauuuga

SEQ ID NO: 1744213 - RNA, 12 nt, Homo sapiens
ucugccaggcac

SEQ ID NO: 1744214 - RNA, 13 nt, Homo sapiens
ucccgggcacugu

SEQ ID NO: 1744215 - RNA, 16 nt, Homo sapiens
gcuccuaguagcuuuc

SEQ ID NO: 1744216 - RNA, 12 nt, Homo sapiens
gccuuacuguac

SEQ ID NO: 1744217 - RNA, 15 nt, Homo sapiens
aacucugcacuacuc

SEQ ID NO: 1744218 - RNA, 16 nt, Homo sapiens
ggacuugaaugcugcc

SEQ ID NO: 1744219 - RNA, 11 nt, Homo sapiens
ggcucuuccaa

SEQ ID NO: 1744220 - RNA, 17 nt, Homo sapiens
uagcauuugucaacaaa

SEQ ID NO: 1744221 - RNA, 20 nt, Homo sapiens
uacuaaggugacuuucugaa

SEQ ID NO: 1744222 - RNA, 21 nt, Homo sapiens
ggucucauuuagaacuugcag

SEQ ID NO: 1744223 - RNA, 20 nt, Homo sapiens
aggcuggagugcaauggcac

SEQ ID NO: 1744224 - RNA, 17 nt, Homo sapiens
cuguuuuccuuaccuau

SEQ ID NO: 1744225 - RNA, 14 nt, Homo sapiens
aucuaugcugagua

SEQ ID NO: 1744226 - RNA, 15 nt, Homo sapiens
gagacuccaucucaa

SEQ ID NO: 1744227 - RNA, 10 nt, Homo sapiens
auauacauga

SEQ ID NO: 1744228 - RNA, 21 nt, Homo sapiens
acagccucagcggacaagcag

SEQ ID NO: 1744229 - RNA, 14 nt, Homo sapiens
ccucgcugccagcu

SEQ ID NO: 1744230 - RNA, 21 nt, Homo sapiens
aaaggcagcugugucugagcc

SEQ ID NO: 1744231 - RNA, 23 nt, Homo sapiens
uuaauauaguugguacacaacua

SEQ ID NO: 1744232 - RNA, 15 nt, Homo sapiens
auuuggcauuccuga

SEQ ID NO: 1744233 - RNA, 13 nt, Homo sapiens
gcuucacauucau

SEQ ID NO: 1744234 - RNA, 21 nt, Homo sapiens
ucugggagacuuugaagacca

SEQ ID NO: 1744235 - RNA, 15 nt, Homo sapiens
ucauuuuucuccuca

SEQ ID NO: 1744236 - RNA, 20 nt, Homo sapiens
aauacuucauucucucucau

SEQ ID NO: 1744237 - RNA, 16 nt, Homo sapiens
uuagcauguuguugaa

SEQ ID NO: 1744238 - RNA, 19 nt, Homo sapiens
ucauucucucucauuauug

SEQ ID NO: 1744239 - RNA, 18 nt, Homo sapiens
aaggaaccauaugugcua

SEQ ID NO: 1744240 - RNA, 17 nt, Homo sapiens
ugagccaaggacagggc

SEQ ID NO: 1744241 - RNA, 13 nt, Homo sapiens
agauuuucuugca

SEQ ID NO: 1744242 - RNA, 19 nt, Homo sapiens
guuguggagagugcaacag

SEQ ID NO: 1744243 - RNA, 21 nt, Homo sapiens
ccucacuguuccccaaaacau

SEQ ID NO: 1744244 - RNA, 13 nt, Homo sapiens
uaucucagcauuu

SEQ ID NO: 1744245 - RNA, 14 nt, Homo sapiens
agggaccagguguc

SEQ ID NO: 1744246 - RNA, 21 nt, Homo sapiens
uuugaugagauauuaaauucu

SEQ ID NO: 1744247 - RNA, 21 nt, Homo sapiens
cugggaucgggguggggacag

SEQ ID NO: 1744248 - RNA, 14 nt, Homo sapiens
aacugggccucuga

SEQ ID NO: 1744249 - RNA, 22 nt, Homo sapiens
cugcuaaaauagaauauagcau

SEQ ID NO: 1744250 - RNA, 17 nt, Homo sapiens
gccuggggucugacaau

SEQ ID NO: 1744251 - RNA, 23 nt, Homo sapiens
uguggcuuuugcaauucacgccc

SEQ ID NO: 1744252 - RNA, 12 nt, Homo sapiens
ugaggacucugg

SEQ ID NO: 1744253 - RNA, 12 nt, Homo sapiens
cugagacuugaa

SEQ ID NO: 1744254 - RNA, 22 nt, Homo sapiens
uuaauacaccgauaaccacagg

SEQ ID NO: 1744255 - RNA, 20 nt, Homo sapiens
acuccaaaacuucguuuaau

SEQ ID NO: 1744256 - RNA, 18 nt, Homo sapiens
ugcuguguaugugaacca

SEQ ID NO: 1744257 - RNA, 22 nt, Homo sapiens
cagaaaauaugauauauaugua

SEQ ID NO: 1744258 - RNA, 17 nt, Homo sapiens
auugcuucugugcaaua

SEQ ID NO: 1744259 - RNA, 22 nt, Homo sapiens
cugauaccuucuggcugugcua

SEQ ID NO: 1744260 - RNA, 14 nt, Homo sapiens
caccugguaugugc

SEQ ID NO: 1744261 - RNA, 16 nt, Homo sapiens
aagacuugagaaauuu

SEQ ID NO: 1744262 - RNA, 23 nt, Homo sapiens
ggugacagagcagugcuggaaua

SEQ ID NO: 1744263 - RNA, 17 nt, Homo sapiens
uguucuaaugcugcaca

SEQ ID NO: 1744264 - RNA, 23 nt, Homo sapiens
ggaugacuuggggacaccccaga

SEQ ID NO: 1744265 - RNA, 16 nt, Homo sapiens
aaguauuauuuuacaa

SEQ ID NO: 1744266 - RNA, 14 nt, Homo sapiens
acccacagcugcag

SEQ ID NO: 1744267 - RNA, 20 nt, Homo sapiens
cuugucauggaaaauguccu

SEQ ID NO: 1744268 - RNA, 11 nt, Homo sapiens
cucucuagcac

SEQ ID NO: 1744269 - RNA, 22 nt, Homo sapiens
cucaguucguguuugauuccau

SEQ ID NO: 1744270 - RNA, 14 nt, Homo sapiens
gcccuggauccauc

SEQ ID NO: 1744271 - RNA, 17 nt, Homo sapiens
agauagaccugacaauu

SEQ ID NO: 1744272 - RNA, 15 nt, Homo sapiens
gugugcagacagcua

SEQ ID NO: 1744273 - RNA, 20 nt, Homo sapiens
guucuggaacauucugucau

SEQ ID NO: 1744274 - RNA, 16 nt, Homo sapiens
uggacaggcucugcuu

SEQ ID NO: 1744275 - RNA, 22 nt, Homo sapiens
ccagggauuaggagcagcucuu

SEQ ID NO: 1744276 - RNA, 13 nt, Homo sapiens
ggaaaaaugucac

SEQ ID NO: 1744277 - RNA, 17 nt, Homo sapiens
caggcccacagcccagc

SEQ ID NO: 1744278 - RNA, 17 nt, Homo sapiens
ucuugcaacucuguaaa

SEQ ID NO: 1744279 - RNA, 15 nt, Homo sapiens
uacugcugucuucca

SEQ ID NO: 1744280 - RNA, 15 nt, Homo sapiens
gaucauucucaguga

SEQ ID NO: 1744281 - RNA, 18 nt, Homo sapiens
uccccucucagcauuucc

SEQ ID NO: 1744282 - RNA, 15 nt, Homo sapiens
uucuacaguguccua

SEQ ID NO: 1744283 - RNA, 18 nt, Homo sapiens
agaaacagaagauuacaa

SEQ ID NO: 1744284 - RNA, 12 nt, Homo sapiens
gaaggaucccau

SEQ ID NO: 1744285 - RNA, 20 nt, Homo sapiens
caccagcccugaccccagug

SEQ ID NO: 1744286 - RNA, 12 nt, Homo sapiens
aagugugcagua

SEQ ID NO: 1744287 - RNA, 22 nt, Homo sapiens
auuuaaaauuacguuuguuauu

SEQ ID NO: 1744288 - RNA, 21 nt, Homo sapiens
uuaacacuucuguaugcauca

SEQ ID NO: 1744289 - RNA, 19 nt, Homo sapiens
aucaucauaucuacuauau

SEQ ID NO: 1744290 - RNA, 19 nt, Homo sapiens
uuuugaaaaacugcucaua

SEQ ID NO: 1744291 - RNA, 17 nt, Homo sapiens
uacccaagcuguggcag

SEQ ID NO: 1744292 - RNA, 13 nt, Homo sapiens
ugagccacuggag

SEQ ID NO: 1744293 - RNA, 16 nt, Homo sapiens
ugacuguucuugguaa

SEQ ID NO: 1744294 - RNA, 17 nt, Homo sapiens
gugagcugagauugcac

SEQ ID NO: 1744295 - RNA, 19 nt, Homo sapiens
aauaucugggauucuacuu

SEQ ID NO: 1744296 - RNA, 19 nt, Homo sapiens
cauuucagccaaacuguag

SEQ ID NO: 1744297 - RNA, 11 nt, Homo sapiens
cacuugucaau

SEQ ID NO: 1744298 - RNA, 13 nt, Homo sapiens
aaaagcauuguuu

SEQ ID NO: 1744299 - RNA, 16 nt, Homo sapiens
aggggaggcaccucca

SEQ ID NO: 1744300 - RNA, 20 nt, Homo sapiens
caguuuaagaaguggugaca

SEQ ID NO: 1744301 - RNA, 14 nt, Homo sapiens
ggccuuaaccauga

SEQ ID NO: 1744302 - RNA, 17 nt, Homo sapiens
gguugaggcugcaguga

SEQ ID NO: 1744303 - RNA, 15 nt, Homo sapiens
ugcauagcagcugcu

SEQ ID NO: 1744304 - RNA, 22 nt, Homo sapiens
cauccagagaccaaauaauuaa

SEQ ID NO: 1744305 - RNA, 16 nt, Homo sapiens
ggacugugaccaaagc

SEQ ID NO: 1744306 - RNA, 20 nt, Homo sapiens
cgaucuggguucacugcaac

SEQ ID NO: 1744307 - RNA, 15 nt, Homo sapiens
uccaacuauguccag

SEQ ID NO: 1744308 - RNA, 18 nt, Homo sapiens
uuaacaaauacauucaaa

SEQ ID NO: 1744309 - RNA, 21 nt, Homo sapiens
cuguggcuucuaggugcccga

SEQ ID NO: 1744310 - RNA, 15 nt, Homo sapiens
accuggcaucuuaca

SEQ ID NO: 1744311 - RNA, 14 nt, Homo sapiens
uagcacugccagga

SEQ ID NO: 1744312 - RNA, 19 nt, Homo sapiens
auuaacagaagccaaaaua

SEQ ID NO: 1744313 - RNA, 21 nt, Homo sapiens
agccggaucaaggcaagcccc

SEQ ID NO: 1744314 - RNA, 18 nt, Homo sapiens
cugcacuaaaauucacuu

SEQ ID NO: 1744315 - RNA, 14 nt, Homo sapiens
cgaaaccccaucuc

SEQ ID NO: 1744316 - RNA, 20 nt, Homo sapiens
uccuccagggugugugcucg

SEQ ID NO: 1744317 - RNA, 16 nt, Homo sapiens
accauuucaagacaga

SEQ ID NO: 1744318 - RNA, 15 nt, Homo sapiens
gccaggggcagugaa

SEQ ID NO: 1744319 - RNA, 12 nt, Homo sapiens
uggccaaaaccu

SEQ ID NO: 1744320 - RNA, 20 nt, Homo sapiens
uaaaaaacuucccaacucac

SEQ ID NO: 1744321 - RNA, 14 nt, Homo sapiens
ccuaaaaaauuccu

SEQ ID NO: 1744322 - RNA, 21 nt, Homo sapiens
uuaacaugacauuuaccagca

SEQ ID NO: 1744323 - RNA, 20 nt, Homo sapiens
uccuaaucauacaccagaag

SEQ ID NO: 1744324 - RNA, 23 nt, Homo sapiens
aucucaguggcacagguuuaaga

SEQ ID NO: 1744325 - RNA, 13 nt, Homo sapiens
gcacucucaggug

SEQ ID NO: 1744326 - RNA, 16 nt, Homo sapiens
aguuugccuuccuuuc

SEQ ID NO: 1744327 - RNA, 17 nt, Homo sapiens
caggaaagaugaugcaa

SEQ ID NO: 1744328 - RNA, 22 nt, Homo sapiens
ucuccaaacuaaacccucacaa

SEQ ID NO: 1744329 - RNA, 16 nt, Homo sapiens
aagcuaucaggccaag

SEQ ID NO: 1744330 - RNA, 15 nt, Homo sapiens
aaacuuugaaaaaga

SEQ ID NO: 1744331 - RNA, 11 nt, Homo sapiens
cagcugugaga

SEQ ID NO: 1744332 - RNA, 16 nt, Homo sapiens
aaugaacaagcauucu

SEQ ID NO: 1744333 - RNA, 18 nt, Homo sapiens
ucugauaaaagauggcca

SEQ ID NO: 1744334 - RNA, 15 nt, Homo sapiens
caugagaggaggcag

SEQ ID NO: 1744335 - RNA, 19 nt, Homo sapiens
aaagguauaugacugagcg

SEQ ID NO: 1744336 - RNA, 22 nt, Homo sapiens
ugaccggaauggucaaaucucu

SEQ ID NO: 1744337 - RNA, 19 nt, Homo sapiens
ucagauucacacaugccac

SEQ ID NO: 1744338 - RNA, 15 nt, Homo sapiens
cauaaccaacauuaa

SEQ ID NO: 1744339 - RNA, 17 nt, Homo sapiens
ucuuucuuacaaggaag

SEQ ID NO: 1744340 - RNA, 18 nt, Homo sapiens
auaaacuugcuuucacuu

SEQ ID NO: 1744341 - RNA, 15 nt, Homo sapiens
ucagcaguccuagcc

SEQ ID NO: 1744342 - RNA, 19 nt, Homo sapiens
cauuugcucuuucaucucu

SEQ ID NO: 1744343 - RNA, 21 nt, Homo sapiens
ccugugugugugugugcugau

SEQ ID NO: 1744344 - RNA, 20 nt, Homo sapiens
uaaagaaaaguuuaccaucu

SEQ ID NO: 1744345 - RNA, 21 nt, Homo sapiens
gcaucuggccuaugacccugu

SEQ ID NO: 1744346 - RNA, 21 nt, Homo sapiens
ccaucaauaaauguugcaaug

SEQ ID NO: 1744347 - RNA, 19 nt, Homo sapiens
ucuggcuagugucuaucag

SEQ ID NO: 1744348 - RNA, 15 nt, Homo sapiens
gaguggccugugagc

SEQ ID NO: 1744349 - RNA, 13 nt, Homo sapiens
ugcagacaugaga

SEQ ID NO: 1744350 - RNA, 13 nt, Homo sapiens
aauugggugugua

SEQ ID NO: 1744351 - RNA, 15 nt, Homo sapiens
uucuuaaagugcagu

SEQ ID NO: 1744352 - RNA, 18 nt, Homo sapiens
gagacccagaucucaugg

SEQ ID NO: 1744353 - RNA, 18 nt, Homo sapiens
auaaaaauuguagcuuuu

SEQ ID NO: 1744354 - RNA, 17 nt, Homo sapiens
uuccucauccuuucccu

SEQ ID NO: 1744355 - RNA, 12 nt, Homo sapiens
ggaaagugcaua

SEQ ID NO: 1744356 - RNA, 12 nt, Homo sapiens
ggugagugcaag

SEQ ID NO: 1744357 - RNA, 14 nt, Homo sapiens
accccguagcucca

SEQ ID NO: 1744358 - RNA, 16 nt, Homo sapiens
aaaugcauguccucaa

SEQ ID NO: 1744359 - RNA, 13 nt, Homo sapiens
ccuccccauguga

SEQ ID NO: 1744360 - RNA, 14 nt, Homo sapiens
gacacccugacccc

SEQ ID NO: 1744361 - RNA, 14 nt, Homo sapiens
uccauucuucccuu

SEQ ID NO: 1744362 - RNA, 13 nt, Homo sapiens
ucuguuccauguc

SEQ ID NO: 1744363 - RNA, 15 nt, Homo sapiens
ugaauagugaggcug

SEQ ID NO: 1744364 - RNA, 18 nt, Homo sapiens
uucuggguucauauauau

SEQ ID NO: 1744365 - RNA, 17 nt, Homo sapiens
cuuagccauugaaaugu

SEQ ID NO: 1744366 - RNA, 23 nt, Homo sapiens
gcaucuauuuccucugugcaaag

SEQ ID NO: 1744367 - RNA, 23 nt, Homo sapiens
cagaagccuaggggagucccugu

SEQ ID NO: 1744368 - RNA, 19 nt, Homo sapiens
aacuuuuugcaaggcauuu

SEQ ID NO: 1744369 - RNA, 16 nt, Homo sapiens
cagccaggcccugaga

SEQ ID NO: 1744370 - RNA, 20 nt, Homo sapiens
gauggaaaaucacaccaccu

SEQ ID NO: 1744371 - RNA, 20 nt, Homo sapiens
cugugccugcucagcagcca

SEQ ID NO: 1744372 - RNA, 16 nt, Homo sapiens
ccuugcuacccagaaa

SEQ ID NO: 1744373 - RNA, 18 nt, Homo sapiens
ccugaaagccacagacaa

SEQ ID NO: 1744374 - RNA, 20 nt, Homo sapiens
cauaaccccaggcaucccau

SEQ ID NO: 1744375 - RNA, 23 nt, Homo sapiens
uuugucaacacaaagacauggaa

SEQ ID NO: 1744376 - RNA, 17 nt, Homo sapiens
uuuguaggggaacucau

SEQ ID NO: 1744377 - RNA, 20 nt, Homo sapiens
acguccugggugcugucaug

SEQ ID NO: 1744378 - RNA, 17 nt, Homo sapiens
ucucugccacccacuca

SEQ ID NO: 1744379 - RNA, 15 nt, Homo sapiens
guagaguguuuguga

SEQ ID NO: 1744380 - RNA, 21 nt, Homo sapiens
gcaggcuauuuguucagagag

SEQ ID NO: 1744381 - RNA, 17 nt, Homo sapiens
agcaugauuuauacuca

SEQ ID NO: 1744382 - RNA, 17 nt, Homo sapiens
cugagcgagcacaccuu

SEQ ID NO: 1744383 - RNA, 15 nt, Homo sapiens
aucacgacaaucaca

SEQ ID NO: 1744384 - RNA, 18 nt, Homo sapiens
uaccauauaauguaaaaa

SEQ ID NO: 1744385 - RNA, 23 nt, Homo sapiens
ucccugcagaugccacccuagcc

SEQ ID NO: 1744386 - RNA, 14 nt, Homo sapiens
uagcagacaguguu

SEQ ID NO: 1744387 - RNA, 20 nt, Homo sapiens
cugccggcccccaggacaag

SEQ ID NO: 1744388 - RNA, 18 nt, Homo sapiens
aguaccuacugugugcca

SEQ ID NO: 1744389 - RNA, 17 nt, Homo sapiens
cuuuguauuugguaaau

SEQ ID NO: 1744390 - RNA, 18 nt, Homo sapiens
uuggaguuaguggauaac

SEQ ID NO: 1744391 - RNA, 20 nt, Homo sapiens
aaugcaguuuuuuggaagaa

SEQ ID NO: 1744392 - RNA, 16 nt, Homo sapiens
ucaucaugaaaacugg

SEQ ID NO: 1744393 - RNA, 21 nt, Homo sapiens
cuuugguuauuggaaggcaag

SEQ ID NO: 1744394 - RNA, 15 nt, Homo sapiens
caaguguaaugaaua

SEQ ID NO: 1744395 - RNA, 22 nt, Homo sapiens
uucuggacuacacccaagccug

SEQ ID NO: 1744396 - RNA, 18 nt, Homo sapiens
ugaaguauauauuccccu

SEQ ID NO: 1744397 - RNA, 13 nt, Homo sapiens
aggagcuuugugu

SEQ ID NO: 1744398 - RNA, 20 nt, Homo sapiens
auauauuuuugcuaaaccua

SEQ ID NO: 1744399 - RNA, 17 nt, Homo sapiens
ccauagaggugagggaa

SEQ ID NO: 1744400 - RNA, 23 nt, Homo sapiens
cauguacugggaaggcaauuuca

SEQ ID NO: 1744401 - RNA, 15 nt, Homo sapiens
cauucaaaauaguuc

SEQ ID NO: 1744402 - RNA, 15 nt, Homo sapiens
ugggaaaaccagacu

SEQ ID NO: 1744403 - RNA, 19 nt, Homo sapiens
uccuagccucuccgcccac

SEQ ID NO: 1744404 - RNA, 23 nt, Homo sapiens
ucccuuuggagauuuuuuaaucc

SEQ ID NO: 1744405 - RNA, 21 nt, Homo sapiens
uguuuccuucuccgaggggcu

SEQ ID NO: 1744406 - RNA, 16 nt, Homo sapiens
agguaaugcacauccu

SEQ ID NO: 1744407 - RNA, 11 nt, Homo sapiens
acuaaagccaa

SEQ ID NO: 1744408 - RNA, 18 nt, Homo sapiens
uaguagcagagucauugu

SEQ ID NO: 1744409 - RNA, 17 nt, Homo sapiens
ucauuaggacauaacag

SEQ ID NO: 1744410 - RNA, 18 nt, Homo sapiens
cagggagcagagcuucca

SEQ ID NO: 1744411 - RNA, 15 nt, Homo sapiens
cugugggccaaaauc

SEQ ID NO: 1744412 - RNA, 22 nt, Homo sapiens
auaaaugucuuuaaugcaauau

SEQ ID NO: 1744413 - RNA, 22 nt, Homo sapiens
agggccagguccucacagcagu

SEQ ID NO: 1744414 - RNA, 21 nt, Homo sapiens
cuuauuuugugugcuuuccca

SEQ ID NO: 1744415 - RNA, 19 nt, Homo sapiens
uuaauuccuucagcacuuu

SEQ ID NO: 1744416 - RNA, 20 nt, Homo sapiens
guaguuagcaacuagggcua

SEQ ID NO: 1744417 - RNA, 13 nt, Homo sapiens
agcgaacugcacu

SEQ ID NO: 1744418 - RNA, 16 nt, Homo sapiens
caccaccacacuacac

SEQ ID NO: 1744419 - RNA, 16 nt, Homo sapiens
acacuaccacauuaaa

SEQ ID NO: 1744420 - RNA, 23 nt, Homo sapiens
agagaagaccaaagcauugccug

SEQ ID NO: 1744421 - RNA, 23 nt, Homo sapiens
auuuuucagcagcaaaaccaaac

SEQ ID NO: 1744422 - RNA, 15 nt, Homo sapiens
cacccugcaccucau

SEQ ID NO: 1744423 - RNA, 16 nt, Homo sapiens
agaaagagaaugaacu

SEQ ID NO: 1744424 - RNA, 13 nt, Homo sapiens
agcuuuaaauuca

SEQ ID NO: 1744425 - RNA, 12 nt, Homo sapiens
uggacaaaggug

SEQ ID NO: 1744426 - RNA, 19 nt, Homo sapiens
cuguccccaaaaugugaug

SEQ ID NO: 1744427 - RNA, 18 nt, Homo sapiens
aauauggaacauaugcac

SEQ ID NO: 1744428 - RNA, 14 nt, Homo sapiens
auuuagugacuuaa

SEQ ID NO: 1744429 - RNA, 12 nt, Homo sapiens
uaccucuuaccu

SEQ ID NO: 1744430 - RNA, 15 nt, Homo sapiens
acuaaauucaaagaa

SEQ ID NO: 1744431 - RNA, 23 nt, Homo sapiens
auucacugguuuuacacagagaa

SEQ ID NO: 1744432 - RNA, 19 nt, Homo sapiens
uguaccaaaacauccacuu

SEQ ID NO: 1744433 - RNA, 16 nt, Homo sapiens
cugggaaaggugcuca

SEQ ID NO: 1744434 - RNA, 13 nt, Homo sapiens
acaugaacagaca

SEQ ID NO: 1744435 - RNA, 18 nt, Homo sapiens
caaaguaauguagcauga

SEQ ID NO: 1744436 - RNA, 15 nt, Homo sapiens
ccucucugcacacua

SEQ ID NO: 1744437 - RNA, 19 nt, Homo sapiens
cagccugcacacaccugcc

SEQ ID NO: 1744438 - RNA, 17 nt, Homo sapiens
aacuuuauacacuugga

SEQ ID NO: 1744439 - RNA, 16 nt, Homo sapiens
cuuucauuuugccuga

SEQ ID NO: 1744440 - RNA, 21 nt, Homo sapiens
uucacacguugugaugaagcu

SEQ ID NO: 1744441 - RNA, 15 nt, Homo sapiens
caaauaaaacauaau

SEQ ID NO: 1744442 - RNA, 19 nt, Homo sapiens
cugaaguacaaacaugaaa

SEQ ID NO: 1744443 - RNA, 19 nt, Homo sapiens
guauauauguguaugcaca

SEQ ID NO: 1744444 - RNA, 20 nt, Homo sapiens
agcucuggggugggcaguuu

SEQ ID NO: 1744445 - RNA, 21 nt, Homo sapiens
aauuauacaucacagcagugc

SEQ ID NO: 1744446 - RNA, 21 nt, Homo sapiens
acuccucucguacuugaacuc

SEQ ID NO: 1744447 - RNA, 16 nt, Homo sapiens
ucucagccuaccauga

SEQ ID NO: 1744448 - RNA, 17 nt, Homo sapiens
uucuuagcauacauuca

SEQ ID NO: 1744449 - RNA, 19 nt, Homo sapiens
ugucuucuccaccacgcug

SEQ ID NO: 1744450 - RNA, 20 nt, Homo sapiens
ccaguagcuucccaaaaaca

SEQ ID NO: 1744451 - RNA, 19 nt, Homo sapiens
ucugaaaggcacacuuuga

SEQ ID NO: 1744452 - RNA, 20 nt, Homo sapiens
uucuaaaacauucuuuaaca

SEQ ID NO: 1744453 - RNA, 18 nt, Homo sapiens
ucucccaggacccaucac

SEQ ID NO: 1744454 - RNA, 14 nt, Homo sapiens
aauguacauacuau

SEQ ID NO: 1744455 - RNA, 19 nt, Homo sapiens
uuaaaaguugugauuccag

SEQ ID NO: 1744456 - RNA, 21 nt, Homo sapiens
uccugcugggcgugugugaca

SEQ ID NO: 1744457 - RNA, 23 nt, Homo sapiens
guugaauuucccacauacccucc

SEQ ID NO: 1744458 - RNA, 14 nt, Homo sapiens
cacugucaucugua

SEQ ID NO: 1744459 - RNA, 15 nt, Homo sapiens
agcuccguucccaag

SEQ ID NO: 1744460 - RNA, 12 nt, Homo sapiens
aagaagacauuu

SEQ ID NO: 1744461 - RNA, 15 nt, Homo sapiens
gggcccuguccaggu

SEQ ID NO: 1744462 - RNA, 13 nt, Homo sapiens
uggugcuaauuaa

SEQ ID NO: 1744463 - RNA, 19 nt, Homo sapiens
ggauauaguagccaugaca

SEQ ID NO: 1744464 - RNA, 18 nt, Homo sapiens
caguagugagcagcaucu

SEQ ID NO: 1744465 - RNA, 18 nt, Homo sapiens
gaucucgggacucagauu

SEQ ID NO: 1744466 - RNA, 12 nt, Homo sapiens
uucccagugugg

SEQ ID NO: 1744467 - RNA, 19 nt, Homo sapiens
aaauacuuuuacucugccu

SEQ ID NO: 1744468 - RNA, 21 nt, Homo sapiens
ugcaaucuucucagaaggcaa

SEQ ID NO: 1744469 - RNA, 18 nt, Homo sapiens
cuuuggucauaugagcuu

SEQ ID NO: 1744470 - RNA, 19 nt, Homo sapiens
cgaucucagcucaccucaa

SEQ ID NO: 1744471 - RNA, 12 nt, Homo sapiens
gaggcuccugug

SEQ ID NO: 1744472 - RNA, 14 nt, Homo sapiens
cuccccgggcagca

SEQ ID NO: 1744473 - RNA, 19 nt, Homo sapiens
uaugacauggaggcacuga

SEQ ID NO: 1744474 - RNA, 13 nt, Homo sapiens
cugagaccucaau

SEQ ID NO: 1744475 - RNA, 15 nt, Homo sapiens
aaaauucaaccacag

SEQ ID NO: 1744476 - RNA, 17 nt, Homo sapiens
cuaagauaauuuacuua

SEQ ID NO: 1744477 - RNA, 18 nt, Homo sapiens
uucacacuuccaccagcc

SEQ ID NO: 1744478 - RNA, 20 nt, Homo sapiens
aaaaggaauguuugaauuua

SEQ ID NO: 1744479 - RNA, 21 nt, Homo sapiens
cucaguguccaguugcagcug

SEQ ID NO: 1744480 - RNA, 18 nt, Homo sapiens
aacauaguuuaaguugau

SEQ ID NO: 1744481 - RNA, 14 nt, Homo sapiens
uagagauaugcaga

SEQ ID NO: 1744482 - RNA, 21 nt, Homo sapiens
auaaauggcccggacaugucu

SEQ ID NO: 1744483 - RNA, 16 nt, Homo sapiens
aucccagucucugcca

SEQ ID NO: 1744484 - RNA, 21 nt, Homo sapiens
agccgagaucgcgccacugca

SEQ ID NO: 1744485 - RNA, 17 nt, Homo sapiens
auguauauuuuugcuag

SEQ ID NO: 1744486 - RNA, 21 nt, Homo sapiens
agcugagaucgugccacugca

SEQ ID NO: 1744487 - RNA, 18 nt, Homo sapiens
agcaaugggacuggaguc

SEQ ID NO: 1744488 - RNA, 23 nt, Homo sapiens
cugugauucgguggagacuauca

SEQ ID NO: 1744489 - RNA, 15 nt, Homo sapiens
ccagaacacacucca

SEQ ID NO: 1744490 - RNA, 21 nt, Homo sapiens
auucagugcagcauauacaau

SEQ ID NO: 1744491 - RNA, 18 nt, Homo sapiens
cuagauuuugcugagaug

SEQ ID NO: 1744492 - RNA, 11 nt, Homo sapiens
cuggcacugag

SEQ ID NO: 1744493 - RNA, 18 nt, Homo sapiens
auuaaaugcauguccuca

SEQ ID NO: 1744494 - RNA, 21 nt, Homo sapiens
aguuuauacaguguacaugua

SEQ ID NO: 1744495 - RNA, 16 nt, Homo sapiens
cuguguagcugugacc

SEQ ID NO: 1744496 - RNA, 22 nt, Homo sapiens
guaaaagcuuacacagguuuca

SEQ ID NO: 1744497 - RNA, 16 nt, Homo sapiens
gcucagcccugagcua

SEQ ID NO: 1744498 - RNA, 10 nt, Homo sapiens
uguagccaug

SEQ ID NO: 1744499 - RNA, 19 nt, Homo sapiens
uaggacucaaaguuucaga

SEQ ID NO: 1744500 - RNA, 12 nt, Homo sapiens
uguagaaacugg

SEQ ID NO: 1744501 - RNA, 12 nt, Homo sapiens
uagaccuuggca

SEQ ID NO: 1744502 - RNA, 17 nt, Homo sapiens
ugggauaucacuuccau

SEQ ID NO: 1744503 - RNA, 17 nt, Homo sapiens
ucacuuguuucuacuca

SEQ ID NO: 1744504 - RNA, 13 nt, Homo sapiens
uaauugacacuau

SEQ ID NO: 1744505 - RNA, 19 nt, Homo sapiens
agcacuaguugauaacuuu

SEQ ID NO: 1744506 - RNA, 14 nt, Homo sapiens
aucucaauuugcag

SEQ ID NO: 1744507 - RNA, 23 nt, Homo sapiens
ccagacuugggaggauguacagu

SEQ ID NO: 1744508 - RNA, 22 nt, Homo sapiens
gcccagguucgagacccaaacc

SEQ ID NO: 1744509 - RNA, 18 nt, Homo sapiens
cauuuaugauuuaucuag

SEQ ID NO: 1744510 - RNA, 18 nt, Homo sapiens
auuauccaucuuucacua

SEQ ID NO: 1744511 - RNA, 18 nt, Homo sapiens
gacaggcagccuggacau

SEQ ID NO: 1744512 - RNA, 12 nt, Homo sapiens
ccauucucccag

SEQ ID NO: 1744513 - RNA, 17 nt, Homo sapiens
aggaccggccuuugcac

SEQ ID NO: 1744514 - RNA, 23 nt, Homo sapiens
auuuuaaaaauaaauucaaauua

SEQ ID NO: 1744515 - RNA, 14 nt, Homo sapiens
cagcgaacagccuu

SEQ ID NO: 1744516 - RNA, 21 nt, Homo sapiens
cagcugagccuucugagcugg

SEQ ID NO: 1744517 - RNA, 14 nt, Homo sapiens
cugagagacaggac

SEQ ID NO: 1744518 - RNA, 23 nt, Homo sapiens
ucucucccaggucccagccccuu

SEQ ID NO: 1744519 - RNA, 22 nt, Homo sapiens
uacugcacccagcagugucacu

SEQ ID NO: 1744520 - RNA, 12 nt, Homo sapiens
cccccuugaggg

SEQ ID NO: 1744521 - RNA, 18 nt, Homo sapiens
ugauguguccucagggag

SEQ ID NO: 1744522 - RNA, 13 nt, Homo sapiens
caaaaccaaauau

SEQ ID NO: 1744523 - RNA, 16 nt, Homo sapiens
ugggaaaacuguauua

SEQ ID NO: 1744524 - RNA, 12 nt, Homo sapiens
aagauaagaguu

SEQ ID NO: 1744525 - RNA, 18 nt, Homo sapiens
cacuggaggggucuccuc

SEQ ID NO: 1744526 - RNA, 15 nt, Homo sapiens
auugccugcagagag

SEQ ID NO: 1744527 - RNA, 14 nt, Homo sapiens
gccucuguggcacu

SEQ ID NO: 1744528 - RNA, 22 nt, Homo sapiens
aaauuuuaauguuaacuuucaa

SEQ ID NO: 1744529 - RNA, 14 nt, Homo sapiens
uucauucugccaaa

SEQ ID NO: 1744530 - RNA, 17 nt, Homo sapiens
ggcugacuaagccccgu

SEQ ID NO: 1744531 - RNA, 23 nt, Homo sapiens
auguugcaugccuauguacucua

SEQ ID NO: 1744532 - RNA, 23 nt, Homo sapiens
ccuggaucaguccuuugaucagu

SEQ ID NO: 1744533 - RNA, 18 nt, Homo sapiens
gggucacugggaugccuc

SEQ ID NO: 1744534 - RNA, 19 nt, Homo sapiens
aaaagcccagcacuugaau

SEQ ID NO: 1744535 - RNA, 12 nt, Homo sapiens
aacuucauucuc

SEQ ID NO: 1744536 - RNA, 14 nt, Homo sapiens
ccaccugcuucugu

SEQ ID NO: 1744537 - RNA, 17 nt, Homo sapiens
cugacgugcagccacac

SEQ ID NO: 1744538 - RNA, 14 nt, Homo sapiens
caagcuccaagagg

SEQ ID NO: 1744539 - RNA, 17 nt, Homo sapiens
gccccagcagugccuug

SEQ ID NO: 1744540 - RNA, 15 nt, Homo sapiens
agagcuaggaacccu

SEQ ID NO: 1744541 - RNA, 19 nt, Homo sapiens
ugcugacguguuucuuguc

SEQ ID NO: 1744542 - RNA, 14 nt, Homo sapiens
cuuauuucaucugu

SEQ ID NO: 1744543 - RNA, 14 nt, Homo sapiens
auguaccagcaucu

SEQ ID NO: 1744544 - RNA, 16 nt, Homo sapiens
agagaaaaauugccuu

SEQ ID NO: 1744545 - RNA, 20 nt, Homo sapiens
acuuaagcccucgugcacac

SEQ ID NO: 1744546 - RNA, 20 nt, Homo sapiens
agacagaguuuucacucuua

SEQ ID NO: 1744547 - RNA, 15 nt, Homo sapiens
agcagggacuugaac

SEQ ID NO: 1744548 - RNA, 14 nt, Homo sapiens
gugaucucaccaac

SEQ ID NO: 1744549 - RNA, 22 nt, Homo sapiens
acccugagguaucuguguuaca

SEQ ID NO: 1744550 - RNA, 16 nt, Homo sapiens
ugcaaccugugcaaaa

SEQ ID NO: 1744551 - RNA, 18 nt, Homo sapiens
guuuuaguuuugggauau

SEQ ID NO: 1744552 - RNA, 22 nt, Homo sapiens
uguuuaaguggcuuucagcaaa

SEQ ID NO: 1744553 - RNA, 23 nt, Homo sapiens
cacaccuuuguccacugucaggg

SEQ ID NO: 1744554 - RNA, 22 nt, Homo sapiens
uagagguccucaugggucccuu

SEQ ID NO: 1744555 - RNA, 21 nt, Homo sapiens
auuaagaaacccccucaugga

SEQ ID NO: 1744556 - RNA, 18 nt, Homo sapiens
uuggggagagcuggagaa

SEQ ID NO: 1744557 - RNA, 12 nt, Homo sapiens
caacaucacuug

SEQ ID NO: 1744558 - RNA, 21 nt, Homo sapiens
ugagcacaggcaacauuacaa

SEQ ID NO: 1744559 - RNA, 14 nt, Homo sapiens
auccucucuggucu

SEQ ID NO: 1744560 - RNA, 12 nt, Homo sapiens
gacauaccucuc

SEQ ID NO: 1744561 - RNA, 14 nt, Homo sapiens
ugccuuaguguccu

SEQ ID NO: 1744562 - RNA, 14 nt, Homo sapiens
aaguccagcuccuu

SEQ ID NO: 1744563 - RNA, 22 nt, Homo sapiens
agaaggucacuacugcauuuau

SEQ ID NO: 1744564 - RNA, 12 nt, Homo sapiens
agucuugucuca

SEQ ID NO: 1744565 - RNA, 16 nt, Homo sapiens
ucugggucaugcacug

SEQ ID NO: 1744566 - RNA, 20 nt, Homo sapiens
ccaaucagcuuuuguucuag

SEQ ID NO: 1744567 - RNA, 13 nt, Homo sapiens
gugaugugcaaag

SEQ ID NO: 1744568 - RNA, 22 nt, Homo sapiens
gcaacguagcuucuaccaugaa

SEQ ID NO: 1744569 - RNA, 22 nt, Homo sapiens
acagaggagagaggcucagcca

SEQ ID NO: 1744570 - RNA, 20 nt, Homo sapiens
uuucuuaaagcaaagucacu

SEQ ID NO: 1744571 - RNA, 13 nt, Homo sapiens
aaaugagaacuaa

SEQ ID NO: 1744572 - RNA, 21 nt, Homo sapiens
augauuuuaaagaaagccaca

SEQ ID NO: 1744573 - RNA, 19 nt, Homo sapiens
gcccugcccuuacaggaac

SEQ ID NO: 1744574 - RNA, 14 nt, Homo sapiens
ucuguaaucacauu

SEQ ID NO: 1744575 - RNA, 22 nt, Homo sapiens
ccccuggcugguaagggccaag

SEQ ID NO: 1744576 - RNA, 20 nt, Homo sapiens
agagaugccucccugagcua

SEQ ID NO: 1744577 - RNA, 16 nt, Homo sapiens
uuagaguaaugaaaug

SEQ ID NO: 1744578 - RNA, 13 nt, Homo sapiens
uacuguaugauca

SEQ ID NO: 1744579 - RNA, 18 nt, Homo sapiens
augggaucccaggccagg

SEQ ID NO: 1744580 - RNA, 18 nt, Homo sapiens
cauguacuguuacugugu

SEQ ID NO: 1744581 - RNA, 16 nt, Homo sapiens
uugucacugacacaca

SEQ ID NO: 1744582 - RNA, 17 nt, Homo sapiens
gaccaggcuggggccag

SEQ ID NO: 1744583 - RNA, 17 nt, Homo sapiens
agacuuacuuacuccca

SEQ ID NO: 1744584 - RNA, 17 nt, Homo sapiens
caucuuuucacaacuua

SEQ ID NO: 1744585 - RNA, 21 nt, Homo sapiens
gguauucuuaagggaacuucc

SEQ ID NO: 1744586 - RNA, 18 nt, Homo sapiens
ggcccuugggccacgcuc

SEQ ID NO: 1744587 - RNA, 15 nt, Homo sapiens
aggggcucgagugcc

SEQ ID NO: 1744588 - RNA, 16 nt, Homo sapiens
cucucugcaagacaga

SEQ ID NO: 1744589 - RNA, 23 nt, Homo sapiens
gacuccuuugguauuucacugaa

SEQ ID NO: 1744590 - RNA, 16 nt, Homo sapiens
gucacggccaagugua

SEQ ID NO: 1744591 - RNA, 22 nt, Homo sapiens
uugauuuuuuaauuucuaugaa

SEQ ID NO: 1744592 - RNA, 19 nt, Homo sapiens
cuuugcccaaaacugucau

SEQ ID NO: 1744593 - RNA, 19 nt, Homo sapiens
agggacagggaaugcugag

SEQ ID NO: 1744594 - RNA, 22 nt, Homo sapiens
aaguaguugaagagcuacuuca

SEQ ID NO: 1744595 - RNA, 17 nt, Homo sapiens
ucaacagcaagugugaa

SEQ ID NO: 1744596 - RNA, 14 nt, Homo sapiens
uaacuuucuaauga

SEQ ID NO: 1744597 - RNA, 23 nt, Homo sapiens
ugaguaaacugaggcccaaagca

SEQ ID NO: 1744598 - RNA, 15 nt, Homo sapiens
cagugcuaaagccug

SEQ ID NO: 1744599 - RNA, 16 nt, Homo sapiens
uugauaccugcacugu

SEQ ID NO: 1744600 - RNA, 19 nt, Homo sapiens
uggcagugcuugugauuca

SEQ ID NO: 1744601 - RNA, 18 nt, Homo sapiens
uguuucugucaagcuggu

SEQ ID NO: 1744602 - RNA, 14 nt, Homo sapiens
cuagaccuugccuc

SEQ ID NO: 1744603 - RNA, 18 nt, Homo sapiens
ccagauguaaauagaaca

SEQ ID NO: 1744604 - RNA, 15 nt, Homo sapiens
uucucaucuugccuc

SEQ ID NO: 1744605 - RNA, 20 nt, Homo sapiens
ucucugucaugugcagauga

SEQ ID NO: 1744606 - RNA, 15 nt, Homo sapiens
aauucaaaagauuaa

SEQ ID NO: 1744607 - RNA, 18 nt, Homo sapiens
uccuggcuaacacgugaa

SEQ ID NO: 1744608 - RNA, 22 nt, Homo sapiens
ucauaguuacuuacugccuuag

SEQ ID NO: 1744609 - RNA, 18 nt, Homo sapiens
uauaagcauguauauucu

SEQ ID NO: 1744610 - RNA, 17 nt, Homo sapiens
uugaaaccugcucugua

SEQ ID NO: 1744611 - RNA, 22 nt, Homo sapiens
ccuuuucuccuaucuucauauc

SEQ ID NO: 1744612 - RNA, 23 nt, Homo sapiens
caacaguuaaacuugcaaugaaa

SEQ ID NO: 1744613 - RNA, 15 nt, Homo sapiens
aaagaaacaagaugc

SEQ ID NO: 1744614 - RNA, 18 nt, Homo sapiens
uuauauauuauauggaaa

SEQ ID NO: 1744615 - RNA, 18 nt, Homo sapiens
cacuuccuuaacagcugu

SEQ ID NO: 1744616 - RNA, 11 nt, Homo sapiens
gcccugugcac

SEQ ID NO: 1744617 - RNA, 22 nt, Homo sapiens
caggcccuggccuccccugcca

SEQ ID NO: 1744618 - RNA, 19 nt, Homo sapiens
cagccaggacaucucugcc

SEQ ID NO: 1744619 - RNA, 15 nt, Homo sapiens
agcucaccacugugc

SEQ ID NO: 1744620 - RNA, 16 nt, Homo sapiens
auaucuuuauacuuaa

SEQ ID NO: 1744621 - RNA, 22 nt, Homo sapiens
uccuucuucaacgccaucucca

SEQ ID NO: 1744622 - RNA, 19 nt, Homo sapiens
cagcccaaagcuggagcca

SEQ ID NO: 1744623 - RNA, 21 nt, Homo sapiens
agcuuccugcugaauguagua

SEQ ID NO: 1744624 - RNA, 22 nt, Homo sapiens
cuuugucagggaguguucccua

SEQ ID NO: 1744625 - RNA, 13 nt, Homo sapiens
agagccagcagca

SEQ ID NO: 1744626 - RNA, 17 nt, Homo sapiens
cacaggaggugugauag

SEQ ID NO: 1744627 - RNA, 14 nt, Homo sapiens
aggaguagucucau

SEQ ID NO: 1744628 - RNA, 14 nt, Homo sapiens
uuaagcagucucac

SEQ ID NO: 1744629 - RNA, 13 nt, Homo sapiens
uucaaaagcacug

SEQ ID NO: 1744630 - RNA, 18 nt, Homo sapiens
ugucagucuacaggccuu

SEQ ID NO: 1744631 - RNA, 13 nt, Homo sapiens
gcacauauuugaa

SEQ ID NO: 1744632 - RNA, 18 nt, Homo sapiens
gaggggcgagaaacaaga

SEQ ID NO: 1744633 - RNA, 15 nt, Homo sapiens
agcaaggugugaaug

SEQ ID NO: 1744634 - RNA, 16 nt, Homo sapiens
agugucugugugcaag

SEQ ID NO: 1744635 - RNA, 15 nt, Homo sapiens
cuucuuuugauacug

SEQ ID NO: 1744636 - RNA, 19 nt, Homo sapiens
aauaucuggguggcuuaaa

SEQ ID NO: 1744637 - RNA, 22 nt, Homo sapiens
ccuacaagucaucauaauucag

SEQ ID NO: 1744638 - RNA, 19 nt, Homo sapiens
aaaacuuuaugcuaaguga

SEQ ID NO: 1744639 - RNA, 16 nt, Homo sapiens
cauaacagaaugcacc

SEQ ID NO: 1744640 - RNA, 19 nt, Homo sapiens
gcaaaagcaggcgacaaaa

SEQ ID NO: 1744641 - RNA, 16 nt, Homo sapiens
gagcaagacugucuca

SEQ ID NO: 1744642 - RNA, 15 nt, Homo sapiens
uuaagacagcauuga

SEQ ID NO: 1744643 - RNA, 21 nt, Homo sapiens
cugcuggggagacaaaucuca

SEQ ID NO: 1744644 - RNA, 15 nt, Homo sapiens
agcaauauguuagca

SEQ ID NO: 1744645 - RNA, 22 nt, Homo sapiens
aacagagcaagacuccaucuca

SEQ ID NO: 1744646 - RNA, 12 nt, Homo sapiens
ucugggccagug

SEQ ID NO: 1744647 - RNA, 22 nt, Homo sapiens
gacagagcgagacuccaucuca

SEQ ID NO: 1744648 - RNA, 17 nt, Homo sapiens
uggccuuuaaaaaugca

SEQ ID NO: 1744649 - RNA, 21 nt, Homo sapiens
ccauggcuucccagagcuccc

SEQ ID NO: 1744650 - RNA, 16 nt, Homo sapiens
cuccccacccaagaga

SEQ ID NO: 1744651 - RNA, 17 nt, Homo sapiens
agauuuaggagcagaaa

SEQ ID NO: 1744652 - RNA, 14 nt, Homo sapiens
ucaguauguuuuua

SEQ ID NO: 1744653 - RNA, 19 nt, Homo sapiens
uuaacucaccucucaaggu

SEQ ID NO: 1744654 - RNA, 16 nt, Homo sapiens
agccauuuggaagcuu

SEQ ID NO: 1744655 - RNA, 21 nt, Homo sapiens
cuuuucucuccugugugcuug

SEQ ID NO: 1744656 - RNA, 22 nt, Homo sapiens
ccacucaguucuuccuccaccu

SEQ ID NO: 1744657 - RNA, 21 nt, Homo sapiens
ccuagaagcccucugagcucc

SEQ ID NO: 1744658 - RNA, 17 nt, Homo sapiens
cgguuuauucacuguau

SEQ ID NO: 1744659 - RNA, 16 nt, Homo sapiens
aguaaauaacuggaaa

SEQ ID NO: 1744660 - RNA, 22 nt, Homo sapiens
uaugcaaaagucagcgugacaa

SEQ ID NO: 1744661 - RNA, 20 nt, Homo sapiens
cuaguguagagcaagccagu

SEQ ID NO: 1744662 - RNA, 17 nt, Homo sapiens
uacauuggcacaaugua

SEQ ID NO: 1744663 - RNA, 20 nt, Homo sapiens
aaaaacccugugacucugga

SEQ ID NO: 1744664 - RNA, 19 nt, Homo sapiens
agagaaugcccacugccug

SEQ ID NO: 1744665 - RNA, 11 nt, Homo sapiens
cucacucucag

SEQ ID NO: 1744666 - RNA, 18 nt, Homo sapiens
guaaaucagacuaugaag

SEQ ID NO: 1744667 - RNA, 12 nt, Homo sapiens
cgagaagccagg

SEQ ID NO: 1744668 - RNA, 14 nt, Homo sapiens
ugcaucaccaccuc

SEQ ID NO: 1744669 - RNA, 13 nt, Homo sapiens
aaaugaaagugag

SEQ ID NO: 1744670 - RNA, 23 nt, Homo sapiens
ugcagggcugggaagaagcugca

SEQ ID NO: 1744671 - RNA, 17 nt, Homo sapiens
ugcuuuuucugcgcuuc

SEQ ID NO: 1744672 - RNA, 18 nt, Homo sapiens
ucacuccccacaucccau

SEQ ID NO: 1744673 - RNA, 17 nt, Homo sapiens
cugagucaaauccagug

SEQ ID NO: 1744674 - RNA, 15 nt, Homo sapiens
uaaaugaucacucca

SEQ ID NO: 1744675 - RNA, 13 nt, Homo sapiens
acaacuauguaau

SEQ ID NO: 1744676 - RNA, 16 nt, Homo sapiens
augaauaaaacauuug

SEQ ID NO: 1744677 - RNA, 16 nt, Homo sapiens
caaguaagaucugaau

SEQ ID NO: 1744678 - RNA, 15 nt, Homo sapiens
uaaaauuugugcugg

SEQ ID NO: 1744679 - RNA, 19 nt, Homo sapiens
uguuaaaggucauaugcac

SEQ ID NO: 1744680 - RNA, 22 nt, Homo sapiens
aaggaacccucaggccacccuc

SEQ ID NO: 1744681 - RNA, 12 nt, Homo sapiens
gcaccagccacc

SEQ ID NO: 1744682 - RNA, 23 nt, Homo sapiens
aggcuggcuugagugaauugugu

SEQ ID NO: 1744683 - RNA, 18 nt, Homo sapiens
aggcgggcggcacgccaa

SEQ ID NO: 1744684 - RNA, 20 nt, Homo sapiens
aaaaggaauccucugugucu

SEQ ID NO: 1744685 - RNA, 15 nt, Homo sapiens
cuuuuccccagggau

SEQ ID NO: 1744686 - RNA, 14 nt, Homo sapiens
cucuagucagcaca

SEQ ID NO: 1744687 - RNA, 20 nt, Homo sapiens
ucucuggguagguguugaaa

SEQ ID NO: 1744688 - RNA, 16 nt, Homo sapiens
aaugucuuacugugau

SEQ ID NO: 1744689 - RNA, 20 nt, Homo sapiens
uaguugcguggacucugcac

SEQ ID NO: 1744690 - RNA, 18 nt, Homo sapiens
aggugagcaggugaugcc

SEQ ID NO: 1744691 - RNA, 11 nt, Homo sapiens
cagcaggcacu

SEQ ID NO: 1744692 - RNA, 18 nt, Homo sapiens
acaucucccuuccaccuc

SEQ ID NO: 1744693 - RNA, 20 nt, Homo sapiens
ugccuggggucugagcauga

SEQ ID NO: 1744694 - RNA, 23 nt, Homo sapiens
acaaccaaccaccuuuccagcca

SEQ ID NO: 1744695 - RNA, 17 nt, Homo sapiens
ugagugaauuacagaca

SEQ ID NO: 1744696 - RNA, 20 nt, Homo sapiens
ugaaucugugcuggccaugg

SEQ ID NO: 1744697 - RNA, 14 nt, Homo sapiens
acucccaugaagcc

SEQ ID NO: 1744698 - RNA, 18 nt, Homo sapiens
gaaggacugaacuccauc

SEQ ID NO: 1744699 - RNA, 14 nt, Homo sapiens
ccaaauuacaagua

SEQ ID NO: 1744700 - RNA, 15 nt, Homo sapiens
acagggcguccucuc

SEQ ID NO: 1744701 - RNA, 12 nt, Homo sapiens
ugacccugagaa

SEQ ID NO: 1744702 - RNA, 15 nt, Homo sapiens
auuuuguugcaucau

SEQ ID NO: 1744703 - RNA, 16 nt, Homo sapiens
uaugcacacacauaua

SEQ ID NO: 1744704 - RNA, 21 nt, Homo sapiens
cagacguccaccucagugcac

SEQ ID NO: 1744705 - RNA, 20 nt, Homo sapiens
caggucucccgggaagccac

SEQ ID NO: 1744706 - RNA, 13 nt, Homo sapiens
uagcuuuacaaau

SEQ ID NO: 1744707 - RNA, 11 nt, Homo sapiens
uagugcugcug

SEQ ID NO: 1744708 - RNA, 15 nt, Homo sapiens
uuaucuuaucuagca

SEQ ID NO: 1744709 - RNA, 14 nt, Homo sapiens
aaauaaaacuuaaa

SEQ ID NO: 1744710 - RNA, 19 nt, Homo sapiens
uaagugagagaaaugaagu

SEQ ID NO: 1744711 - RNA, 20 nt, Homo sapiens
uccuguguguacucugucca

SEQ ID NO: 1744712 - RNA, 12 nt, Homo sapiens
ccuucaccuuca

SEQ ID NO: 1744713 - RNA, 21 nt, Homo sapiens
gcccauggaagucucaaagau

SEQ ID NO: 1744714 - RNA, 22 nt, Homo sapiens
aagcaucccgcuggugccuccc

SEQ ID NO: 1744715 - RNA, 19 nt, Homo sapiens
cuuuuauucuaacuuuuau

SEQ ID NO: 1744716 - RNA, 14 nt, Homo sapiens
cagagugacaucca

SEQ ID NO: 1744717 - RNA, 18 nt, Homo sapiens
uacaacugauugcaacag

SEQ ID NO: 1744718 - RNA, 23 nt, Homo sapiens
uuuauuugagacagagucucacu

SEQ ID NO: 1744719 - RNA, 15 nt, Homo sapiens
uggugccccacagcu

SEQ ID NO: 1744720 - RNA, 13 nt, Homo sapiens
cagugcaguacuc

SEQ ID NO: 1744721 - RNA, 15 nt, Homo sapiens
cauuuguuauucuua

SEQ ID NO: 1744722 - RNA, 13 nt, Homo sapiens
aaaauaaccagua

SEQ ID NO: 1744723 - RNA, 19 nt, Homo sapiens
auuagcaauugacugucac

SEQ ID NO: 1744724 - RNA, 13 nt, Homo sapiens
cugccccuguuga

SEQ ID NO: 1744725 - RNA, 23 nt, Homo sapiens
uggacaacacugauuccuggaga

SEQ ID NO: 1744726 - RNA, 17 nt, Homo sapiens
uauucucacuccaccac

SEQ ID NO: 1744727 - RNA, 15 nt, Homo sapiens
uaguuugcuguugca

SEQ ID NO: 1744728 - RNA, 18 nt, Homo sapiens
aaagugcuucauugacua

SEQ ID NO: 1744729 - RNA, 14 nt, Homo sapiens
caauacagcuucau

SEQ ID NO: 1744730 - RNA, 23 nt, Homo sapiens
ccuacugcugugagcaugacuua

SEQ ID NO: 1744731 - RNA, 17 nt, Homo sapiens
ucauaccagaaagcucu

SEQ ID NO: 1744732 - RNA, 21 nt, Homo sapiens
acuugaugacagacacuucua

SEQ ID NO: 1744733 - RNA, 17 nt, Homo sapiens
guuccugcuccaugacu

SEQ ID NO: 1744734 - RNA, 16 nt, Homo sapiens
cuuccaccaugugcau

SEQ ID NO: 1744735 - RNA, 21 nt, Homo sapiens
acuguauauuuguaugauauu

SEQ ID NO: 1744736 - RNA, 14 nt, Homo sapiens
cgaaaucaguuucu

SEQ ID NO: 1744737 - RNA, 14 nt, Homo sapiens
cgaccacaccagcc

SEQ ID NO: 1744738 - RNA, 16 nt, Homo sapiens
uucuggguccugaaga

SEQ ID NO: 1744739 - RNA, 22 nt, Homo sapiens
caaaucaccaccgacugaagug

SEQ ID NO: 1744740 - RNA, 22 nt, Homo sapiens
augaagcguugccauugaacuc

SEQ ID NO: 1744741 - RNA, 13 nt, Homo sapiens
aacugccagaaca

SEQ ID NO: 1744742 - RNA, 20 nt, Homo sapiens
uucuugauaucuuuccuccc

SEQ ID NO: 1744743 - RNA, 18 nt, Homo sapiens
ugggagguggugucccuu

SEQ ID NO: 1744744 - RNA, 18 nt, Homo sapiens
agaugaaagauucaguga

SEQ ID NO: 1744745 - RNA, 23 nt, Homo sapiens
auuaagcaucacaaaugauauua

SEQ ID NO: 1744746 - RNA, 22 nt, Homo sapiens
cauucagugauuacugucaagg

SEQ ID NO: 1744747 - RNA, 17 nt, Homo sapiens
cuucccaacucacuuug

SEQ ID NO: 1744748 - RNA, 19 nt, Homo sapiens
ucagaagggagcuagccag

SEQ ID NO: 1744749 - RNA, 16 nt, Homo sapiens
uugcuaaaauauaauu

SEQ ID NO: 1744750 - RNA, 19 nt, Homo sapiens
uauuaagucaucaucucca

SEQ ID NO: 1744751 - RNA, 21 nt, Homo sapiens
ucuaugagauagguacuauua

SEQ ID NO: 1744752 - RNA, 19 nt, Homo sapiens
ugaguuucuuagacuuuuc

SEQ ID NO: 1744753 - RNA, 22 nt, Homo sapiens
ccgggccccucucuagggaccc

SEQ ID NO: 1744754 - RNA, 15 nt, Homo sapiens
gaaagccaugaccuu

SEQ ID NO: 1744755 - RNA, 19 nt, Homo sapiens
gaauguuauuuccugagaa

SEQ ID NO: 1744756 - RNA, 21 nt, Homo sapiens
cugcuuuguuuuggcugcucu

SEQ ID NO: 1744757 - RNA, 12 nt, Homo sapiens
guacaaucucaa

SEQ ID NO: 1744758 - RNA, 15 nt, Homo sapiens
aaccacaacugacac

SEQ ID NO: 1744759 - RNA, 21 nt, Homo sapiens
cccaggacauggcugacuuug

SEQ ID NO: 1744760 - RNA, 15 nt, Homo sapiens
ccugaggaguggcag

SEQ ID NO: 1744761 - RNA, 18 nt, Homo sapiens
ggacucucugacaaagug

SEQ ID NO: 1744762 - RNA, 20 nt, Homo sapiens
cucacaucuuuuucacugac

SEQ ID NO: 1744763 - RNA, 21 nt, Homo sapiens
agcucccccaggcuguucucc

SEQ ID NO: 1744764 - RNA, 14 nt, Homo sapiens
ucaccccaccccac

SEQ ID NO: 1744765 - RNA, 14 nt, Homo sapiens
cuaaaccauucacc

SEQ ID NO: 1744766 - RNA, 24 nt, Homo sapiens
gauugagaaauguguagcugcaaa

SEQ ID NO: 1744767 - RNA, 17 nt, Homo sapiens
uuauguaauagauacca

SEQ ID NO: 1744768 - RNA, 21 nt, Homo sapiens
acccuucccccagcaccauuu

SEQ ID NO: 1744769 - RNA, 11 nt, Homo sapiens
gugcgugccug

SEQ ID NO: 1744770 - RNA, 18 nt, Homo sapiens
guuaucuaauauguaaca

SEQ ID NO: 1744771 - RNA, 17 nt, Homo sapiens
aagggcauuuuggcucc

SEQ ID NO: 1744772 - RNA, 16 nt, Homo sapiens
guaguuacagaauucc

SEQ ID NO: 1744773 - RNA, 16 nt, Homo sapiens
aaguagcugcuaccuu

SEQ ID NO: 1744774 - RNA, 15 nt, Homo sapiens
ucaggggaauuucag

SEQ ID NO: 1744775 - RNA, 20 nt, Homo sapiens
ggaagacuguugugcuccau

SEQ ID NO: 1744776 - RNA, 21 nt, Homo sapiens
uaacagguuuguuugugcuuu

SEQ ID NO: 1744777 - RNA, 15 nt, Homo sapiens
caguguucuaugaac

SEQ ID NO: 1744778 - RNA, 14 nt, Homo sapiens
uaaaagccuuggcc

SEQ ID NO: 1744779 - RNA, 18 nt, Homo sapiens
cacugggagcugcuccua

SEQ ID NO: 1744780 - RNA, 18 nt, Homo sapiens
cagacagaccucaaggga

SEQ ID NO: 1744781 - RNA, 19 nt, Homo sapiens
agaguacaccccaacagca

SEQ ID NO: 1744782 - RNA, 23 nt, Homo sapiens
accucaagugccuuauucucaca

SEQ ID NO: 1744783 - RNA, 23 nt, Homo sapiens
aaggguaggauguugcuucugaa

SEQ ID NO: 1744784 - RNA, 10 nt, Homo sapiens
ccacauaaca

SEQ ID NO: 1744785 - RNA, 22 nt, Homo sapiens
agcacaaucacuaaacuuuauu

SEQ ID NO: 1744786 - RNA, 15 nt, Homo sapiens
cugagaccucaauga

SEQ ID NO: 1744787 - RNA, 17 nt, Homo sapiens
ggggagggggguuuugu

SEQ ID NO: 1744788 - RNA, 15 nt, Homo sapiens
caaaguaagccucac

SEQ ID NO: 1744789 - RNA, 14 nt, Homo sapiens
agaggggaggccaa

SEQ ID NO: 1744790 - RNA, 19 nt, Homo sapiens
uccucaucugggucuccca

SEQ ID NO: 1744791 - RNA, 12 nt, Homo sapiens
ggccagcccgga

SEQ ID NO: 1744792 - RNA, 14 nt, Homo sapiens
uguuuuguauacaa

SEQ ID NO: 1744793 - RNA, 21 nt, Homo sapiens
cagagccuccuagauguaaca

SEQ ID NO: 1744794 - RNA, 21 nt, Homo sapiens
cuucuuguaauauuucuucaa

SEQ ID NO: 1744795 - RNA, 19 nt, Homo sapiens
auggugaggcgaaggccag

SEQ ID NO: 1744796 - RNA, 18 nt, Homo sapiens
acggcuacuacccggcgc

SEQ ID NO: 1744797 - RNA, 18 nt, Homo sapiens
ugaggacuuaauuuacuu

SEQ ID NO: 1744798 - RNA, 24 nt, Homo sapiens
gcagacugcuaguguucugucuaa

SEQ ID NO: 1744799 - RNA, 19 nt, Homo sapiens
cuaacacgcacagcugaaa

SEQ ID NO: 1744800 - RNA, 16 nt, Homo sapiens
cagauucaagagccag

SEQ ID NO: 1744801 - RNA, 16 nt, Homo sapiens
uccacccccagcugcu

SEQ ID NO: 1744802 - RNA, 23 nt, Homo sapiens
uggagguggaaaagcaacauuca

SEQ ID NO: 1744803 - RNA, 22 nt, Homo sapiens
uuguaacuagauagaacauuaa

SEQ ID NO: 1744804 - RNA, 20 nt, Homo sapiens
gucacaugcccccacuuccc

SEQ ID NO: 1744805 - RNA, 19 nt, Homo sapiens
ucacaauuuacgaaaccaa

SEQ ID NO: 1744806 - RNA, 20 nt, Homo sapiens
cugaucugcaguuuuugccu

SEQ ID NO: 1744807 - RNA, 20 nt, Homo sapiens
auauauuuucauccuauaag

SEQ ID NO: 1744808 - RNA, 20 nt, Homo sapiens
ugauauugaaagguagcaau

SEQ ID NO: 1744809 - RNA, 18 nt, Homo sapiens
ggcugccccucucaccaa

SEQ ID NO: 1744810 - RNA, 14 nt, Homo sapiens
ccugcuacacaaaa

SEQ ID NO: 1744811 - RNA, 14 nt, Homo sapiens
agucucagcugcug

SEQ ID NO: 1744812 - RNA, 20 nt, Homo sapiens
ugaagcaagcuguguuacuu

SEQ ID NO: 1744813 - RNA, 20 nt, Homo sapiens
auguaucccaacuccuauaa

SEQ ID NO: 1744814 - RNA, 22 nt, Homo sapiens
auucauauuuacuucuuauaca

SEQ ID NO: 1744815 - RNA, 23 nt, Homo sapiens
cucagucuuaaaaaaauaugccu

SEQ ID NO: 1744816 - RNA, 15 nt, Homo sapiens
uuuucuacaguacau

SEQ ID NO: 1744817 - RNA, 16 nt, Homo sapiens
uauuugcacaugggau

SEQ ID NO: 1744818 - RNA, 19 nt, Homo sapiens
cugacuuuaaaaggauuaa

SEQ ID NO: 1744819 - RNA, 13 nt, Homo sapiens
auagcaucucagg

SEQ ID NO: 1744820 - RNA, 13 nt, Homo sapiens
aauauagugcaau

SEQ ID NO: 1744821 - RNA, 18 nt, Homo sapiens
gauguaggguaaggugcc

SEQ ID NO: 1744822 - RNA, 13 nt, Homo sapiens
cuugaacuaggau

SEQ ID NO: 1744823 - RNA, 19 nt, Homo sapiens
cuuuuauuuuacacagaaa

SEQ ID NO: 1744824 - RNA, 22 nt, Homo sapiens
aagugagagagacaagaagcaa

SEQ ID NO: 1744825 - RNA, 15 nt, Homo sapiens
cuuuauaacccaaaa

SEQ ID NO: 1744826 - RNA, 17 nt, Homo sapiens
caugcucauguguacac

SEQ ID NO: 1744827 - RNA, 22 nt, Homo sapiens
auuuccuuuguugucuacauua

SEQ ID NO: 1744828 - RNA, 13 nt, Homo sapiens
uaaggauagggaa

SEQ ID NO: 1744829 - RNA, 20 nt, Homo sapiens
aagaccuucugaagaucuca

SEQ ID NO: 1744830 - RNA, 23 nt, Homo sapiens
gaaaagcacauuuuaaaaaccag

SEQ ID NO: 1744831 - RNA, 21 nt, Homo sapiens
aggaccacucccuaaguaauc

SEQ ID NO: 1744832 - RNA, 12 nt, Homo sapiens
uaagaagcucug

SEQ ID NO: 1744833 - RNA, 12 nt, Homo sapiens
aauaaagcacaa

SEQ ID NO: 1744834 - RNA, 17 nt, Homo sapiens
acuguggcacuuuucac

SEQ ID NO: 1744835 - RNA, 19 nt, Homo sapiens
uccccucccccagaccucc

SEQ ID NO: 1744836 - RNA, 13 nt, Homo sapiens
acaagaugagauu

SEQ ID NO: 1744837 - RNA, 20 nt, Homo sapiens
gacucugguuucucauucuu

SEQ ID NO: 1744838 - RNA, 15 nt, Homo sapiens
aaccagcaucucugu

SEQ ID NO: 1744839 - RNA, 13 nt, Homo sapiens
caaaacaguaaaa

SEQ ID NO: 1744840 - RNA, 21 nt, Homo sapiens
cagcuauuuagaagcaucauc

SEQ ID NO: 1744841 - RNA, 16 nt, Homo sapiens
aggugugccaaacuac

SEQ ID NO: 1744842 - RNA, 16 nt, Homo sapiens
caaacugaaagaucug

SEQ ID NO: 1744843 - RNA, 13 nt, Homo sapiens
aacagaacagaca

SEQ ID NO: 1744844 - RNA, 17 nt, Homo sapiens
acccuucagauuugccu

SEQ ID NO: 1744845 - RNA, 14 nt, Homo sapiens
guagagucacugac

SEQ ID NO: 1744846 - RNA, 21 nt, Homo sapiens
agaggcuauggaacuuaacac

SEQ ID NO: 1744847 - RNA, 18 nt, Homo sapiens
ccuuucauaaaaaccaaa

SEQ ID NO: 1744848 - RNA, 13 nt, Homo sapiens
ucuugacagugag

SEQ ID NO: 1744849 - RNA, 21 nt, Homo sapiens
ucagugcaaagauuugcuuua

SEQ ID NO: 1744850 - RNA, 15 nt, Homo sapiens
uucuuccccauggaa

SEQ ID NO: 1744851 - RNA, 16 nt, Homo sapiens
gcuggaaugugccaca

SEQ ID NO: 1744852 - RNA, 15 nt, Homo sapiens
agagucuugcucugu

SEQ ID NO: 1744853 - RNA, 19 nt, Homo sapiens
agaagucauauguugucuu

SEQ ID NO: 1744854 - RNA, 19 nt, Homo sapiens
aacugccucgaaacacaga

SEQ ID NO: 1744855 - RNA, 19 nt, Homo sapiens
gugugagcaucucugugua

SEQ ID NO: 1744856 - RNA, 15 nt, Homo sapiens
ucaacauuuaaucaa

SEQ ID NO: 1744857 - RNA, 15 nt, Homo sapiens
cugguaaucagcaaa

SEQ ID NO: 1744858 - RNA, 14 nt, Homo sapiens
cuaaaaaguuccau

SEQ ID NO: 1744859 - RNA, 18 nt, Homo sapiens
ugcacaccuaagcccaaa

SEQ ID NO: 1744860 - RNA, 22 nt, Homo sapiens
ccacauaaacacuucuccuuaa

SEQ ID NO: 1744861 - RNA, 18 nt, Homo sapiens
gagauauggacucucuaa

SEQ ID NO: 1744862 - RNA, 23 nt, Homo sapiens
caaauuuuucacccauuuacaca

SEQ ID NO: 1744863 - RNA, 14 nt, Homo sapiens
acaaagaugacugu

SEQ ID NO: 1744864 - RNA, 21 nt, Homo sapiens
agauaauuuauuaaagguggu

SEQ ID NO: 1744865 - RNA, 22 nt, Homo sapiens
uuuuugcccagaaaguccagcu

SEQ ID NO: 1744866 - RNA, 10 nt, Homo sapiens
aaaagcuuuc

SEQ ID NO: 1744867 - RNA, 16 nt, Homo sapiens
acucuucuuugcugca

SEQ ID NO: 1744868 - RNA, 13 nt, Homo sapiens
ucagucaagcugu

SEQ ID NO: 1744869 - RNA, 21 nt, Homo sapiens
cugcccuuuuaauacagggac

SEQ ID NO: 1744870 - RNA, 11 nt, Homo sapiens
uucucugccaa

SEQ ID NO: 1744871 - RNA, 23 nt, Homo sapiens
ugccccacccaacuccacagggc

SEQ ID NO: 1744872 - RNA, 11 nt, Homo sapiens
ucuuacuuugu

SEQ ID NO: 1744873 - RNA, 14 nt, Homo sapiens
aggguggagaggga

SEQ ID NO: 1744874 - RNA, 20 nt, Homo sapiens
ggccuaagggccacauccca

SEQ ID NO: 1744875 - RNA, 20 nt, Homo sapiens
auugguauacuuuugcuuca

SEQ ID NO: 1744876 - RNA, 16 nt, Homo sapiens
aaugaaccuugcuauc

SEQ ID NO: 1744877 - RNA, 15 nt, Homo sapiens
ggaggccagugccau

SEQ ID NO: 1744878 - RNA, 17 nt, Homo sapiens
cagccaacaaacauaga

SEQ ID NO: 1744879 - RNA, 23 nt, Homo sapiens
gacugaauauggacccugcugaa

SEQ ID NO: 1744880 - RNA, 14 nt, Homo sapiens
cacugugggaccaa

SEQ ID NO: 1744881 - RNA, 17 nt, Homo sapiens
ccuagucuggacugcuu

SEQ ID NO: 1744882 - RNA, 20 nt, Homo sapiens
uaucugggcaugguggcaca

SEQ ID NO: 1744883 - RNA, 23 nt, Homo sapiens
ugcacaugguucaccaugcagug

SEQ ID NO: 1744884 - RNA, 22 nt, Homo sapiens
gugagaagaaagaaacuugaua

SEQ ID NO: 1744885 - RNA, 19 nt, Homo sapiens
ccuguaauuuuucugggaa

SEQ ID NO: 1744886 - RNA, 15 nt, Homo sapiens
gaugaggcacuggaa

SEQ ID NO: 1744887 - RNA, 17 nt, Homo sapiens
caagguuucccagugag

SEQ ID NO: 1744888 - RNA, 18 nt, Homo sapiens
uuauuaccccacacaucc

SEQ ID NO: 1744889 - RNA, 18 nt, Homo sapiens
aaacagguauauacuuug

SEQ ID NO: 1744890 - RNA, 16 nt, Homo sapiens
auuccuuagauaccuu

SEQ ID NO: 1744891 - RNA, 23 nt, Homo sapiens
ggcuugcuuucuucuccugugau

SEQ ID NO: 1744892 - RNA, 22 nt, Homo sapiens
gcucuaggcuguucuguagcuu

SEQ ID NO: 1744893 - RNA, 17 nt, Homo sapiens
acauucccuaucaaaac

SEQ ID NO: 1744894 - RNA, 22 nt, Homo sapiens
uccuguauauuccauguauaag

SEQ ID NO: 1744895 - RNA, 22 nt, Homo sapiens
acugccucuggaauugcucaag

SEQ ID NO: 1744896 - RNA, 19 nt, Homo sapiens
uagaacuaaaguaucugag

SEQ ID NO: 1744897 - RNA, 16 nt, Homo sapiens
aaauuaaaugcauguc

SEQ ID NO: 1744898 - RNA, 17 nt, Homo sapiens
acccaacuugccaaaau

SEQ ID NO: 1744899 - RNA, 17 nt, Homo sapiens
guuugcugacaggugau

SEQ ID NO: 1744900 - RNA, 21 nt, Homo sapiens
uguugaaucuauuucacuuau

SEQ ID NO: 1744901 - RNA, 19 nt, Homo sapiens
gucagaguggcgugagcug

SEQ ID NO: 1744902 - RNA, 14 nt, Homo sapiens
uacaaaaggcauuu

SEQ ID NO: 1744903 - RNA, 23 nt, Homo sapiens
uuagucuguuuucuaaagccagg

SEQ ID NO: 1744904 - RNA, 19 nt, Homo sapiens
accuugacuucugcccaaa

SEQ ID NO: 1744905 - RNA, 16 nt, Homo sapiens
uaccaaaauguugcug

SEQ ID NO: 1744906 - RNA, 23 nt, Homo sapiens
ucagcagcuauuugaaugagaug

SEQ ID NO: 1744907 - RNA, 18 nt, Homo sapiens
aaggaugccuuagcaugu

SEQ ID NO: 1744908 - RNA, 17 nt, Homo sapiens
ucucaaaguuugacagg

SEQ ID NO: 1744909 - RNA, 13 nt, Homo sapiens
uguaaaugugcuu

SEQ ID NO: 1744910 - RNA, 12 nt, Homo sapiens
acuguacuggcc

SEQ ID NO: 1744911 - RNA, 23 nt, Homo sapiens
ucauacucuguguaaucucugau

SEQ ID NO: 1744912 - RNA, 13 nt, Homo sapiens
ucacauccauugu

SEQ ID NO: 1744913 - RNA, 18 nt, Homo sapiens
ugcuauguguacugucuu

SEQ ID NO: 1744914 - RNA, 16 nt, Homo sapiens
acgccaucuccacucu

SEQ ID NO: 1744915 - RNA, 16 nt, Homo sapiens
cuauucugagaaaaca

SEQ ID NO: 1744916 - RNA, 22 nt, Homo sapiens
uucauuaauuacccuacuuuca

SEQ ID NO: 1744917 - RNA, 14 nt, Homo sapiens
agguaacuacugcu

SEQ ID NO: 1744918 - RNA, 15 nt, Homo sapiens
acucacuuguaagaa

SEQ ID NO: 1744919 - RNA, 19 nt, Homo sapiens
guuccuccucuccuacucg

SEQ ID NO: 1744920 - RNA, 15 nt, Homo sapiens
augcagguucagguc

SEQ ID NO: 1744921 - RNA, 18 nt, Homo sapiens
aauuauuaugucucaaaa

SEQ ID NO: 1744922 - RNA, 20 nt, Homo sapiens
ugcaccccuuuccuccccau

SEQ ID NO: 1744923 - RNA, 18 nt, Homo sapiens
cauuauuuugauugauuu

SEQ ID NO: 1744924 - RNA, 22 nt, Homo sapiens
acacauuuggaaugcacacagc

SEQ ID NO: 1744925 - RNA, 14 nt, Homo sapiens
gccuugcaacccaa

SEQ ID NO: 1744926 - RNA, 17 nt, Homo sapiens
uuugaaugcuuaauuca

SEQ ID NO: 1744927 - RNA, 23 nt, Homo sapiens
gcccugugcccccugaaacagcu

SEQ ID NO: 1744928 - RNA, 17 nt, Homo sapiens
aauccagagagcuuaaa

SEQ ID NO: 1744929 - RNA, 17 nt, Homo sapiens
uggcccuugcuuaccuc

SEQ ID NO: 1744930 - RNA, 13 nt, Homo sapiens
guucccauuauua

SEQ ID NO: 1744931 - RNA, 19 nt, Homo sapiens
aucuucaggugaacacuua

SEQ ID NO: 1744932 - RNA, 21 nt, Homo sapiens
cacccauaccagcuagaauca

SEQ ID NO: 1744933 - RNA, 16 nt, Homo sapiens
agucagagaucuuggu

SEQ ID NO: 1744934 - RNA, 16 nt, Homo sapiens
ugcuuaaucugagaau

SEQ ID NO: 1744935 - RNA, 17 nt, Homo sapiens
auaacagauccuuucaa

SEQ ID NO: 1744936 - RNA, 18 nt, Homo sapiens
gccacuugcacugugcuu

SEQ ID NO: 1744937 - RNA, 18 nt, Homo sapiens
ucccuguguugucucuag

SEQ ID NO: 1744938 - RNA, 14 nt, Homo sapiens
uaagucaucaucuc

SEQ ID NO: 1744939 - RNA, 18 nt, Homo sapiens
uccagcuaagccugauga

SEQ ID NO: 1744940 - RNA, 14 nt, Homo sapiens
auuaaaauuuuccu

SEQ ID NO: 1744941 - RNA, 15 nt, Homo sapiens
ugggagauguggaaa

SEQ ID NO: 1744942 - RNA, 16 nt, Homo sapiens
caauauaucaauguaa

SEQ ID NO: 1744943 - RNA, 20 nt, Homo sapiens
aaacauagaaagacaugggc

SEQ ID NO: 1744944 - RNA, 15 nt, Homo sapiens
ucagaaugucaauga

SEQ ID NO: 1744945 - RNA, 17 nt, Homo sapiens
cagccuugcacacccac

SEQ ID NO: 1744946 - RNA, 18 nt, Homo sapiens
cucuccccagcccagaga

SEQ ID NO: 1744947 - RNA, 19 nt, Homo sapiens
cccguggcuuggcaucugu

SEQ ID NO: 1744948 - RNA, 21 nt, Homo sapiens
ccuuuuaauggaugguugaau

SEQ ID NO: 1744949 - RNA, 21 nt, Homo sapiens
augauuuuaaguuucucugca

SEQ ID NO: 1744950 - RNA, 22 nt, Homo sapiens
cugggguacuacucuccagcuu

SEQ ID NO: 1744951 - RNA, 16 nt, Homo sapiens
gcagagggcaggggug

SEQ ID NO: 1744952 - RNA, 18 nt, Homo sapiens
gaucaguaugcuguuuua

SEQ ID NO: 1744953 - RNA, 16 nt, Homo sapiens
guucacauagugaaau

SEQ ID NO: 1744954 - RNA, 17 nt, Homo sapiens
ucauggaaaagcccagu

SEQ ID NO: 1744955 - RNA, 14 nt, Homo sapiens
aggcaggguggugu

SEQ ID NO: 1744956 - RNA, 15 nt, Homo sapiens
acucacuuguucuca

SEQ ID NO: 1744957 - RNA, 19 nt, Homo sapiens
gaucaucuuggaacugcau

SEQ ID NO: 1744958 - RNA, 15 nt, Homo sapiens
agggcuacagcaucc

SEQ ID NO: 1744959 - RNA, 14 nt, Homo sapiens
cagccaagugugac

SEQ ID NO: 1744960 - RNA, 14 nt, Homo sapiens
ugcucccugauuaa

SEQ ID NO: 1744961 - RNA, 20 nt, Homo sapiens
cauugauucguaugccagcu

SEQ ID NO: 1744962 - RNA, 13 nt, Homo sapiens
ucuaauccuaucu

SEQ ID NO: 1744963 - RNA, 19 nt, Homo sapiens
gguacuugagggaugcccg

SEQ ID NO: 1744964 - RNA, 17 nt, Homo sapiens
aacccuacuuucuggaa

SEQ ID NO: 1744965 - RNA, 19 nt, Homo sapiens
ugcaguggcccccacagaa

SEQ ID NO: 1744966 - RNA, 14 nt, Homo sapiens
gucuuuagugcucc

SEQ ID NO: 1744967 - RNA, 13 nt, Homo sapiens
gaucagaucaaua

SEQ ID NO: 1744968 - RNA, 18 nt, Homo sapiens
ugucuauuuucucaguca

SEQ ID NO: 1744969 - RNA, 15 nt, Homo sapiens
guagagucaucucca

SEQ ID NO: 1744970 - RNA, 18 nt, Homo sapiens
uagggcuuauccaugccu

SEQ ID NO: 1744971 - RNA, 15 nt, Homo sapiens
auggcgcgaucucag

SEQ ID NO: 1744972 - RNA, 18 nt, Homo sapiens
gucuacuaaauaauacuu

SEQ ID NO: 1744973 - RNA, 16 nt, Homo sapiens
aauaucccuacaugua

SEQ ID NO: 1744974 - RNA, 21 nt, Homo sapiens
uugggcagagcuggacaaggu

SEQ ID NO: 1744975 - RNA, 18 nt, Homo sapiens
aaaaggaaaaccaucucu

SEQ ID NO: 1744976 - RNA, 19 nt, Homo sapiens
aagucuugugugugagugu

SEQ ID NO: 1744977 - RNA, 22 nt, Homo sapiens
agacucuugcuccugcuucucc

SEQ ID NO: 1744978 - RNA, 19 nt, Homo sapiens
caaccugccaccaaaagaa

SEQ ID NO: 1744979 - RNA, 18 nt, Homo sapiens
uacauuuuguuguaaaaa

SEQ ID NO: 1744980 - RNA, 22 nt, Homo sapiens
uaacucuuacagcuuugccuug

SEQ ID NO: 1744981 - RNA, 19 nt, Homo sapiens
caaagauccacccaaauau

SEQ ID NO: 1744982 - RNA, 18 nt, Homo sapiens
cugcuuaaaauaagcaaa

SEQ ID NO: 1744983 - RNA, 22 nt, Homo sapiens
gacugguuuuaaacagugcuuu

SEQ ID NO: 1744984 - RNA, 16 nt, Homo sapiens
cugaggcccugugaua

SEQ ID NO: 1744985 - RNA, 20 nt, Homo sapiens
cugaucccugcucucugagu

SEQ ID NO: 1744986 - RNA, 22 nt, Homo sapiens
gugcagcuccucagcggcucca

SEQ ID NO: 1744987 - RNA, 13 nt, Homo sapiens
auuuuuaaacuug

SEQ ID NO: 1744988 - RNA, 14 nt, Homo sapiens
cugaauuggcagga

SEQ ID NO: 1744989 - RNA, 16 nt, Homo sapiens
acuguccacaucugcc

SEQ ID NO: 1744990 - RNA, 17 nt, Homo sapiens
auuuauuaguauucuaa

SEQ ID NO: 1744991 - RNA, 17 nt, Homo sapiens
auuuugggaaaaaaaca

SEQ ID NO: 1744992 - RNA, 23 nt, Homo sapiens
gaauggcucacuauggugccaau

SEQ ID NO: 1744993 - RNA, 15 nt, Homo sapiens
acaaaaaaaccucuu

SEQ ID NO: 1744994 - RNA, 22 nt, Homo sapiens
uuaaaauauauguucugcaaga

SEQ ID NO: 1744995 - RNA, 14 nt, Homo sapiens
uuguuuccaaaaac

SEQ ID NO: 1744996 - RNA, 12 nt, Homo sapiens
ccaaauucccug

SEQ ID NO: 1744997 - RNA, 19 nt, Homo sapiens
gccccguggugacauuucc

SEQ ID NO: 1744998 - RNA, 22 nt, Homo sapiens
agccacuuuuagcuacugcuaa

SEQ ID NO: 1744999 - RNA, 21 nt, Homo sapiens
ccuuccuggucuuugaauaaa

SEQ ID NO: 1745000 - RNA, 18 nt, Homo sapiens
cucacccuguaccacaaa

SEQ ID NO: 1745001 - RNA, 17 nt, Homo sapiens
acaagaaucacuugaac

SEQ ID NO: 1745002 - RNA, 16 nt, Homo sapiens
ccuuccugacugggaa

SEQ ID NO: 1745003 - RNA, 12 nt, Homo sapiens
cuuucauccagc

SEQ ID NO: 1745004 - RNA, 21 nt, Homo sapiens
caaaaauaaaaggaaaaccag

SEQ ID NO: 1745005 - RNA, 21 nt, Homo sapiens
ucucuauagagccaaguccaa

SEQ ID NO: 1745006 - RNA, 15 nt, Homo sapiens
acccuggauuugcau

SEQ ID NO: 1745007 - RNA, 20 nt, Homo sapiens
uuccugacaaaaguuccaua

SEQ ID NO: 1745008 - RNA, 20 nt, Homo sapiens
uuggaacuggaggcagggaa

SEQ ID NO: 1745009 - RNA, 15 nt, Homo sapiens
ccaagcugguggcuc

SEQ ID NO: 1745010 - RNA, 18 nt, Homo sapiens
aaaacaugauuguuuaca

SEQ ID NO: 1745011 - RNA, 22 nt, Homo sapiens
agaagacauggaugaucuggga

SEQ ID NO: 1745012 - RNA, 19 nt, Homo sapiens
gcugccagaugauuguuca

SEQ ID NO: 1745013 - RNA, 16 nt, Homo sapiens
ucucaggcauggauga

SEQ ID NO: 1745014 - RNA, 20 nt, Homo sapiens
guggccaggagccaugacag

SEQ ID NO: 1745015 - RNA, 19 nt, Homo sapiens
ucucugaacacacauugcu

SEQ ID NO: 1745016 - RNA, 20 nt, Homo sapiens
cagccuggccccugugcacc

SEQ ID NO: 1745017 - RNA, 14 nt, Homo sapiens
uaaucugcugccau

SEQ ID NO: 1745018 - RNA, 16 nt, Homo sapiens
cuggccuuuaagguca

SEQ ID NO: 1745019 - RNA, 16 nt, Homo sapiens
cagagaaaucacugaa

SEQ ID NO: 1745020 - RNA, 21 nt, Homo sapiens
agaugcuacuucccacuguau

SEQ ID NO: 1745021 - RNA, 15 nt, Homo sapiens
aucuguuuucuggaa

SEQ ID NO: 1745022 - RNA, 16 nt, Homo sapiens
gagaccuaacugccgc

SEQ ID NO: 1745023 - RNA, 23 nt, Homo sapiens
cacugugcaaauauaucugcuau

SEQ ID NO: 1745024 - RNA, 20 nt, Homo sapiens
auaauguguaguucauguaa

SEQ ID NO: 1745025 - RNA, 11 nt, Homo sapiens
gacacaacuca

SEQ ID NO: 1745026 - RNA, 23 nt, Homo sapiens
ucccagguuuaagcgauucucau

SEQ ID NO: 1745027 - RNA, 22 nt, Homo sapiens
gaccaauaaccaugcccaagaa

SEQ ID NO: 1745028 - RNA, 17 nt, Homo sapiens
ugucagugucacuggau

SEQ ID NO: 1745029 - RNA, 20 nt, Homo sapiens
ggcauaucuuguuguucagu

SEQ ID NO: 1745030 - RNA, 19 nt, Homo sapiens
uauauauuuguaacauugu

SEQ ID NO: 1745031 - RNA, 19 nt, Homo sapiens
uccuccuuugcucuuggga

SEQ ID NO: 1745032 - RNA, 20 nt, Homo sapiens
caaagccuucauugccuuaa

SEQ ID NO: 1745033 - RNA, 15 nt, Homo sapiens
uuaaacuuauuucaa

SEQ ID NO: 1745034 - RNA, 22 nt, Homo sapiens
cuaaagucaucaugaacuggcu

SEQ ID NO: 1745035 - RNA, 21 nt, Homo sapiens
ugcccugcccuuggcacccaa

SEQ ID NO: 1745036 - RNA, 16 nt, Homo sapiens
acaguaggauguggaa

SEQ ID NO: 1745037 - RNA, 14 nt, Homo sapiens
gugaauuaggcugu

SEQ ID NO: 1745038 - RNA, 17 nt, Homo sapiens
uuacuuuuucuuguauu

SEQ ID NO: 1745039 - RNA, 19 nt, Homo sapiens
auccagaggguugugauuu

SEQ ID NO: 1745040 - RNA, 16 nt, Homo sapiens
gagccuugguguacag

SEQ ID NO: 1745041 - RNA, 19 nt, Homo sapiens
accugcugagggaccagcc

SEQ ID NO: 1745042 - RNA, 18 nt, Homo sapiens
ccuguucauuugaagaaa

SEQ ID NO: 1745043 - RNA, 19 nt, Homo sapiens
uggugugaaaauacacuua

SEQ ID NO: 1745044 - RNA, 21 nt, Homo sapiens
ugauuauuuuuuauacuguau

SEQ ID NO: 1745045 - RNA, 12 nt, Homo sapiens
agaaaaacauuu

SEQ ID NO: 1745046 - RNA, 12 nt, Homo sapiens
agagccucagug

SEQ ID NO: 1745047 - RNA, 17 nt, Homo sapiens
aggaggcagagguugca

SEQ ID NO: 1745048 - RNA, 21 nt, Homo sapiens
aucaguuuuguauaacuuaaa

SEQ ID NO: 1745049 - RNA, 12 nt, Homo sapiens
cuaaauccauua

SEQ ID NO: 1745050 - RNA, 17 nt, Homo sapiens
cagauuguuaucuauca

SEQ ID NO: 1745051 - RNA, 17 nt, Homo sapiens
agaaaauggaaugcuac

SEQ ID NO: 1745052 - RNA, 14 nt, Homo sapiens
ucauugaagcuuug

SEQ ID NO: 1745053 - RNA, 14 nt, Homo sapiens
ucuccuaagcaccu

SEQ ID NO: 1745054 - RNA, 23 nt, Homo sapiens
caucuuuuguuaaguucaccgua

SEQ ID NO: 1745055 - RNA, 18 nt, Homo sapiens
gaagcccaugcuuuccca

SEQ ID NO: 1745056 - RNA, 15 nt, Homo sapiens
ccaaggaaugaucca

SEQ ID NO: 1745057 - RNA, 14 nt, Homo sapiens
auuuugaccuugua

SEQ ID NO: 1745058 - RNA, 15 nt, Homo sapiens
aguccuucccuuuca

SEQ ID NO: 1745059 - RNA, 19 nt, Homo sapiens
uucacaaaguuuguucccu

SEQ ID NO: 1745060 - RNA, 16 nt, Homo sapiens
ccauagguacauugga

SEQ ID NO: 1745061 - RNA, 23 nt, Homo sapiens
acgaggucuugugauauugccca

SEQ ID NO: 1745062 - RNA, 22 nt, Homo sapiens
cuacaucaucuccaaccgguca

SEQ ID NO: 1745063 - RNA, 14 nt, Homo sapiens
aucaugaugaugau

SEQ ID NO: 1745064 - RNA, 13 nt, Homo sapiens
uaaauaugcagug

SEQ ID NO: 1745065 - RNA, 18 nt, Homo sapiens
auucuuuuuucuauucaa

SEQ ID NO: 1745066 - RNA, 19 nt, Homo sapiens
auuacuuuuccacaaauca

SEQ ID NO: 1745067 - RNA, 15 nt, Homo sapiens
auauuaaaacacuua

SEQ ID NO: 1745068 - RNA, 17 nt, Homo sapiens
uugaaauuaaagcugcc

SEQ ID NO: 1745069 - RNA, 16 nt, Homo sapiens
uguuagguuacagauu

SEQ ID NO: 1745070 - RNA, 18 nt, Homo sapiens
ugugaauagaacucugaa

SEQ ID NO: 1745071 - RNA, 18 nt, Homo sapiens
uuguuauuuuugucucga

SEQ ID NO: 1745072 - RNA, 11 nt, Homo sapiens
uaugcauuuga

SEQ ID NO: 1745073 - RNA, 17 nt, Homo sapiens
aaggaaagaggcucugg

SEQ ID NO: 1745074 - RNA, 19 nt, Homo sapiens
agggucuagaggccugaaa

SEQ ID NO: 1745075 - RNA, 14 nt, Homo sapiens
ucacuugagaccag

SEQ ID NO: 1745076 - RNA, 23 nt, Homo sapiens
guuucguguguaaagagagcaag

SEQ ID NO: 1745077 - RNA, 14 nt, Homo sapiens
acucucucuuauca

SEQ ID NO: 1745078 - RNA, 18 nt, Homo sapiens
cacgucccgggcacuguc

SEQ ID NO: 1745079 - RNA, 18 nt, Homo sapiens
caagacccccagcacuug

SEQ ID NO: 1745080 - RNA, 22 nt, Homo sapiens
gagucagccaugucugugcugu

SEQ ID NO: 1745081 - RNA, 23 nt, Homo sapiens
aacugcugccaacuccaugucag

SEQ ID NO: 1745082 - RNA, 17 nt, Homo sapiens
aggaauuaaauaaugua

SEQ ID NO: 1745083 - RNA, 15 nt, Homo sapiens
ugccaggcacaggca

SEQ ID NO: 1745084 - RNA, 19 nt, Homo sapiens
acaugaugauuaagugcac

SEQ ID NO: 1745085 - RNA, 14 nt, Homo sapiens
gguaguguucagua

SEQ ID NO: 1745086 - RNA, 15 nt, Homo sapiens
ugcuggaaaaucugu

SEQ ID NO: 1745087 - RNA, 13 nt, Homo sapiens
ugccccuugaaag

SEQ ID NO: 1745088 - RNA, 21 nt, Homo sapiens
caggguuagcucacgugucuu

SEQ ID NO: 1745089 - RNA, 14 nt, Homo sapiens
aggaugggcacugc

SEQ ID NO: 1745090 - RNA, 16 nt, Homo sapiens
uucaagccugugaaua

SEQ ID NO: 1745091 - RNA, 22 nt, Homo sapiens
auuuccuuaaauguuuugccag

SEQ ID NO: 1745092 - RNA, 20 nt, Homo sapiens
auuucucuauguuuauucua

SEQ ID NO: 1745093 - RNA, 14 nt, Homo sapiens
uggugggucagggg

SEQ ID NO: 1745094 - RNA, 14 nt, Homo sapiens
gacccaaaugcaaa

SEQ ID NO: 1745095 - RNA, 14 nt, Homo sapiens
gauccaaauguaaa

SEQ ID NO: 1745096 - RNA, 13 nt, Homo sapiens
cagucacuggaaa

SEQ ID NO: 1745097 - RNA, 13 nt, Homo sapiens
accaaguucucau

SEQ ID NO: 1745098 - RNA, 16 nt, Homo sapiens
cagagugaccagcaca

SEQ ID NO: 1745099 - RNA, 16 nt, Homo sapiens
agcaaccuucuugccu

SEQ ID NO: 1745100 - RNA, 16 nt, Homo sapiens
cugucgcccuucuccc

SEQ ID NO: 1745101 - RNA, 14 nt, Homo sapiens
cuuucacuaugucc

SEQ ID NO: 1745102 - RNA, 18 nt, Homo sapiens
ccaaucggagacaaaagc

SEQ ID NO: 1745103 - RNA, 16 nt, Homo sapiens
gggcucucugugcaag

SEQ ID NO: 1745104 - RNA, 20 nt, Homo sapiens
ugaccauaucacaagugauu

SEQ ID NO: 1745105 - RNA, 12 nt, Homo sapiens
ccacccaugcca

SEQ ID NO: 1745106 - RNA, 14 nt, Homo sapiens
aaccacuguacaca

SEQ ID NO: 1745107 - RNA, 15 nt, Homo sapiens
gcagugauacaugua

SEQ ID NO: 1745108 - RNA, 19 nt, Homo sapiens
aguugcagugagcagggug

SEQ ID NO: 1745109 - RNA, 17 nt, Homo sapiens
uuagauuuugaaugaua

SEQ ID NO: 1745110 - RNA, 19 nt, Homo sapiens
caaacuugggcccuucccu

SEQ ID NO: 1745111 - RNA, 12 nt, Homo sapiens
ugucuugcugag

SEQ ID NO: 1745112 - RNA, 17 nt, Homo sapiens
aagaaagacuccuuucc

SEQ ID NO: 1745113 - RNA, 20 nt, Homo sapiens
uccaguagugggaucaucca

SEQ ID NO: 1745114 - RNA, 23 nt, Homo sapiens
gacaggcuggguccugccagcug

SEQ ID NO: 1745115 - RNA, 13 nt, Homo sapiens
uacuugggucaca

SEQ ID NO: 1745116 - RNA, 16 nt, Homo sapiens
cuggugccaccucaga

SEQ ID NO: 1745117 - RNA, 14 nt, Homo sapiens
caaauaaacuuaca

SEQ ID NO: 1745118 - RNA, 20 nt, Homo sapiens
uccagguaccuugaccuuug

SEQ ID NO: 1745119 - RNA, 15 nt, Homo sapiens
cuuuuauuuggugug

SEQ ID NO: 1745120 - RNA, 22 nt, Homo sapiens
gauccaucuuaacugaggcuca

SEQ ID NO: 1745121 - RNA, 20 nt, Homo sapiens
cugugucuuuuuucacuaca

SEQ ID NO: 1745122 - RNA, 16 nt, Homo sapiens
aauugauuugcauuga

SEQ ID NO: 1745123 - RNA, 16 nt, Homo sapiens
augcuccuccugauga

SEQ ID NO: 1745124 - RNA, 23 nt, Homo sapiens
agcugagauugcaccacugcacu

SEQ ID NO: 1745125 - RNA, 17 nt, Homo sapiens
agucacucuagucaaug

SEQ ID NO: 1745126 - RNA, 17 nt, Homo sapiens
gaguuuccucgcauuaa

SEQ ID NO: 1745127 - RNA, 14 nt, Homo sapiens
cuuccauccuguca

SEQ ID NO: 1745128 - RNA, 17 nt, Homo sapiens
agggcaacccaccaucu

SEQ ID NO: 1745129 - RNA, 12 nt, Homo sapiens
uguguggcugcu

SEQ ID NO: 1745130 - RNA, 15 nt, Homo sapiens
aguuucaaugugauu

SEQ ID NO: 1745131 - RNA, 21 nt, Homo sapiens
uaaucuucugccuucucauga

SEQ ID NO: 1745132 - RNA, 16 nt, Homo sapiens
aggugugggcucccac

SEQ ID NO: 1745133 - RNA, 21 nt, Homo sapiens
cagggagacgguuuccaggga

SEQ ID NO: 1745134 - RNA, 19 nt, Homo sapiens
ggccugcgugugucugugu

SEQ ID NO: 1745135 - RNA, 13 nt, Homo sapiens
cggcaacaucucu

SEQ ID NO: 1745136 - RNA, 20 nt, Homo sapiens
gcaaugaauuaguugcauug

SEQ ID NO: 1745137 - RNA, 18 nt, Homo sapiens
aacauaggugcucuuccu

SEQ ID NO: 1745138 - RNA, 23 nt, Homo sapiens
gcauguccucauccuuuccugcc

SEQ ID NO: 1745139 - RNA, 21 nt, Homo sapiens
gagauuucaguuacuuaccug

SEQ ID NO: 1745140 - RNA, 23 nt, Homo sapiens
agagcagcacaaagaaacagccu

SEQ ID NO: 1745141 - RNA, 23 nt, Homo sapiens
aaucaucuauaaagaagaacuug

SEQ ID NO: 1745142 - RNA, 19 nt, Homo sapiens
accgauuucagcacaugca

SEQ ID NO: 1745143 - RNA, 16 nt, Homo sapiens
uggagaacaacccaag

SEQ ID NO: 1745144 - RNA, 18 nt, Homo sapiens
cauugaagggggaugcag

SEQ ID NO: 1745145 - RNA, 21 nt, Homo sapiens
aauguaucuauuuguacaauu

SEQ ID NO: 1745146 - RNA, 15 nt, Homo sapiens
cgccuucucccacau

SEQ ID NO: 1745147 - RNA, 18 nt, Homo sapiens
auauacugguucacaucc

SEQ ID NO: 1745148 - RNA, 21 nt, Homo sapiens
cauuccccugaugggcccuga

SEQ ID NO: 1745149 - RNA, 15 nt, Homo sapiens
agaaguggcccuugg

SEQ ID NO: 1745150 - RNA, 11 nt, Homo sapiens
cgccucuggau

SEQ ID NO: 1745151 - RNA, 22 nt, Homo sapiens
uccucacccugccggguagcug

SEQ ID NO: 1745152 - RNA, 20 nt, Homo sapiens
gcuuauauaaauguacagua

SEQ ID NO: 1745153 - RNA, 21 nt, Homo sapiens
augucaguacuauucagguaa

SEQ ID NO: 1745154 - RNA, 19 nt, Homo sapiens
gaccacgugagaucauuca

SEQ ID NO: 1745155 - RNA, 24 nt, Homo sapiens
gaacacuuauguuauacaauacag

SEQ ID NO: 1745156 - RNA, 17 nt, Homo sapiens
gcagaaaggguuccaaa

SEQ ID NO: 1745157 - RNA, 22 nt, Homo sapiens
caguuguuaaaaugagcauuga

SEQ ID NO: 1745158 - RNA, 23 nt, Homo sapiens
caccuuuccucaaauguugacau

SEQ ID NO: 1745159 - RNA, 15 nt, Homo sapiens
uuuaugcuaagugaa

SEQ ID NO: 1745160 - RNA, 19 nt, Homo sapiens
aaccagaaaggugauucca

SEQ ID NO: 1745161 - RNA, 14 nt, Homo sapiens
caucagccagugaa

SEQ ID NO: 1745162 - RNA, 16 nt, Homo sapiens
auaauuuuucuuacac

SEQ ID NO: 1745163 - RNA, 14 nt, Homo sapiens
uccccagaccagua

SEQ ID NO: 1745164 - RNA, 20 nt, Homo sapiens
gccaccuccagacaccagug

SEQ ID NO: 1745165 - RNA, 20 nt, Homo sapiens
uuugagauuaagaaugccag

SEQ ID NO: 1745166 - RNA, 14 nt, Homo sapiens
aucuuucaccaagu

SEQ ID NO: 1745167 - RNA, 22 nt, Homo sapiens
aaguuccagcauguugcaucuc

SEQ ID NO: 1745168 - RNA, 14 nt, Homo sapiens
gaugugucuuacca

SEQ ID NO: 1745169 - RNA, 17 nt, Homo sapiens
cucuggauacaccgaau

SEQ ID NO: 1745170 - RNA, 19 nt, Homo sapiens
acaaaguuauauucacagu

SEQ ID NO: 1745171 - RNA, 15 nt, Homo sapiens
acuuaauuauaagcu

SEQ ID NO: 1745172 - RNA, 14 nt, Homo sapiens
uagugcacuagcau

SEQ ID NO: 1745173 - RNA, 19 nt, Homo sapiens
uacuggaaaaaaauacaaa

SEQ ID NO: 1745174 - RNA, 12 nt, Homo sapiens
cccuugcuguac

SEQ ID NO: 1745175 - RNA, 19 nt, Homo sapiens
cuuuuaaauacauucccug

SEQ ID NO: 1745176 - RNA, 17 nt, Homo sapiens
gucucgaacuccugacc

SEQ ID NO: 1745177 - RNA, 13 nt, Homo sapiens
cacccuuucaccc

SEQ ID NO: 1745178 - RNA, 20 nt, Homo sapiens
gcauucugggguggggcuug

SEQ ID NO: 1745179 - RNA, 21 nt, Homo sapiens
uguugacauuagucucaguga

SEQ ID NO: 1745180 - RNA, 16 nt, Homo sapiens
auacacagaugaaggu

SEQ ID NO: 1745181 - RNA, 13 nt, Homo sapiens
aauauauccugug

SEQ ID NO: 1745182 - RNA, 12 nt, Homo sapiens
aaauacaaucag

SEQ ID NO: 1745183 - RNA, 19 nt, Homo sapiens
cccacccucuggagaaggu

SEQ ID NO: 1745184 - RNA, 17 nt, Homo sapiens
gcauggaaaaucaguga

SEQ ID NO: 1745185 - RNA, 23 nt, Homo sapiens
agugcaauggcaccaucuuggcu

SEQ ID NO: 1745186 - RNA, 17 nt, Homo sapiens
auugcaugaaagacaga

SEQ ID NO: 1745187 - RNA, 17 nt, Homo sapiens
gccaaggcagagcgcaa

SEQ ID NO: 1745188 - RNA, 19 nt, Homo sapiens
ccuuaagaggccuccacuc

SEQ ID NO: 1745189 - RNA, 21 nt, Homo sapiens
uuccaacauuauccuguguga

SEQ ID NO: 1745190 - RNA, 15 nt, Homo sapiens
cagaaauucuggccc

SEQ ID NO: 1745191 - RNA, 18 nt, Homo sapiens
aggggugggccugugaau

SEQ ID NO: 1745192 - RNA, 15 nt, Homo sapiens
augccuguaaucuca

SEQ ID NO: 1745193 - RNA, 19 nt, Homo sapiens
uucuaauuugcugcugaua

SEQ ID NO: 1745194 - RNA, 13 nt, Homo sapiens
gcuguuagcacgu

SEQ ID NO: 1745195 - RNA, 14 nt, Homo sapiens
auugugcacuguau

SEQ ID NO: 1745196 - RNA, 17 nt, Homo sapiens
ugcuuccaagcccuucc

SEQ ID NO: 1745197 - RNA, 19 nt, Homo sapiens
gaagaagugggagcagcuu

SEQ ID NO: 1745198 - RNA, 12 nt, Homo sapiens
auguuacuucuc

SEQ ID NO: 1745199 - RNA, 13 nt, Homo sapiens
uuuucccaccacc

SEQ ID NO: 1745200 - RNA, 21 nt, Homo sapiens
cugagcgggcuugugauaugc

SEQ ID NO: 1745201 - RNA, 20 nt, Homo sapiens
uuuugguagaugcaugacuu

SEQ ID NO: 1745202 - RNA, 17 nt, Homo sapiens
ccuguguauucuaguga

SEQ ID NO: 1745203 - RNA, 14 nt, Homo sapiens
aucaccacagggau

SEQ ID NO: 1745204 - RNA, 16 nt, Homo sapiens
gaagagaaaucugaua

SEQ ID NO: 1745205 - RNA, 20 nt, Homo sapiens
gugagaugaaggaaggacua

SEQ ID NO: 1745206 - RNA, 21 nt, Homo sapiens
uaauuuauuuaauauacuuua

SEQ ID NO: 1745207 - RNA, 16 nt, Homo sapiens
uuaauugcugcaagga

SEQ ID NO: 1745208 - RNA, 20 nt, Homo sapiens
aaaugaugccccagagcucu

SEQ ID NO: 1745209 - RNA, 18 nt, Homo sapiens
aagucccuucaauuucua

SEQ ID NO: 1745210 - RNA, 18 nt, Homo sapiens
gcaacuggugacuguccc

SEQ ID NO: 1745211 - RNA, 19 nt, Homo sapiens
cucacagagugcauuguga

SEQ ID NO: 1745212 - RNA, 21 nt, Homo sapiens
agaaacaacuucuacuucugc

SEQ ID NO: 1745213 - RNA, 20 nt, Homo sapiens
caauaugaacugcaggcaaa

SEQ ID NO: 1745214 - RNA, 19 nt, Homo sapiens
ugauagauuucuacacuga

SEQ ID NO: 1745215 - RNA, 14 nt, Homo sapiens
guaagcaacuugcu

SEQ ID NO: 1745216 - RNA, 20 nt, Homo sapiens
ugucuugugcauaauucuuc

SEQ ID NO: 1745217 - RNA, 15 nt, Homo sapiens
gacuaccucagaaca

SEQ ID NO: 1745218 - RNA, 17 nt, Homo sapiens
gugggcaaacaggcagu

SEQ ID NO: 1745219 - RNA, 22 nt, Homo sapiens
aacacuauuucuggaaugcuuc

SEQ ID NO: 1745220 - RNA, 21 nt, Homo sapiens
agcuucacccugaggugagca

SEQ ID NO: 1745221 - RNA, 19 nt, Homo sapiens
cagcuaucgccucuugccu

SEQ ID NO: 1745222 - RNA, 22 nt, Homo sapiens
caauaccguguggcccaagacc

SEQ ID NO: 1745223 - RNA, 14 nt, Homo sapiens
gaugugccuacucc

SEQ ID NO: 1745224 - RNA, 23 nt, Homo sapiens
uucccacgucccucgagcucugu

SEQ ID NO: 1745225 - RNA, 15 nt, Homo sapiens
uagccagugcucagc

SEQ ID NO: 1745226 - RNA, 22 nt, Homo sapiens
ggcaauuuuuguauccaaggaa

SEQ ID NO: 1745227 - RNA, 20 nt, Homo sapiens
cucuaagaugaauccaaaug

SEQ ID NO: 1745228 - RNA, 15 nt, Homo sapiens
gcaaaggccagcagc

SEQ ID NO: 1745229 - RNA, 11 nt, Homo sapiens
gcugauucaau

SEQ ID NO: 1745230 - RNA, 22 nt, Homo sapiens
uacaagaugcuaguucauuuga

SEQ ID NO: 1745231 - RNA, 23 nt, Homo sapiens
aaaggauucuauaucaugaccaa

SEQ ID NO: 1745232 - RNA, 13 nt, Homo sapiens
uauugcauaacag

SEQ ID NO: 1745233 - RNA, 13 nt, Homo sapiens
auuugcauuucag

SEQ ID NO: 1745234 - RNA, 17 nt, Homo sapiens
ggauaggaacugggccu

SEQ ID NO: 1745235 - RNA, 14 nt, Homo sapiens
aggagcucacugug

SEQ ID NO: 1745236 - RNA, 18 nt, Homo sapiens
ccucagcccccugcuuca

SEQ ID NO: 1745237 - RNA, 15 nt, Homo sapiens
aucaguggaguccag

SEQ ID NO: 1745238 - RNA, 21 nt, Homo sapiens
aucuucaaacuuucacuuuga

SEQ ID NO: 1745239 - RNA, 18 nt, Homo sapiens
uaaagcuuucaacaugua

SEQ ID NO: 1745240 - RNA, 23 nt, Homo sapiens
aaacccaagugccuucagaggau

SEQ ID NO: 1745241 - RNA, 21 nt, Homo sapiens
cucuuucucugagaaccaaaa

SEQ ID NO: 1745242 - RNA, 22 nt, Homo sapiens
uggccugagcgcagcgccucca

SEQ ID NO: 1745243 - RNA, 15 nt, Homo sapiens
gaaaacauaugcauu

SEQ ID NO: 1745244 - RNA, 13 nt, Homo sapiens
augaaguuauuaa

SEQ ID NO: 1745245 - RNA, 13 nt, Homo sapiens
ugcugugcacauu

SEQ ID NO: 1745246 - RNA, 13 nt, Homo sapiens
gcucacugucaca

SEQ ID NO: 1745247 - RNA, 19 nt, Homo sapiens
acccauuuuggugcaauau

SEQ ID NO: 1745248 - RNA, 14 nt, Homo sapiens
aagcguccucucag

SEQ ID NO: 1745249 - RNA, 16 nt, Homo sapiens
ucucauagcuuuggag

SEQ ID NO: 1745250 - RNA, 19 nt, Homo sapiens
ggcagucacugaauuccau

SEQ ID NO: 1745251 - RNA, 19 nt, Homo sapiens
ugugcuucaucugugggau

SEQ ID NO: 1745252 - RNA, 13 nt, Homo sapiens
ucauuucaucuca

SEQ ID NO: 1745253 - RNA, 15 nt, Homo sapiens
cugaggucacugggu

SEQ ID NO: 1745254 - RNA, 18 nt, Homo sapiens
uugugacagucacugcau

SEQ ID NO: 1745255 - RNA, 20 nt, Homo sapiens
accccagacgaugucuucau

SEQ ID NO: 1745256 - RNA, 19 nt, Homo sapiens
gccaggugugguggcucac

SEQ ID NO: 1745257 - RNA, 14 nt, Homo sapiens
cuaauaauaccuug

SEQ ID NO: 1745258 - RNA, 22 nt, Homo sapiens
aucuuguggucugcugccucag

SEQ ID NO: 1745259 - RNA, 15 nt, Homo sapiens
uggcugcuccaugag

SEQ ID NO: 1745260 - RNA, 20 nt, Homo sapiens
uuucuccgaaaggcaaaaau

SEQ ID NO: 1745261 - RNA, 17 nt, Homo sapiens
ugcacaaaguggcauaa

SEQ ID NO: 1745262 - RNA, 18 nt, Homo sapiens
gcuugccgaaacuggaag

SEQ ID NO: 1745263 - RNA, 21 nt, Homo sapiens
acacaucccggccucuuccac

SEQ ID NO: 1745264 - RNA, 20 nt, Homo sapiens
ccaaguacuuuccaaucuca

SEQ ID NO: 1745265 - RNA, 15 nt, Homo sapiens
aacuccuacuaaauc

SEQ ID NO: 1745266 - RNA, 12 nt, Homo sapiens
auguacuugaua

SEQ ID NO: 1745267 - RNA, 12 nt, Homo sapiens
auuaacuugagu

SEQ ID NO: 1745268 - RNA, 13 nt, Homo sapiens
ucccaacauuucu

SEQ ID NO: 1745269 - RNA, 10 nt, Homo sapiens
cccccagugg

SEQ ID NO: 1745270 - RNA, 21 nt, Homo sapiens
uagcccuccucucccagugac

SEQ ID NO: 1745271 - RNA, 23 nt, Homo sapiens
cuguuuuugcaguacauggguga

SEQ ID NO: 1745272 - RNA, 15 nt, Homo sapiens
cgucacgcucccuga

SEQ ID NO: 1745273 - RNA, 17 nt, Homo sapiens
agaaagcccugugcuuu

SEQ ID NO: 1745274 - RNA, 17 nt, Homo sapiens
acaucuacccagauaaa

SEQ ID NO: 1745275 - RNA, 18 nt, Homo sapiens
cccacugaacaugcucau

SEQ ID NO: 1745276 - RNA, 22 nt, Homo sapiens
caugaaucugcacaucuguaaa

SEQ ID NO: 1745277 - RNA, 21 nt, Homo sapiens
aaguguguuuccugcugacua

SEQ ID NO: 1745278 - RNA, 14 nt, Homo sapiens
cuccaagcauuuca

SEQ ID NO: 1745279 - RNA, 15 nt, Homo sapiens
auugcauucauguac

SEQ ID NO: 1745280 - RNA, 17 nt, Homo sapiens
ccagacuggagugcagu

SEQ ID NO: 1745281 - RNA, 17 nt, Homo sapiens
ccaggcuggaguacagu

SEQ ID NO: 1745282 - RNA, 14 nt, Homo sapiens
cauguccauaugca

SEQ ID NO: 1745283 - RNA, 14 nt, Homo sapiens
uauuuggaaccuug

SEQ ID NO: 1745284 - RNA, 14 nt, Homo sapiens
uccacagaaauaca

SEQ ID NO: 1745285 - RNA, 15 nt, Homo sapiens
cccugcccuuggcac

SEQ ID NO: 1745286 - RNA, 21 nt, Homo sapiens
ugccugccucaugcucucuau

SEQ ID NO: 1745287 - RNA, 20 nt, Homo sapiens
agaaguaacucccacuccua

SEQ ID NO: 1745288 - RNA, 16 nt, Homo sapiens
agacauacauuucuca

SEQ ID NO: 1745289 - RNA, 17 nt, Homo sapiens
caaaaaucccaaauuca

SEQ ID NO: 1745290 - RNA, 15 nt, Homo sapiens
agcugcucacuuaaa

SEQ ID NO: 1745291 - RNA, 11 nt, Homo sapiens
uggcacuauuu

SEQ ID NO: 1745292 - RNA, 12 nt, Homo sapiens
cugaacugaaag

SEQ ID NO: 1745293 - RNA, 16 nt, Homo sapiens
gagacaacuucccaaa

SEQ ID NO: 1745294 - RNA, 12 nt, Homo sapiens
cuugauucucuc

SEQ ID NO: 1745295 - RNA, 17 nt, Homo sapiens
agacuucuggugcugcu

SEQ ID NO: 1745296 - RNA, 16 nt, Homo sapiens
aaacuuuuaguauuac

SEQ ID NO: 1745297 - RNA, 15 nt, Homo sapiens
ucaccacaagccacc

SEQ ID NO: 1745298 - RNA, 20 nt, Homo sapiens
acaagccaacauaugaauau

SEQ ID NO: 1745299 - RNA, 19 nt, Homo sapiens
uaccuuaaaugcugagauc

SEQ ID NO: 1745300 - RNA, 16 nt, Homo sapiens
caugacaaaccuuaug

SEQ ID NO: 1745301 - RNA, 13 nt, Homo sapiens
gaggccacgugau

SEQ ID NO: 1745302 - RNA, 13 nt, Homo sapiens
ggucauucacaga

SEQ ID NO: 1745303 - RNA, 17 nt, Homo sapiens
gcaaagaaaagccagag

SEQ ID NO: 1745304 - RNA, 22 nt, Homo sapiens
gagcauccucucucacauggaa

SEQ ID NO: 1745305 - RNA, 20 nt, Homo sapiens
gauauuguauguaccuggga

SEQ ID NO: 1745306 - RNA, 13 nt, Homo sapiens
ugcugacugucaa

SEQ ID NO: 1745307 - RNA, 16 nt, Homo sapiens
agggaaugugaaauuu

SEQ ID NO: 1745308 - RNA, 13 nt, Homo sapiens
uguaaugagccau

SEQ ID NO: 1745309 - RNA, 16 nt, Homo sapiens
ucagcaggacgacugu

SEQ ID NO: 1745310 - RNA, 15 nt, Homo sapiens
ucagcaggagccaau

SEQ ID NO: 1745311 - RNA, 21 nt, Homo sapiens
uucuggagaaagguauguuac

SEQ ID NO: 1745312 - RNA, 16 nt, Homo sapiens
ugugaacccaaagugu

SEQ ID NO: 1745313 - RNA, 22 nt, Homo sapiens
caaugcagugccuuucuucucu

SEQ ID NO: 1745314 - RNA, 15 nt, Homo sapiens
gucuauggcacuaau

SEQ ID NO: 1745315 - RNA, 22 nt, Homo sapiens
cuucuguugcccuugugcucca

SEQ ID NO: 1745316 - RNA, 18 nt, Homo sapiens
aucuucaaacuuucacuu

SEQ ID NO: 1745317 - RNA, 19 nt, Homo sapiens
caggagagacagugaggcu

SEQ ID NO: 1745318 - RNA, 20 nt, Homo sapiens
cacccaggcuggacugcaau

SEQ ID NO: 1745319 - RNA, 22 nt, Homo sapiens
gguggagcagcaaacuugguga

SEQ ID NO: 1745320 - RNA, 20 nt, Homo sapiens
acuagacuacucaauauuaa

SEQ ID NO: 1745321 - RNA, 13 nt, Homo sapiens
gacuuacugggug

SEQ ID NO: 1745322 - RNA, 21 nt, Homo sapiens
aaaaaucagaaagacauucuu

SEQ ID NO: 1745323 - RNA, 22 nt, Homo sapiens
cuuaaaagcaaguuucagugaa

SEQ ID NO: 1745324 - RNA, 20 nt, Homo sapiens
aacuuguuacaccacauuag

SEQ ID NO: 1745325 - RNA, 13 nt, Homo sapiens
uguguuucuugcu

SEQ ID NO: 1745326 - RNA, 14 nt, Homo sapiens
aauagaaaagcacu

SEQ ID NO: 1745327 - RNA, 22 nt, Homo sapiens
cuuaaaauugugagcgaauuag

SEQ ID NO: 1745328 - RNA, 21 nt, Homo sapiens
uuaugagcccuauauauucaa

SEQ ID NO: 1745329 - RNA, 23 nt, Homo sapiens
gcaauaaaauaacagacugucug

SEQ ID NO: 1745330 - RNA, 13 nt, Homo sapiens
uuuucaccaauga

SEQ ID NO: 1745331 - RNA, 13 nt, Homo sapiens
cacaccacccucc

SEQ ID NO: 1745332 - RNA, 19 nt, Homo sapiens
ucugauugcagcacagagc

SEQ ID NO: 1745333 - RNA, 18 nt, Homo sapiens
auucuugugccucagcuu

SEQ ID NO: 1745334 - RNA, 19 nt, Homo sapiens
gccgcaaaccacacuggac

SEQ ID NO: 1745335 - RNA, 21 nt, Homo sapiens
cacuccccaaccccucuccag

SEQ ID NO: 1745336 - RNA, 21 nt, Homo sapiens
uuugauaccauggcacugaca

SEQ ID NO: 1745337 - RNA, 20 nt, Homo sapiens
agaaagccaggagcagcccu

SEQ ID NO: 1745338 - RNA, 23 nt, Homo sapiens
uauucauucauuuacucauucau

SEQ ID NO: 1745339 - RNA, 20 nt, Homo sapiens
ugaacaccauaccuuugcua

SEQ ID NO: 1745340 - RNA, 14 nt, Homo sapiens
caccccaccagaag

SEQ ID NO: 1745341 - RNA, 15 nt, Homo sapiens
ugacauuguauguau

SEQ ID NO: 1745342 - RNA, 14 nt, Homo sapiens
uaaaaaugcaugau

SEQ ID NO: 1745343 - RNA, 19 nt, Homo sapiens
ugagcuuagugaaauuacu

SEQ ID NO: 1745344 - RNA, 22 nt, Homo sapiens
guccugcccaaugccuugacaa

SEQ ID NO: 1745345 - RNA, 21 nt, Homo sapiens
cccccauaucuuuaaagugug

SEQ ID NO: 1745346 - RNA, 21 nt, Homo sapiens
gccugccaagagguacuguaa

SEQ ID NO: 1745347 - RNA, 16 nt, Homo sapiens
aggaaagcagcauucu

SEQ ID NO: 1745348 - RNA, 17 nt, Homo sapiens
auaggcaguagacucau

SEQ ID NO: 1745349 - RNA, 16 nt, Homo sapiens
aauuccugcuaugaca

SEQ ID NO: 1745350 - RNA, 16 nt, Homo sapiens
ugccuuuagugaucac

SEQ ID NO: 1745351 - RNA, 14 nt, Homo sapiens
cuucacucuuugaa

SEQ ID NO: 1745352 - RNA, 17 nt, Homo sapiens
ugagacggagucuugcu

SEQ ID NO: 1745353 - RNA, 19 nt, Homo sapiens
aggacagcucagaaaauca

SEQ ID NO: 1745354 - RNA, 20 nt, Homo sapiens
caggugugagccaccgcgcc

SEQ ID NO: 1745355 - RNA, 18 nt, Homo sapiens
caauuagauaaaugucca

SEQ ID NO: 1745356 - RNA, 17 nt, Homo sapiens
uccagaacgcccugugu

SEQ ID NO: 1745357 - RNA, 15 nt, Homo sapiens
cugagauggggacag

SEQ ID NO: 1745358 - RNA, 18 nt, Homo sapiens
ugaccucgugaucugccc

SEQ ID NO: 1745359 - RNA, 19 nt, Homo sapiens
ucugggauauggcugccca

SEQ ID NO: 1745360 - RNA, 22 nt, Homo sapiens
uaccuucaauaaaguaucuaca

SEQ ID NO: 1745361 - RNA, 14 nt, Homo sapiens
auaagaacgucauu

SEQ ID NO: 1745362 - RNA, 15 nt, Homo sapiens
aggcagagacugaaa

SEQ ID NO: 1745363 - RNA, 20 nt, Homo sapiens
cgugccccgccuccccgaaa

SEQ ID NO: 1745364 - RNA, 18 nt, Homo sapiens
cgaaugguuccauucucu

SEQ ID NO: 1745365 - RNA, 17 nt, Homo sapiens
aauauguuugugccuua

SEQ ID NO: 1745366 - RNA, 19 nt, Homo sapiens
cauggaggugccggaugca

SEQ ID NO: 1745367 - RNA, 21 nt, Homo sapiens
caugaauucuggucacauucc

SEQ ID NO: 1745368 - RNA, 23 nt, Homo sapiens
cugauccagauguuaugcuccug

SEQ ID NO: 1745369 - RNA, 11 nt, Homo sapiens
caaucuaguaa

SEQ ID NO: 1745370 - RNA, 17 nt, Homo sapiens
gcaaauuaacuuuacau

SEQ ID NO: 1745371 - RNA, 22 nt, Homo sapiens
aaucuuuguuaagguccugaaa

SEQ ID NO: 1745372 - RNA, 18 nt, Homo sapiens
ugagauauuugguaccau

SEQ ID NO: 1745373 - RNA, 14 nt, Homo sapiens
augaucauuugccc

SEQ ID NO: 1745374 - RNA, 24 nt, Homo sapiens
caauuccccuacaucaaaugcuca

SEQ ID NO: 1745375 - RNA, 14 nt, Homo sapiens
uccuucugggggug

SEQ ID NO: 1745376 - RNA, 18 nt, Homo sapiens
uaugacgugacuggccug

SEQ ID NO: 1745377 - RNA, 20 nt, Homo sapiens
gagugaugguucuggcugau

SEQ ID NO: 1745378 - RNA, 23 nt, Homo sapiens
uuugauacaaaugggaauucacu

SEQ ID NO: 1745379 - RNA, 19 nt, Homo sapiens
cugaucccuuccaccugcu

SEQ ID NO: 1745380 - RNA, 22 nt, Homo sapiens
aggcugcccugacccuuccaca

SEQ ID NO: 1745381 - RNA, 20 nt, Homo sapiens
cagaaaaacucugggaaaua

SEQ ID NO: 1745382 - RNA, 17 nt, Homo sapiens
gacucguucuucuggga

SEQ ID NO: 1745383 - RNA, 11 nt, Homo sapiens
aaaguauauau

SEQ ID NO: 1745384 - RNA, 19 nt, Homo sapiens
cauaacuuagagacuuuag

SEQ ID NO: 1745385 - RNA, 18 nt, Homo sapiens
uagcuuuugaugucucca

SEQ ID NO: 1745386 - RNA, 20 nt, Homo sapiens
ucugcaaaaggccucuugua

SEQ ID NO: 1745387 - RNA, 14 nt, Homo sapiens
gcauuacaauugca

SEQ ID NO: 1745388 - RNA, 17 nt, Homo sapiens
ugaguuugaacacagau

SEQ ID NO: 1745389 - RNA, 15 nt, Homo sapiens
ugugccuuggugauu

SEQ ID NO: 1745390 - RNA, 20 nt, Homo sapiens
aacgcuuaaaggugucuucc

SEQ ID NO: 1745391 - RNA, 14 nt, Homo sapiens
gugggauuuugcaa

SEQ ID NO: 1745392 - RNA, 17 nt, Homo sapiens
ucugugcuggacuuuaa

SEQ ID NO: 1745393 - RNA, 13 nt, Homo sapiens
cuauaauugccac

SEQ ID NO: 1745394 - RNA, 21 nt, Homo sapiens
gcugccaccucuccauccugc

SEQ ID NO: 1745395 - RNA, 13 nt, Homo sapiens
gccugaacacuca

SEQ ID NO: 1745396 - RNA, 22 nt, Homo sapiens
auuggaauuuucuuucauacau

SEQ ID NO: 1745397 - RNA, 18 nt, Homo sapiens
ucuuagcacacucacaga

SEQ ID NO: 1745398 - RNA, 23 nt, Homo sapiens
auauuacuguaauuucauauaca

SEQ ID NO: 1745399 - RNA, 13 nt, Homo sapiens
aaacugaagccca

SEQ ID NO: 1745400 - RNA, 13 nt, Homo sapiens
acaaagaagacau

SEQ ID NO: 1745401 - RNA, 19 nt, Homo sapiens
ucgcaaugagggagcaugu

SEQ ID NO: 1745402 - RNA, 13 nt, Homo sapiens
uccugagcacugc

SEQ ID NO: 1745403 - RNA, 22 nt, Homo sapiens
gaucgcaccacugcacuccagc

SEQ ID NO: 1745404 - RNA, 20 nt, Homo sapiens
acccuuggcuccugugucug

SEQ ID NO: 1745405 - RNA, 22 nt, Homo sapiens
uucaaggucauuuacuuguacg

SEQ ID NO: 1745406 - RNA, 15 nt, Homo sapiens
ucaucacauucaggg

SEQ ID NO: 1745407 - RNA, 18 nt, Homo sapiens
cauggccccuugcauuuc

SEQ ID NO: 1745408 - RNA, 22 nt, Homo sapiens
ucgcagagaguguaucaucugu

SEQ ID NO: 1745409 - RNA, 15 nt, Homo sapiens
cugaucucaguuucc

SEQ ID NO: 1745410 - RNA, 14 nt, Homo sapiens
auuuugaucuucaa

SEQ ID NO: 1745411 - RNA, 18 nt, Homo sapiens
uucuuuaauguuguccag

SEQ ID NO: 1745412 - RNA, 19 nt, Homo sapiens
uaaagcauccaaguauaua

SEQ ID NO: 1745413 - RNA, 19 nt, Homo sapiens
gcugauuuuuuuucugaua

SEQ ID NO: 1745414 - RNA, 13 nt, Homo sapiens
ucuuacaguauuu

SEQ ID NO: 1745415 - RNA, 17 nt, Homo sapiens
uuggaaggcugaggcag

SEQ ID NO: 1745416 - RNA, 21 nt, Homo sapiens
uaaggacaaagugccaaagaa

SEQ ID NO: 1745417 - RNA, 16 nt, Homo sapiens
ccaaggauauuuacag

SEQ ID NO: 1745418 - RNA, 24 nt, Homo sapiens
auagcaagucuuaguacauccuca

SEQ ID NO: 1745419 - RNA, 16 nt, Homo sapiens
ucucgcacaaugcaug

SEQ ID NO: 1745420 - RNA, 13 nt, Homo sapiens
aagguacauauuu

SEQ ID NO: 1745421 - RNA, 20 nt, Homo sapiens
augagaguaauugcuugaca

SEQ ID NO: 1745422 - RNA, 16 nt, Homo sapiens
uugucuccugaaguuu

SEQ ID NO: 1745423 - RNA, 14 nt, Homo sapiens
cuaauagagauuaa

SEQ ID NO: 1745424 - RNA, 24 nt, Homo sapiens
uaaggacuuagcuggccacaguga

SEQ ID NO: 1745425 - RNA, 18 nt, Homo sapiens
cuauuuguuuacaugcag

SEQ ID NO: 1745426 - RNA, 16 nt, Homo sapiens
caaggaauuucugcuc

SEQ ID NO: 1745427 - RNA, 15 nt, Homo sapiens
gauccccaaguggug

SEQ ID NO: 1745428 - RNA, 21 nt, Homo sapiens
aaaauaguaaaugcuuugugu

SEQ ID NO: 1745429 - RNA, 15 nt, Homo sapiens
acagcugugugagcu

SEQ ID NO: 1745430 - RNA, 22 nt, Homo sapiens
aagaauguugguuuacuuucaa

SEQ ID NO: 1745431 - RNA, 22 nt, Homo sapiens
cacucugagugaauacuuugau

SEQ ID NO: 1745432 - RNA, 14 nt, Homo sapiens
gagaguaagcacgu

SEQ ID NO: 1745433 - RNA, 15 nt, Homo sapiens
agcccggcacuccag

SEQ ID NO: 1745434 - RNA, 20 nt, Homo sapiens
cucugcuaccccuacugaaa

SEQ ID NO: 1745435 - RNA, 21 nt, Homo sapiens
agccauuuccauggcucuguu

SEQ ID NO: 1745436 - RNA, 15 nt, Homo sapiens
aggccagcccacugg

SEQ ID NO: 1745437 - RNA, 13 nt, Homo sapiens
ggaaaaccaucuc

SEQ ID NO: 1745438 - RNA, 13 nt, Homo sapiens
cucuguggccagc

SEQ ID NO: 1745439 - RNA, 14 nt, Homo sapiens
ucuagagcuuuuau

SEQ ID NO: 1745440 - RNA, 18 nt, Homo sapiens
caauggcccgacauuucu

SEQ ID NO: 1745441 - RNA, 13 nt, Homo sapiens
uuccuaaugauua

SEQ ID NO: 1745442 - RNA, 21 nt, Homo sapiens
aauucccuguuauaauuugca

SEQ ID NO: 1745443 - RNA, 18 nt, Homo sapiens
ucuccaaaggcacugacc

SEQ ID NO: 1745444 - RNA, 20 nt, Homo sapiens
aagcugugccacccugggcu

SEQ ID NO: 1745445 - RNA, 15 nt, Homo sapiens
gaugugaguugcaca

SEQ ID NO: 1745446 - RNA, 12 nt, Homo sapiens
aaggaaagugau

SEQ ID NO: 1745447 - RNA, 20 nt, Homo sapiens
ccuaugauaaguuccaaaaa

SEQ ID NO: 1745448 - RNA, 18 nt, Homo sapiens
ucagccaugucugugcug

SEQ ID NO: 1745449 - RNA, 20 nt, Homo sapiens
ccaucuaggaugauuuuccc

SEQ ID NO: 1745450 - RNA, 16 nt, Homo sapiens
auuccuuuauggcaaa

SEQ ID NO: 1745451 - RNA, 18 nt, Homo sapiens
gcuuugcugccaaugcaa

SEQ ID NO: 1745452 - RNA, 14 nt, Homo sapiens
gagauggccugaga

SEQ ID NO: 1745453 - RNA, 15 nt, Homo sapiens
uggaagucucaaaga

SEQ ID NO: 1745454 - RNA, 13 nt, Homo sapiens
caugaugcugccc

SEQ ID NO: 1745455 - RNA, 21 nt, Homo sapiens
aaucuauccauugaacuaaaa

SEQ ID NO: 1745456 - RNA, 20 nt, Homo sapiens
uagccauugaaaugucaaau

SEQ ID NO: 1745457 - RNA, 11 nt, Homo sapiens
gccucagugag

SEQ ID NO: 1745458 - RNA, 18 nt, Homo sapiens
aggaagaacaucuggauu

SEQ ID NO: 1745459 - RNA, 10 nt, Homo sapiens
aguuuuuacu

SEQ ID NO: 1745460 - RNA, 17 nt, Homo sapiens
guacaggcaagcuugug

SEQ ID NO: 1745461 - RNA, 20 nt, Homo sapiens
uggaaaauaaacaucaguuu

SEQ ID NO: 1745462 - RNA, 13 nt, Homo sapiens
aguuggguguauu

SEQ ID NO: 1745463 - RNA, 16 nt, Homo sapiens
auauauuuaauauguc

SEQ ID NO: 1745464 - RNA, 23 nt, Homo sapiens
guuugcucuugcauugcaaaaau

SEQ ID NO: 1745465 - RNA, 23 nt, Homo sapiens
auaauacuugcaacuaaggacaa

SEQ ID NO: 1745466 - RNA, 24 nt, Homo sapiens
gaaggcuacauauacauaguugcu

SEQ ID NO: 1745467 - RNA, 22 nt, Homo sapiens
ucccucuugacguggcacuuac

SEQ ID NO: 1745468 - RNA, 12 nt, Homo sapiens
ccaggaaggcag

SEQ ID NO: 1745469 - RNA, 17 nt, Homo sapiens
uuuauaaauguguggug

SEQ ID NO: 1745470 - RNA, 22 nt, Homo sapiens
ccucuagguccccauacuccua

SEQ ID NO: 1745471 - RNA, 19 nt, Homo sapiens
ugcccuuccccucccgaca

SEQ ID NO: 1745472 - RNA, 19 nt, Homo sapiens
gcuuaguauuucucaggaa

SEQ ID NO: 1745473 - RNA, 14 nt, Homo sapiens
auaugugcuugccu

SEQ ID NO: 1745474 - RNA, 22 nt, Homo sapiens
gauuccagugcaguagugccaa

SEQ ID NO: 1745475 - RNA, 15 nt, Homo sapiens
uuguccaucuugaga

SEQ ID NO: 1745476 - RNA, 19 nt, Homo sapiens
uguauuuuuuccuguaaga

SEQ ID NO: 1745477 - RNA, 18 nt, Homo sapiens
cucugcacaugucuugua

SEQ ID NO: 1745478 - RNA, 21 nt, Homo sapiens
uauccuguuccgagcaacuuu

SEQ ID NO: 1745479 - RNA, 18 nt, Homo sapiens
ucacuucccuacauggag

SEQ ID NO: 1745480 - RNA, 20 nt, Homo sapiens
ucauggcagcuaagccacau

SEQ ID NO: 1745481 - RNA, 14 nt, Homo sapiens
guucuugcugcuag

SEQ ID NO: 1745482 - RNA, 15 nt, Homo sapiens
cacugagcacaguca

SEQ ID NO: 1745483 - RNA, 21 nt, Homo sapiens
ccuugguguuucuuuuuccac

SEQ ID NO: 1745484 - RNA, 19 nt, Homo sapiens
ucugugcagaugcuuugcc

SEQ ID NO: 1745485 - RNA, 17 nt, Homo sapiens
aguaauuucuucucaaa

SEQ ID NO: 1745486 - RNA, 20 nt, Homo sapiens
aguugacucagagugcaaga

SEQ ID NO: 1745487 - RNA, 20 nt, Homo sapiens
uaccaaauccacaagccauu

SEQ ID NO: 1745488 - RNA, 22 nt, Homo sapiens
ucaccuucguuuacuaugccug

SEQ ID NO: 1745489 - RNA, 18 nt, Homo sapiens
gaaaaauauauuggcaaa

SEQ ID NO: 1745490 - RNA, 18 nt, Homo sapiens
aaaucugguauugaacug

SEQ ID NO: 1745491 - RNA, 18 nt, Homo sapiens
aaaaccuuucaaauuuca

SEQ ID NO: 1745492 - RNA, 18 nt, Homo sapiens
cucuugccucaaccuccc

SEQ ID NO: 1745493 - RNA, 20 nt, Homo sapiens
uguguaaccagcagucacag

SEQ ID NO: 1745494 - RNA, 13 nt, Homo sapiens
auccuuuacuguu

SEQ ID NO: 1745495 - RNA, 14 nt, Homo sapiens
aacuccuaccugaa

SEQ ID NO: 1745496 - RNA, 20 nt, Homo sapiens
cugugagcucccaggugcag

SEQ ID NO: 1745497 - RNA, 14 nt, Homo sapiens
ccacuccccaguug

SEQ ID NO: 1745498 - RNA, 16 nt, Homo sapiens
ucccguaucacagugu

SEQ ID NO: 1745499 - RNA, 14 nt, Homo sapiens
agagaaugaugaua

SEQ ID NO: 1745500 - RNA, 13 nt, Homo sapiens
ccccagggcccug

SEQ ID NO: 1745501 - RNA, 24 nt, Homo sapiens
guaaagccaguuggcuucugugcc

SEQ ID NO: 1745502 - RNA, 18 nt, Homo sapiens
cauuaaagagccaguuua

SEQ ID NO: 1745503 - RNA, 18 nt, Homo sapiens
agguauuucgaaacugcc

SEQ ID NO: 1745504 - RNA, 18 nt, Homo sapiens
uaaaggggagaccucaga

SEQ ID NO: 1745505 - RNA, 19 nt, Homo sapiens
uaccaggggcugggcuccc

SEQ ID NO: 1745506 - RNA, 14 nt, Homo sapiens
aucuauuaucucaa

SEQ ID NO: 1745507 - RNA, 11 nt, Homo sapiens
aaaauugcucc

SEQ ID NO: 1745508 - RNA, 17 nt, Homo sapiens
caggaauugucaaauga

SEQ ID NO: 1745509 - RNA, 22 nt, Homo sapiens
gugugguuuuugcaaaugcuuu

SEQ ID NO: 1745510 - RNA, 22 nt, Homo sapiens
cagcuacgugugccccucucau

SEQ ID NO: 1745511 - RNA, 17 nt, Homo sapiens
ugcugcuccagugcagg

SEQ ID NO: 1745512 - RNA, 23 nt, Homo sapiens
gcugaguggccagccagugccau

SEQ ID NO: 1745513 - RNA, 14 nt, Homo sapiens
acaaagaaauagca

SEQ ID NO: 1745514 - RNA, 13 nt, Homo sapiens
guauuaacacuua

SEQ ID NO: 1745515 - RNA, 13 nt, Homo sapiens
agagaaauguguc

SEQ ID NO: 1745516 - RNA, 14 nt, Homo sapiens
cccaguguaaagaa

SEQ ID NO: 1745517 - RNA, 14 nt, Homo sapiens
gaauguucaucucu

SEQ ID NO: 1745518 - RNA, 14 nt, Homo sapiens
aacuugaaaugugu

SEQ ID NO: 1745519 - RNA, 17 nt, Homo sapiens
caagcaauuauugugcc

SEQ ID NO: 1745520 - RNA, 15 nt, Homo sapiens
aacaaccaagcgcau

SEQ ID NO: 1745521 - RNA, 15 nt, Homo sapiens
uguaaaaggccuuca

SEQ ID NO: 1745522 - RNA, 16 nt, Homo sapiens
cauaaagugucuauaa

SEQ ID NO: 1745523 - RNA, 19 nt, Homo sapiens
gaaggcuggggccagugua

SEQ ID NO: 1745524 - RNA, 21 nt, Homo sapiens
cuccacaugcugccuggcaca

SEQ ID NO: 1745525 - RNA, 21 nt, Homo sapiens
cuacugacauaucuacacuuc

SEQ ID NO: 1745526 - RNA, 18 nt, Homo sapiens
gguccuccuccagggaca

SEQ ID NO: 1745527 - RNA, 20 nt, Homo sapiens
ugggggugcucucucugagg

SEQ ID NO: 1745528 - RNA, 15 nt, Homo sapiens
ugggucuugccaugu

SEQ ID NO: 1745529 - RNA, 19 nt, Homo sapiens
aaccugaugucauauucca

SEQ ID NO: 1745530 - RNA, 12 nt, Homo sapiens
uuccucuaauau

SEQ ID NO: 1745531 - RNA, 19 nt, Homo sapiens
ucacugcauggcuucugaa

SEQ ID NO: 1745532 - RNA, 17 nt, Homo sapiens
cagccucuugagcugaa

SEQ ID NO: 1745533 - RNA, 15 nt, Homo sapiens
ugcacugcauuagaa

SEQ ID NO: 1745534 - RNA, 18 nt, Homo sapiens
aguugaccaaugaaauga

SEQ ID NO: 1745535 - RNA, 18 nt, Homo sapiens
aagauugaagccuuugcc

SEQ ID NO: 1745536 - RNA, 18 nt, Homo sapiens
gaccagcuuugcagugac

SEQ ID NO: 1745537 - RNA, 17 nt, Homo sapiens
ugaaaaauaguucuaaa

SEQ ID NO: 1745538 - RNA, 23 nt, Homo sapiens
acaugcagcccagaauagcuuug

SEQ ID NO: 1745539 - RNA, 18 nt, Homo sapiens
auacauccacagauucac

SEQ ID NO: 1745540 - RNA, 15 nt, Homo sapiens
caguucuuuccaugg

SEQ ID NO: 1745541 - RNA, 18 nt, Homo sapiens
auuaucaucaaucuuuau

SEQ ID NO: 1745542 - RNA, 23 nt, Homo sapiens
caaaugcccuuacacuuacuguu

SEQ ID NO: 1745543 - RNA, 23 nt, Homo sapiens
ucugacuguaaaauacaugguau

SEQ ID NO: 1745544 - RNA, 19 nt, Homo sapiens
caaaccaaagaccaucuga

SEQ ID NO: 1745545 - RNA, 20 nt, Homo sapiens
ccugugcccugcacguauac

SEQ ID NO: 1745546 - RNA, 17 nt, Homo sapiens
uuugcuuuuugugauau

SEQ ID NO: 1745547 - RNA, 23 nt, Homo sapiens
gcauauauuggguuccauucuca

SEQ ID NO: 1745548 - RNA, 19 nt, Homo sapiens
cgaccaaggaugggccauc

SEQ ID NO: 1745549 - RNA, 14 nt, Homo sapiens
ucucgcacaaugca

SEQ ID NO: 1745550 - RNA, 19 nt, Homo sapiens
cacuaaccaaacaaugcag

SEQ ID NO: 1745551 - RNA, 15 nt, Homo sapiens
aaagcaggacuucag

SEQ ID NO: 1745552 - RNA, 20 nt, Homo sapiens
ggccuccucucucaguuuuu

SEQ ID NO: 1745553 - RNA, 17 nt, Homo sapiens
aguuauuuacuuuuacc

SEQ ID NO: 1745554 - RNA, 13 nt, Homo sapiens
caacucuugcaca

SEQ ID NO: 1745555 - RNA, 19 nt, Homo sapiens
ggaaaauaguuugcaacau

SEQ ID NO: 1745556 - RNA, 18 nt, Homo sapiens
auuguauuccuccugaga

SEQ ID NO: 1745557 - RNA, 13 nt, Homo sapiens
ucuugcucuguca

SEQ ID NO: 1745558 - RNA, 17 nt, Homo sapiens
cugcugccucuguggaa

SEQ ID NO: 1745559 - RNA, 14 nt, Homo sapiens
accaccaaccacug

SEQ ID NO: 1745560 - RNA, 14 nt, Homo sapiens
aaaaugauuuacau

SEQ ID NO: 1745561 - RNA, 24 nt, Homo sapiens
cugcuauauauuuuaagccuucau

SEQ ID NO: 1745562 - RNA, 20 nt, Homo sapiens
ugcauuucauauuauuuuag

SEQ ID NO: 1745563 - RNA, 17 nt, Homo sapiens
uguuaguggaaaaugga

SEQ ID NO: 1745564 - RNA, 13 nt, Homo sapiens
gauauacuggccc

SEQ ID NO: 1745565 - RNA, 15 nt, Homo sapiens
ucguguggaucuugc

SEQ ID NO: 1745566 - RNA, 11 nt, Homo sapiens
aauaugcaucu

SEQ ID NO: 1745567 - RNA, 22 nt, Homo sapiens
ugcuagcauuuuagcugugcaa

SEQ ID NO: 1745568 - RNA, 23 nt, Homo sapiens
cagauacccuguuucuggaguca

SEQ ID NO: 1745569 - RNA, 15 nt, Homo sapiens
acagguaaguggcag

SEQ ID NO: 1745570 - RNA, 18 nt, Homo sapiens
caaacaguuccauaccaa

SEQ ID NO: 1745571 - RNA, 13 nt, Homo sapiens
gugcgagggccac

SEQ ID NO: 1745572 - RNA, 14 nt, Homo sapiens
gaguagcugggauu

SEQ ID NO: 1745573 - RNA, 12 nt, Homo sapiens
gcaaagugcuuu

SEQ ID NO: 1745574 - RNA, 14 nt, Homo sapiens
cacuugucucagga

SEQ ID NO: 1745575 - RNA, 19 nt, Homo sapiens
agcuugcacaacauccuca

SEQ ID NO: 1745576 - RNA, 15 nt, Homo sapiens
uuaacugcauccagc

SEQ ID NO: 1745577 - RNA, 14 nt, Homo sapiens
ccaaguacacugag

SEQ ID NO: 1745578 - RNA, 13 nt, Homo sapiens
cauauucaaggag

SEQ ID NO: 1745579 - RNA, 14 nt, Homo sapiens
cugauauccaugau

SEQ ID NO: 1745580 - RNA, 18 nt, Homo sapiens
aacccagagaugccugau

SEQ ID NO: 1745581 - RNA, 19 nt, Homo sapiens
ucccgauucccaacugagu

SEQ ID NO: 1745582 - RNA, 14 nt, Homo sapiens
cauuuguuccacag

SEQ ID NO: 1745583 - RNA, 14 nt, Homo sapiens
ccauuuuucaucau

SEQ ID NO: 1745584 - RNA, 14 nt, Homo sapiens
aaacauuuacuuuu

SEQ ID NO: 1745585 - RNA, 17 nt, Homo sapiens
uaacuggccagccauau

SEQ ID NO: 1745586 - RNA, 19 nt, Homo sapiens
auaaagcuucucucugagc

SEQ ID NO: 1745587 - RNA, 15 nt, Homo sapiens
ccagauaaguuauuu

SEQ ID NO: 1745588 - RNA, 17 nt, Homo sapiens
guaauuuuaaaagucua

SEQ ID NO: 1745589 - RNA, 14 nt, Homo sapiens
ugggaccugugauc

SEQ ID NO: 1745590 - RNA, 16 nt, Homo sapiens
agcccuucuauaccca

SEQ ID NO: 1745591 - RNA, 15 nt, Homo sapiens
guaagccccugugac

SEQ ID NO: 1745592 - RNA, 14 nt, Homo sapiens
aguggacacucaga

SEQ ID NO: 1745593 - RNA, 18 nt, Homo sapiens
caucgcaguggacugugu

SEQ ID NO: 1745594 - RNA, 14 nt, Homo sapiens
uaaauuugcuagca

SEQ ID NO: 1745595 - RNA, 22 nt, Homo sapiens
cauucccaagggagacugacca

SEQ ID NO: 1745596 - RNA, 17 nt, Homo sapiens
uauuuggcaauucacaa

SEQ ID NO: 1745597 - RNA, 22 nt, Homo sapiens
aauaucaucuuuuagacacagc

SEQ ID NO: 1745598 - RNA, 21 nt, Homo sapiens
gcaccaaggagaaggcaggaa

SEQ ID NO: 1745599 - RNA, 19 nt, Homo sapiens
ggauugacuuugcugucaa

SEQ ID NO: 1745600 - RNA, 17 nt, Homo sapiens
uccugacgcagcacaag

SEQ ID NO: 1745601 - RNA, 14 nt, Homo sapiens
ucaaaauuacauau

SEQ ID NO: 1745602 - RNA, 18 nt, Homo sapiens
uauaagugagaacaugca

SEQ ID NO: 1745603 - RNA, 18 nt, Homo sapiens
ccucccagaaugcugggu

SEQ ID NO: 1745604 - RNA, 15 nt, Homo sapiens
auggugauugucaug

SEQ ID NO: 1745605 - RNA, 22 nt, Homo sapiens
gcugcgucuccuccgcacaccu

SEQ ID NO: 1745606 - RNA, 15 nt, Homo sapiens
uugauuuuugcccag

SEQ ID NO: 1745607 - RNA, 20 nt, Homo sapiens
aaccgagguguugccagugc

SEQ ID NO: 1745608 - RNA, 17 nt, Homo sapiens
auaaaauugaguucuca

SEQ ID NO: 1745609 - RNA, 18 nt, Homo sapiens
aaucuacauucacuuuuu

SEQ ID NO: 1745610 - RNA, 15 nt, Homo sapiens
uccagagacacugag

SEQ ID NO: 1745611 - RNA, 20 nt, Homo sapiens
aggccugcagacagaccuca

SEQ ID NO: 1745612 - RNA, 16 nt, Homo sapiens
caaugggcucuuccaa

SEQ ID NO: 1745613 - RNA, 17 nt, Homo sapiens
guggcuaaaugccuaau

SEQ ID NO: 1745614 - RNA, 19 nt, Homo sapiens
uguggagugugugucuuuc

SEQ ID NO: 1745615 - RNA, 18 nt, Homo sapiens
uucuagaaaagcuuccua

SEQ ID NO: 1745616 - RNA, 16 nt, Homo sapiens
aggcaugguggcucau

SEQ ID NO: 1745617 - RNA, 14 nt, Homo sapiens
uauuuuagugugua

SEQ ID NO: 1745618 - RNA, 16 nt, Homo sapiens
cacucagcaccacuca

SEQ ID NO: 1745619 - RNA, 11 nt, Homo sapiens
gauagagcaaa

SEQ ID NO: 1745620 - RNA, 12 nt, Homo sapiens
uaguaacaugug

SEQ ID NO: 1745621 - RNA, 13 nt, Homo sapiens
agucugcuuucac

SEQ ID NO: 1745622 - RNA, 15 nt, Homo sapiens
acacaaaaaucauua

SEQ ID NO: 1745623 - RNA, 14 nt, Homo sapiens
gcagacaccagcag

SEQ ID NO: 1745624 - RNA, 22 nt, Homo sapiens
uucaccuaagucucugugaauu

SEQ ID NO: 1745625 - RNA, 12 nt, Homo sapiens
gagaaacccaga

SEQ ID NO: 1745626 - RNA, 23 nt, Homo sapiens
acugcaaacaguguucugugaca

SEQ ID NO: 1745627 - RNA, 14 nt, Homo sapiens
agcagagaacugcc

SEQ ID NO: 1745628 - RNA, 21 nt, Homo sapiens
ucuuaaacuaaaugugcaaua

SEQ ID NO: 1745629 - RNA, 14 nt, Homo sapiens
agguuugcacuucc

SEQ ID NO: 1745630 - RNA, 13 nt, Homo sapiens
cugauacuguauc

SEQ ID NO: 1745631 - RNA, 19 nt, Homo sapiens
caggcagacuacacaggau

SEQ ID NO: 1745632 - RNA, 19 nt, Homo sapiens
caagaugaguuggacccau

SEQ ID NO: 1745633 - RNA, 16 nt, Homo sapiens
acagaaauccuuucau

SEQ ID NO: 1745634 - RNA, 15 nt, Homo sapiens
uuaaucccacuugcc

SEQ ID NO: 1745635 - RNA, 22 nt, Homo sapiens
gcuuaggccucucugccuggga

SEQ ID NO: 1745636 - RNA, 22 nt, Homo sapiens
agagggucuuacuguuccaggg

SEQ ID NO: 1745637 - RNA, 16 nt, Homo sapiens
ugcaucugcuacugug

SEQ ID NO: 1745638 - RNA, 20 nt, Homo sapiens
uguguacuucuucauccaua

SEQ ID NO: 1745639 - RNA, 17 nt, Homo sapiens
cagacaaguaaucacua

SEQ ID NO: 1745640 - RNA, 20 nt, Homo sapiens
uaacaaugacauuuauauca

SEQ ID NO: 1745641 - RNA, 16 nt, Homo sapiens
aguuuggcaguauuua

SEQ ID NO: 1745642 - RNA, 16 nt, Homo sapiens
uguaauacauauagca

SEQ ID NO: 1745643 - RNA, 14 nt, Homo sapiens
uuuugguaucuuca

SEQ ID NO: 1745644 - RNA, 13 nt, Homo sapiens
ccccacagcgcuc

SEQ ID NO: 1745645 - RNA, 20 nt, Homo sapiens
aggcuggagugcaauggcgu

SEQ ID NO: 1745646 - RNA, 20 nt, Homo sapiens
aggcuagagugcaguggcgu

SEQ ID NO: 1745647 - RNA, 13 nt, Homo sapiens
guuuacagaauuu

SEQ ID NO: 1745648 - RNA, 16 nt, Homo sapiens
acaauuuucuguaaga

SEQ ID NO: 1745649 - RNA, 15 nt, Homo sapiens
caaauuuguaaacuu

SEQ ID NO: 1745650 - RNA, 18 nt, Homo sapiens
acuugugaugagagauaa

SEQ ID NO: 1745651 - RNA, 23 nt, Homo sapiens
ucucucuaaaaauaaaaugaugu

SEQ ID NO: 1745652 - RNA, 17 nt, Homo sapiens
gggucugccuccagcca

SEQ ID NO: 1745653 - RNA, 13 nt, Homo sapiens
auuccaaagucuc

SEQ ID NO: 1745654 - RNA, 17 nt, Homo sapiens
uccuuguaaagacugua

SEQ ID NO: 1745655 - RNA, 14 nt, Homo sapiens
aacuaaagcaguuu

SEQ ID NO: 1745656 - RNA, 20 nt, Homo sapiens
agaaaauaacaauaaaagac

SEQ ID NO: 1745657 - RNA, 19 nt, Homo sapiens
cucagccuggagaggccug

SEQ ID NO: 1745658 - RNA, 15 nt, Homo sapiens
gaagaauagggccca

SEQ ID NO: 1745659 - RNA, 23 nt, Homo sapiens
cccaccaugcaccccugauguuc

SEQ ID NO: 1745660 - RNA, 15 nt, Homo sapiens
acgcagaucacuaaa

SEQ ID NO: 1745661 - RNA, 14 nt, Homo sapiens
agcaccccaugcca

SEQ ID NO: 1745662 - RNA, 13 nt, Homo sapiens
augaaacagcagc

SEQ ID NO: 1745663 - RNA, 17 nt, Homo sapiens
guuccaggaaugaaaua

SEQ ID NO: 1745664 - RNA, 16 nt, Homo sapiens
aguuaauaaguuaaaa

SEQ ID NO: 1745665 - RNA, 18 nt, Homo sapiens
caaggacagucagcauuu

SEQ ID NO: 1745666 - RNA, 12 nt, Homo sapiens
agcccagggucu

SEQ ID NO: 1745667 - RNA, 22 nt, Homo sapiens
ugcucuccugggagacaaagca

SEQ ID NO: 1745668 - RNA, 23 nt, Homo sapiens
gccccugucauccucaugcugcu

SEQ ID NO: 1745669 - RNA, 20 nt, Homo sapiens
gaugugauuuaauaguguua

SEQ ID NO: 1745670 - RNA, 14 nt, Homo sapiens
uccugggggaccuu

SEQ ID NO: 1745671 - RNA, 23 nt, Homo sapiens
agcguuguaguaaaugcgugcuu

SEQ ID NO: 1745672 - RNA, 20 nt, Homo sapiens
gcuucaaggauauacugcag

SEQ ID NO: 1745673 - RNA, 14 nt, Homo sapiens
gaucuuuggacaga

SEQ ID NO: 1745674 - RNA, 16 nt, Homo sapiens
agccuugagagaccca

SEQ ID NO: 1745675 - RNA, 11 nt, Homo sapiens
uuaaccaucuu

SEQ ID NO: 1745676 - RNA, 18 nt, Homo sapiens
agcccagagcauccugcc

SEQ ID NO: 1745677 - RNA, 14 nt, Homo sapiens
auuaugcuaccuac

SEQ ID NO: 1745678 - RNA, 15 nt, Homo sapiens
uuuaacagaaccaga

SEQ ID NO: 1745679 - RNA, 16 nt, Homo sapiens
accauggagaugaaau

SEQ ID NO: 1745680 - RNA, 16 nt, Homo sapiens
gcagggacacccgacc

SEQ ID NO: 1745681 - RNA, 15 nt, Homo sapiens
gcauugacaucacag

SEQ ID NO: 1745682 - RNA, 15 nt, Homo sapiens
gcaaugacaucucag

SEQ ID NO: 1745683 - RNA, 21 nt, Homo sapiens
cccuggugaaucaccuggcug

SEQ ID NO: 1745684 - RNA, 17 nt, Homo sapiens
ccuggcgaaaccccauc

SEQ ID NO: 1745685 - RNA, 15 nt, Homo sapiens
aagauuuuaugugcu

SEQ ID NO: 1745686 - RNA, 16 nt, Homo sapiens
aaauaguauaugcauu

SEQ ID NO: 1745687 - RNA, 21 nt, Homo sapiens
aaauccccaagaacacaagaa

SEQ ID NO: 1745688 - RNA, 17 nt, Homo sapiens
guguugacaugugcuuu

SEQ ID NO: 1745689 - RNA, 14 nt, Homo sapiens
caucuucaucccaa

SEQ ID NO: 1745690 - RNA, 19 nt, Homo sapiens
ucaccucuuuguucuuccu

SEQ ID NO: 1745691 - RNA, 15 nt, Homo sapiens
aacauugacuucuug

SEQ ID NO: 1745692 - RNA, 21 nt, Homo sapiens
ugaaaaagccucuaauggacu

SEQ ID NO: 1745693 - RNA, 16 nt, Homo sapiens
guaacuggcaguuuuc

SEQ ID NO: 1745694 - RNA, 17 nt, Homo sapiens
accaccucguccucgug

SEQ ID NO: 1745695 - RNA, 17 nt, Homo sapiens
gugguccuuccaccuca

SEQ ID NO: 1745696 - RNA, 19 nt, Homo sapiens
ccauagccaauacauuuac

SEQ ID NO: 1745697 - RNA, 18 nt, Homo sapiens
cccaggcuggagggcagu

SEQ ID NO: 1745698 - RNA, 21 nt, Homo sapiens
aguaaccauggggaagaaauc

SEQ ID NO: 1745699 - RNA, 18 nt, Homo sapiens
ucccaggaaagaagcauu

SEQ ID NO: 1745700 - RNA, 16 nt, Homo sapiens
uauaacgcaggccuuu

SEQ ID NO: 1745701 - RNA, 22 nt, Homo sapiens
uaaaacuaggcauuuguaaaua

SEQ ID NO: 1745702 - RNA, 14 nt, Homo sapiens
ugaaaugcuuuuau

SEQ ID NO: 1745703 - RNA, 17 nt, Homo sapiens
uccucuuaauucccaau

SEQ ID NO: 1745704 - RNA, 16 nt, Homo sapiens
ggcaguagaacuccag

SEQ ID NO: 1745705 - RNA, 14 nt, Homo sapiens
gccggagugacaga

SEQ ID NO: 1745706 - RNA, 12 nt, Homo sapiens
uguacucagugg

SEQ ID NO: 1745707 - RNA, 16 nt, Homo sapiens
cauauggagaacaugu

SEQ ID NO: 1745708 - RNA, 19 nt, Homo sapiens
aagguguuuccugcaccug

SEQ ID NO: 1745709 - RNA, 21 nt, Homo sapiens
cuguugaagcucuggugacac

SEQ ID NO: 1745710 - RNA, 21 nt, Homo sapiens
cauguuugaaucuacauucac

SEQ ID NO: 1745711 - RNA, 15 nt, Homo sapiens
uguuggcauuaacaa

SEQ ID NO: 1745712 - RNA, 18 nt, Homo sapiens
acuucauauaacugagau

SEQ ID NO: 1745713 - RNA, 21 nt, Homo sapiens
cccuaggacuuauucccgcug

SEQ ID NO: 1745714 - RNA, 14 nt, Homo sapiens
caguuuagaaugga

SEQ ID NO: 1745715 - RNA, 16 nt, Homo sapiens
gucaaaacacugugga

SEQ ID NO: 1745716 - RNA, 23 nt, Homo sapiens
ccaaggcaaaaaaaucauauaag

SEQ ID NO: 1745717 - RNA, 16 nt, Homo sapiens
ccaagccaacccugug

SEQ ID NO: 1745718 - RNA, 16 nt, Homo sapiens
cagggcauugcucagc

SEQ ID NO: 1745719 - RNA, 17 nt, Homo sapiens
accaauuugcaccaguu

SEQ ID NO: 1745720 - RNA, 14 nt, Homo sapiens
aaccacuguacaua

SEQ ID NO: 1745721 - RNA, 11 nt, Homo sapiens
aauacuaugua

SEQ ID NO: 1745722 - RNA, 16 nt, Homo sapiens
cacuccagucuggcaa

SEQ ID NO: 1745723 - RNA, 15 nt, Homo sapiens
aaaaauguccagcca

SEQ ID NO: 1745724 - RNA, 14 nt, Homo sapiens
ucucucgugauuga

SEQ ID NO: 1745725 - RNA, 14 nt, Homo sapiens
ccggagucuucucg

SEQ ID NO: 1745726 - RNA, 21 nt, Homo sapiens
agccccgcccuccacaccucc

SEQ ID NO: 1745727 - RNA, 14 nt, Homo sapiens
gucuauaaugcaau

SEQ ID NO: 1745728 - RNA, 22 nt, Homo sapiens
agaaggguaccuugaacacugg

SEQ ID NO: 1745729 - RNA, 19 nt, Homo sapiens
guccugggauuacaggugu

SEQ ID NO: 1745730 - RNA, 19 nt, Homo sapiens
ucagcaaaagaugcuucuc

SEQ ID NO: 1745731 - RNA, 14 nt, Homo sapiens
caauaaaccacaag

SEQ ID NO: 1745732 - RNA, 15 nt, Homo sapiens
cuggcagggcgccaa

SEQ ID NO: 1745733 - RNA, 16 nt, Homo sapiens
gaaaauaaaguguaua

SEQ ID NO: 1745734 - RNA, 19 nt, Homo sapiens
aaugagaaggagucagaaa

SEQ ID NO: 1745735 - RNA, 13 nt, Homo sapiens
cagcccccugcuu

SEQ ID NO: 1745736 - RNA, 21 nt, Homo sapiens
acacucauggggaagcuucca

SEQ ID NO: 1745737 - RNA, 20 nt, Homo sapiens
ggaaacagcuaaugggacac

SEQ ID NO: 1745738 - RNA, 15 nt, Homo sapiens
uacacaauacaguau

SEQ ID NO: 1745739 - RNA, 19 nt, Homo sapiens
auaugucaugccucacuuu

SEQ ID NO: 1745740 - RNA, 15 nt, Homo sapiens
acucacuuccagugc

SEQ ID NO: 1745741 - RNA, 22 nt, Homo sapiens
auugcuaaaaaauaaauaaaag

SEQ ID NO: 1745742 - RNA, 19 nt, Homo sapiens
ucuacuaagugaugcugug

SEQ ID NO: 1745743 - RNA, 16 nt, Homo sapiens
ccucacuguccuguga

SEQ ID NO: 1745744 - RNA, 13 nt, Homo sapiens
guuuggaguuuaa

SEQ ID NO: 1745745 - RNA, 17 nt, Homo sapiens
acagagccacucuucaa

SEQ ID NO: 1745746 - RNA, 16 nt, Homo sapiens
ucaagguuacugggag

SEQ ID NO: 1745747 - RNA, 20 nt, Homo sapiens
gccuccuccagaauggagcu

SEQ ID NO: 1745748 - RNA, 21 nt, Homo sapiens
cauuuugauggugucugugac

SEQ ID NO: 1745749 - RNA, 15 nt, Homo sapiens
uuucauucuucucua

SEQ ID NO: 1745750 - RNA, 20 nt, Homo sapiens
acauuuaccagcaacuugaa

SEQ ID NO: 1745751 - RNA, 16 nt, Homo sapiens
agcugccugcagcaca

SEQ ID NO: 1745752 - RNA, 16 nt, Homo sapiens
agaaacuccagacuug

SEQ ID NO: 1745753 - RNA, 13 nt, Homo sapiens
cuucuaccagaga

SEQ ID NO: 1745754 - RNA, 19 nt, Homo sapiens
aagugauauaaaagcugca

SEQ ID NO: 1745755 - RNA, 20 nt, Homo sapiens
gccugcuugacuuuccagaa

SEQ ID NO: 1745756 - RNA, 15 nt, Homo sapiens
cuauacggaccuuuu

SEQ ID NO: 1745757 - RNA, 20 nt, Homo sapiens
cccaggccagugcugugagc

SEQ ID NO: 1745758 - RNA, 15 nt, Homo sapiens
aaggcuguaugagcu

SEQ ID NO: 1745759 - RNA, 15 nt, Homo sapiens
aggaagggagaacuu

SEQ ID NO: 1745760 - RNA, 20 nt, Homo sapiens
ugaauuagccaaaacacuua

SEQ ID NO: 1745761 - RNA, 23 nt, Homo sapiens
cugaccaacauucaaaagcacaa

SEQ ID NO: 1745762 - RNA, 15 nt, Homo sapiens
auuguacaguuuaaa

SEQ ID NO: 1745763 - RNA, 22 nt, Homo sapiens
cacugauguaaguguuguggaa

SEQ ID NO: 1745764 - RNA, 19 nt, Homo sapiens
caagauuaauuucaucacu

SEQ ID NO: 1745765 - RNA, 10 nt, Homo sapiens
ccacccaaac

SEQ ID NO: 1745766 - RNA, 13 nt, Homo sapiens
ucccaaaugaaaa

SEQ ID NO: 1745767 - RNA, 18 nt, Homo sapiens
cuuuacaccaacuccuaa

SEQ ID NO: 1745768 - RNA, 13 nt, Homo sapiens
uauucugauaaug

SEQ ID NO: 1745769 - RNA, 20 nt, Homo sapiens
cuaacuuuuccaagcaaaau

SEQ ID NO: 1745770 - RNA, 19 nt, Homo sapiens
uggcuuaagcaacagauaa

SEQ ID NO: 1745771 - RNA, 14 nt, Homo sapiens
aaccucauuuacca

SEQ ID NO: 1745772 - RNA, 14 nt, Homo sapiens
ucucuagugcugug

SEQ ID NO: 1745773 - RNA, 13 nt, Homo sapiens
uaaaggugcuauu

SEQ ID NO: 1745774 - RNA, 22 nt, Homo sapiens
ugcacacuaguuuaugcuaccu

SEQ ID NO: 1745775 - RNA, 22 nt, Homo sapiens
ugcuugccucaguaaaaugaac

SEQ ID NO: 1745776 - RNA, 15 nt, Homo sapiens
aaugucuuaaugcaa

SEQ ID NO: 1745777 - RNA, 22 nt, Homo sapiens
gaagugugucacccuuaggcca

SEQ ID NO: 1745778 - RNA, 16 nt, Homo sapiens
ucuccgagccauguga

SEQ ID NO: 1745779 - RNA, 21 nt, Homo sapiens
ugguuucuguacaacuaccuc

SEQ ID NO: 1745780 - RNA, 18 nt, Homo sapiens
cuaagacuaacaaaggca

SEQ ID NO: 1745781 - RNA, 15 nt, Homo sapiens
ugaauucucugcuca

SEQ ID NO: 1745782 - RNA, 17 nt, Homo sapiens
ggcagagaagagaccaa

SEQ ID NO: 1745783 - RNA, 23 nt, Homo sapiens
cagccuugaugccauaugccuug

SEQ ID NO: 1745784 - RNA, 15 nt, Homo sapiens
ccacucaguugcaac

SEQ ID NO: 1745785 - RNA, 23 nt, Homo sapiens
uccaguuuagaacgcaauguuuc

SEQ ID NO: 1745786 - RNA, 21 nt, Homo sapiens
cuuacugucuucuucauguca

SEQ ID NO: 1745787 - RNA, 15 nt, Homo sapiens
uguaacuuacugcga

SEQ ID NO: 1745788 - RNA, 18 nt, Homo sapiens
cuggccacagacucccuc

SEQ ID NO: 1745789 - RNA, 16 nt, Homo sapiens
cuggcagccucaggag

SEQ ID NO: 1745790 - RNA, 17 nt, Homo sapiens
gcuuagugagcagugag

SEQ ID NO: 1745791 - RNA, 13 nt, Homo sapiens
acagcugaugaac

SEQ ID NO: 1745792 - RNA, 17 nt, Homo sapiens
ucugacuuugaauuuau

SEQ ID NO: 1745793 - RNA, 19 nt, Homo sapiens
ugaaaguaaaagcagcaua

SEQ ID NO: 1745794 - RNA, 22 nt, Homo sapiens
acccuccccaaggaugaccaca

SEQ ID NO: 1745795 - RNA, 19 nt, Homo sapiens
auacaagccacuaccuucu

SEQ ID NO: 1745796 - RNA, 15 nt, Homo sapiens
agcccugucugcuag

SEQ ID NO: 1745797 - RNA, 19 nt, Homo sapiens
acuuuaggugaacaaauaa

SEQ ID NO: 1745798 - RNA, 19 nt, Homo sapiens
aagcugagacccucgccac

SEQ ID NO: 1745799 - RNA, 15 nt, Homo sapiens
acuuggaaccucauu

SEQ ID NO: 1745800 - RNA, 15 nt, Homo sapiens
cugcauaaauguggu

SEQ ID NO: 1745801 - RNA, 19 nt, Homo sapiens
auuauuuccuuauaugugu

SEQ ID NO: 1745802 - RNA, 13 nt, Homo sapiens
uaaauaguuugaa

SEQ ID NO: 1745803 - RNA, 19 nt, Homo sapiens
cuccauuucaacuccagaa

SEQ ID NO: 1745804 - RNA, 18 nt, Homo sapiens
ggucggggggguccccau

SEQ ID NO: 1745805 - RNA, 15 nt, Homo sapiens
cuagauuagaagugu

SEQ ID NO: 1745806 - RNA, 21 nt, Homo sapiens
agugagccaagaaacacugcc

SEQ ID NO: 1745807 - RNA, 21 nt, Homo sapiens
ccaguguccccaggggcacac

SEQ ID NO: 1745808 - RNA, 12 nt, Homo sapiens
ugaaacaaacau

SEQ ID NO: 1745809 - RNA, 20 nt, Homo sapiens
uagcaauguaacauuaauuc

SEQ ID NO: 1745810 - RNA, 19 nt, Homo sapiens
cggagggauugaucuucag

SEQ ID NO: 1745811 - RNA, 18 nt, Homo sapiens
gagggagaccccaaaaag

SEQ ID NO: 1745812 - RNA, 14 nt, Homo sapiens
gcugacacuggcag

SEQ ID NO: 1745813 - RNA, 15 nt, Homo sapiens
caauucccauugcau

SEQ ID NO: 1745814 - RNA, 20 nt, Homo sapiens
cucccauaagcuaagccuua

SEQ ID NO: 1745815 - RNA, 18 nt, Homo sapiens
gucacaauuaugugcaaa

SEQ ID NO: 1745816 - RNA, 23 nt, Homo sapiens
auuuuaauagggaauauaucucu

SEQ ID NO: 1745817 - RNA, 14 nt, Homo sapiens
agcuuggauaacca

SEQ ID NO: 1745818 - RNA, 12 nt, Homo sapiens
auauuacucagc

SEQ ID NO: 1745819 - RNA, 22 nt, Homo sapiens
cuggcaauaaacuccuacuaaa

SEQ ID NO: 1745820 - RNA, 16 nt, Homo sapiens
gcaggugggcacugga

SEQ ID NO: 1745821 - RNA, 16 nt, Homo sapiens
aaacuuagaaagggaa

SEQ ID NO: 1745822 - RNA, 15 nt, Homo sapiens
ucaaacauaacugug

SEQ ID NO: 1745823 - RNA, 15 nt, Homo sapiens
gggacccaguggcag

SEQ ID NO: 1745824 - RNA, 17 nt, Homo sapiens
gaauauuuauucaguga

SEQ ID NO: 1745825 - RNA, 22 nt, Homo sapiens
ggcugaccuuccucgcagagag

SEQ ID NO: 1745826 - RNA, 17 nt, Homo sapiens
caacaggaggacaauuc

SEQ ID NO: 1745827 - RNA, 17 nt, Homo sapiens
acgcacgcucgcugcca

SEQ ID NO: 1745828 - RNA, 22 nt, Homo sapiens
ugaaaagcagauugcagaaaua

SEQ ID NO: 1745829 - RNA, 16 nt, Homo sapiens
accuuuuugaacaugu

SEQ ID NO: 1745830 - RNA, 18 nt, Homo sapiens
ccaagcccugcauuguaa

SEQ ID NO: 1745831 - RNA, 23 nt, Homo sapiens
ggcauucuguggccagccaaaag

SEQ ID NO: 1745832 - RNA, 19 nt, Homo sapiens
uuccuggcauaccuuuaag

SEQ ID NO: 1745833 - RNA, 22 nt, Homo sapiens
uaaacauuacuguuuuccaugc

SEQ ID NO: 1745834 - RNA, 13 nt, Homo sapiens
cagcacugacaau

SEQ ID NO: 1745835 - RNA, 22 nt, Homo sapiens
ccuauagcagaagcacauuuuc

SEQ ID NO: 1745836 - RNA, 17 nt, Homo sapiens
aaaguguaaguucacaa

SEQ ID NO: 1745837 - RNA, 15 nt, Homo sapiens
cauuccagcuuccuu

SEQ ID NO: 1745838 - RNA, 23 nt, Homo sapiens
gaggcuuagcuuugcucugccaa

SEQ ID NO: 1745839 - RNA, 12 nt, Homo sapiens
cuuauacuguag

SEQ ID NO: 1745840 - RNA, 12 nt, Homo sapiens
caaauacugaug

SEQ ID NO: 1745841 - RNA, 14 nt, Homo sapiens
ccuagcugugucag

SEQ ID NO: 1745842 - RNA, 18 nt, Homo sapiens
ccaacgcuccaaagucau

SEQ ID NO: 1745843 - RNA, 16 nt, Homo sapiens
gcagacaccugccuua

SEQ ID NO: 1745844 - RNA, 18 nt, Homo sapiens
ucugucgccuuagcaugu

SEQ ID NO: 1745845 - RNA, 20 nt, Homo sapiens
gcuccauggcugccaucuca

SEQ ID NO: 1745846 - RNA, 14 nt, Homo sapiens
gaaaauguuuugua

SEQ ID NO: 1745847 - RNA, 15 nt, Homo sapiens
cauauucaugcaagu

SEQ ID NO: 1745848 - RNA, 14 nt, Homo sapiens
ugcacagugauaua

SEQ ID NO: 1745849 - RNA, 13 nt, Homo sapiens
uccagucuuccac

SEQ ID NO: 1745850 - RNA, 14 nt, Homo sapiens
uuaacauuuugagc

SEQ ID NO: 1745851 - RNA, 17 nt, Homo sapiens
gcucgccaaggccuagg

SEQ ID NO: 1745852 - RNA, 20 nt, Homo sapiens
gcacgcacaugccaaugcac

SEQ ID NO: 1745853 - RNA, 18 nt, Homo sapiens
aagcaugaaacuguguau

SEQ ID NO: 1745854 - RNA, 16 nt, Homo sapiens
accgugaccagugcug

SEQ ID NO: 1745855 - RNA, 15 nt, Homo sapiens
uggcucccaaauucc

SEQ ID NO: 1745856 - RNA, 19 nt, Homo sapiens
aauaaggccucauccucca

SEQ ID NO: 1745857 - RNA, 22 nt, Homo sapiens
uguguauauauaguagcauuuc

SEQ ID NO: 1745858 - RNA, 16 nt, Homo sapiens
auuguaggaucuuuag

SEQ ID NO: 1745859 - RNA, 20 nt, Homo sapiens
agccauaacguuagacugca

SEQ ID NO: 1745860 - RNA, 16 nt, Homo sapiens
gcucugaccugagcua

SEQ ID NO: 1745861 - RNA, 13 nt, Homo sapiens
aaacuuuuucaca

SEQ ID NO: 1745862 - RNA, 18 nt, Homo sapiens
cauaauuggacucuguca

SEQ ID NO: 1745863 - RNA, 17 nt, Homo sapiens
aaagcauguacaguguu

SEQ ID NO: 1745864 - RNA, 15 nt, Homo sapiens
uccgaggcaaagaga

SEQ ID NO: 1745865 - RNA, 21 nt, Homo sapiens
gcucagaggcgcacugugacc

SEQ ID NO: 1745866 - RNA, 19 nt, Homo sapiens
aaaaauaagcugaugucca

SEQ ID NO: 1745867 - RNA, 17 nt, Homo sapiens
ucaaacuauagugauau

SEQ ID NO: 1745868 - RNA, 13 nt, Homo sapiens
agauggucaucca

SEQ ID NO: 1745869 - RNA, 17 nt, Homo sapiens
uacaguaugaucucagu

SEQ ID NO: 1745870 - RNA, 21 nt, Homo sapiens
gcucugcgccgagccucagaa

SEQ ID NO: 1745871 - RNA, 15 nt, Homo sapiens
uaacagucauuuaaa

SEQ ID NO: 1745872 - RNA, 23 nt, Homo sapiens
gcuuccgagaauagcuccacugg

SEQ ID NO: 1745873 - RNA, 23 nt, Homo sapiens
gucuauuugucucuuacaucucc

SEQ ID NO: 1745874 - RNA, 18 nt, Homo sapiens
gcguuuggcccugugacu

SEQ ID NO: 1745875 - RNA, 16 nt, Homo sapiens
aucauacuuacuaguu

SEQ ID NO: 1745876 - RNA, 20 nt, Homo sapiens
ugucuauguugugauccuuc

SEQ ID NO: 1745877 - RNA, 16 nt, Homo sapiens
cagcaaugacaucuca

SEQ ID NO: 1745878 - RNA, 16 nt, Homo sapiens
gaaucaagucugugaa

SEQ ID NO: 1745879 - RNA, 15 nt, Homo sapiens
gacaaauauuuucau

SEQ ID NO: 1745880 - RNA, 14 nt, Homo sapiens
acauuuugaaauaa

SEQ ID NO: 1745881 - RNA, 17 nt, Homo sapiens
ucuuacuccuggcuuua

SEQ ID NO: 1745882 - RNA, 20 nt, Homo sapiens
ugaacauaaugaacagaauu

SEQ ID NO: 1745883 - RNA, 20 nt, Homo sapiens
aggagacccuagaugugcuc

SEQ ID NO: 1745884 - RNA, 21 nt, Homo sapiens
gaaacgucuucuaaacuuccc

SEQ ID NO: 1745885 - RNA, 14 nt, Homo sapiens
guguuaacaaugca

SEQ ID NO: 1745886 - RNA, 12 nt, Homo sapiens
caaaacccaggg

SEQ ID NO: 1745887 - RNA, 23 nt, Homo sapiens
uucccaaucccauuccugggcua

SEQ ID NO: 1745888 - RNA, 19 nt, Homo sapiens
uaccuuaagagacacucca

SEQ ID NO: 1745889 - RNA, 17 nt, Homo sapiens
uuauauaucgacauaca

SEQ ID NO: 1745890 - RNA, 14 nt, Homo sapiens
cagcgccaccucuu

SEQ ID NO: 1745891 - RNA, 19 nt, Homo sapiens
ugcaaggcuaagaaguacu

SEQ ID NO: 1745892 - RNA, 22 nt, Homo sapiens
aauuccuaauaaguuugaucaa

SEQ ID NO: 1745893 - RNA, 13 nt, Homo sapiens
acuguuuuccuua

SEQ ID NO: 1745894 - RNA, 18 nt, Homo sapiens
cacauggugugaguccaa

SEQ ID NO: 1745895 - RNA, 20 nt, Homo sapiens
acugcauaaaccaaugagcu

SEQ ID NO: 1745896 - RNA, 16 nt, Homo sapiens
gugaacggacacugaa

SEQ ID NO: 1745897 - RNA, 18 nt, Homo sapiens
uccuugaagcugcccuug

SEQ ID NO: 1745898 - RNA, 16 nt, Homo sapiens
uccaaagagccuucag

SEQ ID NO: 1745899 - RNA, 15 nt, Homo sapiens
aagaaugaaacaauc

SEQ ID NO: 1745900 - RNA, 18 nt, Homo sapiens
cuuugggagcaggauuuu

SEQ ID NO: 1745901 - RNA, 23 nt, Homo sapiens
gaauuaguccuugcuuggcugcu

SEQ ID NO: 1745902 - RNA, 22 nt, Homo sapiens
auguaaaugaaguaacuugucu

SEQ ID NO: 1745903 - RNA, 16 nt, Homo sapiens
guaagcaagagccaac

SEQ ID NO: 1745904 - RNA, 12 nt, Homo sapiens
ggagcagccagg

SEQ ID NO: 1745905 - RNA, 19 nt, Homo sapiens
guggccccaaauuugcuau

SEQ ID NO: 1745906 - RNA, 19 nt, Homo sapiens
acucuggccuccaaaaugg

SEQ ID NO: 1745907 - RNA, 17 nt, Homo sapiens
cacacuuuacacaagaa

SEQ ID NO: 1745908 - RNA, 12 nt, Homo sapiens
gacagggcgggg

SEQ ID NO: 1745909 - RNA, 16 nt, Homo sapiens
uacuuuuaaaugucuu

SEQ ID NO: 1745910 - RNA, 12 nt, Homo sapiens
gaaauuacuuua

SEQ ID NO: 1745911 - RNA, 23 nt, Homo sapiens
aaaaccuacgcacauaccuucau

SEQ ID NO: 1745912 - RNA, 16 nt, Homo sapiens
uuaauggggaggacaa

SEQ ID NO: 1745913 - RNA, 20 nt, Homo sapiens
cuguggccaguugacaucca

SEQ ID NO: 1745914 - RNA, 13 nt, Homo sapiens
cagauacauuucc

SEQ ID NO: 1745915 - RNA, 16 nt, Homo sapiens
gcagcuuggcauucuu

SEQ ID NO: 1745916 - RNA, 14 nt, Homo sapiens
auuuucuaccccca

SEQ ID NO: 1745917 - RNA, 19 nt, Homo sapiens
augucuuguuucaguccau

SEQ ID NO: 1745918 - RNA, 17 nt, Homo sapiens
guuccaaugucaaugug

SEQ ID NO: 1745919 - RNA, 13 nt, Homo sapiens
ccuaccccagggc

SEQ ID NO: 1745920 - RNA, 16 nt, Homo sapiens
aggucaccugugcaca

SEQ ID NO: 1745921 - RNA, 17 nt, Homo sapiens
caugguggcucaugccu

SEQ ID NO: 1745922 - RNA, 23 nt, Homo sapiens
aggcuccgggcaccaggggccaa

SEQ ID NO: 1745923 - RNA, 11 nt, Homo sapiens
ccccacuccag

SEQ ID NO: 1745924 - RNA, 17 nt, Homo sapiens
uguaaaugcucguguga

SEQ ID NO: 1745925 - RNA, 13 nt, Homo sapiens
acacguacuucua

SEQ ID NO: 1745926 - RNA, 13 nt, Homo sapiens
ucauguacaucca

SEQ ID NO: 1745927 - RNA, 20 nt, Homo sapiens
auuucuagccugcacuuuga

SEQ ID NO: 1745928 - RNA, 14 nt, Homo sapiens
gcuucauacagaag

SEQ ID NO: 1745929 - RNA, 14 nt, Homo sapiens
aagaacaucaguuc

SEQ ID NO: 1745930 - RNA, 17 nt, Homo sapiens
aggggcaaagaacugcc

SEQ ID NO: 1745931 - RNA, 14 nt, Homo sapiens
aaagcaugcauucu

SEQ ID NO: 1745932 - RNA, 18 nt, Homo sapiens
uccucgggggaaagcaca

SEQ ID NO: 1745933 - RNA, 20 nt, Homo sapiens
accauugaaggaaagcuaua

SEQ ID NO: 1745934 - RNA, 17 nt, Homo sapiens
ugcaugaaaccacugga

SEQ ID NO: 1745935 - RNA, 20 nt, Homo sapiens
gauuuguaguuugucccauu

SEQ ID NO: 1745936 - RNA, 15 nt, Homo sapiens
caaaaagaugcuuua

SEQ ID NO: 1745937 - RNA, 10 nt, Homo sapiens
gcaccagagg

SEQ ID NO: 1745938 - RNA, 13 nt, Homo sapiens
gcacauguauuga

SEQ ID NO: 1745939 - RNA, 21 nt, Homo sapiens
agagucccacugccucagguu

SEQ ID NO: 1745940 - RNA, 12 nt, Homo sapiens
auauauuucaca

SEQ ID NO: 1745941 - RNA, 12 nt, Homo sapiens
caacucuugauu

SEQ ID NO: 1745942 - RNA, 19 nt, Homo sapiens
cugcccccuuuacuccucg

SEQ ID NO: 1745943 - RNA, 20 nt, Homo sapiens
cauaauaaaucacacauuca

SEQ ID NO: 1745944 - RNA, 20 nt, Homo sapiens
uccauuucguuuagcugaau

SEQ ID NO: 1745945 - RNA, 18 nt, Homo sapiens
uguauugcucuuuaucug

SEQ ID NO: 1745946 - RNA, 14 nt, Homo sapiens
cucuuaugccauuu

SEQ ID NO: 1745947 - RNA, 24 nt, Homo sapiens
gacaacucauuuucauauuguaau

SEQ ID NO: 1745948 - RNA, 15 nt, Homo sapiens
aaauacaaaaagcaa

SEQ ID NO: 1745949 - RNA, 23 nt, Homo sapiens
cuuaggaauacuguuuuaucucc

SEQ ID NO: 1745950 - RNA, 21 nt, Homo sapiens
cccucugcagaacagugaaag

SEQ ID NO: 1745951 - RNA, 22 nt, Homo sapiens
aaacugcccuggcuccagugaa

SEQ ID NO: 1745952 - RNA, 22 nt, Homo sapiens
acuguugauucgucugcgauuu

SEQ ID NO: 1745953 - RNA, 18 nt, Homo sapiens
ucaaugugaaauaaagag

SEQ ID NO: 1745954 - RNA, 19 nt, Homo sapiens
cugaaguuugugggggcca

SEQ ID NO: 1745955 - RNA, 17 nt, Homo sapiens
agaaccuaaugcacucu

SEQ ID NO: 1745956 - RNA, 17 nt, Homo sapiens
ccugcugggacugagaa

SEQ ID NO: 1745957 - RNA, 15 nt, Homo sapiens
uucacugcacaagau

SEQ ID NO: 1745958 - RNA, 15 nt, Homo sapiens
ucauguucaucucag

SEQ ID NO: 1745959 - RNA, 12 nt, Homo sapiens
uuuucuguucuc

SEQ ID NO: 1745960 - RNA, 21 nt, Homo sapiens
cagcuaacccgugcagaacca

SEQ ID NO: 1745961 - RNA, 14 nt, Homo sapiens
auggcuacugugcc

SEQ ID NO: 1745962 - RNA, 21 nt, Homo sapiens
cuauaaucccagcuacuuggg

SEQ ID NO: 1745963 - RNA, 20 nt, Homo sapiens
agggcuggcucugcacuaag

SEQ ID NO: 1745964 - RNA, 20 nt, Homo sapiens
cacucauuuggauugccuua

SEQ ID NO: 1745965 - RNA, 13 nt, Homo sapiens
augaugcaguuuu

SEQ ID NO: 1745966 - RNA, 18 nt, Homo sapiens
auucugccacuccugaca

SEQ ID NO: 1745967 - RNA, 21 nt, Homo sapiens
uuaauaaguauuuauugcaua

SEQ ID NO: 1745968 - RNA, 19 nt, Homo sapiens
cagguucucaccucagggg

SEQ ID NO: 1745969 - RNA, 17 nt, Homo sapiens
caugguuuuacagugaa

SEQ ID NO: 1745970 - RNA, 17 nt, Homo sapiens
cgugcauuagcacagau

SEQ ID NO: 1745971 - RNA, 17 nt, Homo sapiens
cuucuuuuugcuucaaa

SEQ ID NO: 1745972 - RNA, 18 nt, Homo sapiens
uccuguuuuuugaugcuu

SEQ ID NO: 1745973 - RNA, 20 nt, Homo sapiens
agacauacauuuaugcacau

SEQ ID NO: 1745974 - RNA, 19 nt, Homo sapiens
cuuuuauuuuuuuggaacu

SEQ ID NO: 1745975 - RNA, 16 nt, Homo sapiens
gcagccccucaugccu

SEQ ID NO: 1745976 - RNA, 21 nt, Homo sapiens
ccauacauuauuucuucccag

SEQ ID NO: 1745977 - RNA, 17 nt, Homo sapiens
cuguuggauuccaugcu

SEQ ID NO: 1745978 - RNA, 20 nt, Homo sapiens
cuucagcagcacccauguaa

SEQ ID NO: 1745979 - RNA, 13 nt, Homo sapiens
ggagggacaagug

SEQ ID NO: 1745980 - RNA, 18 nt, Homo sapiens
guaauccguucauagaaa

SEQ ID NO: 1745981 - RNA, 17 nt, Homo sapiens
ugcucccugaguucacu

SEQ ID NO: 1745982 - RNA, 18 nt, Homo sapiens
aggucuggcugcuugccc

SEQ ID NO: 1745983 - RNA, 14 nt, Homo sapiens
ugaaacacagucau

SEQ ID NO: 1745984 - RNA, 17 nt, Homo sapiens
uuaauggacgaagcaac

SEQ ID NO: 1745985 - RNA, 23 nt, Homo sapiens
aggauuuggguuuggaaauggag

SEQ ID NO: 1745986 - RNA, 14 nt, Homo sapiens
gugaacaguguaua

SEQ ID NO: 1745987 - RNA, 21 nt, Homo sapiens
cauauauuaccccuucauguc

SEQ ID NO: 1745988 - RNA, 17 nt, Homo sapiens
uauauuacaagggauaa

SEQ ID NO: 1745989 - RNA, 14 nt, Homo sapiens
ccagcuuaucucag

SEQ ID NO: 1745990 - RNA, 13 nt, Homo sapiens
aagacuaaauuaa

SEQ ID NO: 1745991 - RNA, 21 nt, Homo sapiens
gcugagaauguggaauaccua

SEQ ID NO: 1745992 - RNA, 12 nt, Homo sapiens
ccugaagugaug

SEQ ID NO: 1745993 - RNA, 14 nt, Homo sapiens
ucaugcuugacaua

SEQ ID NO: 1745994 - RNA, 17 nt, Homo sapiens
cuucaccuaagucucug

SEQ ID NO: 1745995 - RNA, 23 nt, Homo sapiens
uaaagcucguccccauugcuuaa

SEQ ID NO: 1745996 - RNA, 20 nt, Homo sapiens
guccaaccagaaacaccccu

SEQ ID NO: 1745997 - RNA, 20 nt, Homo sapiens
aacaguucccaucaccauca

SEQ ID NO: 1745998 - RNA, 22 nt, Homo sapiens
auccauuugccuuucugggagc

SEQ ID NO: 1745999 - RNA, 16 nt, Homo sapiens
auguuacugacuccuc

SEQ ID NO: 1746000 - RNA, 22 nt, Homo sapiens
uuuggucauuucccucuguaau

SEQ ID NO: 1746001 - RNA, 12 nt, Homo sapiens
cauccaucagcu

SEQ ID NO: 1746002 - RNA, 21 nt, Homo sapiens
guauuuaauuguaaacuguac

SEQ ID NO: 1746003 - RNA, 18 nt, Homo sapiens
cacuaucccauuugcccu

SEQ ID NO: 1746004 - RNA, 18 nt, Homo sapiens
agcucuuccccaucucac

SEQ ID NO: 1746005 - RNA, 18 nt, Homo sapiens
cacuucuuuccucaaaga

SEQ ID NO: 1746006 - RNA, 22 nt, Homo sapiens
cagcuucaucaauuuuuauaca

SEQ ID NO: 1746007 - RNA, 19 nt, Homo sapiens
uaaauguuaugacuaugua

SEQ ID NO: 1746008 - RNA, 12 nt, Homo sapiens
aggacuguagaa

SEQ ID NO: 1746009 - RNA, 23 nt, Homo sapiens
cauugcacuccagccugggcaac

SEQ ID NO: 1746010 - RNA, 21 nt, Homo sapiens
ugcuccagcaacugcccuucc

SEQ ID NO: 1746011 - RNA, 15 nt, Homo sapiens
ucccaagguucaaua

SEQ ID NO: 1746012 - RNA, 14 nt, Homo sapiens
gcccugcgcugccu

SEQ ID NO: 1746013 - RNA, 17 nt, Homo sapiens
aacaauauauguccuau

SEQ ID NO: 1746014 - RNA, 18 nt, Homo sapiens
auuuuauuacaucuuuca

SEQ ID NO: 1746015 - RNA, 13 nt, Homo sapiens
gagcuacaacaaa

SEQ ID NO: 1746016 - RNA, 22 nt, Homo sapiens
acaucauaaacaaagaguagaa

SEQ ID NO: 1746017 - RNA, 13 nt, Homo sapiens
aaaucaacugaau

SEQ ID NO: 1746018 - RNA, 20 nt, Homo sapiens
uuuaaauaauagacauacag

SEQ ID NO: 1746019 - RNA, 18 nt, Homo sapiens
gcuuccuugcucagugca

SEQ ID NO: 1746020 - RNA, 20 nt, Homo sapiens
ucaaaggaaaauaguaaugu

SEQ ID NO: 1746021 - RNA, 13 nt, Homo sapiens
uggcucagaaaau

SEQ ID NO: 1746022 - RNA, 19 nt, Homo sapiens
acgguggccagagaugcca

SEQ ID NO: 1746023 - RNA, 14 nt, Homo sapiens
guacuaguacuauu

SEQ ID NO: 1746024 - RNA, 20 nt, Homo sapiens
uaauagggagaaaccaagag

SEQ ID NO: 1746025 - RNA, 14 nt, Homo sapiens
aaugcaaucaggau

SEQ ID NO: 1746026 - RNA, 21 nt, Homo sapiens
uccagccagccaaauccaucc

SEQ ID NO: 1746027 - RNA, 23 nt, Homo sapiens
accaaaucccugggguaaaagcu

SEQ ID NO: 1746028 - RNA, 21 nt, Homo sapiens
augucuccugagcacccagaa

SEQ ID NO: 1746029 - RNA, 15 nt, Homo sapiens
caaggcacucuagau

SEQ ID NO: 1746030 - RNA, 20 nt, Homo sapiens
caugcuuccuauacaguucu

SEQ ID NO: 1746031 - RNA, 21 nt, Homo sapiens
aguuuauuuuuauacuuucag

SEQ ID NO: 1746032 - RNA, 14 nt, Homo sapiens
ucuuuaaugcaaua

SEQ ID NO: 1746033 - RNA, 17 nt, Homo sapiens
uuucccugccccugucc

SEQ ID NO: 1746034 - RNA, 18 nt, Homo sapiens
ugagagaaagccacaaag

SEQ ID NO: 1746035 - RNA, 23 nt, Homo sapiens
gcaucauuaauaccuaaacugua

SEQ ID NO: 1746036 - RNA, 18 nt, Homo sapiens
gaauuaagaaauacucau

SEQ ID NO: 1746037 - RNA, 19 nt, Homo sapiens
caauuucacuuagucugua

SEQ ID NO: 1746038 - RNA, 14 nt, Homo sapiens
aacugagaagccaa

SEQ ID NO: 1746039 - RNA, 14 nt, Homo sapiens
cucuacgccaaagu

SEQ ID NO: 1746040 - RNA, 19 nt, Homo sapiens
aagaagggaguuccaguca

SEQ ID NO: 1746041 - RNA, 15 nt, Homo sapiens
augucacugcucuug

SEQ ID NO: 1746042 - RNA, 14 nt, Homo sapiens
gaagcucuucuucc

SEQ ID NO: 1746043 - RNA, 19 nt, Homo sapiens
cggcagcuugagccuguca

SEQ ID NO: 1746044 - RNA, 17 nt, Homo sapiens
ucagaaauguguuauca

SEQ ID NO: 1746045 - RNA, 13 nt, Homo sapiens
uguauucauauau

SEQ ID NO: 1746046 - RNA, 13 nt, Homo sapiens
aagugucaaggug

SEQ ID NO: 1746047 - RNA, 20 nt, Homo sapiens
caggguuucgagaagcugcu

SEQ ID NO: 1746048 - RNA, 23 nt, Homo sapiens
agccugccucccaagguccucuc

SEQ ID NO: 1746049 - RNA, 19 nt, Homo sapiens
cuuaaaagaacauaggaau

SEQ ID NO: 1746050 - RNA, 17 nt, Homo sapiens
ccugguuuucauuauuu

SEQ ID NO: 1746051 - RNA, 16 nt, Homo sapiens
agcacaucucuucaug

SEQ ID NO: 1746052 - RNA, 21 nt, Homo sapiens
gggccgguuuuccucagcucu

SEQ ID NO: 1746053 - RNA, 13 nt, Homo sapiens
cuccaccauuucu

SEQ ID NO: 1746054 - RNA, 13 nt, Homo sapiens
ucccuccaccuca

SEQ ID NO: 1746055 - RNA, 17 nt, Homo sapiens
ucuuaaaauagccauaa

SEQ ID NO: 1746056 - RNA, 16 nt, Homo sapiens
ugacauguaagaaaau

SEQ ID NO: 1746057 - RNA, 11 nt, Homo sapiens
ucuguaucugc

SEQ ID NO: 1746058 - RNA, 19 nt, Homo sapiens
ggaugugaggcacuguggg

SEQ ID NO: 1746059 - RNA, 20 nt, Homo sapiens
uucaccccacucagcucacc

SEQ ID NO: 1746060 - RNA, 18 nt, Homo sapiens
caucuuucaagggaccuc

SEQ ID NO: 1746061 - RNA, 22 nt, Homo sapiens
aggccucucggugcuccaucuc

SEQ ID NO: 1746062 - RNA, 14 nt, Homo sapiens
agcugccccgggga

SEQ ID NO: 1746063 - RNA, 19 nt, Homo sapiens
cacaugaccacauagcaug

SEQ ID NO: 1746064 - RNA, 11 nt, Homo sapiens
ggcuuccaucc

SEQ ID NO: 1746065 - RNA, 15 nt, Homo sapiens
ccugcugaccuccca

SEQ ID NO: 1746066 - RNA, 16 nt, Homo sapiens
gggaacggcagggcuc

SEQ ID NO: 1746067 - RNA, 13 nt, Homo sapiens
guacugagacaaa

SEQ ID NO: 1746068 - RNA, 15 nt, Homo sapiens
cagagggaccagcug

SEQ ID NO: 1746069 - RNA, 16 nt, Homo sapiens
uuuauacguguagcua

SEQ ID NO: 1746070 - RNA, 19 nt, Homo sapiens
aggaccagcccuugaggga

SEQ ID NO: 1746071 - RNA, 19 nt, Homo sapiens
ccucucucccuuuuacccu

SEQ ID NO: 1746072 - RNA, 22 nt, Homo sapiens
cacagcuguaguaccccaagaa

SEQ ID NO: 1746073 - RNA, 18 nt, Homo sapiens
gagggagguuccucgcag

SEQ ID NO: 1746074 - RNA, 19 nt, Homo sapiens
gaaaaacuuuugacuugua

SEQ ID NO: 1746075 - RNA, 21 nt, Homo sapiens
acugugacuuuauuagcagcu

SEQ ID NO: 1746076 - RNA, 14 nt, Homo sapiens
ccacuaccaaaaga

SEQ ID NO: 1746077 - RNA, 16 nt, Homo sapiens
caggcagauguuccua

SEQ ID NO: 1746078 - RNA, 18 nt, Homo sapiens
aaugugguguuacuguag

SEQ ID NO: 1746079 - RNA, 18 nt, Homo sapiens
acaaaugccacacaucac

SEQ ID NO: 1746080 - RNA, 15 nt, Homo sapiens
cuggaccauuccagg

SEQ ID NO: 1746081 - RNA, 15 nt, Homo sapiens
uugauucauguucau

SEQ ID NO: 1746082 - RNA, 20 nt, Homo sapiens
cgggcacucccuaaguccac

SEQ ID NO: 1746083 - RNA, 15 nt, Homo sapiens
gaagccggcggccca

SEQ ID NO: 1746084 - RNA, 22 nt, Homo sapiens
cagcucuuggcuccacugggau

SEQ ID NO: 1746085 - RNA, 14 nt, Homo sapiens
uuaaauuccacaga

SEQ ID NO: 1746086 - RNA, 21 nt, Homo sapiens
agcugaaugugauacaugccg

SEQ ID NO: 1746087 - RNA, 16 nt, Homo sapiens
cucgaccucccaaagu

SEQ ID NO: 1746088 - RNA, 16 nt, Homo sapiens
agcggagaggacccca

SEQ ID NO: 1746089 - RNA, 23 nt, Homo sapiens
ugccaauuauuguuacacauuaa

SEQ ID NO: 1746090 - RNA, 12 nt, Homo sapiens
gcugucaggggc

SEQ ID NO: 1746091 - RNA, 14 nt, Homo sapiens
gccuuuuauguaaa

SEQ ID NO: 1746092 - RNA, 22 nt, Homo sapiens
ugaucacaucuaaagcuuuauc

SEQ ID NO: 1746093 - RNA, 18 nt, Homo sapiens
cuguuagcugcucacuua

SEQ ID NO: 1746094 - RNA, 18 nt, Homo sapiens
cauuugaauucauuugcu

SEQ ID NO: 1746095 - RNA, 20 nt, Homo sapiens
uuuaacugucccagcgacau

SEQ ID NO: 1746096 - RNA, 23 nt, Homo sapiens
uggaaagauuauccuguuacuga

SEQ ID NO: 1746097 - RNA, 19 nt, Homo sapiens
ccagucacugugagcuccc

SEQ ID NO: 1746098 - RNA, 18 nt, Homo sapiens
aggcauugagacuucaag

SEQ ID NO: 1746099 - RNA, 16 nt, Homo sapiens
cucaaguuaggaggau

SEQ ID NO: 1746100 - RNA, 17 nt, Homo sapiens
ucccuugaaauuuagau

SEQ ID NO: 1746101 - RNA, 18 nt, Homo sapiens
cucaagcuucuucacuca

SEQ ID NO: 1746102 - RNA, 13 nt, Homo sapiens
uuaucaacaugca

SEQ ID NO: 1746103 - RNA, 15 nt, Homo sapiens
gauaaaucagugccu

SEQ ID NO: 1746104 - RNA, 18 nt, Homo sapiens
gaauucuaggcagcaccu

SEQ ID NO: 1746105 - RNA, 11 nt, Homo sapiens
aaauccaaaga

SEQ ID NO: 1746106 - RNA, 19 nt, Homo sapiens
ugccggccggggcugagac

SEQ ID NO: 1746107 - RNA, 17 nt, Homo sapiens
uuuaaagaaagcaacuu

SEQ ID NO: 1746108 - RNA, 15 nt, Homo sapiens
ucucaaagaaucuca

SEQ ID NO: 1746109 - RNA, 15 nt, Homo sapiens
uaacucagacacaaa

SEQ ID NO: 1746110 - RNA, 22 nt, Homo sapiens
cuuuuuuuauaucagaaugagg

SEQ ID NO: 1746111 - RNA, 23 nt, Homo sapiens
augucacgaauauggacauauca

SEQ ID NO: 1746112 - RNA, 16 nt, Homo sapiens
cccaaguaugccuuaa

SEQ ID NO: 1746113 - RNA, 14 nt, Homo sapiens
ggcagacucaccac

SEQ ID NO: 1746114 - RNA, 20 nt, Homo sapiens
cauauguauauauauauaug

SEQ ID NO: 1746115 - RNA, 18 nt, Homo sapiens
uggcauccccuuuauuaa

SEQ ID NO: 1746116 - RNA, 15 nt, Homo sapiens
cuauguaaaccacau

SEQ ID NO: 1746117 - RNA, 16 nt, Homo sapiens
ccgucacccaacauca

SEQ ID NO: 1746118 - RNA, 23 nt, Homo sapiens
ggggcacccuccaaacacugggc

SEQ ID NO: 1746119 - RNA, 22 nt, Homo sapiens
ggaauuccagugccaggccagu

SEQ ID NO: 1746120 - RNA, 21 nt, Homo sapiens
cccuacacagggccugcuauu

SEQ ID NO: 1746121 - RNA, 13 nt, Homo sapiens
uguuagaaaugca

SEQ ID NO: 1746122 - RNA, 19 nt, Homo sapiens
acuuucuguucuccagugu

SEQ ID NO: 1746123 - RNA, 21 nt, Homo sapiens
agacucuuaaugcagacucuu

SEQ ID NO: 1746124 - RNA, 23 nt, Homo sapiens
auacaaagcggggagaggguaca

SEQ ID NO: 1746125 - RNA, 17 nt, Homo sapiens
uucauauaaauggaauc

SEQ ID NO: 1746126 - RNA, 12 nt, Homo sapiens
gacaauuugaau

SEQ ID NO: 1746127 - RNA, 18 nt, Homo sapiens
gccugaagaguccucuga

SEQ ID NO: 1746128 - RNA, 20 nt, Homo sapiens
auacuuauagaauucaguca

SEQ ID NO: 1746129 - RNA, 23 nt, Homo sapiens
gcuucacauucugggcugacuca

SEQ ID NO: 1746130 - RNA, 13 nt, Homo sapiens
gaaaccacagcug

SEQ ID NO: 1746131 - RNA, 13 nt, Homo sapiens
ccuuauacaucac

SEQ ID NO: 1746132 - RNA, 16 nt, Homo sapiens
acagucacaugcccau

SEQ ID NO: 1746133 - RNA, 14 nt, Homo sapiens
aaagcaaagucacu

SEQ ID NO: 1746134 - RNA, 22 nt, Homo sapiens
aagcaaggcuggggucuugggu

SEQ ID NO: 1746135 - RNA, 23 nt, Homo sapiens
acggugcccaaacaccagucacc

SEQ ID NO: 1746136 - RNA, 15 nt, Homo sapiens
cacgugucuauaaug

SEQ ID NO: 1746137 - RNA, 13 nt, Homo sapiens
agugccaagcaca

SEQ ID NO: 1746138 - RNA, 22 nt, Homo sapiens
aggugaucugcugcagagcagu

SEQ ID NO: 1746139 - RNA, 19 nt, Homo sapiens
ucagacuugucaagccugu

SEQ ID NO: 1746140 - RNA, 22 nt, Homo sapiens
augcacuguucccccugugcag

SEQ ID NO: 1746141 - RNA, 23 nt, Homo sapiens
acuuuaauugaagaacugcacuu

SEQ ID NO: 1746142 - RNA, 14 nt, Homo sapiens
cuucacuucuggga

SEQ ID NO: 1746143 - RNA, 16 nt, Homo sapiens
cuuacagccagaggaa

SEQ ID NO: 1746144 - RNA, 17 nt, Homo sapiens
auacuaucuacucuccu

SEQ ID NO: 1746145 - RNA, 20 nt, Homo sapiens
ucccaauuaagaaauuccau

SEQ ID NO: 1746146 - RNA, 12 nt, Homo sapiens
accauuucucac

SEQ ID NO: 1746147 - RNA, 16 nt, Homo sapiens
ccaacagcuccaccuu

SEQ ID NO: 1746148 - RNA, 17 nt, Homo sapiens
auaugaagugaaaaaag

SEQ ID NO: 1746149 - RNA, 20 nt, Homo sapiens
uuuaggaaguauggcaaaaa

SEQ ID NO: 1746150 - RNA, 20 nt, Homo sapiens
cagugaaggcuguccuuacc

SEQ ID NO: 1746151 - RNA, 19 nt, Homo sapiens
gacaucuuaggcuggccag

SEQ ID NO: 1746152 - RNA, 22 nt, Homo sapiens
aaccuuacuaauuauacuacuu

SEQ ID NO: 1746153 - RNA, 14 nt, Homo sapiens
gcaaaaagcaacuu

SEQ ID NO: 1746154 - RNA, 17 nt, Homo sapiens
uggugcucaaugcaaau

SEQ ID NO: 1746155 - RNA, 15 nt, Homo sapiens
auuuucacaugaaca

SEQ ID NO: 1746156 - RNA, 17 nt, Homo sapiens
aaucccugccacugggc

SEQ ID NO: 1746157 - RNA, 14 nt, Homo sapiens
uagacaaaguacau

SEQ ID NO: 1746158 - RNA, 13 nt, Homo sapiens
gacagucaccuca

SEQ ID NO: 1746159 - RNA, 16 nt, Homo sapiens
cgagcacuguccagua

SEQ ID NO: 1746160 - RNA, 23 nt, Homo sapiens
acauucccuggccuggcucuccu

SEQ ID NO: 1746161 - RNA, 19 nt, Homo sapiens
aguaaucuguauaauacuu

SEQ ID NO: 1746162 - RNA, 19 nt, Homo sapiens
cacaguauuuacugugcua

SEQ ID NO: 1746163 - RNA, 14 nt, Homo sapiens
uucuucauacuuaa

SEQ ID NO: 1746164 - RNA, 21 nt, Homo sapiens
cucaagcacugauaucuggcc

SEQ ID NO: 1746165 - RNA, 23 nt, Homo sapiens
ccacugcguucaacaaugcugca

SEQ ID NO: 1746166 - RNA, 21 nt, Homo sapiens
aauaaacgagauguuugccaa

SEQ ID NO: 1746167 - RNA, 22 nt, Homo sapiens
ucauuacuguuccagauuccua

SEQ ID NO: 1746168 - RNA, 17 nt, Homo sapiens
ccuaucuggggagcucc

SEQ ID NO: 1746169 - RNA, 15 nt, Homo sapiens
agcugaaaguucuug

SEQ ID NO: 1746170 - RNA, 21 nt, Homo sapiens
caccaugccuccuucccagga

SEQ ID NO: 1746171 - RNA, 23 nt, Homo sapiens
ccugacuuggcuggggaggacca

SEQ ID NO: 1746172 - RNA, 12 nt, Homo sapiens
gaggccuguccu

SEQ ID NO: 1746173 - RNA, 19 nt, Homo sapiens
augauuuuuuuuucauaca

SEQ ID NO: 1746174 - RNA, 12 nt, Homo sapiens
ccguuguuguuu

SEQ ID NO: 1746175 - RNA, 16 nt, Homo sapiens
accucuaacagcacca

SEQ ID NO: 1746176 - RNA, 19 nt, Homo sapiens
auuaagucaucaucuccaa

SEQ ID NO: 1746177 - RNA, 18 nt, Homo sapiens
auaaaccacaagcaucuc

SEQ ID NO: 1746178 - RNA, 14 nt, Homo sapiens
ucacuacaaccucc

SEQ ID NO: 1746179 - RNA, 18 nt, Homo sapiens
agacgugugagagggacg

SEQ ID NO: 1746180 - RNA, 20 nt, Homo sapiens
agcaaagcacauagagccag

SEQ ID NO: 1746181 - RNA, 12 nt, Homo sapiens
acuuuguaaaau

SEQ ID NO: 1746182 - RNA, 12 nt, Homo sapiens
caaguguaccug

SEQ ID NO: 1746183 - RNA, 21 nt, Homo sapiens
auuuugggagugacucaagaa

SEQ ID NO: 1746184 - RNA, 21 nt, Homo sapiens
agguccuuguuguuucuugcc

SEQ ID NO: 1746185 - RNA, 17 nt, Homo sapiens
ucccucaugcuguuuca

SEQ ID NO: 1746186 - RNA, 20 nt, Homo sapiens
uauaucauucuacagaauaa

SEQ ID NO: 1746187 - RNA, 13 nt, Homo sapiens
uccucauuccuga

SEQ ID NO: 1746188 - RNA, 23 nt, Homo sapiens
aacuggggaaugggguauggaag

SEQ ID NO: 1746189 - RNA, 22 nt, Homo sapiens
gccuguaaauguauucauucuu

SEQ ID NO: 1746190 - RNA, 18 nt, Homo sapiens
aggggaagaggccuguuu

SEQ ID NO: 1746191 - RNA, 12 nt, Homo sapiens
uccacucugcca

SEQ ID NO: 1746192 - RNA, 18 nt, Homo sapiens
uauaugcaugcacaggaa

SEQ ID NO: 1746193 - RNA, 24 nt, Homo sapiens
aggauauguucacaccuagcguca

SEQ ID NO: 1746194 - RNA, 17 nt, Homo sapiens
caugguaauucacuuca

SEQ ID NO: 1746195 - RNA, 13 nt, Homo sapiens
uuaaagagucuag

SEQ ID NO: 1746196 - RNA, 16 nt, Homo sapiens
uagauaaucuugugca

SEQ ID NO: 1746197 - RNA, 19 nt, Homo sapiens
auaugacuaaguucacuaa

SEQ ID NO: 1746198 - RNA, 23 nt, Homo sapiens
ucccuucccuguccaccucacca

SEQ ID NO: 1746199 - RNA, 15 nt, Homo sapiens
cuuauucuccaucuc

SEQ ID NO: 1746200 - RNA, 23 nt, Homo sapiens
ccuagcaaggcaugauguuaacc

SEQ ID NO: 1746201 - RNA, 23 nt, Homo sapiens
gagccauuugucccaagugccaa

SEQ ID NO: 1746202 - RNA, 19 nt, Homo sapiens
ggaaauaaagcguccucuc

SEQ ID NO: 1746203 - RNA, 19 nt, Homo sapiens
cccaugaccccaaagccaa

SEQ ID NO: 1746204 - RNA, 12 nt, Homo sapiens
acuccuggugcc

SEQ ID NO: 1746205 - RNA, 18 nt, Homo sapiens
uucaaaauaaacaauaaa

SEQ ID NO: 1746206 - RNA, 16 nt, Homo sapiens
aucccagcaccugcca

SEQ ID NO: 1746207 - RNA, 16 nt, Homo sapiens
acaaagagagcucauc

SEQ ID NO: 1746208 - RNA, 14 nt, Homo sapiens
gcgcaagaccagcu

SEQ ID NO: 1746209 - RNA, 15 nt, Homo sapiens
cauuuugauauacca

SEQ ID NO: 1746210 - RNA, 14 nt, Homo sapiens
uaauauggcuguau

SEQ ID NO: 1746211 - RNA, 23 nt, Homo sapiens
cccugcugacacagacauccucu

SEQ ID NO: 1746212 - RNA, 14 nt, Homo sapiens
ugcauuuagcuucu

SEQ ID NO: 1746213 - RNA, 15 nt, Homo sapiens
caggcagcugaaauu

SEQ ID NO: 1746214 - RNA, 13 nt, Homo sapiens
gugacacccaaga

SEQ ID NO: 1746215 - RNA, 15 nt, Homo sapiens
ccugcauugcucucc

SEQ ID NO: 1746216 - RNA, 19 nt, Homo sapiens
uuugacaaaacccacuguu

SEQ ID NO: 1746217 - RNA, 17 nt, Homo sapiens
gacagcccuccuugacc

SEQ ID NO: 1746218 - RNA, 19 nt, Homo sapiens
uacagaauggaaccaaaau

SEQ ID NO: 1746219 - RNA, 17 nt, Homo sapiens
ccagcugggucaggcag

SEQ ID NO: 1746220 - RNA, 16 nt, Homo sapiens
uaucaguugcaauaau

SEQ ID NO: 1746221 - RNA, 18 nt, Homo sapiens
gaguguuuaaaguucaac

SEQ ID NO: 1746222 - RNA, 18 nt, Homo sapiens
ugggcaucucaagcccca

SEQ ID NO: 1746223 - RNA, 18 nt, Homo sapiens
aaccacaauauccagcaa

SEQ ID NO: 1746224 - RNA, 17 nt, Homo sapiens
cuguggugagccaagau

SEQ ID NO: 1746225 - RNA, 19 nt, Homo sapiens
ucaauucugauacagccuu

SEQ ID NO: 1746226 - RNA, 16 nt, Homo sapiens
acuagacucauacuca

SEQ ID NO: 1746227 - RNA, 22 nt, Homo sapiens
aagcauuagcacauauuucaca

SEQ ID NO: 1746228 - RNA, 16 nt, Homo sapiens
gagucagaaaccaaag

SEQ ID NO: 1746229 - RNA, 19 nt, Homo sapiens
ucaugggaaggggaggacc

SEQ ID NO: 1746230 - RNA, 22 nt, Homo sapiens
uccaggcuccucaugaggccau

SEQ ID NO: 1746231 - RNA, 16 nt, Homo sapiens
ccugucccuggccauc

SEQ ID NO: 1746232 - RNA, 11 nt, Homo sapiens
ccacugaagag

SEQ ID NO: 1746233 - RNA, 21 nt, Homo sapiens
agggaggcaggggaggggugc

SEQ ID NO: 1746234 - RNA, 18 nt, Homo sapiens
gcugccuguccccaugcu

SEQ ID NO: 1746235 - RNA, 22 nt, Homo sapiens
uuuaaaguaucauuuauuugaa

SEQ ID NO: 1746236 - RNA, 14 nt, Homo sapiens
acauguagcuucuu

SEQ ID NO: 1746237 - RNA, 18 nt, Homo sapiens
ggucaggcagggugcagu

SEQ ID NO: 1746238 - RNA, 16 nt, Homo sapiens
cucacacuuacuguaa

SEQ ID NO: 1746239 - RNA, 19 nt, Homo sapiens
aagcauuguccaaaauccc

SEQ ID NO: 1746240 - RNA, 20 nt, Homo sapiens
ugcugaaaaaugggcacuua

SEQ ID NO: 1746241 - RNA, 15 nt, Homo sapiens
uccaaagaggcugcc

SEQ ID NO: 1746242 - RNA, 14 nt, Homo sapiens
guuguuuguuuaaa

SEQ ID NO: 1746243 - RNA, 16 nt, Homo sapiens
cacccucuccuuguca

SEQ ID NO: 1746244 - RNA, 21 nt, Homo sapiens
gagcuguaucuguaauuaaua

SEQ ID NO: 1746245 - RNA, 18 nt, Homo sapiens
acuguuuugaaucucaua

SEQ ID NO: 1746246 - RNA, 23 nt, Homo sapiens
guauaggacucucaggcuuuuau

SEQ ID NO: 1746247 - RNA, 21 nt, Homo sapiens
ucucauaauugucaaaaacca

SEQ ID NO: 1746248 - RNA, 19 nt, Homo sapiens
ccaguuauaaagaggucac

SEQ ID NO: 1746249 - RNA, 20 nt, Homo sapiens
cuugccgucacuauucauca

SEQ ID NO: 1746250 - RNA, 15 nt, Homo sapiens
ucuuccuagcuuaaa

SEQ ID NO: 1746251 - RNA, 18 nt, Homo sapiens
uuugaaaaagagaacaga

SEQ ID NO: 1746252 - RNA, 17 nt, Homo sapiens
ccucugcagucucuaua

SEQ ID NO: 1746253 - RNA, 17 nt, Homo sapiens
auccugucccaugggcu

SEQ ID NO: 1746254 - RNA, 14 nt, Homo sapiens
cuaugauaaauuca

SEQ ID NO: 1746255 - RNA, 19 nt, Homo sapiens
cuaauguauuaauaccacu

SEQ ID NO: 1746256 - RNA, 21 nt, Homo sapiens
ugcagucucuauaccaauaaa

SEQ ID NO: 1746257 - RNA, 17 nt, Homo sapiens
guggagcuccacugcca

SEQ ID NO: 1746258 - RNA, 15 nt, Homo sapiens
uaauugcaagggaag

SEQ ID NO: 1746259 - RNA, 16 nt, Homo sapiens
uguuagacuaggcaaa

SEQ ID NO: 1746260 - RNA, 19 nt, Homo sapiens
cuuucucugagaaccaaaa

SEQ ID NO: 1746261 - RNA, 21 nt, Homo sapiens
ugcuggguuuccacacagccu

SEQ ID NO: 1746262 - RNA, 23 nt, Homo sapiens
ccaaguugaagggaaacaaagaa

SEQ ID NO: 1746263 - RNA, 21 nt, Homo sapiens
ugcugcagcggccacacugua

SEQ ID NO: 1746264 - RNA, 18 nt, Homo sapiens
gugcccacccugggagac

SEQ ID NO: 1746265 - RNA, 17 nt, Homo sapiens
acagcgcuaaggauggu

SEQ ID NO: 1746266 - RNA, 21 nt, Homo sapiens
gguggaugaggagacagaaua

SEQ ID NO: 1746267 - RNA, 17 nt, Homo sapiens
ugaaaagguugccugaa

SEQ ID NO: 1746268 - RNA, 16 nt, Homo sapiens
agucccccuucaaucu

SEQ ID NO: 1746269 - RNA, 17 nt, Homo sapiens
acagaagggcuaacuca

SEQ ID NO: 1746270 - RNA, 18 nt, Homo sapiens
acagcccuuaugcgguua

SEQ ID NO: 1746271 - RNA, 17 nt, Homo sapiens
auaaagaauauuuacaa

SEQ ID NO: 1746272 - RNA, 20 nt, Homo sapiens
gcuggaaaagggucuuggga

SEQ ID NO: 1746273 - RNA, 16 nt, Homo sapiens
aaucauuaauacucuu

SEQ ID NO: 1746274 - RNA, 22 nt, Homo sapiens
agagugcaguggcgcgaucuca

SEQ ID NO: 1746275 - RNA, 20 nt, Homo sapiens
cugcagucaucuugaccaag

SEQ ID NO: 1746276 - RNA, 21 nt, Homo sapiens
guguuauuaaugacaaaggca

SEQ ID NO: 1746277 - RNA, 20 nt, Homo sapiens
ucuugaaauuaagaaggcaa

SEQ ID NO: 1746278 - RNA, 20 nt, Homo sapiens
gagaucaugucauugaugaa

SEQ ID NO: 1746279 - RNA, 12 nt, Homo sapiens
uuguuugcuuac

SEQ ID NO: 1746280 - RNA, 20 nt, Homo sapiens
ugaccuugcacaaacagccc

SEQ ID NO: 1746281 - RNA, 13 nt, Homo sapiens
agacggagucuca

SEQ ID NO: 1746282 - RNA, 21 nt, Homo sapiens
agaaagcacuuaaacagaagc

SEQ ID NO: 1746283 - RNA, 16 nt, Homo sapiens
acaucaucuuagacuu

SEQ ID NO: 1746284 - RNA, 23 nt, Homo sapiens
ugaagucaccccuuucuguccca

SEQ ID NO: 1746285 - RNA, 17 nt, Homo sapiens
acuuaaaaauaauugag

SEQ ID NO: 1746286 - RNA, 23 nt, Homo sapiens
uacuaguguguguguguauauau

SEQ ID NO: 1746287 - RNA, 18 nt, Homo sapiens
ccaggagaguacauggca

SEQ ID NO: 1746288 - RNA, 19 nt, Homo sapiens
agaauaccccucaacucau

SEQ ID NO: 1746289 - RNA, 18 nt, Homo sapiens
acugacacgaagccagca

SEQ ID NO: 1746290 - RNA, 16 nt, Homo sapiens
cugcuugugcacugga

SEQ ID NO: 1746291 - RNA, 19 nt, Homo sapiens
ucaugaauuuauugcacau

SEQ ID NO: 1746292 - RNA, 22 nt, Homo sapiens
acaaauacuugacucagugaua

SEQ ID NO: 1746293 - RNA, 15 nt, Homo sapiens
uugaaaguaaaagca

SEQ ID NO: 1746294 - RNA, 16 nt, Homo sapiens
uucaguuuagcauuaa

SEQ ID NO: 1746295 - RNA, 17 nt, Homo sapiens
ucccggggccagcacuu

SEQ ID NO: 1746296 - RNA, 15 nt, Homo sapiens
caugucagacuguac

SEQ ID NO: 1746297 - RNA, 15 nt, Homo sapiens
uucaauucucaaaag

SEQ ID NO: 1746298 - RNA, 19 nt, Homo sapiens
gcaaaugaccaaauggugu

SEQ ID NO: 1746299 - RNA, 15 nt, Homo sapiens
auaacaucaccacug

SEQ ID NO: 1746300 - RNA, 16 nt, Homo sapiens
auuuaugaccuaaguc

SEQ ID NO: 1746301 - RNA, 22 nt, Homo sapiens
cggcugucccucauggagaccu

SEQ ID NO: 1746302 - RNA, 16 nt, Homo sapiens
agugccuguaucuuuu

SEQ ID NO: 1746303 - RNA, 17 nt, Homo sapiens
ucuugaagucagauuga

SEQ ID NO: 1746304 - RNA, 21 nt, Homo sapiens
gcuauguauaaaauacauagu

SEQ ID NO: 1746305 - RNA, 22 nt, Homo sapiens
gcagcuucacccaccaggccag

SEQ ID NO: 1746306 - RNA, 23 nt, Homo sapiens
guguugucccagggcugaugcug

SEQ ID NO: 1746307 - RNA, 15 nt, Homo sapiens
cuuaacacuauuuaa

SEQ ID NO: 1746308 - RNA, 16 nt, Homo sapiens
auuucaagaaacugag

SEQ ID NO: 1746309 - RNA, 22 nt, Homo sapiens
uaugagccaggcaucauacuaa

SEQ ID NO: 1746310 - RNA, 15 nt, Homo sapiens
uagaaagaagaugaa

SEQ ID NO: 1746311 - RNA, 15 nt, Homo sapiens
ccuccaucaccugaa

SEQ ID NO: 1746312 - RNA, 18 nt, Homo sapiens
cuccaucccaaccaggca

SEQ ID NO: 1746313 - RNA, 12 nt, Homo sapiens
caaaauguuaau

SEQ ID NO: 1746314 - RNA, 12 nt, Homo sapiens
ccaaauguucau

SEQ ID NO: 1746315 - RNA, 18 nt, Homo sapiens
gucucuacccaguagaug

SEQ ID NO: 1746316 - RNA, 20 nt, Homo sapiens
ucuagugucuuuugccuuua

SEQ ID NO: 1746317 - RNA, 14 nt, Homo sapiens
aauguaacugcuga

SEQ ID NO: 1746318 - RNA, 20 nt, Homo sapiens
uuuugauauaauuguacugu

SEQ ID NO: 1746319 - RNA, 21 nt, Homo sapiens
uguaggccccuggucugcccu

SEQ ID NO: 1746320 - RNA, 18 nt, Homo sapiens
uguauacugugugcuaaa

SEQ ID NO: 1746321 - RNA, 23 nt, Homo sapiens
aacaggcaaaguuuuacagagag

SEQ ID NO: 1746322 - RNA, 22 nt, Homo sapiens
augaaaauaacugaaccaaauu

SEQ ID NO: 1746323 - RNA, 14 nt, Homo sapiens
agcccugaacaaag

SEQ ID NO: 1746324 - RNA, 23 nt, Homo sapiens
cuugugggagcacagucagugac

SEQ ID NO: 1746325 - RNA, 14 nt, Homo sapiens
acccaauauugcua

SEQ ID NO: 1746326 - RNA, 16 nt, Homo sapiens
accccugauguggcau

SEQ ID NO: 1746327 - RNA, 20 nt, Homo sapiens
ugcacaggccacuugcucag

SEQ ID NO: 1746328 - RNA, 14 nt, Homo sapiens
agcauaaugcuccc

SEQ ID NO: 1746329 - RNA, 16 nt, Homo sapiens
uuuucucagagauuaa

SEQ ID NO: 1746330 - RNA, 22 nt, Homo sapiens
uuccucagcaccccuagcauga

SEQ ID NO: 1746331 - RNA, 13 nt, Homo sapiens
ccauucacuggca

SEQ ID NO: 1746332 - RNA, 19 nt, Homo sapiens
ugcugcuugaggcaacuca

SEQ ID NO: 1746333 - RNA, 14 nt, Homo sapiens
cuacguauccugca

SEQ ID NO: 1746334 - RNA, 19 nt, Homo sapiens
gcucagagugacccucagc

SEQ ID NO: 1746335 - RNA, 18 nt, Homo sapiens
ucacugcuuuuuccuuag

SEQ ID NO: 1746336 - RNA, 21 nt, Homo sapiens
gaccaacgcacaacaggaaac

SEQ ID NO: 1746337 - RNA, 18 nt, Homo sapiens
ugaguaugugcaccaaca

SEQ ID NO: 1746338 - RNA, 15 nt, Homo sapiens
uuccacaaaccugga

SEQ ID NO: 1746339 - RNA, 20 nt, Homo sapiens
cuggguacccugagcccacc

SEQ ID NO: 1746340 - RNA, 17 nt, Homo sapiens
auuucaaucaaccaaag

SEQ ID NO: 1746341 - RNA, 24 nt, Homo sapiens
auucccugcacacacaugcauacu

SEQ ID NO: 1746342 - RNA, 14 nt, Homo sapiens
gacagcugugcccu

SEQ ID NO: 1746343 - RNA, 18 nt, Homo sapiens
ggccagugacgugguuca

SEQ ID NO: 1746344 - RNA, 20 nt, Homo sapiens
uaccuaguuuguuagugcau

SEQ ID NO: 1746345 - RNA, 15 nt, Homo sapiens
ugccacuauaguuua

SEQ ID NO: 1746346 - RNA, 14 nt, Homo sapiens
accugcuucaguga

SEQ ID NO: 1746347 - RNA, 16 nt, Homo sapiens
aauaagcaaaaugcca

SEQ ID NO: 1746348 - RNA, 17 nt, Homo sapiens
ugaguguccacagggac

SEQ ID NO: 1746349 - RNA, 13 nt, Homo sapiens
cacacggaucuga

SEQ ID NO: 1746350 - RNA, 22 nt, Homo sapiens
agcucaacucucuuauugccuc

SEQ ID NO: 1746351 - RNA, 23 nt, Homo sapiens
uugcaaggauuacacauuucacu

SEQ ID NO: 1746352 - RNA, 21 nt, Homo sapiens
auugccaggaauguuucagcu

SEQ ID NO: 1746353 - RNA, 23 nt, Homo sapiens
aaaacagaacaucauuagaacaa

SEQ ID NO: 1746354 - RNA, 15 nt, Homo sapiens
ugugucaaccacuaa

SEQ ID NO: 1746355 - RNA, 20 nt, Homo sapiens
cacauggaaucuacaugugu

SEQ ID NO: 1746356 - RNA, 12 nt, Homo sapiens
ccuggaaacaga

SEQ ID NO: 1746357 - RNA, 14 nt, Homo sapiens
caacagacccagug

SEQ ID NO: 1746358 - RNA, 14 nt, Homo sapiens
uauccuguuuucau

SEQ ID NO: 1746359 - RNA, 22 nt, Homo sapiens
uaaugugaaugugagugaagcu

SEQ ID NO: 1746360 - RNA, 20 nt, Homo sapiens
uuucauggguuauguguaug

SEQ ID NO: 1746361 - RNA, 14 nt, Homo sapiens
uggcuggcucugca

SEQ ID NO: 1746362 - RNA, 19 nt, Homo sapiens
aauaauaccauaauacaug

SEQ ID NO: 1746363 - RNA, 19 nt, Homo sapiens
cucccagggacccagggag

SEQ ID NO: 1746364 - RNA, 22 nt, Homo sapiens
accucuccaaccuaacuggcuu

SEQ ID NO: 1746365 - RNA, 16 nt, Homo sapiens
uagguggugccagugg

SEQ ID NO: 1746366 - RNA, 20 nt, Homo sapiens
aaacgucacagcaguacuug

SEQ ID NO: 1746367 - RNA, 19 nt, Homo sapiens
guccacccaggcugcacug

SEQ ID NO: 1746368 - RNA, 22 nt, Homo sapiens
ucugccugcccugaaaguccca

SEQ ID NO: 1746369 - RNA, 14 nt, Homo sapiens
uaguauucuaauaa

SEQ ID NO: 1746370 - RNA, 15 nt, Homo sapiens
uucccacagugccua

SEQ ID NO: 1746371 - RNA, 12 nt, Homo sapiens
agacccucagac

SEQ ID NO: 1746372 - RNA, 14 nt, Homo sapiens
cgacuucaucccaa

SEQ ID NO: 1746373 - RNA, 18 nt, Homo sapiens
cauccauucuucccuuga

SEQ ID NO: 1746374 - RNA, 18 nt, Homo sapiens
guauuauauaaacuuaac

SEQ ID NO: 1746375 - RNA, 13 nt, Homo sapiens
ggguuccugccag

SEQ ID NO: 1746376 - RNA, 19 nt, Homo sapiens
uauuuacuuuuaccacuau

SEQ ID NO: 1746377 - RNA, 19 nt, Homo sapiens
gccuggccagaccagguga

SEQ ID NO: 1746378 - RNA, 13 nt, Homo sapiens
ccaagagaacuca

SEQ ID NO: 1746379 - RNA, 13 nt, Homo sapiens
ggcaagagcucuu

SEQ ID NO: 1746380 - RNA, 16 nt, Homo sapiens
ggagccaaguccagau

SEQ ID NO: 1746381 - RNA, 22 nt, Homo sapiens
uucuccccucucuuucuaagag

SEQ ID NO: 1746382 - RNA, 15 nt, Homo sapiens
ccuucucugcuccac

SEQ ID NO: 1746383 - RNA, 22 nt, Homo sapiens
aggccaccuuuugcuccacgga

SEQ ID NO: 1746384 - RNA, 19 nt, Homo sapiens
uggcuuuguuaaacuuauu

SEQ ID NO: 1746385 - RNA, 23 nt, Homo sapiens
ugagagagggagggaacagugcc

SEQ ID NO: 1746386 - RNA, 14 nt, Homo sapiens
uggauucacaccca

SEQ ID NO: 1746387 - RNA, 19 nt, Homo sapiens
uguucuuguaaaacuguga

SEQ ID NO: 1746388 - RNA, 13 nt, Homo sapiens
gggcaguugacag

SEQ ID NO: 1746389 - RNA, 19 nt, Homo sapiens
ggaagguucuggugugaac

SEQ ID NO: 1746390 - RNA, 16 nt, Homo sapiens
cggggggcauagcucu

SEQ ID NO: 1746391 - RNA, 23 nt, Homo sapiens
ggaaaucuuugguggccaaagau

SEQ ID NO: 1746392 - RNA, 15 nt, Homo sapiens
acuuuauaaauccag

SEQ ID NO: 1746393 - RNA, 18 nt, Homo sapiens
caauaacaaagcacauaa

SEQ ID NO: 1746394 - RNA, 15 nt, Homo sapiens
cagaaaagugacagu

SEQ ID NO: 1746395 - RNA, 16 nt, Homo sapiens
agcaaguuugacacaa

SEQ ID NO: 1746396 - RNA, 22 nt, Homo sapiens
ucuacaugugagauaguuuuca

SEQ ID NO: 1746397 - RNA, 22 nt, Homo sapiens
aaugcuguuuucaacauuguau

SEQ ID NO: 1746398 - RNA, 14 nt, Homo sapiens
ucagaugacagaug

SEQ ID NO: 1746399 - RNA, 18 nt, Homo sapiens
cuuuagugcuuucuuguc

SEQ ID NO: 1746400 - RNA, 22 nt, Homo sapiens
gacaccacgcuggagcugugua

SEQ ID NO: 1746401 - RNA, 17 nt, Homo sapiens
auuagugggggacugag

SEQ ID NO: 1746402 - RNA, 16 nt, Homo sapiens
ucagacugcacccagg

SEQ ID NO: 1746403 - RNA, 20 nt, Homo sapiens
cuaugaaaacagcuaucuca

SEQ ID NO: 1746404 - RNA, 14 nt, Homo sapiens
aaaaagacaacuca

SEQ ID NO: 1746405 - RNA, 16 nt, Homo sapiens
aggcauccuuccucac

SEQ ID NO: 1746406 - RNA, 14 nt, Homo sapiens
auuuuagacacuuc

SEQ ID NO: 1746407 - RNA, 23 nt, Homo sapiens
agccuccccuuggcggggagaag

SEQ ID NO: 1746408 - RNA, 21 nt, Homo sapiens
ccgacccagcucuacuccagg

SEQ ID NO: 1746409 - RNA, 22 nt, Homo sapiens
ccagucucagagaccagcacuc

SEQ ID NO: 1746410 - RNA, 18 nt, Homo sapiens
acauguuguacauuucac

SEQ ID NO: 1746411 - RNA, 21 nt, Homo sapiens
augaagugggcuccaguauua

SEQ ID NO: 1746412 - RNA, 17 nt, Homo sapiens
auguccagaagagucaa

SEQ ID NO: 1746413 - RNA, 18 nt, Homo sapiens
uaagggagcagacuuuua

SEQ ID NO: 1746414 - RNA, 23 nt, Homo sapiens
aacuacuauuuuuagcaauguuu

SEQ ID NO: 1746415 - RNA, 23 nt, Homo sapiens
cucuccuguauuuaacaaaaagu

SEQ ID NO: 1746416 - RNA, 18 nt, Homo sapiens
uccaucagcucucugcaa

SEQ ID NO: 1746417 - RNA, 16 nt, Homo sapiens
uccugugauacauuuc

SEQ ID NO: 1746418 - RNA, 16 nt, Homo sapiens
augaguggcuuuaaug

SEQ ID NO: 1746419 - RNA, 19 nt, Homo sapiens
caugguaauaaaauaugaa

SEQ ID NO: 1746420 - RNA, 17 nt, Homo sapiens
acugcagugaccacuua

SEQ ID NO: 1746421 - RNA, 23 nt, Homo sapiens
cagcugagcaaucucuugcauuu

SEQ ID NO: 1746422 - RNA, 14 nt, Homo sapiens
cuaucccuuaccug

SEQ ID NO: 1746423 - RNA, 14 nt, Homo sapiens
uugaggaacauuca

SEQ ID NO: 1746424 - RNA, 17 nt, Homo sapiens
aagcugaccccaaagac

SEQ ID NO: 1746425 - RNA, 20 nt, Homo sapiens
acuuccauucccguggucuc

SEQ ID NO: 1746426 - RNA, 20 nt, Homo sapiens
gcagaguucagacuucgcua

SEQ ID NO: 1746427 - RNA, 19 nt, Homo sapiens
ugccuucuuacaacagaga

SEQ ID NO: 1746428 - RNA, 17 nt, Homo sapiens
aguguccucuugcucaa

SEQ ID NO: 1746429 - RNA, 20 nt, Homo sapiens
cuuuguugcacugaaaugga

SEQ ID NO: 1746430 - RNA, 19 nt, Homo sapiens
aguaaacgggaacaugccc

SEQ ID NO: 1746431 - RNA, 13 nt, Homo sapiens
aaccugugaagcu

SEQ ID NO: 1746432 - RNA, 20 nt, Homo sapiens
accuguguggacaggacuaa

SEQ ID NO: 1746433 - RNA, 13 nt, Homo sapiens
acauaagaaggca

SEQ ID NO: 1746434 - RNA, 15 nt, Homo sapiens
uuacugaugugauau

SEQ ID NO: 1746435 - RNA, 21 nt, Homo sapiens
uaggaaggcagcauuccauga

SEQ ID NO: 1746436 - RNA, 17 nt, Homo sapiens
ucaauggacugcaccuu

SEQ ID NO: 1746437 - RNA, 14 nt, Homo sapiens
uagugaaaucuugu

SEQ ID NO: 1746438 - RNA, 21 nt, Homo sapiens
aaggacuauuuauaacuaaua

SEQ ID NO: 1746439 - RNA, 23 nt, Homo sapiens
accuagaagggcuagaaccugga

SEQ ID NO: 1746440 - RNA, 15 nt, Homo sapiens
uuacuguccaaagac

SEQ ID NO: 1746441 - RNA, 19 nt, Homo sapiens
aggucaauuuccugaugca

SEQ ID NO: 1746442 - RNA, 14 nt, Homo sapiens
ggaggaacccaaga

SEQ ID NO: 1746443 - RNA, 14 nt, Homo sapiens
auccacaauucauu

SEQ ID NO: 1746444 - RNA, 20 nt, Homo sapiens
cccagcacuuugggaggcca

SEQ ID NO: 1746445 - RNA, 22 nt, Homo sapiens
aauuauuucagucaucaucuca

SEQ ID NO: 1746446 - RNA, 14 nt, Homo sapiens
ccagagacacugag

SEQ ID NO: 1746447 - RNA, 14 nt, Homo sapiens
cauuaaacaaauaa

SEQ ID NO: 1746448 - RNA, 12 nt, Homo sapiens
aaucacucacaa

SEQ ID NO: 1746449 - RNA, 15 nt, Homo sapiens
aaucaaauucugucu

SEQ ID NO: 1746450 - RNA, 19 nt, Homo sapiens
ggaagcuuggggaacccau

SEQ ID NO: 1746451 - RNA, 17 nt, Homo sapiens
acucagcacucuggacu

SEQ ID NO: 1746452 - RNA, 21 nt, Homo sapiens
aagucaucuguuuaauuuaca

SEQ ID NO: 1746453 - RNA, 13 nt, Homo sapiens
uucuacaugugag

SEQ ID NO: 1746454 - RNA, 22 nt, Homo sapiens
uccaguggaauggagauuucau

SEQ ID NO: 1746455 - RNA, 18 nt, Homo sapiens
uaauaaucuaugaugaag

SEQ ID NO: 1746456 - RNA, 22 nt, Homo sapiens
gguggggagucagucaugucac

SEQ ID NO: 1746457 - RNA, 18 nt, Homo sapiens
ccaggccggccagccuca

SEQ ID NO: 1746458 - RNA, 13 nt, Homo sapiens
caggaaguacugg

SEQ ID NO: 1746459 - RNA, 14 nt, Homo sapiens
uguuuauuccugau

SEQ ID NO: 1746460 - RNA, 14 nt, Homo sapiens
cuacuuaugaaaug

SEQ ID NO: 1746461 - RNA, 18 nt, Homo sapiens
cauuuauuuuuagccauu

SEQ ID NO: 1746462 - RNA, 15 nt, Homo sapiens
uuauauuucauauca

SEQ ID NO: 1746463 - RNA, 21 nt, Homo sapiens
acaaagauucucuauguauca

SEQ ID NO: 1746464 - RNA, 13 nt, Homo sapiens
gcuggaccugggg

SEQ ID NO: 1746465 - RNA, 20 nt, Homo sapiens
gcaugagccacugcaccuga

SEQ ID NO: 1746466 - RNA, 23 nt, Homo sapiens
cugccuccagaauggucuuucua

SEQ ID NO: 1746467 - RNA, 14 nt, Homo sapiens
ucaggguauaguca

SEQ ID NO: 1746468 - RNA, 18 nt, Homo sapiens
agcucacagugacauuac

SEQ ID NO: 1746469 - RNA, 14 nt, Homo sapiens
cuggccuccaaguc

SEQ ID NO: 1746470 - RNA, 13 nt, Homo sapiens
cucuucucugcaa

SEQ ID NO: 1746471 - RNA, 24 nt, Homo sapiens
acacuaaaacuuuccugacuuaca

SEQ ID NO: 1746472 - RNA, 17 nt, Homo sapiens
ugaaagggaacaaggaa

SEQ ID NO: 1746473 - RNA, 15 nt, Homo sapiens
cugugggacugggac

SEQ ID NO: 1746474 - RNA, 15 nt, Homo sapiens
cugugugcuugucag

SEQ ID NO: 1746475 - RNA, 14 nt, Homo sapiens
aacagauaacacca

SEQ ID NO: 1746476 - RNA, 16 nt, Homo sapiens
gaccaaaaugccaaaa

SEQ ID NO: 1746477 - RNA, 23 nt, Homo sapiens
uccuaaagaaaaauaucuuggcc

SEQ ID NO: 1746478 - RNA, 16 nt, Homo sapiens
aguacacccuuuccag

SEQ ID NO: 1746479 - RNA, 23 nt, Homo sapiens
aggguauauuuuugauaccuuca

SEQ ID NO: 1746480 - RNA, 14 nt, Homo sapiens
gacccuccugucca

SEQ ID NO: 1746481 - RNA, 23 nt, Homo sapiens
ccaaguugagauuuuaauucugu

SEQ ID NO: 1746482 - RNA, 23 nt, Homo sapiens
agaaaaaaagcacaaaguucuca

SEQ ID NO: 1746483 - RNA, 23 nt, Homo sapiens
aagacugagcucaaggugggaac

SEQ ID NO: 1746484 - RNA, 19 nt, Homo sapiens
ucuccagcucagaacccag

SEQ ID NO: 1746485 - RNA, 20 nt, Homo sapiens
cugggauuacaggugugaac

SEQ ID NO: 1746486 - RNA, 18 nt, Homo sapiens
agcuuaccugggcacaaa

SEQ ID NO: 1746487 - RNA, 20 nt, Homo sapiens
gugagggcaccaccaagaau

SEQ ID NO: 1746488 - RNA, 19 nt, Homo sapiens
acauccacacagccaauac

SEQ ID NO: 1746489 - RNA, 16 nt, Homo sapiens
uaaggaguaacuugca

SEQ ID NO: 1746490 - RNA, 22 nt, Homo sapiens
gauaacauguaucacucacugc

SEQ ID NO: 1746491 - RNA, 22 nt, Homo sapiens
cuauccaaagaacuugauuugc

SEQ ID NO: 1746492 - RNA, 20 nt, Homo sapiens
aggcucuuaugugugccuuu

SEQ ID NO: 1746493 - RNA, 12 nt, Homo sapiens
ccuuuacauauu

SEQ ID NO: 1746494 - RNA, 12 nt, Homo sapiens
ccuguacauaug

SEQ ID NO: 1746495 - RNA, 17 nt, Homo sapiens
cuuucaucccauacuca

SEQ ID NO: 1746496 - RNA, 22 nt, Homo sapiens
uuauucugugcuguuacaguuu

SEQ ID NO: 1746497 - RNA, 13 nt, Homo sapiens
cuauauccuuccu

SEQ ID NO: 1746498 - RNA, 20 nt, Homo sapiens
uugaaaauggugggauucau

SEQ ID NO: 1746499 - RNA, 17 nt, Homo sapiens
gacaauuucaaaaugca

SEQ ID NO: 1746500 - RNA, 16 nt, Homo sapiens
aaaaaacacaucuggc

SEQ ID NO: 1746501 - RNA, 21 nt, Homo sapiens
ucaaaucauuuuugagacugg

SEQ ID NO: 1746502 - RNA, 23 nt, Homo sapiens
cccuuacaauucccucuacugug

SEQ ID NO: 1746503 - RNA, 22 nt, Homo sapiens
uacuaccccagaacgcaugcag

SEQ ID NO: 1746504 - RNA, 21 nt, Homo sapiens
uucgaaguucuagaauucuag

SEQ ID NO: 1746505 - RNA, 13 nt, Homo sapiens
accucucugggcc

SEQ ID NO: 1746506 - RNA, 19 nt, Homo sapiens
ccagucucaaaaauacaaa

SEQ ID NO: 1746507 - RNA, 20 nt, Homo sapiens
ccugccugcgggcaccuaca

SEQ ID NO: 1746508 - RNA, 16 nt, Homo sapiens
aagccugaguccaguu

SEQ ID NO: 1746509 - RNA, 15 nt, Homo sapiens
uuuaagccaggagca

SEQ ID NO: 1746510 - RNA, 21 nt, Homo sapiens
aaauacacaugaaaacaagaa

SEQ ID NO: 1746511 - RNA, 21 nt, Homo sapiens
agacaccuuggacauccuccu

SEQ ID NO: 1746512 - RNA, 21 nt, Homo sapiens
caggagcccuacugaagggaa

SEQ ID NO: 1746513 - RNA, 12 nt, Homo sapiens
auacacacucaa

SEQ ID NO: 1746514 - RNA, 15 nt, Homo sapiens
auuccucuacagauu

SEQ ID NO: 1746515 - RNA, 22 nt, Homo sapiens
ugugcacaucuacaugccaugc

SEQ ID NO: 1746516 - RNA, 21 nt, Homo sapiens
ggaccacagaggcugugguca

SEQ ID NO: 1746517 - RNA, 15 nt, Homo sapiens
acccuaggucuccac

SEQ ID NO: 1746518 - RNA, 16 nt, Homo sapiens
ucacucuugccaaccu

SEQ ID NO: 1746519 - RNA, 16 nt, Homo sapiens
ucaguauuucaacuga

SEQ ID NO: 1746520 - RNA, 16 nt, Homo sapiens
uugggcaccugaccac

SEQ ID NO: 1746521 - RNA, 22 nt, Homo sapiens
ugauagaagaaggacugaagaa

SEQ ID NO: 1746522 - RNA, 18 nt, Homo sapiens
gaagacguggacuccucu

SEQ ID NO: 1746523 - RNA, 19 nt, Homo sapiens
cugcagcacaggaggcucc

SEQ ID NO: 1746524 - RNA, 12 nt, Homo sapiens
caaugagccaug

SEQ ID NO: 1746525 - RNA, 17 nt, Homo sapiens
ucagggucagggccauu

SEQ ID NO: 1746526 - RNA, 15 nt, Homo sapiens
gcuagaaggacucac

SEQ ID NO: 1746527 - RNA, 21 nt, Homo sapiens
aaaguuacugauucacugcau

SEQ ID NO: 1746528 - RNA, 19 nt, Homo sapiens
caauucuuagaauaucuaa

SEQ ID NO: 1746529 - RNA, 22 nt, Homo sapiens
gugcacauugguuuaagcccag

SEQ ID NO: 1746530 - RNA, 20 nt, Homo sapiens
aaccuggcugcgaacugugc

SEQ ID NO: 1746531 - RNA, 19 nt, Homo sapiens
ucagauuucuacacuuuau

SEQ ID NO: 1746532 - RNA, 17 nt, Homo sapiens
gagucagugccaggucc

SEQ ID NO: 1746533 - RNA, 16 nt, Homo sapiens
cucuaagcacauucca

SEQ ID NO: 1746534 - RNA, 13 nt, Homo sapiens
acaaccacuggga

SEQ ID NO: 1746535 - RNA, 19 nt, Homo sapiens
gacccccaucucuacaaaa

SEQ ID NO: 1746536 - RNA, 19 nt, Homo sapiens
gcccugggaaccacuccca

SEQ ID NO: 1746537 - RNA, 13 nt, Homo sapiens
acaauuuccauau

SEQ ID NO: 1746538 - RNA, 19 nt, Homo sapiens
uaguaguuaaaacagcuau

SEQ ID NO: 1746539 - RNA, 18 nt, Homo sapiens
aauguacaauaaagcaau

SEQ ID NO: 1746540 - RNA, 15 nt, Homo sapiens
gcuuaccugaucuca

SEQ ID NO: 1746541 - RNA, 21 nt, Homo sapiens
gaaagagagaagccagccaca

SEQ ID NO: 1746542 - RNA, 13 nt, Homo sapiens
gagaaagcacuga

SEQ ID NO: 1746543 - RNA, 18 nt, Homo sapiens
gaccuacuuccuccuagc

SEQ ID NO: 1746544 - RNA, 13 nt, Homo sapiens
ucacucagcacuu

SEQ ID NO: 1746545 - RNA, 18 nt, Homo sapiens
ugaccacauccaccuuua

SEQ ID NO: 1746546 - RNA, 17 nt, Homo sapiens
acaccauucuccugccu

SEQ ID NO: 1746547 - RNA, 22 nt, Homo sapiens
cuagggucuugggggucagggg

SEQ ID NO: 1746548 - RNA, 20 nt, Homo sapiens
gcuaaucauuaagguauuau

SEQ ID NO: 1746549 - RNA, 13 nt, Homo sapiens
ccuuuuaagggug

SEQ ID NO: 1746550 - RNA, 18 nt, Homo sapiens
gugaggagcugcugugug

SEQ ID NO: 1746551 - RNA, 20 nt, Homo sapiens
auuuccuaaugucagaguag

SEQ ID NO: 1746552 - RNA, 17 nt, Homo sapiens
ccagccgaaaagcuuuu

SEQ ID NO: 1746553 - RNA, 14 nt, Homo sapiens
aaucaccacaccaa

SEQ ID NO: 1746554 - RNA, 14 nt, Homo sapiens
aacucacacauucc

SEQ ID NO: 1746555 - RNA, 21 nt, Homo sapiens
cgcccagguccccgcuuucuu

SEQ ID NO: 1746556 - RNA, 18 nt, Homo sapiens
uaucuuauauacuuauca

SEQ ID NO: 1746557 - RNA, 18 nt, Homo sapiens
auuccacacuaccacauu

SEQ ID NO: 1746558 - RNA, 20 nt, Homo sapiens
ucucaggagcuugcaagaag

SEQ ID NO: 1746559 - RNA, 14 nt, Homo sapiens
uucuuagucauuac

SEQ ID NO: 1746560 - RNA, 13 nt, Homo sapiens
aauaacugacccu

SEQ ID NO: 1746561 - RNA, 18 nt, Homo sapiens
cuggggcaggucacuuua

SEQ ID NO: 1746562 - RNA, 15 nt, Homo sapiens
ccuaaaacaauccug

SEQ ID NO: 1746563 - RNA, 21 nt, Homo sapiens
augccugcauggauacuacag

SEQ ID NO: 1746564 - RNA, 13 nt, Homo sapiens
aucagacugacag

SEQ ID NO: 1746565 - RNA, 13 nt, Homo sapiens
aaagcacuguagc

SEQ ID NO: 1746566 - RNA, 13 nt, Homo sapiens
ccuuguccaccca

SEQ ID NO: 1746567 - RNA, 17 nt, Homo sapiens
ucuaguuagcugcuuua

SEQ ID NO: 1746568 - RNA, 17 nt, Homo sapiens
uggugggucuauguucc

SEQ ID NO: 1746569 - RNA, 13 nt, Homo sapiens
gguucagugccac

SEQ ID NO: 1746570 - RNA, 19 nt, Homo sapiens
uuucugcuaguggugagca

SEQ ID NO: 1746571 - RNA, 17 nt, Homo sapiens
auguaaauaaaauugag

SEQ ID NO: 1746572 - RNA, 20 nt, Homo sapiens
augauuagucagaaacugcc

SEQ ID NO: 1746573 - RNA, 21 nt, Homo sapiens
acucucuauugaccaccaguu

SEQ ID NO: 1746574 - RNA, 12 nt, Homo sapiens
gcagcacuagcg

SEQ ID NO: 1746575 - RNA, 17 nt, Homo sapiens
cuaugauauaacaugug

SEQ ID NO: 1746576 - RNA, 17 nt, Homo sapiens
auacaaaagggucuuga

SEQ ID NO: 1746577 - RNA, 13 nt, Homo sapiens
caaccugaguuca

SEQ ID NO: 1746578 - RNA, 22 nt, Homo sapiens
ugagcacuguuuauacacugug

SEQ ID NO: 1746579 - RNA, 19 nt, Homo sapiens
gauugacguaccgugcauc

SEQ ID NO: 1746580 - RNA, 15 nt, Homo sapiens
ugggagagccuggca

SEQ ID NO: 1746581 - RNA, 19 nt, Homo sapiens
uguacuggagaguggcaaa

SEQ ID NO: 1746582 - RNA, 15 nt, Homo sapiens
agcugcaccugccag

SEQ ID NO: 1746583 - RNA, 14 nt, Homo sapiens
ccccuuguccuuuc

SEQ ID NO: 1746584 - RNA, 18 nt, Homo sapiens
gucaguuuuaggguugcc

SEQ ID NO: 1746585 - RNA, 19 nt, Homo sapiens
agcacauugcccugagggg

SEQ ID NO: 1746586 - RNA, 21 nt, Homo sapiens
gaaauagccaccgucuacaga

SEQ ID NO: 1746587 - RNA, 19 nt, Homo sapiens
auccccuggacugggaggu

SEQ ID NO: 1746588 - RNA, 22 nt, Homo sapiens
acaggggcccauggacucuuca

SEQ ID NO: 1746589 - RNA, 13 nt, Homo sapiens
ggcgcagugcuuc

SEQ ID NO: 1746590 - RNA, 16 nt, Homo sapiens
guucccuguucuuccu

SEQ ID NO: 1746591 - RNA, 19 nt, Homo sapiens
uacagucaagauacauagu

SEQ ID NO: 1746592 - RNA, 17 nt, Homo sapiens
acaaaugggucccucag

SEQ ID NO: 1746593 - RNA, 23 nt, Homo sapiens
aguuucuugaggccaaacacacu

SEQ ID NO: 1746594 - RNA, 12 nt, Homo sapiens
uguguuacuuga

SEQ ID NO: 1746595 - RNA, 16 nt, Homo sapiens
auuguaguguucaaaa

SEQ ID NO: 1746596 - RNA, 12 nt, Homo sapiens
cacaugccuuaa

SEQ ID NO: 1746597 - RNA, 23 nt, Homo sapiens
gccuguaaucccaacacuuugag

SEQ ID NO: 1746598 - RNA, 21 nt, Homo sapiens
uccccacccuggaggcucucu

SEQ ID NO: 1746599 - RNA, 21 nt, Homo sapiens
uagcaauuccccuacaucaaa

SEQ ID NO: 1746600 - RNA, 18 nt, Homo sapiens
ggccucccacagacucaa

SEQ ID NO: 1746601 - RNA, 16 nt, Homo sapiens
agaaaauucuccugau

SEQ ID NO: 1746602 - RNA, 21 nt, Homo sapiens
uuaaacagaugaugagaauuu

SEQ ID NO: 1746603 - RNA, 17 nt, Homo sapiens
aggaaauacaccuggac

SEQ ID NO: 1746604 - RNA, 18 nt, Homo sapiens
uaauauuauuacuguuga

SEQ ID NO: 1746605 - RNA, 22 nt, Homo sapiens
gcucagggcuaaacgggcauug

SEQ ID NO: 1746606 - RNA, 20 nt, Homo sapiens
uuccaauuugacaaaaccca

SEQ ID NO: 1746607 - RNA, 20 nt, Homo sapiens
cacccuccaugcuccucacc

SEQ ID NO: 1746608 - RNA, 12 nt, Homo sapiens
ccugugaucucg

SEQ ID NO: 1746609 - RNA, 11 nt, Homo sapiens
caagugcaguc

SEQ ID NO: 1746610 - RNA, 14 nt, Homo sapiens
gaaacgccuugcac

SEQ ID NO: 1746611 - RNA, 18 nt, Homo sapiens
caaucuuucaccaaguaa

SEQ ID NO: 1746612 - RNA, 13 nt, Homo sapiens
uuggaaccaaagu

SEQ ID NO: 1746613 - RNA, 18 nt, Homo sapiens
aaauuaagacuugugcau

SEQ ID NO: 1746614 - RNA, 13 nt, Homo sapiens
uaaaaaauuugua

SEQ ID NO: 1746615 - RNA, 13 nt, Homo sapiens
cugaaaaucaaua

SEQ ID NO: 1746616 - RNA, 13 nt, Homo sapiens
gaaauggaaucag

SEQ ID NO: 1746617 - RNA, 14 nt, Homo sapiens
ugaaacauuuuagc

SEQ ID NO: 1746618 - RNA, 22 nt, Homo sapiens
aaguuggguguaauuaggugaa

SEQ ID NO: 1746619 - RNA, 16 nt, Homo sapiens
augacugcaccaacau

SEQ ID NO: 1746620 - RNA, 15 nt, Homo sapiens
acauauauguauaua

SEQ ID NO: 1746621 - RNA, 16 nt, Homo sapiens
uaguauaauaugcagu

SEQ ID NO: 1746622 - RNA, 17 nt, Homo sapiens
ccaggccaguaagggaa

SEQ ID NO: 1746623 - RNA, 17 nt, Homo sapiens
uacauagagagagacag

SEQ ID NO: 1746624 - RNA, 20 nt, Homo sapiens
acaagacccaaguagcugcu

SEQ ID NO: 1746625 - RNA, 15 nt, Homo sapiens
cuuauuguggauaac

SEQ ID NO: 1746626 - RNA, 17 nt, Homo sapiens
ccuccgccucucagguu

SEQ ID NO: 1746627 - RNA, 18 nt, Homo sapiens
uuggaaaccuggaacaca

SEQ ID NO: 1746628 - RNA, 22 nt, Homo sapiens
uguguuagcguggguuagggga

SEQ ID NO: 1746629 - RNA, 17 nt, Homo sapiens
caggacuaggcauguca

SEQ ID NO: 1746630 - RNA, 22 nt, Homo sapiens
cauguuuuguauguuaaauuca

SEQ ID NO: 1746631 - RNA, 19 nt, Homo sapiens
acaaacucugaaagaccua

SEQ ID NO: 1746632 - RNA, 15 nt, Homo sapiens
uuccaaaaaccaugu

SEQ ID NO: 1746633 - RNA, 23 nt, Homo sapiens
aaccuuugagacuauugagauau

SEQ ID NO: 1746634 - RNA, 23 nt, Homo sapiens
agaucaugccauugcauuccagc

SEQ ID NO: 1746635 - RNA, 15 nt, Homo sapiens
ccagagcugugccag

SEQ ID NO: 1746636 - RNA, 22 nt, Homo sapiens
uguaaaauuagaggauugcacu

SEQ ID NO: 1746637 - RNA, 16 nt, Homo sapiens
gcagguagggcuugua

SEQ ID NO: 1746638 - RNA, 15 nt, Homo sapiens
cauauauauauguau

SEQ ID NO: 1746639 - RNA, 15 nt, Homo sapiens
uguaugcacgugugc

SEQ ID NO: 1746640 - RNA, 18 nt, Homo sapiens
cagccaagacccaacagg

SEQ ID NO: 1746641 - RNA, 15 nt, Homo sapiens
ccuuuguguggcucc

SEQ ID NO: 1746642 - RNA, 12 nt, Homo sapiens
ugaauucuacug

SEQ ID NO: 1746643 - RNA, 13 nt, Homo sapiens
cuucauugccuua

SEQ ID NO: 1746644 - RNA, 14 nt, Homo sapiens
ugucaauugauauu

SEQ ID NO: 1746645 - RNA, 13 nt, Homo sapiens
auugccuguaaca

SEQ ID NO: 1746646 - RNA, 19 nt, Homo sapiens
cuccagucuggcaacagag

SEQ ID NO: 1746647 - RNA, 17 nt, Homo sapiens
caggcugaagucagcuc

SEQ ID NO: 1746648 - RNA, 15 nt, Homo sapiens
cauguguguguguga

SEQ ID NO: 1746649 - RNA, 13 nt, Homo sapiens
gccccagggcuau

SEQ ID NO: 1746650 - RNA, 17 nt, Homo sapiens
agcacuuaauaauugca

SEQ ID NO: 1746651 - RNA, 11 nt, Homo sapiens
ucccacuccag

SEQ ID NO: 1746652 - RNA, 18 nt, Homo sapiens
aaggcuaaggauagggaa

SEQ ID NO: 1746653 - RNA, 15 nt, Homo sapiens
auaacuucucugagu

SEQ ID NO: 1746654 - RNA, 11 nt, Homo sapiens
ccacauuccaa

SEQ ID NO: 1746655 - RNA, 19 nt, Homo sapiens
uuacccacacacagauaaa

SEQ ID NO: 1746656 - RNA, 17 nt, Homo sapiens
uacaguguugauugauu

SEQ ID NO: 1746657 - RNA, 20 nt, Homo sapiens
aggccuguuucuuuuccccu

SEQ ID NO: 1746658 - RNA, 21 nt, Homo sapiens
accacugugguuuugacuuaa

SEQ ID NO: 1746659 - RNA, 14 nt, Homo sapiens
aaacugaagcuuuu

SEQ ID NO: 1746660 - RNA, 14 nt, Homo sapiens
gaacugaaacuuuu

SEQ ID NO: 1746661 - RNA, 16 nt, Homo sapiens
uccuggcaugacacuc

SEQ ID NO: 1746662 - RNA, 14 nt, Homo sapiens
cccugggaaccacu

SEQ ID NO: 1746663 - RNA, 22 nt, Homo sapiens
aaggucuugccugaauccauca

SEQ ID NO: 1746664 - RNA, 15 nt, Homo sapiens
uaaauaucugucaua

SEQ ID NO: 1746665 - RNA, 14 nt, Homo sapiens
uauuuaaagcuuuc

SEQ ID NO: 1746666 - RNA, 19 nt, Homo sapiens
auuagggcaaagaucucag

SEQ ID NO: 1746667 - RNA, 15 nt, Homo sapiens
caucaguaacaguau

SEQ ID NO: 1746668 - RNA, 13 nt, Homo sapiens
acacaauguggac

SEQ ID NO: 1746669 - RNA, 21 nt, Homo sapiens
cauggcccuucaaauuggaau

SEQ ID NO: 1746670 - RNA, 18 nt, Homo sapiens
gucaucuuaaauuucaaa

SEQ ID NO: 1746671 - RNA, 22 nt, Homo sapiens
ggaaucacuucuccaaucagug

SEQ ID NO: 1746672 - RNA, 15 nt, Homo sapiens
cagcaggugcucaau

SEQ ID NO: 1746673 - RNA, 14 nt, Homo sapiens
gacuuuaccugcug

SEQ ID NO: 1746674 - RNA, 19 nt, Homo sapiens
gcagcacgccaacauggca

SEQ ID NO: 1746675 - RNA, 14 nt, Homo sapiens
cagaaauuguauau

SEQ ID NO: 1746676 - RNA, 23 nt, Homo sapiens
caugcugcuauacacaagcaaug

SEQ ID NO: 1746677 - RNA, 21 nt, Homo sapiens
auuuucucuuucuuccuguca

SEQ ID NO: 1746678 - RNA, 23 nt, Homo sapiens
agggcagaggagagcagcuguca

SEQ ID NO: 1746679 - RNA, 21 nt, Homo sapiens
uuuuuggaaggggacacguga

SEQ ID NO: 1746680 - RNA, 23 nt, Homo sapiens
auacauuccugagauucugggaa

SEQ ID NO: 1746681 - RNA, 15 nt, Homo sapiens
cagccucacaguccu

SEQ ID NO: 1746682 - RNA, 20 nt, Homo sapiens
acugcauuguuuucuagccc

SEQ ID NO: 1746683 - RNA, 16 nt, Homo sapiens
caaaaaaaacaacaaa

SEQ ID NO: 1746684 - RNA, 22 nt, Homo sapiens
gucagacucuuggcuacaguga

SEQ ID NO: 1746685 - RNA, 15 nt, Homo sapiens
gaaaaaaauucugau

SEQ ID NO: 1746686 - RNA, 14 nt, Homo sapiens
auucaucucucaaa

SEQ ID NO: 1746687 - RNA, 19 nt, Homo sapiens
uuagguaaauaaagcucaa

SEQ ID NO: 1746688 - RNA, 15 nt, Homo sapiens
agcagugaaguauaa

SEQ ID NO: 1746689 - RNA, 19 nt, Homo sapiens
gggucucgcuuuguugccc

SEQ ID NO: 1746690 - RNA, 20 nt, Homo sapiens
ggaauuacgugcucuguggg

SEQ ID NO: 1746691 - RNA, 20 nt, Homo sapiens
uguuaugccaaacaguugua

SEQ ID NO: 1746692 - RNA, 12 nt, Homo sapiens
gaccuugugaca

SEQ ID NO: 1746693 - RNA, 16 nt, Homo sapiens
acggugugcaccaaca

SEQ ID NO: 1746694 - RNA, 20 nt, Homo sapiens
gaauauaauuucaaaccaca

SEQ ID NO: 1746695 - RNA, 21 nt, Homo sapiens
cagagacaaucuagcacuuua

SEQ ID NO: 1746696 - RNA, 22 nt, Homo sapiens
ccaauguuugacaaaacacagc

SEQ ID NO: 1746697 - RNA, 16 nt, Homo sapiens
auaaagcauuuugcaa

SEQ ID NO: 1746698 - RNA, 20 nt, Homo sapiens
auuuuaauugauuauucuga

SEQ ID NO: 1746699 - RNA, 16 nt, Homo sapiens
aguagccccuaaucac

SEQ ID NO: 1746700 - RNA, 17 nt, Homo sapiens
acugccuggauuccauu

SEQ ID NO: 1746701 - RNA, 17 nt, Homo sapiens
caugagggcuggagacc

SEQ ID NO: 1746702 - RNA, 13 nt, Homo sapiens
caaggauucuguu

SEQ ID NO: 1746703 - RNA, 19 nt, Homo sapiens
uuuaaagauaagucuacau

SEQ ID NO: 1746704 - RNA, 21 nt, Homo sapiens
cugcucaggaaaccacaaccu

SEQ ID NO: 1746705 - RNA, 22 nt, Homo sapiens
cuacaaggcuacaguaaccaaa

SEQ ID NO: 1746706 - RNA, 17 nt, Homo sapiens
ucaagaaaagaauuaca

SEQ ID NO: 1746707 - RNA, 21 nt, Homo sapiens
caccaauauuucuucacaaag

SEQ ID NO: 1746708 - RNA, 17 nt, Homo sapiens
cagccacuaaucaggag

SEQ ID NO: 1746709 - RNA, 17 nt, Homo sapiens
aaauagagccugaggga

SEQ ID NO: 1746710 - RNA, 17 nt, Homo sapiens
cauuuauuuacauguga

SEQ ID NO: 1746711 - RNA, 12 nt, Homo sapiens
ccagaaaggaca

SEQ ID NO: 1746712 - RNA, 13 nt, Homo sapiens
ccagaaacgcaga

SEQ ID NO: 1746713 - RNA, 14 nt, Homo sapiens
ucauccacuuucca

SEQ ID NO: 1746714 - RNA, 14 nt, Homo sapiens
acaucaacauuccc

SEQ ID NO: 1746715 - RNA, 19 nt, Homo sapiens
aauccccaagaacacaaga

SEQ ID NO: 1746716 - RNA, 16 nt, Homo sapiens
cgcuggaccuugaacu

SEQ ID NO: 1746717 - RNA, 17 nt, Homo sapiens
uaguaguguaagcuaga

SEQ ID NO: 1746718 - RNA, 16 nt, Homo sapiens
uuccuugggaugaucu

SEQ ID NO: 1746719 - RNA, 22 nt, Homo sapiens
gaaaucgggagugcacuuuuug

SEQ ID NO: 1746720 - RNA, 22 nt, Homo sapiens
auucauaaaccuugucuaugaa

SEQ ID NO: 1746721 - RNA, 17 nt, Homo sapiens
uucuaaaugccuuugac

SEQ ID NO: 1746722 - RNA, 15 nt, Homo sapiens
aaggcuccugaccua

SEQ ID NO: 1746723 - RNA, 20 nt, Homo sapiens
uaaguguguaugugcauuaa

SEQ ID NO: 1746724 - RNA, 20 nt, Homo sapiens
auauacagaugcaagcaagg

SEQ ID NO: 1746725 - RNA, 20 nt, Homo sapiens
uagggcuggagggacaggga

SEQ ID NO: 1746726 - RNA, 23 nt, Homo sapiens
gaaagccacacagagcugaaugg

SEQ ID NO: 1746727 - RNA, 23 nt, Homo sapiens
ugcacauuaaggagaaaucuaua

SEQ ID NO: 1746728 - RNA, 17 nt, Homo sapiens
ucucccugggucugcgu

SEQ ID NO: 1746729 - RNA, 13 nt, Homo sapiens
uagagcacagccu

SEQ ID NO: 1746730 - RNA, 22 nt, Homo sapiens
aacuaaagcuuuaggaugacug

SEQ ID NO: 1746731 - RNA, 22 nt, Homo sapiens
ucacucaucuaaagucuaguga

SEQ ID NO: 1746732 - RNA, 21 nt, Homo sapiens
gauaugcccuccuggugacuc

SEQ ID NO: 1746733 - RNA, 19 nt, Homo sapiens
uuaaagcuugcucacaucu

SEQ ID NO: 1746734 - RNA, 16 nt, Homo sapiens
aagacucugagccaag

SEQ ID NO: 1746735 - RNA, 21 nt, Homo sapiens
cuuugucauuauuagucuuca

SEQ ID NO: 1746736 - RNA, 18 nt, Homo sapiens
uauugacgcauauuuaac

SEQ ID NO: 1746737 - RNA, 14 nt, Homo sapiens
gugcgugugugcaa

SEQ ID NO: 1746738 - RNA, 21 nt, Homo sapiens
aauaugugaagcccagcaucu

SEQ ID NO: 1746739 - RNA, 18 nt, Homo sapiens
uuguauccacacaaauuc

SEQ ID NO: 1746740 - RNA, 19 nt, Homo sapiens
ucugcggagcacacuggcu

SEQ ID NO: 1746741 - RNA, 14 nt, Homo sapiens
auaaauaccaaaga

SEQ ID NO: 1746742 - RNA, 14 nt, Homo sapiens
cauuauacauuuga

SEQ ID NO: 1746743 - RNA, 18 nt, Homo sapiens
acugaaggcauaugcaca

SEQ ID NO: 1746744 - RNA, 17 nt, Homo sapiens
cucuaacaaacaagaga

SEQ ID NO: 1746745 - RNA, 15 nt, Homo sapiens
ugguaaaacacagau

SEQ ID NO: 1746746 - RNA, 22 nt, Homo sapiens
uaucuugaaacauagagaucua

SEQ ID NO: 1746747 - RNA, 23 nt, Homo sapiens
caacaaauuagguuuuguacaau

SEQ ID NO: 1746748 - RNA, 14 nt, Homo sapiens
cagaacacaaugcu

SEQ ID NO: 1746749 - RNA, 15 nt, Homo sapiens
gugucacuuagugag

SEQ ID NO: 1746750 - RNA, 17 nt, Homo sapiens
cgcaaacuuuaacaggu

SEQ ID NO: 1746751 - RNA, 18 nt, Homo sapiens
gagagccagcccacagau

SEQ ID NO: 1746752 - RNA, 19 nt, Homo sapiens
aaagauugcuauaauguau

SEQ ID NO: 1746753 - RNA, 13 nt, Homo sapiens
auccaauacuguu

SEQ ID NO: 1746754 - RNA, 16 nt, Homo sapiens
ugcuacaguacuaugu

SEQ ID NO: 1746755 - RNA, 15 nt, Homo sapiens
gcagagguugcagug

SEQ ID NO: 1746756 - RNA, 21 nt, Homo sapiens
accugcagggacuccaugcug

SEQ ID NO: 1746757 - RNA, 17 nt, Homo sapiens
uaaaccuggaacaucuc

SEQ ID NO: 1746758 - RNA, 16 nt, Homo sapiens
aucugaggaaggugcu

SEQ ID NO: 1746759 - RNA, 12 nt, Homo sapiens
cccucuaccuuc

SEQ ID NO: 1746760 - RNA, 20 nt, Homo sapiens
gagaccguccuggagcugga

SEQ ID NO: 1746761 - RNA, 14 nt, Homo sapiens
gccgcgugugacag

SEQ ID NO: 1746762 - RNA, 21 nt, Homo sapiens
uaaaaccauaaacuguacaaa

SEQ ID NO: 1746763 - RNA, 12 nt, Homo sapiens
gaggcaggugag

SEQ ID NO: 1746764 - RNA, 19 nt, Homo sapiens
ugucuucgcuggcuccuac

SEQ ID NO: 1746765 - RNA, 21 nt, Homo sapiens
uaacaucacuauccaugcacc

SEQ ID NO: 1746766 - RNA, 19 nt, Homo sapiens
uugagccaacaacucugau

SEQ ID NO: 1746767 - RNA, 16 nt, Homo sapiens
acacacgaugcauuua

SEQ ID NO: 1746768 - RNA, 21 nt, Homo sapiens
aaaugggacugaugucaucuu

SEQ ID NO: 1746769 - RNA, 19 nt, Homo sapiens
gugccauagaauggcacau

SEQ ID NO: 1746770 - RNA, 20 nt, Homo sapiens
uauuuuaaaguaaaagucua

SEQ ID NO: 1746771 - RNA, 18 nt, Homo sapiens
gguguaaaauaucuaccu

SEQ ID NO: 1746772 - RNA, 16 nt, Homo sapiens
aggggaaaguucucag

SEQ ID NO: 1746773 - RNA, 13 nt, Homo sapiens
ccccugacugugu

SEQ ID NO: 1746774 - RNA, 23 nt, Homo sapiens
gcucagcccugcaccaugcugcu

SEQ ID NO: 1746775 - RNA, 19 nt, Homo sapiens
guuuuuguacucugcagac

SEQ ID NO: 1746776 - RNA, 13 nt, Homo sapiens
gucacaugaccca

SEQ ID NO: 1746777 - RNA, 21 nt, Homo sapiens
cauaaagucuuugaagugacu

SEQ ID NO: 1746778 - RNA, 18 nt, Homo sapiens
aagcauguuuucacuaau

SEQ ID NO: 1746779 - RNA, 20 nt, Homo sapiens
caaagggaaauacucuuaau

SEQ ID NO: 1746780 - RNA, 17 nt, Homo sapiens
guuccacuugguucagg

SEQ ID NO: 1746781 - RNA, 14 nt, Homo sapiens
aagaggcagugaga

SEQ ID NO: 1746782 - RNA, 17 nt, Homo sapiens
cugacaaauucaaaaga

SEQ ID NO: 1746783 - RNA, 14 nt, Homo sapiens
gaaaagcccaguga

SEQ ID NO: 1746784 - RNA, 21 nt, Homo sapiens
auuuagacucaucuuacugua

SEQ ID NO: 1746785 - RNA, 17 nt, Homo sapiens
ugaaagggaguauuaca

SEQ ID NO: 1746786 - RNA, 18 nt, Homo sapiens
agaucuuugcaccagaua

SEQ ID NO: 1746787 - RNA, 15 nt, Homo sapiens
cuuggaaagguuuca

SEQ ID NO: 1746788 - RNA, 17 nt, Homo sapiens
ccagcccugaacaaagc

SEQ ID NO: 1746789 - RNA, 20 nt, Homo sapiens
ccagggugggagggcuaggg

SEQ ID NO: 1746790 - RNA, 22 nt, Homo sapiens
ccagcucuacuccaggcuucca

SEQ ID NO: 1746791 - RNA, 15 nt, Homo sapiens
ugguuggguccucac

SEQ ID NO: 1746792 - RNA, 18 nt, Homo sapiens
ucgugacaagugccuuca

SEQ ID NO: 1746793 - RNA, 16 nt, Homo sapiens
gacacagcagugguau

SEQ ID NO: 1746794 - RNA, 22 nt, Homo sapiens
acugaauucaaauauucuuuca

SEQ ID NO: 1746795 - RNA, 23 nt, Homo sapiens
aucccuggauguggauuucacac

SEQ ID NO: 1746796 - RNA, 14 nt, Homo sapiens
cagaaaggcuuuuu

SEQ ID NO: 1746797 - RNA, 21 nt, Homo sapiens
auacacuguaagcuuuguucu

SEQ ID NO: 1746798 - RNA, 14 nt, Homo sapiens
gcuauagucuggca

SEQ ID NO: 1746799 - RNA, 16 nt, Homo sapiens
aauaugcauugucugc

SEQ ID NO: 1746800 - RNA, 12 nt, Homo sapiens
gccuucuuacaa

SEQ ID NO: 1746801 - RNA, 17 nt, Homo sapiens
ggcaggugguaggccau

SEQ ID NO: 1746802 - RNA, 23 nt, Homo sapiens
aguaucaguguuuuaaauucuga

SEQ ID NO: 1746803 - RNA, 19 nt, Homo sapiens
auguuuuuggggacacuga

SEQ ID NO: 1746804 - RNA, 18 nt, Homo sapiens
gucagcaucagcucaggg

SEQ ID NO: 1746805 - RNA, 22 nt, Homo sapiens
ggguuuugucucugcaucucau

SEQ ID NO: 1746806 - RNA, 17 nt, Homo sapiens
uuuaauuuaugauauaa

SEQ ID NO: 1746807 - RNA, 20 nt, Homo sapiens
cuugauuuagcacuauuuac

SEQ ID NO: 1746808 - RNA, 13 nt, Homo sapiens
ggucauucucacc

SEQ ID NO: 1746809 - RNA, 20 nt, Homo sapiens
ccuugagcuguccuauggaa

SEQ ID NO: 1746810 - RNA, 18 nt, Homo sapiens
ugguauuuuccagcacuu

SEQ ID NO: 1746811 - RNA, 19 nt, Homo sapiens
uuuagauuaaacaaacaaa

SEQ ID NO: 1746812 - RNA, 16 nt, Homo sapiens
uccccuucugggcaac

SEQ ID NO: 1746813 - RNA, 20 nt, Homo sapiens
cacaagaagcugguggagca

SEQ ID NO: 1746814 - RNA, 23 nt, Homo sapiens
acucccugaucccagaccugucg

SEQ ID NO: 1746815 - RNA, 14 nt, Homo sapiens
auaaaggcauauau

SEQ ID NO: 1746816 - RNA, 18 nt, Homo sapiens
cauuacaauugcaguuuu

SEQ ID NO: 1746817 - RNA, 12 nt, Homo sapiens
agaaguacuuua

SEQ ID NO: 1746818 - RNA, 16 nt, Homo sapiens
uacaauuacaucucua

SEQ ID NO: 1746819 - RNA, 12 nt, Homo sapiens
aauuuacaagag

SEQ ID NO: 1746820 - RNA, 20 nt, Homo sapiens
uucuuugacaccacaccauc

SEQ ID NO: 1746821 - RNA, 16 nt, Homo sapiens
ggugccugcucaggug

SEQ ID NO: 1746822 - RNA, 18 nt, Homo sapiens
acacauuccaucuuacau

SEQ ID NO: 1746823 - RNA, 19 nt, Homo sapiens
ccagcacuuugguaggcaa

SEQ ID NO: 1746824 - RNA, 19 nt, Homo sapiens
uccuaagaaagacaucaca

SEQ ID NO: 1746825 - RNA, 18 nt, Homo sapiens
uucauucccuuucaugau

SEQ ID NO: 1746826 - RNA, 18 nt, Homo sapiens
aaggcagugcaguacuca

SEQ ID NO: 1746827 - RNA, 17 nt, Homo sapiens
augaacuggaccugcac

SEQ ID NO: 1746828 - RNA, 23 nt, Homo sapiens
uacaguuaucauuaucaucauca

SEQ ID NO: 1746829 - RNA, 12 nt, Homo sapiens
aagaauuugcau

SEQ ID NO: 1746830 - RNA, 23 nt, Homo sapiens
uaacacuggauuuguuucuguga

SEQ ID NO: 1746831 - RNA, 16 nt, Homo sapiens
agagguaaaaaaaaga

SEQ ID NO: 1746832 - RNA, 14 nt, Homo sapiens
aaauggugcugcag

SEQ ID NO: 1746833 - RNA, 14 nt, Homo sapiens
uuguaacauuucac

SEQ ID NO: 1746834 - RNA, 20 nt, Homo sapiens
aaacuacuguuaacacugcu

SEQ ID NO: 1746835 - RNA, 17 nt, Homo sapiens
uauucgaaccacugaga

SEQ ID NO: 1746836 - RNA, 18 nt, Homo sapiens
uggguccugggucuuuca

SEQ ID NO: 1746837 - RNA, 14 nt, Homo sapiens
uacacuauguucua

SEQ ID NO: 1746838 - RNA, 20 nt, Homo sapiens
aggaccaggugucucugaga

SEQ ID NO: 1746839 - RNA, 16 nt, Homo sapiens
ugaacacaaagccugu

SEQ ID NO: 1746840 - RNA, 21 nt, Homo sapiens
uacugaacaaucaaagcacuu

SEQ ID NO: 1746841 - RNA, 16 nt, Homo sapiens
ucugccauuacucugc

SEQ ID NO: 1746842 - RNA, 21 nt, Homo sapiens
aagucaaauuuggauuuucca

SEQ ID NO: 1746843 - RNA, 17 nt, Homo sapiens
aagaacaguaacugcca

SEQ ID NO: 1746844 - RNA, 20 nt, Homo sapiens
caacugccggggguucaggg

SEQ ID NO: 1746845 - RNA, 23 nt, Homo sapiens
gcagcucccauuucaucagcaag

SEQ ID NO: 1746846 - RNA, 19 nt, Homo sapiens
ccuaugcucugggugaaua

SEQ ID NO: 1746847 - RNA, 20 nt, Homo sapiens
acgcacacacacgcaaauac

SEQ ID NO: 1746848 - RNA, 22 nt, Homo sapiens
gcccuguucccuguccuaccaa

SEQ ID NO: 1746849 - RNA, 21 nt, Homo sapiens
accuguaaucccagcacuuug

SEQ ID NO: 1746850 - RNA, 14 nt, Homo sapiens
cauuugugcaaaau

SEQ ID NO: 1746851 - RNA, 12 nt, Homo sapiens
agccaagguuca

SEQ ID NO: 1746852 - RNA, 18 nt, Homo sapiens
gacacuguaugacucucc

SEQ ID NO: 1746853 - RNA, 22 nt, Homo sapiens
ucuugaguucuggaagggacuu

SEQ ID NO: 1746854 - RNA, 16 nt, Homo sapiens
acaggugucugagaug

SEQ ID NO: 1746855 - RNA, 16 nt, Homo sapiens
acucggggugcuuccu

SEQ ID NO: 1746856 - RNA, 20 nt, Homo sapiens
agaauccugccucuccccaa

SEQ ID NO: 1746857 - RNA, 17 nt, Homo sapiens
ugagauagcauugugaa

SEQ ID NO: 1746858 - RNA, 19 nt, Homo sapiens
cuugauagcaaacacuggg

SEQ ID NO: 1746859 - RNA, 20 nt, Homo sapiens
ugguauuguaaaacauucac

SEQ ID NO: 1746860 - RNA, 14 nt, Homo sapiens
uuggauacagcagu

SEQ ID NO: 1746861 - RNA, 23 nt, Homo sapiens
ugugggcucccuuccucccaaaa

SEQ ID NO: 1746862 - RNA, 12 nt, Homo sapiens
uaccacugcuaa

SEQ ID NO: 1746863 - RNA, 12 nt, Homo sapiens
cuccacuguaaa

SEQ ID NO: 1746864 - RNA, 19 nt, Homo sapiens
caggaaggacagacuggcc

SEQ ID NO: 1746865 - RNA, 13 nt, Homo sapiens
uggagcugucuac

SEQ ID NO: 1746866 - RNA, 18 nt, Homo sapiens
aauuaaaaccaucuggca

SEQ ID NO: 1746867 - RNA, 15 nt, Homo sapiens
uaauaugacaaaaca

SEQ ID NO: 1746868 - RNA, 18 nt, Homo sapiens
cuuuggccccacuuugaa

SEQ ID NO: 1746869 - RNA, 19 nt, Homo sapiens
ucaauaaauuaaguuuuau

SEQ ID NO: 1746870 - RNA, 17 nt, Homo sapiens
cauacacugugaacuca

SEQ ID NO: 1746871 - RNA, 23 nt, Homo sapiens
aaaaauggaacuguacacuuguu

SEQ ID NO: 1746872 - RNA, 13 nt, Homo sapiens
acucaaaagacaa

SEQ ID NO: 1746873 - RNA, 13 nt, Homo sapiens
gacacaaaacucc

SEQ ID NO: 1746874 - RNA, 21 nt, Homo sapiens
uacuugucauaucacuaaaua

SEQ ID NO: 1746875 - RNA, 15 nt, Homo sapiens
ucaagacaagagcug

SEQ ID NO: 1746876 - RNA, 17 nt, Homo sapiens
ugcuaaugcuaugcaaa

SEQ ID NO: 1746877 - RNA, 20 nt, Homo sapiens
ugguggcauaugccuguaau

SEQ ID NO: 1746878 - RNA, 16 nt, Homo sapiens
ucugcacagacaagca

SEQ ID NO: 1746879 - RNA, 16 nt, Homo sapiens
gcccugugagcacaaa

SEQ ID NO: 1746880 - RNA, 18 nt, Homo sapiens
uaggggagagaucuccaa

SEQ ID NO: 1746881 - RNA, 19 nt, Homo sapiens
aacacacuccuuugcuuag

SEQ ID NO: 1746882 - RNA, 14 nt, Homo sapiens
ucaccuucugccau

SEQ ID NO: 1746883 - RNA, 12 nt, Homo sapiens
uucagaugaggu

SEQ ID NO: 1746884 - RNA, 12 nt, Homo sapiens
aggcaagaucua

SEQ ID NO: 1746885 - RNA, 14 nt, Homo sapiens
gccuucacaugaaa

SEQ ID NO: 1746886 - RNA, 15 nt, Homo sapiens
ggcuuuuccaaugau

SEQ ID NO: 1746887 - RNA, 16 nt, Homo sapiens
ccaccaccauucuccu

SEQ ID NO: 1746888 - RNA, 13 nt, Homo sapiens
auuaguugcacua

SEQ ID NO: 1746889 - RNA, 12 nt, Homo sapiens
cuuuuguaccag

SEQ ID NO: 1746890 - RNA, 17 nt, Homo sapiens
ucaguguuaauacugag

SEQ ID NO: 1746891 - RNA, 21 nt, Homo sapiens
ucacaucccauugggacucca

SEQ ID NO: 1746892 - RNA, 21 nt, Homo sapiens
uucauaguuucaaaucuguaa

SEQ ID NO: 1746893 - RNA, 15 nt, Homo sapiens
accuauuugucaugu

SEQ ID NO: 1746894 - RNA, 13 nt, Homo sapiens
gaaaucuguaauu

SEQ ID NO: 1746895 - RNA, 13 nt, Homo sapiens
gccaacuguccua

SEQ ID NO: 1746896 - RNA, 21 nt, Homo sapiens
cuucucucagaccgucuuccu

SEQ ID NO: 1746897 - RNA, 17 nt, Homo sapiens
uaacaccucccugggcc

SEQ ID NO: 1746898 - RNA, 18 nt, Homo sapiens
guucucuaaccauucugu

SEQ ID NO: 1746899 - RNA, 16 nt, Homo sapiens
agccuugaucagugac

SEQ ID NO: 1746900 - RNA, 11 nt, Homo sapiens
gcgaguucucu

SEQ ID NO: 1746901 - RNA, 16 nt, Homo sapiens
cuuuuguucugagggg

SEQ ID NO: 1746902 - RNA, 13 nt, Homo sapiens
ccugggacacugc

SEQ ID NO: 1746903 - RNA, 12 nt, Homo sapiens
aguuaaccaauc

SEQ ID NO: 1746904 - RNA, 20 nt, Homo sapiens
aacuugcaauaccaauguuc

SEQ ID NO: 1746905 - RNA, 23 nt, Homo sapiens
ucuaauuuauacaaaauaauuua

SEQ ID NO: 1746906 - RNA, 19 nt, Homo sapiens
auggucccuuaaggcacag

SEQ ID NO: 1746907 - RNA, 17 nt, Homo sapiens
aguaaauuuaaguccac

SEQ ID NO: 1746908 - RNA, 22 nt, Homo sapiens
gaagagcuguguggccuggcaa

SEQ ID NO: 1746909 - RNA, 12 nt, Homo sapiens
uugauaucucaa

SEQ ID NO: 1746910 - RNA, 21 nt, Homo sapiens
aaagcuauucuuaugcuguaa

SEQ ID NO: 1746911 - RNA, 14 nt, Homo sapiens
acaaaaugcugaca

SEQ ID NO: 1746912 - RNA, 22 nt, Homo sapiens
gaaaccaaaguaaccuuuugca

SEQ ID NO: 1746913 - RNA, 16 nt, Homo sapiens
agcugcugucacuaga

SEQ ID NO: 1746914 - RNA, 14 nt, Homo sapiens
acuacauaaucucu

SEQ ID NO: 1746915 - RNA, 14 nt, Homo sapiens
auuuauuaaccaaa

SEQ ID NO: 1746916 - RNA, 18 nt, Homo sapiens
auuuguuaagguucaaga

SEQ ID NO: 1746917 - RNA, 13 nt, Homo sapiens
cuuggggguggug

SEQ ID NO: 1746918 - RNA, 23 nt, Homo sapiens
uauuuugguuuagugcaaaguau

SEQ ID NO: 1746919 - RNA, 16 nt, Homo sapiens
ggaaguuucacuggcu

SEQ ID NO: 1746920 - RNA, 20 nt, Homo sapiens
caggguggcacccaccacuc

SEQ ID NO: 1746921 - RNA, 20 nt, Homo sapiens
ggcagggagcugggcccgac

SEQ ID NO: 1746922 - RNA, 14 nt, Homo sapiens
cccgccugcagucu

SEQ ID NO: 1746923 - RNA, 18 nt, Homo sapiens
gauuguauauggaacaaa

SEQ ID NO: 1746924 - RNA, 18 nt, Homo sapiens
ugcaccuguacucaggag

SEQ ID NO: 1746925 - RNA, 13 nt, Homo sapiens
gagagagggcaaa

SEQ ID NO: 1746926 - RNA, 22 nt, Homo sapiens
uugacuagggauucaggcugcu

SEQ ID NO: 1746927 - RNA, 21 nt, Homo sapiens
caaugagcauguuuagacuuu

SEQ ID NO: 1746928 - RNA, 15 nt, Homo sapiens
acuguucuuugcagu

SEQ ID NO: 1746929 - RNA, 16 nt, Homo sapiens
acuauugagccuugca

SEQ ID NO: 1746930 - RNA, 18 nt, Homo sapiens
ccugauggagugugcaga

SEQ ID NO: 1746931 - RNA, 15 nt, Homo sapiens
aaaggacaggccaca

SEQ ID NO: 1746932 - RNA, 16 nt, Homo sapiens
uuauuauggcuuguga

SEQ ID NO: 1746933 - RNA, 21 nt, Homo sapiens
acagagugagacuccaucuca

SEQ ID NO: 1746934 - RNA, 15 nt, Homo sapiens
ucaaaagacuuuuau

SEQ ID NO: 1746935 - RNA, 22 nt, Homo sapiens
aguuaccuuugcugucacuuuc

SEQ ID NO: 1746936 - RNA, 18 nt, Homo sapiens
accccaacuuggcagcuu

SEQ ID NO: 1746937 - RNA, 21 nt, Homo sapiens
gcacaucaauuacaagcugua

SEQ ID NO: 1746938 - RNA, 18 nt, Homo sapiens
agaagaagugaacacuua

SEQ ID NO: 1746939 - RNA, 16 nt, Homo sapiens
guagacauuugcuaug

SEQ ID NO: 1746940 - RNA, 18 nt, Homo sapiens
acaaacuucaaagaggaa

SEQ ID NO: 1746941 - RNA, 18 nt, Homo sapiens
cauagcuugauaaagggc

SEQ ID NO: 1746942 - RNA, 20 nt, Homo sapiens
ggacuaugguggccaagggc

SEQ ID NO: 1746943 - RNA, 13 nt, Homo sapiens
gaaaggaccaaau

SEQ ID NO: 1746944 - RNA, 13 nt, Homo sapiens
gaagugaccaagg

SEQ ID NO: 1746945 - RNA, 23 nt, Homo sapiens
uuuuauggaucuguugggaacca

SEQ ID NO: 1746946 - RNA, 14 nt, Homo sapiens
auaugcaaagucua

SEQ ID NO: 1746947 - RNA, 16 nt, Homo sapiens
uacugccccugcccug

SEQ ID NO: 1746948 - RNA, 23 nt, Homo sapiens
aauugccccugguugagaaacau

SEQ ID NO: 1746949 - RNA, 20 nt, Homo sapiens
aauaaucaacugaauugcaa

SEQ ID NO: 1746950 - RNA, 21 nt, Homo sapiens
gcucucugucaggugugauaa

SEQ ID NO: 1746951 - RNA, 13 nt, Homo sapiens
aauggcaugucag

SEQ ID NO: 1746952 - RNA, 18 nt, Homo sapiens
cuaaguguguauccagaa

SEQ ID NO: 1746953 - RNA, 20 nt, Homo sapiens
cgugaaauuugccucugucc

SEQ ID NO: 1746954 - RNA, 22 nt, Homo sapiens
ggguugaagggcaguguucccu

SEQ ID NO: 1746955 - RNA, 23 nt, Homo sapiens
caggaccccagagggaccagcug

SEQ ID NO: 1746956 - RNA, 21 nt, Homo sapiens
aaccgaugguccucacaagcc

SEQ ID NO: 1746957 - RNA, 23 nt, Homo sapiens
ccaucugcacuggcaucuaguca

SEQ ID NO: 1746958 - RNA, 14 nt, Homo sapiens
acugcugucuucca

SEQ ID NO: 1746959 - RNA, 14 nt, Homo sapiens
gcaggcaaggcaag

SEQ ID NO: 1746960 - RNA, 21 nt, Homo sapiens
agagccaugugucauguaaua

SEQ ID NO: 1746961 - RNA, 22 nt, Homo sapiens
cgcacccccacugcugcugcag

SEQ ID NO: 1746962 - RNA, 22 nt, Homo sapiens
cugggauguccacagaugccuc

SEQ ID NO: 1746963 - RNA, 22 nt, Homo sapiens
aggcauuaaauuuuagcaaaga

SEQ ID NO: 1746964 - RNA, 13 nt, Homo sapiens
aggagaaggugcc

SEQ ID NO: 1746965 - RNA, 12 nt, Homo sapiens
aguggucuucaa

SEQ ID NO: 1746966 - RNA, 16 nt, Homo sapiens
aaugcagacauuuaca

SEQ ID NO: 1746967 - RNA, 19 nt, Homo sapiens
gcacagucauacaagucau

SEQ ID NO: 1746968 - RNA, 20 nt, Homo sapiens
caaaggauguguuuucaguc

SEQ ID NO: 1746969 - RNA, 22 nt, Homo sapiens
guuucucuugaagaacugacua

SEQ ID NO: 1746970 - RNA, 23 nt, Homo sapiens
gaacugaggccuugugugucagg

SEQ ID NO: 1746971 - RNA, 18 nt, Homo sapiens
uggaaauaaaccauugga

SEQ ID NO: 1746972 - RNA, 17 nt, Homo sapiens
gagaagcugucagggac

SEQ ID NO: 1746973 - RNA, 23 nt, Homo sapiens
aacaugaacucuugaagucacac

SEQ ID NO: 1746974 - RNA, 15 nt, Homo sapiens
gaugggaugcacucu

SEQ ID NO: 1746975 - RNA, 12 nt, Homo sapiens
guaccaccaaaa

SEQ ID NO: 1746976 - RNA, 15 nt, Homo sapiens
auaucaucagcauac

SEQ ID NO: 1746977 - RNA, 18 nt, Homo sapiens
acauaauuaaagugucca

SEQ ID NO: 1746978 - RNA, 17 nt, Homo sapiens
aauaaacugguaugaau

SEQ ID NO: 1746979 - RNA, 15 nt, Homo sapiens
aauaguacauuuuca

SEQ ID NO: 1746980 - RNA, 16 nt, Homo sapiens
ccaaaaucaugccauu

SEQ ID NO: 1746981 - RNA, 15 nt, Homo sapiens
guaacuaaaggaauc

SEQ ID NO: 1746982 - RNA, 16 nt, Homo sapiens
guagcccuggaccugc

SEQ ID NO: 1746983 - RNA, 14 nt, Homo sapiens
gacauuuuuccucu

SEQ ID NO: 1746984 - RNA, 16 nt, Homo sapiens
gcaagcagacauuuau

SEQ ID NO: 1746985 - RNA, 19 nt, Homo sapiens
uacuugggagaccuguaau

SEQ ID NO: 1746986 - RNA, 15 nt, Homo sapiens
accaucauagcucac

SEQ ID NO: 1746987 - RNA, 23 nt, Homo sapiens
uggcucccccucgcccuaugcaa

SEQ ID NO: 1746988 - RNA, 19 nt, Homo sapiens
ugacaaccugaauuaucua

SEQ ID NO: 1746989 - RNA, 23 nt, Homo sapiens
aauccuagcagacacugccuuga

SEQ ID NO: 1746990 - RNA, 14 nt, Homo sapiens
uccugccuugauga

SEQ ID NO: 1746991 - RNA, 18 nt, Homo sapiens
uuacacaaaaucccauga

SEQ ID NO: 1746992 - RNA, 21 nt, Homo sapiens
ucaacuacuauucaaaaccuc

SEQ ID NO: 1746993 - RNA, 16 nt, Homo sapiens
ggaguccaaaccuucu

SEQ ID NO: 1746994 - RNA, 21 nt, Homo sapiens
gggggcggggcugucaccacg

SEQ ID NO: 1746995 - RNA, 19 nt, Homo sapiens
cgccgugucuuguguugcu

SEQ ID NO: 1746996 - RNA, 17 nt, Homo sapiens
ugauaucugcagggaca

SEQ ID NO: 1746997 - RNA, 18 nt, Homo sapiens
agccuugauaauacuuga

SEQ ID NO: 1746998 - RNA, 14 nt, Homo sapiens
uuacuuuucacagu

SEQ ID NO: 1746999 - RNA, 18 nt, Homo sapiens
ccuguguauucauucuca

SEQ ID NO: 1747000 - RNA, 21 nt, Homo sapiens
uagcaaagcacauagagccag

SEQ ID NO: 1747001 - RNA, 15 nt, Homo sapiens
uuugcuuuucacugg

SEQ ID NO: 1747002 - RNA, 16 nt, Homo sapiens
gcaugaaccacccaga

SEQ ID NO: 1747003 - RNA, 19 nt, Homo sapiens
ugaaacgucccacacuuug

SEQ ID NO: 1747004 - RNA, 16 nt, Homo sapiens
uacuacagaaagcaaa

SEQ ID NO: 1747005 - RNA, 15 nt, Homo sapiens
guuauucuuguuaua

SEQ ID NO: 1747006 - RNA, 21 nt, Homo sapiens
agaaugaucuauugcucauca

SEQ ID NO: 1747007 - RNA, 14 nt, Homo sapiens
uccaucagcucucu

SEQ ID NO: 1747008 - RNA, 21 nt, Homo sapiens
cacauccgccuuuuguauaca

SEQ ID NO: 1747009 - RNA, 18 nt, Homo sapiens
ccagaugcagcacauaua

SEQ ID NO: 1747010 - RNA, 20 nt, Homo sapiens
cagaaauaguugucugugcu

SEQ ID NO: 1747011 - RNA, 18 nt, Homo sapiens
caauaaagugacccugcu

SEQ ID NO: 1747012 - RNA, 21 nt, Homo sapiens
aaugacucauaggucccugac

SEQ ID NO: 1747013 - RNA, 18 nt, Homo sapiens
gacgcacagcacuccugu

SEQ ID NO: 1747014 - RNA, 13 nt, Homo sapiens
acugaauuccauu

SEQ ID NO: 1747015 - RNA, 14 nt, Homo sapiens
gaaguuacuuuuug

SEQ ID NO: 1747016 - RNA, 22 nt, Homo sapiens
aaagagaauggaaaaaugauuu

SEQ ID NO: 1747017 - RNA, 16 nt, Homo sapiens
aucugaggaguccaaa

SEQ ID NO: 1747018 - RNA, 15 nt, Homo sapiens
accccugguucucau

SEQ ID NO: 1747019 - RNA, 16 nt, Homo sapiens
cuguaaaauacaugua

SEQ ID NO: 1747020 - RNA, 12 nt, Homo sapiens
uguacaaugaca

SEQ ID NO: 1747021 - RNA, 14 nt, Homo sapiens
auuucagggaaaug

SEQ ID NO: 1747022 - RNA, 18 nt, Homo sapiens
uggauuuucaucaggggc

SEQ ID NO: 1747023 - RNA, 13 nt, Homo sapiens
guauaucuaauaa

SEQ ID NO: 1747024 - RNA, 19 nt, Homo sapiens
acugcacaaugaccagcag

SEQ ID NO: 1747025 - RNA, 11 nt, Homo sapiens
uacugccuuaa

SEQ ID NO: 1747026 - RNA, 17 nt, Homo sapiens
gcaggaagauagcuuga

SEQ ID NO: 1747027 - RNA, 15 nt, Homo sapiens
ugaguuccuagccac

SEQ ID NO: 1747028 - RNA, 12 nt, Homo sapiens
cugugagcacau

SEQ ID NO: 1747029 - RNA, 13 nt, Homo sapiens
augcucaaucuca

SEQ ID NO: 1747030 - RNA, 16 nt, Homo sapiens
cugauccagacaagug

SEQ ID NO: 1747031 - RNA, 15 nt, Homo sapiens
agguggggucacucu

SEQ ID NO: 1747032 - RNA, 22 nt, Homo sapiens
cacugaggagacagaaagccuc

SEQ ID NO: 1747033 - RNA, 17 nt, Homo sapiens
guuccucucugguggcu

SEQ ID NO: 1747034 - RNA, 22 nt, Homo sapiens
caguuaagacaacaggcauuuu

SEQ ID NO: 1747035 - RNA, 13 nt, Homo sapiens
cacuggguugacu

SEQ ID NO: 1747036 - RNA, 16 nt, Homo sapiens
aaguguggaagcagaa

SEQ ID NO: 1747037 - RNA, 22 nt, Homo sapiens
ggcuguugacgcaccugugguu

SEQ ID NO: 1747038 - RNA, 13 nt, Homo sapiens
ccacccacugacc

SEQ ID NO: 1747039 - RNA, 18 nt, Homo sapiens
ccaaggcagcgaccccag

SEQ ID NO: 1747040 - RNA, 21 nt, Homo sapiens
augucagcagacacacauggg

SEQ ID NO: 1747041 - RNA, 17 nt, Homo sapiens
cucuccuccguggcaca

SEQ ID NO: 1747042 - RNA, 14 nt, Homo sapiens
gcuauaaagcagua

SEQ ID NO: 1747043 - RNA, 20 nt, Homo sapiens
guaacaaauaaauaagauca

SEQ ID NO: 1747044 - RNA, 15 nt, Homo sapiens
ggcccccaggacaag

SEQ ID NO: 1747045 - RNA, 21 nt, Homo sapiens
uauaaagauacuaaaccagca

SEQ ID NO: 1747046 - RNA, 14 nt, Homo sapiens
cugucaggugugau

SEQ ID NO: 1747047 - RNA, 16 nt, Homo sapiens
auaacuguuguugaua

SEQ ID NO: 1747048 - RNA, 17 nt, Homo sapiens
cagucagguccaugugc

SEQ ID NO: 1747049 - RNA, 17 nt, Homo sapiens
uguagacuuaacacuuc

SEQ ID NO: 1747050 - RNA, 17 nt, Homo sapiens
cauucgggccacagggc

SEQ ID NO: 1747051 - RNA, 22 nt, Homo sapiens
gaagaacagaauugcuccugca

SEQ ID NO: 1747052 - RNA, 16 nt, Homo sapiens
cauucuuacucgggcg

SEQ ID NO: 1747053 - RNA, 16 nt, Homo sapiens
uuuugaaauccaaaga

SEQ ID NO: 1747054 - RNA, 18 nt, Homo sapiens
cuauucccuaacuuguga

SEQ ID NO: 1747055 - RNA, 18 nt, Homo sapiens
acuucacagagugugcug

SEQ ID NO: 1747056 - RNA, 16 nt, Homo sapiens
cuuaauguuucuuaga

SEQ ID NO: 1747057 - RNA, 14 nt, Homo sapiens
aaagguuaagccau

SEQ ID NO: 1747058 - RNA, 18 nt, Homo sapiens
ggaaggaagcacaaaaga

SEQ ID NO: 1747059 - RNA, 15 nt, Homo sapiens
aaagggaaacuggcu

SEQ ID NO: 1747060 - RNA, 17 nt, Homo sapiens
ccacacagcacaugcac

SEQ ID NO: 1747061 - RNA, 17 nt, Homo sapiens
cucacugguccauuucu

SEQ ID NO: 1747062 - RNA, 20 nt, Homo sapiens
aaauuaaacaugcuguuacc

SEQ ID NO: 1747063 - RNA, 18 nt, Homo sapiens
cuaaaguaaaaagggaau

SEQ ID NO: 1747064 - RNA, 17 nt, Homo sapiens
aucagagccagucucac

SEQ ID NO: 1747065 - RNA, 20 nt, Homo sapiens
uacauaauguuaguagcacu

SEQ ID NO: 1747066 - RNA, 22 nt, Homo sapiens
gaagggcugggccaccagggau

SEQ ID NO: 1747067 - RNA, 18 nt, Homo sapiens
acucacuugccauugcca

SEQ ID NO: 1747068 - RNA, 18 nt, Homo sapiens
caaaaagaagauggaugu

SEQ ID NO: 1747069 - RNA, 22 nt, Homo sapiens
ucccaggggcuggcuucaggag

SEQ ID NO: 1747070 - RNA, 20 nt, Homo sapiens
uggaugugcauuucugugau

SEQ ID NO: 1747071 - RNA, 23 nt, Homo sapiens
gguaguaaauaugaaacuagggu

SEQ ID NO: 1747072 - RNA, 15 nt, Homo sapiens
guuuggcuucagugu

SEQ ID NO: 1747073 - RNA, 16 nt, Homo sapiens
auuucuguuagcaaua

SEQ ID NO: 1747074 - RNA, 17 nt, Homo sapiens
cuauuuaaguggacugu

SEQ ID NO: 1747075 - RNA, 23 nt, Homo sapiens
caacuugauuuuuucaaaaaagu

SEQ ID NO: 1747076 - RNA, 22 nt, Homo sapiens
uaccauuuguaauaaaguauau

SEQ ID NO: 1747077 - RNA, 21 nt, Homo sapiens
uagaaauaagcccaacagaca

SEQ ID NO: 1747078 - RNA, 15 nt, Homo sapiens
ccuugggauagcaaa

SEQ ID NO: 1747079 - RNA, 14 nt, Homo sapiens
uuacaugaguucaa

SEQ ID NO: 1747080 - RNA, 23 nt, Homo sapiens
acauauauucccauguaaugugu

SEQ ID NO: 1747081 - RNA, 17 nt, Homo sapiens
ggcuccccuggggugca

SEQ ID NO: 1747082 - RNA, 16 nt, Homo sapiens
aucugcagccacuuuc

SEQ ID NO: 1747083 - RNA, 23 nt, Homo sapiens
cugugaaacuguuuaggauuuuc

SEQ ID NO: 1747084 - RNA, 15 nt, Homo sapiens
gccauagaauggcac

SEQ ID NO: 1747085 - RNA, 17 nt, Homo sapiens
ccauuuuuuaauaaaga

SEQ ID NO: 1747086 - RNA, 15 nt, Homo sapiens
auuuguugacugaau

SEQ ID NO: 1747087 - RNA, 15 nt, Homo sapiens
cagggugucccagac

SEQ ID NO: 1747088 - RNA, 18 nt, Homo sapiens
augaugagaaauggaugu

SEQ ID NO: 1747089 - RNA, 16 nt, Homo sapiens
caggcucuccaggugg

SEQ ID NO: 1747090 - RNA, 15 nt, Homo sapiens
cccgccugccagucc

SEQ ID NO: 1747091 - RNA, 20 nt, Homo sapiens
ugucaauaaaaccacuguac

SEQ ID NO: 1747092 - RNA, 18 nt, Homo sapiens
ugaauugaguuuguaauu

SEQ ID NO: 1747093 - RNA, 14 nt, Homo sapiens
uagugguauuauac

SEQ ID NO: 1747094 - RNA, 17 nt, Homo sapiens
uugaauguccuuuuaug

SEQ ID NO: 1747095 - RNA, 21 nt, Homo sapiens
agaugcuagaaaaauguucuu

SEQ ID NO: 1747096 - RNA, 18 nt, Homo sapiens
cuugccugaucaacaauu

SEQ ID NO: 1747097 - RNA, 19 nt, Homo sapiens
gaacauucuuauauuuuau

SEQ ID NO: 1747098 - RNA, 14 nt, Homo sapiens
acgcuugugacagu

SEQ ID NO: 1747099 - RNA, 16 nt, Homo sapiens
auuaauuuuuccauaa

SEQ ID NO: 1747100 - RNA, 18 nt, Homo sapiens
auuuacuuguugaugaca

SEQ ID NO: 1747101 - RNA, 20 nt, Homo sapiens
aguagcugggacuacaggca

SEQ ID NO: 1747102 - RNA, 14 nt, Homo sapiens
agccauaacuugaa

SEQ ID NO: 1747103 - RNA, 14 nt, Homo sapiens
aagcccauucauuc

SEQ ID NO: 1747104 - RNA, 23 nt, Homo sapiens
auggagggcgacgaggaggacag

SEQ ID NO: 1747105 - RNA, 16 nt, Homo sapiens
aacaggaggacaauuc

SEQ ID NO: 1747106 - RNA, 14 nt, Homo sapiens
acucaccaccuuag

SEQ ID NO: 1747107 - RNA, 19 nt, Homo sapiens
uauuucaauguuagccuca

SEQ ID NO: 1747108 - RNA, 17 nt, Homo sapiens
agagaguacacuguguc

SEQ ID NO: 1747109 - RNA, 18 nt, Homo sapiens
cugugccuccaucagcua

SEQ ID NO: 1747110 - RNA, 13 nt, Homo sapiens
guguuagccagga

SEQ ID NO: 1747111 - RNA, 11 nt, Homo sapiens
cccaagcagua

SEQ ID NO: 1747112 - RNA, 20 nt, Homo sapiens
cagaguccuuauucuucuca

SEQ ID NO: 1747113 - RNA, 16 nt, Homo sapiens
uuggggcuuuacauac

SEQ ID NO: 1747114 - RNA, 23 nt, Homo sapiens
aaaaauaaugguguccagucuuu

SEQ ID NO: 1747115 - RNA, 14 nt, Homo sapiens
cagggcugcucccc

SEQ ID NO: 1747116 - RNA, 17 nt, Homo sapiens
aguauuuuuaacacuua

SEQ ID NO: 1747117 - RNA, 22 nt, Homo sapiens
acagaucacagcuucagccagg

SEQ ID NO: 1747118 - RNA, 16 nt, Homo sapiens
ugccacaucauugaag

SEQ ID NO: 1747119 - RNA, 16 nt, Homo sapiens
cacuuauuuccaugga

SEQ ID NO: 1747120 - RNA, 19 nt, Homo sapiens
uucugacuucucccaucua

SEQ ID NO: 1747121 - RNA, 13 nt, Homo sapiens
aauugacugucac

SEQ ID NO: 1747122 - RNA, 23 nt, Homo sapiens
aggaggugcuaucgcaccacugu

SEQ ID NO: 1747123 - RNA, 21 nt, Homo sapiens
guaauuuuaguuauacuccuc

SEQ ID NO: 1747124 - RNA, 16 nt, Homo sapiens
uuuuauaaaagccuug

SEQ ID NO: 1747125 - RNA, 14 nt, Homo sapiens
aacuaugacagaua

SEQ ID NO: 1747126 - RNA, 17 nt, Homo sapiens
gguuauuguucagacau

SEQ ID NO: 1747127 - RNA, 15 nt, Homo sapiens
cacacacacagaugu

SEQ ID NO: 1747128 - RNA, 17 nt, Homo sapiens
acugauggccaggcaag

SEQ ID NO: 1747129 - RNA, 13 nt, Homo sapiens
ccucuccuuggaa

SEQ ID NO: 1747130 - RNA, 16 nt, Homo sapiens
uaccguauguauuuau

SEQ ID NO: 1747131 - RNA, 22 nt, Homo sapiens
guccuuuuuccaauguuuuauu

SEQ ID NO: 1747132 - RNA, 21 nt, Homo sapiens
gcagcuuuaaacucagggaca

SEQ ID NO: 1747133 - RNA, 13 nt, Homo sapiens
cuuuaaaaggcaa

SEQ ID NO: 1747134 - RNA, 14 nt, Homo sapiens
caauaacacuaaaa

SEQ ID NO: 1747135 - RNA, 14 nt, Homo sapiens
gacacacagucuca

SEQ ID NO: 1747136 - RNA, 14 nt, Homo sapiens
uagaaacauuguaa

SEQ ID NO: 1747137 - RNA, 17 nt, Homo sapiens
ggcaggcgguccccauc

SEQ ID NO: 1747138 - RNA, 14 nt, Homo sapiens
uaagaauaguagau

SEQ ID NO: 1747139 - RNA, 17 nt, Homo sapiens
caaauucuuuugaauug

SEQ ID NO: 1747140 - RNA, 18 nt, Homo sapiens
uuaaacuugcaucacuua

SEQ ID NO: 1747141 - RNA, 15 nt, Homo sapiens
cagaauagaaauuag

SEQ ID NO: 1747142 - RNA, 18 nt, Homo sapiens
aguagaaccacuugugga

SEQ ID NO: 1747143 - RNA, 13 nt, Homo sapiens
cuccugacuuuua

SEQ ID NO: 1747144 - RNA, 21 nt, Homo sapiens
acccgagggacagcagauucc

SEQ ID NO: 1747145 - RNA, 20 nt, Homo sapiens
agacccgugaccugagaugu

SEQ ID NO: 1747146 - RNA, 20 nt, Homo sapiens
uagauuuaugcuccuuauga

SEQ ID NO: 1747147 - RNA, 14 nt, Homo sapiens
uggaccaugccaga

SEQ ID NO: 1747148 - RNA, 18 nt, Homo sapiens
ggcuauauuucugggaug

SEQ ID NO: 1747149 - RNA, 22 nt, Homo sapiens
gaagcucucgagggaagcagug

SEQ ID NO: 1747150 - RNA, 19 nt, Homo sapiens
uaucaccucuuaugcacac

SEQ ID NO: 1747151 - RNA, 13 nt, Homo sapiens
ccuugaaugccau

SEQ ID NO: 1747152 - RNA, 20 nt, Homo sapiens
gucagacacuacaugaugac

SEQ ID NO: 1747153 - RNA, 16 nt, Homo sapiens
aguuuauuauguacua

SEQ ID NO: 1747154 - RNA, 16 nt, Homo sapiens
acaucugcuggugggu

SEQ ID NO: 1747155 - RNA, 20 nt, Homo sapiens
cuccagucaacagauucaga

SEQ ID NO: 1747156 - RNA, 21 nt, Homo sapiens
agaucagagguuacuaggguu

SEQ ID NO: 1747157 - RNA, 13 nt, Homo sapiens
cuggaacaccagc

SEQ ID NO: 1747158 - RNA, 15 nt, Homo sapiens
acuagagcucaggcc

SEQ ID NO: 1747159 - RNA, 20 nt, Homo sapiens
gagaagcugcaggcuuugcc

SEQ ID NO: 1747160 - RNA, 19 nt, Homo sapiens
cuucauauagcauugauaa

SEQ ID NO: 1747161 - RNA, 21 nt, Homo sapiens
auuuucuaaauucuuucauga

SEQ ID NO: 1747162 - RNA, 15 nt, Homo sapiens
auaaaugcacuguaa

SEQ ID NO: 1747163 - RNA, 17 nt, Homo sapiens
uuuuuugccaaggcuaa

SEQ ID NO: 1747164 - RNA, 16 nt, Homo sapiens
aaggcacguucuuucc

SEQ ID NO: 1747165 - RNA, 21 nt, Homo sapiens
augggccaagccaggguucca

SEQ ID NO: 1747166 - RNA, 18 nt, Homo sapiens
guuucuugugcacuggca

SEQ ID NO: 1747167 - RNA, 16 nt, Homo sapiens
aagucuucagggaagg

SEQ ID NO: 1747168 - RNA, 14 nt, Homo sapiens
gacgcaugcagggc

SEQ ID NO: 1747169 - RNA, 19 nt, Homo sapiens
auuucugucuuucugcuau

SEQ ID NO: 1747170 - RNA, 16 nt, Homo sapiens
cacuuccaucacaaga

SEQ ID NO: 1747171 - RNA, 19 nt, Homo sapiens
ugccgcuggaggccaccaa

SEQ ID NO: 1747172 - RNA, 17 nt, Homo sapiens
uaagcuccaugugcaua

SEQ ID NO: 1747173 - RNA, 15 nt, Homo sapiens
aauacaacacauuga

SEQ ID NO: 1747174 - RNA, 15 nt, Homo sapiens
gaggcuggugacagg

SEQ ID NO: 1747175 - RNA, 17 nt, Homo sapiens
gauaccuucaugguguu

SEQ ID NO: 1747176 - RNA, 19 nt, Homo sapiens
ugggccuccugggugccag

SEQ ID NO: 1747177 - RNA, 13 nt, Homo sapiens
ugcaaccucuacc

SEQ ID NO: 1747178 - RNA, 20 nt, Homo sapiens
cagagagacaacuugcuccu

SEQ ID NO: 1747179 - RNA, 23 nt, Homo sapiens
cagcguuguguguuuucugggag

SEQ ID NO: 1747180 - RNA, 19 nt, Homo sapiens
caagugauucuccugccuc

SEQ ID NO: 1747181 - RNA, 19 nt, Homo sapiens
ugagggucugaaaagggca

SEQ ID NO: 1747182 - RNA, 20 nt, Homo sapiens
cauugguuuaagcccagaga

SEQ ID NO: 1747183 - RNA, 15 nt, Homo sapiens
cugagugucaucuca

SEQ ID NO: 1747184 - RNA, 23 nt, Homo sapiens
acccucccucccugcugccagaa

SEQ ID NO: 1747185 - RNA, 14 nt, Homo sapiens
aauauacuaugaaa

SEQ ID NO: 1747186 - RNA, 16 nt, Homo sapiens
ccuucuugcucagucc

SEQ ID NO: 1747187 - RNA, 14 nt, Homo sapiens
gaacagccacaaaa

SEQ ID NO: 1747188 - RNA, 19 nt, Homo sapiens
uggagauggaagcuuguug

SEQ ID NO: 1747189 - RNA, 20 nt, Homo sapiens
aguuuuccuuuuguuuucca

SEQ ID NO: 1747190 - RNA, 12 nt, Homo sapiens
ucagucaucuca

SEQ ID NO: 1747191 - RNA, 15 nt, Homo sapiens
gccaggccaccagga

SEQ ID NO: 1747192 - RNA, 14 nt, Homo sapiens
cugucaccaugacu

SEQ ID NO: 1747193 - RNA, 16 nt, Homo sapiens
cagcagcccccagcuc

SEQ ID NO: 1747194 - RNA, 19 nt, Homo sapiens
uauggcugccugcaucuau

SEQ ID NO: 1747195 - RNA, 12 nt, Homo sapiens
aaaaaacagagg

SEQ ID NO: 1747196 - RNA, 16 nt, Homo sapiens
cugagagcuguucccc

SEQ ID NO: 1747197 - RNA, 20 nt, Homo sapiens
gugccugguucgugccaugc

SEQ ID NO: 1747198 - RNA, 22 nt, Homo sapiens
cccuagccauuuuuacuguuau

SEQ ID NO: 1747199 - RNA, 19 nt, Homo sapiens
uucauauuucaaaccacaa

SEQ ID NO: 1747200 - RNA, 17 nt, Homo sapiens
acaaggcuacgcugaca

SEQ ID NO: 1747201 - RNA, 17 nt, Homo sapiens
gagacccggcucucagc

SEQ ID NO: 1747202 - RNA, 19 nt, Homo sapiens
acaauguauugucugccca

SEQ ID NO: 1747203 - RNA, 13 nt, Homo sapiens
gcuaaaacugcuc

SEQ ID NO: 1747204 - RNA, 19 nt, Homo sapiens
gugcccuccugaauggauu

SEQ ID NO: 1747205 - RNA, 18 nt, Homo sapiens
uucauaccuaaguacugu

SEQ ID NO: 1747206 - RNA, 14 nt, Homo sapiens
guggacugugcugg

SEQ ID NO: 1747207 - RNA, 15 nt, Homo sapiens
uacaccccagcuccu

SEQ ID NO: 1747208 - RNA, 16 nt, Homo sapiens
gugaaugaacacucuu

SEQ ID NO: 1747209 - RNA, 16 nt, Homo sapiens
ugcccaguguguuucu

SEQ ID NO: 1747210 - RNA, 18 nt, Homo sapiens
uuuccccacacaugccua

SEQ ID NO: 1747211 - RNA, 15 nt, Homo sapiens
guuuuuaauucauau

SEQ ID NO: 1747212 - RNA, 18 nt, Homo sapiens
aagaggcugccccucuca

SEQ ID NO: 1747213 - RNA, 13 nt, Homo sapiens
ccaaagaaaugaa

SEQ ID NO: 1747214 - RNA, 20 nt, Homo sapiens
aucuagagaaggcauuucau

SEQ ID NO: 1747215 - RNA, 14 nt, Homo sapiens
acagacaugagcca

SEQ ID NO: 1747216 - RNA, 14 nt, Homo sapiens
ggauuaguacacac

SEQ ID NO: 1747217 - RNA, 19 nt, Homo sapiens
uguuuaggaauauaagguu

SEQ ID NO: 1747218 - RNA, 16 nt, Homo sapiens
aauuugaggacaagau

SEQ ID NO: 1747219 - RNA, 22 nt, Homo sapiens
gcaagagcaccuggccaagcga

SEQ ID NO: 1747220 - RNA, 23 nt, Homo sapiens
aucccagagcccagggcauccca

SEQ ID NO: 1747221 - RNA, 14 nt, Homo sapiens
agcaggaguggugc

SEQ ID NO: 1747222 - RNA, 23 nt, Homo sapiens
cacaaugguuuuguuucuuuccu

SEQ ID NO: 1747223 - RNA, 20 nt, Homo sapiens
uucccacucugaagauccca

SEQ ID NO: 1747224 - RNA, 22 nt, Homo sapiens
uaacuguagauaaagugguuug

SEQ ID NO: 1747225 - RNA, 16 nt, Homo sapiens
uuauauuuugaucuga

SEQ ID NO: 1747226 - RNA, 13 nt, Homo sapiens
uauacuuugcaau

SEQ ID NO: 1747227 - RNA, 13 nt, Homo sapiens
ucaaaguggcaaa

SEQ ID NO: 1747228 - RNA, 21 nt, Homo sapiens
uaagcgugcugacaucagauu

SEQ ID NO: 1747229 - RNA, 23 nt, Homo sapiens
agcaaacuuggugaaacuacauc

SEQ ID NO: 1747230 - RNA, 15 nt, Homo sapiens
cccagauagguggug

SEQ ID NO: 1747231 - RNA, 22 nt, Homo sapiens
agaaaucccaguucauguugcu

SEQ ID NO: 1747232 - RNA, 18 nt, Homo sapiens
uggauuccccaucucagg

SEQ ID NO: 1747233 - RNA, 21 nt, Homo sapiens
cuuuaaggagaagagaucuuc

SEQ ID NO: 1747234 - RNA, 14 nt, Homo sapiens
auuuagaauaucua

SEQ ID NO: 1747235 - RNA, 23 nt, Homo sapiens
auaaugagcagccccucccagau

SEQ ID NO: 1747236 - RNA, 13 nt, Homo sapiens
uguaaauugcaca

SEQ ID NO: 1747237 - RNA, 19 nt, Homo sapiens
uccaggaauuuugugugau

SEQ ID NO: 1747238 - RNA, 13 nt, Homo sapiens
gguucucacuguu

SEQ ID NO: 1747239 - RNA, 14 nt, Homo sapiens
aaaugcucaaggaa

SEQ ID NO: 1747240 - RNA, 18 nt, Homo sapiens
cuaguguaccuccucuca

SEQ ID NO: 1747241 - RNA, 20 nt, Homo sapiens
aagauuuaccauaagggacu

SEQ ID NO: 1747242 - RNA, 18 nt, Homo sapiens
ucccagaggaugucacaa

SEQ ID NO: 1747243 - RNA, 13 nt, Homo sapiens
uaccagugugcuu

SEQ ID NO: 1747244 - RNA, 16 nt, Homo sapiens
caaaucuccugcugau

SEQ ID NO: 1747245 - RNA, 18 nt, Homo sapiens
cacugccgaugcccaauc

SEQ ID NO: 1747246 - RNA, 19 nt, Homo sapiens
gcacuggggccacccagcc

SEQ ID NO: 1747247 - RNA, 19 nt, Homo sapiens
gcugcuucugcaaaaaacu

SEQ ID NO: 1747248 - RNA, 20 nt, Homo sapiens
gcaacuagggcuagucuucc

SEQ ID NO: 1747249 - RNA, 13 nt, Homo sapiens
acccuugccaugg

SEQ ID NO: 1747250 - RNA, 16 nt, Homo sapiens
aaaacugaacuaugua

SEQ ID NO: 1747251 - RNA, 17 nt, Homo sapiens
aggaagcuagguugaaa

SEQ ID NO: 1747252 - RNA, 13 nt, Homo sapiens
aucaucuccaguu

SEQ ID NO: 1747253 - RNA, 13 nt, Homo sapiens
ucucucaaugaau

SEQ ID NO: 1747254 - RNA, 19 nt, Homo sapiens
cacccuuuaauguucuaua

SEQ ID NO: 1747255 - RNA, 17 nt, Homo sapiens
aauaaagacuugugcau

SEQ ID NO: 1747256 - RNA, 16 nt, Homo sapiens
acuuuuuagccaguga

SEQ ID NO: 1747257 - RNA, 18 nt, Homo sapiens
cagugucaugaauguugc

SEQ ID NO: 1747258 - RNA, 17 nt, Homo sapiens
aucaagcuccaucuuau

SEQ ID NO: 1747259 - RNA, 16 nt, Homo sapiens
acaucccauugcccug

SEQ ID NO: 1747260 - RNA, 15 nt, Homo sapiens
aggaacaaagacagg

SEQ ID NO: 1747261 - RNA, 13 nt, Homo sapiens
cuggcccuugcaa

SEQ ID NO: 1747262 - RNA, 15 nt, Homo sapiens
cuuaauaacauacaa

SEQ ID NO: 1747263 - RNA, 19 nt, Homo sapiens
ucuuacagucagcacagaa

SEQ ID NO: 1747264 - RNA, 15 nt, Homo sapiens
gaggugucgggacau

SEQ ID NO: 1747265 - RNA, 23 nt, Homo sapiens
ugucacuaaacaagaaaucugac

SEQ ID NO: 1747266 - RNA, 15 nt, Homo sapiens
ggggcagacaauaaa

SEQ ID NO: 1747267 - RNA, 16 nt, Homo sapiens
gcggcauuaaagccau

SEQ ID NO: 1747268 - RNA, 22 nt, Homo sapiens
ggcuccacagaggccacaaaau

SEQ ID NO: 1747269 - RNA, 16 nt, Homo sapiens
cauuugaaaucuauga

SEQ ID NO: 1747270 - RNA, 22 nt, Homo sapiens
auuuauauaugaaaacuauaca

SEQ ID NO: 1747271 - RNA, 15 nt, Homo sapiens
aaggcagauccucuc

SEQ ID NO: 1747272 - RNA, 11 nt, Homo sapiens
gcucacagauu

SEQ ID NO: 1747273 - RNA, 15 nt, Homo sapiens
ucaacauacuguuga

SEQ ID NO: 1747274 - RNA, 20 nt, Homo sapiens
caggugaaaauccaucucau

SEQ ID NO: 1747275 - RNA, 17 nt, Homo sapiens
gguggcccacgccugua

SEQ ID NO: 1747276 - RNA, 19 nt, Homo sapiens
ccuagaggccugacugcca

SEQ ID NO: 1747277 - RNA, 22 nt, Homo sapiens
uugcugccaaacacccaugccc

SEQ ID NO: 1747278 - RNA, 19 nt, Homo sapiens
uguagucucagcuacuuag

SEQ ID NO: 1747279 - RNA, 19 nt, Homo sapiens
uuugccacccucaugcugu

SEQ ID NO: 1747280 - RNA, 18 nt, Homo sapiens
uucccaccagguucuccu

SEQ ID NO: 1747281 - RNA, 17 nt, Homo sapiens
uucacucucugcauuga

SEQ ID NO: 1747282 - RNA, 23 nt, Homo sapiens
agaguauuaaugaaaagcacaaa

SEQ ID NO: 1747283 - RNA, 23 nt, Homo sapiens
ggccaaggugccaccacccugcc

SEQ ID NO: 1747284 - RNA, 19 nt, Homo sapiens
gaaaaaucauaacucacuu

SEQ ID NO: 1747285 - RNA, 17 nt, Homo sapiens
cuguuuauauugguaua

SEQ ID NO: 1747286 - RNA, 21 nt, Homo sapiens
auaggucagugcaaauacucu

SEQ ID NO: 1747287 - RNA, 15 nt, Homo sapiens
cuccccugcacugua

SEQ ID NO: 1747288 - RNA, 20 nt, Homo sapiens
aacacaaccuacucugcaaa

SEQ ID NO: 1747289 - RNA, 23 nt, Homo sapiens
augaagcagcuuuaaacaaauuc

SEQ ID NO: 1747290 - RNA, 22 nt, Homo sapiens
ccagaagaaagggccuucacag

SEQ ID NO: 1747291 - RNA, 15 nt, Homo sapiens
aguccucacucuuca

SEQ ID NO: 1747292 - RNA, 19 nt, Homo sapiens
ccuacccccugugccuugu

SEQ ID NO: 1747293 - RNA, 20 nt, Homo sapiens
gugaaacacccaucguucuc

SEQ ID NO: 1747294 - RNA, 21 nt, Homo sapiens
uguggcugcuagcacuuggag

SEQ ID NO: 1747295 - RNA, 23 nt, Homo sapiens
cuguaaacuguguauuccaagac

SEQ ID NO: 1747296 - RNA, 22 nt, Homo sapiens
ucagagcagugauucucucuuc

SEQ ID NO: 1747297 - RNA, 21 nt, Homo sapiens
uuuguuucagguucaguauua

SEQ ID NO: 1747298 - RNA, 12 nt, Homo sapiens
cauaaacacuuc

SEQ ID NO: 1747299 - RNA, 19 nt, Homo sapiens
uacauuuuauuacacuaaa

SEQ ID NO: 1747300 - RNA, 14 nt, Homo sapiens
gcacuugcuuuuau

SEQ ID NO: 1747301 - RNA, 20 nt, Homo sapiens
auuuaaagguuaguauggaa

SEQ ID NO: 1747302 - RNA, 18 nt, Homo sapiens
ugucaagauuaaguuaua

SEQ ID NO: 1747303 - RNA, 21 nt, Homo sapiens
agugaucucagcucacugcaa

SEQ ID NO: 1747304 - RNA, 16 nt, Homo sapiens
ucuuuaaugauuccua

SEQ ID NO: 1747305 - RNA, 22 nt, Homo sapiens
caaggacgugggccuccagagu

SEQ ID NO: 1747306 - RNA, 19 nt, Homo sapiens
cugugacgagguggcaguc

SEQ ID NO: 1747307 - RNA, 19 nt, Homo sapiens
gagcaguuagcucauuuga

SEQ ID NO: 1747308 - RNA, 15 nt, Homo sapiens
ucuagugaccuuaaa

SEQ ID NO: 1747309 - RNA, 19 nt, Homo sapiens
ugcuuaccucucagccuua

SEQ ID NO: 1747310 - RNA, 16 nt, Homo sapiens
cuuaccugccagauaa

SEQ ID NO: 1747311 - RNA, 14 nt, Homo sapiens
ugacuugacuuuag

SEQ ID NO: 1747312 - RNA, 23 nt, Homo sapiens
uagggggccuugcggaagccaua

SEQ ID NO: 1747313 - RNA, 22 nt, Homo sapiens
uacuucagguuuuaucaguaga

SEQ ID NO: 1747314 - RNA, 23 nt, Homo sapiens
uuccucccagcauaggauucauu

SEQ ID NO: 1747315 - RNA, 15 nt, Homo sapiens
uagaguggcgauuga

SEQ ID NO: 1747316 - RNA, 19 nt, Homo sapiens
aaguaccacauuccaugac

SEQ ID NO: 1747317 - RNA, 18 nt, Homo sapiens
cuucuuccacacaugcaa

SEQ ID NO: 1747318 - RNA, 15 nt, Homo sapiens
cuggcuuccaugcuc

SEQ ID NO: 1747319 - RNA, 12 nt, Homo sapiens
augcuuuggcaa

SEQ ID NO: 1747320 - RNA, 14 nt, Homo sapiens
uuauuguaccucuc

SEQ ID NO: 1747321 - RNA, 12 nt, Homo sapiens
ucacccugcuac

SEQ ID NO: 1747322 - RNA, 13 nt, Homo sapiens
auuaauguuaaca

SEQ ID NO: 1747323 - RNA, 19 nt, Homo sapiens
aauuuuaaugaagugcaau

SEQ ID NO: 1747324 - RNA, 23 nt, Homo sapiens
cacauggaaucaaucuuuaacaa

SEQ ID NO: 1747325 - RNA, 19 nt, Homo sapiens
ggugcgcucaccucagagc

SEQ ID NO: 1747326 - RNA, 21 nt, Homo sapiens
ugaguugcccaucauacgcau

SEQ ID NO: 1747327 - RNA, 21 nt, Homo sapiens
auccucucccauggagacaag

SEQ ID NO: 1747328 - RNA, 13 nt, Homo sapiens
ucuccugcugauu

SEQ ID NO: 1747329 - RNA, 10 nt, Homo sapiens
caugcacaaa

SEQ ID NO: 1747330 - RNA, 22 nt, Homo sapiens
aucuuuuggggucaucuuugau

SEQ ID NO: 1747331 - RNA, 16 nt, Homo sapiens
uggauauuuguacugu

SEQ ID NO: 1747332 - RNA, 12 nt, Homo sapiens
cucaaaauaucc

SEQ ID NO: 1747333 - RNA, 21 nt, Homo sapiens
ccaucaaacauaauucucuca

SEQ ID NO: 1747334 - RNA, 14 nt, Homo sapiens
ugucccuagcucac

SEQ ID NO: 1747335 - RNA, 19 nt, Homo sapiens
uaaagcauuuagaaaacuu

SEQ ID NO: 1747336 - RNA, 18 nt, Homo sapiens
caagugauccacccaccu

SEQ ID NO: 1747337 - RNA, 20 nt, Homo sapiens
uccaaggaaauaaugugaau

SEQ ID NO: 1747338 - RNA, 22 nt, Homo sapiens
aagaagaccaugaucucaauag

SEQ ID NO: 1747339 - RNA, 17 nt, Homo sapiens
cuccuugaaaccagcuc

SEQ ID NO: 1747340 - RNA, 23 nt, Homo sapiens
aagugggggguggacacagaagu

SEQ ID NO: 1747341 - RNA, 15 nt, Homo sapiens
ugaaaauaugauguu

SEQ ID NO: 1747342 - RNA, 15 nt, Homo sapiens
agcugagaagcaaug

SEQ ID NO: 1747343 - RNA, 20 nt, Homo sapiens
ucuacagugccaacuccuca

SEQ ID NO: 1747344 - RNA, 14 nt, Homo sapiens
aauaaaaauggauc

SEQ ID NO: 1747345 - RNA, 14 nt, Homo sapiens
aagcaaaaugucuc

SEQ ID NO: 1747346 - RNA, 20 nt, Homo sapiens
uccagcucuuuauuacauag

SEQ ID NO: 1747347 - RNA, 19 nt, Homo sapiens
acgcauucucguauccaac

SEQ ID NO: 1747348 - RNA, 16 nt, Homo sapiens
caaugcaaacaucuuc

SEQ ID NO: 1747349 - RNA, 15 nt, Homo sapiens
ugagacggugucucg

SEQ ID NO: 1747350 - RNA, 17 nt, Homo sapiens
cagggagggcuguggug

SEQ ID NO: 1747351 - RNA, 14 nt, Homo sapiens
ugcaaaugcaugcu

SEQ ID NO: 1747352 - RNA, 13 nt, Homo sapiens
auggaacagaaua

SEQ ID NO: 1747353 - RNA, 19 nt, Homo sapiens
auacauuacaucugaguau

SEQ ID NO: 1747354 - RNA, 23 nt, Homo sapiens
ucgaacauggaacucauuccugc

SEQ ID NO: 1747355 - RNA, 19 nt, Homo sapiens
caucccagcaccugccucc

SEQ ID NO: 1747356 - RNA, 17 nt, Homo sapiens
uggggcauuauccaucu

SEQ ID NO: 1747357 - RNA, 19 nt, Homo sapiens
cuugggagcucaucccucu

SEQ ID NO: 1747358 - RNA, 17 nt, Homo sapiens
acccaauucaaauugac

SEQ ID NO: 1747359 - RNA, 14 nt, Homo sapiens
uacaaauacuaaaa

SEQ ID NO: 1747360 - RNA, 17 nt, Homo sapiens
auauuauuacuguugau

SEQ ID NO: 1747361 - RNA, 16 nt, Homo sapiens
auguguaauucuucca

SEQ ID NO: 1747362 - RNA, 24 nt, Homo sapiens
aaguuauuaacgggcauguauuau

SEQ ID NO: 1747363 - RNA, 18 nt, Homo sapiens
auguugggaaacuuggcu

SEQ ID NO: 1747364 - RNA, 15 nt, Homo sapiens
acacauauacauaua

SEQ ID NO: 1747365 - RNA, 21 nt, Homo sapiens
cagaggaagaaaaugagccau

SEQ ID NO: 1747366 - RNA, 22 nt, Homo sapiens
gcccacccaucacgugugauug

SEQ ID NO: 1747367 - RNA, 15 nt, Homo sapiens
aggaaaaauaaucaa

SEQ ID NO: 1747368 - RNA, 17 nt, Homo sapiens
guaucaggacugugacc

SEQ ID NO: 1747369 - RNA, 19 nt, Homo sapiens
ggccaggacaaaaugcaaa

SEQ ID NO: 1747370 - RNA, 14 nt, Homo sapiens
aaaucauuucugca

SEQ ID NO: 1747371 - RNA, 20 nt, Homo sapiens
cagaaagugccuuuaucuca

SEQ ID NO: 1747372 - RNA, 14 nt, Homo sapiens
gaacuuucuggucc

SEQ ID NO: 1747373 - RNA, 12 nt, Homo sapiens
caaacacuccac

SEQ ID NO: 1747374 - RNA, 12 nt, Homo sapiens
uacccacuucca

SEQ ID NO: 1747375 - RNA, 17 nt, Homo sapiens
uauaauaauauacugua

SEQ ID NO: 1747376 - RNA, 21 nt, Homo sapiens
gaccaaauugcuuuacaguuu

SEQ ID NO: 1747377 - RNA, 15 nt, Homo sapiens
ugccaugguagaaga

SEQ ID NO: 1747378 - RNA, 18 nt, Homo sapiens
guucagacacuaccccau

SEQ ID NO: 1747379 - RNA, 23 nt, Homo sapiens
ccauuuuguggauuguguccuau

SEQ ID NO: 1747380 - RNA, 17 nt, Homo sapiens
guuuggacccaugguca

SEQ ID NO: 1747381 - RNA, 20 nt, Homo sapiens
uggcagagccagagcuugaa

SEQ ID NO: 1747382 - RNA, 14 nt, Homo sapiens
aagcgaaauacuug

SEQ ID NO: 1747383 - RNA, 12 nt, Homo sapiens
cugaugggacau

SEQ ID NO: 1747384 - RNA, 19 nt, Homo sapiens
aucauucucucacaagaac

SEQ ID NO: 1747385 - RNA, 16 nt, Homo sapiens
ugcuuaguacauuuga

SEQ ID NO: 1747386 - RNA, 14 nt, Homo sapiens
auguauuuucauag

SEQ ID NO: 1747387 - RNA, 16 nt, Homo sapiens
uacccaauuuaauucc

SEQ ID NO: 1747388 - RNA, 14 nt, Homo sapiens
ugggucuauguucc

SEQ ID NO: 1747389 - RNA, 16 nt, Homo sapiens
caauacuuacauaucu

SEQ ID NO: 1747390 - RNA, 15 nt, Homo sapiens
uguagacucuggaag

SEQ ID NO: 1747391 - RNA, 22 nt, Homo sapiens
uucauggugcacugagcugcaa

SEQ ID NO: 1747392 - RNA, 20 nt, Homo sapiens
uuuccucaggcaaggucugg

SEQ ID NO: 1747393 - RNA, 13 nt, Homo sapiens
uaauaucuucaca

SEQ ID NO: 1747394 - RNA, 19 nt, Homo sapiens
caguucugucauauguuaa

SEQ ID NO: 1747395 - RNA, 23 nt, Homo sapiens
aaauccacugacgaucauucucc

SEQ ID NO: 1747396 - RNA, 13 nt, Homo sapiens
cagccacacuggg

SEQ ID NO: 1747397 - RNA, 20 nt, Homo sapiens
uuugaaaaauuaccuguaua

SEQ ID NO: 1747398 - RNA, 13 nt, Homo sapiens
ggagacauaucac

SEQ ID NO: 1747399 - RNA, 15 nt, Homo sapiens
ccagcauaauuccuc

SEQ ID NO: 1747400 - RNA, 15 nt, Homo sapiens
cacgaagacaaccau

SEQ ID NO: 1747401 - RNA, 13 nt, Homo sapiens
gugaugggcugca

SEQ ID NO: 1747402 - RNA, 13 nt, Homo sapiens
gagcugggcagaa

SEQ ID NO: 1747403 - RNA, 17 nt, Homo sapiens
ugcaaauaagacucuua

SEQ ID NO: 1747404 - RNA, 17 nt, Homo sapiens
agagccaugugucaugu

SEQ ID NO: 1747405 - RNA, 22 nt, Homo sapiens
ugccuuugaaggguaugucaca

SEQ ID NO: 1747406 - RNA, 19 nt, Homo sapiens
auacuuggaugcagcucuu

SEQ ID NO: 1747407 - RNA, 23 nt, Homo sapiens
cuguguagcucuguccacucuga

SEQ ID NO: 1747408 - RNA, 21 nt, Homo sapiens
augagguucugagaccagugu

SEQ ID NO: 1747409 - RNA, 16 nt, Homo sapiens
ugcuccauuuacaaac

SEQ ID NO: 1747410 - RNA, 17 nt, Homo sapiens
aucuggccacacugggc

SEQ ID NO: 1747411 - RNA, 22 nt, Homo sapiens
agugagggucuucuuacaugca

SEQ ID NO: 1747412 - RNA, 18 nt, Homo sapiens
accccuacacacacccag

SEQ ID NO: 1747413 - RNA, 18 nt, Homo sapiens
ugaucgcuucucccccac

SEQ ID NO: 1747414 - RNA, 13 nt, Homo sapiens
gaauuaaucacuu

SEQ ID NO: 1747415 - RNA, 16 nt, Homo sapiens
uacagacugaugccag

SEQ ID NO: 1747416 - RNA, 23 nt, Homo sapiens
uaaaaguacauguuaaacuuacu

SEQ ID NO: 1747417 - RNA, 15 nt, Homo sapiens
ugaagccaaagggac

SEQ ID NO: 1747418 - RNA, 18 nt, Homo sapiens
ccugaacaggaauccuua

SEQ ID NO: 1747419 - RNA, 21 nt, Homo sapiens
gggcagaauaaauaagcaaaa

SEQ ID NO: 1747420 - RNA, 21 nt, Homo sapiens
aggauaccccaaaguccaggc

SEQ ID NO: 1747421 - RNA, 15 nt, Homo sapiens
uguaauuagcucugg

SEQ ID NO: 1747422 - RNA, 20 nt, Homo sapiens
aaucugugaugacauucccu

SEQ ID NO: 1747423 - RNA, 19 nt, Homo sapiens
cagaagcauugccuggacu

SEQ ID NO: 1747424 - RNA, 22 nt, Homo sapiens
gaucuguuuuucaccacuucac

SEQ ID NO: 1747425 - RNA, 21 nt, Homo sapiens
acaagcauucucuccauuuca

SEQ ID NO: 1747426 - RNA, 18 nt, Homo sapiens
caugccccugacagaucu

SEQ ID NO: 1747427 - RNA, 13 nt, Homo sapiens
auugcaugcaauu

SEQ ID NO: 1747428 - RNA, 12 nt, Homo sapiens
uagcccagcacu

SEQ ID NO: 1747429 - RNA, 21 nt, Homo sapiens
uggggaagagugacucuccag

SEQ ID NO: 1747430 - RNA, 21 nt, Homo sapiens
uaaauccucagguaguacugg

SEQ ID NO: 1747431 - RNA, 16 nt, Homo sapiens
ggagagagccaagacg

SEQ ID NO: 1747432 - RNA, 20 nt, Homo sapiens
guauguuacaugcauucuac

SEQ ID NO: 1747433 - RNA, 22 nt, Homo sapiens
agaaacagagguggcugcugug

SEQ ID NO: 1747434 - RNA, 23 nt, Homo sapiens
agaaauuccaggaaaaucugcac

SEQ ID NO: 1747435 - RNA, 13 nt, Homo sapiens
agugacacuggac

SEQ ID NO: 1747436 - RNA, 17 nt, Homo sapiens
cuucuucauccauagac

SEQ ID NO: 1747437 - RNA, 18 nt, Homo sapiens
aagggagaagaaauccau

SEQ ID NO: 1747438 - RNA, 16 nt, Homo sapiens
accaaaaccagagggc

SEQ ID NO: 1747439 - RNA, 19 nt, Homo sapiens
cugauaauaugcaaaugaa

SEQ ID NO: 1747440 - RNA, 18 nt, Homo sapiens
cuauuaccaguguucccu

SEQ ID NO: 1747441 - RNA, 20 nt, Homo sapiens
auagugcaauagugcaacau

SEQ ID NO: 1747442 - RNA, 16 nt, Homo sapiens
gcuuucccaggcagcu

SEQ ID NO: 1747443 - RNA, 17 nt, Homo sapiens
cccucaaauuaacuuuc

SEQ ID NO: 1747444 - RNA, 15 nt, Homo sapiens
agcacggacucuuac

SEQ ID NO: 1747445 - RNA, 16 nt, Homo sapiens
ccuggucugcucagga

SEQ ID NO: 1747446 - RNA, 20 nt, Homo sapiens
uagcaugaauccuacauaca

SEQ ID NO: 1747447 - RNA, 23 nt, Homo sapiens
cauauaacaauucaguaacaaag

SEQ ID NO: 1747448 - RNA, 13 nt, Homo sapiens
ucuuacacaagag

SEQ ID NO: 1747449 - RNA, 18 nt, Homo sapiens
uaccaccccuuccugucc

SEQ ID NO: 1747450 - RNA, 20 nt, Homo sapiens
cugcuuuagagcuagggugg

SEQ ID NO: 1747451 - RNA, 18 nt, Homo sapiens
uaucagaguauccacugu

SEQ ID NO: 1747452 - RNA, 21 nt, Homo sapiens
aagacugugcggcacaggaaa

SEQ ID NO: 1747453 - RNA, 20 nt, Homo sapiens
cugggauaacaguaagggau

SEQ ID NO: 1747454 - RNA, 16 nt, Homo sapiens
cuuggcgcugccauuu

SEQ ID NO: 1747455 - RNA, 15 nt, Homo sapiens
auacccuguccuuuc

SEQ ID NO: 1747456 - RNA, 15 nt, Homo sapiens
cuggaaaaugaaucc

SEQ ID NO: 1747457 - RNA, 16 nt, Homo sapiens
ccaacugcagaccaac

SEQ ID NO: 1747458 - RNA, 14 nt, Homo sapiens
auuuugaguauucc

SEQ ID NO: 1747459 - RNA, 12 nt, Homo sapiens
uuucccaaaaac

SEQ ID NO: 1747460 - RNA, 19 nt, Homo sapiens
guuacccaggcuggucuca

SEQ ID NO: 1747461 - RNA, 15 nt, Homo sapiens
caccacucaaaaaug

SEQ ID NO: 1747462 - RNA, 18 nt, Homo sapiens
aagacuuguuucugaucu

SEQ ID NO: 1747463 - RNA, 14 nt, Homo sapiens
ugagaugauucaga

SEQ ID NO: 1747464 - RNA, 23 nt, Homo sapiens
uuuaguuguaaaccaagugauca

SEQ ID NO: 1747465 - RNA, 13 nt, Homo sapiens
uauagaaacacca

SEQ ID NO: 1747466 - RNA, 16 nt, Homo sapiens
agaugaauagauggaa

SEQ ID NO: 1747467 - RNA, 13 nt, Homo sapiens
uguguagauuuga

SEQ ID NO: 1747468 - RNA, 13 nt, Homo sapiens
gugaguucucagg

SEQ ID NO: 1747469 - RNA, 13 nt, Homo sapiens
uuauacagugaua

SEQ ID NO: 1747470 - RNA, 13 nt, Homo sapiens
uguaaugcaugcc

SEQ ID NO: 1747471 - RNA, 23 nt, Homo sapiens
acuugcauuuauuuaagacacug

SEQ ID NO: 1747472 - RNA, 23 nt, Homo sapiens
ccugcaaagggaaucucuugccu

SEQ ID NO: 1747473 - RNA, 17 nt, Homo sapiens
accuuucuagccuuaga

SEQ ID NO: 1747474 - RNA, 20 nt, Homo sapiens
aggugaagucgagcacucua

SEQ ID NO: 1747475 - RNA, 20 nt, Homo sapiens
acgagucaccugcaagcccc

SEQ ID NO: 1747476 - RNA, 19 nt, Homo sapiens
uguuggacucugagcucau

SEQ ID NO: 1747477 - RNA, 23 nt, Homo sapiens
caggaauuucccaggacccugaa

SEQ ID NO: 1747478 - RNA, 21 nt, Homo sapiens
aggccuguccucuacauacca

SEQ ID NO: 1747479 - RNA, 17 nt, Homo sapiens
uccaguaguuagcuuuc

SEQ ID NO: 1747480 - RNA, 18 nt, Homo sapiens
gaagccauauaugaccag

SEQ ID NO: 1747481 - RNA, 20 nt, Homo sapiens
uaucccaaucaaagaauuac

SEQ ID NO: 1747482 - RNA, 15 nt, Homo sapiens
acaaagcacuagaga

SEQ ID NO: 1747483 - RNA, 15 nt, Homo sapiens
aaacuuaacauucau

SEQ ID NO: 1747484 - RNA, 15 nt, Homo sapiens
cugguauauaaucca

SEQ ID NO: 1747485 - RNA, 11 nt, Homo sapiens
gugaacuuugu

SEQ ID NO: 1747486 - RNA, 19 nt, Homo sapiens
gaauggauucaacacugug

SEQ ID NO: 1747487 - RNA, 23 nt, Homo sapiens
gauucuaaaaugugauguucuaa

SEQ ID NO: 1747488 - RNA, 15 nt, Homo sapiens
ucacugcugaucgua

SEQ ID NO: 1747489 - RNA, 18 nt, Homo sapiens
gcugcccagacacauggg

SEQ ID NO: 1747490 - RNA, 16 nt, Homo sapiens
ggucuccauccuccau

SEQ ID NO: 1747491 - RNA, 14 nt, Homo sapiens
uccuguuuugcaaa

SEQ ID NO: 1747492 - RNA, 14 nt, Homo sapiens
ggccuuguggcacu

SEQ ID NO: 1747493 - RNA, 14 nt, Homo sapiens
ggcacuguggccuu

SEQ ID NO: 1747494 - RNA, 14 nt, Homo sapiens
aagggcagcuguga

SEQ ID NO: 1747495 - RNA, 16 nt, Homo sapiens
aaggauucuauaucau

SEQ ID NO: 1747496 - RNA, 15 nt, Homo sapiens
ccaaaaaacuacuuc

SEQ ID NO: 1747497 - RNA, 20 nt, Homo sapiens
agguguuauaucuaugcaaa

SEQ ID NO: 1747498 - RNA, 16 nt, Homo sapiens
uauuguguguucucac

SEQ ID NO: 1747499 - RNA, 21 nt, Homo sapiens
aacacagucuacucuuucugc

SEQ ID NO: 1747500 - RNA, 17 nt, Homo sapiens
aaugugcagugucuugu

SEQ ID NO: 1747501 - RNA, 21 nt, Homo sapiens
gacuccuucgguagcugcaac

SEQ ID NO: 1747502 - RNA, 22 nt, Homo sapiens
caauucaagaaacuaguaagaa

SEQ ID NO: 1747503 - RNA, 11 nt, Homo sapiens
uuaaaauaucu

SEQ ID NO: 1747504 - RNA, 13 nt, Homo sapiens
cgugcuaccugca

SEQ ID NO: 1747505 - RNA, 18 nt, Homo sapiens
cccucacucucuacaggu

SEQ ID NO: 1747506 - RNA, 20 nt, Homo sapiens
ggaggaguuccaccaugagc

SEQ ID NO: 1747507 - RNA, 20 nt, Homo sapiens
ucccaaaaucauaagauauu

SEQ ID NO: 1747508 - RNA, 17 nt, Homo sapiens
ccagagguugugcacug

SEQ ID NO: 1747509 - RNA, 17 nt, Homo sapiens
aucuuccaaauccaaaa

SEQ ID NO: 1747510 - RNA, 12 nt, Homo sapiens
uccccauugcuu

SEQ ID NO: 1747511 - RNA, 18 nt, Homo sapiens
cauccacuucaccaucca

SEQ ID NO: 1747512 - RNA, 21 nt, Homo sapiens
ugcccucauaaaccaaugugg

SEQ ID NO: 1747513 - RNA, 23 nt, Homo sapiens
ugggggaaaaguuagucaauccu

SEQ ID NO: 1747514 - RNA, 15 nt, Homo sapiens
uagguaggcuucuac

SEQ ID NO: 1747515 - RNA, 15 nt, Homo sapiens
uccaccucuaccaaa

SEQ ID NO: 1747516 - RNA, 18 nt, Homo sapiens
uguuaugauauuguuuaa

SEQ ID NO: 1747517 - RNA, 18 nt, Homo sapiens
uacugagacaaaaaggaa

SEQ ID NO: 1747518 - RNA, 18 nt, Homo sapiens
cucuuuguccauuauuca

SEQ ID NO: 1747519 - RNA, 21 nt, Homo sapiens
acugacagaugaccgcaauaa

SEQ ID NO: 1747520 - RNA, 17 nt, Homo sapiens
gaucaggcugcuggaaa

SEQ ID NO: 1747521 - RNA, 17 nt, Homo sapiens
caaggaugcacauauac

SEQ ID NO: 1747522 - RNA, 22 nt, Homo sapiens
aaaaaugugcaaaacagcguuu

SEQ ID NO: 1747523 - RNA, 12 nt, Homo sapiens
caggccaggugc

SEQ ID NO: 1747524 - RNA, 15 nt, Homo sapiens
augaagauaccauca

SEQ ID NO: 1747525 - RNA, 21 nt, Homo sapiens
ugaaaaaaugccaagacauga

SEQ ID NO: 1747526 - RNA, 14 nt, Homo sapiens
guuguaaugcugca

SEQ ID NO: 1747527 - RNA, 14 nt, Homo sapiens
guaucuaugcauuu

SEQ ID NO: 1747528 - RNA, 22 nt, Homo sapiens
auccaaauggacuggccagcgu

SEQ ID NO: 1747529 - RNA, 18 nt, Homo sapiens
cuggcuucaaaaagccac

SEQ ID NO: 1747530 - RNA, 15 nt, Homo sapiens
uagucaccuucauga

SEQ ID NO: 1747531 - RNA, 15 nt, Homo sapiens
auuacuggaucucuu

SEQ ID NO: 1747532 - RNA, 19 nt, Homo sapiens
ugacccccugcugccaucu

SEQ ID NO: 1747533 - RNA, 17 nt, Homo sapiens
uaaaauucucauuacuc

SEQ ID NO: 1747534 - RNA, 11 nt, Homo sapiens
ggccuaugaaa

SEQ ID NO: 1747535 - RNA, 11 nt, Homo sapiens
ugaacauggaa

SEQ ID NO: 1747536 - RNA, 21 nt, Homo sapiens
gccuugguaaaaacugcagug

SEQ ID NO: 1747537 - RNA, 11 nt, Homo sapiens
ggaaaccacag

SEQ ID NO: 1747538 - RNA, 17 nt, Homo sapiens
ucauggauauccacuga

SEQ ID NO: 1747539 - RNA, 13 nt, Homo sapiens
acauuuccuuaca

SEQ ID NO: 1747540 - RNA, 13 nt, Homo sapiens
uaacuuguguuac

SEQ ID NO: 1747541 - RNA, 19 nt, Homo sapiens
gacucaggagcugcuaaac

SEQ ID NO: 1747542 - RNA, 20 nt, Homo sapiens
cuuucuaaugcugauaugau

SEQ ID NO: 1747543 - RNA, 13 nt, Homo sapiens
uggcacucaugga

SEQ ID NO: 1747544 - RNA, 20 nt, Homo sapiens
gccuggccaacauggugaaa

SEQ ID NO: 1747545 - RNA, 13 nt, Homo sapiens
ggguguguguagc

SEQ ID NO: 1747546 - RNA, 18 nt, Homo sapiens
ucuaaaugugacaugcaa

SEQ ID NO: 1747547 - RNA, 19 nt, Homo sapiens
ugucuuaaccuauucccaa

SEQ ID NO: 1747548 - RNA, 18 nt, Homo sapiens
agccgugaauucaguugg

SEQ ID NO: 1747549 - RNA, 22 nt, Homo sapiens
gauuuaugaugcacuuauucaa

SEQ ID NO: 1747550 - RNA, 16 nt, Homo sapiens
gucuuguacacuuaag

SEQ ID NO: 1747551 - RNA, 15 nt, Homo sapiens
uucucagaaccauuu

SEQ ID NO: 1747552 - RNA, 17 nt, Homo sapiens
uuauuugucaagcaaau

SEQ ID NO: 1747553 - RNA, 21 nt, Homo sapiens
agucauacaagucauggucac

SEQ ID NO: 1747554 - RNA, 15 nt, Homo sapiens
caugauuuauauaug

SEQ ID NO: 1747555 - RNA, 11 nt, Homo sapiens
aacagcauuua

SEQ ID NO: 1747556 - RNA, 18 nt, Homo sapiens
aggaggcccccuccucac

SEQ ID NO: 1747557 - RNA, 18 nt, Homo sapiens
auuuccccuuaucuuucu

SEQ ID NO: 1747558 - RNA, 15 nt, Homo sapiens
uugcaauaaugcagu

SEQ ID NO: 1747559 - RNA, 18 nt, Homo sapiens
aggugcauagcaagugaa

SEQ ID NO: 1747560 - RNA, 16 nt, Homo sapiens
uauuuaaaaguauaaa

SEQ ID NO: 1747561 - RNA, 16 nt, Homo sapiens
uaaagaaaagaugaaa

SEQ ID NO: 1747562 - RNA, 14 nt, Homo sapiens
ucccuccuuuacca

SEQ ID NO: 1747563 - RNA, 19 nt, Homo sapiens
ugagcaacucuugauuauc

SEQ ID NO: 1747564 - RNA, 14 nt, Homo sapiens
gaauagacauaaau

SEQ ID NO: 1747565 - RNA, 15 nt, Homo sapiens
auucuuguccuggcu

SEQ ID NO: 1747566 - RNA, 22 nt, Homo sapiens
acaaccaacggccgacugccug

SEQ ID NO: 1747567 - RNA, 13 nt, Homo sapiens
ucaguucuagucu

SEQ ID NO: 1747568 - RNA, 19 nt, Homo sapiens
agugaacauucgaccucca

SEQ ID NO: 1747569 - RNA, 14 nt, Homo sapiens
ccuccaacaccaag

SEQ ID NO: 1747570 - RNA, 22 nt, Homo sapiens
gauacuauuaaaguaacauuua

SEQ ID NO: 1747571 - RNA, 12 nt, Homo sapiens
gugggggguccc

SEQ ID NO: 1747572 - RNA, 18 nt, Homo sapiens
cacucuuucuccugcuuu

SEQ ID NO: 1747573 - RNA, 21 nt, Homo sapiens
cccaaggaugccuuagcaugu

SEQ ID NO: 1747574 - RNA, 21 nt, Homo sapiens
acccggccccuaccagccacg

SEQ ID NO: 1747575 - RNA, 19 nt, Homo sapiens
uuaaacucuacuucaagaa

SEQ ID NO: 1747576 - RNA, 19 nt, Homo sapiens
aagaaugugcuaugaagcu

SEQ ID NO: 1747577 - RNA, 21 nt, Homo sapiens
ggaacacuacucuuacaugua

SEQ ID NO: 1747578 - RNA, 19 nt, Homo sapiens
auuucaugugaaucccuuu

SEQ ID NO: 1747579 - RNA, 14 nt, Homo sapiens
cuccagcuccugcc

SEQ ID NO: 1747580 - RNA, 15 nt, Homo sapiens
ccuuuuacuaccauu

SEQ ID NO: 1747581 - RNA, 15 nt, Homo sapiens
uguaagaaaauguua

SEQ ID NO: 1747582 - RNA, 17 nt, Homo sapiens
cauaguggcacuugccu

SEQ ID NO: 1747583 - RNA, 16 nt, Homo sapiens
ccucgcccuccacaaa

SEQ ID NO: 1747584 - RNA, 19 nt, Homo sapiens
aauguaccauguugcccag

SEQ ID NO: 1747585 - RNA, 11 nt, Homo sapiens
ucacacuuugc

SEQ ID NO: 1747586 - RNA, 19 nt, Homo sapiens
cuacgguuccauguucacc

SEQ ID NO: 1747587 - RNA, 11 nt, Homo sapiens
uaaacauguga

SEQ ID NO: 1747588 - RNA, 22 nt, Homo sapiens
guggagcacaaaagccucucau

SEQ ID NO: 1747589 - RNA, 15 nt, Homo sapiens
ggauccuagccuuau

SEQ ID NO: 1747590 - RNA, 21 nt, Homo sapiens
gacauaggacucaaaguuuca

SEQ ID NO: 1747591 - RNA, 12 nt, Homo sapiens
cacuguaaaaug

SEQ ID NO: 1747592 - RNA, 20 nt, Homo sapiens
auaaacugcuauuacuuuua

SEQ ID NO: 1747593 - RNA, 23 nt, Homo sapiens
gaaucccagcccccugaccacuc

SEQ ID NO: 1747594 - RNA, 15 nt, Homo sapiens
uaucaccuuccaaac

SEQ ID NO: 1747595 - RNA, 21 nt, Homo sapiens
guuaccauaagucugauucuc

SEQ ID NO: 1747596 - RNA, 11 nt, Homo sapiens
cauuugcugca

SEQ ID NO: 1747597 - RNA, 18 nt, Homo sapiens
ugacccccaucugagcug

SEQ ID NO: 1747598 - RNA, 19 nt, Homo sapiens
aacagagugaaaugccauu

SEQ ID NO: 1747599 - RNA, 15 nt, Homo sapiens
agcaagacugagggg

SEQ ID NO: 1747600 - RNA, 17 nt, Homo sapiens
gucccagcggcaccaac

SEQ ID NO: 1747601 - RNA, 12 nt, Homo sapiens
gcccuccagggc

SEQ ID NO: 1747602 - RNA, 17 nt, Homo sapiens
ugcaccacaccuggcau

SEQ ID NO: 1747603 - RNA, 13 nt, Homo sapiens
gacuggcugugag

SEQ ID NO: 1747604 - RNA, 13 nt, Homo sapiens
auguuaguggcau

SEQ ID NO: 1747605 - RNA, 21 nt, Homo sapiens
auuuauuuuuauguucuuggc

SEQ ID NO: 1747606 - RNA, 17 nt, Homo sapiens
cccaggaauuugggacc

SEQ ID NO: 1747607 - RNA, 17 nt, Homo sapiens
aaauauuuuaaaaucag

SEQ ID NO: 1747608 - RNA, 17 nt, Homo sapiens
aggcgcaugugccaguu

SEQ ID NO: 1747609 - RNA, 21 nt, Homo sapiens
ugccccuggaugcacuuucau

SEQ ID NO: 1747610 - RNA, 22 nt, Homo sapiens
ugucuggcaggcuacucugccc

SEQ ID NO: 1747611 - RNA, 20 nt, Homo sapiens
ugagaaucuaggccacccca

SEQ ID NO: 1747612 - RNA, 13 nt, Homo sapiens
auuuucucuccau

SEQ ID NO: 1747613 - RNA, 23 nt, Homo sapiens
ccagguagcugggauuacaggca

SEQ ID NO: 1747614 - RNA, 19 nt, Homo sapiens
aaaacuacugauacuuuca

SEQ ID NO: 1747615 - RNA, 14 nt, Homo sapiens
cuuccagguacuga

SEQ ID NO: 1747616 - RNA, 19 nt, Homo sapiens
aggugaaaauccaucucau

SEQ ID NO: 1747617 - RNA, 23 nt, Homo sapiens
ccugcugggacugagaaggcuca

SEQ ID NO: 1747618 - RNA, 19 nt, Homo sapiens
caucucugguuuucuugcc

SEQ ID NO: 1747619 - RNA, 14 nt, Homo sapiens
cuugcaucacuuaa

SEQ ID NO: 1747620 - RNA, 17 nt, Homo sapiens
aauaaaaggucggacca

SEQ ID NO: 1747621 - RNA, 19 nt, Homo sapiens
aagauugaagccuuugcca

SEQ ID NO: 1747622 - RNA, 20 nt, Homo sapiens
cagcacagaacacacugaga

SEQ ID NO: 1747623 - RNA, 13 nt, Homo sapiens
gaaacuaacuugg

SEQ ID NO: 1747624 - RNA, 16 nt, Homo sapiens
ugcagucagugcuaau

SEQ ID NO: 1747625 - RNA, 20 nt, Homo sapiens
aacaacaaagccaacaguca

SEQ ID NO: 1747626 - RNA, 17 nt, Homo sapiens
cccucuggcuccagcug

SEQ ID NO: 1747627 - RNA, 20 nt, Homo sapiens
uaagguggguggaucaccug

SEQ ID NO: 1747628 - RNA, 18 nt, Homo sapiens
ggagaaguugagauucaa

SEQ ID NO: 1747629 - RNA, 16 nt, Homo sapiens
guaaaacaaugccaug

SEQ ID NO: 1747630 - RNA, 22 nt, Homo sapiens
ugaaaaugugaauugcaugacu

SEQ ID NO: 1747631 - RNA, 17 nt, Homo sapiens
cuuaauuaggaugcaug

SEQ ID NO: 1747632 - RNA, 16 nt, Homo sapiens
cagugcuguaaacuua

SEQ ID NO: 1747633 - RNA, 22 nt, Homo sapiens
agccuaggaaagccaguuacau

SEQ ID NO: 1747634 - RNA, 17 nt, Homo sapiens
uuguaaaucacauccuu

SEQ ID NO: 1747635 - RNA, 19 nt, Homo sapiens
gaaacucccuuguguuccu

SEQ ID NO: 1747636 - RNA, 14 nt, Homo sapiens
agccagccugggac

SEQ ID NO: 1747637 - RNA, 13 nt, Homo sapiens
cuaccucuuccag

SEQ ID NO: 1747638 - RNA, 19 nt, Homo sapiens
ccaaggagggugagugcaa

SEQ ID NO: 1747639 - RNA, 14 nt, Homo sapiens
cacccaugugcaca

SEQ ID NO: 1747640 - RNA, 19 nt, Homo sapiens
guuugaaaguuguacauga

SEQ ID NO: 1747641 - RNA, 14 nt, Homo sapiens
agaaggaauaagca

SEQ ID NO: 1747642 - RNA, 21 nt, Homo sapiens
aaaaauguaugccacaucuca

SEQ ID NO: 1747643 - RNA, 18 nt, Homo sapiens
ugaaugaguaaacugaga

SEQ ID NO: 1747644 - RNA, 24 nt, Homo sapiens
cuagcaaauaguaaucuguaagca

SEQ ID NO: 1747645 - RNA, 18 nt, Homo sapiens
cucaugccuguaauccca

SEQ ID NO: 1747646 - RNA, 21 nt, Homo sapiens
gcccugagguuugaaucugac

SEQ ID NO: 1747647 - RNA, 18 nt, Homo sapiens
aaauuuuugucauuuuaa

SEQ ID NO: 1747648 - RNA, 13 nt, Homo sapiens
uuguaauugcuua

SEQ ID NO: 1747649 - RNA, 14 nt, Homo sapiens
ucaucccuuucucc

SEQ ID NO: 1747650 - RNA, 16 nt, Homo sapiens
ggugaccucacuuuag

SEQ ID NO: 1747651 - RNA, 16 nt, Homo sapiens
aguauuaauagguuaa

SEQ ID NO: 1747652 - RNA, 21 nt, Homo sapiens
cauuuuuuuucagcagacuau

SEQ ID NO: 1747653 - RNA, 14 nt, Homo sapiens
ucuagaacagccag

SEQ ID NO: 1747654 - RNA, 22 nt, Homo sapiens
agauuuuccugagaugacugag

SEQ ID NO: 1747655 - RNA, 22 nt, Homo sapiens
gggcucccuuuaagccaagaga

SEQ ID NO: 1747656 - RNA, 14 nt, Homo sapiens
aaaugggcacuuaa

SEQ ID NO: 1747657 - RNA, 18 nt, Homo sapiens
agacucaagacuuaugga

SEQ ID NO: 1747658 - RNA, 21 nt, Homo sapiens
gccucuggucccagcauccag

SEQ ID NO: 1747659 - RNA, 22 nt, Homo sapiens
acacacagaaggggacugccac

SEQ ID NO: 1747660 - RNA, 21 nt, Homo sapiens
gaguauauuuccgcacuucag

SEQ ID NO: 1747661 - RNA, 19 nt, Homo sapiens
uauuaauguuuacagugga

SEQ ID NO: 1747662 - RNA, 20 nt, Homo sapiens
uucaacaacaccagaacugu

SEQ ID NO: 1747663 - RNA, 14 nt, Homo sapiens
agggcugaguuaug

SEQ ID NO: 1747664 - RNA, 14 nt, Homo sapiens
agaaaguguauuug

SEQ ID NO: 1747665 - RNA, 16 nt, Homo sapiens
gucagaggaccccagg

SEQ ID NO: 1747666 - RNA, 14 nt, Homo sapiens
aaaauaccaugcca

SEQ ID NO: 1747667 - RNA, 20 nt, Homo sapiens
cugagagcauguuuuaucau

SEQ ID NO: 1747668 - RNA, 19 nt, Homo sapiens
cuauucaaaauaaacaaua

SEQ ID NO: 1747669 - RNA, 17 nt, Homo sapiens
aacaggcuguaauucca

SEQ ID NO: 1747670 - RNA, 22 nt, Homo sapiens
uggagacacccucugggggucc

SEQ ID NO: 1747671 - RNA, 22 nt, Homo sapiens
ucaugaaacuuguuucacugaa

SEQ ID NO: 1747672 - RNA, 23 nt, Homo sapiens
aaucucuugccugcuccaucuca

SEQ ID NO: 1747673 - RNA, 19 nt, Homo sapiens
ucagaagauuagcaugaaa

SEQ ID NO: 1747674 - RNA, 11 nt, Homo sapiens
gauggagacac

SEQ ID NO: 1747675 - RNA, 17 nt, Homo sapiens
uucacugugagugaaaa

SEQ ID NO: 1747676 - RNA, 19 nt, Homo sapiens
cagugcuauucugagugaa

SEQ ID NO: 1747677 - RNA, 16 nt, Homo sapiens
auaaguaaagaauuac

SEQ ID NO: 1747678 - RNA, 16 nt, Homo sapiens
agggugacauggggaa

SEQ ID NO: 1747679 - RNA, 15 nt, Homo sapiens
uuuuaggaacuuuau

SEQ ID NO: 1747680 - RNA, 22 nt, Homo sapiens
cuucaagugccuuuugcugcgc

SEQ ID NO: 1747681 - RNA, 18 nt, Homo sapiens
cauucucugccuguacug

SEQ ID NO: 1747682 - RNA, 12 nt, Homo sapiens
caaccuacuguc

SEQ ID NO: 1747683 - RNA, 12 nt, Homo sapiens
agcauguucuca

SEQ ID NO: 1747684 - RNA, 14 nt, Homo sapiens
cuggaccaagcaca

SEQ ID NO: 1747685 - RNA, 16 nt, Homo sapiens
caaaugccacacauca

SEQ ID NO: 1747686 - RNA, 18 nt, Homo sapiens
ugcuagaggaagucccag

SEQ ID NO: 1747687 - RNA, 17 nt, Homo sapiens
ucacagguuaauguggu

SEQ ID NO: 1747688 - RNA, 23 nt, Homo sapiens
cacugcuugaggaaaacaagcau

SEQ ID NO: 1747689 - RNA, 22 nt, Homo sapiens
ugugcaggguguguacugcaca

SEQ ID NO: 1747690 - RNA, 15 nt, Homo sapiens
ggagaagagugucag

SEQ ID NO: 1747691 - RNA, 13 nt, Homo sapiens
caaaucugaggga

SEQ ID NO: 1747692 - RNA, 13 nt, Homo sapiens
aauaaaggaagca

SEQ ID NO: 1747693 - RNA, 18 nt, Homo sapiens
gagcuuuacagugccacg

SEQ ID NO: 1747694 - RNA, 19 nt, Homo sapiens
caucugggaacuugucaca

SEQ ID NO: 1747695 - RNA, 12 nt, Homo sapiens
gaagccaaagaa

SEQ ID NO: 1747696 - RNA, 17 nt, Homo sapiens
uuagguugcacauucac

SEQ ID NO: 1747697 - RNA, 15 nt, Homo sapiens
ccacuucaccaucca

SEQ ID NO: 1747698 - RNA, 15 nt, Homo sapiens
aacaaaaaccaaaaa

SEQ ID NO: 1747699 - RNA, 21 nt, Homo sapiens
agcuuaaggcggccuacagaa

SEQ ID NO: 1747700 - RNA, 20 nt, Homo sapiens
ucacuacagggagaaaaucc

SEQ ID NO: 1747701 - RNA, 18 nt, Homo sapiens
ccagcuuuucuugccagc

SEQ ID NO: 1747702 - RNA, 18 nt, Homo sapiens
ugcaaaccgugaggucac

SEQ ID NO: 1747703 - RNA, 13 nt, Homo sapiens
gcaaaaccaaaua

SEQ ID NO: 1747704 - RNA, 18 nt, Homo sapiens
aggaccugcgcaaagggc

SEQ ID NO: 1747705 - RNA, 16 nt, Homo sapiens
gcaaagauuuuuggca

SEQ ID NO: 1747706 - RNA, 18 nt, Homo sapiens
agggaaauaugcuuucau

SEQ ID NO: 1747707 - RNA, 14 nt, Homo sapiens
aaaggaagaguuau

SEQ ID NO: 1747708 - RNA, 13 nt, Homo sapiens
uguacuaaucuga

SEQ ID NO: 1747709 - RNA, 22 nt, Homo sapiens
acuaugguguguuguaucuuug

SEQ ID NO: 1747710 - RNA, 21 nt, Homo sapiens
cuagcauguaaggccuuucaa

SEQ ID NO: 1747711 - RNA, 15 nt, Homo sapiens
ugucaugcugucagu

SEQ ID NO: 1747712 - RNA, 16 nt, Homo sapiens
uauuucagccaaucug

SEQ ID NO: 1747713 - RNA, 15 nt, Homo sapiens
uguuacuguucuugc

SEQ ID NO: 1747714 - RNA, 15 nt, Homo sapiens
uugagcaacucccuc

SEQ ID NO: 1747715 - RNA, 13 nt, Homo sapiens
uuggugcuagaaa

SEQ ID NO: 1747716 - RNA, 23 nt, Homo sapiens
aaauauugaacucaaugauagca

SEQ ID NO: 1747717 - RNA, 21 nt, Homo sapiens
ggaaccacaccaaugcaacau

SEQ ID NO: 1747718 - RNA, 20 nt, Homo sapiens
guggagaacugggauuugaa

SEQ ID NO: 1747719 - RNA, 17 nt, Homo sapiens
auuuccuaauaugaucu

SEQ ID NO: 1747720 - RNA, 20 nt, Homo sapiens
auuuaacaaaaagugcuuca

SEQ ID NO: 1747721 - RNA, 15 nt, Homo sapiens
cuccagagaugguca

SEQ ID NO: 1747722 - RNA, 20 nt, Homo sapiens
uuuucuguagcaccagagaa

SEQ ID NO: 1747723 - RNA, 19 nt, Homo sapiens
gaacauggggaguguuuca

SEQ ID NO: 1747724 - RNA, 18 nt, Homo sapiens
aauauuuuuccacuuaaa

SEQ ID NO: 1747725 - RNA, 22 nt, Homo sapiens
ugcaaucugguugugauuuaua

SEQ ID NO: 1747726 - RNA, 19 nt, Homo sapiens
ccuuggaggaaaugugcuc

SEQ ID NO: 1747727 - RNA, 22 nt, Homo sapiens
aagagagcaacauuuuacccac

SEQ ID NO: 1747728 - RNA, 21 nt, Homo sapiens
ugaaaauguguuguugcugug

SEQ ID NO: 1747729 - RNA, 22 nt, Homo sapiens
cuaauuuuucagcuccuucaau

SEQ ID NO: 1747730 - RNA, 13 nt, Homo sapiens
cagcagaugccaa

SEQ ID NO: 1747731 - RNA, 18 nt, Homo sapiens
aagacauggaauuaccuu

SEQ ID NO: 1747732 - RNA, 20 nt, Homo sapiens
ggcaagggcaacccaccauc

SEQ ID NO: 1747733 - RNA, 22 nt, Homo sapiens
aggaauauugcugcugguucuc

SEQ ID NO: 1747734 - RNA, 22 nt, Homo sapiens
aaggauuauuugcucaggggaa

SEQ ID NO: 1747735 - RNA, 19 nt, Homo sapiens
guuugcacuuggcaaaaag

SEQ ID NO: 1747736 - RNA, 16 nt, Homo sapiens
aauauuauuacuuuau

SEQ ID NO: 1747737 - RNA, 18 nt, Homo sapiens
gugacauugcuggucauc

SEQ ID NO: 1747738 - RNA, 13 nt, Homo sapiens
aacacaugccaaa

SEQ ID NO: 1747739 - RNA, 18 nt, Homo sapiens
gccugcccguaaacacgc

SEQ ID NO: 1747740 - RNA, 12 nt, Homo sapiens
ucagucaaugaa

SEQ ID NO: 1747741 - RNA, 13 nt, Homo sapiens
ccuccagaacuca

SEQ ID NO: 1747742 - RNA, 14 nt, Homo sapiens
ugcaguugugauuu

SEQ ID NO: 1747743 - RNA, 22 nt, Homo sapiens
augaagguaacuagaaagugag

SEQ ID NO: 1747744 - RNA, 19 nt, Homo sapiens
ccuggauuccucacuuuga

SEQ ID NO: 1747745 - RNA, 16 nt, Homo sapiens
ucagaguugacuuucc

SEQ ID NO: 1747746 - RNA, 21 nt, Homo sapiens
uaagacuaaugcucaaccuaa

SEQ ID NO: 1747747 - RNA, 23 nt, Homo sapiens
agcaccagcgguccaacgccgcc

SEQ ID NO: 1747748 - RNA, 12 nt, Homo sapiens
cugucucugagg

SEQ ID NO: 1747749 - RNA, 23 nt, Homo sapiens
cuucagacaggagccacagggag

SEQ ID NO: 1747750 - RNA, 21 nt, Homo sapiens
uugcuuguguacaaacccaga

SEQ ID NO: 1747751 - RNA, 17 nt, Homo sapiens
agcagcacagcugccaa

SEQ ID NO: 1747752 - RNA, 21 nt, Homo sapiens
uauuugaaaauuuuacuucca

SEQ ID NO: 1747753 - RNA, 18 nt, Homo sapiens
cugucugcagugugcacg

SEQ ID NO: 1747754 - RNA, 21 nt, Homo sapiens
agacaaaauuguaagccagag

SEQ ID NO: 1747755 - RNA, 16 nt, Homo sapiens
agcgagacuccaucuc

SEQ ID NO: 1747756 - RNA, 14 nt, Homo sapiens
aagcccaguucauc

SEQ ID NO: 1747757 - RNA, 19 nt, Homo sapiens
acgaggccacagcugccau

SEQ ID NO: 1747758 - RNA, 18 nt, Homo sapiens
uucauauuuauugauuaa

SEQ ID NO: 1747759 - RNA, 22 nt, Homo sapiens
aaguagcuguaugagcaguuca

SEQ ID NO: 1747760 - RNA, 16 nt, Homo sapiens
ucaccuagcaacauau

SEQ ID NO: 1747761 - RNA, 20 nt, Homo sapiens
aggggaagcugccaccccuc

SEQ ID NO: 1747762 - RNA, 19 nt, Homo sapiens
auuuauuccuuuguuacuu

SEQ ID NO: 1747763 - RNA, 18 nt, Homo sapiens
agcguaacaaacaaaauc

SEQ ID NO: 1747764 - RNA, 17 nt, Homo sapiens
uuuuccaucauuuuaca

SEQ ID NO: 1747765 - RNA, 21 nt, Homo sapiens
aaaaauucaucauaugaaugu

SEQ ID NO: 1747766 - RNA, 22 nt, Homo sapiens
ggagucgugaacgggacucagg

SEQ ID NO: 1747767 - RNA, 12 nt, Homo sapiens
ucaucauggcaa

SEQ ID NO: 1747768 - RNA, 21 nt, Homo sapiens
guucagucacaugugcucucg

SEQ ID NO: 1747769 - RNA, 13 nt, Homo sapiens
cugaguucuuaga

SEQ ID NO: 1747770 - RNA, 21 nt, Homo sapiens
aaugagaauuuaagccucaaa

SEQ ID NO: 1747771 - RNA, 13 nt, Homo sapiens
cucuucuaacaca

SEQ ID NO: 1747772 - RNA, 17 nt, Homo sapiens
guauaaugugcuuuauu

SEQ ID NO: 1747773 - RNA, 20 nt, Homo sapiens
cuucaguguuuuucauuucu

SEQ ID NO: 1747774 - RNA, 20 nt, Homo sapiens
gguaaccgaacuggugcuuu

SEQ ID NO: 1747775 - RNA, 16 nt, Homo sapiens
uugcucuggacagaga

SEQ ID NO: 1747776 - RNA, 14 nt, Homo sapiens
cugggaacucccaa

SEQ ID NO: 1747777 - RNA, 15 nt, Homo sapiens
uuaaaaguugcaaag

SEQ ID NO: 1747778 - RNA, 19 nt, Homo sapiens
cccacuguuucucuugagc

SEQ ID NO: 1747779 - RNA, 22 nt, Homo sapiens
ugugagagagacugaugggguc

SEQ ID NO: 1747780 - RNA, 21 nt, Homo sapiens
gagaugggacaagcagucccu

SEQ ID NO: 1747781 - RNA, 17 nt, Homo sapiens
gcucgcccacaaacuga

SEQ ID NO: 1747782 - RNA, 15 nt, Homo sapiens
ccauuacuacuguac

SEQ ID NO: 1747783 - RNA, 21 nt, Homo sapiens
uggauaauagcguucagcagc

SEQ ID NO: 1747784 - RNA, 13 nt, Homo sapiens
acggcacucccau

SEQ ID NO: 1747785 - RNA, 19 nt, Homo sapiens
ugugacucaagccuuucac

SEQ ID NO: 1747786 - RNA, 17 nt, Homo sapiens
auuugggaaggcuuuaa

SEQ ID NO: 1747787 - RNA, 18 nt, Homo sapiens
uuugcgcagcccuaccuu

SEQ ID NO: 1747788 - RNA, 16 nt, Homo sapiens
aauugcaaaacccaac

SEQ ID NO: 1747789 - RNA, 17 nt, Homo sapiens
caagaacauucuaccaa

SEQ ID NO: 1747790 - RNA, 18 nt, Homo sapiens
agaugccauuacauuuau

SEQ ID NO: 1747791 - RNA, 22 nt, Homo sapiens
auaauauuguaacuugcaugua

SEQ ID NO: 1747792 - RNA, 20 nt, Homo sapiens
gagcucaagugaucuuccca

SEQ ID NO: 1747793 - RNA, 20 nt, Homo sapiens
ucagagcuaacauaaaggac

SEQ ID NO: 1747794 - RNA, 18 nt, Homo sapiens
ucaaguggagagaaauca

SEQ ID NO: 1747795 - RNA, 18 nt, Homo sapiens
acauucagugauaaagcu

SEQ ID NO: 1747796 - RNA, 20 nt, Homo sapiens
cauggccccaguccaugcuu

SEQ ID NO: 1747797 - RNA, 21 nt, Homo sapiens
acuuuuuaaaauaauaacaau

SEQ ID NO: 1747798 - RNA, 15 nt, Homo sapiens
uaagcuaaagccuga

SEQ ID NO: 1747799 - RNA, 19 nt, Homo sapiens
cuuaaccagaucauuguga

SEQ ID NO: 1747800 - RNA, 18 nt, Homo sapiens
cagcacaaacacaccucu

SEQ ID NO: 1747801 - RNA, 19 nt, Homo sapiens
uaguuuaggagaaaccagc

SEQ ID NO: 1747802 - RNA, 13 nt, Homo sapiens
agagucaaaguag

SEQ ID NO: 1747803 - RNA, 19 nt, Homo sapiens
uuugcuuguuuauuucuga

SEQ ID NO: 1747804 - RNA, 22 nt, Homo sapiens
augaggcacuuaucagcaugaa

SEQ ID NO: 1747805 - RNA, 22 nt, Homo sapiens
ucaguaggaacuguacaugugu

SEQ ID NO: 1747806 - RNA, 23 nt, Homo sapiens
caaugaagaauauaccauuucaa

SEQ ID NO: 1747807 - RNA, 14 nt, Homo sapiens
caguggacaccagg

SEQ ID NO: 1747808 - RNA, 13 nt, Homo sapiens
aucuuuuacuuuu

SEQ ID NO: 1747809 - RNA, 16 nt, Homo sapiens
uucauggucugcugag

SEQ ID NO: 1747810 - RNA, 16 nt, Homo sapiens
gugaagcaaaacacaa

SEQ ID NO: 1747811 - RNA, 19 nt, Homo sapiens
cuaacguuuucuacuuuga

SEQ ID NO: 1747812 - RNA, 22 nt, Homo sapiens
agcugacuuggcugguguggua

SEQ ID NO: 1747813 - RNA, 13 nt, Homo sapiens
caguugaauuuau

SEQ ID NO: 1747814 - RNA, 18 nt, Homo sapiens
cacuuauagccucugucu

SEQ ID NO: 1747815 - RNA, 13 nt, Homo sapiens
ccucgagauccca

SEQ ID NO: 1747816 - RNA, 17 nt, Homo sapiens
uaaagaacauucuaaaa

SEQ ID NO: 1747817 - RNA, 21 nt, Homo sapiens
ucuguucuguugaucccacuu

SEQ ID NO: 1747818 - RNA, 17 nt, Homo sapiens
ccuuuuuuauacaggaa

SEQ ID NO: 1747819 - RNA, 21 nt, Homo sapiens
aaaguagccagcuggucuuca

SEQ ID NO: 1747820 - RNA, 18 nt, Homo sapiens
aguguuuuugcaggugag

SEQ ID NO: 1747821 - RNA, 14 nt, Homo sapiens
uguaaaguagcugu

SEQ ID NO: 1747822 - RNA, 17 nt, Homo sapiens
guagacucauucuucac

SEQ ID NO: 1747823 - RNA, 20 nt, Homo sapiens
cccuggggggacuucccaaa

SEQ ID NO: 1747824 - RNA, 16 nt, Homo sapiens
gggcucagaguggggu

SEQ ID NO: 1747825 - RNA, 21 nt, Homo sapiens
ucaacuagaaacaguacauug

SEQ ID NO: 1747826 - RNA, 21 nt, Homo sapiens
gcugccugcccguaaacacgc

SEQ ID NO: 1747827 - RNA, 16 nt, Homo sapiens
gagggagggcggugga

SEQ ID NO: 1747828 - RNA, 20 nt, Homo sapiens
uuccucagggacagagacac

SEQ ID NO: 1747829 - RNA, 21 nt, Homo sapiens
cgcugagugggagaaggcagu

SEQ ID NO: 1747830 - RNA, 12 nt, Homo sapiens
auaggagucuuc

SEQ ID NO: 1747831 - RNA, 13 nt, Homo sapiens
ucuuggacacugu

SEQ ID NO: 1747832 - RNA, 14 nt, Homo sapiens
ucugacgucucuuu

SEQ ID NO: 1747833 - RNA, 21 nt, Homo sapiens
aggaacaucucugcuuucacu

SEQ ID NO: 1747834 - RNA, 18 nt, Homo sapiens
ucauuuuccauaaaggua

SEQ ID NO: 1747835 - RNA, 21 nt, Homo sapiens
caucguggccuugaccuccaa

SEQ ID NO: 1747836 - RNA, 15 nt, Homo sapiens
uccacagauuaucaa

SEQ ID NO: 1747837 - RNA, 18 nt, Homo sapiens
caccuaauaaagaaauaa

SEQ ID NO: 1747838 - RNA, 16 nt, Homo sapiens
ggaaagugcauaugaa

SEQ ID NO: 1747839 - RNA, 18 nt, Homo sapiens
cucaaaauaccaugccau

SEQ ID NO: 1747840 - RNA, 21 nt, Homo sapiens
uacuaggauacagaaaugcaa

SEQ ID NO: 1747841 - RNA, 13 nt, Homo sapiens
uucuugaaccaau

SEQ ID NO: 1747842 - RNA, 15 nt, Homo sapiens
cagccacgacugcca

SEQ ID NO: 1747843 - RNA, 22 nt, Homo sapiens
aggggccuugcugaguggcgca

SEQ ID NO: 1747844 - RNA, 19 nt, Homo sapiens
uaagagugccguaacaacu

SEQ ID NO: 1747845 - RNA, 20 nt, Homo sapiens
uccuggccuugugucacugg

SEQ ID NO: 1747846 - RNA, 15 nt, Homo sapiens
cccagggacaaaaca

SEQ ID NO: 1747847 - RNA, 22 nt, Homo sapiens
ggcugguguaugcacagggugu

SEQ ID NO: 1747848 - RNA, 21 nt, Homo sapiens
auaauuguugaaauuuugcaa

SEQ ID NO: 1747849 - RNA, 20 nt, Homo sapiens
ugauugaaucugauuggaca

SEQ ID NO: 1747850 - RNA, 23 nt, Homo sapiens
uggccacucagcuuccuacccac

SEQ ID NO: 1747851 - RNA, 24 nt, Homo sapiens
uuggagccaggaguuugagaccag

SEQ ID NO: 1747852 - RNA, 18 nt, Homo sapiens
ggagcacgaggucuggcc

SEQ ID NO: 1747853 - RNA, 19 nt, Homo sapiens
aacccugucuccucucugu

SEQ ID NO: 1747854 - RNA, 22 nt, Homo sapiens
auagaagaaaagcacugggaga

SEQ ID NO: 1747855 - RNA, 17 nt, Homo sapiens
gaacuauuagacaugaa

SEQ ID NO: 1747856 - RNA, 13 nt, Homo sapiens
gcuggaaugcagu

SEQ ID NO: 1747857 - RNA, 22 nt, Homo sapiens
gcuucuccaggguccacaggaa

SEQ ID NO: 1747858 - RNA, 23 nt, Homo sapiens
ccagaggcagagguugcagugag

SEQ ID NO: 1747859 - RNA, 16 nt, Homo sapiens
cugugcgucucagugu

SEQ ID NO: 1747860 - RNA, 17 nt, Homo sapiens
ugguaaaguauuuacug

SEQ ID NO: 1747861 - RNA, 16 nt, Homo sapiens
gaaaauuaauccucac

SEQ ID NO: 1747862 - RNA, 13 nt, Homo sapiens
uaauuacugugga

SEQ ID NO: 1747863 - RNA, 20 nt, Homo sapiens
gauguguccugacacugcaa

SEQ ID NO: 1747864 - RNA, 14 nt, Homo sapiens
uuuaauuuaaucuu

SEQ ID NO: 1747865 - RNA, 20 nt, Homo sapiens
ggaucccacuauauugcaca

SEQ ID NO: 1747866 - RNA, 12 nt, Homo sapiens
cacugcaagcac

SEQ ID NO: 1747867 - RNA, 21 nt, Homo sapiens
ugcccaacagggcaaccaaua

SEQ ID NO: 1747868 - RNA, 21 nt, Homo sapiens
gaguuuacuaccuggggaccc

SEQ ID NO: 1747869 - RNA, 17 nt, Homo sapiens
ugaaacuugaacucugg

SEQ ID NO: 1747870 - RNA, 22 nt, Homo sapiens
uuaccugcauguguuguacaau

SEQ ID NO: 1747871 - RNA, 17 nt, Homo sapiens
caagggggugacuggaa

SEQ ID NO: 1747872 - RNA, 22 nt, Homo sapiens
cccuccaccgccacuaugggcc

SEQ ID NO: 1747873 - RNA, 20 nt, Homo sapiens
gagacugggagccacuucuc

SEQ ID NO: 1747874 - RNA, 22 nt, Homo sapiens
auuucaauaaccuuucacuuaa

SEQ ID NO: 1747875 - RNA, 19 nt, Homo sapiens
cucagagaaccagugcaga

SEQ ID NO: 1747876 - RNA, 22 nt, Homo sapiens
gacauucaaggcauuucuauca

SEQ ID NO: 1747877 - RNA, 18 nt, Homo sapiens
ccugcagaaguacuccua

SEQ ID NO: 1747878 - RNA, 20 nt, Homo sapiens
gcaaacaggguuugauagca

SEQ ID NO: 1747879 - RNA, 21 nt, Homo sapiens
aaagaaauuuugccugccauu

SEQ ID NO: 1747880 - RNA, 20 nt, Homo sapiens
gacccuuaccugaaccagcc

SEQ ID NO: 1747881 - RNA, 14 nt, Homo sapiens
auacaaaccuacca

SEQ ID NO: 1747882 - RNA, 14 nt, Homo sapiens
cucuauacaucucu

SEQ ID NO: 1747883 - RNA, 19 nt, Homo sapiens
aagugucucuugacuggcu

SEQ ID NO: 1747884 - RNA, 22 nt, Homo sapiens
gaccagguuugaugccugugaa

SEQ ID NO: 1747885 - RNA, 15 nt, Homo sapiens
ccaguaaaaauccac

SEQ ID NO: 1747886 - RNA, 20 nt, Homo sapiens
ccacucaccuaucaacagau

SEQ ID NO: 1747887 - RNA, 15 nt, Homo sapiens
acccagacaaccaaa

SEQ ID NO: 1747888 - RNA, 15 nt, Homo sapiens
aacaaauuguuuaca

SEQ ID NO: 1747889 - RNA, 16 nt, Homo sapiens
uaaaguuguaaauaau

SEQ ID NO: 1747890 - RNA, 15 nt, Homo sapiens
cuugaugggugcugc

SEQ ID NO: 1747891 - RNA, 20 nt, Homo sapiens
gaauaaaauuccuaucucau

SEQ ID NO: 1747892 - RNA, 19 nt, Homo sapiens
accauacagacagcacaag

SEQ ID NO: 1747893 - RNA, 23 nt, Homo sapiens
gcauguauauuacugauuuacaa

SEQ ID NO: 1747894 - RNA, 18 nt, Homo sapiens
cuaguuaaacagugccau

SEQ ID NO: 1747895 - RNA, 17 nt, Homo sapiens
cagacauuccaugguga

SEQ ID NO: 1747896 - RNA, 15 nt, Homo sapiens
aaaauguuggugcaa

SEQ ID NO: 1747897 - RNA, 20 nt, Homo sapiens
ggggaagaccaaaguuugca

SEQ ID NO: 1747898 - RNA, 22 nt, Homo sapiens
agacacgaugccgagaccucaa

SEQ ID NO: 1747899 - RNA, 16 nt, Homo sapiens
cuucggccaaacagac

SEQ ID NO: 1747900 - RNA, 17 nt, Homo sapiens
cugccacucaggcccaa

SEQ ID NO: 1747901 - RNA, 21 nt, Homo sapiens
gaaauaaaaaaaaauuuuaag

SEQ ID NO: 1747902 - RNA, 17 nt, Homo sapiens
agaauuaugcuguuaaa

SEQ ID NO: 1747903 - RNA, 20 nt, Homo sapiens
ggucuuucugaauugcacau

SEQ ID NO: 1747904 - RNA, 12 nt, Homo sapiens
gccugaccucca

SEQ ID NO: 1747905 - RNA, 12 nt, Homo sapiens
gucaacauugug

SEQ ID NO: 1747906 - RNA, 19 nt, Homo sapiens
uguuaagggaagcugauac

SEQ ID NO: 1747907 - RNA, 20 nt, Homo sapiens
uuuucuccucauggauuuga

SEQ ID NO: 1747908 - RNA, 14 nt, Homo sapiens
cugaguugcacaua

SEQ ID NO: 1747909 - RNA, 11 nt, Homo sapiens
cuuugcugguu

SEQ ID NO: 1747910 - RNA, 17 nt, Homo sapiens
cccagugacaacaucgc

SEQ ID NO: 1747911 - RNA, 17 nt, Homo sapiens
accacagguucaugcca

SEQ ID NO: 1747912 - RNA, 13 nt, Homo sapiens
cccaugaauacac

SEQ ID NO: 1747913 - RNA, 22 nt, Homo sapiens
caaaucuuguuauugaaguguu

SEQ ID NO: 1747914 - RNA, 17 nt, Homo sapiens
aagauggaaaucacauu

SEQ ID NO: 1747915 - RNA, 16 nt, Homo sapiens
uacucaugugcaauag

SEQ ID NO: 1747916 - RNA, 15 nt, Homo sapiens
uucagcgaaagggac

SEQ ID NO: 1747917 - RNA, 23 nt, Homo sapiens
aaaggcagcugccucugcucccu

SEQ ID NO: 1747918 - RNA, 18 nt, Homo sapiens
agcucugguggagacaaa

SEQ ID NO: 1747919 - RNA, 21 nt, Homo sapiens
gaccaggguuggcaccuuccc

SEQ ID NO: 1747920 - RNA, 18 nt, Homo sapiens
cccagccucccaaagugc

SEQ ID NO: 1747921 - RNA, 13 nt, Homo sapiens
ggucaaggacaaa

SEQ ID NO: 1747922 - RNA, 12 nt, Homo sapiens
caguuacaacca

SEQ ID NO: 1747923 - RNA, 22 nt, Homo sapiens
gccuauuaucugucagcugcaa

SEQ ID NO: 1747924 - RNA, 14 nt, Homo sapiens
auucucaguucucu

SEQ ID NO: 1747925 - RNA, 16 nt, Homo sapiens
ucguuuuuuuggucac

SEQ ID NO: 1747926 - RNA, 22 nt, Homo sapiens
ugcccauuguaacuuauuucag

SEQ ID NO: 1747927 - RNA, 21 nt, Homo sapiens
uucuguauauuugucaugaca

SEQ ID NO: 1747928 - RNA, 23 nt, Homo sapiens
cggaagcugucgacuucaugaca

SEQ ID NO: 1747929 - RNA, 13 nt, Homo sapiens
gauugaaagggag

SEQ ID NO: 1747930 - RNA, 19 nt, Homo sapiens
cugaggaauggacauuucu

SEQ ID NO: 1747931 - RNA, 15 nt, Homo sapiens
acagagacucuggaa

SEQ ID NO: 1747932 - RNA, 12 nt, Homo sapiens
gacaggguguug

SEQ ID NO: 1747933 - RNA, 14 nt, Homo sapiens
acgccacagucucc

SEQ ID NO: 1747934 - RNA, 14 nt, Homo sapiens
aaucacggcucacu

SEQ ID NO: 1747935 - RNA, 18 nt, Homo sapiens
ucccauugguguugucau

SEQ ID NO: 1747936 - RNA, 20 nt, Homo sapiens
ccgccugcccagacugauga

SEQ ID NO: 1747937 - RNA, 21 nt, Homo sapiens
gaacagaauaucaggaugccu

SEQ ID NO: 1747938 - RNA, 16 nt, Homo sapiens
cugcuugaacacugaa

SEQ ID NO: 1747939 - RNA, 17 nt, Homo sapiens
uaaggauaugcauuaac

SEQ ID NO: 1747940 - RNA, 15 nt, Homo sapiens
cagcuacauuccuca

SEQ ID NO: 1747941 - RNA, 17 nt, Homo sapiens
cccugaacacugugaca

SEQ ID NO: 1747942 - RNA, 12 nt, Homo sapiens
gagaccagugua

SEQ ID NO: 1747943 - RNA, 12 nt, Homo sapiens
uguuaugacucc

SEQ ID NO: 1747944 - RNA, 15 nt, Homo sapiens
ucacaacucucuggu

SEQ ID NO: 1747945 - RNA, 19 nt, Homo sapiens
caaaugaacacacccauca

SEQ ID NO: 1747946 - RNA, 16 nt, Homo sapiens
agaugggggacugaga

SEQ ID NO: 1747947 - RNA, 16 nt, Homo sapiens
cagggcagacugcaga

SEQ ID NO: 1747948 - RNA, 18 nt, Homo sapiens
gacaguuuucaccaucuc

SEQ ID NO: 1747949 - RNA, 23 nt, Homo sapiens
uacucucaggcauggaugaauaa

SEQ ID NO: 1747950 - RNA, 21 nt, Homo sapiens
uggacuucacauaagcucaga

SEQ ID NO: 1747951 - RNA, 13 nt, Homo sapiens
aguuuggagacaa

SEQ ID NO: 1747952 - RNA, 17 nt, Homo sapiens
aagcauuccugcucaag

SEQ ID NO: 1747953 - RNA, 13 nt, Homo sapiens
guaauaucauuuc

SEQ ID NO: 1747954 - RNA, 22 nt, Homo sapiens
agagccugcagggugaccugcu

SEQ ID NO: 1747955 - RNA, 17 nt, Homo sapiens
ccaccugugcugcugca

SEQ ID NO: 1747956 - RNA, 18 nt, Homo sapiens
gguuuauugaaugugauu

SEQ ID NO: 1747957 - RNA, 13 nt, Homo sapiens
aggagcagcacuc

SEQ ID NO: 1747958 - RNA, 16 nt, Homo sapiens
accucauccaugcacu

SEQ ID NO: 1747959 - RNA, 13 nt, Homo sapiens
auaugaagacaua

SEQ ID NO: 1747960 - RNA, 16 nt, Homo sapiens
gagacuguuugaaugu

SEQ ID NO: 1747961 - RNA, 19 nt, Homo sapiens
aacguggcaggacuuccau

SEQ ID NO: 1747962 - RNA, 16 nt, Homo sapiens
aaguagaauccuaaau

SEQ ID NO: 1747963 - RNA, 22 nt, Homo sapiens
cauuaaaaggcccuucaccucu

SEQ ID NO: 1747964 - RNA, 17 nt, Homo sapiens
auuuuuuaaugugcucu

SEQ ID NO: 1747965 - RNA, 14 nt, Homo sapiens
uucuauucagcaaa

SEQ ID NO: 1747966 - RNA, 16 nt, Homo sapiens
aaaauggaaaagagag

SEQ ID NO: 1747967 - RNA, 18 nt, Homo sapiens
uuuguacauauuaucauc

SEQ ID NO: 1747968 - RNA, 15 nt, Homo sapiens
uuccagcgucugcug

SEQ ID NO: 1747969 - RNA, 16 nt, Homo sapiens
uuguugagugcacuga

SEQ ID NO: 1747970 - RNA, 15 nt, Homo sapiens
aaagaauuauuugcc

SEQ ID NO: 1747971 - RNA, 19 nt, Homo sapiens
uggguuugccaagcccuuu

SEQ ID NO: 1747972 - RNA, 20 nt, Homo sapiens
gugcaaaagugaaacauaca

SEQ ID NO: 1747973 - RNA, 20 nt, Homo sapiens
uccuaaauaaaaaaagacaa

SEQ ID NO: 1747974 - RNA, 19 nt, Homo sapiens
cucaugagaaguugauaua

SEQ ID NO: 1747975 - RNA, 14 nt, Homo sapiens
cgggggaugaauga

SEQ ID NO: 1747976 - RNA, 21 nt, Homo sapiens
uaaaauagaguguaguuuaca

SEQ ID NO: 1747977 - RNA, 18 nt, Homo sapiens
cacuucccauuuacucuu

SEQ ID NO: 1747978 - RNA, 22 nt, Homo sapiens
cuuccuugcaggagugacucaa

SEQ ID NO: 1747979 - RNA, 19 nt, Homo sapiens
gauaaucgagucuaccucu

SEQ ID NO: 1747980 - RNA, 14 nt, Homo sapiens
aggaagaugcucau

SEQ ID NO: 1747981 - RNA, 15 nt, Homo sapiens
agggucugccuccag

SEQ ID NO: 1747982 - RNA, 16 nt, Homo sapiens
agagggaggucacugg

SEQ ID NO: 1747983 - RNA, 19 nt, Homo sapiens
gcuuccccgugcaugauuu

SEQ ID NO: 1747984 - RNA, 14 nt, Homo sapiens
gcagccucugccag

SEQ ID NO: 1747985 - RNA, 21 nt, Homo sapiens
ugggaaagcgcggacgugcug

SEQ ID NO: 1747986 - RNA, 15 nt, Homo sapiens
ucugaaaggagacau

SEQ ID NO: 1747987 - RNA, 13 nt, Homo sapiens
ugauuguuuacag

SEQ ID NO: 1747988 - RNA, 16 nt, Homo sapiens
acuugugaacaugccu

SEQ ID NO: 1747989 - RNA, 16 nt, Homo sapiens
uguucuguugauccca

SEQ ID NO: 1747990 - RNA, 13 nt, Homo sapiens
uagagcuucuuau

SEQ ID NO: 1747991 - RNA, 21 nt, Homo sapiens
gaagaauguugauggugcuag

SEQ ID NO: 1747992 - RNA, 12 nt, Homo sapiens
gaaugcagggaa

SEQ ID NO: 1747993 - RNA, 15 nt, Homo sapiens
ucauauacugccaug

SEQ ID NO: 1747994 - RNA, 13 nt, Homo sapiens
cucugaagccaca

SEQ ID NO: 1747995 - RNA, 16 nt, Homo sapiens
ggucuguguguguucu

SEQ ID NO: 1747996 - RNA, 13 nt, Homo sapiens
gcagcaagcaauu

SEQ ID NO: 1747997 - RNA, 15 nt, Homo sapiens
ccaggauaccagcaa

SEQ ID NO: 1747998 - RNA, 20 nt, Homo sapiens
aauucaguacugauuauucu

SEQ ID NO: 1747999 - RNA, 22 nt, Homo sapiens
ggauuauuuuaaauacaaaagg

SEQ ID NO: 1748000 - RNA, 16 nt, Homo sapiens
cuucucuuucacaacu

SEQ ID NO: 1748001 - RNA, 13 nt, Homo sapiens
cugauauaauuua

SEQ ID NO: 1748002 - RNA, 21 nt, Homo sapiens
cugguugcuaaugacagccuu

SEQ ID NO: 1748003 - RNA, 14 nt, Homo sapiens
cuaagacaccugca

SEQ ID NO: 1748004 - RNA, 16 nt, Homo sapiens
uuauugaaaaaucagu

SEQ ID NO: 1748005 - RNA, 16 nt, Homo sapiens
auaaugaauaaacagu

SEQ ID NO: 1748006 - RNA, 20 nt, Homo sapiens
cucguauaugucucaggucc

SEQ ID NO: 1748007 - RNA, 20 nt, Homo sapiens
gagcuuuccuacuugcacuc

SEQ ID NO: 1748008 - RNA, 14 nt, Homo sapiens
uguucuauuguggg

SEQ ID NO: 1748009 - RNA, 18 nt, Homo sapiens
gcauucauucauccucuu

SEQ ID NO: 1748010 - RNA, 23 nt, Homo sapiens
agaagaagcuccugaaucccuuu

SEQ ID NO: 1748011 - RNA, 13 nt, Homo sapiens
gaagcagcugcuu

SEQ ID NO: 1748012 - RNA, 15 nt, Homo sapiens
uccuuaacuucaggg

SEQ ID NO: 1748013 - RNA, 20 nt, Homo sapiens
uaaaagaacuuacugauuau

SEQ ID NO: 1748014 - RNA, 14 nt, Homo sapiens
uucccacugcacuu

SEQ ID NO: 1748015 - RNA, 22 nt, Homo sapiens
uaaacucuguuguaaguaauaa

SEQ ID NO: 1748016 - RNA, 17 nt, Homo sapiens
uugcucacaguuauuac

SEQ ID NO: 1748017 - RNA, 21 nt, Homo sapiens
uacacacucagugacauuucu

SEQ ID NO: 1748018 - RNA, 20 nt, Homo sapiens
guauucauuuuuucuacccu

SEQ ID NO: 1748019 - RNA, 23 nt, Homo sapiens
acaggcaacauuacaaacaaagg

SEQ ID NO: 1748020 - RNA, 22 nt, Homo sapiens
uuucuguuagcuggguuuacau

SEQ ID NO: 1748021 - RNA, 22 nt, Homo sapiens
aaacaaaaaaaccucuaugcaa

SEQ ID NO: 1748022 - RNA, 18 nt, Homo sapiens
ggagguccugcuacccag

SEQ ID NO: 1748023 - RNA, 20 nt, Homo sapiens
ccccagaggcucagcacuuu

SEQ ID NO: 1748024 - RNA, 19 nt, Homo sapiens
ccaugcaaugccucuggaa

SEQ ID NO: 1748025 - RNA, 19 nt, Homo sapiens
ucaucucaaacacugcuua

SEQ ID NO: 1748026 - RNA, 19 nt, Homo sapiens
cugucucuuucaugaguuu

SEQ ID NO: 1748027 - RNA, 16 nt, Homo sapiens
uaaaaaaaacaauucc

SEQ ID NO: 1748028 - RNA, 14 nt, Homo sapiens
gacauugcauuugg

SEQ ID NO: 1748029 - RNA, 14 nt, Homo sapiens
uauguagugcauuu

SEQ ID NO: 1748030 - RNA, 15 nt, Homo sapiens
auucaucauccagga

SEQ ID NO: 1748031 - RNA, 16 nt, Homo sapiens
aaauguauauuuugau

SEQ ID NO: 1748032 - RNA, 14 nt, Homo sapiens
ucucuucugagcua

SEQ ID NO: 1748033 - RNA, 22 nt, Homo sapiens
gauauuuucgcccaccuaaagg

SEQ ID NO: 1748034 - RNA, 14 nt, Homo sapiens
uuauuaauuucagu

SEQ ID NO: 1748035 - RNA, 17 nt, Homo sapiens
cauaggacucuuugguc

SEQ ID NO: 1748036 - RNA, 19 nt, Homo sapiens
aagagugccguaacaacug

SEQ ID NO: 1748037 - RNA, 14 nt, Homo sapiens
ggaggaugugggca

SEQ ID NO: 1748038 - RNA, 23 nt, Homo sapiens
cgugguaugucugccauguugcc

SEQ ID NO: 1748039 - RNA, 21 nt, Homo sapiens
gugggauggcauuuggucuca

SEQ ID NO: 1748040 - RNA, 22 nt, Homo sapiens
cuccuggacuccggaggacuga

SEQ ID NO: 1748041 - RNA, 22 nt, Homo sapiens
uguuguggguuuuuucacauaa

SEQ ID NO: 1748042 - RNA, 13 nt, Homo sapiens
aacaaaugaaaua

SEQ ID NO: 1748043 - RNA, 15 nt, Homo sapiens
ugcaaagaguuauau

SEQ ID NO: 1748044 - RNA, 16 nt, Homo sapiens
gaguaggaagacuuug

SEQ ID NO: 1748045 - RNA, 16 nt, Homo sapiens
uccuggaucucccuga

SEQ ID NO: 1748046 - RNA, 19 nt, Homo sapiens
uaaggucugacaucagagg

SEQ ID NO: 1748047 - RNA, 21 nt, Homo sapiens
auuuguauuaauaaagcauuc

SEQ ID NO: 1748048 - RNA, 23 nt, Homo sapiens
gugauucccuccugcuacucugu

SEQ ID NO: 1748049 - RNA, 23 nt, Homo sapiens
aggauauugguucuuccccucau

SEQ ID NO: 1748050 - RNA, 23 nt, Homo sapiens
agauuucggaggccauccugcca

SEQ ID NO: 1748051 - RNA, 16 nt, Homo sapiens
acuaaguguguaucca

SEQ ID NO: 1748052 - RNA, 16 nt, Homo sapiens
gccaagaaacacugcc

SEQ ID NO: 1748053 - RNA, 18 nt, Homo sapiens
auucauaauuagaacaau

SEQ ID NO: 1748054 - RNA, 15 nt, Homo sapiens
aggccauugucccug

SEQ ID NO: 1748055 - RNA, 13 nt, Homo sapiens
cauucuacugugu

SEQ ID NO: 1748056 - RNA, 16 nt, Homo sapiens
cucuccccucugcaac

SEQ ID NO: 1748057 - RNA, 14 nt, Homo sapiens
aucucuuccucaca

SEQ ID NO: 1748058 - RNA, 18 nt, Homo sapiens
auacauuaaagcagucac

SEQ ID NO: 1748059 - RNA, 14 nt, Homo sapiens
uccaggauuccucu

SEQ ID NO: 1748060 - RNA, 18 nt, Homo sapiens
acaacaaaaaccaaaaaa

SEQ ID NO: 1748061 - RNA, 16 nt, Homo sapiens
acauuucuaaaccaga

SEQ ID NO: 1748062 - RNA, 15 nt, Homo sapiens
gcugcgucugcaaag

SEQ ID NO: 1748063 - RNA, 15 nt, Homo sapiens
acagcagaacuucug

SEQ ID NO: 1748064 - RNA, 17 nt, Homo sapiens
ccuacaucuucuuccca

SEQ ID NO: 1748065 - RNA, 21 nt, Homo sapiens
ggaaccucccugggccugucu

SEQ ID NO: 1748066 - RNA, 15 nt, Homo sapiens
auaaaguuacuugaa

SEQ ID NO: 1748067 - RNA, 18 nt, Homo sapiens
auguaggguaaggugccu

SEQ ID NO: 1748068 - RNA, 22 nt, Homo sapiens
caccugaguguccuugcucuag

SEQ ID NO: 1748069 - RNA, 14 nt, Homo sapiens
agggccaauggaga

SEQ ID NO: 1748070 - RNA, 19 nt, Homo sapiens
cuuuagucugcaaaaugag

SEQ ID NO: 1748071 - RNA, 16 nt, Homo sapiens
cucuaaaaaagaacuu

SEQ ID NO: 1748072 - RNA, 17 nt, Homo sapiens
agaguggcuuugucagu

SEQ ID NO: 1748073 - RNA, 22 nt, Homo sapiens
ugagaaacucuacauguaacua

SEQ ID NO: 1748074 - RNA, 22 nt, Homo sapiens
cgguggacucucauguggccaa

SEQ ID NO: 1748075 - RNA, 18 nt, Homo sapiens
gggugcugucaugcccag

SEQ ID NO: 1748076 - RNA, 18 nt, Homo sapiens
ggaacagauuucaaaaaa

SEQ ID NO: 1748077 - RNA, 16 nt, Homo sapiens
uccuuugccugauccu

SEQ ID NO: 1748078 - RNA, 15 nt, Homo sapiens
aacacuaggugccug

SEQ ID NO: 1748079 - RNA, 20 nt, Homo sapiens
aagggaauucggugugcacc

SEQ ID NO: 1748080 - RNA, 23 nt, Homo sapiens
cacugaaaaaucuaagugauaua

SEQ ID NO: 1748081 - RNA, 12 nt, Homo sapiens
caccgcaguuuu

SEQ ID NO: 1748082 - RNA, 16 nt, Homo sapiens
uuaugcaaauggagau

SEQ ID NO: 1748083 - RNA, 14 nt, Homo sapiens
uguguuuuuaauua

SEQ ID NO: 1748084 - RNA, 22 nt, Homo sapiens
aauguaucuaguguguccugug

SEQ ID NO: 1748085 - RNA, 22 nt, Homo sapiens
aagaaggucucauuaucuccau

SEQ ID NO: 1748086 - RNA, 15 nt, Homo sapiens
ucaccccagugccug

SEQ ID NO: 1748087 - RNA, 15 nt, Homo sapiens
agcacagugccugac

SEQ ID NO: 1748088 - RNA, 23 nt, Homo sapiens
cuaccugcucguugccugccacu

SEQ ID NO: 1748089 - RNA, 12 nt, Homo sapiens
aaguaacauaua

SEQ ID NO: 1748090 - RNA, 12 nt, Homo sapiens
gaaagcuguaua

SEQ ID NO: 1748091 - RNA, 12 nt, Homo sapiens
agccgaggucau

SEQ ID NO: 1748092 - RNA, 17 nt, Homo sapiens
acuuuucaagcugcuga

SEQ ID NO: 1748093 - RNA, 18 nt, Homo sapiens
ucucuacuuccccagaug

SEQ ID NO: 1748094 - RNA, 12 nt, Homo sapiens
auaaagcuucug

SEQ ID NO: 1748095 - RNA, 20 nt, Homo sapiens
gcaaccaggcagcugagacc

SEQ ID NO: 1748096 - RNA, 19 nt, Homo sapiens
agauuuauguaaugcuuua

SEQ ID NO: 1748097 - RNA, 12 nt, Homo sapiens
gguggggggcca

SEQ ID NO: 1748098 - RNA, 20 nt, Homo sapiens
aaaucauacuuucucuucaa

SEQ ID NO: 1748099 - RNA, 18 nt, Homo sapiens
uugaagguggcuacaaag

SEQ ID NO: 1748100 - RNA, 21 nt, Homo sapiens
cccaacucuccuggacugccu

SEQ ID NO: 1748101 - RNA, 16 nt, Homo sapiens
uugaaggaucaucuga

SEQ ID NO: 1748102 - RNA, 18 nt, Homo sapiens
ccccacuguccugugagg

SEQ ID NO: 1748103 - RNA, 22 nt, Homo sapiens
augaaaaaacggucugccggug

SEQ ID NO: 1748104 - RNA, 16 nt, Homo sapiens
cuuuauagcacauggc

SEQ ID NO: 1748105 - RNA, 13 nt, Homo sapiens
guacagaugaaug

SEQ ID NO: 1748106 - RNA, 22 nt, Homo sapiens
ggccccucccgccccuucccac

SEQ ID NO: 1748107 - RNA, 22 nt, Homo sapiens
ucuuaugauuacuaucauggca

SEQ ID NO: 1748108 - RNA, 19 nt, Homo sapiens
acuuuuuaaaauaauaaca

SEQ ID NO: 1748109 - RNA, 20 nt, Homo sapiens
acucuccugugaacacugga

SEQ ID NO: 1748110 - RNA, 16 nt, Homo sapiens
uagaaagccaugugcu

SEQ ID NO: 1748111 - RNA, 21 nt, Homo sapiens
uucuucgggauguuguuugcu

SEQ ID NO: 1748112 - RNA, 14 nt, Homo sapiens
gaaauucuuuccca

SEQ ID NO: 1748113 - RNA, 23 nt, Homo sapiens
ugaguaaauauugaggcuuugug

SEQ ID NO: 1748114 - RNA, 17 nt, Homo sapiens
uuccuaacauuuugaag

SEQ ID NO: 1748115 - RNA, 20 nt, Homo sapiens
uuucccccgagcucuuggcc

SEQ ID NO: 1748116 - RNA, 16 nt, Homo sapiens
ugaaaaacaaaauggg

SEQ ID NO: 1748117 - RNA, 15 nt, Homo sapiens
ugucccugcacugug

SEQ ID NO: 1748118 - RNA, 22 nt, Homo sapiens
caggaacaauaaaaugucuucu

SEQ ID NO: 1748119 - RNA, 22 nt, Homo sapiens
cguagugucauguucugugcau

SEQ ID NO: 1748120 - RNA, 14 nt, Homo sapiens
gaucacaccacugc

SEQ ID NO: 1748121 - RNA, 16 nt, Homo sapiens
agucuccucacucugu

SEQ ID NO: 1748122 - RNA, 19 nt, Homo sapiens
acuaggaucagaauaucac

SEQ ID NO: 1748123 - RNA, 14 nt, Homo sapiens
uguuucacuaugau

SEQ ID NO: 1748124 - RNA, 23 nt, Homo sapiens
cuaaguaaauuuucuuuaaguca

SEQ ID NO: 1748125 - RNA, 15 nt, Homo sapiens
cuaccugaauggaga

SEQ ID NO: 1748126 - RNA, 14 nt, Homo sapiens
caaaauugagcuua

SEQ ID NO: 1748127 - RNA, 20 nt, Homo sapiens
uuuagaacagagggaccaaa

SEQ ID NO: 1748128 - RNA, 18 nt, Homo sapiens
acuuugcuuccccuccag

SEQ ID NO: 1748129 - RNA, 23 nt, Homo sapiens
guaccaagaagcccaagauauca

SEQ ID NO: 1748130 - RNA, 14 nt, Homo sapiens
uaggagacuugcca

SEQ ID NO: 1748131 - RNA, 13 nt, Homo sapiens
acuuauguggaac

SEQ ID NO: 1748132 - RNA, 17 nt, Homo sapiens
auuuguuugugcuucaa

SEQ ID NO: 1748133 - RNA, 18 nt, Homo sapiens
cagcauuugccaagucuc

SEQ ID NO: 1748134 - RNA, 16 nt, Homo sapiens
ugccaguacuuaccag

SEQ ID NO: 1748135 - RNA, 22 nt, Homo sapiens
cccaacugggggcaaagguuug

SEQ ID NO: 1748136 - RNA, 18 nt, Homo sapiens
guguucaaacacaaccua

SEQ ID NO: 1748137 - RNA, 13 nt, Homo sapiens
cccagucccacac

SEQ ID NO: 1748138 - RNA, 21 nt, Homo sapiens
cauuaaaccugucuccacugu

SEQ ID NO: 1748139 - RNA, 12 nt, Homo sapiens
agaaauuugcaa

SEQ ID NO: 1748140 - RNA, 17 nt, Homo sapiens
agcccaggccacagcca

SEQ ID NO: 1748141 - RNA, 20 nt, Homo sapiens
cgaugagauaauaugagauu

SEQ ID NO: 1748142 - RNA, 21 nt, Homo sapiens
cucaccuguaagaugaagaua

SEQ ID NO: 1748143 - RNA, 10 nt, Homo sapiens
agagugaaug

SEQ ID NO: 1748144 - RNA, 15 nt, Homo sapiens
ucugaucccagccaa

SEQ ID NO: 1748145 - RNA, 20 nt, Homo sapiens
uaggugaccccaucucugcu

SEQ ID NO: 1748146 - RNA, 15 nt, Homo sapiens
agccuagaggaggaa

SEQ ID NO: 1748147 - RNA, 21 nt, Homo sapiens
aguucaccuauuucaaaaauu

SEQ ID NO: 1748148 - RNA, 23 nt, Homo sapiens
caaucuuuuagcacauguguaag

SEQ ID NO: 1748149 - RNA, 22 nt, Homo sapiens
agaaaauacuauuucaagucau

SEQ ID NO: 1748150 - RNA, 15 nt, Homo sapiens
aguauuaauacuacc

SEQ ID NO: 1748151 - RNA, 18 nt, Homo sapiens
uaccaccuaauguuuaua

SEQ ID NO: 1748152 - RNA, 19 nt, Homo sapiens
gcccagaaucauguggcca

SEQ ID NO: 1748153 - RNA, 18 nt, Homo sapiens
agaccagaaaccuuccag

SEQ ID NO: 1748154 - RNA, 14 nt, Homo sapiens
ggaggaguggcauc

SEQ ID NO: 1748155 - RNA, 13 nt, Homo sapiens
uuaugacuccaga

SEQ ID NO: 1748156 - RNA, 19 nt, Homo sapiens
caacucuguacaaagcccu

SEQ ID NO: 1748157 - RNA, 17 nt, Homo sapiens
caguauuccaugggaug

SEQ ID NO: 1748158 - RNA, 14 nt, Homo sapiens
cagaggacugugau

SEQ ID NO: 1748159 - RNA, 17 nt, Homo sapiens
caaaugucauuucauac

SEQ ID NO: 1748160 - RNA, 12 nt, Homo sapiens
aagugaugugau

SEQ ID NO: 1748161 - RNA, 17 nt, Homo sapiens
uucccguuagucucuga

SEQ ID NO: 1748162 - RNA, 14 nt, Homo sapiens
ugaaaaccaucugg

SEQ ID NO: 1748163 - RNA, 14 nt, Homo sapiens
uauaaauuauaucc

SEQ ID NO: 1748164 - RNA, 13 nt, Homo sapiens
gccacaguucaca

SEQ ID NO: 1748165 - RNA, 22 nt, Homo sapiens
ugggcaucauagcaagaccuca

SEQ ID NO: 1748166 - RNA, 19 nt, Homo sapiens
ugcccuccugggagcucau

SEQ ID NO: 1748167 - RNA, 17 nt, Homo sapiens
auguuauugccuaauca

SEQ ID NO: 1748168 - RNA, 16 nt, Homo sapiens
cacagggcuagaagca

SEQ ID NO: 1748169 - RNA, 22 nt, Homo sapiens
uggugguauuuuuauagccaua

SEQ ID NO: 1748170 - RNA, 16 nt, Homo sapiens
uauagaguagaagauu

SEQ ID NO: 1748171 - RNA, 14 nt, Homo sapiens
gccauaacuugaaa

SEQ ID NO: 1748172 - RNA, 13 nt, Homo sapiens
ccacaagccauuu

SEQ ID NO: 1748173 - RNA, 15 nt, Homo sapiens
ggcuaagggggacca

SEQ ID NO: 1748174 - RNA, 13 nt, Homo sapiens
aggaguuccuuga

SEQ ID NO: 1748175 - RNA, 15 nt, Homo sapiens
cauuucauauucuuu

SEQ ID NO: 1748176 - RNA, 13 nt, Homo sapiens
agaucaagccugc

SEQ ID NO: 1748177 - RNA, 15 nt, Homo sapiens
gaccaaaguuugcaa

SEQ ID NO: 1748178 - RNA, 21 nt, Homo sapiens
cucauuuauuuccauauuaaa

SEQ ID NO: 1748179 - RNA, 13 nt, Homo sapiens
caguuuucuugca

SEQ ID NO: 1748180 - RNA, 17 nt, Homo sapiens
ggcuuuagggaccugcu

SEQ ID NO: 1748181 - RNA, 17 nt, Homo sapiens
gauugacacacagcacu

SEQ ID NO: 1748182 - RNA, 22 nt, Homo sapiens
acaaaaacaagcaaugggcaau

SEQ ID NO: 1748183 - RNA, 18 nt, Homo sapiens
uuaggugagacaguugcc

SEQ ID NO: 1748184 - RNA, 19 nt, Homo sapiens
uguagagccccuacugugg

SEQ ID NO: 1748185 - RNA, 16 nt, Homo sapiens
gcuucaccccaauccc

SEQ ID NO: 1748186 - RNA, 20 nt, Homo sapiens
ucuucaccaggugcaugcau

SEQ ID NO: 1748187 - RNA, 13 nt, Homo sapiens
agccaaacagagc

SEQ ID NO: 1748188 - RNA, 21 nt, Homo sapiens
gcagaguccuuauucuucuca

SEQ ID NO: 1748189 - RNA, 23 nt, Homo sapiens
ucaaguuguuccuuaagucagaa

SEQ ID NO: 1748190 - RNA, 21 nt, Homo sapiens
cuguaaaugaagggucauuuc

SEQ ID NO: 1748191 - RNA, 19 nt, Homo sapiens
gaaucuacaaaaaacaaca

SEQ ID NO: 1748192 - RNA, 18 nt, Homo sapiens
cuguggaaggccgaggca

SEQ ID NO: 1748193 - RNA, 17 nt, Homo sapiens
ucacauauaacaugcaa

SEQ ID NO: 1748194 - RNA, 24 nt, Homo sapiens
cacgacuuacauagcucaaauauu

SEQ ID NO: 1748195 - RNA, 16 nt, Homo sapiens
cccauaauaaguuccu

SEQ ID NO: 1748196 - RNA, 20 nt, Homo sapiens
cauauauagagggagcugua

SEQ ID NO: 1748197 - RNA, 16 nt, Homo sapiens
aguggaaauaaaaaga

SEQ ID NO: 1748198 - RNA, 16 nt, Homo sapiens
gaaguuugcaaccuuu

SEQ ID NO: 1748199 - RNA, 20 nt, Homo sapiens
ucagucuuugcucagugucc

SEQ ID NO: 1748200 - RNA, 20 nt, Homo sapiens
aaggaaaguuuuuacuuuuu

SEQ ID NO: 1748201 - RNA, 14 nt, Homo sapiens
gacuggccacugaa

SEQ ID NO: 1748202 - RNA, 18 nt, Homo sapiens
gagaauaaaccaggccug

SEQ ID NO: 1748203 - RNA, 21 nt, Homo sapiens
gaaacauuauuagcacuuccc

SEQ ID NO: 1748204 - RNA, 21 nt, Homo sapiens
acaugguuuaaauaugaauga

SEQ ID NO: 1748205 - RNA, 23 nt, Homo sapiens
ggcagaaacaaaaugacuguaga

SEQ ID NO: 1748206 - RNA, 15 nt, Homo sapiens
augcuaucaguuuua

SEQ ID NO: 1748207 - RNA, 17 nt, Homo sapiens
uggugcgcccugucucu

SEQ ID NO: 1748208 - RNA, 20 nt, Homo sapiens
acugaguccuguucuuguua

SEQ ID NO: 1748209 - RNA, 20 nt, Homo sapiens
ggagaagaaggcaacccaaa

SEQ ID NO: 1748210 - RNA, 12 nt, Homo sapiens
agaaauagugug

SEQ ID NO: 1748211 - RNA, 16 nt, Homo sapiens
uaaaaaauuaguuugu

SEQ ID NO: 1748212 - RNA, 20 nt, Homo sapiens
ugccaucaugccugacuaau

SEQ ID NO: 1748213 - RNA, 18 nt, Homo sapiens
uucauguggagucauuau

SEQ ID NO: 1748214 - RNA, 19 nt, Homo sapiens
acuugguucaguaccacau

SEQ ID NO: 1748215 - RNA, 23 nt, Homo sapiens
uaguauacugcccaaacuaauga

SEQ ID NO: 1748216 - RNA, 22 nt, Homo sapiens
aacuuuaccauaaagccuuuaa

SEQ ID NO: 1748217 - RNA, 17 nt, Homo sapiens
uguacaauuuucauccc

SEQ ID NO: 1748218 - RNA, 12 nt, Homo sapiens
ccaaagcacuuu

SEQ ID NO: 1748219 - RNA, 22 nt, Homo sapiens
uuauuacuguuuauuacuucca

SEQ ID NO: 1748220 - RNA, 19 nt, Homo sapiens
gcgcagcaucccuagucuc

SEQ ID NO: 1748221 - RNA, 17 nt, Homo sapiens
accuuccagcccggggc

SEQ ID NO: 1748222 - RNA, 21 nt, Homo sapiens
aguucccuccugcccaggacu

SEQ ID NO: 1748223 - RNA, 13 nt, Homo sapiens
uauauaucugcuu

SEQ ID NO: 1748224 - RNA, 14 nt, Homo sapiens
acuguggcucugca

SEQ ID NO: 1748225 - RNA, 14 nt, Homo sapiens
agcuuggcugcuca

SEQ ID NO: 1748226 - RNA, 19 nt, Homo sapiens
accucccugccuccaggaa

SEQ ID NO: 1748227 - RNA, 14 nt, Homo sapiens
cccucccaccacuc

SEQ ID NO: 1748228 - RNA, 22 nt, Homo sapiens
cucucucaugccuccugaggcu

SEQ ID NO: 1748229 - RNA, 14 nt, Homo sapiens
auuaacaugugcca

SEQ ID NO: 1748230 - RNA, 15 nt, Homo sapiens
uacuuugugcauucu

SEQ ID NO: 1748231 - RNA, 16 nt, Homo sapiens
uagcaucauguauaua

SEQ ID NO: 1748232 - RNA, 14 nt, Homo sapiens
ugaaaacauggaac

SEQ ID NO: 1748233 - RNA, 13 nt, Homo sapiens
accaauggaaaaa

SEQ ID NO: 1748234 - RNA, 16 nt, Homo sapiens
cuaagaauaaacucca

SEQ ID NO: 1748235 - RNA, 19 nt, Homo sapiens
auuuaaaacguuuugguca

SEQ ID NO: 1748236 - RNA, 19 nt, Homo sapiens
ugaauaagauuaaugaccu

SEQ ID NO: 1748237 - RNA, 20 nt, Homo sapiens
aaagcuggacugaccaaaga

SEQ ID NO: 1748238 - RNA, 19 nt, Homo sapiens
aauuuaaagggaaaacccu

SEQ ID NO: 1748239 - RNA, 15 nt, Homo sapiens
guguggccugccuuc

SEQ ID NO: 1748240 - RNA, 16 nt, Homo sapiens
cucccaguuaccugca

SEQ ID NO: 1748241 - RNA, 18 nt, Homo sapiens
caucacugaaaucccucu

SEQ ID NO: 1748242 - RNA, 12 nt, Homo sapiens
ccaccccaagag

SEQ ID NO: 1748243 - RNA, 19 nt, Homo sapiens
acuucuuauacauuugaua

SEQ ID NO: 1748244 - RNA, 9 nt, Homo sapiens
ugugcaaua

SEQ ID NO: 1748245 - RNA, 16 nt, Homo sapiens
uugcgggacagaguag

SEQ ID NO: 1748246 - RNA, 23 nt, Homo sapiens
auuagauuuggaggcuaccucac

SEQ ID NO: 1748247 - RNA, 19 nt, Homo sapiens
gccgcauucccugagucac

SEQ ID NO: 1748248 - RNA, 16 nt, Homo sapiens
aguugguguucauaau

SEQ ID NO: 1748249 - RNA, 19 nt, Homo sapiens
agggcagggccaguuccuc

SEQ ID NO: 1748250 - RNA, 17 nt, Homo sapiens
cuguggcugguccucau

SEQ ID NO: 1748251 - RNA, 14 nt, Homo sapiens
uaggaaaagggaua

SEQ ID NO: 1748252 - RNA, 16 nt, Homo sapiens
agauuggcugggcaaa

SEQ ID NO: 1748253 - RNA, 19 nt, Homo sapiens
agcacaaccuuuuccucac

SEQ ID NO: 1748254 - RNA, 20 nt, Homo sapiens
uugccauagcugacuacaaa

SEQ ID NO: 1748255 - RNA, 15 nt, Homo sapiens
gguugggcuauagca

SEQ ID NO: 1748256 - RNA, 21 nt, Homo sapiens
gacaucagggaguaagugaca

SEQ ID NO: 1748257 - RNA, 23 nt, Homo sapiens
aucuuccguggucagagugccac

SEQ ID NO: 1748258 - RNA, 21 nt, Homo sapiens
cagauguaaaugccacaaaga

SEQ ID NO: 1748259 - RNA, 17 nt, Homo sapiens
ucacgcuuauugcccag

SEQ ID NO: 1748260 - RNA, 18 nt, Homo sapiens
aacucucuuauugccuca

SEQ ID NO: 1748261 - RNA, 18 nt, Homo sapiens
auugcuucagcugcugaa

SEQ ID NO: 1748262 - RNA, 18 nt, Homo sapiens
ucuaccaccgcauccuca

SEQ ID NO: 1748263 - RNA, 15 nt, Homo sapiens
accugcacaaccugg

SEQ ID NO: 1748264 - RNA, 22 nt, Homo sapiens
aagauaaucucucagcuuuuaa

SEQ ID NO: 1748265 - RNA, 23 nt, Homo sapiens
agaagugaaacuauauguauuca

SEQ ID NO: 1748266 - RNA, 15 nt, Homo sapiens
gaaaaauguguaauu

SEQ ID NO: 1748267 - RNA, 11 nt, Homo sapiens
caaaugaaaua

SEQ ID NO: 1748268 - RNA, 16 nt, Homo sapiens
uugagacagucucacu

SEQ ID NO: 1748269 - RNA, 16 nt, Homo sapiens
gucccauaauugagaa

SEQ ID NO: 1748270 - RNA, 12 nt, Homo sapiens
cagaugcaauga

SEQ ID NO: 1748271 - RNA, 17 nt, Homo sapiens
gggcauccauaccagcu

SEQ ID NO: 1748272 - RNA, 19 nt, Homo sapiens
ggauguaguuuaguuacua

SEQ ID NO: 1748273 - RNA, 23 nt, Homo sapiens
cauaaagcugggaggccaaacac

SEQ ID NO: 1748274 - RNA, 16 nt, Homo sapiens
aucaacugaauugcaa

SEQ ID NO: 1748275 - RNA, 21 nt, Homo sapiens
acacaccccuccggacaucca

SEQ ID NO: 1748276 - RNA, 14 nt, Homo sapiens
augucuuuaaaaug

SEQ ID NO: 1748277 - RNA, 16 nt, Homo sapiens
uuuaaucaaguugaau

SEQ ID NO: 1748278 - RNA, 14 nt, Homo sapiens
ggucagccacuguu

SEQ ID NO: 1748279 - RNA, 17 nt, Homo sapiens
aaauugagacauuuaca

SEQ ID NO: 1748280 - RNA, 21 nt, Homo sapiens
aaagagcuccuguaagaggga

SEQ ID NO: 1748281 - RNA, 13 nt, Homo sapiens
aaauguaacuuga

SEQ ID NO: 1748282 - RNA, 21 nt, Homo sapiens
auuuuauagaaaaugcauuau

SEQ ID NO: 1748283 - RNA, 16 nt, Homo sapiens
cccuccuggucuguau

SEQ ID NO: 1748284 - RNA, 13 nt, Homo sapiens
uacuaugcauugu

SEQ ID NO: 1748285 - RNA, 17 nt, Homo sapiens
uguauuuuauuacaucu

SEQ ID NO: 1748286 - RNA, 21 nt, Homo sapiens
ccuuugccuuagcagggguga

SEQ ID NO: 1748287 - RNA, 14 nt, Homo sapiens
ucuagccuuagaca

SEQ ID NO: 1748288 - RNA, 13 nt, Homo sapiens
ucuccaggcuuca

SEQ ID NO: 1748289 - RNA, 12 nt, Homo sapiens
ucuguacuucau

SEQ ID NO: 1748290 - RNA, 15 nt, Homo sapiens
accucccccaggugc

SEQ ID NO: 1748291 - RNA, 16 nt, Homo sapiens
gcucugggguccucac

SEQ ID NO: 1748292 - RNA, 16 nt, Homo sapiens
aaauauuuugauauaa

SEQ ID NO: 1748293 - RNA, 23 nt, Homo sapiens
auggacaugugucccagccacag

SEQ ID NO: 1748294 - RNA, 22 nt, Homo sapiens
ugucaucaaaaucugcacaguc

SEQ ID NO: 1748295 - RNA, 17 nt, Homo sapiens
acggaaacaacguugcu

SEQ ID NO: 1748296 - RNA, 13 nt, Homo sapiens
cagagcagcucac

SEQ ID NO: 1748297 - RNA, 19 nt, Homo sapiens
cugugucugccugucccca

SEQ ID NO: 1748298 - RNA, 18 nt, Homo sapiens
uaaacguguuugugguca

SEQ ID NO: 1748299 - RNA, 19 nt, Homo sapiens
ucagugaagucuagaauca

SEQ ID NO: 1748300 - RNA, 19 nt, Homo sapiens
ggcucugacagaaagcaga

SEQ ID NO: 1748301 - RNA, 19 nt, Homo sapiens
gacuucauuuaacacugag

SEQ ID NO: 1748302 - RNA, 17 nt, Homo sapiens
auaguucccaggugaua

SEQ ID NO: 1748303 - RNA, 17 nt, Homo sapiens
cccaaucugaaauucaa

SEQ ID NO: 1748304 - RNA, 21 nt, Homo sapiens
ucaauccugggcaaucagaca

SEQ ID NO: 1748305 - RNA, 17 nt, Homo sapiens
ccaucccuuuuuuuaca

SEQ ID NO: 1748306 - RNA, 21 nt, Homo sapiens
caucaaagacucagguuaaaa

SEQ ID NO: 1748307 - RNA, 18 nt, Homo sapiens
cuuccgcucccaccagcc

SEQ ID NO: 1748308 - RNA, 14 nt, Homo sapiens
cuuugccugucaag

SEQ ID NO: 1748309 - RNA, 21 nt, Homo sapiens
cauaugacaauguugcauuua

SEQ ID NO: 1748310 - RNA, 20 nt, Homo sapiens
cagcacuaacacaugcacac

SEQ ID NO: 1748311 - RNA, 19 nt, Homo sapiens
agcuuaaaaucugauuuac

SEQ ID NO: 1748312 - RNA, 20 nt, Homo sapiens
uuucugugauaacucugcaa

SEQ ID NO: 1748313 - RNA, 22 nt, Homo sapiens
uuaguuuuuguucuuaauugca

SEQ ID NO: 1748314 - RNA, 23 nt, Homo sapiens
ggcccuuuuuuuuuuuucuuugc

SEQ ID NO: 1748315 - RNA, 20 nt, Homo sapiens
uccuacuggucucucuaugc

SEQ ID NO: 1748316 - RNA, 21 nt, Homo sapiens
gcgaggucagaggagggcaug

SEQ ID NO: 1748317 - RNA, 13 nt, Homo sapiens
aauuugcacugaa

SEQ ID NO: 1748318 - RNA, 17 nt, Homo sapiens
aagcguuaugugcagua

SEQ ID NO: 1748319 - RNA, 21 nt, Homo sapiens
aucaucaccacaccgugagca

SEQ ID NO: 1748320 - RNA, 20 nt, Homo sapiens
cucugagugaauacuuugau

SEQ ID NO: 1748321 - RNA, 23 nt, Homo sapiens
ggaagaucuugagagcugcugag

SEQ ID NO: 1748322 - RNA, 18 nt, Homo sapiens
cuacauuauggaaucaug

SEQ ID NO: 1748323 - RNA, 23 nt, Homo sapiens
ucagcuucuaaucccagcacuuu

SEQ ID NO: 1748324 - RNA, 14 nt, Homo sapiens
uaacagacacugua

SEQ ID NO: 1748325 - RNA, 22 nt, Homo sapiens
agggguccgcugccccaugugu

SEQ ID NO: 1748326 - RNA, 21 nt, Homo sapiens
cccacacagaucuguaauuca

SEQ ID NO: 1748327 - RNA, 18 nt, Homo sapiens
uggcauuuucuguuccag

SEQ ID NO: 1748328 - RNA, 16 nt, Homo sapiens
uuucacuuugcucuca

SEQ ID NO: 1748329 - RNA, 16 nt, Homo sapiens
gcucucauggggucca

SEQ ID NO: 1748330 - RNA, 22 nt, Homo sapiens
accucuguuaccacgacuucua

SEQ ID NO: 1748331 - RNA, 15 nt, Homo sapiens
auuuuccccaaccuc

SEQ ID NO: 1748332 - RNA, 15 nt, Homo sapiens
aaauaagauuccaga

SEQ ID NO: 1748333 - RNA, 20 nt, Homo sapiens
caugcugcccagccacucca

SEQ ID NO: 1748334 - RNA, 17 nt, Homo sapiens
guuuccugcugcuuugu

SEQ ID NO: 1748335 - RNA, 16 nt, Homo sapiens
uacagugaugccauga

SEQ ID NO: 1748336 - RNA, 19 nt, Homo sapiens
cugaagccaccucucugcc

SEQ ID NO: 1748337 - RNA, 22 nt, Homo sapiens
guaucagaucuaucuugucaau

SEQ ID NO: 1748338 - RNA, 18 nt, Homo sapiens
gaaggaggggaaccagau

SEQ ID NO: 1748339 - RNA, 16 nt, Homo sapiens
aguuugacacuugaaa

SEQ ID NO: 1748340 - RNA, 21 nt, Homo sapiens
guucuuauauaagaucacuga

SEQ ID NO: 1748341 - RNA, 15 nt, Homo sapiens
guuuuuaagcuguuu

SEQ ID NO: 1748342 - RNA, 20 nt, Homo sapiens
augaucacggcucacugcag

SEQ ID NO: 1748343 - RNA, 22 nt, Homo sapiens
uaguugcuucuuuccuuuccau

SEQ ID NO: 1748344 - RNA, 14 nt, Homo sapiens
uucagaccuuuuaa

SEQ ID NO: 1748345 - RNA, 18 nt, Homo sapiens
gcuuuaguaauguggauu

SEQ ID NO: 1748346 - RNA, 22 nt, Homo sapiens
gaccagcagcugaugccuccuu

SEQ ID NO: 1748347 - RNA, 16 nt, Homo sapiens
ccuccuucaauuccau

SEQ ID NO: 1748348 - RNA, 18 nt, Homo sapiens
gcagggcacugugccuga

SEQ ID NO: 1748349 - RNA, 20 nt, Homo sapiens
ccagcagccugccagcaguu

SEQ ID NO: 1748350 - RNA, 15 nt, Homo sapiens
accauucaacccagc

SEQ ID NO: 1748351 - RNA, 22 nt, Homo sapiens
cagggacacacagccuagcaca

SEQ ID NO: 1748352 - RNA, 17 nt, Homo sapiens
auacugggaaucaagac

SEQ ID NO: 1748353 - RNA, 20 nt, Homo sapiens
agccuaaaagugggcuugau

SEQ ID NO: 1748354 - RNA, 20 nt, Homo sapiens
gugcaguggcccccacagaa

SEQ ID NO: 1748355 - RNA, 20 nt, Homo sapiens
ugaaguuaagaaccugaaua

SEQ ID NO: 1748356 - RNA, 23 nt, Homo sapiens
cuagaguauggagagauggucag

SEQ ID NO: 1748357 - RNA, 18 nt, Homo sapiens
cuauugcuggcaaagaca

SEQ ID NO: 1748358 - RNA, 14 nt, Homo sapiens
guuuucuaccuccu

SEQ ID NO: 1748359 - RNA, 21 nt, Homo sapiens
ugccucccaggccaccucagu

SEQ ID NO: 1748360 - RNA, 13 nt, Homo sapiens
acauucacuucca

SEQ ID NO: 1748361 - RNA, 19 nt, Homo sapiens
acccugaaggggccaugau

SEQ ID NO: 1748362 - RNA, 13 nt, Homo sapiens
acacaaagacaug

SEQ ID NO: 1748363 - RNA, 13 nt, Homo sapiens
ccaugaagccaca

SEQ ID NO: 1748364 - RNA, 13 nt, Homo sapiens
cacugaagcacca

SEQ ID NO: 1748365 - RNA, 11 nt, Homo sapiens
cacaccugugg

SEQ ID NO: 1748366 - RNA, 20 nt, Homo sapiens
uauuuuuugacacuuccauu

SEQ ID NO: 1748367 - RNA, 15 nt, Homo sapiens
ccaagucuuccugac

SEQ ID NO: 1748368 - RNA, 18 nt, Homo sapiens
auuagccgggcauggugg

SEQ ID NO: 1748369 - RNA, 16 nt, Homo sapiens
acaagucuggcacuuc

SEQ ID NO: 1748370 - RNA, 16 nt, Homo sapiens
uacauauauaccacau

SEQ ID NO: 1748371 - RNA, 18 nt, Homo sapiens
cccgagcccucacacccu

SEQ ID NO: 1748372 - RNA, 17 nt, Homo sapiens
gaaauagugucugauga

SEQ ID NO: 1748373 - RNA, 22 nt, Homo sapiens
caagugauucucaugccucagc

SEQ ID NO: 1748374 - RNA, 18 nt, Homo sapiens
cucccuggccuaggcagu

SEQ ID NO: 1748375 - RNA, 18 nt, Homo sapiens
ugcgcaaugagacuacaa

SEQ ID NO: 1748376 - RNA, 15 nt, Homo sapiens
ggacuuccauuugcu

SEQ ID NO: 1748377 - RNA, 21 nt, Homo sapiens
ccaguuuaaccugaugcaguc

SEQ ID NO: 1748378 - RNA, 22 nt, Homo sapiens
ccgguacccuccucccgacuga

SEQ ID NO: 1748379 - RNA, 18 nt, Homo sapiens
aggcagcuguugcaguga

SEQ ID NO: 1748380 - RNA, 12 nt, Homo sapiens
agaaggggacag

SEQ ID NO: 1748381 - RNA, 17 nt, Homo sapiens
agcuaauuaacuaacuc

SEQ ID NO: 1748382 - RNA, 18 nt, Homo sapiens
uccccgccugcagucuuc

SEQ ID NO: 1748383 - RNA, 21 nt, Homo sapiens
uguccccaaaaugugaugcuu

SEQ ID NO: 1748384 - RNA, 18 nt, Homo sapiens
auaccaacugaagucaau

SEQ ID NO: 1748385 - RNA, 14 nt, Homo sapiens
ucaauagugcaacu

SEQ ID NO: 1748386 - RNA, 23 nt, Homo sapiens
uccaaagaguagaauugcauuga

SEQ ID NO: 1748387 - RNA, 22 nt, Homo sapiens
gcagguaggggcacagugaaug

SEQ ID NO: 1748388 - RNA, 19 nt, Homo sapiens
ucuucuaucuacgcccuuc

SEQ ID NO: 1748389 - RNA, 19 nt, Homo sapiens
agggcgugaggucuugcag

SEQ ID NO: 1748390 - RNA, 15 nt, Homo sapiens
uggggcaccaugaga

SEQ ID NO: 1748391 - RNA, 23 nt, Homo sapiens
ucccagcuagaauucacuccacu

SEQ ID NO: 1748392 - RNA, 16 nt, Homo sapiens
cuagucuugaucuguu

SEQ ID NO: 1748393 - RNA, 23 nt, Homo sapiens
gagaagcagacguccauagcucc

SEQ ID NO: 1748394 - RNA, 15 nt, Homo sapiens
uuaacuuacgaucuc

SEQ ID NO: 1748395 - RNA, 20 nt, Homo sapiens
aaagggagaauaaaauuccu

SEQ ID NO: 1748396 - RNA, 22 nt, Homo sapiens
uuuuaucacuucauucacauuc

SEQ ID NO: 1748397 - RNA, 17 nt, Homo sapiens
aaggcacgggagcugcc

SEQ ID NO: 1748398 - RNA, 16 nt, Homo sapiens
ugauaccacgaggaaa

SEQ ID NO: 1748399 - RNA, 12 nt, Homo sapiens
uacccucugaga

SEQ ID NO: 1748400 - RNA, 23 nt, Homo sapiens
uaaaucauuaagacaacugaguu

SEQ ID NO: 1748401 - RNA, 15 nt, Homo sapiens
uguuuaaaguggcaa

SEQ ID NO: 1748402 - RNA, 13 nt, Homo sapiens
acaaauacuacag

SEQ ID NO: 1748403 - RNA, 18 nt, Homo sapiens
ucuguucugcacacagca

SEQ ID NO: 1748404 - RNA, 14 nt, Homo sapiens
uaaaaccaagugcu

SEQ ID NO: 1748405 - RNA, 14 nt, Homo sapiens
cccuuucuuugcaa

SEQ ID NO: 1748406 - RNA, 17 nt, Homo sapiens
uguggagacuucaucaa

SEQ ID NO: 1748407 - RNA, 15 nt, Homo sapiens
aauucaaacauauuc

SEQ ID NO: 1748408 - RNA, 21 nt, Homo sapiens
uucuagcuuuguuguccuccc

SEQ ID NO: 1748409 - RNA, 15 nt, Homo sapiens
gaaacauuugccaaa

SEQ ID NO: 1748410 - RNA, 23 nt, Homo sapiens
cugcacucuuauuucacuaaaga

SEQ ID NO: 1748411 - RNA, 14 nt, Homo sapiens
agacaaaaaccaag

SEQ ID NO: 1748412 - RNA, 14 nt, Homo sapiens
uugguccaaaauaa

SEQ ID NO: 1748413 - RNA, 20 nt, Homo sapiens
aggccacccagggaccacgg

SEQ ID NO: 1748414 - RNA, 11 nt, Homo sapiens
uugcuuuucag

SEQ ID NO: 1748415 - RNA, 16 nt, Homo sapiens
agauacacgucacaaa

SEQ ID NO: 1748416 - RNA, 22 nt, Homo sapiens
uucuucaagaaugguguuugca

SEQ ID NO: 1748417 - RNA, 21 nt, Homo sapiens
aagauuuuuuaaauugucaua

SEQ ID NO: 1748418 - RNA, 18 nt, Homo sapiens
cagaaauuuaauucaugu

SEQ ID NO: 1748419 - RNA, 20 nt, Homo sapiens
ucuuccacccacaaacucca

SEQ ID NO: 1748420 - RNA, 22 nt, Homo sapiens
agucugccugccucggggacac

SEQ ID NO: 1748421 - RNA, 20 nt, Homo sapiens
uaaccugccaacauacuuua

SEQ ID NO: 1748422 - RNA, 13 nt, Homo sapiens
agcacauaauccc

SEQ ID NO: 1748423 - RNA, 13 nt, Homo sapiens
auuauauaagucu

SEQ ID NO: 1748424 - RNA, 15 nt, Homo sapiens
aucagcauugucucg

SEQ ID NO: 1748425 - RNA, 12 nt, Homo sapiens
gauagauguuug

SEQ ID NO: 1748426 - RNA, 14 nt, Homo sapiens
auacuguucacuca

SEQ ID NO: 1748427 - RNA, 15 nt, Homo sapiens
uccuuucauuuacug

SEQ ID NO: 1748428 - RNA, 16 nt, Homo sapiens
aauccgagcacuuugg

SEQ ID NO: 1748429 - RNA, 16 nt, Homo sapiens
gugagacuguacauaa

SEQ ID NO: 1748430 - RNA, 19 nt, Homo sapiens
auuaagacuuuauguaguu

SEQ ID NO: 1748431 - RNA, 21 nt, Homo sapiens
gaagccacagagucucucccu

SEQ ID NO: 1748432 - RNA, 18 nt, Homo sapiens
uaaaugggaaaugucgau

SEQ ID NO: 1748433 - RNA, 12 nt, Homo sapiens
acccaacuccac

SEQ ID NO: 1748434 - RNA, 21 nt, Homo sapiens
ccuuugagcccacaaagccuu

SEQ ID NO: 1748435 - RNA, 13 nt, Homo sapiens
auaaguaaauaca

SEQ ID NO: 1748436 - RNA, 17 nt, Homo sapiens
gaagccagcuuuccuca

SEQ ID NO: 1748437 - RNA, 21 nt, Homo sapiens
aacuggaaaacagaacacuua

SEQ ID NO: 1748438 - RNA, 18 nt, Homo sapiens
uaguagauuuuaaagaca

SEQ ID NO: 1748439 - RNA, 21 nt, Homo sapiens
ucuauagagaaaaacuuucau

SEQ ID NO: 1748440 - RNA, 19 nt, Homo sapiens
ccauugaccucagcugcac

SEQ ID NO: 1748441 - RNA, 21 nt, Homo sapiens
accagccuguccaacauggug

SEQ ID NO: 1748442 - RNA, 18 nt, Homo sapiens
auaugcuaauauauguau

SEQ ID NO: 1748443 - RNA, 16 nt, Homo sapiens
auggcucuacuuucag

SEQ ID NO: 1748444 - RNA, 17 nt, Homo sapiens
gggaaauacaaggaaua

SEQ ID NO: 1748445 - RNA, 12 nt, Homo sapiens
gugggcccagca

SEQ ID NO: 1748446 - RNA, 15 nt, Homo sapiens
cuugugaaaaugugu

SEQ ID NO: 1748447 - RNA, 20 nt, Homo sapiens
cuauaaaaagaaguguuccu

SEQ ID NO: 1748448 - RNA, 17 nt, Homo sapiens
uaaauaugauuacuuua

SEQ ID NO: 1748449 - RNA, 15 nt, Homo sapiens
aggugcuuggaguuu

SEQ ID NO: 1748450 - RNA, 15 nt, Homo sapiens
aauuuuccugugaca

SEQ ID NO: 1748451 - RNA, 19 nt, Homo sapiens
agagggaagccaggauugg

SEQ ID NO: 1748452 - RNA, 12 nt, Homo sapiens
auacuucagguu

SEQ ID NO: 1748453 - RNA, 18 nt, Homo sapiens
cagucaaggauggaugca

SEQ ID NO: 1748454 - RNA, 19 nt, Homo sapiens
cagauggggcacugaccca

SEQ ID NO: 1748455 - RNA, 16 nt, Homo sapiens
accuuggaccucagug

SEQ ID NO: 1748456 - RNA, 17 nt, Homo sapiens
aggaaagcacacaguca

SEQ ID NO: 1748457 - RNA, 21 nt, Homo sapiens
ccugucuuggggccacuuuca

SEQ ID NO: 1748458 - RNA, 23 nt, Homo sapiens
guaguucaagaaaugaagagcug

SEQ ID NO: 1748459 - RNA, 16 nt, Homo sapiens
cccacugacuguaugg

SEQ ID NO: 1748460 - RNA, 12 nt, Homo sapiens
cagcaacugaag

SEQ ID NO: 1748461 - RNA, 11 nt, Homo sapiens
ugagauaacca

SEQ ID NO: 1748462 - RNA, 18 nt, Homo sapiens
acagaaguaucaagccau

SEQ ID NO: 1748463 - RNA, 22 nt, Homo sapiens
auacuucauuaauuucaaucaa

SEQ ID NO: 1748464 - RNA, 24 nt, Homo sapiens
aagauacaugucuuucuccaggga

SEQ ID NO: 1748465 - RNA, 22 nt, Homo sapiens
gcugaccccaggaagugggaga

SEQ ID NO: 1748466 - RNA, 17 nt, Homo sapiens
uacaugcauugagcucu

SEQ ID NO: 1748467 - RNA, 16 nt, Homo sapiens
cccugaaacacugcuu

SEQ ID NO: 1748468 - RNA, 16 nt, Homo sapiens
acaagaaaaaaagcuu

SEQ ID NO: 1748469 - RNA, 17 nt, Homo sapiens
ucagaaguucaaggcca

SEQ ID NO: 1748470 - RNA, 16 nt, Homo sapiens
acuaacaggccaaaga

SEQ ID NO: 1748471 - RNA, 15 nt, Homo sapiens
agccuuccacccagg

SEQ ID NO: 1748472 - RNA, 16 nt, Homo sapiens
cucuugaguuccucug

SEQ ID NO: 1748473 - RNA, 16 nt, Homo sapiens
ccaacaaacaaugcca

SEQ ID NO: 1748474 - RNA, 18 nt, Homo sapiens
auaagaagacccuauuuc

SEQ ID NO: 1748475 - RNA, 14 nt, Homo sapiens
gacugucuuucaga

SEQ ID NO: 1748476 - RNA, 17 nt, Homo sapiens
gcaagcaaucaaauaau

SEQ ID NO: 1748477 - RNA, 14 nt, Homo sapiens
auugucaccaugau

SEQ ID NO: 1748478 - RNA, 23 nt, Homo sapiens
cuccugugucuuaaauacuuuaa

SEQ ID NO: 1748479 - RNA, 14 nt, Homo sapiens
aauaaacugcaaau

SEQ ID NO: 1748480 - RNA, 23 nt, Homo sapiens
uacauugaucuuuugcuaaugca

SEQ ID NO: 1748481 - RNA, 14 nt, Homo sapiens
agugugaagaccca

SEQ ID NO: 1748482 - RNA, 13 nt, Homo sapiens
gauuugccucuua

SEQ ID NO: 1748483 - RNA, 20 nt, Homo sapiens
uagccaacuucaagaauuaa

SEQ ID NO: 1748484 - RNA, 22 nt, Homo sapiens
uauuaucuuaaacccacauaaa

SEQ ID NO: 1748485 - RNA, 20 nt, Homo sapiens
uuuuaauccuuaacacauuc

SEQ ID NO: 1748486 - RNA, 17 nt, Homo sapiens
cuucuguugaucucagu

SEQ ID NO: 1748487 - RNA, 16 nt, Homo sapiens
gauuaaggugauguga

SEQ ID NO: 1748488 - RNA, 20 nt, Homo sapiens
acagggugucguucugucgc

SEQ ID NO: 1748489 - RNA, 21 nt, Homo sapiens
cacagcggaggagaccagcuc

SEQ ID NO: 1748490 - RNA, 13 nt, Homo sapiens
agcccccagcugg

SEQ ID NO: 1748491 - RNA, 21 nt, Homo sapiens
ccuaaaaguuacuuaccacag

SEQ ID NO: 1748492 - RNA, 17 nt, Homo sapiens
gauuuaaagcacaugcc

SEQ ID NO: 1748493 - RNA, 15 nt, Homo sapiens
cauucuauagccaua

SEQ ID NO: 1748494 - RNA, 17 nt, Homo sapiens
gaauuauuacacuguaa

SEQ ID NO: 1748495 - RNA, 15 nt, Homo sapiens
cuuaaguaucagaaa

SEQ ID NO: 1748496 - RNA, 20 nt, Homo sapiens
guacucaguaacacagugca

SEQ ID NO: 1748497 - RNA, 20 nt, Homo sapiens
cugugcauacuuucccucau

SEQ ID NO: 1748498 - RNA, 12 nt, Homo sapiens
caaaggugugcu

SEQ ID NO: 1748499 - RNA, 23 nt, Homo sapiens
auguuaguuuuucuuacuugcau

SEQ ID NO: 1748500 - RNA, 23 nt, Homo sapiens
uaaagaaggugauaaaugucagu

SEQ ID NO: 1748501 - RNA, 19 nt, Homo sapiens
auggcaucauccauucucu

SEQ ID NO: 1748502 - RNA, 17 nt, Homo sapiens
gaaaggggauggaguga

SEQ ID NO: 1748503 - RNA, 17 nt, Homo sapiens
ugcagacggaugcccau

SEQ ID NO: 1748504 - RNA, 14 nt, Homo sapiens
uuauacagcagaga

SEQ ID NO: 1748505 - RNA, 17 nt, Homo sapiens
ugguuuuccaugaccuu

SEQ ID NO: 1748506 - RNA, 18 nt, Homo sapiens
auaacuuccauuuuauua

SEQ ID NO: 1748507 - RNA, 14 nt, Homo sapiens
guccccuccaggaa

SEQ ID NO: 1748508 - RNA, 17 nt, Homo sapiens
cuugcacgcccaugugu

SEQ ID NO: 1748509 - RNA, 14 nt, Homo sapiens
ugcacaagcacuau

SEQ ID NO: 1748510 - RNA, 23 nt, Homo sapiens
ucuugaaaaaugcccauuugccu

SEQ ID NO: 1748511 - RNA, 17 nt, Homo sapiens
ccauccauuaccuccau

SEQ ID NO: 1748512 - RNA, 14 nt, Homo sapiens
aggaucagaaagua

SEQ ID NO: 1748513 - RNA, 16 nt, Homo sapiens
cccugagcuggccuca

SEQ ID NO: 1748514 - RNA, 13 nt, Homo sapiens
uuucugccucaca

SEQ ID NO: 1748515 - RNA, 20 nt, Homo sapiens
ugacaguaaaucucacaaau

SEQ ID NO: 1748516 - RNA, 19 nt, Homo sapiens
ugggggcaauugacuuccu

SEQ ID NO: 1748517 - RNA, 13 nt, Homo sapiens
aagaaauacuuuc

SEQ ID NO: 1748518 - RNA, 12 nt, Homo sapiens
cucaucugcaaa

SEQ ID NO: 1748519 - RNA, 15 nt, Homo sapiens
guaugugccaaagcu

SEQ ID NO: 1748520 - RNA, 22 nt, Homo sapiens
uacacacacacacacagccaca

SEQ ID NO: 1748521 - RNA, 18 nt, Homo sapiens
aagcucagagcagccucu

SEQ ID NO: 1748522 - RNA, 15 nt, Homo sapiens
gcaaucauggugcuc

SEQ ID NO: 1748523 - RNA, 21 nt, Homo sapiens
ccagcucggcgagcuccucca

SEQ ID NO: 1748524 - RNA, 22 nt, Homo sapiens
aaguaguuagccaauaugcaau

SEQ ID NO: 1748525 - RNA, 17 nt, Homo sapiens
cagggcaccuacugaga

SEQ ID NO: 1748526 - RNA, 21 nt, Homo sapiens
acauugaagguauaugccaaa

SEQ ID NO: 1748527 - RNA, 20 nt, Homo sapiens
auuuucagucaaaacuuuaa

SEQ ID NO: 1748528 - RNA, 12 nt, Homo sapiens
cauuaacagugc

SEQ ID NO: 1748529 - RNA, 18 nt, Homo sapiens
aaucuuucuccacuguuc

SEQ ID NO: 1748530 - RNA, 16 nt, Homo sapiens
aagugaccgcaccuca

SEQ ID NO: 1748531 - RNA, 17 nt, Homo sapiens
aagauugcagcauuuau

SEQ ID NO: 1748532 - RNA, 21 nt, Homo sapiens
gcuccauccuugcaucacugg

SEQ ID NO: 1748533 - RNA, 13 nt, Homo sapiens
cacucacacuggc

SEQ ID NO: 1748534 - RNA, 14 nt, Homo sapiens
ccaaaaaaauccau

SEQ ID NO: 1748535 - RNA, 17 nt, Homo sapiens
acucgcaggaccaaggg

SEQ ID NO: 1748536 - RNA, 23 nt, Homo sapiens
auugaacuguaaauaugucacua

SEQ ID NO: 1748537 - RNA, 21 nt, Homo sapiens
gguugucaucacuaguggcaa

SEQ ID NO: 1748538 - RNA, 14 nt, Homo sapiens
gcucugcaggcacc

SEQ ID NO: 1748539 - RNA, 12 nt, Homo sapiens
aggauuaaugaa

SEQ ID NO: 1748540 - RNA, 13 nt, Homo sapiens
ugaacugcaguga

SEQ ID NO: 1748541 - RNA, 14 nt, Homo sapiens
guccauauuuacau

SEQ ID NO: 1748542 - RNA, 14 nt, Homo sapiens
uaaaaaaugacaaa

SEQ ID NO: 1748543 - RNA, 14 nt, Homo sapiens
gaggucuaaucuag

SEQ ID NO: 1748544 - RNA, 12 nt, Homo sapiens
auaacagcacug

SEQ ID NO: 1748545 - RNA, 13 nt, Homo sapiens
ucuuggauuggua

SEQ ID NO: 1748546 - RNA, 17 nt, Homo sapiens
aguuauuacucaagugg

SEQ ID NO: 1748547 - RNA, 14 nt, Homo sapiens
gaaaaaucaaguau

SEQ ID NO: 1748548 - RNA, 20 nt, Homo sapiens
ucagacuugcggccacagca

SEQ ID NO: 1748549 - RNA, 13 nt, Homo sapiens
cugagcucugaga

SEQ ID NO: 1748550 - RNA, 13 nt, Homo sapiens
cuaaacucugggg

SEQ ID NO: 1748551 - RNA, 20 nt, Homo sapiens
ucaacaaaaagacauggaag

SEQ ID NO: 1748552 - RNA, 16 nt, Homo sapiens
gucucccuguguuacc

SEQ ID NO: 1748553 - RNA, 22 nt, Homo sapiens
aaauuuuaguucuuacugcuua

SEQ ID NO: 1748554 - RNA, 18 nt, Homo sapiens
acccaagugcugcacaaa

SEQ ID NO: 1748555 - RNA, 22 nt, Homo sapiens
uugcaaauauugguuaguauuu

SEQ ID NO: 1748556 - RNA, 22 nt, Homo sapiens
gagggcagagagguuaacagau

SEQ ID NO: 1748557 - RNA, 21 nt, Homo sapiens
aggccugccucccacuucacu

SEQ ID NO: 1748558 - RNA, 18 nt, Homo sapiens
gauucuuuccauuaugau

SEQ ID NO: 1748559 - RNA, 22 nt, Homo sapiens
cuguugggaaaaccgauaaaga

SEQ ID NO: 1748560 - RNA, 15 nt, Homo sapiens
agagaagggacacau

SEQ ID NO: 1748561 - RNA, 19 nt, Homo sapiens
uccaauccuuaaacugcca

SEQ ID NO: 1748562 - RNA, 18 nt, Homo sapiens
ccacaccggguaagagcu

SEQ ID NO: 1748563 - RNA, 22 nt, Homo sapiens
aagaaacgucuauguguacaga

SEQ ID NO: 1748564 - RNA, 17 nt, Homo sapiens
uauaucuuuuuccauca

SEQ ID NO: 1748565 - RNA, 15 nt, Homo sapiens
ugucauagcuaugac

SEQ ID NO: 1748566 - RNA, 18 nt, Homo sapiens
uccuccacuccaccucca

SEQ ID NO: 1748567 - RNA, 23 nt, Homo sapiens
cuaagacauauucagacaucaac

SEQ ID NO: 1748568 - RNA, 17 nt, Homo sapiens
acaaauaacaucucacc

SEQ ID NO: 1748569 - RNA, 19 nt, Homo sapiens
cuguucuuccuaccaaaua

SEQ ID NO: 1748570 - RNA, 21 nt, Homo sapiens
ucucuuccgucuaaucucuca

SEQ ID NO: 1748571 - RNA, 19 nt, Homo sapiens
aaccauggugaagugcuug

SEQ ID NO: 1748572 - RNA, 21 nt, Homo sapiens
gcaucaucccuggauguggau

SEQ ID NO: 1748573 - RNA, 13 nt, Homo sapiens
uauguugaagccu

SEQ ID NO: 1748574 - RNA, 18 nt, Homo sapiens
cgauaaagggaaccacuu

SEQ ID NO: 1748575 - RNA, 18 nt, Homo sapiens
aguaccaaaugcuuuaaa

SEQ ID NO: 1748576 - RNA, 21 nt, Homo sapiens
aaugucuuuugaauauuccca

SEQ ID NO: 1748577 - RNA, 15 nt, Homo sapiens
acaaacacugccaua

SEQ ID NO: 1748578 - RNA, 16 nt, Homo sapiens
uuacuuacacaccuga

SEQ ID NO: 1748579 - RNA, 23 nt, Homo sapiens
ugacauuuaccagcaacuugaac

SEQ ID NO: 1748580 - RNA, 14 nt, Homo sapiens
gugugcaucaggcu

SEQ ID NO: 1748581 - RNA, 20 nt, Homo sapiens
gcauuuccuuucaguggcuu

SEQ ID NO: 1748582 - RNA, 11 nt, Homo sapiens
ccaaaauauca

SEQ ID NO: 1748583 - RNA, 23 nt, Homo sapiens
cgaucgauggaugggaugcacuc

SEQ ID NO: 1748584 - RNA, 15 nt, Homo sapiens
uaggaauucuuugca

SEQ ID NO: 1748585 - RNA, 16 nt, Homo sapiens
uaaauacuugcuccau

SEQ ID NO: 1748586 - RNA, 12 nt, Homo sapiens
gaagaguauuaa

SEQ ID NO: 1748587 - RNA, 19 nt, Homo sapiens
aaccagacccuguaugaca

SEQ ID NO: 1748588 - RNA, 20 nt, Homo sapiens
auggcuauaaacaauuacau

SEQ ID NO: 1748589 - RNA, 20 nt, Homo sapiens
uaaguaaucacuaaugcuca

SEQ ID NO: 1748590 - RNA, 19 nt, Homo sapiens
accacaggcccuuuccuca

SEQ ID NO: 1748591 - RNA, 22 nt, Homo sapiens
gagaggaaagaccuacauuccc

SEQ ID NO: 1748592 - RNA, 20 nt, Homo sapiens
auuuuugacagguugcugaa

SEQ ID NO: 1748593 - RNA, 20 nt, Homo sapiens
gcuguccccuccaucugggg

SEQ ID NO: 1748594 - RNA, 19 nt, Homo sapiens
guaaauuauauuugugcua

SEQ ID NO: 1748595 - RNA, 22 nt, Homo sapiens
ucaauuuauaacguucucaguc

SEQ ID NO: 1748596 - RNA, 20 nt, Homo sapiens
uggaaaccugcccugccuga

SEQ ID NO: 1748597 - RNA, 19 nt, Homo sapiens
ucugaaaauuaacacugcu

SEQ ID NO: 1748598 - RNA, 14 nt, Homo sapiens
gacuucacacagca

SEQ ID NO: 1748599 - RNA, 15 nt, Homo sapiens
uacuuacuuuuccaa

SEQ ID NO: 1748600 - RNA, 16 nt, Homo sapiens
aauggacucaucuuag

SEQ ID NO: 1748601 - RNA, 22 nt, Homo sapiens
cuuugacguggagcugcucaac

SEQ ID NO: 1748602 - RNA, 23 nt, Homo sapiens
cgugcaguaggggcuacugugac

SEQ ID NO: 1748603 - RNA, 19 nt, Homo sapiens
aaugccaaugucagcauca

SEQ ID NO: 1748604 - RNA, 14 nt, Homo sapiens
cuuaggcaaucaca

SEQ ID NO: 1748605 - RNA, 20 nt, Homo sapiens
uuccucucucuaccagucua

SEQ ID NO: 1748606 - RNA, 17 nt, Homo sapiens
uugaucuccugagcucg

SEQ ID NO: 1748607 - RNA, 23 nt, Homo sapiens
cguuuacaagcccccccuuccac

SEQ ID NO: 1748608 - RNA, 22 nt, Homo sapiens
ccccagucuacguucuccagcc

SEQ ID NO: 1748609 - RNA, 18 nt, Homo sapiens
uggggaccucaccugcug

SEQ ID NO: 1748610 - RNA, 13 nt, Homo sapiens
cugccucaccucu

SEQ ID NO: 1748611 - RNA, 14 nt, Homo sapiens
gccaaccuggaaug

SEQ ID NO: 1748612 - RNA, 23 nt, Homo sapiens
caguuccuccaagaggucuccau

SEQ ID NO: 1748613 - RNA, 13 nt, Homo sapiens
ugauggaaauauu

SEQ ID NO: 1748614 - RNA, 19 nt, Homo sapiens
augcuguuuuauauguaga

SEQ ID NO: 1748615 - RNA, 15 nt, Homo sapiens
gccacuggcugcuaa

SEQ ID NO: 1748616 - RNA, 15 nt, Homo sapiens
gaggucuguuucucu

SEQ ID NO: 1748617 - RNA, 21 nt, Homo sapiens
aagcaagacccuaaacaucca

SEQ ID NO: 1748618 - RNA, 17 nt, Homo sapiens
uucuguaugaacuuuau

SEQ ID NO: 1748619 - RNA, 23 nt, Homo sapiens
agcuucacauuugcguguaucua

SEQ ID NO: 1748620 - RNA, 19 nt, Homo sapiens
cuggcaguugaauggggcg

SEQ ID NO: 1748621 - RNA, 14 nt, Homo sapiens
gguuccgccacucc

SEQ ID NO: 1748622 - RNA, 20 nt, Homo sapiens
augaaagugcuucauugacu

SEQ ID NO: 1748623 - RNA, 21 nt, Homo sapiens
auauuuuuuaaaauaacuuca

SEQ ID NO: 1748624 - RNA, 14 nt, Homo sapiens
ccugcccacugcug

SEQ ID NO: 1748625 - RNA, 16 nt, Homo sapiens
cucugucuggauuugc

SEQ ID NO: 1748626 - RNA, 18 nt, Homo sapiens
accagaaaauuaauuuca

SEQ ID NO: 1748627 - RNA, 21 nt, Homo sapiens
ucauggaugagacuacuucag

SEQ ID NO: 1748628 - RNA, 12 nt, Homo sapiens
ucuucuuccuca

SEQ ID NO: 1748629 - RNA, 16 nt, Homo sapiens
uaaucugcugccauau

SEQ ID NO: 1748630 - RNA, 22 nt, Homo sapiens
ccccacagcuucucuacagacu

SEQ ID NO: 1748631 - RNA, 14 nt, Homo sapiens
uuuucaguaccaaa

SEQ ID NO: 1748632 - RNA, 14 nt, Homo sapiens
ucaugguacuguag

SEQ ID NO: 1748633 - RNA, 22 nt, Homo sapiens
ugcuuagaugagggugacuguc

SEQ ID NO: 1748634 - RNA, 19 nt, Homo sapiens
uuucuaaagcucugaacaa

SEQ ID NO: 1748635 - RNA, 21 nt, Homo sapiens
aguugaggggggggcauuagu

SEQ ID NO: 1748636 - RNA, 11 nt, Homo sapiens
gagcugugagu

SEQ ID NO: 1748637 - RNA, 11 nt, Homo sapiens
cggacuaugua

SEQ ID NO: 1748638 - RNA, 17 nt, Homo sapiens
ccugagccccucaaucc

SEQ ID NO: 1748639 - RNA, 22 nt, Homo sapiens
uguaugcggaauuccaccugga

SEQ ID NO: 1748640 - RNA, 16 nt, Homo sapiens
cauauuuaaugaugau

SEQ ID NO: 1748641 - RNA, 18 nt, Homo sapiens
auaaaguaguccugugaa

SEQ ID NO: 1748642 - RNA, 22 nt, Homo sapiens
uauuaauacugccggucaccca

SEQ ID NO: 1748643 - RNA, 22 nt, Homo sapiens
caugaucccuguguugucucua

SEQ ID NO: 1748644 - RNA, 19 nt, Homo sapiens
cuuucccuagaaagccaua

SEQ ID NO: 1748645 - RNA, 19 nt, Homo sapiens
uuauaaagugcuuguguaa

SEQ ID NO: 1748646 - RNA, 19 nt, Homo sapiens
ggagagcgaggccacgcac

SEQ ID NO: 1748647 - RNA, 15 nt, Homo sapiens
caaugcuaucacugu

SEQ ID NO: 1748648 - RNA, 23 nt, Homo sapiens
uaccggggcuccucuccuaacau

SEQ ID NO: 1748649 - RNA, 21 nt, Homo sapiens
uacuuuauauaaggcauucca

SEQ ID NO: 1748650 - RNA, 14 nt, Homo sapiens
gaguucaagaccag

SEQ ID NO: 1748651 - RNA, 21 nt, Homo sapiens
cagugagaguacucacuuuuc

SEQ ID NO: 1748652 - RNA, 13 nt, Homo sapiens
aucauuuuauaga

SEQ ID NO: 1748653 - RNA, 18 nt, Homo sapiens
auuauaaucucauuucaa

SEQ ID NO: 1748654 - RNA, 17 nt, Homo sapiens
gccucugggaucugcca

SEQ ID NO: 1748655 - RNA, 15 nt, Homo sapiens
agcauguugugaugu

SEQ ID NO: 1748656 - RNA, 19 nt, Homo sapiens
uguaccuaaguaaauuuuc

SEQ ID NO: 1748657 - RNA, 17 nt, Homo sapiens
cacucugaauccucaug

SEQ ID NO: 1748658 - RNA, 12 nt, Homo sapiens
ccauugcuuaaa

SEQ ID NO: 1748659 - RNA, 12 nt, Homo sapiens
cauaugcuucuu

SEQ ID NO: 1748660 - RNA, 13 nt, Homo sapiens
caaggaccaggau

SEQ ID NO: 1748661 - RNA, 21 nt, Homo sapiens
cuugucacgccagacuuccca

SEQ ID NO: 1748662 - RNA, 15 nt, Homo sapiens
cauaaugcacuuuag

SEQ ID NO: 1748663 - RNA, 17 nt, Homo sapiens
uucuaguuguaaugugu

SEQ ID NO: 1748664 - RNA, 22 nt, Homo sapiens
aaaagcaaaaggcauuucccac

SEQ ID NO: 1748665 - RNA, 13 nt, Homo sapiens
uguacaccaaggu

SEQ ID NO: 1748666 - RNA, 22 nt, Homo sapiens
cuuauuguccuucuaccuugaa

SEQ ID NO: 1748667 - RNA, 17 nt, Homo sapiens
ugaccaguugcacuugg

SEQ ID NO: 1748668 - RNA, 18 nt, Homo sapiens
cuggguggggucagggaa

SEQ ID NO: 1748669 - RNA, 15 nt, Homo sapiens
agaugggacugggag

SEQ ID NO: 1748670 - RNA, 24 nt, Homo sapiens
ggauccuccaggugcacaagcucc

SEQ ID NO: 1748671 - RNA, 20 nt, Homo sapiens
aacauaaauuguacuguuga

SEQ ID NO: 1748672 - RNA, 15 nt, Homo sapiens
ggguauuuuggucac

SEQ ID NO: 1748673 - RNA, 23 nt, Homo sapiens
uagucaagcgauugucugaggaa

SEQ ID NO: 1748674 - RNA, 19 nt, Homo sapiens
aaagaggagauuaaccucu

SEQ ID NO: 1748675 - RNA, 17 nt, Homo sapiens
uaaaaauacaacacuga

SEQ ID NO: 1748676 - RNA, 14 nt, Homo sapiens
uugguagcacuuua

SEQ ID NO: 1748677 - RNA, 15 nt, Homo sapiens
auguguguaaauucu

SEQ ID NO: 1748678 - RNA, 16 nt, Homo sapiens
uguacagcaguucaca

SEQ ID NO: 1748679 - RNA, 17 nt, Homo sapiens
cucuugcugaaagccaa

SEQ ID NO: 1748680 - RNA, 21 nt, Homo sapiens
auguuuaugaaggguaaggga

SEQ ID NO: 1748681 - RNA, 14 nt, Homo sapiens
gaggccucagggag

SEQ ID NO: 1748682 - RNA, 17 nt, Homo sapiens
ugacaguugaacagagc

SEQ ID NO: 1748683 - RNA, 20 nt, Homo sapiens
uuaccccacaacgugcaacu

SEQ ID NO: 1748684 - RNA, 14 nt, Homo sapiens
cccugggccagggu

SEQ ID NO: 1748685 - RNA, 22 nt, Homo sapiens
aacacuuauguuauacaauaca

SEQ ID NO: 1748686 - RNA, 21 nt, Homo sapiens
uggccgcuuggugagugucug

SEQ ID NO: 1748687 - RNA, 20 nt, Homo sapiens
auuuuaccuaguuugcacua

SEQ ID NO: 1748688 - RNA, 18 nt, Homo sapiens
uggccaaccaaagacacu

SEQ ID NO: 1748689 - RNA, 18 nt, Homo sapiens
cuaguggguuagugugaa

SEQ ID NO: 1748690 - RNA, 14 nt, Homo sapiens
cguacucucacaug

SEQ ID NO: 1748691 - RNA, 23 nt, Homo sapiens
aaugggcacugauuugauaccau

SEQ ID NO: 1748692 - RNA, 16 nt, Homo sapiens
uaaaauaagaauugaa

SEQ ID NO: 1748693 - RNA, 16 nt, Homo sapiens
ggcaagaaugcuuuaa

SEQ ID NO: 1748694 - RNA, 23 nt, Homo sapiens
ucccaccugcagagccagugucc

SEQ ID NO: 1748695 - RNA, 19 nt, Homo sapiens
auguggguguccugcagaa

SEQ ID NO: 1748696 - RNA, 22 nt, Homo sapiens
uaaaauagaaacauuuguaugg

SEQ ID NO: 1748697 - RNA, 23 nt, Homo sapiens
auuucuuccuucaaauccugcca

SEQ ID NO: 1748698 - RNA, 17 nt, Homo sapiens
gcagccaggacaccggg

SEQ ID NO: 1748699 - RNA, 20 nt, Homo sapiens
auccucucuaugggccauau

SEQ ID NO: 1748700 - RNA, 23 nt, Homo sapiens
cugcaucuuuucuguugccccau

SEQ ID NO: 1748701 - RNA, 21 nt, Homo sapiens
cugcaugggaaaaauguugga

SEQ ID NO: 1748702 - RNA, 20 nt, Homo sapiens
auccauccucacugcuguca

SEQ ID NO: 1748703 - RNA, 18 nt, Homo sapiens
ugaguauuccaugagcug

SEQ ID NO: 1748704 - RNA, 15 nt, Homo sapiens
aauuuauaagcauuu

SEQ ID NO: 1748705 - RNA, 15 nt, Homo sapiens
uacuuuaauguauaa

SEQ ID NO: 1748706 - RNA, 17 nt, Homo sapiens
uuuagcaauguguuucu

SEQ ID NO: 1748707 - RNA, 13 nt, Homo sapiens
uuguuuguuucuu

SEQ ID NO: 1748708 - RNA, 12 nt, Homo sapiens
aucugucuuuca

SEQ ID NO: 1748709 - RNA, 16 nt, Homo sapiens
caccucccccuaccca

SEQ ID NO: 1748710 - RNA, 17 nt, Homo sapiens
auugacagcuuucuaac

SEQ ID NO: 1748711 - RNA, 23 nt, Homo sapiens
ugcuagugggcccucucucuggg

SEQ ID NO: 1748712 - RNA, 14 nt, Homo sapiens
aauauacaaucuau

SEQ ID NO: 1748713 - RNA, 14 nt, Homo sapiens
uauauacauucuau

SEQ ID NO: 1748714 - RNA, 13 nt, Homo sapiens
uuucucucagauu

SEQ ID NO: 1748715 - RNA, 14 nt, Homo sapiens
cagguggauguuua

SEQ ID NO: 1748716 - RNA, 17 nt, Homo sapiens
ugguuuucccaucucag

SEQ ID NO: 1748717 - RNA, 23 nt, Homo sapiens
aaccacuuugccucugaaacuua

SEQ ID NO: 1748718 - RNA, 19 nt, Homo sapiens
caaacugaacccccucaaa

SEQ ID NO: 1748719 - RNA, 19 nt, Homo sapiens
caggauaaaaggggaaaua

SEQ ID NO: 1748720 - RNA, 21 nt, Homo sapiens
ugaauggacucaaacugccuu

SEQ ID NO: 1748721 - RNA, 12 nt, Homo sapiens
uggcucacaggg

SEQ ID NO: 1748722 - RNA, 12 nt, Homo sapiens
agagucacugac

SEQ ID NO: 1748723 - RNA, 18 nt, Homo sapiens
guacaaguggcaaccugc

SEQ ID NO: 1748724 - RNA, 16 nt, Homo sapiens
uccccuucuugccauu

SEQ ID NO: 1748725 - RNA, 13 nt, Homo sapiens
agagaaucccagg

SEQ ID NO: 1748726 - RNA, 16 nt, Homo sapiens
uggguauuuguucaaa

SEQ ID NO: 1748727 - RNA, 22 nt, Homo sapiens
cauccaccaccuugccaauggu

SEQ ID NO: 1748728 - RNA, 15 nt, Homo sapiens
ugcagucaucuacuu

SEQ ID NO: 1748729 - RNA, 15 nt, Homo sapiens
gcaacaaacucaaaa

SEQ ID NO: 1748730 - RNA, 15 nt, Homo sapiens
ugcucuaagcccagg

SEQ ID NO: 1748731 - RNA, 16 nt, Homo sapiens
agaaugcuuuaauguc

SEQ ID NO: 1748732 - RNA, 12 nt, Homo sapiens
cugacagcaucc

SEQ ID NO: 1748733 - RNA, 11 nt, Homo sapiens
gagcucaccag

SEQ ID NO: 1748734 - RNA, 13 nt, Homo sapiens
uaauaggaugaau

SEQ ID NO: 1748735 - RNA, 22 nt, Homo sapiens
ccaugcucucuguggccuccau

SEQ ID NO: 1748736 - RNA, 21 nt, Homo sapiens
uagaauauauuuccuuauuca

SEQ ID NO: 1748737 - RNA, 18 nt, Homo sapiens
cauauuggaauguacaug

SEQ ID NO: 1748738 - RNA, 22 nt, Homo sapiens
auuugguuuguugagccuaaua

SEQ ID NO: 1748739 - RNA, 22 nt, Homo sapiens
uauucuccuauguuuggcugcu

SEQ ID NO: 1748740 - RNA, 19 nt, Homo sapiens
ucuucagccaccucccagg

SEQ ID NO: 1748741 - RNA, 13 nt, Homo sapiens
cuuguaaugcuca

SEQ ID NO: 1748742 - RNA, 23 nt, Homo sapiens
ugagaauguaaauaaaugugucu

SEQ ID NO: 1748743 - RNA, 18 nt, Homo sapiens
uugaguuuaaaaccuggg

SEQ ID NO: 1748744 - RNA, 14 nt, Homo sapiens
aauguuauuaccua

SEQ ID NO: 1748745 - RNA, 14 nt, Homo sapiens
aucaaaauccaaaa

SEQ ID NO: 1748746 - RNA, 21 nt, Homo sapiens
acaguucauggauauccacug

SEQ ID NO: 1748747 - RNA, 23 nt, Homo sapiens
aucccguaccucuucccaugacu

SEQ ID NO: 1748748 - RNA, 21 nt, Homo sapiens
aaagaaaaucaggcuggccaa

SEQ ID NO: 1748749 - RNA, 12 nt, Homo sapiens
gugucugugcau

SEQ ID NO: 1748750 - RNA, 21 nt, Homo sapiens
cugcagccccgcgccuccuuc

SEQ ID NO: 1748751 - RNA, 19 nt, Homo sapiens
ggcugacucuaggugcccu

SEQ ID NO: 1748752 - RNA, 15 nt, Homo sapiens
cggacgccaccugcg

SEQ ID NO: 1748753 - RNA, 17 nt, Homo sapiens
aaggagccccccaaaga

SEQ ID NO: 1748754 - RNA, 23 nt, Homo sapiens
ugccauguggaaggcaagccagg

SEQ ID NO: 1748755 - RNA, 15 nt, Homo sapiens
auacaugucuaucaa

SEQ ID NO: 1748756 - RNA, 17 nt, Homo sapiens
cucaccaacuacagaaa

SEQ ID NO: 1748757 - RNA, 16 nt, Homo sapiens
agcuggccuggaccau

SEQ ID NO: 1748758 - RNA, 23 nt, Homo sapiens
caauuucacgcuuuuaauucuca

SEQ ID NO: 1748759 - RNA, 14 nt, Homo sapiens
uuuccugugcaugg

SEQ ID NO: 1748760 - RNA, 20 nt, Homo sapiens
ucaaaguguaaacaccauag

SEQ ID NO: 1748761 - RNA, 13 nt, Homo sapiens
aaagcgccccggg

SEQ ID NO: 1748762 - RNA, 19 nt, Homo sapiens
caugguggcaugcaccugc

SEQ ID NO: 1748763 - RNA, 16 nt, Homo sapiens
caauguacaccagagc

SEQ ID NO: 1748764 - RNA, 20 nt, Homo sapiens
ucagaauggcaguccuggag

SEQ ID NO: 1748765 - RNA, 14 nt, Homo sapiens
gcacugaagcugcg

SEQ ID NO: 1748766 - RNA, 15 nt, Homo sapiens
uaucuucuccaggau

SEQ ID NO: 1748767 - RNA, 15 nt, Homo sapiens
cagacccccauucug

SEQ ID NO: 1748768 - RNA, 21 nt, Homo sapiens
ggcggugucaggucccagcga

SEQ ID NO: 1748769 - RNA, 22 nt, Homo sapiens
caaaugaggggagaaugcuaaa

SEQ ID NO: 1748770 - RNA, 15 nt, Homo sapiens
uuuugaaaccaugaa

SEQ ID NO: 1748771 - RNA, 21 nt, Homo sapiens
cuauguugccuaagcuggucu

SEQ ID NO: 1748772 - RNA, 19 nt, Homo sapiens
agacuuggggaaauugcuu

SEQ ID NO: 1748773 - RNA, 20 nt, Homo sapiens
uuaccaaaaucaucacauuu

SEQ ID NO: 1748774 - RNA, 11 nt, Homo sapiens
cucuguauacu

SEQ ID NO: 1748775 - RNA, 21 nt, Homo sapiens
cauuuuugaugacuaccucag

SEQ ID NO: 1748776 - RNA, 13 nt, Homo sapiens
caauacaguuuca

SEQ ID NO: 1748777 - RNA, 20 nt, Homo sapiens
agcugaaaagggcacuccca

SEQ ID NO: 1748778 - RNA, 12 nt, Homo sapiens
ggggcagccucc

SEQ ID NO: 1748779 - RNA, 23 nt, Homo sapiens
uaauccacaucuuuacucaggca

SEQ ID NO: 1748780 - RNA, 21 nt, Homo sapiens
uucucuguguuuguuccuaca

SEQ ID NO: 1748781 - RNA, 18 nt, Homo sapiens
uuugauacuaagcauuga

SEQ ID NO: 1748782 - RNA, 14 nt, Homo sapiens
aucauuaacugcca

SEQ ID NO: 1748783 - RNA, 13 nt, Homo sapiens
uguauccaugcac

SEQ ID NO: 1748784 - RNA, 18 nt, Homo sapiens
aaaagucagagacagaua

SEQ ID NO: 1748785 - RNA, 20 nt, Homo sapiens
auuuagguuuucucuguuuu

SEQ ID NO: 1748786 - RNA, 17 nt, Homo sapiens
ucuuucuuguuugucag

SEQ ID NO: 1748787 - RNA, 16 nt, Homo sapiens
uauuuuugaagacuau

SEQ ID NO: 1748788 - RNA, 14 nt, Homo sapiens
gauuugccaaaaac

SEQ ID NO: 1748789 - RNA, 23 nt, Homo sapiens
acaaugcgaggucgcaacugaga

SEQ ID NO: 1748790 - RNA, 15 nt, Homo sapiens
ccucaaauacaugca

SEQ ID NO: 1748791 - RNA, 18 nt, Homo sapiens
guggcuauuaaaacucuu

SEQ ID NO: 1748792 - RNA, 13 nt, Homo sapiens
cgagcagucagca

SEQ ID NO: 1748793 - RNA, 22 nt, Homo sapiens
cucuugagcaucaaucuuguua

SEQ ID NO: 1748794 - RNA, 14 nt, Homo sapiens
gagagggugacaag

SEQ ID NO: 1748795 - RNA, 18 nt, Homo sapiens
gacuuaugaaacuugaaa

SEQ ID NO: 1748796 - RNA, 19 nt, Homo sapiens
ccuuuauuccuucauuuca

SEQ ID NO: 1748797 - RNA, 15 nt, Homo sapiens
uguuccuagaaugca

SEQ ID NO: 1748798 - RNA, 20 nt, Homo sapiens
gauguaugcuguuuguacaa

SEQ ID NO: 1748799 - RNA, 14 nt, Homo sapiens
auggguucaugucu

SEQ ID NO: 1748800 - RNA, 19 nt, Homo sapiens
gaguaauucuagcuuucaa

SEQ ID NO: 1748801 - RNA, 19 nt, Homo sapiens
gaauauguguggcagugaa

SEQ ID NO: 1748802 - RNA, 20 nt, Homo sapiens
cacuucucaucauauuguau

SEQ ID NO: 1748803 - RNA, 20 nt, Homo sapiens
uacuagcaggcaaugcugua

SEQ ID NO: 1748804 - RNA, 20 nt, Homo sapiens
guucaguacucuacaauucc

SEQ ID NO: 1748805 - RNA, 22 nt, Homo sapiens
cggcagcugguucugcaaugac

SEQ ID NO: 1748806 - RNA, 15 nt, Homo sapiens
gaaugcagugacaca

SEQ ID NO: 1748807 - RNA, 21 nt, Homo sapiens
cacaacuugccaaaacagaua

SEQ ID NO: 1748808 - RNA, 20 nt, Homo sapiens
ugauuccaauuacuacuuug

SEQ ID NO: 1748809 - RNA, 20 nt, Homo sapiens
caggcuggagugcaacggca

SEQ ID NO: 1748810 - RNA, 22 nt, Homo sapiens
aauuuaguuauugauguauaaa

SEQ ID NO: 1748811 - RNA, 14 nt, Homo sapiens
caccccacggaugu

SEQ ID NO: 1748812 - RNA, 20 nt, Homo sapiens
caacccugagguaucugugu

SEQ ID NO: 1748813 - RNA, 11 nt, Homo sapiens
cugccagcugc

SEQ ID NO: 1748814 - RNA, 12 nt, Homo sapiens
ccauccauucag

SEQ ID NO: 1748815 - RNA, 22 nt, Homo sapiens
ccuauuuuaauuggaauucugg

SEQ ID NO: 1748816 - RNA, 20 nt, Homo sapiens
ccuuacggucaugaugucug

SEQ ID NO: 1748817 - RNA, 12 nt, Homo sapiens
ugaggaacuguc

SEQ ID NO: 1748818 - RNA, 15 nt, Homo sapiens
ugcugagcaguauuc

SEQ ID NO: 1748819 - RNA, 13 nt, Homo sapiens
uuuuuuuaaagga

SEQ ID NO: 1748820 - RNA, 20 nt, Homo sapiens
agcaccuuugagccuuggcc

SEQ ID NO: 1748821 - RNA, 21 nt, Homo sapiens
ugagucuguguuguguccuga

SEQ ID NO: 1748822 - RNA, 23 nt, Homo sapiens
aaaaauguaaaauccuacaguga

SEQ ID NO: 1748823 - RNA, 19 nt, Homo sapiens
caaaugccuugaacuguug

SEQ ID NO: 1748824 - RNA, 15 nt, Homo sapiens
uauucauaugcauau

SEQ ID NO: 1748825 - RNA, 17 nt, Homo sapiens
uggauccaaacccaucu

SEQ ID NO: 1748826 - RNA, 22 nt, Homo sapiens
aagcugacauugacccagacau

SEQ ID NO: 1748827 - RNA, 17 nt, Homo sapiens
gggcaagagcagcuccu

SEQ ID NO: 1748828 - RNA, 18 nt, Homo sapiens
cacccugcauuacaugug

SEQ ID NO: 1748829 - RNA, 14 nt, Homo sapiens
cugcacaccaaggc

SEQ ID NO: 1748830 - RNA, 22 nt, Homo sapiens
ccgaauugcuuuuaucaguguu

SEQ ID NO: 1748831 - RNA, 14 nt, Homo sapiens
gcccaccuccuucc

SEQ ID NO: 1748832 - RNA, 13 nt, Homo sapiens
gucagcccagugg

SEQ ID NO: 1748833 - RNA, 20 nt, Homo sapiens
aggccugucccuugccucug

SEQ ID NO: 1748834 - RNA, 23 nt, Homo sapiens
aaaucucucauauucgcuagugu

SEQ ID NO: 1748835 - RNA, 17 nt, Homo sapiens
uugcaaccacugcaacg

SEQ ID NO: 1748836 - RNA, 19 nt, Homo sapiens
ccagaugagaagucugcua

SEQ ID NO: 1748837 - RNA, 15 nt, Homo sapiens
ucauauugaauguuu

SEQ ID NO: 1748838 - RNA, 18 nt, Homo sapiens
augugcaggcaccugaua

SEQ ID NO: 1748839 - RNA, 18 nt, Homo sapiens
uuugagaaguucucagaa

SEQ ID NO: 1748840 - RNA, 20 nt, Homo sapiens
uccuuucugugcccuacuca

SEQ ID NO: 1748841 - RNA, 19 nt, Homo sapiens
ggauugagcagaacccaga

SEQ ID NO: 1748842 - RNA, 14 nt, Homo sapiens
cagugcaaccacac

SEQ ID NO: 1748843 - RNA, 22 nt, Homo sapiens
aaucauuucaguaucaucucca

SEQ ID NO: 1748844 - RNA, 19 nt, Homo sapiens
gucuaaaaaugauucucua

SEQ ID NO: 1748845 - RNA, 23 nt, Homo sapiens
cccauagaaacaugacacugacc

SEQ ID NO: 1748846 - RNA, 20 nt, Homo sapiens
cagaacguggugaccuuuca

SEQ ID NO: 1748847 - RNA, 16 nt, Homo sapiens
agcuaaaugcaauuua

SEQ ID NO: 1748848 - RNA, 21 nt, Homo sapiens
uggcaauuuccuggcccucca

SEQ ID NO: 1748849 - RNA, 19 nt, Homo sapiens
cccaguacuuccuggacaa

SEQ ID NO: 1748850 - RNA, 24 nt, Homo sapiens
cugguccuaaccagugagcacugg

SEQ ID NO: 1748851 - RNA, 15 nt, Homo sapiens
uaaugccagcccuuu

SEQ ID NO: 1748852 - RNA, 20 nt, Homo sapiens
gggacagagcagaacuuuca

SEQ ID NO: 1748853 - RNA, 13 nt, Homo sapiens
cugcugagugaau

SEQ ID NO: 1748854 - RNA, 14 nt, Homo sapiens
acuugaacacugau

SEQ ID NO: 1748855 - RNA, 20 nt, Homo sapiens
aaacacuucuguccugugag

SEQ ID NO: 1748856 - RNA, 19 nt, Homo sapiens
agcuagaacauuccauuug

SEQ ID NO: 1748857 - RNA, 17 nt, Homo sapiens
cagcuccuuacucugag

SEQ ID NO: 1748858 - RNA, 17 nt, Homo sapiens
gccggcugugcucagag

SEQ ID NO: 1748859 - RNA, 15 nt, Homo sapiens
agccucucaccugga

SEQ ID NO: 1748860 - RNA, 23 nt, Homo sapiens
acucuuguuuucugguaaaacuu

SEQ ID NO: 1748861 - RNA, 21 nt, Homo sapiens
aaaucaguuuuaauguagaga

SEQ ID NO: 1748862 - RNA, 20 nt, Homo sapiens
gcaugaacccucuugccauc

SEQ ID NO: 1748863 - RNA, 17 nt, Homo sapiens
agcucuguaucugccau

SEQ ID NO: 1748864 - RNA, 15 nt, Homo sapiens
cggggucacuugcaa

SEQ ID NO: 1748865 - RNA, 20 nt, Homo sapiens
acccaccauggaccagccca

SEQ ID NO: 1748866 - RNA, 17 nt, Homo sapiens
auaaaaucuacuccaaa

SEQ ID NO: 1748867 - RNA, 20 nt, Homo sapiens
ucauaaggcauauacaaaua

SEQ ID NO: 1748868 - RNA, 16 nt, Homo sapiens
uccuguauuccugacc

SEQ ID NO: 1748869 - RNA, 16 nt, Homo sapiens
gaccuggcagcucugg

SEQ ID NO: 1748870 - RNA, 19 nt, Homo sapiens
cucaugucauuaugacauu

SEQ ID NO: 1748871 - RNA, 18 nt, Homo sapiens
guuguaaccugcugugau

SEQ ID NO: 1748872 - RNA, 19 nt, Homo sapiens
aauaugucaccuggcacau

SEQ ID NO: 1748873 - RNA, 17 nt, Homo sapiens
cuucaguuucacagaaa

SEQ ID NO: 1748874 - RNA, 17 nt, Homo sapiens
gauguacaauuuagcuu

SEQ ID NO: 1748875 - RNA, 14 nt, Homo sapiens
uguuugcucuugca

SEQ ID NO: 1748876 - RNA, 14 nt, Homo sapiens
ucuccuucugaaag

SEQ ID NO: 1748877 - RNA, 20 nt, Homo sapiens
gcuagcaccauggcaugcgc

SEQ ID NO: 1748878 - RNA, 19 nt, Homo sapiens
uggcacguaaggucucauu

SEQ ID NO: 1748879 - RNA, 11 nt, Homo sapiens
auucauuccau

SEQ ID NO: 1748880 - RNA, 23 nt, Homo sapiens
ucgcacauguauugcucuuuauc

SEQ ID NO: 1748881 - RNA, 23 nt, Homo sapiens
aaucaguguuuccaaucuguccu

SEQ ID NO: 1748882 - RNA, 23 nt, Homo sapiens
gugggcucugugcagucacugga

SEQ ID NO: 1748883 - RNA, 18 nt, Homo sapiens
aguauuguagaaagcuaa

SEQ ID NO: 1748884 - RNA, 15 nt, Homo sapiens
aacaugccaggcuca

SEQ ID NO: 1748885 - RNA, 23 nt, Homo sapiens
ugggaauggggacacggugucca

SEQ ID NO: 1748886 - RNA, 22 nt, Homo sapiens
ccagacuaaaggauccagagag

SEQ ID NO: 1748887 - RNA, 21 nt, Homo sapiens
guccuucacauuuacuagcug

SEQ ID NO: 1748888 - RNA, 13 nt, Homo sapiens
acaggcacuccaa

SEQ ID NO: 1748889 - RNA, 22 nt, Homo sapiens
gacuccuaccugcccuggaaca

SEQ ID NO: 1748890 - RNA, 18 nt, Homo sapiens
aaaaggaggcucuucuca

SEQ ID NO: 1748891 - RNA, 21 nt, Homo sapiens
cagcuccucccuuguucucua

SEQ ID NO: 1748892 - RNA, 17 nt, Homo sapiens
ugaauaaauguaucuga

SEQ ID NO: 1748893 - RNA, 16 nt, Homo sapiens
acuugugugugcgugu

SEQ ID NO: 1748894 - RNA, 13 nt, Homo sapiens
aacccugcuucug

SEQ ID NO: 1748895 - RNA, 12 nt, Homo sapiens
aucccagcacuu

SEQ ID NO: 1748896 - RNA, 17 nt, Homo sapiens
gaaaccuaucucaggga

SEQ ID NO: 1748897 - RNA, 23 nt, Homo sapiens
cggacacccgacuccaguccaag

SEQ ID NO: 1748898 - RNA, 15 nt, Homo sapiens
uuuaacacacauaaa

SEQ ID NO: 1748899 - RNA, 12 nt, Homo sapiens
aucccuuuccag

SEQ ID NO: 1748900 - RNA, 19 nt, Homo sapiens
ucucuugccgacaagggca

SEQ ID NO: 1748901 - RNA, 13 nt, Homo sapiens
uauuuuucaugau

SEQ ID NO: 1748902 - RNA, 22 nt, Homo sapiens
uauuuaaagccuccucaucccg

SEQ ID NO: 1748903 - RNA, 22 nt, Homo sapiens
cgguacuaguucagacacuuug

SEQ ID NO: 1748904 - RNA, 16 nt, Homo sapiens
gugucuuuggugggga

SEQ ID NO: 1748905 - RNA, 17 nt, Homo sapiens
cugccagcccugcagua

SEQ ID NO: 1748906 - RNA, 18 nt, Homo sapiens
ucaguuguguuuggcagg

SEQ ID NO: 1748907 - RNA, 19 nt, Homo sapiens
augcuggacacccucuucc

SEQ ID NO: 1748908 - RNA, 20 nt, Homo sapiens
uggggaguuguuaugccaug

SEQ ID NO: 1748909 - RNA, 22 nt, Homo sapiens
aaguuugugaaugugacuacuu

SEQ ID NO: 1748910 - RNA, 19 nt, Homo sapiens
uucaguugccauugacaga

SEQ ID NO: 1748911 - RNA, 22 nt, Homo sapiens
augagauuggucauuaaauacu

SEQ ID NO: 1748912 - RNA, 17 nt, Homo sapiens
aguacuuggguuugcaa

SEQ ID NO: 1748913 - RNA, 12 nt, Homo sapiens
aauuaaaaccaa

SEQ ID NO: 1748914 - RNA, 12 nt, Homo sapiens
aauaaaaaccau

SEQ ID NO: 1748915 - RNA, 13 nt, Homo sapiens
accaaaguaacug

SEQ ID NO: 1748916 - RNA, 13 nt, Homo sapiens
aauagaguacuua

SEQ ID NO: 1748917 - RNA, 15 nt, Homo sapiens
acaaagcacaguguu

SEQ ID NO: 1748918 - RNA, 19 nt, Homo sapiens
cagcuccacaguguugcca

SEQ ID NO: 1748919 - RNA, 14 nt, Homo sapiens
gcagccugagcucc

SEQ ID NO: 1748920 - RNA, 16 nt, Homo sapiens
cacuggaguccagucu

SEQ ID NO: 1748921 - RNA, 22 nt, Homo sapiens
aaugaguaaugcagacauuuac

SEQ ID NO: 1748922 - RNA, 23 nt, Homo sapiens
aacaaauguaaauagaacgaauu

SEQ ID NO: 1748923 - RNA, 18 nt, Homo sapiens
gugccugagacacccggu

SEQ ID NO: 1748924 - RNA, 20 nt, Homo sapiens
aauuaaaaccauuaccuuaa

SEQ ID NO: 1748925 - RNA, 15 nt, Homo sapiens
gcagcuggugcugug

SEQ ID NO: 1748926 - RNA, 18 nt, Homo sapiens
caggaaugaucccacuca

SEQ ID NO: 1748927 - RNA, 13 nt, Homo sapiens
caugaugucugca

SEQ ID NO: 1748928 - RNA, 20 nt, Homo sapiens
cuauaguuucaccacuccuc

SEQ ID NO: 1748929 - RNA, 14 nt, Homo sapiens
gguccugcacagau

SEQ ID NO: 1748930 - RNA, 15 nt, Homo sapiens
gucccccuaugcucc

SEQ ID NO: 1748931 - RNA, 23 nt, Homo sapiens
uaaaaaagcugugugcucuccaa

SEQ ID NO: 1748932 - RNA, 17 nt, Homo sapiens
auuugcaauauggauuu

SEQ ID NO: 1748933 - RNA, 17 nt, Homo sapiens
uuugccaaaauucauuu

SEQ ID NO: 1748934 - RNA, 15 nt, Homo sapiens
cccuagguccaaaaa

SEQ ID NO: 1748935 - RNA, 15 nt, Homo sapiens
aauaauguacucaca

SEQ ID NO: 1748936 - RNA, 16 nt, Homo sapiens
cccauggacacuccag

SEQ ID NO: 1748937 - RNA, 18 nt, Homo sapiens
auaauucuaaucuaacaa

SEQ ID NO: 1748938 - RNA, 14 nt, Homo sapiens
uuguucauguuugg

SEQ ID NO: 1748939 - RNA, 22 nt, Homo sapiens
uugaaucuaccauucauagcca

SEQ ID NO: 1748940 - RNA, 20 nt, Homo sapiens
uguuuauccuuucauauagu

SEQ ID NO: 1748941 - RNA, 15 nt, Homo sapiens
aacguguuccagugu

SEQ ID NO: 1748942 - RNA, 19 nt, Homo sapiens
ccuccuguugccacacuuu

SEQ ID NO: 1748943 - RNA, 13 nt, Homo sapiens
aaggggcuggggc

SEQ ID NO: 1748944 - RNA, 22 nt, Homo sapiens
ucauagggaggccuuuagcuua

SEQ ID NO: 1748945 - RNA, 18 nt, Homo sapiens
gucccacuacuguagaaa

SEQ ID NO: 1748946 - RNA, 15 nt, Homo sapiens
cugcaucaagacuuc

SEQ ID NO: 1748947 - RNA, 21 nt, Homo sapiens
ggaucuguaaggaacuggaac

SEQ ID NO: 1748948 - RNA, 15 nt, Homo sapiens
aguuguuccuacuca

SEQ ID NO: 1748949 - RNA, 16 nt, Homo sapiens
auuugccacaucuuaa

SEQ ID NO: 1748950 - RNA, 19 nt, Homo sapiens
uauuaggaaauucugauga

SEQ ID NO: 1748951 - RNA, 23 nt, Homo sapiens
aguuuggaaguguuaacuauuua

SEQ ID NO: 1748952 - RNA, 19 nt, Homo sapiens
aaguaacugugguuuacua

SEQ ID NO: 1748953 - RNA, 11 nt, Homo sapiens
auauaauacug

SEQ ID NO: 1748954 - RNA, 12 nt, Homo sapiens
uuggacauuuac

SEQ ID NO: 1748955 - RNA, 14 nt, Homo sapiens
cauugaaaugucac

SEQ ID NO: 1748956 - RNA, 22 nt, Homo sapiens
aaagcucacuaagaagcuugaa

SEQ ID NO: 1748957 - RNA, 12 nt, Homo sapiens
gcaacauccaga

SEQ ID NO: 1748958 - RNA, 22 nt, Homo sapiens
ucaauguguuggaaacuguaaa

SEQ ID NO: 1748959 - RNA, 13 nt, Homo sapiens
uaaauuagcuuuu

SEQ ID NO: 1748960 - RNA, 14 nt, Homo sapiens
ccucugcggagaua

SEQ ID NO: 1748961 - RNA, 17 nt, Homo sapiens
cuauaccuuauccauag

SEQ ID NO: 1748962 - RNA, 9 nt, Homo sapiens
ugcacaauu

SEQ ID NO: 1748963 - RNA, 13 nt, Homo sapiens
cccuagcaguuug

SEQ ID NO: 1748964 - RNA, 16 nt, Homo sapiens
auuuuaagaagacaua

SEQ ID NO: 1748965 - RNA, 17 nt, Homo sapiens
cagugcagcaagccugg

SEQ ID NO: 1748966 - RNA, 19 nt, Homo sapiens
uaaaaccugggauuauaua

SEQ ID NO: 1748967 - RNA, 19 nt, Homo sapiens
cuggacuugcagaguacau

SEQ ID NO: 1748968 - RNA, 18 nt, Homo sapiens
agagugaggcagcgccuc

SEQ ID NO: 1748969 - RNA, 23 nt, Homo sapiens
uuucuucuacugcuaucuacuac

SEQ ID NO: 1748970 - RNA, 22 nt, Homo sapiens
agcagagcccucaugugacaug

SEQ ID NO: 1748971 - RNA, 14 nt, Homo sapiens
ccucugcugggacu

SEQ ID NO: 1748972 - RNA, 15 nt, Homo sapiens
uaacuggcaguuuuc

SEQ ID NO: 1748973 - RNA, 16 nt, Homo sapiens
gaagcagccuccacuu

SEQ ID NO: 1748974 - RNA, 12 nt, Homo sapiens
agauagcuuauu

SEQ ID NO: 1748975 - RNA, 13 nt, Homo sapiens
aucuaacaguaac

SEQ ID NO: 1748976 - RNA, 20 nt, Homo sapiens
cucacauacccucacuuaaa

SEQ ID NO: 1748977 - RNA, 21 nt, Homo sapiens
ggaggccaagaacuugcaaua

SEQ ID NO: 1748978 - RNA, 22 nt, Homo sapiens
cuuguucagggcuuuucuuaau

SEQ ID NO: 1748979 - RNA, 13 nt, Homo sapiens
agaaaacuaaucu

SEQ ID NO: 1748980 - RNA, 16 nt, Homo sapiens
agauaagggugucuuc

SEQ ID NO: 1748981 - RNA, 11 nt, Homo sapiens
agcaauacuuu

SEQ ID NO: 1748982 - RNA, 14 nt, Homo sapiens
gaaaacacugucau

SEQ ID NO: 1748983 - RNA, 15 nt, Homo sapiens
agcaaaaggcagcuc

SEQ ID NO: 1748984 - RNA, 12 nt, Homo sapiens
cugcccaugcac

SEQ ID NO: 1748985 - RNA, 18 nt, Homo sapiens
ucuuaauuuggaaacuaa

SEQ ID NO: 1748986 - RNA, 14 nt, Homo sapiens
ucuuaccugugcuu

SEQ ID NO: 1748987 - RNA, 19 nt, Homo sapiens
ucgggaagaaggggacaau

SEQ ID NO: 1748988 - RNA, 19 nt, Homo sapiens
aaaaggagucaagaacaau

SEQ ID NO: 1748989 - RNA, 14 nt, Homo sapiens
agcugucacuuuug

SEQ ID NO: 1748990 - RNA, 23 nt, Homo sapiens
gaaaagcuauuagccaggaucau

SEQ ID NO: 1748991 - RNA, 15 nt, Homo sapiens
ucccagaaguggcua

SEQ ID NO: 1748992 - RNA, 16 nt, Homo sapiens
gcccugaggaccucuc

SEQ ID NO: 1748993 - RNA, 14 nt, Homo sapiens
uuacacacaaaaaa

SEQ ID NO: 1748994 - RNA, 18 nt, Homo sapiens
cugacaccuuucagucuc

SEQ ID NO: 1748995 - RNA, 20 nt, Homo sapiens
agccccuccucccucagacc

SEQ ID NO: 1748996 - RNA, 17 nt, Homo sapiens
gacuacagaaguggaag

SEQ ID NO: 1748997 - RNA, 18 nt, Homo sapiens
ccaguucaucuauggcag

SEQ ID NO: 1748998 - RNA, 14 nt, Homo sapiens
gggccaguccuggu

SEQ ID NO: 1748999 - RNA, 19 nt, Homo sapiens
acagcuuuuugcaguaugg

SEQ ID NO: 1749000 - RNA, 12 nt, Homo sapiens
uugcagcccaaa

SEQ ID NO: 1749001 - RNA, 16 nt, Homo sapiens
cuuguaaagacugguu

SEQ ID NO: 1749002 - RNA, 21 nt, Homo sapiens
uuccuaggaggaaaauuccau

SEQ ID NO: 1749003 - RNA, 16 nt, Homo sapiens
cuccacaggcacaggu

SEQ ID NO: 1749004 - RNA, 12 nt, Homo sapiens
cucuguccuucg

SEQ ID NO: 1749005 - RNA, 20 nt, Homo sapiens
gaauaaagcauccaaguaua

SEQ ID NO: 1749006 - RNA, 14 nt, Homo sapiens
ugucucagccuccc

SEQ ID NO: 1749007 - RNA, 22 nt, Homo sapiens
aaacacuauuuccaaaagcaca

SEQ ID NO: 1749008 - RNA, 14 nt, Homo sapiens
gcagcugucaccac

SEQ ID NO: 1749009 - RNA, 18 nt, Homo sapiens
auggggagaaaagacaug

SEQ ID NO: 1749010 - RNA, 16 nt, Homo sapiens
ggcagcacucagugag

SEQ ID NO: 1749011 - RNA, 15 nt, Homo sapiens
gacaccggccagugg

SEQ ID NO: 1749012 - RNA, 21 nt, Homo sapiens
cauggcacucccuccagcaca

SEQ ID NO: 1749013 - RNA, 16 nt, Homo sapiens
uaaugagaauuccuua

SEQ ID NO: 1749014 - RNA, 17 nt, Homo sapiens
gaugaaauuauuuguca

SEQ ID NO: 1749015 - RNA, 16 nt, Homo sapiens
gggguacuacucucca

SEQ ID NO: 1749016 - RNA, 17 nt, Homo sapiens
ggccuccauauugcucu

SEQ ID NO: 1749017 - RNA, 20 nt, Homo sapiens
guuagcuccucacuguggua

SEQ ID NO: 1749018 - RNA, 14 nt, Homo sapiens
aagaaagauuucau

SEQ ID NO: 1749019 - RNA, 19 nt, Homo sapiens
caccuaagucucugugaau

SEQ ID NO: 1749020 - RNA, 17 nt, Homo sapiens
gaacuuccccacggaug

SEQ ID NO: 1749021 - RNA, 20 nt, Homo sapiens
uucuguccuggagcuagcaa

SEQ ID NO: 1749022 - RNA, 18 nt, Homo sapiens
uuccacaauuuugucucu

SEQ ID NO: 1749023 - RNA, 20 nt, Homo sapiens
gaauuacuccaaaaagacaa

SEQ ID NO: 1749024 - RNA, 17 nt, Homo sapiens
uagaaauguaaacugcc

SEQ ID NO: 1749025 - RNA, 15 nt, Homo sapiens
aaccgugugcuccuc

SEQ ID NO: 1749026 - RNA, 17 nt, Homo sapiens
agguugagggcaaugga

SEQ ID NO: 1749027 - RNA, 20 nt, Homo sapiens
acuugaccccugcccaccuc

SEQ ID NO: 1749028 - RNA, 20 nt, Homo sapiens
gaaccaagggcccucacuca

SEQ ID NO: 1749029 - RNA, 19 nt, Homo sapiens
ugggguaaaguaucacuuu

SEQ ID NO: 1749030 - RNA, 15 nt, Homo sapiens
augcuucgugccaca

SEQ ID NO: 1749031 - RNA, 12 nt, Homo sapiens
aguccggugccu

SEQ ID NO: 1749032 - RNA, 15 nt, Homo sapiens
ucucuucagugccca

SEQ ID NO: 1749033 - RNA, 17 nt, Homo sapiens
auguuggggcccugugc

SEQ ID NO: 1749034 - RNA, 21 nt, Homo sapiens
ugcuugacauaccuaccagua

SEQ ID NO: 1749035 - RNA, 18 nt, Homo sapiens
guacaaagacagggaaua

SEQ ID NO: 1749036 - RNA, 23 nt, Homo sapiens
cuauaaguguucaguguugacau

SEQ ID NO: 1749037 - RNA, 16 nt, Homo sapiens
accuuggcgcucucag

SEQ ID NO: 1749038 - RNA, 19 nt, Homo sapiens
guccugaaaaaugcucaau

SEQ ID NO: 1749039 - RNA, 19 nt, Homo sapiens
uggaggggggaggugggau

SEQ ID NO: 1749040 - RNA, 13 nt, Homo sapiens
aaggaguucucuu

SEQ ID NO: 1749041 - RNA, 21 nt, Homo sapiens
cauaccaagacccccgucucu

SEQ ID NO: 1749042 - RNA, 14 nt, Homo sapiens
ucaaagggaaacuu

SEQ ID NO: 1749043 - RNA, 19 nt, Homo sapiens
uguccucagccuugccaga

SEQ ID NO: 1749044 - RNA, 15 nt, Homo sapiens
aaaauaaccaguuaa

SEQ ID NO: 1749045 - RNA, 14 nt, Homo sapiens
cucaagcaauauua

SEQ ID NO: 1749046 - RNA, 18 nt, Homo sapiens
agcacagagcaguggcca

SEQ ID NO: 1749047 - RNA, 13 nt, Homo sapiens
aauuccucagugg

SEQ ID NO: 1749048 - RNA, 14 nt, Homo sapiens
cucagugccaaaga

SEQ ID NO: 1749049 - RNA, 18 nt, Homo sapiens
caaggagaaaaaaggcag

SEQ ID NO: 1749050 - RNA, 16 nt, Homo sapiens
gcccauuucuccauac

SEQ ID NO: 1749051 - RNA, 18 nt, Homo sapiens
ucccuuucagcugcugcu

SEQ ID NO: 1749052 - RNA, 22 nt, Homo sapiens
guaaagcauuagaagucuuccc

SEQ ID NO: 1749053 - RNA, 19 nt, Homo sapiens
ccuacccccaguaaaauca

SEQ ID NO: 1749054 - RNA, 21 nt, Homo sapiens
uuaugaugcuggaaauaugaa

SEQ ID NO: 1749055 - RNA, 15 nt, Homo sapiens
augcucugugccaga

SEQ ID NO: 1749056 - RNA, 19 nt, Homo sapiens
aucuuucugcacacaaaua

SEQ ID NO: 1749057 - RNA, 17 nt, Homo sapiens
acccuggaccauuccag

SEQ ID NO: 1749058 - RNA, 18 nt, Homo sapiens
ugagaaccuaaugcacuc

SEQ ID NO: 1749059 - RNA, 12 nt, Homo sapiens
gcuggaaccugc

SEQ ID NO: 1749060 - RNA, 23 nt, Homo sapiens
uuuuagaaugaugcacauuucau

SEQ ID NO: 1749061 - RNA, 20 nt, Homo sapiens
uauuauauauuuauagcaaa

SEQ ID NO: 1749062 - RNA, 17 nt, Homo sapiens
caaagacuugugugaug

SEQ ID NO: 1749063 - RNA, 23 nt, Homo sapiens
gcucauuuaguuagaaaauaagg

SEQ ID NO: 1749064 - RNA, 12 nt, Homo sapiens
agauccuaauau

SEQ ID NO: 1749065 - RNA, 14 nt, Homo sapiens
ugauguggaugaaa

SEQ ID NO: 1749066 - RNA, 14 nt, Homo sapiens
cuagcugggcacag

SEQ ID NO: 1749067 - RNA, 16 nt, Homo sapiens
guguaccaagugcuuc

SEQ ID NO: 1749068 - RNA, 14 nt, Homo sapiens
cuaaaaaaaugcaa

SEQ ID NO: 1749069 - RNA, 23 nt, Homo sapiens
uauccuguuugaggaaagcaaga

SEQ ID NO: 1749070 - RNA, 20 nt, Homo sapiens
cucuucugggcuacugccac

SEQ ID NO: 1749071 - RNA, 22 nt, Homo sapiens
caucagggggcaugaagcacau

SEQ ID NO: 1749072 - RNA, 11 nt, Homo sapiens
uacugcaguga

SEQ ID NO: 1749073 - RNA, 23 nt, Homo sapiens
gaggaaaaacgaucgcugugaaa

SEQ ID NO: 1749074 - RNA, 15 nt, Homo sapiens
uauguaauacuuaaa

SEQ ID NO: 1749075 - RNA, 21 nt, Homo sapiens
cuuacuuuuggauaauaucca

SEQ ID NO: 1749076 - RNA, 18 nt, Homo sapiens
ucaagccaucaaaccugg

SEQ ID NO: 1749077 - RNA, 16 nt, Homo sapiens
gguauaaggaaauauc

SEQ ID NO: 1749078 - RNA, 17 nt, Homo sapiens
gaugauucuaugucuca

SEQ ID NO: 1749079 - RNA, 19 nt, Homo sapiens
cuuuauuuguagccaaaga

SEQ ID NO: 1749080 - RNA, 19 nt, Homo sapiens
uuuauagagugucucaggg

SEQ ID NO: 1749081 - RNA, 11 nt, Homo sapiens
aaagugccuuc

SEQ ID NO: 1749082 - RNA, 19 nt, Homo sapiens
cccggcugucaaggggugu

SEQ ID NO: 1749083 - RNA, 19 nt, Homo sapiens
uuuguaaaagcuugaugaa

SEQ ID NO: 1749084 - RNA, 20 nt, Homo sapiens
gagcagugcuugaaugaagu

SEQ ID NO: 1749085 - RNA, 17 nt, Homo sapiens
uaaacuucauacaaugu

SEQ ID NO: 1749086 - RNA, 18 nt, Homo sapiens
agcaauccuccuaccuca

SEQ ID NO: 1749087 - RNA, 14 nt, Homo sapiens
ggcccaagggaugg

SEQ ID NO: 1749088 - RNA, 15 nt, Homo sapiens
aucucagcuuugaga

SEQ ID NO: 1749089 - RNA, 18 nt, Homo sapiens
caaauccuucaucauguc

SEQ ID NO: 1749090 - RNA, 13 nt, Homo sapiens
caaaccagagcag

SEQ ID NO: 1749091 - RNA, 19 nt, Homo sapiens
ggagaguacauggcauuga

SEQ ID NO: 1749092 - RNA, 13 nt, Homo sapiens
ugcacagucauac

SEQ ID NO: 1749093 - RNA, 18 nt, Homo sapiens
agcacugccucccuuaau

SEQ ID NO: 1749094 - RNA, 17 nt, Homo sapiens
gcuucucucuccagggu

SEQ ID NO: 1749095 - RNA, 23 nt, Homo sapiens
acuccuuaauaugaucuguggag

SEQ ID NO: 1749096 - RNA, 18 nt, Homo sapiens
cagagugcacagcugucc

SEQ ID NO: 1749097 - RNA, 20 nt, Homo sapiens
gaagguucucugugcuccuc

SEQ ID NO: 1749098 - RNA, 22 nt, Homo sapiens
ugacacccuggccugaacugag

SEQ ID NO: 1749099 - RNA, 14 nt, Homo sapiens
guuuguuacuuuaa

SEQ ID NO: 1749100 - RNA, 16 nt, Homo sapiens
guuauaccuuccucuu

SEQ ID NO: 1749101 - RNA, 14 nt, Homo sapiens
cagcauaugcaaag

SEQ ID NO: 1749102 - RNA, 16 nt, Homo sapiens
guuuguucacacuccu

SEQ ID NO: 1749103 - RNA, 15 nt, Homo sapiens
acuaguuuccagugg

SEQ ID NO: 1749104 - RNA, 16 nt, Homo sapiens
aauucauccucacuca

SEQ ID NO: 1749105 - RNA, 13 nt, Homo sapiens
caggcagcugcag

SEQ ID NO: 1749106 - RNA, 16 nt, Homo sapiens
gaguguaguaaagccg

SEQ ID NO: 1749107 - RNA, 16 nt, Homo sapiens
acuuguuucuacucaa

SEQ ID NO: 1749108 - RNA, 17 nt, Homo sapiens
aauuagaaacacacuuu

SEQ ID NO: 1749109 - RNA, 15 nt, Homo sapiens
cggaccugcuuugag

SEQ ID NO: 1749110 - RNA, 14 nt, Homo sapiens
ucaccacuacauca

SEQ ID NO: 1749111 - RNA, 12 nt, Homo sapiens
ggucuugcaaaa

SEQ ID NO: 1749112 - RNA, 17 nt, Homo sapiens
cuguauauaauacuaaa

SEQ ID NO: 1749113 - RNA, 15 nt, Homo sapiens
caguucaagacuuag

SEQ ID NO: 1749114 - RNA, 13 nt, Homo sapiens
aagcgauucucau

SEQ ID NO: 1749115 - RNA, 23 nt, Homo sapiens
ccucucuagcacaauuugcacua

SEQ ID NO: 1749116 - RNA, 21 nt, Homo sapiens
agcagcaaaggucaccaggcu

SEQ ID NO: 1749117 - RNA, 22 nt, Homo sapiens
gcaaucuccuuacuguguuuca

SEQ ID NO: 1749118 - RNA, 14 nt, Homo sapiens
aaccugaauuaaag

SEQ ID NO: 1749119 - RNA, 22 nt, Homo sapiens
caaaccugugcugaccaaagau

SEQ ID NO: 1749120 - RNA, 15 nt, Homo sapiens
cuuuuuaacuuaacu

SEQ ID NO: 1749121 - RNA, 16 nt, Homo sapiens
ccacucggcggcagca

SEQ ID NO: 1749122 - RNA, 16 nt, Homo sapiens
uaaaggcaguguuaca

SEQ ID NO: 1749123 - RNA, 17 nt, Homo sapiens
caguaagacagugcagu

SEQ ID NO: 1749124 - RNA, 17 nt, Homo sapiens
caguaaggcagugcaau

SEQ ID NO: 1749125 - RNA, 14 nt, Homo sapiens
ucugcuguucagga

SEQ ID NO: 1749126 - RNA, 13 nt, Homo sapiens
ucugccaagcccu

SEQ ID NO: 1749127 - RNA, 16 nt, Homo sapiens
ggaaaagaguaucaaa

SEQ ID NO: 1749128 - RNA, 23 nt, Homo sapiens
agcacuauucuuuguauuaccaa

SEQ ID NO: 1749129 - RNA, 15 nt, Homo sapiens
ugacaacacaugugg

SEQ ID NO: 1749130 - RNA, 19 nt, Homo sapiens
gggcuucuagaaccaggca

SEQ ID NO: 1749131 - RNA, 13 nt, Homo sapiens
uugguuauucuaa

SEQ ID NO: 1749132 - RNA, 19 nt, Homo sapiens
aaacaagucagaucuacac

SEQ ID NO: 1749133 - RNA, 12 nt, Homo sapiens
cugaagugcagc

SEQ ID NO: 1749134 - RNA, 18 nt, Homo sapiens
gucuuuuuucucucuuag

SEQ ID NO: 1749135 - RNA, 17 nt, Homo sapiens
uagaugucuguguauac

SEQ ID NO: 1749136 - RNA, 17 nt, Homo sapiens
uuacauaagggcauuau

SEQ ID NO: 1749137 - RNA, 13 nt, Homo sapiens
cccugccugaaua

SEQ ID NO: 1749138 - RNA, 19 nt, Homo sapiens
caggccccaggacuguggg

SEQ ID NO: 1749139 - RNA, 17 nt, Homo sapiens
gagcugcuguccaggaa

SEQ ID NO: 1749140 - RNA, 23 nt, Homo sapiens
cuuccccggggucuucuaccuca

SEQ ID NO: 1749141 - RNA, 21 nt, Homo sapiens
ccauagucuguauccaaauaa

SEQ ID NO: 1749142 - RNA, 14 nt, Homo sapiens
uggcuugccauuuu

SEQ ID NO: 1749143 - RNA, 16 nt, Homo sapiens
gcaggcuccaguugaa

SEQ ID NO: 1749144 - RNA, 22 nt, Homo sapiens
cucaaaccuaccacucaggaau

SEQ ID NO: 1749145 - RNA, 14 nt, Homo sapiens
gagucccugugaug

SEQ ID NO: 1749146 - RNA, 22 nt, Homo sapiens
aaaacagcuuugucuccaaaga

SEQ ID NO: 1749147 - RNA, 21 nt, Homo sapiens
acuucuuuaaaaaaacacaua

SEQ ID NO: 1749148 - RNA, 16 nt, Homo sapiens
aaacuuagcaacuugg

SEQ ID NO: 1749149 - RNA, 19 nt, Homo sapiens
gaaagaaauuuggcuauaa

SEQ ID NO: 1749150 - RNA, 17 nt, Homo sapiens
agaaagccucagugaaa

SEQ ID NO: 1749151 - RNA, 22 nt, Homo sapiens
auauccuuagcccaucuuucaa

SEQ ID NO: 1749152 - RNA, 23 nt, Homo sapiens
agaugaaucaguaugaagacacu

SEQ ID NO: 1749153 - RNA, 14 nt, Homo sapiens
gcuaugccuugcac

SEQ ID NO: 1749154 - RNA, 19 nt, Homo sapiens
uggucauuuccuaugcaaa

SEQ ID NO: 1749155 - RNA, 17 nt, Homo sapiens
ggaucccuccugagcuc

SEQ ID NO: 1749156 - RNA, 19 nt, Homo sapiens
aauguuuucaaaaccaagu

SEQ ID NO: 1749157 - RNA, 16 nt, Homo sapiens
uaugggcgugaaccac

SEQ ID NO: 1749158 - RNA, 20 nt, Homo sapiens
gcauggccccaguccaugcu

SEQ ID NO: 1749159 - RNA, 17 nt, Homo sapiens
aucuuucuuuccaaaac

SEQ ID NO: 1749160 - RNA, 13 nt, Homo sapiens
ugggcaucauuuu

SEQ ID NO: 1749161 - RNA, 12 nt, Homo sapiens
ccuaugcaaaua

SEQ ID NO: 1749162 - RNA, 18 nt, Homo sapiens
caaauuuggccuuaagaa

SEQ ID NO: 1749163 - RNA, 15 nt, Homo sapiens
caagacuauguucuc

SEQ ID NO: 1749164 - RNA, 18 nt, Homo sapiens
ggccucuccaguuugcac

SEQ ID NO: 1749165 - RNA, 17 nt, Homo sapiens
cccccaaaaucugucac

SEQ ID NO: 1749166 - RNA, 20 nt, Homo sapiens
ugaguaagaaaugcugccca

SEQ ID NO: 1749167 - RNA, 14 nt, Homo sapiens
gcacuggagcugca

SEQ ID NO: 1749168 - RNA, 13 nt, Homo sapiens
cagucucccauuc

SEQ ID NO: 1749169 - RNA, 22 nt, Homo sapiens
uucaccaguuuccaaguuuauu

SEQ ID NO: 1749170 - RNA, 18 nt, Homo sapiens
caaagcagcaauuacaug

SEQ ID NO: 1749171 - RNA, 15 nt, Homo sapiens
aggcaaagguucuau

SEQ ID NO: 1749172 - RNA, 20 nt, Homo sapiens
uugcuucucauccccagucc

SEQ ID NO: 1749173 - RNA, 12 nt, Homo sapiens
aaaugauuugcu

SEQ ID NO: 1749174 - RNA, 23 nt, Homo sapiens
uagccccagagaugccagcccuu

SEQ ID NO: 1749175 - RNA, 21 nt, Homo sapiens
gcaaaggggacagcuguguga

SEQ ID NO: 1749176 - RNA, 16 nt, Homo sapiens
cauggagaaugcacca

SEQ ID NO: 1749177 - RNA, 17 nt, Homo sapiens
uuuaauuuguuaucuca

SEQ ID NO: 1749178 - RNA, 14 nt, Homo sapiens
aauguaugcauuca

SEQ ID NO: 1749179 - RNA, 17 nt, Homo sapiens
cuguggaugcaaauaga

SEQ ID NO: 1749180 - RNA, 21 nt, Homo sapiens
ccugugcaguagagagccuuu

SEQ ID NO: 1749181 - RNA, 17 nt, Homo sapiens
uugcacugacaguggga

SEQ ID NO: 1749182 - RNA, 21 nt, Homo sapiens
gguuugggagaacacauuucu

SEQ ID NO: 1749183 - RNA, 15 nt, Homo sapiens
agcucgagcaugccc

SEQ ID NO: 1749184 - RNA, 14 nt, Homo sapiens
gcaagggauaacuc

SEQ ID NO: 1749185 - RNA, 22 nt, Homo sapiens
uugccaagagccugagugacag

SEQ ID NO: 1749186 - RNA, 20 nt, Homo sapiens
uguauaugcauucuuuucag

SEQ ID NO: 1749187 - RNA, 20 nt, Homo sapiens
uguguuuuuaacaugucaau

SEQ ID NO: 1749188 - RNA, 20 nt, Homo sapiens
aguguuauuugcacacugca

SEQ ID NO: 1749189 - RNA, 16 nt, Homo sapiens
gauuuaaaaaugccaa

SEQ ID NO: 1749190 - RNA, 18 nt, Homo sapiens
augcaccuugugucugua

SEQ ID NO: 1749191 - RNA, 12 nt, Homo sapiens
aguggccaguuc

SEQ ID NO: 1749192 - RNA, 17 nt, Homo sapiens
gugcuugcuggccacaa

SEQ ID NO: 1749193 - RNA, 22 nt, Homo sapiens
uggagaauggaaaauacauuuu

SEQ ID NO: 1749194 - RNA, 12 nt, Homo sapiens
acucaacuuuca

SEQ ID NO: 1749195 - RNA, 13 nt, Homo sapiens
uccaccugugaga

SEQ ID NO: 1749196 - RNA, 20 nt, Homo sapiens
cagccccuccccacaccagu

SEQ ID NO: 1749197 - RNA, 20 nt, Homo sapiens
uccucugcccgggagcucag

SEQ ID NO: 1749198 - RNA, 13 nt, Homo sapiens
ugaucaggugugg

SEQ ID NO: 1749199 - RNA, 17 nt, Homo sapiens
cuucugacuuaagugug

SEQ ID NO: 1749200 - RNA, 15 nt, Homo sapiens
aggaagaaugaaacu

SEQ ID NO: 1749201 - RNA, 20 nt, Homo sapiens
guuuucucucuccgauuuug

SEQ ID NO: 1749202 - RNA, 22 nt, Homo sapiens
aaagaaguccgcuggcacccau

SEQ ID NO: 1749203 - RNA, 20 nt, Homo sapiens
acaaagcggggagaggguac

SEQ ID NO: 1749204 - RNA, 17 nt, Homo sapiens
aggcuggagugcagugc

SEQ ID NO: 1749205 - RNA, 18 nt, Homo sapiens
uggaauggcagcaugcaa

SEQ ID NO: 1749206 - RNA, 15 nt, Homo sapiens
cuagagauuacaauu

SEQ ID NO: 1749207 - RNA, 12 nt, Homo sapiens
auagauuuagcu

SEQ ID NO: 1749208 - RNA, 19 nt, Homo sapiens
cuuacaagacccuaugaaa

SEQ ID NO: 1749209 - RNA, 16 nt, Homo sapiens
uuguguccacugugac

SEQ ID NO: 1749210 - RNA, 23 nt, Homo sapiens
agaaacccggcuuccugugcuaa

SEQ ID NO: 1749211 - RNA, 20 nt, Homo sapiens
ucuacagagaagauucuugu

SEQ ID NO: 1749212 - RNA, 21 nt, Homo sapiens
uggaagccagggcuugucaca

SEQ ID NO: 1749213 - RNA, 14 nt, Homo sapiens
aacuucugccucua

SEQ ID NO: 1749214 - RNA, 21 nt, Homo sapiens
ccaagugaacacuagccagac

SEQ ID NO: 1749215 - RNA, 17 nt, Homo sapiens
cuuuuuuuguauaguua

SEQ ID NO: 1749216 - RNA, 20 nt, Homo sapiens
ugaacagagagcgcuuuugu

SEQ ID NO: 1749217 - RNA, 17 nt, Homo sapiens
ugagucagacauuuggu

SEQ ID NO: 1749218 - RNA, 19 nt, Homo sapiens
ugccugcaggcaugaguca

SEQ ID NO: 1749219 - RNA, 20 nt, Homo sapiens
uucuaaugguagucagauuu

SEQ ID NO: 1749220 - RNA, 19 nt, Homo sapiens
acgucacguuggucuugaa

SEQ ID NO: 1749221 - RNA, 19 nt, Homo sapiens
aaggggccaggaaggggac

SEQ ID NO: 1749222 - RNA, 20 nt, Homo sapiens
cucccgaguagcugagauua

SEQ ID NO: 1749223 - RNA, 18 nt, Homo sapiens
cauuugauuugauauaca

SEQ ID NO: 1749224 - RNA, 21 nt, Homo sapiens
ugaauguuuuauggaauugaa

SEQ ID NO: 1749225 - RNA, 21 nt, Homo sapiens
acaauuugagauguauuucaa

SEQ ID NO: 1749226 - RNA, 17 nt, Homo sapiens
uaauuaccaguuuucca

SEQ ID NO: 1749227 - RNA, 17 nt, Homo sapiens
aaaauauauguauuuaa

SEQ ID NO: 1749228 - RNA, 14 nt, Homo sapiens
aggaguccacugcc

SEQ ID NO: 1749229 - RNA, 22 nt, Homo sapiens
gaagagggaaauguacacuuuu

SEQ ID NO: 1749230 - RNA, 14 nt, Homo sapiens
aguuugauacgugu

SEQ ID NO: 1749231 - RNA, 15 nt, Homo sapiens
cauuugaaugcauuu

SEQ ID NO: 1749232 - RNA, 12 nt, Homo sapiens
aucugaccaaac

SEQ ID NO: 1749233 - RNA, 15 nt, Homo sapiens
aguuauaauucugug

SEQ ID NO: 1749234 - RNA, 20 nt, Homo sapiens
auugaguucgaggacuacaa

SEQ ID NO: 1749235 - RNA, 17 nt, Homo sapiens
uccuguugcugucuuca

SEQ ID NO: 1749236 - RNA, 20 nt, Homo sapiens
guucagucuugucuuugaua

SEQ ID NO: 1749237 - RNA, 21 nt, Homo sapiens
cacguaugguggcucaugucu

SEQ ID NO: 1749238 - RNA, 13 nt, Homo sapiens
cuugaucagugac

SEQ ID NO: 1749239 - RNA, 18 nt, Homo sapiens
uauaucacuucacuguuc

SEQ ID NO: 1749240 - RNA, 17 nt, Homo sapiens
gccccugcuccagaaga

SEQ ID NO: 1749241 - RNA, 18 nt, Homo sapiens
auggacacaucaggaagu

SEQ ID NO: 1749242 - RNA, 17 nt, Homo sapiens
uuguucaaagcacagaa

SEQ ID NO: 1749243 - RNA, 22 nt, Homo sapiens
acgggaagugagagauguugcc

SEQ ID NO: 1749244 - RNA, 15 nt, Homo sapiens
gcugccccaccugcc

SEQ ID NO: 1749245 - RNA, 16 nt, Homo sapiens
cuuucuauucuuggaa

SEQ ID NO: 1749246 - RNA, 22 nt, Homo sapiens
ggauuuugaacgcuuaagucau

SEQ ID NO: 1749247 - RNA, 19 nt, Homo sapiens
aaagccccccagcucccac

SEQ ID NO: 1749248 - RNA, 20 nt, Homo sapiens
ggccuucugccugcugacca

SEQ ID NO: 1749249 - RNA, 15 nt, Homo sapiens
uacauuuuuguacac

SEQ ID NO: 1749250 - RNA, 16 nt, Homo sapiens
aaaaaucaaguuuaau

SEQ ID NO: 1749251 - RNA, 15 nt, Homo sapiens
ugauuauauaagcaa

SEQ ID NO: 1749252 - RNA, 20 nt, Homo sapiens
gaaugccucgcucccuucaa

SEQ ID NO: 1749253 - RNA, 17 nt, Homo sapiens
aaagacacaaaaaaaga

SEQ ID NO: 1749254 - RNA, 16 nt, Homo sapiens
gggcauguguaugugu

SEQ ID NO: 1749255 - RNA, 23 nt, Homo sapiens
gcagaucaacagaccuaagaaau

SEQ ID NO: 1749256 - RNA, 13 nt, Homo sapiens
auaaaaguaccua

SEQ ID NO: 1749257 - RNA, 14 nt, Homo sapiens
aguguuuugcagaa

SEQ ID NO: 1749258 - RNA, 23 nt, Homo sapiens
ugugaccacugaagcaccacagg

SEQ ID NO: 1749259 - RNA, 14 nt, Homo sapiens
uuauuuauguaugu

SEQ ID NO: 1749260 - RNA, 20 nt, Homo sapiens
ggcucuggagcccacuguac

SEQ ID NO: 1749261 - RNA, 20 nt, Homo sapiens
agugcccucucugaaccuca

SEQ ID NO: 1749262 - RNA, 11 nt, Homo sapiens
auuugauguaa

SEQ ID NO: 1749263 - RNA, 11 nt, Homo sapiens
uuuugaugaaa

SEQ ID NO: 1749264 - RNA, 19 nt, Homo sapiens
auaguuucaaaucuguaau

SEQ ID NO: 1749265 - RNA, 14 nt, Homo sapiens
aagacuucacugca

SEQ ID NO: 1749266 - RNA, 21 nt, Homo sapiens
cacacacagucccauuugcau

SEQ ID NO: 1749267 - RNA, 21 nt, Homo sapiens
aguggguuugccccaucacuu

SEQ ID NO: 1749268 - RNA, 13 nt, Homo sapiens
uucauacuccuuu

SEQ ID NO: 1749269 - RNA, 18 nt, Homo sapiens
uuucaugugcuauagaca

SEQ ID NO: 1749270 - RNA, 18 nt, Homo sapiens
ucucagagugacagucau

SEQ ID NO: 1749271 - RNA, 17 nt, Homo sapiens
gaggucagauggcacaa

SEQ ID NO: 1749272 - RNA, 21 nt, Homo sapiens
auuuccucugagcuguuaucu

SEQ ID NO: 1749273 - RNA, 19 nt, Homo sapiens
guugcugaaagacuaccuc

SEQ ID NO: 1749274 - RNA, 22 nt, Homo sapiens
aaacagucccgcgugcaaagga

SEQ ID NO: 1749275 - RNA, 19 nt, Homo sapiens
aucaacauuuagucuucau

SEQ ID NO: 1749276 - RNA, 19 nt, Homo sapiens
caaaagcccauucauucca

SEQ ID NO: 1749277 - RNA, 13 nt, Homo sapiens
cccugcacuucau

SEQ ID NO: 1749278 - RNA, 17 nt, Homo sapiens
uuacauuaagccuacaa

SEQ ID NO: 1749279 - RNA, 23 nt, Homo sapiens
ucauuuugggaccuauaucucag

SEQ ID NO: 1749280 - RNA, 16 nt, Homo sapiens
auuguccauucuugcu

SEQ ID NO: 1749281 - RNA, 16 nt, Homo sapiens
uccucgaaacugccau

SEQ ID NO: 1749282 - RNA, 17 nt, Homo sapiens
gccauuaaagaauauga

SEQ ID NO: 1749283 - RNA, 16 nt, Homo sapiens
aaaugaaaaucaauuu

SEQ ID NO: 1749284 - RNA, 22 nt, Homo sapiens
aguggugccaucaccacggcuc

SEQ ID NO: 1749285 - RNA, 21 nt, Homo sapiens
uagugcaugaauagauucucu

SEQ ID NO: 1749286 - RNA, 15 nt, Homo sapiens
aggagucccuaacuu

SEQ ID NO: 1749287 - RNA, 16 nt, Homo sapiens
ccuaccuaccaagaua

SEQ ID NO: 1749288 - RNA, 16 nt, Homo sapiens
acaggcaaacugcaaa

SEQ ID NO: 1749289 - RNA, 14 nt, Homo sapiens
cacucaggugaaaa

SEQ ID NO: 1749290 - RNA, 15 nt, Homo sapiens
aaggaucucugagac

SEQ ID NO: 1749291 - RNA, 13 nt, Homo sapiens
uggucacauggag

SEQ ID NO: 1749292 - RNA, 14 nt, Homo sapiens
ugccucauccuccu

SEQ ID NO: 1749293 - RNA, 13 nt, Homo sapiens
aucuuaacucuuu

SEQ ID NO: 1749294 - RNA, 13 nt, Homo sapiens
caugcaaugacau

SEQ ID NO: 1749295 - RNA, 22 nt, Homo sapiens
caguuuaucuguucauauggau

SEQ ID NO: 1749296 - RNA, 17 nt, Homo sapiens
cacuagcauccacugau

SEQ ID NO: 1749297 - RNA, 18 nt, Homo sapiens
ucacugaacaaacuaaag

SEQ ID NO: 1749298 - RNA, 16 nt, Homo sapiens
gacuuagagcugggaa

SEQ ID NO: 1749299 - RNA, 13 nt, Homo sapiens
acuuuucauuacu

SEQ ID NO: 1749300 - RNA, 21 nt, Homo sapiens
uacccuaagguugcagacucu

SEQ ID NO: 1749301 - RNA, 13 nt, Homo sapiens
cagcugagucuau

SEQ ID NO: 1749302 - RNA, 13 nt, Homo sapiens
uucccagguguua

SEQ ID NO: 1749303 - RNA, 22 nt, Homo sapiens
aucuauugauaguuucauuuac

SEQ ID NO: 1749304 - RNA, 17 nt, Homo sapiens
gaaucacuugaacccag

SEQ ID NO: 1749305 - RNA, 21 nt, Homo sapiens
cagagagacagacuugagaac

SEQ ID NO: 1749306 - RNA, 23 nt, Homo sapiens
guauuguuaggagaugucaucaa

SEQ ID NO: 1749307 - RNA, 20 nt, Homo sapiens
uccugagggaucuauacuug

SEQ ID NO: 1749308 - RNA, 16 nt, Homo sapiens
agugacacaaucucag

SEQ ID NO: 1749309 - RNA, 23 nt, Homo sapiens
ucccugagcuuuggugcaucuca

SEQ ID NO: 1749310 - RNA, 15 nt, Homo sapiens
gaccaggcaauguga

SEQ ID NO: 1749311 - RNA, 13 nt, Homo sapiens
aauucguucucug

SEQ ID NO: 1749312 - RNA, 16 nt, Homo sapiens
cccucuuccugugauc

SEQ ID NO: 1749313 - RNA, 12 nt, Homo sapiens
uuuaauuugacc

SEQ ID NO: 1749314 - RNA, 15 nt, Homo sapiens
augcauauacuuuaa

SEQ ID NO: 1749315 - RNA, 20 nt, Homo sapiens
uuuuaaaguaaagauguauu

SEQ ID NO: 1749316 - RNA, 13 nt, Homo sapiens
uagccaaccugcu

SEQ ID NO: 1749317 - RNA, 13 nt, Homo sapiens
cagugcuguccaa

SEQ ID NO: 1749318 - RNA, 15 nt, Homo sapiens
uagagcuagaugugu

SEQ ID NO: 1749319 - RNA, 20 nt, Homo sapiens
gaucgcaccauugcacucca

SEQ ID NO: 1749320 - RNA, 20 nt, Homo sapiens
ugcuuccuccccuccuggca

SEQ ID NO: 1749321 - RNA, 18 nt, Homo sapiens
uuccugagaggaagccug

SEQ ID NO: 1749322 - RNA, 21 nt, Homo sapiens
ggacuccaccuuggaccucag

SEQ ID NO: 1749323 - RNA, 13 nt, Homo sapiens
uagacaacccuga

SEQ ID NO: 1749324 - RNA, 19 nt, Homo sapiens
uagggcucuccaagcacua

SEQ ID NO: 1749325 - RNA, 18 nt, Homo sapiens
aaacuaaccagcauuccc

SEQ ID NO: 1749326 - RNA, 17 nt, Homo sapiens
acaauaaaaguguccau

SEQ ID NO: 1749327 - RNA, 22 nt, Homo sapiens
cgggaaugcgcccaccaaggcc

SEQ ID NO: 1749328 - RNA, 14 nt, Homo sapiens
uggcguuacugcuu

SEQ ID NO: 1749329 - RNA, 17 nt, Homo sapiens
ucucgcagauguuaccu

SEQ ID NO: 1749330 - RNA, 19 nt, Homo sapiens
cagaggcugcagaaggcca

SEQ ID NO: 1749331 - RNA, 20 nt, Homo sapiens
gaaaacauucauccaguugc

SEQ ID NO: 1749332 - RNA, 19 nt, Homo sapiens
cccuuccuacagauaguca

SEQ ID NO: 1749333 - RNA, 14 nt, Homo sapiens
guuuaagucauuuu

SEQ ID NO: 1749334 - RNA, 14 nt, Homo sapiens
caagaaguguaguu

SEQ ID NO: 1749335 - RNA, 15 nt, Homo sapiens
agccagaguuugccu

SEQ ID NO: 1749336 - RNA, 18 nt, Homo sapiens
caggggagggucagccag

SEQ ID NO: 1749337 - RNA, 14 nt, Homo sapiens
auuauuaugucuca

SEQ ID NO: 1749338 - RNA, 14 nt, Homo sapiens
accaguauucccuu

SEQ ID NO: 1749339 - RNA, 12 nt, Homo sapiens
gccuacugccuc

SEQ ID NO: 1749340 - RNA, 13 nt, Homo sapiens
gccaccccagaaa

SEQ ID NO: 1749341 - RNA, 22 nt, Homo sapiens
aucugucauuauauucuaauua

SEQ ID NO: 1749342 - RNA, 21 nt, Homo sapiens
gccaguuugaccuuugucuuc

SEQ ID NO: 1749343 - RNA, 16 nt, Homo sapiens
uguggccacuuuccag

SEQ ID NO: 1749344 - RNA, 17 nt, Homo sapiens
auauuuuuccacuuaaa

SEQ ID NO: 1749345 - RNA, 13 nt, Homo sapiens
aaauggugggaac

SEQ ID NO: 1749346 - RNA, 21 nt, Homo sapiens
caaucaggguuuuuagauuaa

SEQ ID NO: 1749347 - RNA, 21 nt, Homo sapiens
agaagcucgccccaccuccac

SEQ ID NO: 1749348 - RNA, 11 nt, Homo sapiens
acuuugggacg

SEQ ID NO: 1749349 - RNA, 20 nt, Homo sapiens
gcuugaccauguugcacugu

SEQ ID NO: 1749350 - RNA, 14 nt, Homo sapiens
uuugugguaguccu

SEQ ID NO: 1749351 - RNA, 17 nt, Homo sapiens
uccuucuccuguuccau

SEQ ID NO: 1749352 - RNA, 15 nt, Homo sapiens
cguggcugcaggggu

SEQ ID NO: 1749353 - RNA, 17 nt, Homo sapiens
gggcucacaugccacug

SEQ ID NO: 1749354 - RNA, 18 nt, Homo sapiens
guuuuaaagcuugcucac

SEQ ID NO: 1749355 - RNA, 16 nt, Homo sapiens
auuugaauucuugauc

SEQ ID NO: 1749356 - RNA, 12 nt, Homo sapiens
cuacucuuugau

SEQ ID NO: 1749357 - RNA, 12 nt, Homo sapiens
uaugacauauga

SEQ ID NO: 1749358 - RNA, 16 nt, Homo sapiens
cugggucaugcacuga

SEQ ID NO: 1749359 - RNA, 16 nt, Homo sapiens
cacaagggcaguggaa

SEQ ID NO: 1749360 - RNA, 22 nt, Homo sapiens
cagcccuguucugggugcagcu

SEQ ID NO: 1749361 - RNA, 16 nt, Homo sapiens
ucggccuccagacugc

SEQ ID NO: 1749362 - RNA, 21 nt, Homo sapiens
guauuuauuuuacagcucauu

SEQ ID NO: 1749363 - RNA, 23 nt, Homo sapiens
ucagagugggguggggagcaugu

SEQ ID NO: 1749364 - RNA, 13 nt, Homo sapiens
aguuggagaccag

SEQ ID NO: 1749365 - RNA, 13 nt, Homo sapiens
agcaugagacuuu

SEQ ID NO: 1749366 - RNA, 13 nt, Homo sapiens
caucugcauuucu

SEQ ID NO: 1749367 - RNA, 13 nt, Homo sapiens
uauaugcacuuau

SEQ ID NO: 1749368 - RNA, 15 nt, Homo sapiens
gaccuauaaaacaaa

SEQ ID NO: 1749369 - RNA, 18 nt, Homo sapiens
uuguaccagggcucugua

SEQ ID NO: 1749370 - RNA, 19 nt, Homo sapiens
caggcacucuccugucuga

SEQ ID NO: 1749371 - RNA, 18 nt, Homo sapiens
aggagaaugaaauguaug

SEQ ID NO: 1749372 - RNA, 21 nt, Homo sapiens
aaaaauguguuccauugccau

SEQ ID NO: 1749373 - RNA, 20 nt, Homo sapiens
aguauuccagaccugaagaa

SEQ ID NO: 1749374 - RNA, 20 nt, Homo sapiens
ggcaguggaagcaguuucag

SEQ ID NO: 1749375 - RNA, 23 nt, Homo sapiens
ccucagcaauugucuacauucag

SEQ ID NO: 1749376 - RNA, 19 nt, Homo sapiens
aucuuugcaagaaagucag

SEQ ID NO: 1749377 - RNA, 21 nt, Homo sapiens
gacuuggcaacagaagugguu

SEQ ID NO: 1749378 - RNA, 15 nt, Homo sapiens
auucccaccccucau

SEQ ID NO: 1749379 - RNA, 14 nt, Homo sapiens
caacauuaccaaaa

SEQ ID NO: 1749380 - RNA, 17 nt, Homo sapiens
cuggcgcauauuaagca

SEQ ID NO: 1749381 - RNA, 21 nt, Homo sapiens
augggcacuggaaaacauaga

SEQ ID NO: 1749382 - RNA, 18 nt, Homo sapiens
cucuauguccggcuuuaa

SEQ ID NO: 1749383 - RNA, 17 nt, Homo sapiens
aaagagaggaaccaaua

SEQ ID NO: 1749384 - RNA, 22 nt, Homo sapiens
aacagaggggcagccaggacau

SEQ ID NO: 1749385 - RNA, 19 nt, Homo sapiens
cugagcuggccuccuaugc

SEQ ID NO: 1749386 - RNA, 15 nt, Homo sapiens
acacaaaccagacag

SEQ ID NO: 1749387 - RNA, 20 nt, Homo sapiens
auucuuuuuccaucccuagc

SEQ ID NO: 1749388 - RNA, 15 nt, Homo sapiens
agggagaacuugaaa

SEQ ID NO: 1749389 - RNA, 14 nt, Homo sapiens
cuuacguaguucua

SEQ ID NO: 1749390 - RNA, 16 nt, Homo sapiens
uuuggaagucaugagc

SEQ ID NO: 1749391 - RNA, 15 nt, Homo sapiens
ggccacucuaccuga

SEQ ID NO: 1749392 - RNA, 14 nt, Homo sapiens
agccucauucugag

SEQ ID NO: 1749393 - RNA, 20 nt, Homo sapiens
cucaaaccaacucaguggug

SEQ ID NO: 1749394 - RNA, 18 nt, Homo sapiens
aggcauaagucauuccaa

SEQ ID NO: 1749395 - RNA, 22 nt, Homo sapiens
gcugggggcagcaguaccaucu

SEQ ID NO: 1749396 - RNA, 16 nt, Homo sapiens
cacacuggagugaaug

SEQ ID NO: 1749397 - RNA, 22 nt, Homo sapiens
agcugccagcccaacugugaga

SEQ ID NO: 1749398 - RNA, 16 nt, Homo sapiens
ccuaguuccaccauca

SEQ ID NO: 1749399 - RNA, 18 nt, Homo sapiens
ucccuggggcacuuucau

SEQ ID NO: 1749400 - RNA, 13 nt, Homo sapiens
gcagccugucacc

SEQ ID NO: 1749401 - RNA, 16 nt, Homo sapiens
uuacaucuacaaacag

SEQ ID NO: 1749402 - RNA, 12 nt, Homo sapiens
aaaggacuguaa

SEQ ID NO: 1749403 - RNA, 18 nt, Homo sapiens
agguagaagugagcaaaa

SEQ ID NO: 1749404 - RNA, 21 nt, Homo sapiens
uauacaaugaguaaaaucaca

SEQ ID NO: 1749405 - RNA, 12 nt, Homo sapiens
ucuaacauuucc

SEQ ID NO: 1749406 - RNA, 14 nt, Homo sapiens
auuucugggcuccu

SEQ ID NO: 1749407 - RNA, 20 nt, Homo sapiens
cauuuacacagugcuuucca

SEQ ID NO: 1749408 - RNA, 15 nt, Homo sapiens
ccuucaagugccaaa

SEQ ID NO: 1749409 - RNA, 18 nt, Homo sapiens
uguaaauuuaacugcaua

SEQ ID NO: 1749410 - RNA, 13 nt, Homo sapiens
ccuggacugggag

SEQ ID NO: 1749411 - RNA, 16 nt, Homo sapiens
gaagcuggccugagag

SEQ ID NO: 1749412 - RNA, 16 nt, Homo sapiens
auugugaagauuucau

SEQ ID NO: 1749413 - RNA, 12 nt, Homo sapiens
ggaccagggaug

SEQ ID NO: 1749414 - RNA, 16 nt, Homo sapiens
cgaggaacuccaggac

SEQ ID NO: 1749415 - RNA, 19 nt, Homo sapiens
gaaacuaauacaauacauu

SEQ ID NO: 1749416 - RNA, 19 nt, Homo sapiens
ucucccaaaguguccuaag

SEQ ID NO: 1749417 - RNA, 16 nt, Homo sapiens
auuuaaagcaucaucu

SEQ ID NO: 1749418 - RNA, 11 nt, Homo sapiens
uuuaaagacag

SEQ ID NO: 1749419 - RNA, 21 nt, Homo sapiens
acugcacuuuccaaugccaca

SEQ ID NO: 1749420 - RNA, 22 nt, Homo sapiens
uaugauuuauuaaauaaucucu

SEQ ID NO: 1749421 - RNA, 12 nt, Homo sapiens
agcuuaucucag

SEQ ID NO: 1749422 - RNA, 23 nt, Homo sapiens
ucccaggcuggagagcacugcca

SEQ ID NO: 1749423 - RNA, 15 nt, Homo sapiens
cagugagccgucauc

SEQ ID NO: 1749424 - RNA, 22 nt, Homo sapiens
cagugaucucagggcagacagc

SEQ ID NO: 1749425 - RNA, 21 nt, Homo sapiens
uucaugcacaguaaauucugc

SEQ ID NO: 1749426 - RNA, 20 nt, Homo sapiens
uguaaucccagcacuuugau

SEQ ID NO: 1749427 - RNA, 16 nt, Homo sapiens
acacuuauauuuugau

SEQ ID NO: 1749428 - RNA, 19 nt, Homo sapiens
uaaguugguaaaguauuua

SEQ ID NO: 1749429 - RNA, 21 nt, Homo sapiens
uccaaugacugagcagcaucc

SEQ ID NO: 1749430 - RNA, 20 nt, Homo sapiens
ugggccaagccaggguucca

SEQ ID NO: 1749431 - RNA, 22 nt, Homo sapiens
cacuguagucagaccucagcaa

SEQ ID NO: 1749432 - RNA, 22 nt, Homo sapiens
acaguuuagugcuuuacaugcu

SEQ ID NO: 1749433 - RNA, 15 nt, Homo sapiens
cucugcuacuccauc

SEQ ID NO: 1749434 - RNA, 15 nt, Homo sapiens
ucugacccacagccu

SEQ ID NO: 1749435 - RNA, 14 nt, Homo sapiens
cccuaggagaccaa

SEQ ID NO: 1749436 - RNA, 21 nt, Homo sapiens
ccuccccagcgccaucugugu

SEQ ID NO: 1749437 - RNA, 16 nt, Homo sapiens
gguuucuuauucaaag

SEQ ID NO: 1749438 - RNA, 15 nt, Homo sapiens
aacucacucugggcu

SEQ ID NO: 1749439 - RNA, 14 nt, Homo sapiens
gaaauagaagcaaa

SEQ ID NO: 1749440 - RNA, 22 nt, Homo sapiens
guccaauggcuguaaacuauaa

SEQ ID NO: 1749441 - RNA, 18 nt, Homo sapiens
cuguccugggaaaugaag

SEQ ID NO: 1749442 - RNA, 22 nt, Homo sapiens
acaucgcauagaaaucaauaau

SEQ ID NO: 1749443 - RNA, 22 nt, Homo sapiens
cugggcuuacaggcaugagcca

SEQ ID NO: 1749444 - RNA, 23 nt, Homo sapiens
cacauuggauucaucagcauuug

SEQ ID NO: 1749445 - RNA, 18 nt, Homo sapiens
ggaucuauugauuugaaa

SEQ ID NO: 1749446 - RNA, 17 nt, Homo sapiens
acuuacagauaggccuu

SEQ ID NO: 1749447 - RNA, 18 nt, Homo sapiens
gacuuuuccaagcccuuu

SEQ ID NO: 1749448 - RNA, 17 nt, Homo sapiens
auaaaugagaccccuuu

SEQ ID NO: 1749449 - RNA, 12 nt, Homo sapiens
aggaaguggugu

SEQ ID NO: 1749450 - RNA, 12 nt, Homo sapiens
gagcaaccucuc

SEQ ID NO: 1749451 - RNA, 19 nt, Homo sapiens
acuuccaugauacuuuaau

SEQ ID NO: 1749452 - RNA, 14 nt, Homo sapiens
cuguaaacaguucu

SEQ ID NO: 1749453 - RNA, 19 nt, Homo sapiens
uuagcuagaagaauuucaa

SEQ ID NO: 1749454 - RNA, 10 nt, Homo sapiens
gcucuugccu

SEQ ID NO: 1749455 - RNA, 16 nt, Homo sapiens
aaauucaaagcauaaa

SEQ ID NO: 1749456 - RNA, 14 nt, Homo sapiens
gacaaugcugccau

SEQ ID NO: 1749457 - RNA, 19 nt, Homo sapiens
uccuccaaccccucuaugu

SEQ ID NO: 1749458 - RNA, 13 nt, Homo sapiens
ggcaucaauauac

SEQ ID NO: 1749459 - RNA, 18 nt, Homo sapiens
ugggggacccugugcauc

SEQ ID NO: 1749460 - RNA, 13 nt, Homo sapiens
uuauucacuguaa

SEQ ID NO: 1749461 - RNA, 14 nt, Homo sapiens
gaaaugcugcagga

SEQ ID NO: 1749462 - RNA, 15 nt, Homo sapiens
uauuucauaaacaac

SEQ ID NO: 1749463 - RNA, 14 nt, Homo sapiens
gagagugagacuca

SEQ ID NO: 1749464 - RNA, 14 nt, Homo sapiens
cagcacuucaggag

SEQ ID NO: 1749465 - RNA, 22 nt, Homo sapiens
cuucuaggucacuucucacaau

SEQ ID NO: 1749466 - RNA, 18 nt, Homo sapiens
accaauuucuuccuucca

SEQ ID NO: 1749467 - RNA, 13 nt, Homo sapiens
uuauuauaacauc

SEQ ID NO: 1749468 - RNA, 16 nt, Homo sapiens
cugagggcuccuccau

SEQ ID NO: 1749469 - RNA, 19 nt, Homo sapiens
agguuaucaaccauaugaa

SEQ ID NO: 1749470 - RNA, 15 nt, Homo sapiens
aaauuuuaugaaguu

SEQ ID NO: 1749471 - RNA, 15 nt, Homo sapiens
acuuauuuagauuca

SEQ ID NO: 1749472 - RNA, 20 nt, Homo sapiens
aaagcaaguuucaucaguca

SEQ ID NO: 1749473 - RNA, 17 nt, Homo sapiens
uucauguguggaaaugg

SEQ ID NO: 1749474 - RNA, 20 nt, Homo sapiens
cucacuuuggaaucagaauu

SEQ ID NO: 1749475 - RNA, 23 nt, Homo sapiens
acuuccccugggaugcugaccca

SEQ ID NO: 1749476 - RNA, 16 nt, Homo sapiens
cuuuaggagauuuauu

SEQ ID NO: 1749477 - RNA, 23 nt, Homo sapiens
ugagaaaccuuauuguaccucuc

SEQ ID NO: 1749478 - RNA, 14 nt, Homo sapiens
ucuuugcagugaag

SEQ ID NO: 1749479 - RNA, 18 nt, Homo sapiens
guauuucuuaagaauuca

SEQ ID NO: 1749480 - RNA, 18 nt, Homo sapiens
acaccuagccagcuguca

SEQ ID NO: 1749481 - RNA, 19 nt, Homo sapiens
gugacaacacuuguguuau

SEQ ID NO: 1749482 - RNA, 13 nt, Homo sapiens
aacaggcccucug

SEQ ID NO: 1749483 - RNA, 20 nt, Homo sapiens
agguagacuuuuaauaucac

SEQ ID NO: 1749484 - RNA, 17 nt, Homo sapiens
uucuaauguuuacuaua

SEQ ID NO: 1749485 - RNA, 20 nt, Homo sapiens
aggaagagccaggacaugaa

SEQ ID NO: 1749486 - RNA, 23 nt, Homo sapiens
uucaagcucaucuguuaugcaua

SEQ ID NO: 1749487 - RNA, 14 nt, Homo sapiens
cagcagaagccaaa

SEQ ID NO: 1749488 - RNA, 13 nt, Homo sapiens
accaguguagccu

SEQ ID NO: 1749489 - RNA, 14 nt, Homo sapiens
acucugaagccaca

SEQ ID NO: 1749490 - RNA, 19 nt, Homo sapiens
ggugagccgagauugcacc

SEQ ID NO: 1749491 - RNA, 15 nt, Homo sapiens
uauuucacuugauga

SEQ ID NO: 1749492 - RNA, 21 nt, Homo sapiens
cucgaagucauggccaccucc

SEQ ID NO: 1749493 - RNA, 17 nt, Homo sapiens
aaagggaaacugggaaa

SEQ ID NO: 1749494 - RNA, 19 nt, Homo sapiens
uagccccauugcuccauuc

SEQ ID NO: 1749495 - RNA, 19 nt, Homo sapiens
cauacacauauauacacac

SEQ ID NO: 1749496 - RNA, 18 nt, Homo sapiens
ucuuaggugacaaugucc

SEQ ID NO: 1749497 - RNA, 21 nt, Homo sapiens
gauaccucaacccccauuucu

SEQ ID NO: 1749498 - RNA, 21 nt, Homo sapiens
guuggucugccuucugcugaa

SEQ ID NO: 1749499 - RNA, 16 nt, Homo sapiens
ugcauucuucuucacu

SEQ ID NO: 1749500 - RNA, 14 nt, Homo sapiens
uucacaggcuguaa

SEQ ID NO: 1749501 - RNA, 17 nt, Homo sapiens
cucagucccuacugagu

SEQ ID NO: 1749502 - RNA, 21 nt, Homo sapiens
uuaugcucaccugacauuaau

SEQ ID NO: 1749503 - RNA, 20 nt, Homo sapiens
uucucucccacgugcacagc

SEQ ID NO: 1749504 - RNA, 12 nt, Homo sapiens
uccagagcugcu

SEQ ID NO: 1749505 - RNA, 17 nt, Homo sapiens
gauccaccugcacaaac

SEQ ID NO: 1749506 - RNA, 11 nt, Homo sapiens
cuacauuccuc

SEQ ID NO: 1749507 - RNA, 22 nt, Homo sapiens
cuaguguacauuucuauaaaua

SEQ ID NO: 1749508 - RNA, 20 nt, Homo sapiens
auuacaauggccagcccaga

SEQ ID NO: 1749509 - RNA, 21 nt, Homo sapiens
aagcccagaucucugcaucuc

SEQ ID NO: 1749510 - RNA, 16 nt, Homo sapiens
ccuaucuugugcucuu

SEQ ID NO: 1749511 - RNA, 17 nt, Homo sapiens
uccuuaacagcuguauu

SEQ ID NO: 1749512 - RNA, 21 nt, Homo sapiens
ccuguacucuggggugcugcc

SEQ ID NO: 1749513 - RNA, 15 nt, Homo sapiens
auucaugaugaacuc

SEQ ID NO: 1749514 - RNA, 14 nt, Homo sapiens
uguccguucauccc

SEQ ID NO: 1749515 - RNA, 13 nt, Homo sapiens
agaggaauccugg

SEQ ID NO: 1749516 - RNA, 17 nt, Homo sapiens
gacagaugccuccuucc

SEQ ID NO: 1749517 - RNA, 18 nt, Homo sapiens
caaaggggaugcccagug

SEQ ID NO: 1749518 - RNA, 16 nt, Homo sapiens
cacccugggaucucag

SEQ ID NO: 1749519 - RNA, 15 nt, Homo sapiens
ugcuugugcacugga

SEQ ID NO: 1749520 - RNA, 17 nt, Homo sapiens
acccaacuccucuccuc

SEQ ID NO: 1749521 - RNA, 17 nt, Homo sapiens
cucugaaguguccuaaa

SEQ ID NO: 1749522 - RNA, 19 nt, Homo sapiens
uuugguguuuuuacagagg

SEQ ID NO: 1749523 - RNA, 20 nt, Homo sapiens
uccagcacccccagugcagc

SEQ ID NO: 1749524 - RNA, 18 nt, Homo sapiens
gagggaggaugcugugug

SEQ ID NO: 1749525 - RNA, 20 nt, Homo sapiens
agaugagccggguccggccu

SEQ ID NO: 1749526 - RNA, 16 nt, Homo sapiens
uucgauauuucaggaa

SEQ ID NO: 1749527 - RNA, 23 nt, Homo sapiens
uguguauuuugagauaaugucaa

SEQ ID NO: 1749528 - RNA, 22 nt, Homo sapiens
auacaacacugagccauuugcu

SEQ ID NO: 1749529 - RNA, 14 nt, Homo sapiens
auuacaauguaucu

SEQ ID NO: 1749530 - RNA, 15 nt, Homo sapiens
gucuuaauucugacc

SEQ ID NO: 1749531 - RNA, 19 nt, Homo sapiens
agccacugcccaaagccau

SEQ ID NO: 1749532 - RNA, 15 nt, Homo sapiens
cgcagagcugacccc

SEQ ID NO: 1749533 - RNA, 14 nt, Homo sapiens
aagaggugggguga

SEQ ID NO: 1749534 - RNA, 16 nt, Homo sapiens
uccugggucagggaga

SEQ ID NO: 1749535 - RNA, 18 nt, Homo sapiens
aucccacacgcacugcac

SEQ ID NO: 1749536 - RNA, 14 nt, Homo sapiens
auaaaaaacauaau

SEQ ID NO: 1749537 - RNA, 23 nt, Homo sapiens
agucauuuuuguuucuaccuccc

SEQ ID NO: 1749538 - RNA, 12 nt, Homo sapiens
uucacuaccugu

SEQ ID NO: 1749539 - RNA, 14 nt, Homo sapiens
acagaggcauuuaa

SEQ ID NO: 1749540 - RNA, 20 nt, Homo sapiens
caaagaugcccccuccagga

SEQ ID NO: 1749541 - RNA, 16 nt, Homo sapiens
aagaggaaagaaugaa

SEQ ID NO: 1749542 - RNA, 20 nt, Homo sapiens
aagcaggaguaaguuucuca

SEQ ID NO: 1749543 - RNA, 15 nt, Homo sapiens
acccaagaugcaaga

SEQ ID NO: 1749544 - RNA, 15 nt, Homo sapiens
gcccagggugcagug

SEQ ID NO: 1749545 - RNA, 20 nt, Homo sapiens
aaagcaaaucuuucuguaaa

SEQ ID NO: 1749546 - RNA, 14 nt, Homo sapiens
aaaauuaugcugca

SEQ ID NO: 1749547 - RNA, 18 nt, Homo sapiens
acuacucuuacauguaua

SEQ ID NO: 1749548 - RNA, 12 nt, Homo sapiens
aagggcagagaa

SEQ ID NO: 1749549 - RNA, 14 nt, Homo sapiens
ucccaggaagccca

SEQ ID NO: 1749550 - RNA, 20 nt, Homo sapiens
uuuuaaauacaaaaggcauu

SEQ ID NO: 1749551 - RNA, 19 nt, Homo sapiens
agguugggaaggcaccugc

SEQ ID NO: 1749552 - RNA, 21 nt, Homo sapiens
ucauauuucacagcaccaaaa

SEQ ID NO: 1749553 - RNA, 22 nt, Homo sapiens
agggaaauuguuuauguguuau

SEQ ID NO: 1749554 - RNA, 19 nt, Homo sapiens
gaaagggguccgauguuug

SEQ ID NO: 1749555 - RNA, 19 nt, Homo sapiens
uccaaccccccaguauaaa

SEQ ID NO: 1749556 - RNA, 21 nt, Homo sapiens
agccuuucuguaucaagcccc

SEQ ID NO: 1749557 - RNA, 18 nt, Homo sapiens
aaaguggguuuucccugg

SEQ ID NO: 1749558 - RNA, 19 nt, Homo sapiens
ccuccuccuuuguuuaaua

SEQ ID NO: 1749559 - RNA, 19 nt, Homo sapiens
agcauggcggcaucugcuu

SEQ ID NO: 1749560 - RNA, 23 nt, Homo sapiens
aacuauaaggugccucaguuuuc

SEQ ID NO: 1749561 - RNA, 21 nt, Homo sapiens
acaguggucccagaaccuauu

SEQ ID NO: 1749562 - RNA, 13 nt, Homo sapiens
aauuauguaaaga

SEQ ID NO: 1749563 - RNA, 18 nt, Homo sapiens
cugggauauggcugccca

SEQ ID NO: 1749564 - RNA, 18 nt, Homo sapiens
gauccuccccgacugugg

SEQ ID NO: 1749565 - RNA, 13 nt, Homo sapiens
aacuagcuuuugc

SEQ ID NO: 1749566 - RNA, 20 nt, Homo sapiens
agaacaauaucgacuucccc

SEQ ID NO: 1749567 - RNA, 14 nt, Homo sapiens
guaaagaugucaau

SEQ ID NO: 1749568 - RNA, 18 nt, Homo sapiens
acugagagcccacugcag

SEQ ID NO: 1749569 - RNA, 14 nt, Homo sapiens
ugggcugucuguca

SEQ ID NO: 1749570 - RNA, 16 nt, Homo sapiens
ucuuccucccuggaau

SEQ ID NO: 1749571 - RNA, 17 nt, Homo sapiens
aaucaaagaacuucucc

SEQ ID NO: 1749572 - RNA, 13 nt, Homo sapiens
aaacauacguucu

SEQ ID NO: 1749573 - RNA, 15 nt, Homo sapiens
agaucuuaggcaaaa

SEQ ID NO: 1749574 - RNA, 17 nt, Homo sapiens
cugcuugaacccaggag

SEQ ID NO: 1749575 - RNA, 13 nt, Homo sapiens
agaggggguagcu

SEQ ID NO: 1749576 - RNA, 22 nt, Homo sapiens
agacgggaggggaggcauugac

SEQ ID NO: 1749577 - RNA, 22 nt, Homo sapiens
gugcaaaaauaaaauggacaga

SEQ ID NO: 1749578 - RNA, 20 nt, Homo sapiens
auccaauaauuuuccuguga

SEQ ID NO: 1749579 - RNA, 13 nt, Homo sapiens
uaaaaaagcaaau

SEQ ID NO: 1749580 - RNA, 13 nt, Homo sapiens
ucucaaagccucu

SEQ ID NO: 1749581 - RNA, 16 nt, Homo sapiens
aaacaccagucaccuc

SEQ ID NO: 1749582 - RNA, 15 nt, Homo sapiens
augucacauucuauu

SEQ ID NO: 1749583 - RNA, 14 nt, Homo sapiens
ucuucagacuuaaa

SEQ ID NO: 1749584 - RNA, 17 nt, Homo sapiens
acuagagaaacuugaau

SEQ ID NO: 1749585 - RNA, 13 nt, Homo sapiens
aucugucaugagc

SEQ ID NO: 1749586 - RNA, 19 nt, Homo sapiens
cuaggauaaaccaaucauc

SEQ ID NO: 1749587 - RNA, 15 nt, Homo sapiens
gacaaggaaaggcaa

SEQ ID NO: 1749588 - RNA, 18 nt, Homo sapiens
uugaaugcggaaccauag

SEQ ID NO: 1749589 - RNA, 19 nt, Homo sapiens
uccugauuauaggauuuua

SEQ ID NO: 1749590 - RNA, 17 nt, Homo sapiens
uguaucaaacuguauaa

SEQ ID NO: 1749591 - RNA, 15 nt, Homo sapiens
ccacuugaagcacuu

SEQ ID NO: 1749592 - RNA, 19 nt, Homo sapiens
agacuagaccaauugucau

SEQ ID NO: 1749593 - RNA, 11 nt, Homo sapiens
agacauacucc

SEQ ID NO: 1749594 - RNA, 20 nt, Homo sapiens
accuuuauuuuucuaucugg

SEQ ID NO: 1749595 - RNA, 16 nt, Homo sapiens
aggaagaaaaccagcg

SEQ ID NO: 1749596 - RNA, 11 nt, Homo sapiens
gagcacacugu

SEQ ID NO: 1749597 - RNA, 14 nt, Homo sapiens
aaauguaguugaug

SEQ ID NO: 1749598 - RNA, 18 nt, Homo sapiens
ggucgccgcacuucugau

SEQ ID NO: 1749599 - RNA, 17 nt, Homo sapiens
ggcccucugccugcacu

SEQ ID NO: 1749600 - RNA, 16 nt, Homo sapiens
ugacaauuuauggaag

SEQ ID NO: 1749601 - RNA, 14 nt, Homo sapiens
uaacaauguuaagg

SEQ ID NO: 1749602 - RNA, 14 nt, Homo sapiens
cuguauuagucaca

SEQ ID NO: 1749603 - RNA, 12 nt, Homo sapiens
agucacuuugac

SEQ ID NO: 1749604 - RNA, 12 nt, Homo sapiens
aguaacuuugaa

SEQ ID NO: 1749605 - RNA, 24 nt, Homo sapiens
aauacuugaauauggaacauaugc

SEQ ID NO: 1749606 - RNA, 16 nt, Homo sapiens
auugguguugccaguu

SEQ ID NO: 1749607 - RNA, 14 nt, Homo sapiens
caucagagaggcaa

SEQ ID NO: 1749608 - RNA, 22 nt, Homo sapiens
agacugagguaaauaaagccac

SEQ ID NO: 1749609 - RNA, 14 nt, Homo sapiens
aucaugauauagcu

SEQ ID NO: 1749610 - RNA, 17 nt, Homo sapiens
ccagcucagaacccauc

SEQ ID NO: 1749611 - RNA, 17 nt, Homo sapiens
cagagcgagacuccauc

SEQ ID NO: 1749612 - RNA, 18 nt, Homo sapiens
uaggccaugggacaggga

SEQ ID NO: 1749613 - RNA, 18 nt, Homo sapiens
ugggacaugggaaagggg

SEQ ID NO: 1749614 - RNA, 14 nt, Homo sapiens
aaacagugacauuu

SEQ ID NO: 1749615 - RNA, 23 nt, Homo sapiens
uucugagauuuuugauaucucaa

SEQ ID NO: 1749616 - RNA, 15 nt, Homo sapiens
cagugccuauugaua

SEQ ID NO: 1749617 - RNA, 14 nt, Homo sapiens
cuccugauucuaaa

SEQ ID NO: 1749618 - RNA, 16 nt, Homo sapiens
cggcgugugcagugcc

SEQ ID NO: 1749619 - RNA, 20 nt, Homo sapiens
acaguugggacccaaaacac

SEQ ID NO: 1749620 - RNA, 15 nt, Homo sapiens
uaugaaaaugucauu

SEQ ID NO: 1749621 - RNA, 23 nt, Homo sapiens
ucaggauuaaugguccugugaug

SEQ ID NO: 1749622 - RNA, 21 nt, Homo sapiens
cagccccaucccuguccucau

SEQ ID NO: 1749623 - RNA, 17 nt, Homo sapiens
gaacagguucucuuccu

SEQ ID NO: 1749624 - RNA, 21 nt, Homo sapiens
cuauaugaacuuagucauuaa

SEQ ID NO: 1749625 - RNA, 16 nt, Homo sapiens
ccauuauaaugaauuu

SEQ ID NO: 1749626 - RNA, 19 nt, Homo sapiens
cugacagggccagugcagu

SEQ ID NO: 1749627 - RNA, 18 nt, Homo sapiens
augauugauuauaucauu

SEQ ID NO: 1749628 - RNA, 14 nt, Homo sapiens
uguuagaaaaaugg

SEQ ID NO: 1749629 - RNA, 20 nt, Homo sapiens
ugaggcaucucucugggaug

SEQ ID NO: 1749630 - RNA, 16 nt, Homo sapiens
acuagauauagcuuuu

SEQ ID NO: 1749631 - RNA, 13 nt, Homo sapiens
cuuccaaaccuca

SEQ ID NO: 1749632 - RNA, 15 nt, Homo sapiens
acaaauucauucccu

SEQ ID NO: 1749633 - RNA, 20 nt, Homo sapiens
ucuccccugaccugugagcc

SEQ ID NO: 1749634 - RNA, 16 nt, Homo sapiens
agacagagcucacaau

SEQ ID NO: 1749635 - RNA, 18 nt, Homo sapiens
cuggaugcacuuucauua

SEQ ID NO: 1749636 - RNA, 19 nt, Homo sapiens
cucgggguccagugcauuu

SEQ ID NO: 1749637 - RNA, 20 nt, Homo sapiens
agaugcugggccaguuccuc

SEQ ID NO: 1749638 - RNA, 18 nt, Homo sapiens
cugaaagaauaggauuaa

SEQ ID NO: 1749639 - RNA, 23 nt, Homo sapiens
gcacaaccaugacgcacugcuca

SEQ ID NO: 1749640 - RNA, 18 nt, Homo sapiens
cuggacacaauaggucuu

SEQ ID NO: 1749641 - RNA, 23 nt, Homo sapiens
ccuggucauacauaggaugacaa

SEQ ID NO: 1749642 - RNA, 23 nt, Homo sapiens
acagccccacccuggugggccaa

SEQ ID NO: 1749643 - RNA, 18 nt, Homo sapiens
caaagcacauagagccag

SEQ ID NO: 1749644 - RNA, 23 nt, Homo sapiens
auucugagguaaccucauuauca

SEQ ID NO: 1749645 - RNA, 17 nt, Homo sapiens
cuuuuccauugcuuauu

SEQ ID NO: 1749646 - RNA, 21 nt, Homo sapiens
cucaugugaucacaauuugca

SEQ ID NO: 1749647 - RNA, 13 nt, Homo sapiens
gccuccugugacg

SEQ ID NO: 1749648 - RNA, 13 nt, Homo sapiens
gcaccuuugcacg

SEQ ID NO: 1749649 - RNA, 15 nt, Homo sapiens
ugaacacacucagca

SEQ ID NO: 1749650 - RNA, 18 nt, Homo sapiens
caaaugucuacugaagcu

SEQ ID NO: 1749651 - RNA, 14 nt, Homo sapiens
gaaggcaaacccau

SEQ ID NO: 1749652 - RNA, 19 nt, Homo sapiens
ucucuaacuccugccauuc

SEQ ID NO: 1749653 - RNA, 19 nt, Homo sapiens
agaucauccuuuccagcau

SEQ ID NO: 1749654 - RNA, 23 nt, Homo sapiens
ugguuuauuugcaguaauuugca

SEQ ID NO: 1749655 - RNA, 19 nt, Homo sapiens
gaaaacuggaaaucuggau

SEQ ID NO: 1749656 - RNA, 10 nt, Homo sapiens
aauugcacca

SEQ ID NO: 1749657 - RNA, 18 nt, Homo sapiens
caauggagucugcaguga

SEQ ID NO: 1749658 - RNA, 17 nt, Homo sapiens
uguccucacugcugauu

SEQ ID NO: 1749659 - RNA, 13 nt, Homo sapiens
aggcccuuaggga

SEQ ID NO: 1749660 - RNA, 15 nt, Homo sapiens
uguucugaacugugg

SEQ ID NO: 1749661 - RNA, 16 nt, Homo sapiens
caguagucccugcaca

SEQ ID NO: 1749662 - RNA, 13 nt, Homo sapiens
gucaugugccuug

SEQ ID NO: 1749663 - RNA, 14 nt, Homo sapiens
uagaucuaguucuc

SEQ ID NO: 1749664 - RNA, 15 nt, Homo sapiens
cucucaucaacugaa

SEQ ID NO: 1749665 - RNA, 13 nt, Homo sapiens
agggacaggagaa

SEQ ID NO: 1749666 - RNA, 20 nt, Homo sapiens
ucaggggaucggcugggaac

SEQ ID NO: 1749667 - RNA, 16 nt, Homo sapiens
cuugaagcaaaugugu

SEQ ID NO: 1749668 - RNA, 15 nt, Homo sapiens
cuuucuggaaaagag

SEQ ID NO: 1749669 - RNA, 18 nt, Homo sapiens
caggggcugcauccucag

SEQ ID NO: 1749670 - RNA, 21 nt, Homo sapiens
ucagaaaugucuggagaauaa

SEQ ID NO: 1749671 - RNA, 13 nt, Homo sapiens
uacuaaaguauug

SEQ ID NO: 1749672 - RNA, 16 nt, Homo sapiens
gucccgugcauggguu

SEQ ID NO: 1749673 - RNA, 18 nt, Homo sapiens
uuucuuacccauauaucu

SEQ ID NO: 1749674 - RNA, 19 nt, Homo sapiens
uggaagaggggacaggucc

SEQ ID NO: 1749675 - RNA, 16 nt, Homo sapiens
uuauauauuacuuguu

SEQ ID NO: 1749676 - RNA, 16 nt, Homo sapiens
ugagcugggggaagaa

SEQ ID NO: 1749677 - RNA, 17 nt, Homo sapiens
ugcugaccagcacugac

SEQ ID NO: 1749678 - RNA, 13 nt, Homo sapiens
aggcucccggggc

SEQ ID NO: 1749679 - RNA, 19 nt, Homo sapiens
gcgucacaucugcagugga

SEQ ID NO: 1749680 - RNA, 17 nt, Homo sapiens
caucucucagaagggag

SEQ ID NO: 1749681 - RNA, 14 nt, Homo sapiens
augaaaucugggca

SEQ ID NO: 1749682 - RNA, 21 nt, Homo sapiens
auguggcacguaaggucucau

SEQ ID NO: 1749683 - RNA, 15 nt, Homo sapiens
auuaauaauuccaac

SEQ ID NO: 1749684 - RNA, 16 nt, Homo sapiens
uggugcgggcaccugu

SEQ ID NO: 1749685 - RNA, 14 nt, Homo sapiens
uagcacaucacuga

SEQ ID NO: 1749686 - RNA, 14 nt, Homo sapiens
caccacauuaguga

SEQ ID NO: 1749687 - RNA, 15 nt, Homo sapiens
caaugcugagaauga

SEQ ID NO: 1749688 - RNA, 17 nt, Homo sapiens
aacagaaauccuuucau

SEQ ID NO: 1749689 - RNA, 13 nt, Homo sapiens
gcuccacuguaaa

SEQ ID NO: 1749690 - RNA, 13 nt, Homo sapiens
gccaauauaacua

SEQ ID NO: 1749691 - RNA, 21 nt, Homo sapiens
acuggagaugacagugaugcu

SEQ ID NO: 1749692 - RNA, 13 nt, Homo sapiens
aacauuaugccuu

SEQ ID NO: 1749693 - RNA, 20 nt, Homo sapiens
cuccccagggaagacccuga

SEQ ID NO: 1749694 - RNA, 12 nt, Homo sapiens
cacaggucccac

SEQ ID NO: 1749695 - RNA, 16 nt, Homo sapiens
uggaaagacugggaca

SEQ ID NO: 1749696 - RNA, 22 nt, Homo sapiens
agguugaagcagaauugcuuga

SEQ ID NO: 1749697 - RNA, 17 nt, Homo sapiens
ggccaccucuugcuugg

SEQ ID NO: 1749698 - RNA, 20 nt, Homo sapiens
cucauaaaauggaagcaauu

SEQ ID NO: 1749699 - RNA, 17 nt, Homo sapiens
aaauuugcuucacucaa

SEQ ID NO: 1749700 - RNA, 15 nt, Homo sapiens
cacgcguccucgggc

SEQ ID NO: 1749701 - RNA, 17 nt, Homo sapiens
acgugggcggcagagag

SEQ ID NO: 1749702 - RNA, 21 nt, Homo sapiens
ccaagagucuggggaccagcu

SEQ ID NO: 1749703 - RNA, 21 nt, Homo sapiens
uggcuccaaggugcucugugu

SEQ ID NO: 1749704 - RNA, 21 nt, Homo sapiens
auaaaucguccucccaggcca

SEQ ID NO: 1749705 - RNA, 22 nt, Homo sapiens
augucuguuguuggucaucucu

SEQ ID NO: 1749706 - RNA, 15 nt, Homo sapiens
accuaguguuuacuc

SEQ ID NO: 1749707 - RNA, 20 nt, Homo sapiens
acauucugcucugcccaugc

SEQ ID NO: 1749708 - RNA, 14 nt, Homo sapiens
agguagagugguca

SEQ ID NO: 1749709 - RNA, 14 nt, Homo sapiens
acauacuguucacu

SEQ ID NO: 1749710 - RNA, 16 nt, Homo sapiens
acugcagacauucuca

SEQ ID NO: 1749711 - RNA, 17 nt, Homo sapiens
uacuguaguucacugua

SEQ ID NO: 1749712 - RNA, 17 nt, Homo sapiens
cucagaguccugcugcc

SEQ ID NO: 1749713 - RNA, 20 nt, Homo sapiens
acaauauauuuaguuguaaa

SEQ ID NO: 1749714 - RNA, 17 nt, Homo sapiens
cuccugaccucagguga

SEQ ID NO: 1749715 - RNA, 13 nt, Homo sapiens
uccucacuugccc

SEQ ID NO: 1749716 - RNA, 13 nt, Homo sapiens
cgucuacuccuuu

SEQ ID NO: 1749717 - RNA, 14 nt, Homo sapiens
uuacuuucucccaa

SEQ ID NO: 1749718 - RNA, 18 nt, Homo sapiens
gcucaguaacacagugca

SEQ ID NO: 1749719 - RNA, 22 nt, Homo sapiens
uaucaaaaaugcaaauucucag

SEQ ID NO: 1749720 - RNA, 18 nt, Homo sapiens
gaaacggccccauugccu

SEQ ID NO: 1749721 - RNA, 22 nt, Homo sapiens
aaugcaccucuuguuacucccu

SEQ ID NO: 1749722 - RNA, 14 nt, Homo sapiens
agaaacacccucac

SEQ ID NO: 1749723 - RNA, 19 nt, Homo sapiens
acagagcaugcaagaacuu

SEQ ID NO: 1749724 - RNA, 15 nt, Homo sapiens
cucagcuaaugucac

SEQ ID NO: 1749725 - RNA, 20 nt, Homo sapiens
auccucacugggugggguga

SEQ ID NO: 1749726 - RNA, 14 nt, Homo sapiens
uacugaacuguuac

SEQ ID NO: 1749727 - RNA, 21 nt, Homo sapiens
uacacugaucaauuucaacau

SEQ ID NO: 1749728 - RNA, 12 nt, Homo sapiens
cuggaaucugaa

SEQ ID NO: 1749729 - RNA, 14 nt, Homo sapiens
cucgaaacacagaa

SEQ ID NO: 1749730 - RNA, 11 nt, Homo sapiens
gcuguuucauc

SEQ ID NO: 1749731 - RNA, 23 nt, Homo sapiens
gucccaugugauuuaaacaaaca

SEQ ID NO: 1749732 - RNA, 21 nt, Homo sapiens
uacauggggcucacucaggca

SEQ ID NO: 1749733 - RNA, 21 nt, Homo sapiens
cuauguuaauauuuuaugugu

SEQ ID NO: 1749734 - RNA, 13 nt, Homo sapiens
ucugcccaccuac

SEQ ID NO: 1749735 - RNA, 23 nt, Homo sapiens
gacuccaaagaaauguaagggaa

SEQ ID NO: 1749736 - RNA, 16 nt, Homo sapiens
gcaacauuguccuuaa

SEQ ID NO: 1749737 - RNA, 14 nt, Homo sapiens
uacuuaaguagccu

SEQ ID NO: 1749738 - RNA, 14 nt, Homo sapiens
auauuuuagaagcu

SEQ ID NO: 1749739 - RNA, 21 nt, Homo sapiens
ucuguccuggaggcacuggga

SEQ ID NO: 1749740 - RNA, 16 nt, Homo sapiens
cugauguuucugugaa

SEQ ID NO: 1749741 - RNA, 18 nt, Homo sapiens
agugaagaaucuaaugaa

SEQ ID NO: 1749742 - RNA, 19 nt, Homo sapiens
agacaauccacucucagga

SEQ ID NO: 1749743 - RNA, 16 nt, Homo sapiens
acacuaucaacacugc

SEQ ID NO: 1749744 - RNA, 19 nt, Homo sapiens
ugccuuaggguagugcuaa

SEQ ID NO: 1749745 - RNA, 22 nt, Homo sapiens
auauccaggaauauaugucagu

SEQ ID NO: 1749746 - RNA, 21 nt, Homo sapiens
guacuuaucccugcucuccca

SEQ ID NO: 1749747 - RNA, 19 nt, Homo sapiens
guggcgcccccugguggga

SEQ ID NO: 1749748 - RNA, 21 nt, Homo sapiens
gcguggagacuggcaggcggg

SEQ ID NO: 1749749 - RNA, 17 nt, Homo sapiens
cuggaugaaauaacucc

SEQ ID NO: 1749750 - RNA, 14 nt, Homo sapiens
uuuuccuguccugc

SEQ ID NO: 1749751 - RNA, 15 nt, Homo sapiens
ugguggaaacagugg

SEQ ID NO: 1749752 - RNA, 15 nt, Homo sapiens
uuaaagaauuuucaa

SEQ ID NO: 1749753 - RNA, 15 nt, Homo sapiens
ucacauuuacuagcu

SEQ ID NO: 1749754 - RNA, 12 nt, Homo sapiens
auuuugcacagu

SEQ ID NO: 1749755 - RNA, 21 nt, Homo sapiens
uuauauauguauaucugugua

SEQ ID NO: 1749756 - RNA, 18 nt, Homo sapiens
uaacagccucagcacauc

SEQ ID NO: 1749757 - RNA, 15 nt, Homo sapiens
ggccugcacuggugu

SEQ ID NO: 1749758 - RNA, 13 nt, Homo sapiens
acaguuuacuugg

SEQ ID NO: 1749759 - RNA, 16 nt, Homo sapiens
aaaaauaaaaaagauc

SEQ ID NO: 1749760 - RNA, 16 nt, Homo sapiens
augcauaaaugcgauc

SEQ ID NO: 1749761 - RNA, 21 nt, Homo sapiens
cuacuguuaucaguaaugcua

SEQ ID NO: 1749762 - RNA, 14 nt, Homo sapiens
acugagaugucaga

SEQ ID NO: 1749763 - RNA, 21 nt, Homo sapiens
gccuggaggaaucacugggga

SEQ ID NO: 1749764 - RNA, 19 nt, Homo sapiens
aaggagaacaagagaccag

SEQ ID NO: 1749765 - RNA, 19 nt, Homo sapiens
acccaagucuugagcaaug

SEQ ID NO: 1749766 - RNA, 15 nt, Homo sapiens
accuagggcacuuua

SEQ ID NO: 1749767 - RNA, 21 nt, Homo sapiens
ugcucaguuuuucuguguuuc

SEQ ID NO: 1749768 - RNA, 12 nt, Homo sapiens
cuggagggcuag

SEQ ID NO: 1749769 - RNA, 18 nt, Homo sapiens
gaagggcuggaaacaagu

SEQ ID NO: 1749770 - RNA, 12 nt, Homo sapiens
caaacuacuuca

SEQ ID NO: 1749771 - RNA, 13 nt, Homo sapiens
ucauuagcaguug

SEQ ID NO: 1749772 - RNA, 20 nt, Homo sapiens
guuggugaauuucacaagcu

SEQ ID NO: 1749773 - RNA, 20 nt, Homo sapiens
cacuugcagucuuguagcua

SEQ ID NO: 1749774 - RNA, 20 nt, Homo sapiens
cucaguuggaaucauugcua

SEQ ID NO: 1749775 - RNA, 15 nt, Homo sapiens
uuaaucugcugccau

SEQ ID NO: 1749776 - RNA, 15 nt, Homo sapiens
acugcugucuuccaa

SEQ ID NO: 1749777 - RNA, 11 nt, Homo sapiens
uuggugccuuu

SEQ ID NO: 1749778 - RNA, 22 nt, Homo sapiens
gccagcuuacuagcacuuugag

SEQ ID NO: 1749779 - RNA, 20 nt, Homo sapiens
guacucuuaacuccuagccc

SEQ ID NO: 1749780 - RNA, 17 nt, Homo sapiens
ugccaucacugagcaua

SEQ ID NO: 1749781 - RNA, 18 nt, Homo sapiens
gaccuauuagaguauuuu

SEQ ID NO: 1749782 - RNA, 16 nt, Homo sapiens
ugcccugguccaggga

SEQ ID NO: 1749783 - RNA, 20 nt, Homo sapiens
augccaacaagaaugcauug

SEQ ID NO: 1749784 - RNA, 16 nt, Homo sapiens
cacuggggaagccagu

SEQ ID NO: 1749785 - RNA, 17 nt, Homo sapiens
cauaguaccucugcuau

SEQ ID NO: 1749786 - RNA, 22 nt, Homo sapiens
cauggcuuaaugcuucuuucau

SEQ ID NO: 1749787 - RNA, 14 nt, Homo sapiens
ucagcccagugcaa

SEQ ID NO: 1749788 - RNA, 16 nt, Homo sapiens
gaagcugggcucuuuu

SEQ ID NO: 1749789 - RNA, 18 nt, Homo sapiens
ucccagaaacaucucugg

SEQ ID NO: 1749790 - RNA, 19 nt, Homo sapiens
uugguuagacgccuuccag

SEQ ID NO: 1749791 - RNA, 20 nt, Homo sapiens
gagauugcgccacugcacuc

SEQ ID NO: 1749792 - RNA, 20 nt, Homo sapiens
gagaaacauuauugucaacu

SEQ ID NO: 1749793 - RNA, 11 nt, Homo sapiens
cuuccaaggau

SEQ ID NO: 1749794 - RNA, 19 nt, Homo sapiens
augauaaauguacagagua

SEQ ID NO: 1749795 - RNA, 18 nt, Homo sapiens
aagucugggauguagaac

SEQ ID NO: 1749796 - RNA, 15 nt, Homo sapiens
aaaacacugugcaca

SEQ ID NO: 1749797 - RNA, 19 nt, Homo sapiens
uugccucccagcuucuuau

SEQ ID NO: 1749798 - RNA, 18 nt, Homo sapiens
uggagagggcagggucca

SEQ ID NO: 1749799 - RNA, 15 nt, Homo sapiens
aauaaauaccaaaaa

SEQ ID NO: 1749800 - RNA, 14 nt, Homo sapiens
gcuaucugaacuaa

SEQ ID NO: 1749801 - RNA, 20 nt, Homo sapiens
gccggggugggguggcugca

SEQ ID NO: 1749802 - RNA, 18 nt, Homo sapiens
uuuaaaacaagcugauag

SEQ ID NO: 1749803 - RNA, 23 nt, Homo sapiens
uuagcuuuguguuugguuuacau

SEQ ID NO: 1749804 - RNA, 18 nt, Homo sapiens
augcaucuggcccaggaa

SEQ ID NO: 1749805 - RNA, 16 nt, Homo sapiens
gaggccacacucagca

SEQ ID NO: 1749806 - RNA, 23 nt, Homo sapiens
uuuaaauauuaucuaacagacaa

SEQ ID NO: 1749807 - RNA, 12 nt, Homo sapiens
gugaaccacugu

SEQ ID NO: 1749808 - RNA, 23 nt, Homo sapiens
ucagaucguucauugccuuucca

SEQ ID NO: 1749809 - RNA, 14 nt, Homo sapiens
ugaaagcaacagcu

SEQ ID NO: 1749810 - RNA, 13 nt, Homo sapiens
agacacaguauug

SEQ ID NO: 1749811 - RNA, 15 nt, Homo sapiens
cuuccagcuagugac

SEQ ID NO: 1749812 - RNA, 17 nt, Homo sapiens
uggauucauucucauaa

SEQ ID NO: 1749813 - RNA, 17 nt, Homo sapiens
cugagggcuuccuuugg

SEQ ID NO: 1749814 - RNA, 22 nt, Homo sapiens
cccugucuguuugccacaccca

SEQ ID NO: 1749815 - RNA, 14 nt, Homo sapiens
guccuugaugcuca

SEQ ID NO: 1749816 - RNA, 19 nt, Homo sapiens
auuaauuccaacuguacuu

SEQ ID NO: 1749817 - RNA, 19 nt, Homo sapiens
ggcaaaggucccugagcuc

SEQ ID NO: 1749818 - RNA, 14 nt, Homo sapiens
guugggcugagacc

SEQ ID NO: 1749819 - RNA, 13 nt, Homo sapiens
agcugcauaugau

SEQ ID NO: 1749820 - RNA, 15 nt, Homo sapiens
cuuuacaaaaguauu

SEQ ID NO: 1749821 - RNA, 15 nt, Homo sapiens
uuauuauauugucga

SEQ ID NO: 1749822 - RNA, 23 nt, Homo sapiens
uaaauacacaacacacacacucu

SEQ ID NO: 1749823 - RNA, 23 nt, Homo sapiens
auuaaaagguaauuguagcacau

SEQ ID NO: 1749824 - RNA, 16 nt, Homo sapiens
ugccaaugccaugacu

SEQ ID NO: 1749825 - RNA, 15 nt, Homo sapiens
acuaccaauuuccca

SEQ ID NO: 1749826 - RNA, 21 nt, Homo sapiens
agaggcaucccaagaccucau

SEQ ID NO: 1749827 - RNA, 15 nt, Homo sapiens
aaucaccuugcauuu

SEQ ID NO: 1749828 - RNA, 19 nt, Homo sapiens
uacauguguggauguguaa

SEQ ID NO: 1749829 - RNA, 23 nt, Homo sapiens
uccauguuguaaaggaacagccc

SEQ ID NO: 1749830 - RNA, 19 nt, Homo sapiens
uccagaaagcaccaaggaa

SEQ ID NO: 1749831 - RNA, 23 nt, Homo sapiens
gauaaacugauuuaucuauuuaa

SEQ ID NO: 1749832 - RNA, 20 nt, Homo sapiens
uuugugggcccagcuacaag

SEQ ID NO: 1749833 - RNA, 20 nt, Homo sapiens
acuugguuuccuauuucccc

SEQ ID NO: 1749834 - RNA, 14 nt, Homo sapiens
uguaugguguguga

SEQ ID NO: 1749835 - RNA, 18 nt, Homo sapiens
cugcauuuuacuguacag

SEQ ID NO: 1749836 - RNA, 17 nt, Homo sapiens
aaaggccaauauaccua

SEQ ID NO: 1749837 - RNA, 18 nt, Homo sapiens
uggacuuucuugcaugaa

SEQ ID NO: 1749838 - RNA, 16 nt, Homo sapiens
augcaaaagucuuccu

SEQ ID NO: 1749839 - RNA, 16 nt, Homo sapiens
augcaaaugucuucca

SEQ ID NO: 1749840 - RNA, 21 nt, Homo sapiens
ucccuccccaaacccaucaga

SEQ ID NO: 1749841 - RNA, 23 nt, Homo sapiens
cagccagugccauuccacuccac

SEQ ID NO: 1749842 - RNA, 23 nt, Homo sapiens
gcuaggaaauccagggugguggu

SEQ ID NO: 1749843 - RNA, 16 nt, Homo sapiens
uucuaaugugcauuaa

SEQ ID NO: 1749844 - RNA, 18 nt, Homo sapiens
agcccugaccccagugua

SEQ ID NO: 1749845 - RNA, 17 nt, Homo sapiens
gggcucagggcaguggc

SEQ ID NO: 1749846 - RNA, 12 nt, Homo sapiens
cucauagcuuug

SEQ ID NO: 1749847 - RNA, 21 nt, Homo sapiens
cucaacuaggcucauacucaa

SEQ ID NO: 1749848 - RNA, 15 nt, Homo sapiens
cuuucuuauuuugua

SEQ ID NO: 1749849 - RNA, 17 nt, Homo sapiens
cugauucucuaugacau

SEQ ID NO: 1749850 - RNA, 20 nt, Homo sapiens
uccaucacagccagcccagc

SEQ ID NO: 1749851 - RNA, 15 nt, Homo sapiens
gcggagagagccaag

SEQ ID NO: 1749852 - RNA, 19 nt, Homo sapiens
uguacccucgcaugacugu

SEQ ID NO: 1749853 - RNA, 14 nt, Homo sapiens
ccucagucccucuu

SEQ ID NO: 1749854 - RNA, 14 nt, Homo sapiens
aaguggugcuccaa

SEQ ID NO: 1749855 - RNA, 16 nt, Homo sapiens
uuugcaccugcucucu

SEQ ID NO: 1749856 - RNA, 18 nt, Homo sapiens
aaucaccuaccuucacca

SEQ ID NO: 1749857 - RNA, 21 nt, Homo sapiens
aucuagcuuauuuugaggcuu

SEQ ID NO: 1749858 - RNA, 12 nt, Homo sapiens
auccagugacaa

SEQ ID NO: 1749859 - RNA, 22 nt, Homo sapiens
cuucagguucuuucugaaaucg

SEQ ID NO: 1749860 - RNA, 14 nt, Homo sapiens
ucagcuggcacugu

SEQ ID NO: 1749861 - RNA, 18 nt, Homo sapiens
ugauccugcaauuccacu

SEQ ID NO: 1749862 - RNA, 17 nt, Homo sapiens
auucuuaauuuauguaa

SEQ ID NO: 1749863 - RNA, 17 nt, Homo sapiens
uagcagacuagaauucu

SEQ ID NO: 1749864 - RNA, 15 nt, Homo sapiens
cuucaaguagauugg

SEQ ID NO: 1749865 - RNA, 13 nt, Homo sapiens
ugcuggaacuguu

SEQ ID NO: 1749866 - RNA, 15 nt, Homo sapiens
acuagacaaguccag

SEQ ID NO: 1749867 - RNA, 21 nt, Homo sapiens
uguguccuggggacuuccuca

SEQ ID NO: 1749868 - RNA, 14 nt, Homo sapiens
ugugacuucuugca

SEQ ID NO: 1749869 - RNA, 13 nt, Homo sapiens
gaaaaaucauaac

SEQ ID NO: 1749870 - RNA, 19 nt, Homo sapiens
agguggauccuguaggcua

SEQ ID NO: 1749871 - RNA, 17 nt, Homo sapiens
gccuguggcaugaagau

SEQ ID NO: 1749872 - RNA, 18 nt, Homo sapiens
cugcacguucauaaccaa

SEQ ID NO: 1749873 - RNA, 9 nt, Homo sapiens
caaugccau

SEQ ID NO: 1749874 - RNA, 18 nt, Homo sapiens
gaaacccucacucucuac

SEQ ID NO: 1749875 - RNA, 13 nt, Homo sapiens
caacaacgacaca

SEQ ID NO: 1749876 - RNA, 14 nt, Homo sapiens
cuauguacugccuu

SEQ ID NO: 1749877 - RNA, 15 nt, Homo sapiens
ugaaaaucaguuuua

SEQ ID NO: 1749878 - RNA, 22 nt, Homo sapiens
caguuguugaaugacugaccca

SEQ ID NO: 1749879 - RNA, 22 nt, Homo sapiens
gcacacugcuugugaaaggaaa

SEQ ID NO: 1749880 - RNA, 15 nt, Homo sapiens
aaaugacgucuucac

SEQ ID NO: 1749881 - RNA, 17 nt, Homo sapiens
gaucaaauugugcagua

SEQ ID NO: 1749882 - RNA, 22 nt, Homo sapiens
cuguggguagacacacaugaag

SEQ ID NO: 1749883 - RNA, 18 nt, Homo sapiens
uggcguaaguacagagaa

SEQ ID NO: 1749884 - RNA, 13 nt, Homo sapiens
ucaaugucuuccc

SEQ ID NO: 1749885 - RNA, 17 nt, Homo sapiens
gcagaaacacacaguca

SEQ ID NO: 1749886 - RNA, 21 nt, Homo sapiens
caagugucugugcaugucccc

SEQ ID NO: 1749887 - RNA, 21 nt, Homo sapiens
uccuuaaaacaauucugugac

SEQ ID NO: 1749888 - RNA, 18 nt, Homo sapiens
aaucuucaaagccuucuc

SEQ ID NO: 1749889 - RNA, 13 nt, Homo sapiens
uaacauauucuaa

SEQ ID NO: 1749890 - RNA, 19 nt, Homo sapiens
aacaauaccugaaugcucu

SEQ ID NO: 1749891 - RNA, 16 nt, Homo sapiens
aucuuuacguacugua

SEQ ID NO: 1749892 - RNA, 19 nt, Homo sapiens
uagaauaaaguuccuguca

SEQ ID NO: 1749893 - RNA, 16 nt, Homo sapiens
ggcucuucucauuuca

SEQ ID NO: 1749894 - RNA, 14 nt, Homo sapiens
ucggguccaugugu

SEQ ID NO: 1749895 - RNA, 17 nt, Homo sapiens
cagggaccccugcccuu

SEQ ID NO: 1749896 - RNA, 23 nt, Homo sapiens
agaaauuuucauucagguauuug

SEQ ID NO: 1749897 - RNA, 19 nt, Homo sapiens
uauaaauggaauuacacaa

SEQ ID NO: 1749898 - RNA, 23 nt, Homo sapiens
ugugcccacgaagacaaccauca

SEQ ID NO: 1749899 - RNA, 17 nt, Homo sapiens
ugcggcauuaaagccau

SEQ ID NO: 1749900 - RNA, 22 nt, Homo sapiens
gauguccuuccaagaauggaau

SEQ ID NO: 1749901 - RNA, 23 nt, Homo sapiens
ucuuuucuaaguggcgugugcau

SEQ ID NO: 1749902 - RNA, 23 nt, Homo sapiens
ugauuccaaauaaguugcgcuua

SEQ ID NO: 1749903 - RNA, 16 nt, Homo sapiens
caagaccucugugcac

SEQ ID NO: 1749904 - RNA, 22 nt, Homo sapiens
acucuucugagcaccuacuuac

SEQ ID NO: 1749905 - RNA, 17 nt, Homo sapiens
aaaugccccucccagau

SEQ ID NO: 1749906 - RNA, 22 nt, Homo sapiens
cucguauguguguuuaccuaaa

SEQ ID NO: 1749907 - RNA, 18 nt, Homo sapiens
cauguggcguauugggcc

SEQ ID NO: 1749908 - RNA, 18 nt, Homo sapiens
uucacagcccauaauuca

SEQ ID NO: 1749909 - RNA, 23 nt, Homo sapiens
cucccuuucuaucguucucucuu

SEQ ID NO: 1749910 - RNA, 17 nt, Homo sapiens
caggcaguuaggugcug

SEQ ID NO: 1749911 - RNA, 17 nt, Homo sapiens
gaggguuggagugcucu

SEQ ID NO: 1749912 - RNA, 16 nt, Homo sapiens
gaaaaggaauuccucu

SEQ ID NO: 1749913 - RNA, 18 nt, Homo sapiens
cuauucaauucuuuuaac

SEQ ID NO: 1749914 - RNA, 23 nt, Homo sapiens
aguuacccugcauguuggcccag

SEQ ID NO: 1749915 - RNA, 21 nt, Homo sapiens
ccauguccauaugcaucuacu

SEQ ID NO: 1749916 - RNA, 22 nt, Homo sapiens
acauuuaucaacuguugauaca

SEQ ID NO: 1749917 - RNA, 21 nt, Homo sapiens
gacugcaacaggcuugugcaa

SEQ ID NO: 1749918 - RNA, 20 nt, Homo sapiens
cucccacugucugcccugaa

SEQ ID NO: 1749919 - RNA, 15 nt, Homo sapiens
ucugcaguagucucu

SEQ ID NO: 1749920 - RNA, 20 nt, Homo sapiens
ucaagcagccaagggaugaa

SEQ ID NO: 1749921 - RNA, 17 nt, Homo sapiens
ugggaggucaaggugag

SEQ ID NO: 1749922 - RNA, 18 nt, Homo sapiens
caucuuuauuaaguagau

SEQ ID NO: 1749923 - RNA, 22 nt, Homo sapiens
uauagcucaggaccugggaccu

SEQ ID NO: 1749924 - RNA, 20 nt, Homo sapiens
ugcuucugcauacuguguua

SEQ ID NO: 1749925 - RNA, 14 nt, Homo sapiens
agguccugccaugg

SEQ ID NO: 1749926 - RNA, 14 nt, Homo sapiens
acugaguugcacau

SEQ ID NO: 1749927 - RNA, 18 nt, Homo sapiens
agagaagaccucugugag

SEQ ID NO: 1749928 - RNA, 15 nt, Homo sapiens
ucagaggccaucuga

SEQ ID NO: 1749929 - RNA, 18 nt, Homo sapiens
uccuuaaugucaccaugc

SEQ ID NO: 1749930 - RNA, 17 nt, Homo sapiens
ugugcuaagcuuuacag

SEQ ID NO: 1749931 - RNA, 11 nt, Homo sapiens
cucgugcagua

SEQ ID NO: 1749932 - RNA, 20 nt, Homo sapiens
ucccucgcccccacacccca

SEQ ID NO: 1749933 - RNA, 14 nt, Homo sapiens
gucagucagggaca

SEQ ID NO: 1749934 - RNA, 19 nt, Homo sapiens
ccagcgagucuggagacca

SEQ ID NO: 1749935 - RNA, 15 nt, Homo sapiens
uauucuuguaaauac

SEQ ID NO: 1749936 - RNA, 15 nt, Homo sapiens
gagcugagugcugaa

SEQ ID NO: 1749937 - RNA, 18 nt, Homo sapiens
acaugcagaguugugcau

SEQ ID NO: 1749938 - RNA, 20 nt, Homo sapiens
ggccaugucuccugcauagc

SEQ ID NO: 1749939 - RNA, 20 nt, Homo sapiens
uuccuuuuagucuagccuug

SEQ ID NO: 1749940 - RNA, 23 nt, Homo sapiens
ccaguuaucuugaguugcagcuc

SEQ ID NO: 1749941 - RNA, 23 nt, Homo sapiens
ugcuagcucugagccaguucagu

SEQ ID NO: 1749942 - RNA, 18 nt, Homo sapiens
agauuagcuaggggacag

SEQ ID NO: 1749943 - RNA, 17 nt, Homo sapiens
cauguuggccucuucag

SEQ ID NO: 1749944 - RNA, 21 nt, Homo sapiens
uaucauuaucuuugcuguuau

SEQ ID NO: 1749945 - RNA, 22 nt, Homo sapiens
cuuugacaauuacucagguuug

SEQ ID NO: 1749946 - RNA, 20 nt, Homo sapiens
uccgggaacagugcaugugc

SEQ ID NO: 1749947 - RNA, 11 nt, Homo sapiens
gaaaggccagc

SEQ ID NO: 1749948 - RNA, 22 nt, Homo sapiens
aggaggcaaagguucuaucugc

SEQ ID NO: 1749949 - RNA, 22 nt, Homo sapiens
aggcaccuggccugcugggaac

SEQ ID NO: 1749950 - RNA, 22 nt, Homo sapiens
ccgaaggugcuggaggugggag

SEQ ID NO: 1749951 - RNA, 18 nt, Homo sapiens
uaaaagcgaccucucuug

SEQ ID NO: 1749952 - RNA, 24 nt, Homo sapiens
uguaagcucuuugaaacaacuuuc

SEQ ID NO: 1749953 - RNA, 16 nt, Homo sapiens
ugccacuguguacugu

SEQ ID NO: 1749954 - RNA, 23 nt, Homo sapiens
ucacuucacagcccugcagugcc

SEQ ID NO: 1749955 - RNA, 19 nt, Homo sapiens
ucaauuagggaugcucaaa

SEQ ID NO: 1749956 - RNA, 15 nt, Homo sapiens
aggagcaugcuuccu

SEQ ID NO: 1749957 - RNA, 19 nt, Homo sapiens
auugaccaagaacugcaug

SEQ ID NO: 1749958 - RNA, 20 nt, Homo sapiens
gaacguacccaaggucacau

SEQ ID NO: 1749959 - RNA, 13 nt, Homo sapiens
ugagccuuggccc

SEQ ID NO: 1749960 - RNA, 14 nt, Homo sapiens
acaacacaaucaaa

SEQ ID NO: 1749961 - RNA, 20 nt, Homo sapiens
uucaggccugcuagucacug

SEQ ID NO: 1749962 - RNA, 22 nt, Homo sapiens
auuuugcucugugaacuauccc

SEQ ID NO: 1749963 - RNA, 13 nt, Homo sapiens
uucuucguguaua

SEQ ID NO: 1749964 - RNA, 21 nt, Homo sapiens
auugacucaaucuuugccuaa

SEQ ID NO: 1749965 - RNA, 20 nt, Homo sapiens
uucaaguuugucacuaaacu

SEQ ID NO: 1749966 - RNA, 19 nt, Homo sapiens
uccgggacccccaggacag

SEQ ID NO: 1749967 - RNA, 16 nt, Homo sapiens
uggccuucgucuccau

SEQ ID NO: 1749968 - RNA, 17 nt, Homo sapiens
uaucuucaggacacuca

SEQ ID NO: 1749969 - RNA, 19 nt, Homo sapiens
agaucauuucuaggcaaaa

SEQ ID NO: 1749970 - RNA, 11 nt, Homo sapiens
caugauuuaga

SEQ ID NO: 1749971 - RNA, 14 nt, Homo sapiens
agugaccagugccu

SEQ ID NO: 1749972 - RNA, 14 nt, Homo sapiens
uuguauccuggcaa

SEQ ID NO: 1749973 - RNA, 18 nt, Homo sapiens
gaugucuguuugcugaug

SEQ ID NO: 1749974 - RNA, 19 nt, Homo sapiens
auuagcugggcauggugcg

SEQ ID NO: 1749975 - RNA, 22 nt, Homo sapiens
agaccaauuuuuugugugugaa

SEQ ID NO: 1749976 - RNA, 15 nt, Homo sapiens
gaaaagaagcuguca

SEQ ID NO: 1749977 - RNA, 20 nt, Homo sapiens
gcuccaaaggaaauccaaaa

SEQ ID NO: 1749978 - RNA, 17 nt, Homo sapiens
aaaugacauuucacuaa

SEQ ID NO: 1749979 - RNA, 17 nt, Homo sapiens
agugacuguuuggcuua

SEQ ID NO: 1749980 - RNA, 15 nt, Homo sapiens
cagcuggcacugaca

SEQ ID NO: 1749981 - RNA, 13 nt, Homo sapiens
aggcaaaggcaau

SEQ ID NO: 1749982 - RNA, 15 nt, Homo sapiens
cuucuccagugguca

SEQ ID NO: 1749983 - RNA, 12 nt, Homo sapiens
acucgcuguaug

SEQ ID NO: 1749984 - RNA, 20 nt, Homo sapiens
accugggagcaggggcaaug

SEQ ID NO: 1749985 - RNA, 23 nt, Homo sapiens
uucaugggaaaacagaccugugu

SEQ ID NO: 1749986 - RNA, 19 nt, Homo sapiens
auugagaaauaaagcacau

SEQ ID NO: 1749987 - RNA, 19 nt, Homo sapiens
caguagaaugggggcagca

SEQ ID NO: 1749988 - RNA, 17 nt, Homo sapiens
ugcugaguuucuguucu

SEQ ID NO: 1749989 - RNA, 15 nt, Homo sapiens
cuauuaaccauucua

SEQ ID NO: 1749990 - RNA, 14 nt, Homo sapiens
cgccgugaguucuc

SEQ ID NO: 1749991 - RNA, 19 nt, Homo sapiens
agcacuaagguggacagca

SEQ ID NO: 1749992 - RNA, 13 nt, Homo sapiens
caggccagucacc

SEQ ID NO: 1749993 - RNA, 20 nt, Homo sapiens
ucuacugucucaguuuacau

SEQ ID NO: 1749994 - RNA, 18 nt, Homo sapiens
auaaauacugcaaaucag

SEQ ID NO: 1749995 - RNA, 16 nt, Homo sapiens
cauaaaaucugugaau

SEQ ID NO: 1749996 - RNA, 18 nt, Homo sapiens
uggaauauguaaauagaa

SEQ ID NO: 1749997 - RNA, 19 nt, Homo sapiens
ccaccccauccgcaucuca

SEQ ID NO: 1749998 - RNA, 12 nt, Homo sapiens
aaggacugaccu

SEQ ID NO: 1749999 - RNA, 22 nt, Homo sapiens
ccccagguucuggaacagcuuu

SEQ ID NO: 1750000 - RNA, 15 nt, Homo sapiens
uggcuccaccacuga

SEQ ID NO: 1750001 - RNA, 11 nt, Homo sapiens
augcaguauug

SEQ ID NO: 1750002 - RNA, 16 nt, Homo sapiens
acagagcccugugagg

SEQ ID NO: 1750003 - RNA, 19 nt, Homo sapiens
cacuuauacccaugaacuu

SEQ ID NO: 1750004 - RNA, 17 nt, Homo sapiens
gaauuggcauguguaug

SEQ ID NO: 1750005 - RNA, 21 nt, Homo sapiens
cuccaguguugcuaugugcaa

SEQ ID NO: 1750006 - RNA, 18 nt, Homo sapiens
cccugcccccgcuccggc

SEQ ID NO: 1750007 - RNA, 23 nt, Homo sapiens
gcuggaauuacaaaacucagaga

SEQ ID NO: 1750008 - RNA, 18 nt, Homo sapiens
gcucauuucaguuucuau

SEQ ID NO: 1750009 - RNA, 20 nt, Homo sapiens
guaaaucagugcaguacuca

SEQ ID NO: 1750010 - RNA, 21 nt, Homo sapiens
gcuucuuuuggaaaguacuau

SEQ ID NO: 1750011 - RNA, 21 nt, Homo sapiens
gaacugcuaccaugaagugaa

SEQ ID NO: 1750012 - RNA, 16 nt, Homo sapiens
uggaucccugcccuuc

SEQ ID NO: 1750013 - RNA, 16 nt, Homo sapiens
agagggcugagccaug

SEQ ID NO: 1750014 - RNA, 21 nt, Homo sapiens
ccuggcccccacccucugcca

SEQ ID NO: 1750015 - RNA, 23 nt, Homo sapiens
uaaagguuucauguucacuguga

SEQ ID NO: 1750016 - RNA, 19 nt, Homo sapiens
aauccagagagcagugugg

SEQ ID NO: 1750017 - RNA, 14 nt, Homo sapiens
uaucuaagacucau

SEQ ID NO: 1750018 - RNA, 20 nt, Homo sapiens
gcagcauuguuggcuguucc

SEQ ID NO: 1750019 - RNA, 13 nt, Homo sapiens
gaagggaauuugg

SEQ ID NO: 1750020 - RNA, 17 nt, Homo sapiens
acuggcuucucuugagu

SEQ ID NO: 1750021 - RNA, 12 nt, Homo sapiens
gcccaguucucg

SEQ ID NO: 1750022 - RNA, 22 nt, Homo sapiens
cacaaggcagccugaacacuca

SEQ ID NO: 1750023 - RNA, 20 nt, Homo sapiens
aaauauugcuucaauuucaa

SEQ ID NO: 1750024 - RNA, 17 nt, Homo sapiens
ccuaaguagcuggguuu

SEQ ID NO: 1750025 - RNA, 16 nt, Homo sapiens
gagguuaaaaagaaaa

SEQ ID NO: 1750026 - RNA, 17 nt, Homo sapiens
uaaaagcaccauuguga

SEQ ID NO: 1750027 - RNA, 23 nt, Homo sapiens
cugagccaggagcuaaaaccuua

SEQ ID NO: 1750028 - RNA, 16 nt, Homo sapiens
accaucuuaaucuuua

SEQ ID NO: 1750029 - RNA, 15 nt, Homo sapiens
caagaguuuguucug

SEQ ID NO: 1750030 - RNA, 19 nt, Homo sapiens
cauugcugucuugccccag

SEQ ID NO: 1750031 - RNA, 16 nt, Homo sapiens
aauuacaguacacauc

SEQ ID NO: 1750032 - RNA, 20 nt, Homo sapiens
agcuagcuucugcaauguuu

SEQ ID NO: 1750033 - RNA, 16 nt, Homo sapiens
ccaccuuccuccagac

SEQ ID NO: 1750034 - RNA, 15 nt, Homo sapiens
cagagacagauaccu

SEQ ID NO: 1750035 - RNA, 20 nt, Homo sapiens
aguuuaggacccaagguggu

SEQ ID NO: 1750036 - RNA, 20 nt, Homo sapiens
cucuuuagccagaaucucau

SEQ ID NO: 1750037 - RNA, 22 nt, Homo sapiens
gccuaaaaauucccuuccuguu

SEQ ID NO: 1750038 - RNA, 21 nt, Homo sapiens
gcaugcucaguuggugcugcu

SEQ ID NO: 1750039 - RNA, 22 nt, Homo sapiens
ggguuuugcuuuagagugcaag

SEQ ID NO: 1750040 - RNA, 20 nt, Homo sapiens
ggcagugggucccacuuccc

SEQ ID NO: 1750041 - RNA, 14 nt, Homo sapiens
aaaagucagucuua

SEQ ID NO: 1750042 - RNA, 20 nt, Homo sapiens
gcaggggccccuccucugug

SEQ ID NO: 1750043 - RNA, 18 nt, Homo sapiens
caguguugacauagccuu

SEQ ID NO: 1750044 - RNA, 14 nt, Homo sapiens
ugaaaaucacuaua

SEQ ID NO: 1750045 - RNA, 17 nt, Homo sapiens
acgcagggcggucuucu

SEQ ID NO: 1750046 - RNA, 21 nt, Homo sapiens
caugcuacuuuuuuuuaguuc

SEQ ID NO: 1750047 - RNA, 17 nt, Homo sapiens
ggcaugagccacugagc

SEQ ID NO: 1750048 - RNA, 15 nt, Homo sapiens
uuggucccagacagc

SEQ ID NO: 1750049 - RNA, 21 nt, Homo sapiens
uuugagguagaaaugcaaggg

SEQ ID NO: 1750050 - RNA, 18 nt, Homo sapiens
cucaagaaacaacuucua

SEQ ID NO: 1750051 - RNA, 18 nt, Homo sapiens
gaaugccagcccaaagcu

SEQ ID NO: 1750052 - RNA, 20 nt, Homo sapiens
uuacuaaacauaugauuuca

SEQ ID NO: 1750053 - RNA, 20 nt, Homo sapiens
ugggaagagcguagacaggu

SEQ ID NO: 1750054 - RNA, 13 nt, Homo sapiens
uucagugugcaua

SEQ ID NO: 1750055 - RNA, 22 nt, Homo sapiens
cugagcaccagggagcaguugc

SEQ ID NO: 1750056 - RNA, 12 nt, Homo sapiens
agaagacauuuu

SEQ ID NO: 1750057 - RNA, 13 nt, Homo sapiens
cagcuuuacugug

SEQ ID NO: 1750058 - RNA, 18 nt, Homo sapiens
auuggagggaagacaggu

SEQ ID NO: 1750059 - RNA, 13 nt, Homo sapiens
aucaagguucagc

SEQ ID NO: 1750060 - RNA, 15 nt, Homo sapiens
ccugcuccgagucuu

SEQ ID NO: 1750061 - RNA, 18 nt, Homo sapiens
uucugccucuuaagccug

SEQ ID NO: 1750062 - RNA, 16 nt, Homo sapiens
uugauaaaugccucau

SEQ ID NO: 1750063 - RNA, 18 nt, Homo sapiens
uugccucaacuccaggau

SEQ ID NO: 1750064 - RNA, 23 nt, Homo sapiens
uauuuaaaucuugcaagaauauu

SEQ ID NO: 1750065 - RNA, 12 nt, Homo sapiens
uucagacuguuu

SEQ ID NO: 1750066 - RNA, 13 nt, Homo sapiens
uuaauaugcugca

SEQ ID NO: 1750067 - RNA, 15 nt, Homo sapiens
uuugacuuugccaaa

SEQ ID NO: 1750068 - RNA, 13 nt, Homo sapiens
aaggcccuuuuca

SEQ ID NO: 1750069 - RNA, 22 nt, Homo sapiens
uuuaauagcacuaaccaaugcc

SEQ ID NO: 1750070 - RNA, 18 nt, Homo sapiens
acagugaaaauguaagcu

SEQ ID NO: 1750071 - RNA, 15 nt, Homo sapiens
uccaaugcguggcuc

SEQ ID NO: 1750072 - RNA, 14 nt, Homo sapiens
ugcaaaguacugua

SEQ ID NO: 1750073 - RNA, 23 nt, Homo sapiens
agggccacauagaugcugaugga

SEQ ID NO: 1750074 - RNA, 18 nt, Homo sapiens
uaugagcugauuugguca

SEQ ID NO: 1750075 - RNA, 16 nt, Homo sapiens
aacagaaccacaaaaa

SEQ ID NO: 1750076 - RNA, 19 nt, Homo sapiens
aaccaaacggaacucuuca

SEQ ID NO: 1750077 - RNA, 14 nt, Homo sapiens
aaucccggcuguca

SEQ ID NO: 1750078 - RNA, 23 nt, Homo sapiens
acaucuuggucagauuugaacuc

SEQ ID NO: 1750079 - RNA, 13 nt, Homo sapiens
cgggguguugcca

SEQ ID NO: 1750080 - RNA, 23 nt, Homo sapiens
ggaugggaggagagccacugggc

SEQ ID NO: 1750081 - RNA, 19 nt, Homo sapiens
cauugacucuguggcuuug

SEQ ID NO: 1750082 - RNA, 13 nt, Homo sapiens
aauguuuaaucuc

SEQ ID NO: 1750083 - RNA, 10 nt, Homo sapiens
aucacuugcc

SEQ ID NO: 1750084 - RNA, 19 nt, Homo sapiens
cuccagcccagacccagug

SEQ ID NO: 1750085 - RNA, 18 nt, Homo sapiens
gugccagcccuggcagac

SEQ ID NO: 1750086 - RNA, 21 nt, Homo sapiens
ugaagccuaccagaagaacua

SEQ ID NO: 1750087 - RNA, 13 nt, Homo sapiens
gcacagccuggcu

SEQ ID NO: 1750088 - RNA, 15 nt, Homo sapiens
auuuccaucauguca

SEQ ID NO: 1750089 - RNA, 16 nt, Homo sapiens
uuggagaguuugccug

SEQ ID NO: 1750090 - RNA, 19 nt, Homo sapiens
acuggagaccagaaaccuu

SEQ ID NO: 1750091 - RNA, 20 nt, Homo sapiens
ggacuaacccaaugccugug

SEQ ID NO: 1750092 - RNA, 16 nt, Homo sapiens
gaugcaggauuucuuc

SEQ ID NO: 1750093 - RNA, 18 nt, Homo sapiens
uggcguggcagccucuug

SEQ ID NO: 1750094 - RNA, 18 nt, Homo sapiens
ucagagggcguguuguuu

SEQ ID NO: 1750095 - RNA, 14 nt, Homo sapiens
caucaugucuggcu

SEQ ID NO: 1750096 - RNA, 21 nt, Homo sapiens
guuuucacaaagaacaggaaa

SEQ ID NO: 1750097 - RNA, 18 nt, Homo sapiens
aacuacaacgaacacaag

SEQ ID NO: 1750098 - RNA, 13 nt, Homo sapiens
aauuuuuaggcaa

SEQ ID NO: 1750099 - RNA, 16 nt, Homo sapiens
cagcugcaucuacuca

SEQ ID NO: 1750100 - RNA, 14 nt, Homo sapiens
uaggcuacaguguc

SEQ ID NO: 1750101 - RNA, 19 nt, Homo sapiens
ggugaaacacuuugguauu

SEQ ID NO: 1750102 - RNA, 13 nt, Homo sapiens
gugccucagugcu

SEQ ID NO: 1750103 - RNA, 13 nt, Homo sapiens
ccuccucaccucu

SEQ ID NO: 1750104 - RNA, 16 nt, Homo sapiens
ccuauuuauucauuca

SEQ ID NO: 1750105 - RNA, 19 nt, Homo sapiens
caggacagaugccacacaa

SEQ ID NO: 1750106 - RNA, 12 nt, Homo sapiens
aagaaacuaccc

SEQ ID NO: 1750107 - RNA, 12 nt, Homo sapiens
gaggugcagcug

SEQ ID NO: 1750108 - RNA, 15 nt, Homo sapiens
caaggauggagcuga

SEQ ID NO: 1750109 - RNA, 21 nt, Homo sapiens
ucccucaggcuuguugcccuc

SEQ ID NO: 1750110 - RNA, 15 nt, Homo sapiens
ucuuuauuaaccuca

SEQ ID NO: 1750111 - RNA, 16 nt, Homo sapiens
cuagaauuugauaugu

SEQ ID NO: 1750112 - RNA, 17 nt, Homo sapiens
ccuguuuucauggacag

SEQ ID NO: 1750113 - RNA, 18 nt, Homo sapiens
ugccgaacauuaggaauu

SEQ ID NO: 1750114 - RNA, 23 nt, Homo sapiens
gcuacugugucagggaacauauu

SEQ ID NO: 1750115 - RNA, 13 nt, Homo sapiens
cucaggcaccugc

SEQ ID NO: 1750116 - RNA, 14 nt, Homo sapiens
uaaguuucugggac

SEQ ID NO: 1750117 - RNA, 14 nt, Homo sapiens
cuauuuucauugua

SEQ ID NO: 1750118 - RNA, 22 nt, Homo sapiens
aaaauaagcuauauuauacaaa

SEQ ID NO: 1750119 - RNA, 19 nt, Homo sapiens
ugguaugugacaccaaagc

SEQ ID NO: 1750120 - RNA, 14 nt, Homo sapiens
uaaugaggaacuaa

SEQ ID NO: 1750121 - RNA, 14 nt, Homo sapiens
uuuuauacuugaaa

SEQ ID NO: 1750122 - RNA, 16 nt, Homo sapiens
acuguauacagaauga

SEQ ID NO: 1750123 - RNA, 14 nt, Homo sapiens
uggagucauucuca

SEQ ID NO: 1750124 - RNA, 20 nt, Homo sapiens
agcugaucaugucagccuca

SEQ ID NO: 1750125 - RNA, 16 nt, Homo sapiens
cuaaauaaacaucuga

SEQ ID NO: 1750126 - RNA, 16 nt, Homo sapiens
acacagacaaagugcu

SEQ ID NO: 1750127 - RNA, 23 nt, Homo sapiens
gaccugcuguaauaaauguauua

SEQ ID NO: 1750128 - RNA, 16 nt, Homo sapiens
auuccaugugauacau

SEQ ID NO: 1750129 - RNA, 23 nt, Homo sapiens
cuaacucaaaucaggaacuguau

SEQ ID NO: 1750130 - RNA, 18 nt, Homo sapiens
ugauuaaaaucuggcaaa

SEQ ID NO: 1750131 - RNA, 17 nt, Homo sapiens
accucucucugcuccuc

SEQ ID NO: 1750132 - RNA, 11 nt, Homo sapiens
guagcuggaau

SEQ ID NO: 1750133 - RNA, 21 nt, Homo sapiens
cucaacaugagucaagagcau

SEQ ID NO: 1750134 - RNA, 18 nt, Homo sapiens
uucaaggcaucaugcaga

SEQ ID NO: 1750135 - RNA, 17 nt, Homo sapiens
caaguacucuuguagca

SEQ ID NO: 1750136 - RNA, 21 nt, Homo sapiens
cuaaggagaagcuaauaugau

SEQ ID NO: 1750137 - RNA, 21 nt, Homo sapiens
caagggaggaacaaaugaaga

SEQ ID NO: 1750138 - RNA, 12 nt, Homo sapiens
ugauaucucaau

SEQ ID NO: 1750139 - RNA, 13 nt, Homo sapiens
acuuuaauucuca

SEQ ID NO: 1750140 - RNA, 16 nt, Homo sapiens
ugugccccuucacuca

SEQ ID NO: 1750141 - RNA, 13 nt, Homo sapiens
cuugcaaagauuu

SEQ ID NO: 1750142 - RNA, 16 nt, Homo sapiens
caaauauuaccaaaaa

SEQ ID NO: 1750143 - RNA, 15 nt, Homo sapiens
caugaauucuucuca

SEQ ID NO: 1750144 - RNA, 19 nt, Homo sapiens
ugauacaugccgaaugcca

SEQ ID NO: 1750145 - RNA, 21 nt, Homo sapiens
gaacacaguuuagugcuuuac

SEQ ID NO: 1750146 - RNA, 14 nt, Homo sapiens
auacacauauuugc

SEQ ID NO: 1750147 - RNA, 17 nt, Homo sapiens
cacagcuuauuauccaa

SEQ ID NO: 1750148 - RNA, 15 nt, Homo sapiens
uucacucuccagggu

SEQ ID NO: 1750149 - RNA, 18 nt, Homo sapiens
aagaucuugaauagucuc

SEQ ID NO: 1750150 - RNA, 15 nt, Homo sapiens
uagaaacaauacugu

SEQ ID NO: 1750151 - RNA, 12 nt, Homo sapiens
guuaucugcuag

SEQ ID NO: 1750152 - RNA, 14 nt, Homo sapiens
augcuaccaugccu

SEQ ID NO: 1750153 - RNA, 14 nt, Homo sapiens
aucuuuccaucuca

SEQ ID NO: 1750154 - RNA, 21 nt, Homo sapiens
ugccaggauuggcacaagcuc

SEQ ID NO: 1750155 - RNA, 20 nt, Homo sapiens
acccaggagccuaguacaau

SEQ ID NO: 1750156 - RNA, 14 nt, Homo sapiens
guauuuaaacuuuc

SEQ ID NO: 1750157 - RNA, 14 nt, Homo sapiens
cugacaccagagcc

SEQ ID NO: 1750158 - RNA, 15 nt, Homo sapiens
cuggacaacacugau

SEQ ID NO: 1750159 - RNA, 14 nt, Homo sapiens
auacagcacuuuga

SEQ ID NO: 1750160 - RNA, 21 nt, Homo sapiens
gaacagcauuacccuccucuc

SEQ ID NO: 1750161 - RNA, 20 nt, Homo sapiens
uggccuauuuaucugaucaa

SEQ ID NO: 1750162 - RNA, 19 nt, Homo sapiens
uaaucccuuugucugucaa

SEQ ID NO: 1750163 - RNA, 18 nt, Homo sapiens
ucaggagcugcucaggcu

SEQ ID NO: 1750164 - RNA, 22 nt, Homo sapiens
uuccccgcccccaaccccagca

SEQ ID NO: 1750165 - RNA, 15 nt, Homo sapiens
auguugguguuccac

SEQ ID NO: 1750166 - RNA, 15 nt, Homo sapiens
cuguuugcuguggaa

SEQ ID NO: 1750167 - RNA, 22 nt, Homo sapiens
cuucgggagggcacucacaugc

SEQ ID NO: 1750168 - RNA, 20 nt, Homo sapiens
gaacaauuuccaaaacuguc

SEQ ID NO: 1750169 - RNA, 18 nt, Homo sapiens
aaucucacagcauuugcc

SEQ ID NO: 1750170 - RNA, 22 nt, Homo sapiens
guuuccaauaaacgcaagcuga

SEQ ID NO: 1750171 - RNA, 13 nt, Homo sapiens
gacaugucucaca

SEQ ID NO: 1750172 - RNA, 14 nt, Homo sapiens
aauugaaagaacuu

SEQ ID NO: 1750173 - RNA, 15 nt, Homo sapiens
uacacauauaccuau

SEQ ID NO: 1750174 - RNA, 15 nt, Homo sapiens
auccauaucagcucu

SEQ ID NO: 1750175 - RNA, 18 nt, Homo sapiens
acauuccugggcacaguu

SEQ ID NO: 1750176 - RNA, 16 nt, Homo sapiens
ucagugacuccugcug

SEQ ID NO: 1750177 - RNA, 14 nt, Homo sapiens
caaaucuggcuuag

SEQ ID NO: 1750178 - RNA, 21 nt, Homo sapiens
gcugccuuuggaaguccagag

SEQ ID NO: 1750179 - RNA, 17 nt, Homo sapiens
cacugccuguaacagcc

SEQ ID NO: 1750180 - RNA, 17 nt, Homo sapiens
caaucuccuuacugugu

SEQ ID NO: 1750181 - RNA, 14 nt, Homo sapiens
ugauaaagccuaaa

SEQ ID NO: 1750182 - RNA, 21 nt, Homo sapiens
agccucuccuugccuggugac

SEQ ID NO: 1750183 - RNA, 14 nt, Homo sapiens
uacucauagcacuu

SEQ ID NO: 1750184 - RNA, 21 nt, Homo sapiens
ugguguggccagcacucugaa

SEQ ID NO: 1750185 - RNA, 14 nt, Homo sapiens
ggggcauuguugcu

SEQ ID NO: 1750186 - RNA, 20 nt, Homo sapiens
cagcucugcaggcuuaauaa

SEQ ID NO: 1750187 - RNA, 20 nt, Homo sapiens
ugcugugccaggacugugac

SEQ ID NO: 1750188 - RNA, 18 nt, Homo sapiens
uccagaccauucaggaca

SEQ ID NO: 1750189 - RNA, 16 nt, Homo sapiens
uuuaaauagcauaaaa

SEQ ID NO: 1750190 - RNA, 21 nt, Homo sapiens
caacaaggguccguggaccag

SEQ ID NO: 1750191 - RNA, 21 nt, Homo sapiens
gaguaaaacuguauaaacaaa

SEQ ID NO: 1750192 - RNA, 21 nt, Homo sapiens
cauuucacuauguuacaugua

SEQ ID NO: 1750193 - RNA, 21 nt, Homo sapiens
agauuucuccugacuccagug

SEQ ID NO: 1750194 - RNA, 17 nt, Homo sapiens
uucugucaacuuguauu

SEQ ID NO: 1750195 - RNA, 21 nt, Homo sapiens
uauaaccagacacauacucau

SEQ ID NO: 1750196 - RNA, 14 nt, Homo sapiens
uuuucugccacaga

SEQ ID NO: 1750197 - RNA, 16 nt, Homo sapiens
auuucuuaaugcuauu

SEQ ID NO: 1750198 - RNA, 16 nt, Homo sapiens
cugcuucucuuucaca

SEQ ID NO: 1750199 - RNA, 15 nt, Homo sapiens
ugcugaggccucgag

SEQ ID NO: 1750200 - RNA, 18 nt, Homo sapiens
cugucaacaaggggucaa

SEQ ID NO: 1750201 - RNA, 22 nt, Homo sapiens
gcugauuucccuuuuuucuucc

SEQ ID NO: 1750202 - RNA, 17 nt, Homo sapiens
gauacacugaaaggaaa

SEQ ID NO: 1750203 - RNA, 17 nt, Homo sapiens
auacagaacucacagua

SEQ ID NO: 1750204 - RNA, 19 nt, Homo sapiens
cuguacacugacuugagac

SEQ ID NO: 1750205 - RNA, 14 nt, Homo sapiens
ucuaaucgaaagaa

SEQ ID NO: 1750206 - RNA, 20 nt, Homo sapiens
uguuaagcaucuaaggacaa

SEQ ID NO: 1750207 - RNA, 18 nt, Homo sapiens
uuugagacagagucucac

SEQ ID NO: 1750208 - RNA, 14 nt, Homo sapiens
auguaacagaaagg

SEQ ID NO: 1750209 - RNA, 15 nt, Homo sapiens
acagauuguucucaa

SEQ ID NO: 1750210 - RNA, 17 nt, Homo sapiens
uagagugcaguggugca

SEQ ID NO: 1750211 - RNA, 21 nt, Homo sapiens
guaaucuguugacagugccaa

SEQ ID NO: 1750212 - RNA, 21 nt, Homo sapiens
cauuugacaggggcucaggau

SEQ ID NO: 1750213 - RNA, 13 nt, Homo sapiens
acuucaaauaucu

SEQ ID NO: 1750214 - RNA, 15 nt, Homo sapiens
aucuucaucugugaa

SEQ ID NO: 1750215 - RNA, 12 nt, Homo sapiens
agcccagugugg

SEQ ID NO: 1750216 - RNA, 17 nt, Homo sapiens
acacagaagccuuugau

SEQ ID NO: 1750217 - RNA, 17 nt, Homo sapiens
cauaucguaaagcuguu

SEQ ID NO: 1750218 - RNA, 16 nt, Homo sapiens
aauucuuaauuuggau

SEQ ID NO: 1750219 - RNA, 14 nt, Homo sapiens
cacugaugcaagga

SEQ ID NO: 1750220 - RNA, 18 nt, Homo sapiens
acuucuucugguccuuca

SEQ ID NO: 1750221 - RNA, 18 nt, Homo sapiens
uaguuuccccuuuccuag

SEQ ID NO: 1750222 - RNA, 20 nt, Homo sapiens
cccucgcucagagggauccu

SEQ ID NO: 1750223 - RNA, 17 nt, Homo sapiens
ugcagugagcugagauu

SEQ ID NO: 1750224 - RNA, 15 nt, Homo sapiens
aaaugcuuuuccuca

SEQ ID NO: 1750225 - RNA, 20 nt, Homo sapiens
gcccgcagccuggcaucugu

SEQ ID NO: 1750226 - RNA, 16 nt, Homo sapiens
ugaauuuuugcacauu

SEQ ID NO: 1750227 - RNA, 16 nt, Homo sapiens
uaaauauauacacuua

SEQ ID NO: 1750228 - RNA, 14 nt, Homo sapiens
cauacccaucugca

SEQ ID NO: 1750229 - RNA, 23 nt, Homo sapiens
ucaaagaaguacuuuauugcaac

SEQ ID NO: 1750230 - RNA, 19 nt, Homo sapiens
cagccuucuccugucucca

SEQ ID NO: 1750231 - RNA, 18 nt, Homo sapiens
guuauuuaaugagucagu

SEQ ID NO: 1750232 - RNA, 18 nt, Homo sapiens
aggugagaucacacugaa

SEQ ID NO: 1750233 - RNA, 17 nt, Homo sapiens
gaaucagaucauuucaa

SEQ ID NO: 1750234 - RNA, 18 nt, Homo sapiens
ugacccuguaaaauggag

SEQ ID NO: 1750235 - RNA, 12 nt, Homo sapiens
gaacaaaucagc

SEQ ID NO: 1750236 - RNA, 19 nt, Homo sapiens
aaacuuguaaaugcuguca

SEQ ID NO: 1750237 - RNA, 14 nt, Homo sapiens
uuaaguuaggcagu

SEQ ID NO: 1750238 - RNA, 18 nt, Homo sapiens
uacagagaagccaucacc

SEQ ID NO: 1750239 - RNA, 17 nt, Homo sapiens
gcagcugguaaucuugc

SEQ ID NO: 1750240 - RNA, 20 nt, Homo sapiens
cacauuuuuuucuaugcaua

SEQ ID NO: 1750241 - RNA, 15 nt, Homo sapiens
agcacccuacaggga

SEQ ID NO: 1750242 - RNA, 16 nt, Homo sapiens
acggacugucaguucu

SEQ ID NO: 1750243 - RNA, 18 nt, Homo sapiens
cauuccagacugcuucca

SEQ ID NO: 1750244 - RNA, 21 nt, Homo sapiens
caauauggugucuugauauau

SEQ ID NO: 1750245 - RNA, 14 nt, Homo sapiens
aacauuuugacuaa

SEQ ID NO: 1750246 - RNA, 13 nt, Homo sapiens
ucccuggcuguga

SEQ ID NO: 1750247 - RNA, 16 nt, Homo sapiens
caagaagggacugaga

SEQ ID NO: 1750248 - RNA, 21 nt, Homo sapiens
augccaaagaaugaauuucaa

SEQ ID NO: 1750249 - RNA, 17 nt, Homo sapiens
ugugcgugaaacacacc

SEQ ID NO: 1750250 - RNA, 15 nt, Homo sapiens
cacagacagauccca

SEQ ID NO: 1750251 - RNA, 20 nt, Homo sapiens
ccauagccaaccuguaguuu

SEQ ID NO: 1750252 - RNA, 21 nt, Homo sapiens
agcucagaaaauaucccuccu

SEQ ID NO: 1750253 - RNA, 13 nt, Homo sapiens
acucagcacuuuc

SEQ ID NO: 1750254 - RNA, 19 nt, Homo sapiens
ccaaaggucaagaacacag

SEQ ID NO: 1750255 - RNA, 20 nt, Homo sapiens
acuagcccuccuuuuuccaa

SEQ ID NO: 1750256 - RNA, 17 nt, Homo sapiens
aaaauauguucuuuaaa

SEQ ID NO: 1750257 - RNA, 19 nt, Homo sapiens
aaguaauauaaugaugcug

SEQ ID NO: 1750258 - RNA, 20 nt, Homo sapiens
cuacagcaaagccuagccug

SEQ ID NO: 1750259 - RNA, 15 nt, Homo sapiens
cauauuuauauguau

SEQ ID NO: 1750260 - RNA, 22 nt, Homo sapiens
agauuaggcacacagauccccu

SEQ ID NO: 1750261 - RNA, 15 nt, Homo sapiens
uaaaugaguucaaca

SEQ ID NO: 1750262 - RNA, 15 nt, Homo sapiens
aaggaguaacuugca

SEQ ID NO: 1750263 - RNA, 17 nt, Homo sapiens
cacaugucauugcccac

SEQ ID NO: 1750264 - RNA, 13 nt, Homo sapiens
uaccaaaugccuu

SEQ ID NO: 1750265 - RNA, 16 nt, Homo sapiens
ggaaucuucugaauuu

SEQ ID NO: 1750266 - RNA, 14 nt, Homo sapiens
guacuuaacauaca

SEQ ID NO: 1750267 - RNA, 18 nt, Homo sapiens
uccaguucauaaacaaca

SEQ ID NO: 1750268 - RNA, 22 nt, Homo sapiens
caggggccugcccagugcacuu

SEQ ID NO: 1750269 - RNA, 20 nt, Homo sapiens
cauuuauuuugagaagcucu

SEQ ID NO: 1750270 - RNA, 13 nt, Homo sapiens
aagaggccuuccc

SEQ ID NO: 1750271 - RNA, 13 nt, Homo sapiens
acaggaauccuua

SEQ ID NO: 1750272 - RNA, 15 nt, Homo sapiens
acuuaaaaguauuca

SEQ ID NO: 1750273 - RNA, 11 nt, Homo sapiens
cugacucugug

SEQ ID NO: 1750274 - RNA, 22 nt, Homo sapiens
ucagcugccugaaacagccaug

SEQ ID NO: 1750275 - RNA, 18 nt, Homo sapiens
ucauagcucauugcaagc

SEQ ID NO: 1750276 - RNA, 12 nt, Homo sapiens
ugauauuucccc

SEQ ID NO: 1750277 - RNA, 20 nt, Homo sapiens
uuuugggagaauuagcauau

SEQ ID NO: 1750278 - RNA, 16 nt, Homo sapiens
gcacaagggcacguga

SEQ ID NO: 1750279 - RNA, 18 nt, Homo sapiens
cagagcacuuugcaacuc

SEQ ID NO: 1750280 - RNA, 15 nt, Homo sapiens
cugagacacaugggu

SEQ ID NO: 1750281 - RNA, 13 nt, Homo sapiens
auaagcuacaugu

SEQ ID NO: 1750282 - RNA, 15 nt, Homo sapiens
uacuaaaaacacugg

SEQ ID NO: 1750283 - RNA, 21 nt, Homo sapiens
uugaacauucccuugaucuca

SEQ ID NO: 1750284 - RNA, 17 nt, Homo sapiens
acucuggcuucaaaaag

SEQ ID NO: 1750285 - RNA, 17 nt, Homo sapiens
augcauuuuugaagaca

SEQ ID NO: 1750286 - RNA, 16 nt, Homo sapiens
gacucugccuaaccau

SEQ ID NO: 1750287 - RNA, 18 nt, Homo sapiens
aauaugauuuuauuugac

SEQ ID NO: 1750288 - RNA, 14 nt, Homo sapiens
cucucuuaaauuca

SEQ ID NO: 1750289 - RNA, 20 nt, Homo sapiens
caugauguuuagaaacacaa

SEQ ID NO: 1750290 - RNA, 20 nt, Homo sapiens
ugaucucccuuggucuucca

SEQ ID NO: 1750291 - RNA, 16 nt, Homo sapiens
ggcagcccccaugggc

SEQ ID NO: 1750292 - RNA, 21 nt, Homo sapiens
aggcuucccccuuuacuauaa

SEQ ID NO: 1750293 - RNA, 13 nt, Homo sapiens
aguggcuggucuc

SEQ ID NO: 1750294 - RNA, 21 nt, Homo sapiens
cuucaaguauaacaacuuuga

SEQ ID NO: 1750295 - RNA, 19 nt, Homo sapiens
uauaaauuuguguucucaa

SEQ ID NO: 1750296 - RNA, 19 nt, Homo sapiens
ucgaauucucacaaggaaa

SEQ ID NO: 1750297 - RNA, 17 nt, Homo sapiens
agauuccaccuagagcu

SEQ ID NO: 1750298 - RNA, 19 nt, Homo sapiens
guuucaucuguucauucac

SEQ ID NO: 1750299 - RNA, 16 nt, Homo sapiens
uuaacagaucuuuacu

SEQ ID NO: 1750300 - RNA, 23 nt, Homo sapiens
ccagccugacaacagccugagaa

SEQ ID NO: 1750301 - RNA, 19 nt, Homo sapiens
ccuuaguaccuuuuuaaca

SEQ ID NO: 1750302 - RNA, 20 nt, Homo sapiens
ggaagaaggaagaagccaga

SEQ ID NO: 1750303 - RNA, 19 nt, Homo sapiens
cagugguugaugaaagcca

SEQ ID NO: 1750304 - RNA, 13 nt, Homo sapiens
ccaacuccaggaa

SEQ ID NO: 1750305 - RNA, 17 nt, Homo sapiens
ccaggcucaggcugccc

SEQ ID NO: 1750306 - RNA, 15 nt, Homo sapiens
cuucaucccauucca

SEQ ID NO: 1750307 - RNA, 18 nt, Homo sapiens
aauauauggaauuccucu

SEQ ID NO: 1750308 - RNA, 20 nt, Homo sapiens
ugcuaggcgcuggggagacu

SEQ ID NO: 1750309 - RNA, 15 nt, Homo sapiens
acuaaagugucuauu

SEQ ID NO: 1750310 - RNA, 18 nt, Homo sapiens
agacuugaacauuugcag

SEQ ID NO: 1750311 - RNA, 21 nt, Homo sapiens
gccuccaaaaauggcagugac

SEQ ID NO: 1750312 - RNA, 21 nt, Homo sapiens
cacagcaagggugaugggaaa

SEQ ID NO: 1750313 - RNA, 18 nt, Homo sapiens
uggucacuggucagggca

SEQ ID NO: 1750314 - RNA, 20 nt, Homo sapiens
uuaagguacauggaacacac

SEQ ID NO: 1750315 - RNA, 13 nt, Homo sapiens
ucaaucuacaggc

SEQ ID NO: 1750316 - RNA, 16 nt, Homo sapiens
caaagaggcuccagaa

SEQ ID NO: 1750317 - RNA, 17 nt, Homo sapiens
agacugggaugccuguc

SEQ ID NO: 1750318 - RNA, 21 nt, Homo sapiens
auuugccaaaaauucaugccc

SEQ ID NO: 1750319 - RNA, 17 nt, Homo sapiens
ucagugaggagggaugu

SEQ ID NO: 1750320 - RNA, 22 nt, Homo sapiens
cagaggaggggccgcugccacc

SEQ ID NO: 1750321 - RNA, 15 nt, Homo sapiens
uuuaccaauaugcau

SEQ ID NO: 1750322 - RNA, 15 nt, Homo sapiens
caaauaaacuagucu

SEQ ID NO: 1750323 - RNA, 14 nt, Homo sapiens
uucaggauacaugu

SEQ ID NO: 1750324 - RNA, 17 nt, Homo sapiens
uucaccuagagguguuc

SEQ ID NO: 1750325 - RNA, 19 nt, Homo sapiens
gguucagggaacugcuugc

SEQ ID NO: 1750326 - RNA, 22 nt, Homo sapiens
aaaccugauacaauuugcccaa

SEQ ID NO: 1750327 - RNA, 14 nt, Homo sapiens
agguucuuccugcc

SEQ ID NO: 1750328 - RNA, 16 nt, Homo sapiens
gcauuugaauacuccu

SEQ ID NO: 1750329 - RNA, 22 nt, Homo sapiens
ugggugggcaggaaaaggugau

SEQ ID NO: 1750330 - RNA, 24 nt, Homo sapiens
uuauaaaagaugcauuaucuauga

SEQ ID NO: 1750331 - RNA, 19 nt, Homo sapiens
ccuguguaacaggacccca

SEQ ID NO: 1750332 - RNA, 21 nt, Homo sapiens
uaagacauacuccuuccauca

SEQ ID NO: 1750333 - RNA, 18 nt, Homo sapiens
aucuugcauuaugcaauu

SEQ ID NO: 1750334 - RNA, 22 nt, Homo sapiens
uuugggggacuuacaugauuca

SEQ ID NO: 1750335 - RNA, 14 nt, Homo sapiens
auucuaaaccaauc

SEQ ID NO: 1750336 - RNA, 19 nt, Homo sapiens
uguuucuucaaugguucuc

SEQ ID NO: 1750337 - RNA, 20 nt, Homo sapiens
gcauuacacgccacaacucc

SEQ ID NO: 1750338 - RNA, 19 nt, Homo sapiens
acuugcuaaagcacuuugc

SEQ ID NO: 1750339 - RNA, 23 nt, Homo sapiens
aaacuugcaacuuugagaacaaa

SEQ ID NO: 1750340 - RNA, 13 nt, Homo sapiens
aauguauaguauu

SEQ ID NO: 1750341 - RNA, 16 nt, Homo sapiens
ugacagcaaacacagu

SEQ ID NO: 1750342 - RNA, 20 nt, Homo sapiens
acaucaaguuccacacacgc

SEQ ID NO: 1750343 - RNA, 17 nt, Homo sapiens
ugaacuguggugccaca

SEQ ID NO: 1750344 - RNA, 23 nt, Homo sapiens
guggcccgcgugauuguggcauu

SEQ ID NO: 1750345 - RNA, 24 nt, Homo sapiens
uuccacgugggccucacauuccag

SEQ ID NO: 1750346 - RNA, 14 nt, Homo sapiens
guguauaugaauga

SEQ ID NO: 1750347 - RNA, 17 nt, Homo sapiens
acccuagucuuuuaaac

SEQ ID NO: 1750348 - RNA, 18 nt, Homo sapiens
aaggcugauuacugaaau

SEQ ID NO: 1750349 - RNA, 21 nt, Homo sapiens
ucaagcgauucuccugccuca

SEQ ID NO: 1750350 - RNA, 17 nt, Homo sapiens
cucaucagaaaugucau

SEQ ID NO: 1750351 - RNA, 12 nt, Homo sapiens
agugcuacuuga

SEQ ID NO: 1750352 - RNA, 15 nt, Homo sapiens
agaccccaagcauuc

SEQ ID NO: 1750353 - RNA, 13 nt, Homo sapiens
uauaaagcucuca

SEQ ID NO: 1750354 - RNA, 20 nt, Homo sapiens
aagcugggcaugaacgcacu

SEQ ID NO: 1750355 - RNA, 19 nt, Homo sapiens
gaaauccgucuaguuaaca

SEQ ID NO: 1750356 - RNA, 21 nt, Homo sapiens
uuccuuccagugucauuucuc

SEQ ID NO: 1750357 - RNA, 15 nt, Homo sapiens
ugcccaaaucuuuag

SEQ ID NO: 1750358 - RNA, 14 nt, Homo sapiens
uaaguugcauuuag

SEQ ID NO: 1750359 - RNA, 18 nt, Homo sapiens
cagaaauuaaaugaauuu

SEQ ID NO: 1750360 - RNA, 21 nt, Homo sapiens
ugaaucuugucccagccucag

SEQ ID NO: 1750361 - RNA, 22 nt, Homo sapiens
aacacuauccaugcauuacuua

SEQ ID NO: 1750362 - RNA, 16 nt, Homo sapiens
caugauauguccucag

SEQ ID NO: 1750363 - RNA, 18 nt, Homo sapiens
uccauauuuauuuaaaca

SEQ ID NO: 1750364 - RNA, 19 nt, Homo sapiens
ccauccaccccguugcuca

SEQ ID NO: 1750365 - RNA, 21 nt, Homo sapiens
uggaaaugucuuucuauucau

SEQ ID NO: 1750366 - RNA, 18 nt, Homo sapiens
uaauuuugagggcaugaa

SEQ ID NO: 1750367 - RNA, 18 nt, Homo sapiens
gaaugcacaagaauggau

SEQ ID NO: 1750368 - RNA, 21 nt, Homo sapiens
uccuuccaagaagaccaugau

SEQ ID NO: 1750369 - RNA, 11 nt, Homo sapiens
aagcauuucag

SEQ ID NO: 1750370 - RNA, 11 nt, Homo sapiens
aaacauuucaa

SEQ ID NO: 1750371 - RNA, 18 nt, Homo sapiens
aauaaaaugguacauuuc

SEQ ID NO: 1750372 - RNA, 19 nt, Homo sapiens
caaaacauuaaauguccau

SEQ ID NO: 1750373 - RNA, 15 nt, Homo sapiens
uacaaaaaacaacaa

SEQ ID NO: 1750374 - RNA, 17 nt, Homo sapiens
cgcaguguuuugcaagu

SEQ ID NO: 1750375 - RNA, 12 nt, Homo sapiens
ugaacaggacau

SEQ ID NO: 1750376 - RNA, 15 nt, Homo sapiens
guggcucaucaucaa

SEQ ID NO: 1750377 - RNA, 15 nt, Homo sapiens
gaauguggucucagg

SEQ ID NO: 1750378 - RNA, 23 nt, Homo sapiens
agagggcacucagaaguugugcu

SEQ ID NO: 1750379 - RNA, 14 nt, Homo sapiens
gcauuuagcacaaa

SEQ ID NO: 1750380 - RNA, 18 nt, Homo sapiens
agaaggcaggaucaaaga

SEQ ID NO: 1750381 - RNA, 15 nt, Homo sapiens
aguccagugugacuu

SEQ ID NO: 1750382 - RNA, 18 nt, Homo sapiens
ucccaagagggcuuuauu

SEQ ID NO: 1750383 - RNA, 23 nt, Homo sapiens
cagaaagauuaaauaugaucacu

SEQ ID NO: 1750384 - RNA, 12 nt, Homo sapiens
gguggcacgugc

SEQ ID NO: 1750385 - RNA, 15 nt, Homo sapiens
uucucaguuuuggag

SEQ ID NO: 1750386 - RNA, 13 nt, Homo sapiens
uaucaaacagcuc

SEQ ID NO: 1750387 - RNA, 21 nt, Homo sapiens
uccuuuaagaaaaacaucugg

SEQ ID NO: 1750388 - RNA, 17 nt, Homo sapiens
uucacugugaguucuga

SEQ ID NO: 1750389 - RNA, 21 nt, Homo sapiens
acucagcuggaagucuaccug

SEQ ID NO: 1750390 - RNA, 21 nt, Homo sapiens
ucucuguggccauuugugaua

SEQ ID NO: 1750391 - RNA, 14 nt, Homo sapiens
gauuguuugacaca

SEQ ID NO: 1750392 - RNA, 15 nt, Homo sapiens
gaggcucuguccuaa

SEQ ID NO: 1750393 - RNA, 21 nt, Homo sapiens
guccaaacccacucaugacug

SEQ ID NO: 1750394 - RNA, 20 nt, Homo sapiens
gagacccucguggccuuccc

SEQ ID NO: 1750395 - RNA, 15 nt, Homo sapiens
cccugacaugcacac

SEQ ID NO: 1750396 - RNA, 18 nt, Homo sapiens
ggagcugcugagugacag

SEQ ID NO: 1750397 - RNA, 16 nt, Homo sapiens
uuguauacauugauca

SEQ ID NO: 1750398 - RNA, 22 nt, Homo sapiens
gcauucucguauccaacccaag

SEQ ID NO: 1750399 - RNA, 17 nt, Homo sapiens
gucaaauaaagcaaagu

SEQ ID NO: 1750400 - RNA, 18 nt, Homo sapiens
agggaucugcuugauauc

SEQ ID NO: 1750401 - RNA, 17 nt, Homo sapiens
gccugaacgcacaugac

SEQ ID NO: 1750402 - RNA, 18 nt, Homo sapiens
agcgaaacacacaaacca

SEQ ID NO: 1750403 - RNA, 16 nt, Homo sapiens
ggaggcuuagcuuucu

SEQ ID NO: 1750404 - RNA, 18 nt, Homo sapiens
ugggaugagagaaagugg

SEQ ID NO: 1750405 - RNA, 16 nt, Homo sapiens
uuugacuuuacuaaaa

SEQ ID NO: 1750406 - RNA, 14 nt, Homo sapiens
cacaugcccauuca

SEQ ID NO: 1750407 - RNA, 23 nt, Homo sapiens
ugugacuucuauuuuaaagacaa

SEQ ID NO: 1750408 - RNA, 22 nt, Homo sapiens
gggcccggcgaggguaugucag

SEQ ID NO: 1750409 - RNA, 13 nt, Homo sapiens
guuguuaugccau

SEQ ID NO: 1750410 - RNA, 18 nt, Homo sapiens
aagguccugcuguggaaa

SEQ ID NO: 1750411 - RNA, 22 nt, Homo sapiens
uaaaugucuaguucuuacccag

SEQ ID NO: 1750412 - RNA, 21 nt, Homo sapiens
caagugaggagugccagcuca

SEQ ID NO: 1750413 - RNA, 13 nt, Homo sapiens
cuaccguagcuuu

SEQ ID NO: 1750414 - RNA, 22 nt, Homo sapiens
guaauuuuucugggaaguccua

SEQ ID NO: 1750415 - RNA, 17 nt, Homo sapiens
uaaaaauuuacaagaga

SEQ ID NO: 1750416 - RNA, 13 nt, Homo sapiens
cagggcccaggca

SEQ ID NO: 1750417 - RNA, 16 nt, Homo sapiens
ugaaaacacacauaca

SEQ ID NO: 1750418 - RNA, 16 nt, Homo sapiens
uccuuuucuccuugcc

SEQ ID NO: 1750419 - RNA, 17 nt, Homo sapiens
gggugcuuccuccucag

SEQ ID NO: 1750420 - RNA, 22 nt, Homo sapiens
ccugaccucaggugauccaccc

SEQ ID NO: 1750421 - RNA, 18 nt, Homo sapiens
ccugaugggccaagggaa

SEQ ID NO: 1750422 - RNA, 20 nt, Homo sapiens
auuagucucagugaagacua

SEQ ID NO: 1750423 - RNA, 16 nt, Homo sapiens
cucacucagcucugaa

SEQ ID NO: 1750424 - RNA, 13 nt, Homo sapiens
gaaggaguuuuau

SEQ ID NO: 1750425 - RNA, 16 nt, Homo sapiens
aggccaggcagauccc

SEQ ID NO: 1750426 - RNA, 17 nt, Homo sapiens
gcucagauuguaauaug

SEQ ID NO: 1750427 - RNA, 13 nt, Homo sapiens
ccucuguugccaa

SEQ ID NO: 1750428 - RNA, 15 nt, Homo sapiens
ucucuugcugccaca

SEQ ID NO: 1750429 - RNA, 15 nt, Homo sapiens
acucacugccuagga

SEQ ID NO: 1750430 - RNA, 20 nt, Homo sapiens
ccuggaaucaagaugucaga

SEQ ID NO: 1750431 - RNA, 20 nt, Homo sapiens
ugauguacucuaaauacuga

SEQ ID NO: 1750432 - RNA, 20 nt, Homo sapiens
ucuucaugcuuuugcuugca

SEQ ID NO: 1750433 - RNA, 22 nt, Homo sapiens
agcuacucaggaggcugagaca

SEQ ID NO: 1750434 - RNA, 14 nt, Homo sapiens
acgugucagguggu

SEQ ID NO: 1750435 - RNA, 14 nt, Homo sapiens
gagggaagggcugg

SEQ ID NO: 1750436 - RNA, 23 nt, Homo sapiens
ggagagccacugggccccugucc

SEQ ID NO: 1750437 - RNA, 11 nt, Homo sapiens
aacaaucaaag

SEQ ID NO: 1750438 - RNA, 23 nt, Homo sapiens
cauuugugugugugcaagugugu

SEQ ID NO: 1750439 - RNA, 20 nt, Homo sapiens
cuucuaccuuugugcuaaau

SEQ ID NO: 1750440 - RNA, 19 nt, Homo sapiens
aucccucaucuagucuuga

SEQ ID NO: 1750441 - RNA, 23 nt, Homo sapiens
ccaggaagguagcccagcacugu

SEQ ID NO: 1750442 - RNA, 14 nt, Homo sapiens
accaaagcauuucu

SEQ ID NO: 1750443 - RNA, 11 nt, Homo sapiens
auugacaucua

SEQ ID NO: 1750444 - RNA, 19 nt, Homo sapiens
cuagugagucagcaccuug

SEQ ID NO: 1750445 - RNA, 21 nt, Homo sapiens
uugaggccacccgcacaaaau

SEQ ID NO: 1750446 - RNA, 18 nt, Homo sapiens
cuuuaaccucaucuacaa

SEQ ID NO: 1750447 - RNA, 18 nt, Homo sapiens
guacaaguaaagcccaga

SEQ ID NO: 1750448 - RNA, 16 nt, Homo sapiens
uuaauauugugcaaac

SEQ ID NO: 1750449 - RNA, 15 nt, Homo sapiens
aaaauaaaagaucuu

SEQ ID NO: 1750450 - RNA, 14 nt, Homo sapiens
cucagcaguggugu

SEQ ID NO: 1750451 - RNA, 22 nt, Homo sapiens
gccauaacuuuaugaagugcua

SEQ ID NO: 1750452 - RNA, 17 nt, Homo sapiens
agauuuggaauacacau

SEQ ID NO: 1750453 - RNA, 20 nt, Homo sapiens
uccccacuucucucucccca

SEQ ID NO: 1750454 - RNA, 23 nt, Homo sapiens
gaccauggagggggcuugcacuc

SEQ ID NO: 1750455 - RNA, 12 nt, Homo sapiens
gacauggcucac

SEQ ID NO: 1750456 - RNA, 18 nt, Homo sapiens
aucauuuuagacacuggg

SEQ ID NO: 1750457 - RNA, 22 nt, Homo sapiens
ugggcucauucuucuuggcuca

SEQ ID NO: 1750458 - RNA, 16 nt, Homo sapiens
caauguaguacucagu

SEQ ID NO: 1750459 - RNA, 14 nt, Homo sapiens
ucugccagguuuaa

SEQ ID NO: 1750460 - RNA, 17 nt, Homo sapiens
auagcuacagugacaga

SEQ ID NO: 1750461 - RNA, 15 nt, Homo sapiens
agucaacagugaaau

SEQ ID NO: 1750462 - RNA, 19 nt, Homo sapiens
gaaauagucauuugugaau

SEQ ID NO: 1750463 - RNA, 22 nt, Homo sapiens
ucaagaaagccagucuuaacau

SEQ ID NO: 1750464 - RNA, 23 nt, Homo sapiens
gcagggguccuuggugugacccu

SEQ ID NO: 1750465 - RNA, 16 nt, Homo sapiens
ucagacauuggcaccu

SEQ ID NO: 1750466 - RNA, 12 nt, Homo sapiens
agaggaauuugg

SEQ ID NO: 1750467 - RNA, 18 nt, Homo sapiens
guucacaugcaucauaac

SEQ ID NO: 1750468 - RNA, 13 nt, Homo sapiens
aggagcucuaggc

SEQ ID NO: 1750469 - RNA, 15 nt, Homo sapiens
gaucaguaugggaac

SEQ ID NO: 1750470 - RNA, 19 nt, Homo sapiens
uggcaugcgccaccaugcc

SEQ ID NO: 1750471 - RNA, 22 nt, Homo sapiens
acguguuuuguuuggacuucac

SEQ ID NO: 1750472 - RNA, 12 nt, Homo sapiens
acaaaauaauuu

SEQ ID NO: 1750473 - RNA, 17 nt, Homo sapiens
uuugaauuggcauuucc

SEQ ID NO: 1750474 - RNA, 16 nt, Homo sapiens
cacaugaguauuguga

SEQ ID NO: 1750475 - RNA, 22 nt, Homo sapiens
aacuaggagcuuugacucagga

SEQ ID NO: 1750476 - RNA, 14 nt, Homo sapiens
aagguuaacaguaa

SEQ ID NO: 1750477 - RNA, 22 nt, Homo sapiens
ccuggacaguaucccacaucca

SEQ ID NO: 1750478 - RNA, 19 nt, Homo sapiens
aaucgauucugcagcaccg

SEQ ID NO: 1750479 - RNA, 15 nt, Homo sapiens
gacaguugauuucca

SEQ ID NO: 1750480 - RNA, 16 nt, Homo sapiens
cuuacaaauauuucag

SEQ ID NO: 1750481 - RNA, 20 nt, Homo sapiens
aaacugagaaauuuacuaca

SEQ ID NO: 1750482 - RNA, 16 nt, Homo sapiens
aaccagcuuccuucag

SEQ ID NO: 1750483 - RNA, 14 nt, Homo sapiens
cuguccacacugaa

SEQ ID NO: 1750484 - RNA, 22 nt, Homo sapiens
gaaagcauuucuuuucucuuua

SEQ ID NO: 1750485 - RNA, 21 nt, Homo sapiens
aaacugagaugugaacacauc

SEQ ID NO: 1750486 - RNA, 12 nt, Homo sapiens
cagcacuuguau

SEQ ID NO: 1750487 - RNA, 19 nt, Homo sapiens
cgcuugcacacaugcacac

SEQ ID NO: 1750488 - RNA, 19 nt, Homo sapiens
uuugcaguaugaacuauug

SEQ ID NO: 1750489 - RNA, 22 nt, Homo sapiens
uuguuuauacacaacuuugcaa

SEQ ID NO: 1750490 - RNA, 16 nt, Homo sapiens
acaucuuuauugaaau

SEQ ID NO: 1750491 - RNA, 16 nt, Homo sapiens
auuucaagacagauug

SEQ ID NO: 1750492 - RNA, 12 nt, Homo sapiens
cccauuaaauuc

SEQ ID NO: 1750493 - RNA, 14 nt, Homo sapiens
augauucaugagcu

SEQ ID NO: 1750494 - RNA, 14 nt, Homo sapiens
augucaagccauaa

SEQ ID NO: 1750495 - RNA, 16 nt, Homo sapiens
aauuaaaggugccaga

SEQ ID NO: 1750496 - RNA, 13 nt, Homo sapiens
cagauaccugguu

SEQ ID NO: 1750497 - RNA, 15 nt, Homo sapiens
caaaguuggugccaa

SEQ ID NO: 1750498 - RNA, 21 nt, Homo sapiens
uuuagcauaguaccucugcua

SEQ ID NO: 1750499 - RNA, 17 nt, Homo sapiens
acuuucuuuacauacca

SEQ ID NO: 1750500 - RNA, 14 nt, Homo sapiens
ccaggacacugccu

SEQ ID NO: 1750501 - RNA, 18 nt, Homo sapiens
cuauagaauaaagccucu

SEQ ID NO: 1750502 - RNA, 13 nt, Homo sapiens
aauguggucauca

SEQ ID NO: 1750503 - RNA, 17 nt, Homo sapiens
cacaguccccagacuca

SEQ ID NO: 1750504 - RNA, 22 nt, Homo sapiens
aucugagcuuaaacauuuucuc

SEQ ID NO: 1750505 - RNA, 17 nt, Homo sapiens
aaccaguuugcauuccc

SEQ ID NO: 1750506 - RNA, 19 nt, Homo sapiens
guaaauagcuaagauauaa

SEQ ID NO: 1750507 - RNA, 15 nt, Homo sapiens
aguuaacuacagacc

SEQ ID NO: 1750508 - RNA, 23 nt, Homo sapiens
uucaugccuugggccgagccugc

SEQ ID NO: 1750509 - RNA, 20 nt, Homo sapiens
aacacuaucauggacuacac

SEQ ID NO: 1750510 - RNA, 15 nt, Homo sapiens
ugcggacagcccuuc

SEQ ID NO: 1750511 - RNA, 19 nt, Homo sapiens
augugagcucuuccuaucc

SEQ ID NO: 1750512 - RNA, 12 nt, Homo sapiens
uccucccaacaa

SEQ ID NO: 1750513 - RNA, 16 nt, Homo sapiens
agcccacuguuaauau

SEQ ID NO: 1750514 - RNA, 18 nt, Homo sapiens
uccauagacacaguauug

SEQ ID NO: 1750515 - RNA, 17 nt, Homo sapiens
gugcaugucacaugaca

SEQ ID NO: 1750516 - RNA, 23 nt, Homo sapiens
ggggagcaaugggcuuugcugcu

SEQ ID NO: 1750517 - RNA, 15 nt, Homo sapiens
acuaaugaggauugc

SEQ ID NO: 1750518 - RNA, 18 nt, Homo sapiens
auuauucagaauuauaca

SEQ ID NO: 1750519 - RNA, 22 nt, Homo sapiens
auacaugccagugacacuucca

SEQ ID NO: 1750520 - RNA, 14 nt, Homo sapiens
cccugccauuuacc

SEQ ID NO: 1750521 - RNA, 23 nt, Homo sapiens
auuguuuugugcucaacuugugu

SEQ ID NO: 1750522 - RNA, 23 nt, Homo sapiens
aauauugaaaggcaaacauuuga

SEQ ID NO: 1750523 - RNA, 18 nt, Homo sapiens
ucaaaggccagaccugca

SEQ ID NO: 1750524 - RNA, 18 nt, Homo sapiens
ccuuauucuacaucauua

SEQ ID NO: 1750525 - RNA, 16 nt, Homo sapiens
gcccagggcugcaaug

SEQ ID NO: 1750526 - RNA, 23 nt, Homo sapiens
cucaaugaaaauuuaaagggaaa

SEQ ID NO: 1750527 - RNA, 20 nt, Homo sapiens
caugagcuuaggcauucuaa

SEQ ID NO: 1750528 - RNA, 18 nt, Homo sapiens
cugauggguggaccugug

SEQ ID NO: 1750529 - RNA, 21 nt, Homo sapiens
auguuaauggggacccuccaa

SEQ ID NO: 1750530 - RNA, 13 nt, Homo sapiens
uucaaagcacaga

SEQ ID NO: 1750531 - RNA, 21 nt, Homo sapiens
caggagcugcggccacucuac

SEQ ID NO: 1750532 - RNA, 15 nt, Homo sapiens
uaaccaacaauauaa

SEQ ID NO: 1750533 - RNA, 15 nt, Homo sapiens
acaggaucaaaguug

SEQ ID NO: 1750534 - RNA, 15 nt, Homo sapiens
uccauuaucuuauga

SEQ ID NO: 1750535 - RNA, 13 nt, Homo sapiens
gaaagcacaagac

SEQ ID NO: 1750536 - RNA, 14 nt, Homo sapiens
agcucaggaucucu

SEQ ID NO: 1750537 - RNA, 15 nt, Homo sapiens
aauuugcguaacuaa

SEQ ID NO: 1750538 - RNA, 17 nt, Homo sapiens
uguggccgacucugcac

SEQ ID NO: 1750539 - RNA, 14 nt, Homo sapiens
auucccugcuaaau

SEQ ID NO: 1750540 - RNA, 15 nt, Homo sapiens
uuaggcagugcagua

SEQ ID NO: 1750541 - RNA, 20 nt, Homo sapiens
ugagcacauucuggcucagg

SEQ ID NO: 1750542 - RNA, 12 nt, Homo sapiens
aucccaacauuc

SEQ ID NO: 1750543 - RNA, 17 nt, Homo sapiens
cauggaaagacugggac

SEQ ID NO: 1750544 - RNA, 20 nt, Homo sapiens
acacucauggggaagcuucc

SEQ ID NO: 1750545 - RNA, 16 nt, Homo sapiens
cagaauauucuucuaa

SEQ ID NO: 1750546 - RNA, 17 nt, Homo sapiens
uauuucuuuagaacaac

SEQ ID NO: 1750547 - RNA, 11 nt, Homo sapiens
ugcacaaacaa

SEQ ID NO: 1750548 - RNA, 22 nt, Homo sapiens
agaagccuaauugucacaucaa

SEQ ID NO: 1750549 - RNA, 14 nt, Homo sapiens
ggccuugucaggac

SEQ ID NO: 1750550 - RNA, 19 nt, Homo sapiens
gguggccgcugaguggcag

SEQ ID NO: 1750551 - RNA, 17 nt, Homo sapiens
auaaaaaacacuaaaca

SEQ ID NO: 1750552 - RNA, 20 nt, Homo sapiens
cucuucaacccucuucucac

SEQ ID NO: 1750553 - RNA, 16 nt, Homo sapiens
acugcccuuccaggug

SEQ ID NO: 1750554 - RNA, 23 nt, Homo sapiens
aggcgcccuuggcuucugugaug

SEQ ID NO: 1750555 - RNA, 14 nt, Homo sapiens
augucacucagaug

SEQ ID NO: 1750556 - RNA, 17 nt, Homo sapiens
ggucccaguugcuguca

SEQ ID NO: 1750557 - RNA, 18 nt, Homo sapiens
uuuauaaacaacaucaaa

SEQ ID NO: 1750558 - RNA, 15 nt, Homo sapiens
ucagaauaaggcagg

SEQ ID NO: 1750559 - RNA, 15 nt, Homo sapiens
acccaguauaugcua

SEQ ID NO: 1750560 - RNA, 12 nt, Homo sapiens
ugucgcaucuca

SEQ ID NO: 1750561 - RNA, 16 nt, Homo sapiens
uggcuagucauaaccu

SEQ ID NO: 1750562 - RNA, 18 nt, Homo sapiens
aggcaggagaaucacuug

SEQ ID NO: 1750563 - RNA, 19 nt, Homo sapiens
acaugagaggacugaugaa

SEQ ID NO: 1750564 - RNA, 16 nt, Homo sapiens
gucuuuaucagugaug

SEQ ID NO: 1750565 - RNA, 14 nt, Homo sapiens
cugaaauacuuuac

SEQ ID NO: 1750566 - RNA, 18 nt, Homo sapiens
acacauuuaccaaauugc

SEQ ID NO: 1750567 - RNA, 15 nt, Homo sapiens
ucaguuuuucacuuc

SEQ ID NO: 1750568 - RNA, 17 nt, Homo sapiens
ccuucaugaucaucaca

SEQ ID NO: 1750569 - RNA, 14 nt, Homo sapiens
aaagacucugacca

SEQ ID NO: 1750570 - RNA, 23 nt, Homo sapiens
gucugucccaggccgacccaagg

SEQ ID NO: 1750571 - RNA, 23 nt, Homo sapiens
uggaguucccucaguacuauucc

SEQ ID NO: 1750572 - RNA, 21 nt, Homo sapiens
auugacacacagcacucucua

SEQ ID NO: 1750573 - RNA, 17 nt, Homo sapiens
cucuugagucacacugc

SEQ ID NO: 1750574 - RNA, 13 nt, Homo sapiens
ugagacuaugcaa

SEQ ID NO: 1750575 - RNA, 16 nt, Homo sapiens
acccugcccacuccca

SEQ ID NO: 1750576 - RNA, 16 nt, Homo sapiens
cauuuuuugucuguga

SEQ ID NO: 1750577 - RNA, 23 nt, Homo sapiens
caguccuggagggaguggguuaa

SEQ ID NO: 1750578 - RNA, 18 nt, Homo sapiens
gauuaagugguuacuuug

SEQ ID NO: 1750579 - RNA, 14 nt, Homo sapiens
gaauucuaagugaa

SEQ ID NO: 1750580 - RNA, 21 nt, Homo sapiens
ccugugugauugacagcuuug

SEQ ID NO: 1750581 - RNA, 16 nt, Homo sapiens
cacagcgaacccaaug

SEQ ID NO: 1750582 - RNA, 22 nt, Homo sapiens
augugguuuuguuguuuuccaa

SEQ ID NO: 1750583 - RNA, 21 nt, Homo sapiens
cccucuccuucuccuagcucu

SEQ ID NO: 1750584 - RNA, 14 nt, Homo sapiens
aagacccugucuca

SEQ ID NO: 1750585 - RNA, 19 nt, Homo sapiens
gagugggcccaaugcacuu

SEQ ID NO: 1750586 - RNA, 19 nt, Homo sapiens
cugaauuguucuaaaugga

SEQ ID NO: 1750587 - RNA, 18 nt, Homo sapiens
cuaauuggccucuuuaag

SEQ ID NO: 1750588 - RNA, 16 nt, Homo sapiens
aaugggcaauuccaga

SEQ ID NO: 1750589 - RNA, 20 nt, Homo sapiens
uccauggguuccuacgccuu

SEQ ID NO: 1750590 - RNA, 17 nt, Homo sapiens
ccuagcagccucaaaac

SEQ ID NO: 1750591 - RNA, 21 nt, Homo sapiens
gaaagauuuucuccacagugu

SEQ ID NO: 1750592 - RNA, 23 nt, Homo sapiens
gagcaucacaguuuugguugcuu

SEQ ID NO: 1750593 - RNA, 15 nt, Homo sapiens
ccuuuggcucuggag

SEQ ID NO: 1750594 - RNA, 13 nt, Homo sapiens
uccacuggaaaag

SEQ ID NO: 1750595 - RNA, 22 nt, Homo sapiens
gagcccccagagcuggaccuga

SEQ ID NO: 1750596 - RNA, 20 nt, Homo sapiens
guuucuaaguaauaugcuua

SEQ ID NO: 1750597 - RNA, 20 nt, Homo sapiens
acaagauccuuaaugcagag

SEQ ID NO: 1750598 - RNA, 19 nt, Homo sapiens
cugaaggucuuaguaccag

SEQ ID NO: 1750599 - RNA, 23 nt, Homo sapiens
aucuuagggcaucgaucuuccuc

SEQ ID NO: 1750600 - RNA, 21 nt, Homo sapiens
uuucccaccgcuuugugagcc

SEQ ID NO: 1750601 - RNA, 21 nt, Homo sapiens
uaugucaaauugucagcauga

SEQ ID NO: 1750602 - RNA, 18 nt, Homo sapiens
agaugucuuuuauagugg

SEQ ID NO: 1750603 - RNA, 20 nt, Homo sapiens
guccuaggucaugaaggaca

SEQ ID NO: 1750604 - RNA, 14 nt, Homo sapiens
guucacaccacagg

SEQ ID NO: 1750605 - RNA, 21 nt, Homo sapiens
cuuuauauuuuggguacugga

SEQ ID NO: 1750606 - RNA, 19 nt, Homo sapiens
ugaaagaagaguuccaugg

SEQ ID NO: 1750607 - RNA, 13 nt, Homo sapiens
auauguugcuaua

SEQ ID NO: 1750608 - RNA, 17 nt, Homo sapiens
aaccagugacaaucuua

SEQ ID NO: 1750609 - RNA, 12 nt, Homo sapiens
aagggaagcaga

SEQ ID NO: 1750610 - RNA, 14 nt, Homo sapiens
aaucuuaugcucuc

SEQ ID NO: 1750611 - RNA, 15 nt, Homo sapiens
agcagggacugugaa

SEQ ID NO: 1750612 - RNA, 23 nt, Homo sapiens
cuguugacucuaguacugugaau

SEQ ID NO: 1750613 - RNA, 16 nt, Homo sapiens
ugggcccuuugagugc

SEQ ID NO: 1750614 - RNA, 14 nt, Homo sapiens
aaaggucauugugg

SEQ ID NO: 1750615 - RNA, 16 nt, Homo sapiens
auuuuugucugcagcu

SEQ ID NO: 1750616 - RNA, 14 nt, Homo sapiens
ugauacuaucugug

SEQ ID NO: 1750617 - RNA, 16 nt, Homo sapiens
ccaccaaaaacugggu

SEQ ID NO: 1750618 - RNA, 16 nt, Homo sapiens
gcccuaaaagcacacu

SEQ ID NO: 1750619 - RNA, 16 nt, Homo sapiens
cuuuauugcugugaau

SEQ ID NO: 1750620 - RNA, 16 nt, Homo sapiens
cugcagcagaggccug

SEQ ID NO: 1750621 - RNA, 15 nt, Homo sapiens
agacgggguuugcca

SEQ ID NO: 1750622 - RNA, 16 nt, Homo sapiens
aaaaguaucuuuaaca

SEQ ID NO: 1750623 - RNA, 14 nt, Homo sapiens
caggaaaucaaaua

SEQ ID NO: 1750624 - RNA, 16 nt, Homo sapiens
uccuagcaaguaagaa

SEQ ID NO: 1750625 - RNA, 17 nt, Homo sapiens
ugguuggaccuauugcc

SEQ ID NO: 1750626 - RNA, 23 nt, Homo sapiens
uguauuaauguguuaagugcagg

SEQ ID NO: 1750627 - RNA, 15 nt, Homo sapiens
augucuguguaugua

SEQ ID NO: 1750628 - RNA, 17 nt, Homo sapiens
ucuggaaagugauguca

SEQ ID NO: 1750629 - RNA, 10 nt, Homo sapiens
caacauaaaa

SEQ ID NO: 1750630 - RNA, 23 nt, Homo sapiens
gugcugcaugaaaaacauuccac

SEQ ID NO: 1750631 - RNA, 15 nt, Homo sapiens
caaucuauguuugca

SEQ ID NO: 1750632 - RNA, 9 nt, Homo sapiens
auggaugaa

SEQ ID NO: 1750633 - RNA, 20 nt, Homo sapiens
caccauguaacaaccagaga

SEQ ID NO: 1750634 - RNA, 14 nt, Homo sapiens
ucuacauucacuuu

SEQ ID NO: 1750635 - RNA, 17 nt, Homo sapiens
augugugugugugcaua

SEQ ID NO: 1750636 - RNA, 13 nt, Homo sapiens
gauagaacaggcu

SEQ ID NO: 1750637 - RNA, 21 nt, Homo sapiens
accacccccgagcuugccuca

SEQ ID NO: 1750638 - RNA, 21 nt, Homo sapiens
gaaacuccuuuugcugucuuu

SEQ ID NO: 1750639 - RNA, 19 nt, Homo sapiens
aaggaaaacuauguauuaa

SEQ ID NO: 1750640 - RNA, 18 nt, Homo sapiens
aauaccuuuaaauaucau

SEQ ID NO: 1750641 - RNA, 16 nt, Homo sapiens
ucugcaacacuuugag

SEQ ID NO: 1750642 - RNA, 22 nt, Homo sapiens
cuguucgucacucaaaugaauu

SEQ ID NO: 1750643 - RNA, 21 nt, Homo sapiens
auccggggaggaaacacuggc

SEQ ID NO: 1750644 - RNA, 17 nt, Homo sapiens
uuauuacuccuugccau

SEQ ID NO: 1750645 - RNA, 12 nt, Homo sapiens
gcaagugccugg

SEQ ID NO: 1750646 - RNA, 19 nt, Homo sapiens
uggaaguguucaagaaaua

SEQ ID NO: 1750647 - RNA, 17 nt, Homo sapiens
uuugacuagccaucuca

SEQ ID NO: 1750648 - RNA, 13 nt, Homo sapiens
aauugugaugcuc

SEQ ID NO: 1750649 - RNA, 14 nt, Homo sapiens
acgaaucuucucaa

SEQ ID NO: 1750650 - RNA, 14 nt, Homo sapiens
auucuucuuugaua

SEQ ID NO: 1750651 - RNA, 17 nt, Homo sapiens
ucccagacauucauugu

SEQ ID NO: 1750652 - RNA, 16 nt, Homo sapiens
ucuaaaucaccagaaa

SEQ ID NO: 1750653 - RNA, 21 nt, Homo sapiens
agcugccugcuuuucacugcu

SEQ ID NO: 1750654 - RNA, 18 nt, Homo sapiens
ucuuuaaaaaaacacaua

SEQ ID NO: 1750655 - RNA, 22 nt, Homo sapiens
ugucagggaguguucccuaucc

SEQ ID NO: 1750656 - RNA, 14 nt, Homo sapiens
uucuagacugugaa

SEQ ID NO: 1750657 - RNA, 18 nt, Homo sapiens
ccagcuuaugagcucaaa

SEQ ID NO: 1750658 - RNA, 16 nt, Homo sapiens
guaaagccucauuuga

SEQ ID NO: 1750659 - RNA, 18 nt, Homo sapiens
aaaguuguuugugccuuu

SEQ ID NO: 1750660 - RNA, 15 nt, Homo sapiens
ugucuucuuucacua

SEQ ID NO: 1750661 - RNA, 17 nt, Homo sapiens
cccucaccccuccaagc

SEQ ID NO: 1750662 - RNA, 17 nt, Homo sapiens
ggaccaaaaaaccucac

SEQ ID NO: 1750663 - RNA, 15 nt, Homo sapiens
acuuuuuuacacuga

SEQ ID NO: 1750664 - RNA, 19 nt, Homo sapiens
cagcccaacgggaagcaac

SEQ ID NO: 1750665 - RNA, 16 nt, Homo sapiens
guaaucaagggucauu

SEQ ID NO: 1750666 - RNA, 15 nt, Homo sapiens
uuaucgaaaguaaaa

SEQ ID NO: 1750667 - RNA, 20 nt, Homo sapiens
ccuguggcugucggugggac

SEQ ID NO: 1750668 - RNA, 15 nt, Homo sapiens
agaaagugugcuuua

SEQ ID NO: 1750669 - RNA, 15 nt, Homo sapiens
ugaaauuguaucuca

SEQ ID NO: 1750670 - RNA, 16 nt, Homo sapiens
caugguaagagucaca

SEQ ID NO: 1750671 - RNA, 23 nt, Homo sapiens
ggcagucaccacccagcccuucc

SEQ ID NO: 1750672 - RNA, 13 nt, Homo sapiens
uagccagacacuc

SEQ ID NO: 1750673 - RNA, 22 nt, Homo sapiens
cacguccuuuuuuccuuccuuc

SEQ ID NO: 1750674 - RNA, 15 nt, Homo sapiens
uaaugccaccaaagg

SEQ ID NO: 1750675 - RNA, 15 nt, Homo sapiens
ugggacauugcaauu

SEQ ID NO: 1750676 - RNA, 12 nt, Homo sapiens
ucagccuuccaa

SEQ ID NO: 1750677 - RNA, 23 nt, Homo sapiens
aagcuaccauuuaucaagcauuu

SEQ ID NO: 1750678 - RNA, 18 nt, Homo sapiens
ugaggaggguacuuuucc

SEQ ID NO: 1750679 - RNA, 14 nt, Homo sapiens
ucgcuccuccuucc

SEQ ID NO: 1750680 - RNA, 22 nt, Homo sapiens
cauugcucuguuaauaaucuca

SEQ ID NO: 1750681 - RNA, 20 nt, Homo sapiens
caggcgucugccaccaugcc

SEQ ID NO: 1750682 - RNA, 18 nt, Homo sapiens
acuacaggccccacaccu

SEQ ID NO: 1750683 - RNA, 19 nt, Homo sapiens
uguucuaaauaaaaagcau

SEQ ID NO: 1750684 - RNA, 20 nt, Homo sapiens
cugcacuggaguccagucuc

SEQ ID NO: 1750685 - RNA, 12 nt, Homo sapiens
cucuuacauggc

SEQ ID NO: 1750686 - RNA, 19 nt, Homo sapiens
guuuaacaucauugcauaa

SEQ ID NO: 1750687 - RNA, 13 nt, Homo sapiens
guuagccucuugc

SEQ ID NO: 1750688 - RNA, 20 nt, Homo sapiens
ggcucacaugccacuggaaa

SEQ ID NO: 1750689 - RNA, 21 nt, Homo sapiens
caagucucccaauauccaauu

SEQ ID NO: 1750690 - RNA, 21 nt, Homo sapiens
acagaacaacaacaaagcaug

SEQ ID NO: 1750691 - RNA, 15 nt, Homo sapiens
ugaaacauaucucuu

SEQ ID NO: 1750692 - RNA, 14 nt, Homo sapiens
aaugcuuacuucua

SEQ ID NO: 1750693 - RNA, 20 nt, Homo sapiens
gaaacugaggugcaaagggg

SEQ ID NO: 1750694 - RNA, 19 nt, Homo sapiens
aaaacugaaaaucuaauau

SEQ ID NO: 1750695 - RNA, 16 nt, Homo sapiens
uagcaagaacugcacg

SEQ ID NO: 1750696 - RNA, 17 nt, Homo sapiens
gugaacagaacaaaagg

SEQ ID NO: 1750697 - RNA, 23 nt, Homo sapiens
agcaacagcgauggcagugagaa

SEQ ID NO: 1750698 - RNA, 16 nt, Homo sapiens
gauugacagcauauag

SEQ ID NO: 1750699 - RNA, 20 nt, Homo sapiens
agguuuuaugaaaagaauaa

SEQ ID NO: 1750700 - RNA, 17 nt, Homo sapiens
agcuguagccauggcuc

SEQ ID NO: 1750701 - RNA, 18 nt, Homo sapiens
gaaacuuacuaaauauca

SEQ ID NO: 1750702 - RNA, 16 nt, Homo sapiens
aguauauuaauaucau

SEQ ID NO: 1750703 - RNA, 21 nt, Homo sapiens
gugccaaagaagcagaccauu

SEQ ID NO: 1750704 - RNA, 16 nt, Homo sapiens
caguaauuugcaauuu

SEQ ID NO: 1750705 - RNA, 18 nt, Homo sapiens
ucuaaagccaguggcagu

SEQ ID NO: 1750706 - RNA, 15 nt, Homo sapiens
ucccaucaauucuua

SEQ ID NO: 1750707 - RNA, 17 nt, Homo sapiens
caauuuuuaccacuucu

SEQ ID NO: 1750708 - RNA, 16 nt, Homo sapiens
uggcucacgccuguaa

SEQ ID NO: 1750709 - RNA, 20 nt, Homo sapiens
uaugaaguaucuaaaagugu

SEQ ID NO: 1750710 - RNA, 14 nt, Homo sapiens
uguguagauugcgu

SEQ ID NO: 1750711 - RNA, 17 nt, Homo sapiens
ccacgcacaggugcuga

SEQ ID NO: 1750712 - RNA, 17 nt, Homo sapiens
caggugauccaccugcc

SEQ ID NO: 1750713 - RNA, 14 nt, Homo sapiens
acaccacacacaac

SEQ ID NO: 1750714 - RNA, 15 nt, Homo sapiens
aaacccuugccaggu

SEQ ID NO: 1750715 - RNA, 20 nt, Homo sapiens
acaugacgcaccaguuacag

SEQ ID NO: 1750716 - RNA, 14 nt, Homo sapiens
acggaacacuguca

SEQ ID NO: 1750717 - RNA, 16 nt, Homo sapiens
gcaggggauggcgcua

SEQ ID NO: 1750718 - RNA, 16 nt, Homo sapiens
ccauaagcuacacaga

SEQ ID NO: 1750719 - RNA, 18 nt, Homo sapiens
uguaaagaauaaaugaau

SEQ ID NO: 1750720 - RNA, 13 nt, Homo sapiens
agugacagguuuu

SEQ ID NO: 1750721 - RNA, 20 nt, Homo sapiens
aacuuuguucguuacuggcu

SEQ ID NO: 1750722 - RNA, 14 nt, Homo sapiens
ggugcuagauccag

SEQ ID NO: 1750723 - RNA, 19 nt, Homo sapiens
uagacuguuucacauugca

SEQ ID NO: 1750724 - RNA, 16 nt, Homo sapiens
accuguuucaccagug

SEQ ID NO: 1750725 - RNA, 16 nt, Homo sapiens
cauuaucuuaucauuu

SEQ ID NO: 1750726 - RNA, 17 nt, Homo sapiens
aaccauugugcauucua

SEQ ID NO: 1750727 - RNA, 21 nt, Homo sapiens
uaaucuugucaaccagugcaa

SEQ ID NO: 1750728 - RNA, 15 nt, Homo sapiens
ucuaaugugcauuaa

SEQ ID NO: 1750729 - RNA, 19 nt, Homo sapiens
aagcuuguccaucacucua

SEQ ID NO: 1750730 - RNA, 16 nt, Homo sapiens
uaaacuuuauugcuca

SEQ ID NO: 1750731 - RNA, 14 nt, Homo sapiens
acaacugacuucca

SEQ ID NO: 1750732 - RNA, 20 nt, Homo sapiens
ccagcucugggggacuccuu

SEQ ID NO: 1750733 - RNA, 21 nt, Homo sapiens
ugucccuuaaaauaacuugua

SEQ ID NO: 1750734 - RNA, 22 nt, Homo sapiens
agaggcuaagaugagauuugcc

SEQ ID NO: 1750735 - RNA, 19 nt, Homo sapiens
cccauagaaaacuugacau

SEQ ID NO: 1750736 - RNA, 21 nt, Homo sapiens
ugcuguuauuuuaucugcuau

SEQ ID NO: 1750737 - RNA, 20 nt, Homo sapiens
auacccagucccagaaccac

SEQ ID NO: 1750738 - RNA, 15 nt, Homo sapiens
aauauuuauuuaacu

SEQ ID NO: 1750739 - RNA, 18 nt, Homo sapiens
gcaccugucaacuggagu

SEQ ID NO: 1750740 - RNA, 13 nt, Homo sapiens
gggagcagugucu

SEQ ID NO: 1750741 - RNA, 15 nt, Homo sapiens
acgaacccaccugcu

SEQ ID NO: 1750742 - RNA, 19 nt, Homo sapiens
ccaagaacugcauggaccu

SEQ ID NO: 1750743 - RNA, 17 nt, Homo sapiens
agaaguagcaagaucuu

SEQ ID NO: 1750744 - RNA, 17 nt, Homo sapiens
aucagagugcacaagca

SEQ ID NO: 1750745 - RNA, 19 nt, Homo sapiens
aguaaaccugaacaaaccc

SEQ ID NO: 1750746 - RNA, 18 nt, Homo sapiens
gugguccuuccaccucag

SEQ ID NO: 1750747 - RNA, 14 nt, Homo sapiens
ggcugcugggagau

SEQ ID NO: 1750748 - RNA, 18 nt, Homo sapiens
acagagucucgcuauugu

SEQ ID NO: 1750749 - RNA, 23 nt, Homo sapiens
uggagaacaaagaccaaugugaa

SEQ ID NO: 1750750 - RNA, 13 nt, Homo sapiens
ccaccaacauaaa

SEQ ID NO: 1750751 - RNA, 23 nt, Homo sapiens
ugcuugggaucuucaaugaacug

SEQ ID NO: 1750752 - RNA, 21 nt, Homo sapiens
aaucugcaggcucuaucuuug

SEQ ID NO: 1750753 - RNA, 15 nt, Homo sapiens
cuccaaaucucaugu

SEQ ID NO: 1750754 - RNA, 14 nt, Homo sapiens
aagccaugaguucc

SEQ ID NO: 1750755 - RNA, 19 nt, Homo sapiens
gcaaccagucaaaaccaga

SEQ ID NO: 1750756 - RNA, 16 nt, Homo sapiens
uuauuauuugcacaga

SEQ ID NO: 1750757 - RNA, 12 nt, Homo sapiens
augaaugaucuu

SEQ ID NO: 1750758 - RNA, 18 nt, Homo sapiens
augaugcuaaucuugucc

SEQ ID NO: 1750759 - RNA, 18 nt, Homo sapiens
guugaugucgaugcucac

SEQ ID NO: 1750760 - RNA, 13 nt, Homo sapiens
cauuuugcuagac

SEQ ID NO: 1750761 - RNA, 22 nt, Homo sapiens
ucucgugauugauaagaaccuu

SEQ ID NO: 1750762 - RNA, 18 nt, Homo sapiens
aaugcauuuguaauucau

SEQ ID NO: 1750763 - RNA, 12 nt, Homo sapiens
uagcacauacua

SEQ ID NO: 1750764 - RNA, 13 nt, Homo sapiens
agcuacccugaaa

SEQ ID NO: 1750765 - RNA, 13 nt, Homo sapiens
ugcuacccagaaa

SEQ ID NO: 1750766 - RNA, 18 nt, Homo sapiens
ucucagucaaacuuaauu

SEQ ID NO: 1750767 - RNA, 17 nt, Homo sapiens
caaaacaaguuggaugc

SEQ ID NO: 1750768 - RNA, 17 nt, Homo sapiens
cuccaacucccucuggg

SEQ ID NO: 1750769 - RNA, 19 nt, Homo sapiens
aaucugaccguucuauugu

SEQ ID NO: 1750770 - RNA, 20 nt, Homo sapiens
acuggcauuuuuagcuccuu

SEQ ID NO: 1750771 - RNA, 21 nt, Homo sapiens
ucaucaaagcucacaccaaau

SEQ ID NO: 1750772 - RNA, 15 nt, Homo sapiens
cuuuuaaaacuucua

SEQ ID NO: 1750773 - RNA, 21 nt, Homo sapiens
uaccccccugagagcaugugg

SEQ ID NO: 1750774 - RNA, 17 nt, Homo sapiens
guuuuuuugcagaauua

SEQ ID NO: 1750775 - RNA, 17 nt, Homo sapiens
auauuugcacugaagca

SEQ ID NO: 1750776 - RNA, 17 nt, Homo sapiens
uggaggcuccuguggua

SEQ ID NO: 1750777 - RNA, 22 nt, Homo sapiens
ccugguuuuagacgaggccaca

SEQ ID NO: 1750778 - RNA, 15 nt, Homo sapiens
uccaugucugaaguu

SEQ ID NO: 1750779 - RNA, 11 nt, Homo sapiens
gccacccagca

SEQ ID NO: 1750780 - RNA, 15 nt, Homo sapiens
guccuaaccacuaac

SEQ ID NO: 1750781 - RNA, 18 nt, Homo sapiens
agguggauuuacugagag

SEQ ID NO: 1750782 - RNA, 16 nt, Homo sapiens
uaauuaccaaccuguu

SEQ ID NO: 1750783 - RNA, 18 nt, Homo sapiens
agcuuuuuguucccucau

SEQ ID NO: 1750784 - RNA, 19 nt, Homo sapiens
uuacuccaucauggcugcu

SEQ ID NO: 1750785 - RNA, 20 nt, Homo sapiens
uaaaaagugacacagcagcu

SEQ ID NO: 1750786 - RNA, 17 nt, Homo sapiens
ucugaggugcacuggga

SEQ ID NO: 1750787 - RNA, 21 nt, Homo sapiens
ucagaucuggaucguuaucua

SEQ ID NO: 1750788 - RNA, 15 nt, Homo sapiens
cugauuugauaccau

SEQ ID NO: 1750789 - RNA, 14 nt, Homo sapiens
acauacuguucuca

SEQ ID NO: 1750790 - RNA, 16 nt, Homo sapiens
cuccuuccaccucccu

SEQ ID NO: 1750791 - RNA, 16 nt, Homo sapiens
cacaacugacacagga

SEQ ID NO: 1750792 - RNA, 19 nt, Homo sapiens
auuugguggccuaauuuac

SEQ ID NO: 1750793 - RNA, 19 nt, Homo sapiens
aaaaggaacaaaaauuaca

SEQ ID NO: 1750794 - RNA, 17 nt, Homo sapiens
cuucaucucaccauccu

SEQ ID NO: 1750795 - RNA, 22 nt, Homo sapiens
cuuguggggcaggauucucugc

SEQ ID NO: 1750796 - RNA, 14 nt, Homo sapiens
uaaaguaauugaca

SEQ ID NO: 1750797 - RNA, 17 nt, Homo sapiens
guccaggucucacugcu

SEQ ID NO: 1750798 - RNA, 18 nt, Homo sapiens
augugggagggagcagac

SEQ ID NO: 1750799 - RNA, 15 nt, Homo sapiens
auacaagauuauaca

SEQ ID NO: 1750800 - RNA, 17 nt, Homo sapiens
cacagaagguccuggug

SEQ ID NO: 1750801 - RNA, 13 nt, Homo sapiens
gagcccuugccca

SEQ ID NO: 1750802 - RNA, 19 nt, Homo sapiens
auucuuguuuuaagugccu

SEQ ID NO: 1750803 - RNA, 18 nt, Homo sapiens
uaaaaaauagacauguag

SEQ ID NO: 1750804 - RNA, 18 nt, Homo sapiens
aaaauugguaacuaagaa

SEQ ID NO: 1750805 - RNA, 21 nt, Homo sapiens
cuucccagcgguuccugugca

SEQ ID NO: 1750806 - RNA, 18 nt, Homo sapiens
uuucaauucaugcuaccu

SEQ ID NO: 1750807 - RNA, 23 nt, Homo sapiens
caugcacacgggaaagccuuaaa

SEQ ID NO: 1750808 - RNA, 19 nt, Homo sapiens
uccugaguuggccaggcau

SEQ ID NO: 1750809 - RNA, 17 nt, Homo sapiens
auuugagaauacauaaa

SEQ ID NO: 1750810 - RNA, 15 nt, Homo sapiens
acccucuuugcugca

SEQ ID NO: 1750811 - RNA, 22 nt, Homo sapiens
gucuccagauguuaauuuacuu

SEQ ID NO: 1750812 - RNA, 23 nt, Homo sapiens
agcagggaggaagaagcuuaggc

SEQ ID NO: 1750813 - RNA, 20 nt, Homo sapiens
gagauugcacuauugcacuc

SEQ ID NO: 1750814 - RNA, 20 nt, Homo sapiens
acucugggaauacaggggug

SEQ ID NO: 1750815 - RNA, 12 nt, Homo sapiens
ugccacagugug

SEQ ID NO: 1750816 - RNA, 21 nt, Homo sapiens
accucagaucuuugcaccaga

SEQ ID NO: 1750817 - RNA, 14 nt, Homo sapiens
cucguuccuaccug

SEQ ID NO: 1750818 - RNA, 22 nt, Homo sapiens
aagcacgugucucagacugcau

SEQ ID NO: 1750819 - RNA, 13 nt, Homo sapiens
uaaaguaacauca

SEQ ID NO: 1750820 - RNA, 14 nt, Homo sapiens
ucccuaguuuacaa

SEQ ID NO: 1750821 - RNA, 15 nt, Homo sapiens
aucuacacugccuua

SEQ ID NO: 1750822 - RNA, 19 nt, Homo sapiens
uguccugauggcacucugu

SEQ ID NO: 1750823 - RNA, 18 nt, Homo sapiens
cuaaguguggguuuauau

SEQ ID NO: 1750824 - RNA, 17 nt, Homo sapiens
cugcauuuuucagagaa

SEQ ID NO: 1750825 - RNA, 18 nt, Homo sapiens
uuuuuugcuaagagccag

SEQ ID NO: 1750826 - RNA, 21 nt, Homo sapiens
cuaugcccugcagagcaauaa

SEQ ID NO: 1750827 - RNA, 18 nt, Homo sapiens
ugcaguggcgugaucuca

SEQ ID NO: 1750828 - RNA, 15 nt, Homo sapiens
ucugaaggcugaguc

SEQ ID NO: 1750829 - RNA, 19 nt, Homo sapiens
cuuuguguagaaagccaaa

SEQ ID NO: 1750830 - RNA, 17 nt, Homo sapiens
auguauauguauaucua

SEQ ID NO: 1750831 - RNA, 18 nt, Homo sapiens
ccagauuuacacugggag

SEQ ID NO: 1750832 - RNA, 14 nt, Homo sapiens
gacuggagugcagu

SEQ ID NO: 1750833 - RNA, 20 nt, Homo sapiens
agaccaggacagcagccacu

SEQ ID NO: 1750834 - RNA, 14 nt, Homo sapiens
uuuaaaaugaauaa

SEQ ID NO: 1750835 - RNA, 17 nt, Homo sapiens
gaauaaauugcuccuug

SEQ ID NO: 1750836 - RNA, 12 nt, Homo sapiens
ggucacuugcaa

SEQ ID NO: 1750837 - RNA, 17 nt, Homo sapiens
ggugauucgcccaccuc

SEQ ID NO: 1750838 - RNA, 20 nt, Homo sapiens
aagguuaaaggaaaagcaca

SEQ ID NO: 1750839 - RNA, 14 nt, Homo sapiens
uagcuuguccaagg

SEQ ID NO: 1750840 - RNA, 12 nt, Homo sapiens
cuuguaaauacu

SEQ ID NO: 1750841 - RNA, 18 nt, Homo sapiens
agacaacccucagauuug

SEQ ID NO: 1750842 - RNA, 17 nt, Homo sapiens
ugaggucaacacaggua

SEQ ID NO: 1750843 - RNA, 16 nt, Homo sapiens
cauucucaggcaccag

SEQ ID NO: 1750844 - RNA, 15 nt, Homo sapiens
auucuccugucagag

SEQ ID NO: 1750845 - RNA, 20 nt, Homo sapiens
acuauugcuaguacuaguac

SEQ ID NO: 1750846 - RNA, 14 nt, Homo sapiens
ugaaaguuaaucca

SEQ ID NO: 1750847 - RNA, 17 nt, Homo sapiens
cugaagauaaugaaaua

SEQ ID NO: 1750848 - RNA, 16 nt, Homo sapiens
uugugaaacagacuug

SEQ ID NO: 1750849 - RNA, 12 nt, Homo sapiens
agaaaauuuauc

SEQ ID NO: 1750850 - RNA, 18 nt, Homo sapiens
uacuucaaaucauauccu

SEQ ID NO: 1750851 - RNA, 12 nt, Homo sapiens
cguuaaaggcau

SEQ ID NO: 1750852 - RNA, 17 nt, Homo sapiens
cugccugcauucugaga

SEQ ID NO: 1750853 - RNA, 22 nt, Homo sapiens
uuaucaacuagaaacaguacau

SEQ ID NO: 1750854 - RNA, 21 nt, Homo sapiens
ucacauuuuaagugcuucaca

SEQ ID NO: 1750855 - RNA, 12 nt, Homo sapiens
gcuuugcccauu

SEQ ID NO: 1750856 - RNA, 17 nt, Homo sapiens
caacauuuacauguauu

SEQ ID NO: 1750857 - RNA, 17 nt, Homo sapiens
ccuagcccuucucucau

SEQ ID NO: 1750858 - RNA, 17 nt, Homo sapiens
ccuagccccucucucac

SEQ ID NO: 1750859 - RNA, 22 nt, Homo sapiens
cauuguaauguucauuucccac

SEQ ID NO: 1750860 - RNA, 16 nt, Homo sapiens
uucgacugguccagcu

SEQ ID NO: 1750861 - RNA, 21 nt, Homo sapiens
auugcuuaagaaacacauaaa

SEQ ID NO: 1750862 - RNA, 15 nt, Homo sapiens
gagcaagacugucuc

SEQ ID NO: 1750863 - RNA, 23 nt, Homo sapiens
cucaaucuacaggccagcaccuu

SEQ ID NO: 1750864 - RNA, 22 nt, Homo sapiens
gcugcagccucccuuccaugcc

SEQ ID NO: 1750865 - RNA, 21 nt, Homo sapiens
acugcaagcacugcaugggca

SEQ ID NO: 1750866 - RNA, 18 nt, Homo sapiens
caaauagugcaacuauga

SEQ ID NO: 1750867 - RNA, 21 nt, Homo sapiens
caucaaaauauuucagugaau

SEQ ID NO: 1750868 - RNA, 15 nt, Homo sapiens
cuucccacggcuccu

SEQ ID NO: 1750869 - RNA, 20 nt, Homo sapiens
aucccaaaucuauagcauuu

SEQ ID NO: 1750870 - RNA, 21 nt, Homo sapiens
gcccuugcccugaccucccag

SEQ ID NO: 1750871 - RNA, 18 nt, Homo sapiens
aauaaggagggacaugau

SEQ ID NO: 1750872 - RNA, 14 nt, Homo sapiens
auuaaugcauucaa

SEQ ID NO: 1750873 - RNA, 15 nt, Homo sapiens
aguucaucuugaauu

SEQ ID NO: 1750874 - RNA, 22 nt, Homo sapiens
ucugguaauauugacuuguaua

SEQ ID NO: 1750875 - RNA, 22 nt, Homo sapiens
ccacaccggccaagaugcuuuu

SEQ ID NO: 1750876 - RNA, 22 nt, Homo sapiens
cugcaaggugaaacgacucaaa

SEQ ID NO: 1750877 - RNA, 19 nt, Homo sapiens
aacaagcuucaaagccaua

SEQ ID NO: 1750878 - RNA, 22 nt, Homo sapiens
uggaugacgugaagccacagga

SEQ ID NO: 1750879 - RNA, 13 nt, Homo sapiens
caggugaucugcc

SEQ ID NO: 1750880 - RNA, 13 nt, Homo sapiens
caagagcugagaa

SEQ ID NO: 1750881 - RNA, 13 nt, Homo sapiens
gcagaacuugaag

SEQ ID NO: 1750882 - RNA, 19 nt, Homo sapiens
aagcugcugccgccucacc

SEQ ID NO: 1750883 - RNA, 18 nt, Homo sapiens
cuuccuucuuacuugcca

SEQ ID NO: 1750884 - RNA, 15 nt, Homo sapiens
aaggacaggacccuc

SEQ ID NO: 1750885 - RNA, 17 nt, Homo sapiens
auucccauguugucaau

SEQ ID NO: 1750886 - RNA, 15 nt, Homo sapiens
agauuuuuaaaaagc

SEQ ID NO: 1750887 - RNA, 12 nt, Homo sapiens
agcucucugcaa

SEQ ID NO: 1750888 - RNA, 21 nt, Homo sapiens
gcuucaaaaauuaaaauccag

SEQ ID NO: 1750889 - RNA, 12 nt, Homo sapiens
ccucaccugcug

SEQ ID NO: 1750890 - RNA, 23 nt, Homo sapiens
agcugggauaaucacauuaucau

SEQ ID NO: 1750891 - RNA, 18 nt, Homo sapiens
gggcagggugagaagcua

SEQ ID NO: 1750892 - RNA, 21 nt, Homo sapiens
auguuuugguguauugucagc

SEQ ID NO: 1750893 - RNA, 22 nt, Homo sapiens
gcucuaaauagccaacacccau

SEQ ID NO: 1750894 - RNA, 16 nt, Homo sapiens
ugcaaaccaaaccauu

SEQ ID NO: 1750895 - RNA, 21 nt, Homo sapiens
ccaaaauaaugcaccacuuuu

SEQ ID NO: 1750896 - RNA, 17 nt, Homo sapiens
aagacugcguggauuca

SEQ ID NO: 1750897 - RNA, 13 nt, Homo sapiens
ccagcugcugucu

SEQ ID NO: 1750898 - RNA, 16 nt, Homo sapiens
augccuauuuacugga

SEQ ID NO: 1750899 - RNA, 21 nt, Homo sapiens
cuucagauuaaugacuggcua

SEQ ID NO: 1750900 - RNA, 17 nt, Homo sapiens
aacuggaaauguccaag

SEQ ID NO: 1750901 - RNA, 13 nt, Homo sapiens
cgacauugucucc

SEQ ID NO: 1750902 - RNA, 20 nt, Homo sapiens
auucugcccuggacagggcu

SEQ ID NO: 1750903 - RNA, 22 nt, Homo sapiens
cuguuuacauccagaguucugu

SEQ ID NO: 1750904 - RNA, 17 nt, Homo sapiens
uuuuccugugcaaaaau

SEQ ID NO: 1750905 - RNA, 19 nt, Homo sapiens
gaaagaguugccauaauga

SEQ ID NO: 1750906 - RNA, 21 nt, Homo sapiens
uuuaauaaauugcuuacugau

SEQ ID NO: 1750907 - RNA, 14 nt, Homo sapiens
aucuguguuuacuu

SEQ ID NO: 1750908 - RNA, 18 nt, Homo sapiens
cuuccaggggaaccugcc

SEQ ID NO: 1750909 - RNA, 21 nt, Homo sapiens
acuggguuuggaccccagcug

SEQ ID NO: 1750910 - RNA, 23 nt, Homo sapiens
aaugcacuuuuaugaaguuuuua

SEQ ID NO: 1750911 - RNA, 22 nt, Homo sapiens
auaucgcuggccagcauuauaa

SEQ ID NO: 1750912 - RNA, 23 nt, Homo sapiens
uggaagaggggacaggucccuca

SEQ ID NO: 1750913 - RNA, 16 nt, Homo sapiens
uaaacagagugcaaag

SEQ ID NO: 1750914 - RNA, 21 nt, Homo sapiens
gaaauuuuugaugcccagaca

SEQ ID NO: 1750915 - RNA, 14 nt, Homo sapiens
ccaaagaccaucug

SEQ ID NO: 1750916 - RNA, 22 nt, Homo sapiens
cuaguuuuguuuauaaauugga

SEQ ID NO: 1750917 - RNA, 19 nt, Homo sapiens
agggcuaaaucccaagugu

SEQ ID NO: 1750918 - RNA, 21 nt, Homo sapiens
ccuuaaaaauuaaauucucuc

SEQ ID NO: 1750919 - RNA, 17 nt, Homo sapiens
cagcucugacuuuacac

SEQ ID NO: 1750920 - RNA, 13 nt, Homo sapiens
cuagaaacccaag

SEQ ID NO: 1750921 - RNA, 18 nt, Homo sapiens
auugugaucagaccauaa

SEQ ID NO: 1750922 - RNA, 17 nt, Homo sapiens
ccaaaccguacuguauu

SEQ ID NO: 1750923 - RNA, 19 nt, Homo sapiens
gcuuuguuuuuggcauuuc

SEQ ID NO: 1750924 - RNA, 14 nt, Homo sapiens
gauggcaggugccu

SEQ ID NO: 1750925 - RNA, 15 nt, Homo sapiens
acuaaaccauugugc

SEQ ID NO: 1750926 - RNA, 21 nt, Homo sapiens
gacuaugacauaaaaacaacu

SEQ ID NO: 1750927 - RNA, 17 nt, Homo sapiens
acugagaaccgugacau

SEQ ID NO: 1750928 - RNA, 18 nt, Homo sapiens
uguccaguuugugcucua

SEQ ID NO: 1750929 - RNA, 14 nt, Homo sapiens
aaaccaaaucacug

SEQ ID NO: 1750930 - RNA, 18 nt, Homo sapiens
ugccuugcugcaccugag

SEQ ID NO: 1750931 - RNA, 23 nt, Homo sapiens
cuggaagaaggaagaagccagac

SEQ ID NO: 1750932 - RNA, 19 nt, Homo sapiens
agauaagguggcuucucac

SEQ ID NO: 1750933 - RNA, 15 nt, Homo sapiens
caaaagcgaaacaca

SEQ ID NO: 1750934 - RNA, 21 nt, Homo sapiens
caaugaaggagauagauuugu

SEQ ID NO: 1750935 - RNA, 13 nt, Homo sapiens
auaccuggcuuuu

SEQ ID NO: 1750936 - RNA, 22 nt, Homo sapiens
gagcccuaagcauugacuucuc

SEQ ID NO: 1750937 - RNA, 17 nt, Homo sapiens
ggugacugaaauugcau

SEQ ID NO: 1750938 - RNA, 17 nt, Homo sapiens
uucauaaagucuugccu

SEQ ID NO: 1750939 - RNA, 17 nt, Homo sapiens
guuacuuaccacagacu

SEQ ID NO: 1750940 - RNA, 15 nt, Homo sapiens
gugaguggcagccau

SEQ ID NO: 1750941 - RNA, 22 nt, Homo sapiens
ccucaucugggggaguggaaua

SEQ ID NO: 1750942 - RNA, 21 nt, Homo sapiens
auuauauaguauaccauacau

SEQ ID NO: 1750943 - RNA, 14 nt, Homo sapiens
uuaucaccacacca

SEQ ID NO: 1750944 - RNA, 14 nt, Homo sapiens
ucucacuuuggacu

SEQ ID NO: 1750945 - RNA, 21 nt, Homo sapiens
cacaacuccuacaugauguua

SEQ ID NO: 1750946 - RNA, 13 nt, Homo sapiens
uuguucacacucc

SEQ ID NO: 1750947 - RNA, 16 nt, Homo sapiens
uuaguacaccauaaac

SEQ ID NO: 1750948 - RNA, 17 nt, Homo sapiens
agggcacucacaugccg

SEQ ID NO: 1750949 - RNA, 20 nt, Homo sapiens
ugaggaacucacauacugac

SEQ ID NO: 1750950 - RNA, 23 nt, Homo sapiens
ccaccacucccagccugauuuau

SEQ ID NO: 1750951 - RNA, 21 nt, Homo sapiens
caucugcauugcccagucuuu

SEQ ID NO: 1750952 - RNA, 13 nt, Homo sapiens
uuugggcugucuu

SEQ ID NO: 1750953 - RNA, 17 nt, Homo sapiens
auggcacucaggaaagu

SEQ ID NO: 1750954 - RNA, 23 nt, Homo sapiens
agguccucuacuuaaugagauag

SEQ ID NO: 1750955 - RNA, 16 nt, Homo sapiens
cugcaugaaacauguu

SEQ ID NO: 1750956 - RNA, 13 nt, Homo sapiens
gaguuccggccug

SEQ ID NO: 1750957 - RNA, 19 nt, Homo sapiens
uuugauugcugagagccau

SEQ ID NO: 1750958 - RNA, 13 nt, Homo sapiens
auuuaugucucau

SEQ ID NO: 1750959 - RNA, 16 nt, Homo sapiens
accccucuuccagcuu

SEQ ID NO: 1750960 - RNA, 15 nt, Homo sapiens
ccuaccaacuuuacu

SEQ ID NO: 1750961 - RNA, 20 nt, Homo sapiens
agagcagcuccuuccuagcc

SEQ ID NO: 1750962 - RNA, 15 nt, Homo sapiens
ccucagugacaucaa

SEQ ID NO: 1750963 - RNA, 17 nt, Homo sapiens
ugcccuugcugggccug

SEQ ID NO: 1750964 - RNA, 19 nt, Homo sapiens
ccuuaaugucaccaugcuu

SEQ ID NO: 1750965 - RNA, 18 nt, Homo sapiens
ucacaacuaggaccucau

SEQ ID NO: 1750966 - RNA, 15 nt, Homo sapiens
aaauuaggccucaaa

SEQ ID NO: 1750967 - RNA, 17 nt, Homo sapiens
caaaugacaugcacuga

SEQ ID NO: 1750968 - RNA, 21 nt, Homo sapiens
uaaagcagagcuaguaaugcu

SEQ ID NO: 1750969 - RNA, 12 nt, Homo sapiens
acugcaucccag

SEQ ID NO: 1750970 - RNA, 14 nt, Homo sapiens
aaugauacugaugg

SEQ ID NO: 1750971 - RNA, 17 nt, Homo sapiens
ggagccaacugcugcuu

SEQ ID NO: 1750972 - RNA, 17 nt, Homo sapiens
acuguucacacugcaga

SEQ ID NO: 1750973 - RNA, 15 nt, Homo sapiens
cuauuuguacaauuu

SEQ ID NO: 1750974 - RNA, 12 nt, Homo sapiens
ucucagcugcug

SEQ ID NO: 1750975 - RNA, 14 nt, Homo sapiens
gaugaaaugccaag

SEQ ID NO: 1750976 - RNA, 20 nt, Homo sapiens
aguaaguuaauguauauaaa

SEQ ID NO: 1750977 - RNA, 20 nt, Homo sapiens
auggauugggggggccaaaa

SEQ ID NO: 1750978 - RNA, 19 nt, Homo sapiens
agcucagaaaaucaaagag

SEQ ID NO: 1750979 - RNA, 12 nt, Homo sapiens
uggcagagccag

SEQ ID NO: 1750980 - RNA, 14 nt, Homo sapiens
ggcccugaaccagg

SEQ ID NO: 1750981 - RNA, 14 nt, Homo sapiens
aaauaaucacagau

SEQ ID NO: 1750982 - RNA, 20 nt, Homo sapiens
caaacuccugggcucaagug

SEQ ID NO: 1750983 - RNA, 23 nt, Homo sapiens
auuuucaaaggcuuccaaugugg

SEQ ID NO: 1750984 - RNA, 20 nt, Homo sapiens
agaggaaggagauuccacac

SEQ ID NO: 1750985 - RNA, 17 nt, Homo sapiens
ugcucaccugaggauaa

SEQ ID NO: 1750986 - RNA, 15 nt, Homo sapiens
ccaagauagagucaa

SEQ ID NO: 1750987 - RNA, 16 nt, Homo sapiens
accgauuucagcacau

SEQ ID NO: 1750988 - RNA, 18 nt, Homo sapiens
agugacugaaaauggcau

SEQ ID NO: 1750989 - RNA, 14 nt, Homo sapiens
ggagcuggggcaag

SEQ ID NO: 1750990 - RNA, 12 nt, Homo sapiens
cucagugcagcc

SEQ ID NO: 1750991 - RNA, 12 nt, Homo sapiens
uaaagucaguga

SEQ ID NO: 1750992 - RNA, 17 nt, Homo sapiens
auuacauggaacuuuuc

SEQ ID NO: 1750993 - RNA, 14 nt, Homo sapiens
cacguuaccauuua

SEQ ID NO: 1750994 - RNA, 22 nt, Homo sapiens
ccugaugugaguguguggcacc

SEQ ID NO: 1750995 - RNA, 15 nt, Homo sapiens
auucuggaagcaaau

SEQ ID NO: 1750996 - RNA, 17 nt, Homo sapiens
uaccuccugucucuggc

SEQ ID NO: 1750997 - RNA, 13 nt, Homo sapiens
aggcucacagauu

SEQ ID NO: 1750998 - RNA, 14 nt, Homo sapiens
gcccuuguccugcc

SEQ ID NO: 1750999 - RNA, 14 nt, Homo sapiens
ccugcugugcccuc

SEQ ID NO: 1751000 - RNA, 17 nt, Homo sapiens
aaggugaaccaugucag

SEQ ID NO: 1751001 - RNA, 18 nt, Homo sapiens
uucugggcaaucaguguu

SEQ ID NO: 1751002 - RNA, 14 nt, Homo sapiens
auguagguguuugu

SEQ ID NO: 1751003 - RNA, 14 nt, Homo sapiens
aaacaaucuuguca

SEQ ID NO: 1751004 - RNA, 21 nt, Homo sapiens
ucuggaaaagcacuuuacaga

SEQ ID NO: 1751005 - RNA, 16 nt, Homo sapiens
uugaauuuaggugaua

SEQ ID NO: 1751006 - RNA, 11 nt, Homo sapiens
ggcaccucucu

SEQ ID NO: 1751007 - RNA, 14 nt, Homo sapiens
agcaauggccagag

SEQ ID NO: 1751008 - RNA, 23 nt, Homo sapiens
ucccccagugcccuuugcaucgu

SEQ ID NO: 1751009 - RNA, 12 nt, Homo sapiens
uaaaaaggaaua

SEQ ID NO: 1751010 - RNA, 20 nt, Homo sapiens
auguugaccauuccaaaguu

SEQ ID NO: 1751011 - RNA, 17 nt, Homo sapiens
cucuccccuccagccuu

SEQ ID NO: 1751012 - RNA, 23 nt, Homo sapiens
acuagagucugaacagcuguaau

SEQ ID NO: 1751013 - RNA, 13 nt, Homo sapiens
uaaacucugucca

SEQ ID NO: 1751014 - RNA, 12 nt, Homo sapiens
agugacagucau

SEQ ID NO: 1751015 - RNA, 18 nt, Homo sapiens
gggugagggaucacugcc

SEQ ID NO: 1751016 - RNA, 23 nt, Homo sapiens
aggaacucuucaugagcacuuug

SEQ ID NO: 1751017 - RNA, 22 nt, Homo sapiens
cucugaugaugucacacaaaau

SEQ ID NO: 1751018 - RNA, 23 nt, Homo sapiens
gggagcugcagucccaugcacaa

SEQ ID NO: 1751019 - RNA, 22 nt, Homo sapiens
ugugcaagugugugcaugugug

SEQ ID NO: 1751020 - RNA, 15 nt, Homo sapiens
aucccuagugcucca

SEQ ID NO: 1751021 - RNA, 17 nt, Homo sapiens
cugucucuagcuguucu

SEQ ID NO: 1751022 - RNA, 23 nt, Homo sapiens
cuugagcaaguagguugcugucu

SEQ ID NO: 1751023 - RNA, 20 nt, Homo sapiens
cauugauguaaggacuguaa

SEQ ID NO: 1751024 - RNA, 19 nt, Homo sapiens
agucuucucauagcauuaa

SEQ ID NO: 1751025 - RNA, 22 nt, Homo sapiens
cucagcggcaaaauuaauggac

SEQ ID NO: 1751026 - RNA, 22 nt, Homo sapiens
ggggaggccaagugcaggcugg

SEQ ID NO: 1751027 - RNA, 20 nt, Homo sapiens
cuuaguuggugaaacccaga

SEQ ID NO: 1751028 - RNA, 22 nt, Homo sapiens
aaugcacguuucaaagcuuucc

SEQ ID NO: 1751029 - RNA, 16 nt, Homo sapiens
cugggaaucaagacaa

SEQ ID NO: 1751030 - RNA, 18 nt, Homo sapiens
gaccacugcuggaccaag

SEQ ID NO: 1751031 - RNA, 17 nt, Homo sapiens
ugagcaaccgcuucccu

SEQ ID NO: 1751032 - RNA, 21 nt, Homo sapiens
cccaccaaaaacacagugaaa

SEQ ID NO: 1751033 - RNA, 19 nt, Homo sapiens
acuuugcugcauuuuacac

SEQ ID NO: 1751034 - RNA, 17 nt, Homo sapiens
aauuuacaagagcuguu

SEQ ID NO: 1751035 - RNA, 14 nt, Homo sapiens
uauggaauuuugca

SEQ ID NO: 1751036 - RNA, 19 nt, Homo sapiens
uggugauauuguguggucu

SEQ ID NO: 1751037 - RNA, 20 nt, Homo sapiens
cugagaaccaaccaaugaaa

SEQ ID NO: 1751038 - RNA, 17 nt, Homo sapiens
aggaaggggaaacacag

SEQ ID NO: 1751039 - RNA, 16 nt, Homo sapiens
ucaauacaaaccagca

SEQ ID NO: 1751040 - RNA, 22 nt, Homo sapiens
uuauacaccagcaauuuagaca

SEQ ID NO: 1751041 - RNA, 20 nt, Homo sapiens
guauaauugaccuacuuugg

SEQ ID NO: 1751042 - RNA, 19 nt, Homo sapiens
accaggcugugggccucaa

SEQ ID NO: 1751043 - RNA, 23 nt, Homo sapiens
uaauuauaaaaugcaaucaauuu

SEQ ID NO: 1751044 - RNA, 13 nt, Homo sapiens
aaauggaccaucc

SEQ ID NO: 1751045 - RNA, 20 nt, Homo sapiens
uaauaaugccuaccuuguga

SEQ ID NO: 1751046 - RNA, 13 nt, Homo sapiens
ucccuccucacac

SEQ ID NO: 1751047 - RNA, 21 nt, Homo sapiens
ugcuaaagaaaggaacuaagu

SEQ ID NO: 1751048 - RNA, 20 nt, Homo sapiens
ggcuggagugcaauggcgcg

SEQ ID NO: 1751049 - RNA, 18 nt, Homo sapiens
uguaaacaaaccacagca

SEQ ID NO: 1751050 - RNA, 15 nt, Homo sapiens
ggaaacacugccuuu

SEQ ID NO: 1751051 - RNA, 18 nt, Homo sapiens
agacuagaauucugggaa

SEQ ID NO: 1751052 - RNA, 15 nt, Homo sapiens
uggaacagucuuccc

SEQ ID NO: 1751053 - RNA, 15 nt, Homo sapiens
gacucugauucuaca

SEQ ID NO: 1751054 - RNA, 21 nt, Homo sapiens
aauaguuaucuuuuaauuaca

SEQ ID NO: 1751055 - RNA, 15 nt, Homo sapiens
gaucgguaucuuugu

SEQ ID NO: 1751056 - RNA, 15 nt, Homo sapiens
ucgcuaaagagugaa

SEQ ID NO: 1751057 - RNA, 18 nt, Homo sapiens
ggauuuaacagucauuua

SEQ ID NO: 1751058 - RNA, 13 nt, Homo sapiens
uugcugugagcaa

SEQ ID NO: 1751059 - RNA, 23 nt, Homo sapiens
gguccaaagaguuucugcaaagu

SEQ ID NO: 1751060 - RNA, 19 nt, Homo sapiens
acaaccguauaccugagaa

SEQ ID NO: 1751061 - RNA, 16 nt, Homo sapiens
aaaggggauggaguga

SEQ ID NO: 1751062 - RNA, 14 nt, Homo sapiens
ccagcgugggaccc

SEQ ID NO: 1751063 - RNA, 19 nt, Homo sapiens
ccagaguuuuuaaagccuu

SEQ ID NO: 1751064 - RNA, 17 nt, Homo sapiens
guggcuaagggggacca

SEQ ID NO: 1751065 - RNA, 15 nt, Homo sapiens
caaagcccacugcca

SEQ ID NO: 1751066 - RNA, 11 nt, Homo sapiens
cauagagccag

SEQ ID NO: 1751067 - RNA, 19 nt, Homo sapiens
uguuuacaugaguucaaau

SEQ ID NO: 1751068 - RNA, 17 nt, Homo sapiens
gaggcagguugaucacc

SEQ ID NO: 1751069 - RNA, 20 nt, Homo sapiens
aaauauuuauucaucugcaa

SEQ ID NO: 1751070 - RNA, 21 nt, Homo sapiens
gugaugugugagcuaugcaaa

SEQ ID NO: 1751071 - RNA, 16 nt, Homo sapiens
ucaaguauuugaucag

SEQ ID NO: 1751072 - RNA, 19 nt, Homo sapiens
ugaaagaacaauauagucu

SEQ ID NO: 1751073 - RNA, 18 nt, Homo sapiens
augaacaugugaaguuau

SEQ ID NO: 1751074 - RNA, 15 nt, Homo sapiens
ccaggcugcaggugg

SEQ ID NO: 1751075 - RNA, 20 nt, Homo sapiens
aauaaguuugcuccuucaua

SEQ ID NO: 1751076 - RNA, 14 nt, Homo sapiens
acaaaccacuguga

SEQ ID NO: 1751077 - RNA, 16 nt, Homo sapiens
ugcgguagaugggagg

SEQ ID NO: 1751078 - RNA, 11 nt, Homo sapiens
caagaccccac

SEQ ID NO: 1751079 - RNA, 18 nt, Homo sapiens
auuaaaauuccaaauuca

SEQ ID NO: 1751080 - RNA, 18 nt, Homo sapiens
accuccagcuuuccugua

SEQ ID NO: 1751081 - RNA, 19 nt, Homo sapiens
ugcuuuaugcaacuaacug

SEQ ID NO: 1751082 - RNA, 19 nt, Homo sapiens
ucuccagcggcccugucau

SEQ ID NO: 1751083 - RNA, 23 nt, Homo sapiens
gucgagaggcaccacggccucac

SEQ ID NO: 1751084 - RNA, 19 nt, Homo sapiens
uaacguauuaguugccaau

SEQ ID NO: 1751085 - RNA, 19 nt, Homo sapiens
cacaaguuuuuuuguucau

SEQ ID NO: 1751086 - RNA, 13 nt, Homo sapiens
uccuucagugcau

SEQ ID NO: 1751087 - RNA, 14 nt, Homo sapiens
aaacauagcaucuc

SEQ ID NO: 1751088 - RNA, 21 nt, Homo sapiens
acauacuaaugaaguauuaca

SEQ ID NO: 1751089 - RNA, 17 nt, Homo sapiens
ucauuuaauuugaaauu

SEQ ID NO: 1751090 - RNA, 17 nt, Homo sapiens
augcucuuuugcacaag

SEQ ID NO: 1751091 - RNA, 22 nt, Homo sapiens
ugguugaauaguucuauacaaa

SEQ ID NO: 1751092 - RNA, 23 nt, Homo sapiens
aagaucacaucacugcacuccag

SEQ ID NO: 1751093 - RNA, 19 nt, Homo sapiens
ucccagguucaagagauuc

SEQ ID NO: 1751094 - RNA, 21 nt, Homo sapiens
ucccauggccccuugcauuuc

SEQ ID NO: 1751095 - RNA, 15 nt, Homo sapiens
cuuuagaaaaggcau

SEQ ID NO: 1751096 - RNA, 20 nt, Homo sapiens
cauaacugaaaaugugcuau

SEQ ID NO: 1751097 - RNA, 20 nt, Homo sapiens
cuucacuuauccuguucucu

SEQ ID NO: 1751098 - RNA, 20 nt, Homo sapiens
gggacuuuggaauucugcuu

SEQ ID NO: 1751099 - RNA, 21 nt, Homo sapiens
cuggaagaaagcccugugcuu

SEQ ID NO: 1751100 - RNA, 16 nt, Homo sapiens
ugccccuagcuuuaua

SEQ ID NO: 1751101 - RNA, 21 nt, Homo sapiens
aaggugcaggggccaggggug

SEQ ID NO: 1751102 - RNA, 21 nt, Homo sapiens
aaguacugguugacuuucuaa

SEQ ID NO: 1751103 - RNA, 12 nt, Homo sapiens
cugaacauauua

SEQ ID NO: 1751104 - RNA, 10 nt, Homo sapiens
gcuguuaaau

SEQ ID NO: 1751105 - RNA, 20 nt, Homo sapiens
aaauagaaaauaugaccaga

SEQ ID NO: 1751106 - RNA, 18 nt, Homo sapiens
caagagugaaacuccauc

SEQ ID NO: 1751107 - RNA, 21 nt, Homo sapiens
uggaccacuuacagugugaua

SEQ ID NO: 1751108 - RNA, 22 nt, Homo sapiens
uucaacgacugccgugacauca

SEQ ID NO: 1751109 - RNA, 15 nt, Homo sapiens
gaaaguggaaaauga

SEQ ID NO: 1751110 - RNA, 12 nt, Homo sapiens
aggccuccgucu

SEQ ID NO: 1751111 - RNA, 14 nt, Homo sapiens
uuguuagcauuuuc

SEQ ID NO: 1751112 - RNA, 12 nt, Homo sapiens
ccugugcuacag

SEQ ID NO: 1751113 - RNA, 18 nt, Homo sapiens
gaacaagacccccaggaa

SEQ ID NO: 1751114 - RNA, 17 nt, Homo sapiens
acccagggcaaauggaa

SEQ ID NO: 1751115 - RNA, 18 nt, Homo sapiens
aggaacugcuugugcacu

SEQ ID NO: 1751116 - RNA, 24 nt, Homo sapiens
ccuuucugucccacuacaucuggg

SEQ ID NO: 1751117 - RNA, 14 nt, Homo sapiens
aagcgggaguggcu

SEQ ID NO: 1751118 - RNA, 14 nt, Homo sapiens
agaggcaaaggcuc

SEQ ID NO: 1751119 - RNA, 21 nt, Homo sapiens
caguuugugcucuacggguga

SEQ ID NO: 1751120 - RNA, 16 nt, Homo sapiens
auuuuuuucaguauua

SEQ ID NO: 1751121 - RNA, 11 nt, Homo sapiens
acacucagggc

SEQ ID NO: 1751122 - RNA, 14 nt, Homo sapiens
ugauugcacuugau

SEQ ID NO: 1751123 - RNA, 12 nt, Homo sapiens
agacucacugug

SEQ ID NO: 1751124 - RNA, 16 nt, Homo sapiens
ggagcuggcccucucc

SEQ ID NO: 1751125 - RNA, 18 nt, Homo sapiens
ggcaccagacacccagga

SEQ ID NO: 1751126 - RNA, 16 nt, Homo sapiens
acaauggacuguacaa

SEQ ID NO: 1751127 - RNA, 11 nt, Homo sapiens
gccucagugac

SEQ ID NO: 1751128 - RNA, 18 nt, Homo sapiens
ucucaucugaggcaucca

SEQ ID NO: 1751129 - RNA, 21 nt, Homo sapiens
aaguacaaauauuccuguuuc

SEQ ID NO: 1751130 - RNA, 18 nt, Homo sapiens
gcuccucugcagccugag

SEQ ID NO: 1751131 - RNA, 17 nt, Homo sapiens
auaagaaguagcaagau

SEQ ID NO: 1751132 - RNA, 17 nt, Homo sapiens
uuccuccuggcuuccag

SEQ ID NO: 1751133 - RNA, 15 nt, Homo sapiens
ucaaaggcacaguga

SEQ ID NO: 1751134 - RNA, 20 nt, Homo sapiens
aaacuuuaugcuaagugaaa

SEQ ID NO: 1751135 - RNA, 23 nt, Homo sapiens
uuuauaucccccuaaacuaccuu

SEQ ID NO: 1751136 - RNA, 13 nt, Homo sapiens
gaacaacuuggaa

SEQ ID NO: 1751137 - RNA, 20 nt, Homo sapiens
acagugaaguuuuacugucu

SEQ ID NO: 1751138 - RNA, 24 nt, Homo sapiens
auuuugggaaaaaaacauacacaa

SEQ ID NO: 1751139 - RNA, 14 nt, Homo sapiens
cuccauggcaucuu

SEQ ID NO: 1751140 - RNA, 14 nt, Homo sapiens
auuaugggaacaag

SEQ ID NO: 1751141 - RNA, 12 nt, Homo sapiens
aggaaacaguua

SEQ ID NO: 1751142 - RNA, 21 nt, Homo sapiens
ucagaacuaccauuguaauau

SEQ ID NO: 1751143 - RNA, 19 nt, Homo sapiens
acacacagagauaugcaca

SEQ ID NO: 1751144 - RNA, 23 nt, Homo sapiens
ugccugaaagcaacuacagaauu

SEQ ID NO: 1751145 - RNA, 16 nt, Homo sapiens
agaggggacaagccag

SEQ ID NO: 1751146 - RNA, 23 nt, Homo sapiens
ucagcugcagccacuuucugcca

SEQ ID NO: 1751147 - RNA, 15 nt, Homo sapiens
caaaagcucagccag

SEQ ID NO: 1751148 - RNA, 17 nt, Homo sapiens
gauuuaaaguggcagcu

SEQ ID NO: 1751149 - RNA, 16 nt, Homo sapiens
cugguccacucagggc

SEQ ID NO: 1751150 - RNA, 21 nt, Homo sapiens
cagcagcuuuguacacgaaga

SEQ ID NO: 1751151 - RNA, 23 nt, Homo sapiens
aggaaugcugacaaugcugccau

SEQ ID NO: 1751152 - RNA, 18 nt, Homo sapiens
aagaaggaacauugcaga

SEQ ID NO: 1751153 - RNA, 14 nt, Homo sapiens
gcaguauuccaugg

SEQ ID NO: 1751154 - RNA, 18 nt, Homo sapiens
acaaaaaacaacaaauaa

SEQ ID NO: 1751155 - RNA, 14 nt, Homo sapiens
uaagugcaugacau

SEQ ID NO: 1751156 - RNA, 14 nt, Homo sapiens
agagugcaaaacau

SEQ ID NO: 1751157 - RNA, 13 nt, Homo sapiens
uuaaaaacuacca

SEQ ID NO: 1751158 - RNA, 12 nt, Homo sapiens
cauuuacagugu

SEQ ID NO: 1751159 - RNA, 20 nt, Homo sapiens
agcccagagacauacuugaa

SEQ ID NO: 1751160 - RNA, 22 nt, Homo sapiens
gaugcauuuuaaaugucuauaa

SEQ ID NO: 1751161 - RNA, 20 nt, Homo sapiens
gagggaaucacuggugcuau

SEQ ID NO: 1751162 - RNA, 17 nt, Homo sapiens
gaauacauaaaguaugu

SEQ ID NO: 1751163 - RNA, 13 nt, Homo sapiens
agagcagcacagg

SEQ ID NO: 1751164 - RNA, 20 nt, Homo sapiens
gacaaauaaguuacccucaa

SEQ ID NO: 1751165 - RNA, 17 nt, Homo sapiens
ccuuggcuuuaugcaaa

SEQ ID NO: 1751166 - RNA, 18 nt, Homo sapiens
gucaugaccuccagggag

SEQ ID NO: 1751167 - RNA, 18 nt, Homo sapiens
caccacgggacaucacag

SEQ ID NO: 1751168 - RNA, 13 nt, Homo sapiens
gaagagggucccu

SEQ ID NO: 1751169 - RNA, 16 nt, Homo sapiens
acugcugauucuugua

SEQ ID NO: 1751170 - RNA, 19 nt, Homo sapiens
cauguuauauuauuacuaa

SEQ ID NO: 1751171 - RNA, 20 nt, Homo sapiens
guucacagcuuuucuugaua

SEQ ID NO: 1751172 - RNA, 21 nt, Homo sapiens
aaacccugucucuacuaaaaa

SEQ ID NO: 1751173 - RNA, 15 nt, Homo sapiens
uuaauaaaguaguua

SEQ ID NO: 1751174 - RNA, 13 nt, Homo sapiens
cuucuuucaugua

SEQ ID NO: 1751175 - RNA, 22 nt, Homo sapiens
cauuuucuuaugucucauuuca

SEQ ID NO: 1751176 - RNA, 15 nt, Homo sapiens
cuaucagguucacaa

SEQ ID NO: 1751177 - RNA, 15 nt, Homo sapiens
agcccuccacgucag

SEQ ID NO: 1751178 - RNA, 15 nt, Homo sapiens
aucuccucuccccaa

SEQ ID NO: 1751179 - RNA, 20 nt, Homo sapiens
uaggcuuuguauacuuuuau

SEQ ID NO: 1751180 - RNA, 16 nt, Homo sapiens
gacugcaucucaaaaa

SEQ ID NO: 1751181 - RNA, 16 nt, Homo sapiens
cuuugcugucacuuuc

SEQ ID NO: 1751182 - RNA, 16 nt, Homo sapiens
gcuugccacuuuccag

SEQ ID NO: 1751183 - RNA, 16 nt, Homo sapiens
auuguuaucuaucaac

SEQ ID NO: 1751184 - RNA, 19 nt, Homo sapiens
ucagcucuugagagcauuc

SEQ ID NO: 1751185 - RNA, 15 nt, Homo sapiens
auaccaucuguagag

SEQ ID NO: 1751186 - RNA, 17 nt, Homo sapiens
aguagcugcuaccuucu

SEQ ID NO: 1751187 - RNA, 17 nt, Homo sapiens
uaucagaggccuauaau

SEQ ID NO: 1751188 - RNA, 21 nt, Homo sapiens
aaaugaaugaggucugggcua

SEQ ID NO: 1751189 - RNA, 16 nt, Homo sapiens
guaucaggugcugcca

SEQ ID NO: 1751190 - RNA, 17 nt, Homo sapiens
agggacacuuucacagu

SEQ ID NO: 1751191 - RNA, 21 nt, Homo sapiens
cugggaaauugaagugucuuc

SEQ ID NO: 1751192 - RNA, 15 nt, Homo sapiens
agcagagggccuagg

SEQ ID NO: 1751193 - RNA, 14 nt, Homo sapiens
augaggugcucaau

SEQ ID NO: 1751194 - RNA, 17 nt, Homo sapiens
caagaguuucuucucau

SEQ ID NO: 1751195 - RNA, 23 nt, Homo sapiens
gggcccuuucuugcacuguccag

SEQ ID NO: 1751196 - RNA, 15 nt, Homo sapiens
guuaugcacugccug

SEQ ID NO: 1751197 - RNA, 13 nt, Homo sapiens
aauaaaggcagcu

SEQ ID NO: 1751198 - RNA, 16 nt, Homo sapiens
aaacuccagaugccac

SEQ ID NO: 1751199 - RNA, 21 nt, Homo sapiens
uugagggugggggugcucucu

SEQ ID NO: 1751200 - RNA, 18 nt, Homo sapiens
uaucuaccucacuauuca

SEQ ID NO: 1751201 - RNA, 23 nt, Homo sapiens
ugggucucauuuagaacuugcag

SEQ ID NO: 1751202 - RNA, 22 nt, Homo sapiens
uguucugccucucccugggucu

SEQ ID NO: 1751203 - RNA, 19 nt, Homo sapiens
aaaacuucaguaaguacgu

SEQ ID NO: 1751204 - RNA, 12 nt, Homo sapiens
ugacagugaauu

SEQ ID NO: 1751205 - RNA, 17 nt, Homo sapiens
ccgagcucuggugcuuu

SEQ ID NO: 1751206 - RNA, 20 nt, Homo sapiens
cauugucaccgcaggugcuc

SEQ ID NO: 1751207 - RNA, 16 nt, Homo sapiens
agcucagaacccaggg

SEQ ID NO: 1751208 - RNA, 22 nt, Homo sapiens
aaagggaucaucaugcagcuca

SEQ ID NO: 1751209 - RNA, 17 nt, Homo sapiens
gaaagcugauggccuug

SEQ ID NO: 1751210 - RNA, 14 nt, Homo sapiens
caaggccucaggag

SEQ ID NO: 1751211 - RNA, 12 nt, Homo sapiens
cugcauguuccu

SEQ ID NO: 1751212 - RNA, 21 nt, Homo sapiens
aaaauauauuuaugauaacua

SEQ ID NO: 1751213 - RNA, 20 nt, Homo sapiens
cucacacaucacauucccau

SEQ ID NO: 1751214 - RNA, 13 nt, Homo sapiens
gccugauggccag

SEQ ID NO: 1751215 - RNA, 13 nt, Homo sapiens
gugucauggugac

SEQ ID NO: 1751216 - RNA, 13 nt, Homo sapiens
gccacacugggcc

SEQ ID NO: 1751217 - RNA, 17 nt, Homo sapiens
gauccuccugaccucaa

SEQ ID NO: 1751218 - RNA, 23 nt, Homo sapiens
accacggggccgacauugucucc

SEQ ID NO: 1751219 - RNA, 17 nt, Homo sapiens
uauuuccuucuccuccu

SEQ ID NO: 1751220 - RNA, 13 nt, Homo sapiens
agggugacugugu

SEQ ID NO: 1751221 - RNA, 13 nt, Homo sapiens
aggaugacuguau

SEQ ID NO: 1751222 - RNA, 13 nt, Homo sapiens
uaucagacaagca

SEQ ID NO: 1751223 - RNA, 20 nt, Homo sapiens
ugcucauaugaacuuucauu

SEQ ID NO: 1751224 - RNA, 20 nt, Homo sapiens
caaaauuuuguaaauaugca

SEQ ID NO: 1751225 - RNA, 21 nt, Homo sapiens
ccagcucagucccaucagaga

SEQ ID NO: 1751226 - RNA, 21 nt, Homo sapiens
auccuuccacuaucauuccca

SEQ ID NO: 1751227 - RNA, 18 nt, Homo sapiens
caaaucagccaugugcug

SEQ ID NO: 1751228 - RNA, 12 nt, Homo sapiens
ggucucaugccc

SEQ ID NO: 1751229 - RNA, 16 nt, Homo sapiens
gguucagaaauagcuc

SEQ ID NO: 1751230 - RNA, 14 nt, Homo sapiens
gacaaucauuugag

SEQ ID NO: 1751231 - RNA, 18 nt, Homo sapiens
caguaaaggcugcugcua

SEQ ID NO: 1751232 - RNA, 18 nt, Homo sapiens
ucuucugauuugucccua

SEQ ID NO: 1751233 - RNA, 22 nt, Homo sapiens
gacagaucccauccaucagcuc

SEQ ID NO: 1751234 - RNA, 12 nt, Homo sapiens
auacguguauga

SEQ ID NO: 1751235 - RNA, 17 nt, Homo sapiens
uucugcccucagcuuca

SEQ ID NO: 1751236 - RNA, 15 nt, Homo sapiens
ccaaccucacccucc

SEQ ID NO: 1751237 - RNA, 15 nt, Homo sapiens
agauauaugaauaug

SEQ ID NO: 1751238 - RNA, 22 nt, Homo sapiens
ugcgcagacccugccacucuca

SEQ ID NO: 1751239 - RNA, 21 nt, Homo sapiens
gagagcccagaaaacugucau

SEQ ID NO: 1751240 - RNA, 15 nt, Homo sapiens
cuuucaccagaauuu

SEQ ID NO: 1751241 - RNA, 15 nt, Homo sapiens
gcugccuggggccca

SEQ ID NO: 1751242 - RNA, 17 nt, Homo sapiens
ccugauccauagugcua

SEQ ID NO: 1751243 - RNA, 16 nt, Homo sapiens
auacaugaagcuucau

SEQ ID NO: 1751244 - RNA, 18 nt, Homo sapiens
cucgaggaacguaguguu

SEQ ID NO: 1751245 - RNA, 20 nt, Homo sapiens
ucaaagcacagaauuuguca

SEQ ID NO: 1751246 - RNA, 20 nt, Homo sapiens
ggcgccccugccaccucccu

SEQ ID NO: 1751247 - RNA, 21 nt, Homo sapiens
aagaggacuguguuguggucu

SEQ ID NO: 1751248 - RNA, 13 nt, Homo sapiens
cucugccagugac

SEQ ID NO: 1751249 - RNA, 20 nt, Homo sapiens
gaugccagcagccucugucg

SEQ ID NO: 1751250 - RNA, 20 nt, Homo sapiens
agaugaccguguacaauacc

SEQ ID NO: 1751251 - RNA, 22 nt, Homo sapiens
ccccacguugccucuacuuuau

SEQ ID NO: 1751252 - RNA, 14 nt, Homo sapiens
auaucagaguaugu

SEQ ID NO: 1751253 - RNA, 15 nt, Homo sapiens
uuaaacacaugcaua

SEQ ID NO: 1751254 - RNA, 16 nt, Homo sapiens
ucccuucuaaccugaa

SEQ ID NO: 1751255 - RNA, 15 nt, Homo sapiens
ucagcuagcucugcc

SEQ ID NO: 1751256 - RNA, 14 nt, Homo sapiens
gaaaugagaacaau

SEQ ID NO: 1751257 - RNA, 19 nt, Homo sapiens
cugauggaaguaaagccuc

SEQ ID NO: 1751258 - RNA, 15 nt, Homo sapiens
agguccuugcccuuu

SEQ ID NO: 1751259 - RNA, 12 nt, Homo sapiens
gacucacugugg

SEQ ID NO: 1751260 - RNA, 17 nt, Homo sapiens
ugaaaaucuccaucuca

SEQ ID NO: 1751261 - RNA, 17 nt, Homo sapiens
auuuugugcaacauaac

SEQ ID NO: 1751262 - RNA, 22 nt, Homo sapiens
cagcuuuauaauaaacuguuua

SEQ ID NO: 1751263 - RNA, 20 nt, Homo sapiens
agauuugauguugugaaaua

SEQ ID NO: 1751264 - RNA, 21 nt, Homo sapiens
uauuugccaagaccauuucac

SEQ ID NO: 1751265 - RNA, 13 nt, Homo sapiens
gcugccacagcaa

SEQ ID NO: 1751266 - RNA, 23 nt, Homo sapiens
cacauugauguaaggacuguaaa

SEQ ID NO: 1751267 - RNA, 19 nt, Homo sapiens
uguuguagugaaauuauac

SEQ ID NO: 1751268 - RNA, 16 nt, Homo sapiens
ccuguggccacuuucc

SEQ ID NO: 1751269 - RNA, 18 nt, Homo sapiens
ccuuugucauuauuaguc

SEQ ID NO: 1751270 - RNA, 21 nt, Homo sapiens
uuauaugaccauauuuacucu

SEQ ID NO: 1751271 - RNA, 14 nt, Homo sapiens
aacaguaagggaua

SEQ ID NO: 1751272 - RNA, 18 nt, Homo sapiens
aguguuguggacacugca

SEQ ID NO: 1751273 - RNA, 23 nt, Homo sapiens
accuauaauguguguauguguau

SEQ ID NO: 1751274 - RNA, 20 nt, Homo sapiens
aauaaauuuucaaauccuua

SEQ ID NO: 1751275 - RNA, 15 nt, Homo sapiens
augaugcaaacugug

SEQ ID NO: 1751276 - RNA, 15 nt, Homo sapiens
uauaccaaagauuac

SEQ ID NO: 1751277 - RNA, 21 nt, Homo sapiens
auugcaccauacuccuugcuu

SEQ ID NO: 1751278 - RNA, 18 nt, Homo sapiens
agacugauaccaccucca

SEQ ID NO: 1751279 - RNA, 16 nt, Homo sapiens
cccugguucugaugau

SEQ ID NO: 1751280 - RNA, 13 nt, Homo sapiens
aaaucuuguuaau

SEQ ID NO: 1751281 - RNA, 14 nt, Homo sapiens
ucacugcaaccucc

SEQ ID NO: 1751282 - RNA, 15 nt, Homo sapiens
uuaacuuuuggaauc

SEQ ID NO: 1751283 - RNA, 21 nt, Homo sapiens
aacacaguuuagugcuuuaca

SEQ ID NO: 1751284 - RNA, 14 nt, Homo sapiens
agcauuuaaaaugg

SEQ ID NO: 1751285 - RNA, 12 nt, Homo sapiens
ugucccuaguaa

SEQ ID NO: 1751286 - RNA, 23 nt, Homo sapiens
uggucacaugaugugcauagaga

SEQ ID NO: 1751287 - RNA, 18 nt, Homo sapiens
agaagguggaaggcagug

SEQ ID NO: 1751288 - RNA, 13 nt, Homo sapiens
caaucugacauuc

SEQ ID NO: 1751289 - RNA, 13 nt, Homo sapiens
ugaaagaagaaua

SEQ ID NO: 1751290 - RNA, 14 nt, Homo sapiens
uaauuuguaucuga

SEQ ID NO: 1751291 - RNA, 21 nt, Homo sapiens
agugcacaacauuacagggaa

SEQ ID NO: 1751292 - RNA, 21 nt, Homo sapiens
caaaaauauaccuucagagac

SEQ ID NO: 1751293 - RNA, 16 nt, Homo sapiens
auggcgauguguuaua

SEQ ID NO: 1751294 - RNA, 21 nt, Homo sapiens
augaggguucaucaucccucc

SEQ ID NO: 1751295 - RNA, 15 nt, Homo sapiens
ccuguguaacacuug

SEQ ID NO: 1751296 - RNA, 13 nt, Homo sapiens
auuauucaucucu

SEQ ID NO: 1751297 - RNA, 18 nt, Homo sapiens
uuaugauugcauuguaug

SEQ ID NO: 1751298 - RNA, 14 nt, Homo sapiens
aagaguucuggaaa

SEQ ID NO: 1751299 - RNA, 17 nt, Homo sapiens
ucacaguucauugcagc

SEQ ID NO: 1751300 - RNA, 18 nt, Homo sapiens
uagagaucuaugggcauu

SEQ ID NO: 1751301 - RNA, 20 nt, Homo sapiens
gccuauuuuaauaaacacuc

SEQ ID NO: 1751302 - RNA, 21 nt, Homo sapiens
cuacccccugugccuugucac

SEQ ID NO: 1751303 - RNA, 19 nt, Homo sapiens
aaccucuucagcugggaag

SEQ ID NO: 1751304 - RNA, 20 nt, Homo sapiens
aagccccauccaacacugga

SEQ ID NO: 1751305 - RNA, 22 nt, Homo sapiens
uccucuccuacccacuggucug

SEQ ID NO: 1751306 - RNA, 19 nt, Homo sapiens
ccuucugaggacauuccaa

SEQ ID NO: 1751307 - RNA, 20 nt, Homo sapiens
ugagaaaaaagacccuauca

SEQ ID NO: 1751308 - RNA, 17 nt, Homo sapiens
agauauauguguauaca

SEQ ID NO: 1751309 - RNA, 16 nt, Homo sapiens
uuuuguuugcaucuga

SEQ ID NO: 1751310 - RNA, 13 nt, Homo sapiens
aggaaacaacacc

SEQ ID NO: 1751311 - RNA, 13 nt, Homo sapiens
gcuuuguugcacu

SEQ ID NO: 1751312 - RNA, 15 nt, Homo sapiens
aguuucagauccuga

SEQ ID NO: 1751313 - RNA, 14 nt, Homo sapiens
aggagccaccagca

SEQ ID NO: 1751314 - RNA, 18 nt, Homo sapiens
ggggagguauucaguuga

SEQ ID NO: 1751315 - RNA, 18 nt, Homo sapiens
uugugcacuucaugucau

SEQ ID NO: 1751316 - RNA, 17 nt, Homo sapiens
ucuuacuacagcuucag

SEQ ID NO: 1751317 - RNA, 19 nt, Homo sapiens
gagccauucuggcacuuua

SEQ ID NO: 1751318 - RNA, 19 nt, Homo sapiens
cagaccacaaaauguaaua

SEQ ID NO: 1751319 - RNA, 12 nt, Homo sapiens
uaaguucacagu

SEQ ID NO: 1751320 - RNA, 17 nt, Homo sapiens
acuuggcuacacaggga

SEQ ID NO: 1751321 - RNA, 14 nt, Homo sapiens
gaaauagacuuugu

SEQ ID NO: 1751322 - RNA, 18 nt, Homo sapiens
aacccugccccacuucuc

SEQ ID NO: 1751323 - RNA, 19 nt, Homo sapiens
cuugacuauuacacugccu

SEQ ID NO: 1751324 - RNA, 20 nt, Homo sapiens
aucaugaaaaugucuauuca

SEQ ID NO: 1751325 - RNA, 21 nt, Homo sapiens
cuccagccuggggaccccacu

SEQ ID NO: 1751326 - RNA, 22 nt, Homo sapiens
uguuuugcauaacgucugccuu

SEQ ID NO: 1751327 - RNA, 17 nt, Homo sapiens
gucacccaucaggacca

SEQ ID NO: 1751328 - RNA, 19 nt, Homo sapiens
aucccaaagagcuaaacaa

SEQ ID NO: 1751329 - RNA, 16 nt, Homo sapiens
uaaacuauaaccucuc

SEQ ID NO: 1751330 - RNA, 17 nt, Homo sapiens
ucugagcccagcugccu

SEQ ID NO: 1751331 - RNA, 15 nt, Homo sapiens
auaauaaauguaccu

SEQ ID NO: 1751332 - RNA, 23 nt, Homo sapiens
accaaccaccuuuccagccauag

SEQ ID NO: 1751333 - RNA, 22 nt, Homo sapiens
aucccaggcgggcggcacgcca

SEQ ID NO: 1751334 - RNA, 17 nt, Homo sapiens
uaaaaugcauacuguug

SEQ ID NO: 1751335 - RNA, 15 nt, Homo sapiens
cuaugauaugcuaau

SEQ ID NO: 1751336 - RNA, 21 nt, Homo sapiens
caaagguuccauucagugcag

SEQ ID NO: 1751337 - RNA, 15 nt, Homo sapiens
gauaaaaauaaugca

SEQ ID NO: 1751338 - RNA, 22 nt, Homo sapiens
uucauugucuacauagugacau

SEQ ID NO: 1751339 - RNA, 21 nt, Homo sapiens
ugucucggagggauuccccua

SEQ ID NO: 1751340 - RNA, 20 nt, Homo sapiens
gcccugaguuccuagccacc

SEQ ID NO: 1751341 - RNA, 21 nt, Homo sapiens
ucccacuacgggcaccuaaaa

SEQ ID NO: 1751342 - RNA, 11 nt, Homo sapiens
accccagcugg

SEQ ID NO: 1751343 - RNA, 17 nt, Homo sapiens
augcaggguagcacugg

SEQ ID NO: 1751344 - RNA, 21 nt, Homo sapiens
auauuugaauuuuaaaucuaa

SEQ ID NO: 1751345 - RNA, 14 nt, Homo sapiens
ccuccccaaauggc

SEQ ID NO: 1751346 - RNA, 23 nt, Homo sapiens
aauacugccaaccagagcagcuc

SEQ ID NO: 1751347 - RNA, 18 nt, Homo sapiens
cuucaggcaccacagaua

SEQ ID NO: 1751348 - RNA, 16 nt, Homo sapiens
ccauagugaccaacau

SEQ ID NO: 1751349 - RNA, 12 nt, Homo sapiens
uagacauugcaa

SEQ ID NO: 1751350 - RNA, 20 nt, Homo sapiens
gccuuagaaauguaaacugc

SEQ ID NO: 1751351 - RNA, 16 nt, Homo sapiens
guauauauaauacuga

SEQ ID NO: 1751352 - RNA, 11 nt, Homo sapiens
ggcuguguucg

SEQ ID NO: 1751353 - RNA, 17 nt, Homo sapiens
uaaaaaguauguucuaa

SEQ ID NO: 1751354 - RNA, 18 nt, Homo sapiens
aguuuucaugugcucaga

SEQ ID NO: 1751355 - RNA, 13 nt, Homo sapiens
cacauuguacuua

SEQ ID NO: 1751356 - RNA, 16 nt, Homo sapiens
cugaaacccaguaauu

SEQ ID NO: 1751357 - RNA, 19 nt, Homo sapiens
ugucauuucucauccacau

SEQ ID NO: 1751358 - RNA, 16 nt, Homo sapiens
cagucuuaccaaugac

SEQ ID NO: 1751359 - RNA, 22 nt, Homo sapiens
uccgacaaccgaugcuccagcc

SEQ ID NO: 1751360 - RNA, 13 nt, Homo sapiens
aagaggaugaagu

SEQ ID NO: 1751361 - RNA, 22 nt, Homo sapiens
ccaaacuguaguaauuguuaca

SEQ ID NO: 1751362 - RNA, 14 nt, Homo sapiens
agauguaaaugcca

SEQ ID NO: 1751363 - RNA, 19 nt, Homo sapiens
cuguuggccagugugacaa

SEQ ID NO: 1751364 - RNA, 22 nt, Homo sapiens
uagccgacugcgcugcuuuuuc

SEQ ID NO: 1751365 - RNA, 17 nt, Homo sapiens
acauccccaccuuccaa

SEQ ID NO: 1751366 - RNA, 20 nt, Homo sapiens
aaaacuguucuuuugcaaua

SEQ ID NO: 1751367 - RNA, 20 nt, Homo sapiens
auauauaguuaugcauacau

SEQ ID NO: 1751368 - RNA, 16 nt, Homo sapiens
gaauaugaaugucaca

SEQ ID NO: 1751369 - RNA, 18 nt, Homo sapiens
aagauucuucccauucuc

SEQ ID NO: 1751370 - RNA, 22 nt, Homo sapiens
cagauggaaugggguccuagca

SEQ ID NO: 1751371 - RNA, 18 nt, Homo sapiens
auacaugcugcuaauuca

SEQ ID NO: 1751372 - RNA, 18 nt, Homo sapiens
uccuucuguauucauaag

SEQ ID NO: 1751373 - RNA, 15 nt, Homo sapiens
uagagggggucucag

SEQ ID NO: 1751374 - RNA, 18 nt, Homo sapiens
ucaaguguaauuagcuuu

SEQ ID NO: 1751375 - RNA, 19 nt, Homo sapiens
guaaagagcauauucacug

SEQ ID NO: 1751376 - RNA, 18 nt, Homo sapiens
uaugaauuuuacuugcac

SEQ ID NO: 1751377 - RNA, 20 nt, Homo sapiens
cgcccacccgaguaccucca

SEQ ID NO: 1751378 - RNA, 12 nt, Homo sapiens
aaaucuagaaga

SEQ ID NO: 1751379 - RNA, 23 nt, Homo sapiens
gaucaaauuuggguauaugcagu

SEQ ID NO: 1751380 - RNA, 20 nt, Homo sapiens
uugucaccucagcacugugg

SEQ ID NO: 1751381 - RNA, 19 nt, Homo sapiens
cagugagccgagaucacac

SEQ ID NO: 1751382 - RNA, 19 nt, Homo sapiens
ccugugccuaacaccagcg

SEQ ID NO: 1751383 - RNA, 16 nt, Homo sapiens
auccagccuccagggc

SEQ ID NO: 1751384 - RNA, 12 nt, Homo sapiens
caggccagcugu

SEQ ID NO: 1751385 - RNA, 21 nt, Homo sapiens
ugugggucccgcacucugccc

SEQ ID NO: 1751386 - RNA, 22 nt, Homo sapiens
aaucacuugcacuccggaggua

SEQ ID NO: 1751387 - RNA, 16 nt, Homo sapiens
agaugaaaugcacugu

SEQ ID NO: 1751388 - RNA, 23 nt, Homo sapiens
cccugaggguggucagccaaggc

SEQ ID NO: 1751389 - RNA, 18 nt, Homo sapiens
uaagucacuuaaacucau

SEQ ID NO: 1751390 - RNA, 20 nt, Homo sapiens
gacucuuccauucaguuuua

SEQ ID NO: 1751391 - RNA, 22 nt, Homo sapiens
gccucugcagucgcuugccaaa

SEQ ID NO: 1751392 - RNA, 19 nt, Homo sapiens
gauacaugccgaaugccac

SEQ ID NO: 1751393 - RNA, 15 nt, Homo sapiens
accacucaggccaca

SEQ ID NO: 1751394 - RNA, 15 nt, Homo sapiens
caugccuugcaaugg

SEQ ID NO: 1751395 - RNA, 18 nt, Homo sapiens
uuuguuacauaaggauga

SEQ ID NO: 1751396 - RNA, 13 nt, Homo sapiens
auuauuccaaagu

SEQ ID NO: 1751397 - RNA, 12 nt, Homo sapiens
ggcucugaccag

SEQ ID NO: 1751398 - RNA, 13 nt, Homo sapiens
caugcacaugccu

SEQ ID NO: 1751399 - RNA, 16 nt, Homo sapiens
auaacauuuaaauucc

SEQ ID NO: 1751400 - RNA, 17 nt, Homo sapiens
auugguuuaagcccaga

SEQ ID NO: 1751401 - RNA, 15 nt, Homo sapiens
uacaagaucucaggu

SEQ ID NO: 1751402 - RNA, 14 nt, Homo sapiens
uuagaacuaugcua

SEQ ID NO: 1751403 - RNA, 14 nt, Homo sapiens
aaucagaauuggaa

SEQ ID NO: 1751404 - RNA, 15 nt, Homo sapiens
gcuuuuugcugugua

SEQ ID NO: 1751405 - RNA, 16 nt, Homo sapiens
guaucguauagcugua

SEQ ID NO: 1751406 - RNA, 20 nt, Homo sapiens
auaguguuguguuacaauaa

SEQ ID NO: 1751407 - RNA, 20 nt, Homo sapiens
ccauuauuccucucacccca

SEQ ID NO: 1751408 - RNA, 19 nt, Homo sapiens
uucugaaagggauggccac

SEQ ID NO: 1751409 - RNA, 15 nt, Homo sapiens
cgccccugccugaga

SEQ ID NO: 1751410 - RNA, 19 nt, Homo sapiens
uugagacugcuagaaccaa

SEQ ID NO: 1751411 - RNA, 23 nt, Homo sapiens
uaaaacugaacuucagagcauga

SEQ ID NO: 1751412 - RNA, 22 nt, Homo sapiens
ggacagaucaauggcgcagugc

SEQ ID NO: 1751413 - RNA, 21 nt, Homo sapiens
aucauuauuucaccaagccaa

SEQ ID NO: 1751414 - RNA, 24 nt, Homo sapiens
cacugcaggacagucaaggugaua

SEQ ID NO: 1751415 - RNA, 11 nt, Homo sapiens
agcgagaagau

SEQ ID NO: 1751416 - RNA, 23 nt, Homo sapiens
ucauaguaagugcgaagacugag

SEQ ID NO: 1751417 - RNA, 16 nt, Homo sapiens
cauuagucacuuugaa

SEQ ID NO: 1751418 - RNA, 16 nt, Homo sapiens
cccuagcucacacuca

SEQ ID NO: 1751419 - RNA, 17 nt, Homo sapiens
aggaauccauccugcaa

SEQ ID NO: 1751420 - RNA, 22 nt, Homo sapiens
augaccuguuauuaccauuagc

SEQ ID NO: 1751421 - RNA, 18 nt, Homo sapiens
ucagggcagccugccugg

SEQ ID NO: 1751422 - RNA, 17 nt, Homo sapiens
uuuguaguuuuugcuga

SEQ ID NO: 1751423 - RNA, 15 nt, Homo sapiens
ucagcuggcacuguc

SEQ ID NO: 1751424 - RNA, 22 nt, Homo sapiens
agaggucuuucagaaggaaacc

SEQ ID NO: 1751425 - RNA, 21 nt, Homo sapiens
ugaauuuaggugauaccuaaa

SEQ ID NO: 1751426 - RNA, 21 nt, Homo sapiens
agcaugaggcagcacgugcac

SEQ ID NO: 1751427 - RNA, 17 nt, Homo sapiens
gcuuugucccacagcuu

SEQ ID NO: 1751428 - RNA, 20 nt, Homo sapiens
ucacugccgucccaaauaca

SEQ ID NO: 1751429 - RNA, 17 nt, Homo sapiens
cacuuuauuucucucau

SEQ ID NO: 1751430 - RNA, 13 nt, Homo sapiens
gaaaaguuuugua

SEQ ID NO: 1751431 - RNA, 17 nt, Homo sapiens
caauuaaaaacaugaau

SEQ ID NO: 1751432 - RNA, 22 nt, Homo sapiens
aaaggacucugcuucaguccac

SEQ ID NO: 1751433 - RNA, 22 nt, Homo sapiens
caucauccugccccuguggcau

SEQ ID NO: 1751434 - RNA, 19 nt, Homo sapiens
guccuuguuguuucuugcc

SEQ ID NO: 1751435 - RNA, 23 nt, Homo sapiens
guaaguuaggaacgaacauguua

SEQ ID NO: 1751436 - RNA, 14 nt, Homo sapiens
accugucaucucac

SEQ ID NO: 1751437 - RNA, 19 nt, Homo sapiens
aguggaguugaaacugcua

SEQ ID NO: 1751438 - RNA, 21 nt, Homo sapiens
aauacuaagaaaaauuuguau

SEQ ID NO: 1751439 - RNA, 13 nt, Homo sapiens
gacaaacugugua

SEQ ID NO: 1751440 - RNA, 14 nt, Homo sapiens
uagaugugucuuac

SEQ ID NO: 1751441 - RNA, 20 nt, Homo sapiens
auaaucauauauaugcauac

SEQ ID NO: 1751442 - RNA, 17 nt, Homo sapiens
acuucauauuguugcau

SEQ ID NO: 1751443 - RNA, 18 nt, Homo sapiens
auaaagucuuacugugcu

SEQ ID NO: 1751444 - RNA, 12 nt, Homo sapiens
uauacugcugua

SEQ ID NO: 1751445 - RNA, 22 nt, Homo sapiens
uaaaaaccuucuauguucauaa

SEQ ID NO: 1751446 - RNA, 15 nt, Homo sapiens
uuguauugcauauau

SEQ ID NO: 1751447 - RNA, 14 nt, Homo sapiens
aucccaagccagaa

SEQ ID NO: 1751448 - RNA, 22 nt, Homo sapiens
auugauauaaagaaauaccuga

SEQ ID NO: 1751449 - RNA, 11 nt, Homo sapiens
aaugcaacuuc

SEQ ID NO: 1751450 - RNA, 20 nt, Homo sapiens
uccccaaggcugcaaagcaa

SEQ ID NO: 1751451 - RNA, 20 nt, Homo sapiens
cggagcuugcagugagccga

SEQ ID NO: 1751452 - RNA, 19 nt, Homo sapiens
auauguugcuuugaaaaag

SEQ ID NO: 1751453 - RNA, 18 nt, Homo sapiens
aacagcaacacagccacu

SEQ ID NO: 1751454 - RNA, 16 nt, Homo sapiens
aagugugaagugcaga

SEQ ID NO: 1751455 - RNA, 19 nt, Homo sapiens
uucaggcucugagacacac

SEQ ID NO: 1751456 - RNA, 12 nt, Homo sapiens
agaagcuuccau

SEQ ID NO: 1751457 - RNA, 17 nt, Homo sapiens
ggggcagcgcagccucc

SEQ ID NO: 1751458 - RNA, 14 nt, Homo sapiens
ugcuuuugccacuu

SEQ ID NO: 1751459 - RNA, 14 nt, Homo sapiens
auggguccagaaga

SEQ ID NO: 1751460 - RNA, 18 nt, Homo sapiens
agugauaacuccuaagag

SEQ ID NO: 1751461 - RNA, 23 nt, Homo sapiens
gauacuguguucccucauaugca

SEQ ID NO: 1751462 - RNA, 14 nt, Homo sapiens
auaauaaacauaau

SEQ ID NO: 1751463 - RNA, 14 nt, Homo sapiens
aauuauaacuauua

SEQ ID NO: 1751464 - RNA, 14 nt, Homo sapiens
auacuaaacaucau

SEQ ID NO: 1751465 - RNA, 16 nt, Homo sapiens
cccagacaaccaaaac

SEQ ID NO: 1751466 - RNA, 18 nt, Homo sapiens
aguaaucauauaucaaac

SEQ ID NO: 1751467 - RNA, 19 nt, Homo sapiens
cuauagccauuugccccaa

SEQ ID NO: 1751468 - RNA, 15 nt, Homo sapiens
augcuguugccucau

SEQ ID NO: 1751469 - RNA, 19 nt, Homo sapiens
caaccucaaugcccugcca

SEQ ID NO: 1751470 - RNA, 23 nt, Homo sapiens
accuuuaccccaccuuccuggga

SEQ ID NO: 1751471 - RNA, 18 nt, Homo sapiens
ucccguacaaacuuggac

SEQ ID NO: 1751472 - RNA, 14 nt, Homo sapiens
gcugaucaguuuuu

SEQ ID NO: 1751473 - RNA, 15 nt, Homo sapiens
ccuaggcgcuguucu

SEQ ID NO: 1751474 - RNA, 14 nt, Homo sapiens
aaucagguuuccaa

SEQ ID NO: 1751475 - RNA, 14 nt, Homo sapiens
uuuaagguaacaaa

SEQ ID NO: 1751476 - RNA, 21 nt, Homo sapiens
uuacugguuucaguugacaaa

SEQ ID NO: 1751477 - RNA, 22 nt, Homo sapiens
gacugugaacugggcauuucac

SEQ ID NO: 1751478 - RNA, 15 nt, Homo sapiens
ggaauccucagagaa

SEQ ID NO: 1751479 - RNA, 16 nt, Homo sapiens
ugccuuugccagguga

SEQ ID NO: 1751480 - RNA, 21 nt, Homo sapiens
uuccacauccccaccuuccaa

SEQ ID NO: 1751481 - RNA, 18 nt, Homo sapiens
ugccuuuuucauuuucca

SEQ ID NO: 1751482 - RNA, 17 nt, Homo sapiens
agagagggcaaagggau

SEQ ID NO: 1751483 - RNA, 15 nt, Homo sapiens
cagaacacacugaga

SEQ ID NO: 1751484 - RNA, 22 nt, Homo sapiens
aacauaauaaaucacacauuca

SEQ ID NO: 1751485 - RNA, 15 nt, Homo sapiens
ugcaagcacaucugc

SEQ ID NO: 1751486 - RNA, 13 nt, Homo sapiens
cuugaaaugaugg

SEQ ID NO: 1751487 - RNA, 24 nt, Homo sapiens
cagauuagaaauguaacauacuca

SEQ ID NO: 1751488 - RNA, 19 nt, Homo sapiens
ugccuggugaauggccuuc

SEQ ID NO: 1751489 - RNA, 12 nt, Homo sapiens
aagccugucauu

SEQ ID NO: 1751490 - RNA, 13 nt, Homo sapiens
cuugaagaacuga

SEQ ID NO: 1751491 - RNA, 12 nt, Homo sapiens
ugucccaaagaa

SEQ ID NO: 1751492 - RNA, 13 nt, Homo sapiens
gauacccagagca

SEQ ID NO: 1751493 - RNA, 17 nt, Homo sapiens
ugagcucaggcauuuga

SEQ ID NO: 1751494 - RNA, 14 nt, Homo sapiens
uuauaccagcaaaa

SEQ ID NO: 1751495 - RNA, 22 nt, Homo sapiens
uaauguugcuuucuuaucccag

SEQ ID NO: 1751496 - RNA, 16 nt, Homo sapiens
aagaaacaccgaguga

SEQ ID NO: 1751497 - RNA, 21 nt, Homo sapiens
ugaagaugaaauauauauugu

SEQ ID NO: 1751498 - RNA, 18 nt, Homo sapiens
guccuggaggcacuggga

SEQ ID NO: 1751499 - RNA, 22 nt, Homo sapiens
ccaggauauccucccuccagau

SEQ ID NO: 1751500 - RNA, 18 nt, Homo sapiens
aagaaaacaccacuaauu

SEQ ID NO: 1751501 - RNA, 19 nt, Homo sapiens
augccaauaaagugaucug

SEQ ID NO: 1751502 - RNA, 19 nt, Homo sapiens
cugaaggcugaaagacagg

SEQ ID NO: 1751503 - RNA, 21 nt, Homo sapiens
uguccacgugugugugugauu

SEQ ID NO: 1751504 - RNA, 17 nt, Homo sapiens
gagcacaucucucugcc

SEQ ID NO: 1751505 - RNA, 21 nt, Homo sapiens
ggcaauuuuuuuauacuacca

SEQ ID NO: 1751506 - RNA, 22 nt, Homo sapiens
cuuaagcaguaaucugucagug

SEQ ID NO: 1751507 - RNA, 13 nt, Homo sapiens
uggccucccccac

SEQ ID NO: 1751508 - RNA, 14 nt, Homo sapiens
uacaggcuagggau

SEQ ID NO: 1751509 - RNA, 19 nt, Homo sapiens
caucacuacaguacaguga

SEQ ID NO: 1751510 - RNA, 13 nt, Homo sapiens
caggucccacugc

SEQ ID NO: 1751511 - RNA, 14 nt, Homo sapiens
aguaaguggugaga

SEQ ID NO: 1751512 - RNA, 15 nt, Homo sapiens
ugacuuuuacagcuu

SEQ ID NO: 1751513 - RNA, 12 nt, Homo sapiens
agcaggccacug

SEQ ID NO: 1751514 - RNA, 23 nt, Homo sapiens
uacccuauaucuauaaacacugu

SEQ ID NO: 1751515 - RNA, 20 nt, Homo sapiens
uugcuacagggcucacagaa

SEQ ID NO: 1751516 - RNA, 16 nt, Homo sapiens
cuauaacuuacuucug

SEQ ID NO: 1751517 - RNA, 17 nt, Homo sapiens
caccugaccucugcaag

SEQ ID NO: 1751518 - RNA, 17 nt, Homo sapiens
cuauucuaaguaauucc

SEQ ID NO: 1751519 - RNA, 14 nt, Homo sapiens
acucaggggucauu

SEQ ID NO: 1751520 - RNA, 20 nt, Homo sapiens
gcucugagaaaccucgggaa

SEQ ID NO: 1751521 - RNA, 22 nt, Homo sapiens
gugaauacauuaacggugcuaa

SEQ ID NO: 1751522 - RNA, 16 nt, Homo sapiens
auccuuguuaagcaac

SEQ ID NO: 1751523 - RNA, 13 nt, Homo sapiens
uuucauuuugcca

SEQ ID NO: 1751524 - RNA, 14 nt, Homo sapiens
cagaacuaacuuug

SEQ ID NO: 1751525 - RNA, 19 nt, Homo sapiens
gaacaucuggggacuaaua

SEQ ID NO: 1751526 - RNA, 19 nt, Homo sapiens
agcccugucaugugccuug

SEQ ID NO: 1751527 - RNA, 17 nt, Homo sapiens
uguuuaggccucauuuc

SEQ ID NO: 1751528 - RNA, 18 nt, Homo sapiens
aacagaugucuucuugca

SEQ ID NO: 1751529 - RNA, 18 nt, Homo sapiens
auaagcacuagaucuccc

SEQ ID NO: 1751530 - RNA, 20 nt, Homo sapiens
uguguuaguuaagaauugaa

SEQ ID NO: 1751531 - RNA, 22 nt, Homo sapiens
auauuuaugaccucaacaaaga

SEQ ID NO: 1751532 - RNA, 21 nt, Homo sapiens
cuauucccugucacuacacac

SEQ ID NO: 1751533 - RNA, 17 nt, Homo sapiens
uacagauaggccuucuu

SEQ ID NO: 1751534 - RNA, 19 nt, Homo sapiens
ucucauuuuguccaugucc

SEQ ID NO: 1751535 - RNA, 16 nt, Homo sapiens
ugcauucuagugcaga

SEQ ID NO: 1751536 - RNA, 17 nt, Homo sapiens
agauuagguacuaucug

SEQ ID NO: 1751537 - RNA, 18 nt, Homo sapiens
cccagagcccugcaguca

SEQ ID NO: 1751538 - RNA, 20 nt, Homo sapiens
agagcaagacuccaucucag

SEQ ID NO: 1751539 - RNA, 21 nt, Homo sapiens
uuuuuaaaauauauugcugca

SEQ ID NO: 1751540 - RNA, 17 nt, Homo sapiens
caaucaugaaauaugca

SEQ ID NO: 1751541 - RNA, 22 nt, Homo sapiens
auuuagaaaauguucaccuaga

SEQ ID NO: 1751542 - RNA, 22 nt, Homo sapiens
caaacugcuuccuuucuugauu

SEQ ID NO: 1751543 - RNA, 15 nt, Homo sapiens
agucuguuucaggag

SEQ ID NO: 1751544 - RNA, 21 nt, Homo sapiens
aagaggcuucccuaguuuaca

SEQ ID NO: 1751545 - RNA, 10 nt, Homo sapiens
agaucuugau

SEQ ID NO: 1751546 - RNA, 20 nt, Homo sapiens
cauagcccucagacauuuau

SEQ ID NO: 1751547 - RNA, 20 nt, Homo sapiens
ggcugcugccauccaugugc

SEQ ID NO: 1751548 - RNA, 11 nt, Homo sapiens
caaauucugug

SEQ ID NO: 1751549 - RNA, 16 nt, Homo sapiens
cugugcacauucuccc

SEQ ID NO: 1751550 - RNA, 14 nt, Homo sapiens
uauucccuugagag

SEQ ID NO: 1751551 - RNA, 13 nt, Homo sapiens
caauaaagccuuc

SEQ ID NO: 1751552 - RNA, 20 nt, Homo sapiens
aacacauuugcccaauucca

SEQ ID NO: 1751553 - RNA, 21 nt, Homo sapiens
cauuuauaauuauuuauguga

SEQ ID NO: 1751554 - RNA, 18 nt, Homo sapiens
uagcccuugcugccacac

SEQ ID NO: 1751555 - RNA, 21 nt, Homo sapiens
ucagccaguggcuagcgcaag

SEQ ID NO: 1751556 - RNA, 13 nt, Homo sapiens
uuuaagaaaucaa

SEQ ID NO: 1751557 - RNA, 14 nt, Homo sapiens
ugggccuccaugcc

SEQ ID NO: 1751558 - RNA, 22 nt, Homo sapiens
cugacccuucucucacuucuaa

SEQ ID NO: 1751559 - RNA, 16 nt, Homo sapiens
uguagagagauaccau

SEQ ID NO: 1751560 - RNA, 20 nt, Homo sapiens
ccugcugcaucaguggguga

SEQ ID NO: 1751561 - RNA, 18 nt, Homo sapiens
ugcgugugucuguguuga

SEQ ID NO: 1751562 - RNA, 20 nt, Homo sapiens
uccaacuccuggagauuuca

SEQ ID NO: 1751563 - RNA, 16 nt, Homo sapiens
cucaugagcacagggu

SEQ ID NO: 1751564 - RNA, 16 nt, Homo sapiens
ugagguggcucaugcc

SEQ ID NO: 1751565 - RNA, 11 nt, Homo sapiens
ucaguaugugg

SEQ ID NO: 1751566 - RNA, 19 nt, Homo sapiens
uauuuguccaaacuguugg

SEQ ID NO: 1751567 - RNA, 19 nt, Homo sapiens
ugcaucaguucauugaccu

SEQ ID NO: 1751568 - RNA, 21 nt, Homo sapiens
caaugggaaaacuucacucca

SEQ ID NO: 1751569 - RNA, 19 nt, Homo sapiens
aaaauauuuucuacaucuu

SEQ ID NO: 1751570 - RNA, 15 nt, Homo sapiens
uuaaaauguauuuac

SEQ ID NO: 1751571 - RNA, 21 nt, Homo sapiens
ugcuggacgccgagaaggccu

SEQ ID NO: 1751572 - RNA, 12 nt, Homo sapiens
agcucugaucag

SEQ ID NO: 1751573 - RNA, 12 nt, Homo sapiens
uccgcugaagau

SEQ ID NO: 1751574 - RNA, 14 nt, Homo sapiens
ugaaaucugaggaa

SEQ ID NO: 1751575 - RNA, 12 nt, Homo sapiens
acuuuccacuuc

SEQ ID NO: 1751576 - RNA, 14 nt, Homo sapiens
cauauuuguuaaau

SEQ ID NO: 1751577 - RNA, 19 nt, Homo sapiens
gcaacuaaaugagaccuaa

SEQ ID NO: 1751578 - RNA, 18 nt, Homo sapiens
ucacccagggacacucca

SEQ ID NO: 1751579 - RNA, 22 nt, Homo sapiens
gacaguuggagggaaagccagc

SEQ ID NO: 1751580 - RNA, 15 nt, Homo sapiens
augucuuaguuauaa

SEQ ID NO: 1751581 - RNA, 22 nt, Homo sapiens
gaaaagguggacuugucuccca

SEQ ID NO: 1751582 - RNA, 15 nt, Homo sapiens
gccaggacagcugca

SEQ ID NO: 1751583 - RNA, 16 nt, Homo sapiens
agcaacagagcacuug

SEQ ID NO: 1751584 - RNA, 14 nt, Homo sapiens
gcucaugacacugu

SEQ ID NO: 1751585 - RNA, 20 nt, Homo sapiens
gcaggaucccuccugagcuc

SEQ ID NO: 1751586 - RNA, 16 nt, Homo sapiens
cuucuggggguggugg

SEQ ID NO: 1751587 - RNA, 16 nt, Homo sapiens
auguacauagcuugau

SEQ ID NO: 1751588 - RNA, 21 nt, Homo sapiens
uguggugagggaagacgccuu

SEQ ID NO: 1751589 - RNA, 16 nt, Homo sapiens
uucaaaggauaugcag

SEQ ID NO: 1751590 - RNA, 16 nt, Homo sapiens
cugagucagacuguca

SEQ ID NO: 1751591 - RNA, 22 nt, Homo sapiens
cccucaagcuuuccugcugucu

SEQ ID NO: 1751592 - RNA, 15 nt, Homo sapiens
agauucaaacccagg

SEQ ID NO: 1751593 - RNA, 21 nt, Homo sapiens
ccugcaaacucacugcucaag

SEQ ID NO: 1751594 - RNA, 16 nt, Homo sapiens
auuuucccuucccuga

SEQ ID NO: 1751595 - RNA, 18 nt, Homo sapiens
cugagcccagaaaaaagg

SEQ ID NO: 1751596 - RNA, 14 nt, Homo sapiens
uuugcauugccaag

SEQ ID NO: 1751597 - RNA, 21 nt, Homo sapiens
ccuccaugaugcaagccagcu

SEQ ID NO: 1751598 - RNA, 18 nt, Homo sapiens
agaauccuacaacuucca

SEQ ID NO: 1751599 - RNA, 19 nt, Homo sapiens
cagaaucaaaucugagccu

SEQ ID NO: 1751600 - RNA, 22 nt, Homo sapiens
uccauaggcgcaggugcacagg

SEQ ID NO: 1751601 - RNA, 15 nt, Homo sapiens
uucccuuuccccagc

SEQ ID NO: 1751602 - RNA, 21 nt, Homo sapiens
cuaacuguauuuauugugaug

SEQ ID NO: 1751603 - RNA, 14 nt, Homo sapiens
ucaccaaaaaccua

SEQ ID NO: 1751604 - RNA, 17 nt, Homo sapiens
aucaugaugaugauaau

SEQ ID NO: 1751605 - RNA, 17 nt, Homo sapiens
gccgccccggacagugg

SEQ ID NO: 1751606 - RNA, 22 nt, Homo sapiens
aauuugggaacauaaaaacuac

SEQ ID NO: 1751607 - RNA, 16 nt, Homo sapiens
gucauuccugucaaca

SEQ ID NO: 1751608 - RNA, 19 nt, Homo sapiens
uguaaucccagcuacuugg

SEQ ID NO: 1751609 - RNA, 16 nt, Homo sapiens
auuuugcaaucugugu

SEQ ID NO: 1751610 - RNA, 17 nt, Homo sapiens
ucccuucucguguuugc

SEQ ID NO: 1751611 - RNA, 21 nt, Homo sapiens
gugccaguucuuuccauaaua

SEQ ID NO: 1751612 - RNA, 20 nt, Homo sapiens
ugccagaauacuggguucuu

SEQ ID NO: 1751613 - RNA, 22 nt, Homo sapiens
gcacaguggcggcaacauugaa

SEQ ID NO: 1751614 - RNA, 15 nt, Homo sapiens
uagcuuaaguguaaa

SEQ ID NO: 1751615 - RNA, 16 nt, Homo sapiens
caacaauaaauaugua

SEQ ID NO: 1751616 - RNA, 15 nt, Homo sapiens
cccaggauacuggca

SEQ ID NO: 1751617 - RNA, 13 nt, Homo sapiens
uaauuugcugcug

SEQ ID NO: 1751618 - RNA, 21 nt, Homo sapiens
aguuuuaauguauaguuuuga

SEQ ID NO: 1751619 - RNA, 17 nt, Homo sapiens
agauagagauuaaguca

SEQ ID NO: 1751620 - RNA, 19 nt, Homo sapiens
caacugaauaaauaccucu

SEQ ID NO: 1751621 - RNA, 22 nt, Homo sapiens
ccugggucaccuuccugggcag

SEQ ID NO: 1751622 - RNA, 13 nt, Homo sapiens
uuuaaucccagca

SEQ ID NO: 1751623 - RNA, 21 nt, Homo sapiens
gacucuugaaguacuuaacau

SEQ ID NO: 1751624 - RNA, 15 nt, Homo sapiens
auuuuagaaccacaa

SEQ ID NO: 1751625 - RNA, 22 nt, Homo sapiens
gcgacucuccugccucagccuc

SEQ ID NO: 1751626 - RNA, 12 nt, Homo sapiens
ccaaugaaauga

SEQ ID NO: 1751627 - RNA, 22 nt, Homo sapiens
uccgaggccccugucucagggu

SEQ ID NO: 1751628 - RNA, 20 nt, Homo sapiens
cucuucaauaaaccacaagc

SEQ ID NO: 1751629 - RNA, 22 nt, Homo sapiens
ucucugaauuuucagagacuuu

SEQ ID NO: 1751630 - RNA, 16 nt, Homo sapiens
ccaaguuauacccaac

SEQ ID NO: 1751631 - RNA, 13 nt, Homo sapiens
ucacaaggucaag

SEQ ID NO: 1751632 - RNA, 21 nt, Homo sapiens
aaacagggcugccuucuggcc

SEQ ID NO: 1751633 - RNA, 21 nt, Homo sapiens
gugacucuauauagcugauca

SEQ ID NO: 1751634 - RNA, 16 nt, Homo sapiens
uaugagaaaaaauaua

SEQ ID NO: 1751635 - RNA, 20 nt, Homo sapiens
cagcccugggauagugcugu

SEQ ID NO: 1751636 - RNA, 15 nt, Homo sapiens
agacaaaaucucuau

SEQ ID NO: 1751637 - RNA, 21 nt, Homo sapiens
ucaagcucuccaaaggcucag

SEQ ID NO: 1751638 - RNA, 20 nt, Homo sapiens
gcuaugaucagaagacuuua

SEQ ID NO: 1751639 - RNA, 17 nt, Homo sapiens
agaaugucuauuuccaa

SEQ ID NO: 1751640 - RNA, 13 nt, Homo sapiens
cuagcuguuucaa

SEQ ID NO: 1751641 - RNA, 18 nt, Homo sapiens
ugcuuugaggcaguucca

SEQ ID NO: 1751642 - RNA, 22 nt, Homo sapiens
gcaagggaggaacaaaugaaga

SEQ ID NO: 1751643 - RNA, 12 nt, Homo sapiens
ccaucaccaccg

SEQ ID NO: 1751644 - RNA, 12 nt, Homo sapiens
ccagcaccaccu

SEQ ID NO: 1751645 - RNA, 21 nt, Homo sapiens
aauccaagaacuuauuuguac

SEQ ID NO: 1751646 - RNA, 16 nt, Homo sapiens
guuagcuuguauauau

SEQ ID NO: 1751647 - RNA, 14 nt, Homo sapiens
ccaguugcugucac

SEQ ID NO: 1751648 - RNA, 23 nt, Homo sapiens
guauguaggcaauacauguaucu

SEQ ID NO: 1751649 - RNA, 19 nt, Homo sapiens
aucccuggcugaccugcug

SEQ ID NO: 1751650 - RNA, 19 nt, Homo sapiens
cccagggaacuaaagggug

SEQ ID NO: 1751651 - RNA, 14 nt, Homo sapiens
uucugaagaucuca

SEQ ID NO: 1751652 - RNA, 17 nt, Homo sapiens
auucugaaaaagacaua

SEQ ID NO: 1751653 - RNA, 17 nt, Homo sapiens
aaauggaaacaccacug

SEQ ID NO: 1751654 - RNA, 16 nt, Homo sapiens
uauugugccaauaugu

SEQ ID NO: 1751655 - RNA, 14 nt, Homo sapiens
agugugacagggcc

SEQ ID NO: 1751656 - RNA, 16 nt, Homo sapiens
uguccuacaauaucau

SEQ ID NO: 1751657 - RNA, 21 nt, Homo sapiens
acucccagauggcucuuucua

SEQ ID NO: 1751658 - RNA, 18 nt, Homo sapiens
auuuuccugcauaaucau

SEQ ID NO: 1751659 - RNA, 21 nt, Homo sapiens
caaagaacucaccacaagcca

SEQ ID NO: 1751660 - RNA, 19 nt, Homo sapiens
cuuucuccaggaccaauaa

SEQ ID NO: 1751661 - RNA, 14 nt, Homo sapiens
cucccucuggucua

SEQ ID NO: 1751662 - RNA, 22 nt, Homo sapiens
gaccaugguagaaaaugcacca

SEQ ID NO: 1751663 - RNA, 17 nt, Homo sapiens
agucauucagauaugau

SEQ ID NO: 1751664 - RNA, 16 nt, Homo sapiens
uaaugaaggcauguaa

SEQ ID NO: 1751665 - RNA, 20 nt, Homo sapiens
aaggcgggaggauugcuuga

SEQ ID NO: 1751666 - RNA, 16 nt, Homo sapiens
ugaggugcauuuucuc

SEQ ID NO: 1751667 - RNA, 17 nt, Homo sapiens
cugaggacuaugccaug

SEQ ID NO: 1751668 - RNA, 13 nt, Homo sapiens
ugauaaagaggca

SEQ ID NO: 1751669 - RNA, 18 nt, Homo sapiens
caccaaaucaucucucau

SEQ ID NO: 1751670 - RNA, 19 nt, Homo sapiens
uccaggauuuaggccuuaa

SEQ ID NO: 1751671 - RNA, 20 nt, Homo sapiens
cuccagaauuuggaaauccu

SEQ ID NO: 1751672 - RNA, 17 nt, Homo sapiens
cucucccaacucuugca

SEQ ID NO: 1751673 - RNA, 17 nt, Homo sapiens
acugcugauauuuucuc

SEQ ID NO: 1751674 - RNA, 14 nt, Homo sapiens
ugaggaagccuaaa

SEQ ID NO: 1751675 - RNA, 18 nt, Homo sapiens
gugucagagcccagggga

SEQ ID NO: 1751676 - RNA, 19 nt, Homo sapiens
auggcagacauugugcuag

SEQ ID NO: 1751677 - RNA, 14 nt, Homo sapiens
caagcaaggccaaa

SEQ ID NO: 1751678 - RNA, 10 nt, Homo sapiens
aaacugccau

SEQ ID NO: 1751679 - RNA, 14 nt, Homo sapiens
uucugagaccagug

SEQ ID NO: 1751680 - RNA, 15 nt, Homo sapiens
ggcgcccccgcccca

SEQ ID NO: 1751681 - RNA, 24 nt, Homo sapiens
aaggcauccacuucacaguucuga

SEQ ID NO: 1751682 - RNA, 19 nt, Homo sapiens
ugcugaccccugugugaca

SEQ ID NO: 1751683 - RNA, 16 nt, Homo sapiens
ucucuagcuuugucau

SEQ ID NO: 1751684 - RNA, 18 nt, Homo sapiens
agucagugucguuuauau

SEQ ID NO: 1751685 - RNA, 22 nt, Homo sapiens
gauuuccuccucccagugccuu

SEQ ID NO: 1751686 - RNA, 18 nt, Homo sapiens
acagaugccacacaagga

SEQ ID NO: 1751687 - RNA, 18 nt, Homo sapiens
uuuauaaaauugcuauaa

SEQ ID NO: 1751688 - RNA, 19 nt, Homo sapiens
cugccauuauuuucuguca

SEQ ID NO: 1751689 - RNA, 14 nt, Homo sapiens
cuguuauuaacaaa

SEQ ID NO: 1751690 - RNA, 17 nt, Homo sapiens
accucaaccuaugguau

SEQ ID NO: 1751691 - RNA, 13 nt, Homo sapiens
acuugaccucauc

SEQ ID NO: 1751692 - RNA, 18 nt, Homo sapiens
agacaggucuagacuuuc

SEQ ID NO: 1751693 - RNA, 15 nt, Homo sapiens
gaacuuuauuuacac

SEQ ID NO: 1751694 - RNA, 20 nt, Homo sapiens
ggguagaaugauuaaucaaa

SEQ ID NO: 1751695 - RNA, 12 nt, Homo sapiens
uuauucagugau

SEQ ID NO: 1751696 - RNA, 24 nt, Homo sapiens
ggaggagaaagcucucuauaccaa

SEQ ID NO: 1751697 - RNA, 18 nt, Homo sapiens
uccuauaacuugaugcau

SEQ ID NO: 1751698 - RNA, 14 nt, Homo sapiens
cacauauauuucca

SEQ ID NO: 1751699 - RNA, 16 nt, Homo sapiens
gacaguaucacugucu

SEQ ID NO: 1751700 - RNA, 12 nt, Homo sapiens
uuuacuaccugg

SEQ ID NO: 1751701 - RNA, 20 nt, Homo sapiens
gagcuuacaagacccuauga

SEQ ID NO: 1751702 - RNA, 16 nt, Homo sapiens
aagggugagacuccau

SEQ ID NO: 1751703 - RNA, 21 nt, Homo sapiens
acuugucaagccugugcaaaa

SEQ ID NO: 1751704 - RNA, 19 nt, Homo sapiens
ugaaaaugaaccauucaca

SEQ ID NO: 1751705 - RNA, 17 nt, Homo sapiens
ugucuagggugugauuu

SEQ ID NO: 1751706 - RNA, 23 nt, Homo sapiens
acaaaaaaauauauuuaaugaua

SEQ ID NO: 1751707 - RNA, 22 nt, Homo sapiens
cuuaaaagggugguaguuuucc

SEQ ID NO: 1751708 - RNA, 15 nt, Homo sapiens
cauuugcauuugcuc

SEQ ID NO: 1751709 - RNA, 11 nt, Homo sapiens
aauacaugcac

SEQ ID NO: 1751710 - RNA, 16 nt, Homo sapiens
uccccuccucuauucc

SEQ ID NO: 1751711 - RNA, 14 nt, Homo sapiens
caucagauaugcuu

SEQ ID NO: 1751712 - RNA, 22 nt, Homo sapiens
uucucauccuuccucauuugca

SEQ ID NO: 1751713 - RNA, 20 nt, Homo sapiens
gcagaaacuuggaugucacu

SEQ ID NO: 1751714 - RNA, 20 nt, Homo sapiens
acuccggccugggugacaga

SEQ ID NO: 1751715 - RNA, 16 nt, Homo sapiens
uaucuugcagcuguaa

SEQ ID NO: 1751716 - RNA, 16 nt, Homo sapiens
auauguuggaaaaaag

SEQ ID NO: 1751717 - RNA, 19 nt, Homo sapiens
uuauuagagugucuuucca

SEQ ID NO: 1751718 - RNA, 23 nt, Homo sapiens
cuuaauaaaagaacaugcuugaa

SEQ ID NO: 1751719 - RNA, 17 nt, Homo sapiens
ucaaggacaggagccug

SEQ ID NO: 1751720 - RNA, 21 nt, Homo sapiens
cuuaaggucuaacuguggaau

SEQ ID NO: 1751721 - RNA, 22 nt, Homo sapiens
cagcaacacaauguuauucguu

SEQ ID NO: 1751722 - RNA, 19 nt, Homo sapiens
cacaugacaacuuugccag

SEQ ID NO: 1751723 - RNA, 18 nt, Homo sapiens
aagauuuguccaccucug

SEQ ID NO: 1751724 - RNA, 19 nt, Homo sapiens
guauuugaaaacucacaga

SEQ ID NO: 1751725 - RNA, 12 nt, Homo sapiens
uuaagaaauuca

SEQ ID NO: 1751726 - RNA, 23 nt, Homo sapiens
caugucgaggcuagaggcauuug

SEQ ID NO: 1751727 - RNA, 22 nt, Homo sapiens
cauguacaaggccccucugcaa

SEQ ID NO: 1751728 - RNA, 16 nt, Homo sapiens
caggucaguuguaaua

SEQ ID NO: 1751729 - RNA, 10 nt, Homo sapiens
auauucuugg

SEQ ID NO: 1751730 - RNA, 23 nt, Homo sapiens
gcgccaaauaaugucucugugag

SEQ ID NO: 1751731 - RNA, 14 nt, Homo sapiens
agaucaacuggaau

SEQ ID NO: 1751732 - RNA, 16 nt, Homo sapiens
guguucccgugccugg

SEQ ID NO: 1751733 - RNA, 23 nt, Homo sapiens
uccugggaaggagggagcugcuc

SEQ ID NO: 1751734 - RNA, 15 nt, Homo sapiens
ccuggacuuuccugc

SEQ ID NO: 1751735 - RNA, 19 nt, Homo sapiens
ccaagaaagcucacuguag

SEQ ID NO: 1751736 - RNA, 17 nt, Homo sapiens
gcugcucccuuuccugc

SEQ ID NO: 1751737 - RNA, 12 nt, Homo sapiens
gagugcugagaa

SEQ ID NO: 1751738 - RNA, 21 nt, Homo sapiens
cuugugguggcugcuccauga

SEQ ID NO: 1751739 - RNA, 16 nt, Homo sapiens
gaguuccgacugccau

SEQ ID NO: 1751740 - RNA, 11 nt, Homo sapiens
uccacugccau

SEQ ID NO: 1751741 - RNA, 23 nt, Homo sapiens
uggggaggugagagugcagaaag

SEQ ID NO: 1751742 - RNA, 16 nt, Homo sapiens
auaugauauguaaaca

SEQ ID NO: 1751743 - RNA, 19 nt, Homo sapiens
gacuuuggaaaacuacuuu

SEQ ID NO: 1751744 - RNA, 23 nt, Homo sapiens
cgagaguguguguauauguauua

SEQ ID NO: 1751745 - RNA, 21 nt, Homo sapiens
agcacuaauucaacauauacc

SEQ ID NO: 1751746 - RNA, 22 nt, Homo sapiens
uuguagcacugaggguggcacu

SEQ ID NO: 1751747 - RNA, 21 nt, Homo sapiens
auugccccuggcuuugccucu

SEQ ID NO: 1751748 - RNA, 21 nt, Homo sapiens
uugaaagaagucaaaugaaug

SEQ ID NO: 1751749 - RNA, 19 nt, Homo sapiens
ccagcacugcccaaagugc

SEQ ID NO: 1751750 - RNA, 20 nt, Homo sapiens
auuuagaaaacauucaucca

SEQ ID NO: 1751751 - RNA, 20 nt, Homo sapiens
ucugccuggcaacaucuuac

SEQ ID NO: 1751752 - RNA, 19 nt, Homo sapiens
uggaauuuuuuccugcuag

SEQ ID NO: 1751753 - RNA, 17 nt, Homo sapiens
uaaucccagcacuuuga

SEQ ID NO: 1751754 - RNA, 22 nt, Homo sapiens
cuguggagaaauaaaaauaccu

SEQ ID NO: 1751755 - RNA, 18 nt, Homo sapiens
ugaaaguuuugauuugaa

SEQ ID NO: 1751756 - RNA, 12 nt, Homo sapiens
ccuaagcacuuu

SEQ ID NO: 1751757 - RNA, 17 nt, Homo sapiens
acuaaagaagaucugua

SEQ ID NO: 1751758 - RNA, 17 nt, Homo sapiens
gcacgguggugcccaag

SEQ ID NO: 1751759 - RNA, 17 nt, Homo sapiens
acugaaccacucuccca

SEQ ID NO: 1751760 - RNA, 17 nt, Homo sapiens
ccaauagacgccaguag

SEQ ID NO: 1751761 - RNA, 14 nt, Homo sapiens
aauaacauugcacu

SEQ ID NO: 1751762 - RNA, 15 nt, Homo sapiens
ucagcuucucaaagu

SEQ ID NO: 1751763 - RNA, 14 nt, Homo sapiens
guauaucauucuac

SEQ ID NO: 1751764 - RNA, 18 nt, Homo sapiens
agauuaccgacacuguca

SEQ ID NO: 1751765 - RNA, 17 nt, Homo sapiens
ugcucugugacaaggcu

SEQ ID NO: 1751766 - RNA, 14 nt, Homo sapiens
ugagaagccuucag

SEQ ID NO: 1751767 - RNA, 12 nt, Homo sapiens
uccuauuggcau

SEQ ID NO: 1751768 - RNA, 22 nt, Homo sapiens
uugagcuggauggguacagcuu

SEQ ID NO: 1751769 - RNA, 13 nt, Homo sapiens
ccacucacauucc

SEQ ID NO: 1751770 - RNA, 20 nt, Homo sapiens
caaauauccuccacuuucag

SEQ ID NO: 1751771 - RNA, 18 nt, Homo sapiens
augagcauccucucucac

SEQ ID NO: 1751772 - RNA, 12 nt, Homo sapiens
uguccaaagagg

SEQ ID NO: 1751773 - RNA, 20 nt, Homo sapiens
ugucaacaaggggucaaugu

SEQ ID NO: 1751774 - RNA, 18 nt, Homo sapiens
cgaguggaugcugugcua

SEQ ID NO: 1751775 - RNA, 21 nt, Homo sapiens
ugugucagagcccaggggaga

SEQ ID NO: 1751776 - RNA, 23 nt, Homo sapiens
agaaauaaauguaccugauguac

SEQ ID NO: 1751777 - RNA, 23 nt, Homo sapiens
cagggaugcugguggcuggugag

SEQ ID NO: 1751778 - RNA, 20 nt, Homo sapiens
aaagccuuggucccgugaaa

SEQ ID NO: 1751779 - RNA, 23 nt, Homo sapiens
auugcagcuaagcucaaauguau

SEQ ID NO: 1751780 - RNA, 17 nt, Homo sapiens
uccauccucacugcugu

SEQ ID NO: 1751781 - RNA, 21 nt, Homo sapiens
acaagucaguuucuacacugg

SEQ ID NO: 1751782 - RNA, 15 nt, Homo sapiens
cugagugaaaacauc

SEQ ID NO: 1751783 - RNA, 19 nt, Homo sapiens
auacuuuuggcuccucuag

SEQ ID NO: 1751784 - RNA, 15 nt, Homo sapiens
uccuguuugauguga

SEQ ID NO: 1751785 - RNA, 15 nt, Homo sapiens
aagacauguuggaaa

SEQ ID NO: 1751786 - RNA, 22 nt, Homo sapiens
ggaccuucuauccucuguauuu

SEQ ID NO: 1751787 - RNA, 21 nt, Homo sapiens
aauccugucgauuagacugga

SEQ ID NO: 1751788 - RNA, 17 nt, Homo sapiens
cucagggagcagggaag

SEQ ID NO: 1751789 - RNA, 16 nt, Homo sapiens
caugaauuauuuccag

SEQ ID NO: 1751790 - RNA, 19 nt, Homo sapiens
uuaauguguuaagugcagg

SEQ ID NO: 1751791 - RNA, 21 nt, Homo sapiens
caguguguaaauaauuugcac

SEQ ID NO: 1751792 - RNA, 14 nt, Homo sapiens
aggaaauaucauaa

SEQ ID NO: 1751793 - RNA, 13 nt, Homo sapiens
auguucacuguga

SEQ ID NO: 1751794 - RNA, 14 nt, Homo sapiens
aguauacucagcua

SEQ ID NO: 1751795 - RNA, 14 nt, Homo sapiens
aguacacucagcca

SEQ ID NO: 1751796 - RNA, 15 nt, Homo sapiens
gacauccccacucac

SEQ ID NO: 1751797 - RNA, 18 nt, Homo sapiens
ucugcagcccauucccaa

SEQ ID NO: 1751798 - RNA, 12 nt, Homo sapiens
uuacagaauuau

SEQ ID NO: 1751799 - RNA, 21 nt, Homo sapiens
uauacucuugaauuccucuca

SEQ ID NO: 1751800 - RNA, 15 nt, Homo sapiens
aacuggagugcucuc

SEQ ID NO: 1751801 - RNA, 18 nt, Homo sapiens
acaccauuucugggcucc

SEQ ID NO: 1751802 - RNA, 22 nt, Homo sapiens
aauguguaaagaucuacaugaa

SEQ ID NO: 1751803 - RNA, 17 nt, Homo sapiens
aacuacuuucuguuauc

SEQ ID NO: 1751804 - RNA, 16 nt, Homo sapiens
caccucuacauuugaa

SEQ ID NO: 1751805 - RNA, 17 nt, Homo sapiens
agaaucuagaaaaucag

SEQ ID NO: 1751806 - RNA, 14 nt, Homo sapiens
auaucaugcaaaau

SEQ ID NO: 1751807 - RNA, 16 nt, Homo sapiens
agucucuagguucuga

SEQ ID NO: 1751808 - RNA, 17 nt, Homo sapiens
uggucuugaacuccuga

SEQ ID NO: 1751809 - RNA, 19 nt, Homo sapiens
gccugugccagcaccuuug

SEQ ID NO: 1751810 - RNA, 17 nt, Homo sapiens
accguaggacccaagca

SEQ ID NO: 1751811 - RNA, 17 nt, Homo sapiens
auguuguuuuaggggcu

SEQ ID NO: 1751812 - RNA, 15 nt, Homo sapiens
uaaaucaagagcuua

SEQ ID NO: 1751813 - RNA, 21 nt, Homo sapiens
gacaccuuuucuauuuaccuc

SEQ ID NO: 1751814 - RNA, 14 nt, Homo sapiens
agacuuuucuuucc

SEQ ID NO: 1751815 - RNA, 19 nt, Homo sapiens
gauuauucccuguacaaua

SEQ ID NO: 1751816 - RNA, 18 nt, Homo sapiens
ccuguugagcaucacaga

SEQ ID NO: 1751817 - RNA, 21 nt, Homo sapiens
uggaauuauuuugaaugucac

SEQ ID NO: 1751818 - RNA, 15 nt, Homo sapiens
ugcgucgaagcuuug

SEQ ID NO: 1751819 - RNA, 13 nt, Homo sapiens
uaccucacuuuua

SEQ ID NO: 1751820 - RNA, 14 nt, Homo sapiens
cauugaaacuguau

SEQ ID NO: 1751821 - RNA, 12 nt, Homo sapiens
uauacacaucca

SEQ ID NO: 1751822 - RNA, 14 nt, Homo sapiens
uauguuuauacaca

SEQ ID NO: 1751823 - RNA, 18 nt, Homo sapiens
uguaaaugccacaaagaa

SEQ ID NO: 1751824 - RNA, 22 nt, Homo sapiens
acucauucuucuguacgucuga

SEQ ID NO: 1751825 - RNA, 18 nt, Homo sapiens
auucacaugcccucgguc

SEQ ID NO: 1751826 - RNA, 11 nt, Homo sapiens
agagauguuuc

SEQ ID NO: 1751827 - RNA, 11 nt, Homo sapiens
aucuaccagca

SEQ ID NO: 1751828 - RNA, 15 nt, Homo sapiens
ccagaugaacugaga

SEQ ID NO: 1751829 - RNA, 23 nt, Homo sapiens
uugggggaggggagacuuugaug

SEQ ID NO: 1751830 - RNA, 15 nt, Homo sapiens
aaacauuuauggaau

SEQ ID NO: 1751831 - RNA, 16 nt, Homo sapiens
ucuaaagugagcucua

SEQ ID NO: 1751832 - RNA, 20 nt, Homo sapiens
gccuguacucccagcacuuu

SEQ ID NO: 1751833 - RNA, 15 nt, Homo sapiens
gcucaguuggugcug

SEQ ID NO: 1751834 - RNA, 23 nt, Homo sapiens
cucaagauauucagguggccaga

SEQ ID NO: 1751835 - RNA, 13 nt, Homo sapiens
aauaaaauguuau

SEQ ID NO: 1751836 - RNA, 18 nt, Homo sapiens
accaaguugauacuugaa

SEQ ID NO: 1751837 - RNA, 13 nt, Homo sapiens
uaggacauaaaga

SEQ ID NO: 1751838 - RNA, 20 nt, Homo sapiens
ccaacauacaauuuacuuuu

SEQ ID NO: 1751839 - RNA, 15 nt, Homo sapiens
acucaccaaacacaa

SEQ ID NO: 1751840 - RNA, 14 nt, Homo sapiens
uuugaggucagggg

SEQ ID NO: 1751841 - RNA, 22 nt, Homo sapiens
cauuuugauggugucugugaca

SEQ ID NO: 1751842 - RNA, 20 nt, Homo sapiens
gcaccucaccucccgaagcc

SEQ ID NO: 1751843 - RNA, 18 nt, Homo sapiens
auucacccagagggaaau

SEQ ID NO: 1751844 - RNA, 17 nt, Homo sapiens
ugauauuggggccauga

SEQ ID NO: 1751845 - RNA, 14 nt, Homo sapiens
aacucuuaaaaccc

SEQ ID NO: 1751846 - RNA, 15 nt, Homo sapiens
aucccacauccaacu

SEQ ID NO: 1751847 - RNA, 19 nt, Homo sapiens
ccagcacggggcuaagcau

SEQ ID NO: 1751848 - RNA, 21 nt, Homo sapiens
ucuacauuucaccuacuuugu

SEQ ID NO: 1751849 - RNA, 21 nt, Homo sapiens
aguucuguaaaauauacuuaa

SEQ ID NO: 1751850 - RNA, 17 nt, Homo sapiens
ggcugccugagcaccuc

SEQ ID NO: 1751851 - RNA, 16 nt, Homo sapiens
uccccagagacaugca

SEQ ID NO: 1751852 - RNA, 19 nt, Homo sapiens
ucacaccugacaaauggaa

SEQ ID NO: 1751853 - RNA, 17 nt, Homo sapiens
aacugucaaagaaucaa

SEQ ID NO: 1751854 - RNA, 17 nt, Homo sapiens
aacuauuuaagaguuua

SEQ ID NO: 1751855 - RNA, 13 nt, Homo sapiens
cuuagacacuuua

SEQ ID NO: 1751856 - RNA, 16 nt, Homo sapiens
ccuggccaaucaggcg

SEQ ID NO: 1751857 - RNA, 15 nt, Homo sapiens
auaaugcuuccccac

SEQ ID NO: 1751858 - RNA, 20 nt, Homo sapiens
agcauauauucauaccuguu

SEQ ID NO: 1751859 - RNA, 20 nt, Homo sapiens
aucuacccacuuacuaaccu

SEQ ID NO: 1751860 - RNA, 13 nt, Homo sapiens
uuguauaauuucg

SEQ ID NO: 1751861 - RNA, 23 nt, Homo sapiens
caaagcagccacgaggugcaaca

SEQ ID NO: 1751862 - RNA, 15 nt, Homo sapiens
ucucugcaucugacu

SEQ ID NO: 1751863 - RNA, 13 nt, Homo sapiens
gcagcccaugccc

SEQ ID NO: 1751864 - RNA, 18 nt, Homo sapiens
uacuuuguugaguauuau

SEQ ID NO: 1751865 - RNA, 11 nt, Homo sapiens
gaaaccuuuac

SEQ ID NO: 1751866 - RNA, 18 nt, Homo sapiens
ccuuucuucagacacuga

SEQ ID NO: 1751867 - RNA, 14 nt, Homo sapiens
agaauaauaaugcc

SEQ ID NO: 1751868 - RNA, 15 nt, Homo sapiens
uaagagagucauaaa

SEQ ID NO: 1751869 - RNA, 13 nt, Homo sapiens
agauagcugugac

SEQ ID NO: 1751870 - RNA, 13 nt, Homo sapiens
aaacuuguuuaca

SEQ ID NO: 1751871 - RNA, 17 nt, Homo sapiens
uauuuaagcagcuugaa

SEQ ID NO: 1751872 - RNA, 20 nt, Homo sapiens
aacccuucuucauguucaau

SEQ ID NO: 1751873 - RNA, 13 nt, Homo sapiens
gucacuggcagcc

SEQ ID NO: 1751874 - RNA, 13 nt, Homo sapiens
gugcuuggcacau

SEQ ID NO: 1751875 - RNA, 20 nt, Homo sapiens
guuuaguagccuuacuguga

SEQ ID NO: 1751876 - RNA, 19 nt, Homo sapiens
gauuccuuuaugagucagu

SEQ ID NO: 1751877 - RNA, 18 nt, Homo sapiens
uaaaaagcagcugcauuu

SEQ ID NO: 1751878 - RNA, 15 nt, Homo sapiens
cuccaucuccagugg

SEQ ID NO: 1751879 - RNA, 15 nt, Homo sapiens
ggcagaaaagcacau

SEQ ID NO: 1751880 - RNA, 15 nt, Homo sapiens
aacaugcacauuuau

SEQ ID NO: 1751881 - RNA, 14 nt, Homo sapiens
cauagaaaacuuga

SEQ ID NO: 1751882 - RNA, 14 nt, Homo sapiens
aaaacuaaccaucu

SEQ ID NO: 1751883 - RNA, 15 nt, Homo sapiens
accaguacugggaag

SEQ ID NO: 1751884 - RNA, 18 nt, Homo sapiens
gccuggggauguaaccaa

SEQ ID NO: 1751885 - RNA, 16 nt, Homo sapiens
uguggcucacgugugu

SEQ ID NO: 1751886 - RNA, 23 nt, Homo sapiens
uaggccacacagcacaugcacac

SEQ ID NO: 1751887 - RNA, 23 nt, Homo sapiens
agccugcggcugcuggcacagac

SEQ ID NO: 1751888 - RNA, 14 nt, Homo sapiens
cugcaggacaugua

SEQ ID NO: 1751889 - RNA, 16 nt, Homo sapiens
gacuguugccacuuaa

SEQ ID NO: 1751890 - RNA, 23 nt, Homo sapiens
agucauuguuguuuuaaccuccc

SEQ ID NO: 1751891 - RNA, 18 nt, Homo sapiens
auguaucaaugaguaaca

SEQ ID NO: 1751892 - RNA, 20 nt, Homo sapiens
cuugcagcuguaaacauauu

SEQ ID NO: 1751893 - RNA, 13 nt, Homo sapiens
aaacaucccaaga

SEQ ID NO: 1751894 - RNA, 13 nt, Homo sapiens
caugauccaauca

SEQ ID NO: 1751895 - RNA, 20 nt, Homo sapiens
aaugucuucuguauucacuu

SEQ ID NO: 1751896 - RNA, 20 nt, Homo sapiens
auacaaacuacagaguuuau

SEQ ID NO: 1751897 - RNA, 19 nt, Homo sapiens
aggcaccuuuuacugugau

SEQ ID NO: 1751898 - RNA, 18 nt, Homo sapiens
acuccucuaucaugcaaa

SEQ ID NO: 1751899 - RNA, 19 nt, Homo sapiens
uagcaaagaagcuucaugc

SEQ ID NO: 1751900 - RNA, 15 nt, Homo sapiens
agccgauuccuccag

SEQ ID NO: 1751901 - RNA, 16 nt, Homo sapiens
ucggccuccaugaccu

SEQ ID NO: 1751902 - RNA, 15 nt, Homo sapiens
cagguaacaucauca

SEQ ID NO: 1751903 - RNA, 14 nt, Homo sapiens
auuaccuugugcua

SEQ ID NO: 1751904 - RNA, 14 nt, Homo sapiens
uagcucaaucugca

SEQ ID NO: 1751905 - RNA, 16 nt, Homo sapiens
aguguuugcaauggug

SEQ ID NO: 1751906 - RNA, 21 nt, Homo sapiens
cccaugggggcugucuuugca

SEQ ID NO: 1751907 - RNA, 22 nt, Homo sapiens
caaaacuucuauuauccagagu

SEQ ID NO: 1751908 - RNA, 17 nt, Homo sapiens
ugaaauauuuucuuccu

SEQ ID NO: 1751909 - RNA, 23 nt, Homo sapiens
cauauucuuuaaauuucaucuca

SEQ ID NO: 1751910 - RNA, 22 nt, Homo sapiens
cagcuacgugggaggcugaggc

SEQ ID NO: 1751911 - RNA, 20 nt, Homo sapiens
gaagaaaacagauaacaaau

SEQ ID NO: 1751912 - RNA, 13 nt, Homo sapiens
aaucacaguauca

SEQ ID NO: 1751913 - RNA, 22 nt, Homo sapiens
uaaaaaaaaagucagagacaga

SEQ ID NO: 1751914 - RNA, 13 nt, Homo sapiens
gcugucacuuuuu

SEQ ID NO: 1751915 - RNA, 15 nt, Homo sapiens
aagcagcucaagaac

SEQ ID NO: 1751916 - RNA, 19 nt, Homo sapiens
gcaaugccuagacuuccca

SEQ ID NO: 1751917 - RNA, 20 nt, Homo sapiens
gugccccuuuccuucacugc

SEQ ID NO: 1751918 - RNA, 18 nt, Homo sapiens
ucccaccugccaccaggc

SEQ ID NO: 1751919 - RNA, 18 nt, Homo sapiens
cgaguuuucccucaguga

SEQ ID NO: 1751920 - RNA, 14 nt, Homo sapiens
cuucauggaacuca

SEQ ID NO: 1751921 - RNA, 13 nt, Homo sapiens
ggaaggagggcac

SEQ ID NO: 1751922 - RNA, 17 nt, Homo sapiens
uuguauauauguguaua

SEQ ID NO: 1751923 - RNA, 17 nt, Homo sapiens
accaggccuccaagcca

SEQ ID NO: 1751924 - RNA, 12 nt, Homo sapiens
aucaaucagaag

SEQ ID NO: 1751925 - RNA, 17 nt, Homo sapiens
ucucaccugucaucuca

SEQ ID NO: 1751926 - RNA, 23 nt, Homo sapiens
ccaccaaaagaagaaaccuucau

SEQ ID NO: 1751927 - RNA, 19 nt, Homo sapiens
gacccccgcaaguuugcac

SEQ ID NO: 1751928 - RNA, 22 nt, Homo sapiens
aaguaauuccucucacuaaacu

SEQ ID NO: 1751929 - RNA, 21 nt, Homo sapiens
caugugccaagauucuacucu

SEQ ID NO: 1751930 - RNA, 19 nt, Homo sapiens
cucauuugagauaaaguca

SEQ ID NO: 1751931 - RNA, 16 nt, Homo sapiens
uugcauauaguuaaac

SEQ ID NO: 1751932 - RNA, 21 nt, Homo sapiens
aacaaaaauguaauuguucau

SEQ ID NO: 1751933 - RNA, 20 nt, Homo sapiens
caguacagcaugugccuuaa

SEQ ID NO: 1751934 - RNA, 19 nt, Homo sapiens
gcaauaaacuccuacuaaa

SEQ ID NO: 1751935 - RNA, 16 nt, Homo sapiens
gaaauaaaccuaugaa

SEQ ID NO: 1751936 - RNA, 15 nt, Homo sapiens
ugccucuucuuugug

SEQ ID NO: 1751937 - RNA, 22 nt, Homo sapiens
uaauaaaaguauucuuguuaga

SEQ ID NO: 1751938 - RNA, 13 nt, Homo sapiens
ucuauagcacaua

SEQ ID NO: 1751939 - RNA, 17 nt, Homo sapiens
aagagccuaacaucucc

SEQ ID NO: 1751940 - RNA, 13 nt, Homo sapiens
aacagcucaguuc

SEQ ID NO: 1751941 - RNA, 16 nt, Homo sapiens
uucacucccaaccuga

SEQ ID NO: 1751942 - RNA, 16 nt, Homo sapiens
aggcgcacagugugag

SEQ ID NO: 1751943 - RNA, 14 nt, Homo sapiens
ugauuuuacauuua

SEQ ID NO: 1751944 - RNA, 15 nt, Homo sapiens
uauucuaaagcugcc

SEQ ID NO: 1751945 - RNA, 20 nt, Homo sapiens
uucugcaauccaaugcacug

SEQ ID NO: 1751946 - RNA, 16 nt, Homo sapiens
uucaaggcccuuacac

SEQ ID NO: 1751947 - RNA, 20 nt, Homo sapiens
ugguuuccccugcacucccg

SEQ ID NO: 1751948 - RNA, 16 nt, Homo sapiens
acuauuagacaugaaa

SEQ ID NO: 1751949 - RNA, 21 nt, Homo sapiens
gcagguuaacagcugucuaug

SEQ ID NO: 1751950 - RNA, 21 nt, Homo sapiens
cucacuguagcuuuuaggaau

SEQ ID NO: 1751951 - RNA, 15 nt, Homo sapiens
uccuauaagcuuaaa

SEQ ID NO: 1751952 - RNA, 14 nt, Homo sapiens
gcaagcuggaguua

SEQ ID NO: 1751953 - RNA, 17 nt, Homo sapiens
uucagacacuaccccau

SEQ ID NO: 1751954 - RNA, 17 nt, Homo sapiens
uaaaagucuccaaaaca

SEQ ID NO: 1751955 - RNA, 23 nt, Homo sapiens
gguuauucacaaccucaccaaac

SEQ ID NO: 1751956 - RNA, 18 nt, Homo sapiens
gcauucuaaaugaacuca

SEQ ID NO: 1751957 - RNA, 14 nt, Homo sapiens
aguuucucagcucc

SEQ ID NO: 1751958 - RNA, 20 nt, Homo sapiens
uacauuucuaucaguacuuu

SEQ ID NO: 1751959 - RNA, 15 nt, Homo sapiens
acaucuggcccugac

SEQ ID NO: 1751960 - RNA, 13 nt, Homo sapiens
cuggagauaugaa

SEQ ID NO: 1751961 - RNA, 20 nt, Homo sapiens
cacguagggcggcacucaca

SEQ ID NO: 1751962 - RNA, 21 nt, Homo sapiens
auugcagguggaacucaguca

SEQ ID NO: 1751963 - RNA, 13 nt, Homo sapiens
gugcaaauauuca

SEQ ID NO: 1751964 - RNA, 16 nt, Homo sapiens
uacaagguugugcccu

SEQ ID NO: 1751965 - RNA, 21 nt, Homo sapiens
uucuugauaaagaagauucug

SEQ ID NO: 1751966 - RNA, 19 nt, Homo sapiens
cauccuuagaccaagggau

SEQ ID NO: 1751967 - RNA, 19 nt, Homo sapiens
aguauuuuuaacacuuaaa

SEQ ID NO: 1751968 - RNA, 17 nt, Homo sapiens
uuccaguggccuggcuc

SEQ ID NO: 1751969 - RNA, 19 nt, Homo sapiens
accaauguacccaccgggc

SEQ ID NO: 1751970 - RNA, 19 nt, Homo sapiens
caaaaacuguacuguguuu

SEQ ID NO: 1751971 - RNA, 20 nt, Homo sapiens
cagccugggccccucagcca

SEQ ID NO: 1751972 - RNA, 14 nt, Homo sapiens
ugcugaccucccag

SEQ ID NO: 1751973 - RNA, 15 nt, Homo sapiens
cauguaucucaguac

SEQ ID NO: 1751974 - RNA, 19 nt, Homo sapiens
cucagcucccacaaaugac

SEQ ID NO: 1751975 - RNA, 21 nt, Homo sapiens
guaucuccggcucccagccuc

SEQ ID NO: 1751976 - RNA, 21 nt, Homo sapiens
uucccaggccagcaagcucuu

SEQ ID NO: 1751977 - RNA, 23 nt, Homo sapiens
aguugcacuucaguuccuuucau

SEQ ID NO: 1751978 - RNA, 19 nt, Homo sapiens
ccccagcuuuaucugucac

SEQ ID NO: 1751979 - RNA, 20 nt, Homo sapiens
gccaagggguagaaguggca

SEQ ID NO: 1751980 - RNA, 14 nt, Homo sapiens
ugcacaucauucau

SEQ ID NO: 1751981 - RNA, 13 nt, Homo sapiens
uuugaacuugaug

SEQ ID NO: 1751982 - RNA, 21 nt, Homo sapiens
ccagauggaacaauaaaagac

SEQ ID NO: 1751983 - RNA, 13 nt, Homo sapiens
aacucuuaccuau

SEQ ID NO: 1751984 - RNA, 15 nt, Homo sapiens
ucacuuggagccagg

SEQ ID NO: 1751985 - RNA, 19 nt, Homo sapiens
uuauccagaaaacugugau

SEQ ID NO: 1751986 - RNA, 17 nt, Homo sapiens
uuguaaugcugcacaga

SEQ ID NO: 1751987 - RNA, 22 nt, Homo sapiens
auauccuuuuagucugcauaua

SEQ ID NO: 1751988 - RNA, 20 nt, Homo sapiens
cacaggauggucucugccau

SEQ ID NO: 1751989 - RNA, 19 nt, Homo sapiens
guccuggucugcucaggaa

SEQ ID NO: 1751990 - RNA, 13 nt, Homo sapiens
aaaggaagacaga

SEQ ID NO: 1751991 - RNA, 21 nt, Homo sapiens
uuggcagcucaaagacuucca

SEQ ID NO: 1751992 - RNA, 18 nt, Homo sapiens
agaaucugugcagucauc

SEQ ID NO: 1751993 - RNA, 20 nt, Homo sapiens
gccucuuaccggaaauacuu

SEQ ID NO: 1751994 - RNA, 14 nt, Homo sapiens
ugcauugaaaugca

SEQ ID NO: 1751995 - RNA, 13 nt, Homo sapiens
aaaacagggccac

SEQ ID NO: 1751996 - RNA, 17 nt, Homo sapiens
aaugacuucuccaggca

SEQ ID NO: 1751997 - RNA, 22 nt, Homo sapiens
caaguguaugcacgugugcaca

SEQ ID NO: 1751998 - RNA, 14 nt, Homo sapiens
auaacuuauaucau

SEQ ID NO: 1751999 - RNA, 14 nt, Homo sapiens
uuuaauuaaaaccu

SEQ ID NO: 1752000 - RNA, 12 nt, Homo sapiens
gcugucuuccaa

SEQ ID NO: 1752001 - RNA, 20 nt, Homo sapiens
agaauaaaagaugauuucuc

SEQ ID NO: 1752002 - RNA, 18 nt, Homo sapiens
agaaucaaauugcuacau

SEQ ID NO: 1752003 - RNA, 20 nt, Homo sapiens
cauaccauuauuauguaaau

SEQ ID NO: 1752004 - RNA, 18 nt, Homo sapiens
ucucugugauuaccucuc

SEQ ID NO: 1752005 - RNA, 17 nt, Homo sapiens
uauuugugcaccugcuu

SEQ ID NO: 1752006 - RNA, 16 nt, Homo sapiens
ucugagagacagaauu

SEQ ID NO: 1752007 - RNA, 14 nt, Homo sapiens
uaggcauuugcuga

SEQ ID NO: 1752008 - RNA, 13 nt, Homo sapiens
ggaccaaauggaa

SEQ ID NO: 1752009 - RNA, 16 nt, Homo sapiens
uucgaauaaagugaau

SEQ ID NO: 1752010 - RNA, 19 nt, Homo sapiens
aggcugcgacugaugaagg

SEQ ID NO: 1752011 - RNA, 17 nt, Homo sapiens
agacuguuaauuacuua

SEQ ID NO: 1752012 - RNA, 13 nt, Homo sapiens
ccccgcuccagau

SEQ ID NO: 1752013 - RNA, 22 nt, Homo sapiens
uauggcaucucauugaggacaa

SEQ ID NO: 1752014 - RNA, 21 nt, Homo sapiens
aagaaauuaacuuacccugua

SEQ ID NO: 1752015 - RNA, 18 nt, Homo sapiens
uacuuguuuucacuuuau

SEQ ID NO: 1752016 - RNA, 15 nt, Homo sapiens
agauuuaacacuaaa

SEQ ID NO: 1752017 - RNA, 17 nt, Homo sapiens
gacauggagaccaucua

SEQ ID NO: 1752018 - RNA, 14 nt, Homo sapiens
cuucccuauaggaa

SEQ ID NO: 1752019 - RNA, 22 nt, Homo sapiens
uuccaacagcaacacagccacu

SEQ ID NO: 1752020 - RNA, 17 nt, Homo sapiens
agaugauuuuccucccu

SEQ ID NO: 1752021 - RNA, 15 nt, Homo sapiens
aggccuuggcuugau

SEQ ID NO: 1752022 - RNA, 15 nt, Homo sapiens
acccagcguggccca

SEQ ID NO: 1752023 - RNA, 16 nt, Homo sapiens
ucucaaacuacuggca

SEQ ID NO: 1752024 - RNA, 14 nt, Homo sapiens
ccuugcccaacucc

SEQ ID NO: 1752025 - RNA, 13 nt, Homo sapiens
gccugcugugcug

SEQ ID NO: 1752026 - RNA, 12 nt, Homo sapiens
agugacagucac

SEQ ID NO: 1752027 - RNA, 15 nt, Homo sapiens
ucuaccaaaaaaagg

SEQ ID NO: 1752028 - RNA, 18 nt, Homo sapiens
caaggagggugagugcaa

SEQ ID NO: 1752029 - RNA, 21 nt, Homo sapiens
gaagucaucagcuuugugcca

SEQ ID NO: 1752030 - RNA, 20 nt, Homo sapiens
ggacuuuuccucucaugucu

SEQ ID NO: 1752031 - RNA, 21 nt, Homo sapiens
cuugugauuuuugaacaauac

SEQ ID NO: 1752032 - RNA, 14 nt, Homo sapiens
agccccauccucug

SEQ ID NO: 1752033 - RNA, 17 nt, Homo sapiens
uuacaugugauugugau

SEQ ID NO: 1752034 - RNA, 14 nt, Homo sapiens
cuugaaaugcauua

SEQ ID NO: 1752035 - RNA, 15 nt, Homo sapiens
ggaccaucacugaga

SEQ ID NO: 1752036 - RNA, 20 nt, Homo sapiens
gauguuuuaacucuaucugu

SEQ ID NO: 1752037 - RNA, 22 nt, Homo sapiens
caucacugaucuaagcaguggc

SEQ ID NO: 1752038 - RNA, 17 nt, Homo sapiens
caaauaaaugccuucca

SEQ ID NO: 1752039 - RNA, 17 nt, Homo sapiens
gcuauaaguuuuagaau

SEQ ID NO: 1752040 - RNA, 18 nt, Homo sapiens
gcuccucacucaccuuca

SEQ ID NO: 1752041 - RNA, 15 nt, Homo sapiens
ggauugacaggccau

SEQ ID NO: 1752042 - RNA, 16 nt, Homo sapiens
gugaguguguggcacc

SEQ ID NO: 1752043 - RNA, 12 nt, Homo sapiens
guucaccagccu

SEQ ID NO: 1752044 - RNA, 13 nt, Homo sapiens
agauaaacacaaa

SEQ ID NO: 1752045 - RNA, 14 nt, Homo sapiens
ccacccaccacagc

SEQ ID NO: 1752046 - RNA, 20 nt, Homo sapiens
ugugugcuugagugugugaa

SEQ ID NO: 1752047 - RNA, 22 nt, Homo sapiens
ugucaucuuccuggaagcagag

SEQ ID NO: 1752048 - RNA, 12 nt, Homo sapiens
aagcuacuuucu

SEQ ID NO: 1752049 - RNA, 19 nt, Homo sapiens
agcccagcaccccuuccuc

SEQ ID NO: 1752050 - RNA, 20 nt, Homo sapiens
uuugggguccuagcccagug

SEQ ID NO: 1752051 - RNA, 16 nt, Homo sapiens
cugggcaacacugcag

SEQ ID NO: 1752052 - RNA, 13 nt, Homo sapiens
ggccaagucacag

SEQ ID NO: 1752053 - RNA, 17 nt, Homo sapiens
agacuauugugccuuag

SEQ ID NO: 1752054 - RNA, 15 nt, Homo sapiens
cugccagcucucuga

SEQ ID NO: 1752055 - RNA, 15 nt, Homo sapiens
cuggcuucagccucc

SEQ ID NO: 1752056 - RNA, 22 nt, Homo sapiens
cuuuuaauguauuuguuugcaa

SEQ ID NO: 1752057 - RNA, 16 nt, Homo sapiens
agcuacuucccagcua

SEQ ID NO: 1752058 - RNA, 23 nt, Homo sapiens
agcaaggucauuucuucagucag

SEQ ID NO: 1752059 - RNA, 18 nt, Homo sapiens
aacagagaugccaugaua

SEQ ID NO: 1752060 - RNA, 18 nt, Homo sapiens
auccaagaaucagugaag

SEQ ID NO: 1752061 - RNA, 22 nt, Homo sapiens
ucauacccaccaggaugugugc

SEQ ID NO: 1752062 - RNA, 12 nt, Homo sapiens
caacugaaggcu

SEQ ID NO: 1752063 - RNA, 23 nt, Homo sapiens
aauuauauuccucuugcauuuca

SEQ ID NO: 1752064 - RNA, 13 nt, Homo sapiens
auugggcaccuga

SEQ ID NO: 1752065 - RNA, 17 nt, Homo sapiens
uaaacacuucuccuuaa

SEQ ID NO: 1752066 - RNA, 21 nt, Homo sapiens
caaagaugagaagccaaagcc

SEQ ID NO: 1752067 - RNA, 14 nt, Homo sapiens
aauauucuguacau

SEQ ID NO: 1752068 - RNA, 14 nt, Homo sapiens
aaaaugcuguucag

SEQ ID NO: 1752069 - RNA, 22 nt, Homo sapiens
aucuccuaaaagugguuuuuau

SEQ ID NO: 1752070 - RNA, 19 nt, Homo sapiens
cuuuauauggccucaagau

SEQ ID NO: 1752071 - RNA, 15 nt, Homo sapiens
aaagaaucugauacu

SEQ ID NO: 1752072 - RNA, 13 nt, Homo sapiens
agcagugcacauc

SEQ ID NO: 1752073 - RNA, 14 nt, Homo sapiens
agcuuuucuugaua

SEQ ID NO: 1752074 - RNA, 13 nt, Homo sapiens
aggcugcuccuuc

SEQ ID NO: 1752075 - RNA, 17 nt, Homo sapiens
aaagaaggaagugaaga

SEQ ID NO: 1752076 - RNA, 21 nt, Homo sapiens
uuuaaacuucaggccagaacc

SEQ ID NO: 1752077 - RNA, 12 nt, Homo sapiens
uuccccucugcu

SEQ ID NO: 1752078 - RNA, 16 nt, Homo sapiens
aaagguggugccaauu

SEQ ID NO: 1752079 - RNA, 20 nt, Homo sapiens
cgaugggaacacaagugccc

SEQ ID NO: 1752080 - RNA, 21 nt, Homo sapiens
ucccauucgggagaucauguc

SEQ ID NO: 1752081 - RNA, 15 nt, Homo sapiens
gcaggcucagacucu

SEQ ID NO: 1752082 - RNA, 23 nt, Homo sapiens
gucuuccuuagcuaaaugcaauu

SEQ ID NO: 1752083 - RNA, 17 nt, Homo sapiens
uccuucuuggaguuaca

SEQ ID NO: 1752084 - RNA, 12 nt, Homo sapiens
uuacauugccau

SEQ ID NO: 1752085 - RNA, 20 nt, Homo sapiens
acuucucuaacaucuagccc

SEQ ID NO: 1752086 - RNA, 13 nt, Homo sapiens
augcauguugccc

SEQ ID NO: 1752087 - RNA, 18 nt, Homo sapiens
auccauuccaaaauacaa

SEQ ID NO: 1752088 - RNA, 16 nt, Homo sapiens
augaaauugcugaaag

SEQ ID NO: 1752089 - RNA, 22 nt, Homo sapiens
guguuguacaauaccagaucac

SEQ ID NO: 1752090 - RNA, 15 nt, Homo sapiens
ccauguuauucucuc

SEQ ID NO: 1752091 - RNA, 20 nt, Homo sapiens
ucccccagucauucugggaa

SEQ ID NO: 1752092 - RNA, 23 nt, Homo sapiens
cgguggccugggauuggcuguga

SEQ ID NO: 1752093 - RNA, 20 nt, Homo sapiens
uucagguauaccucacuuua

SEQ ID NO: 1752094 - RNA, 15 nt, Homo sapiens
ccucaauucaucaau

SEQ ID NO: 1752095 - RNA, 15 nt, Homo sapiens
caagggcuccagggc

SEQ ID NO: 1752096 - RNA, 15 nt, Homo sapiens
aauuaaguacuuaag

SEQ ID NO: 1752097 - RNA, 15 nt, Homo sapiens
gacaaagugccaaag

SEQ ID NO: 1752098 - RNA, 19 nt, Homo sapiens
uguuuugaccccuuacaca

SEQ ID NO: 1752099 - RNA, 13 nt, Homo sapiens
auaucuuugcacu

SEQ ID NO: 1752100 - RNA, 16 nt, Homo sapiens
cugugccgccaccucu

SEQ ID NO: 1752101 - RNA, 18 nt, Homo sapiens
caucugucuucagcacau

SEQ ID NO: 1752102 - RNA, 13 nt, Homo sapiens
acaaggaagccaa

SEQ ID NO: 1752103 - RNA, 21 nt, Homo sapiens
gagagaggaaggagauuccac

SEQ ID NO: 1752104 - RNA, 23 nt, Homo sapiens
ugcaccuugccagggagguggaa

SEQ ID NO: 1752105 - RNA, 16 nt, Homo sapiens
guaaccaaauguuggc

SEQ ID NO: 1752106 - RNA, 15 nt, Homo sapiens
ugaaguaugccuuga

SEQ ID NO: 1752107 - RNA, 19 nt, Homo sapiens
aaaauuuuuuaaauucaua

SEQ ID NO: 1752108 - RNA, 23 nt, Homo sapiens
cuaucacugcauuaucuugcuca

SEQ ID NO: 1752109 - RNA, 16 nt, Homo sapiens
aguggcugcucuggga

SEQ ID NO: 1752110 - RNA, 20 nt, Homo sapiens
aaucugccgcuuugucuguc

SEQ ID NO: 1752111 - RNA, 14 nt, Homo sapiens
augauggugcugac

SEQ ID NO: 1752112 - RNA, 13 nt, Homo sapiens
uaauuuuugcaau

SEQ ID NO: 1752113 - RNA, 13 nt, Homo sapiens
gcugcucucaggc

SEQ ID NO: 1752114 - RNA, 14 nt, Homo sapiens
aaaguagcuuccuc

SEQ ID NO: 1752115 - RNA, 17 nt, Homo sapiens
uaggcgcuguucuugcu

SEQ ID NO: 1752116 - RNA, 12 nt, Homo sapiens
agccugcugauu

SEQ ID NO: 1752117 - RNA, 15 nt, Homo sapiens
ccagcucauucauuu

SEQ ID NO: 1752118 - RNA, 16 nt, Homo sapiens
ugacuuaagugugcaa

SEQ ID NO: 1752119 - RNA, 22 nt, Homo sapiens
auggggcgaucaaguccagagc

SEQ ID NO: 1752120 - RNA, 17 nt, Homo sapiens
uuaagggcucagcauaa

SEQ ID NO: 1752121 - RNA, 15 nt, Homo sapiens
gggacacaggggcaa

SEQ ID NO: 1752122 - RNA, 13 nt, Homo sapiens
ccuuaaaagccau

SEQ ID NO: 1752123 - RNA, 13 nt, Homo sapiens
cuuuaaaagucau

SEQ ID NO: 1752124 - RNA, 16 nt, Homo sapiens
aauuagaaauaucuuc

SEQ ID NO: 1752125 - RNA, 22 nt, Homo sapiens
acuucuuuaguacuuacaucag

SEQ ID NO: 1752126 - RNA, 12 nt, Homo sapiens
uugaagccucag

SEQ ID NO: 1752127 - RNA, 21 nt, Homo sapiens
cuguguaccucauggaugcuu

SEQ ID NO: 1752128 - RNA, 13 nt, Homo sapiens
uuauuuugacaaa

SEQ ID NO: 1752129 - RNA, 23 nt, Homo sapiens
ugauggauuaguauuauaccuga

SEQ ID NO: 1752130 - RNA, 15 nt, Homo sapiens
ugaccaucugugacu

SEQ ID NO: 1752131 - RNA, 18 nt, Homo sapiens
ugauuugacccacucaca

SEQ ID NO: 1752132 - RNA, 17 nt, Homo sapiens
gccuguuacacaugaca

SEQ ID NO: 1752133 - RNA, 15 nt, Homo sapiens
aaaguuuugaugaaa

SEQ ID NO: 1752134 - RNA, 14 nt, Homo sapiens
agagcagugcacau

SEQ ID NO: 1752135 - RNA, 20 nt, Homo sapiens
gauuuugucugcccaaucca

SEQ ID NO: 1752136 - RNA, 22 nt, Homo sapiens
cugaggcagguggauugcuuga

SEQ ID NO: 1752137 - RNA, 16 nt, Homo sapiens
agcucauuugugacaa

SEQ ID NO: 1752138 - RNA, 15 nt, Homo sapiens
caucacaucugcaca

SEQ ID NO: 1752139 - RNA, 18 nt, Homo sapiens
cuucuuuagaugccaaac

SEQ ID NO: 1752140 - RNA, 15 nt, Homo sapiens
auagcuaaauggcaa

SEQ ID NO: 1752141 - RNA, 19 nt, Homo sapiens
cagacuauaaaaucuggau

SEQ ID NO: 1752142 - RNA, 22 nt, Homo sapiens
caccagaugccauuacauuuau

SEQ ID NO: 1752143 - RNA, 19 nt, Homo sapiens
cuucuguugaucucaguau

SEQ ID NO: 1752144 - RNA, 15 nt, Homo sapiens
cagccaugccagcug

SEQ ID NO: 1752145 - RNA, 20 nt, Homo sapiens
caguggcgugaucucagcuc

SEQ ID NO: 1752146 - RNA, 16 nt, Homo sapiens
gacagugaacauucug

SEQ ID NO: 1752147 - RNA, 13 nt, Homo sapiens
ugaaaugcuucca

SEQ ID NO: 1752148 - RNA, 14 nt, Homo sapiens
gccugggacccagc

SEQ ID NO: 1752149 - RNA, 13 nt, Homo sapiens
agcugcucuugca

SEQ ID NO: 1752150 - RNA, 23 nt, Homo sapiens
aauaacuuagcuugcacaugaau

SEQ ID NO: 1752151 - RNA, 19 nt, Homo sapiens
acauuagauugaugugcac

SEQ ID NO: 1752152 - RNA, 21 nt, Homo sapiens
aauguggaaaacauccugacu

SEQ ID NO: 1752153 - RNA, 23 nt, Homo sapiens
gucaagaagaaaaagguuugcau

SEQ ID NO: 1752154 - RNA, 18 nt, Homo sapiens
aaaccaccuaguucuccc

SEQ ID NO: 1752155 - RNA, 20 nt, Homo sapiens
uaaaacaacacucacauuua

SEQ ID NO: 1752156 - RNA, 22 nt, Homo sapiens
cuggagcccccagcagaggcag

SEQ ID NO: 1752157 - RNA, 23 nt, Homo sapiens
uuucucuuuacuugaaauuuggc

SEQ ID NO: 1752158 - RNA, 21 nt, Homo sapiens
ucccacagcgcuggccgggac

SEQ ID NO: 1752159 - RNA, 14 nt, Homo sapiens
ugcuggaucuugcc

SEQ ID NO: 1752160 - RNA, 21 nt, Homo sapiens
gaaagcguuucuguguagaaa

SEQ ID NO: 1752161 - RNA, 20 nt, Homo sapiens
acucaaguaccaccaaggga

SEQ ID NO: 1752162 - RNA, 18 nt, Homo sapiens
agaccaagcugugcccug

SEQ ID NO: 1752163 - RNA, 14 nt, Homo sapiens
acagauucuuucag

SEQ ID NO: 1752164 - RNA, 19 nt, Homo sapiens
uuagagcccauuaaucuug

SEQ ID NO: 1752165 - RNA, 19 nt, Homo sapiens
ugaugaaguuguacaacac

SEQ ID NO: 1752166 - RNA, 20 nt, Homo sapiens
caugugugcgagugugugca

SEQ ID NO: 1752167 - RNA, 22 nt, Homo sapiens
aggauucccuucugggcuucau

SEQ ID NO: 1752168 - RNA, 23 nt, Homo sapiens
ccagcccgggcuggcccaaggag

SEQ ID NO: 1752169 - RNA, 22 nt, Homo sapiens
acuccuaaauaaacuaguauga

SEQ ID NO: 1752170 - RNA, 12 nt, Homo sapiens
accaugcaaugc

SEQ ID NO: 1752171 - RNA, 12 nt, Homo sapiens
ccccugcacuga

SEQ ID NO: 1752172 - RNA, 23 nt, Homo sapiens
ugaugauguguuuaaacugagua

SEQ ID NO: 1752173 - RNA, 14 nt, Homo sapiens
ggcucacugcagcc

SEQ ID NO: 1752174 - RNA, 23 nt, Homo sapiens
uacaagaguggagagaagcucuu

SEQ ID NO: 1752175 - RNA, 12 nt, Homo sapiens
aaugacaauauc

SEQ ID NO: 1752176 - RNA, 15 nt, Homo sapiens
uuccaaaacuuuaau

SEQ ID NO: 1752177 - RNA, 14 nt, Homo sapiens
cgccagacuuccca

SEQ ID NO: 1752178 - RNA, 21 nt, Homo sapiens
aauaacaucucuuucaucuag

SEQ ID NO: 1752179 - RNA, 23 nt, Homo sapiens
ucaaauuaauguuccaguuugaa

SEQ ID NO: 1752180 - RNA, 16 nt, Homo sapiens
gugaaaggucaucuca

SEQ ID NO: 1752181 - RNA, 17 nt, Homo sapiens
gaggcugugcacagacu

SEQ ID NO: 1752182 - RNA, 20 nt, Homo sapiens
cccuccccaaagccacugga

SEQ ID NO: 1752183 - RNA, 16 nt, Homo sapiens
auguugaucugcauau

SEQ ID NO: 1752184 - RNA, 19 nt, Homo sapiens
agaucuccaacagccagug

SEQ ID NO: 1752185 - RNA, 23 nt, Homo sapiens
aggcauguacaaaaauuaugcaa

SEQ ID NO: 1752186 - RNA, 18 nt, Homo sapiens
gccguguuguagcuaauu

SEQ ID NO: 1752187 - RNA, 20 nt, Homo sapiens
uguauguaauacauauagca

SEQ ID NO: 1752188 - RNA, 23 nt, Homo sapiens
ggacuaaguucucauuguucaaa

SEQ ID NO: 1752189 - RNA, 14 nt, Homo sapiens
gcagcacaccucag

SEQ ID NO: 1752190 - RNA, 17 nt, Homo sapiens
cauucuaagucacagga

SEQ ID NO: 1752191 - RNA, 15 nt, Homo sapiens
gccugcaggaucuca

SEQ ID NO: 1752192 - RNA, 18 nt, Homo sapiens
gaagauggccaugcccuc

SEQ ID NO: 1752193 - RNA, 20 nt, Homo sapiens
aggggaauaaacuguugagu

SEQ ID NO: 1752194 - RNA, 22 nt, Homo sapiens
aaccucccacccugcaaaggga

SEQ ID NO: 1752195 - RNA, 13 nt, Homo sapiens
cgcggagguccug

SEQ ID NO: 1752196 - RNA, 17 nt, Homo sapiens
uuccccugugucauccc

SEQ ID NO: 1752197 - RNA, 17 nt, Homo sapiens
uccacagaagugagcuc

SEQ ID NO: 1752198 - RNA, 12 nt, Homo sapiens
ucucugugaaag

SEQ ID NO: 1752199 - RNA, 21 nt, Homo sapiens
cacggccuguacggacacugu

SEQ ID NO: 1752200 - RNA, 15 nt, Homo sapiens
agugguauccuguga

SEQ ID NO: 1752201 - RNA, 16 nt, Homo sapiens
uagugacaugcaguua

SEQ ID NO: 1752202 - RNA, 13 nt, Homo sapiens
uuaauuaagcaaa

SEQ ID NO: 1752203 - RNA, 14 nt, Homo sapiens
auaaacugcuuugc

SEQ ID NO: 1752204 - RNA, 15 nt, Homo sapiens
ucuuaggaggcauuu

SEQ ID NO: 1752205 - RNA, 13 nt, Homo sapiens
auuccaaaccaac

SEQ ID NO: 1752206 - RNA, 23 nt, Homo sapiens
uuaaaacacauuauguaucuuag

SEQ ID NO: 1752207 - RNA, 13 nt, Homo sapiens
cuucuaaaacaau

SEQ ID NO: 1752208 - RNA, 19 nt, Homo sapiens
cgugagauccggcagcaca

SEQ ID NO: 1752209 - RNA, 16 nt, Homo sapiens
auccuuacuauccuau

SEQ ID NO: 1752210 - RNA, 13 nt, Homo sapiens
uucuuuugacuga

SEQ ID NO: 1752211 - RNA, 19 nt, Homo sapiens
aagugacccagcucuucuc

SEQ ID NO: 1752212 - RNA, 21 nt, Homo sapiens
ucucuggcaaucuugcccuua

SEQ ID NO: 1752213 - RNA, 21 nt, Homo sapiens
cugaaaguugucacccuggaa

SEQ ID NO: 1752214 - RNA, 21 nt, Homo sapiens
uugaagaucccuauuauggga

SEQ ID NO: 1752215 - RNA, 14 nt, Homo sapiens
caaccucugagcca

SEQ ID NO: 1752216 - RNA, 17 nt, Homo sapiens
ccaagaguagcaccuuc

SEQ ID NO: 1752217 - RNA, 14 nt, Homo sapiens
acauaauucauuaa

SEQ ID NO: 1752218 - RNA, 14 nt, Homo sapiens
uuaccuaaacugag

SEQ ID NO: 1752219 - RNA, 17 nt, Homo sapiens
cuuugccauccuugcac

SEQ ID NO: 1752220 - RNA, 15 nt, Homo sapiens
gugguuauuuugccg

SEQ ID NO: 1752221 - RNA, 17 nt, Homo sapiens
cagaaagacccugaugc

SEQ ID NO: 1752222 - RNA, 18 nt, Homo sapiens
caaaaggagaacugugcu

SEQ ID NO: 1752223 - RNA, 21 nt, Homo sapiens
uguguuaggacagcauauaaa

SEQ ID NO: 1752224 - RNA, 13 nt, Homo sapiens
gugagauguaauu

SEQ ID NO: 1752225 - RNA, 21 nt, Homo sapiens
cuguuuuguaagugcugcuau

SEQ ID NO: 1752226 - RNA, 21 nt, Homo sapiens
ucccacacuccuauggucaca

SEQ ID NO: 1752227 - RNA, 10 nt, Homo sapiens
ccuaucucau

SEQ ID NO: 1752228 - RNA, 18 nt, Homo sapiens
acccacugcccauggcau

SEQ ID NO: 1752229 - RNA, 18 nt, Homo sapiens
agauauggacacacggga

SEQ ID NO: 1752230 - RNA, 16 nt, Homo sapiens
accaugggaugaugau

SEQ ID NO: 1752231 - RNA, 17 nt, Homo sapiens
auguuccauccuguaca

SEQ ID NO: 1752232 - RNA, 18 nt, Homo sapiens
ccagaucuaacaucuuga

SEQ ID NO: 1752233 - RNA, 15 nt, Homo sapiens
auaauucuacaggau

SEQ ID NO: 1752234 - RNA, 20 nt, Homo sapiens
cgagaucgcgccacugcacu

SEQ ID NO: 1752235 - RNA, 20 nt, Homo sapiens
caagaucgcaccacugcacu

SEQ ID NO: 1752236 - RNA, 22 nt, Homo sapiens
agcagagugaaauucaauucau

SEQ ID NO: 1752237 - RNA, 13 nt, Homo sapiens
ugaccacccugcc

SEQ ID NO: 1752238 - RNA, 21 nt, Homo sapiens
cugccucugggcagccugcuu

SEQ ID NO: 1752239 - RNA, 22 nt, Homo sapiens
ugucacuacucacagucucuuu

SEQ ID NO: 1752240 - RNA, 16 nt, Homo sapiens
ucuuggcccgcacaga

SEQ ID NO: 1752241 - RNA, 18 nt, Homo sapiens
cccuguugcuuuucacaa

SEQ ID NO: 1752242 - RNA, 13 nt, Homo sapiens
gccuccucagggg

SEQ ID NO: 1752243 - RNA, 16 nt, Homo sapiens
uacacacucagugaca

SEQ ID NO: 1752244 - RNA, 16 nt, Homo sapiens
aguuaggcagugcagu

SEQ ID NO: 1752245 - RNA, 16 nt, Homo sapiens
uguauaccaaggcaaa

SEQ ID NO: 1752246 - RNA, 22 nt, Homo sapiens
aaaagagaaugaugcugugcau

SEQ ID NO: 1752247 - RNA, 13 nt, Homo sapiens
cucggugaccucc

SEQ ID NO: 1752248 - RNA, 17 nt, Homo sapiens
acaauugcaguuuugcc

SEQ ID NO: 1752249 - RNA, 12 nt, Homo sapiens
ugaauugcaaac

SEQ ID NO: 1752250 - RNA, 12 nt, Homo sapiens
aacauugcugcc

SEQ ID NO: 1752251 - RNA, 12 nt, Homo sapiens
aguuaaggguua

SEQ ID NO: 1752252 - RNA, 14 nt, Homo sapiens
uggggcuggcugca

SEQ ID NO: 1752253 - RNA, 13 nt, Homo sapiens
aaucauuaucuca

SEQ ID NO: 1752254 - RNA, 16 nt, Homo sapiens
gagaaccaacaaguaa

SEQ ID NO: 1752255 - RNA, 14 nt, Homo sapiens
caacaaaucucagu

SEQ ID NO: 1752256 - RNA, 18 nt, Homo sapiens
aacucaaauggggccaga

SEQ ID NO: 1752257 - RNA, 18 nt, Homo sapiens
gacagggucucacugugu

SEQ ID NO: 1752258 - RNA, 23 nt, Homo sapiens
aauccaacuuuuaauuaccagag

SEQ ID NO: 1752259 - RNA, 12 nt, Homo sapiens
gcauaugcaaua

SEQ ID NO: 1752260 - RNA, 22 nt, Homo sapiens
uucaagaaagauaucuaugacu

SEQ ID NO: 1752261 - RNA, 21 nt, Homo sapiens
acugcgugccaguguccccac

SEQ ID NO: 1752262 - RNA, 22 nt, Homo sapiens
aauugaaugggggaggcccaau

SEQ ID NO: 1752263 - RNA, 20 nt, Homo sapiens
aagcucuggugacaccagcc

SEQ ID NO: 1752264 - RNA, 15 nt, Homo sapiens
cagaguggggagcuc

SEQ ID NO: 1752265 - RNA, 15 nt, Homo sapiens
gcgcuauccacagaa

SEQ ID NO: 1752266 - RNA, 21 nt, Homo sapiens
gccaagagccgacaaugcccu

SEQ ID NO: 1752267 - RNA, 22 nt, Homo sapiens
caugcugugugacucaaaccaa

SEQ ID NO: 1752268 - RNA, 20 nt, Homo sapiens
cucauggcaucauccauucu

SEQ ID NO: 1752269 - RNA, 22 nt, Homo sapiens
uacagauuuuaccuauccacaa

SEQ ID NO: 1752270 - RNA, 22 nt, Homo sapiens
gcuugacaaaggagcauugcag

SEQ ID NO: 1752271 - RNA, 13 nt, Homo sapiens
uuauuauugcugu

SEQ ID NO: 1752272 - RNA, 22 nt, Homo sapiens
uuucccccuucccgccuuccaa

SEQ ID NO: 1752273 - RNA, 15 nt, Homo sapiens
caugauccaagcaag

SEQ ID NO: 1752274 - RNA, 16 nt, Homo sapiens
uuaaauaaagucucuc

SEQ ID NO: 1752275 - RNA, 16 nt, Homo sapiens
aaaggugaaaaaagcu

SEQ ID NO: 1752276 - RNA, 20 nt, Homo sapiens
acuuaagccaauuucaaucu

SEQ ID NO: 1752277 - RNA, 16 nt, Homo sapiens
auuuaaaaagugcuau

SEQ ID NO: 1752278 - RNA, 10 nt, Homo sapiens
uggcaucugu

SEQ ID NO: 1752279 - RNA, 17 nt, Homo sapiens
uguacugagacauuaca

SEQ ID NO: 1752280 - RNA, 14 nt, Homo sapiens
gucuucuaguuuag

SEQ ID NO: 1752281 - RNA, 18 nt, Homo sapiens
acucugucacccuagcua

SEQ ID NO: 1752282 - RNA, 20 nt, Homo sapiens
cacagaggcauagaauacac

SEQ ID NO: 1752283 - RNA, 11 nt, Homo sapiens
ucaaagggaac

SEQ ID NO: 1752284 - RNA, 13 nt, Homo sapiens
caggcaugcaugu

SEQ ID NO: 1752285 - RNA, 13 nt, Homo sapiens
cugucaugcuuuu

SEQ ID NO: 1752286 - RNA, 17 nt, Homo sapiens
ccauuauaaacauguuu

SEQ ID NO: 1752287 - RNA, 16 nt, Homo sapiens
cuggcccacugagcca

SEQ ID NO: 1752288 - RNA, 19 nt, Homo sapiens
gauaaaucauuucaguauc

SEQ ID NO: 1752289 - RNA, 21 nt, Homo sapiens
cagucgaugcguucacuccaa

SEQ ID NO: 1752290 - RNA, 21 nt, Homo sapiens
uagacuguuucacauugcacu

SEQ ID NO: 1752291 - RNA, 21 nt, Homo sapiens
accuggagcccacagagucug

SEQ ID NO: 1752292 - RNA, 17 nt, Homo sapiens
cauuacugcauaaaaua

SEQ ID NO: 1752293 - RNA, 17 nt, Homo sapiens
cuugaccguacucucac

SEQ ID NO: 1752294 - RNA, 14 nt, Homo sapiens
agaccccagacuca

SEQ ID NO: 1752295 - RNA, 12 nt, Homo sapiens
cugcugcugcua

SEQ ID NO: 1752296 - RNA, 19 nt, Homo sapiens
aucaccaccgccucuggcc

SEQ ID NO: 1752297 - RNA, 17 nt, Homo sapiens
ugccccuggaccaguac

SEQ ID NO: 1752298 - RNA, 19 nt, Homo sapiens
ccucugucaacaucaaaga

SEQ ID NO: 1752299 - RNA, 17 nt, Homo sapiens
aauucuggaaaugucuu

SEQ ID NO: 1752300 - RNA, 16 nt, Homo sapiens
uuccaaugaagccaua

SEQ ID NO: 1752301 - RNA, 22 nt, Homo sapiens
ugcuaagcaagcuaaccuuauc

SEQ ID NO: 1752302 - RNA, 23 nt, Homo sapiens
ugcuuacuaagcuuugccagcug

SEQ ID NO: 1752303 - RNA, 24 nt, Homo sapiens
cagcauagggucacuuugccauua

SEQ ID NO: 1752304 - RNA, 17 nt, Homo sapiens
gcucauagggaagaccu

SEQ ID NO: 1752305 - RNA, 16 nt, Homo sapiens
gaagacaucaggaaac

SEQ ID NO: 1752306 - RNA, 14 nt, Homo sapiens
auauaguccagaca

SEQ ID NO: 1752307 - RNA, 14 nt, Homo sapiens
ucagaugauucuau

SEQ ID NO: 1752308 - RNA, 20 nt, Homo sapiens
cuucacacuaucaacacugc

SEQ ID NO: 1752309 - RNA, 13 nt, Homo sapiens
aaaguuugcucaa

SEQ ID NO: 1752310 - RNA, 13 nt, Homo sapiens
caagauugaucau

SEQ ID NO: 1752311 - RNA, 14 nt, Homo sapiens
gcugcuccaugagg

SEQ ID NO: 1752312 - RNA, 22 nt, Homo sapiens
cauuaccaagaaacaguagcca

SEQ ID NO: 1752313 - RNA, 21 nt, Homo sapiens
uuuaagaaagcuucuugugau

SEQ ID NO: 1752314 - RNA, 23 nt, Homo sapiens
uuugagugugugugugcaugugu

SEQ ID NO: 1752315 - RNA, 15 nt, Homo sapiens
uguuuggacuuuuau

SEQ ID NO: 1752316 - RNA, 16 nt, Homo sapiens
auugcaucauuuacaa

SEQ ID NO: 1752317 - RNA, 24 nt, Homo sapiens
auguaaggucuucuuguguccuga

SEQ ID NO: 1752318 - RNA, 15 nt, Homo sapiens
cagguggaggcaaca

SEQ ID NO: 1752319 - RNA, 18 nt, Homo sapiens
uagacucuccacuguuac

SEQ ID NO: 1752320 - RNA, 13 nt, Homo sapiens
uaaaccuccgcca

SEQ ID NO: 1752321 - RNA, 19 nt, Homo sapiens
cagguaguauuacaccacc

SEQ ID NO: 1752322 - RNA, 19 nt, Homo sapiens
ugcuuuaaaguaccuguag

SEQ ID NO: 1752323 - RNA, 14 nt, Homo sapiens
gcucaaccuuccaa

SEQ ID NO: 1752324 - RNA, 14 nt, Homo sapiens
acaauauacuucac

SEQ ID NO: 1752325 - RNA, 15 nt, Homo sapiens
gccaucaucucugua

SEQ ID NO: 1752326 - RNA, 15 nt, Homo sapiens
agaaaaagaucuuuc

SEQ ID NO: 1752327 - RNA, 22 nt, Homo sapiens
cuguguguuaagcucugcuauu

SEQ ID NO: 1752328 - RNA, 19 nt, Homo sapiens
aauuuauuauacaccuuag

SEQ ID NO: 1752329 - RNA, 17 nt, Homo sapiens
uggaagaggcaccuguc

SEQ ID NO: 1752330 - RNA, 13 nt, Homo sapiens
aagucugaaguca

SEQ ID NO: 1752331 - RNA, 17 nt, Homo sapiens
aaacauuuuacagauuu

SEQ ID NO: 1752332 - RNA, 18 nt, Homo sapiens
auuucaugaagcaagaau

SEQ ID NO: 1752333 - RNA, 18 nt, Homo sapiens
uguccauugacauguaca

SEQ ID NO: 1752334 - RNA, 17 nt, Homo sapiens
auaacuuauuagcaguc

SEQ ID NO: 1752335 - RNA, 16 nt, Homo sapiens
auguuauuuccugaga

SEQ ID NO: 1752336 - RNA, 22 nt, Homo sapiens
guguccccacggucauccagug

SEQ ID NO: 1752337 - RNA, 22 nt, Homo sapiens
uuuagguaguagaaucucagca

SEQ ID NO: 1752338 - RNA, 17 nt, Homo sapiens
agcuauuuuaaaccaau

SEQ ID NO: 1752339 - RNA, 14 nt, Homo sapiens
aguaaguaauauca

SEQ ID NO: 1752340 - RNA, 14 nt, Homo sapiens
ugacacccagucau

SEQ ID NO: 1752341 - RNA, 14 nt, Homo sapiens
gccaacaacuucuc

SEQ ID NO: 1752342 - RNA, 14 nt, Homo sapiens
cuucauaagccauu

SEQ ID NO: 1752343 - RNA, 15 nt, Homo sapiens
cagcagcacuguucu

SEQ ID NO: 1752344 - RNA, 16 nt, Homo sapiens
aguacuacugcucuca

SEQ ID NO: 1752345 - RNA, 18 nt, Homo sapiens
ccaaacgcuuauugugua

SEQ ID NO: 1752346 - RNA, 21 nt, Homo sapiens
uuuccucgccuaggccuguga

SEQ ID NO: 1752347 - RNA, 20 nt, Homo sapiens
caagcuuggcuguagaagga

SEQ ID NO: 1752348 - RNA, 16 nt, Homo sapiens
gugauauucuaagacu

SEQ ID NO: 1752349 - RNA, 20 nt, Homo sapiens
agccacugcggaguccaggc

SEQ ID NO: 1752350 - RNA, 17 nt, Homo sapiens
uacuucauggacuucca

SEQ ID NO: 1752351 - RNA, 17 nt, Homo sapiens
uuaucaguacaauucuu

SEQ ID NO: 1752352 - RNA, 19 nt, Homo sapiens
augaagcacaucaauuaca

SEQ ID NO: 1752353 - RNA, 18 nt, Homo sapiens
auaaaccuguucuuccuu

SEQ ID NO: 1752354 - RNA, 20 nt, Homo sapiens
ccuccugcccagcacaggaa

SEQ ID NO: 1752355 - RNA, 15 nt, Homo sapiens
ggcacauagugaaag

SEQ ID NO: 1752356 - RNA, 11 nt, Homo sapiens
agauacaugau

SEQ ID NO: 1752357 - RNA, 18 nt, Homo sapiens
uaaauugggaaaacucca

SEQ ID NO: 1752358 - RNA, 14 nt, Homo sapiens
gaugcuuaggugaa

SEQ ID NO: 1752359 - RNA, 14 nt, Homo sapiens
aggaauuaaagaca

SEQ ID NO: 1752360 - RNA, 14 nt, Homo sapiens
gagugugugcaagu

SEQ ID NO: 1752361 - RNA, 19 nt, Homo sapiens
acgcaacaagaaacucaau

SEQ ID NO: 1752362 - RNA, 13 nt, Homo sapiens
ucguggccuuccc

SEQ ID NO: 1752363 - RNA, 23 nt, Homo sapiens
acugugaaccaacccccaucucc

SEQ ID NO: 1752364 - RNA, 16 nt, Homo sapiens
agugguaugaccagug

SEQ ID NO: 1752365 - RNA, 23 nt, Homo sapiens
aauacuuagacaguaugcauacu

SEQ ID NO: 1752366 - RNA, 21 nt, Homo sapiens
acugucuugaagacaauggcu

SEQ ID NO: 1752367 - RNA, 16 nt, Homo sapiens
augcagcuacuggaau

SEQ ID NO: 1752368 - RNA, 22 nt, Homo sapiens
aaagaucucagcagccagcucc

SEQ ID NO: 1752369 - RNA, 22 nt, Homo sapiens
uuuguuacagccaagugccaaa

SEQ ID NO: 1752370 - RNA, 12 nt, Homo sapiens
ccgugaacacaa

SEQ ID NO: 1752371 - RNA, 16 nt, Homo sapiens
gccuuucccccuguga

SEQ ID NO: 1752372 - RNA, 15 nt, Homo sapiens
cacauguaacauaga

SEQ ID NO: 1752373 - RNA, 20 nt, Homo sapiens
cgagggcaaagcggccucau

SEQ ID NO: 1752374 - RNA, 13 nt, Homo sapiens
ccagcaagcaaac

SEQ ID NO: 1752375 - RNA, 21 nt, Homo sapiens
aaagaaugcauguucugugug

SEQ ID NO: 1752376 - RNA, 14 nt, Homo sapiens
aucugugcagucau

SEQ ID NO: 1752377 - RNA, 18 nt, Homo sapiens
ugucuacggaagccucug

SEQ ID NO: 1752378 - RNA, 17 nt, Homo sapiens
gccuccugagggcucca

SEQ ID NO: 1752379 - RNA, 13 nt, Homo sapiens
auauuuaagcaau

SEQ ID NO: 1752380 - RNA, 21 nt, Homo sapiens
auacagaaagaagcaguucuc

SEQ ID NO: 1752381 - RNA, 19 nt, Homo sapiens
uuugucugcccaauccauc

SEQ ID NO: 1752382 - RNA, 22 nt, Homo sapiens
aaaaaugcccauuuuugcuaau

SEQ ID NO: 1752383 - RNA, 21 nt, Homo sapiens
gcauuauaaaauaaaaggauu

SEQ ID NO: 1752384 - RNA, 14 nt, Homo sapiens
auuuuauucaaggu

SEQ ID NO: 1752385 - RNA, 18 nt, Homo sapiens
augaaugguuucaacaaa

SEQ ID NO: 1752386 - RNA, 22 nt, Homo sapiens
ucauguggggugggaaccuggg

SEQ ID NO: 1752387 - RNA, 18 nt, Homo sapiens
cuuuugcaauucagggaa

SEQ ID NO: 1752388 - RNA, 16 nt, Homo sapiens
augcaacagaagugac

SEQ ID NO: 1752389 - RNA, 14 nt, Homo sapiens
ugacauagccuuug

SEQ ID NO: 1752390 - RNA, 21 nt, Homo sapiens
caaagcagagugaaauucaau

SEQ ID NO: 1752391 - RNA, 15 nt, Homo sapiens
uggcuacugugccuu

SEQ ID NO: 1752392 - RNA, 11 nt, Homo sapiens
uuccauucaac

SEQ ID NO: 1752393 - RNA, 18 nt, Homo sapiens
gcccuggcccaggugccc

SEQ ID NO: 1752394 - RNA, 15 nt, Homo sapiens
aaagccuauucacuu

SEQ ID NO: 1752395 - RNA, 14 nt, Homo sapiens
agggccacucgggg

SEQ ID NO: 1752396 - RNA, 14 nt, Homo sapiens
ucagggacagagcc

SEQ ID NO: 1752397 - RNA, 22 nt, Homo sapiens
acccacaaucccaccuagccca

SEQ ID NO: 1752398 - RNA, 13 nt, Homo sapiens
uauugugcauaga

SEQ ID NO: 1752399 - RNA, 14 nt, Homo sapiens
uggaacacaaccau

SEQ ID NO: 1752400 - RNA, 21 nt, Homo sapiens
ucagaggacaccuguacugga

SEQ ID NO: 1752401 - RNA, 22 nt, Homo sapiens
agcagcaugauuauaagccaaa

SEQ ID NO: 1752402 - RNA, 14 nt, Homo sapiens
uuguuuuuacugua

SEQ ID NO: 1752403 - RNA, 19 nt, Homo sapiens
ugucauuaauauauccuaa

SEQ ID NO: 1752404 - RNA, 22 nt, Homo sapiens
ggguaggaaagaggaagcaaau

SEQ ID NO: 1752405 - RNA, 14 nt, Homo sapiens
uacagaagugaaag

SEQ ID NO: 1752406 - RNA, 17 nt, Homo sapiens
cugguuuccugccucca

SEQ ID NO: 1752407 - RNA, 13 nt, Homo sapiens
ccauuucuacucu

SEQ ID NO: 1752408 - RNA, 14 nt, Homo sapiens
uuuacauucaucaa

SEQ ID NO: 1752409 - RNA, 13 nt, Homo sapiens
ggacccugaccag

SEQ ID NO: 1752410 - RNA, 22 nt, Homo sapiens
cauugcuguuguccaacuauuu

SEQ ID NO: 1752411 - RNA, 23 nt, Homo sapiens
cucaaggggcuggaaucucauga

SEQ ID NO: 1752412 - RNA, 14 nt, Homo sapiens
uaugaaacuugaaa

SEQ ID NO: 1752413 - RNA, 16 nt, Homo sapiens
ggguggagaagccauu

SEQ ID NO: 1752414 - RNA, 17 nt, Homo sapiens
cauuguccuguagcuuu

SEQ ID NO: 1752415 - RNA, 19 nt, Homo sapiens
agccugggcgacagagcaa

SEQ ID NO: 1752416 - RNA, 14 nt, Homo sapiens
ccacaauacuuccu

SEQ ID NO: 1752417 - RNA, 20 nt, Homo sapiens
uaaucacucagugauugcaa

SEQ ID NO: 1752418 - RNA, 20 nt, Homo sapiens
gccucgggacaucaaaaaca

SEQ ID NO: 1752419 - RNA, 19 nt, Homo sapiens
uaaaauagcuuugcaguga

SEQ ID NO: 1752420 - RNA, 13 nt, Homo sapiens
cccgaacaccauu

SEQ ID NO: 1752421 - RNA, 18 nt, Homo sapiens
auccaggacugugccagc

SEQ ID NO: 1752422 - RNA, 12 nt, Homo sapiens
gaauuucucaca

SEQ ID NO: 1752423 - RNA, 17 nt, Homo sapiens
uccgcccccaugcucuc

SEQ ID NO: 1752424 - RNA, 19 nt, Homo sapiens
ugguaguuguggcuuuuau

SEQ ID NO: 1752425 - RNA, 14 nt, Homo sapiens
caggaagcagcuuu

SEQ ID NO: 1752426 - RNA, 17 nt, Homo sapiens
uuuaagaaugacaggcu

SEQ ID NO: 1752427 - RNA, 19 nt, Homo sapiens
gcaaaucuaugagauuuug

SEQ ID NO: 1752428 - RNA, 18 nt, Homo sapiens
agggggcuggcucugaga

SEQ ID NO: 1752429 - RNA, 11 nt, Homo sapiens
agaaguucugg

SEQ ID NO: 1752430 - RNA, 19 nt, Homo sapiens
agugaucuucccacaccag

SEQ ID NO: 1752431 - RNA, 19 nt, Homo sapiens
cacccaggcuggagugcag

SEQ ID NO: 1752432 - RNA, 19 nt, Homo sapiens
cacccaggcuagagugcaa

SEQ ID NO: 1752433 - RNA, 18 nt, Homo sapiens
auccucacccagcaccca

SEQ ID NO: 1752434 - RNA, 15 nt, Homo sapiens
auuucuaggacugaa

SEQ ID NO: 1752435 - RNA, 18 nt, Homo sapiens
aaugaaaggugacaaaag

SEQ ID NO: 1752436 - RNA, 14 nt, Homo sapiens
agacaucacaagaa

SEQ ID NO: 1752437 - RNA, 18 nt, Homo sapiens
gaauauuuauucagugac

SEQ ID NO: 1752438 - RNA, 20 nt, Homo sapiens
gguaauaucaucuugaaaag

SEQ ID NO: 1752439 - RNA, 18 nt, Homo sapiens
uuccagcauguuucuccc

SEQ ID NO: 1752440 - RNA, 20 nt, Homo sapiens
uuucugauuuuuauucucaa

SEQ ID NO: 1752441 - RNA, 18 nt, Homo sapiens
uaaagagcauauucacug

SEQ ID NO: 1752442 - RNA, 23 nt, Homo sapiens
ccucuggauccagccaugccuga

SEQ ID NO: 1752443 - RNA, 15 nt, Homo sapiens
aaugugauugcagcu

SEQ ID NO: 1752444 - RNA, 21 nt, Homo sapiens
uacacgguucaaaccugugaa

SEQ ID NO: 1752445 - RNA, 16 nt, Homo sapiens
uuggucccacaggcca

SEQ ID NO: 1752446 - RNA, 22 nt, Homo sapiens
uguuucugucaagcuggugcua

SEQ ID NO: 1752447 - RNA, 15 nt, Homo sapiens
aaacaaaaggaaaug

SEQ ID NO: 1752448 - RNA, 15 nt, Homo sapiens
aagcucucacucugu

SEQ ID NO: 1752449 - RNA, 22 nt, Homo sapiens
ugcaggccgugugucugucagc

SEQ ID NO: 1752450 - RNA, 17 nt, Homo sapiens
auggucgauauacaauu

SEQ ID NO: 1752451 - RNA, 18 nt, Homo sapiens
aauggaggaauccuugac

SEQ ID NO: 1752452 - RNA, 19 nt, Homo sapiens
gucucuacuaaaaguacaa

SEQ ID NO: 1752453 - RNA, 15 nt, Homo sapiens
uuucaugcgugugug

SEQ ID NO: 1752454 - RNA, 21 nt, Homo sapiens
agagcagagcccccauggccu

SEQ ID NO: 1752455 - RNA, 17 nt, Homo sapiens
gccuauuccugaacuau

SEQ ID NO: 1752456 - RNA, 21 nt, Homo sapiens
cagaugggccuggccuugaga

SEQ ID NO: 1752457 - RNA, 17 nt, Homo sapiens
agaaaaagacaccgucc

SEQ ID NO: 1752458 - RNA, 17 nt, Homo sapiens
acuguguugacuuugcu

SEQ ID NO: 1752459 - RNA, 15 nt, Homo sapiens
ggccuauuccugcug

SEQ ID NO: 1752460 - RNA, 16 nt, Homo sapiens
aagccugggugacauu

SEQ ID NO: 1752461 - RNA, 13 nt, Homo sapiens
agucacguguauu

SEQ ID NO: 1752462 - RNA, 22 nt, Homo sapiens
augaaauggacaaacagugcac

SEQ ID NO: 1752463 - RNA, 16 nt, Homo sapiens
ugcuggggccucagac

SEQ ID NO: 1752464 - RNA, 15 nt, Homo sapiens
aguggagucgacuca

SEQ ID NO: 1752465 - RNA, 17 nt, Homo sapiens
guagccccgggcugacc

SEQ ID NO: 1752466 - RNA, 14 nt, Homo sapiens
gccucagggaccaa

SEQ ID NO: 1752467 - RNA, 12 nt, Homo sapiens
gucaacaucuaa

SEQ ID NO: 1752468 - RNA, 16 nt, Homo sapiens
gacaucgguucauauu

SEQ ID NO: 1752469 - RNA, 17 nt, Homo sapiens
gacucugucucauugac

SEQ ID NO: 1752470 - RNA, 20 nt, Homo sapiens
caugugugugccaagcccug

SEQ ID NO: 1752471 - RNA, 17 nt, Homo sapiens
cucagaaccuuguccca

SEQ ID NO: 1752472 - RNA, 19 nt, Homo sapiens
aaugucaucagaacuuuuu

SEQ ID NO: 1752473 - RNA, 17 nt, Homo sapiens
uuguagaccacuguccu

SEQ ID NO: 1752474 - RNA, 16 nt, Homo sapiens
gccacuggaacacuaa

SEQ ID NO: 1752475 - RNA, 16 nt, Homo sapiens
aaaccugggcaccuaa

SEQ ID NO: 1752476 - RNA, 12 nt, Homo sapiens
uugucugucuca

SEQ ID NO: 1752477 - RNA, 16 nt, Homo sapiens
cagcucagccccggcc

SEQ ID NO: 1752478 - RNA, 12 nt, Homo sapiens
uuccaagaccaa

SEQ ID NO: 1752479 - RNA, 15 nt, Homo sapiens
guauaaacuaucagu

SEQ ID NO: 1752480 - RNA, 15 nt, Homo sapiens
gaaaaugcuguuuuc

SEQ ID NO: 1752481 - RNA, 20 nt, Homo sapiens
ucugcuggauucuaaauuau

SEQ ID NO: 1752482 - RNA, 15 nt, Homo sapiens
aucuaccugcuccuu

SEQ ID NO: 1752483 - RNA, 18 nt, Homo sapiens
cagugagggcuauacaug

SEQ ID NO: 1752484 - RNA, 23 nt, Homo sapiens
acccuagcccucucccucuaggc

SEQ ID NO: 1752485 - RNA, 22 nt, Homo sapiens
cuuuccuguuucuaucuuucau

SEQ ID NO: 1752486 - RNA, 15 nt, Homo sapiens
uccaggcuguucuca

SEQ ID NO: 1752487 - RNA, 16 nt, Homo sapiens
caagauguguucuccu

SEQ ID NO: 1752488 - RNA, 22 nt, Homo sapiens
cccuccuagcagacaugccaca

SEQ ID NO: 1752489 - RNA, 14 nt, Homo sapiens
cuugcgucccauga

SEQ ID NO: 1752490 - RNA, 18 nt, Homo sapiens
gcuuuguggaaacagcug

SEQ ID NO: 1752491 - RNA, 20 nt, Homo sapiens
cuccacauguucaacuauua

SEQ ID NO: 1752492 - RNA, 16 nt, Homo sapiens
ccugguccuagacaua

SEQ ID NO: 1752493 - RNA, 19 nt, Homo sapiens
cauucauuccauucuggaa

SEQ ID NO: 1752494 - RNA, 12 nt, Homo sapiens
gauaauucuuaa

SEQ ID NO: 1752495 - RNA, 12 nt, Homo sapiens
aagcugcucaac

SEQ ID NO: 1752496 - RNA, 14 nt, Homo sapiens
auaaacuuaaaaua

SEQ ID NO: 1752497 - RNA, 13 nt, Homo sapiens
ccaaguuccguca

SEQ ID NO: 1752498 - RNA, 21 nt, Homo sapiens
cugcuccguggaggagguugg

SEQ ID NO: 1752499 - RNA, 15 nt, Homo sapiens
aaggagcugauacuu

SEQ ID NO: 1752500 - RNA, 12 nt, Homo sapiens
auaauaccucaa

SEQ ID NO: 1752501 - RNA, 12 nt, Homo sapiens
acuuuaccuuuu

SEQ ID NO: 1752502 - RNA, 12 nt, Homo sapiens
gccugcugugcc

SEQ ID NO: 1752503 - RNA, 12 nt, Homo sapiens
aaucagcuuugu

SEQ ID NO: 1752504 - RNA, 20 nt, Homo sapiens
uaacuggugauauaucucaa

SEQ ID NO: 1752505 - RNA, 21 nt, Homo sapiens
auauuuugauucucauugcca

SEQ ID NO: 1752506 - RNA, 16 nt, Homo sapiens
ugguucugcuuucucu

SEQ ID NO: 1752507 - RNA, 16 nt, Homo sapiens
cagaacaaacauuaaa

SEQ ID NO: 1752508 - RNA, 19 nt, Homo sapiens
uccugggccugggcuuuag

SEQ ID NO: 1752509 - RNA, 22 nt, Homo sapiens
cccuaguucaaaacaaccacuu

SEQ ID NO: 1752510 - RNA, 22 nt, Homo sapiens
acuagcaauaaguugaaugaua

SEQ ID NO: 1752511 - RNA, 21 nt, Homo sapiens
cuaaccgaauauucauggaug

SEQ ID NO: 1752512 - RNA, 15 nt, Homo sapiens
caagaguggacugaa

SEQ ID NO: 1752513 - RNA, 15 nt, Homo sapiens
uguagaaacacauaa

SEQ ID NO: 1752514 - RNA, 15 nt, Homo sapiens
aaaaaaacauaucca

SEQ ID NO: 1752515 - RNA, 13 nt, Homo sapiens
agauaagcuucca

SEQ ID NO: 1752516 - RNA, 14 nt, Homo sapiens
uccccuacucugcc

SEQ ID NO: 1752517 - RNA, 14 nt, Homo sapiens
cucccuaccuugcc

SEQ ID NO: 1752518 - RNA, 23 nt, Homo sapiens
ucacaaggcacaccagugcaagc

SEQ ID NO: 1752519 - RNA, 23 nt, Homo sapiens
cucagagaauuucuaccauuuca

SEQ ID NO: 1752520 - RNA, 19 nt, Homo sapiens
agaaccucagauucuucau

SEQ ID NO: 1752521 - RNA, 24 nt, Homo sapiens
agugagacuuugaggguguauauu

SEQ ID NO: 1752522 - RNA, 22 nt, Homo sapiens
auguaaagaacgcgacuuccac

SEQ ID NO: 1752523 - RNA, 18 nt, Homo sapiens
auaaacggacucagugga

SEQ ID NO: 1752524 - RNA, 20 nt, Homo sapiens
cuaagcacgggccauaugaa

SEQ ID NO: 1752525 - RNA, 14 nt, Homo sapiens
guucagcugcccca

SEQ ID NO: 1752526 - RNA, 13 nt, Homo sapiens
uggagcugagcua

SEQ ID NO: 1752527 - RNA, 21 nt, Homo sapiens
uggagaacauucaaucuugcc

SEQ ID NO: 1752528 - RNA, 12 nt, Homo sapiens
uucaugccagcu

SEQ ID NO: 1752529 - RNA, 20 nt, Homo sapiens
agauaaagucaaaugccaaa

SEQ ID NO: 1752530 - RNA, 14 nt, Homo sapiens
uucacuaccuguca

SEQ ID NO: 1752531 - RNA, 13 nt, Homo sapiens
cugcgcagcaucc

SEQ ID NO: 1752532 - RNA, 18 nt, Homo sapiens
gacguuuacuagacuuug

SEQ ID NO: 1752533 - RNA, 14 nt, Homo sapiens
ucugggcugucagc

SEQ ID NO: 1752534 - RNA, 15 nt, Homo sapiens
cucauuacugcuuca

SEQ ID NO: 1752535 - RNA, 20 nt, Homo sapiens
auuuuguguaaaaaaaccac

SEQ ID NO: 1752536 - RNA, 16 nt, Homo sapiens
auuucucaaaaaccac

SEQ ID NO: 1752537 - RNA, 15 nt, Homo sapiens
aacccuugagcucaa

SEQ ID NO: 1752538 - RNA, 12 nt, Homo sapiens
acuaugugaugu

SEQ ID NO: 1752539 - RNA, 14 nt, Homo sapiens
ggacuugggcggga

SEQ ID NO: 1752540 - RNA, 14 nt, Homo sapiens
gagacaaaagcagu

SEQ ID NO: 1752541 - RNA, 15 nt, Homo sapiens
uauaagaaaauggag

SEQ ID NO: 1752542 - RNA, 13 nt, Homo sapiens
gcuaagugaaaga

SEQ ID NO: 1752543 - RNA, 17 nt, Homo sapiens
agauucucugugucuaa

SEQ ID NO: 1752544 - RNA, 16 nt, Homo sapiens
ugccaccacucaagca

SEQ ID NO: 1752545 - RNA, 20 nt, Homo sapiens
agaacaccugacaacuucug

SEQ ID NO: 1752546 - RNA, 14 nt, Homo sapiens
aguuaagaacuaug

SEQ ID NO: 1752547 - RNA, 23 nt, Homo sapiens
cuuccugauucaaagacugucaa

SEQ ID NO: 1752548 - RNA, 22 nt, Homo sapiens
caagugaacauuacauugccau

SEQ ID NO: 1752549 - RNA, 19 nt, Homo sapiens
caauaguuagaucuacccu

SEQ ID NO: 1752550 - RNA, 13 nt, Homo sapiens
aucuguauggacu

SEQ ID NO: 1752551 - RNA, 18 nt, Homo sapiens
gcucuaagaagcugcaau

SEQ ID NO: 1752552 - RNA, 16 nt, Homo sapiens
agcuggcggccugcag

SEQ ID NO: 1752553 - RNA, 16 nt, Homo sapiens
gcugggccaguggcac

SEQ ID NO: 1752554 - RNA, 22 nt, Homo sapiens
acauguagguaggaagcacuga

SEQ ID NO: 1752555 - RNA, 17 nt, Homo sapiens
uuucaggauacaugugc

SEQ ID NO: 1752556 - RNA, 15 nt, Homo sapiens
acugauacuauucaa

SEQ ID NO: 1752557 - RNA, 20 nt, Homo sapiens
gugugccguugcuccggccu

SEQ ID NO: 1752558 - RNA, 15 nt, Homo sapiens
cggagccuccagcug

SEQ ID NO: 1752559 - RNA, 18 nt, Homo sapiens
ugcuggguccauaucaca

SEQ ID NO: 1752560 - RNA, 17 nt, Homo sapiens
aggaaguggacauucua

SEQ ID NO: 1752561 - RNA, 15 nt, Homo sapiens
aaaccuggaugucac

SEQ ID NO: 1752562 - RNA, 15 nt, Homo sapiens
guuuggggcccucua

SEQ ID NO: 1752563 - RNA, 19 nt, Homo sapiens
ggauugcuugagcccagaa

SEQ ID NO: 1752564 - RNA, 21 nt, Homo sapiens
acacagcccuggaaacauaca

SEQ ID NO: 1752565 - RNA, 21 nt, Homo sapiens
gaagagauccuuccauuccau

SEQ ID NO: 1752566 - RNA, 14 nt, Homo sapiens
gaauaauuauuuca

SEQ ID NO: 1752567 - RNA, 15 nt, Homo sapiens
aaugcagucugucca

SEQ ID NO: 1752568 - RNA, 16 nt, Homo sapiens
uauccuugaccaauaa

SEQ ID NO: 1752569 - RNA, 17 nt, Homo sapiens
cuaaucagcauucucac

SEQ ID NO: 1752570 - RNA, 15 nt, Homo sapiens
uucaaaucagugauc

SEQ ID NO: 1752571 - RNA, 21 nt, Homo sapiens
ucuuucacuggggaagccagu

SEQ ID NO: 1752572 - RNA, 13 nt, Homo sapiens
cccaggaugcaug

SEQ ID NO: 1752573 - RNA, 15 nt, Homo sapiens
ucaaaaaucuguccg

SEQ ID NO: 1752574 - RNA, 14 nt, Homo sapiens
ugaagucagcucag

SEQ ID NO: 1752575 - RNA, 20 nt, Homo sapiens
gaagggaaaagcccaugauc

SEQ ID NO: 1752576 - RNA, 14 nt, Homo sapiens
ugcuuugugacuuc

SEQ ID NO: 1752577 - RNA, 18 nt, Homo sapiens
cagaccucaccuccaucc

SEQ ID NO: 1752578 - RNA, 14 nt, Homo sapiens
uugcugaauggagu

SEQ ID NO: 1752579 - RNA, 16 nt, Homo sapiens
aacuagagcacagaag

SEQ ID NO: 1752580 - RNA, 16 nt, Homo sapiens
uuucgacguuugacua

SEQ ID NO: 1752581 - RNA, 16 nt, Homo sapiens
uaaccuuuuagauggu

SEQ ID NO: 1752582 - RNA, 14 nt, Homo sapiens
gcaccuaaagccua

SEQ ID NO: 1752583 - RNA, 15 nt, Homo sapiens
auuuugcagaaggaa

SEQ ID NO: 1752584 - RNA, 22 nt, Homo sapiens
uugggcaggagucaccaugcaa

SEQ ID NO: 1752585 - RNA, 18 nt, Homo sapiens
caauccucaggauuucau

SEQ ID NO: 1752586 - RNA, 15 nt, Homo sapiens
uuaaaauucaauuag

SEQ ID NO: 1752587 - RNA, 14 nt, Homo sapiens
ugagacaacaguac

SEQ ID NO: 1752588 - RNA, 14 nt, Homo sapiens
caugaguuacacug

SEQ ID NO: 1752589 - RNA, 15 nt, Homo sapiens
augcaagacuucacu

SEQ ID NO: 1752590 - RNA, 13 nt, Homo sapiens
caggaaacuaacu

SEQ ID NO: 1752591 - RNA, 20 nt, Homo sapiens
guauagccuauacugcauua

SEQ ID NO: 1752592 - RNA, 20 nt, Homo sapiens
caugaucuugugacauauua

SEQ ID NO: 1752593 - RNA, 15 nt, Homo sapiens
auuuuaaagacaaaa

SEQ ID NO: 1752594 - RNA, 19 nt, Homo sapiens
uauaaaguauaacuauaaa

SEQ ID NO: 1752595 - RNA, 18 nt, Homo sapiens
cugcauuuggucaggggg

SEQ ID NO: 1752596 - RNA, 13 nt, Homo sapiens
gucuaauggucac

SEQ ID NO: 1752597 - RNA, 13 nt, Homo sapiens
cauuaaaugacaa

SEQ ID NO: 1752598 - RNA, 17 nt, Homo sapiens
uguaacccucacccaca

SEQ ID NO: 1752599 - RNA, 15 nt, Homo sapiens
gcuggagugcagugg

SEQ ID NO: 1752600 - RNA, 20 nt, Homo sapiens
cagauccugcagucaauguu

SEQ ID NO: 1752601 - RNA, 18 nt, Homo sapiens
cuguuacuaaauccuuuu

SEQ ID NO: 1752602 - RNA, 18 nt, Homo sapiens
uuauagaaagauagauau

SEQ ID NO: 1752603 - RNA, 22 nt, Homo sapiens
cgugauacuguacauagcuguu

SEQ ID NO: 1752604 - RNA, 20 nt, Homo sapiens
acuauugcaaggacagcauc

SEQ ID NO: 1752605 - RNA, 20 nt, Homo sapiens
aagagccaaccaacagagaa

SEQ ID NO: 1752606 - RNA, 16 nt, Homo sapiens
cugaacauaguuuuca

SEQ ID NO: 1752607 - RNA, 18 nt, Homo sapiens
gagccgugaacugugcau

SEQ ID NO: 1752608 - RNA, 19 nt, Homo sapiens
uggggcccaaguugcagug

SEQ ID NO: 1752609 - RNA, 23 nt, Homo sapiens
gcccagcuccaaggggaaucaga

SEQ ID NO: 1752610 - RNA, 21 nt, Homo sapiens
cagaaugaggcugcuuuccaa

SEQ ID NO: 1752611 - RNA, 16 nt, Homo sapiens
cuguacuagugccauu

SEQ ID NO: 1752612 - RNA, 23 nt, Homo sapiens
acacuuagguuaauuccauucaa

SEQ ID NO: 1752613 - RNA, 22 nt, Homo sapiens
uuugaguguuuauagaucacug

SEQ ID NO: 1752614 - RNA, 24 nt, Homo sapiens
guguuggggaaaccuucaucugaa

SEQ ID NO: 1752615 - RNA, 20 nt, Homo sapiens
gccuccugggacugugacug

SEQ ID NO: 1752616 - RNA, 19 nt, Homo sapiens
gguugucuuauugcaccau

SEQ ID NO: 1752617 - RNA, 19 nt, Homo sapiens
auauagggaucaaccagcu

SEQ ID NO: 1752618 - RNA, 16 nt, Homo sapiens
aagcccuccaaaagca

SEQ ID NO: 1752619 - RNA, 23 nt, Homo sapiens
uauuaauaugaguuacugaaggu

SEQ ID NO: 1752620 - RNA, 17 nt, Homo sapiens
caaagaacucauuugaa

SEQ ID NO: 1752621 - RNA, 19 nt, Homo sapiens
cugcuuugaggcaguucca

SEQ ID NO: 1752622 - RNA, 22 nt, Homo sapiens
ggcacucugaggucucuguggc

SEQ ID NO: 1752623 - RNA, 19 nt, Homo sapiens
ccucaaagcuuccauucca

SEQ ID NO: 1752624 - RNA, 15 nt, Homo sapiens
aguccuuugugaaua

SEQ ID NO: 1752625 - RNA, 12 nt, Homo sapiens
auccucucucuc

SEQ ID NO: 1752626 - RNA, 16 nt, Homo sapiens
gggucccagagaccuc

SEQ ID NO: 1752627 - RNA, 17 nt, Homo sapiens
ucaaaugaagugaguca

SEQ ID NO: 1752628 - RNA, 17 nt, Homo sapiens
uguauucacccguccag

SEQ ID NO: 1752629 - RNA, 19 nt, Homo sapiens
ugcagucucuauaccaaua

SEQ ID NO: 1752630 - RNA, 17 nt, Homo sapiens
ucacugggcucacugca

SEQ ID NO: 1752631 - RNA, 17 nt, Homo sapiens
gaccugcccuacauauc

SEQ ID NO: 1752632 - RNA, 21 nt, Homo sapiens
aaugcacacagcggcugccuc

SEQ ID NO: 1752633 - RNA, 18 nt, Homo sapiens
aaacaacuuccucccuua

SEQ ID NO: 1752634 - RNA, 23 nt, Homo sapiens
auguaguccguuaacacuacuua

SEQ ID NO: 1752635 - RNA, 19 nt, Homo sapiens
ccucagccuggccagacac

SEQ ID NO: 1752636 - RNA, 19 nt, Homo sapiens
gaugugggucccucucuug

SEQ ID NO: 1752637 - RNA, 17 nt, Homo sapiens
ccugucaccaugauucu

SEQ ID NO: 1752638 - RNA, 23 nt, Homo sapiens
cuaacuacuguccuuaaagccau

SEQ ID NO: 1752639 - RNA, 17 nt, Homo sapiens
cugauagggauacaugc

SEQ ID NO: 1752640 - RNA, 19 nt, Homo sapiens
agaaaaaaaccacacaaag

SEQ ID NO: 1752641 - RNA, 19 nt, Homo sapiens
cuugcauucccuuaugaug

SEQ ID NO: 1752642 - RNA, 17 nt, Homo sapiens
ucgccaaauaguuccau

SEQ ID NO: 1752643 - RNA, 21 nt, Homo sapiens
ucuuaaaaugaauuauguuau

SEQ ID NO: 1752644 - RNA, 18 nt, Homo sapiens
gacugaaggggcacacca

SEQ ID NO: 1752645 - RNA, 14 nt, Homo sapiens
auuuucuacuguaa

SEQ ID NO: 1752646 - RNA, 14 nt, Homo sapiens
aaugggcuuucaua

SEQ ID NO: 1752647 - RNA, 19 nt, Homo sapiens
gcacacccaugcacacuca

SEQ ID NO: 1752648 - RNA, 19 nt, Homo sapiens
gugaucuucccacaccagc

SEQ ID NO: 1752649 - RNA, 21 nt, Homo sapiens
aagcugucccucacuguugaa

SEQ ID NO: 1752650 - RNA, 15 nt, Homo sapiens
cuucaaauauuuccc

SEQ ID NO: 1752651 - RNA, 23 nt, Homo sapiens
ugcccucucccuguguucugggc

SEQ ID NO: 1752652 - RNA, 12 nt, Homo sapiens
aggacauuccaa

SEQ ID NO: 1752653 - RNA, 19 nt, Homo sapiens
uauucccuucuaaccugaa

SEQ ID NO: 1752654 - RNA, 13 nt, Homo sapiens
uuaccugacacaa

SEQ ID NO: 1752655 - RNA, 12 nt, Homo sapiens
caaaugucauca

SEQ ID NO: 1752656 - RNA, 21 nt, Homo sapiens
agccuguucauggcagaugua

SEQ ID NO: 1752657 - RNA, 14 nt, Homo sapiens
uaguuuucauuuua

SEQ ID NO: 1752658 - RNA, 14 nt, Homo sapiens
aaucaaucuugcau

SEQ ID NO: 1752659 - RNA, 14 nt, Homo sapiens
acacauauuugcac

SEQ ID NO: 1752660 - RNA, 21 nt, Homo sapiens
augcaaaauaaauguuuuuau

SEQ ID NO: 1752661 - RNA, 14 nt, Homo sapiens
aaaaugcaccacuu

SEQ ID NO: 1752662 - RNA, 15 nt, Homo sapiens
gcuguauuuugauau

SEQ ID NO: 1752663 - RNA, 13 nt, Homo sapiens
ggagcgcaccugc

SEQ ID NO: 1752664 - RNA, 21 nt, Homo sapiens
acauauuccaugggacuuucc

SEQ ID NO: 1752665 - RNA, 18 nt, Homo sapiens
ccacugaacauuugcuuu

SEQ ID NO: 1752666 - RNA, 13 nt, Homo sapiens
agugaggacaaaa

SEQ ID NO: 1752667 - RNA, 22 nt, Homo sapiens
acaggggccccuccucuaauga

SEQ ID NO: 1752668 - RNA, 17 nt, Homo sapiens
uaacucaggacuccagc

SEQ ID NO: 1752669 - RNA, 15 nt, Homo sapiens
gcagaucuuggaaug

SEQ ID NO: 1752670 - RNA, 17 nt, Homo sapiens
agcugggcuucugucca

SEQ ID NO: 1752671 - RNA, 14 nt, Homo sapiens
ucauugaccuucag

SEQ ID NO: 1752672 - RNA, 14 nt, Homo sapiens
ccucaccaccacac

SEQ ID NO: 1752673 - RNA, 14 nt, Homo sapiens
guaauucaguuauu

SEQ ID NO: 1752674 - RNA, 14 nt, Homo sapiens
cuuaaacacuaaaa

SEQ ID NO: 1752675 - RNA, 22 nt, Homo sapiens
ugcaguagagucaucuccauca

SEQ ID NO: 1752676 - RNA, 16 nt, Homo sapiens
uaaagaaaaaugccug

SEQ ID NO: 1752677 - RNA, 19 nt, Homo sapiens
cgaugccugcaugcugaaa

SEQ ID NO: 1752678 - RNA, 14 nt, Homo sapiens
cuuggaaaggacca

SEQ ID NO: 1752679 - RNA, 16 nt, Homo sapiens
uccagggagaaggcau

SEQ ID NO: 1752680 - RNA, 21 nt, Homo sapiens
uuacagcuccuuugaaaacuc

SEQ ID NO: 1752681 - RNA, 17 nt, Homo sapiens
uagucauggauaacuac

SEQ ID NO: 1752682 - RNA, 12 nt, Homo sapiens
ggaugaugccuc

SEQ ID NO: 1752683 - RNA, 14 nt, Homo sapiens
cucuuuuaugccaa

SEQ ID NO: 1752684 - RNA, 11 nt, Homo sapiens
agagacuucac

SEQ ID NO: 1752685 - RNA, 12 nt, Homo sapiens
acagucagcucu

SEQ ID NO: 1752686 - RNA, 15 nt, Homo sapiens
agcagagaucugcag

SEQ ID NO: 1752687 - RNA, 19 nt, Homo sapiens
acuuuacugagacaaugua

SEQ ID NO: 1752688 - RNA, 19 nt, Homo sapiens
gagaccuagagaucuggcu

SEQ ID NO: 1752689 - RNA, 20 nt, Homo sapiens
ggcuaugccugccucaaagg

SEQ ID NO: 1752690 - RNA, 21 nt, Homo sapiens
aagucauucaagagucucauu

SEQ ID NO: 1752691 - RNA, 15 nt, Homo sapiens
gaauucagaagugga

SEQ ID NO: 1752692 - RNA, 19 nt, Homo sapiens
gggaugucugagaucagug

SEQ ID NO: 1752693 - RNA, 22 nt, Homo sapiens
uagaggggccccugauccucac

SEQ ID NO: 1752694 - RNA, 22 nt, Homo sapiens
accccaguaccgacuaagcaaa

SEQ ID NO: 1752695 - RNA, 19 nt, Homo sapiens
gcuucacagaugugugauu

SEQ ID NO: 1752696 - RNA, 19 nt, Homo sapiens
ccaugcuucucaucugcaa

SEQ ID NO: 1752697 - RNA, 19 nt, Homo sapiens
gcuauuaagaaaaucacau

SEQ ID NO: 1752698 - RNA, 22 nt, Homo sapiens
cugaaucaaaagcugaaauucu

SEQ ID NO: 1752699 - RNA, 16 nt, Homo sapiens
cuuggguucacagugc

SEQ ID NO: 1752700 - RNA, 22 nt, Homo sapiens
cucucuaaaggggacuugaggg

SEQ ID NO: 1752701 - RNA, 12 nt, Homo sapiens
aguuucuaagca

SEQ ID NO: 1752702 - RNA, 17 nt, Homo sapiens
gaacaaagacuacuaau

SEQ ID NO: 1752703 - RNA, 16 nt, Homo sapiens
ccagucauauguucuc

SEQ ID NO: 1752704 - RNA, 14 nt, Homo sapiens
cuuuggauacacac

SEQ ID NO: 1752705 - RNA, 22 nt, Homo sapiens
ggaagcccugucuguuugccac

SEQ ID NO: 1752706 - RNA, 16 nt, Homo sapiens
cugaaucaccaauuaa

SEQ ID NO: 1752707 - RNA, 23 nt, Homo sapiens
gucugaacugcuugcuaccaauc

SEQ ID NO: 1752708 - RNA, 22 nt, Homo sapiens
gaacaugaagaagaccuuuaca

SEQ ID NO: 1752709 - RNA, 16 nt, Homo sapiens
gaugccaacuucccac

SEQ ID NO: 1752710 - RNA, 12 nt, Homo sapiens
uuucaagucucu

SEQ ID NO: 1752711 - RNA, 19 nt, Homo sapiens
aauauugacuucucuugaa

SEQ ID NO: 1752712 - RNA, 17 nt, Homo sapiens
ccagguaugcaaauauc

SEQ ID NO: 1752713 - RNA, 22 nt, Homo sapiens
accucagugaaagcagucaucu

SEQ ID NO: 1752714 - RNA, 20 nt, Homo sapiens
gucuuugcggggccugucuc

SEQ ID NO: 1752715 - RNA, 14 nt, Homo sapiens
accaaauaagacuu

SEQ ID NO: 1752716 - RNA, 16 nt, Homo sapiens
gcacagucugaugaca

SEQ ID NO: 1752717 - RNA, 12 nt, Homo sapiens
uaucuaugcaaa

SEQ ID NO: 1752718 - RNA, 18 nt, Homo sapiens
aaaggaugcacagaguug

SEQ ID NO: 1752719 - RNA, 18 nt, Homo sapiens
cacaugcuaggaugcgga

SEQ ID NO: 1752720 - RNA, 13 nt, Homo sapiens
acagcagauuuca

SEQ ID NO: 1752721 - RNA, 20 nt, Homo sapiens
ugagacuccaucucaaaaaa

SEQ ID NO: 1752722 - RNA, 15 nt, Homo sapiens
ucuggccacacugga

SEQ ID NO: 1752723 - RNA, 22 nt, Homo sapiens
cugaacuuuguggucgacauca

SEQ ID NO: 1752724 - RNA, 22 nt, Homo sapiens
agugauuuuggccacacuguca

SEQ ID NO: 1752725 - RNA, 13 nt, Homo sapiens
gaacucuaucugu

SEQ ID NO: 1752726 - RNA, 15 nt, Homo sapiens
cuaugugagcacaaa

SEQ ID NO: 1752727 - RNA, 17 nt, Homo sapiens
uggaaggcugcuuucuc

SEQ ID NO: 1752728 - RNA, 18 nt, Homo sapiens
acaugcugaacaucacag

SEQ ID NO: 1752729 - RNA, 15 nt, Homo sapiens
acaugcgaccgugac

SEQ ID NO: 1752730 - RNA, 22 nt, Homo sapiens
uucaauaaaggaaauaugcacu

SEQ ID NO: 1752731 - RNA, 17 nt, Homo sapiens
cuggacaaacagccuca

SEQ ID NO: 1752732 - RNA, 19 nt, Homo sapiens
aauguggauaaaacugugu

SEQ ID NO: 1752733 - RNA, 17 nt, Homo sapiens
cuacuuuagagucuucu

SEQ ID NO: 1752734 - RNA, 17 nt, Homo sapiens
guaggauuggggaccau

SEQ ID NO: 1752735 - RNA, 21 nt, Homo sapiens
ucaagcuggaagaagugagca

SEQ ID NO: 1752736 - RNA, 15 nt, Homo sapiens
uacgcuuugcucaaa

SEQ ID NO: 1752737 - RNA, 14 nt, Homo sapiens
auuugaugcauguc

SEQ ID NO: 1752738 - RNA, 21 nt, Homo sapiens
ggggccuggacacccaucuca

SEQ ID NO: 1752739 - RNA, 16 nt, Homo sapiens
uguauucggcaccuuc

SEQ ID NO: 1752740 - RNA, 15 nt, Homo sapiens
guagaggagcagggu

SEQ ID NO: 1752741 - RNA, 15 nt, Homo sapiens
auugacgaacuggcu

SEQ ID NO: 1752742 - RNA, 23 nt, Homo sapiens
aauacaggagacccaacaaugag

SEQ ID NO: 1752743 - RNA, 21 nt, Homo sapiens
uccauucuguuccacugcucu

SEQ ID NO: 1752744 - RNA, 20 nt, Homo sapiens
ucaagagacaguauugcuaa

SEQ ID NO: 1752745 - RNA, 18 nt, Homo sapiens
aacacgucgauucugucc

SEQ ID NO: 1752746 - RNA, 16 nt, Homo sapiens
ucuuaccuguaaccua

SEQ ID NO: 1752747 - RNA, 22 nt, Homo sapiens
gcucuuagacucgccuaucuua

SEQ ID NO: 1752748 - RNA, 14 nt, Homo sapiens
ccucucauuagaaa

SEQ ID NO: 1752749 - RNA, 22 nt, Homo sapiens
uccagaugugccuagacacgaa

SEQ ID NO: 1752750 - RNA, 22 nt, Homo sapiens
uuuuucuuugagacugggucuc

SEQ ID NO: 1752751 - RNA, 14 nt, Homo sapiens
augucagucacuaa

SEQ ID NO: 1752752 - RNA, 15 nt, Homo sapiens
gcagaucaacugagu

SEQ ID NO: 1752753 - RNA, 21 nt, Homo sapiens
cagccccacugcccuccaggg

SEQ ID NO: 1752754 - RNA, 21 nt, Homo sapiens
guauaguuuaaaaaucugcca

SEQ ID NO: 1752755 - RNA, 14 nt, Homo sapiens
cuucuggugcugcu

SEQ ID NO: 1752756 - RNA, 14 nt, Homo sapiens
aauucauccuuaca

SEQ ID NO: 1752757 - RNA, 13 nt, Homo sapiens
aacgcagccucca

SEQ ID NO: 1752758 - RNA, 12 nt, Homo sapiens
auuauucccaug

SEQ ID NO: 1752759 - RNA, 21 nt, Homo sapiens
auuuauuauaugugcacuuca

SEQ ID NO: 1752760 - RNA, 19 nt, Homo sapiens
aaugugaacuagcuggaau

SEQ ID NO: 1752761 - RNA, 14 nt, Homo sapiens
acaauacaguauua

SEQ ID NO: 1752762 - RNA, 21 nt, Homo sapiens
uggucaaguaguuugacucag

SEQ ID NO: 1752763 - RNA, 20 nt, Homo sapiens
acccuagccaaugucuccuc

SEQ ID NO: 1752764 - RNA, 18 nt, Homo sapiens
cugauuauuuagagccau

SEQ ID NO: 1752765 - RNA, 19 nt, Homo sapiens
uggaggggcauagccuuuc

SEQ ID NO: 1752766 - RNA, 13 nt, Homo sapiens
cucucaaaacccu

SEQ ID NO: 1752767 - RNA, 15 nt, Homo sapiens
cuguuaguuguccac

SEQ ID NO: 1752768 - RNA, 22 nt, Homo sapiens
gcuagacuaccggacacucguc

SEQ ID NO: 1752769 - RNA, 18 nt, Homo sapiens
cuacauguguuugaacua

SEQ ID NO: 1752770 - RNA, 17 nt, Homo sapiens
ccugccgguaaacacgc

SEQ ID NO: 1752771 - RNA, 22 nt, Homo sapiens
ucuuaguguaugauuacuggcc

SEQ ID NO: 1752772 - RNA, 16 nt, Homo sapiens
uauccugggccucagc

SEQ ID NO: 1752773 - RNA, 20 nt, Homo sapiens
acagaaggaaucugugcaga

SEQ ID NO: 1752774 - RNA, 17 nt, Homo sapiens
uuucaaggcauuugucu

SEQ ID NO: 1752775 - RNA, 17 nt, Homo sapiens
caucugaaccacuuugc

SEQ ID NO: 1752776 - RNA, 16 nt, Homo sapiens
cuccuccagaccuccu

SEQ ID NO: 1752777 - RNA, 16 nt, Homo sapiens
caccugcuguccugca

SEQ ID NO: 1752778 - RNA, 12 nt, Homo sapiens
ccucagucucac

SEQ ID NO: 1752779 - RNA, 19 nt, Homo sapiens
uacucuggcaaaugaugau

SEQ ID NO: 1752780 - RNA, 22 nt, Homo sapiens
acacagcgagacuccgucucaa

SEQ ID NO: 1752781 - RNA, 18 nt, Homo sapiens
caaagugacaaagcaauu

SEQ ID NO: 1752782 - RNA, 17 nt, Homo sapiens
caguaagaaaaagaaga

SEQ ID NO: 1752783 - RNA, 22 nt, Homo sapiens
ugaauuacaguugaaagcugua

SEQ ID NO: 1752784 - RNA, 12 nt, Homo sapiens
uauaugcaauau

SEQ ID NO: 1752785 - RNA, 23 nt, Homo sapiens
gacaacaaaugggucccucaguc

SEQ ID NO: 1752786 - RNA, 22 nt, Homo sapiens
agaaauggccaaauauauuucc

SEQ ID NO: 1752787 - RNA, 18 nt, Homo sapiens
uguaggaaaagcuguucc

SEQ ID NO: 1752788 - RNA, 23 nt, Homo sapiens
auguuggaugaugaaacauucau

SEQ ID NO: 1752789 - RNA, 17 nt, Homo sapiens
aaaauauaaguggugcu

SEQ ID NO: 1752790 - RNA, 20 nt, Homo sapiens
uaaaaauuuauaagcauuug

SEQ ID NO: 1752791 - RNA, 22 nt, Homo sapiens
caggucuuccugcuuuccaugg

SEQ ID NO: 1752792 - RNA, 16 nt, Homo sapiens
aucucuugaaaccugu

SEQ ID NO: 1752793 - RNA, 14 nt, Homo sapiens
uggcaaagugacaa

SEQ ID NO: 1752794 - RNA, 19 nt, Homo sapiens
ucuggaccccaucugugaa

SEQ ID NO: 1752795 - RNA, 23 nt, Homo sapiens
cccagagaccccuuccuuuccuc

SEQ ID NO: 1752796 - RNA, 14 nt, Homo sapiens
ccagcuacucagga

SEQ ID NO: 1752797 - RNA, 17 nt, Homo sapiens
acccagccucagaucca

SEQ ID NO: 1752798 - RNA, 16 nt, Homo sapiens
uggaauguuacaucug

SEQ ID NO: 1752799 - RNA, 19 nt, Homo sapiens
cagccucccuaguagcugg

SEQ ID NO: 1752800 - RNA, 14 nt, Homo sapiens
uuguuuaacuguga

SEQ ID NO: 1752801 - RNA, 21 nt, Homo sapiens
gcucaaagcguggacaggugu

SEQ ID NO: 1752802 - RNA, 16 nt, Homo sapiens
uugccaaucugcauuu

SEQ ID NO: 1752803 - RNA, 18 nt, Homo sapiens
cuccauuucuacaaugca

SEQ ID NO: 1752804 - RNA, 15 nt, Homo sapiens
ugcaucugaccagca

SEQ ID NO: 1752805 - RNA, 22 nt, Homo sapiens
auaggaaaagauguauggucua

SEQ ID NO: 1752806 - RNA, 15 nt, Homo sapiens
guauauauaauacug

SEQ ID NO: 1752807 - RNA, 18 nt, Homo sapiens
ccucaauaaauguugcuu

SEQ ID NO: 1752808 - RNA, 14 nt, Homo sapiens
agggucugcacucu

SEQ ID NO: 1752809 - RNA, 15 nt, Homo sapiens
aaacaaugcagaucu

SEQ ID NO: 1752810 - RNA, 17 nt, Homo sapiens
uaaugacaaggugauau

SEQ ID NO: 1752811 - RNA, 16 nt, Homo sapiens
uguuuacagugucugu

SEQ ID NO: 1752812 - RNA, 13 nt, Homo sapiens
ugagaacacugug

SEQ ID NO: 1752813 - RNA, 16 nt, Homo sapiens
ccaagugaggccauag

SEQ ID NO: 1752814 - RNA, 23 nt, Homo sapiens
aaagacuaacaggagaaugcaca

SEQ ID NO: 1752815 - RNA, 12 nt, Homo sapiens
cugacaguauua

SEQ ID NO: 1752816 - RNA, 17 nt, Homo sapiens
aucauagcucacuguaa

SEQ ID NO: 1752817 - RNA, 13 nt, Homo sapiens
aguuccacugcug

SEQ ID NO: 1752818 - RNA, 13 nt, Homo sapiens
acucuggggaugg

SEQ ID NO: 1752819 - RNA, 18 nt, Homo sapiens
guacuugugaccauugua

SEQ ID NO: 1752820 - RNA, 17 nt, Homo sapiens
ccagagaccugacccaa

SEQ ID NO: 1752821 - RNA, 13 nt, Homo sapiens
gaucauauuucac

SEQ ID NO: 1752822 - RNA, 14 nt, Homo sapiens
acacuggucacagg

SEQ ID NO: 1752823 - RNA, 16 nt, Homo sapiens
agguguuucuuuccug

SEQ ID NO: 1752824 - RNA, 20 nt, Homo sapiens
cccccucaaaagccaaaaaa

SEQ ID NO: 1752825 - RNA, 16 nt, Homo sapiens
auauauuguaaagaag

SEQ ID NO: 1752826 - RNA, 19 nt, Homo sapiens
ucgggacagaccagcagca

SEQ ID NO: 1752827 - RNA, 13 nt, Homo sapiens
agcaucugaccau

SEQ ID NO: 1752828 - RNA, 13 nt, Homo sapiens
aguuacugacuua

SEQ ID NO: 1752829 - RNA, 21 nt, Homo sapiens
gccuuuccagagaacugcaga

SEQ ID NO: 1752830 - RNA, 20 nt, Homo sapiens
uccaccccacuggaucuuca

SEQ ID NO: 1752831 - RNA, 18 nt, Homo sapiens
aauguguaagcauuguau

SEQ ID NO: 1752832 - RNA, 20 nt, Homo sapiens
aauucggcaguuggccaaaa

SEQ ID NO: 1752833 - RNA, 16 nt, Homo sapiens
uacuacccagcucugu

SEQ ID NO: 1752834 - RNA, 18 nt, Homo sapiens
aagagcaauauuccagua

SEQ ID NO: 1752835 - RNA, 15 nt, Homo sapiens
ugguugcauuuguca

SEQ ID NO: 1752836 - RNA, 16 nt, Homo sapiens
ggaaauaucugugaag

SEQ ID NO: 1752837 - RNA, 20 nt, Homo sapiens
gccacuagugggguccugag

SEQ ID NO: 1752838 - RNA, 16 nt, Homo sapiens
uaagacguauguaaca

SEQ ID NO: 1752839 - RNA, 10 nt, Homo sapiens
caggugggag

SEQ ID NO: 1752840 - RNA, 19 nt, Homo sapiens
cuuauuaugcauaaagcca

SEQ ID NO: 1752841 - RNA, 15 nt, Homo sapiens
gcauauguugaauac

SEQ ID NO: 1752842 - RNA, 20 nt, Homo sapiens
agcuaucucucagugaacug

SEQ ID NO: 1752843 - RNA, 23 nt, Homo sapiens
cucagcccucgggccgggcacca

SEQ ID NO: 1752844 - RNA, 22 nt, Homo sapiens
acacacuucggcucucuggaca

SEQ ID NO: 1752845 - RNA, 19 nt, Homo sapiens
gcccucaccagaagcagau

SEQ ID NO: 1752846 - RNA, 18 nt, Homo sapiens
ggucaucaaacauuugcc

SEQ ID NO: 1752847 - RNA, 19 nt, Homo sapiens
ugugauguuaugaauacau

SEQ ID NO: 1752848 - RNA, 15 nt, Homo sapiens
uacaaccaauuccaa

SEQ ID NO: 1752849 - RNA, 11 nt, Homo sapiens
gggccucagug

SEQ ID NO: 1752850 - RNA, 13 nt, Homo sapiens
agguggugccaau

SEQ ID NO: 1752851 - RNA, 13 nt, Homo sapiens
gaauuugcuaaua

SEQ ID NO: 1752852 - RNA, 15 nt, Homo sapiens
auccagcugggcuag

SEQ ID NO: 1752853 - RNA, 17 nt, Homo sapiens
ccacgcauggugcagga

SEQ ID NO: 1752854 - RNA, 18 nt, Homo sapiens
ggcugcccacacacccca

SEQ ID NO: 1752855 - RNA, 13 nt, Homo sapiens
aaaugacuacuua

SEQ ID NO: 1752856 - RNA, 13 nt, Homo sapiens
aaaugauacagua

SEQ ID NO: 1752857 - RNA, 20 nt, Homo sapiens
uuaagagagugaacauaucc

SEQ ID NO: 1752858 - RNA, 13 nt, Homo sapiens
ccagccacugcag

SEQ ID NO: 1752859 - RNA, 16 nt, Homo sapiens
cagacgggcacagugg

SEQ ID NO: 1752860 - RNA, 21 nt, Homo sapiens
aauuauagcucaugugcauua

SEQ ID NO: 1752861 - RNA, 19 nt, Homo sapiens
gcugugcgagggggccuug

SEQ ID NO: 1752862 - RNA, 22 nt, Homo sapiens
uauuguuaggagaugucaucaa

SEQ ID NO: 1752863 - RNA, 13 nt, Homo sapiens
gagcacuucuaag

SEQ ID NO: 1752864 - RNA, 23 nt, Homo sapiens
uguacauguucuugucauaaaau

SEQ ID NO: 1752865 - RNA, 17 nt, Homo sapiens
cguauagggcacuccca

SEQ ID NO: 1752866 - RNA, 15 nt, Homo sapiens
cuggaauuuaauuca

SEQ ID NO: 1752867 - RNA, 14 nt, Homo sapiens
ugucauugcuuuac

SEQ ID NO: 1752868 - RNA, 13 nt, Homo sapiens
uaaucgugucuuc

SEQ ID NO: 1752869 - RNA, 23 nt, Homo sapiens
cuuggcaugguggcacgugccug

SEQ ID NO: 1752870 - RNA, 23 nt, Homo sapiens
gauccaaguuuacucaacccucu

SEQ ID NO: 1752871 - RNA, 19 nt, Homo sapiens
cuucccucgugacaguggu

SEQ ID NO: 1752872 - RNA, 19 nt, Homo sapiens
ugguauguaauggaacuua

SEQ ID NO: 1752873 - RNA, 23 nt, Homo sapiens
ucuccuucccugcagagcuuugg

SEQ ID NO: 1752874 - RNA, 22 nt, Homo sapiens
aaggucacacaguauuaaguga

SEQ ID NO: 1752875 - RNA, 17 nt, Homo sapiens
cagauacagcacaucca

SEQ ID NO: 1752876 - RNA, 20 nt, Homo sapiens
auccuaaaagagaucugggc

SEQ ID NO: 1752877 - RNA, 16 nt, Homo sapiens
ugaacuccuuccccac

SEQ ID NO: 1752878 - RNA, 19 nt, Homo sapiens
cacagaaagacugagcuca

SEQ ID NO: 1752879 - RNA, 23 nt, Homo sapiens
acucagggaucucagaccuagug

SEQ ID NO: 1752880 - RNA, 18 nt, Homo sapiens
ugguuagugcaugucaca

SEQ ID NO: 1752881 - RNA, 21 nt, Homo sapiens
gagcaaugcuuuuaaugaauu

SEQ ID NO: 1752882 - RNA, 19 nt, Homo sapiens
ucgacuguauucgugcauu

SEQ ID NO: 1752883 - RNA, 13 nt, Homo sapiens
uguuuugcucaau

SEQ ID NO: 1752884 - RNA, 23 nt, Homo sapiens
uauuuccuuuccaaguauuucac

SEQ ID NO: 1752885 - RNA, 18 nt, Homo sapiens
aaacaacaaauaagucaa

SEQ ID NO: 1752886 - RNA, 11 nt, Homo sapiens
uggugacucac

SEQ ID NO: 1752887 - RNA, 20 nt, Homo sapiens
uacuauauuuauacuguaua

SEQ ID NO: 1752888 - RNA, 15 nt, Homo sapiens
ucuuugucauaccuu

SEQ ID NO: 1752889 - RNA, 22 nt, Homo sapiens
cucugcagccucagagacauca

SEQ ID NO: 1752890 - RNA, 16 nt, Homo sapiens
gcagccaaccaagaug

SEQ ID NO: 1752891 - RNA, 19 nt, Homo sapiens
uagaauaggcagggggccc

SEQ ID NO: 1752892 - RNA, 16 nt, Homo sapiens
auugaaauuuugcacc

SEQ ID NO: 1752893 - RNA, 13 nt, Homo sapiens
uccauaauuauua

SEQ ID NO: 1752894 - RNA, 17 nt, Homo sapiens
ugaacugagccuagcua

SEQ ID NO: 1752895 - RNA, 14 nt, Homo sapiens
cugugaacugauca

SEQ ID NO: 1752896 - RNA, 20 nt, Homo sapiens
cacaguugagugcaucccag

SEQ ID NO: 1752897 - RNA, 15 nt, Homo sapiens
uucucccucauuuca

SEQ ID NO: 1752898 - RNA, 12 nt, Homo sapiens
ucuuuuaucuag

SEQ ID NO: 1752899 - RNA, 17 nt, Homo sapiens
agcccagcuacauuccu

SEQ ID NO: 1752900 - RNA, 15 nt, Homo sapiens
cucuguuucuucaau

SEQ ID NO: 1752901 - RNA, 21 nt, Homo sapiens
ucucuagcagugaguacucau

SEQ ID NO: 1752902 - RNA, 16 nt, Homo sapiens
uaugaauugcugucua

SEQ ID NO: 1752903 - RNA, 15 nt, Homo sapiens
cauguaauugcagau

SEQ ID NO: 1752904 - RNA, 13 nt, Homo sapiens
aaagcugugggac

SEQ ID NO: 1752905 - RNA, 15 nt, Homo sapiens
caaacuacauguaau

SEQ ID NO: 1752906 - RNA, 22 nt, Homo sapiens
ucccauggguuguguguuuauu

SEQ ID NO: 1752907 - RNA, 20 nt, Homo sapiens
gacaccagagcccacuucca

SEQ ID NO: 1752908 - RNA, 16 nt, Homo sapiens
ggcuuugcuuagcuug

SEQ ID NO: 1752909 - RNA, 15 nt, Homo sapiens
cauaacucacuuuaa

SEQ ID NO: 1752910 - RNA, 19 nt, Homo sapiens
uacucgcuauuuuguagua

SEQ ID NO: 1752911 - RNA, 15 nt, Homo sapiens
aauaucccaacauuc

SEQ ID NO: 1752912 - RNA, 20 nt, Homo sapiens
cauucuuuuugaaaugucaa

SEQ ID NO: 1752913 - RNA, 11 nt, Homo sapiens
acuuaacuuaa

SEQ ID NO: 1752914 - RNA, 21 nt, Homo sapiens
ggaagcaacaggaaucaagag

SEQ ID NO: 1752915 - RNA, 15 nt, Homo sapiens
ccagccaucuuuggc

SEQ ID NO: 1752916 - RNA, 12 nt, Homo sapiens
ggaggaggugac

SEQ ID NO: 1752917 - RNA, 13 nt, Homo sapiens
gagacucugucuc

SEQ ID NO: 1752918 - RNA, 14 nt, Homo sapiens
aaauucacuuaggg

SEQ ID NO: 1752919 - RNA, 17 nt, Homo sapiens
ggcuagaaccuggagaa

SEQ ID NO: 1752920 - RNA, 21 nt, Homo sapiens
guccaggaaaugugcacaaaa

SEQ ID NO: 1752921 - RNA, 14 nt, Homo sapiens
gcugcuaggccaga

SEQ ID NO: 1752922 - RNA, 14 nt, Homo sapiens
uucagaaguuugcu

SEQ ID NO: 1752923 - RNA, 17 nt, Homo sapiens
cuccacucaguugcaac

SEQ ID NO: 1752924 - RNA, 17 nt, Homo sapiens
auuuggucugccagaau

SEQ ID NO: 1752925 - RNA, 15 nt, Homo sapiens
aagucugacucucca

SEQ ID NO: 1752926 - RNA, 18 nt, Homo sapiens
uggacagaaaaugcaaug

SEQ ID NO: 1752927 - RNA, 17 nt, Homo sapiens
auguguaugugccauuu

SEQ ID NO: 1752928 - RNA, 21 nt, Homo sapiens
gcccaaauggcucugugaaau

SEQ ID NO: 1752929 - RNA, 22 nt, Homo sapiens
agccagagcugugccugcucag

SEQ ID NO: 1752930 - RNA, 16 nt, Homo sapiens
uugguccuugcugcca

SEQ ID NO: 1752931 - RNA, 18 nt, Homo sapiens
uuaucaccucauucugaa

SEQ ID NO: 1752932 - RNA, 22 nt, Homo sapiens
uagaauagccuguggccuuugc

SEQ ID NO: 1752933 - RNA, 13 nt, Homo sapiens
agagguuucuuga

SEQ ID NO: 1752934 - RNA, 17 nt, Homo sapiens
aguaccuuaaucugcca

SEQ ID NO: 1752935 - RNA, 23 nt, Homo sapiens
uuugcaaacacugugauuacucu

SEQ ID NO: 1752936 - RNA, 18 nt, Homo sapiens
gcacaagguaaauauuca

SEQ ID NO: 1752937 - RNA, 15 nt, Homo sapiens
ugacagaguaagacu

SEQ ID NO: 1752938 - RNA, 16 nt, Homo sapiens
ucuucuccagaaggca

SEQ ID NO: 1752939 - RNA, 21 nt, Homo sapiens
cucaccuaaacccucugugaa

SEQ ID NO: 1752940 - RNA, 23 nt, Homo sapiens
cugcacaucuguaaaucuacaca

SEQ ID NO: 1752941 - RNA, 12 nt, Homo sapiens
ugugaaaccacu

SEQ ID NO: 1752942 - RNA, 23 nt, Homo sapiens
guaauuaguguugugcacuucau

SEQ ID NO: 1752943 - RNA, 18 nt, Homo sapiens
aagagaccacccauauca

SEQ ID NO: 1752944 - RNA, 14 nt, Homo sapiens
aggaagacuugaag

SEQ ID NO: 1752945 - RNA, 14 nt, Homo sapiens
agugacacuuugac

SEQ ID NO: 1752946 - RNA, 14 nt, Homo sapiens
agcuuuacuucuuu

SEQ ID NO: 1752947 - RNA, 15 nt, Homo sapiens
aacuucuuacuggaa

SEQ ID NO: 1752948 - RNA, 17 nt, Homo sapiens
accaucuacaucuccuu

SEQ ID NO: 1752949 - RNA, 18 nt, Homo sapiens
ugaaccaaaccaaaucau

SEQ ID NO: 1752950 - RNA, 11 nt, Homo sapiens
acauguuccug

SEQ ID NO: 1752951 - RNA, 12 nt, Homo sapiens
cuagaauuauuc

SEQ ID NO: 1752952 - RNA, 23 nt, Homo sapiens
ccaaggcugccagacauggaccu

SEQ ID NO: 1752953 - RNA, 15 nt, Homo sapiens
cuuccuccuccauca

SEQ ID NO: 1752954 - RNA, 9 nt, Homo sapiens
uaaugccaa

SEQ ID NO: 1752955 - RNA, 18 nt, Homo sapiens
cugcccauuguaacuuau

SEQ ID NO: 1752956 - RNA, 11 nt, Homo sapiens
auuacauauuu

SEQ ID NO: 1752957 - RNA, 18 nt, Homo sapiens
gcuguccucccaccucag

SEQ ID NO: 1752958 - RNA, 14 nt, Homo sapiens
cuuguaaauaugau

SEQ ID NO: 1752959 - RNA, 16 nt, Homo sapiens
cagcuguaaacauauu

SEQ ID NO: 1752960 - RNA, 14 nt, Homo sapiens
uaaaguuacaguuu

SEQ ID NO: 1752961 - RNA, 19 nt, Homo sapiens
cagaugccuacaaccaucc

SEQ ID NO: 1752962 - RNA, 19 nt, Homo sapiens
cccuuuaucauguguuucu

SEQ ID NO: 1752963 - RNA, 15 nt, Homo sapiens
uugagggcaauggac

SEQ ID NO: 1752964 - RNA, 21 nt, Homo sapiens
acaaagaauuuaaaauaacac

SEQ ID NO: 1752965 - RNA, 15 nt, Homo sapiens
uggaaauauguaaug

SEQ ID NO: 1752966 - RNA, 13 nt, Homo sapiens
aaaucagggccac

SEQ ID NO: 1752967 - RNA, 19 nt, Homo sapiens
gcagucugcuucugcaccu

SEQ ID NO: 1752968 - RNA, 22 nt, Homo sapiens
caggaucaaaccccgaccaccu

SEQ ID NO: 1752969 - RNA, 12 nt, Homo sapiens
ucuggcuucccu

SEQ ID NO: 1752970 - RNA, 16 nt, Homo sapiens
gaaaucuuaaaccuua

SEQ ID NO: 1752971 - RNA, 14 nt, Homo sapiens
agcugcucuugcau

SEQ ID NO: 1752972 - RNA, 23 nt, Homo sapiens
aaaaaccucuaugcaaucugagu

SEQ ID NO: 1752973 - RNA, 20 nt, Homo sapiens
guaacucauuuacagucaua

SEQ ID NO: 1752974 - RNA, 19 nt, Homo sapiens
aguuuuccuacacuugaga

SEQ ID NO: 1752975 - RNA, 21 nt, Homo sapiens
agcaaaccaaagaccaucuga

SEQ ID NO: 1752976 - RNA, 12 nt, Homo sapiens
auuuacuguggc

SEQ ID NO: 1752977 - RNA, 23 nt, Homo sapiens
cuuauuuugauuguuugaugaau

SEQ ID NO: 1752978 - RNA, 18 nt, Homo sapiens
acccagucaccucugucu

SEQ ID NO: 1752979 - RNA, 23 nt, Homo sapiens
uuggaggagcaaaggcugagaac

SEQ ID NO: 1752980 - RNA, 18 nt, Homo sapiens
ccuggaugaaguuaucug

SEQ ID NO: 1752981 - RNA, 17 nt, Homo sapiens
auccccuggcuccagag

SEQ ID NO: 1752982 - RNA, 18 nt, Homo sapiens
augcaaucucuugucuca

SEQ ID NO: 1752983 - RNA, 20 nt, Homo sapiens
ggauaugcccuccuggugac

SEQ ID NO: 1752984 - RNA, 18 nt, Homo sapiens
gacaauuaucaaccacgu

SEQ ID NO: 1752985 - RNA, 20 nt, Homo sapiens
ccaggcugccugugugcaug

SEQ ID NO: 1752986 - RNA, 22 nt, Homo sapiens
gauuccuuuugauggggagaaa

SEQ ID NO: 1752987 - RNA, 20 nt, Homo sapiens
caacccaauaaaacugaugu

SEQ ID NO: 1752988 - RNA, 19 nt, Homo sapiens
gacaauucauucauuugca

SEQ ID NO: 1752989 - RNA, 19 nt, Homo sapiens
uccucacagagguccgggu

SEQ ID NO: 1752990 - RNA, 23 nt, Homo sapiens
gcuacugccgucagugcugugcu

SEQ ID NO: 1752991 - RNA, 23 nt, Homo sapiens
auaaacagagcuuucaaacacuc

SEQ ID NO: 1752992 - RNA, 18 nt, Homo sapiens
agcucuguauggucagga

SEQ ID NO: 1752993 - RNA, 13 nt, Homo sapiens
gauuauguucaau

SEQ ID NO: 1752994 - RNA, 14 nt, Homo sapiens
uacugugcauacau

SEQ ID NO: 1752995 - RNA, 16 nt, Homo sapiens
acagagccacucuuca

SEQ ID NO: 1752996 - RNA, 19 nt, Homo sapiens
caauaaguuccauguuaaa

SEQ ID NO: 1752997 - RNA, 15 nt, Homo sapiens
uagcagggauagauu

SEQ ID NO: 1752998 - RNA, 16 nt, Homo sapiens
gaacagaagauuuggc

SEQ ID NO: 1752999 - RNA, 18 nt, Homo sapiens
aagcaauaauuaacugcu

SEQ ID NO: 1753000 - RNA, 19 nt, Homo sapiens
uauauaugcauaccuggau

SEQ ID NO: 1753001 - RNA, 19 nt, Homo sapiens
agagacgguguuuugccau

SEQ ID NO: 1753002 - RNA, 21 nt, Homo sapiens
acacacaccucuaggacucca

SEQ ID NO: 1753003 - RNA, 21 nt, Homo sapiens
caggaggugugauuccugaag

SEQ ID NO: 1753004 - RNA, 12 nt, Homo sapiens
cacagauaagua

SEQ ID NO: 1753005 - RNA, 13 nt, Homo sapiens
auugggugggggg

SEQ ID NO: 1753006 - RNA, 24 nt, Homo sapiens
guuagaugcccccacccaccugua

SEQ ID NO: 1753007 - RNA, 13 nt, Homo sapiens
aaaacugcauuuu

SEQ ID NO: 1753008 - RNA, 22 nt, Homo sapiens
uugcacacuuugguaccagaua

SEQ ID NO: 1753009 - RNA, 18 nt, Homo sapiens
uaccuuugcuacuacuau

SEQ ID NO: 1753010 - RNA, 22 nt, Homo sapiens
cugucacuugcuggcugugaaa

SEQ ID NO: 1753011 - RNA, 20 nt, Homo sapiens
guucaucaauaccugcugag

SEQ ID NO: 1753012 - RNA, 23 nt, Homo sapiens
ccguggcuuugguuuaaaagaca

SEQ ID NO: 1753013 - RNA, 13 nt, Homo sapiens
gggacugagccug

SEQ ID NO: 1753014 - RNA, 13 nt, Homo sapiens
guggggacaucag

SEQ ID NO: 1753015 - RNA, 19 nt, Homo sapiens
ucacauaguuuauuucaac

SEQ ID NO: 1753016 - RNA, 14 nt, Homo sapiens
cugcacacaugcac

SEQ ID NO: 1753017 - RNA, 21 nt, Homo sapiens
agaaacacaaauguaaaauaa

SEQ ID NO: 1753018 - RNA, 12 nt, Homo sapiens
cucacaaacagu

SEQ ID NO: 1753019 - RNA, 22 nt, Homo sapiens
cagcauaccuuuauugugaucu

SEQ ID NO: 1753020 - RNA, 15 nt, Homo sapiens
guaaaacuauauucu

SEQ ID NO: 1753021 - RNA, 22 nt, Homo sapiens
caaaggugccucauagcauagc

SEQ ID NO: 1753022 - RNA, 22 nt, Homo sapiens
aggagccaggccuugggcuccu

SEQ ID NO: 1753023 - RNA, 16 nt, Homo sapiens
ugucuaauaguuauuc

SEQ ID NO: 1753024 - RNA, 23 nt, Homo sapiens
gagugcaguaguaauugauuuga

SEQ ID NO: 1753025 - RNA, 13 nt, Homo sapiens
agggaaaacugca

SEQ ID NO: 1753026 - RNA, 21 nt, Homo sapiens
ggggauaauguccccacuccc

SEQ ID NO: 1753027 - RNA, 15 nt, Homo sapiens
cucgccuaggauuuc

SEQ ID NO: 1753028 - RNA, 19 nt, Homo sapiens
acccuagccuccaccaucc

SEQ ID NO: 1753029 - RNA, 19 nt, Homo sapiens
caaaucaauaaauucccaa

SEQ ID NO: 1753030 - RNA, 15 nt, Homo sapiens
guggccugaucagca

SEQ ID NO: 1753031 - RNA, 12 nt, Homo sapiens
ucauuucacuuu

SEQ ID NO: 1753032 - RNA, 12 nt, Homo sapiens
ucucuucacuac

SEQ ID NO: 1753033 - RNA, 19 nt, Homo sapiens
cacauaauacauuccauca

SEQ ID NO: 1753034 - RNA, 14 nt, Homo sapiens
acgugccguuuaaa

SEQ ID NO: 1753035 - RNA, 20 nt, Homo sapiens
ugugacguagcaaucuuggu

SEQ ID NO: 1753036 - RNA, 16 nt, Homo sapiens
cauaaauguugacaug

SEQ ID NO: 1753037 - RNA, 17 nt, Homo sapiens
gacucaguggguuaaca

SEQ ID NO: 1753038 - RNA, 12 nt, Homo sapiens
ccacagcugcag

SEQ ID NO: 1753039 - RNA, 14 nt, Homo sapiens
uugaguuacagggg

SEQ ID NO: 1753040 - RNA, 17 nt, Homo sapiens
acuagccccccaguggu

SEQ ID NO: 1753041 - RNA, 17 nt, Homo sapiens
acacccagcaauagaga

SEQ ID NO: 1753042 - RNA, 15 nt, Homo sapiens
uuuccauauagucua

SEQ ID NO: 1753043 - RNA, 18 nt, Homo sapiens
acuaaccauccccaacuc

SEQ ID NO: 1753044 - RNA, 13 nt, Homo sapiens
ugguuaugaacuu

SEQ ID NO: 1753045 - RNA, 18 nt, Homo sapiens
ugcugacucuggccuuac

SEQ ID NO: 1753046 - RNA, 13 nt, Homo sapiens
agaaguucacauc

SEQ ID NO: 1753047 - RNA, 20 nt, Homo sapiens
uuggucuuacuuugugcaaa

SEQ ID NO: 1753048 - RNA, 12 nt, Homo sapiens
uuccauggaaau

SEQ ID NO: 1753049 - RNA, 15 nt, Homo sapiens
acuugccagggcucu

SEQ ID NO: 1753050 - RNA, 19 nt, Homo sapiens
uccuuuaaaccaucagccg

SEQ ID NO: 1753051 - RNA, 13 nt, Homo sapiens
agccugaccucua

SEQ ID NO: 1753052 - RNA, 15 nt, Homo sapiens
ccccauuccugggaa

SEQ ID NO: 1753053 - RNA, 18 nt, Homo sapiens
ccgagaaggaauggugcu

SEQ ID NO: 1753054 - RNA, 18 nt, Homo sapiens
uaugauuccagguggcau

SEQ ID NO: 1753055 - RNA, 16 nt, Homo sapiens
ugaaaucccaucaggu

SEQ ID NO: 1753056 - RNA, 16 nt, Homo sapiens
auuaaagacuaacuaa

SEQ ID NO: 1753057 - RNA, 18 nt, Homo sapiens
accagacagagggucaca

SEQ ID NO: 1753058 - RNA, 14 nt, Homo sapiens
auugucugucuaca

SEQ ID NO: 1753059 - RNA, 16 nt, Homo sapiens
uuugugccccacacua

SEQ ID NO: 1753060 - RNA, 20 nt, Homo sapiens
ugcaccaaagagaaugcccu

SEQ ID NO: 1753061 - RNA, 14 nt, Homo sapiens
aaugaccucaagau

SEQ ID NO: 1753062 - RNA, 15 nt, Homo sapiens
gccaaagauaaucuc

SEQ ID NO: 1753063 - RNA, 21 nt, Homo sapiens
cacugcggaagccaaaggcag

SEQ ID NO: 1753064 - RNA, 17 nt, Homo sapiens
ugaggcccucauuccca

SEQ ID NO: 1753065 - RNA, 20 nt, Homo sapiens
gaaugcggccgcauucccug

SEQ ID NO: 1753066 - RNA, 14 nt, Homo sapiens
guaaaggaggaaua

SEQ ID NO: 1753067 - RNA, 14 nt, Homo sapiens
acgugccauugucu

SEQ ID NO: 1753068 - RNA, 22 nt, Homo sapiens
cgccuguggacagccugaguca

SEQ ID NO: 1753069 - RNA, 15 nt, Homo sapiens
uauauuucaugaaua

SEQ ID NO: 1753070 - RNA, 15 nt, Homo sapiens
uaacauaugauacug

SEQ ID NO: 1753071 - RNA, 23 nt, Homo sapiens
gaaccucucaggaucaaugaccc

SEQ ID NO: 1753072 - RNA, 16 nt, Homo sapiens
gagagacccugucuca

SEQ ID NO: 1753073 - RNA, 16 nt, Homo sapiens
guaugaaacaaacuac

SEQ ID NO: 1753074 - RNA, 11 nt, Homo sapiens
uggaagcagag

SEQ ID NO: 1753075 - RNA, 14 nt, Homo sapiens
uucucacagcaaac

SEQ ID NO: 1753076 - RNA, 13 nt, Homo sapiens
cauacacuugcau

SEQ ID NO: 1753077 - RNA, 23 nt, Homo sapiens
aagacuaaugcuuucuguggaca

SEQ ID NO: 1753078 - RNA, 17 nt, Homo sapiens
aguggcaccagaggugc

SEQ ID NO: 1753079 - RNA, 16 nt, Homo sapiens
cuccauguuugaugua

SEQ ID NO: 1753080 - RNA, 15 nt, Homo sapiens
uaaaguacauaacaa

SEQ ID NO: 1753081 - RNA, 22 nt, Homo sapiens
uguccacauaauccacgcucau

SEQ ID NO: 1753082 - RNA, 21 nt, Homo sapiens
gaugcugccaggggcagugaa

SEQ ID NO: 1753083 - RNA, 15 nt, Homo sapiens
aaaguccacaguuua

SEQ ID NO: 1753084 - RNA, 17 nt, Homo sapiens
cauaaauuauuucuaaa

SEQ ID NO: 1753085 - RNA, 22 nt, Homo sapiens
aauuccaaguagaauugauuuc

SEQ ID NO: 1753086 - RNA, 14 nt, Homo sapiens
uuuauccuagucau

SEQ ID NO: 1753087 - RNA, 20 nt, Homo sapiens
accaagugccuugagcugcc

SEQ ID NO: 1753088 - RNA, 17 nt, Homo sapiens
gaaaacagaugaccaua

SEQ ID NO: 1753089 - RNA, 20 nt, Homo sapiens
aggaaaacgugaacaaacuu

SEQ ID NO: 1753090 - RNA, 13 nt, Homo sapiens
aauagacugugaa

SEQ ID NO: 1753091 - RNA, 16 nt, Homo sapiens
uauucucucuaugcaa

SEQ ID NO: 1753092 - RNA, 14 nt, Homo sapiens
ugccagcauaugca

SEQ ID NO: 1753093 - RNA, 13 nt, Homo sapiens
ucuccaugcucac

SEQ ID NO: 1753094 - RNA, 15 nt, Homo sapiens
cuuuucuuuaccagu

SEQ ID NO: 1753095 - RNA, 13 nt, Homo sapiens
acuguucaucuca

SEQ ID NO: 1753096 - RNA, 19 nt, Homo sapiens
agggguacauuucccugug

SEQ ID NO: 1753097 - RNA, 11 nt, Homo sapiens
uacaacacugg

SEQ ID NO: 1753098 - RNA, 15 nt, Homo sapiens
gcugggaguggcaug

SEQ ID NO: 1753099 - RNA, 20 nt, Homo sapiens
ugaggagagcacccuaggca

SEQ ID NO: 1753100 - RNA, 21 nt, Homo sapiens
ggcucagccuagugaacugca

SEQ ID NO: 1753101 - RNA, 13 nt, Homo sapiens
auaaacugcaagu

SEQ ID NO: 1753102 - RNA, 14 nt, Homo sapiens
uggcccagccuuug

SEQ ID NO: 1753103 - RNA, 21 nt, Homo sapiens
cacaaacgauuuggaucaaaa

SEQ ID NO: 1753104 - RNA, 23 nt, Homo sapiens
ucuaaugauguucucugacccag

SEQ ID NO: 1753105 - RNA, 19 nt, Homo sapiens
gacgugauuuugcuguaga

SEQ ID NO: 1753106 - RNA, 21 nt, Homo sapiens
uuacuuccaugauacuuuaau

SEQ ID NO: 1753107 - RNA, 21 nt, Homo sapiens
auauuguugacaacugugacu

SEQ ID NO: 1753108 - RNA, 17 nt, Homo sapiens
uuaauguauucccuuca

SEQ ID NO: 1753109 - RNA, 19 nt, Homo sapiens
guucauucugcauugagaa

SEQ ID NO: 1753110 - RNA, 19 nt, Homo sapiens
uuccaggggucguuugcuu

SEQ ID NO: 1753111 - RNA, 15 nt, Homo sapiens
aaugaacccaagagc

SEQ ID NO: 1753112 - RNA, 21 nt, Homo sapiens
gagacagucuggaaagugaug

SEQ ID NO: 1753113 - RNA, 13 nt, Homo sapiens
caaaauucauuca

SEQ ID NO: 1753114 - RNA, 16 nt, Homo sapiens
cacugcccacuggccg

SEQ ID NO: 1753115 - RNA, 19 nt, Homo sapiens
aagugucuugagacuuuau

SEQ ID NO: 1753116 - RNA, 21 nt, Homo sapiens
guacaaauaaaccugaggcag

SEQ ID NO: 1753117 - RNA, 18 nt, Homo sapiens
gacccuuggaacuuugaa

SEQ ID NO: 1753118 - RNA, 21 nt, Homo sapiens
uuauuccaaaauaacaaaaua

SEQ ID NO: 1753119 - RNA, 13 nt, Homo sapiens
acaccacacauac

SEQ ID NO: 1753120 - RNA, 15 nt, Homo sapiens
caagcuccaccacuu

SEQ ID NO: 1753121 - RNA, 19 nt, Homo sapiens
ucaaaauguccugauuaca

SEQ ID NO: 1753122 - RNA, 20 nt, Homo sapiens
gcggccuacagaaaaaggaa

SEQ ID NO: 1753123 - RNA, 15 nt, Homo sapiens
agccgggaaagaaga

SEQ ID NO: 1753124 - RNA, 16 nt, Homo sapiens
cauuuucaagacugaa

SEQ ID NO: 1753125 - RNA, 22 nt, Homo sapiens
ugagcgucacugcccaccaaag

SEQ ID NO: 1753126 - RNA, 13 nt, Homo sapiens
gaauuaaagucua

SEQ ID NO: 1753127 - RNA, 20 nt, Homo sapiens
cauuuacuuagcagaaccac

SEQ ID NO: 1753128 - RNA, 14 nt, Homo sapiens
cugcacuccagaau

SEQ ID NO: 1753129 - RNA, 19 nt, Homo sapiens
gcagaucuggacuuggcaa

SEQ ID NO: 1753130 - RNA, 15 nt, Homo sapiens
uggggaggggugcuc

SEQ ID NO: 1753131 - RNA, 20 nt, Homo sapiens
gucacgggaggaacaugaca

SEQ ID NO: 1753132 - RNA, 21 nt, Homo sapiens
aaugauacaguugcauguuau

SEQ ID NO: 1753133 - RNA, 16 nt, Homo sapiens
gguacauuucccugug

SEQ ID NO: 1753134 - RNA, 17 nt, Homo sapiens
caaaauuacacaguuaa

SEQ ID NO: 1753135 - RNA, 16 nt, Homo sapiens
cuacagaacacuuugc

SEQ ID NO: 1753136 - RNA, 15 nt, Homo sapiens
gccccagaccccagg

SEQ ID NO: 1753137 - RNA, 15 nt, Homo sapiens
cugcccucuauuuau

SEQ ID NO: 1753138 - RNA, 16 nt, Homo sapiens
ggacaccauccaggaa

SEQ ID NO: 1753139 - RNA, 20 nt, Homo sapiens
aauucauuuucaucacuggg

SEQ ID NO: 1753140 - RNA, 14 nt, Homo sapiens
cuccugacuuuuaa

SEQ ID NO: 1753141 - RNA, 19 nt, Homo sapiens
ucucaaggguuaaccagac

SEQ ID NO: 1753142 - RNA, 12 nt, Homo sapiens
gcuggaaccagc

SEQ ID NO: 1753143 - RNA, 16 nt, Homo sapiens
agucuggccacuguca

SEQ ID NO: 1753144 - RNA, 16 nt, Homo sapiens
aacucgggcacucccu

SEQ ID NO: 1753145 - RNA, 16 nt, Homo sapiens
uucucccacuuggcca

SEQ ID NO: 1753146 - RNA, 12 nt, Homo sapiens
aagagcugaaaa

SEQ ID NO: 1753147 - RNA, 17 nt, Homo sapiens
uaggguccuggcccucu

SEQ ID NO: 1753148 - RNA, 15 nt, Homo sapiens
auauuuaucuuucaa

SEQ ID NO: 1753149 - RNA, 21 nt, Homo sapiens
uugaguaccuacugugugcca

SEQ ID NO: 1753150 - RNA, 19 nt, Homo sapiens
ggcuccucucacuucccag

SEQ ID NO: 1753151 - RNA, 17 nt, Homo sapiens
cagccgcucuccugcca

SEQ ID NO: 1753152 - RNA, 16 nt, Homo sapiens
aggugaggucagcaca

SEQ ID NO: 1753153 - RNA, 14 nt, Homo sapiens
caugauugcccaau

SEQ ID NO: 1753154 - RNA, 20 nt, Homo sapiens
aguaggguuugacauuucau

SEQ ID NO: 1753155 - RNA, 20 nt, Homo sapiens
ugguucaggccaagccccuu

SEQ ID NO: 1753156 - RNA, 19 nt, Homo sapiens
augccuguguacugccuua

SEQ ID NO: 1753157 - RNA, 15 nt, Homo sapiens
acccuuugcugugag

SEQ ID NO: 1753158 - RNA, 14 nt, Homo sapiens
gcuugucagaaaca

SEQ ID NO: 1753159 - RNA, 16 nt, Homo sapiens
caaaucucaaagugua

SEQ ID NO: 1753160 - RNA, 16 nt, Homo sapiens
ucucucuacugaucaa

SEQ ID NO: 1753161 - RNA, 14 nt, Homo sapiens
aagggaauugcuca

SEQ ID NO: 1753162 - RNA, 14 nt, Homo sapiens
gcugccaaaaccac

SEQ ID NO: 1753163 - RNA, 19 nt, Homo sapiens
uagaugagagaacagggcu

SEQ ID NO: 1753164 - RNA, 19 nt, Homo sapiens
augaacauauguccaucca

SEQ ID NO: 1753165 - RNA, 21 nt, Homo sapiens
aauacaauagagccacuaaga

SEQ ID NO: 1753166 - RNA, 14 nt, Homo sapiens
gucccauccuggac

SEQ ID NO: 1753167 - RNA, 18 nt, Homo sapiens
agaaaaucaucuuggcca

SEQ ID NO: 1753168 - RNA, 20 nt, Homo sapiens
aguccagaauaagugcuguu

SEQ ID NO: 1753169 - RNA, 14 nt, Homo sapiens
uaauaaauacuuaa

SEQ ID NO: 1753170 - RNA, 14 nt, Homo sapiens
ggauuuuucuuuaa

SEQ ID NO: 1753171 - RNA, 12 nt, Homo sapiens
cuuaguuuccac

SEQ ID NO: 1753172 - RNA, 14 nt, Homo sapiens
caaucuguccagac

SEQ ID NO: 1753173 - RNA, 18 nt, Homo sapiens
acuuuaguauuccuguaa

SEQ ID NO: 1753174 - RNA, 22 nt, Homo sapiens
uacgagaugaccuugacauacc

SEQ ID NO: 1753175 - RNA, 14 nt, Homo sapiens
aaauuaacauguca

SEQ ID NO: 1753176 - RNA, 19 nt, Homo sapiens
gagugcaguggugugaucu

SEQ ID NO: 1753177 - RNA, 12 nt, Homo sapiens
ccucaaacugca

SEQ ID NO: 1753178 - RNA, 12 nt, Homo sapiens
uguucauuuccu

SEQ ID NO: 1753179 - RNA, 12 nt, Homo sapiens
gcaaaucacaaa

SEQ ID NO: 1753180 - RNA, 15 nt, Homo sapiens
ucccagcccacucau

SEQ ID NO: 1753181 - RNA, 16 nt, Homo sapiens
auauuucaagugccua

SEQ ID NO: 1753182 - RNA, 19 nt, Homo sapiens
uacauaaguuccuauaccu

SEQ ID NO: 1753183 - RNA, 13 nt, Homo sapiens
agucuugcauucu

SEQ ID NO: 1753184 - RNA, 16 nt, Homo sapiens
auuauauaagcaaaau

SEQ ID NO: 1753185 - RNA, 14 nt, Homo sapiens
aggugauggcagaa

SEQ ID NO: 1753186 - RNA, 14 nt, Homo sapiens
aauaaagugacccu

SEQ ID NO: 1753187 - RNA, 20 nt, Homo sapiens
cauaccuuuggauuuagugu

SEQ ID NO: 1753188 - RNA, 17 nt, Homo sapiens
uucuggagugagcacuc

SEQ ID NO: 1753189 - RNA, 20 nt, Homo sapiens
gcagaaaauuguacaaccug

SEQ ID NO: 1753190 - RNA, 12 nt, Homo sapiens
agagucagcucu

SEQ ID NO: 1753191 - RNA, 20 nt, Homo sapiens
acagucucccuuccuaugcu

SEQ ID NO: 1753192 - RNA, 23 nt, Homo sapiens
ucaucuguagauacuagcuaucu

SEQ ID NO: 1753193 - RNA, 15 nt, Homo sapiens
aaagaacaucugcac

SEQ ID NO: 1753194 - RNA, 14 nt, Homo sapiens
ucaugcuucacuua

SEQ ID NO: 1753195 - RNA, 17 nt, Homo sapiens
gucuccucugcagcuca

SEQ ID NO: 1753196 - RNA, 19 nt, Homo sapiens
gcccuuaccccacacacag

SEQ ID NO: 1753197 - RNA, 20 nt, Homo sapiens
cucccaggcccgagauguga

SEQ ID NO: 1753198 - RNA, 14 nt, Homo sapiens
ccagaugacacaua

SEQ ID NO: 1753199 - RNA, 15 nt, Homo sapiens
ggguauguguugcca

SEQ ID NO: 1753200 - RNA, 19 nt, Homo sapiens
uucuuuguauaugcauucu

SEQ ID NO: 1753201 - RNA, 18 nt, Homo sapiens
gcauuuguuccaugccug

SEQ ID NO: 1753202 - RNA, 20 nt, Homo sapiens
agaguauuggucuccucuca

SEQ ID NO: 1753203 - RNA, 17 nt, Homo sapiens
ucucuugcuaccuguga

SEQ ID NO: 1753204 - RNA, 16 nt, Homo sapiens
cucaauccuaucacag

SEQ ID NO: 1753205 - RNA, 20 nt, Homo sapiens
uuuguuaaaaacacugcuga

SEQ ID NO: 1753206 - RNA, 18 nt, Homo sapiens
ccauguguguguacaaca

SEQ ID NO: 1753207 - RNA, 21 nt, Homo sapiens
uguuucagaaagagcucucca

SEQ ID NO: 1753208 - RNA, 13 nt, Homo sapiens
gagaagauuucag

SEQ ID NO: 1753209 - RNA, 21 nt, Homo sapiens
gucucugccugcggcccagaa

SEQ ID NO: 1753210 - RNA, 14 nt, Homo sapiens
uuaauucaucuuua

SEQ ID NO: 1753211 - RNA, 14 nt, Homo sapiens
guuuaucagcaaaa

SEQ ID NO: 1753212 - RNA, 18 nt, Homo sapiens
ucaccaugcccagcuaau

SEQ ID NO: 1753213 - RNA, 17 nt, Homo sapiens
aagucuaagaaagcaau

SEQ ID NO: 1753214 - RNA, 13 nt, Homo sapiens
acugacaguuuac

SEQ ID NO: 1753215 - RNA, 20 nt, Homo sapiens
gaaagacugaaagaauacau

SEQ ID NO: 1753216 - RNA, 23 nt, Homo sapiens
agucccaaccccagcuacucuga

SEQ ID NO: 1753217 - RNA, 19 nt, Homo sapiens
acuuagaugggcauggugg

SEQ ID NO: 1753218 - RNA, 21 nt, Homo sapiens
cugauuauuuucuacacauac

SEQ ID NO: 1753219 - RNA, 22 nt, Homo sapiens
caaauuuggcucacuugccuua

SEQ ID NO: 1753220 - RNA, 20 nt, Homo sapiens
gaaggagauaauuacugccu

SEQ ID NO: 1753221 - RNA, 14 nt, Homo sapiens
ugaaguacuuuuaa

SEQ ID NO: 1753222 - RNA, 21 nt, Homo sapiens
gaucaaaauaaaaagugacac

SEQ ID NO: 1753223 - RNA, 17 nt, Homo sapiens
caccauuuagaacuuuc

SEQ ID NO: 1753224 - RNA, 20 nt, Homo sapiens
aguuguuuguuuuugcuugu

SEQ ID NO: 1753225 - RNA, 19 nt, Homo sapiens
cuuuaugaaguuaacaguc

SEQ ID NO: 1753226 - RNA, 15 nt, Homo sapiens
acuauguaaaccaca

SEQ ID NO: 1753227 - RNA, 16 nt, Homo sapiens
cugccugguauaucca

SEQ ID NO: 1753228 - RNA, 18 nt, Homo sapiens
cuuccccuggcacuggca

SEQ ID NO: 1753229 - RNA, 14 nt, Homo sapiens
cugaagaagaugag

SEQ ID NO: 1753230 - RNA, 14 nt, Homo sapiens
ggccucagucucua

SEQ ID NO: 1753231 - RNA, 19 nt, Homo sapiens
agcaggugugacccugagg

SEQ ID NO: 1753232 - RNA, 14 nt, Homo sapiens
auaaauuugguucu

SEQ ID NO: 1753233 - RNA, 21 nt, Homo sapiens
cuccuccauccauguguucca

SEQ ID NO: 1753234 - RNA, 11 nt, Homo sapiens
ccuuuccauaa

SEQ ID NO: 1753235 - RNA, 16 nt, Homo sapiens
ccucucagagcuacuu

SEQ ID NO: 1753236 - RNA, 18 nt, Homo sapiens
acuauaaacuacuguaau

SEQ ID NO: 1753237 - RNA, 22 nt, Homo sapiens
uauauaauuuuaugguggaaaa

SEQ ID NO: 1753238 - RNA, 22 nt, Homo sapiens
acaguucaacauaaagagcaau

SEQ ID NO: 1753239 - RNA, 15 nt, Homo sapiens
uuguugaacacuuga

SEQ ID NO: 1753240 - RNA, 15 nt, Homo sapiens
cagacacauucacac

SEQ ID NO: 1753241 - RNA, 13 nt, Homo sapiens
cacaaaaacagaa

SEQ ID NO: 1753242 - RNA, 17 nt, Homo sapiens
gaagcaccaaucaugaa

SEQ ID NO: 1753243 - RNA, 13 nt, Homo sapiens
uaugaaaacucau

SEQ ID NO: 1753244 - RNA, 13 nt, Homo sapiens
ccaacagaugugu

SEQ ID NO: 1753245 - RNA, 21 nt, Homo sapiens
aggacacccucccacaugaug

SEQ ID NO: 1753246 - RNA, 13 nt, Homo sapiens
agucuguaccuca

SEQ ID NO: 1753247 - RNA, 18 nt, Homo sapiens
acagaugacaaugggagc

SEQ ID NO: 1753248 - RNA, 16 nt, Homo sapiens
agaacaacuacuguga

SEQ ID NO: 1753249 - RNA, 16 nt, Homo sapiens
ucauagcucacuguaa

SEQ ID NO: 1753250 - RNA, 18 nt, Homo sapiens
ugcucuccaagucucagu

SEQ ID NO: 1753251 - RNA, 18 nt, Homo sapiens
gcucugugugguccaggu

SEQ ID NO: 1753252 - RNA, 23 nt, Homo sapiens
aucacuuguaccuuccacaagac

SEQ ID NO: 1753253 - RNA, 18 nt, Homo sapiens
gcacacagcugcagagac

SEQ ID NO: 1753254 - RNA, 22 nt, Homo sapiens
gggcaggcaagguuuacacugc

SEQ ID NO: 1753255 - RNA, 15 nt, Homo sapiens
agaaagaaugcaaga

SEQ ID NO: 1753256 - RNA, 17 nt, Homo sapiens
ccauuucauuugugcca

SEQ ID NO: 1753257 - RNA, 15 nt, Homo sapiens
guggagguugcagug

SEQ ID NO: 1753258 - RNA, 21 nt, Homo sapiens
agaauauguaacagccaaacc

SEQ ID NO: 1753259 - RNA, 16 nt, Homo sapiens
cuugugcacuggaugu

SEQ ID NO: 1753260 - RNA, 18 nt, Homo sapiens
aaguggccccacauagcc

SEQ ID NO: 1753261 - RNA, 23 nt, Homo sapiens
acacgggggcagcugauacaaau

SEQ ID NO: 1753262 - RNA, 15 nt, Homo sapiens
auugucauaaccaac

SEQ ID NO: 1753263 - RNA, 18 nt, Homo sapiens
auuucucuccucacacac

SEQ ID NO: 1753264 - RNA, 21 nt, Homo sapiens
uccuauuuccccaaagacuua

SEQ ID NO: 1753265 - RNA, 16 nt, Homo sapiens
aagaggggccugauga

SEQ ID NO: 1753266 - RNA, 21 nt, Homo sapiens
auaaaaccauuuuuugaacca

SEQ ID NO: 1753267 - RNA, 20 nt, Homo sapiens
ucacugagaaaggcucaauu

SEQ ID NO: 1753268 - RNA, 21 nt, Homo sapiens
aaauuuuagcguuaaagucag

SEQ ID NO: 1753269 - RNA, 17 nt, Homo sapiens
ugcugcaccuggucaua

SEQ ID NO: 1753270 - RNA, 14 nt, Homo sapiens
ggacccaaagagga

SEQ ID NO: 1753271 - RNA, 12 nt, Homo sapiens
ucacuugcucaa

SEQ ID NO: 1753272 - RNA, 14 nt, Homo sapiens
gaauuaugcaucug

SEQ ID NO: 1753273 - RNA, 12 nt, Homo sapiens
ugaccucuagcc

SEQ ID NO: 1753274 - RNA, 12 nt, Homo sapiens
uuagaaaguaau

SEQ ID NO: 1753275 - RNA, 16 nt, Homo sapiens
guaaauaacugugacu

SEQ ID NO: 1753276 - RNA, 14 nt, Homo sapiens
gcuuagaagugcua

SEQ ID NO: 1753277 - RNA, 17 nt, Homo sapiens
uaacaauauaugauaua

SEQ ID NO: 1753278 - RNA, 16 nt, Homo sapiens
aaaugccuuugaccca

SEQ ID NO: 1753279 - RNA, 20 nt, Homo sapiens
ggcuccaggccccaccuccu

SEQ ID NO: 1753280 - RNA, 21 nt, Homo sapiens
cugaaggcauaugcacaguca

SEQ ID NO: 1753281 - RNA, 15 nt, Homo sapiens
gauguauguguaaua

SEQ ID NO: 1753282 - RNA, 11 nt, Homo sapiens
cacaccacagc

SEQ ID NO: 1753283 - RNA, 19 nt, Homo sapiens
agcauguggggaagcaaga

SEQ ID NO: 1753284 - RNA, 14 nt, Homo sapiens
acucaugacugcau

SEQ ID NO: 1753285 - RNA, 17 nt, Homo sapiens
aauagcuauugcaugua

SEQ ID NO: 1753286 - RNA, 19 nt, Homo sapiens
uuaucuuggccuuacugua

SEQ ID NO: 1753287 - RNA, 20 nt, Homo sapiens
gccaagcucaggaccaggca

SEQ ID NO: 1753288 - RNA, 23 nt, Homo sapiens
auccauuccucagggacagagac

SEQ ID NO: 1753289 - RNA, 23 nt, Homo sapiens
uccccaagugguuuccacaugcu

SEQ ID NO: 1753290 - RNA, 17 nt, Homo sapiens
aucucugaggccucaga

SEQ ID NO: 1753291 - RNA, 18 nt, Homo sapiens
guuaaugucauugcuaaa

SEQ ID NO: 1753292 - RNA, 19 nt, Homo sapiens
ugccuguggggguccauuu

SEQ ID NO: 1753293 - RNA, 14 nt, Homo sapiens
uuuaaauguucaca

SEQ ID NO: 1753294 - RNA, 21 nt, Homo sapiens
gucagcacaggccauggugca

SEQ ID NO: 1753295 - RNA, 20 nt, Homo sapiens
accaguguagcaucuuccuc

SEQ ID NO: 1753296 - RNA, 12 nt, Homo sapiens
aaagccaaaaac

SEQ ID NO: 1753297 - RNA, 21 nt, Homo sapiens
aaggauuauuacuaauucuau

SEQ ID NO: 1753298 - RNA, 19 nt, Homo sapiens
gacacucacagcaaggaug

SEQ ID NO: 1753299 - RNA, 17 nt, Homo sapiens
accugcaugugcuguca

SEQ ID NO: 1753300 - RNA, 17 nt, Homo sapiens
cauuaggguaauaucau

SEQ ID NO: 1753301 - RNA, 17 nt, Homo sapiens
gcacaucacaacauuua

SEQ ID NO: 1753302 - RNA, 14 nt, Homo sapiens
guaguuauucugcc

SEQ ID NO: 1753303 - RNA, 12 nt, Homo sapiens
auucacaucuca

SEQ ID NO: 1753304 - RNA, 19 nt, Homo sapiens
agauguuccauccuguaca

SEQ ID NO: 1753305 - RNA, 21 nt, Homo sapiens
aggacccgcccaagaguggcc

SEQ ID NO: 1753306 - RNA, 21 nt, Homo sapiens
ccugcccccagcgugggggug

SEQ ID NO: 1753307 - RNA, 20 nt, Homo sapiens
auuagccuugaacaaccaga

SEQ ID NO: 1753308 - RNA, 17 nt, Homo sapiens
uuagagucaauuugcug

SEQ ID NO: 1753309 - RNA, 16 nt, Homo sapiens
ugcaacaaaaagucau

SEQ ID NO: 1753310 - RNA, 14 nt, Homo sapiens
auuggggaggacua

SEQ ID NO: 1753311 - RNA, 21 nt, Homo sapiens
ucguggguguguguagccaag

SEQ ID NO: 1753312 - RNA, 20 nt, Homo sapiens
gcuuccuggggaccaagauu

SEQ ID NO: 1753313 - RNA, 14 nt, Homo sapiens
aacugcuccucccc

SEQ ID NO: 1753314 - RNA, 20 nt, Homo sapiens
uccucacauauuauugguca

SEQ ID NO: 1753315 - RNA, 17 nt, Homo sapiens
gcgcucgccacgcucag

SEQ ID NO: 1753316 - RNA, 21 nt, Homo sapiens
uuggcgggggcuuggcugugc

SEQ ID NO: 1753317 - RNA, 17 nt, Homo sapiens
accauggcauaaagcug

SEQ ID NO: 1753318 - RNA, 20 nt, Homo sapiens
caguuuagcaagaacaccua

SEQ ID NO: 1753319 - RNA, 20 nt, Homo sapiens
cuguguaagaagcugugaau

SEQ ID NO: 1753320 - RNA, 23 nt, Homo sapiens
uagaauaguaugaugcuuuacau

SEQ ID NO: 1753321 - RNA, 15 nt, Homo sapiens
uucucuauuuugccu

SEQ ID NO: 1753322 - RNA, 12 nt, Homo sapiens
caggcccugugg

SEQ ID NO: 1753323 - RNA, 19 nt, Homo sapiens
gccacacaagugcaguagu

SEQ ID NO: 1753324 - RNA, 17 nt, Homo sapiens
uuggcaguggacucaga

SEQ ID NO: 1753325 - RNA, 13 nt, Homo sapiens
gcugcacugcccu

SEQ ID NO: 1753326 - RNA, 17 nt, Homo sapiens
aggauauuugcacuauu

SEQ ID NO: 1753327 - RNA, 21 nt, Homo sapiens
guauuuuuuacauuuuacaca

SEQ ID NO: 1753328 - RNA, 11 nt, Homo sapiens
aucuaccuccc

SEQ ID NO: 1753329 - RNA, 17 nt, Homo sapiens
guguaucucagcauuuu

SEQ ID NO: 1753330 - RNA, 22 nt, Homo sapiens
caaugcucaccucuucuuuacc

SEQ ID NO: 1753331 - RNA, 16 nt, Homo sapiens
cauuuuuccaugacau

SEQ ID NO: 1753332 - RNA, 16 nt, Homo sapiens
caugaccuaucaguau

SEQ ID NO: 1753333 - RNA, 20 nt, Homo sapiens
ccaucuccuauaaucuguca

SEQ ID NO: 1753334 - RNA, 16 nt, Homo sapiens
ucaggcagggugcagu

SEQ ID NO: 1753335 - RNA, 22 nt, Homo sapiens
ucauauuucuuuucuuucucau

SEQ ID NO: 1753336 - RNA, 15 nt, Homo sapiens
gccccuccaucugua

SEQ ID NO: 1753337 - RNA, 18 nt, Homo sapiens
cacaaccggucccuucca

SEQ ID NO: 1753338 - RNA, 18 nt, Homo sapiens
uccaaagugccacucauu

SEQ ID NO: 1753339 - RNA, 11 nt, Homo sapiens
ccaagucacac

SEQ ID NO: 1753340 - RNA, 12 nt, Homo sapiens
gcuuucaugacc

SEQ ID NO: 1753341 - RNA, 18 nt, Homo sapiens
gacuauuaaaacuaauaa

SEQ ID NO: 1753342 - RNA, 19 nt, Homo sapiens
auguaaaauuacacuuuga

SEQ ID NO: 1753343 - RNA, 19 nt, Homo sapiens
auucaaagaaaacccuaag

SEQ ID NO: 1753344 - RNA, 22 nt, Homo sapiens
cuuuugacaaauucuuuuucac

SEQ ID NO: 1753345 - RNA, 18 nt, Homo sapiens
uugaaagacaucaaugaa

SEQ ID NO: 1753346 - RNA, 19 nt, Homo sapiens
auuuugagcccccauucca

SEQ ID NO: 1753347 - RNA, 12 nt, Homo sapiens
ccccggcccacc

SEQ ID NO: 1753348 - RNA, 18 nt, Homo sapiens
uucuggagggaagcacca

SEQ ID NO: 1753349 - RNA, 16 nt, Homo sapiens
uuaacugaacugugaa

SEQ ID NO: 1753350 - RNA, 19 nt, Homo sapiens
cuauuuauauguacaugag

SEQ ID NO: 1753351 - RNA, 16 nt, Homo sapiens
gccagggcugcccuga

SEQ ID NO: 1753352 - RNA, 16 nt, Homo sapiens
aacucuaccugcacac

SEQ ID NO: 1753353 - RNA, 16 nt, Homo sapiens
acacacagauaugcac

SEQ ID NO: 1753354 - RNA, 18 nt, Homo sapiens
aaauuagccauuucacuc

SEQ ID NO: 1753355 - RNA, 20 nt, Homo sapiens
cuccuuggucuaagugugcu

SEQ ID NO: 1753356 - RNA, 17 nt, Homo sapiens
uggguuuugugccuuug

SEQ ID NO: 1753357 - RNA, 16 nt, Homo sapiens
gaaacuugaacucugg

SEQ ID NO: 1753358 - RNA, 23 nt, Homo sapiens
cagagcagcuccaccacugugca

SEQ ID NO: 1753359 - RNA, 20 nt, Homo sapiens
cucccguguaggaaccugca

SEQ ID NO: 1753360 - RNA, 17 nt, Homo sapiens
ucucugugucugagagc

SEQ ID NO: 1753361 - RNA, 19 nt, Homo sapiens
gcugccuggaacaccagca

SEQ ID NO: 1753362 - RNA, 16 nt, Homo sapiens
augauccagggauugg

SEQ ID NO: 1753363 - RNA, 22 nt, Homo sapiens
aucaauauuuuuauaucaugca

SEQ ID NO: 1753364 - RNA, 12 nt, Homo sapiens
ucaccaggggag

SEQ ID NO: 1753365 - RNA, 13 nt, Homo sapiens
gcccuucuacccc

SEQ ID NO: 1753366 - RNA, 17 nt, Homo sapiens
ugucgugucugcuguug

SEQ ID NO: 1753367 - RNA, 17 nt, Homo sapiens
cuuuguaggcauugcau

SEQ ID NO: 1753368 - RNA, 12 nt, Homo sapiens
auagaauuaaca

SEQ ID NO: 1753369 - RNA, 22 nt, Homo sapiens
ucugaagguaaagggacacugg

SEQ ID NO: 1753370 - RNA, 22 nt, Homo sapiens
gaugaggaccaagggcaccugg

SEQ ID NO: 1753371 - RNA, 13 nt, Homo sapiens
gagcuacugauga

SEQ ID NO: 1753372 - RNA, 12 nt, Homo sapiens
guacaagcauuu

SEQ ID NO: 1753373 - RNA, 18 nt, Homo sapiens
caugcauuacuuacuguu

SEQ ID NO: 1753374 - RNA, 16 nt, Homo sapiens
accuucaggaaauaua

SEQ ID NO: 1753375 - RNA, 20 nt, Homo sapiens
caaucccuggggcugugcau

SEQ ID NO: 1753376 - RNA, 21 nt, Homo sapiens
ccaacccugccgucaccacca

SEQ ID NO: 1753377 - RNA, 23 nt, Homo sapiens
ugguucagugccuuccucucucu

SEQ ID NO: 1753378 - RNA, 17 nt, Homo sapiens
ucaacagaauucacuug

SEQ ID NO: 1753379 - RNA, 20 nt, Homo sapiens
uguguagcucuguccacucu

SEQ ID NO: 1753380 - RNA, 18 nt, Homo sapiens
auccuaugaaauacuuua

SEQ ID NO: 1753381 - RNA, 14 nt, Homo sapiens
cgaguuccagaccc

SEQ ID NO: 1753382 - RNA, 20 nt, Homo sapiens
aggagucccugguucauuga

SEQ ID NO: 1753383 - RNA, 17 nt, Homo sapiens
cucagacugcacccagg

SEQ ID NO: 1753384 - RNA, 22 nt, Homo sapiens
ugauucccuccugcuacucugu

SEQ ID NO: 1753385 - RNA, 16 nt, Homo sapiens
cuguguguccaaaacu

SEQ ID NO: 1753386 - RNA, 13 nt, Homo sapiens
uuucugaguucuu

SEQ ID NO: 1753387 - RNA, 17 nt, Homo sapiens
uuaauuuuuaaugcuua

SEQ ID NO: 1753388 - RNA, 20 nt, Homo sapiens
uuguauuaugugucacaugg

SEQ ID NO: 1753389 - RNA, 16 nt, Homo sapiens
ucggugaccuccgucc

SEQ ID NO: 1753390 - RNA, 13 nt, Homo sapiens
ucagauaugauau

SEQ ID NO: 1753391 - RNA, 14 nt, Homo sapiens
gguuccauucucac

SEQ ID NO: 1753392 - RNA, 13 nt, Homo sapiens
ccauucaaacagg

SEQ ID NO: 1753393 - RNA, 18 nt, Homo sapiens
aucucagcgugggccaga

SEQ ID NO: 1753394 - RNA, 15 nt, Homo sapiens
cacaaguacuugaga

SEQ ID NO: 1753395 - RNA, 20 nt, Homo sapiens
ggauacaauguauaagcuac

SEQ ID NO: 1753396 - RNA, 20 nt, Homo sapiens
ugaaaccaccgugaaccaga

SEQ ID NO: 1753397 - RNA, 21 nt, Homo sapiens
acacuaucaccuauuacauuu

SEQ ID NO: 1753398 - RNA, 20 nt, Homo sapiens
uuuggggcucagaguggggu

SEQ ID NO: 1753399 - RNA, 16 nt, Homo sapiens
uacacaauucaguuaa

SEQ ID NO: 1753400 - RNA, 15 nt, Homo sapiens
agcgugcgucugugu

SEQ ID NO: 1753401 - RNA, 20 nt, Homo sapiens
guuggaugaugaaacauuca

SEQ ID NO: 1753402 - RNA, 20 nt, Homo sapiens
gccuguaaucccagcacuuu

SEQ ID NO: 1753403 - RNA, 19 nt, Homo sapiens
acuacuccugaggaugcua

SEQ ID NO: 1753404 - RNA, 14 nt, Homo sapiens
guuggauaagccaa

SEQ ID NO: 1753405 - RNA, 17 nt, Homo sapiens
aaguggcugaugggaac

SEQ ID NO: 1753406 - RNA, 22 nt, Homo sapiens
aaguauuuaguuauaucacuug

SEQ ID NO: 1753407 - RNA, 16 nt, Homo sapiens
acauuuccaaaugaau

SEQ ID NO: 1753408 - RNA, 18 nt, Homo sapiens
augagaugauacauccaa

SEQ ID NO: 1753409 - RNA, 12 nt, Homo sapiens
uucuaagcaugu

SEQ ID NO: 1753410 - RNA, 16 nt, Homo sapiens
gcagacccccaugaga

SEQ ID NO: 1753411 - RNA, 18 nt, Homo sapiens
uugauuuuuacugaggaa

SEQ ID NO: 1753412 - RNA, 20 nt, Homo sapiens
gcauccccccugcucagcaa

SEQ ID NO: 1753413 - RNA, 18 nt, Homo sapiens
aguucaaaacaaccacuu

SEQ ID NO: 1753414 - RNA, 19 nt, Homo sapiens
acaagaaucuaaacuuuau

SEQ ID NO: 1753415 - RNA, 11 nt, Homo sapiens
gauuccauuug

SEQ ID NO: 1753416 - RNA, 20 nt, Homo sapiens
cucaauuuaagauacaaaua

SEQ ID NO: 1753417 - RNA, 16 nt, Homo sapiens
cuguugauuccacuga

SEQ ID NO: 1753418 - RNA, 11 nt, Homo sapiens
ggcugccuugu

SEQ ID NO: 1753419 - RNA, 16 nt, Homo sapiens
gagaaggcccacugag

SEQ ID NO: 1753420 - RNA, 12 nt, Homo sapiens
cuauagagccaa

SEQ ID NO: 1753421 - RNA, 15 nt, Homo sapiens
gcagagagcaccugg

SEQ ID NO: 1753422 - RNA, 15 nt, Homo sapiens
aaugaagacacucaa

SEQ ID NO: 1753423 - RNA, 16 nt, Homo sapiens
cccaagcagagaagcu

SEQ ID NO: 1753424 - RNA, 15 nt, Homo sapiens
ugugguuaacgccuu

SEQ ID NO: 1753425 - RNA, 17 nt, Homo sapiens
agagagauucagaaguu

SEQ ID NO: 1753426 - RNA, 18 nt, Homo sapiens
gaaguuugguuucuuugc

SEQ ID NO: 1753427 - RNA, 15 nt, Homo sapiens
ccuguagucccagcu

SEQ ID NO: 1753428 - RNA, 14 nt, Homo sapiens
ucauaaaguuacag

SEQ ID NO: 1753429 - RNA, 14 nt, Homo sapiens
acaaaagaaacuua

SEQ ID NO: 1753430 - RNA, 14 nt, Homo sapiens
cacacuauggcaug

SEQ ID NO: 1753431 - RNA, 23 nt, Homo sapiens
uuagacuuuuaacuucaccuuaa

SEQ ID NO: 1753432 - RNA, 14 nt, Homo sapiens
uuucuacaggccag

SEQ ID NO: 1753433 - RNA, 18 nt, Homo sapiens
uuguauagacaucugccc

SEQ ID NO: 1753434 - RNA, 18 nt, Homo sapiens
ggacuggugugcucucuu

SEQ ID NO: 1753435 - RNA, 17 nt, Homo sapiens
ugcugagguacagaagc

SEQ ID NO: 1753436 - RNA, 17 nt, Homo sapiens
auuacaagccuacauga

SEQ ID NO: 1753437 - RNA, 18 nt, Homo sapiens
caugaaaauaaacuugaa

SEQ ID NO: 1753438 - RNA, 20 nt, Homo sapiens
uugcccaggcuggagugcaa

SEQ ID NO: 1753439 - RNA, 13 nt, Homo sapiens
cuuuucucaggac

SEQ ID NO: 1753440 - RNA, 23 nt, Homo sapiens
gguaccucucaacauuaccaaaa

SEQ ID NO: 1753441 - RNA, 21 nt, Homo sapiens
aagucuuugguaaauggcaaa

SEQ ID NO: 1753442 - RNA, 20 nt, Homo sapiens
ggcacacaccaccaugcuca

SEQ ID NO: 1753443 - RNA, 17 nt, Homo sapiens
ccuaaucaagagucucu

SEQ ID NO: 1753444 - RNA, 20 nt, Homo sapiens
ucaacauggcaauugcacuc

SEQ ID NO: 1753445 - RNA, 20 nt, Homo sapiens
gaacgcaagaggcaucccaa

SEQ ID NO: 1753446 - RNA, 20 nt, Homo sapiens
gcuuggagcaaucagaacuu

SEQ ID NO: 1753447 - RNA, 19 nt, Homo sapiens
caaaaaugaaauccaguga

SEQ ID NO: 1753448 - RNA, 14 nt, Homo sapiens
uccagacacuuaac

SEQ ID NO: 1753449 - RNA, 23 nt, Homo sapiens
aguggcaaccuugucucuaugcc

SEQ ID NO: 1753450 - RNA, 18 nt, Homo sapiens
ugcucuggaaaaugugac

SEQ ID NO: 1753451 - RNA, 10 nt, Homo sapiens
ggccucagag

SEQ ID NO: 1753452 - RNA, 23 nt, Homo sapiens
gagaaauacuuucaggcacuaag

SEQ ID NO: 1753453 - RNA, 20 nt, Homo sapiens
ugaacugcuugcuaccaauc

SEQ ID NO: 1753454 - RNA, 15 nt, Homo sapiens
acaguaguugcaaug

SEQ ID NO: 1753455 - RNA, 13 nt, Homo sapiens
uaaaguacuaaga

SEQ ID NO: 1753456 - RNA, 19 nt, Homo sapiens
acugcuccagaguugguga

SEQ ID NO: 1753457 - RNA, 16 nt, Homo sapiens
uacucugcccucuaga

SEQ ID NO: 1753458 - RNA, 20 nt, Homo sapiens
gcuuccugaaauaaacacug

SEQ ID NO: 1753459 - RNA, 19 nt, Homo sapiens
ucaguucugcuugcuccca

SEQ ID NO: 1753460 - RNA, 19 nt, Homo sapiens
aacuccuauaaagugccuc

SEQ ID NO: 1753461 - RNA, 19 nt, Homo sapiens
ggauaaaucauaaagucag

SEQ ID NO: 1753462 - RNA, 15 nt, Homo sapiens
cagccuacuuuucag

SEQ ID NO: 1753463 - RNA, 17 nt, Homo sapiens
guaaccaagaguauucc

SEQ ID NO: 1753464 - RNA, 17 nt, Homo sapiens
accaucugcugcaguua

SEQ ID NO: 1753465 - RNA, 13 nt, Homo sapiens
cuccuaccuauca

SEQ ID NO: 1753466 - RNA, 13 nt, Homo sapiens
caucuaccuucca

SEQ ID NO: 1753467 - RNA, 22 nt, Homo sapiens
gcacacgugaagcaacauuucu

SEQ ID NO: 1753468 - RNA, 13 nt, Homo sapiens
uacauaaacugac

SEQ ID NO: 1753469 - RNA, 19 nt, Homo sapiens
agugacuuugagcugagug

SEQ ID NO: 1753470 - RNA, 17 nt, Homo sapiens
uggaucucauccaucca

SEQ ID NO: 1753471 - RNA, 23 nt, Homo sapiens
auagagcagccugcugcucucag

SEQ ID NO: 1753472 - RNA, 14 nt, Homo sapiens
ccuggacugaccac

SEQ ID NO: 1753473 - RNA, 19 nt, Homo sapiens
acauuguguccugcuuaua

SEQ ID NO: 1753474 - RNA, 16 nt, Homo sapiens
agacuuuccauuacaa

SEQ ID NO: 1753475 - RNA, 12 nt, Homo sapiens
gcaagccagcuu

SEQ ID NO: 1753476 - RNA, 16 nt, Homo sapiens
cuuccagcaaaaucca

SEQ ID NO: 1753477 - RNA, 12 nt, Homo sapiens
uuacaucuggcu

SEQ ID NO: 1753478 - RNA, 20 nt, Homo sapiens
cagauugucuuauuacagca

SEQ ID NO: 1753479 - RNA, 15 nt, Homo sapiens
uccuggauuccucac

SEQ ID NO: 1753480 - RNA, 20 nt, Homo sapiens
cuuucaagugaaaccagcuu

SEQ ID NO: 1753481 - RNA, 18 nt, Homo sapiens
agccccagcagcccucaa

SEQ ID NO: 1753482 - RNA, 14 nt, Homo sapiens
auccaaaccuaccu

SEQ ID NO: 1753483 - RNA, 14 nt, Homo sapiens
acuggaacggugaa

SEQ ID NO: 1753484 - RNA, 21 nt, Homo sapiens
aaagucaccauucugcauuua

SEQ ID NO: 1753485 - RNA, 13 nt, Homo sapiens
ugaccacuuuauu

SEQ ID NO: 1753486 - RNA, 13 nt, Homo sapiens
gccagacucugcc

SEQ ID NO: 1753487 - RNA, 22 nt, Homo sapiens
ucccaaaucugaaucgaauuac

SEQ ID NO: 1753488 - RNA, 18 nt, Homo sapiens
gcucuguggcgagccauu

SEQ ID NO: 1753489 - RNA, 17 nt, Homo sapiens
uggagcucgugggacag

SEQ ID NO: 1753490 - RNA, 17 nt, Homo sapiens
cacauuaaguggcuuuu

SEQ ID NO: 1753491 - RNA, 22 nt, Homo sapiens
gucuucaacaugguuaccucug

SEQ ID NO: 1753492 - RNA, 13 nt, Homo sapiens
aggaaacugaguc

SEQ ID NO: 1753493 - RNA, 17 nt, Homo sapiens
ccuauagcaucuucuca

SEQ ID NO: 1753494 - RNA, 14 nt, Homo sapiens
gucacaaaggaaug

SEQ ID NO: 1753495 - RNA, 16 nt, Homo sapiens
gaucuacuacauccca

SEQ ID NO: 1753496 - RNA, 23 nt, Homo sapiens
augggauuucaccguauuagcca

SEQ ID NO: 1753497 - RNA, 13 nt, Homo sapiens
cuuccacauguac

SEQ ID NO: 1753498 - RNA, 19 nt, Homo sapiens
uggauaugaaacuuaggaa

SEQ ID NO: 1753499 - RNA, 15 nt, Homo sapiens
gccagaaggugcagg

SEQ ID NO: 1753500 - RNA, 18 nt, Homo sapiens
ggaaagcuuugaacaauu

SEQ ID NO: 1753501 - RNA, 17 nt, Homo sapiens
uuuccauuuaguaacag

SEQ ID NO: 1753502 - RNA, 20 nt, Homo sapiens
aggauuguuucucggcacca

SEQ ID NO: 1753503 - RNA, 20 nt, Homo sapiens
uaaccucggagacgggaccc

SEQ ID NO: 1753504 - RNA, 14 nt, Homo sapiens
caaagcaugcucag

SEQ ID NO: 1753505 - RNA, 21 nt, Homo sapiens
agcuacaauuuguuuuugcau

SEQ ID NO: 1753506 - RNA, 17 nt, Homo sapiens
acuggcauuuuuagcuc

SEQ ID NO: 1753507 - RNA, 23 nt, Homo sapiens
gccauaugcccucaucaucccag

SEQ ID NO: 1753508 - RNA, 13 nt, Homo sapiens
gaggccaacacug

SEQ ID NO: 1753509 - RNA, 12 nt, Homo sapiens
acaguaucucag

SEQ ID NO: 1753510 - RNA, 12 nt, Homo sapiens
uuucuaucauuc

SEQ ID NO: 1753511 - RNA, 19 nt, Homo sapiens
cagucacuugggagcugcu

SEQ ID NO: 1753512 - RNA, 13 nt, Homo sapiens
uauaucauaugua

SEQ ID NO: 1753513 - RNA, 22 nt, Homo sapiens
gguuuuccaucuuaucugucuu

SEQ ID NO: 1753514 - RNA, 18 nt, Homo sapiens
cuuaccacugcucugaug

SEQ ID NO: 1753515 - RNA, 15 nt, Homo sapiens
cugacccugcuccua

SEQ ID NO: 1753516 - RNA, 17 nt, Homo sapiens
aaauuauaagaugucau

SEQ ID NO: 1753517 - RNA, 16 nt, Homo sapiens
agcagcccccagcucc

SEQ ID NO: 1753518 - RNA, 19 nt, Homo sapiens
aacuucagugugguacaag

SEQ ID NO: 1753519 - RNA, 23 nt, Homo sapiens
cuggucauacauaggaugacaaa

SEQ ID NO: 1753520 - RNA, 17 nt, Homo sapiens
uggggaggccaggguag

SEQ ID NO: 1753521 - RNA, 19 nt, Homo sapiens
gccuucucuaaacauuuca

SEQ ID NO: 1753522 - RNA, 15 nt, Homo sapiens
uuuauguacaggaug

SEQ ID NO: 1753523 - RNA, 12 nt, Homo sapiens
cccaggaaccga

SEQ ID NO: 1753524 - RNA, 21 nt, Homo sapiens
uggagucccacccggacaggu

SEQ ID NO: 1753525 - RNA, 16 nt, Homo sapiens
gcauuucuacauguuu

SEQ ID NO: 1753526 - RNA, 18 nt, Homo sapiens
aaguguuuucauauugcu

SEQ ID NO: 1753527 - RNA, 22 nt, Homo sapiens
cacaucuuaauuaagcuccuuc

SEQ ID NO: 1753528 - RNA, 13 nt, Homo sapiens
agaacacauuuca

SEQ ID NO: 1753529 - RNA, 16 nt, Homo sapiens
guguggggaauggaaa

SEQ ID NO: 1753530 - RNA, 18 nt, Homo sapiens
uagaggauguggcuguaa

SEQ ID NO: 1753531 - RNA, 16 nt, Homo sapiens
uauucugcaagcaaua

SEQ ID NO: 1753532 - RNA, 16 nt, Homo sapiens
augcauucuuuucaga

SEQ ID NO: 1753533 - RNA, 21 nt, Homo sapiens
uucuguagcucaguucccaga

SEQ ID NO: 1753534 - RNA, 16 nt, Homo sapiens
ggacagucagcucucu

SEQ ID NO: 1753535 - RNA, 15 nt, Homo sapiens
ucaaacguguuauau

SEQ ID NO: 1753536 - RNA, 18 nt, Homo sapiens
aagcaggcugguuugcaa

SEQ ID NO: 1753537 - RNA, 16 nt, Homo sapiens
agugcacuccugguga

SEQ ID NO: 1753538 - RNA, 15 nt, Homo sapiens
auccacuucuuucag

SEQ ID NO: 1753539 - RNA, 17 nt, Homo sapiens
uauguuaaaauucucau

SEQ ID NO: 1753540 - RNA, 19 nt, Homo sapiens
ucggccagagucuguuuca

SEQ ID NO: 1753541 - RNA, 21 nt, Homo sapiens
uccuaauggcauggagacucu

SEQ ID NO: 1753542 - RNA, 18 nt, Homo sapiens
caaagugggguacaguaa

SEQ ID NO: 1753543 - RNA, 21 nt, Homo sapiens
ccuccuuccuuuuacuaccau

SEQ ID NO: 1753544 - RNA, 17 nt, Homo sapiens
gagauguauuaugcaaa

SEQ ID NO: 1753545 - RNA, 21 nt, Homo sapiens
uguguccugacacugcaauug

SEQ ID NO: 1753546 - RNA, 14 nt, Homo sapiens
cugaccucaaguga

SEQ ID NO: 1753547 - RNA, 16 nt, Homo sapiens
accuuguuauaugcag

SEQ ID NO: 1753548 - RNA, 17 nt, Homo sapiens
cuguaguucuaagacuc

SEQ ID NO: 1753549 - RNA, 19 nt, Homo sapiens
aguggcccauggcauuuua

SEQ ID NO: 1753550 - RNA, 15 nt, Homo sapiens
auacugggugcuguc

SEQ ID NO: 1753551 - RNA, 23 nt, Homo sapiens
ccaggcuggaguguaguggcaca

SEQ ID NO: 1753552 - RNA, 18 nt, Homo sapiens
agaaucuuccuggcacaa

SEQ ID NO: 1753553 - RNA, 15 nt, Homo sapiens
uuuuccagugacuug

SEQ ID NO: 1753554 - RNA, 13 nt, Homo sapiens
ugaaugugucacu

SEQ ID NO: 1753555 - RNA, 13 nt, Homo sapiens
ucaaagugugaca

SEQ ID NO: 1753556 - RNA, 17 nt, Homo sapiens
caccuugccaagcuuuc

SEQ ID NO: 1753557 - RNA, 15 nt, Homo sapiens
uccugucccuaccca

SEQ ID NO: 1753558 - RNA, 12 nt, Homo sapiens
uccucagccucu

SEQ ID NO: 1753559 - RNA, 23 nt, Homo sapiens
cugaauccauaaaggcauaccuu

SEQ ID NO: 1753560 - RNA, 19 nt, Homo sapiens
cucuuucaucuagcuccau

SEQ ID NO: 1753561 - RNA, 18 nt, Homo sapiens
aucacuuguggagcgcca

SEQ ID NO: 1753562 - RNA, 15 nt, Homo sapiens
cccaguggauuugga

SEQ ID NO: 1753563 - RNA, 23 nt, Homo sapiens
cuucugcaggaucccuacugcca

SEQ ID NO: 1753564 - RNA, 19 nt, Homo sapiens
ccuuuccucuuaauuccca

SEQ ID NO: 1753565 - RNA, 13 nt, Homo sapiens
aaacacauuuacc

SEQ ID NO: 1753566 - RNA, 18 nt, Homo sapiens
uaaacaauaucagacuuu

SEQ ID NO: 1753567 - RNA, 13 nt, Homo sapiens
uguuuuuuuccaa

SEQ ID NO: 1753568 - RNA, 13 nt, Homo sapiens
aguauuuuaccua

SEQ ID NO: 1753569 - RNA, 22 nt, Homo sapiens
uuggauaacaccaccauucaca

SEQ ID NO: 1753570 - RNA, 18 nt, Homo sapiens
ugugaccucacgugcaaa

SEQ ID NO: 1753571 - RNA, 23 nt, Homo sapiens
aaaauuagcugggugugguggca

SEQ ID NO: 1753572 - RNA, 15 nt, Homo sapiens
cuaauaccucugugu

SEQ ID NO: 1753573 - RNA, 18 nt, Homo sapiens
acagacaucuaauguucu

SEQ ID NO: 1753574 - RNA, 12 nt, Homo sapiens
uuacaguuuaca

SEQ ID NO: 1753575 - RNA, 18 nt, Homo sapiens
aacucaaugcaugaugac

SEQ ID NO: 1753576 - RNA, 18 nt, Homo sapiens
gucugagacucacaggaa

SEQ ID NO: 1753577 - RNA, 18 nt, Homo sapiens
uaauuuugugcucuuucc

SEQ ID NO: 1753578 - RNA, 18 nt, Homo sapiens
uuguaguauuuaguauau

SEQ ID NO: 1753579 - RNA, 15 nt, Homo sapiens
accucuuaccuguaa

SEQ ID NO: 1753580 - RNA, 14 nt, Homo sapiens
agcaagaccauggg

SEQ ID NO: 1753581 - RNA, 20 nt, Homo sapiens
cucaauuuugucuguacuca

SEQ ID NO: 1753582 - RNA, 13 nt, Homo sapiens
gauggaagcuugu

SEQ ID NO: 1753583 - RNA, 18 nt, Homo sapiens
gcccagggccgucaagga

SEQ ID NO: 1753584 - RNA, 15 nt, Homo sapiens
auauccacagacucc

SEQ ID NO: 1753585 - RNA, 17 nt, Homo sapiens
uuugacagcugugcugu

SEQ ID NO: 1753586 - RNA, 22 nt, Homo sapiens
acacguguggcgggcaguggga

SEQ ID NO: 1753587 - RNA, 15 nt, Homo sapiens
auuuauguuaacucu

SEQ ID NO: 1753588 - RNA, 20 nt, Homo sapiens
guacaccagagccucaguga

SEQ ID NO: 1753589 - RNA, 19 nt, Homo sapiens
guugacucagagugcaaga

SEQ ID NO: 1753590 - RNA, 19 nt, Homo sapiens
uaaggagggucacuggggc

SEQ ID NO: 1753591 - RNA, 18 nt, Homo sapiens
auuucuuucuuuccuuaa

SEQ ID NO: 1753592 - RNA, 12 nt, Homo sapiens
gacuggcaauaa

SEQ ID NO: 1753593 - RNA, 18 nt, Homo sapiens
agcccugaguuccuagcc

SEQ ID NO: 1753594 - RNA, 22 nt, Homo sapiens
uuucaguauaauuuaacuucag

SEQ ID NO: 1753595 - RNA, 14 nt, Homo sapiens
uuugguugccuuaa

SEQ ID NO: 1753596 - RNA, 19 nt, Homo sapiens
uuauuuuuaagaaagaaau

SEQ ID NO: 1753597 - RNA, 14 nt, Homo sapiens
ugccaggcuugcag

SEQ ID NO: 1753598 - RNA, 18 nt, Homo sapiens
cacauccaccccacugga

SEQ ID NO: 1753599 - RNA, 17 nt, Homo sapiens
ugaccacugacagccuc

SEQ ID NO: 1753600 - RNA, 16 nt, Homo sapiens
gcaucugcuacugugu

SEQ ID NO: 1753601 - RNA, 20 nt, Homo sapiens
cuuucuccuguuuauuccca

SEQ ID NO: 1753602 - RNA, 19 nt, Homo sapiens
caggagaauggugugaacc

SEQ ID NO: 1753603 - RNA, 17 nt, Homo sapiens
agcaaugacaucucagg

SEQ ID NO: 1753604 - RNA, 14 nt, Homo sapiens
ugcauuuguaaaaa

SEQ ID NO: 1753605 - RNA, 14 nt, Homo sapiens
uaaaauugugcaua

SEQ ID NO: 1753606 - RNA, 23 nt, Homo sapiens
caauuauuccuaaauaaauggau

SEQ ID NO: 1753607 - RNA, 22 nt, Homo sapiens
uaaaaaggccuuugggauuugc

SEQ ID NO: 1753608 - RNA, 13 nt, Homo sapiens
aaucuguacaaug

SEQ ID NO: 1753609 - RNA, 15 nt, Homo sapiens
cugagaaaggucuga

SEQ ID NO: 1753610 - RNA, 13 nt, Homo sapiens
cuucuuacuguau

SEQ ID NO: 1753611 - RNA, 19 nt, Homo sapiens
aggaccgccauggugcugg

SEQ ID NO: 1753612 - RNA, 20 nt, Homo sapiens
gacacuugccuucuucaccc

SEQ ID NO: 1753613 - RNA, 18 nt, Homo sapiens
ccugacccguuugcuaca

SEQ ID NO: 1753614 - RNA, 17 nt, Homo sapiens
ccagaaauaccacauuu

SEQ ID NO: 1753615 - RNA, 11 nt, Homo sapiens
uuucauguauu

SEQ ID NO: 1753616 - RNA, 20 nt, Homo sapiens
uucuuuuuugggucuucauu

SEQ ID NO: 1753617 - RNA, 21 nt, Homo sapiens
gaaacacagcugaugaacugu

SEQ ID NO: 1753618 - RNA, 16 nt, Homo sapiens
gaguggacaagucaug

SEQ ID NO: 1753619 - RNA, 15 nt, Homo sapiens
cauuaucucacuuag

SEQ ID NO: 1753620 - RNA, 13 nt, Homo sapiens
agggugacggggg

SEQ ID NO: 1753621 - RNA, 18 nt, Homo sapiens
gagaaugcccacugccug

SEQ ID NO: 1753622 - RNA, 23 nt, Homo sapiens
aucaauccuucuuauguuugcuu

SEQ ID NO: 1753623 - RNA, 21 nt, Homo sapiens
uugcauuuauuuaagacacug

SEQ ID NO: 1753624 - RNA, 20 nt, Homo sapiens
gucagagacagauaccucca

SEQ ID NO: 1753625 - RNA, 15 nt, Homo sapiens
ugauaugauccagag

SEQ ID NO: 1753626 - RNA, 15 nt, Homo sapiens
uggauagucugucca

SEQ ID NO: 1753627 - RNA, 22 nt, Homo sapiens
ugucccaccccuagccaccagu

SEQ ID NO: 1753628 - RNA, 12 nt, Homo sapiens
aaaaucuagagg

SEQ ID NO: 1753629 - RNA, 14 nt, Homo sapiens
acuacuucuauuca

SEQ ID NO: 1753630 - RNA, 15 nt, Homo sapiens
ccacauaaaugcucc

SEQ ID NO: 1753631 - RNA, 16 nt, Homo sapiens
ggcagauuacagucau

SEQ ID NO: 1753632 - RNA, 18 nt, Homo sapiens
ugugcuaauaacagugca

SEQ ID NO: 1753633 - RNA, 17 nt, Homo sapiens
auucagcuaauacaaag

SEQ ID NO: 1753634 - RNA, 17 nt, Homo sapiens
aauggaaagaagcaguu

SEQ ID NO: 1753635 - RNA, 23 nt, Homo sapiens
cacgucauuaagguuaugcacug

SEQ ID NO: 1753636 - RNA, 22 nt, Homo sapiens
aaugcagacaaacaaacauaaa

SEQ ID NO: 1753637 - RNA, 15 nt, Homo sapiens
cuugcugugaaauga

SEQ ID NO: 1753638 - RNA, 22 nt, Homo sapiens
uaguuuuuaaaauuuauuugca

SEQ ID NO: 1753639 - RNA, 24 nt, Homo sapiens
accucuaguaaauuuaaguccacc

SEQ ID NO: 1753640 - RNA, 15 nt, Homo sapiens
guagauguagcauug

SEQ ID NO: 1753641 - RNA, 22 nt, Homo sapiens
gcuuugagagcaacgucacugg

SEQ ID NO: 1753642 - RNA, 14 nt, Homo sapiens
uuuuguuugcauca

SEQ ID NO: 1753643 - RNA, 21 nt, Homo sapiens
gccgagcggggagccaggaaa

SEQ ID NO: 1753644 - RNA, 21 nt, Homo sapiens
ugcaguuucuuguguagauuu

SEQ ID NO: 1753645 - RNA, 15 nt, Homo sapiens
gccguuuaaaccacu

SEQ ID NO: 1753646 - RNA, 17 nt, Homo sapiens
guuuaaaaaaaguauau

SEQ ID NO: 1753647 - RNA, 20 nt, Homo sapiens
caacuucagcaguaccuaua

SEQ ID NO: 1753648 - RNA, 22 nt, Homo sapiens
cuucccagagggauugcuguga

SEQ ID NO: 1753649 - RNA, 21 nt, Homo sapiens
agcagagagauugaacuuuga

SEQ ID NO: 1753650 - RNA, 17 nt, Homo sapiens
aguuauuaaacaguguu

SEQ ID NO: 1753651 - RNA, 17 nt, Homo sapiens
ugcuuguaaaaccaacu

SEQ ID NO: 1753652 - RNA, 14 nt, Homo sapiens
gaggccaaggcagg

SEQ ID NO: 1753653 - RNA, 22 nt, Homo sapiens
ggugcagcaggcucaaaggcau

SEQ ID NO: 1753654 - RNA, 13 nt, Homo sapiens
ugaagcugcucac

SEQ ID NO: 1753655 - RNA, 18 nt, Homo sapiens
acaacaaauauguucucu

SEQ ID NO: 1753656 - RNA, 13 nt, Homo sapiens
gcaugagcaccuu

SEQ ID NO: 1753657 - RNA, 17 nt, Homo sapiens
uugcagaaugaagccau

SEQ ID NO: 1753658 - RNA, 13 nt, Homo sapiens
caaagaugcauuu

SEQ ID NO: 1753659 - RNA, 17 nt, Homo sapiens
uucucagcaaguguaca

SEQ ID NO: 1753660 - RNA, 15 nt, Homo sapiens
gggaguguugucaca

SEQ ID NO: 1753661 - RNA, 19 nt, Homo sapiens
gugucacucagcaguggga

SEQ ID NO: 1753662 - RNA, 16 nt, Homo sapiens
cacaucuaaugucucu

SEQ ID NO: 1753663 - RNA, 17 nt, Homo sapiens
agauauuaauguuaaca

SEQ ID NO: 1753664 - RNA, 12 nt, Homo sapiens
ucagguucucau

SEQ ID NO: 1753665 - RNA, 13 nt, Homo sapiens
uggagacauugag

SEQ ID NO: 1753666 - RNA, 12 nt, Homo sapiens
uugggcauguga

SEQ ID NO: 1753667 - RNA, 14 nt, Homo sapiens
auguuuugcacuga

SEQ ID NO: 1753668 - RNA, 23 nt, Homo sapiens
gagaguguggggaaugggaagaa

SEQ ID NO: 1753669 - RNA, 15 nt, Homo sapiens
ugggagaucagccac

SEQ ID NO: 1753670 - RNA, 23 nt, Homo sapiens
aucacaagaaaaaggaagccacu

SEQ ID NO: 1753671 - RNA, 13 nt, Homo sapiens
uauaaaaagugaa

SEQ ID NO: 1753672 - RNA, 19 nt, Homo sapiens
cgagcaccuccagccugaa

SEQ ID NO: 1753673 - RNA, 11 nt, Homo sapiens
gcuucugccau

SEQ ID NO: 1753674 - RNA, 23 nt, Homo sapiens
uccucuuaccuguaauagccuca

SEQ ID NO: 1753675 - RNA, 14 nt, Homo sapiens
aaugacugacugca

SEQ ID NO: 1753676 - RNA, 19 nt, Homo sapiens
uugagaccuggaaccagag

SEQ ID NO: 1753677 - RNA, 23 nt, Homo sapiens
cccuggaggaaccgaaaggccaa

SEQ ID NO: 1753678 - RNA, 20 nt, Homo sapiens
aacccagcaguucucugcca

SEQ ID NO: 1753679 - RNA, 16 nt, Homo sapiens
uagcaaauguuuacug

SEQ ID NO: 1753680 - RNA, 18 nt, Homo sapiens
cucuccuacucacuuaaa

SEQ ID NO: 1753681 - RNA, 14 nt, Homo sapiens
cagaaauacaguau

SEQ ID NO: 1753682 - RNA, 13 nt, Homo sapiens
aauaaucuuauua

SEQ ID NO: 1753683 - RNA, 16 nt, Homo sapiens
cuugauuccacuugug

SEQ ID NO: 1753684 - RNA, 18 nt, Homo sapiens
guaagguuauaacugugg

SEQ ID NO: 1753685 - RNA, 16 nt, Homo sapiens
cuguaccacacagcca

SEQ ID NO: 1753686 - RNA, 20 nt, Homo sapiens
aguguuaagcguucagugau

SEQ ID NO: 1753687 - RNA, 16 nt, Homo sapiens
ccaggcccugccagag

SEQ ID NO: 1753688 - RNA, 20 nt, Homo sapiens
cuucccugguucaagcgauu

SEQ ID NO: 1753689 - RNA, 18 nt, Homo sapiens
gcugcugggcugagugac

SEQ ID NO: 1753690 - RNA, 22 nt, Homo sapiens
gaauuguaaugauguuggugcu

SEQ ID NO: 1753691 - RNA, 12 nt, Homo sapiens
cugucaagaaga

SEQ ID NO: 1753692 - RNA, 16 nt, Homo sapiens
caaugaacucuuuccc

SEQ ID NO: 1753693 - RNA, 17 nt, Homo sapiens
gucacuuuuuggccaug

SEQ ID NO: 1753694 - RNA, 15 nt, Homo sapiens
uagaaugcaucucau

SEQ ID NO: 1753695 - RNA, 23 nt, Homo sapiens
cucacuuucuagauuaagauaug

SEQ ID NO: 1753696 - RNA, 16 nt, Homo sapiens
uggaggcugccccauu

SEQ ID NO: 1753697 - RNA, 20 nt, Homo sapiens
aaugaccuuccaaguaagca

SEQ ID NO: 1753698 - RNA, 21 nt, Homo sapiens
cauggaacagcauuacccucc

SEQ ID NO: 1753699 - RNA, 19 nt, Homo sapiens
cagaugauucuaugucuca

SEQ ID NO: 1753700 - RNA, 16 nt, Homo sapiens
ggagugggcgcagugg

SEQ ID NO: 1753701 - RNA, 11 nt, Homo sapiens
ucuuagacauu

SEQ ID NO: 1753702 - RNA, 19 nt, Homo sapiens
accuaccgaugugugaugu

SEQ ID NO: 1753703 - RNA, 18 nt, Homo sapiens
caggcuggagugcaguga

SEQ ID NO: 1753704 - RNA, 18 nt, Homo sapiens
caggcuggaaugcagugg

SEQ ID NO: 1753705 - RNA, 15 nt, Homo sapiens
aaggcggugagcaau

SEQ ID NO: 1753706 - RNA, 20 nt, Homo sapiens
aggcuugccccaaaucucaa

SEQ ID NO: 1753707 - RNA, 18 nt, Homo sapiens
cuucaaucggcuuguggg

SEQ ID NO: 1753708 - RNA, 20 nt, Homo sapiens
ucaucugucauuauauucua

SEQ ID NO: 1753709 - RNA, 15 nt, Homo sapiens
ccaagcuugucuuua

SEQ ID NO: 1753710 - RNA, 16 nt, Homo sapiens
accauauaacugugau

SEQ ID NO: 1753711 - RNA, 23 nt, Homo sapiens
ccuuuauuaaugaacugugacag

SEQ ID NO: 1753712 - RNA, 15 nt, Homo sapiens
ccuuggaaaacaaaa

SEQ ID NO: 1753713 - RNA, 19 nt, Homo sapiens
uguuccuugucacugguag

SEQ ID NO: 1753714 - RNA, 21 nt, Homo sapiens
cccaggagcgcagcugcauuu

SEQ ID NO: 1753715 - RNA, 20 nt, Homo sapiens
ucuggucagagccacagggu

SEQ ID NO: 1753716 - RNA, 20 nt, Homo sapiens
gccuguaaucucagcacuuu

SEQ ID NO: 1753717 - RNA, 13 nt, Homo sapiens
ugaggaucauaug

SEQ ID NO: 1753718 - RNA, 23 nt, Homo sapiens
cgucgaggggcucucagcucagc

SEQ ID NO: 1753719 - RNA, 22 nt, Homo sapiens
aggcuugccaccggggaaccca

SEQ ID NO: 1753720 - RNA, 20 nt, Homo sapiens
caucuacccugcugaccucc

SEQ ID NO: 1753721 - RNA, 14 nt, Homo sapiens
cugcguccaccagg

SEQ ID NO: 1753722 - RNA, 18 nt, Homo sapiens
gagaauggaaaccacaac

SEQ ID NO: 1753723 - RNA, 18 nt, Homo sapiens
ccugccccugcaaagaca

SEQ ID NO: 1753724 - RNA, 13 nt, Homo sapiens
auuucaugauuca

SEQ ID NO: 1753725 - RNA, 18 nt, Homo sapiens
gaacauaaugaacagaau

SEQ ID NO: 1753726 - RNA, 12 nt, Homo sapiens
auugaagcagau

SEQ ID NO: 1753727 - RNA, 20 nt, Homo sapiens
acucagagaugaacaucuaa

SEQ ID NO: 1753728 - RNA, 23 nt, Homo sapiens
aauccauuccaaaauacaauguu

SEQ ID NO: 1753729 - RNA, 17 nt, Homo sapiens
caaguaguauucauguu

SEQ ID NO: 1753730 - RNA, 17 nt, Homo sapiens
agagggggcaagggcaa

SEQ ID NO: 1753731 - RNA, 19 nt, Homo sapiens
uguaaagacuaugaucuca

SEQ ID NO: 1753732 - RNA, 11 nt, Homo sapiens
auaaccacugc

SEQ ID NO: 1753733 - RNA, 17 nt, Homo sapiens
caguacucucaugcaau

SEQ ID NO: 1753734 - RNA, 21 nt, Homo sapiens
acaaguauuauuuuacaauca

SEQ ID NO: 1753735 - RNA, 22 nt, Homo sapiens
uucacuugguucaguaccacau

SEQ ID NO: 1753736 - RNA, 17 nt, Homo sapiens
cuggccuugggcccucu

SEQ ID NO: 1753737 - RNA, 13 nt, Homo sapiens
gccauugucuuua

SEQ ID NO: 1753738 - RNA, 15 nt, Homo sapiens
ugggcucagggacca

SEQ ID NO: 1753739 - RNA, 16 nt, Homo sapiens
cuuucugcacauaagu

SEQ ID NO: 1753740 - RNA, 14 nt, Homo sapiens
ugaugcaccugcag

SEQ ID NO: 1753741 - RNA, 20 nt, Homo sapiens
aaauucauggugcacugagc

SEQ ID NO: 1753742 - RNA, 18 nt, Homo sapiens
uuaacucuuauguuacuu

SEQ ID NO: 1753743 - RNA, 23 nt, Homo sapiens
accccuccggacauccagcguga

SEQ ID NO: 1753744 - RNA, 18 nt, Homo sapiens
agugauauuauaguauuc

SEQ ID NO: 1753745 - RNA, 18 nt, Homo sapiens
ugggauguaagaguguuc

SEQ ID NO: 1753746 - RNA, 14 nt, Homo sapiens
agauuucaguuacu

SEQ ID NO: 1753747 - RNA, 16 nt, Homo sapiens
ucuaagcaguugcaau

SEQ ID NO: 1753748 - RNA, 19 nt, Homo sapiens
auaugugguccaucucuga

SEQ ID NO: 1753749 - RNA, 12 nt, Homo sapiens
aaagcaccugcc

SEQ ID NO: 1753750 - RNA, 12 nt, Homo sapiens
ugcccaccaaag

SEQ ID NO: 1753751 - RNA, 19 nt, Homo sapiens
agacacaccccaacaugcc

SEQ ID NO: 1753752 - RNA, 19 nt, Homo sapiens
uaguaaaggggcccagaaa

SEQ ID NO: 1753753 - RNA, 12 nt, Homo sapiens
ucaaaagugccu

SEQ ID NO: 1753754 - RNA, 21 nt, Homo sapiens
agaaacacauucuuauugaca

SEQ ID NO: 1753755 - RNA, 22 nt, Homo sapiens
agcccaggagagagcuacggca

SEQ ID NO: 1753756 - RNA, 11 nt, Homo sapiens
ggaagcauuuu

SEQ ID NO: 1753757 - RNA, 18 nt, Homo sapiens
cuagagggagaagacugu

SEQ ID NO: 1753758 - RNA, 14 nt, Homo sapiens
ucucuaucccugaa

SEQ ID NO: 1753759 - RNA, 14 nt, Homo sapiens
cgugugucugucag

SEQ ID NO: 1753760 - RNA, 18 nt, Homo sapiens
cuugcaucaagggcuuua

SEQ ID NO: 1753761 - RNA, 22 nt, Homo sapiens
guuauuuauuuccuuagugcca

SEQ ID NO: 1753762 - RNA, 16 nt, Homo sapiens
uagaagcaucagaguu

SEQ ID NO: 1753763 - RNA, 19 nt, Homo sapiens
auaagcucaugagaugaca

SEQ ID NO: 1753764 - RNA, 17 nt, Homo sapiens
cuucuauccaaaccuuu

SEQ ID NO: 1753765 - RNA, 22 nt, Homo sapiens
acguccuuucccuacuccaugg

SEQ ID NO: 1753766 - RNA, 16 nt, Homo sapiens
cuuagauugauuuugu

SEQ ID NO: 1753767 - RNA, 22 nt, Homo sapiens
cccaccagcuaaggacauuucc

SEQ ID NO: 1753768 - RNA, 17 nt, Homo sapiens
cugcccuuuccuaggcc

SEQ ID NO: 1753769 - RNA, 19 nt, Homo sapiens
aucacuggguguugaucuu

SEQ ID NO: 1753770 - RNA, 18 nt, Homo sapiens
aacucugugucagcaucu

SEQ ID NO: 1753771 - RNA, 20 nt, Homo sapiens
uucugugagaagugcaacug

SEQ ID NO: 1753772 - RNA, 20 nt, Homo sapiens
cugcaguaugggaucugaua

SEQ ID NO: 1753773 - RNA, 22 nt, Homo sapiens
uucuccaaaacaauuuucugca

SEQ ID NO: 1753774 - RNA, 19 nt, Homo sapiens
caacacuguuacuuucgua

SEQ ID NO: 1753775 - RNA, 18 nt, Homo sapiens
uuugagacagaguuucac

SEQ ID NO: 1753776 - RNA, 15 nt, Homo sapiens
uggaguaacacaaag

SEQ ID NO: 1753777 - RNA, 15 nt, Homo sapiens
aguauccaggcuuug

SEQ ID NO: 1753778 - RNA, 21 nt, Homo sapiens
accagccguauuuuacaugaa

SEQ ID NO: 1753779 - RNA, 23 nt, Homo sapiens
uuauggugccgaauugucuuugg

SEQ ID NO: 1753780 - RNA, 21 nt, Homo sapiens
cugagguucuugggauacaga

SEQ ID NO: 1753781 - RNA, 21 nt, Homo sapiens
uuguuccuuccuuucuuuccg

SEQ ID NO: 1753782 - RNA, 21 nt, Homo sapiens
ccuggcaaagaugaucaguau

SEQ ID NO: 1753783 - RNA, 19 nt, Homo sapiens
aauauuacuuugucuuuuc

SEQ ID NO: 1753784 - RNA, 20 nt, Homo sapiens
acugugaccaaagcauuucu

SEQ ID NO: 1753785 - RNA, 22 nt, Homo sapiens
cauguucuaaauaaaaagcauu

SEQ ID NO: 1753786 - RNA, 14 nt, Homo sapiens
agccugcaauaagg

SEQ ID NO: 1753787 - RNA, 15 nt, Homo sapiens
acauuugggcucagg

SEQ ID NO: 1753788 - RNA, 19 nt, Homo sapiens
gagucucugaaugaagcug

SEQ ID NO: 1753789 - RNA, 17 nt, Homo sapiens
auuguucugggugauuu

SEQ ID NO: 1753790 - RNA, 16 nt, Homo sapiens
acccugggcaaacaga

SEQ ID NO: 1753791 - RNA, 22 nt, Homo sapiens
cauucacagcaagucacuggcc

SEQ ID NO: 1753792 - RNA, 14 nt, Homo sapiens
acagugccacugca

SEQ ID NO: 1753793 - RNA, 13 nt, Homo sapiens
agccuaaauguua

SEQ ID NO: 1753794 - RNA, 15 nt, Homo sapiens
acauuucuaacucua

SEQ ID NO: 1753795 - RNA, 13 nt, Homo sapiens
cuucuggcuccua

SEQ ID NO: 1753796 - RNA, 18 nt, Homo sapiens
caacagaaucagaucuga

SEQ ID NO: 1753797 - RNA, 17 nt, Homo sapiens
uucguauucccauuaga

SEQ ID NO: 1753798 - RNA, 20 nt, Homo sapiens
auucacagaauagcacaaac

SEQ ID NO: 1753799 - RNA, 12 nt, Homo sapiens
uauccaucuccu

SEQ ID NO: 1753800 - RNA, 16 nt, Homo sapiens
accugcauuuccucua

SEQ ID NO: 1753801 - RNA, 18 nt, Homo sapiens
uccaaaauaaagcauaaa

SEQ ID NO: 1753802 - RNA, 15 nt, Homo sapiens
aguuucugugugaac

SEQ ID NO: 1753803 - RNA, 13 nt, Homo sapiens
ccucugugccgca

SEQ ID NO: 1753804 - RNA, 13 nt, Homo sapiens
cuucagugcugcu

SEQ ID NO: 1753805 - RNA, 17 nt, Homo sapiens
gcacauaccacugcacc

SEQ ID NO: 1753806 - RNA, 16 nt, Homo sapiens
ugauuuaaacucuuag

SEQ ID NO: 1753807 - RNA, 13 nt, Homo sapiens
caaaagcccaaug

SEQ ID NO: 1753808 - RNA, 18 nt, Homo sapiens
aucuggaacccagacuca

SEQ ID NO: 1753809 - RNA, 20 nt, Homo sapiens
gucccuggaaucagaagcac

SEQ ID NO: 1753810 - RNA, 15 nt, Homo sapiens
auguucuuacuuugu

SEQ ID NO: 1753811 - RNA, 15 nt, Homo sapiens
gugcgcgcgugcaug

SEQ ID NO: 1753812 - RNA, 15 nt, Homo sapiens
auacguacauacaca

SEQ ID NO: 1753813 - RNA, 18 nt, Homo sapiens
uuucuugcaagcuccagu

SEQ ID NO: 1753814 - RNA, 20 nt, Homo sapiens
cucugcagacuucccagcua

SEQ ID NO: 1753815 - RNA, 16 nt, Homo sapiens
cucuccauacuuugaa

SEQ ID NO: 1753816 - RNA, 23 nt, Homo sapiens
ugaauuauucugccuacguucuc

SEQ ID NO: 1753817 - RNA, 13 nt, Homo sapiens
uaaaaaugcaaau

SEQ ID NO: 1753818 - RNA, 17 nt, Homo sapiens
gggugagaacgugccca

SEQ ID NO: 1753819 - RNA, 21 nt, Homo sapiens
auguauggaaucccacuguau

SEQ ID NO: 1753820 - RNA, 14 nt, Homo sapiens
aaaagcuguucuca

SEQ ID NO: 1753821 - RNA, 21 nt, Homo sapiens
ugggacugugccuggcucccu

SEQ ID NO: 1753822 - RNA, 22 nt, Homo sapiens
cuucaguauuuuuaaauuguaa

SEQ ID NO: 1753823 - RNA, 19 nt, Homo sapiens
augucacgggaccaguauu

SEQ ID NO: 1753824 - RNA, 18 nt, Homo sapiens
cugaaaaagaacuguauu

SEQ ID NO: 1753825 - RNA, 14 nt, Homo sapiens
ucugaucacauugc

SEQ ID NO: 1753826 - RNA, 22 nt, Homo sapiens
gcacgaucucgacucacugcaa

SEQ ID NO: 1753827 - RNA, 15 nt, Homo sapiens
cagccagggugugac

SEQ ID NO: 1753828 - RNA, 17 nt, Homo sapiens
ccagcaguucuguuaua

SEQ ID NO: 1753829 - RNA, 14 nt, Homo sapiens
aucucuuccuugac

SEQ ID NO: 1753830 - RNA, 19 nt, Homo sapiens
aggcuucaguuuuacucug

SEQ ID NO: 1753831 - RNA, 12 nt, Homo sapiens
ccucuaucccug

SEQ ID NO: 1753832 - RNA, 20 nt, Homo sapiens
cagggcaccguauuccucuc

SEQ ID NO: 1753833 - RNA, 19 nt, Homo sapiens
uaugguucuugccaaaacu

SEQ ID NO: 1753834 - RNA, 13 nt, Homo sapiens
acuccuggacaac

SEQ ID NO: 1753835 - RNA, 19 nt, Homo sapiens
gcaguggugcaaucuuggc

SEQ ID NO: 1753836 - RNA, 16 nt, Homo sapiens
agugcagggauuacag

SEQ ID NO: 1753837 - RNA, 21 nt, Homo sapiens
ggcaguagacuauaagcagaa

SEQ ID NO: 1753838 - RNA, 18 nt, Homo sapiens
uauuuaaggggaauuaac

SEQ ID NO: 1753839 - RNA, 18 nt, Homo sapiens
ccuuguaucuugcauuca

SEQ ID NO: 1753840 - RNA, 24 nt, Homo sapiens
gcauggcacucccuccagcacaaa

SEQ ID NO: 1753841 - RNA, 13 nt, Homo sapiens
cuaccaucaggga

SEQ ID NO: 1753842 - RNA, 13 nt, Homo sapiens
ggcuuaaagggau

SEQ ID NO: 1753843 - RNA, 14 nt, Homo sapiens
ucucauaaaugagg

SEQ ID NO: 1753844 - RNA, 14 nt, Homo sapiens
aaucagaugccuca

SEQ ID NO: 1753845 - RNA, 19 nt, Homo sapiens
gcaauguaucccuucucac

SEQ ID NO: 1753846 - RNA, 15 nt, Homo sapiens
uagaccuauacugaa

SEQ ID NO: 1753847 - RNA, 19 nt, Homo sapiens
uacuauucuuacuaaucug

SEQ ID NO: 1753848 - RNA, 14 nt, Homo sapiens
auacacaaagggau

SEQ ID NO: 1753849 - RNA, 17 nt, Homo sapiens
acagcucuguguuucug

SEQ ID NO: 1753850 - RNA, 21 nt, Homo sapiens
uggcuauaacaugucuuucag

SEQ ID NO: 1753851 - RNA, 22 nt, Homo sapiens
ccaaagcccacucacccuuuga

SEQ ID NO: 1753852 - RNA, 14 nt, Homo sapiens
ggaaggaaccagaa

SEQ ID NO: 1753853 - RNA, 13 nt, Homo sapiens
caagcugauuaaa

SEQ ID NO: 1753854 - RNA, 13 nt, Homo sapiens
cuaugaaaggcag

SEQ ID NO: 1753855 - RNA, 16 nt, Homo sapiens
ucaacacccaacuguc

SEQ ID NO: 1753856 - RNA, 23 nt, Homo sapiens
aaaugaagguuucuacaacauau

SEQ ID NO: 1753857 - RNA, 16 nt, Homo sapiens
agagggccucaucuca

SEQ ID NO: 1753858 - RNA, 17 nt, Homo sapiens
auucacaucgcagauuc

SEQ ID NO: 1753859 - RNA, 12 nt, Homo sapiens
uaauuaauuuca

SEQ ID NO: 1753860 - RNA, 15 nt, Homo sapiens
uuuauuauacaccuu

SEQ ID NO: 1753861 - RNA, 22 nt, Homo sapiens
gcagucugcuucagugcaguga

SEQ ID NO: 1753862 - RNA, 20 nt, Homo sapiens
ugauauagaucacauaacag

SEQ ID NO: 1753863 - RNA, 17 nt, Homo sapiens
uggcuuuuaauugacag

SEQ ID NO: 1753864 - RNA, 16 nt, Homo sapiens
ugggaggguaccagca

SEQ ID NO: 1753865 - RNA, 16 nt, Homo sapiens
uaucacauuuuagucc

SEQ ID NO: 1753866 - RNA, 14 nt, Homo sapiens
auuuugaaguuuac

SEQ ID NO: 1753867 - RNA, 23 nt, Homo sapiens
auaagcuaguugaauacuugaac

SEQ ID NO: 1753868 - RNA, 19 nt, Homo sapiens
cauucuaggccuccuggcc

SEQ ID NO: 1753869 - RNA, 19 nt, Homo sapiens
ucuagcauucuaguuucau

SEQ ID NO: 1753870 - RNA, 23 nt, Homo sapiens
uucccgguugugagagccuguga

SEQ ID NO: 1753871 - RNA, 18 nt, Homo sapiens
gcaccccugccuccugcc

SEQ ID NO: 1753872 - RNA, 12 nt, Homo sapiens
cuuauauuguaa

SEQ ID NO: 1753873 - RNA, 20 nt, Homo sapiens
cauuuuaggaaucaccaaug

SEQ ID NO: 1753874 - RNA, 16 nt, Homo sapiens
uggacaagaaagucaa

SEQ ID NO: 1753875 - RNA, 14 nt, Homo sapiens
ugcuuuuuuuccaa

SEQ ID NO: 1753876 - RNA, 21 nt, Homo sapiens
gcccuccccaggcgauggaca

SEQ ID NO: 1753877 - RNA, 17 nt, Homo sapiens
gaauaaucuccuguuaa

SEQ ID NO: 1753878 - RNA, 22 nt, Homo sapiens
agccucugucgcccuuagucau

SEQ ID NO: 1753879 - RNA, 16 nt, Homo sapiens
aaagaagauaaacaca

SEQ ID NO: 1753880 - RNA, 17 nt, Homo sapiens
uucccacugcacuccag

SEQ ID NO: 1753881 - RNA, 20 nt, Homo sapiens
cauuuuauuuuuucuugcaa

SEQ ID NO: 1753882 - RNA, 16 nt, Homo sapiens
gccuccagcaccaagg

SEQ ID NO: 1753883 - RNA, 17 nt, Homo sapiens
gaucccacuccuaggac

SEQ ID NO: 1753884 - RNA, 15 nt, Homo sapiens
ggccgagaugugcaa

SEQ ID NO: 1753885 - RNA, 14 nt, Homo sapiens
cuucaaaucucagc

SEQ ID NO: 1753886 - RNA, 23 nt, Homo sapiens
ucgguagcugcaaccaggaguga

SEQ ID NO: 1753887 - RNA, 21 nt, Homo sapiens
gaagucauccagucuauucac

SEQ ID NO: 1753888 - RNA, 17 nt, Homo sapiens
caagccacguugcagaa

SEQ ID NO: 1753889 - RNA, 16 nt, Homo sapiens
agagauggauauugaa

SEQ ID NO: 1753890 - RNA, 18 nt, Homo sapiens
guccugaaaguaacucau

SEQ ID NO: 1753891 - RNA, 15 nt, Homo sapiens
uauugcagcaauuaa

SEQ ID NO: 1753892 - RNA, 22 nt, Homo sapiens
cacagaaggguguggcauuugg

SEQ ID NO: 1753893 - RNA, 17 nt, Homo sapiens
ugaaaacaucugcacaa

SEQ ID NO: 1753894 - RNA, 17 nt, Homo sapiens
ugcggcugcaucuucca

SEQ ID NO: 1753895 - RNA, 15 nt, Homo sapiens
caaagaaguacugua

SEQ ID NO: 1753896 - RNA, 21 nt, Homo sapiens
uuaaagucaacaaccaugcca

SEQ ID NO: 1753897 - RNA, 14 nt, Homo sapiens
guccaacucuucca

SEQ ID NO: 1753898 - RNA, 19 nt, Homo sapiens
auuaaaagaauaucuggca

SEQ ID NO: 1753899 - RNA, 20 nt, Homo sapiens
aggugugcaccaccaugccc

SEQ ID NO: 1753900 - RNA, 23 nt, Homo sapiens
uaaucaaaagaaccagacugugu

SEQ ID NO: 1753901 - RNA, 20 nt, Homo sapiens
uuacgugcucccucagcucc

SEQ ID NO: 1753902 - RNA, 23 nt, Homo sapiens
uuuaacaaaaggacaaccacaga

SEQ ID NO: 1753903 - RNA, 16 nt, Homo sapiens
ugccuuuggcacucug

SEQ ID NO: 1753904 - RNA, 13 nt, Homo sapiens
guuuugauuuauu

SEQ ID NO: 1753905 - RNA, 12 nt, Homo sapiens
guuuucuccucu

SEQ ID NO: 1753906 - RNA, 15 nt, Homo sapiens
acucuaagcugugug

SEQ ID NO: 1753907 - RNA, 17 nt, Homo sapiens
guuuuccuaaaugcagu

SEQ ID NO: 1753908 - RNA, 15 nt, Homo sapiens
auacuagauguuaag

SEQ ID NO: 1753909 - RNA, 19 nt, Homo sapiens
ucaggacccucccaggaga

SEQ ID NO: 1753910 - RNA, 13 nt, Homo sapiens
cuccucauucaca

SEQ ID NO: 1753911 - RNA, 23 nt, Homo sapiens
gugaagucgucuuaacucaccau

SEQ ID NO: 1753912 - RNA, 16 nt, Homo sapiens
aauuugauucuaugac

SEQ ID NO: 1753913 - RNA, 22 nt, Homo sapiens
caggaggacauagccugcaaag

SEQ ID NO: 1753914 - RNA, 13 nt, Homo sapiens
ugagggugcccag

SEQ ID NO: 1753915 - RNA, 12 nt, Homo sapiens
acugcauuugcu

SEQ ID NO: 1753916 - RNA, 13 nt, Homo sapiens
gaaaagagcaaaa

SEQ ID NO: 1753917 - RNA, 11 nt, Homo sapiens
aaggacucuca

SEQ ID NO: 1753918 - RNA, 21 nt, Homo sapiens
uguguuuauccuaaacugaga

SEQ ID NO: 1753919 - RNA, 17 nt, Homo sapiens
agcaaaugucaugcugc

SEQ ID NO: 1753920 - RNA, 23 nt, Homo sapiens
augauaaaauacuaaacuacauu

SEQ ID NO: 1753921 - RNA, 13 nt, Homo sapiens
gccugcaaacugg

SEQ ID NO: 1753922 - RNA, 17 nt, Homo sapiens
auccucacccagcaccc

SEQ ID NO: 1753923 - RNA, 15 nt, Homo sapiens
cucagagcacagcca

SEQ ID NO: 1753924 - RNA, 17 nt, Homo sapiens
acagauagucaaaccau

SEQ ID NO: 1753925 - RNA, 22 nt, Homo sapiens
uagaaaaguguggcuugggcau

SEQ ID NO: 1753926 - RNA, 20 nt, Homo sapiens
aucuccuucaccccuauggu

SEQ ID NO: 1753927 - RNA, 19 nt, Homo sapiens
gaaauugauguuacuguau

SEQ ID NO: 1753928 - RNA, 22 nt, Homo sapiens
aacucucgagacuucucuguga

SEQ ID NO: 1753929 - RNA, 20 nt, Homo sapiens
agcucccgcggaaaacugcu

SEQ ID NO: 1753930 - RNA, 13 nt, Homo sapiens
uucugcaauucaa

SEQ ID NO: 1753931 - RNA, 23 nt, Homo sapiens
ggugggaugagggagacagacca

SEQ ID NO: 1753932 - RNA, 17 nt, Homo sapiens
caucccaucccauccca

SEQ ID NO: 1753933 - RNA, 23 nt, Homo sapiens
aaguuuugguucuucagugcaga

SEQ ID NO: 1753934 - RNA, 10 nt, Homo sapiens
aucuuucuac

SEQ ID NO: 1753935 - RNA, 12 nt, Homo sapiens
auguguacaagu

SEQ ID NO: 1753936 - RNA, 20 nt, Homo sapiens
gaaaugauaaagacuuuuau

SEQ ID NO: 1753937 - RNA, 17 nt, Homo sapiens
cauuucauuaguauucc

SEQ ID NO: 1753938 - RNA, 20 nt, Homo sapiens
auaccauugaaacaugccac

SEQ ID NO: 1753939 - RNA, 18 nt, Homo sapiens
gagugugagugugagaga

SEQ ID NO: 1753940 - RNA, 14 nt, Homo sapiens
ugaugcccagguca

SEQ ID NO: 1753941 - RNA, 19 nt, Homo sapiens
gcgugacacucuccuugca

SEQ ID NO: 1753942 - RNA, 21 nt, Homo sapiens
guccagaaaauaggguggaca

SEQ ID NO: 1753943 - RNA, 16 nt, Homo sapiens
ucuuccugcuuuccau

SEQ ID NO: 1753944 - RNA, 19 nt, Homo sapiens
auuuaucugugcaaauccu

SEQ ID NO: 1753945 - RNA, 18 nt, Homo sapiens
aagaauuucuaacaguac

SEQ ID NO: 1753946 - RNA, 18 nt, Homo sapiens
uagauccaaggcagggaa

SEQ ID NO: 1753947 - RNA, 18 nt, Homo sapiens
aguauuaucacugcugga

SEQ ID NO: 1753948 - RNA, 21 nt, Homo sapiens
gcacugcugggggugaggaca

SEQ ID NO: 1753949 - RNA, 23 nt, Homo sapiens
ccagccuauagcagaagcacauu

SEQ ID NO: 1753950 - RNA, 14 nt, Homo sapiens
ugaccaaagcucuc

SEQ ID NO: 1753951 - RNA, 17 nt, Homo sapiens
gaugguucccaauauca

SEQ ID NO: 1753952 - RNA, 15 nt, Homo sapiens
cccugaaauuucuca

SEQ ID NO: 1753953 - RNA, 18 nt, Homo sapiens
ugaaaguuguacaugaua

SEQ ID NO: 1753954 - RNA, 16 nt, Homo sapiens
uaguuguuggucugua

SEQ ID NO: 1753955 - RNA, 16 nt, Homo sapiens
uccccaaacccagaaa

SEQ ID NO: 1753956 - RNA, 14 nt, Homo sapiens
caucauuuuacucu

SEQ ID NO: 1753957 - RNA, 17 nt, Homo sapiens
ucaugagugcaacugug

SEQ ID NO: 1753958 - RNA, 22 nt, Homo sapiens
agguacagcaacaggaaucuca

SEQ ID NO: 1753959 - RNA, 15 nt, Homo sapiens
uuauccugugcuaca

SEQ ID NO: 1753960 - RNA, 15 nt, Homo sapiens
ggcaguucucacucc

SEQ ID NO: 1753961 - RNA, 17 nt, Homo sapiens
aagcacaaguacuuuug

SEQ ID NO: 1753962 - RNA, 17 nt, Homo sapiens
agaggucaccagcugcu

SEQ ID NO: 1753963 - RNA, 23 nt, Homo sapiens
gcaaagcgauuccuaccauacaa

SEQ ID NO: 1753964 - RNA, 15 nt, Homo sapiens
ugaaaagucauucag

SEQ ID NO: 1753965 - RNA, 21 nt, Homo sapiens
gaagagcgcaguguuuugcaa

SEQ ID NO: 1753966 - RNA, 13 nt, Homo sapiens
caauuaccaauau

SEQ ID NO: 1753967 - RNA, 15 nt, Homo sapiens
cacucugacaguauu

SEQ ID NO: 1753968 - RNA, 17 nt, Homo sapiens
caugcaggucuccauga

SEQ ID NO: 1753969 - RNA, 18 nt, Homo sapiens
auguggaguuuacauggg

SEQ ID NO: 1753970 - RNA, 23 nt, Homo sapiens
gcagcuccccaggagcucaggug

SEQ ID NO: 1753971 - RNA, 17 nt, Homo sapiens
agcagucagaguccagu

SEQ ID NO: 1753972 - RNA, 18 nt, Homo sapiens
ccucagcugcacauuccu

SEQ ID NO: 1753973 - RNA, 22 nt, Homo sapiens
ugguagaacguaaccacggaaa

SEQ ID NO: 1753974 - RNA, 22 nt, Homo sapiens
ggagaacgcggggaccccagaa

SEQ ID NO: 1753975 - RNA, 13 nt, Homo sapiens
aacauacuguuga

SEQ ID NO: 1753976 - RNA, 16 nt, Homo sapiens
cacuacagaucuccca

SEQ ID NO: 1753977 - RNA, 20 nt, Homo sapiens
cgggaucucguaucuuuaaa

SEQ ID NO: 1753978 - RNA, 17 nt, Homo sapiens
agcccagaagugcagaa

SEQ ID NO: 1753979 - RNA, 21 nt, Homo sapiens
uggcccacccaguccaugcuc

SEQ ID NO: 1753980 - RNA, 24 nt, Homo sapiens
cucugccuuaaacacacauugcag

SEQ ID NO: 1753981 - RNA, 13 nt, Homo sapiens
uaggcagcacuag

SEQ ID NO: 1753982 - RNA, 15 nt, Homo sapiens
cacaaguguguaaag

SEQ ID NO: 1753983 - RNA, 16 nt, Homo sapiens
gcuaugugagcacaaa

SEQ ID NO: 1753984 - RNA, 17 nt, Homo sapiens
accauuaccagaggguc

SEQ ID NO: 1753985 - RNA, 15 nt, Homo sapiens
gucuuaaucauuugu

SEQ ID NO: 1753986 - RNA, 19 nt, Homo sapiens
acagcagguuuauccagau

SEQ ID NO: 1753987 - RNA, 18 nt, Homo sapiens
caaguaaaacaaaaccac

SEQ ID NO: 1753988 - RNA, 18 nt, Homo sapiens
uccugaauuaacuaucau

SEQ ID NO: 1753989 - RNA, 14 nt, Homo sapiens
uaacugugugagau

SEQ ID NO: 1753990 - RNA, 18 nt, Homo sapiens
ccagggccgucaaggaaa

SEQ ID NO: 1753991 - RNA, 21 nt, Homo sapiens
gucaauauuaaauacagacac

SEQ ID NO: 1753992 - RNA, 13 nt, Homo sapiens
uaugucugcugaa

SEQ ID NO: 1753993 - RNA, 19 nt, Homo sapiens
aaaggcugauuacugaaau

SEQ ID NO: 1753994 - RNA, 15 nt, Homo sapiens
caccaccuccagcuu

SEQ ID NO: 1753995 - RNA, 14 nt, Homo sapiens
guacguuacagcuu

SEQ ID NO: 1753996 - RNA, 16 nt, Homo sapiens
gcuggccucuaccaca

SEQ ID NO: 1753997 - RNA, 18 nt, Homo sapiens
aguaucggcacuguacaa

SEQ ID NO: 1753998 - RNA, 23 nt, Homo sapiens
guaaacacauguucugugccugc

SEQ ID NO: 1753999 - RNA, 14 nt, Homo sapiens
accugaaacacuuu

SEQ ID NO: 1754000 - RNA, 14 nt, Homo sapiens
uccaaagacauguu

SEQ ID NO: 1754001 - RNA, 17 nt, Homo sapiens
aaagguuucaagacuug

SEQ ID NO: 1754002 - RNA, 18 nt, Homo sapiens
uggccaggagccaugaca

SEQ ID NO: 1754003 - RNA, 19 nt, Homo sapiens
agggaguagggcucgccau

SEQ ID NO: 1754004 - RNA, 12 nt, Homo sapiens
acaggagccuag

SEQ ID NO: 1754005 - RNA, 21 nt, Homo sapiens
accacuuucccacacugugaa

SEQ ID NO: 1754006 - RNA, 22 nt, Homo sapiens
ugggcuggaacagcagauuuca

SEQ ID NO: 1754007 - RNA, 18 nt, Homo sapiens
auauauacaucauacuua

SEQ ID NO: 1754008 - RNA, 17 nt, Homo sapiens
aaagaugcaucaucucu

SEQ ID NO: 1754009 - RNA, 17 nt, Homo sapiens
agcuaugcuguaucugu

SEQ ID NO: 1754010 - RNA, 22 nt, Homo sapiens
uuaaguccuuaaugaagagcca

SEQ ID NO: 1754011 - RNA, 20 nt, Homo sapiens
cuuguccacauagguuuaga

SEQ ID NO: 1754012 - RNA, 22 nt, Homo sapiens
cugaaguugcugagcaguauuc

SEQ ID NO: 1754013 - RNA, 23 nt, Homo sapiens
ucacuuuuuuucuuuucucugcc

SEQ ID NO: 1754014 - RNA, 21 nt, Homo sapiens
uacauugucaaagcuugccgu

SEQ ID NO: 1754015 - RNA, 22 nt, Homo sapiens
gaccacugaagcaccacaggga

SEQ ID NO: 1754016 - RNA, 14 nt, Homo sapiens
uggguuccauucuc

SEQ ID NO: 1754017 - RNA, 14 nt, Homo sapiens
cauccaaagaacau

SEQ ID NO: 1754018 - RNA, 17 nt, Homo sapiens
ucagugauaacucugag

SEQ ID NO: 1754019 - RNA, 20 nt, Homo sapiens
uaaauauuguguugugcagc

SEQ ID NO: 1754020 - RNA, 14 nt, Homo sapiens
cuuugcuacuacua

SEQ ID NO: 1754021 - RNA, 22 nt, Homo sapiens
cuggugagauacccagagagaa

SEQ ID NO: 1754022 - RNA, 23 nt, Homo sapiens
ccuggcaucaguagcaucuguaa

SEQ ID NO: 1754023 - RNA, 17 nt, Homo sapiens
ucauaacuauacuugau

SEQ ID NO: 1754024 - RNA, 16 nt, Homo sapiens
gggacacaacacagau

SEQ ID NO: 1754025 - RNA, 16 nt, Homo sapiens
gccgcagacgggcaca

SEQ ID NO: 1754026 - RNA, 20 nt, Homo sapiens
auauacauauguagacuaua

SEQ ID NO: 1754027 - RNA, 13 nt, Homo sapiens
acuccugccauuc

SEQ ID NO: 1754028 - RNA, 21 nt, Homo sapiens
cauguacaaaaauuaugcaau

SEQ ID NO: 1754029 - RNA, 15 nt, Homo sapiens
caggugccuaccacc

SEQ ID NO: 1754030 - RNA, 14 nt, Homo sapiens
cccagggagcucug

SEQ ID NO: 1754031 - RNA, 17 nt, Homo sapiens
uggagaguggaaggacu

SEQ ID NO: 1754032 - RNA, 18 nt, Homo sapiens
ccagguuucuacaccccc

SEQ ID NO: 1754033 - RNA, 18 nt, Homo sapiens
cacagcuucucuacagac

SEQ ID NO: 1754034 - RNA, 13 nt, Homo sapiens
aaauccacccaua

SEQ ID NO: 1754035 - RNA, 13 nt, Homo sapiens
acagccaccaaga

SEQ ID NO: 1754036 - RNA, 15 nt, Homo sapiens
uuaaccaagaaacaa

SEQ ID NO: 1754037 - RNA, 18 nt, Homo sapiens
cagaaaagcccaaguuca

SEQ ID NO: 1754038 - RNA, 18 nt, Homo sapiens
ccaggauuuuaauuucag

SEQ ID NO: 1754039 - RNA, 17 nt, Homo sapiens
cuuacgaaauccuuugu

SEQ ID NO: 1754040 - RNA, 14 nt, Homo sapiens
cuaaaaauacaauu

SEQ ID NO: 1754041 - RNA, 17 nt, Homo sapiens
aaauucaaauuauucua

SEQ ID NO: 1754042 - RNA, 21 nt, Homo sapiens
uacaaauacuaucucuguauu

SEQ ID NO: 1754043 - RNA, 21 nt, Homo sapiens
auauuuauucauuauuuguca

SEQ ID NO: 1754044 - RNA, 14 nt, Homo sapiens
gaauuucacaagcu

SEQ ID NO: 1754045 - RNA, 19 nt, Homo sapiens
cucgggaguuugagaccag

SEQ ID NO: 1754046 - RNA, 14 nt, Homo sapiens
agcugagguaaaaa

SEQ ID NO: 1754047 - RNA, 17 nt, Homo sapiens
gcaaaagaaacuaucaa

SEQ ID NO: 1754048 - RNA, 12 nt, Homo sapiens
uacuaaucucaa

SEQ ID NO: 1754049 - RNA, 13 nt, Homo sapiens
uuguagcauuugg

SEQ ID NO: 1754050 - RNA, 22 nt, Homo sapiens
ccugacccucaucuuucuucca

SEQ ID NO: 1754051 - RNA, 23 nt, Homo sapiens
guuauuugaaaauuugauuuuga

SEQ ID NO: 1754052 - RNA, 20 nt, Homo sapiens
ccagugaccccugaccucac

SEQ ID NO: 1754053 - RNA, 18 nt, Homo sapiens
caaggaucagauucuugc

SEQ ID NO: 1754054 - RNA, 13 nt, Homo sapiens
acauuaacaagcu

SEQ ID NO: 1754055 - RNA, 17 nt, Homo sapiens
augaauuauuacagugu

SEQ ID NO: 1754056 - RNA, 16 nt, Homo sapiens
uucuccaacaauaaga

SEQ ID NO: 1754057 - RNA, 18 nt, Homo sapiens
uuccccucuguguccucu

SEQ ID NO: 1754058 - RNA, 12 nt, Homo sapiens
ggagcacgugga

SEQ ID NO: 1754059 - RNA, 23 nt, Homo sapiens
uaacccaugaaggauaaaagccc

SEQ ID NO: 1754060 - RNA, 14 nt, Homo sapiens
ggcccggccggccu

SEQ ID NO: 1754061 - RNA, 24 nt, Homo sapiens
ccacagccuggcuauacagugcau

SEQ ID NO: 1754062 - RNA, 16 nt, Homo sapiens
agaguggcagccaaga

SEQ ID NO: 1754063 - RNA, 22 nt, Homo sapiens
augcuccuccuccaugcucccu

SEQ ID NO: 1754064 - RNA, 21 nt, Homo sapiens
aaauguuauagcugcauuugu

SEQ ID NO: 1754065 - RNA, 17 nt, Homo sapiens
gcuuuggaaaggugccc

SEQ ID NO: 1754066 - RNA, 20 nt, Homo sapiens
cuuuguagaguuuugucauu

SEQ ID NO: 1754067 - RNA, 15 nt, Homo sapiens
gggcccagcgcagug

SEQ ID NO: 1754068 - RNA, 19 nt, Homo sapiens
aucacugccaucacaucac

SEQ ID NO: 1754069 - RNA, 23 nt, Homo sapiens
augugagaccauuuagcacacug

SEQ ID NO: 1754070 - RNA, 13 nt, Homo sapiens
guuauauauauca

SEQ ID NO: 1754071 - RNA, 17 nt, Homo sapiens
aaaccaguugauuuaaa

SEQ ID NO: 1754072 - RNA, 16 nt, Homo sapiens
uaaagaggucagggga

SEQ ID NO: 1754073 - RNA, 13 nt, Homo sapiens
cucuucaaacagu

SEQ ID NO: 1754074 - RNA, 19 nt, Homo sapiens
gagggugcagcccucuugc

SEQ ID NO: 1754075 - RNA, 17 nt, Homo sapiens
uugccuuucuucugccc

SEQ ID NO: 1754076 - RNA, 20 nt, Homo sapiens
aguuaaaauguuuacuguaa

SEQ ID NO: 1754077 - RNA, 22 nt, Homo sapiens
ucuggauuugccugcagaguuu

SEQ ID NO: 1754078 - RNA, 21 nt, Homo sapiens
aagcagauuucugcuuccuuu

SEQ ID NO: 1754079 - RNA, 21 nt, Homo sapiens
aggaucacagcucacggcagc

SEQ ID NO: 1754080 - RNA, 20 nt, Homo sapiens
uucacucccaaaugcaaaca

SEQ ID NO: 1754081 - RNA, 19 nt, Homo sapiens
agaauauguuucaaacuuu

SEQ ID NO: 1754082 - RNA, 13 nt, Homo sapiens
cucuuaugcacac

SEQ ID NO: 1754083 - RNA, 12 nt, Homo sapiens
cuccaucucaua

SEQ ID NO: 1754084 - RNA, 15 nt, Homo sapiens
aguuuuacaaaccuu

SEQ ID NO: 1754085 - RNA, 20 nt, Homo sapiens
acggaggacugaacugggga

SEQ ID NO: 1754086 - RNA, 18 nt, Homo sapiens
ucuacuacuuggaaggaa

SEQ ID NO: 1754087 - RNA, 21 nt, Homo sapiens
gauucugcaggaacaugaccc

SEQ ID NO: 1754088 - RNA, 17 nt, Homo sapiens
aaacacuaggugccugc

SEQ ID NO: 1754089 - RNA, 16 nt, Homo sapiens
aguuuaugaugcaaau

SEQ ID NO: 1754090 - RNA, 13 nt, Homo sapiens
augaacagcauua

SEQ ID NO: 1754091 - RNA, 21 nt, Homo sapiens
caaacucagaucucaucaggg

SEQ ID NO: 1754092 - RNA, 20 nt, Homo sapiens
gccugucugccccagcccag

SEQ ID NO: 1754093 - RNA, 19 nt, Homo sapiens
gaggcccccaguauugcag

SEQ ID NO: 1754094 - RNA, 16 nt, Homo sapiens
guuauggcagaugaca

SEQ ID NO: 1754095 - RNA, 15 nt, Homo sapiens
acauucacacagaga

SEQ ID NO: 1754096 - RNA, 19 nt, Homo sapiens
ccaaucaaauauauuauuu

SEQ ID NO: 1754097 - RNA, 12 nt, Homo sapiens
gagcuauaacuu

SEQ ID NO: 1754098 - RNA, 14 nt, Homo sapiens
auguaaacugugca

SEQ ID NO: 1754099 - RNA, 18 nt, Homo sapiens
cagugaaauaacuaccuu

SEQ ID NO: 1754100 - RNA, 20 nt, Homo sapiens
ggagcaggugcccccaggug

SEQ ID NO: 1754101 - RNA, 15 nt, Homo sapiens
ggcccugcccagcca

SEQ ID NO: 1754102 - RNA, 13 nt, Homo sapiens
aaacugaugccaa

SEQ ID NO: 1754103 - RNA, 22 nt, Homo sapiens
aagaauguguuucaaacuguaa

SEQ ID NO: 1754104 - RNA, 14 nt, Homo sapiens
uuggaagagaauca

SEQ ID NO: 1754105 - RNA, 22 nt, Homo sapiens
acuguucaauacuguaugccuu

SEQ ID NO: 1754106 - RNA, 20 nt, Homo sapiens
ucaaggaggcccacuguguc

SEQ ID NO: 1754107 - RNA, 18 nt, Homo sapiens
auuuucucugauacuuuu

SEQ ID NO: 1754108 - RNA, 22 nt, Homo sapiens
guccagaaauugugugugcaag

SEQ ID NO: 1754109 - RNA, 23 nt, Homo sapiens
acaggugcccuuucucuuaccac

SEQ ID NO: 1754110 - RNA, 21 nt, Homo sapiens
ucucauuuuguauguaugugu

SEQ ID NO: 1754111 - RNA, 19 nt, Homo sapiens
aguuuaucauugggagaag

SEQ ID NO: 1754112 - RNA, 15 nt, Homo sapiens
ucuuugcugugccaa

SEQ ID NO: 1754113 - RNA, 13 nt, Homo sapiens
cuaugcuuuggaa

SEQ ID NO: 1754114 - RNA, 13 nt, Homo sapiens
cuggggaagccag

SEQ ID NO: 1754115 - RNA, 15 nt, Homo sapiens
guuaaauaugcaucu

SEQ ID NO: 1754116 - RNA, 16 nt, Homo sapiens
gcagucccacacugug

SEQ ID NO: 1754117 - RNA, 22 nt, Homo sapiens
guaccuauuuuguauguguaua

SEQ ID NO: 1754118 - RNA, 17 nt, Homo sapiens
auuuugaauagcaauua

SEQ ID NO: 1754119 - RNA, 16 nt, Homo sapiens
cuucuucaccauuugg

SEQ ID NO: 1754120 - RNA, 16 nt, Homo sapiens
guaaguugagggccag

SEQ ID NO: 1754121 - RNA, 16 nt, Homo sapiens
uaggcauucuggaccu

SEQ ID NO: 1754122 - RNA, 17 nt, Homo sapiens
cauuaccuccauccauc

SEQ ID NO: 1754123 - RNA, 18 nt, Homo sapiens
aaaauuauguuccuagaa

SEQ ID NO: 1754124 - RNA, 20 nt, Homo sapiens
ggagccccugaaagccucac

SEQ ID NO: 1754125 - RNA, 20 nt, Homo sapiens
aagaccugacaccuuucaua

SEQ ID NO: 1754126 - RNA, 12 nt, Homo sapiens
gguaaagcacau

SEQ ID NO: 1754127 - RNA, 15 nt, Homo sapiens
gugugugugugugca

SEQ ID NO: 1754128 - RNA, 22 nt, Homo sapiens
uaauaagagaauguuccuacuc

SEQ ID NO: 1754129 - RNA, 15 nt, Homo sapiens
ucagaauaucacaga

SEQ ID NO: 1754130 - RNA, 23 nt, Homo sapiens
ucugggagguuacugucugguag

SEQ ID NO: 1754131 - RNA, 20 nt, Homo sapiens
aauuuuagaagacagccuac

SEQ ID NO: 1754132 - RNA, 16 nt, Homo sapiens
gcuggggacuggggaa

SEQ ID NO: 1754133 - RNA, 19 nt, Homo sapiens
aguacucaaauauuucuga

SEQ ID NO: 1754134 - RNA, 16 nt, Homo sapiens
cagugauuuggaugaa

SEQ ID NO: 1754135 - RNA, 24 nt, Homo sapiens
ugccauaucagugaaccuuuagaa

SEQ ID NO: 1754136 - RNA, 18 nt, Homo sapiens
ccuguagguuugcuucaa

SEQ ID NO: 1754137 - RNA, 16 nt, Homo sapiens
auaauucuuuuuccac

SEQ ID NO: 1754138 - RNA, 14 nt, Homo sapiens
acagugaugccaug

SEQ ID NO: 1754139 - RNA, 13 nt, Homo sapiens
acuaaugagcaag

SEQ ID NO: 1754140 - RNA, 15 nt, Homo sapiens
ccagccuuggcgaca

SEQ ID NO: 1754141 - RNA, 17 nt, Homo sapiens
auaggcaucaucaauaa

SEQ ID NO: 1754142 - RNA, 20 nt, Homo sapiens
acuugaguaaaucuaaagaa

SEQ ID NO: 1754143 - RNA, 14 nt, Homo sapiens
uuaagaguccaaga

SEQ ID NO: 1754144 - RNA, 17 nt, Homo sapiens
aauucauucauuugcau

SEQ ID NO: 1754145 - RNA, 17 nt, Homo sapiens
auagugcacuagcauuu

SEQ ID NO: 1754146 - RNA, 15 nt, Homo sapiens
cugcaucugugaaaa

SEQ ID NO: 1754147 - RNA, 23 nt, Homo sapiens
uggaaaguaucaugaaaggaaga

SEQ ID NO: 1754148 - RNA, 15 nt, Homo sapiens
caaugacaauggugc

SEQ ID NO: 1754149 - RNA, 17 nt, Homo sapiens
agcuuucugauacuuau

SEQ ID NO: 1754150 - RNA, 18 nt, Homo sapiens
cucagcuguccugcagca

SEQ ID NO: 1754151 - RNA, 17 nt, Homo sapiens
accuugaugugccugug

SEQ ID NO: 1754152 - RNA, 17 nt, Homo sapiens
cugucuggccccugaga

SEQ ID NO: 1754153 - RNA, 11 nt, Homo sapiens
aauguauuuaa

SEQ ID NO: 1754154 - RNA, 13 nt, Homo sapiens
cuaagaugaucau

SEQ ID NO: 1754155 - RNA, 14 nt, Homo sapiens
aacuuaaaagcaag

SEQ ID NO: 1754156 - RNA, 17 nt, Homo sapiens
uccuucuguagugccau

SEQ ID NO: 1754157 - RNA, 18 nt, Homo sapiens
cacggcugcgcacugugu

SEQ ID NO: 1754158 - RNA, 21 nt, Homo sapiens
gccucaguccuccccucacag

SEQ ID NO: 1754159 - RNA, 17 nt, Homo sapiens
ucuugggaaauauguca

SEQ ID NO: 1754160 - RNA, 16 nt, Homo sapiens
ccccacaccugcagug

SEQ ID NO: 1754161 - RNA, 14 nt, Homo sapiens
acugucaugcccag

SEQ ID NO: 1754162 - RNA, 14 nt, Homo sapiens
gaauuuuugcacau

SEQ ID NO: 1754163 - RNA, 17 nt, Homo sapiens
uuaccgccugucucuuu

SEQ ID NO: 1754164 - RNA, 22 nt, Homo sapiens
gcacaugggcaugguugaaucu

SEQ ID NO: 1754165 - RNA, 23 nt, Homo sapiens
cagcucuccccaggcauuugcca

SEQ ID NO: 1754166 - RNA, 19 nt, Homo sapiens
gcaaacuccagguuccuga

SEQ ID NO: 1754167 - RNA, 16 nt, Homo sapiens
augucuucauaauaua

SEQ ID NO: 1754168 - RNA, 20 nt, Homo sapiens
uuccagcauuugccauuccu

SEQ ID NO: 1754169 - RNA, 12 nt, Homo sapiens
aagcucacaaua

SEQ ID NO: 1754170 - RNA, 17 nt, Homo sapiens
ucagaucucaucagggu

SEQ ID NO: 1754171 - RNA, 17 nt, Homo sapiens
auuucagccuacauuga

SEQ ID NO: 1754172 - RNA, 17 nt, Homo sapiens
aagcaccuaaaugaugc

SEQ ID NO: 1754173 - RNA, 18 nt, Homo sapiens
auuucuauaggcaaagaa

SEQ ID NO: 1754174 - RNA, 18 nt, Homo sapiens
aacuaugacagauauauu

SEQ ID NO: 1754175 - RNA, 17 nt, Homo sapiens
ugagcuaggaauugugu

SEQ ID NO: 1754176 - RNA, 21 nt, Homo sapiens
aaaaccagucucagauaucau

SEQ ID NO: 1754177 - RNA, 21 nt, Homo sapiens
accucuuuuaaacaggcaaaa

SEQ ID NO: 1754178 - RNA, 14 nt, Homo sapiens
ggcuuccugugcua

SEQ ID NO: 1754179 - RNA, 17 nt, Homo sapiens
ugcuucugcucacauuc

SEQ ID NO: 1754180 - RNA, 13 nt, Homo sapiens
aguaccaaaauaa

SEQ ID NO: 1754181 - RNA, 15 nt, Homo sapiens
uccugaccucgugau

SEQ ID NO: 1754182 - RNA, 15 nt, Homo sapiens
agacacccaguggaa

SEQ ID NO: 1754183 - RNA, 15 nt, Homo sapiens
ugucacccugaggaa

SEQ ID NO: 1754184 - RNA, 15 nt, Homo sapiens
aaaguagaacuuugu

SEQ ID NO: 1754185 - RNA, 16 nt, Homo sapiens
acuaaugucucuacaa

SEQ ID NO: 1754186 - RNA, 24 nt, Homo sapiens
ugauugggucagcuggcuuccuag

SEQ ID NO: 1754187 - RNA, 15 nt, Homo sapiens
auuuuuuuaaucguc

SEQ ID NO: 1754188 - RNA, 22 nt, Homo sapiens
aaacccaguuuucccucuggga

SEQ ID NO: 1754189 - RNA, 17 nt, Homo sapiens
cacucaggauugggaau

SEQ ID NO: 1754190 - RNA, 20 nt, Homo sapiens
gucuuaagccuuuugcucac

SEQ ID NO: 1754191 - RNA, 11 nt, Homo sapiens
gucuguuggca

SEQ ID NO: 1754192 - RNA, 22 nt, Homo sapiens
agaacaguuuuacaauagacau

SEQ ID NO: 1754193 - RNA, 13 nt, Homo sapiens
cccgucugggaau

SEQ ID NO: 1754194 - RNA, 13 nt, Homo sapiens
cccaucugggagu

SEQ ID NO: 1754195 - RNA, 13 nt, Homo sapiens
auggccagccaac

SEQ ID NO: 1754196 - RNA, 14 nt, Homo sapiens
gcaugaaagguaau

SEQ ID NO: 1754197 - RNA, 14 nt, Homo sapiens
ucauaacccaugaa

SEQ ID NO: 1754198 - RNA, 13 nt, Homo sapiens
gcacgcucgcugc

SEQ ID NO: 1754199 - RNA, 16 nt, Homo sapiens
uaagguggguggauca

SEQ ID NO: 1754200 - RNA, 20 nt, Homo sapiens
aaggauauuuacuacuuuug

SEQ ID NO: 1754201 - RNA, 22 nt, Homo sapiens
cagcgcagaguagcugcuuccu

SEQ ID NO: 1754202 - RNA, 12 nt, Homo sapiens
ugcauggccuua

SEQ ID NO: 1754203 - RNA, 17 nt, Homo sapiens
agaaaacuugaauucau

SEQ ID NO: 1754204 - RNA, 15 nt, Homo sapiens
agcugcacaugacua

SEQ ID NO: 1754205 - RNA, 17 nt, Homo sapiens
aacucacaguaaugugu

SEQ ID NO: 1754206 - RNA, 22 nt, Homo sapiens
gguagucacuugcgugaaugcu

SEQ ID NO: 1754207 - RNA, 17 nt, Homo sapiens
ccucuggagcuuugcag

SEQ ID NO: 1754208 - RNA, 14 nt, Homo sapiens
gcucacgcaggacc

SEQ ID NO: 1754209 - RNA, 14 nt, Homo sapiens
aagaacaacacuaa

SEQ ID NO: 1754210 - RNA, 17 nt, Homo sapiens
caguagggaggucagug

SEQ ID NO: 1754211 - RNA, 19 nt, Homo sapiens
gcugggaauaagugccagg

SEQ ID NO: 1754212 - RNA, 19 nt, Homo sapiens
caucguacacacucaguga

SEQ ID NO: 1754213 - RNA, 21 nt, Homo sapiens
auuuuuuaugaaacauuacag

SEQ ID NO: 1754214 - RNA, 24 nt, Homo sapiens
cuaugccagcaaccuuguaagcua

SEQ ID NO: 1754215 - RNA, 23 nt, Homo sapiens
caccucaggaccaugugauaauu

SEQ ID NO: 1754216 - RNA, 22 nt, Homo sapiens
aagcugggagcacaggcacugc

SEQ ID NO: 1754217 - RNA, 14 nt, Homo sapiens
augcagaaguauuc

SEQ ID NO: 1754218 - RNA, 19 nt, Homo sapiens
agaaaaguagguuuacauu

SEQ ID NO: 1754219 - RNA, 19 nt, Homo sapiens
ggggcugucccgugcaugg

SEQ ID NO: 1754220 - RNA, 11 nt, Homo sapiens
gggcugggaug

SEQ ID NO: 1754221 - RNA, 17 nt, Homo sapiens
uggcuggaucagggaau

SEQ ID NO: 1754222 - RNA, 12 nt, Homo sapiens
cacgaagcaauu

SEQ ID NO: 1754223 - RNA, 19 nt, Homo sapiens
cagguuccugaaauaucca

SEQ ID NO: 1754224 - RNA, 14 nt, Homo sapiens
aaauaaauggaaua

SEQ ID NO: 1754225 - RNA, 14 nt, Homo sapiens
aguuauaugauauu

SEQ ID NO: 1754226 - RNA, 22 nt, Homo sapiens
ugguauauaggcuaaccacuuu

SEQ ID NO: 1754227 - RNA, 15 nt, Homo sapiens
uccccuugucugcac

SEQ ID NO: 1754228 - RNA, 13 nt, Homo sapiens
ucauggcauucac

SEQ ID NO: 1754229 - RNA, 20 nt, Homo sapiens
ccuggauggggcaggccacc

SEQ ID NO: 1754230 - RNA, 16 nt, Homo sapiens
uaaacugguacaauuu

SEQ ID NO: 1754231 - RNA, 16 nt, Homo sapiens
agcagcacaugguguu

SEQ ID NO: 1754232 - RNA, 11 nt, Homo sapiens
guacuguguuu

SEQ ID NO: 1754233 - RNA, 16 nt, Homo sapiens
cuagauccaauugcau

SEQ ID NO: 1754234 - RNA, 17 nt, Homo sapiens
aagugucuagagucaug

SEQ ID NO: 1754235 - RNA, 22 nt, Homo sapiens
uaacaugguacacugcaucuca

SEQ ID NO: 1754236 - RNA, 12 nt, Homo sapiens
aagauggcauaa

SEQ ID NO: 1754237 - RNA, 13 nt, Homo sapiens
cauucuugcuaau

SEQ ID NO: 1754238 - RNA, 21 nt, Homo sapiens
acgaacccaaucugcacacuc

SEQ ID NO: 1754239 - RNA, 12 nt, Homo sapiens
cucucugccaug

SEQ ID NO: 1754240 - RNA, 19 nt, Homo sapiens
ccuuaaccuuaaaauugau

SEQ ID NO: 1754241 - RNA, 16 nt, Homo sapiens
uuuagagaagccauaa

SEQ ID NO: 1754242 - RNA, 14 nt, Homo sapiens
uagucaccagagac

SEQ ID NO: 1754243 - RNA, 19 nt, Homo sapiens
uuuugauccuguaaucaca

SEQ ID NO: 1754244 - RNA, 18 nt, Homo sapiens
aacacauuacuugcacaa

SEQ ID NO: 1754245 - RNA, 17 nt, Homo sapiens
acacuacucuuacaugu

SEQ ID NO: 1754246 - RNA, 14 nt, Homo sapiens
gcucugaagccaag

SEQ ID NO: 1754247 - RNA, 23 nt, Homo sapiens
aauuauccauuacgugcauuuaa

SEQ ID NO: 1754248 - RNA, 17 nt, Homo sapiens
cugacauuuugcagaaa

SEQ ID NO: 1754249 - RNA, 16 nt, Homo sapiens
uuuuuaaaaaagcaag

SEQ ID NO: 1754250 - RNA, 16 nt, Homo sapiens
auacccuauccuggug

SEQ ID NO: 1754251 - RNA, 20 nt, Homo sapiens
aacaugacauuuaccagcaa

SEQ ID NO: 1754252 - RNA, 22 nt, Homo sapiens
acucgauguaagggauuccuug

SEQ ID NO: 1754253 - RNA, 15 nt, Homo sapiens
acaaggggcccagug

SEQ ID NO: 1754254 - RNA, 23 nt, Homo sapiens
gagaauuagaaacaacauagcaa

SEQ ID NO: 1754255 - RNA, 17 nt, Homo sapiens
gccugggauggggcuuc

SEQ ID NO: 1754256 - RNA, 23 nt, Homo sapiens
acauuaagagauuuucaagauca

SEQ ID NO: 1754257 - RNA, 11 nt, Homo sapiens
gauaccaucuc

SEQ ID NO: 1754258 - RNA, 14 nt, Homo sapiens
auaauagcauucau

SEQ ID NO: 1754259 - RNA, 23 nt, Homo sapiens
gcucuuuagaauggaccacugag

SEQ ID NO: 1754260 - RNA, 13 nt, Homo sapiens
gcuucuaacucau

SEQ ID NO: 1754261 - RNA, 14 nt, Homo sapiens
auuuaugagcucuu

SEQ ID NO: 1754262 - RNA, 15 nt, Homo sapiens
gagaaaugucuuuug

SEQ ID NO: 1754263 - RNA, 22 nt, Homo sapiens
agaugaguaggaguuugcuaag

SEQ ID NO: 1754264 - RNA, 17 nt, Homo sapiens
aggauccuggccugaga

SEQ ID NO: 1754265 - RNA, 14 nt, Homo sapiens
gccgccugucaaua

SEQ ID NO: 1754266 - RNA, 18 nt, Homo sapiens
ggcuuucccggaggccag

SEQ ID NO: 1754267 - RNA, 14 nt, Homo sapiens
aaguauuuugccac

SEQ ID NO: 1754268 - RNA, 15 nt, Homo sapiens
uguacagugaaucug

SEQ ID NO: 1754269 - RNA, 15 nt, Homo sapiens
ucaauaaacuaaaga

SEQ ID NO: 1754270 - RNA, 16 nt, Homo sapiens
acuagaauucugggaa

SEQ ID NO: 1754271 - RNA, 14 nt, Homo sapiens
cuuuggcaacagaa

SEQ ID NO: 1754272 - RNA, 16 nt, Homo sapiens
acaaugugacuuugaa

SEQ ID NO: 1754273 - RNA, 20 nt, Homo sapiens
aaaaaaauuaacaugucaca

SEQ ID NO: 1754274 - RNA, 15 nt, Homo sapiens
ucuguuaaaugaacu

SEQ ID NO: 1754275 - RNA, 15 nt, Homo sapiens
ggcauuccucuaaug

SEQ ID NO: 1754276 - RNA, 22 nt, Homo sapiens
aacgagauugcuggaaaccaag

SEQ ID NO: 1754277 - RNA, 23 nt, Homo sapiens
agcagccucuggacagccaguga

SEQ ID NO: 1754278 - RNA, 13 nt, Homo sapiens
aacaaacaaugaa

SEQ ID NO: 1754279 - RNA, 22 nt, Homo sapiens
uguaaaccacuugucacuacaa

SEQ ID NO: 1754280 - RNA, 21 nt, Homo sapiens
gccuggcaucugugugcgugg

SEQ ID NO: 1754281 - RNA, 17 nt, Homo sapiens
cuccuggaccaggucuc

SEQ ID NO: 1754282 - RNA, 17 nt, Homo sapiens
gggugcauaucuuccca

SEQ ID NO: 1754283 - RNA, 20 nt, Homo sapiens
agcccccaaguugauauuuc

SEQ ID NO: 1754284 - RNA, 17 nt, Homo sapiens
auuaucaauuaccacac

SEQ ID NO: 1754285 - RNA, 13 nt, Homo sapiens
uuugaagucuugu

SEQ ID NO: 1754286 - RNA, 23 nt, Homo sapiens
acuuuuuuuuuuuuuugguugca

SEQ ID NO: 1754287 - RNA, 17 nt, Homo sapiens
augcuuaaacuaaauaa

SEQ ID NO: 1754288 - RNA, 15 nt, Homo sapiens
aguuaggagaaagaa

SEQ ID NO: 1754289 - RNA, 16 nt, Homo sapiens
cauugugauuguggaa

SEQ ID NO: 1754290 - RNA, 14 nt, Homo sapiens
cuuugggaccugcu

SEQ ID NO: 1754291 - RNA, 16 nt, Homo sapiens
caccccuaaguacaag

SEQ ID NO: 1754292 - RNA, 20 nt, Homo sapiens
guggaucuugccacauuucu

SEQ ID NO: 1754293 - RNA, 15 nt, Homo sapiens
uaaauacaugcauau

SEQ ID NO: 1754294 - RNA, 17 nt, Homo sapiens
ccaagccagcugccuag

SEQ ID NO: 1754295 - RNA, 15 nt, Homo sapiens
cuucauuuuagucca

SEQ ID NO: 1754296 - RNA, 18 nt, Homo sapiens
cugaaaaugaacuguaaa

SEQ ID NO: 1754297 - RNA, 11 nt, Homo sapiens
uucaguuucag

SEQ ID NO: 1754298 - RNA, 13 nt, Homo sapiens
ggauccucuccuu

SEQ ID NO: 1754299 - RNA, 22 nt, Homo sapiens
cauaaguauacaguucaauaaa

SEQ ID NO: 1754300 - RNA, 12 nt, Homo sapiens
uuucaaaggaua

SEQ ID NO: 1754301 - RNA, 14 nt, Homo sapiens
aaauaaauagauuu

SEQ ID NO: 1754302 - RNA, 20 nt, Homo sapiens
uuuaagaucacgccacugga

SEQ ID NO: 1754303 - RNA, 22 nt, Homo sapiens
gcuuccuccccccgacuccccc

SEQ ID NO: 1754304 - RNA, 15 nt, Homo sapiens
uucuauuauggaaaa

SEQ ID NO: 1754305 - RNA, 14 nt, Homo sapiens
uagugccaacauuu

SEQ ID NO: 1754306 - RNA, 20 nt, Homo sapiens
accuacuuugguaguggaau

SEQ ID NO: 1754307 - RNA, 15 nt, Homo sapiens
acaacagauucucuu

SEQ ID NO: 1754308 - RNA, 23 nt, Homo sapiens
agggcagggcugaggccucucau

SEQ ID NO: 1754309 - RNA, 19 nt, Homo sapiens
gacacuggcguuacugcuu

SEQ ID NO: 1754310 - RNA, 16 nt, Homo sapiens
gaaaauaagugcucug

SEQ ID NO: 1754311 - RNA, 17 nt, Homo sapiens
uuaucuaccaacuuuca

SEQ ID NO: 1754312 - RNA, 22 nt, Homo sapiens
cagcaggacgacuguuuuccca

SEQ ID NO: 1754313 - RNA, 14 nt, Homo sapiens
gaauauuacucuca

SEQ ID NO: 1754314 - RNA, 23 nt, Homo sapiens
gauggagacaguaacacuggcga

SEQ ID NO: 1754315 - RNA, 22 nt, Homo sapiens
acucuggguuuauuacauggca

SEQ ID NO: 1754316 - RNA, 19 nt, Homo sapiens
cuccuaaaccauugagcua

SEQ ID NO: 1754317 - RNA, 12 nt, Homo sapiens
ugcacaaggugg

SEQ ID NO: 1754318 - RNA, 20 nt, Homo sapiens
aagaaagcagaaaguucaac

SEQ ID NO: 1754319 - RNA, 16 nt, Homo sapiens
cauguguuuacuuuau

SEQ ID NO: 1754320 - RNA, 14 nt, Homo sapiens
auaggcacaggcaa

SEQ ID NO: 1754321 - RNA, 15 nt, Homo sapiens
cauugucugucugca

SEQ ID NO: 1754322 - RNA, 11 nt, Homo sapiens
acucacuccau

SEQ ID NO: 1754323 - RNA, 14 nt, Homo sapiens
gcucgcucuuggga

SEQ ID NO: 1754324 - RNA, 14 nt, Homo sapiens
ucuuacagcacauc

SEQ ID NO: 1754325 - RNA, 15 nt, Homo sapiens
gagugauauacucca

SEQ ID NO: 1754326 - RNA, 15 nt, Homo sapiens
cacugagucucaugg

SEQ ID NO: 1754327 - RNA, 17 nt, Homo sapiens
guccagaauaagugcug

SEQ ID NO: 1754328 - RNA, 14 nt, Homo sapiens
gucaugagcauuug

SEQ ID NO: 1754329 - RNA, 16 nt, Homo sapiens
cagaacccaucccucu

SEQ ID NO: 1754330 - RNA, 15 nt, Homo sapiens
gcuguucaccaccau

SEQ ID NO: 1754331 - RNA, 18 nt, Homo sapiens
gaaaucagugguguuaca

SEQ ID NO: 1754332 - RNA, 20 nt, Homo sapiens
cguccgcgcgccagcacaga

SEQ ID NO: 1754333 - RNA, 22 nt, Homo sapiens
ggagugggcccaaugcacuuug

SEQ ID NO: 1754334 - RNA, 19 nt, Homo sapiens
acucauaaaggacacugga

SEQ ID NO: 1754335 - RNA, 20 nt, Homo sapiens
guccccuuccuguucuuccu

SEQ ID NO: 1754336 - RNA, 20 nt, Homo sapiens
agcaggcuggcagcucucca

SEQ ID NO: 1754337 - RNA, 13 nt, Homo sapiens
gccuucaguuuau

SEQ ID NO: 1754338 - RNA, 20 nt, Homo sapiens
agcugcuguccuuuuaggaa

SEQ ID NO: 1754339 - RNA, 14 nt, Homo sapiens
cagugcauacugua

SEQ ID NO: 1754340 - RNA, 23 nt, Homo sapiens
uaaaauuggauuacaguauggca

SEQ ID NO: 1754341 - RNA, 13 nt, Homo sapiens
agauccuguccca

SEQ ID NO: 1754342 - RNA, 20 nt, Homo sapiens
agcagacacuccaguuugcc

SEQ ID NO: 1754343 - RNA, 14 nt, Homo sapiens
auggccacaagcaa

SEQ ID NO: 1754344 - RNA, 16 nt, Homo sapiens
ggaaccaaagcuggcc

SEQ ID NO: 1754345 - RNA, 21 nt, Homo sapiens
auccauccugcucuuccauuu

SEQ ID NO: 1754346 - RNA, 17 nt, Homo sapiens
aaauaggcauaucaagg

SEQ ID NO: 1754347 - RNA, 20 nt, Homo sapiens
uuuccucacacccaccugcu

SEQ ID NO: 1754348 - RNA, 18 nt, Homo sapiens
auaaauauuuguuugggu

SEQ ID NO: 1754349 - RNA, 18 nt, Homo sapiens
gugauuuggaccauggca

SEQ ID NO: 1754350 - RNA, 12 nt, Homo sapiens
aaagcuuucaac

SEQ ID NO: 1754351 - RNA, 21 nt, Homo sapiens
uuguuuccuccuugucacuga

SEQ ID NO: 1754352 - RNA, 23 nt, Homo sapiens
gaucucggcucauguagccucaa

SEQ ID NO: 1754353 - RNA, 18 nt, Homo sapiens
gagggaagcccacccgcc

SEQ ID NO: 1754354 - RNA, 10 nt, Homo sapiens
gauaaacuag

SEQ ID NO: 1754355 - RNA, 15 nt, Homo sapiens
caacacacugccuua

SEQ ID NO: 1754356 - RNA, 12 nt, Homo sapiens
cagaaaugcugc

SEQ ID NO: 1754357 - RNA, 13 nt, Homo sapiens
gugaauacacugg

SEQ ID NO: 1754358 - RNA, 21 nt, Homo sapiens
auuuuguauuuuuuccuguaa

SEQ ID NO: 1754359 - RNA, 13 nt, Homo sapiens
cauaguaauuuca

SEQ ID NO: 1754360 - RNA, 22 nt, Homo sapiens
caaaaauaucuuuuuuccccca

SEQ ID NO: 1754361 - RNA, 18 nt, Homo sapiens
aucuuuuuaaaaacucuu

SEQ ID NO: 1754362 - RNA, 18 nt, Homo sapiens
ugcugagucagacuguca

SEQ ID NO: 1754363 - RNA, 16 nt, Homo sapiens
gcauggaaggggcuuc

SEQ ID NO: 1754364 - RNA, 19 nt, Homo sapiens
uucuuuucaaaacugcuaa

SEQ ID NO: 1754365 - RNA, 16 nt, Homo sapiens
ccuccgccuccaggaa

SEQ ID NO: 1754366 - RNA, 13 nt, Homo sapiens
uagcuugcaccuu

SEQ ID NO: 1754367 - RNA, 17 nt, Homo sapiens
gaacaacuugcuacuga

SEQ ID NO: 1754368 - RNA, 21 nt, Homo sapiens
gaaagcagccaaaccuuuccu

SEQ ID NO: 1754369 - RNA, 14 nt, Homo sapiens
uggcccucuguguu

SEQ ID NO: 1754370 - RNA, 21 nt, Homo sapiens
cuauugugggacuuauuacaa

SEQ ID NO: 1754371 - RNA, 17 nt, Homo sapiens
uaaaaucaucacaauua

SEQ ID NO: 1754372 - RNA, 20 nt, Homo sapiens
ugaccaggggcccuaccugg

SEQ ID NO: 1754373 - RNA, 20 nt, Homo sapiens
guacauaauauccaauggaa

SEQ ID NO: 1754374 - RNA, 22 nt, Homo sapiens
cauacucucaauugaguuaaau

SEQ ID NO: 1754375 - RNA, 19 nt, Homo sapiens
ggccucucuuggacccugg

SEQ ID NO: 1754376 - RNA, 14 nt, Homo sapiens
auaacuucugaccu

SEQ ID NO: 1754377 - RNA, 19 nt, Homo sapiens
ccagcugaccugguacuga

SEQ ID NO: 1754378 - RNA, 15 nt, Homo sapiens
gcaauuagauagaaa

SEQ ID NO: 1754379 - RNA, 13 nt, Homo sapiens
ggccagccagugc

SEQ ID NO: 1754380 - RNA, 18 nt, Homo sapiens
cuuaacccacaguucucc

SEQ ID NO: 1754381 - RNA, 12 nt, Homo sapiens
acuucucccacc

SEQ ID NO: 1754382 - RNA, 14 nt, Homo sapiens
aguagaagaagcuu

SEQ ID NO: 1754383 - RNA, 19 nt, Homo sapiens
augacuugggccaaucacu

SEQ ID NO: 1754384 - RNA, 17 nt, Homo sapiens
guucccucagugugaag

SEQ ID NO: 1754385 - RNA, 20 nt, Homo sapiens
cacuggacuccggggcccca

SEQ ID NO: 1754386 - RNA, 21 nt, Homo sapiens
uccaugaguuacacuggauga

SEQ ID NO: 1754387 - RNA, 16 nt, Homo sapiens
gguaaaaacugcagug

SEQ ID NO: 1754388 - RNA, 23 nt, Homo sapiens
gccuuguugguggagaguggaag

SEQ ID NO: 1754389 - RNA, 22 nt, Homo sapiens
gagaaugaucaaggaucuggac

SEQ ID NO: 1754390 - RNA, 21 nt, Homo sapiens
guuaauugggcaggugaaaag

SEQ ID NO: 1754391 - RNA, 15 nt, Homo sapiens
aucuuuaacacagcc

SEQ ID NO: 1754392 - RNA, 14 nt, Homo sapiens
cucugccugaaguc

SEQ ID NO: 1754393 - RNA, 18 nt, Homo sapiens
cacuggaaugaguugaaa

SEQ ID NO: 1754394 - RNA, 18 nt, Homo sapiens
cccucccacuugaccuga

SEQ ID NO: 1754395 - RNA, 21 nt, Homo sapiens
agugccuacccaccugugagg

SEQ ID NO: 1754396 - RNA, 22 nt, Homo sapiens
acugaauauaaaaacauuugua

SEQ ID NO: 1754397 - RNA, 19 nt, Homo sapiens
gcugucccccaacacugag

SEQ ID NO: 1754398 - RNA, 21 nt, Homo sapiens
ugaccuuccaaaccucaauaa

SEQ ID NO: 1754399 - RNA, 21 nt, Homo sapiens
uggaugugcauuucugugaug

SEQ ID NO: 1754400 - RNA, 20 nt, Homo sapiens
ccucaaccuccuggguucaa

SEQ ID NO: 1754401 - RNA, 17 nt, Homo sapiens
uaccguguugguuuuga

SEQ ID NO: 1754402 - RNA, 15 nt, Homo sapiens
agauucaugcacugu

SEQ ID NO: 1754403 - RNA, 23 nt, Homo sapiens
uucuaaaaucaagugcaccuaca

SEQ ID NO: 1754404 - RNA, 19 nt, Homo sapiens
guccuguuuucuacagguu

SEQ ID NO: 1754405 - RNA, 17 nt, Homo sapiens
uugggaacaugcuggaa

SEQ ID NO: 1754406 - RNA, 17 nt, Homo sapiens
gaaaaugccaugaaaau

SEQ ID NO: 1754407 - RNA, 18 nt, Homo sapiens
ucaaaaucugcacaguca

SEQ ID NO: 1754408 - RNA, 16 nt, Homo sapiens
aaacucuuccacuaga

SEQ ID NO: 1754409 - RNA, 23 nt, Homo sapiens
gaaauuuuucaauauuuguuucu

SEQ ID NO: 1754410 - RNA, 21 nt, Homo sapiens
accccagaaauaggacaauuc

SEQ ID NO: 1754411 - RNA, 18 nt, Homo sapiens
cugucuuccaaauugaag

SEQ ID NO: 1754412 - RNA, 19 nt, Homo sapiens
uagcuuaacacuaccaauu

SEQ ID NO: 1754413 - RNA, 14 nt, Homo sapiens
agcuacugacuaug

SEQ ID NO: 1754414 - RNA, 18 nt, Homo sapiens
guacccaauagcugccca

SEQ ID NO: 1754415 - RNA, 16 nt, Homo sapiens
uacaaauagaauuuga

SEQ ID NO: 1754416 - RNA, 19 nt, Homo sapiens
cugacuucagaguggacuu

SEQ ID NO: 1754417 - RNA, 12 nt, Homo sapiens
gagcaugaccug

SEQ ID NO: 1754418 - RNA, 17 nt, Homo sapiens
gccugccccgacaccca

SEQ ID NO: 1754419 - RNA, 16 nt, Homo sapiens
auguguaugugccauu

SEQ ID NO: 1754420 - RNA, 12 nt, Homo sapiens
uuagauucucau

SEQ ID NO: 1754421 - RNA, 18 nt, Homo sapiens
agacccacagagugccau

SEQ ID NO: 1754422 - RNA, 16 nt, Homo sapiens
gaggaugaugccaguu

SEQ ID NO: 1754423 - RNA, 14 nt, Homo sapiens
cauuuuucugggag

SEQ ID NO: 1754424 - RNA, 15 nt, Homo sapiens
uuuugaacacauucu

SEQ ID NO: 1754425 - RNA, 17 nt, Homo sapiens
cauggaggaauugggac

SEQ ID NO: 1754426 - RNA, 15 nt, Homo sapiens
gaagaacaguacucc

SEQ ID NO: 1754427 - RNA, 15 nt, Homo sapiens
uauugggacucguau

SEQ ID NO: 1754428 - RNA, 13 nt, Homo sapiens
gggagaaggcagu

SEQ ID NO: 1754429 - RNA, 21 nt, Homo sapiens
aucauugacuaaagccauuug

SEQ ID NO: 1754430 - RNA, 12 nt, Homo sapiens
uuuacauuugau

SEQ ID NO: 1754431 - RNA, 18 nt, Homo sapiens
ucccuggccauccaugug

SEQ ID NO: 1754432 - RNA, 16 nt, Homo sapiens
uuaugcaaguguuccu

SEQ ID NO: 1754433 - RNA, 17 nt, Homo sapiens
cucaucaggaguuccag

SEQ ID NO: 1754434 - RNA, 17 nt, Homo sapiens
aauuuuugaugcccaga

SEQ ID NO: 1754435 - RNA, 17 nt, Homo sapiens
cagcaaugacaucucag

SEQ ID NO: 1754436 - RNA, 17 nt, Homo sapiens
agaaaguaaacuguaau

SEQ ID NO: 1754437 - RNA, 23 nt, Homo sapiens
uucucgcuggaaucaauuuccca

SEQ ID NO: 1754438 - RNA, 20 nt, Homo sapiens
ccugauuggggccucaccca

SEQ ID NO: 1754439 - RNA, 19 nt, Homo sapiens
ucuguguugcaagauauca

SEQ ID NO: 1754440 - RNA, 18 nt, Homo sapiens
cuccuuuucccaaagcau

SEQ ID NO: 1754441 - RNA, 12 nt, Homo sapiens
agucaacaaacu

SEQ ID NO: 1754442 - RNA, 19 nt, Homo sapiens
cuucccaaauagcagcaca

SEQ ID NO: 1754443 - RNA, 21 nt, Homo sapiens
uaaaugacuauuguaaugcca

SEQ ID NO: 1754444 - RNA, 14 nt, Homo sapiens
caccgcagaaggaa

SEQ ID NO: 1754445 - RNA, 19 nt, Homo sapiens
ggucuucuccccucaccca

SEQ ID NO: 1754446 - RNA, 19 nt, Homo sapiens
gaucagcccugccaggugg

SEQ ID NO: 1754447 - RNA, 21 nt, Homo sapiens
cuguauucccccaucuagcca

SEQ ID NO: 1754448 - RNA, 12 nt, Homo sapiens
aacuucaaagag

SEQ ID NO: 1754449 - RNA, 22 nt, Homo sapiens
gaugaguuucacuguacugcau

SEQ ID NO: 1754450 - RNA, 23 nt, Homo sapiens
cagacuuuuaaagacuugcacaa

SEQ ID NO: 1754451 - RNA, 20 nt, Homo sapiens
cccuacugggagacugggac

SEQ ID NO: 1754452 - RNA, 18 nt, Homo sapiens
ggauguguccuagacucc

SEQ ID NO: 1754453 - RNA, 12 nt, Homo sapiens
uauaacauauau

SEQ ID NO: 1754454 - RNA, 21 nt, Homo sapiens
augagauguaacucaugaaug

SEQ ID NO: 1754455 - RNA, 13 nt, Homo sapiens
gaaaccuugccuu

SEQ ID NO: 1754456 - RNA, 18 nt, Homo sapiens
ucauucuagaaacaggaa

SEQ ID NO: 1754457 - RNA, 13 nt, Homo sapiens
gcagugagcugag

SEQ ID NO: 1754458 - RNA, 20 nt, Homo sapiens
ucuauaaaccgaacugaugu

SEQ ID NO: 1754459 - RNA, 12 nt, Homo sapiens
uuaauucuagua

SEQ ID NO: 1754460 - RNA, 23 nt, Homo sapiens
aaggguguugcuaagcuguaacc

SEQ ID NO: 1754461 - RNA, 19 nt, Homo sapiens
cauuggcacuguggagcuc

SEQ ID NO: 1754462 - RNA, 18 nt, Homo sapiens
cucaucucccgagcaaug

SEQ ID NO: 1754463 - RNA, 17 nt, Homo sapiens
agggacgugauaaugca

SEQ ID NO: 1754464 - RNA, 22 nt, Homo sapiens
cuaugcaggcagcacagcagac

SEQ ID NO: 1754465 - RNA, 12 nt, Homo sapiens
cacaaauaugcu

SEQ ID NO: 1754466 - RNA, 12 nt, Homo sapiens
uguguguuucaa

SEQ ID NO: 1754467 - RNA, 16 nt, Homo sapiens
ccugcauucacccaga

SEQ ID NO: 1754468 - RNA, 19 nt, Homo sapiens
ggauuuuguuuuuugaaca

SEQ ID NO: 1754469 - RNA, 18 nt, Homo sapiens
agggcugauggaggaaaa

SEQ ID NO: 1754470 - RNA, 12 nt, Homo sapiens
uccuuguggucu

SEQ ID NO: 1754471 - RNA, 16 nt, Homo sapiens
uaacgcagucuaauua

SEQ ID NO: 1754472 - RNA, 22 nt, Homo sapiens
agaggaauaacaucaccacugu

SEQ ID NO: 1754473 - RNA, 14 nt, Homo sapiens
agaagguaaggugu

SEQ ID NO: 1754474 - RNA, 18 nt, Homo sapiens
uuguggugugugcgcaca

SEQ ID NO: 1754475 - RNA, 22 nt, Homo sapiens
aggaugagggaaaagaaaaaga

SEQ ID NO: 1754476 - RNA, 19 nt, Homo sapiens
ugaaagacaaagaaggaaa

SEQ ID NO: 1754477 - RNA, 18 nt, Homo sapiens
gaaccaaggcagccucca

SEQ ID NO: 1754478 - RNA, 13 nt, Homo sapiens
gauuugcaacuuu

SEQ ID NO: 1754479 - RNA, 17 nt, Homo sapiens
acaaaagaagagcucac

SEQ ID NO: 1754480 - RNA, 12 nt, Homo sapiens
cccaucauuaaa

SEQ ID NO: 1754481 - RNA, 22 nt, Homo sapiens
auuuuuagaauaagaauuugca

SEQ ID NO: 1754482 - RNA, 18 nt, Homo sapiens
gcuguccauguauucaca

SEQ ID NO: 1754483 - RNA, 21 nt, Homo sapiens
cagaaccaauuuacacucaac

SEQ ID NO: 1754484 - RNA, 19 nt, Homo sapiens
acuucacagcccugcagug

SEQ ID NO: 1754485 - RNA, 18 nt, Homo sapiens
aaagaccuuccagcuccu

SEQ ID NO: 1754486 - RNA, 13 nt, Homo sapiens
gcaguccuggguc

SEQ ID NO: 1754487 - RNA, 20 nt, Homo sapiens
cacccuccugccccacacuc

SEQ ID NO: 1754488 - RNA, 20 nt, Homo sapiens
ccaguggccuugguccuuaa

SEQ ID NO: 1754489 - RNA, 15 nt, Homo sapiens
ugauggcaacacuga

SEQ ID NO: 1754490 - RNA, 13 nt, Homo sapiens
ucuuuugccauga

SEQ ID NO: 1754491 - RNA, 18 nt, Homo sapiens
agaaaccacugggcauaa

SEQ ID NO: 1754492 - RNA, 15 nt, Homo sapiens
ugaucccugccaaaa

SEQ ID NO: 1754493 - RNA, 11 nt, Homo sapiens
agaugccaaac

SEQ ID NO: 1754494 - RNA, 11 nt, Homo sapiens
agcugccaaaa

SEQ ID NO: 1754495 - RNA, 18 nt, Homo sapiens
aagaagacucaguaugcu

SEQ ID NO: 1754496 - RNA, 21 nt, Homo sapiens
augcaaauucccagauuugaa

SEQ ID NO: 1754497 - RNA, 20 nt, Homo sapiens
auacuggccaugccuggaga

SEQ ID NO: 1754498 - RNA, 14 nt, Homo sapiens
cugcaucccugcuc

SEQ ID NO: 1754499 - RNA, 15 nt, Homo sapiens
ggcaucauugugacg

SEQ ID NO: 1754500 - RNA, 14 nt, Homo sapiens
ucugugaagaaaga

SEQ ID NO: 1754501 - RNA, 14 nt, Homo sapiens
uagaaaagucucca

SEQ ID NO: 1754502 - RNA, 12 nt, Homo sapiens
uauuuacaagac

SEQ ID NO: 1754503 - RNA, 19 nt, Homo sapiens
ugcagcacucuuaucuaca

SEQ ID NO: 1754504 - RNA, 22 nt, Homo sapiens
ucucaggcuucugcaguucuca

SEQ ID NO: 1754505 - RNA, 15 nt, Homo sapiens
guguagcuacagaga

SEQ ID NO: 1754506 - RNA, 21 nt, Homo sapiens
acaucaaguaugguaggggag

SEQ ID NO: 1754507 - RNA, 16 nt, Homo sapiens
ugcauucucuagucag

SEQ ID NO: 1754508 - RNA, 15 nt, Homo sapiens
ugcucuuucuugacu

SEQ ID NO: 1754509 - RNA, 14 nt, Homo sapiens
cacuuccauaguga

SEQ ID NO: 1754510 - RNA, 23 nt, Homo sapiens
ccauaucuacaguacuuccagau

SEQ ID NO: 1754511 - RNA, 20 nt, Homo sapiens
guguugagaacuaccuggau

SEQ ID NO: 1754512 - RNA, 22 nt, Homo sapiens
accgccgguucauuuugcaccu

SEQ ID NO: 1754513 - RNA, 20 nt, Homo sapiens
cccacagcagcaauaugcuu

SEQ ID NO: 1754514 - RNA, 18 nt, Homo sapiens
aagguuucugcacauugu

SEQ ID NO: 1754515 - RNA, 20 nt, Homo sapiens
uuuuggguauugaauguggu

SEQ ID NO: 1754516 - RNA, 14 nt, Homo sapiens
agaagaaacugcuu

SEQ ID NO: 1754517 - RNA, 21 nt, Homo sapiens
aaacaaauaaucacauugacu

SEQ ID NO: 1754518 - RNA, 15 nt, Homo sapiens
gacacacaucaaaaa

SEQ ID NO: 1754519 - RNA, 12 nt, Homo sapiens
aacaccaugaag

SEQ ID NO: 1754520 - RNA, 22 nt, Homo sapiens
cuagacccagguggagggcaca

SEQ ID NO: 1754521 - RNA, 15 nt, Homo sapiens
ucgccccacccguuc

SEQ ID NO: 1754522 - RNA, 21 nt, Homo sapiens
aggggcuggcccagggcugca

SEQ ID NO: 1754523 - RNA, 23 nt, Homo sapiens
ggaauaugcaucccacagccagu

SEQ ID NO: 1754524 - RNA, 16 nt, Homo sapiens
ugucacuaaacucuca

SEQ ID NO: 1754525 - RNA, 20 nt, Homo sapiens
cuucacaccuacccuccuuu

SEQ ID NO: 1754526 - RNA, 15 nt, Homo sapiens
ugagggguugaggga

SEQ ID NO: 1754527 - RNA, 15 nt, Homo sapiens
gaccugaugaccugg

SEQ ID NO: 1754528 - RNA, 15 nt, Homo sapiens
cugagagucugagaa

SEQ ID NO: 1754529 - RNA, 21 nt, Homo sapiens
cuuguggaaccaaauguaucc

SEQ ID NO: 1754530 - RNA, 14 nt, Homo sapiens
aucuguucugggug

SEQ ID NO: 1754531 - RNA, 15 nt, Homo sapiens
cgccuuccaaaaccu

SEQ ID NO: 1754532 - RNA, 12 nt, Homo sapiens
agauuucaagaa

SEQ ID NO: 1754533 - RNA, 15 nt, Homo sapiens
ugaggacaauuucau

SEQ ID NO: 1754534 - RNA, 15 nt, Homo sapiens
cugcuccagaccuga

SEQ ID NO: 1754535 - RNA, 20 nt, Homo sapiens
ugcauuuucugaaacuaaug

SEQ ID NO: 1754536 - RNA, 14 nt, Homo sapiens
agguuauauccaau

SEQ ID NO: 1754537 - RNA, 14 nt, Homo sapiens
aaauuaaaaccaau

SEQ ID NO: 1754538 - RNA, 23 nt, Homo sapiens
ccgcgcgaagugggcauugcaaa

SEQ ID NO: 1754539 - RNA, 23 nt, Homo sapiens
uucccuccccagaauggaggcaa

SEQ ID NO: 1754540 - RNA, 22 nt, Homo sapiens
cucugcuccagcaagcaaacag

SEQ ID NO: 1754541 - RNA, 23 nt, Homo sapiens
aauagucuugcagaaaaugaaug

SEQ ID NO: 1754542 - RNA, 13 nt, Homo sapiens
uggcacaaucuca

SEQ ID NO: 1754543 - RNA, 23 nt, Homo sapiens
caguuaugaguauaauacauuac

SEQ ID NO: 1754544 - RNA, 22 nt, Homo sapiens
gcagcgcccccaucugucuuca

SEQ ID NO: 1754545 - RNA, 14 nt, Homo sapiens
accuggucugguca

SEQ ID NO: 1754546 - RNA, 17 nt, Homo sapiens
ugaaaauaaaucaucuu

SEQ ID NO: 1754547 - RNA, 19 nt, Homo sapiens
ucuucgaccacaucagaaa

SEQ ID NO: 1754548 - RNA, 14 nt, Homo sapiens
accaggauuuccuu

SEQ ID NO: 1754549 - RNA, 19 nt, Homo sapiens
agaguucuccagacagggu

SEQ ID NO: 1754550 - RNA, 19 nt, Homo sapiens
ccuguucuguguugcaaga

SEQ ID NO: 1754551 - RNA, 16 nt, Homo sapiens
uacuguuuacaguuua

SEQ ID NO: 1754552 - RNA, 17 nt, Homo sapiens
acccuucuuuucugacu

SEQ ID NO: 1754553 - RNA, 20 nt, Homo sapiens
cuuccuggcuccaacacugc

SEQ ID NO: 1754554 - RNA, 16 nt, Homo sapiens
ccuaauaggcugggag

SEQ ID NO: 1754555 - RNA, 19 nt, Homo sapiens
uuuuaccuuugucuuucug

SEQ ID NO: 1754556 - RNA, 13 nt, Homo sapiens
ugagaagaucuga

SEQ ID NO: 1754557 - RNA, 19 nt, Homo sapiens
gccugaguuuagggucaag

SEQ ID NO: 1754558 - RNA, 16 nt, Homo sapiens
ucuuuauaaugggaua

SEQ ID NO: 1754559 - RNA, 17 nt, Homo sapiens
acucucaccauuuggau

SEQ ID NO: 1754560 - RNA, 18 nt, Homo sapiens
acauuuuucauucaugaa

SEQ ID NO: 1754561 - RNA, 22 nt, Homo sapiens
gaccuucucuuaggacaguaaa

SEQ ID NO: 1754562 - RNA, 19 nt, Homo sapiens
auuaaaauguuaagcugcu

SEQ ID NO: 1754563 - RNA, 15 nt, Homo sapiens
gacgguaaccccaua

SEQ ID NO: 1754564 - RNA, 18 nt, Homo sapiens
aggaguuugagaccagcc

SEQ ID NO: 1754565 - RNA, 11 nt, Homo sapiens
ccaagcagcuu

SEQ ID NO: 1754566 - RNA, 22 nt, Homo sapiens
agagaaauuauguuuucaucca

SEQ ID NO: 1754567 - RNA, 12 nt, Homo sapiens
auauaguucugu

SEQ ID NO: 1754568 - RNA, 14 nt, Homo sapiens
uuaacggugcuaaa

SEQ ID NO: 1754569 - RNA, 13 nt, Homo sapiens
ucacucaauuuuc

SEQ ID NO: 1754570 - RNA, 16 nt, Homo sapiens
aauauauaucacucua

SEQ ID NO: 1754571 - RNA, 17 nt, Homo sapiens
aguuugagaccugaaua

SEQ ID NO: 1754572 - RNA, 14 nt, Homo sapiens
ugcuggggaccuca

SEQ ID NO: 1754573 - RNA, 11 nt, Homo sapiens
caggagcucag

SEQ ID NO: 1754574 - RNA, 19 nt, Homo sapiens
cuggggcuuguccugugcu

SEQ ID NO: 1754575 - RNA, 16 nt, Homo sapiens
guccacccugccugcc

SEQ ID NO: 1754576 - RNA, 20 nt, Homo sapiens
auuucuaucuugaauuucau

SEQ ID NO: 1754577 - RNA, 17 nt, Homo sapiens
aaauaaaagaucuugaa

SEQ ID NO: 1754578 - RNA, 19 nt, Homo sapiens
ugagcacaucucucugccc

SEQ ID NO: 1754579 - RNA, 22 nt, Homo sapiens
aggaagugcccucgagcacuga

SEQ ID NO: 1754580 - RNA, 12 nt, Homo sapiens
acagcugcgaca

SEQ ID NO: 1754581 - RNA, 14 nt, Homo sapiens
aagcuaaauuccac

SEQ ID NO: 1754582 - RNA, 24 nt, Homo sapiens
agcaggguccauguuugcugccuu

SEQ ID NO: 1754583 - RNA, 18 nt, Homo sapiens
ugagaacaccccagcugc

SEQ ID NO: 1754584 - RNA, 18 nt, Homo sapiens
ccuucucuucucuuugcu

SEQ ID NO: 1754585 - RNA, 21 nt, Homo sapiens
acaugccagggccaugucaga

SEQ ID NO: 1754586 - RNA, 23 nt, Homo sapiens
gcagcggggcaagcaaaaacaau

SEQ ID NO: 1754587 - RNA, 16 nt, Homo sapiens
ugaaugcuccagucaa

SEQ ID NO: 1754588 - RNA, 16 nt, Homo sapiens
gcuguagaccaccuaa

SEQ ID NO: 1754589 - RNA, 13 nt, Homo sapiens
guccagcacugga

SEQ ID NO: 1754590 - RNA, 17 nt, Homo sapiens
cccauaucuacaguacu

SEQ ID NO: 1754591 - RNA, 15 nt, Homo sapiens
uucuucuccauuaau

SEQ ID NO: 1754592 - RNA, 21 nt, Homo sapiens
caagaggugugcacaccaaag

SEQ ID NO: 1754593 - RNA, 15 nt, Homo sapiens
guuuuuucuccucau

SEQ ID NO: 1754594 - RNA, 16 nt, Homo sapiens
aauuauaucuccccca

SEQ ID NO: 1754595 - RNA, 17 nt, Homo sapiens
gaauuuggccugcacua

SEQ ID NO: 1754596 - RNA, 22 nt, Homo sapiens
aaacuugccuggggucugagca

SEQ ID NO: 1754597 - RNA, 17 nt, Homo sapiens
ggccuccugucccucau

SEQ ID NO: 1754598 - RNA, 16 nt, Homo sapiens
aaauauuuugcauaua

SEQ ID NO: 1754599 - RNA, 17 nt, Homo sapiens
cuacaggcccaccccug

SEQ ID NO: 1754600 - RNA, 16 nt, Homo sapiens
ccauuacugcauaaaa

SEQ ID NO: 1754601 - RNA, 23 nt, Homo sapiens
ucuuuugccaugacaacuucuaa

SEQ ID NO: 1754602 - RNA, 22 nt, Homo sapiens
auuccugggguaaaguaucacu

SEQ ID NO: 1754603 - RNA, 17 nt, Homo sapiens
acccaguguucagcaua

SEQ ID NO: 1754604 - RNA, 15 nt, Homo sapiens
ccugucccuugccuc

SEQ ID NO: 1754605 - RNA, 22 nt, Homo sapiens
uacagagaagucacagggcagu

SEQ ID NO: 1754606 - RNA, 15 nt, Homo sapiens
agagcagcuagcucu

SEQ ID NO: 1754607 - RNA, 18 nt, Homo sapiens
augucugccauguugccc

SEQ ID NO: 1754608 - RNA, 22 nt, Homo sapiens
cagucucacaauagcgugagcu

SEQ ID NO: 1754609 - RNA, 23 nt, Homo sapiens
ucgcuaccuuuugcuguggcaaa

SEQ ID NO: 1754610 - RNA, 18 nt, Homo sapiens
aaaagcuaccaucacuuc

SEQ ID NO: 1754611 - RNA, 18 nt, Homo sapiens
cuuuauguggaacaucua

SEQ ID NO: 1754612 - RNA, 16 nt, Homo sapiens
aaauaaguaacauaua

SEQ ID NO: 1754613 - RNA, 17 nt, Homo sapiens
gcucauagaucagcaaa

SEQ ID NO: 1754614 - RNA, 15 nt, Homo sapiens
ugcuuauacugcugu

SEQ ID NO: 1754615 - RNA, 24 nt, Homo sapiens
cuuuccuggaaaacucaugaauaa

SEQ ID NO: 1754616 - RNA, 14 nt, Homo sapiens
guuucuacucaaaa

SEQ ID NO: 1754617 - RNA, 24 nt, Homo sapiens
augcuccagucaacaaacuauuuc

SEQ ID NO: 1754618 - RNA, 20 nt, Homo sapiens
ugcuguuccacaaagcagug

SEQ ID NO: 1754619 - RNA, 14 nt, Homo sapiens
auguaauuuaugca

SEQ ID NO: 1754620 - RNA, 18 nt, Homo sapiens
accugcaccccugaugug

SEQ ID NO: 1754621 - RNA, 21 nt, Homo sapiens
ucauaaugugcaaagucauca

SEQ ID NO: 1754622 - RNA, 23 nt, Homo sapiens
augcauuauuuauugcuguguaa

SEQ ID NO: 1754623 - RNA, 20 nt, Homo sapiens
ucuucagucuggacuauauu

SEQ ID NO: 1754624 - RNA, 20 nt, Homo sapiens
ugacacucuagucaaagccu

SEQ ID NO: 1754625 - RNA, 23 nt, Homo sapiens
aaaauacuguaagucucaauuaa

SEQ ID NO: 1754626 - RNA, 22 nt, Homo sapiens
ugauaguuuacaaacaagauac

SEQ ID NO: 1754627 - RNA, 22 nt, Homo sapiens
aauagcauuaucuuaucauuua

SEQ ID NO: 1754628 - RNA, 21 nt, Homo sapiens
aagcauauuuuguggcauuug

SEQ ID NO: 1754629 - RNA, 23 nt, Homo sapiens
aaccaagaaugucuccauuguua

SEQ ID NO: 1754630 - RNA, 23 nt, Homo sapiens
auaccacaauaaaaaaaaaccua

SEQ ID NO: 1754631 - RNA, 17 nt, Homo sapiens
cagauagauauaugcuc

SEQ ID NO: 1754632 - RNA, 16 nt, Homo sapiens
uggagaccuccaggcu

SEQ ID NO: 1754633 - RNA, 23 nt, Homo sapiens
uguauucuguuugcguacuugua

SEQ ID NO: 1754634 - RNA, 15 nt, Homo sapiens
agauaugaugucccu

SEQ ID NO: 1754635 - RNA, 15 nt, Homo sapiens
cuggagcccgaggca

SEQ ID NO: 1754636 - RNA, 20 nt, Homo sapiens
gauuggauuuuacagcuacu

SEQ ID NO: 1754637 - RNA, 15 nt, Homo sapiens
aaaaagaaugcagag

SEQ ID NO: 1754638 - RNA, 19 nt, Homo sapiens
ucaaacaggucgagcugug

SEQ ID NO: 1754639 - RNA, 18 nt, Homo sapiens
auaaaauugaaaguaaua

SEQ ID NO: 1754640 - RNA, 18 nt, Homo sapiens
cacauagagguugagcca

SEQ ID NO: 1754641 - RNA, 16 nt, Homo sapiens
ugguaauauguuacaa

SEQ ID NO: 1754642 - RNA, 18 nt, Homo sapiens
aacaaguuagaaaauuca

SEQ ID NO: 1754643 - RNA, 16 nt, Homo sapiens
uggaagaacugugaua

SEQ ID NO: 1754644 - RNA, 12 nt, Homo sapiens
ugauucuauguc

SEQ ID NO: 1754645 - RNA, 17 nt, Homo sapiens
gcuaagcauuagcuuua

SEQ ID NO: 1754646 - RNA, 18 nt, Homo sapiens
uagaguuccaaauaagga

SEQ ID NO: 1754647 - RNA, 20 nt, Homo sapiens
ugaaguguaguggcauccau

SEQ ID NO: 1754648 - RNA, 20 nt, Homo sapiens
ugcugagcagcccagcacaa

SEQ ID NO: 1754649 - RNA, 19 nt, Homo sapiens
aucaggaauauuuuccaaa

SEQ ID NO: 1754650 - RNA, 19 nt, Homo sapiens
gggacgcaggccccucucc

SEQ ID NO: 1754651 - RNA, 15 nt, Homo sapiens
gcuaggucuugccaa

SEQ ID NO: 1754652 - RNA, 12 nt, Homo sapiens
aaaguugugauc

SEQ ID NO: 1754653 - RNA, 22 nt, Homo sapiens
aguuuauaccaagagauucuuc

SEQ ID NO: 1754654 - RNA, 13 nt, Homo sapiens
ggugcugcagcca

SEQ ID NO: 1754655 - RNA, 12 nt, Homo sapiens
ucagccagacau

SEQ ID NO: 1754656 - RNA, 19 nt, Homo sapiens
uuguauucucuccuguacc

SEQ ID NO: 1754657 - RNA, 20 nt, Homo sapiens
agggcuuaucuagccaaaga

SEQ ID NO: 1754658 - RNA, 19 nt, Homo sapiens
accauggugagaaauugac

SEQ ID NO: 1754659 - RNA, 12 nt, Homo sapiens
cuccuguuccau

SEQ ID NO: 1754660 - RNA, 19 nt, Homo sapiens
uacuauguaagggcuuuaa

SEQ ID NO: 1754661 - RNA, 13 nt, Homo sapiens
cuucuccaaauac

SEQ ID NO: 1754662 - RNA, 21 nt, Homo sapiens
aaugugccucucaguaucuua

SEQ ID NO: 1754663 - RNA, 21 nt, Homo sapiens
gcagcacggacaauaaaccuc

SEQ ID NO: 1754664 - RNA, 19 nt, Homo sapiens
aucuucacgacaauguuga

SEQ ID NO: 1754665 - RNA, 17 nt, Homo sapiens
cguccugucacugaugg

SEQ ID NO: 1754666 - RNA, 22 nt, Homo sapiens
ccuguuacuugaaauaccagug

SEQ ID NO: 1754667 - RNA, 20 nt, Homo sapiens
uucacacagggcucuuugau

SEQ ID NO: 1754668 - RNA, 21 nt, Homo sapiens
cagcccaaacuguauacauua

SEQ ID NO: 1754669 - RNA, 22 nt, Homo sapiens
uaaugaagaaucacgauuucau

SEQ ID NO: 1754670 - RNA, 15 nt, Homo sapiens
aaugaggcaacucag

SEQ ID NO: 1754671 - RNA, 19 nt, Homo sapiens
gggcagucuggcgcccaug

SEQ ID NO: 1754672 - RNA, 13 nt, Homo sapiens
aguaaucaggcag

SEQ ID NO: 1754673 - RNA, 15 nt, Homo sapiens
accucuugaaaauag

SEQ ID NO: 1754674 - RNA, 13 nt, Homo sapiens
uguugacuggggc

SEQ ID NO: 1754675 - RNA, 13 nt, Homo sapiens
cagaaggacucag

SEQ ID NO: 1754676 - RNA, 24 nt, Homo sapiens
gaaagagaaugggagcauauguga

SEQ ID NO: 1754677 - RNA, 20 nt, Homo sapiens
cucuucagucucuauaccaa

SEQ ID NO: 1754678 - RNA, 15 nt, Homo sapiens
ugguuacacuguuag

SEQ ID NO: 1754679 - RNA, 14 nt, Homo sapiens
uucuuugucuuauc

SEQ ID NO: 1754680 - RNA, 15 nt, Homo sapiens
augguuuccauuuac

SEQ ID NO: 1754681 - RNA, 17 nt, Homo sapiens
auuauuccaagccuuau

SEQ ID NO: 1754682 - RNA, 17 nt, Homo sapiens
aauuuacacacuugcau

SEQ ID NO: 1754683 - RNA, 20 nt, Homo sapiens
cagacugaacucgcagggaa

SEQ ID NO: 1754684 - RNA, 18 nt, Homo sapiens
guaaaugggggugcauuu

SEQ ID NO: 1754685 - RNA, 19 nt, Homo sapiens
agggaugcugccugaguca

SEQ ID NO: 1754686 - RNA, 16 nt, Homo sapiens
uguacccuccauguac

SEQ ID NO: 1754687 - RNA, 19 nt, Homo sapiens
uuuugaaauaagaaagugc

SEQ ID NO: 1754688 - RNA, 22 nt, Homo sapiens
agcuuucauguaaacugugcac

SEQ ID NO: 1754689 - RNA, 22 nt, Homo sapiens
acaccuggcacugcugugcugu

SEQ ID NO: 1754690 - RNA, 16 nt, Homo sapiens
gugagcggagaucgca

SEQ ID NO: 1754691 - RNA, 22 nt, Homo sapiens
cuggccucccacccgaugcugc

SEQ ID NO: 1754692 - RNA, 18 nt, Homo sapiens
auuauagugaaacaugua

SEQ ID NO: 1754693 - RNA, 18 nt, Homo sapiens
augccaaccggucaccca

SEQ ID NO: 1754694 - RNA, 15 nt, Homo sapiens
ugggcaucuccgugu

SEQ ID NO: 1754695 - RNA, 13 nt, Homo sapiens
caggaagcucagg

SEQ ID NO: 1754696 - RNA, 16 nt, Homo sapiens
caguagcuuaucucag

SEQ ID NO: 1754697 - RNA, 14 nt, Homo sapiens
aauagcacaaucca

SEQ ID NO: 1754698 - RNA, 19 nt, Homo sapiens
uccuaaauuuuuacaucaa

SEQ ID NO: 1754699 - RNA, 20 nt, Homo sapiens
cuugucauuucuacuuucag

SEQ ID NO: 1754700 - RNA, 22 nt, Homo sapiens
gaggcuaaaaaacggauuuccu

SEQ ID NO: 1754701 - RNA, 21 nt, Homo sapiens
ucacaagggauuggcaauugu

SEQ ID NO: 1754702 - RNA, 23 nt, Homo sapiens
gauauaauuuaacuguguuuuag

SEQ ID NO: 1754703 - RNA, 18 nt, Homo sapiens
cucuugaucagugugcua

SEQ ID NO: 1754704 - RNA, 16 nt, Homo sapiens
uguaagugcugcuaua

SEQ ID NO: 1754705 - RNA, 22 nt, Homo sapiens
ucuggagggaagcaccaugaau

SEQ ID NO: 1754706 - RNA, 22 nt, Homo sapiens
cuauuucuguauauaaaggugc

SEQ ID NO: 1754707 - RNA, 13 nt, Homo sapiens
gugauagcacuuu

SEQ ID NO: 1754708 - RNA, 16 nt, Homo sapiens
auagucuggaaaguug

SEQ ID NO: 1754709 - RNA, 20 nt, Homo sapiens
gacacugaggagauacugaa

SEQ ID NO: 1754710 - RNA, 10 nt, Homo sapiens
auagaauuau

SEQ ID NO: 1754711 - RNA, 16 nt, Homo sapiens
ugacuuugaacuaaug

SEQ ID NO: 1754712 - RNA, 17 nt, Homo sapiens
aaguauuuaaauguucu

SEQ ID NO: 1754713 - RNA, 14 nt, Homo sapiens
uucacuuauugacu

SEQ ID NO: 1754714 - RNA, 14 nt, Homo sapiens
cagagauacacaga

SEQ ID NO: 1754715 - RNA, 19 nt, Homo sapiens
gacgugagugugacuuuuu

SEQ ID NO: 1754716 - RNA, 13 nt, Homo sapiens
ugaaguaaccuua

SEQ ID NO: 1754717 - RNA, 22 nt, Homo sapiens
ugaaaaacuuaccuacugggga

SEQ ID NO: 1754718 - RNA, 23 nt, Homo sapiens
accuuccuucccugggcugugcu

SEQ ID NO: 1754719 - RNA, 23 nt, Homo sapiens
ccuaggugagaacccuugcacua

SEQ ID NO: 1754720 - RNA, 17 nt, Homo sapiens
agccaucguccugggac

SEQ ID NO: 1754721 - RNA, 21 nt, Homo sapiens
augccugccccccucaucuca

SEQ ID NO: 1754722 - RNA, 22 nt, Homo sapiens
gccuguggguuugguccuugaa

SEQ ID NO: 1754723 - RNA, 18 nt, Homo sapiens
uaaagaugaucuacucag

SEQ ID NO: 1754724 - RNA, 14 nt, Homo sapiens
acuguacccagucu

SEQ ID NO: 1754725 - RNA, 18 nt, Homo sapiens
gcugccaggacaccugcc

SEQ ID NO: 1754726 - RNA, 20 nt, Homo sapiens
cuugaccacggcuguucccc

SEQ ID NO: 1754727 - RNA, 22 nt, Homo sapiens
ugacuccauucaaaucuacggu

SEQ ID NO: 1754728 - RNA, 16 nt, Homo sapiens
gaaaacuucagagaaa

SEQ ID NO: 1754729 - RNA, 12 nt, Homo sapiens
gcacaaguacuu

SEQ ID NO: 1754730 - RNA, 19 nt, Homo sapiens
gaacuaaauuuaagcuuaa

SEQ ID NO: 1754731 - RNA, 20 nt, Homo sapiens
acugcaggagcaguuugcca

SEQ ID NO: 1754732 - RNA, 16 nt, Homo sapiens
gccagccccaagcugg

SEQ ID NO: 1754733 - RNA, 23 nt, Homo sapiens
ugugcugucagccucccacaggu

SEQ ID NO: 1754734 - RNA, 13 nt, Homo sapiens
ucuucccaugacu

SEQ ID NO: 1754735 - RNA, 14 nt, Homo sapiens
acagugccucuucc

SEQ ID NO: 1754736 - RNA, 20 nt, Homo sapiens
uaugucaaagcaacagucca

SEQ ID NO: 1754737 - RNA, 15 nt, Homo sapiens
cacguaaggucucau

SEQ ID NO: 1754738 - RNA, 18 nt, Homo sapiens
aauaacuucucugugaac

SEQ ID NO: 1754739 - RNA, 19 nt, Homo sapiens
uguaagcuuguaugugguu

SEQ ID NO: 1754740 - RNA, 16 nt, Homo sapiens
cagaacuuauucucca

SEQ ID NO: 1754741 - RNA, 22 nt, Homo sapiens
caauacaaucuuggagucaaaa

SEQ ID NO: 1754742 - RNA, 21 nt, Homo sapiens
ccaacuaagcgaggcaugccu

SEQ ID NO: 1754743 - RNA, 15 nt, Homo sapiens
ccaagacucugcucu

SEQ ID NO: 1754744 - RNA, 14 nt, Homo sapiens
gcccagcugcaccu

SEQ ID NO: 1754745 - RNA, 20 nt, Homo sapiens
uccuucuuucuaguucagcu

SEQ ID NO: 1754746 - RNA, 16 nt, Homo sapiens
caggauuugcacagaa

SEQ ID NO: 1754747 - RNA, 18 nt, Homo sapiens
ugaggugaacuccaggca

SEQ ID NO: 1754748 - RNA, 12 nt, Homo sapiens
caacuucagcag

SEQ ID NO: 1754749 - RNA, 19 nt, Homo sapiens
gguuguucacaccacaggc

SEQ ID NO: 1754750 - RNA, 14 nt, Homo sapiens
cuacuugggagcac

SEQ ID NO: 1754751 - RNA, 17 nt, Homo sapiens
gaacugcuugugcacug

SEQ ID NO: 1754752 - RNA, 18 nt, Homo sapiens
ugacuugguaugcuuuau

SEQ ID NO: 1754753 - RNA, 16 nt, Homo sapiens
auccaacuaacuccag

SEQ ID NO: 1754754 - RNA, 20 nt, Homo sapiens
gaccuccagggagccuagaa

SEQ ID NO: 1754755 - RNA, 13 nt, Homo sapiens
ugucucacacugg

SEQ ID NO: 1754756 - RNA, 16 nt, Homo sapiens
caacacaccuugccca

SEQ ID NO: 1754757 - RNA, 19 nt, Homo sapiens
aaaaucucaauucuucccu

SEQ ID NO: 1754758 - RNA, 18 nt, Homo sapiens
acugcugaucaaugaaau

SEQ ID NO: 1754759 - RNA, 17 nt, Homo sapiens
gaauucacuccacuugg

SEQ ID NO: 1754760 - RNA, 13 nt, Homo sapiens
uaagaucuugccu

SEQ ID NO: 1754761 - RNA, 16 nt, Homo sapiens
uucccuccuuggagac

SEQ ID NO: 1754762 - RNA, 21 nt, Homo sapiens
gagccuuauuuaccuagugca

SEQ ID NO: 1754763 - RNA, 12 nt, Homo sapiens
aaauuagcaaaa

SEQ ID NO: 1754764 - RNA, 12 nt, Homo sapiens
uuuuuagcuuua

SEQ ID NO: 1754765 - RNA, 22 nt, Homo sapiens
ccucuuggccacagaggacuca

SEQ ID NO: 1754766 - RNA, 19 nt, Homo sapiens
guuauugugaaaacagaag

SEQ ID NO: 1754767 - RNA, 19 nt, Homo sapiens
aaacauucagucugacaaa

SEQ ID NO: 1754768 - RNA, 19 nt, Homo sapiens
cuuaaccuuccaugucucc

SEQ ID NO: 1754769 - RNA, 18 nt, Homo sapiens
uguauuuuuaaugggggu

SEQ ID NO: 1754770 - RNA, 14 nt, Homo sapiens
aauaaauauaugau

SEQ ID NO: 1754771 - RNA, 14 nt, Homo sapiens
uauuuuaauuuugc

SEQ ID NO: 1754772 - RNA, 14 nt, Homo sapiens
cagaucaacugagu

SEQ ID NO: 1754773 - RNA, 14 nt, Homo sapiens
cucugcaacacuuu

SEQ ID NO: 1754774 - RNA, 20 nt, Homo sapiens
acaguguuuuguagauuuca

SEQ ID NO: 1754775 - RNA, 12 nt, Homo sapiens
cagguucacuuu

SEQ ID NO: 1754776 - RNA, 15 nt, Homo sapiens
cucauugcuucacaa

SEQ ID NO: 1754777 - RNA, 20 nt, Homo sapiens
uaugcaaagucucucauuuc

SEQ ID NO: 1754778 - RNA, 16 nt, Homo sapiens
guauaaacaugacccu

SEQ ID NO: 1754779 - RNA, 12 nt, Homo sapiens
cugggugcaaag

SEQ ID NO: 1754780 - RNA, 18 nt, Homo sapiens
uccuuguagaucuuugug

SEQ ID NO: 1754781 - RNA, 19 nt, Homo sapiens
aaauuauagucuuuugcca

SEQ ID NO: 1754782 - RNA, 15 nt, Homo sapiens
accaugcgcugcuca

SEQ ID NO: 1754783 - RNA, 14 nt, Homo sapiens
ugugggugggacca

SEQ ID NO: 1754784 - RNA, 22 nt, Homo sapiens
gaaggccuuucuucuguguuaa

SEQ ID NO: 1754785 - RNA, 20 nt, Homo sapiens
uugccaaacaggauguggaa

SEQ ID NO: 1754786 - RNA, 20 nt, Homo sapiens
auuaauguuuacaguggaau

SEQ ID NO: 1754787 - RNA, 16 nt, Homo sapiens
auucuaguuucucuca

SEQ ID NO: 1754788 - RNA, 15 nt, Homo sapiens
uuauuuagauucacu

SEQ ID NO: 1754789 - RNA, 15 nt, Homo sapiens
uaacucagaauuauu

SEQ ID NO: 1754790 - RNA, 21 nt, Homo sapiens
caaagaccaaguuaucaucuc

SEQ ID NO: 1754791 - RNA, 19 nt, Homo sapiens
ccaugucgccucugcauuc

SEQ ID NO: 1754792 - RNA, 15 nt, Homo sapiens
accaggaaucuccga

SEQ ID NO: 1754793 - RNA, 18 nt, Homo sapiens
gcugggggugaggacaca

SEQ ID NO: 1754794 - RNA, 19 nt, Homo sapiens
guauuuuaacucauaccuu

SEQ ID NO: 1754795 - RNA, 19 nt, Homo sapiens
uaccaauuaauauuacuca

SEQ ID NO: 1754796 - RNA, 13 nt, Homo sapiens
ugucccuucacau

SEQ ID NO: 1754797 - RNA, 23 nt, Homo sapiens
cacaugcacacacacacaucuca

SEQ ID NO: 1754798 - RNA, 18 nt, Homo sapiens
ugcccccucccccacugc

SEQ ID NO: 1754799 - RNA, 22 nt, Homo sapiens
uuuauacucuagaacaugcaca

SEQ ID NO: 1754800 - RNA, 21 nt, Homo sapiens
cccauugcugccaagguggag

SEQ ID NO: 1754801 - RNA, 14 nt, Homo sapiens
uggcuugacuggau

SEQ ID NO: 1754802 - RNA, 17 nt, Homo sapiens
agaauuuaagcuguaaa

SEQ ID NO: 1754803 - RNA, 19 nt, Homo sapiens
augccuucacuuuacaaau

SEQ ID NO: 1754804 - RNA, 14 nt, Homo sapiens
caguauuaagugug

SEQ ID NO: 1754805 - RNA, 15 nt, Homo sapiens
agaacugaaaagaga

SEQ ID NO: 1754806 - RNA, 14 nt, Homo sapiens
acucauuaauucaa

SEQ ID NO: 1754807 - RNA, 23 nt, Homo sapiens
gggcacgagagagucuuccaggu

SEQ ID NO: 1754808 - RNA, 23 nt, Homo sapiens
ccauaaguaauauuuaaagauua

SEQ ID NO: 1754809 - RNA, 14 nt, Homo sapiens
auugugcacaucuc

SEQ ID NO: 1754810 - RNA, 19 nt, Homo sapiens
uucagaaaagaagugaagu

SEQ ID NO: 1754811 - RNA, 15 nt, Homo sapiens
cuuucugucugugaa

SEQ ID NO: 1754812 - RNA, 16 nt, Homo sapiens
uacugcuugcuuucca

SEQ ID NO: 1754813 - RNA, 17 nt, Homo sapiens
augggcaucacacccuc

SEQ ID NO: 1754814 - RNA, 17 nt, Homo sapiens
cugaacagugcucugcc

SEQ ID NO: 1754815 - RNA, 16 nt, Homo sapiens
gaggccccagguggga

SEQ ID NO: 1754816 - RNA, 20 nt, Homo sapiens
acugccaggaguagugagcu

SEQ ID NO: 1754817 - RNA, 22 nt, Homo sapiens
aaaguaccacacugaguucuau

SEQ ID NO: 1754818 - RNA, 15 nt, Homo sapiens
uauuucuagcauuac

SEQ ID NO: 1754819 - RNA, 18 nt, Homo sapiens
auacugagugugccucau

SEQ ID NO: 1754820 - RNA, 20 nt, Homo sapiens
cacaugcagaguugugcaug

SEQ ID NO: 1754821 - RNA, 22 nt, Homo sapiens
cccugaccuucugggacauggu

SEQ ID NO: 1754822 - RNA, 18 nt, Homo sapiens
uuuaccccucuaccaagc

SEQ ID NO: 1754823 - RNA, 21 nt, Homo sapiens
gcaacaugccagccacuguga

SEQ ID NO: 1754824 - RNA, 15 nt, Homo sapiens
aaaagaaaugcacua

SEQ ID NO: 1754825 - RNA, 19 nt, Homo sapiens
gcucucuguaucagucuuu

SEQ ID NO: 1754826 - RNA, 21 nt, Homo sapiens
cugccagggcaccuacugaga

SEQ ID NO: 1754827 - RNA, 15 nt, Homo sapiens
agcacagcagcaucu

SEQ ID NO: 1754828 - RNA, 18 nt, Homo sapiens
acagaggcuagaaagcau

SEQ ID NO: 1754829 - RNA, 13 nt, Homo sapiens
gucccacacugug

SEQ ID NO: 1754830 - RNA, 14 nt, Homo sapiens
auguguguaaaaaa

SEQ ID NO: 1754831 - RNA, 13 nt, Homo sapiens
aagcucuguccaa

SEQ ID NO: 1754832 - RNA, 20 nt, Homo sapiens
accauagggacccauucuac

SEQ ID NO: 1754833 - RNA, 12 nt, Homo sapiens
acaacacacuuu

SEQ ID NO: 1754834 - RNA, 19 nt, Homo sapiens
uggccaggacccugaccuc

SEQ ID NO: 1754835 - RNA, 17 nt, Homo sapiens
auguccauuuauaucau

SEQ ID NO: 1754836 - RNA, 16 nt, Homo sapiens
ugcaacuucuauccuu

SEQ ID NO: 1754837 - RNA, 21 nt, Homo sapiens
cagugaaggucuuuguuauga

SEQ ID NO: 1754838 - RNA, 19 nt, Homo sapiens
uuuccuuguacuugauccu

SEQ ID NO: 1754839 - RNA, 14 nt, Homo sapiens
ucuuugacaacuaa

SEQ ID NO: 1754840 - RNA, 19 nt, Homo sapiens
ugcauguguauauauguca

SEQ ID NO: 1754841 - RNA, 17 nt, Homo sapiens
auuuaccugaagucuuu

SEQ ID NO: 1754842 - RNA, 17 nt, Homo sapiens
auauagccaaaaauguc

SEQ ID NO: 1754843 - RNA, 15 nt, Homo sapiens
acggaggaugaugcc

SEQ ID NO: 1754844 - RNA, 22 nt, Homo sapiens
uuaaaggaaaaucacaucucca

SEQ ID NO: 1754845 - RNA, 15 nt, Homo sapiens
uugucccguggcauu

SEQ ID NO: 1754846 - RNA, 17 nt, Homo sapiens
uagaugaacucuucuca

SEQ ID NO: 1754847 - RNA, 14 nt, Homo sapiens
cagugaaguacuca

SEQ ID NO: 1754848 - RNA, 18 nt, Homo sapiens
auaaugcacugaguaugc

SEQ ID NO: 1754849 - RNA, 22 nt, Homo sapiens
caagacuuuaaacauuuauguu

SEQ ID NO: 1754850 - RNA, 16 nt, Homo sapiens
ucuaguugcaguauug

SEQ ID NO: 1754851 - RNA, 15 nt, Homo sapiens
caauuuuguuuguga

SEQ ID NO: 1754852 - RNA, 20 nt, Homo sapiens
cucgggcgagucacugccuc

SEQ ID NO: 1754853 - RNA, 20 nt, Homo sapiens
caaacacauuauaaaguuca

SEQ ID NO: 1754854 - RNA, 13 nt, Homo sapiens
gggccugggacaa

SEQ ID NO: 1754855 - RNA, 20 nt, Homo sapiens
augugccaggccuacuguaa

SEQ ID NO: 1754856 - RNA, 21 nt, Homo sapiens
guugcucagcuccuaccucug

SEQ ID NO: 1754857 - RNA, 16 nt, Homo sapiens
auccuacaagacacag

SEQ ID NO: 1754858 - RNA, 16 nt, Homo sapiens
cugcacagauaccuca

SEQ ID NO: 1754859 - RNA, 14 nt, Homo sapiens
aguggcacucugug

SEQ ID NO: 1754860 - RNA, 20 nt, Homo sapiens
aagagccuucacugguucug

SEQ ID NO: 1754861 - RNA, 15 nt, Homo sapiens
uauuuagucugcauu

SEQ ID NO: 1754862 - RNA, 14 nt, Homo sapiens
agugcuggcucaca

SEQ ID NO: 1754863 - RNA, 22 nt, Homo sapiens
cccgagucgucauccccggagu

SEQ ID NO: 1754864 - RNA, 17 nt, Homo sapiens
ccacccuuuggagacca

SEQ ID NO: 1754865 - RNA, 23 nt, Homo sapiens
cucaccuguuacuugaaauacca

SEQ ID NO: 1754866 - RNA, 19 nt, Homo sapiens
uuucaggcuacuguucuug

SEQ ID NO: 1754867 - RNA, 18 nt, Homo sapiens
cauuuaaauuuuacccuu

SEQ ID NO: 1754868 - RNA, 22 nt, Homo sapiens
uagaagcagaucauuucccaaa

SEQ ID NO: 1754869 - RNA, 22 nt, Homo sapiens
gucuuggcucacugcaacuucu

SEQ ID NO: 1754870 - RNA, 21 nt, Homo sapiens
cuuaguauugcagccaaagaa

SEQ ID NO: 1754871 - RNA, 16 nt, Homo sapiens
cguguggaucuugcca

SEQ ID NO: 1754872 - RNA, 22 nt, Homo sapiens
auccuauuuaaagaccugacag

SEQ ID NO: 1754873 - RNA, 19 nt, Homo sapiens
gucccugcagaagccagaa

SEQ ID NO: 1754874 - RNA, 17 nt, Homo sapiens
cgcaggcccggacucac

SEQ ID NO: 1754875 - RNA, 21 nt, Homo sapiens
ugaaucugagaaaguacuuuc

SEQ ID NO: 1754876 - RNA, 20 nt, Homo sapiens
gagaucgugccauuacacuc

SEQ ID NO: 1754877 - RNA, 18 nt, Homo sapiens
agaugggcagggccuagg

SEQ ID NO: 1754878 - RNA, 21 nt, Homo sapiens
caucguggggcucucaguucc

SEQ ID NO: 1754879 - RNA, 15 nt, Homo sapiens
cuguugaaacuuaca

SEQ ID NO: 1754880 - RNA, 16 nt, Homo sapiens
gaugaggcagaugccu

SEQ ID NO: 1754881 - RNA, 22 nt, Homo sapiens
uaaaacuguacuuugauucaca

SEQ ID NO: 1754882 - RNA, 15 nt, Homo sapiens
uaucuuaucuacuga

SEQ ID NO: 1754883 - RNA, 12 nt, Homo sapiens
augugugugcaa

SEQ ID NO: 1754884 - RNA, 19 nt, Homo sapiens
ucuuuuccuccuccaccca

SEQ ID NO: 1754885 - RNA, 20 nt, Homo sapiens
uucugaccucaugaguguca

SEQ ID NO: 1754886 - RNA, 20 nt, Homo sapiens
cauuuaaaaaaaucacaaaa

SEQ ID NO: 1754887 - RNA, 21 nt, Homo sapiens
aaaauguucugacagcauuuc

SEQ ID NO: 1754888 - RNA, 14 nt, Homo sapiens
acagcuaugaaggc

SEQ ID NO: 1754889 - RNA, 16 nt, Homo sapiens
cagugacagugcccag

SEQ ID NO: 1754890 - RNA, 15 nt, Homo sapiens
gucguccccagacca

SEQ ID NO: 1754891 - RNA, 19 nt, Homo sapiens
ugucugcuugcaucugcac

SEQ ID NO: 1754892 - RNA, 11 nt, Homo sapiens
uuauauauucc

SEQ ID NO: 1754893 - RNA, 15 nt, Homo sapiens
agaaaauauuacuua

SEQ ID NO: 1754894 - RNA, 23 nt, Homo sapiens
cuuccuggguccuguucccuacc

SEQ ID NO: 1754895 - RNA, 20 nt, Homo sapiens
cuccacccucccucccugau

SEQ ID NO: 1754896 - RNA, 14 nt, Homo sapiens
uaaguaucagggga

SEQ ID NO: 1754897 - RNA, 20 nt, Homo sapiens
caggacuccaucucuuaaaa

SEQ ID NO: 1754898 - RNA, 16 nt, Homo sapiens
cucucuguacacugcc

SEQ ID NO: 1754899 - RNA, 12 nt, Homo sapiens
guccucacccau

SEQ ID NO: 1754900 - RNA, 19 nt, Homo sapiens
ggccuccccaugggcacag

SEQ ID NO: 1754901 - RNA, 20 nt, Homo sapiens
uauaaauuuauuuacugcua

SEQ ID NO: 1754902 - RNA, 12 nt, Homo sapiens
cuggacaccucu

SEQ ID NO: 1754903 - RNA, 16 nt, Homo sapiens
cgauucucaugccuca

SEQ ID NO: 1754904 - RNA, 18 nt, Homo sapiens
ucccagaacacacuccau

SEQ ID NO: 1754905 - RNA, 14 nt, Homo sapiens
auggacgaccucca

SEQ ID NO: 1754906 - RNA, 15 nt, Homo sapiens
ggcauauucaucuac

SEQ ID NO: 1754907 - RNA, 15 nt, Homo sapiens
agaauaaagucuuug

SEQ ID NO: 1754908 - RNA, 17 nt, Homo sapiens
gaacucuuuucccugaa

SEQ ID NO: 1754909 - RNA, 23 nt, Homo sapiens
auuucuggugaaaaaagccagcc

SEQ ID NO: 1754910 - RNA, 15 nt, Homo sapiens
accaaauaggaucau

SEQ ID NO: 1754911 - RNA, 23 nt, Homo sapiens
ccaaguucuuagggcacaugaaa

SEQ ID NO: 1754912 - RNA, 14 nt, Homo sapiens
cucugaagccacaa

SEQ ID NO: 1754913 - RNA, 18 nt, Homo sapiens
uacuugugaaacacagcu

SEQ ID NO: 1754914 - RNA, 17 nt, Homo sapiens
accuuuggagcaaagcu

SEQ ID NO: 1754915 - RNA, 19 nt, Homo sapiens
aucuuaaccucaaaacugu

SEQ ID NO: 1754916 - RNA, 16 nt, Homo sapiens
ucccucuuugagggag

SEQ ID NO: 1754917 - RNA, 12 nt, Homo sapiens
uucuucuagcuc

SEQ ID NO: 1754918 - RNA, 20 nt, Homo sapiens
ccugcacuguccugaccauc

SEQ ID NO: 1754919 - RNA, 12 nt, Homo sapiens
cuuuuuugccag

SEQ ID NO: 1754920 - RNA, 14 nt, Homo sapiens
caagagaggaagga

SEQ ID NO: 1754921 - RNA, 21 nt, Homo sapiens
gaguggucaggcaucuucccu

SEQ ID NO: 1754922 - RNA, 21 nt, Homo sapiens
ccagcucacgccugguggugg

SEQ ID NO: 1754923 - RNA, 17 nt, Homo sapiens
uuggcauuaucucuuuc

SEQ ID NO: 1754924 - RNA, 21 nt, Homo sapiens
uccagggcuauagggugugau

SEQ ID NO: 1754925 - RNA, 16 nt, Homo sapiens
uuagaagucacacagu

SEQ ID NO: 1754926 - RNA, 22 nt, Homo sapiens
ccuccaaggacuaaggccucca

SEQ ID NO: 1754927 - RNA, 16 nt, Homo sapiens
agagaccauugcaaug

SEQ ID NO: 1754928 - RNA, 20 nt, Homo sapiens
aaauauuaucuuuguucucc

SEQ ID NO: 1754929 - RNA, 14 nt, Homo sapiens
gguaaguuggcuca

SEQ ID NO: 1754930 - RNA, 14 nt, Homo sapiens
caguguucaguaaa

SEQ ID NO: 1754931 - RNA, 15 nt, Homo sapiens
uggccugcccgugcc

SEQ ID NO: 1754932 - RNA, 19 nt, Homo sapiens
uuccaguggcuucucccaa

SEQ ID NO: 1754933 - RNA, 12 nt, Homo sapiens
aaaugacaguuu

SEQ ID NO: 1754934 - RNA, 17 nt, Homo sapiens
ugguauuucuaauucca

SEQ ID NO: 1754935 - RNA, 20 nt, Homo sapiens
gaucuccaacagccagugug

SEQ ID NO: 1754936 - RNA, 18 nt, Homo sapiens
cuuugauuuagagaugau

SEQ ID NO: 1754937 - RNA, 13 nt, Homo sapiens
cuugacucuuaca

SEQ ID NO: 1754938 - RNA, 16 nt, Homo sapiens
auauggaaauccuguu

SEQ ID NO: 1754939 - RNA, 18 nt, Homo sapiens
acccacucccugucaaug

SEQ ID NO: 1754940 - RNA, 20 nt, Homo sapiens
uucuugguagauuauucaua

SEQ ID NO: 1754941 - RNA, 14 nt, Homo sapiens
ugcaagaaggauac

SEQ ID NO: 1754942 - RNA, 16 nt, Homo sapiens
cccagccucuucccau

SEQ ID NO: 1754943 - RNA, 14 nt, Homo sapiens
auuuuagacuuacc

SEQ ID NO: 1754944 - RNA, 22 nt, Homo sapiens
ggagguugcagugagcugagau

SEQ ID NO: 1754945 - RNA, 21 nt, Homo sapiens
agaucagccugggcaauguga

SEQ ID NO: 1754946 - RNA, 22 nt, Homo sapiens
ucauggcuuuguuaaacuuauu

SEQ ID NO: 1754947 - RNA, 12 nt, Homo sapiens
uggacuacacaa

SEQ ID NO: 1754948 - RNA, 21 nt, Homo sapiens
ucaauauaccaugacaugaag

SEQ ID NO: 1754949 - RNA, 18 nt, Homo sapiens
cuugggaccuguuuagag

SEQ ID NO: 1754950 - RNA, 13 nt, Homo sapiens
gaaaauaagcuua

SEQ ID NO: 1754951 - RNA, 22 nt, Homo sapiens
gccuggccuccuucaccaaaga

SEQ ID NO: 1754952 - RNA, 13 nt, Homo sapiens
caggacaacauca

SEQ ID NO: 1754953 - RNA, 22 nt, Homo sapiens
auggaugaaucucccacuccag

SEQ ID NO: 1754954 - RNA, 18 nt, Homo sapiens
aagucuugaauaguacau

SEQ ID NO: 1754955 - RNA, 17 nt, Homo sapiens
aauguaacuauaaucuc

SEQ ID NO: 1754956 - RNA, 15 nt, Homo sapiens
aacugagucacucac

SEQ ID NO: 1754957 - RNA, 21 nt, Homo sapiens
auugaauuauauguucagauu

SEQ ID NO: 1754958 - RNA, 23 nt, Homo sapiens
aaugaaugaaauauaaacuguga

SEQ ID NO: 1754959 - RNA, 21 nt, Homo sapiens
accuacuuugacuuuuugcau

SEQ ID NO: 1754960 - RNA, 15 nt, Homo sapiens
aaaggaguggucaag

SEQ ID NO: 1754961 - RNA, 17 nt, Homo sapiens
gagcugcucugcuauau

SEQ ID NO: 1754962 - RNA, 13 nt, Homo sapiens
guguucuaagcaa

SEQ ID NO: 1754963 - RNA, 23 nt, Homo sapiens
caucuguaacaauuauguuuuca

SEQ ID NO: 1754964 - RNA, 14 nt, Homo sapiens
uaccaugugugcua

SEQ ID NO: 1754965 - RNA, 13 nt, Homo sapiens
uccuauuuagaca

SEQ ID NO: 1754966 - RNA, 13 nt, Homo sapiens
gggacagggauga

SEQ ID NO: 1754967 - RNA, 19 nt, Homo sapiens
uggaacacaauaauguguc

SEQ ID NO: 1754968 - RNA, 21 nt, Homo sapiens
ugcagauuagcuaggggacag

SEQ ID NO: 1754969 - RNA, 17 nt, Homo sapiens
uccaacugcaacucauc

SEQ ID NO: 1754970 - RNA, 19 nt, Homo sapiens
ccugugguuugcuccagaa

SEQ ID NO: 1754971 - RNA, 22 nt, Homo sapiens
ugggcagugcaggacaacauca

SEQ ID NO: 1754972 - RNA, 17 nt, Homo sapiens
accaugacaugaagaau

SEQ ID NO: 1754973 - RNA, 10 nt, Homo sapiens
cagugacacc

SEQ ID NO: 1754974 - RNA, 17 nt, Homo sapiens
uagagaaaacaugcaga

SEQ ID NO: 1754975 - RNA, 19 nt, Homo sapiens
gaagacugugaaguugcca

SEQ ID NO: 1754976 - RNA, 20 nt, Homo sapiens
caaugcuuauacccagugag

SEQ ID NO: 1754977 - RNA, 13 nt, Homo sapiens
cccagcccaauaa

SEQ ID NO: 1754978 - RNA, 23 nt, Homo sapiens
gcaucagcugcugaaacaacaaa

SEQ ID NO: 1754979 - RNA, 23 nt, Homo sapiens
cucuucuccaccucccacaaagg

SEQ ID NO: 1754980 - RNA, 18 nt, Homo sapiens
aaauagugcacuccaaga

SEQ ID NO: 1754981 - RNA, 16 nt, Homo sapiens
auggggacacagauca

SEQ ID NO: 1754982 - RNA, 17 nt, Homo sapiens
ggccggcugugcucaga

SEQ ID NO: 1754983 - RNA, 15 nt, Homo sapiens
caggucccuauagca

SEQ ID NO: 1754984 - RNA, 18 nt, Homo sapiens
ccaauugggaaugcaaua

SEQ ID NO: 1754985 - RNA, 14 nt, Homo sapiens
aaugccaccaucca

SEQ ID NO: 1754986 - RNA, 14 nt, Homo sapiens
ccacccacacagca

SEQ ID NO: 1754987 - RNA, 17 nt, Homo sapiens
cugaagauccacaaaag

SEQ ID NO: 1754988 - RNA, 20 nt, Homo sapiens
cacuacaagcuuuuaacuuu

SEQ ID NO: 1754989 - RNA, 19 nt, Homo sapiens
aaaauuuuuugagugaagu

SEQ ID NO: 1754990 - RNA, 23 nt, Homo sapiens
cucaggaaacgagacuuuccauu

SEQ ID NO: 1754991 - RNA, 15 nt, Homo sapiens
cuugcccaucagcca

SEQ ID NO: 1754992 - RNA, 23 nt, Homo sapiens
uagaaauaaaagugaaugaaaga

SEQ ID NO: 1754993 - RNA, 18 nt, Homo sapiens
cacugaggugaggcuaca

SEQ ID NO: 1754994 - RNA, 14 nt, Homo sapiens
accaguuaccacac

SEQ ID NO: 1754995 - RNA, 21 nt, Homo sapiens
gcaagauagucuucaguuuca

SEQ ID NO: 1754996 - RNA, 14 nt, Homo sapiens
cccgccuccaguca

SEQ ID NO: 1754997 - RNA, 16 nt, Homo sapiens
aaauauauaugucaau

SEQ ID NO: 1754998 - RNA, 17 nt, Homo sapiens
agaugucuguguauaca

SEQ ID NO: 1754999 - RNA, 14 nt, Homo sapiens
uucauuccauuugc

SEQ ID NO: 1755000 - RNA, 18 nt, Homo sapiens
uaacaagucgaugaacua

SEQ ID NO: 1755001 - RNA, 13 nt, Homo sapiens
ugaaguuugcuau

SEQ ID NO: 1755002 - RNA, 16 nt, Homo sapiens
ucauucaaaaagccaa

SEQ ID NO: 1755003 - RNA, 17 nt, Homo sapiens
caaaacauuuuacuuua

SEQ ID NO: 1755004 - RNA, 21 nt, Homo sapiens
aaucccaucuauucucugccu

SEQ ID NO: 1755005 - RNA, 15 nt, Homo sapiens
agaccccacugccac

SEQ ID NO: 1755006 - RNA, 21 nt, Homo sapiens
gucaacaaccaugccagggau

SEQ ID NO: 1755007 - RNA, 20 nt, Homo sapiens
cagggcucauuuuugcacuu

SEQ ID NO: 1755008 - RNA, 16 nt, Homo sapiens
aggaguauauggacac

SEQ ID NO: 1755009 - RNA, 22 nt, Homo sapiens
gcaugagacuuucugcugggau

SEQ ID NO: 1755010 - RNA, 20 nt, Homo sapiens
uacuagcuuuauaaauuaca

SEQ ID NO: 1755011 - RNA, 14 nt, Homo sapiens
acucucacaugugg

SEQ ID NO: 1755012 - RNA, 20 nt, Homo sapiens
caggcuggagggcaguggca

SEQ ID NO: 1755013 - RNA, 12 nt, Homo sapiens
caucuggcugca

SEQ ID NO: 1755014 - RNA, 12 nt, Homo sapiens
agugacagaucc

SEQ ID NO: 1755015 - RNA, 16 nt, Homo sapiens
cacaugccaagcacug

SEQ ID NO: 1755016 - RNA, 17 nt, Homo sapiens
auaacuuucucugugaa

SEQ ID NO: 1755017 - RNA, 18 nt, Homo sapiens
gguccugaaaguaacuca

SEQ ID NO: 1755018 - RNA, 17 nt, Homo sapiens
ccgagugcaaugaauga

SEQ ID NO: 1755019 - RNA, 17 nt, Homo sapiens
auacauuucuacuuuau

SEQ ID NO: 1755020 - RNA, 14 nt, Homo sapiens
guguccaaggagca

SEQ ID NO: 1755021 - RNA, 16 nt, Homo sapiens
ggagcccuauugcugc

SEQ ID NO: 1755022 - RNA, 14 nt, Homo sapiens
uaguauaaacucau

SEQ ID NO: 1755023 - RNA, 14 nt, Homo sapiens
aacuuacgaucucu

SEQ ID NO: 1755024 - RNA, 19 nt, Homo sapiens
ugcguagaagauauggaag

SEQ ID NO: 1755025 - RNA, 21 nt, Homo sapiens
aaguauuguguuuaugcauuu

SEQ ID NO: 1755026 - RNA, 12 nt, Homo sapiens
aaagucuugccu

SEQ ID NO: 1755027 - RNA, 14 nt, Homo sapiens
uaaguugcgcuuaa

SEQ ID NO: 1755028 - RNA, 13 nt, Homo sapiens
gcagacucaccac

SEQ ID NO: 1755029 - RNA, 16 nt, Homo sapiens
caucaagcacuuccca

SEQ ID NO: 1755030 - RNA, 17 nt, Homo sapiens
cucaaugaaauauguga

SEQ ID NO: 1755031 - RNA, 15 nt, Homo sapiens
uuuucuuacucugaa

SEQ ID NO: 1755032 - RNA, 17 nt, Homo sapiens
cuucccuaaucuuccac

SEQ ID NO: 1755033 - RNA, 17 nt, Homo sapiens
accuuuuaacuccucaa

SEQ ID NO: 1755034 - RNA, 14 nt, Homo sapiens
cgaaauaucuaugu

SEQ ID NO: 1755035 - RNA, 14 nt, Homo sapiens
uucuauauugcagu

SEQ ID NO: 1755036 - RNA, 15 nt, Homo sapiens
acugaauuaaugaca

SEQ ID NO: 1755037 - RNA, 20 nt, Homo sapiens
ugcucgcacagauuacuuca

SEQ ID NO: 1755038 - RNA, 18 nt, Homo sapiens
auugacuauagugugagc

SEQ ID NO: 1755039 - RNA, 11 nt, Homo sapiens
cuaaacuuaau

SEQ ID NO: 1755040 - RNA, 15 nt, Homo sapiens
agggagggcucugag

SEQ ID NO: 1755041 - RNA, 13 nt, Homo sapiens
gagcaaacagaaa

SEQ ID NO: 1755042 - RNA, 15 nt, Homo sapiens
uugaguuuuucaggu

SEQ ID NO: 1755043 - RNA, 18 nt, Homo sapiens
uacugaguagggggagca

SEQ ID NO: 1755044 - RNA, 16 nt, Homo sapiens
uggaaaaaacaaaaac

SEQ ID NO: 1755045 - RNA, 21 nt, Homo sapiens
ccccauucagugacauguccu

SEQ ID NO: 1755046 - RNA, 21 nt, Homo sapiens
ucugcugguaccuauuuguca

SEQ ID NO: 1755047 - RNA, 20 nt, Homo sapiens
ucauaaccaaacacaaugau

SEQ ID NO: 1755048 - RNA, 19 nt, Homo sapiens
ugaguccucuuaaugcuag

SEQ ID NO: 1755049 - RNA, 20 nt, Homo sapiens
aagcuuggauuaaauacaua

SEQ ID NO: 1755050 - RNA, 13 nt, Homo sapiens
uaaugaagaauca

SEQ ID NO: 1755051 - RNA, 17 nt, Homo sapiens
acucaggcuuucacuau

SEQ ID NO: 1755052 - RNA, 20 nt, Homo sapiens
gaggggauggggaugcuucc

SEQ ID NO: 1755053 - RNA, 20 nt, Homo sapiens
uagaagauuuuaugcugcug

SEQ ID NO: 1755054 - RNA, 22 nt, Homo sapiens
gagaggcugagaaaugcagaga

SEQ ID NO: 1755055 - RNA, 14 nt, Homo sapiens
uuuaucaagccaua

SEQ ID NO: 1755056 - RNA, 22 nt, Homo sapiens
uuggggaugagucaguccuugc

SEQ ID NO: 1755057 - RNA, 17 nt, Homo sapiens
augacacagcuuuauca

SEQ ID NO: 1755058 - RNA, 22 nt, Homo sapiens
caguccaguacuugacccaugc

SEQ ID NO: 1755059 - RNA, 21 nt, Homo sapiens
ggcuugggccuaggcugcauu

SEQ ID NO: 1755060 - RNA, 16 nt, Homo sapiens
cagccaccacaucccu

SEQ ID NO: 1755061 - RNA, 12 nt, Homo sapiens
ccuuccacccau

SEQ ID NO: 1755062 - RNA, 19 nt, Homo sapiens
aacauccuucaagaacucu

SEQ ID NO: 1755063 - RNA, 17 nt, Homo sapiens
uguccugauggcccaaa

SEQ ID NO: 1755064 - RNA, 15 nt, Homo sapiens
uggccacaauaccca

SEQ ID NO: 1755065 - RNA, 18 nt, Homo sapiens
acuuuuaaaacuuugcca

SEQ ID NO: 1755066 - RNA, 17 nt, Homo sapiens
gcugcuaaguggaagac

SEQ ID NO: 1755067 - RNA, 17 nt, Homo sapiens
uucaaagagcuugaaaa

SEQ ID NO: 1755068 - RNA, 18 nt, Homo sapiens
cgcuaaggcuuccggcug

SEQ ID NO: 1755069 - RNA, 23 nt, Homo sapiens
uccaaauuuggcucacuugccuu

SEQ ID NO: 1755070 - RNA, 17 nt, Homo sapiens
guaaacagaaauugcaa

SEQ ID NO: 1755071 - RNA, 21 nt, Homo sapiens
aacagauuaguaguuacaugg

SEQ ID NO: 1755072 - RNA, 19 nt, Homo sapiens
cccaguauuuuuauacgga

SEQ ID NO: 1755073 - RNA, 15 nt, Homo sapiens
uuccuuagaauggag

SEQ ID NO: 1755074 - RNA, 20 nt, Homo sapiens
gagagcaggggagcuuggga

SEQ ID NO: 1755075 - RNA, 20 nt, Homo sapiens
augucuugcaaagccuuuaa

SEQ ID NO: 1755076 - RNA, 15 nt, Homo sapiens
uacagggauuacugg

SEQ ID NO: 1755077 - RNA, 14 nt, Homo sapiens
auaguucugugacu

SEQ ID NO: 1755078 - RNA, 23 nt, Homo sapiens
cagagugacagcuguauauugcu

SEQ ID NO: 1755079 - RNA, 12 nt, Homo sapiens
uuguuugcuuau

SEQ ID NO: 1755080 - RNA, 15 nt, Homo sapiens
gcucccucacccagg

SEQ ID NO: 1755081 - RNA, 14 nt, Homo sapiens
ccagaggugcucca

SEQ ID NO: 1755082 - RNA, 14 nt, Homo sapiens
ucuucauuaccuca

SEQ ID NO: 1755083 - RNA, 14 nt, Homo sapiens
uuuucauuaucuca

SEQ ID NO: 1755084 - RNA, 15 nt, Homo sapiens
aagggugguuugcag

SEQ ID NO: 1755085 - RNA, 17 nt, Homo sapiens
agguucgggauucccug

SEQ ID NO: 1755086 - RNA, 12 nt, Homo sapiens
gucaacauaugc

SEQ ID NO: 1755087 - RNA, 14 nt, Homo sapiens
gaacaaugacaaac

SEQ ID NO: 1755088 - RNA, 18 nt, Homo sapiens
gucacuuauaccaugagu

SEQ ID NO: 1755089 - RNA, 22 nt, Homo sapiens
ucauugucccugaaugcuccau

SEQ ID NO: 1755090 - RNA, 23 nt, Homo sapiens
uacaaggacauucacugcugauu

SEQ ID NO: 1755091 - RNA, 20 nt, Homo sapiens
aaccagcagaaaagugcuua

SEQ ID NO: 1755092 - RNA, 19 nt, Homo sapiens
ccugagcggaccuucccag

SEQ ID NO: 1755093 - RNA, 16 nt, Homo sapiens
agaacacgaauugcuc

SEQ ID NO: 1755094 - RNA, 20 nt, Homo sapiens
cuccugaguaguugggauua

SEQ ID NO: 1755095 - RNA, 20 nt, Homo sapiens
cucuugaguagcugggauua

SEQ ID NO: 1755096 - RNA, 21 nt, Homo sapiens
guggcagguggaggugucagg

SEQ ID NO: 1755097 - RNA, 22 nt, Homo sapiens
caaaagauacggcccaugcaau

SEQ ID NO: 1755098 - RNA, 22 nt, Homo sapiens
aggccagcugacuagaucucug

SEQ ID NO: 1755099 - RNA, 13 nt, Homo sapiens
aucaggcaccugg

SEQ ID NO: 1755100 - RNA, 14 nt, Homo sapiens
gcuggaauauuaaa

SEQ ID NO: 1755101 - RNA, 21 nt, Homo sapiens
aggagauaauuguuucauuca

SEQ ID NO: 1755102 - RNA, 14 nt, Homo sapiens
aaugcaccaagaaa

SEQ ID NO: 1755103 - RNA, 18 nt, Homo sapiens
caaaagguuaagccauau

SEQ ID NO: 1755104 - RNA, 22 nt, Homo sapiens
acaauuacugugagaacuguga

SEQ ID NO: 1755105 - RNA, 17 nt, Homo sapiens
cacaggaaacuacuuca

SEQ ID NO: 1755106 - RNA, 18 nt, Homo sapiens
cacuggggugggggugga

SEQ ID NO: 1755107 - RNA, 17 nt, Homo sapiens
uauaucuguggucuuca

SEQ ID NO: 1755108 - RNA, 19 nt, Homo sapiens
uuuggaugagcauggagcu

SEQ ID NO: 1755109 - RNA, 14 nt, Homo sapiens
guuuugugugguau

SEQ ID NO: 1755110 - RNA, 15 nt, Homo sapiens
aagugccuaccccag

SEQ ID NO: 1755111 - RNA, 19 nt, Homo sapiens
uuuccuccaaaguaaugua

SEQ ID NO: 1755112 - RNA, 13 nt, Homo sapiens
uuuugcacugaca

SEQ ID NO: 1755113 - RNA, 14 nt, Homo sapiens
cucacggaccccau

SEQ ID NO: 1755114 - RNA, 22 nt, Homo sapiens
acaugcuuaugacaaugacugu

SEQ ID NO: 1755115 - RNA, 17 nt, Homo sapiens
uucuccccggacacucg

SEQ ID NO: 1755116 - RNA, 17 nt, Homo sapiens
uuaguucugacuuugaa

SEQ ID NO: 1755117 - RNA, 22 nt, Homo sapiens
ugagcauagagaacaaaguaaa

SEQ ID NO: 1755118 - RNA, 20 nt, Homo sapiens
aaaaagaaacuuacuaaaua

SEQ ID NO: 1755119 - RNA, 22 nt, Homo sapiens
auuugguucccuuccuauucca

SEQ ID NO: 1755120 - RNA, 16 nt, Homo sapiens
cuuggggccaccaaag

SEQ ID NO: 1755121 - RNA, 17 nt, Homo sapiens
aggcuaguccggaccca

SEQ ID NO: 1755122 - RNA, 13 nt, Homo sapiens
cuguggaaugagu

SEQ ID NO: 1755123 - RNA, 13 nt, Homo sapiens
ucuguauucuugc

SEQ ID NO: 1755124 - RNA, 13 nt, Homo sapiens
agcuaccaggugu

SEQ ID NO: 1755125 - RNA, 16 nt, Homo sapiens
gcauacaaagcaguuu

SEQ ID NO: 1755126 - RNA, 16 nt, Homo sapiens
cuacacagggcugcug

SEQ ID NO: 1755127 - RNA, 15 nt, Homo sapiens
ccaugcucaaccacu

SEQ ID NO: 1755128 - RNA, 19 nt, Homo sapiens
ccuggucaauaaaccacug

SEQ ID NO: 1755129 - RNA, 20 nt, Homo sapiens
ccaaacaacagucuucauuu

SEQ ID NO: 1755130 - RNA, 12 nt, Homo sapiens
augaaaucucag

SEQ ID NO: 1755131 - RNA, 12 nt, Homo sapiens
auaaaaucucgg

SEQ ID NO: 1755132 - RNA, 21 nt, Homo sapiens
aggcccgcacugggggcaauu

SEQ ID NO: 1755133 - RNA, 14 nt, Homo sapiens
gccgccaugagcaa

SEQ ID NO: 1755134 - RNA, 21 nt, Homo sapiens
aaucaaucuguaaaacuaaga

SEQ ID NO: 1755135 - RNA, 14 nt, Homo sapiens
auggggaucugggg

SEQ ID NO: 1755136 - RNA, 14 nt, Homo sapiens
auagaaaucuagaa

SEQ ID NO: 1755137 - RNA, 16 nt, Homo sapiens
gucacagaucugggag

SEQ ID NO: 1755138 - RNA, 16 nt, Homo sapiens
aauaccugaaugcucu

SEQ ID NO: 1755139 - RNA, 17 nt, Homo sapiens
acugucaggaaguaaaa

SEQ ID NO: 1755140 - RNA, 21 nt, Homo sapiens
ugaaucgcaaggccugugcug

SEQ ID NO: 1755141 - RNA, 20 nt, Homo sapiens
acuccuuauauugcugugag

SEQ ID NO: 1755142 - RNA, 20 nt, Homo sapiens
guauuauuuacaaugcagaa

SEQ ID NO: 1755143 - RNA, 12 nt, Homo sapiens
uguccuacagaa

SEQ ID NO: 1755144 - RNA, 12 nt, Homo sapiens
uucuauaacaua

SEQ ID NO: 1755145 - RNA, 15 nt, Homo sapiens
ucaccuucaacuguc

SEQ ID NO: 1755146 - RNA, 23 nt, Homo sapiens
ucuacucugcuuuuuuucuacug

SEQ ID NO: 1755147 - RNA, 12 nt, Homo sapiens
uugggaguugua

SEQ ID NO: 1755148 - RNA, 19 nt, Homo sapiens
aaccguaucauuuuuucac

SEQ ID NO: 1755149 - RNA, 16 nt, Homo sapiens
aauuacuuauauucau

SEQ ID NO: 1755150 - RNA, 16 nt, Homo sapiens
gaauaaauguuuuauu

SEQ ID NO: 1755151 - RNA, 19 nt, Homo sapiens
ucaagaauggggaucacag

SEQ ID NO: 1755152 - RNA, 17 nt, Homo sapiens
aaaugacugccggucau

SEQ ID NO: 1755153 - RNA, 18 nt, Homo sapiens
auuucacugaugcuucua

SEQ ID NO: 1755154 - RNA, 12 nt, Homo sapiens
aguaaacacuug

SEQ ID NO: 1755155 - RNA, 15 nt, Homo sapiens
ccauucugucuuccu

SEQ ID NO: 1755156 - RNA, 12 nt, Homo sapiens
uguuauucuugc

SEQ ID NO: 1755157 - RNA, 16 nt, Homo sapiens
cuuguggagaucacag

SEQ ID NO: 1755158 - RNA, 17 nt, Homo sapiens
ugcuuaccaaaagcuca

SEQ ID NO: 1755159 - RNA, 14 nt, Homo sapiens
gucucaguaccucc

SEQ ID NO: 1755160 - RNA, 11 nt, Homo sapiens
uugauaucuca

SEQ ID NO: 1755161 - RNA, 16 nt, Homo sapiens
gauuuugcuguagaag

SEQ ID NO: 1755162 - RNA, 20 nt, Homo sapiens
auauauagggguuccaggaa

SEQ ID NO: 1755163 - RNA, 21 nt, Homo sapiens
aguuaaagcagugcuucucaa

SEQ ID NO: 1755164 - RNA, 20 nt, Homo sapiens
caaguggacuuggagcugca

SEQ ID NO: 1755165 - RNA, 20 nt, Homo sapiens
gcugccagguuccuguacua

SEQ ID NO: 1755166 - RNA, 19 nt, Homo sapiens
uugagcuuaagaauuuuga

SEQ ID NO: 1755167 - RNA, 16 nt, Homo sapiens
gugcagugucuuguaa

SEQ ID NO: 1755168 - RNA, 17 nt, Homo sapiens
uuccacuccaaccagaa

SEQ ID NO: 1755169 - RNA, 16 nt, Homo sapiens
caaauagaucaugcau

SEQ ID NO: 1755170 - RNA, 13 nt, Homo sapiens
cagugcccaugca

SEQ ID NO: 1755171 - RNA, 20 nt, Homo sapiens
aaaacuacauuuuaacaugg

SEQ ID NO: 1755172 - RNA, 14 nt, Homo sapiens
ucccaugauccaga

SEQ ID NO: 1755173 - RNA, 16 nt, Homo sapiens
cuggagaaaaggcagu

SEQ ID NO: 1755174 - RNA, 17 nt, Homo sapiens
cugagggagacugcaaa

SEQ ID NO: 1755175 - RNA, 21 nt, Homo sapiens
ucuuagugaaaggucaucuca

SEQ ID NO: 1755176 - RNA, 15 nt, Homo sapiens
uggagcagagaacau

SEQ ID NO: 1755177 - RNA, 13 nt, Homo sapiens
uggauauuucaau

SEQ ID NO: 1755178 - RNA, 19 nt, Homo sapiens
caguuaucauuaucaucau

SEQ ID NO: 1755179 - RNA, 16 nt, Homo sapiens
auauucuuuguaugau

SEQ ID NO: 1755180 - RNA, 14 nt, Homo sapiens
acacaaacaaggcc

SEQ ID NO: 1755181 - RNA, 14 nt, Homo sapiens
acucgcuagcacuc

SEQ ID NO: 1755182 - RNA, 23 nt, Homo sapiens
accacugugguggugugcugcuu

SEQ ID NO: 1755183 - RNA, 23 nt, Homo sapiens
agcuuugcagugaaagcuuucau

SEQ ID NO: 1755184 - RNA, 19 nt, Homo sapiens
aggaugcugucaagcaccu

SEQ ID NO: 1755185 - RNA, 22 nt, Homo sapiens
agaaaaguucuuaaaacacuaa

SEQ ID NO: 1755186 - RNA, 13 nt, Homo sapiens
acccugcaggcag

SEQ ID NO: 1755187 - RNA, 18 nt, Homo sapiens
gucaauggggguguagua

SEQ ID NO: 1755188 - RNA, 15 nt, Homo sapiens
gagcaagcccuacuc

SEQ ID NO: 1755189 - RNA, 18 nt, Homo sapiens
ucaugcccccucagugag

SEQ ID NO: 1755190 - RNA, 15 nt, Homo sapiens
agcaaggagaaggca

SEQ ID NO: 1755191 - RNA, 16 nt, Homo sapiens
cccuuggcccaucugu

SEQ ID NO: 1755192 - RNA, 14 nt, Homo sapiens
ucuuaggugccagu

SEQ ID NO: 1755193 - RNA, 16 nt, Homo sapiens
uaguuauuuuacaaau

SEQ ID NO: 1755194 - RNA, 17 nt, Homo sapiens
cuuccuucucagccuug

SEQ ID NO: 1755195 - RNA, 21 nt, Homo sapiens
acucuaccaugguucugccuc

SEQ ID NO: 1755196 - RNA, 23 nt, Homo sapiens
uuacuauuuauugcugaaugacu

SEQ ID NO: 1755197 - RNA, 14 nt, Homo sapiens
auguuuccucucaa

SEQ ID NO: 1755198 - RNA, 20 nt, Homo sapiens
uuuccacucaaaauauguca

SEQ ID NO: 1755199 - RNA, 18 nt, Homo sapiens
ugcggguccucagcugcu

SEQ ID NO: 1755200 - RNA, 10 nt, Homo sapiens
uuugugagag

SEQ ID NO: 1755201 - RNA, 16 nt, Homo sapiens
gcuaaaugcacugacc

SEQ ID NO: 1755202 - RNA, 23 nt, Homo sapiens
uuaaauaaaauuuuuauguaauu

SEQ ID NO: 1755203 - RNA, 19 nt, Homo sapiens
aggcuaucuggccugagac

SEQ ID NO: 1755204 - RNA, 22 nt, Homo sapiens
caaugaugugucuucaauguca

SEQ ID NO: 1755205 - RNA, 18 nt, Homo sapiens
caaggcaggaggagcuga

SEQ ID NO: 1755206 - RNA, 19 nt, Homo sapiens
aagugguacuaacuuuccu

SEQ ID NO: 1755207 - RNA, 22 nt, Homo sapiens
cagacugaaaugugcucaggcc

SEQ ID NO: 1755208 - RNA, 20 nt, Homo sapiens
aaaacggguggugugucuca

SEQ ID NO: 1755209 - RNA, 13 nt, Homo sapiens
caagugccuucac

SEQ ID NO: 1755210 - RNA, 15 nt, Homo sapiens
aacuucaaagaggaa

SEQ ID NO: 1755211 - RNA, 14 nt, Homo sapiens
uuguagaugugauu

SEQ ID NO: 1755212 - RNA, 15 nt, Homo sapiens
ucugucuucuuugcc

SEQ ID NO: 1755213 - RNA, 19 nt, Homo sapiens
agcccaucugcacaguggg

SEQ ID NO: 1755214 - RNA, 13 nt, Homo sapiens
acccgcucucuca

SEQ ID NO: 1755215 - RNA, 20 nt, Homo sapiens
acagaagcggcucaguucac

SEQ ID NO: 1755216 - RNA, 22 nt, Homo sapiens
uagugccacccaccuuugccac

SEQ ID NO: 1755217 - RNA, 17 nt, Homo sapiens
aagaauuuaaaacgcau

SEQ ID NO: 1755218 - RNA, 17 nt, Homo sapiens
agcuggagggagucgaa

SEQ ID NO: 1755219 - RNA, 17 nt, Homo sapiens
acucagagggcuggauu

SEQ ID NO: 1755220 - RNA, 17 nt, Homo sapiens
ggcauaaaugucuaaag

SEQ ID NO: 1755221 - RNA, 18 nt, Homo sapiens
uucuaggauaagcacuag

SEQ ID NO: 1755222 - RNA, 16 nt, Homo sapiens
aaauauuuagauguaa

SEQ ID NO: 1755223 - RNA, 22 nt, Homo sapiens
aacaguuuccagucauggccaa

SEQ ID NO: 1755224 - RNA, 14 nt, Homo sapiens
auugggaauccgcc

SEQ ID NO: 1755225 - RNA, 18 nt, Homo sapiens
ccuagagaaggcugugag

SEQ ID NO: 1755226 - RNA, 16 nt, Homo sapiens
uguugacuggccaaaa

SEQ ID NO: 1755227 - RNA, 13 nt, Homo sapiens
gcaggcaggcaga

SEQ ID NO: 1755228 - RNA, 23 nt, Homo sapiens
caggauugauuaugcagaauacu

SEQ ID NO: 1755229 - RNA, 15 nt, Homo sapiens
ucuuaaugacauuuc

SEQ ID NO: 1755230 - RNA, 13 nt, Homo sapiens
uaagacacauuga

SEQ ID NO: 1755231 - RNA, 13 nt, Homo sapiens
uccuccacuccac

SEQ ID NO: 1755232 - RNA, 22 nt, Homo sapiens
agaccaacagaacuucacagug

SEQ ID NO: 1755233 - RNA, 19 nt, Homo sapiens
aucagccuccgccauucca

SEQ ID NO: 1755234 - RNA, 21 nt, Homo sapiens
cagacugguggcaguggagua

SEQ ID NO: 1755235 - RNA, 21 nt, Homo sapiens
ugcauucguaaacaccaaaua

SEQ ID NO: 1755236 - RNA, 15 nt, Homo sapiens
cuucugccucagcuu

SEQ ID NO: 1755237 - RNA, 17 nt, Homo sapiens
gcuauacacaagcaaug

SEQ ID NO: 1755238 - RNA, 16 nt, Homo sapiens
auugugauuguggaag

SEQ ID NO: 1755239 - RNA, 17 nt, Homo sapiens
ccaaccaaagggggaca

SEQ ID NO: 1755240 - RNA, 23 nt, Homo sapiens
gagaaaaaacauugcccagggau

SEQ ID NO: 1755241 - RNA, 18 nt, Homo sapiens
ccuuauucuauacuuucu

SEQ ID NO: 1755242 - RNA, 16 nt, Homo sapiens
aaaucuaccacuguau

SEQ ID NO: 1755243 - RNA, 12 nt, Homo sapiens
auucaugcaaga

SEQ ID NO: 1755244 - RNA, 14 nt, Homo sapiens
augugaaaagaaua

SEQ ID NO: 1755245 - RNA, 21 nt, Homo sapiens
gaucguccacugucaaguguu

SEQ ID NO: 1755246 - RNA, 16 nt, Homo sapiens
cagagaaagggacaau

SEQ ID NO: 1755247 - RNA, 12 nt, Homo sapiens
acugaugcauug

SEQ ID NO: 1755248 - RNA, 23 nt, Homo sapiens
uuauggaccaauuagcauuccau

SEQ ID NO: 1755249 - RNA, 19 nt, Homo sapiens
accugacagcaaacacagu

SEQ ID NO: 1755250 - RNA, 15 nt, Homo sapiens
ugguuuccacauuua

SEQ ID NO: 1755251 - RNA, 12 nt, Homo sapiens
aacuuccaaagg

SEQ ID NO: 1755252 - RNA, 12 nt, Homo sapiens
ggcuuccagggg

SEQ ID NO: 1755253 - RNA, 16 nt, Homo sapiens
ugaaaauccaucucau

SEQ ID NO: 1755254 - RNA, 15 nt, Homo sapiens
gaauccaaaagacaa

SEQ ID NO: 1755255 - RNA, 16 nt, Homo sapiens
augcagacaacaccuu

SEQ ID NO: 1755256 - RNA, 17 nt, Homo sapiens
aaaagcaguaggagaaa

SEQ ID NO: 1755257 - RNA, 11 nt, Homo sapiens
uuaagcagcuc

SEQ ID NO: 1755258 - RNA, 21 nt, Homo sapiens
acaaguacugguugacuuucu

SEQ ID NO: 1755259 - RNA, 19 nt, Homo sapiens
uagucugugggagugagag

SEQ ID NO: 1755260 - RNA, 22 nt, Homo sapiens
caauaaagagaaccaugugcua

SEQ ID NO: 1755261 - RNA, 23 nt, Homo sapiens
gacaauaguauuucuccuuugca

SEQ ID NO: 1755262 - RNA, 16 nt, Homo sapiens
aaugucuucaugaccu

SEQ ID NO: 1755263 - RNA, 15 nt, Homo sapiens
ccacacacacuggcc

SEQ ID NO: 1755264 - RNA, 16 nt, Homo sapiens
guagugcuuuaagaau

SEQ ID NO: 1755265 - RNA, 13 nt, Homo sapiens
uguaaaauccaca

SEQ ID NO: 1755266 - RNA, 15 nt, Homo sapiens
aauuggccaucuuaa

SEQ ID NO: 1755267 - RNA, 15 nt, Homo sapiens
uauuugccuucugaa

SEQ ID NO: 1755268 - RNA, 16 nt, Homo sapiens
cuugguaugugccagg

SEQ ID NO: 1755269 - RNA, 19 nt, Homo sapiens
aucugaguugccaagacaa

SEQ ID NO: 1755270 - RNA, 18 nt, Homo sapiens
aaccaaaagaauuugcac

SEQ ID NO: 1755271 - RNA, 21 nt, Homo sapiens
aggugacuggagcccgagggc

SEQ ID NO: 1755272 - RNA, 17 nt, Homo sapiens
ggaauggcccucauuca

SEQ ID NO: 1755273 - RNA, 17 nt, Homo sapiens
accuaccaaaauggaau

SEQ ID NO: 1755274 - RNA, 23 nt, Homo sapiens
gagcccagaaaagguacacuuug

SEQ ID NO: 1755275 - RNA, 13 nt, Homo sapiens
cagggacuugaac

SEQ ID NO: 1755276 - RNA, 20 nt, Homo sapiens
cuuuguugcaagaugugaau

SEQ ID NO: 1755277 - RNA, 20 nt, Homo sapiens
aaaugaauuucucuacagau

SEQ ID NO: 1755278 - RNA, 20 nt, Homo sapiens
uguacaaguugaaauaugcu

SEQ ID NO: 1755279 - RNA, 17 nt, Homo sapiens
cuugcuguugacauauu

SEQ ID NO: 1755280 - RNA, 16 nt, Homo sapiens
aaauguuuuacucaga

SEQ ID NO: 1755281 - RNA, 16 nt, Homo sapiens
cucagggaacugaccc

SEQ ID NO: 1755282 - RNA, 22 nt, Homo sapiens
aguccugcuaccucccuugccu

SEQ ID NO: 1755283 - RNA, 16 nt, Homo sapiens
uucuuacucacacaca

SEQ ID NO: 1755284 - RNA, 14 nt, Homo sapiens
uucacuauguuaca

SEQ ID NO: 1755285 - RNA, 15 nt, Homo sapiens
agccaaauucauccu

SEQ ID NO: 1755286 - RNA, 13 nt, Homo sapiens
cuuaagcaguaau

SEQ ID NO: 1755287 - RNA, 13 nt, Homo sapiens
uuugacucaugaa

SEQ ID NO: 1755288 - RNA, 16 nt, Homo sapiens
aaucucacagcauuug

SEQ ID NO: 1755289 - RNA, 16 nt, Homo sapiens
cugcuggcugcucccc

SEQ ID NO: 1755290 - RNA, 15 nt, Homo sapiens
caucaaguugugcca

SEQ ID NO: 1755291 - RNA, 18 nt, Homo sapiens
ugaaggauuuguguuuua

SEQ ID NO: 1755292 - RNA, 23 nt, Homo sapiens
ugggauacuauuuaauuauuuca

SEQ ID NO: 1755293 - RNA, 17 nt, Homo sapiens
caaccacuaauuuguca

SEQ ID NO: 1755294 - RNA, 17 nt, Homo sapiens
gugccauguucaaaaga

SEQ ID NO: 1755295 - RNA, 22 nt, Homo sapiens
ccuuuuuacagccaacuuuucu

SEQ ID NO: 1755296 - RNA, 11 nt, Homo sapiens
ccuuacagucu

SEQ ID NO: 1755297 - RNA, 22 nt, Homo sapiens
agccuuuccuuuuagugauaaa

SEQ ID NO: 1755298 - RNA, 17 nt, Homo sapiens
agccccagccuaggaaa

SEQ ID NO: 1755299 - RNA, 14 nt, Homo sapiens
caugcccaugauga

SEQ ID NO: 1755300 - RNA, 19 nt, Homo sapiens
cagaaacuccuguucaugc

SEQ ID NO: 1755301 - RNA, 19 nt, Homo sapiens
acccugcugcuggugcaca

SEQ ID NO: 1755302 - RNA, 15 nt, Homo sapiens
cauagcagcugcuac

SEQ ID NO: 1755303 - RNA, 22 nt, Homo sapiens
agugugugugcuugaaugugag

SEQ ID NO: 1755304 - RNA, 21 nt, Homo sapiens
uuaacagaugcaaugugcuac

SEQ ID NO: 1755305 - RNA, 23 nt, Homo sapiens
auugagccuugcauguacuugaa

SEQ ID NO: 1755306 - RNA, 20 nt, Homo sapiens
acaccacagcagagaccacc

SEQ ID NO: 1755307 - RNA, 21 nt, Homo sapiens
agcuguaguagcccuuucugu

SEQ ID NO: 1755308 - RNA, 15 nt, Homo sapiens
ugcugccagcucuca

SEQ ID NO: 1755309 - RNA, 17 nt, Homo sapiens
uaacaugacauuuacca

SEQ ID NO: 1755310 - RNA, 18 nt, Homo sapiens
augucuuuuaagaaacau

SEQ ID NO: 1755311 - RNA, 14 nt, Homo sapiens
caaagcaaaggcag

SEQ ID NO: 1755312 - RNA, 22 nt, Homo sapiens
uaucaaaagccugaaguggaau

SEQ ID NO: 1755313 - RNA, 21 nt, Homo sapiens
caccaucuacaccagugacgc

SEQ ID NO: 1755314 - RNA, 21 nt, Homo sapiens
ugccuuuuaguuccugugcac

SEQ ID NO: 1755315 - RNA, 18 nt, Homo sapiens
ccuuagcaaggggcucag

SEQ ID NO: 1755316 - RNA, 18 nt, Homo sapiens
cucuuagggacagucaaa

SEQ ID NO: 1755317 - RNA, 23 nt, Homo sapiens
gcagagagguggagaacugggau

SEQ ID NO: 1755318 - RNA, 21 nt, Homo sapiens
gcagagccacagcugugcaug

SEQ ID NO: 1755319 - RNA, 17 nt, Homo sapiens
agucuugguaacaaaua

SEQ ID NO: 1755320 - RNA, 13 nt, Homo sapiens
gagaggacuggag

SEQ ID NO: 1755321 - RNA, 17 nt, Homo sapiens
accuugcaaacucuaua

SEQ ID NO: 1755322 - RNA, 20 nt, Homo sapiens
agagaggagggacugucaca

SEQ ID NO: 1755323 - RNA, 18 nt, Homo sapiens
uauuccuucacacaguuc

SEQ ID NO: 1755324 - RNA, 18 nt, Homo sapiens
ccuauagcaucuucucau

SEQ ID NO: 1755325 - RNA, 15 nt, Homo sapiens
uauuauggcaaguga

SEQ ID NO: 1755326 - RNA, 21 nt, Homo sapiens
gaggugggcaugccacccuca

SEQ ID NO: 1755327 - RNA, 15 nt, Homo sapiens
gaagugucacagccu

SEQ ID NO: 1755328 - RNA, 23 nt, Homo sapiens
auguugcuuucuuaucccaguga

SEQ ID NO: 1755329 - RNA, 12 nt, Homo sapiens
ccagugggcaug

SEQ ID NO: 1755330 - RNA, 18 nt, Homo sapiens
acuagccacauacuagca

SEQ ID NO: 1755331 - RNA, 12 nt, Homo sapiens
gcccaccagagc

SEQ ID NO: 1755332 - RNA, 19 nt, Homo sapiens
cagcuccuccaugccugac

SEQ ID NO: 1755333 - RNA, 19 nt, Homo sapiens
aauaguucuaaacuaucaa

SEQ ID NO: 1755334 - RNA, 21 nt, Homo sapiens
gauuuauuuuaauuguugaua

SEQ ID NO: 1755335 - RNA, 16 nt, Homo sapiens
ucacaaauaaaagcca

SEQ ID NO: 1755336 - RNA, 16 nt, Homo sapiens
acguuggugcaagugu

SEQ ID NO: 1755337 - RNA, 16 nt, Homo sapiens
aggaugggggaugugg

SEQ ID NO: 1755338 - RNA, 17 nt, Homo sapiens
uuagaagaaaacauaua

SEQ ID NO: 1755339 - RNA, 21 nt, Homo sapiens
uagccuugggguuggacaucu

SEQ ID NO: 1755340 - RNA, 22 nt, Homo sapiens
cagaggccuugcuguggagcuc

SEQ ID NO: 1755341 - RNA, 20 nt, Homo sapiens
guagcugagacuacagguga

SEQ ID NO: 1755342 - RNA, 20 nt, Homo sapiens
ccagcaccuggcacaccaga

SEQ ID NO: 1755343 - RNA, 22 nt, Homo sapiens
ucuggggcgcggccacagggga

SEQ ID NO: 1755344 - RNA, 15 nt, Homo sapiens
cugcauggauucagc

SEQ ID NO: 1755345 - RNA, 24 nt, Homo sapiens
ugucaaaauuguuuaccauagaaa

SEQ ID NO: 1755346 - RNA, 22 nt, Homo sapiens
ggcguggugggauuugcuccug

SEQ ID NO: 1755347 - RNA, 16 nt, Homo sapiens
auagugcaacaucucu

SEQ ID NO: 1755348 - RNA, 16 nt, Homo sapiens
cugagcugugcccuau

SEQ ID NO: 1755349 - RNA, 19 nt, Homo sapiens
aaggauaugagccuuugca

SEQ ID NO: 1755350 - RNA, 18 nt, Homo sapiens
ggccacggagcaguucag

SEQ ID NO: 1755351 - RNA, 16 nt, Homo sapiens
uuuaaaaaucugccac

SEQ ID NO: 1755352 - RNA, 14 nt, Homo sapiens
ccauuccugggcua

SEQ ID NO: 1755353 - RNA, 21 nt, Homo sapiens
aagaugaaacagggcacccca

SEQ ID NO: 1755354 - RNA, 16 nt, Homo sapiens
auggcauuuggucuca

SEQ ID NO: 1755355 - RNA, 16 nt, Homo sapiens
aggcuaucaacauguu

SEQ ID NO: 1755356 - RNA, 18 nt, Homo sapiens
gggacugagcccaugaca

SEQ ID NO: 1755357 - RNA, 19 nt, Homo sapiens
ggaaaaauaaaaugcaaau

SEQ ID NO: 1755358 - RNA, 20 nt, Homo sapiens
gagugcaguggcacgaucuc

SEQ ID NO: 1755359 - RNA, 14 nt, Homo sapiens
gaaagaaaucagcu

SEQ ID NO: 1755360 - RNA, 23 nt, Homo sapiens
ucagauuguggaauguuggauaa

SEQ ID NO: 1755361 - RNA, 15 nt, Homo sapiens
ccccugaacugcugu

SEQ ID NO: 1755362 - RNA, 17 nt, Homo sapiens
acucaaacgaugugcaa

SEQ ID NO: 1755363 - RNA, 17 nt, Homo sapiens
agauguuguguggcaau

SEQ ID NO: 1755364 - RNA, 18 nt, Homo sapiens
cacaguucuccauuucac

SEQ ID NO: 1755365 - RNA, 17 nt, Homo sapiens
agugcuucauugacuaa

SEQ ID NO: 1755366 - RNA, 14 nt, Homo sapiens
caucauuucaaucg

SEQ ID NO: 1755367 - RNA, 18 nt, Homo sapiens
caaaggcugucauuucau

SEQ ID NO: 1755368 - RNA, 16 nt, Homo sapiens
accuguaauaaauaug

SEQ ID NO: 1755369 - RNA, 21 nt, Homo sapiens
gauagaacaggcugguucuga

SEQ ID NO: 1755370 - RNA, 17 nt, Homo sapiens
aggucuccaaaccagac

SEQ ID NO: 1755371 - RNA, 11 nt, Homo sapiens
cuuacuccauc

SEQ ID NO: 1755372 - RNA, 13 nt, Homo sapiens
ccuaaacuuucca

SEQ ID NO: 1755373 - RNA, 11 nt, Homo sapiens
ugaacuuuguc

SEQ ID NO: 1755374 - RNA, 13 nt, Homo sapiens
gagaggggggcca

SEQ ID NO: 1755375 - RNA, 14 nt, Homo sapiens
ucccugcuugcaca

SEQ ID NO: 1755376 - RNA, 18 nt, Homo sapiens
cguaccucuucccaugac

SEQ ID NO: 1755377 - RNA, 19 nt, Homo sapiens
aaaccuguucuaccaauua

SEQ ID NO: 1755378 - RNA, 16 nt, Homo sapiens
augaaaaugaauagcu

SEQ ID NO: 1755379 - RNA, 20 nt, Homo sapiens
ggaaagccauugaccaccca

SEQ ID NO: 1755380 - RNA, 21 nt, Homo sapiens
uuugaauaagcagaacauacu

SEQ ID NO: 1755381 - RNA, 13 nt, Homo sapiens
aggucuuuggucu

SEQ ID NO: 1755382 - RNA, 19 nt, Homo sapiens
caaaguccucugcuccagc

SEQ ID NO: 1755383 - RNA, 15 nt, Homo sapiens
cuucauguccaguga

SEQ ID NO: 1755384 - RNA, 22 nt, Homo sapiens
uccacuccugaccccucuccuc

SEQ ID NO: 1755385 - RNA, 22 nt, Homo sapiens
cccacuguccuuucuccaggcc

SEQ ID NO: 1755386 - RNA, 20 nt, Homo sapiens
aacuugcugugucugaggua

SEQ ID NO: 1755387 - RNA, 16 nt, Homo sapiens
ggguacuacugcugca

SEQ ID NO: 1755388 - RNA, 16 nt, Homo sapiens
cuuuauuaaguagaug

SEQ ID NO: 1755389 - RNA, 22 nt, Homo sapiens
cuuguugacacggccaugacca

SEQ ID NO: 1755390 - RNA, 22 nt, Homo sapiens
aguugcuuuaaaguaccuguag

SEQ ID NO: 1755391 - RNA, 13 nt, Homo sapiens
agucgaugaacua

SEQ ID NO: 1755392 - RNA, 18 nt, Homo sapiens
cuuaucuccaagaccaga

SEQ ID NO: 1755393 - RNA, 21 nt, Homo sapiens
agccuuggcugccuuggugca

SEQ ID NO: 1755394 - RNA, 23 nt, Homo sapiens
uuuuccuuuuaacaauaugcacu

SEQ ID NO: 1755395 - RNA, 23 nt, Homo sapiens
aaaggugugccuggcagccauuu

SEQ ID NO: 1755396 - RNA, 14 nt, Homo sapiens
agcucugucaccca

SEQ ID NO: 1755397 - RNA, 16 nt, Homo sapiens
uuggugcugcuuucuu

SEQ ID NO: 1755398 - RNA, 22 nt, Homo sapiens
aggugacuuguuuacucauuga

SEQ ID NO: 1755399 - RNA, 18 nt, Homo sapiens
aguucaagcccaggacca

SEQ ID NO: 1755400 - RNA, 22 nt, Homo sapiens
ucaaaagaaauuuaaguucuau

SEQ ID NO: 1755401 - RNA, 23 nt, Homo sapiens
ggacacccgacuccaguccaagu

SEQ ID NO: 1755402 - RNA, 15 nt, Homo sapiens
uucaaguacuguaac

SEQ ID NO: 1755403 - RNA, 19 nt, Homo sapiens
cauacaauguauguacaau

SEQ ID NO: 1755404 - RNA, 19 nt, Homo sapiens
aggguaggggaagugugcu

SEQ ID NO: 1755405 - RNA, 20 nt, Homo sapiens
ucaugguuacaaacuacaga

SEQ ID NO: 1755406 - RNA, 21 nt, Homo sapiens
gguaucagcaucuguccucau

SEQ ID NO: 1755407 - RNA, 22 nt, Homo sapiens
cuuuuccugaauuggaaaggaa

SEQ ID NO: 1755408 - RNA, 19 nt, Homo sapiens
aaugaguuagaacuauuaa

SEQ ID NO: 1755409 - RNA, 22 nt, Homo sapiens
uuuggaaaucacacgucuggcu

SEQ ID NO: 1755410 - RNA, 15 nt, Homo sapiens
augcaaaguagcaau

SEQ ID NO: 1755411 - RNA, 21 nt, Homo sapiens
ccauuugcuggacaaccaaca

SEQ ID NO: 1755412 - RNA, 12 nt, Homo sapiens
aaauuuuacuuu

SEQ ID NO: 1755413 - RNA, 19 nt, Homo sapiens
uugacaccaaccagacagc

SEQ ID NO: 1755414 - RNA, 18 nt, Homo sapiens
uucauauuuuaaacagag

SEQ ID NO: 1755415 - RNA, 22 nt, Homo sapiens
auccaucaggguuugcaaagua

SEQ ID NO: 1755416 - RNA, 17 nt, Homo sapiens
cuuagaggagugaaaug

SEQ ID NO: 1755417 - RNA, 18 nt, Homo sapiens
agaggcugacuuuuccaa

SEQ ID NO: 1755418 - RNA, 24 nt, Homo sapiens
ccccucucugggcuagaguuuccu

SEQ ID NO: 1755419 - RNA, 19 nt, Homo sapiens
uauguggguuuuacacuaa

SEQ ID NO: 1755420 - RNA, 19 nt, Homo sapiens
gaacacagaacugaucuca

SEQ ID NO: 1755421 - RNA, 22 nt, Homo sapiens
acauguguucucuauuuugccu

SEQ ID NO: 1755422 - RNA, 19 nt, Homo sapiens
cucagauccugggcaugau

SEQ ID NO: 1755423 - RNA, 14 nt, Homo sapiens
gaagagaaaugcaa

SEQ ID NO: 1755424 - RNA, 16 nt, Homo sapiens
agaaugaaauguaugu

SEQ ID NO: 1755425 - RNA, 16 nt, Homo sapiens
uguccucuugcucaaa

SEQ ID NO: 1755426 - RNA, 20 nt, Homo sapiens
aaacaggcugauaccuuugu

SEQ ID NO: 1755427 - RNA, 17 nt, Homo sapiens
agccaagucagcuuugc

SEQ ID NO: 1755428 - RNA, 21 nt, Homo sapiens
ccuccaccccaguccccggga

SEQ ID NO: 1755429 - RNA, 17 nt, Homo sapiens
aaauuuuuacaucaaaa

SEQ ID NO: 1755430 - RNA, 17 nt, Homo sapiens
auauucgguaauaucau

SEQ ID NO: 1755431 - RNA, 14 nt, Homo sapiens
cauugcucacacua

SEQ ID NO: 1755432 - RNA, 13 nt, Homo sapiens
cagugugaaguua

SEQ ID NO: 1755433 - RNA, 15 nt, Homo sapiens
auccuucuacuuguc

SEQ ID NO: 1755434 - RNA, 19 nt, Homo sapiens
auucuagagggauccaccg

SEQ ID NO: 1755435 - RNA, 15 nt, Homo sapiens
auccugggggaccaa

SEQ ID NO: 1755436 - RNA, 23 nt, Homo sapiens
aagcagcagcuuguugguuguca

SEQ ID NO: 1755437 - RNA, 23 nt, Homo sapiens
cugccaucauguuuacagaggac

SEQ ID NO: 1755438 - RNA, 16 nt, Homo sapiens
gaugaaccugacaaaa

SEQ ID NO: 1755439 - RNA, 16 nt, Homo sapiens
ugucuucauguugaug

SEQ ID NO: 1755440 - RNA, 19 nt, Homo sapiens
aaauaauauggcuaugcuu

SEQ ID NO: 1755441 - RNA, 18 nt, Homo sapiens
uuuccugaucacuaugca

SEQ ID NO: 1755442 - RNA, 18 nt, Homo sapiens
guaaccuagugaauuucu

SEQ ID NO: 1755443 - RNA, 15 nt, Homo sapiens
uuggagccugcaaua

SEQ ID NO: 1755444 - RNA, 19 nt, Homo sapiens
agaucucuuuguagccauc

SEQ ID NO: 1755445 - RNA, 21 nt, Homo sapiens
cauccgguggccuauuccagg

SEQ ID NO: 1755446 - RNA, 20 nt, Homo sapiens
agugaaaaucuacacuccag

SEQ ID NO: 1755447 - RNA, 21 nt, Homo sapiens
uggagauaggggaaaucacau

SEQ ID NO: 1755448 - RNA, 19 nt, Homo sapiens
caguacaauaaauaaaaga

SEQ ID NO: 1755449 - RNA, 19 nt, Homo sapiens
acacacacguuauaaucau

SEQ ID NO: 1755450 - RNA, 23 nt, Homo sapiens
aacguuaucucauugcaaaaaua

SEQ ID NO: 1755451 - RNA, 12 nt, Homo sapiens
caugauggugaa

SEQ ID NO: 1755452 - RNA, 19 nt, Homo sapiens
cuuauuuguauaauggugu

SEQ ID NO: 1755453 - RNA, 15 nt, Homo sapiens
uacauauauauguca

SEQ ID NO: 1755454 - RNA, 19 nt, Homo sapiens
caccguccacguccacaag

SEQ ID NO: 1755455 - RNA, 13 nt, Homo sapiens
augugcccuccug

SEQ ID NO: 1755456 - RNA, 21 nt, Homo sapiens
acagguuuuaaggauucugca

SEQ ID NO: 1755457 - RNA, 21 nt, Homo sapiens
ucacaguaacccaaaccucaa

SEQ ID NO: 1755458 - RNA, 13 nt, Homo sapiens
cccucccaacaga

SEQ ID NO: 1755459 - RNA, 20 nt, Homo sapiens
cuggccaagggccagacaga

SEQ ID NO: 1755460 - RNA, 15 nt, Homo sapiens
ccaugccaaccagcu

SEQ ID NO: 1755461 - RNA, 15 nt, Homo sapiens
uaacauuuaaauucc

SEQ ID NO: 1755462 - RNA, 22 nt, Homo sapiens
cccuaggaaggugaaucugccc

SEQ ID NO: 1755463 - RNA, 18 nt, Homo sapiens
cugagcuguaucuugaug

SEQ ID NO: 1755464 - RNA, 15 nt, Homo sapiens
agcccugugaggcug

SEQ ID NO: 1755465 - RNA, 20 nt, Homo sapiens
caugucuuuauuaguaacau

SEQ ID NO: 1755466 - RNA, 16 nt, Homo sapiens
aaagaaguucauuccu

SEQ ID NO: 1755467 - RNA, 17 nt, Homo sapiens
aacugugaagcauuuac

SEQ ID NO: 1755468 - RNA, 16 nt, Homo sapiens
acaggcacaugcacca

SEQ ID NO: 1755469 - RNA, 15 nt, Homo sapiens
aguuggagugcuugu

SEQ ID NO: 1755470 - RNA, 23 nt, Homo sapiens
caacuuuaauugcuuaaaagaca

SEQ ID NO: 1755471 - RNA, 15 nt, Homo sapiens
uugaccucagcugca

SEQ ID NO: 1755472 - RNA, 19 nt, Homo sapiens
ucccucagugaaguagcaa

SEQ ID NO: 1755473 - RNA, 13 nt, Homo sapiens
aaacaucuggaag

SEQ ID NO: 1755474 - RNA, 20 nt, Homo sapiens
gcccaggaucagauugcaug

SEQ ID NO: 1755475 - RNA, 16 nt, Homo sapiens
acccugccccuugcca

SEQ ID NO: 1755476 - RNA, 14 nt, Homo sapiens
cuuucaaagaaauc

SEQ ID NO: 1755477 - RNA, 15 nt, Homo sapiens
cuauaucuauuugag

SEQ ID NO: 1755478 - RNA, 15 nt, Homo sapiens
cuuugaaguggcacc

SEQ ID NO: 1755479 - RNA, 20 nt, Homo sapiens
caagauugugucccauuccc

SEQ ID NO: 1755480 - RNA, 16 nt, Homo sapiens
gcguacucagcacagc

SEQ ID NO: 1755481 - RNA, 15 nt, Homo sapiens
gaggacucacuugcc

SEQ ID NO: 1755482 - RNA, 21 nt, Homo sapiens
gagaacaccgagcacugaacu

SEQ ID NO: 1755483 - RNA, 14 nt, Homo sapiens
cuaucuacuacaaa

SEQ ID NO: 1755484 - RNA, 22 nt, Homo sapiens
ggcagcaccgcagccucugccc

SEQ ID NO: 1755485 - RNA, 20 nt, Homo sapiens
gacacuaggaugaauuaucu

SEQ ID NO: 1755486 - RNA, 15 nt, Homo sapiens
cagcuggugucacuc

SEQ ID NO: 1755487 - RNA, 15 nt, Homo sapiens
gcccacuucacugcu

SEQ ID NO: 1755488 - RNA, 16 nt, Homo sapiens
uucccggccauucucc

SEQ ID NO: 1755489 - RNA, 17 nt, Homo sapiens
caugaaaggaagaguua

SEQ ID NO: 1755490 - RNA, 18 nt, Homo sapiens
caccccacccucccugga

SEQ ID NO: 1755491 - RNA, 21 nt, Homo sapiens
cuuugguuucucaacuucucu

SEQ ID NO: 1755492 - RNA, 16 nt, Homo sapiens
uacauacacuguaugu

SEQ ID NO: 1755493 - RNA, 14 nt, Homo sapiens
cgaugcugaccuca

SEQ ID NO: 1755494 - RNA, 14 nt, Homo sapiens
uaauaaagcuuuau

SEQ ID NO: 1755495 - RNA, 21 nt, Homo sapiens
uguugcaaaucacucugcaau

SEQ ID NO: 1755496 - RNA, 17 nt, Homo sapiens
acuguaacugacugccu

SEQ ID NO: 1755497 - RNA, 17 nt, Homo sapiens
auacauuuuacauaugg

SEQ ID NO: 1755498 - RNA, 16 nt, Homo sapiens
ggaagaugugugauaa

SEQ ID NO: 1755499 - RNA, 19 nt, Homo sapiens
uuaaaacaaaacaaaacaa

SEQ ID NO: 1755500 - RNA, 18 nt, Homo sapiens
uccaguuagcaacaaauc

SEQ ID NO: 1755501 - RNA, 21 nt, Homo sapiens
accgagguucccacucugggc

SEQ ID NO: 1755502 - RNA, 13 nt, Homo sapiens
uugagagacacug

SEQ ID NO: 1755503 - RNA, 23 nt, Homo sapiens
ucugcaagugaggugugucacaa

SEQ ID NO: 1755504 - RNA, 22 nt, Homo sapiens
cauacauucccucuaauuugaa

SEQ ID NO: 1755505 - RNA, 17 nt, Homo sapiens
caaacauccucuuccau

SEQ ID NO: 1755506 - RNA, 24 nt, Homo sapiens
ucccagauccucugcugacuccau

SEQ ID NO: 1755507 - RNA, 18 nt, Homo sapiens
gagugaauacuuugauga

SEQ ID NO: 1755508 - RNA, 18 nt, Homo sapiens
agaaaguaaaaaguugcu

SEQ ID NO: 1755509 - RNA, 11 nt, Homo sapiens
aauccagcucc

SEQ ID NO: 1755510 - RNA, 22 nt, Homo sapiens
ccaaaggaauuugcauccagca

SEQ ID NO: 1755511 - RNA, 16 nt, Homo sapiens
aucuucgggaccagga

SEQ ID NO: 1755512 - RNA, 15 nt, Homo sapiens
uggucaaaaagcucc

SEQ ID NO: 1755513 - RNA, 13 nt, Homo sapiens
gcauucucuaguc

SEQ ID NO: 1755514 - RNA, 15 nt, Homo sapiens
cccauaaccauacac

SEQ ID NO: 1755515 - RNA, 14 nt, Homo sapiens
aauugagucuucca

SEQ ID NO: 1755516 - RNA, 23 nt, Homo sapiens
auuuugaguaaauauuuguuacu

SEQ ID NO: 1755517 - RNA, 20 nt, Homo sapiens
uuaauuuuuuuaaguuccca

SEQ ID NO: 1755518 - RNA, 15 nt, Homo sapiens
aaagucaaggacuaa

SEQ ID NO: 1755519 - RNA, 15 nt, Homo sapiens
aaaaucuuauaauuu

SEQ ID NO: 1755520 - RNA, 22 nt, Homo sapiens
agguaguaggaagaauuacaau

SEQ ID NO: 1755521 - RNA, 16 nt, Homo sapiens
caagccugugcaaaaa

SEQ ID NO: 1755522 - RNA, 17 nt, Homo sapiens
auuuaucuuuaccaaaa

SEQ ID NO: 1755523 - RNA, 18 nt, Homo sapiens
ugcucauguauauuuagu

SEQ ID NO: 1755524 - RNA, 23 nt, Homo sapiens
acagagucuggcucugucaccca

SEQ ID NO: 1755525 - RNA, 17 nt, Homo sapiens
acaucuuuacucaggca

SEQ ID NO: 1755526 - RNA, 19 nt, Homo sapiens
gauggcuuuaccuuuauua

SEQ ID NO: 1755527 - RNA, 21 nt, Homo sapiens
aggaucaaaguugaugaaaua

SEQ ID NO: 1755528 - RNA, 18 nt, Homo sapiens
auuuucagauuugcacaa

SEQ ID NO: 1755529 - RNA, 21 nt, Homo sapiens
uaauauuugucugugugcuac

SEQ ID NO: 1755530 - RNA, 12 nt, Homo sapiens
agcgcucgccac

SEQ ID NO: 1755531 - RNA, 22 nt, Homo sapiens
ugaagaccuggacuauugaaug

SEQ ID NO: 1755532 - RNA, 18 nt, Homo sapiens
uuaugagaaaguucucau

SEQ ID NO: 1755533 - RNA, 14 nt, Homo sapiens
ugcuagugugaauu

SEQ ID NO: 1755534 - RNA, 22 nt, Homo sapiens
uguuuaaaauaaaaguaccuau

SEQ ID NO: 1755535 - RNA, 18 nt, Homo sapiens
guccacacccaauuccac

SEQ ID NO: 1755536 - RNA, 20 nt, Homo sapiens
uggcccuaccagacacugcu

SEQ ID NO: 1755537 - RNA, 19 nt, Homo sapiens
auuucaggagaaccuaaca

SEQ ID NO: 1755538 - RNA, 20 nt, Homo sapiens
acugcuguagacauuugcua

SEQ ID NO: 1755539 - RNA, 20 nt, Homo sapiens
uugcccgaaacuaagccagg

SEQ ID NO: 1755540 - RNA, 13 nt, Homo sapiens
uaguagugucuuc

SEQ ID NO: 1755541 - RNA, 23 nt, Homo sapiens
gagacagauauacugggagaaau

SEQ ID NO: 1755542 - RNA, 15 nt, Homo sapiens
auaauggggaauuaa

SEQ ID NO: 1755543 - RNA, 19 nt, Homo sapiens
aaaguuauuucauaccauu

SEQ ID NO: 1755544 - RNA, 13 nt, Homo sapiens
gaaagcuuugaac

SEQ ID NO: 1755545 - RNA, 13 nt, Homo sapiens
uacagcuuggcac

SEQ ID NO: 1755546 - RNA, 17 nt, Homo sapiens
aacuauaacaaucacug

SEQ ID NO: 1755547 - RNA, 16 nt, Homo sapiens
uuauccuagucauucu

SEQ ID NO: 1755548 - RNA, 17 nt, Homo sapiens
uaaaaauacacaugaaa

SEQ ID NO: 1755549 - RNA, 22 nt, Homo sapiens
cacauuacaugaaaguucagau

SEQ ID NO: 1755550 - RNA, 16 nt, Homo sapiens
ugucuguacuaaaaau

SEQ ID NO: 1755551 - RNA, 14 nt, Homo sapiens
auguguaucucaca

SEQ ID NO: 1755552 - RNA, 20 nt, Homo sapiens
aggcccaccccugaggacac

SEQ ID NO: 1755553 - RNA, 13 nt, Homo sapiens
aaugacagccuuu

SEQ ID NO: 1755554 - RNA, 15 nt, Homo sapiens
caggcuuuuuuccag

SEQ ID NO: 1755555 - RNA, 23 nt, Homo sapiens
caaugcaucacguaccccacugg

SEQ ID NO: 1755556 - RNA, 22 nt, Homo sapiens
aggcccagaaagaggcagugau

SEQ ID NO: 1755557 - RNA, 15 nt, Homo sapiens
guuucauaccaaaua

SEQ ID NO: 1755558 - RNA, 16 nt, Homo sapiens
ggagaugggugcaacu

SEQ ID NO: 1755559 - RNA, 19 nt, Homo sapiens
acacauuuuccauauuugg

SEQ ID NO: 1755560 - RNA, 17 nt, Homo sapiens
ucuccuguucucucugu

SEQ ID NO: 1755561 - RNA, 13 nt, Homo sapiens
aucccucucugcu

SEQ ID NO: 1755562 - RNA, 16 nt, Homo sapiens
aguggcgugaucucag

SEQ ID NO: 1755563 - RNA, 14 nt, Homo sapiens
agaaaggcaaagua

SEQ ID NO: 1755564 - RNA, 17 nt, Homo sapiens
gucucaguggcuucauc

SEQ ID NO: 1755565 - RNA, 14 nt, Homo sapiens
guguccucuccagc

SEQ ID NO: 1755566 - RNA, 24 nt, Homo sapiens
caguaaguagcaacccugugauac

SEQ ID NO: 1755567 - RNA, 19 nt, Homo sapiens
uuucucuaguguauuauca

SEQ ID NO: 1755568 - RNA, 22 nt, Homo sapiens
agcuuugugcuugucauuccag

SEQ ID NO: 1755569 - RNA, 22 nt, Homo sapiens
cucauguauauuuuauaugaaa

SEQ ID NO: 1755570 - RNA, 22 nt, Homo sapiens
gacacgugcaacagacugccuu

SEQ ID NO: 1755571 - RNA, 15 nt, Homo sapiens
uaaaccaugugacua

SEQ ID NO: 1755572 - RNA, 19 nt, Homo sapiens
aucacaacauuuacuuaac

SEQ ID NO: 1755573 - RNA, 15 nt, Homo sapiens
acaggagcguguccu

SEQ ID NO: 1755574 - RNA, 20 nt, Homo sapiens
uucuagucucucuggggcca

SEQ ID NO: 1755575 - RNA, 19 nt, Homo sapiens
ggacgacuguuuucccaac

SEQ ID NO: 1755576 - RNA, 19 nt, Homo sapiens
agcacauuauguuugcaac

SEQ ID NO: 1755577 - RNA, 11 nt, Homo sapiens
gcaaccccagg

SEQ ID NO: 1755578 - RNA, 15 nt, Homo sapiens
ugacaugcacugacc

SEQ ID NO: 1755579 - RNA, 17 nt, Homo sapiens
aacaugggcaaagggag

SEQ ID NO: 1755580 - RNA, 15 nt, Homo sapiens
cacauuuucaaguga

SEQ ID NO: 1755581 - RNA, 20 nt, Homo sapiens
gaggcagcuguugcagugag

SEQ ID NO: 1755582 - RNA, 16 nt, Homo sapiens
cauguguaccuacaga

SEQ ID NO: 1755583 - RNA, 13 nt, Homo sapiens
gagcaagcauugg

SEQ ID NO: 1755584 - RNA, 17 nt, Homo sapiens
aagugcucuaacuuuuc

SEQ ID NO: 1755585 - RNA, 20 nt, Homo sapiens
gcugaauugggagugagaug

SEQ ID NO: 1755586 - RNA, 23 nt, Homo sapiens
caauguuuuaaggucuaucuuaa

SEQ ID NO: 1755587 - RNA, 18 nt, Homo sapiens
caaugggaggcagggaca

SEQ ID NO: 1755588 - RNA, 15 nt, Homo sapiens
uguaacuugugcuuu

SEQ ID NO: 1755589 - RNA, 16 nt, Homo sapiens
uccugaccugagccag

SEQ ID NO: 1755590 - RNA, 19 nt, Homo sapiens
gggcaaguggagccaccuc

SEQ ID NO: 1755591 - RNA, 20 nt, Homo sapiens
uguggcccaucuuacuggaa

SEQ ID NO: 1755592 - RNA, 17 nt, Homo sapiens
ucugaugcagaacuuuc

SEQ ID NO: 1755593 - RNA, 21 nt, Homo sapiens
cauguuugucugugugcugua

SEQ ID NO: 1755594 - RNA, 19 nt, Homo sapiens
acccaggcccgcaccgcug

SEQ ID NO: 1755595 - RNA, 16 nt, Homo sapiens
caaguguucacaaccu

SEQ ID NO: 1755596 - RNA, 19 nt, Homo sapiens
aguccagccuagucuggac

SEQ ID NO: 1755597 - RNA, 23 nt, Homo sapiens
cacacauacacacacacaagcuu

SEQ ID NO: 1755598 - RNA, 19 nt, Homo sapiens
auguuuccugcucuucccu

SEQ ID NO: 1755599 - RNA, 20 nt, Homo sapiens
cacuggggggcucucaggga

SEQ ID NO: 1755600 - RNA, 20 nt, Homo sapiens
ugcucucuguucucuugcuu

SEQ ID NO: 1755601 - RNA, 17 nt, Homo sapiens
aagauuaggcacacaga

SEQ ID NO: 1755602 - RNA, 11 nt, Homo sapiens
uggaugccuug

SEQ ID NO: 1755603 - RNA, 12 nt, Homo sapiens
ccucucugcucu

SEQ ID NO: 1755604 - RNA, 12 nt, Homo sapiens
gucuucuggcuc

SEQ ID NO: 1755605 - RNA, 12 nt, Homo sapiens
ccuuucugcucc

SEQ ID NO: 1755606 - RNA, 14 nt, Homo sapiens
caaagagguauuua

SEQ ID NO: 1755607 - RNA, 22 nt, Homo sapiens
ugaagaggcugcuucucuacag

SEQ ID NO: 1755608 - RNA, 13 nt, Homo sapiens
aagccccagugag

SEQ ID NO: 1755609 - RNA, 20 nt, Homo sapiens
ggcuccugaagggugcucag

SEQ ID NO: 1755610 - RNA, 20 nt, Homo sapiens
agccuuugccuccaccauuc

SEQ ID NO: 1755611 - RNA, 14 nt, Homo sapiens
augguaucaaugga

SEQ ID NO: 1755612 - RNA, 20 nt, Homo sapiens
cacaagaacaauucaagaaa

SEQ ID NO: 1755613 - RNA, 20 nt, Homo sapiens
gggcagcaaaacgacacugc

SEQ ID NO: 1755614 - RNA, 22 nt, Homo sapiens
cuccugagacacaugggugcua

SEQ ID NO: 1755615 - RNA, 15 nt, Homo sapiens
acaaacacauuauaa

SEQ ID NO: 1755616 - RNA, 21 nt, Homo sapiens
acucaaaugcucagaccagcu

SEQ ID NO: 1755617 - RNA, 22 nt, Homo sapiens
agaccguuauaaagugugccac

SEQ ID NO: 1755618 - RNA, 15 nt, Homo sapiens
cugugugaacgugua

SEQ ID NO: 1755619 - RNA, 16 nt, Homo sapiens
gaugccauaugccuug

SEQ ID NO: 1755620 - RNA, 19 nt, Homo sapiens
ugggauggccgcugcucag

SEQ ID NO: 1755621 - RNA, 19 nt, Homo sapiens
uaauauuuuuaacaaguca

SEQ ID NO: 1755622 - RNA, 17 nt, Homo sapiens
gucccaaugguccugac

SEQ ID NO: 1755623 - RNA, 22 nt, Homo sapiens
uuaggauaaagaauauuuacaa

SEQ ID NO: 1755624 - RNA, 15 nt, Homo sapiens
augggccugccaaac

SEQ ID NO: 1755625 - RNA, 19 nt, Homo sapiens
agccggacacuucucagga

SEQ ID NO: 1755626 - RNA, 13 nt, Homo sapiens
gcugccucaugac

SEQ ID NO: 1755627 - RNA, 13 nt, Homo sapiens
gaaaugcaaccaa

SEQ ID NO: 1755628 - RNA, 12 nt, Homo sapiens
auccacauggga

SEQ ID NO: 1755629 - RNA, 11 nt, Homo sapiens
uuaaaaaccac

SEQ ID NO: 1755630 - RNA, 14 nt, Homo sapiens
aaggcauuccucau

SEQ ID NO: 1755631 - RNA, 13 nt, Homo sapiens
cacgugcacacac

SEQ ID NO: 1755632 - RNA, 13 nt, Homo sapiens
caggugcacagac

SEQ ID NO: 1755633 - RNA, 22 nt, Homo sapiens
ucacauuucaccccaggcucaa

SEQ ID NO: 1755634 - RNA, 19 nt, Homo sapiens
acacauaauggcagcucac

SEQ ID NO: 1755635 - RNA, 19 nt, Homo sapiens
auacaggccucaaggggaa

SEQ ID NO: 1755636 - RNA, 18 nt, Homo sapiens
auagcaugguuccaauuu

SEQ ID NO: 1755637 - RNA, 18 nt, Homo sapiens
ggguccugaagugaccuc

SEQ ID NO: 1755638 - RNA, 15 nt, Homo sapiens
caauuucagacuccc

SEQ ID NO: 1755639 - RNA, 17 nt, Homo sapiens
gacugugcaauacuuag

SEQ ID NO: 1755640 - RNA, 18 nt, Homo sapiens
cugagcgggagucaggga

SEQ ID NO: 1755641 - RNA, 15 nt, Homo sapiens
ggauuuuaguugucc

SEQ ID NO: 1755642 - RNA, 16 nt, Homo sapiens
auucuuuucacuuccu

SEQ ID NO: 1755643 - RNA, 17 nt, Homo sapiens
gacuauuucacuaauaa

SEQ ID NO: 1755644 - RNA, 22 nt, Homo sapiens
agccucuuuccuaacuuccuuu

SEQ ID NO: 1755645 - RNA, 20 nt, Homo sapiens
acuauugagccuugcaugua

SEQ ID NO: 1755646 - RNA, 22 nt, Homo sapiens
ucuuccacuggcuccacaucca

SEQ ID NO: 1755647 - RNA, 21 nt, Homo sapiens
aaggaauguuaucaguauuaa

SEQ ID NO: 1755648 - RNA, 13 nt, Homo sapiens
gcuaugcuauuga

SEQ ID NO: 1755649 - RNA, 12 nt, Homo sapiens
gcauugcucagc

SEQ ID NO: 1755650 - RNA, 13 nt, Homo sapiens
ucccuaaguccaa

SEQ ID NO: 1755651 - RNA, 12 nt, Homo sapiens
caugcaacucca

SEQ ID NO: 1755652 - RNA, 14 nt, Homo sapiens
gcauagcacuugca

SEQ ID NO: 1755653 - RNA, 17 nt, Homo sapiens
agaaacuuccuuugaga

SEQ ID NO: 1755654 - RNA, 21 nt, Homo sapiens
cuaaggaugucacagggccaa

SEQ ID NO: 1755655 - RNA, 16 nt, Homo sapiens
aaaucuauagaacuga

SEQ ID NO: 1755656 - RNA, 19 nt, Homo sapiens
cucaauaaaugauucuuag

SEQ ID NO: 1755657 - RNA, 18 nt, Homo sapiens
agauguuuggaaaccaca

SEQ ID NO: 1755658 - RNA, 19 nt, Homo sapiens
ugccaucuauaggggccaa

SEQ ID NO: 1755659 - RNA, 14 nt, Homo sapiens
ugcuuccuccucag

SEQ ID NO: 1755660 - RNA, 14 nt, Homo sapiens
uggcacucucugcc

SEQ ID NO: 1755661 - RNA, 17 nt, Homo sapiens
uggaauccuacagccuc

SEQ ID NO: 1755662 - RNA, 21 nt, Homo sapiens
agccaucggaagagagggcug

SEQ ID NO: 1755663 - RNA, 23 nt, Homo sapiens
gcaucugugccagagauguacug

SEQ ID NO: 1755664 - RNA, 24 nt, Homo sapiens
aagugacuucuggagaaagcucau

SEQ ID NO: 1755665 - RNA, 15 nt, Homo sapiens
ucauguucaugugau

SEQ ID NO: 1755666 - RNA, 18 nt, Homo sapiens
cacugauggaaaauacca

SEQ ID NO: 1755667 - RNA, 22 nt, Homo sapiens
gauuauuagccagguaauguga

SEQ ID NO: 1755668 - RNA, 23 nt, Homo sapiens
uugcccagcaaggaccagugaga

SEQ ID NO: 1755669 - RNA, 21 nt, Homo sapiens
guucaaaagaacaucaacgug

SEQ ID NO: 1755670 - RNA, 12 nt, Homo sapiens
cagguaauacaa

SEQ ID NO: 1755671 - RNA, 14 nt, Homo sapiens
ugggccauguccaa

SEQ ID NO: 1755672 - RNA, 17 nt, Homo sapiens
acacagcaacauccaga

SEQ ID NO: 1755673 - RNA, 12 nt, Homo sapiens
auaccuugccug

SEQ ID NO: 1755674 - RNA, 23 nt, Homo sapiens
accccaggcccacucagggguca

SEQ ID NO: 1755675 - RNA, 19 nt, Homo sapiens
guuaguuuuuaaucucucc

SEQ ID NO: 1755676 - RNA, 23 nt, Homo sapiens
gggacagaggauuucugcuuagg

SEQ ID NO: 1755677 - RNA, 18 nt, Homo sapiens
gcuaagaaagcaagccaa

SEQ ID NO: 1755678 - RNA, 18 nt, Homo sapiens
augcaauggcucaucaga

SEQ ID NO: 1755679 - RNA, 21 nt, Homo sapiens
ucagaauauugucugccuuaa

SEQ ID NO: 1755680 - RNA, 16 nt, Homo sapiens
aaucuauucugcuaag

SEQ ID NO: 1755681 - RNA, 23 nt, Homo sapiens
gcagcaucccuagucucuaccca

SEQ ID NO: 1755682 - RNA, 15 nt, Homo sapiens
aaagaacuagcauaa

SEQ ID NO: 1755683 - RNA, 22 nt, Homo sapiens
aaaggacaggccacaccacagc

SEQ ID NO: 1755684 - RNA, 19 nt, Homo sapiens
gaugaaccugacaaaaaca

SEQ ID NO: 1755685 - RNA, 21 nt, Homo sapiens
caggaaagaucccaagucaaa

SEQ ID NO: 1755686 - RNA, 21 nt, Homo sapiens
uuuggauaucaaaagcaaaua

SEQ ID NO: 1755687 - RNA, 15 nt, Homo sapiens
ugggggaggcucuga

SEQ ID NO: 1755688 - RNA, 18 nt, Homo sapiens
ggguggcacucucaggug

SEQ ID NO: 1755689 - RNA, 13 nt, Homo sapiens
augcaucacuggg

SEQ ID NO: 1755690 - RNA, 23 nt, Homo sapiens
uuaacuuccaaggugguuuuacu

SEQ ID NO: 1755691 - RNA, 14 nt, Homo sapiens
gcgaucucagcuca

SEQ ID NO: 1755692 - RNA, 20 nt, Homo sapiens
auggcaacaaacacauugug

SEQ ID NO: 1755693 - RNA, 23 nt, Homo sapiens
acugccaggauuuuguauugcca

SEQ ID NO: 1755694 - RNA, 16 nt, Homo sapiens
ugaaguccuccagaca

SEQ ID NO: 1755695 - RNA, 15 nt, Homo sapiens
ugccacuuugcacau

SEQ ID NO: 1755696 - RNA, 15 nt, Homo sapiens
uaccccuuuacaaau

SEQ ID NO: 1755697 - RNA, 16 nt, Homo sapiens
uacaaauuuuuccugc

SEQ ID NO: 1755698 - RNA, 13 nt, Homo sapiens
auucucuaauaaa

SEQ ID NO: 1755699 - RNA, 13 nt, Homo sapiens
caucucuacaaaa

SEQ ID NO: 1755700 - RNA, 16 nt, Homo sapiens
gaaucugauaccaaag

SEQ ID NO: 1755701 - RNA, 14 nt, Homo sapiens
aaagcaauccaugu

SEQ ID NO: 1755702 - RNA, 23 nt, Homo sapiens
uguuaucuucuaucaaagcacau

SEQ ID NO: 1755703 - RNA, 20 nt, Homo sapiens
gccaggcguggugacucaca

SEQ ID NO: 1755704 - RNA, 17 nt, Homo sapiens
uaacaugucacaaugua

SEQ ID NO: 1755705 - RNA, 19 nt, Homo sapiens
aguauucauguuguuauua

SEQ ID NO: 1755706 - RNA, 23 nt, Homo sapiens
auuuuuucucuguaaacuuccaa

SEQ ID NO: 1755707 - RNA, 17 nt, Homo sapiens
ccuagccaacaugguga

SEQ ID NO: 1755708 - RNA, 15 nt, Homo sapiens
cuuccuggcaucaua

SEQ ID NO: 1755709 - RNA, 18 nt, Homo sapiens
aagauaguuaaauccuaa

SEQ ID NO: 1755710 - RNA, 21 nt, Homo sapiens
aaacugauguauagcuuuaac

SEQ ID NO: 1755711 - RNA, 14 nt, Homo sapiens
guuuugcuccuucu

SEQ ID NO: 1755712 - RNA, 14 nt, Homo sapiens
cucacgcugccauu

SEQ ID NO: 1755713 - RNA, 19 nt, Homo sapiens
ccauuguaaaucugaagaa

SEQ ID NO: 1755714 - RNA, 21 nt, Homo sapiens
cugcuccagcaagcaaacagg

SEQ ID NO: 1755715 - RNA, 15 nt, Homo sapiens
cagccccgccuguca

SEQ ID NO: 1755716 - RNA, 14 nt, Homo sapiens
cuguuuuguuguuu

SEQ ID NO: 1755717 - RNA, 14 nt, Homo sapiens
ccuuccugucuucc

SEQ ID NO: 1755718 - RNA, 23 nt, Homo sapiens
cugggauuaccggcgugagccac

SEQ ID NO: 1755719 - RNA, 14 nt, Homo sapiens
aguaaauauacuug

SEQ ID NO: 1755720 - RNA, 15 nt, Homo sapiens
ccugaaccagcacua

SEQ ID NO: 1755721 - RNA, 22 nt, Homo sapiens
agaauauguaacagccaaaccu

SEQ ID NO: 1755722 - RNA, 18 nt, Homo sapiens
gaaaauaauuaauuucau

SEQ ID NO: 1755723 - RNA, 13 nt, Homo sapiens
uaaguaaggaauu

SEQ ID NO: 1755724 - RNA, 23 nt, Homo sapiens
auaccaaacaugcggugccauga

SEQ ID NO: 1755725 - RNA, 17 nt, Homo sapiens
ggggcacggagggcagu

SEQ ID NO: 1755726 - RNA, 17 nt, Homo sapiens
cuuaaaacaaagccaug

SEQ ID NO: 1755727 - RNA, 14 nt, Homo sapiens
caguucuuacacau

SEQ ID NO: 1755728 - RNA, 20 nt, Homo sapiens
augacaaaguuacaaauuca

SEQ ID NO: 1755729 - RNA, 15 nt, Homo sapiens
gaacccuagcacaaa

SEQ ID NO: 1755730 - RNA, 20 nt, Homo sapiens
cauuaaaaauguuaguauuu

SEQ ID NO: 1755731 - RNA, 22 nt, Homo sapiens
uccgaacuacuguuauaauuau

SEQ ID NO: 1755732 - RNA, 17 nt, Homo sapiens
uguuuuaaguugcuuua

SEQ ID NO: 1755733 - RNA, 15 nt, Homo sapiens
acuugccuccaucuu

SEQ ID NO: 1755734 - RNA, 14 nt, Homo sapiens
aaccucugccuccc

SEQ ID NO: 1755735 - RNA, 13 nt, Homo sapiens
uguaaauguuaug

SEQ ID NO: 1755736 - RNA, 22 nt, Homo sapiens
uccgcaggcagacuacacagga

SEQ ID NO: 1755737 - RNA, 22 nt, Homo sapiens
ucuuuaaucuccuauuccuuca

SEQ ID NO: 1755738 - RNA, 22 nt, Homo sapiens
uguuugcugauuauuuaugacc

SEQ ID NO: 1755739 - RNA, 16 nt, Homo sapiens
augaguuggacuucag

SEQ ID NO: 1755740 - RNA, 19 nt, Homo sapiens
ggacugaccaaagacugca

SEQ ID NO: 1755741 - RNA, 22 nt, Homo sapiens
cauugucucaauucaaauccau

SEQ ID NO: 1755742 - RNA, 18 nt, Homo sapiens
gauaaagucaaaugccaa

SEQ ID NO: 1755743 - RNA, 15 nt, Homo sapiens
gcugucuucuggucu

SEQ ID NO: 1755744 - RNA, 15 nt, Homo sapiens
aagcccagugcugcu

SEQ ID NO: 1755745 - RNA, 17 nt, Homo sapiens
agaguguauaugaauga

SEQ ID NO: 1755746 - RNA, 13 nt, Homo sapiens
cuaccuucagggu

SEQ ID NO: 1755747 - RNA, 21 nt, Homo sapiens
augggaagguuguucuuggcu

SEQ ID NO: 1755748 - RNA, 18 nt, Homo sapiens
ccuuccuaugcuguucac

SEQ ID NO: 1755749 - RNA, 13 nt, Homo sapiens
uuggagugcacug

SEQ ID NO: 1755750 - RNA, 20 nt, Homo sapiens
cuauuugagagcagaugcca

SEQ ID NO: 1755751 - RNA, 18 nt, Homo sapiens
aagauggggcgagccagg

SEQ ID NO: 1755752 - RNA, 20 nt, Homo sapiens
caacuugaauaauacaccag

SEQ ID NO: 1755753 - RNA, 13 nt, Homo sapiens
agaaacuucccaa

SEQ ID NO: 1755754 - RNA, 17 nt, Homo sapiens
cugcacuguccugacca

SEQ ID NO: 1755755 - RNA, 20 nt, Homo sapiens
uauagcaauguaacauuaau

SEQ ID NO: 1755756 - RNA, 17 nt, Homo sapiens
cauccaggcccaacugu

SEQ ID NO: 1755757 - RNA, 19 nt, Homo sapiens
cuucaucacacacugagag

SEQ ID NO: 1755758 - RNA, 14 nt, Homo sapiens
ggggcagggccuuc

SEQ ID NO: 1755759 - RNA, 16 nt, Homo sapiens
agcccucucacugugu

SEQ ID NO: 1755760 - RNA, 17 nt, Homo sapiens
ugcuccuuguuccuaga

SEQ ID NO: 1755761 - RNA, 16 nt, Homo sapiens
aacaucuuuagugucu

SEQ ID NO: 1755762 - RNA, 21 nt, Homo sapiens
cuauaaaacacaucaucaaua

SEQ ID NO: 1755763 - RNA, 22 nt, Homo sapiens
gauggaugaaucucccacucca

SEQ ID NO: 1755764 - RNA, 23 nt, Homo sapiens
guagaaaagugcuguuugaggga

SEQ ID NO: 1755765 - RNA, 12 nt, Homo sapiens
cuaugagucuag

SEQ ID NO: 1755766 - RNA, 12 nt, Homo sapiens
cacccaccacuc

SEQ ID NO: 1755767 - RNA, 21 nt, Homo sapiens
uauuuccucugugcaaaggga

SEQ ID NO: 1755768 - RNA, 22 nt, Homo sapiens
aucaguccuaccugagcaacaa

SEQ ID NO: 1755769 - RNA, 15 nt, Homo sapiens
cagcugcaacagugg

SEQ ID NO: 1755770 - RNA, 17 nt, Homo sapiens
cauugcucuugagucuu

SEQ ID NO: 1755771 - RNA, 19 nt, Homo sapiens
caagguauuuacacauaca

SEQ ID NO: 1755772 - RNA, 15 nt, Homo sapiens
uacauaauaaccaaa

SEQ ID NO: 1755773 - RNA, 22 nt, Homo sapiens
aacuuaagcugggauaaucaca

SEQ ID NO: 1755774 - RNA, 12 nt, Homo sapiens
gaggcugucaca

SEQ ID NO: 1755775 - RNA, 20 nt, Homo sapiens
cauacugaaaaaaugcugag

SEQ ID NO: 1755776 - RNA, 19 nt, Homo sapiens
cagauugauaaguaaugaa

SEQ ID NO: 1755777 - RNA, 15 nt, Homo sapiens
cuacuaaaacauaca

SEQ ID NO: 1755778 - RNA, 19 nt, Homo sapiens
ggcagccucuggaauggcu

SEQ ID NO: 1755779 - RNA, 22 nt, Homo sapiens
uuaaugacuuuugaauuacaga

SEQ ID NO: 1755780 - RNA, 16 nt, Homo sapiens
uaauggaaacugucaa

SEQ ID NO: 1755781 - RNA, 20 nt, Homo sapiens
uccccguuccaccccaagag

SEQ ID NO: 1755782 - RNA, 21 nt, Homo sapiens
caaucauauuaauacaaugau

SEQ ID NO: 1755783 - RNA, 14 nt, Homo sapiens
aaugccaugaauua

SEQ ID NO: 1755784 - RNA, 21 nt, Homo sapiens
gcacugccugauggaccuguc

SEQ ID NO: 1755785 - RNA, 16 nt, Homo sapiens
auauucaguggugaaa

SEQ ID NO: 1755786 - RNA, 18 nt, Homo sapiens
aucaccaggaugucacau

SEQ ID NO: 1755787 - RNA, 20 nt, Homo sapiens
cauucuuucccaacaccucu

SEQ ID NO: 1755788 - RNA, 22 nt, Homo sapiens
guccugguggggcagcuccucu

SEQ ID NO: 1755789 - RNA, 14 nt, Homo sapiens
acuuaucaucacac

SEQ ID NO: 1755790 - RNA, 15 nt, Homo sapiens
guauucuuauuuaau

SEQ ID NO: 1755791 - RNA, 22 nt, Homo sapiens
gagcaagacuccaucucaaaaa

SEQ ID NO: 1755792 - RNA, 22 nt, Homo sapiens
acgcagagauuuucaucuauua

SEQ ID NO: 1755793 - RNA, 21 nt, Homo sapiens
ugcuaugaaauuggugggugg

SEQ ID NO: 1755794 - RNA, 23 nt, Homo sapiens
uugcuggaccugaauucuacuga

SEQ ID NO: 1755795 - RNA, 23 nt, Homo sapiens
guguucuucauuaccucagugag

SEQ ID NO: 1755796 - RNA, 13 nt, Homo sapiens
ccuugugaaggaa

SEQ ID NO: 1755797 - RNA, 22 nt, Homo sapiens
acacagccccggaaugcuucca

SEQ ID NO: 1755798 - RNA, 22 nt, Homo sapiens
uaacuguccguaguaucagaga

SEQ ID NO: 1755799 - RNA, 11 nt, Homo sapiens
accucccucau

SEQ ID NO: 1755800 - RNA, 21 nt, Homo sapiens
cacagucucugggagacuuuc

SEQ ID NO: 1755801 - RNA, 16 nt, Homo sapiens
cuaauuuuuaagaauu

SEQ ID NO: 1755802 - RNA, 19 nt, Homo sapiens
aagcgagcagucagcauuc

SEQ ID NO: 1755803 - RNA, 15 nt, Homo sapiens
uuuucacaccuuaca

SEQ ID NO: 1755804 - RNA, 15 nt, Homo sapiens
cuuucccaucuuaaa

SEQ ID NO: 1755805 - RNA, 15 nt, Homo sapiens
caggaagccaaagag

SEQ ID NO: 1755806 - RNA, 16 nt, Homo sapiens
gugcauuuaguuuugu

SEQ ID NO: 1755807 - RNA, 16 nt, Homo sapiens
gugaggaagaacuaca

SEQ ID NO: 1755808 - RNA, 18 nt, Homo sapiens
ugucacaaccucucugau

SEQ ID NO: 1755809 - RNA, 15 nt, Homo sapiens
augucuguguguuga

SEQ ID NO: 1755810 - RNA, 21 nt, Homo sapiens
aaugcugacaaaaauauuuuc

SEQ ID NO: 1755811 - RNA, 22 nt, Homo sapiens
aaugguuuucuuguguguuuau

SEQ ID NO: 1755812 - RNA, 15 nt, Homo sapiens
gaauauagacagugc

SEQ ID NO: 1755813 - RNA, 17 nt, Homo sapiens
cugucuguauagugucu

SEQ ID NO: 1755814 - RNA, 12 nt, Homo sapiens
cacgguggugcc

SEQ ID NO: 1755815 - RNA, 22 nt, Homo sapiens
aggaagaccaagacacagauca

SEQ ID NO: 1755816 - RNA, 14 nt, Homo sapiens
auggaaauccacaa

SEQ ID NO: 1755817 - RNA, 17 nt, Homo sapiens
aauucagaacaagcaau

SEQ ID NO: 1755818 - RNA, 13 nt, Homo sapiens
aucuugcuggcua

SEQ ID NO: 1755819 - RNA, 19 nt, Homo sapiens
uuaccaacuuucuguaaac

SEQ ID NO: 1755820 - RNA, 17 nt, Homo sapiens
aucuaagaauagugaaa

SEQ ID NO: 1755821 - RNA, 16 nt, Homo sapiens
uuuuagagcuuccaaa

SEQ ID NO: 1755822 - RNA, 20 nt, Homo sapiens
cauaaaaugauccugccaau

SEQ ID NO: 1755823 - RNA, 13 nt, Homo sapiens
aggaaugcaauaa

SEQ ID NO: 1755824 - RNA, 21 nt, Homo sapiens
acgcacacccugccccuggug

SEQ ID NO: 1755825 - RNA, 13 nt, Homo sapiens
ucccaaugaaaua

SEQ ID NO: 1755826 - RNA, 21 nt, Homo sapiens
gugaccuuuuguaagacauua

SEQ ID NO: 1755827 - RNA, 14 nt, Homo sapiens
uaaacuucagggau

SEQ ID NO: 1755828 - RNA, 13 nt, Homo sapiens
cauaagauucuau

SEQ ID NO: 1755829 - RNA, 13 nt, Homo sapiens
cagagacugaaaa

SEQ ID NO: 1755830 - RNA, 19 nt, Homo sapiens
ugguuacaaucauugcuga

SEQ ID NO: 1755831 - RNA, 20 nt, Homo sapiens
aucaauucuuagaauaucua

SEQ ID NO: 1755832 - RNA, 19 nt, Homo sapiens
aguggccugugcuuuucag

SEQ ID NO: 1755833 - RNA, 23 nt, Homo sapiens
cggcucaugccuguaaucccagc

SEQ ID NO: 1755834 - RNA, 18 nt, Homo sapiens
ccuccuggguucacauga

SEQ ID NO: 1755835 - RNA, 17 nt, Homo sapiens
gauugaaggugaccucu

SEQ ID NO: 1755836 - RNA, 13 nt, Homo sapiens
caaaugucaucag

SEQ ID NO: 1755837 - RNA, 13 nt, Homo sapiens
aacuuguccuaug

SEQ ID NO: 1755838 - RNA, 19 nt, Homo sapiens
cugcccacaacuugccaaa

SEQ ID NO: 1755839 - RNA, 13 nt, Homo sapiens
cuggaaucaaaua

SEQ ID NO: 1755840 - RNA, 22 nt, Homo sapiens
ucauuaguccuuugucuaagua

SEQ ID NO: 1755841 - RNA, 21 nt, Homo sapiens
cuguggaacuacauuacugua

SEQ ID NO: 1755842 - RNA, 16 nt, Homo sapiens
cagaugcaaugacuca

SEQ ID NO: 1755843 - RNA, 21 nt, Homo sapiens
uacuccaauucauaaaucuau

SEQ ID NO: 1755844 - RNA, 20 nt, Homo sapiens
gagaucgcaucauugcacuc

SEQ ID NO: 1755845 - RNA, 22 nt, Homo sapiens
aacagugucuggugcacauaau

SEQ ID NO: 1755846 - RNA, 21 nt, Homo sapiens
cacugcuuuuggccuggaguu

SEQ ID NO: 1755847 - RNA, 14 nt, Homo sapiens
uguuuuauugggga

SEQ ID NO: 1755848 - RNA, 21 nt, Homo sapiens
gugacaagggcacaagcucag

SEQ ID NO: 1755849 - RNA, 15 nt, Homo sapiens
gaaaagagcuuugua

SEQ ID NO: 1755850 - RNA, 16 nt, Homo sapiens
acaccaagaaaccacu

SEQ ID NO: 1755851 - RNA, 21 nt, Homo sapiens
uugucaauagcaugcaaaaaa

SEQ ID NO: 1755852 - RNA, 19 nt, Homo sapiens
uucacaaagggaauugccu

SEQ ID NO: 1755853 - RNA, 20 nt, Homo sapiens
uuacauuuaaaagacagaca

SEQ ID NO: 1755854 - RNA, 14 nt, Homo sapiens
gagagagaugacaa

SEQ ID NO: 1755855 - RNA, 20 nt, Homo sapiens
auauugccuguguuugccac

SEQ ID NO: 1755856 - RNA, 19 nt, Homo sapiens
cagccacuugacuggcaca

SEQ ID NO: 1755857 - RNA, 16 nt, Homo sapiens
gcgcucuggacagaug

SEQ ID NO: 1755858 - RNA, 15 nt, Homo sapiens
ggcgcccgggaucca

SEQ ID NO: 1755859 - RNA, 16 nt, Homo sapiens
cgccacuggacugucu

SEQ ID NO: 1755860 - RNA, 12 nt, Homo sapiens
ggcagagccaug

SEQ ID NO: 1755861 - RNA, 15 nt, Homo sapiens
gcuuuacagacaaaa

SEQ ID NO: 1755862 - RNA, 24 nt, Homo sapiens
ggaguuuauuugaguauugcugau

SEQ ID NO: 1755863 - RNA, 22 nt, Homo sapiens
uucaccagucugucuacugugg

SEQ ID NO: 1755864 - RNA, 19 nt, Homo sapiens
ucuucugccuuuaugagau

SEQ ID NO: 1755865 - RNA, 18 nt, Homo sapiens
uggcaagucuuccaugac

SEQ ID NO: 1755866 - RNA, 17 nt, Homo sapiens
ugcucucuauguaugua

SEQ ID NO: 1755867 - RNA, 13 nt, Homo sapiens
uccaaccacucau

SEQ ID NO: 1755868 - RNA, 21 nt, Homo sapiens
ucagaaagggagggcucugag

SEQ ID NO: 1755869 - RNA, 17 nt, Homo sapiens
agaagaaagacacaaag

SEQ ID NO: 1755870 - RNA, 23 nt, Homo sapiens
uucuuuaagcagcgccagugaca

SEQ ID NO: 1755871 - RNA, 23 nt, Homo sapiens
ccauagcaauuccccuacaucaa

SEQ ID NO: 1755872 - RNA, 16 nt, Homo sapiens
acaucauucuacauaa

SEQ ID NO: 1755873 - RNA, 13 nt, Homo sapiens
ggcaucaaacagg

SEQ ID NO: 1755874 - RNA, 21 nt, Homo sapiens
caggccauggguucaccagcc

SEQ ID NO: 1755875 - RNA, 22 nt, Homo sapiens
ucccaaaugucuauuuucuuga

SEQ ID NO: 1755876 - RNA, 23 nt, Homo sapiens
gcaccacucucuucauccugggg

SEQ ID NO: 1755877 - RNA, 17 nt, Homo sapiens
ugcggcuccucagggac

SEQ ID NO: 1755878 - RNA, 14 nt, Homo sapiens
ucugccucugacac

SEQ ID NO: 1755879 - RNA, 19 nt, Homo sapiens
gccagggucugugugaaug

SEQ ID NO: 1755880 - RNA, 20 nt, Homo sapiens
aagcaaaucagaaaacccac

SEQ ID NO: 1755881 - RNA, 17 nt, Homo sapiens
uuguccucauuucucca

SEQ ID NO: 1755882 - RNA, 17 nt, Homo sapiens
cuucucuccugcuuccu

SEQ ID NO: 1755883 - RNA, 21 nt, Homo sapiens
cuuugauuuuugcccagaaag

SEQ ID NO: 1755884 - RNA, 18 nt, Homo sapiens
uuagcuuugggugccuuu

SEQ ID NO: 1755885 - RNA, 19 nt, Homo sapiens
acugcucccaucauuccuu

SEQ ID NO: 1755886 - RNA, 15 nt, Homo sapiens
gcgcucccuugccuu

SEQ ID NO: 1755887 - RNA, 20 nt, Homo sapiens
aagaccaggucuacagugau

SEQ ID NO: 1755888 - RNA, 23 nt, Homo sapiens
gcggagaugcuucuaaggcaugg

SEQ ID NO: 1755889 - RNA, 22 nt, Homo sapiens
ucuaauuuucacacauagucuu

SEQ ID NO: 1755890 - RNA, 18 nt, Homo sapiens
aaggaaaaaugcugcuuc

SEQ ID NO: 1755891 - RNA, 22 nt, Homo sapiens
acaccaaugaaaacauguacua

SEQ ID NO: 1755892 - RNA, 20 nt, Homo sapiens
ugccuucuuauugcuuuuau

SEQ ID NO: 1755893 - RNA, 23 nt, Homo sapiens
ggacaagacaggcagagaucuau

SEQ ID NO: 1755894 - RNA, 23 nt, Homo sapiens
ggaacaaaccaggggacacuuug

SEQ ID NO: 1755895 - RNA, 21 nt, Homo sapiens
cauguuguugaggcugucaca

SEQ ID NO: 1755896 - RNA, 14 nt, Homo sapiens
cagagaaaagagau

SEQ ID NO: 1755897 - RNA, 11 nt, Homo sapiens
cacgucauguc

SEQ ID NO: 1755898 - RNA, 23 nt, Homo sapiens
acacugagcaaguuuucaccuau

SEQ ID NO: 1755899 - RNA, 20 nt, Homo sapiens
aggugguccuuccaccucag

SEQ ID NO: 1755900 - RNA, 18 nt, Homo sapiens
uugccugcuccaucucau

SEQ ID NO: 1755901 - RNA, 19 nt, Homo sapiens
aauguacauuuaauugcaa

SEQ ID NO: 1755902 - RNA, 20 nt, Homo sapiens
ugguccugcugcuggcugcc

SEQ ID NO: 1755903 - RNA, 20 nt, Homo sapiens
uggcccccucaguguuguca

SEQ ID NO: 1755904 - RNA, 16 nt, Homo sapiens
uuguauugucugacac

SEQ ID NO: 1755905 - RNA, 21 nt, Homo sapiens
agguuuugaauaaaaagugaa

SEQ ID NO: 1755906 - RNA, 21 nt, Homo sapiens
cuuugacccuauucaugucuc

SEQ ID NO: 1755907 - RNA, 13 nt, Homo sapiens
ugaaauuggaaag

SEQ ID NO: 1755908 - RNA, 20 nt, Homo sapiens
uaaaagguauuuugaauacc

SEQ ID NO: 1755909 - RNA, 16 nt, Homo sapiens
cuuugccaauucauuu

SEQ ID NO: 1755910 - RNA, 17 nt, Homo sapiens
uucucugugaacuauua

SEQ ID NO: 1755911 - RNA, 14 nt, Homo sapiens
aauauuaaaugacu

SEQ ID NO: 1755912 - RNA, 21 nt, Homo sapiens
gaaaacucaugaucaagauau

SEQ ID NO: 1755913 - RNA, 15 nt, Homo sapiens
aaaacuuuguagaca

SEQ ID NO: 1755914 - RNA, 20 nt, Homo sapiens
aaaaacugauugaaugauau

SEQ ID NO: 1755915 - RNA, 13 nt, Homo sapiens
ugguuguccaggu

SEQ ID NO: 1755916 - RNA, 18 nt, Homo sapiens
uuguagccagguacugca

SEQ ID NO: 1755917 - RNA, 16 nt, Homo sapiens
uaaaauauauacuaua

SEQ ID NO: 1755918 - RNA, 13 nt, Homo sapiens
uggccuggcacac

SEQ ID NO: 1755919 - RNA, 14 nt, Homo sapiens
aauuuugcauuuca

SEQ ID NO: 1755920 - RNA, 17 nt, Homo sapiens
gguacuugguaagcaaa

SEQ ID NO: 1755921 - RNA, 18 nt, Homo sapiens
cuuguaaaauuucacuua

SEQ ID NO: 1755922 - RNA, 20 nt, Homo sapiens
agagauauuucaagcucaug

SEQ ID NO: 1755923 - RNA, 18 nt, Homo sapiens
acauuuauucugcucaca

SEQ ID NO: 1755924 - RNA, 15 nt, Homo sapiens
aacauggguuuccuu

SEQ ID NO: 1755925 - RNA, 16 nt, Homo sapiens
auguucuauauucuca

SEQ ID NO: 1755926 - RNA, 15 nt, Homo sapiens
gcaggggacugggcc

SEQ ID NO: 1755927 - RNA, 16 nt, Homo sapiens
gaagucuuuguacaga

SEQ ID NO: 1755928 - RNA, 18 nt, Homo sapiens
cugagaccaggguggcca

SEQ ID NO: 1755929 - RNA, 21 nt, Homo sapiens
agauaauguccuugcuuuaca

SEQ ID NO: 1755930 - RNA, 19 nt, Homo sapiens
cauggaaaacccccuuccu

SEQ ID NO: 1755931 - RNA, 23 nt, Homo sapiens
ggugaaauuauaacuauuacagu

SEQ ID NO: 1755932 - RNA, 23 nt, Homo sapiens
gaacgaguuguuggcugcucccu

SEQ ID NO: 1755933 - RNA, 23 nt, Homo sapiens
ugaauuuuccgggaacuuugcag

SEQ ID NO: 1755934 - RNA, 19 nt, Homo sapiens
uguaaaauagaauguuacu

SEQ ID NO: 1755935 - RNA, 16 nt, Homo sapiens
accuagaguuuuauca

SEQ ID NO: 1755936 - RNA, 17 nt, Homo sapiens
aaacagaacugcaguca

SEQ ID NO: 1755937 - RNA, 14 nt, Homo sapiens
aauaaaaaugcacg

SEQ ID NO: 1755938 - RNA, 19 nt, Homo sapiens
uuuccuaccuauauuacac

SEQ ID NO: 1755939 - RNA, 20 nt, Homo sapiens
caggccucaugccucgcuca

SEQ ID NO: 1755940 - RNA, 19 nt, Homo sapiens
ggcgacugagccaugcuca

SEQ ID NO: 1755941 - RNA, 23 nt, Homo sapiens
uucaccuuaaugcauauuccccu

SEQ ID NO: 1755942 - RNA, 19 nt, Homo sapiens
augaagucuuaaggacaaa

SEQ ID NO: 1755943 - RNA, 19 nt, Homo sapiens
uagagcugggaaacaggga

SEQ ID NO: 1755944 - RNA, 12 nt, Homo sapiens
aauaaaugccuu

SEQ ID NO: 1755945 - RNA, 18 nt, Homo sapiens
ugaggacgcuggggaaua

SEQ ID NO: 1755946 - RNA, 23 nt, Homo sapiens
agaauaaucuaaauucauacuca

SEQ ID NO: 1755947 - RNA, 13 nt, Homo sapiens
aacagcaaaucac

SEQ ID NO: 1755948 - RNA, 21 nt, Homo sapiens
gucaguaacuuacccuuaggg

SEQ ID NO: 1755949 - RNA, 21 nt, Homo sapiens
aaauuaaaauccagcauccca

SEQ ID NO: 1755950 - RNA, 18 nt, Homo sapiens
auaaugucgaacucugaa

SEQ ID NO: 1755951 - RNA, 12 nt, Homo sapiens
acaguguucuca

SEQ ID NO: 1755952 - RNA, 15 nt, Homo sapiens
auuuaaaacauguaa

SEQ ID NO: 1755953 - RNA, 15 nt, Homo sapiens
aaccucuuugcucaa

SEQ ID NO: 1755954 - RNA, 14 nt, Homo sapiens
auugcgcucagggg

SEQ ID NO: 1755955 - RNA, 22 nt, Homo sapiens
gugaauacuuacuauaauuuga

SEQ ID NO: 1755956 - RNA, 15 nt, Homo sapiens
ggcugggcaucccag

SEQ ID NO: 1755957 - RNA, 13 nt, Homo sapiens
aagugacuauuca

SEQ ID NO: 1755958 - RNA, 18 nt, Homo sapiens
acuauauaagacauuaag

SEQ ID NO: 1755959 - RNA, 13 nt, Homo sapiens
ggagaaacucauc

SEQ ID NO: 1755960 - RNA, 23 nt, Homo sapiens
uaucuugaguguuaugugaauuu

SEQ ID NO: 1755961 - RNA, 17 nt, Homo sapiens
cuggaaucacauucuua

SEQ ID NO: 1755962 - RNA, 13 nt, Homo sapiens
uagagcugggaau

SEQ ID NO: 1755963 - RNA, 23 nt, Homo sapiens
uggcggcuccauccguggcugca

SEQ ID NO: 1755964 - RNA, 20 nt, Homo sapiens
gucagauuugaacucuucaa

SEQ ID NO: 1755965 - RNA, 20 nt, Homo sapiens
cuuauacucuugagaaugaa

SEQ ID NO: 1755966 - RNA, 22 nt, Homo sapiens
aucccauuucuugaaaagccuu

SEQ ID NO: 1755967 - RNA, 23 nt, Homo sapiens
cgacaagccugccaacaagcuga

SEQ ID NO: 1755968 - RNA, 14 nt, Homo sapiens
uuauaagcauguau

SEQ ID NO: 1755969 - RNA, 21 nt, Homo sapiens
ccuggcccagggcaucuggga

SEQ ID NO: 1755970 - RNA, 14 nt, Homo sapiens
cccugccugccaua

SEQ ID NO: 1755971 - RNA, 22 nt, Homo sapiens
ggccaguggggccuguggaaug

SEQ ID NO: 1755972 - RNA, 19 nt, Homo sapiens
cuagaaaggaacugcaaua

SEQ ID NO: 1755973 - RNA, 15 nt, Homo sapiens
gaccugaaucacaac

SEQ ID NO: 1755974 - RNA, 18 nt, Homo sapiens
gggacugcaaguggccau

SEQ ID NO: 1755975 - RNA, 14 nt, Homo sapiens
gacuccccugggca

SEQ ID NO: 1755976 - RNA, 13 nt, Homo sapiens
ggacuccaucucu

SEQ ID NO: 1755977 - RNA, 13 nt, Homo sapiens
ucaggccaggugg

SEQ ID NO: 1755978 - RNA, 16 nt, Homo sapiens
uuaaauccuaccaaag

SEQ ID NO: 1755979 - RNA, 14 nt, Homo sapiens
uaacacauucaaua

SEQ ID NO: 1755980 - RNA, 16 nt, Homo sapiens
guguaccugccauaac

SEQ ID NO: 1755981 - RNA, 13 nt, Homo sapiens
agcacuugcucaa

SEQ ID NO: 1755982 - RNA, 18 nt, Homo sapiens
ucaccugagaagauuuua

SEQ ID NO: 1755983 - RNA, 11 nt, Homo sapiens
ccaacacaaag

SEQ ID NO: 1755984 - RNA, 18 nt, Homo sapiens
ccauuuuuaauucauucu

SEQ ID NO: 1755985 - RNA, 21 nt, Homo sapiens
cauauauauauagcagcuuua

SEQ ID NO: 1755986 - RNA, 17 nt, Homo sapiens
cuauaaacauaugcaaa

SEQ ID NO: 1755987 - RNA, 14 nt, Homo sapiens
guccccgaugcuga

SEQ ID NO: 1755988 - RNA, 19 nt, Homo sapiens
agcuuucugccuuagccua

SEQ ID NO: 1755989 - RNA, 13 nt, Homo sapiens
aguggcauggucc

SEQ ID NO: 1755990 - RNA, 14 nt, Homo sapiens
uucccucacaccgc

SEQ ID NO: 1755991 - RNA, 13 nt, Homo sapiens
uucuuugaauuua

SEQ ID NO: 1755992 - RNA, 18 nt, Homo sapiens
cccugcagggccaagcac

SEQ ID NO: 1755993 - RNA, 11 nt, Homo sapiens
cugacccagug

SEQ ID NO: 1755994 - RNA, 11 nt, Homo sapiens
uguccuaagca

SEQ ID NO: 1755995 - RNA, 17 nt, Homo sapiens
aagugcacaggagccaa

SEQ ID NO: 1755996 - RNA, 19 nt, Homo sapiens
acaggagaaucaccugaac

SEQ ID NO: 1755997 - RNA, 18 nt, Homo sapiens
uaucuguauuuucauuua

SEQ ID NO: 1755998 - RNA, 19 nt, Homo sapiens
uucugauacguguaugaga

SEQ ID NO: 1755999 - RNA, 13 nt, Homo sapiens
aucucagcuuuga

SEQ ID NO: 1756000 - RNA, 17 nt, Homo sapiens
ugagauaggagauacaa

SEQ ID NO: 1756001 - RNA, 20 nt, Homo sapiens
ccugcaaggggacauuccag

SEQ ID NO: 1756002 - RNA, 23 nt, Homo sapiens
uguguacacauaugaacgcacaa

SEQ ID NO: 1756003 - RNA, 14 nt, Homo sapiens
uaucaauggugcug

SEQ ID NO: 1756004 - RNA, 22 nt, Homo sapiens
uucagagauauaauaagcccaa

SEQ ID NO: 1756005 - RNA, 16 nt, Homo sapiens
uagcuggccacauggc

SEQ ID NO: 1756006 - RNA, 19 nt, Homo sapiens
caggcuguucugcacugaa

SEQ ID NO: 1756007 - RNA, 17 nt, Homo sapiens
aaauuggacagaacaga

SEQ ID NO: 1756008 - RNA, 19 nt, Homo sapiens
augggaaaacuucacucca

SEQ ID NO: 1756009 - RNA, 19 nt, Homo sapiens
aauuuaaucuuccauggau

SEQ ID NO: 1756010 - RNA, 22 nt, Homo sapiens
gacaccaguugcgaagggaaau

SEQ ID NO: 1756011 - RNA, 15 nt, Homo sapiens
gacaucugcuguuau

SEQ ID NO: 1756012 - RNA, 15 nt, Homo sapiens
aaauuaaaaccugau

SEQ ID NO: 1756013 - RNA, 10 nt, Homo sapiens
uugagcccag

SEQ ID NO: 1756014 - RNA, 13 nt, Homo sapiens
aauucaugaacuu

SEQ ID NO: 1756015 - RNA, 14 nt, Homo sapiens
aaagcuuugaaccc

SEQ ID NO: 1756016 - RNA, 14 nt, Homo sapiens
cccccagaggacuu

SEQ ID NO: 1756017 - RNA, 17 nt, Homo sapiens
gagcacauacuguguuc

SEQ ID NO: 1756018 - RNA, 18 nt, Homo sapiens
auugcuuuauccaaaagu

SEQ ID NO: 1756019 - RNA, 16 nt, Homo sapiens
agccuacgcugaagau

SEQ ID NO: 1756020 - RNA, 12 nt, Homo sapiens
aaugagugcuua

SEQ ID NO: 1756021 - RNA, 16 nt, Homo sapiens
cacagcaggugcugag

SEQ ID NO: 1756022 - RNA, 20 nt, Homo sapiens
cucaacaucccuuaccuccu

SEQ ID NO: 1756023 - RNA, 21 nt, Homo sapiens
cggggaagugcucuaacuuuu

SEQ ID NO: 1756024 - RNA, 17 nt, Homo sapiens
cauacuguugaugucua

SEQ ID NO: 1756025 - RNA, 17 nt, Homo sapiens
auucacaugaugcacuu

SEQ ID NO: 1756026 - RNA, 19 nt, Homo sapiens
ccuacagcuacauugagau

SEQ ID NO: 1756027 - RNA, 23 nt, Homo sapiens
uaaauuuuaacauuuuccaaaau

SEQ ID NO: 1756028 - RNA, 21 nt, Homo sapiens
cuuccaucagcgggucuccuc

SEQ ID NO: 1756029 - RNA, 16 nt, Homo sapiens
agcaguuucagauaaa

SEQ ID NO: 1756030 - RNA, 21 nt, Homo sapiens
ggucacugaaggccuggccca

SEQ ID NO: 1756031 - RNA, 16 nt, Homo sapiens
aaaaugugucuguaag

SEQ ID NO: 1756032 - RNA, 22 nt, Homo sapiens
cuuaagcccucgugcacacaca

SEQ ID NO: 1756033 - RNA, 13 nt, Homo sapiens
uccacccuuccau

SEQ ID NO: 1756034 - RNA, 13 nt, Homo sapiens
cuuggcucugaga

SEQ ID NO: 1756035 - RNA, 16 nt, Homo sapiens
guugagugcaucccag

SEQ ID NO: 1756036 - RNA, 20 nt, Homo sapiens
auuuuguaauguaucaaaua

SEQ ID NO: 1756037 - RNA, 18 nt, Homo sapiens
acaugaaaauagcaauau

SEQ ID NO: 1756038 - RNA, 18 nt, Homo sapiens
gguaaaaucuagaagcuu

SEQ ID NO: 1756039 - RNA, 15 nt, Homo sapiens
ccucugcuugccauc

SEQ ID NO: 1756040 - RNA, 19 nt, Homo sapiens
ucgacuucgggcuggccau

SEQ ID NO: 1756041 - RNA, 18 nt, Homo sapiens
ccuuuacuauuaagggaa

SEQ ID NO: 1756042 - RNA, 12 nt, Homo sapiens
cugaacugggau

SEQ ID NO: 1756043 - RNA, 13 nt, Homo sapiens
ugaaaucuaugaa

SEQ ID NO: 1756044 - RNA, 16 nt, Homo sapiens
aaggagacuucugucu

SEQ ID NO: 1756045 - RNA, 14 nt, Homo sapiens
uuaauuuugauuca

SEQ ID NO: 1756046 - RNA, 15 nt, Homo sapiens
uguuuugcuaaagga

SEQ ID NO: 1756047 - RNA, 16 nt, Homo sapiens
aaaauccuuacuucca

SEQ ID NO: 1756048 - RNA, 14 nt, Homo sapiens
ugauaacagcacug

SEQ ID NO: 1756049 - RNA, 18 nt, Homo sapiens
ccucauuuccuagacgua

SEQ ID NO: 1756050 - RNA, 21 nt, Homo sapiens
ucaaugcugggcccucuuauc

SEQ ID NO: 1756051 - RNA, 17 nt, Homo sapiens
auuacagauucugcuag

SEQ ID NO: 1756052 - RNA, 20 nt, Homo sapiens
ugccuuuucaucuaauguga

SEQ ID NO: 1756053 - RNA, 20 nt, Homo sapiens
agccccuccucccccggcug

SEQ ID NO: 1756054 - RNA, 17 nt, Homo sapiens
aauuuuaucucuucuuc

SEQ ID NO: 1756055 - RNA, 18 nt, Homo sapiens
aucugaagacucaggcag

SEQ ID NO: 1756056 - RNA, 17 nt, Homo sapiens
gggauagaggaaaggga

SEQ ID NO: 1756057 - RNA, 16 nt, Homo sapiens
cagccucuccacucau

SEQ ID NO: 1756058 - RNA, 23 nt, Homo sapiens
ugucccugccuucacugugcucc

SEQ ID NO: 1756059 - RNA, 18 nt, Homo sapiens
ggcugacauuguggcaca

SEQ ID NO: 1756060 - RNA, 21 nt, Homo sapiens
aauuucuuccacguaauucaa

SEQ ID NO: 1756061 - RNA, 13 nt, Homo sapiens
augggacaucaaa

SEQ ID NO: 1756062 - RNA, 17 nt, Homo sapiens
gacaugcuuuccauuuu

SEQ ID NO: 1756063 - RNA, 16 nt, Homo sapiens
cugacuuuuaauguca

SEQ ID NO: 1756064 - RNA, 18 nt, Homo sapiens
auacaauauggacaugua

SEQ ID NO: 1756065 - RNA, 21 nt, Homo sapiens
uaugugaauugaagucaucau

SEQ ID NO: 1756066 - RNA, 23 nt, Homo sapiens
guccuggggccugugcacuguug

SEQ ID NO: 1756067 - RNA, 13 nt, Homo sapiens
aggucuguaguau

SEQ ID NO: 1756068 - RNA, 19 nt, Homo sapiens
ucuucccucagaaacuaga

SEQ ID NO: 1756069 - RNA, 15 nt, Homo sapiens
ccaccuagagcuaga

SEQ ID NO: 1756070 - RNA, 18 nt, Homo sapiens
gcugcucuaagaagggaa

SEQ ID NO: 1756071 - RNA, 13 nt, Homo sapiens
uccuucugugaag

SEQ ID NO: 1756072 - RNA, 13 nt, Homo sapiens
aacauguugccuc

SEQ ID NO: 1756073 - RNA, 19 nt, Homo sapiens
agaaacugagaccaaagaa

SEQ ID NO: 1756074 - RNA, 16 nt, Homo sapiens
cacucccuaaguccac

SEQ ID NO: 1756075 - RNA, 17 nt, Homo sapiens
uuaagaacugcuguuuc

SEQ ID NO: 1756076 - RNA, 16 nt, Homo sapiens
ccaggcuugccucaag

SEQ ID NO: 1756077 - RNA, 16 nt, Homo sapiens
caucuucccacagugg

SEQ ID NO: 1756078 - RNA, 19 nt, Homo sapiens
uccuguauucuacagcaga

SEQ ID NO: 1756079 - RNA, 12 nt, Homo sapiens
gguucuaugauu

SEQ ID NO: 1756080 - RNA, 13 nt, Homo sapiens
ggccccacuggac

SEQ ID NO: 1756081 - RNA, 14 nt, Homo sapiens
ucuaacacaguuga

SEQ ID NO: 1756082 - RNA, 15 nt, Homo sapiens
ucaucccauugucuu

SEQ ID NO: 1756083 - RNA, 14 nt, Homo sapiens
uuucauuaggcaaa

SEQ ID NO: 1756084 - RNA, 12 nt, Homo sapiens
cacagcuuuaug

SEQ ID NO: 1756085 - RNA, 20 nt, Homo sapiens
cagggaaaucaggguuacaa

SEQ ID NO: 1756086 - RNA, 12 nt, Homo sapiens
cacauuccugau

SEQ ID NO: 1756087 - RNA, 22 nt, Homo sapiens
agcguuguguguuuucugggag

SEQ ID NO: 1756088 - RNA, 18 nt, Homo sapiens
uugaaacauagagaucua

SEQ ID NO: 1756089 - RNA, 14 nt, Homo sapiens
uuauguuacuguau

SEQ ID NO: 1756090 - RNA, 14 nt, Homo sapiens
ucuucuccacugga

SEQ ID NO: 1756091 - RNA, 23 nt, Homo sapiens
gugagcaauccugcaagaacaag

SEQ ID NO: 1756092 - RNA, 22 nt, Homo sapiens
accucgcucgaugacugugaac

SEQ ID NO: 1756093 - RNA, 20 nt, Homo sapiens
ugaucacauucuuuccaaaa

SEQ ID NO: 1756094 - RNA, 17 nt, Homo sapiens
agauguuauuaugcuaa

SEQ ID NO: 1756095 - RNA, 13 nt, Homo sapiens
acuuugaccuaaa

SEQ ID NO: 1756096 - RNA, 19 nt, Homo sapiens
gaaaggauuuuaccaaagc

SEQ ID NO: 1756097 - RNA, 15 nt, Homo sapiens
gccugcugcacuucc

SEQ ID NO: 1756098 - RNA, 12 nt, Homo sapiens
ccaucccaaagc

SEQ ID NO: 1756099 - RNA, 18 nt, Homo sapiens
uguguuguaauucuucag

SEQ ID NO: 1756100 - RNA, 18 nt, Homo sapiens
uuucaaugguugggacaa

SEQ ID NO: 1756101 - RNA, 14 nt, Homo sapiens
uuggccggcugugc

SEQ ID NO: 1756102 - RNA, 19 nt, Homo sapiens
cacaugccacuaugagcuu

SEQ ID NO: 1756103 - RNA, 20 nt, Homo sapiens
uugugccacuacacuccagc

SEQ ID NO: 1756104 - RNA, 20 nt, Homo sapiens
ugaaggacgugucucaggag

SEQ ID NO: 1756105 - RNA, 19 nt, Homo sapiens
ccaacccaaaccuggagau

SEQ ID NO: 1756106 - RNA, 17 nt, Homo sapiens
ccagaaggaaccagcca

SEQ ID NO: 1756107 - RNA, 22 nt, Homo sapiens
cugaucacuuccccaaucaaua

SEQ ID NO: 1756108 - RNA, 16 nt, Homo sapiens
uauuaacaauuaggca

SEQ ID NO: 1756109 - RNA, 14 nt, Homo sapiens
acuucuacauccaa

SEQ ID NO: 1756110 - RNA, 12 nt, Homo sapiens
cacaguguuacc

SEQ ID NO: 1756111 - RNA, 22 nt, Homo sapiens
auguauaugaacuuaacaugcu

SEQ ID NO: 1756112 - RNA, 21 nt, Homo sapiens
uucagagaaaacuucagagaa

SEQ ID NO: 1756113 - RNA, 19 nt, Homo sapiens
ccugguuuucgucaucuuc

SEQ ID NO: 1756114 - RNA, 18 nt, Homo sapiens
aauaugagauaaugcagu

SEQ ID NO: 1756115 - RNA, 20 nt, Homo sapiens
aguucauaucuggagccuga

SEQ ID NO: 1756116 - RNA, 18 nt, Homo sapiens
cugugcaaauccuugaua

SEQ ID NO: 1756117 - RNA, 16 nt, Homo sapiens
agguauuuaucauuca

SEQ ID NO: 1756118 - RNA, 17 nt, Homo sapiens
ucuuguugagugccagc

SEQ ID NO: 1756119 - RNA, 13 nt, Homo sapiens
uguggcugaugau

SEQ ID NO: 1756120 - RNA, 19 nt, Homo sapiens
cucacacacagacucauau

SEQ ID NO: 1756121 - RNA, 23 nt, Homo sapiens
aaucuguuaccucugacaucaag

SEQ ID NO: 1756122 - RNA, 20 nt, Homo sapiens
gacugggcaucucugagcaa

SEQ ID NO: 1756123 - RNA, 15 nt, Homo sapiens
uacaagcaucaugga

SEQ ID NO: 1756124 - RNA, 19 nt, Homo sapiens
ucugauuuuuaauuucuau

SEQ ID NO: 1756125 - RNA, 13 nt, Homo sapiens
auuuacacauaca

SEQ ID NO: 1756126 - RNA, 19 nt, Homo sapiens
caguacauuguauucuguu

SEQ ID NO: 1756127 - RNA, 22 nt, Homo sapiens
gguccacaacacacagauuuga

SEQ ID NO: 1756128 - RNA, 14 nt, Homo sapiens
ucuucccccaaagc

SEQ ID NO: 1756129 - RNA, 22 nt, Homo sapiens
uaguguuggaaaaugugcaaua

SEQ ID NO: 1756130 - RNA, 20 nt, Homo sapiens
aagucaguacccaccaccuu

SEQ ID NO: 1756131 - RNA, 16 nt, Homo sapiens
gaucugcacauuucau

SEQ ID NO: 1756132 - RNA, 23 nt, Homo sapiens
ccccagcuauuuucugaccaaaa

SEQ ID NO: 1756133 - RNA, 17 nt, Homo sapiens
ccccuggacugggaggu

SEQ ID NO: 1756134 - RNA, 22 nt, Homo sapiens
agaggauuucuucaaaucucag

SEQ ID NO: 1756135 - RNA, 13 nt, Homo sapiens
agaaaggcucuau

SEQ ID NO: 1756136 - RNA, 15 nt, Homo sapiens
auaaaagaucuugca

SEQ ID NO: 1756137 - RNA, 20 nt, Homo sapiens
caccuaugacauacauggaa

SEQ ID NO: 1756138 - RNA, 20 nt, Homo sapiens
auauuucuguguacacaucu

SEQ ID NO: 1756139 - RNA, 19 nt, Homo sapiens
ugccaguggaauacaguga

SEQ ID NO: 1756140 - RNA, 12 nt, Homo sapiens
uagguagcuuua

SEQ ID NO: 1756141 - RNA, 16 nt, Homo sapiens
ccuuggcuucugugau

SEQ ID NO: 1756142 - RNA, 18 nt, Homo sapiens
aaaaaagaaaacauucca

SEQ ID NO: 1756143 - RNA, 22 nt, Homo sapiens
agcaucagagagacuguuauca

SEQ ID NO: 1756144 - RNA, 16 nt, Homo sapiens
cuauuccuucacacag

SEQ ID NO: 1756145 - RNA, 21 nt, Homo sapiens
acugguaaaaagauccaggga

SEQ ID NO: 1756146 - RNA, 17 nt, Homo sapiens
gaagggaugcugcaaug

SEQ ID NO: 1756147 - RNA, 18 nt, Homo sapiens
ccaaagggugacuuuuca

SEQ ID NO: 1756148 - RNA, 20 nt, Homo sapiens
gcuggcgugcaguggugcga

SEQ ID NO: 1756149 - RNA, 17 nt, Homo sapiens
aggaugacaaaauggaa

SEQ ID NO: 1756150 - RNA, 22 nt, Homo sapiens
auucuuacaauugcacugcugu

SEQ ID NO: 1756151 - RNA, 14 nt, Homo sapiens
acaaagacuacuaa

SEQ ID NO: 1756152 - RNA, 20 nt, Homo sapiens
cuagacuguuugcugauccc

SEQ ID NO: 1756153 - RNA, 18 nt, Homo sapiens
agccuaccaaugccaaaa

SEQ ID NO: 1756154 - RNA, 22 nt, Homo sapiens
uccccuaggcgcuguucuugcu

SEQ ID NO: 1756155 - RNA, 20 nt, Homo sapiens
agauucccaaaccuaaugau

SEQ ID NO: 1756156 - RNA, 17 nt, Homo sapiens
ugucuuaucugcuauaa

SEQ ID NO: 1756157 - RNA, 17 nt, Homo sapiens
ggauucucuacugccaa

SEQ ID NO: 1756158 - RNA, 21 nt, Homo sapiens
aauucuuauugacucauacac

SEQ ID NO: 1756159 - RNA, 21 nt, Homo sapiens
acaaagugaggagaaugaaau

SEQ ID NO: 1756160 - RNA, 15 nt, Homo sapiens
gccagaggaucacca

SEQ ID NO: 1756161 - RNA, 19 nt, Homo sapiens
gcucucagaccuuacacac

SEQ ID NO: 1756162 - RNA, 16 nt, Homo sapiens
ucuaccugccacucac

SEQ ID NO: 1756163 - RNA, 21 nt, Homo sapiens
uaccuagcaaagcuccugccu

SEQ ID NO: 1756164 - RNA, 18 nt, Homo sapiens
agcuuugguaaucucugu

SEQ ID NO: 1756165 - RNA, 20 nt, Homo sapiens
aaauucaaaccaauucaccc

SEQ ID NO: 1756166 - RNA, 22 nt, Homo sapiens
uuaaacuuagacagcauguaug

SEQ ID NO: 1756167 - RNA, 14 nt, Homo sapiens
gcuuuggugccugg

SEQ ID NO: 1756168 - RNA, 22 nt, Homo sapiens
guaauuuuguaucuugaugucu

SEQ ID NO: 1756169 - RNA, 23 nt, Homo sapiens
uugacagggucucacucugucac

SEQ ID NO: 1756170 - RNA, 19 nt, Homo sapiens
gcccagccuaucucucuuc

SEQ ID NO: 1756171 - RNA, 22 nt, Homo sapiens
uucaugcaauccuuccaaauga

SEQ ID NO: 1756172 - RNA, 18 nt, Homo sapiens
acagguugggaugggaua

SEQ ID NO: 1756173 - RNA, 13 nt, Homo sapiens
uuaucccaaucau

SEQ ID NO: 1756174 - RNA, 15 nt, Homo sapiens
aucugauguuucaua

SEQ ID NO: 1756175 - RNA, 18 nt, Homo sapiens
aagaagaguuuacagaca

SEQ ID NO: 1756176 - RNA, 20 nt, Homo sapiens
auuccuacugacaacauuau

SEQ ID NO: 1756177 - RNA, 18 nt, Homo sapiens
gcuuccucuggccaggua

SEQ ID NO: 1756178 - RNA, 17 nt, Homo sapiens
aaucaacagaagcauuu

SEQ ID NO: 1756179 - RNA, 21 nt, Homo sapiens
aucuaagcuguuugccaagcu

SEQ ID NO: 1756180 - RNA, 18 nt, Homo sapiens
aagaagcuuccacaaaau

SEQ ID NO: 1756181 - RNA, 23 nt, Homo sapiens
auggcaccccaaccccagugaua

SEQ ID NO: 1756182 - RNA, 16 nt, Homo sapiens
caugagggacuccucc

SEQ ID NO: 1756183 - RNA, 18 nt, Homo sapiens
augaggcccucauuccca

SEQ ID NO: 1756184 - RNA, 20 nt, Homo sapiens
ugugagcuacuggcccaaga

SEQ ID NO: 1756185 - RNA, 23 nt, Homo sapiens
accgucucggcccugaaccacga

SEQ ID NO: 1756186 - RNA, 17 nt, Homo sapiens
uaaaaaaaaaaguuaca

SEQ ID NO: 1756187 - RNA, 22 nt, Homo sapiens
caggugugauaaaauguugaac

SEQ ID NO: 1756188 - RNA, 15 nt, Homo sapiens
cccaaggcgugcagg

SEQ ID NO: 1756189 - RNA, 23 nt, Homo sapiens
uccuaggaugucaugucugcuug

SEQ ID NO: 1756190 - RNA, 14 nt, Homo sapiens
aaacugucuugccc

SEQ ID NO: 1756191 - RNA, 13 nt, Homo sapiens
caauaaacuaaag

SEQ ID NO: 1756192 - RNA, 17 nt, Homo sapiens
agccguccaagaacaag

SEQ ID NO: 1756193 - RNA, 20 nt, Homo sapiens
ggccugcuagucacuggaaa

SEQ ID NO: 1756194 - RNA, 16 nt, Homo sapiens
guucacggcaaaaugu

SEQ ID NO: 1756195 - RNA, 19 nt, Homo sapiens
uaagaccugaucuauagau

SEQ ID NO: 1756196 - RNA, 22 nt, Homo sapiens
ucugcauggaacagcauuaccc

SEQ ID NO: 1756197 - RNA, 18 nt, Homo sapiens
ucacuggggggcucucag

SEQ ID NO: 1756198 - RNA, 21 nt, Homo sapiens
cccuuuaccaaauaaagcaaa

SEQ ID NO: 1756199 - RNA, 15 nt, Homo sapiens
aaacucauaacaguc

SEQ ID NO: 1756200 - RNA, 14 nt, Homo sapiens
ucaaaauguuuauu

SEQ ID NO: 1756201 - RNA, 20 nt, Homo sapiens
cagccauuguggaagacagu

SEQ ID NO: 1756202 - RNA, 13 nt, Homo sapiens
ucucagugcugua

SEQ ID NO: 1756203 - RNA, 14 nt, Homo sapiens
acccucagcacugu

SEQ ID NO: 1756204 - RNA, 13 nt, Homo sapiens
uucauuuguauug

SEQ ID NO: 1756205 - RNA, 16 nt, Homo sapiens
ccagcaccaacaccac

SEQ ID NO: 1756206 - RNA, 16 nt, Homo sapiens
guacaacuucugggcc

SEQ ID NO: 1756207 - RNA, 19 nt, Homo sapiens
uauuacaagaucuuuccaa

SEQ ID NO: 1756208 - RNA, 17 nt, Homo sapiens
aauacugagaaaaccug

SEQ ID NO: 1756209 - RNA, 16 nt, Homo sapiens
gccauuuuugugcuuu

SEQ ID NO: 1756210 - RNA, 17 nt, Homo sapiens
gauuguucaucaugaca

SEQ ID NO: 1756211 - RNA, 17 nt, Homo sapiens
auucaugguaucuugag

SEQ ID NO: 1756212 - RNA, 17 nt, Homo sapiens
agccauggaacccugcc

SEQ ID NO: 1756213 - RNA, 19 nt, Homo sapiens
ccaaauuucauaccuauca

SEQ ID NO: 1756214 - RNA, 21 nt, Homo sapiens
ucuaaagcaguuuauuauaau

SEQ ID NO: 1756215 - RNA, 19 nt, Homo sapiens
uuuuaucaggccaaguuaa

SEQ ID NO: 1756216 - RNA, 17 nt, Homo sapiens
acaugacaguauuccau

SEQ ID NO: 1756217 - RNA, 13 nt, Homo sapiens
aguaaaaagggaa

SEQ ID NO: 1756218 - RNA, 21 nt, Homo sapiens
cccuacuuucuggaaguggag

SEQ ID NO: 1756219 - RNA, 18 nt, Homo sapiens
ugagcauuguaauuaaua

SEQ ID NO: 1756220 - RNA, 13 nt, Homo sapiens
cucacacuggcca

SEQ ID NO: 1756221 - RNA, 14 nt, Homo sapiens
aagaaagcugagaa

SEQ ID NO: 1756222 - RNA, 19 nt, Homo sapiens
acucuguaauugaauauaa

SEQ ID NO: 1756223 - RNA, 9 nt, Homo sapiens
aacagggaa

SEQ ID NO: 1756224 - RNA, 22 nt, Homo sapiens
cuuagugguuaagcauuccuuu

SEQ ID NO: 1756225 - RNA, 11 nt, Homo sapiens
aggcuuggcac

SEQ ID NO: 1756226 - RNA, 12 nt, Homo sapiens
uauuuugagauu

SEQ ID NO: 1756227 - RNA, 15 nt, Homo sapiens
uguucuuagcugaac

SEQ ID NO: 1756228 - RNA, 15 nt, Homo sapiens
ccccaacauggaugu

SEQ ID NO: 1756229 - RNA, 19 nt, Homo sapiens
aguagaugaaacauuaacu

SEQ ID NO: 1756230 - RNA, 15 nt, Homo sapiens
ugagagaccaggcaa

SEQ ID NO: 1756231 - RNA, 16 nt, Homo sapiens
uggacuacauccugag

SEQ ID NO: 1756232 - RNA, 17 nt, Homo sapiens
uuuaaaaauucacuucu

SEQ ID NO: 1756233 - RNA, 13 nt, Homo sapiens
ccccacgugugaa

SEQ ID NO: 1756234 - RNA, 17 nt, Homo sapiens
aucagaaagccucucca

SEQ ID NO: 1756235 - RNA, 20 nt, Homo sapiens
ugaggcccugcccaaugaga

SEQ ID NO: 1756236 - RNA, 13 nt, Homo sapiens
guggcccaagacu

SEQ ID NO: 1756237 - RNA, 20 nt, Homo sapiens
uuaccaaggaugaaagagga

SEQ ID NO: 1756238 - RNA, 15 nt, Homo sapiens
gucagcuucucccaa

SEQ ID NO: 1756239 - RNA, 14 nt, Homo sapiens
ugcaaagcauuuga

SEQ ID NO: 1756240 - RNA, 15 nt, Homo sapiens
aacccugugucacuu

SEQ ID NO: 1756241 - RNA, 13 nt, Homo sapiens
aacuaccaucuga

SEQ ID NO: 1756242 - RNA, 17 nt, Homo sapiens
acuucauagaaaccucu

SEQ ID NO: 1756243 - RNA, 16 nt, Homo sapiens
acaagaauggucuuuc

SEQ ID NO: 1756244 - RNA, 16 nt, Homo sapiens
aguaugcuaugauuaa

SEQ ID NO: 1756245 - RNA, 22 nt, Homo sapiens
ccaggcuguucuccaggcuuca

SEQ ID NO: 1756246 - RNA, 20 nt, Homo sapiens
uauucgguaauaucauuaau

SEQ ID NO: 1756247 - RNA, 15 nt, Homo sapiens
aacuuacauaugucu

SEQ ID NO: 1756248 - RNA, 15 nt, Homo sapiens
cagccuagauaugaa

SEQ ID NO: 1756249 - RNA, 17 nt, Homo sapiens
acuguacacauaagcca

SEQ ID NO: 1756250 - RNA, 15 nt, Homo sapiens
ggaccagagcugcca

SEQ ID NO: 1756251 - RNA, 15 nt, Homo sapiens
ggggcguucgcugcg

SEQ ID NO: 1756252 - RNA, 13 nt, Homo sapiens
agcugggggacac

SEQ ID NO: 1756253 - RNA, 21 nt, Homo sapiens
aguaucuuuuuuccuuaucua

SEQ ID NO: 1756254 - RNA, 22 nt, Homo sapiens
ucugagccaaagagaaugccau

SEQ ID NO: 1756255 - RNA, 13 nt, Homo sapiens
aggacucuuccac

SEQ ID NO: 1756256 - RNA, 18 nt, Homo sapiens
aaacagcugacccaguga

SEQ ID NO: 1756257 - RNA, 21 nt, Homo sapiens
aaauggucacguuuggugcuu

SEQ ID NO: 1756258 - RNA, 15 nt, Homo sapiens
aacaucgauauguau

SEQ ID NO: 1756259 - RNA, 21 nt, Homo sapiens
caguguuuuucuucaugugca

SEQ ID NO: 1756260 - RNA, 18 nt, Homo sapiens
agucuauuuuuauuccuu

SEQ ID NO: 1756261 - RNA, 23 nt, Homo sapiens
uucugggagacacccaaagggug

SEQ ID NO: 1756262 - RNA, 17 nt, Homo sapiens
aagggccacgggaacuu

SEQ ID NO: 1756263 - RNA, 14 nt, Homo sapiens
agaguuaugcuuua

SEQ ID NO: 1756264 - RNA, 13 nt, Homo sapiens
uugcacaugugac

SEQ ID NO: 1756265 - RNA, 15 nt, Homo sapiens
aucuugcucuaucuc

SEQ ID NO: 1756266 - RNA, 15 nt, Homo sapiens
uguagcuaacaguga

SEQ ID NO: 1756267 - RNA, 18 nt, Homo sapiens
cggaggacgcuggggaaa

SEQ ID NO: 1756268 - RNA, 17 nt, Homo sapiens
cuucacccagagccagu

SEQ ID NO: 1756269 - RNA, 14 nt, Homo sapiens
ugcaaaaacuuuca

SEQ ID NO: 1756270 - RNA, 14 nt, Homo sapiens
auuaaaaccugaua

SEQ ID NO: 1756271 - RNA, 15 nt, Homo sapiens
uaaugauaacuggaa

SEQ ID NO: 1756272 - RNA, 23 nt, Homo sapiens
acaugccgcagggagggcugugg

SEQ ID NO: 1756273 - RNA, 23 nt, Homo sapiens
aggagaucgagaccaucuuggcc

SEQ ID NO: 1756274 - RNA, 22 nt, Homo sapiens
caagugauccuccugccucagc

SEQ ID NO: 1756275 - RNA, 20 nt, Homo sapiens
gcccccucaucucacugccc

SEQ ID NO: 1756276 - RNA, 23 nt, Homo sapiens
uggaccaaccccaggcagaaggu

SEQ ID NO: 1756277 - RNA, 15 nt, Homo sapiens
uucucuuaucugcca

SEQ ID NO: 1756278 - RNA, 21 nt, Homo sapiens
aucucuacuaaaaauacaaaa

SEQ ID NO: 1756279 - RNA, 22 nt, Homo sapiens
cacucaaaauagggacuaucua

SEQ ID NO: 1756280 - RNA, 21 nt, Homo sapiens
cugucaagcuuacuacaguga

SEQ ID NO: 1756281 - RNA, 15 nt, Homo sapiens
cucacugguuuucaa

SEQ ID NO: 1756282 - RNA, 15 nt, Homo sapiens
ugcaguuucauguau

SEQ ID NO: 1756283 - RNA, 14 nt, Homo sapiens
caucacuacaguac

SEQ ID NO: 1756284 - RNA, 14 nt, Homo sapiens
cuuccuuacugucu

SEQ ID NO: 1756285 - RNA, 14 nt, Homo sapiens
gcucuggggguccc

SEQ ID NO: 1756286 - RNA, 15 nt, Homo sapiens
ucucuuuaauggaau

SEQ ID NO: 1756287 - RNA, 17 nt, Homo sapiens
uuuuuaggagugauuac

SEQ ID NO: 1756288 - RNA, 15 nt, Homo sapiens
aauaucugaccaaga

SEQ ID NO: 1756289 - RNA, 14 nt, Homo sapiens
aauuaauacauucu

SEQ ID NO: 1756290 - RNA, 16 nt, Homo sapiens
gacauaucagugaccu

SEQ ID NO: 1756291 - RNA, 16 nt, Homo sapiens
cuuguacuugauccuc

SEQ ID NO: 1756292 - RNA, 21 nt, Homo sapiens
ucagccagcccguguguauaa

SEQ ID NO: 1756293 - RNA, 20 nt, Homo sapiens
cauuuaaaaggacugcugau

SEQ ID NO: 1756294 - RNA, 18 nt, Homo sapiens
auaagaugcugcugagca

SEQ ID NO: 1756295 - RNA, 21 nt, Homo sapiens
aaagucuaccccugcuaagga

SEQ ID NO: 1756296 - RNA, 14 nt, Homo sapiens
aucccaacuacuca

SEQ ID NO: 1756297 - RNA, 22 nt, Homo sapiens
cuuccaagucauucucaccuaa

SEQ ID NO: 1756298 - RNA, 18 nt, Homo sapiens
cagaucacuacugcaguc

SEQ ID NO: 1756299 - RNA, 21 nt, Homo sapiens
auuuugucuguacucauguca

SEQ ID NO: 1756300 - RNA, 17 nt, Homo sapiens
uggaggaaaaaaagcau

SEQ ID NO: 1756301 - RNA, 20 nt, Homo sapiens
ccaccugacaauggcagcua

SEQ ID NO: 1756302 - RNA, 20 nt, Homo sapiens
aauugaacauacucuaguga

SEQ ID NO: 1756303 - RNA, 23 nt, Homo sapiens
gacauuucgaagucaucauuccu

SEQ ID NO: 1756304 - RNA, 21 nt, Homo sapiens
cuugaaaggaagagcuaauaa

SEQ ID NO: 1756305 - RNA, 21 nt, Homo sapiens
caaccuguaguuuuacauaua

SEQ ID NO: 1756306 - RNA, 18 nt, Homo sapiens
cacugcaccccaagagag

SEQ ID NO: 1756307 - RNA, 13 nt, Homo sapiens
cucuuuuccuggc

SEQ ID NO: 1756308 - RNA, 16 nt, Homo sapiens
aacuccugccugagaa

SEQ ID NO: 1756309 - RNA, 18 nt, Homo sapiens
uccuaaaucuuccagcau

SEQ ID NO: 1756310 - RNA, 17 nt, Homo sapiens
cucuuguggugcauuga

SEQ ID NO: 1756311 - RNA, 15 nt, Homo sapiens
gacacagacauuuug

SEQ ID NO: 1756312 - RNA, 20 nt, Homo sapiens
cagauuuuaccuauccacaa

SEQ ID NO: 1756313 - RNA, 18 nt, Homo sapiens
acaaguagccucugggau

SEQ ID NO: 1756314 - RNA, 15 nt, Homo sapiens
aacaauucaugccuu

SEQ ID NO: 1756315 - RNA, 20 nt, Homo sapiens
gagggaccuacugaacccag

SEQ ID NO: 1756316 - RNA, 20 nt, Homo sapiens
agcaaagauugugccacuac

SEQ ID NO: 1756317 - RNA, 19 nt, Homo sapiens
caaaggagaaaaaaaaccu

SEQ ID NO: 1756318 - RNA, 24 nt, Homo sapiens
uaaaacaaagggcacagcaucugu

SEQ ID NO: 1756319 - RNA, 21 nt, Homo sapiens
cagcuaauugagaccacaggc

SEQ ID NO: 1756320 - RNA, 13 nt, Homo sapiens
auucaaaauauaa

SEQ ID NO: 1756321 - RNA, 18 nt, Homo sapiens
gaaacauuuuauacugua

SEQ ID NO: 1756322 - RNA, 16 nt, Homo sapiens
ugcucaggaaaccaca

SEQ ID NO: 1756323 - RNA, 16 nt, Homo sapiens
uuaccaauagccugaa

SEQ ID NO: 1756324 - RNA, 16 nt, Homo sapiens
cagcaaaccucaguca

SEQ ID NO: 1756325 - RNA, 15 nt, Homo sapiens
uagacgaacagcuga

SEQ ID NO: 1756326 - RNA, 16 nt, Homo sapiens
gacauaaagccauguu

SEQ ID NO: 1756327 - RNA, 23 nt, Homo sapiens
uaaguuuuguuuguucacacucc

SEQ ID NO: 1756328 - RNA, 15 nt, Homo sapiens
ccaccccuucccuau

SEQ ID NO: 1756329 - RNA, 19 nt, Homo sapiens
uucuauguauuagugucaa

SEQ ID NO: 1756330 - RNA, 19 nt, Homo sapiens
uggaaaucuuuuacauuuu

SEQ ID NO: 1756331 - RNA, 19 nt, Homo sapiens
ucccaaggccccacuuuca

SEQ ID NO: 1756332 - RNA, 16 nt, Homo sapiens
ccaguguggugucuug

SEQ ID NO: 1756333 - RNA, 19 nt, Homo sapiens
ugucuauuuaagugcaauu

SEQ ID NO: 1756334 - RNA, 14 nt, Homo sapiens
aacuaaauacuugc

SEQ ID NO: 1756335 - RNA, 13 nt, Homo sapiens
ccucccuucccag

SEQ ID NO: 1756336 - RNA, 13 nt, Homo sapiens
cagcuugcugcua

SEQ ID NO: 1756337 - RNA, 21 nt, Homo sapiens
aacuauggaaauaauacccca

SEQ ID NO: 1756338 - RNA, 21 nt, Homo sapiens
ugaaaccccaucuccacuaaa

SEQ ID NO: 1756339 - RNA, 19 nt, Homo sapiens
augucuaccaacugaugaa

SEQ ID NO: 1756340 - RNA, 18 nt, Homo sapiens
cagauauuguaagcauuc

SEQ ID NO: 1756341 - RNA, 21 nt, Homo sapiens
uguaauuguggauuaauguca

SEQ ID NO: 1756342 - RNA, 18 nt, Homo sapiens
gcuuaggugccaggcugu

SEQ ID NO: 1756343 - RNA, 22 nt, Homo sapiens
acuuauauugaagacaauuuga

SEQ ID NO: 1756344 - RNA, 16 nt, Homo sapiens
aaaaccucacuugaag

SEQ ID NO: 1756345 - RNA, 21 nt, Homo sapiens
cuauuaugggaaugacucuga

SEQ ID NO: 1756346 - RNA, 15 nt, Homo sapiens
ccagccccacuccuc

SEQ ID NO: 1756347 - RNA, 23 nt, Homo sapiens
ccuucaaggaagugauaacacug

SEQ ID NO: 1756348 - RNA, 22 nt, Homo sapiens
aacacauaacaauaaaaaccaa

SEQ ID NO: 1756349 - RNA, 17 nt, Homo sapiens
aauaaagaaauugcaau

SEQ ID NO: 1756350 - RNA, 17 nt, Homo sapiens
auacaccuuauuaauga

SEQ ID NO: 1756351 - RNA, 13 nt, Homo sapiens
ugauuggcucacc

SEQ ID NO: 1756352 - RNA, 14 nt, Homo sapiens
cauaugcuauguua

SEQ ID NO: 1756353 - RNA, 14 nt, Homo sapiens
uuuagaaacacaag

SEQ ID NO: 1756354 - RNA, 22 nt, Homo sapiens
accacaagugugcauuaccaca

SEQ ID NO: 1756355 - RNA, 23 nt, Homo sapiens
agguccucacagcagucacaggc

SEQ ID NO: 1756356 - RNA, 15 nt, Homo sapiens
auuguguuaaaucag

SEQ ID NO: 1756357 - RNA, 13 nt, Homo sapiens
augugcaaaaauu

SEQ ID NO: 1756358 - RNA, 12 nt, Homo sapiens
uccagacagucg

SEQ ID NO: 1756359 - RNA, 15 nt, Homo sapiens
aaauguuuaagucac

SEQ ID NO: 1756360 - RNA, 15 nt, Homo sapiens
gggcagggccacuca

SEQ ID NO: 1756361 - RNA, 15 nt, Homo sapiens
auuagcaaagcaaaa

SEQ ID NO: 1756362 - RNA, 17 nt, Homo sapiens
uccagagacauguggca

SEQ ID NO: 1756363 - RNA, 21 nt, Homo sapiens
caaguucuuaguugcuguaug

SEQ ID NO: 1756364 - RNA, 16 nt, Homo sapiens
uuuacagcucuuggca

SEQ ID NO: 1756365 - RNA, 19 nt, Homo sapiens
acacaguugggacccaaaa

SEQ ID NO: 1756366 - RNA, 23 nt, Homo sapiens
cuuccucgguagcagaggcccug

SEQ ID NO: 1756367 - RNA, 17 nt, Homo sapiens
caguugagaaacaguuc

SEQ ID NO: 1756368 - RNA, 12 nt, Homo sapiens
cagggugagcuc

SEQ ID NO: 1756369 - RNA, 15 nt, Homo sapiens
aaauaaaaaccaaga

SEQ ID NO: 1756370 - RNA, 18 nt, Homo sapiens
uuaaaaaaauacaguauu

SEQ ID NO: 1756371 - RNA, 13 nt, Homo sapiens
ggacuccagaucu

SEQ ID NO: 1756372 - RNA, 16 nt, Homo sapiens
cucaguuuuugcugau

SEQ ID NO: 1756373 - RNA, 20 nt, Homo sapiens
cugcccaccucucccugcau

SEQ ID NO: 1756374 - RNA, 17 nt, Homo sapiens
accugucauucuagaaa

SEQ ID NO: 1756375 - RNA, 17 nt, Homo sapiens
acccuagcuauaugcau

SEQ ID NO: 1756376 - RNA, 13 nt, Homo sapiens
cuuuugaggggcu

SEQ ID NO: 1756377 - RNA, 15 nt, Homo sapiens
cuuuuuaugcaaaag

SEQ ID NO: 1756378 - RNA, 20 nt, Homo sapiens
uagcuauggaaucaauucaa

SEQ ID NO: 1756379 - RNA, 19 nt, Homo sapiens
agacacaacaacuccuagg

SEQ ID NO: 1756380 - RNA, 15 nt, Homo sapiens
aauuuucauucugaa

SEQ ID NO: 1756381 - RNA, 15 nt, Homo sapiens
ggagacugauggcca

SEQ ID NO: 1756382 - RNA, 14 nt, Homo sapiens
caacuuaacaugaa

SEQ ID NO: 1756383 - RNA, 14 nt, Homo sapiens
ugagaaaaugucuu

SEQ ID NO: 1756384 - RNA, 13 nt, Homo sapiens
gacaaaauugcug

SEQ ID NO: 1756385 - RNA, 11 nt, Homo sapiens
caugaauucau

SEQ ID NO: 1756386 - RNA, 23 nt, Homo sapiens
aucagucaacaacuuacacuuau

SEQ ID NO: 1756387 - RNA, 13 nt, Homo sapiens
aauaaacaugacc

SEQ ID NO: 1756388 - RNA, 13 nt, Homo sapiens
agcccaugcuuuc

SEQ ID NO: 1756389 - RNA, 16 nt, Homo sapiens
aacauccauguuguca

SEQ ID NO: 1756390 - RNA, 20 nt, Homo sapiens
acacacccauguaaccacug

SEQ ID NO: 1756391 - RNA, 17 nt, Homo sapiens
ucaccccgccagccuac

SEQ ID NO: 1756392 - RNA, 20 nt, Homo sapiens
gcacugaagagagcauuugg

SEQ ID NO: 1756393 - RNA, 21 nt, Homo sapiens
aauaucccuccauacagugua

SEQ ID NO: 1756394 - RNA, 15 nt, Homo sapiens
uccucaugucaucaa

SEQ ID NO: 1756395 - RNA, 22 nt, Homo sapiens
aaaugacgguguuaauuuugcu

SEQ ID NO: 1756396 - RNA, 14 nt, Homo sapiens
uuuggauugucaaa

SEQ ID NO: 1756397 - RNA, 13 nt, Homo sapiens
guuuaaucuucac

SEQ ID NO: 1756398 - RNA, 13 nt, Homo sapiens
acaaaauacuugu

SEQ ID NO: 1756399 - RNA, 18 nt, Homo sapiens
ucuuguugcugcaucucc

SEQ ID NO: 1756400 - RNA, 18 nt, Homo sapiens
ccugcugcccagugcaaa

SEQ ID NO: 1756401 - RNA, 13 nt, Homo sapiens
aaaucuaccaaga

SEQ ID NO: 1756402 - RNA, 13 nt, Homo sapiens
ccuugagucaaaa

SEQ ID NO: 1756403 - RNA, 18 nt, Homo sapiens
agcuuuagagaagccaua

SEQ ID NO: 1756404 - RNA, 17 nt, Homo sapiens
agggcaguggcuucuuu

SEQ ID NO: 1756405 - RNA, 20 nt, Homo sapiens
uuaaaaguguaaaucuaaac

SEQ ID NO: 1756406 - RNA, 10 nt, Homo sapiens
uuugccacuu

SEQ ID NO: 1756407 - RNA, 16 nt, Homo sapiens
aacagaauuuuccauu

SEQ ID NO: 1756408 - RNA, 18 nt, Homo sapiens
aagaugguaaaccagauc

SEQ ID NO: 1756409 - RNA, 15 nt, Homo sapiens
agcaaugguggugca

SEQ ID NO: 1756410 - RNA, 14 nt, Homo sapiens
guccucuucuguga

SEQ ID NO: 1756411 - RNA, 20 nt, Homo sapiens
cagauccuccucauucacau

SEQ ID NO: 1756412 - RNA, 15 nt, Homo sapiens
aacuggggcuugcaa

SEQ ID NO: 1756413 - RNA, 13 nt, Homo sapiens
ccucugcugggaa

SEQ ID NO: 1756414 - RNA, 18 nt, Homo sapiens
augagaagucaacaguga

SEQ ID NO: 1756415 - RNA, 17 nt, Homo sapiens
aaugacugugucugccu

SEQ ID NO: 1756416 - RNA, 19 nt, Homo sapiens
aauuugacccuaaaaucua

SEQ ID NO: 1756417 - RNA, 15 nt, Homo sapiens
uugucuaccauuugu

SEQ ID NO: 1756418 - RNA, 21 nt, Homo sapiens
ugagccuguuuauugccauua

SEQ ID NO: 1756419 - RNA, 17 nt, Homo sapiens
auuuaaauuccacagau

SEQ ID NO: 1756420 - RNA, 13 nt, Homo sapiens
cacuuucaccagu

SEQ ID NO: 1756421 - RNA, 15 nt, Homo sapiens
caaucaugugccaga

SEQ ID NO: 1756422 - RNA, 18 nt, Homo sapiens
caggcugcccacucuggg

SEQ ID NO: 1756423 - RNA, 19 nt, Homo sapiens
ggccuaaagccagcauuuc

SEQ ID NO: 1756424 - RNA, 23 nt, Homo sapiens
cauuuaagucuguccauuaucua

SEQ ID NO: 1756425 - RNA, 20 nt, Homo sapiens
ccgcguuuagaccaaggaac

SEQ ID NO: 1756426 - RNA, 20 nt, Homo sapiens
aauuuucauuaaacuugaag

SEQ ID NO: 1756427 - RNA, 23 nt, Homo sapiens
caucagccccacaggacuuugau

SEQ ID NO: 1756428 - RNA, 23 nt, Homo sapiens
gagggugguuccuguucucagca

SEQ ID NO: 1756429 - RNA, 16 nt, Homo sapiens
uuucuaacacuagcuu

SEQ ID NO: 1756430 - RNA, 17 nt, Homo sapiens
uguaaaacgcugucaaa

SEQ ID NO: 1756431 - RNA, 15 nt, Homo sapiens
acuggggaagccagu

SEQ ID NO: 1756432 - RNA, 21 nt, Homo sapiens
gaacaugagccuuuguugcua

SEQ ID NO: 1756433 - RNA, 21 nt, Homo sapiens
ucgugcccaucaagugcaguc

SEQ ID NO: 1756434 - RNA, 13 nt, Homo sapiens
guuuauaaugcca

SEQ ID NO: 1756435 - RNA, 12 nt, Homo sapiens
ugcaagugcaaa

SEQ ID NO: 1756436 - RNA, 14 nt, Homo sapiens
augugcuacagggg

SEQ ID NO: 1756437 - RNA, 23 nt, Homo sapiens
ugccuuauauuuguccaacaacu

SEQ ID NO: 1756438 - RNA, 13 nt, Homo sapiens
uaaagcucucaaa

SEQ ID NO: 1756439 - RNA, 12 nt, Homo sapiens
uacuaaacauuu

SEQ ID NO: 1756440 - RNA, 19 nt, Homo sapiens
uuagagaaggcucagccuu

SEQ ID NO: 1756441 - RNA, 16 nt, Homo sapiens
ugucugugggcuucag

SEQ ID NO: 1756442 - RNA, 15 nt, Homo sapiens
guuaguuaaaagccc

SEQ ID NO: 1756443 - RNA, 12 nt, Homo sapiens
ccaugcugccag

SEQ ID NO: 1756444 - RNA, 20 nt, Homo sapiens
gacaauuagauaaaugucca

SEQ ID NO: 1756445 - RNA, 22 nt, Homo sapiens
uaacuucucccaaaguguccua

SEQ ID NO: 1756446 - RNA, 16 nt, Homo sapiens
agcuaauaaugagcua

SEQ ID NO: 1756447 - RNA, 15 nt, Homo sapiens
gccugauccaucccc

SEQ ID NO: 1756448 - RNA, 15 nt, Homo sapiens
uuagacuuugaaugu

SEQ ID NO: 1756449 - RNA, 20 nt, Homo sapiens
gggccugcaggccccagcca

SEQ ID NO: 1756450 - RNA, 15 nt, Homo sapiens
aaggucaaaacugaa

SEQ ID NO: 1756451 - RNA, 21 nt, Homo sapiens
acugucccucaaaugacccaa

SEQ ID NO: 1756452 - RNA, 14 nt, Homo sapiens
ggggcuacugugac

SEQ ID NO: 1756453 - RNA, 15 nt, Homo sapiens
acuauagugauauau

SEQ ID NO: 1756454 - RNA, 13 nt, Homo sapiens
auccuguguaugu

SEQ ID NO: 1756455 - RNA, 20 nt, Homo sapiens
aaauaugucacuagagaaau

SEQ ID NO: 1756456 - RNA, 12 nt, Homo sapiens
ucacaguacuuu

SEQ ID NO: 1756457 - RNA, 16 nt, Homo sapiens
gugacagcacuuuccu

SEQ ID NO: 1756458 - RNA, 16 nt, Homo sapiens
acuucuaaaccaaaaa

SEQ ID NO: 1756459 - RNA, 20 nt, Homo sapiens
caugacggcucaugccugua

SEQ ID NO: 1756460 - RNA, 13 nt, Homo sapiens
cauagagaacugu

SEQ ID NO: 1756461 - RNA, 20 nt, Homo sapiens
aacuucuacuucugcccuug

SEQ ID NO: 1756462 - RNA, 15 nt, Homo sapiens
ccauuauaaaaucuu

SEQ ID NO: 1756463 - RNA, 18 nt, Homo sapiens
ccccagccaucuacugga

SEQ ID NO: 1756464 - RNA, 21 nt, Homo sapiens
uuccuaaagccaucaugccuu

SEQ ID NO: 1756465 - RNA, 21 nt, Homo sapiens
acugccccugcugugcugcuc

SEQ ID NO: 1756466 - RNA, 15 nt, Homo sapiens
ugagguguugugcau

SEQ ID NO: 1756467 - RNA, 15 nt, Homo sapiens
caacuccaggauuua

SEQ ID NO: 1756468 - RNA, 17 nt, Homo sapiens
cacuuuauaaauaucaa

SEQ ID NO: 1756469 - RNA, 18 nt, Homo sapiens
gcaauaacucagcaguua

SEQ ID NO: 1756470 - RNA, 17 nt, Homo sapiens
ccuaguucaaugugcuu

SEQ ID NO: 1756471 - RNA, 22 nt, Homo sapiens
cacugucucauccacauaagca

SEQ ID NO: 1756472 - RNA, 16 nt, Homo sapiens
agugauagcuacugua

SEQ ID NO: 1756473 - RNA, 13 nt, Homo sapiens
aaaaauacaauua

SEQ ID NO: 1756474 - RNA, 13 nt, Homo sapiens
aagcaaggccagc

SEQ ID NO: 1756475 - RNA, 17 nt, Homo sapiens
uagccuauacugcauua

SEQ ID NO: 1756476 - RNA, 14 nt, Homo sapiens
ugcuguaugucucg

SEQ ID NO: 1756477 - RNA, 23 nt, Homo sapiens
ugcuuugccaaguugcugucacu

SEQ ID NO: 1756478 - RNA, 24 nt, Homo sapiens
augaggccacugcugcuucuccau

SEQ ID NO: 1756479 - RNA, 12 nt, Homo sapiens
aauuaaggccag

SEQ ID NO: 1756480 - RNA, 15 nt, Homo sapiens
gaaguaucaagccau

SEQ ID NO: 1756481 - RNA, 15 nt, Homo sapiens
guuauauuacuugcc

SEQ ID NO: 1756482 - RNA, 13 nt, Homo sapiens
cuccaaacugaag

SEQ ID NO: 1756483 - RNA, 22 nt, Homo sapiens
acuaacaagaauguaacuccag

SEQ ID NO: 1756484 - RNA, 15 nt, Homo sapiens
gccugucugugugca

SEQ ID NO: 1756485 - RNA, 18 nt, Homo sapiens
cuuugagauagcccaucu

SEQ ID NO: 1756486 - RNA, 12 nt, Homo sapiens
cccuaagcaugg

SEQ ID NO: 1756487 - RNA, 13 nt, Homo sapiens
uagcucacugaau

SEQ ID NO: 1756488 - RNA, 23 nt, Homo sapiens
acaucaacugcaucaagauguga

SEQ ID NO: 1756489 - RNA, 21 nt, Homo sapiens
cacguagcaaaucguacauug

SEQ ID NO: 1756490 - RNA, 16 nt, Homo sapiens
gacuccgucucaagga

SEQ ID NO: 1756491 - RNA, 14 nt, Homo sapiens
gucuccgcucugaa

SEQ ID NO: 1756492 - RNA, 16 nt, Homo sapiens
uaagcagauauucaau

SEQ ID NO: 1756493 - RNA, 11 nt, Homo sapiens
aauuguugcua

SEQ ID NO: 1756494 - RNA, 13 nt, Homo sapiens
uucaugugacaca

SEQ ID NO: 1756495 - RNA, 13 nt, Homo sapiens
uccaugugauaca

SEQ ID NO: 1756496 - RNA, 21 nt, Homo sapiens
cuucugagaccuuguuucaau

SEQ ID NO: 1756497 - RNA, 20 nt, Homo sapiens
gccacaggcauuuccugcuu

SEQ ID NO: 1756498 - RNA, 11 nt, Homo sapiens
uggacuuccag

SEQ ID NO: 1756499 - RNA, 23 nt, Homo sapiens
gcagcacucaaaccuggagcuga

SEQ ID NO: 1756500 - RNA, 18 nt, Homo sapiens
ccuucugcuguauacugu

SEQ ID NO: 1756501 - RNA, 23 nt, Homo sapiens
aaugguaaccgagccagcagcug

SEQ ID NO: 1756502 - RNA, 18 nt, Homo sapiens
cagagcgccucaccugca

SEQ ID NO: 1756503 - RNA, 21 nt, Homo sapiens
ccgccacccucccacugccaa

SEQ ID NO: 1756504 - RNA, 19 nt, Homo sapiens
cuuuguagacuguuucaca

SEQ ID NO: 1756505 - RNA, 15 nt, Homo sapiens
cauaucaacuugagg

SEQ ID NO: 1756506 - RNA, 22 nt, Homo sapiens
ugaacccccucaaaagccaaaa

SEQ ID NO: 1756507 - RNA, 13 nt, Homo sapiens
ugcuggugcauca

SEQ ID NO: 1756508 - RNA, 24 nt, Homo sapiens
cccugugaguuuguacagucuugc

SEQ ID NO: 1756509 - RNA, 14 nt, Homo sapiens
uccugaagcugcug

SEQ ID NO: 1756510 - RNA, 19 nt, Homo sapiens
accagacgguucaccagcc

SEQ ID NO: 1756511 - RNA, 17 nt, Homo sapiens
cugcaauaaaaugauau

SEQ ID NO: 1756512 - RNA, 14 nt, Homo sapiens
cgcagcgggugguc

SEQ ID NO: 1756513 - RNA, 13 nt, Homo sapiens
augugcagauauc

SEQ ID NO: 1756514 - RNA, 19 nt, Homo sapiens
acaucacugucuugccaga

SEQ ID NO: 1756515 - RNA, 13 nt, Homo sapiens
aaagccucaucca

SEQ ID NO: 1756516 - RNA, 22 nt, Homo sapiens
auuugucuucccuucuuugcac

SEQ ID NO: 1756517 - RNA, 22 nt, Homo sapiens
acuuauagaauucagucaaaga

SEQ ID NO: 1756518 - RNA, 14 nt, Homo sapiens
uuuaucugugcaaa

SEQ ID NO: 1756519 - RNA, 14 nt, Homo sapiens
acaguauccacaau

SEQ ID NO: 1756520 - RNA, 21 nt, Homo sapiens
ucacugccagagauaaacuaa

SEQ ID NO: 1756521 - RNA, 16 nt, Homo sapiens
gaaugccacagugaag

SEQ ID NO: 1756522 - RNA, 19 nt, Homo sapiens
uaauagauuguuuugccac

SEQ ID NO: 1756523 - RNA, 14 nt, Homo sapiens
cauuuaauguauau

SEQ ID NO: 1756524 - RNA, 18 nt, Homo sapiens
cuaaucugugcuguuuca

SEQ ID NO: 1756525 - RNA, 15 nt, Homo sapiens
caccauuuagucacu

SEQ ID NO: 1756526 - RNA, 23 nt, Homo sapiens
gaaaauuauagucaauauaccau

SEQ ID NO: 1756527 - RNA, 20 nt, Homo sapiens
agagaugacuauuacuuuuc

SEQ ID NO: 1756528 - RNA, 12 nt, Homo sapiens
caauguguacaa

SEQ ID NO: 1756529 - RNA, 12 nt, Homo sapiens
aaaaguguccau

SEQ ID NO: 1756530 - RNA, 23 nt, Homo sapiens
auguguaguuaauuuuauuccag

SEQ ID NO: 1756531 - RNA, 21 nt, Homo sapiens
aauuagggguuaaagcagaca

SEQ ID NO: 1756532 - RNA, 15 nt, Homo sapiens
aaaccuaauauucaa

SEQ ID NO: 1756533 - RNA, 17 nt, Homo sapiens
ugauccccaagugguga

SEQ ID NO: 1756534 - RNA, 13 nt, Homo sapiens
auuguuaccuuaa

SEQ ID NO: 1756535 - RNA, 16 nt, Homo sapiens
gcaucuuccacuggaa

SEQ ID NO: 1756536 - RNA, 20 nt, Homo sapiens
cuuugcuauggggacauucc

SEQ ID NO: 1756537 - RNA, 14 nt, Homo sapiens
agaauacacuauca

SEQ ID NO: 1756538 - RNA, 21 nt, Homo sapiens
auacuuauauuucccuaaaau

SEQ ID NO: 1756539 - RNA, 16 nt, Homo sapiens
uccaagaaagauccac

SEQ ID NO: 1756540 - RNA, 16 nt, Homo sapiens
uuuaacaguuaugcuu

SEQ ID NO: 1756541 - RNA, 12 nt, Homo sapiens
gaauuaagcaaa

SEQ ID NO: 1756542 - RNA, 17 nt, Homo sapiens
aaguauguaaguaucac

SEQ ID NO: 1756543 - RNA, 12 nt, Homo sapiens
gcucuguggcaa

SEQ ID NO: 1756544 - RNA, 23 nt, Homo sapiens
cagagaaguugcugcuugugauc

SEQ ID NO: 1756545 - RNA, 15 nt, Homo sapiens
gaccccaggcucuua

SEQ ID NO: 1756546 - RNA, 18 nt, Homo sapiens
gccauauggacacuguga

SEQ ID NO: 1756547 - RNA, 17 nt, Homo sapiens
caauaaaacuuuuccaa

SEQ ID NO: 1756548 - RNA, 18 nt, Homo sapiens
accugauauucaggcuac

SEQ ID NO: 1756549 - RNA, 22 nt, Homo sapiens
guaucaagcccugaaaauaugg

SEQ ID NO: 1756550 - RNA, 19 nt, Homo sapiens
aaaccgaggacccaugaaa

SEQ ID NO: 1756551 - RNA, 21 nt, Homo sapiens
guuucgugaaguauacuguau

SEQ ID NO: 1756552 - RNA, 23 nt, Homo sapiens
aaagcccccuguuuuaugcccuu

SEQ ID NO: 1756553 - RNA, 16 nt, Homo sapiens
uggaauuuuucauuga

SEQ ID NO: 1756554 - RNA, 18 nt, Homo sapiens
cugaaguagugugcaguu

SEQ ID NO: 1756555 - RNA, 14 nt, Homo sapiens
ucuucuacugcuau

SEQ ID NO: 1756556 - RNA, 16 nt, Homo sapiens
uuuuaaugcaccaauc

SEQ ID NO: 1756557 - RNA, 19 nt, Homo sapiens
uccuugagagaccaggcaa

SEQ ID NO: 1756558 - RNA, 20 nt, Homo sapiens
uaugguacaagcaaugccug

SEQ ID NO: 1756559 - RNA, 17 nt, Homo sapiens
aacugauguuacuagcc

SEQ ID NO: 1756560 - RNA, 19 nt, Homo sapiens
cccugguggucacaggcug

SEQ ID NO: 1756561 - RNA, 15 nt, Homo sapiens
uauacaaaacuuuau

SEQ ID NO: 1756562 - RNA, 18 nt, Homo sapiens
acucauuucacagccuuu

SEQ ID NO: 1756563 - RNA, 17 nt, Homo sapiens
gagacugcccuucucac

SEQ ID NO: 1756564 - RNA, 14 nt, Homo sapiens
agaaaguggugcuc

SEQ ID NO: 1756565 - RNA, 21 nt, Homo sapiens
ugagaacucguucaccuccaa

SEQ ID NO: 1756566 - RNA, 14 nt, Homo sapiens
aauauacccaucca

SEQ ID NO: 1756567 - RNA, 21 nt, Homo sapiens
acagaucauccugcuugacug

SEQ ID NO: 1756568 - RNA, 17 nt, Homo sapiens
ucacuaaaauuaaucug

SEQ ID NO: 1756569 - RNA, 17 nt, Homo sapiens
agaugauggaugccaau

SEQ ID NO: 1756570 - RNA, 18 nt, Homo sapiens
gaccauaucaggagaccu

SEQ ID NO: 1756571 - RNA, 15 nt, Homo sapiens
aauaaaguugaauau

SEQ ID NO: 1756572 - RNA, 23 nt, Homo sapiens
agccugacaacagccugagaaau

SEQ ID NO: 1756573 - RNA, 19 nt, Homo sapiens
caaugauauugacacuguc

SEQ ID NO: 1756574 - RNA, 14 nt, Homo sapiens
uuuucaagaugcuu

SEQ ID NO: 1756575 - RNA, 20 nt, Homo sapiens
uguagggccugcauggagaa

SEQ ID NO: 1756576 - RNA, 14 nt, Homo sapiens
gaugcuaaaccuua

SEQ ID NO: 1756577 - RNA, 14 nt, Homo sapiens
agcuggcucuguga

SEQ ID NO: 1756578 - RNA, 14 nt, Homo sapiens
uuguaaaacaaaga

SEQ ID NO: 1756579 - RNA, 15 nt, Homo sapiens
agggacaaugccaau

SEQ ID NO: 1756580 - RNA, 17 nt, Homo sapiens
ccuaaagggacuaccuc

SEQ ID NO: 1756581 - RNA, 20 nt, Homo sapiens
uuuaccaaagagauauugau

SEQ ID NO: 1756582 - RNA, 14 nt, Homo sapiens
gucauuucaaagac

SEQ ID NO: 1756583 - RNA, 12 nt, Homo sapiens
aaugagugcacc

SEQ ID NO: 1756584 - RNA, 20 nt, Homo sapiens
gaucucugguuguccucacu

SEQ ID NO: 1756585 - RNA, 14 nt, Homo sapiens
cccugcccugagga

SEQ ID NO: 1756586 - RNA, 18 nt, Homo sapiens
cagaguguccuuccucug

SEQ ID NO: 1756587 - RNA, 21 nt, Homo sapiens
cccuuuccugggggaugugca

SEQ ID NO: 1756588 - RNA, 13 nt, Homo sapiens
uuccuaaggcaug

SEQ ID NO: 1756589 - RNA, 12 nt, Homo sapiens
gcuuucugccac

SEQ ID NO: 1756590 - RNA, 15 nt, Homo sapiens
ucacaggacuaugga

SEQ ID NO: 1756591 - RNA, 19 nt, Homo sapiens
aguuguagguaauauugca

SEQ ID NO: 1756592 - RNA, 19 nt, Homo sapiens
aaacugauuacaacugcua

SEQ ID NO: 1756593 - RNA, 17 nt, Homo sapiens
ucccugcaccgucucac

SEQ ID NO: 1756594 - RNA, 22 nt, Homo sapiens
ucagacuggcccuuaagccaaa

SEQ ID NO: 1756595 - RNA, 13 nt, Homo sapiens
cucgcaccugccu

SEQ ID NO: 1756596 - RNA, 17 nt, Homo sapiens
ucugguaggaaugcuuc

SEQ ID NO: 1756597 - RNA, 21 nt, Homo sapiens
uguguacaguugguucauccc

SEQ ID NO: 1756598 - RNA, 21 nt, Homo sapiens
uauauauaauuugaguguaua

SEQ ID NO: 1756599 - RNA, 16 nt, Homo sapiens
gaucugcuagugcugu

SEQ ID NO: 1756600 - RNA, 16 nt, Homo sapiens
aaaaagcccaaccucu

SEQ ID NO: 1756601 - RNA, 21 nt, Homo sapiens
caaaugaaguauuucauguaa

SEQ ID NO: 1756602 - RNA, 18 nt, Homo sapiens
aacgccuguuacacacaa

SEQ ID NO: 1756603 - RNA, 14 nt, Homo sapiens
aaugauuauauuca

SEQ ID NO: 1756604 - RNA, 17 nt, Homo sapiens
gccgaggccugcauguc

SEQ ID NO: 1756605 - RNA, 20 nt, Homo sapiens
ucaugcugcuuagaugacau

SEQ ID NO: 1756606 - RNA, 17 nt, Homo sapiens
cuauuugccaagaccau

SEQ ID NO: 1756607 - RNA, 11 nt, Homo sapiens
gaagacauuuu

SEQ ID NO: 1756608 - RNA, 21 nt, Homo sapiens
cacguguuuuccaucccacau

SEQ ID NO: 1756609 - RNA, 18 nt, Homo sapiens
gcaugguguuuucauucc

SEQ ID NO: 1756610 - RNA, 10 nt, Homo sapiens
gcuggugggg

SEQ ID NO: 1756611 - RNA, 20 nt, Homo sapiens
cccugcuaccugauuucagc

SEQ ID NO: 1756612 - RNA, 21 nt, Homo sapiens
uauggcaaaaguaggcaucua

SEQ ID NO: 1756613 - RNA, 15 nt, Homo sapiens
augaccauaugcaca

SEQ ID NO: 1756614 - RNA, 13 nt, Homo sapiens
guugcucuucuac

SEQ ID NO: 1756615 - RNA, 11 nt, Homo sapiens
ggccaguguga

SEQ ID NO: 1756616 - RNA, 20 nt, Homo sapiens
ugaaaauguccauuuacacg

SEQ ID NO: 1756617 - RNA, 19 nt, Homo sapiens
auacaagaaagcaaugcca

SEQ ID NO: 1756618 - RNA, 12 nt, Homo sapiens
ccaugcccucau

SEQ ID NO: 1756619 - RNA, 21 nt, Homo sapiens
cuggagugaaguggugugauc

SEQ ID NO: 1756620 - RNA, 19 nt, Homo sapiens
agccaaggugcuaaaagga

SEQ ID NO: 1756621 - RNA, 12 nt, Homo sapiens
caguauuaugca

SEQ ID NO: 1756622 - RNA, 19 nt, Homo sapiens
ugaaagggacaaguaucau

SEQ ID NO: 1756623 - RNA, 14 nt, Homo sapiens
uugcaugugaaaau

SEQ ID NO: 1756624 - RNA, 12 nt, Homo sapiens
acggugccaagg

SEQ ID NO: 1756625 - RNA, 16 nt, Homo sapiens
uuacaagugguuaaaa

SEQ ID NO: 1756626 - RNA, 18 nt, Homo sapiens
uucaagugcuucuccagc

SEQ ID NO: 1756627 - RNA, 15 nt, Homo sapiens
uuuuggggggaacau

SEQ ID NO: 1756628 - RNA, 14 nt, Homo sapiens
aaaugauacaguca

SEQ ID NO: 1756629 - RNA, 16 nt, Homo sapiens
ccuuuuuugcaugugc

SEQ ID NO: 1756630 - RNA, 14 nt, Homo sapiens
gaacugcacuuuuu

SEQ ID NO: 1756631 - RNA, 22 nt, Homo sapiens
gccuuagggugcugagugccug

SEQ ID NO: 1756632 - RNA, 14 nt, Homo sapiens
guuggcacaugccu

SEQ ID NO: 1756633 - RNA, 14 nt, Homo sapiens
ugcuuaaaguuuua

SEQ ID NO: 1756634 - RNA, 15 nt, Homo sapiens
ugaguguucugggau

SEQ ID NO: 1756635 - RNA, 14 nt, Homo sapiens
acauuuaugaccua

SEQ ID NO: 1756636 - RNA, 15 nt, Homo sapiens
ugacucagcacuguu

SEQ ID NO: 1756637 - RNA, 19 nt, Homo sapiens
cagccuccucaguagcuag

SEQ ID NO: 1756638 - RNA, 18 nt, Homo sapiens
agacuggccaggccuccc

SEQ ID NO: 1756639 - RNA, 21 nt, Homo sapiens
uugcuuguaaaauuucacuua

SEQ ID NO: 1756640 - RNA, 20 nt, Homo sapiens
cucucuaagguaacauuuau

SEQ ID NO: 1756641 - RNA, 13 nt, Homo sapiens
gcauucagacucc

SEQ ID NO: 1756642 - RNA, 15 nt, Homo sapiens
aauguguuugcaaua

SEQ ID NO: 1756643 - RNA, 13 nt, Homo sapiens
auccuaacaugac

SEQ ID NO: 1756644 - RNA, 13 nt, Homo sapiens
aggccaacagcau

SEQ ID NO: 1756645 - RNA, 11 nt, Homo sapiens
cucacuagcuc

SEQ ID NO: 1756646 - RNA, 13 nt, Homo sapiens
gcuuggcugugcc

SEQ ID NO: 1756647 - RNA, 13 nt, Homo sapiens
ccuuggcucugcc

SEQ ID NO: 1756648 - RNA, 19 nt, Homo sapiens
gcuuauagaggaacuugaa

SEQ ID NO: 1756649 - RNA, 13 nt, Homo sapiens
acaaucuggcuca

SEQ ID NO: 1756650 - RNA, 20 nt, Homo sapiens
caggcccacgaggagcagca

SEQ ID NO: 1756651 - RNA, 18 nt, Homo sapiens
ugaggcuugguuccuucc

SEQ ID NO: 1756652 - RNA, 13 nt, Homo sapiens
aggaaaugaaugc

SEQ ID NO: 1756653 - RNA, 17 nt, Homo sapiens
gccagcauuuucauuca

SEQ ID NO: 1756654 - RNA, 15 nt, Homo sapiens
gucucgaacuccuga

SEQ ID NO: 1756655 - RNA, 15 nt, Homo sapiens
gcuucugugcaauaa

SEQ ID NO: 1756656 - RNA, 21 nt, Homo sapiens
ccauguaugaagccaaauauu

SEQ ID NO: 1756657 - RNA, 11 nt, Homo sapiens
aagucuuucau

SEQ ID NO: 1756658 - RNA, 21 nt, Homo sapiens
aaggcaaaaaaggaugcaaca

SEQ ID NO: 1756659 - RNA, 18 nt, Homo sapiens
acaauggcuaauucccag

SEQ ID NO: 1756660 - RNA, 20 nt, Homo sapiens
augugcucugauuugauaua

SEQ ID NO: 1756661 - RNA, 23 nt, Homo sapiens
agagcuuuacagugccacgacau

SEQ ID NO: 1756662 - RNA, 21 nt, Homo sapiens
uaucuuguucuuuaaaaucac

SEQ ID NO: 1756663 - RNA, 18 nt, Homo sapiens
cugcaguuuuugacuuca

SEQ ID NO: 1756664 - RNA, 20 nt, Homo sapiens
agcaugucccaggcacugua

SEQ ID NO: 1756665 - RNA, 13 nt, Homo sapiens
guuuuuucacuau

SEQ ID NO: 1756666 - RNA, 17 nt, Homo sapiens
ugccauuucugaacugu

SEQ ID NO: 1756667 - RNA, 22 nt, Homo sapiens
gcgcacuucagaaucagauaua

SEQ ID NO: 1756668 - RNA, 15 nt, Homo sapiens
uaauuaagggaaucc

SEQ ID NO: 1756669 - RNA, 13 nt, Homo sapiens
aguagcugagcuc

SEQ ID NO: 1756670 - RNA, 13 nt, Homo sapiens
guuuccuggucag

SEQ ID NO: 1756671 - RNA, 15 nt, Homo sapiens
ggcauauacagugaa

SEQ ID NO: 1756672 - RNA, 14 nt, Homo sapiens
aauggcacgcuccu

SEQ ID NO: 1756673 - RNA, 15 nt, Homo sapiens
uuacuguuucuguca

SEQ ID NO: 1756674 - RNA, 17 nt, Homo sapiens
caggagcagcugugcug

SEQ ID NO: 1756675 - RNA, 17 nt, Homo sapiens
uaauuauguuuaccuca

SEQ ID NO: 1756676 - RNA, 12 nt, Homo sapiens
ugccauggugau

SEQ ID NO: 1756677 - RNA, 22 nt, Homo sapiens
cuggcuucaggagggagcauag

SEQ ID NO: 1756678 - RNA, 17 nt, Homo sapiens
uguuauguuugcacuuu

SEQ ID NO: 1756679 - RNA, 21 nt, Homo sapiens
aagauaaaaaaacagcuuuau

SEQ ID NO: 1756680 - RNA, 17 nt, Homo sapiens
acgugcacgcacacugu

SEQ ID NO: 1756681 - RNA, 17 nt, Homo sapiens
uccacaguuaggccaag

SEQ ID NO: 1756682 - RNA, 19 nt, Homo sapiens
ucuuguugauuuccgugaa

SEQ ID NO: 1756683 - RNA, 16 nt, Homo sapiens
ggccaucaaccucugu

SEQ ID NO: 1756684 - RNA, 19 nt, Homo sapiens
gcccaggcuggaguacagu

SEQ ID NO: 1756685 - RNA, 23 nt, Homo sapiens
gccauaccugguaagcaaaaacu

SEQ ID NO: 1756686 - RNA, 22 nt, Homo sapiens
ccagguggugguuccgccucca

SEQ ID NO: 1756687 - RNA, 14 nt, Homo sapiens
cauucacagagccu

SEQ ID NO: 1756688 - RNA, 15 nt, Homo sapiens
uaccuucaacaugug

SEQ ID NO: 1756689 - RNA, 12 nt, Homo sapiens
aaauauucccug

SEQ ID NO: 1756690 - RNA, 14 nt, Homo sapiens
ugcagcagagccug

SEQ ID NO: 1756691 - RNA, 19 nt, Homo sapiens
caaaccuuuaaauuuucaa

SEQ ID NO: 1756692 - RNA, 20 nt, Homo sapiens
ccauccaaagaauuaugcau

SEQ ID NO: 1756693 - RNA, 18 nt, Homo sapiens
guucaaaacaaccacuuu

SEQ ID NO: 1756694 - RNA, 17 nt, Homo sapiens
acauucuggcucaggga

SEQ ID NO: 1756695 - RNA, 17 nt, Homo sapiens
uaaaauaacuaguacaa

SEQ ID NO: 1756696 - RNA, 23 nt, Homo sapiens
cuuuauaaaauauuuaaugugac

SEQ ID NO: 1756697 - RNA, 19 nt, Homo sapiens
augaaccuacuacccaggu

SEQ ID NO: 1756698 - RNA, 17 nt, Homo sapiens
agaaauagacaguauau

SEQ ID NO: 1756699 - RNA, 20 nt, Homo sapiens
cuuucugauucacagucuca

SEQ ID NO: 1756700 - RNA, 20 nt, Homo sapiens
auaucuauuauucaaaaaau

SEQ ID NO: 1756701 - RNA, 16 nt, Homo sapiens
auucccugcuaccuga

SEQ ID NO: 1756702 - RNA, 16 nt, Homo sapiens
aaauaaaucuaucaaa

SEQ ID NO: 1756703 - RNA, 18 nt, Homo sapiens
ucauuuccccauaacuca

SEQ ID NO: 1756704 - RNA, 15 nt, Homo sapiens
aaugaagaaagggag

SEQ ID NO: 1756705 - RNA, 12 nt, Homo sapiens
uaaguguacuuc

SEQ ID NO: 1756706 - RNA, 16 nt, Homo sapiens
agaaaaaaaaagugaa

SEQ ID NO: 1756707 - RNA, 13 nt, Homo sapiens
gagacauugcucu

SEQ ID NO: 1756708 - RNA, 18 nt, Homo sapiens
agaaaaucaguaauugga

SEQ ID NO: 1756709 - RNA, 22 nt, Homo sapiens
ucacaugaugaauaaauagaug

SEQ ID NO: 1756710 - RNA, 15 nt, Homo sapiens
ucccuccucaugccu

SEQ ID NO: 1756711 - RNA, 21 nt, Homo sapiens
gccccacaccaguugcccaga

SEQ ID NO: 1756712 - RNA, 14 nt, Homo sapiens
ccuucagauuugcc

SEQ ID NO: 1756713 - RNA, 13 nt, Homo sapiens
agauaauugccau

SEQ ID NO: 1756714 - RNA, 19 nt, Homo sapiens
aaagugugagcucuucccu

SEQ ID NO: 1756715 - RNA, 18 nt, Homo sapiens
aaccuccccaacagcacu

SEQ ID NO: 1756716 - RNA, 21 nt, Homo sapiens
gaugacgauucuuaacaauaa

SEQ ID NO: 1756717 - RNA, 14 nt, Homo sapiens
ccuugaggagucuu

SEQ ID NO: 1756718 - RNA, 20 nt, Homo sapiens
gccuauuguuuguaaaacca

SEQ ID NO: 1756719 - RNA, 19 nt, Homo sapiens
caggcaguaugcugucaug

SEQ ID NO: 1756720 - RNA, 23 nt, Homo sapiens
cuuccagcauuuagcuggccaca

SEQ ID NO: 1756721 - RNA, 15 nt, Homo sapiens
acugcacccagcuaa

SEQ ID NO: 1756722 - RNA, 15 nt, Homo sapiens
aaugaugcuaugaaa

SEQ ID NO: 1756723 - RNA, 22 nt, Homo sapiens
uagauugagcuuagauugccuc

SEQ ID NO: 1756724 - RNA, 20 nt, Homo sapiens
uguuauauuuaaugcauuaa

SEQ ID NO: 1756725 - RNA, 15 nt, Homo sapiens
uaguaugaaugcagu

SEQ ID NO: 1756726 - RNA, 18 nt, Homo sapiens
caguuugauaccugcacu

SEQ ID NO: 1756727 - RNA, 23 nt, Homo sapiens
ucucaagggcuagcaucccugag

SEQ ID NO: 1756728 - RNA, 17 nt, Homo sapiens
acuuagaagaaaucauu

SEQ ID NO: 1756729 - RNA, 17 nt, Homo sapiens
aauuaacuuuacauccu

SEQ ID NO: 1756730 - RNA, 18 nt, Homo sapiens
uggaacccccacuuuuac

SEQ ID NO: 1756731 - RNA, 14 nt, Homo sapiens
ugaaaaacagcaga

SEQ ID NO: 1756732 - RNA, 19 nt, Homo sapiens
acagagaagaagugcuugg

SEQ ID NO: 1756733 - RNA, 12 nt, Homo sapiens
cuguggaugcuu

SEQ ID NO: 1756734 - RNA, 18 nt, Homo sapiens
ccacauuggcugccuuau

SEQ ID NO: 1756735 - RNA, 17 nt, Homo sapiens
gcaggagacuggcguga

SEQ ID NO: 1756736 - RNA, 19 nt, Homo sapiens
gagaagaagguggucaucu

SEQ ID NO: 1756737 - RNA, 19 nt, Homo sapiens
auagucaguuacugaugcu

SEQ ID NO: 1756738 - RNA, 22 nt, Homo sapiens
uuugaaaugugguuuuccugaa

SEQ ID NO: 1756739 - RNA, 15 nt, Homo sapiens
ugcccucagauuccg

SEQ ID NO: 1756740 - RNA, 18 nt, Homo sapiens
aggcaggguagccugaau

SEQ ID NO: 1756741 - RNA, 23 nt, Homo sapiens
ugaaacccuuguauaaguaauac

SEQ ID NO: 1756742 - RNA, 22 nt, Homo sapiens
gugagccaagagugcacuacug

SEQ ID NO: 1756743 - RNA, 21 nt, Homo sapiens
uguguccccucacgcaagugc

SEQ ID NO: 1756744 - RNA, 13 nt, Homo sapiens
ugaaaacugucaa

SEQ ID NO: 1756745 - RNA, 20 nt, Homo sapiens
acccucuaucccaauaggca

SEQ ID NO: 1756746 - RNA, 12 nt, Homo sapiens
ccaucuguagag

SEQ ID NO: 1756747 - RNA, 14 nt, Homo sapiens
agcuuaaccaagau

SEQ ID NO: 1756748 - RNA, 18 nt, Homo sapiens
gauguugcuuuugcaccu

SEQ ID NO: 1756749 - RNA, 12 nt, Homo sapiens
cuccaggcuccu

SEQ ID NO: 1756750 - RNA, 12 nt, Homo sapiens
gcggaagccaua

SEQ ID NO: 1756751 - RNA, 13 nt, Homo sapiens
gucuguacauacu

SEQ ID NO: 1756752 - RNA, 14 nt, Homo sapiens
uagaaacaccagcc

SEQ ID NO: 1756753 - RNA, 15 nt, Homo sapiens
ccauaauguuccuua

SEQ ID NO: 1756754 - RNA, 15 nt, Homo sapiens
cuucacugcagauuu

SEQ ID NO: 1756755 - RNA, 14 nt, Homo sapiens
gagacuggccaggc

SEQ ID NO: 1756756 - RNA, 20 nt, Homo sapiens
uacaugccuuuccagugcug

SEQ ID NO: 1756757 - RNA, 23 nt, Homo sapiens
ggacaaggaugaucuaggaagac

SEQ ID NO: 1756758 - RNA, 21 nt, Homo sapiens
cagacaagaaugugcacucuc

SEQ ID NO: 1756759 - RNA, 12 nt, Homo sapiens
auguagacugaa

SEQ ID NO: 1756760 - RNA, 15 nt, Homo sapiens
cauaaaugcacaaaa

SEQ ID NO: 1756761 - RNA, 15 nt, Homo sapiens
uccauaugucuauaa

SEQ ID NO: 1756762 - RNA, 22 nt, Homo sapiens
aaaggaacuauguucacaagaa

SEQ ID NO: 1756763 - RNA, 12 nt, Homo sapiens
aaacgugcaugg

SEQ ID NO: 1756764 - RNA, 12 nt, Homo sapiens
ucugacccagug

SEQ ID NO: 1756765 - RNA, 20 nt, Homo sapiens
ggggcuggguaagagcacag

SEQ ID NO: 1756766 - RNA, 13 nt, Homo sapiens
acaggacucugcc

SEQ ID NO: 1756767 - RNA, 21 nt, Homo sapiens
uucgaggcgguuuccaggaag

SEQ ID NO: 1756768 - RNA, 16 nt, Homo sapiens
ugcuguucagugcuuu

SEQ ID NO: 1756769 - RNA, 14 nt, Homo sapiens
ucuuuccuggcacu

SEQ ID NO: 1756770 - RNA, 14 nt, Homo sapiens
acucucacccauaa

SEQ ID NO: 1756771 - RNA, 18 nt, Homo sapiens
aaauaugucacuagagaa

SEQ ID NO: 1756772 - RNA, 15 nt, Homo sapiens
uauugcuacuauaau

SEQ ID NO: 1756773 - RNA, 16 nt, Homo sapiens
aaccaguauacaagau

SEQ ID NO: 1756774 - RNA, 21 nt, Homo sapiens
cuucauccagggaacugagca

SEQ ID NO: 1756775 - RNA, 21 nt, Homo sapiens
ccgagucagacuuuguguuca

SEQ ID NO: 1756776 - RNA, 19 nt, Homo sapiens
auuuuagcguuaaagucag

SEQ ID NO: 1756777 - RNA, 15 nt, Homo sapiens
guauaucuuugcacu

SEQ ID NO: 1756778 - RNA, 13 nt, Homo sapiens
ggcacaguggcuc

SEQ ID NO: 1756779 - RNA, 13 nt, Homo sapiens
gccucagugccac

SEQ ID NO: 1756780 - RNA, 19 nt, Homo sapiens
guauuucuuuguuauacau

SEQ ID NO: 1756781 - RNA, 17 nt, Homo sapiens
aguaauauauaaugugg

SEQ ID NO: 1756782 - RNA, 16 nt, Homo sapiens
uaggcaauacauguau

SEQ ID NO: 1756783 - RNA, 22 nt, Homo sapiens
ugaauauuaaaaaaagacauaa

SEQ ID NO: 1756784 - RNA, 16 nt, Homo sapiens
ugcaugccaguaaugu

SEQ ID NO: 1756785 - RNA, 21 nt, Homo sapiens
ugagcuggcgggauugaagga

SEQ ID NO: 1756786 - RNA, 14 nt, Homo sapiens
cuuuuuugccaaau

SEQ ID NO: 1756787 - RNA, 14 nt, Homo sapiens
gcgcccucucugcu

SEQ ID NO: 1756788 - RNA, 20 nt, Homo sapiens
cagugagucacauccuggga

SEQ ID NO: 1756789 - RNA, 13 nt, Homo sapiens
ggcugcugcacug

SEQ ID NO: 1756790 - RNA, 14 nt, Homo sapiens
aaaauggucaucca

SEQ ID NO: 1756791 - RNA, 18 nt, Homo sapiens
auaguuauuuacuugaaa

SEQ ID NO: 1756792 - RNA, 14 nt, Homo sapiens
gcaagcuccaucuc

SEQ ID NO: 1756793 - RNA, 16 nt, Homo sapiens
cugaucccgugugcca

SEQ ID NO: 1756794 - RNA, 17 nt, Homo sapiens
uacuauugcuauuacua

SEQ ID NO: 1756795 - RNA, 15 nt, Homo sapiens
cucaaguuccagugc

SEQ ID NO: 1756796 - RNA, 22 nt, Homo sapiens
gugcagggaggaaaagugcaag

SEQ ID NO: 1756797 - RNA, 17 nt, Homo sapiens
ccugaggauaacucaau

SEQ ID NO: 1756798 - RNA, 17 nt, Homo sapiens
agagaagaccuagcuau

SEQ ID NO: 1756799 - RNA, 14 nt, Homo sapiens
aguacuuuauugca

SEQ ID NO: 1756800 - RNA, 18 nt, Homo sapiens
uuuaauaacuaaaccaga

SEQ ID NO: 1756801 - RNA, 16 nt, Homo sapiens
ugggaaaacacugcca

SEQ ID NO: 1756802 - RNA, 14 nt, Homo sapiens
ccuggacagugacg

SEQ ID NO: 1756803 - RNA, 14 nt, Homo sapiens
aauaaaugugcuua

SEQ ID NO: 1756804 - RNA, 17 nt, Homo sapiens
agagcuuccacaagaca

SEQ ID NO: 1756805 - RNA, 17 nt, Homo sapiens
ucucaccagcugcaaag

SEQ ID NO: 1756806 - RNA, 15 nt, Homo sapiens
uuuagaaaaagucaa

SEQ ID NO: 1756807 - RNA, 16 nt, Homo sapiens
aacugcguuaugaaga

SEQ ID NO: 1756808 - RNA, 21 nt, Homo sapiens
aaaauuagcugggcauggugg

SEQ ID NO: 1756809 - RNA, 22 nt, Homo sapiens
uguaaaauguuuuagcaauuua

SEQ ID NO: 1756810 - RNA, 12 nt, Homo sapiens
agaaugugaaca

SEQ ID NO: 1756811 - RNA, 20 nt, Homo sapiens
cuugcucugagugcuagcua

SEQ ID NO: 1756812 - RNA, 23 nt, Homo sapiens
uugauuagaagauaaaaguacau

SEQ ID NO: 1756813 - RNA, 16 nt, Homo sapiens
uggcacaugccuguaa

SEQ ID NO: 1756814 - RNA, 21 nt, Homo sapiens
auccuggccacauucaccaac

SEQ ID NO: 1756815 - RNA, 13 nt, Homo sapiens
gccuuggcugcag

SEQ ID NO: 1756816 - RNA, 16 nt, Homo sapiens
aaugcacacacacaga

SEQ ID NO: 1756817 - RNA, 16 nt, Homo sapiens
gagugaagugguguga

SEQ ID NO: 1756818 - RNA, 20 nt, Homo sapiens
gccaaccaagagcacauucu

SEQ ID NO: 1756819 - RNA, 11 nt, Homo sapiens
cagugccugua

SEQ ID NO: 1756820 - RNA, 22 nt, Homo sapiens
ggcuguuuucccucugcugcuu

SEQ ID NO: 1756821 - RNA, 22 nt, Homo sapiens
acaaaucaagaauaaacacugg

SEQ ID NO: 1756822 - RNA, 22 nt, Homo sapiens
gccaccuguuuagccuagucau

SEQ ID NO: 1756823 - RNA, 22 nt, Homo sapiens
aagggagagaacaaaagcuaua

SEQ ID NO: 1756824 - RNA, 15 nt, Homo sapiens
caaaaugucucaguu

SEQ ID NO: 1756825 - RNA, 21 nt, Homo sapiens
ggucauucuuuucuccuccuc

SEQ ID NO: 1756826 - RNA, 15 nt, Homo sapiens
acaugaaaguccuca

SEQ ID NO: 1756827 - RNA, 18 nt, Homo sapiens
cugaaaggugauugcagc

SEQ ID NO: 1756828 - RNA, 16 nt, Homo sapiens
uaaugacuuacaggcu

SEQ ID NO: 1756829 - RNA, 13 nt, Homo sapiens
ggccacacacuga

SEQ ID NO: 1756830 - RNA, 23 nt, Homo sapiens
agcuacugugugugugaaugaac

SEQ ID NO: 1756831 - RNA, 12 nt, Homo sapiens
cccugcaaagcc

SEQ ID NO: 1756832 - RNA, 18 nt, Homo sapiens
guaccugguccccacugc

SEQ ID NO: 1756833 - RNA, 19 nt, Homo sapiens
uaacuaguauuguccauau

SEQ ID NO: 1756834 - RNA, 12 nt, Homo sapiens
agaauauuuacu

SEQ ID NO: 1756835 - RNA, 19 nt, Homo sapiens
uaaagguuucacuguucau

SEQ ID NO: 1756836 - RNA, 22 nt, Homo sapiens
cacuuguauauugaaaagauag

SEQ ID NO: 1756837 - RNA, 10 nt, Homo sapiens
uggaccuucu

SEQ ID NO: 1756838 - RNA, 15 nt, Homo sapiens
acagcauaugcaaag

SEQ ID NO: 1756839 - RNA, 23 nt, Homo sapiens
ggaacuuagacuccucuucccag

SEQ ID NO: 1756840 - RNA, 14 nt, Homo sapiens
caucuuguacccag

SEQ ID NO: 1756841 - RNA, 21 nt, Homo sapiens
cucagaagugaaaaucuugga

SEQ ID NO: 1756842 - RNA, 15 nt, Homo sapiens
ggagcuaacacuggc

SEQ ID NO: 1756843 - RNA, 20 nt, Homo sapiens
agaaaugcauaccaguaauu

SEQ ID NO: 1756844 - RNA, 14 nt, Homo sapiens
ccugggccuaugga

SEQ ID NO: 1756845 - RNA, 15 nt, Homo sapiens
auccugcuacacuca

SEQ ID NO: 1756846 - RNA, 14 nt, Homo sapiens
aaguauacauuuag

SEQ ID NO: 1756847 - RNA, 21 nt, Homo sapiens
cuuucaguguuauuaguguau

SEQ ID NO: 1756848 - RNA, 20 nt, Homo sapiens
aaguuucuuaaggaaauggu

SEQ ID NO: 1756849 - RNA, 20 nt, Homo sapiens
cuucucccccucagcucucc

SEQ ID NO: 1756850 - RNA, 12 nt, Homo sapiens
agacccuaugaa

SEQ ID NO: 1756851 - RNA, 24 nt, Homo sapiens
ugaggaauauugcugcugguucuc

SEQ ID NO: 1756852 - RNA, 16 nt, Homo sapiens
uuuccaauuagcuccu

SEQ ID NO: 1756853 - RNA, 18 nt, Homo sapiens
aaugcuguggguuuccaa

SEQ ID NO: 1756854 - RNA, 20 nt, Homo sapiens
gccaggcuggagugcagugg

SEQ ID NO: 1756855 - RNA, 22 nt, Homo sapiens
cuguaaugaucagaugaacuca

SEQ ID NO: 1756856 - RNA, 16 nt, Homo sapiens
cugcacacaccugcac

SEQ ID NO: 1756857 - RNA, 22 nt, Homo sapiens
ucugcuugccgacuggcuguga

SEQ ID NO: 1756858 - RNA, 23 nt, Homo sapiens
uccuacuccuggagcacuguaaa

SEQ ID NO: 1756859 - RNA, 21 nt, Homo sapiens
aaagcauauuggugcuagaaa

SEQ ID NO: 1756860 - RNA, 13 nt, Homo sapiens
cugggaaacuggg

SEQ ID NO: 1756861 - RNA, 13 nt, Homo sapiens
gccauaaagccau

SEQ ID NO: 1756862 - RNA, 13 nt, Homo sapiens
gaagaaaagaaga

SEQ ID NO: 1756863 - RNA, 13 nt, Homo sapiens
uuccaaaauucca

SEQ ID NO: 1756864 - RNA, 13 nt, Homo sapiens
uaauaaaauaaua

SEQ ID NO: 1756865 - RNA, 14 nt, Homo sapiens
cauacaguuugcac

SEQ ID NO: 1756866 - RNA, 20 nt, Homo sapiens
cggaucccgcguagugucag

SEQ ID NO: 1756867 - RNA, 13 nt, Homo sapiens
gauacaguauuau

SEQ ID NO: 1756868 - RNA, 17 nt, Homo sapiens
ucggcuuccucaggggc

SEQ ID NO: 1756869 - RNA, 17 nt, Homo sapiens
uaauuaguuaacaguuu

SEQ ID NO: 1756870 - RNA, 15 nt, Homo sapiens
uagacuggauaauca

SEQ ID NO: 1756871 - RNA, 19 nt, Homo sapiens
cuuaugaaagaaagcuuua

SEQ ID NO: 1756872 - RNA, 21 nt, Homo sapiens
uccccuccaaaucucauguuc

SEQ ID NO: 1756873 - RNA, 18 nt, Homo sapiens
aauuccagcaaaagagcu

SEQ ID NO: 1756874 - RNA, 19 nt, Homo sapiens
cuggauagaaccaccauag

SEQ ID NO: 1756875 - RNA, 14 nt, Homo sapiens
guuugaauguuaaa

SEQ ID NO: 1756876 - RNA, 14 nt, Homo sapiens
cugugaaucugaaa

SEQ ID NO: 1756877 - RNA, 14 nt, Homo sapiens
cucucucaacauca

SEQ ID NO: 1756878 - RNA, 13 nt, Homo sapiens
aauguaauacugu

SEQ ID NO: 1756879 - RNA, 19 nt, Homo sapiens
cagagaaaagcuguuugca

SEQ ID NO: 1756880 - RNA, 15 nt, Homo sapiens
aagcuuuaaaugucu

SEQ ID NO: 1756881 - RNA, 22 nt, Homo sapiens
agaaaauguugagaaucccaaa

SEQ ID NO: 1756882 - RNA, 15 nt, Homo sapiens
uaagccacugccaca

SEQ ID NO: 1756883 - RNA, 18 nt, Homo sapiens
guccaaguggcugugaca

SEQ ID NO: 1756884 - RNA, 17 nt, Homo sapiens
caucugaggaguccaaa

SEQ ID NO: 1756885 - RNA, 20 nt, Homo sapiens
cuuuggaaauggcuguauca

SEQ ID NO: 1756886 - RNA, 18 nt, Homo sapiens
gacagugucagagucauu

SEQ ID NO: 1756887 - RNA, 22 nt, Homo sapiens
cacaagaagaccagacugugga

SEQ ID NO: 1756888 - RNA, 19 nt, Homo sapiens
ucaagauacugcuacugua

SEQ ID NO: 1756889 - RNA, 15 nt, Homo sapiens
agacggccaagugaa

SEQ ID NO: 1756890 - RNA, 17 nt, Homo sapiens
ucuggagucuccagugg

SEQ ID NO: 1756891 - RNA, 21 nt, Homo sapiens
aaguacagggcagaaccaaga

SEQ ID NO: 1756892 - RNA, 22 nt, Homo sapiens
ucagaauugaaccgucaaugug

SEQ ID NO: 1756893 - RNA, 21 nt, Homo sapiens
cauuagguuuccuuuuauucu

SEQ ID NO: 1756894 - RNA, 16 nt, Homo sapiens
uugguuuugacuucag

SEQ ID NO: 1756895 - RNA, 21 nt, Homo sapiens
auuauagaaacaauacuguuc

SEQ ID NO: 1756896 - RNA, 22 nt, Homo sapiens
aucagagcuggauucaauuccu

SEQ ID NO: 1756897 - RNA, 14 nt, Homo sapiens
ccaauaucagcucu

SEQ ID NO: 1756898 - RNA, 16 nt, Homo sapiens
ucuugguuugccuucc

SEQ ID NO: 1756899 - RNA, 16 nt, Homo sapiens
aagugaggagugccag

SEQ ID NO: 1756900 - RNA, 12 nt, Homo sapiens
ccagaaugcugc

SEQ ID NO: 1756901 - RNA, 15 nt, Homo sapiens
uaaauaggagcuuaa

SEQ ID NO: 1756902 - RNA, 19 nt, Homo sapiens
cuaaggcaggagaaucacu

SEQ ID NO: 1756903 - RNA, 19 nt, Homo sapiens
caucacccaguccuggcca

SEQ ID NO: 1756904 - RNA, 22 nt, Homo sapiens
cauacuccacuccaagugcccc

SEQ ID NO: 1756905 - RNA, 15 nt, Homo sapiens
cuuaaaaauuaaaga

SEQ ID NO: 1756906 - RNA, 15 nt, Homo sapiens
ucuaagaaccaaaaa

SEQ ID NO: 1756907 - RNA, 22 nt, Homo sapiens
caucagagaugguaaucuacag

SEQ ID NO: 1756908 - RNA, 15 nt, Homo sapiens
guccucucugugucc

SEQ ID NO: 1756909 - RNA, 19 nt, Homo sapiens
cuccacuggccuccuggca

SEQ ID NO: 1756910 - RNA, 16 nt, Homo sapiens
agucuagaagaauuaa

SEQ ID NO: 1756911 - RNA, 14 nt, Homo sapiens
aauguuaguggcau

SEQ ID NO: 1756912 - RNA, 21 nt, Homo sapiens
uuccuguuuaaaaaaccacau

SEQ ID NO: 1756913 - RNA, 24 nt, Homo sapiens
caugagucaaaacaaagcagcuuu

SEQ ID NO: 1756914 - RNA, 16 nt, Homo sapiens
cuuuuauucuaacuuu

SEQ ID NO: 1756915 - RNA, 21 nt, Homo sapiens
gguucauccaucaucugcugc

SEQ ID NO: 1756916 - RNA, 13 nt, Homo sapiens
uaagagagccuug

SEQ ID NO: 1756917 - RNA, 20 nt, Homo sapiens
cuacugggagccuacccacc

SEQ ID NO: 1756918 - RNA, 15 nt, Homo sapiens
cgcaaagacaucaaa

SEQ ID NO: 1756919 - RNA, 16 nt, Homo sapiens
ugaaacacacgugcug

SEQ ID NO: 1756920 - RNA, 18 nt, Homo sapiens
uuugguuuucuacuguua

SEQ ID NO: 1756921 - RNA, 16 nt, Homo sapiens
cuucuuacaacagaga

SEQ ID NO: 1756922 - RNA, 22 nt, Homo sapiens
agauucagguauguugccuuua

SEQ ID NO: 1756923 - RNA, 19 nt, Homo sapiens
uuccuauuuguuuucaugg

SEQ ID NO: 1756924 - RNA, 14 nt, Homo sapiens
guaugaggcauuug

SEQ ID NO: 1756925 - RNA, 22 nt, Homo sapiens
caaauaauaaaaacagaaggaa

SEQ ID NO: 1756926 - RNA, 12 nt, Homo sapiens
auggaugggaug

SEQ ID NO: 1756927 - RNA, 14 nt, Homo sapiens
caaaacccuuucug

SEQ ID NO: 1756928 - RNA, 15 nt, Homo sapiens
ugcccuuacaggaac

SEQ ID NO: 1756929 - RNA, 18 nt, Homo sapiens
agaugugaugcugguacc

SEQ ID NO: 1756930 - RNA, 18 nt, Homo sapiens
caaccggucacccaggag

SEQ ID NO: 1756931 - RNA, 15 nt, Homo sapiens
ucagucagugcacua

SEQ ID NO: 1756932 - RNA, 14 nt, Homo sapiens
ugcacaggccucug

SEQ ID NO: 1756933 - RNA, 23 nt, Homo sapiens
gcguccucguucaaaacauucca

SEQ ID NO: 1756934 - RNA, 15 nt, Homo sapiens
uaccagcucagggga

SEQ ID NO: 1756935 - RNA, 19 nt, Homo sapiens
augacuucccugcuccaac

SEQ ID NO: 1756936 - RNA, 20 nt, Homo sapiens
uacuuucucuagggagaaaa

SEQ ID NO: 1756937 - RNA, 17 nt, Homo sapiens
agagcgaggaaaggauu

SEQ ID NO: 1756938 - RNA, 15 nt, Homo sapiens
ggccaaguuccucua

SEQ ID NO: 1756939 - RNA, 22 nt, Homo sapiens
aauacuucuaccauaauuuuca

SEQ ID NO: 1756940 - RNA, 20 nt, Homo sapiens
auuuaaaaggacugcugauu

SEQ ID NO: 1756941 - RNA, 18 nt, Homo sapiens
ccagcugcaccugccagc

SEQ ID NO: 1756942 - RNA, 20 nt, Homo sapiens
ucaccaacuuuuaaugggau

SEQ ID NO: 1756943 - RNA, 16 nt, Homo sapiens
cacagcucaggaacua

SEQ ID NO: 1756944 - RNA, 15 nt, Homo sapiens
caucccagcuugccc

SEQ ID NO: 1756945 - RNA, 24 nt, Homo sapiens
gcaguagccuaacacacuccaaga

SEQ ID NO: 1756946 - RNA, 12 nt, Homo sapiens
uuaagacuaaaa

SEQ ID NO: 1756947 - RNA, 15 nt, Homo sapiens
ggcgaccccucagug

SEQ ID NO: 1756948 - RNA, 12 nt, Homo sapiens
ccacugagcugg

SEQ ID NO: 1756949 - RNA, 15 nt, Homo sapiens
aaaauuauggcauau

SEQ ID NO: 1756950 - RNA, 23 nt, Homo sapiens
ccuccaugaacaucauggacuga

SEQ ID NO: 1756951 - RNA, 11 nt, Homo sapiens
caacuguguug

SEQ ID NO: 1756952 - RNA, 11 nt, Homo sapiens
uccaugcugug

SEQ ID NO: 1756953 - RNA, 21 nt, Homo sapiens
aaauaaacaagcugugguaug

SEQ ID NO: 1756954 - RNA, 22 nt, Homo sapiens
aauaauuggcaugucuccucaa

SEQ ID NO: 1756955 - RNA, 11 nt, Homo sapiens
aaaaacuuaaa

SEQ ID NO: 1756956 - RNA, 11 nt, Homo sapiens
uacaacuuuac

SEQ ID NO: 1756957 - RNA, 18 nt, Homo sapiens
uauaguuaugcauacaua

SEQ ID NO: 1756958 - RNA, 23 nt, Homo sapiens
auagaaauuguaaaucagagguu

SEQ ID NO: 1756959 - RNA, 20 nt, Homo sapiens
auacagcucuacguggcaaa

SEQ ID NO: 1756960 - RNA, 18 nt, Homo sapiens
ggaaugauugcugacuca

SEQ ID NO: 1756961 - RNA, 21 nt, Homo sapiens
aauucuagagucucuguuacu

SEQ ID NO: 1756962 - RNA, 17 nt, Homo sapiens
agaaacacaacuauauu

SEQ ID NO: 1756963 - RNA, 19 nt, Homo sapiens
ucuguuugcguacuuguaa

SEQ ID NO: 1756964 - RNA, 16 nt, Homo sapiens
ucuggucgcuccugcc

SEQ ID NO: 1756965 - RNA, 13 nt, Homo sapiens
aaaacgacacugc

SEQ ID NO: 1756966 - RNA, 15 nt, Homo sapiens
acccaccaggaugug

SEQ ID NO: 1756967 - RNA, 19 nt, Homo sapiens
uggagccgggaaagcuguu

SEQ ID NO: 1756968 - RNA, 20 nt, Homo sapiens
agcaugugccaagauucuac

SEQ ID NO: 1756969 - RNA, 16 nt, Homo sapiens
uacaacaccuuuuuca

SEQ ID NO: 1756970 - RNA, 15 nt, Homo sapiens
uagcccaggagcaac

SEQ ID NO: 1756971 - RNA, 18 nt, Homo sapiens
uaaaaaccuucaaaggug

SEQ ID NO: 1756972 - RNA, 20 nt, Homo sapiens
cccagugcagguauuucaga

SEQ ID NO: 1756973 - RNA, 17 nt, Homo sapiens
uaacagauccuuucaaa

SEQ ID NO: 1756974 - RNA, 16 nt, Homo sapiens
ucauguuuuucaccua

SEQ ID NO: 1756975 - RNA, 14 nt, Homo sapiens
acagaacacccaau

SEQ ID NO: 1756976 - RNA, 12 nt, Homo sapiens
agggccaggacu

SEQ ID NO: 1756977 - RNA, 14 nt, Homo sapiens
uucuuuaaggcaua

SEQ ID NO: 1756978 - RNA, 19 nt, Homo sapiens
gacacacacacacacacaa

SEQ ID NO: 1756979 - RNA, 19 nt, Homo sapiens
gagcuugcaugcuugcaua

SEQ ID NO: 1756980 - RNA, 15 nt, Homo sapiens
cacuuccugagccag

SEQ ID NO: 1756981 - RNA, 12 nt, Homo sapiens
uuggaauaucuc

SEQ ID NO: 1756982 - RNA, 13 nt, Homo sapiens
uucuuaaauucau

SEQ ID NO: 1756983 - RNA, 13 nt, Homo sapiens
uguaaaaauguua

SEQ ID NO: 1756984 - RNA, 13 nt, Homo sapiens
ccaacaaaccauc

SEQ ID NO: 1756985 - RNA, 13 nt, Homo sapiens
cacagaaacacug

SEQ ID NO: 1756986 - RNA, 17 nt, Homo sapiens
uaacauauucaaugcaa

SEQ ID NO: 1756987 - RNA, 15 nt, Homo sapiens
aaagauuugugaacu

SEQ ID NO: 1756988 - RNA, 15 nt, Homo sapiens
auggggugcaugaua

SEQ ID NO: 1756989 - RNA, 18 nt, Homo sapiens
agcagaacaaauguguuu

SEQ ID NO: 1756990 - RNA, 13 nt, Homo sapiens
caccuuugcacgu

SEQ ID NO: 1756991 - RNA, 23 nt, Homo sapiens
uuauuuacagcucuguaaccucc

SEQ ID NO: 1756992 - RNA, 22 nt, Homo sapiens
gcgcacacacacacacacacau

SEQ ID NO: 1756993 - RNA, 23 nt, Homo sapiens
gagugaaggugcuggaaagggag

SEQ ID NO: 1756994 - RNA, 18 nt, Homo sapiens
cacuggaggccucugcaa

SEQ ID NO: 1756995 - RNA, 15 nt, Homo sapiens
ugacacaacugcacu

SEQ ID NO: 1756996 - RNA, 15 nt, Homo sapiens
guuacuuacugccuu

SEQ ID NO: 1756997 - RNA, 15 nt, Homo sapiens
ugcccacgcagagga

SEQ ID NO: 1756998 - RNA, 16 nt, Homo sapiens
cugacuacuacucugc

SEQ ID NO: 1756999 - RNA, 22 nt, Homo sapiens
gaauuucuagacaguauugcca

SEQ ID NO: 1757000 - RNA, 13 nt, Homo sapiens
agaaaauuggacu

SEQ ID NO: 1757001 - RNA, 23 nt, Homo sapiens
caugcugcaguggguaguucuaa

SEQ ID NO: 1757002 - RNA, 19 nt, Homo sapiens
ugaagaaaguaaaaccaua

SEQ ID NO: 1757003 - RNA, 13 nt, Homo sapiens
ggccucaagaaca

SEQ ID NO: 1757004 - RNA, 15 nt, Homo sapiens
ccugugccaccugca

SEQ ID NO: 1757005 - RNA, 22 nt, Homo sapiens
ccccaggcaucuguuagcagag

SEQ ID NO: 1757006 - RNA, 18 nt, Homo sapiens
gaagaaaaucaaccagca

SEQ ID NO: 1757007 - RNA, 16 nt, Homo sapiens
agcaaauagaucaugc

SEQ ID NO: 1757008 - RNA, 14 nt, Homo sapiens
ugaaaaacauacau

SEQ ID NO: 1757009 - RNA, 19 nt, Homo sapiens
aauuaaauauacuaccaag

SEQ ID NO: 1757010 - RNA, 21 nt, Homo sapiens
aaccauaguuauuuacuugaa

SEQ ID NO: 1757011 - RNA, 20 nt, Homo sapiens
ggaggcacccuuagccacuu

SEQ ID NO: 1757012 - RNA, 21 nt, Homo sapiens
uugcaugaagagaagcaauuu

SEQ ID NO: 1757013 - RNA, 19 nt, Homo sapiens
augucuuuuuacccuuuaa

SEQ ID NO: 1757014 - RNA, 18 nt, Homo sapiens
cuauccagugagguaauu

SEQ ID NO: 1757015 - RNA, 17 nt, Homo sapiens
agugcaaugcacgaucu

SEQ ID NO: 1757016 - RNA, 22 nt, Homo sapiens
gcaggggaccuggagcugccag

SEQ ID NO: 1757017 - RNA, 16 nt, Homo sapiens
gccacgucugugcucu

SEQ ID NO: 1757018 - RNA, 21 nt, Homo sapiens
gaauugagcuagaaaucacaa

SEQ ID NO: 1757019 - RNA, 18 nt, Homo sapiens
uuuaaagugguucuggau

SEQ ID NO: 1757020 - RNA, 17 nt, Homo sapiens
uaaacaaucucccaagu

SEQ ID NO: 1757021 - RNA, 23 nt, Homo sapiens
gugaccauggaggccagugccag

SEQ ID NO: 1757022 - RNA, 21 nt, Homo sapiens
ucuuaccaucugagccgucag

SEQ ID NO: 1757023 - RNA, 11 nt, Homo sapiens
gcccaccagag

SEQ ID NO: 1757024 - RNA, 22 nt, Homo sapiens
aauccugagcaaacaaaaccac

SEQ ID NO: 1757025 - RNA, 18 nt, Homo sapiens
acugucuucaacccugcc

SEQ ID NO: 1757026 - RNA, 19 nt, Homo sapiens
cuauuucugaagaggcuuc

SEQ ID NO: 1757027 - RNA, 14 nt, Homo sapiens
uuuaucaaucccag

SEQ ID NO: 1757028 - RNA, 17 nt, Homo sapiens
ccucuuugaguauauua

SEQ ID NO: 1757029 - RNA, 19 nt, Homo sapiens
gcaaaaaaaaaaauauuaa

SEQ ID NO: 1757030 - RNA, 16 nt, Homo sapiens
aacaaaucguuucuca

SEQ ID NO: 1757031 - RNA, 15 nt, Homo sapiens
guauguaacucuuaa

SEQ ID NO: 1757032 - RNA, 19 nt, Homo sapiens
uucucacaaugucccuuca

SEQ ID NO: 1757033 - RNA, 13 nt, Homo sapiens
ccaggccaaagcc

SEQ ID NO: 1757034 - RNA, 12 nt, Homo sapiens
aguuacuuuaga

SEQ ID NO: 1757035 - RNA, 20 nt, Homo sapiens
aaauaaaauauggacuucca

SEQ ID NO: 1757036 - RNA, 14 nt, Homo sapiens
cucacucagcacuu

SEQ ID NO: 1757037 - RNA, 17 nt, Homo sapiens
uuugaaugaguuuauau

SEQ ID NO: 1757038 - RNA, 22 nt, Homo sapiens
gaggccauggacucuguccuga

SEQ ID NO: 1757039 - RNA, 16 nt, Homo sapiens
acucuuuaagaccuca

SEQ ID NO: 1757040 - RNA, 18 nt, Homo sapiens
cgguggcucaugccugua

SEQ ID NO: 1757041 - RNA, 20 nt, Homo sapiens
guggcugaugcuuugaacau

SEQ ID NO: 1757042 - RNA, 13 nt, Homo sapiens
gcugaauucucug

SEQ ID NO: 1757043 - RNA, 21 nt, Homo sapiens
gcuggagggagaacccaaaga

SEQ ID NO: 1757044 - RNA, 21 nt, Homo sapiens
cccagagcccagggcauccca

SEQ ID NO: 1757045 - RNA, 18 nt, Homo sapiens
uaaaagaaacagauuuga

SEQ ID NO: 1757046 - RNA, 15 nt, Homo sapiens
uugugaugcauuuau

SEQ ID NO: 1757047 - RNA, 18 nt, Homo sapiens
cuugcuggguugaucuag

SEQ ID NO: 1757048 - RNA, 20 nt, Homo sapiens
ucaggaggcagagguugcaa

SEQ ID NO: 1757049 - RNA, 21 nt, Homo sapiens
ccccagcuauuuucugaccaa

SEQ ID NO: 1757050 - RNA, 18 nt, Homo sapiens
cagcaaugacaucucagg

SEQ ID NO: 1757051 - RNA, 18 nt, Homo sapiens
ugccauaguuugugaauc

SEQ ID NO: 1757052 - RNA, 17 nt, Homo sapiens
augagaugagaugacca

SEQ ID NO: 1757053 - RNA, 19 nt, Homo sapiens
cugcaccaggccaucagca

SEQ ID NO: 1757054 - RNA, 16 nt, Homo sapiens
cacaugcccaugauga

SEQ ID NO: 1757055 - RNA, 11 nt, Homo sapiens
ccugaccucaa

SEQ ID NO: 1757056 - RNA, 21 nt, Homo sapiens
auuccugauggaaaaugcaaa

SEQ ID NO: 1757057 - RNA, 20 nt, Homo sapiens
cuucuuuaaaaaaacacaua

SEQ ID NO: 1757058 - RNA, 14 nt, Homo sapiens
uaguuaagugugga

SEQ ID NO: 1757059 - RNA, 18 nt, Homo sapiens
ugcccguugccgggccug

SEQ ID NO: 1757060 - RNA, 18 nt, Homo sapiens
ccugcucagcccugcacc

SEQ ID NO: 1757061 - RNA, 11 nt, Homo sapiens
cugcacuucau

SEQ ID NO: 1757062 - RNA, 23 nt, Homo sapiens
cuauuucaucuauuuuuggcagu

SEQ ID NO: 1757063 - RNA, 14 nt, Homo sapiens
gggacuucagcuca

SEQ ID NO: 1757064 - RNA, 23 nt, Homo sapiens
agaugagggugucggcugugagg

SEQ ID NO: 1757065 - RNA, 17 nt, Homo sapiens
uccccauggaacaaaug

SEQ ID NO: 1757066 - RNA, 22 nt, Homo sapiens
cauagaagggcuagaauaggag

SEQ ID NO: 1757067 - RNA, 15 nt, Homo sapiens
ccagcccuugcucua

SEQ ID NO: 1757068 - RNA, 18 nt, Homo sapiens
aacuguuccugacuuuau

SEQ ID NO: 1757069 - RNA, 15 nt, Homo sapiens
uauuaauaugcaugc

SEQ ID NO: 1757070 - RNA, 22 nt, Homo sapiens
uuaaaauaaugaacacuacaga

SEQ ID NO: 1757071 - RNA, 22 nt, Homo sapiens
cugagagaggccauucuuuccc

SEQ ID NO: 1757072 - RNA, 17 nt, Homo sapiens
ugucauauaucaaauca

SEQ ID NO: 1757073 - RNA, 16 nt, Homo sapiens
auaaaacaggucaaua

SEQ ID NO: 1757074 - RNA, 21 nt, Homo sapiens
cccuuuuacagucacauucag

SEQ ID NO: 1757075 - RNA, 18 nt, Homo sapiens
gagaguaauuugggaaaa

SEQ ID NO: 1757076 - RNA, 13 nt, Homo sapiens
auaucaguaccuc

SEQ ID NO: 1757077 - RNA, 15 nt, Homo sapiens
agcuuuacucauggc

SEQ ID NO: 1757078 - RNA, 17 nt, Homo sapiens
guauuccucaugucauc

SEQ ID NO: 1757079 - RNA, 17 nt, Homo sapiens
aacgcuuuuugggagaa

SEQ ID NO: 1757080 - RNA, 12 nt, Homo sapiens
ucacauucugaa

SEQ ID NO: 1757081 - RNA, 17 nt, Homo sapiens
cagcaaguguacaguau

SEQ ID NO: 1757082 - RNA, 21 nt, Homo sapiens
caaaaaguaacacaguggacu

SEQ ID NO: 1757083 - RNA, 21 nt, Homo sapiens
caagagugauauacuccagga

SEQ ID NO: 1757084 - RNA, 18 nt, Homo sapiens
agugaggggcaguggugc

SEQ ID NO: 1757085 - RNA, 16 nt, Homo sapiens
gggauucugagcagug

SEQ ID NO: 1757086 - RNA, 20 nt, Homo sapiens
cugaugaaugaugaaugaau

SEQ ID NO: 1757087 - RNA, 15 nt, Homo sapiens
aacagcuugcuguca

SEQ ID NO: 1757088 - RNA, 15 nt, Homo sapiens
gacauauuacuggaa

SEQ ID NO: 1757089 - RNA, 23 nt, Homo sapiens
auuccuagauuacaucugccuua

SEQ ID NO: 1757090 - RNA, 19 nt, Homo sapiens
cuucccuacacagggccug

SEQ ID NO: 1757091 - RNA, 16 nt, Homo sapiens
agccuucacacagaua

SEQ ID NO: 1757092 - RNA, 12 nt, Homo sapiens
ugggcagggaug

SEQ ID NO: 1757093 - RNA, 15 nt, Homo sapiens
ugucuccuacuccug

SEQ ID NO: 1757094 - RNA, 23 nt, Homo sapiens
ggagccccuccucccccggcugg

SEQ ID NO: 1757095 - RNA, 15 nt, Homo sapiens
ugauccccacgccac

SEQ ID NO: 1757096 - RNA, 16 nt, Homo sapiens
auuagaauaccacagg

SEQ ID NO: 1757097 - RNA, 22 nt, Homo sapiens
uaguuuuaccuaccccagucuu

SEQ ID NO: 1757098 - RNA, 22 nt, Homo sapiens
ugcccaucgugaagaagccugu

SEQ ID NO: 1757099 - RNA, 13 nt, Homo sapiens
uaucaguccaaag

SEQ ID NO: 1757100 - RNA, 17 nt, Homo sapiens
cacacucagaacccagg

SEQ ID NO: 1757101 - RNA, 13 nt, Homo sapiens
gcaguagacaagc

SEQ ID NO: 1757102 - RNA, 13 nt, Homo sapiens
cacuguucaauac

SEQ ID NO: 1757103 - RNA, 15 nt, Homo sapiens
ucaacauaugugauu

SEQ ID NO: 1757104 - RNA, 15 nt, Homo sapiens
augucuuaaccucag

SEQ ID NO: 1757105 - RNA, 20 nt, Homo sapiens
uggaagagaguuccgggaaa

SEQ ID NO: 1757106 - RNA, 15 nt, Homo sapiens
ucaguugacagugua

SEQ ID NO: 1757107 - RNA, 16 nt, Homo sapiens
ggcuugauauuuucca

SEQ ID NO: 1757108 - RNA, 13 nt, Homo sapiens
gcaucacugggug

SEQ ID NO: 1757109 - RNA, 11 nt, Homo sapiens
ucauaccuuau

SEQ ID NO: 1757110 - RNA, 23 nt, Homo sapiens
agucgccuccccucucugggcua

SEQ ID NO: 1757111 - RNA, 18 nt, Homo sapiens
uaacauuaucuaguucau

SEQ ID NO: 1757112 - RNA, 14 nt, Homo sapiens
aacuugacccccuu

SEQ ID NO: 1757113 - RNA, 13 nt, Homo sapiens
agcaacuguaaaa

SEQ ID NO: 1757114 - RNA, 21 nt, Homo sapiens
cuaaauauugcuucaauuuca

SEQ ID NO: 1757115 - RNA, 14 nt, Homo sapiens
acuauguacugccu

SEQ ID NO: 1757116 - RNA, 14 nt, Homo sapiens
aucaagaccaaaga

SEQ ID NO: 1757117 - RNA, 16 nt, Homo sapiens
gcaggaagucccugag

SEQ ID NO: 1757118 - RNA, 19 nt, Homo sapiens
ccucaggggaaaacuguua

SEQ ID NO: 1757119 - RNA, 20 nt, Homo sapiens
cccaaaugugugcccagcuu

SEQ ID NO: 1757120 - RNA, 15 nt, Homo sapiens
aacucaccacagugu

SEQ ID NO: 1757121 - RNA, 17 nt, Homo sapiens
uaaaaccucucuuucca

SEQ ID NO: 1757122 - RNA, 21 nt, Homo sapiens
aagaauguacaguugagcuca

SEQ ID NO: 1757123 - RNA, 24 nt, Homo sapiens
gcauguaugucuuggacacuguac

SEQ ID NO: 1757124 - RNA, 17 nt, Homo sapiens
ucuuuggggucagccag

SEQ ID NO: 1757125 - RNA, 16 nt, Homo sapiens
uaaagagaguuugcca

SEQ ID NO: 1757126 - RNA, 16 nt, Homo sapiens
accagcccacauccag

SEQ ID NO: 1757127 - RNA, 17 nt, Homo sapiens
agcaagugucaucacuu

SEQ ID NO: 1757128 - RNA, 22 nt, Homo sapiens
aucucugcuuuggaaaucacac

SEQ ID NO: 1757129 - RNA, 19 nt, Homo sapiens
acgccccccggccugaugg

SEQ ID NO: 1757130 - RNA, 20 nt, Homo sapiens
gauuaaaaaaucucccaaag

SEQ ID NO: 1757131 - RNA, 23 nt, Homo sapiens
agaguauagcucuguaguggaau

SEQ ID NO: 1757132 - RNA, 10 nt, Homo sapiens
cauccaaagu

SEQ ID NO: 1757133 - RNA, 18 nt, Homo sapiens
gagacuccgucucaagga

SEQ ID NO: 1757134 - RNA, 11 nt, Homo sapiens
accauguggau

SEQ ID NO: 1757135 - RNA, 16 nt, Homo sapiens
ggccggcccugugugc

SEQ ID NO: 1757136 - RNA, 22 nt, Homo sapiens
ugagauggguguacaaacucau

SEQ ID NO: 1757137 - RNA, 17 nt, Homo sapiens
aguccuuugucuaagua

SEQ ID NO: 1757138 - RNA, 19 nt, Homo sapiens
gacuucaggagcugacaga

SEQ ID NO: 1757139 - RNA, 23 nt, Homo sapiens
gcucugagacccuuuucucagga

SEQ ID NO: 1757140 - RNA, 13 nt, Homo sapiens
auggaucaugucc

SEQ ID NO: 1757141 - RNA, 14 nt, Homo sapiens
aucacaagucagca

SEQ ID NO: 1757142 - RNA, 15 nt, Homo sapiens
caggcagggugagcu

SEQ ID NO: 1757143 - RNA, 21 nt, Homo sapiens
aagcuuccaguagagcuucuu

SEQ ID NO: 1757144 - RNA, 19 nt, Homo sapiens
cugcagagcugacccagag

SEQ ID NO: 1757145 - RNA, 13 nt, Homo sapiens
cgcaccaaucagc

SEQ ID NO: 1757146 - RNA, 21 nt, Homo sapiens
agaaauuucugugaaaccugu

SEQ ID NO: 1757147 - RNA, 18 nt, Homo sapiens
guagaaagacaucugccu

SEQ ID NO: 1757148 - RNA, 13 nt, Homo sapiens
auguguaugugua

SEQ ID NO: 1757149 - RNA, 21 nt, Homo sapiens
cuuuaccaaaugaaaugccaa

SEQ ID NO: 1757150 - RNA, 19 nt, Homo sapiens
aggccuccuuauuccccau

SEQ ID NO: 1757151 - RNA, 22 nt, Homo sapiens
aggcuggauacuaagcacaaag

SEQ ID NO: 1757152 - RNA, 22 nt, Homo sapiens
agcuacccauuauagcacaaaa

SEQ ID NO: 1757153 - RNA, 19 nt, Homo sapiens
uccuguaagcaagagccaa

SEQ ID NO: 1757154 - RNA, 17 nt, Homo sapiens
cacagugcugaccagac

SEQ ID NO: 1757155 - RNA, 14 nt, Homo sapiens
gucuucagacccag

SEQ ID NO: 1757156 - RNA, 21 nt, Homo sapiens
aaagggugagacuccaucuca

SEQ ID NO: 1757157 - RNA, 14 nt, Homo sapiens
aucacuuuuuggaa

SEQ ID NO: 1757158 - RNA, 13 nt, Homo sapiens
agacuuaauucug

SEQ ID NO: 1757159 - RNA, 19 nt, Homo sapiens
auuuucacuuuuaaacuac

SEQ ID NO: 1757160 - RNA, 16 nt, Homo sapiens
ccuguaccugugcacg

SEQ ID NO: 1757161 - RNA, 20 nt, Homo sapiens
uucuccauacgcacugguau

SEQ ID NO: 1757162 - RNA, 13 nt, Homo sapiens
ugagucccuguga

SEQ ID NO: 1757163 - RNA, 19 nt, Homo sapiens
agcauauguguuacuucaa

SEQ ID NO: 1757164 - RNA, 20 nt, Homo sapiens
uaaaaauacuguuucacuaa

SEQ ID NO: 1757165 - RNA, 17 nt, Homo sapiens
aggaagcaagaaagccg

SEQ ID NO: 1757166 - RNA, 21 nt, Homo sapiens
cuaauugcuguugaaagcaaa

SEQ ID NO: 1757167 - RNA, 22 nt, Homo sapiens
cuagcauuuucuugaaccaaua

SEQ ID NO: 1757168 - RNA, 13 nt, Homo sapiens
auuagagccugua

SEQ ID NO: 1757169 - RNA, 13 nt, Homo sapiens
auguaaaguaaga

SEQ ID NO: 1757170 - RNA, 13 nt, Homo sapiens
uuguuauaccauu

SEQ ID NO: 1757171 - RNA, 13 nt, Homo sapiens
gugggcuuugcaa

SEQ ID NO: 1757172 - RNA, 14 nt, Homo sapiens
uuggcucaauccuc

SEQ ID NO: 1757173 - RNA, 19 nt, Homo sapiens
guucauggguuuaccacua

SEQ ID NO: 1757174 - RNA, 13 nt, Homo sapiens
uacauguaaucca

SEQ ID NO: 1757175 - RNA, 20 nt, Homo sapiens
gaugugccuggguggacaug

SEQ ID NO: 1757176 - RNA, 12 nt, Homo sapiens
uugcugccacaa

SEQ ID NO: 1757177 - RNA, 17 nt, Homo sapiens
ggggacgccuguuguuu

SEQ ID NO: 1757178 - RNA, 13 nt, Homo sapiens
ucauauuuuccaa

SEQ ID NO: 1757179 - RNA, 13 nt, Homo sapiens
guauuuuugucau

SEQ ID NO: 1757180 - RNA, 16 nt, Homo sapiens
acaggcaacauuacaa

SEQ ID NO: 1757181 - RNA, 15 nt, Homo sapiens
acuucaaaagcaaca

SEQ ID NO: 1757182 - RNA, 22 nt, Homo sapiens
agggagacaacagcccugucuc

SEQ ID NO: 1757183 - RNA, 21 nt, Homo sapiens
acagggcucauuuuugcacuu

SEQ ID NO: 1757184 - RNA, 19 nt, Homo sapiens
uaucaucugcuaaguaauu

SEQ ID NO: 1757185 - RNA, 15 nt, Homo sapiens
aggcccagcugcuca

SEQ ID NO: 1757186 - RNA, 14 nt, Homo sapiens
augauguaaucucu

SEQ ID NO: 1757187 - RNA, 11 nt, Homo sapiens
gagacauguga

SEQ ID NO: 1757188 - RNA, 17 nt, Homo sapiens
auacauuugaggggaaa

SEQ ID NO: 1757189 - RNA, 18 nt, Homo sapiens
uguuagcagacccagcuu

SEQ ID NO: 1757190 - RNA, 19 nt, Homo sapiens
guucuuuuugaaguauuua

SEQ ID NO: 1757191 - RNA, 14 nt, Homo sapiens
caaccaugaagucu

SEQ ID NO: 1757192 - RNA, 16 nt, Homo sapiens
gggcugggcucuacua

SEQ ID NO: 1757193 - RNA, 23 nt, Homo sapiens
cagcccuugcacuccuacugagu

SEQ ID NO: 1757194 - RNA, 21 nt, Homo sapiens
uccucaagaagaaaguguuca

SEQ ID NO: 1757195 - RNA, 20 nt, Homo sapiens
acuucugcuguacagauauc

SEQ ID NO: 1757196 - RNA, 17 nt, Homo sapiens
auuuagucugcauugcu

SEQ ID NO: 1757197 - RNA, 23 nt, Homo sapiens
uuccauugaagccgacucuggcc

SEQ ID NO: 1757198 - RNA, 14 nt, Homo sapiens
uugagcuguccuau

SEQ ID NO: 1757199 - RNA, 19 nt, Homo sapiens
gauaauucugaucaaucau

SEQ ID NO: 1757200 - RNA, 16 nt, Homo sapiens
agcuaguguaccuccu

SEQ ID NO: 1757201 - RNA, 12 nt, Homo sapiens
ucccuacugcca

SEQ ID NO: 1757202 - RNA, 17 nt, Homo sapiens
ccuuccagcuccuguaa

SEQ ID NO: 1757203 - RNA, 13 nt, Homo sapiens
agaaaaaugucau

SEQ ID NO: 1757204 - RNA, 22 nt, Homo sapiens
uuuucugugagaauaaagcauu

SEQ ID NO: 1757205 - RNA, 18 nt, Homo sapiens
uucucgggcugagaaccc

SEQ ID NO: 1757206 - RNA, 18 nt, Homo sapiens
uacagacuucuccagacc

SEQ ID NO: 1757207 - RNA, 20 nt, Homo sapiens
uugaauaggcauuaaaugca

SEQ ID NO: 1757208 - RNA, 19 nt, Homo sapiens
aagagaaaauaaaccaaga

SEQ ID NO: 1757209 - RNA, 22 nt, Homo sapiens
cccucugugcuucgacuacugc

SEQ ID NO: 1757210 - RNA, 20 nt, Homo sapiens
caggaggguugggcgugcua

SEQ ID NO: 1757211 - RNA, 18 nt, Homo sapiens
aggaaaaaauaauaucca

SEQ ID NO: 1757212 - RNA, 21 nt, Homo sapiens
cugcucuggauaacaagacuu

SEQ ID NO: 1757213 - RNA, 21 nt, Homo sapiens
auucugauuauuacaacaagc

SEQ ID NO: 1757214 - RNA, 14 nt, Homo sapiens
agagcauugugcaa

SEQ ID NO: 1757215 - RNA, 23 nt, Homo sapiens
agaguguguguuuguguguuuca

SEQ ID NO: 1757216 - RNA, 18 nt, Homo sapiens
cucaaugcuuuucuagca

SEQ ID NO: 1757217 - RNA, 22 nt, Homo sapiens
uucucuuuuguccucacaugca

SEQ ID NO: 1757218 - RNA, 16 nt, Homo sapiens
gcucccuuucucagga

SEQ ID NO: 1757219 - RNA, 14 nt, Homo sapiens
ucuucagcacuguc

SEQ ID NO: 1757220 - RNA, 19 nt, Homo sapiens
uuaaggucuccaaaccaga

SEQ ID NO: 1757221 - RNA, 18 nt, Homo sapiens
caaagaguuauaugacuu

SEQ ID NO: 1757222 - RNA, 19 nt, Homo sapiens
caaugcuaauaaaguccua

SEQ ID NO: 1757223 - RNA, 21 nt, Homo sapiens
ucuuccugaccaccuugcacu

SEQ ID NO: 1757224 - RNA, 15 nt, Homo sapiens
cugucaaagcuguca

SEQ ID NO: 1757225 - RNA, 19 nt, Homo sapiens
augacaucagcaauacaga

SEQ ID NO: 1757226 - RNA, 14 nt, Homo sapiens
auccagugugagau

SEQ ID NO: 1757227 - RNA, 15 nt, Homo sapiens
uacauuuaucacuga

SEQ ID NO: 1757228 - RNA, 22 nt, Homo sapiens
agguggcucccaccuguagucc

SEQ ID NO: 1757229 - RNA, 22 nt, Homo sapiens
uggcaguuuguugaucuuuuaa

SEQ ID NO: 1757230 - RNA, 15 nt, Homo sapiens
cugcucguggccaaa

SEQ ID NO: 1757231 - RNA, 12 nt, Homo sapiens
uaaaaugcuuuu

SEQ ID NO: 1757232 - RNA, 18 nt, Homo sapiens
gccaagagugaagggaag

SEQ ID NO: 1757233 - RNA, 17 nt, Homo sapiens
uuuuaagcaacuggaaa

SEQ ID NO: 1757234 - RNA, 16 nt, Homo sapiens
gguacgaugacagugu

SEQ ID NO: 1757235 - RNA, 23 nt, Homo sapiens
caaaaacauguaugugcauuuca

SEQ ID NO: 1757236 - RNA, 20 nt, Homo sapiens
auaaaacuuauaaauuucau

SEQ ID NO: 1757237 - RNA, 22 nt, Homo sapiens
cauccaugagcugcuccaucac

SEQ ID NO: 1757238 - RNA, 15 nt, Homo sapiens
uggagccaaagccga

SEQ ID NO: 1757239 - RNA, 20 nt, Homo sapiens
uggugagcucugggaagugu

SEQ ID NO: 1757240 - RNA, 22 nt, Homo sapiens
cauuaaauauaaaauacauaaa

SEQ ID NO: 1757241 - RNA, 22 nt, Homo sapiens
uacccccuucugggcaucuguu

SEQ ID NO: 1757242 - RNA, 20 nt, Homo sapiens
gugauggaguuucucuagaa

SEQ ID NO: 1757243 - RNA, 16 nt, Homo sapiens
cugcugcuccacggcg

SEQ ID NO: 1757244 - RNA, 15 nt, Homo sapiens
agauaacagugugcu

SEQ ID NO: 1757245 - RNA, 17 nt, Homo sapiens
ugaucaguggacagucu

SEQ ID NO: 1757246 - RNA, 15 nt, Homo sapiens
ugaucgcacaaggac

SEQ ID NO: 1757247 - RNA, 14 nt, Homo sapiens
aaugucacauucua

SEQ ID NO: 1757248 - RNA, 23 nt, Homo sapiens
aaugagauauaucuuuauacuua

SEQ ID NO: 1757249 - RNA, 15 nt, Homo sapiens
ugaagcuucaugcac

SEQ ID NO: 1757250 - RNA, 22 nt, Homo sapiens
aaacuggcccuguuucuggucu

SEQ ID NO: 1757251 - RNA, 15 nt, Homo sapiens
ccuuuaugagucagu

SEQ ID NO: 1757252 - RNA, 13 nt, Homo sapiens
agcuagccuccag

SEQ ID NO: 1757253 - RNA, 19 nt, Homo sapiens
cacgugucuuccacuuugc

SEQ ID NO: 1757254 - RNA, 11 nt, Homo sapiens
uucuucuagau

SEQ ID NO: 1757255 - RNA, 19 nt, Homo sapiens
cagaaagagagcacugacc

SEQ ID NO: 1757256 - RNA, 21 nt, Homo sapiens
acuacaauugaggagugucau

SEQ ID NO: 1757257 - RNA, 14 nt, Homo sapiens
gacagcccaucacc

SEQ ID NO: 1757258 - RNA, 18 nt, Homo sapiens
gauuuguucuuacaguua

SEQ ID NO: 1757259 - RNA, 20 nt, Homo sapiens
ucuucuugugauugcugcca

SEQ ID NO: 1757260 - RNA, 15 nt, Homo sapiens
gguccagaaggagac

SEQ ID NO: 1757261 - RNA, 22 nt, Homo sapiens
gaagggaauagaaauguuugcu

SEQ ID NO: 1757262 - RNA, 13 nt, Homo sapiens
cauauaccagcaa

SEQ ID NO: 1757263 - RNA, 13 nt, Homo sapiens
cacaaaccaguau

SEQ ID NO: 1757264 - RNA, 18 nt, Homo sapiens
ucuggcccucgacacuca

SEQ ID NO: 1757265 - RNA, 22 nt, Homo sapiens
aagcugaugaaguuaagcacaa

SEQ ID NO: 1757266 - RNA, 15 nt, Homo sapiens
ugcagauacuuugaa

SEQ ID NO: 1757267 - RNA, 17 nt, Homo sapiens
cugucacccagcuccuc

SEQ ID NO: 1757268 - RNA, 19 nt, Homo sapiens
caucccugaaacaucucaa

SEQ ID NO: 1757269 - RNA, 19 nt, Homo sapiens
auguuugacacaauuggaa

SEQ ID NO: 1757270 - RNA, 20 nt, Homo sapiens
gagacuuucuucuagugcuu

SEQ ID NO: 1757271 - RNA, 14 nt, Homo sapiens
cucugaaugcauga

SEQ ID NO: 1757272 - RNA, 21 nt, Homo sapiens
ggcugccacuaaccuguagaa

SEQ ID NO: 1757273 - RNA, 15 nt, Homo sapiens
uucauucacuuuaau

SEQ ID NO: 1757274 - RNA, 16 nt, Homo sapiens
cagaacagagccuuug

SEQ ID NO: 1757275 - RNA, 12 nt, Homo sapiens
aauaaaucuucc

SEQ ID NO: 1757276 - RNA, 19 nt, Homo sapiens
aaagcacauguauugacaa

SEQ ID NO: 1757277 - RNA, 11 nt, Homo sapiens
caugacugugg

SEQ ID NO: 1757278 - RNA, 11 nt, Homo sapiens
caggacugugu

SEQ ID NO: 1757279 - RNA, 21 nt, Homo sapiens
uauuuuuuuuacugugcauac

SEQ ID NO: 1757280 - RNA, 21 nt, Homo sapiens
ccugugcuggaccagcuggcc

SEQ ID NO: 1757281 - RNA, 17 nt, Homo sapiens
caaacuccugaccucaa

SEQ ID NO: 1757282 - RNA, 11 nt, Homo sapiens
caaugacugug

SEQ ID NO: 1757283 - RNA, 18 nt, Homo sapiens
augucucggucacaucag

SEQ ID NO: 1757284 - RNA, 20 nt, Homo sapiens
ggcuaaauugaaaccuggaa

SEQ ID NO: 1757285 - RNA, 17 nt, Homo sapiens
augggaugauugaagaa

SEQ ID NO: 1757286 - RNA, 13 nt, Homo sapiens
cuauuuaaagcau

SEQ ID NO: 1757287 - RNA, 16 nt, Homo sapiens
caaaccgagugcaaug

SEQ ID NO: 1757288 - RNA, 17 nt, Homo sapiens
ugacucuaccugcaaga

SEQ ID NO: 1757289 - RNA, 22 nt, Homo sapiens
ccugagguuugccagcauuuag

SEQ ID NO: 1757290 - RNA, 21 nt, Homo sapiens
aaggcagaaagauagcuugag

SEQ ID NO: 1757291 - RNA, 24 nt, Homo sapiens
uacuaacauuuucauugaugagca

SEQ ID NO: 1757292 - RNA, 17 nt, Homo sapiens
ucugaaaucagugccua

SEQ ID NO: 1757293 - RNA, 16 nt, Homo sapiens
uacacuaaaguuacaa

SEQ ID NO: 1757294 - RNA, 19 nt, Homo sapiens
ucuuccuuuuauauaaaua

SEQ ID NO: 1757295 - RNA, 12 nt, Homo sapiens
cugaaaugugac

SEQ ID NO: 1757296 - RNA, 22 nt, Homo sapiens
agauuuaauuguaauugucuca

SEQ ID NO: 1757297 - RNA, 17 nt, Homo sapiens
cuaacagcaacacaaag

SEQ ID NO: 1757298 - RNA, 18 nt, Homo sapiens
cuauaacaaucacuggcu

SEQ ID NO: 1757299 - RNA, 16 nt, Homo sapiens
caaaaagucauuguaa

SEQ ID NO: 1757300 - RNA, 22 nt, Homo sapiens
cauaaggccggacgcaucucaa

SEQ ID NO: 1757301 - RNA, 17 nt, Homo sapiens
uuguuuuucucucuucc

SEQ ID NO: 1757302 - RNA, 18 nt, Homo sapiens
agacccaaacauaugcac

SEQ ID NO: 1757303 - RNA, 23 nt, Homo sapiens
agugaggaacccugaucucucag

SEQ ID NO: 1757304 - RNA, 19 nt, Homo sapiens
gaagaaguuuaaaaaacca

SEQ ID NO: 1757305 - RNA, 21 nt, Homo sapiens
ggaagccggugucccuggaug

SEQ ID NO: 1757306 - RNA, 14 nt, Homo sapiens
accagggacccugg

SEQ ID NO: 1757307 - RNA, 15 nt, Homo sapiens
uuuggggggcacuag

SEQ ID NO: 1757308 - RNA, 15 nt, Homo sapiens
cuuggggcaugaccc

SEQ ID NO: 1757309 - RNA, 13 nt, Homo sapiens
uugggcaugccau

SEQ ID NO: 1757310 - RNA, 15 nt, Homo sapiens
uaaaagacagugaaa

SEQ ID NO: 1757311 - RNA, 17 nt, Homo sapiens
uuuguauauuuacaugc

SEQ ID NO: 1757312 - RNA, 16 nt, Homo sapiens
uuauuaucgcauacag

SEQ ID NO: 1757313 - RNA, 12 nt, Homo sapiens
uuaaaaacuaaa

SEQ ID NO: 1757314 - RNA, 11 nt, Homo sapiens
aagcugugcug

SEQ ID NO: 1757315 - RNA, 17 nt, Homo sapiens
uccaccuuggaccucag

SEQ ID NO: 1757316 - RNA, 19 nt, Homo sapiens
cgcugggagaaaagccaga

SEQ ID NO: 1757317 - RNA, 19 nt, Homo sapiens
auuuaacuugagcuuuaaa

SEQ ID NO: 1757318 - RNA, 18 nt, Homo sapiens
gccaccagaccaugggcc

SEQ ID NO: 1757319 - RNA, 15 nt, Homo sapiens
auagaaacuugcuua

SEQ ID NO: 1757320 - RNA, 15 nt, Homo sapiens
uacuagaaguuuuac

SEQ ID NO: 1757321 - RNA, 21 nt, Homo sapiens
agucugauuuuaaugaaauca

SEQ ID NO: 1757322 - RNA, 20 nt, Homo sapiens
auuuauaaaauaaaaaggaa

SEQ ID NO: 1757323 - RNA, 20 nt, Homo sapiens
caucacaaccuccaacaaca

SEQ ID NO: 1757324 - RNA, 13 nt, Homo sapiens
aucuccacuguua

SEQ ID NO: 1757325 - RNA, 23 nt, Homo sapiens
agccuugcauguacuugaaggau

SEQ ID NO: 1757326 - RNA, 18 nt, Homo sapiens
uggugccugcacacagag

SEQ ID NO: 1757327 - RNA, 13 nt, Homo sapiens
cacaucacauucc

SEQ ID NO: 1757328 - RNA, 17 nt, Homo sapiens
acagccguguguucaaa

SEQ ID NO: 1757329 - RNA, 23 nt, Homo sapiens
guucuuggguaaggaaauggaau

SEQ ID NO: 1757330 - RNA, 17 nt, Homo sapiens
aagggauguucacugua

SEQ ID NO: 1757331 - RNA, 13 nt, Homo sapiens
ucugcacacagca

SEQ ID NO: 1757332 - RNA, 23 nt, Homo sapiens
cauugauuaaucuccuggaagau

SEQ ID NO: 1757333 - RNA, 14 nt, Homo sapiens
aacauccacuguua

SEQ ID NO: 1757334 - RNA, 16 nt, Homo sapiens
cugccugcucuucaga

SEQ ID NO: 1757335 - RNA, 23 nt, Homo sapiens
cgaauacuggggauuaccauuca

SEQ ID NO: 1757336 - RNA, 15 nt, Homo sapiens
gaacaacaugggagc

SEQ ID NO: 1757337 - RNA, 18 nt, Homo sapiens
cucucccugggucugggg

SEQ ID NO: 1757338 - RNA, 20 nt, Homo sapiens
acuuuucuuucagccaagaa

SEQ ID NO: 1757339 - RNA, 16 nt, Homo sapiens
ugccuguaaucccagc

SEQ ID NO: 1757340 - RNA, 13 nt, Homo sapiens
cucucccauccag

SEQ ID NO: 1757341 - RNA, 17 nt, Homo sapiens
caucuuuuuaugcaaaa

SEQ ID NO: 1757342 - RNA, 17 nt, Homo sapiens
cuucugcuugucccaaa

SEQ ID NO: 1757343 - RNA, 12 nt, Homo sapiens
auggcugugaaa

SEQ ID NO: 1757344 - RNA, 21 nt, Homo sapiens
uauauaaugguuuacugcugu

SEQ ID NO: 1757345 - RNA, 14 nt, Homo sapiens
auaaaaagcauuau

SEQ ID NO: 1757346 - RNA, 15 nt, Homo sapiens
ugagcuccccaaaaa

SEQ ID NO: 1757347 - RNA, 21 nt, Homo sapiens
cuaauaagaaaaccaccccuu

SEQ ID NO: 1757348 - RNA, 16 nt, Homo sapiens
ccuccucaggcacaca

SEQ ID NO: 1757349 - RNA, 15 nt, Homo sapiens
ucagcuguucagauu

SEQ ID NO: 1757350 - RNA, 14 nt, Homo sapiens
cugaggcauccacu

SEQ ID NO: 1757351 - RNA, 18 nt, Homo sapiens
agaaaaacaucccaagaa

SEQ ID NO: 1757352 - RNA, 19 nt, Homo sapiens
ugguuuuaccccagcucca

SEQ ID NO: 1757353 - RNA, 22 nt, Homo sapiens
aucauuccccugcccaccuccu

SEQ ID NO: 1757354 - RNA, 18 nt, Homo sapiens
aggaacauuggagccugc

SEQ ID NO: 1757355 - RNA, 15 nt, Homo sapiens
aacacuuacuaccug

SEQ ID NO: 1757356 - RNA, 17 nt, Homo sapiens
ucagccucauucacugu

SEQ ID NO: 1757357 - RNA, 21 nt, Homo sapiens
ucuacaccuguugcaccucag

SEQ ID NO: 1757358 - RNA, 17 nt, Homo sapiens
uacucuuucacucaggc

SEQ ID NO: 1757359 - RNA, 18 nt, Homo sapiens
uccagaaacaaaaagccc

SEQ ID NO: 1757360 - RNA, 20 nt, Homo sapiens
ucacuuugacagguuccuuu

SEQ ID NO: 1757361 - RNA, 17 nt, Homo sapiens
uggcucgccaggccaaa

SEQ ID NO: 1757362 - RNA, 22 nt, Homo sapiens
gagcccagaucaccaccugaac

SEQ ID NO: 1757363 - RNA, 21 nt, Homo sapiens
gaaaauuuccuccacauucau

SEQ ID NO: 1757364 - RNA, 20 nt, Homo sapiens
uuugaucaaauguacaucuc

SEQ ID NO: 1757365 - RNA, 17 nt, Homo sapiens
uaauuuaaguacuugag

SEQ ID NO: 1757366 - RNA, 20 nt, Homo sapiens
ucuccgucacuccauucuca

SEQ ID NO: 1757367 - RNA, 16 nt, Homo sapiens
gcugagucaccuccuc

SEQ ID NO: 1757368 - RNA, 23 nt, Homo sapiens
uaugaccauaaaauuagacauac

SEQ ID NO: 1757369 - RNA, 17 nt, Homo sapiens
uuacacaaaggaccuca

SEQ ID NO: 1757370 - RNA, 19 nt, Homo sapiens
uucauguaaaaagugcagu

SEQ ID NO: 1757371 - RNA, 11 nt, Homo sapiens
acuagggccaa

SEQ ID NO: 1757372 - RNA, 20 nt, Homo sapiens
cuugucaaacuugucaagaa

SEQ ID NO: 1757373 - RNA, 20 nt, Homo sapiens
acccucggggauguguccug

SEQ ID NO: 1757374 - RNA, 13 nt, Homo sapiens
gccccucauuuau

SEQ ID NO: 1757375 - RNA, 17 nt, Homo sapiens
ccccuuauccuucuccc

SEQ ID NO: 1757376 - RNA, 14 nt, Homo sapiens
uaaauaauucuucc

SEQ ID NO: 1757377 - RNA, 21 nt, Homo sapiens
ucccccacucucucacccacc

SEQ ID NO: 1757378 - RNA, 17 nt, Homo sapiens
ccaugaagauaaacugu

SEQ ID NO: 1757379 - RNA, 21 nt, Homo sapiens
aguucagccagaaucuucguc

SEQ ID NO: 1757380 - RNA, 20 nt, Homo sapiens
uauuuacauaaagacugugc

SEQ ID NO: 1757381 - RNA, 22 nt, Homo sapiens
cccucccaguuacguuguguau

SEQ ID NO: 1757382 - RNA, 21 nt, Homo sapiens
uuacacgggguuacacuguua

SEQ ID NO: 1757383 - RNA, 14 nt, Homo sapiens
uccuacaauaucau

SEQ ID NO: 1757384 - RNA, 20 nt, Homo sapiens
ccuucuauuuggggcuugau

SEQ ID NO: 1757385 - RNA, 22 nt, Homo sapiens
ggaaagcaucaccucaggccag

SEQ ID NO: 1757386 - RNA, 17 nt, Homo sapiens
uaaucucucauggugaa

SEQ ID NO: 1757387 - RNA, 14 nt, Homo sapiens
gcucgggugcagag

SEQ ID NO: 1757388 - RNA, 11 nt, Homo sapiens
cccugcugagu

SEQ ID NO: 1757389 - RNA, 23 nt, Homo sapiens
uuugacucaugaacuauuuacau

SEQ ID NO: 1757390 - RNA, 19 nt, Homo sapiens
ugagaccaggguggccaca

SEQ ID NO: 1757391 - RNA, 19 nt, Homo sapiens
acuuccccauggcccugag

SEQ ID NO: 1757392 - RNA, 22 nt, Homo sapiens
uuucuuggcaaaagccuugugu

SEQ ID NO: 1757393 - RNA, 14 nt, Homo sapiens
uuuaauauaugcau

SEQ ID NO: 1757394 - RNA, 21 nt, Homo sapiens
auagaugucaggaaacauuca

SEQ ID NO: 1757395 - RNA, 14 nt, Homo sapiens
uauuuauauuucaa

SEQ ID NO: 1757396 - RNA, 22 nt, Homo sapiens
ucucuguuuuuuuuuuuuuaac

SEQ ID NO: 1757397 - RNA, 20 nt, Homo sapiens
acaaaaugcuaaaauauuua

SEQ ID NO: 1757398 - RNA, 15 nt, Homo sapiens
agcucuccccucaga

SEQ ID NO: 1757399 - RNA, 21 nt, Homo sapiens
acaggcaguggaagcaguuuc

SEQ ID NO: 1757400 - RNA, 12 nt, Homo sapiens
ugagauccugca

SEQ ID NO: 1757401 - RNA, 14 nt, Homo sapiens
cucagcaacccagg

SEQ ID NO: 1757402 - RNA, 16 nt, Homo sapiens
ugcaaauaaucacaga

SEQ ID NO: 1757403 - RNA, 13 nt, Homo sapiens
guauuacuuccuc

SEQ ID NO: 1757404 - RNA, 16 nt, Homo sapiens
cucuggcuugccccag

SEQ ID NO: 1757405 - RNA, 21 nt, Homo sapiens
gagcuuggacagucugagcug

SEQ ID NO: 1757406 - RNA, 19 nt, Homo sapiens
acgugcaguaucucaagau

SEQ ID NO: 1757407 - RNA, 15 nt, Homo sapiens
caagacacccagugg

SEQ ID NO: 1757408 - RNA, 19 nt, Homo sapiens
caagaccucaucucuacua

SEQ ID NO: 1757409 - RNA, 20 nt, Homo sapiens
cuguagcagcauuacagaaa

SEQ ID NO: 1757410 - RNA, 18 nt, Homo sapiens
cuaaugacauucaauaaa

SEQ ID NO: 1757411 - RNA, 16 nt, Homo sapiens
uccaccgccacugggc

SEQ ID NO: 1757412 - RNA, 22 nt, Homo sapiens
acagcaugggccucaccuccuc

SEQ ID NO: 1757413 - RNA, 22 nt, Homo sapiens
uuugagaagaaaacaucuauuc

SEQ ID NO: 1757414 - RNA, 21 nt, Homo sapiens
agggacucagggccaugccug

SEQ ID NO: 1757415 - RNA, 21 nt, Homo sapiens
guaaccaauaauguagcaguu

SEQ ID NO: 1757416 - RNA, 16 nt, Homo sapiens
cauuuuuaauguaucu

SEQ ID NO: 1757417 - RNA, 18 nt, Homo sapiens
cagaugugaaggacauga

SEQ ID NO: 1757418 - RNA, 16 nt, Homo sapiens
agcuacuaaugauguu

SEQ ID NO: 1757419 - RNA, 16 nt, Homo sapiens
uggaaguuuucuucua

SEQ ID NO: 1757420 - RNA, 20 nt, Homo sapiens
agcuaagagcaguacucuga

SEQ ID NO: 1757421 - RNA, 14 nt, Homo sapiens
agucaucuacuuaa

SEQ ID NO: 1757422 - RNA, 15 nt, Homo sapiens
agggaaguccuugca

SEQ ID NO: 1757423 - RNA, 13 nt, Homo sapiens
aacauaaagccuu

SEQ ID NO: 1757424 - RNA, 12 nt, Homo sapiens
uccaucugucca

SEQ ID NO: 1757425 - RNA, 12 nt, Homo sapiens
uauaucuguaua

SEQ ID NO: 1757426 - RNA, 12 nt, Homo sapiens
ucacucugucac

SEQ ID NO: 1757427 - RNA, 23 nt, Homo sapiens
aacugcccagcggacaguggcag

SEQ ID NO: 1757428 - RNA, 16 nt, Homo sapiens
aggacaagggcucaga

SEQ ID NO: 1757429 - RNA, 20 nt, Homo sapiens
uugucauuuuaaaaucugau

SEQ ID NO: 1757430 - RNA, 20 nt, Homo sapiens
aaggcagugaacacacucag

SEQ ID NO: 1757431 - RNA, 14 nt, Homo sapiens
uccuagauggaacu

SEQ ID NO: 1757432 - RNA, 14 nt, Homo sapiens
uuaugcuguuuccu

SEQ ID NO: 1757433 - RNA, 18 nt, Homo sapiens
ugccuucuaggucacuuc

SEQ ID NO: 1757434 - RNA, 15 nt, Homo sapiens
acucacucacuccaa

SEQ ID NO: 1757435 - RNA, 21 nt, Homo sapiens
ucaagaacgagaagcagcauu

SEQ ID NO: 1757436 - RNA, 20 nt, Homo sapiens
aaaguaaaauagauggugua

SEQ ID NO: 1757437 - RNA, 13 nt, Homo sapiens
ugguugauuccca

SEQ ID NO: 1757438 - RNA, 13 nt, Homo sapiens
ugccaacauaccc

SEQ ID NO: 1757439 - RNA, 13 nt, Homo sapiens
gagacacagggaa

SEQ ID NO: 1757440 - RNA, 19 nt, Homo sapiens
ggcagccacgugcucucug

SEQ ID NO: 1757441 - RNA, 20 nt, Homo sapiens
uugcacugaucuuacucuac

SEQ ID NO: 1757442 - RNA, 13 nt, Homo sapiens
aggccuaccucuc

SEQ ID NO: 1757443 - RNA, 12 nt, Homo sapiens
cuucgguuugua

SEQ ID NO: 1757444 - RNA, 15 nt, Homo sapiens
ugaacauugcauaua

SEQ ID NO: 1757445 - RNA, 13 nt, Homo sapiens
caaauggacauag

SEQ ID NO: 1757446 - RNA, 13 nt, Homo sapiens
uaacugugaauaa

SEQ ID NO: 1757447 - RNA, 16 nt, Homo sapiens
ccaaaaucuuaucaug

SEQ ID NO: 1757448 - RNA, 23 nt, Homo sapiens
auugaauuaugcuguguaaaaau

SEQ ID NO: 1757449 - RNA, 18 nt, Homo sapiens
ccaagcuggagugcagug

SEQ ID NO: 1757450 - RNA, 20 nt, Homo sapiens
cucugcacaugucuuguaca

SEQ ID NO: 1757451 - RNA, 22 nt, Homo sapiens
uucucucuguucccuuccucac

SEQ ID NO: 1757452 - RNA, 20 nt, Homo sapiens
cacuacaucugggacugacu

SEQ ID NO: 1757453 - RNA, 17 nt, Homo sapiens
ucacucaccaucuggaa

SEQ ID NO: 1757454 - RNA, 15 nt, Homo sapiens
cccugaugugacauu

SEQ ID NO: 1757455 - RNA, 16 nt, Homo sapiens
ccuacuugauaauauu

SEQ ID NO: 1757456 - RNA, 23 nt, Homo sapiens
uuuuguauugagggccagugaug

SEQ ID NO: 1757457 - RNA, 14 nt, Homo sapiens
gccucccacaguga

SEQ ID NO: 1757458 - RNA, 16 nt, Homo sapiens
cauuugaagcagugau

SEQ ID NO: 1757459 - RNA, 17 nt, Homo sapiens
aauauuugaagcagcuc

SEQ ID NO: 1757460 - RNA, 22 nt, Homo sapiens
uuucuuauagucaauguuucuu

SEQ ID NO: 1757461 - RNA, 20 nt, Homo sapiens
uuaugaaguaaaguuucuga

SEQ ID NO: 1757462 - RNA, 19 nt, Homo sapiens
aauacuucagugagauuaa

SEQ ID NO: 1757463 - RNA, 20 nt, Homo sapiens
ucucuggcuguaaggcucua

SEQ ID NO: 1757464 - RNA, 20 nt, Homo sapiens
aauauguguggcagugaaga

SEQ ID NO: 1757465 - RNA, 20 nt, Homo sapiens
ucagagagcuaaauuacaau

SEQ ID NO: 1757466 - RNA, 10 nt, Homo sapiens
ccuuacuuug

SEQ ID NO: 1757467 - RNA, 19 nt, Homo sapiens
gaaugaaauauagauguua

SEQ ID NO: 1757468 - RNA, 14 nt, Homo sapiens
gugccagcacaaag

SEQ ID NO: 1757469 - RNA, 15 nt, Homo sapiens
gagaggaacgggcag

SEQ ID NO: 1757470 - RNA, 13 nt, Homo sapiens
cagaccuuugucu

SEQ ID NO: 1757471 - RNA, 13 nt, Homo sapiens
gcagcgaccucaa

SEQ ID NO: 1757472 - RNA, 17 nt, Homo sapiens
acaagaugguucuagca

SEQ ID NO: 1757473 - RNA, 18 nt, Homo sapiens
ccaguuugcccauucucu

SEQ ID NO: 1757474 - RNA, 13 nt, Homo sapiens
ccuguacccagug

SEQ ID NO: 1757475 - RNA, 21 nt, Homo sapiens
ugagccuucagcacuaaccua

SEQ ID NO: 1757476 - RNA, 12 nt, Homo sapiens
acuguaaaucac

SEQ ID NO: 1757477 - RNA, 17 nt, Homo sapiens
acuuagauugugcuccu

SEQ ID NO: 1757478 - RNA, 14 nt, Homo sapiens
aacacuuucauccg

SEQ ID NO: 1757479 - RNA, 21 nt, Homo sapiens
gcccagaaaagguacacuuug

SEQ ID NO: 1757480 - RNA, 17 nt, Homo sapiens
cagugucccuuuugcua

SEQ ID NO: 1757481 - RNA, 14 nt, Homo sapiens
caugggcgauguca

SEQ ID NO: 1757482 - RNA, 23 nt, Homo sapiens
agcucaggaaggggugugcugag

SEQ ID NO: 1757483 - RNA, 11 nt, Homo sapiens
gcaugaugaaa

SEQ ID NO: 1757484 - RNA, 18 nt, Homo sapiens
gggacccuccaaggccag

SEQ ID NO: 1757485 - RNA, 11 nt, Homo sapiens
cugacccaaau

SEQ ID NO: 1757486 - RNA, 20 nt, Homo sapiens
cugaaagauugauuaaugaa

SEQ ID NO: 1757487 - RNA, 22 nt, Homo sapiens
cucgguggccaugcuucuugcc

SEQ ID NO: 1757488 - RNA, 18 nt, Homo sapiens
gagagagccuuggccuga

SEQ ID NO: 1757489 - RNA, 16 nt, Homo sapiens
uucacaccccauucuc

SEQ ID NO: 1757490 - RNA, 22 nt, Homo sapiens
cugguguccugcccgccuuuca

SEQ ID NO: 1757491 - RNA, 14 nt, Homo sapiens
cggauacaaacugg

SEQ ID NO: 1757492 - RNA, 14 nt, Homo sapiens
aacaugcacgguga

SEQ ID NO: 1757493 - RNA, 15 nt, Homo sapiens
agcuuuacauauucc

SEQ ID NO: 1757494 - RNA, 20 nt, Homo sapiens
ccacagcuucucuacagacu

SEQ ID NO: 1757495 - RNA, 23 nt, Homo sapiens
caugacugccccuugcuucucaa

SEQ ID NO: 1757496 - RNA, 12 nt, Homo sapiens
gcaagagacugg

SEQ ID NO: 1757497 - RNA, 20 nt, Homo sapiens
uucaccauguaauucaggua

SEQ ID NO: 1757498 - RNA, 12 nt, Homo sapiens
acggccaugagg

SEQ ID NO: 1757499 - RNA, 12 nt, Homo sapiens
aacuccaugccu

SEQ ID NO: 1757500 - RNA, 14 nt, Homo sapiens
acauguaaaaucca

SEQ ID NO: 1757501 - RNA, 15 nt, Homo sapiens
gaaaauuacagucca

SEQ ID NO: 1757502 - RNA, 17 nt, Homo sapiens
ugccguggcaacugugg

SEQ ID NO: 1757503 - RNA, 17 nt, Homo sapiens
gguagaaagauggggca

SEQ ID NO: 1757504 - RNA, 13 nt, Homo sapiens
uugucugugaucu

SEQ ID NO: 1757505 - RNA, 14 nt, Homo sapiens
uuucuaacuguaaa

SEQ ID NO: 1757506 - RNA, 19 nt, Homo sapiens
caguauggccccaccugcu

SEQ ID NO: 1757507 - RNA, 19 nt, Homo sapiens
aggcguggagcugccugau

SEQ ID NO: 1757508 - RNA, 14 nt, Homo sapiens
aucuaaggauguca

SEQ ID NO: 1757509 - RNA, 21 nt, Homo sapiens
gcacuggugguuuuugcucuc

SEQ ID NO: 1757510 - RNA, 17 nt, Homo sapiens
aaauauugcuaaaagca

SEQ ID NO: 1757511 - RNA, 23 nt, Homo sapiens
uauccaaucugugaugacauucc

SEQ ID NO: 1757512 - RNA, 13 nt, Homo sapiens
uguuauuuaucaa

SEQ ID NO: 1757513 - RNA, 17 nt, Homo sapiens
auugagcuuugcauuua

SEQ ID NO: 1757514 - RNA, 16 nt, Homo sapiens
ugagguagcugacaca

SEQ ID NO: 1757515 - RNA, 22 nt, Homo sapiens
gaauaugcauugucugcaaugg

SEQ ID NO: 1757516 - RNA, 20 nt, Homo sapiens
agauuucuccucuuccugcc

SEQ ID NO: 1757517 - RNA, 18 nt, Homo sapiens
cuaacauuggugcaaaga

SEQ ID NO: 1757518 - RNA, 22 nt, Homo sapiens
cuggcagagagcacagugauca

SEQ ID NO: 1757519 - RNA, 13 nt, Homo sapiens
ggaggcacuggga

SEQ ID NO: 1757520 - RNA, 13 nt, Homo sapiens
cugcuacuugugg

SEQ ID NO: 1757521 - RNA, 17 nt, Homo sapiens
uuugaagguaacugaga

SEQ ID NO: 1757522 - RNA, 18 nt, Homo sapiens
ucuagucagcacuagauc

SEQ ID NO: 1757523 - RNA, 14 nt, Homo sapiens
cccuccugagggag

SEQ ID NO: 1757524 - RNA, 19 nt, Homo sapiens
aauacuagccccccagugg

SEQ ID NO: 1757525 - RNA, 13 nt, Homo sapiens
auauaaacuuuau

SEQ ID NO: 1757526 - RNA, 18 nt, Homo sapiens
ucuaaaauuacagacaaa

SEQ ID NO: 1757527 - RNA, 20 nt, Homo sapiens
aagauucauuggcaugccac

SEQ ID NO: 1757528 - RNA, 22 nt, Homo sapiens
agugugacagggccaguggggc

SEQ ID NO: 1757529 - RNA, 20 nt, Homo sapiens
uggcaagauaaacacuuucu

SEQ ID NO: 1757530 - RNA, 14 nt, Homo sapiens
cacagaaugugaua

SEQ ID NO: 1757531 - RNA, 19 nt, Homo sapiens
guagcuagcgugugccagg

SEQ ID NO: 1757532 - RNA, 14 nt, Homo sapiens
ucacuccacucccc

SEQ ID NO: 1757533 - RNA, 19 nt, Homo sapiens
aauaaacacauacaaugaa

SEQ ID NO: 1757534 - RNA, 23 nt, Homo sapiens
agcccucuucugacacuaaaaca

SEQ ID NO: 1757535 - RNA, 16 nt, Homo sapiens
agguauuuacccaaga

SEQ ID NO: 1757536 - RNA, 23 nt, Homo sapiens
auauucuaguaauaaagacucua

SEQ ID NO: 1757537 - RNA, 16 nt, Homo sapiens
gaaugucacuggugga

SEQ ID NO: 1757538 - RNA, 20 nt, Homo sapiens
ugugaaguugcccaccaaaa

SEQ ID NO: 1757539 - RNA, 20 nt, Homo sapiens
cuguccucucccaacucaag

SEQ ID NO: 1757540 - RNA, 17 nt, Homo sapiens
cuuccccccaucucuga

SEQ ID NO: 1757541 - RNA, 14 nt, Homo sapiens
cuggcugucuuccc

SEQ ID NO: 1757542 - RNA, 19 nt, Homo sapiens
ggaggaauccuggaccaag

SEQ ID NO: 1757543 - RNA, 19 nt, Homo sapiens
gaggcggagaguacaguga

SEQ ID NO: 1757544 - RNA, 19 nt, Homo sapiens
ggaugcucauuccaugacu

SEQ ID NO: 1757545 - RNA, 23 nt, Homo sapiens
uuuaaucagcuuaaaauccaaag

SEQ ID NO: 1757546 - RNA, 23 nt, Homo sapiens
gacuuuacuaguggggcaaugac

SEQ ID NO: 1757547 - RNA, 22 nt, Homo sapiens
ugcuauggaaauaaaaggcauu

SEQ ID NO: 1757548 - RNA, 18 nt, Homo sapiens
agccauuuuucaaagcaa

SEQ ID NO: 1757549 - RNA, 19 nt, Homo sapiens
cauuugacuccacuuuucc

SEQ ID NO: 1757550 - RNA, 22 nt, Homo sapiens
cugugcccggugccaucuucca

SEQ ID NO: 1757551 - RNA, 22 nt, Homo sapiens
ggccccaccuggcccucucuga

SEQ ID NO: 1757552 - RNA, 19 nt, Homo sapiens
cccucagucuucucaugaa

SEQ ID NO: 1757553 - RNA, 16 nt, Homo sapiens
uagguuagauucucau

SEQ ID NO: 1757554 - RNA, 15 nt, Homo sapiens
aucuaauagggcaau

SEQ ID NO: 1757555 - RNA, 17 nt, Homo sapiens
cagcaugcauuuagcau

SEQ ID NO: 1757556 - RNA, 14 nt, Homo sapiens
uuaagucaaagaag

SEQ ID NO: 1757557 - RNA, 15 nt, Homo sapiens
uagaauacuuuuuaa

SEQ ID NO: 1757558 - RNA, 20 nt, Homo sapiens
aucucaggcaauauggccac

SEQ ID NO: 1757559 - RNA, 13 nt, Homo sapiens
ugggagggggucc

SEQ ID NO: 1757560 - RNA, 11 nt, Homo sapiens
cagugacucca

SEQ ID NO: 1757561 - RNA, 20 nt, Homo sapiens
uacugggaaggcaauuucau

SEQ ID NO: 1757562 - RNA, 15 nt, Homo sapiens
uacuuaaucaagaua

SEQ ID NO: 1757563 - RNA, 15 nt, Homo sapiens
ucuuucuauucauaa

SEQ ID NO: 1757564 - RNA, 20 nt, Homo sapiens
guguuaugcggucuagggaa

SEQ ID NO: 1757565 - RNA, 10 nt, Homo sapiens
uuugagacag

SEQ ID NO: 1757566 - RNA, 20 nt, Homo sapiens
ucccaagcagcugggauuac

SEQ ID NO: 1757567 - RNA, 22 nt, Homo sapiens
aauccuguaccaaaucugacau

SEQ ID NO: 1757568 - RNA, 21 nt, Homo sapiens
agagaauuucaaggcagggga

SEQ ID NO: 1757569 - RNA, 13 nt, Homo sapiens
aggaaauaaagua

SEQ ID NO: 1757570 - RNA, 22 nt, Homo sapiens
aagcucgccccaccuccaccug

SEQ ID NO: 1757571 - RNA, 14 nt, Homo sapiens
auccuuucaagaca

SEQ ID NO: 1757572 - RNA, 13 nt, Homo sapiens
ucugcgccugagu

SEQ ID NO: 1757573 - RNA, 20 nt, Homo sapiens
uagugucuaaaacacuauuc

SEQ ID NO: 1757574 - RNA, 17 nt, Homo sapiens
gacgauuucacugacac

SEQ ID NO: 1757575 - RNA, 19 nt, Homo sapiens
auaccuaauguuaaaugac

SEQ ID NO: 1757576 - RNA, 16 nt, Homo sapiens
ucuccauacucuguaa

SEQ ID NO: 1757577 - RNA, 18 nt, Homo sapiens
cagacucccaccccaggg

SEQ ID NO: 1757578 - RNA, 14 nt, Homo sapiens
caacuaauacaugg

SEQ ID NO: 1757579 - RNA, 17 nt, Homo sapiens
ucaagaacauucuacca

SEQ ID NO: 1757580 - RNA, 18 nt, Homo sapiens
auggugagcugaguucau

SEQ ID NO: 1757581 - RNA, 15 nt, Homo sapiens
guuugaacacaauuc

SEQ ID NO: 1757582 - RNA, 17 nt, Homo sapiens
acauuuuucaacauuuu

SEQ ID NO: 1757583 - RNA, 15 nt, Homo sapiens
augagauaacucaag

SEQ ID NO: 1757584 - RNA, 20 nt, Homo sapiens
ugugucaacugagagucaua

SEQ ID NO: 1757585 - RNA, 22 nt, Homo sapiens
aacaucucaacaaccugaaugu

SEQ ID NO: 1757586 - RNA, 16 nt, Homo sapiens
uacuuuaacauuuugg

SEQ ID NO: 1757587 - RNA, 23 nt, Homo sapiens
ucagaaucagguugacagucccu

SEQ ID NO: 1757588 - RNA, 15 nt, Homo sapiens
uguugcuuguaauca

SEQ ID NO: 1757589 - RNA, 21 nt, Homo sapiens
uuauaaagagugcuacauggu

SEQ ID NO: 1757590 - RNA, 22 nt, Homo sapiens
uguacuugauuuuucaaagacu

SEQ ID NO: 1757591 - RNA, 15 nt, Homo sapiens
aacucauuugaaugc

SEQ ID NO: 1757592 - RNA, 20 nt, Homo sapiens
cugaaucugagaaaguacuu

SEQ ID NO: 1757593 - RNA, 16 nt, Homo sapiens
gucccuccaaagggca

SEQ ID NO: 1757594 - RNA, 13 nt, Homo sapiens
ugcucugagguaa

SEQ ID NO: 1757595 - RNA, 14 nt, Homo sapiens
accauggacacuac

SEQ ID NO: 1757596 - RNA, 18 nt, Homo sapiens
ucuuuuguuguuucuuaa

SEQ ID NO: 1757597 - RNA, 18 nt, Homo sapiens
auuguuuuugcucaaggc

SEQ ID NO: 1757598 - RNA, 22 nt, Homo sapiens
cccagcuccugacacugcugga

SEQ ID NO: 1757599 - RNA, 16 nt, Homo sapiens
ucucuccuuggccaca

SEQ ID NO: 1757600 - RNA, 17 nt, Homo sapiens
aaggcggcaggugggac

SEQ ID NO: 1757601 - RNA, 16 nt, Homo sapiens
gaccacccccaaacac

SEQ ID NO: 1757602 - RNA, 13 nt, Homo sapiens
cagcuauccagug

SEQ ID NO: 1757603 - RNA, 18 nt, Homo sapiens
gagaguaugguccucaga

SEQ ID NO: 1757604 - RNA, 23 nt, Homo sapiens
uaaaauauuuuagauguuauuau

SEQ ID NO: 1757605 - RNA, 18 nt, Homo sapiens
gaagaaaggcauugcaca

SEQ ID NO: 1757606 - RNA, 22 nt, Homo sapiens
uguuuagcgaacuuguauacuu

SEQ ID NO: 1757607 - RNA, 18 nt, Homo sapiens
uaagggucgaaagcucua

SEQ ID NO: 1757608 - RNA, 17 nt, Homo sapiens
ugggaguccaggcacag

SEQ ID NO: 1757609 - RNA, 13 nt, Homo sapiens
uaagugccuucca

SEQ ID NO: 1757610 - RNA, 14 nt, Homo sapiens
ucugggucugaguc

SEQ ID NO: 1757611 - RNA, 16 nt, Homo sapiens
cagccccuugcucuca

SEQ ID NO: 1757612 - RNA, 22 nt, Homo sapiens
gucugagagauucaugcugauu

SEQ ID NO: 1757613 - RNA, 21 nt, Homo sapiens
ucacugccugcagcugagauu

SEQ ID NO: 1757614 - RNA, 20 nt, Homo sapiens
gcaucuacacagccuggacu

SEQ ID NO: 1757615 - RNA, 17 nt, Homo sapiens
cagacucgcuagcacuc

SEQ ID NO: 1757616 - RNA, 19 nt, Homo sapiens
uugauaccauggcacugac

SEQ ID NO: 1757617 - RNA, 16 nt, Homo sapiens
agguuaugccaaaaug

SEQ ID NO: 1757618 - RNA, 15 nt, Homo sapiens
aggacgauuucuguc

SEQ ID NO: 1757619 - RNA, 23 nt, Homo sapiens
cauguggacuggugcaaguugag

SEQ ID NO: 1757620 - RNA, 16 nt, Homo sapiens
cauacuucuucauuca

SEQ ID NO: 1757621 - RNA, 18 nt, Homo sapiens
gggaccucgaacacuagu

SEQ ID NO: 1757622 - RNA, 16 nt, Homo sapiens
cuuauuuaaauuuuca

SEQ ID NO: 1757623 - RNA, 16 nt, Homo sapiens
acgggugaugugauuc

SEQ ID NO: 1757624 - RNA, 19 nt, Homo sapiens
uccuggcugcacucuugaa

SEQ ID NO: 1757625 - RNA, 14 nt, Homo sapiens
acuggugcugauaa

SEQ ID NO: 1757626 - RNA, 16 nt, Homo sapiens
uucugucccacuacau

SEQ ID NO: 1757627 - RNA, 13 nt, Homo sapiens
ucuccagugaaau

SEQ ID NO: 1757628 - RNA, 22 nt, Homo sapiens
ggaaagaguugagcacaggcaa

SEQ ID NO: 1757629 - RNA, 15 nt, Homo sapiens
uguuguaagcacuga

SEQ ID NO: 1757630 - RNA, 20 nt, Homo sapiens
uuugcauaauaagcagguug

SEQ ID NO: 1757631 - RNA, 21 nt, Homo sapiens
ggaaaugugucuugucuccau

SEQ ID NO: 1757632 - RNA, 18 nt, Homo sapiens
aaaauaaaguaccacaca

SEQ ID NO: 1757633 - RNA, 13 nt, Homo sapiens
gggggaacagcag

SEQ ID NO: 1757634 - RNA, 22 nt, Homo sapiens
auccaagcccagccuaucucuc

SEQ ID NO: 1757635 - RNA, 18 nt, Homo sapiens
caugaaucaaaagugccu

SEQ ID NO: 1757636 - RNA, 15 nt, Homo sapiens
gggcccuaugucuca

SEQ ID NO: 1757637 - RNA, 19 nt, Homo sapiens
uagcacagagagggacaca

SEQ ID NO: 1757638 - RNA, 14 nt, Homo sapiens
aaugaauacuuuau

SEQ ID NO: 1757639 - RNA, 16 nt, Homo sapiens
gccccuucaaaccuca

SEQ ID NO: 1757640 - RNA, 20 nt, Homo sapiens
acucaugcugaaagcccaag

SEQ ID NO: 1757641 - RNA, 21 nt, Homo sapiens
acuacuguaagagacaugaau

SEQ ID NO: 1757642 - RNA, 20 nt, Homo sapiens
uuucucccucuuucuuccca

SEQ ID NO: 1757643 - RNA, 13 nt, Homo sapiens
uaagaagucugau

SEQ ID NO: 1757644 - RNA, 21 nt, Homo sapiens
aauagaucuuuauaaccugau

SEQ ID NO: 1757645 - RNA, 12 nt, Homo sapiens
cugcuuugccua

SEQ ID NO: 1757646 - RNA, 15 nt, Homo sapiens
ggcccuuugcugucc

SEQ ID NO: 1757647 - RNA, 23 nt, Homo sapiens
agcauggcucauucugcaaugag

SEQ ID NO: 1757648 - RNA, 14 nt, Homo sapiens
gcuguuuguuucau

SEQ ID NO: 1757649 - RNA, 14 nt, Homo sapiens
uaaagugccaguau

SEQ ID NO: 1757650 - RNA, 13 nt, Homo sapiens
cguccgaagggaa

SEQ ID NO: 1757651 - RNA, 20 nt, Homo sapiens
gccugcauguaaacacgccu

SEQ ID NO: 1757652 - RNA, 17 nt, Homo sapiens
ucagcuggagauacuga

SEQ ID NO: 1757653 - RNA, 14 nt, Homo sapiens
uauacugccaaaga

SEQ ID NO: 1757654 - RNA, 13 nt, Homo sapiens
ucagcaagccaug

SEQ ID NO: 1757655 - RNA, 13 nt, Homo sapiens
gaauuucaaacau

SEQ ID NO: 1757656 - RNA, 23 nt, Homo sapiens
cauuacuuuaauacucaccuccu

SEQ ID NO: 1757657 - RNA, 16 nt, Homo sapiens
agcaggccacuaguga

SEQ ID NO: 1757658 - RNA, 15 nt, Homo sapiens
aagaaugaauuucaa

SEQ ID NO: 1757659 - RNA, 20 nt, Homo sapiens
gacuucauuuuuccuaacag

SEQ ID NO: 1757660 - RNA, 21 nt, Homo sapiens
auaguugcugucauccacuuu

SEQ ID NO: 1757661 - RNA, 16 nt, Homo sapiens
ggaggcggcuccaggu

SEQ ID NO: 1757662 - RNA, 11 nt, Homo sapiens
aaucacacugu

SEQ ID NO: 1757663 - RNA, 20 nt, Homo sapiens
cuaacauuugcaaaauggaa

SEQ ID NO: 1757664 - RNA, 12 nt, Homo sapiens
gauuuacaagca

SEQ ID NO: 1757665 - RNA, 14 nt, Homo sapiens
cauuucccauuaaa

SEQ ID NO: 1757666 - RNA, 12 nt, Homo sapiens
ucucugcucugc

SEQ ID NO: 1757667 - RNA, 23 nt, Homo sapiens
caggggaaggcccugaggcggag

SEQ ID NO: 1757668 - RNA, 21 nt, Homo sapiens
uggaggaccuggcgugcucag

SEQ ID NO: 1757669 - RNA, 21 nt, Homo sapiens
aauuugguaaauuaguauuua

SEQ ID NO: 1757670 - RNA, 17 nt, Homo sapiens
uauuguaaagauccuau

SEQ ID NO: 1757671 - RNA, 13 nt, Homo sapiens
cauggugacacac

SEQ ID NO: 1757672 - RNA, 19 nt, Homo sapiens
agcaagcucacuugcuuua

SEQ ID NO: 1757673 - RNA, 22 nt, Homo sapiens
aaaucaaaaagggaaugcauua

SEQ ID NO: 1757674 - RNA, 15 nt, Homo sapiens
aagaaagaucaaaga

SEQ ID NO: 1757675 - RNA, 23 nt, Homo sapiens
uuggucuguuuugccuucaccca

SEQ ID NO: 1757676 - RNA, 22 nt, Homo sapiens
cauguacacggccucaagggau

SEQ ID NO: 1757677 - RNA, 22 nt, Homo sapiens
ugucacauaaugcucauacuua

SEQ ID NO: 1757678 - RNA, 13 nt, Homo sapiens
cugggauaucacu

SEQ ID NO: 1757679 - RNA, 18 nt, Homo sapiens
uuaucuguuaaccaaaua

SEQ ID NO: 1757680 - RNA, 19 nt, Homo sapiens
ccucagacuucaagaccau

SEQ ID NO: 1757681 - RNA, 17 nt, Homo sapiens
caggaacccuuggucac

SEQ ID NO: 1757682 - RNA, 22 nt, Homo sapiens
cagcagccucugaucugugcag

SEQ ID NO: 1757683 - RNA, 20 nt, Homo sapiens
gccccugaccccaugucucc

SEQ ID NO: 1757684 - RNA, 15 nt, Homo sapiens
guuggauuccaugcu

SEQ ID NO: 1757685 - RNA, 21 nt, Homo sapiens
aaaauuaguugggcauggugg

SEQ ID NO: 1757686 - RNA, 19 nt, Homo sapiens
uauugauaauaaauuauac

SEQ ID NO: 1757687 - RNA, 21 nt, Homo sapiens
cagggguuggucaaggccacc

SEQ ID NO: 1757688 - RNA, 18 nt, Homo sapiens
agaaaagugggccagugu

SEQ ID NO: 1757689 - RNA, 21 nt, Homo sapiens
aaagaaugaaaguagcuguau

SEQ ID NO: 1757690 - RNA, 21 nt, Homo sapiens
ccccugccucaagaaauugcc

SEQ ID NO: 1757691 - RNA, 19 nt, Homo sapiens
guucuacagagugagaccu

SEQ ID NO: 1757692 - RNA, 15 nt, Homo sapiens
aucccaaauucacuu

SEQ ID NO: 1757693 - RNA, 15 nt, Homo sapiens
uccacuaaaccccau

SEQ ID NO: 1757694 - RNA, 15 nt, Homo sapiens
uaucuuuaaauauaa

SEQ ID NO: 1757695 - RNA, 17 nt, Homo sapiens
agcagaacuucugaaac

SEQ ID NO: 1757696 - RNA, 20 nt, Homo sapiens
caaguagccaccugaguucc

SEQ ID NO: 1757697 - RNA, 20 nt, Homo sapiens
cucuuggguucaagugauuc

SEQ ID NO: 1757698 - RNA, 18 nt, Homo sapiens
gaucgccaaccuuucccc

SEQ ID NO: 1757699 - RNA, 17 nt, Homo sapiens
caguguuauuaaugaca

SEQ ID NO: 1757700 - RNA, 20 nt, Homo sapiens
cuagagauuaaguccagaaa

SEQ ID NO: 1757701 - RNA, 14 nt, Homo sapiens
gucucauucuguca

SEQ ID NO: 1757702 - RNA, 20 nt, Homo sapiens
uggaauaggagaccauuuga

SEQ ID NO: 1757703 - RNA, 13 nt, Homo sapiens
aggcagugucuua

SEQ ID NO: 1757704 - RNA, 15 nt, Homo sapiens
gagucagacugucag

SEQ ID NO: 1757705 - RNA, 16 nt, Homo sapiens
cagugagcugagauca

SEQ ID NO: 1757706 - RNA, 17 nt, Homo sapiens
ccugcuccuaccuauca

SEQ ID NO: 1757707 - RNA, 22 nt, Homo sapiens
auacagcccucccccagcaguu

SEQ ID NO: 1757708 - RNA, 16 nt, Homo sapiens
accaaagagggcuucc

SEQ ID NO: 1757709 - RNA, 13 nt, Homo sapiens
cuguaguugacaa

SEQ ID NO: 1757710 - RNA, 18 nt, Homo sapiens
ugcuggaagucuccauga

SEQ ID NO: 1757711 - RNA, 23 nt, Homo sapiens
uuguaucucauacugucugggau

SEQ ID NO: 1757712 - RNA, 17 nt, Homo sapiens
auuacaggugugcacca

SEQ ID NO: 1757713 - RNA, 16 nt, Homo sapiens
cuuguucuuuggccag

SEQ ID NO: 1757714 - RNA, 14 nt, Homo sapiens
ugcagcgagugugc

SEQ ID NO: 1757715 - RNA, 20 nt, Homo sapiens
uauuagaugaauuauccuau

SEQ ID NO: 1757716 - RNA, 16 nt, Homo sapiens
cagauggccccuccac

SEQ ID NO: 1757717 - RNA, 22 nt, Homo sapiens
acugguuuguaugauguauuag

SEQ ID NO: 1757718 - RNA, 18 nt, Homo sapiens
uucuuccuggauggggca

SEQ ID NO: 1757719 - RNA, 14 nt, Homo sapiens
caauagccauauaa

SEQ ID NO: 1757720 - RNA, 14 nt, Homo sapiens
cugcagccaagcaa

SEQ ID NO: 1757721 - RNA, 14 nt, Homo sapiens
cagauaccaugaug

SEQ ID NO: 1757722 - RNA, 17 nt, Homo sapiens
agagaaagagaacuacu

SEQ ID NO: 1757723 - RNA, 16 nt, Homo sapiens
uuucaguucuauuuaa

SEQ ID NO: 1757724 - RNA, 13 nt, Homo sapiens
auuuuuguggaag

SEQ ID NO: 1757725 - RNA, 23 nt, Homo sapiens
gugucauaucaucccugcaaaaa

SEQ ID NO: 1757726 - RNA, 22 nt, Homo sapiens
agagguagguaggaucauccca

SEQ ID NO: 1757727 - RNA, 14 nt, Homo sapiens
uggauugaggccag

SEQ ID NO: 1757728 - RNA, 17 nt, Homo sapiens
uacccaguagaugccac

SEQ ID NO: 1757729 - RNA, 22 nt, Homo sapiens
acaagaagccacagaccuagga

SEQ ID NO: 1757730 - RNA, 20 nt, Homo sapiens
uggaaaaaucagaagcacaa

SEQ ID NO: 1757731 - RNA, 19 nt, Homo sapiens
gagauaccauggugccauc

SEQ ID NO: 1757732 - RNA, 16 nt, Homo sapiens
ccaucccaaggcuccu

SEQ ID NO: 1757733 - RNA, 22 nt, Homo sapiens
cuugaaacaagcaacagaugga

SEQ ID NO: 1757734 - RNA, 17 nt, Homo sapiens
cauaucacguacaccau

SEQ ID NO: 1757735 - RNA, 22 nt, Homo sapiens
cagaaaugaggaggaugcuaaa

SEQ ID NO: 1757736 - RNA, 21 nt, Homo sapiens
caaaagacgagugaugccauu

SEQ ID NO: 1757737 - RNA, 14 nt, Homo sapiens
ggcccccaugcaag

SEQ ID NO: 1757738 - RNA, 20 nt, Homo sapiens
aguaugggaaaaaaacugaa

SEQ ID NO: 1757739 - RNA, 21 nt, Homo sapiens
auaaagaugucaaauaucuca

SEQ ID NO: 1757740 - RNA, 22 nt, Homo sapiens
caguugauacauaguuguauau

SEQ ID NO: 1757741 - RNA, 19 nt, Homo sapiens
cauccaugagaguuucaaa

SEQ ID NO: 1757742 - RNA, 19 nt, Homo sapiens
acuuucuucucuuucccaa

SEQ ID NO: 1757743 - RNA, 21 nt, Homo sapiens
cuguuggccagugugacaagg

SEQ ID NO: 1757744 - RNA, 21 nt, Homo sapiens
caagaguuuauuuccaaauaa

SEQ ID NO: 1757745 - RNA, 17 nt, Homo sapiens
agggcgcaaagggcaug

SEQ ID NO: 1757746 - RNA, 19 nt, Homo sapiens
caacaaaguuccacuucca

SEQ ID NO: 1757747 - RNA, 16 nt, Homo sapiens
ccggcucuucaaagac

SEQ ID NO: 1757748 - RNA, 12 nt, Homo sapiens
caaacaaacaaa

SEQ ID NO: 1757749 - RNA, 12 nt, Homo sapiens
ucaucugaagau

SEQ ID NO: 1757750 - RNA, 16 nt, Homo sapiens
agaacuacgcacagcu

SEQ ID NO: 1757751 - RNA, 16 nt, Homo sapiens
cuugcauuucacuuga

SEQ ID NO: 1757752 - RNA, 13 nt, Homo sapiens
acguacugguuua

SEQ ID NO: 1757753 - RNA, 14 nt, Homo sapiens
cgcuggaccugguu

SEQ ID NO: 1757754 - RNA, 19 nt, Homo sapiens
gcagaucgcucacuguugu

SEQ ID NO: 1757755 - RNA, 18 nt, Homo sapiens
acguggcuucugaugaau

SEQ ID NO: 1757756 - RNA, 13 nt, Homo sapiens
ucggggucccugg

SEQ ID NO: 1757757 - RNA, 21 nt, Homo sapiens
uccaacagauaaaagaaggaa

SEQ ID NO: 1757758 - RNA, 23 nt, Homo sapiens
ucugccuguggccuugcccgcca

SEQ ID NO: 1757759 - RNA, 20 nt, Homo sapiens
caaucucugggggcugagga

SEQ ID NO: 1757760 - RNA, 12 nt, Homo sapiens
ucuuugccucaa

SEQ ID NO: 1757761 - RNA, 22 nt, Homo sapiens
uggagauaacagccucuugccc

SEQ ID NO: 1757762 - RNA, 16 nt, Homo sapiens
aagauacacugcagcu

SEQ ID NO: 1757763 - RNA, 17 nt, Homo sapiens
ucuccacuuucucaaug

SEQ ID NO: 1757764 - RNA, 15 nt, Homo sapiens
ucugaaggaggccac

SEQ ID NO: 1757765 - RNA, 21 nt, Homo sapiens
ugauuuacuacuuaugcguaa

SEQ ID NO: 1757766 - RNA, 20 nt, Homo sapiens
acugaguguuauuugcacac

SEQ ID NO: 1757767 - RNA, 16 nt, Homo sapiens
acaagcagcaggaaac

SEQ ID NO: 1757768 - RNA, 23 nt, Homo sapiens
aucuuauauauaauaauauguga

SEQ ID NO: 1757769 - RNA, 15 nt, Homo sapiens
gaguuguugcuuaua

SEQ ID NO: 1757770 - RNA, 22 nt, Homo sapiens
guggacaagucauggacauuca

SEQ ID NO: 1757771 - RNA, 17 nt, Homo sapiens
aauucucauaaguagca

SEQ ID NO: 1757772 - RNA, 21 nt, Homo sapiens
agugggcugcagcagccggaa

SEQ ID NO: 1757773 - RNA, 22 nt, Homo sapiens
cugcaccuuacaacucggggac

SEQ ID NO: 1757774 - RNA, 20 nt, Homo sapiens
gcaacaauaaaguacuuuac

SEQ ID NO: 1757775 - RNA, 14 nt, Homo sapiens
uuccuucugaccac

SEQ ID NO: 1757776 - RNA, 18 nt, Homo sapiens
ggguaagguaugggagag

SEQ ID NO: 1757777 - RNA, 22 nt, Homo sapiens
ugaguuugcuguauacaaacag

SEQ ID NO: 1757778 - RNA, 13 nt, Homo sapiens
auucuucuaccac

SEQ ID NO: 1757779 - RNA, 17 nt, Homo sapiens
ugaagagguugaagcua

SEQ ID NO: 1757780 - RNA, 17 nt, Homo sapiens
ugacuuuuuaguacuaa

SEQ ID NO: 1757781 - RNA, 22 nt, Homo sapiens
aggaagcuccacugucacccuc

SEQ ID NO: 1757782 - RNA, 22 nt, Homo sapiens
ucuggaaaugucuuucuauuca

SEQ ID NO: 1757783 - RNA, 18 nt, Homo sapiens
ggacugagcugggggaag

SEQ ID NO: 1757784 - RNA, 18 nt, Homo sapiens
cauccuuuacaccaacuc

SEQ ID NO: 1757785 - RNA, 22 nt, Homo sapiens
uggcucccauucacucuuccag

SEQ ID NO: 1757786 - RNA, 20 nt, Homo sapiens
ugaaucuucagcauguucuc

SEQ ID NO: 1757787 - RNA, 16 nt, Homo sapiens
augaguaacaggaaaa

SEQ ID NO: 1757788 - RNA, 21 nt, Homo sapiens
guaaccaggucguccaagcaa

SEQ ID NO: 1757789 - RNA, 15 nt, Homo sapiens
uuagagugucuuaaa

SEQ ID NO: 1757790 - RNA, 22 nt, Homo sapiens
uaggccuaguacaaucuuggga

SEQ ID NO: 1757791 - RNA, 10 nt, Homo sapiens
aaacauucau

SEQ ID NO: 1757792 - RNA, 15 nt, Homo sapiens
ucacacaugccacua

SEQ ID NO: 1757793 - RNA, 21 nt, Homo sapiens
gcccaucccugugaaggagua

SEQ ID NO: 1757794 - RNA, 14 nt, Homo sapiens
guuaauauggcucu

SEQ ID NO: 1757795 - RNA, 19 nt, Homo sapiens
uaagcaaauugcuuuuuuc

SEQ ID NO: 1757796 - RNA, 17 nt, Homo sapiens
aaaauagaugguguaug

SEQ ID NO: 1757797 - RNA, 11 nt, Homo sapiens
ggcccuaccug

SEQ ID NO: 1757798 - RNA, 15 nt, Homo sapiens
uuacuauaaacauuu

SEQ ID NO: 1757799 - RNA, 13 nt, Homo sapiens
agugaaucuugcu

SEQ ID NO: 1757800 - RNA, 16 nt, Homo sapiens
uuaaagcaaucuuggc

SEQ ID NO: 1757801 - RNA, 12 nt, Homo sapiens
ugucauuccaga

SEQ ID NO: 1757802 - RNA, 13 nt, Homo sapiens
gaaacaacuucua

SEQ ID NO: 1757803 - RNA, 19 nt, Homo sapiens
gagauggagucuugcuaua

SEQ ID NO: 1757804 - RNA, 16 nt, Homo sapiens
aaaagcccuuugcuaa

SEQ ID NO: 1757805 - RNA, 22 nt, Homo sapiens
uccagccugaauguuauuuccu

SEQ ID NO: 1757806 - RNA, 11 nt, Homo sapiens
aucucagcuca

SEQ ID NO: 1757807 - RNA, 16 nt, Homo sapiens
gcaucagauggaagcu

SEQ ID NO: 1757808 - RNA, 20 nt, Homo sapiens
caacugaagauccacaaaag

SEQ ID NO: 1757809 - RNA, 15 nt, Homo sapiens
cuggccuguacccag

SEQ ID NO: 1757810 - RNA, 18 nt, Homo sapiens
ucaaacugacaaccugug

SEQ ID NO: 1757811 - RNA, 18 nt, Homo sapiens
uuuuccccaaaccauaaa

SEQ ID NO: 1757812 - RNA, 22 nt, Homo sapiens
aagguggccacaaauucuuuga

SEQ ID NO: 1757813 - RNA, 18 nt, Homo sapiens
ucaauauuuguauuugug

SEQ ID NO: 1757814 - RNA, 20 nt, Homo sapiens
uggucuuaagaaauguauaa

SEQ ID NO: 1757815 - RNA, 20 nt, Homo sapiens
uggagagucagaucuuucuc

SEQ ID NO: 1757816 - RNA, 13 nt, Homo sapiens
ugcuaacuuugcc

SEQ ID NO: 1757817 - RNA, 12 nt, Homo sapiens
uuaucacuuaau

SEQ ID NO: 1757818 - RNA, 12 nt, Homo sapiens
uuaacacuuaaa

SEQ ID NO: 1757819 - RNA, 17 nt, Homo sapiens
aucauaagggcacugag

SEQ ID NO: 1757820 - RNA, 21 nt, Homo sapiens
aaucagucuauccacagagag

SEQ ID NO: 1757821 - RNA, 15 nt, Homo sapiens
ucagggccaggugca

SEQ ID NO: 1757822 - RNA, 20 nt, Homo sapiens
cucuuuuccacuccaagaug

SEQ ID NO: 1757823 - RNA, 15 nt, Homo sapiens
uuggauuggcacugu

SEQ ID NO: 1757824 - RNA, 14 nt, Homo sapiens
gaccagccugggca

SEQ ID NO: 1757825 - RNA, 22 nt, Homo sapiens
gcuggcaagucuuccaugaccc

SEQ ID NO: 1757826 - RNA, 15 nt, Homo sapiens
uucaucccacaaucu

SEQ ID NO: 1757827 - RNA, 17 nt, Homo sapiens
ugauagacaaaaucagu

SEQ ID NO: 1757828 - RNA, 21 nt, Homo sapiens
uuuuuaauggcaauaggacau

SEQ ID NO: 1757829 - RNA, 17 nt, Homo sapiens
agggagaggaagcacac

SEQ ID NO: 1757830 - RNA, 13 nt, Homo sapiens
gucagacugaaac

SEQ ID NO: 1757831 - RNA, 21 nt, Homo sapiens
aaggcugagaccuacugggcu

SEQ ID NO: 1757832 - RNA, 14 nt, Homo sapiens
ugugauuuuguccc

SEQ ID NO: 1757833 - RNA, 16 nt, Homo sapiens
acaaaagacagaccca

SEQ ID NO: 1757834 - RNA, 22 nt, Homo sapiens
gagaaucacugcuccaggccug

SEQ ID NO: 1757835 - RNA, 18 nt, Homo sapiens
uccgggacccccaggaca

SEQ ID NO: 1757836 - RNA, 18 nt, Homo sapiens
uuacguaguaaaagucau

SEQ ID NO: 1757837 - RNA, 23 nt, Homo sapiens
gcuuaagaaagaacauuuugccu

SEQ ID NO: 1757838 - RNA, 14 nt, Homo sapiens
cauuugauggccac

SEQ ID NO: 1757839 - RNA, 13 nt, Homo sapiens
gagccaugucaug

SEQ ID NO: 1757840 - RNA, 14 nt, Homo sapiens
gcaaagaugaaggu

SEQ ID NO: 1757841 - RNA, 13 nt, Homo sapiens
ugccuuaccuaag

SEQ ID NO: 1757842 - RNA, 18 nt, Homo sapiens
cacugcaaguuuuaguua

SEQ ID NO: 1757843 - RNA, 14 nt, Homo sapiens
gacauguccaggag

SEQ ID NO: 1757844 - RNA, 19 nt, Homo sapiens
agucacauggccuaugcac

SEQ ID NO: 1757845 - RNA, 23 nt, Homo sapiens
ugagaugggagaaucacuugaac

SEQ ID NO: 1757846 - RNA, 13 nt, Homo sapiens
acaaugugcugga

SEQ ID NO: 1757847 - RNA, 22 nt, Homo sapiens
auguaaauguguuagcacugau

SEQ ID NO: 1757848 - RNA, 16 nt, Homo sapiens
ggccuuguucugucac

SEQ ID NO: 1757849 - RNA, 10 nt, Homo sapiens
uggucucuuu

SEQ ID NO: 1757850 - RNA, 19 nt, Homo sapiens
uucuuguggcaagagcagc

SEQ ID NO: 1757851 - RNA, 22 nt, Homo sapiens
accuaccaccuucccucuuucu

SEQ ID NO: 1757852 - RNA, 22 nt, Homo sapiens
aucucuguuuaggugccucuac

SEQ ID NO: 1757853 - RNA, 20 nt, Homo sapiens
aaucaaauaugcaaagcacu

SEQ ID NO: 1757854 - RNA, 20 nt, Homo sapiens
auugcucaggcuggucuuga

SEQ ID NO: 1757855 - RNA, 12 nt, Homo sapiens
aaauggcacugc

SEQ ID NO: 1757856 - RNA, 16 nt, Homo sapiens
acaccugcagccuccc

SEQ ID NO: 1757857 - RNA, 19 nt, Homo sapiens
cugcaaaguguaugugacc

SEQ ID NO: 1757858 - RNA, 15 nt, Homo sapiens
augcccaaggcgaua

SEQ ID NO: 1757859 - RNA, 16 nt, Homo sapiens
auacaaauucuacuuu

SEQ ID NO: 1757860 - RNA, 22 nt, Homo sapiens
auaauucagcacuuaacuauga

SEQ ID NO: 1757861 - RNA, 15 nt, Homo sapiens
caauuaauguagcug

SEQ ID NO: 1757862 - RNA, 12 nt, Homo sapiens
aaucaaugaagu

SEQ ID NO: 1757863 - RNA, 21 nt, Homo sapiens
auuauuguccuuugauuccaa

SEQ ID NO: 1757864 - RNA, 17 nt, Homo sapiens
agagacgcaccuugcug

SEQ ID NO: 1757865 - RNA, 20 nt, Homo sapiens
uugugacauuguaguaggga

SEQ ID NO: 1757866 - RNA, 17 nt, Homo sapiens
aauuucaaucaaccaaa

SEQ ID NO: 1757867 - RNA, 16 nt, Homo sapiens
ggaacuccuggccuuu

SEQ ID NO: 1757868 - RNA, 12 nt, Homo sapiens
aacgaugugucu

SEQ ID NO: 1757869 - RNA, 13 nt, Homo sapiens
guaacacuguaua

SEQ ID NO: 1757870 - RNA, 19 nt, Homo sapiens
uggggcuuccagcucagaa

SEQ ID NO: 1757871 - RNA, 15 nt, Homo sapiens
ggcuaugguugccac

SEQ ID NO: 1757872 - RNA, 20 nt, Homo sapiens
ucuuuuuaaagcuuauccau

SEQ ID NO: 1757873 - RNA, 20 nt, Homo sapiens
ucuguauugggguacaggaa

SEQ ID NO: 1757874 - RNA, 15 nt, Homo sapiens
uaccacacauauugc

SEQ ID NO: 1757875 - RNA, 17 nt, Homo sapiens
ugggccauuaaaaacua

SEQ ID NO: 1757876 - RNA, 17 nt, Homo sapiens
ccauguauuuaucucua

SEQ ID NO: 1757877 - RNA, 12 nt, Homo sapiens
aaggaacuucca

SEQ ID NO: 1757878 - RNA, 18 nt, Homo sapiens
ccaaggaaacccccagug

SEQ ID NO: 1757879 - RNA, 19 nt, Homo sapiens
agaggugggcagcagcuca

SEQ ID NO: 1757880 - RNA, 19 nt, Homo sapiens
uucugugauaagagguacu

SEQ ID NO: 1757881 - RNA, 20 nt, Homo sapiens
uuugaagucaaaugucacau

SEQ ID NO: 1757882 - RNA, 20 nt, Homo sapiens
auaaacacuccacaguguuu

SEQ ID NO: 1757883 - RNA, 16 nt, Homo sapiens
ggcuagguaucauuca

SEQ ID NO: 1757884 - RNA, 14 nt, Homo sapiens
cccugauguggcau

SEQ ID NO: 1757885 - RNA, 19 nt, Homo sapiens
aaguuuuaaauaaaccuau

SEQ ID NO: 1757886 - RNA, 17 nt, Homo sapiens
cuuaaucuuauggggcc

SEQ ID NO: 1757887 - RNA, 15 nt, Homo sapiens
cuuuucccuauccac

SEQ ID NO: 1757888 - RNA, 16 nt, Homo sapiens
uauaagcaucugccau

SEQ ID NO: 1757889 - RNA, 12 nt, Homo sapiens
aguaugaucuca

SEQ ID NO: 1757890 - RNA, 18 nt, Homo sapiens
uacauggaaaggauuuug

SEQ ID NO: 1757891 - RNA, 18 nt, Homo sapiens
cuuuugcacaucuaguga

SEQ ID NO: 1757892 - RNA, 12 nt, Homo sapiens
gaucauagcuca

SEQ ID NO: 1757893 - RNA, 15 nt, Homo sapiens
uauuaagauucuuga

SEQ ID NO: 1757894 - RNA, 20 nt, Homo sapiens
uguuauguauauagaugugc

SEQ ID NO: 1757895 - RNA, 20 nt, Homo sapiens
auuuuuuaauccuaccucaa

SEQ ID NO: 1757896 - RNA, 19 nt, Homo sapiens
ucagaaggaucuucaucug

SEQ ID NO: 1757897 - RNA, 14 nt, Homo sapiens
guauauugucagau

SEQ ID NO: 1757898 - RNA, 14 nt, Homo sapiens
ccaggaggugcaga

SEQ ID NO: 1757899 - RNA, 21 nt, Homo sapiens
ucaacaaacugcaagcaccug

SEQ ID NO: 1757900 - RNA, 18 nt, Homo sapiens
gugccuuugaccaucucu

SEQ ID NO: 1757901 - RNA, 15 nt, Homo sapiens
gaaaucugcugcauu

SEQ ID NO: 1757902 - RNA, 22 nt, Homo sapiens
aaauuaauguaauaaagugaac

SEQ ID NO: 1757903 - RNA, 23 nt, Homo sapiens
agaacauucccuggaauugccac

SEQ ID NO: 1757904 - RNA, 17 nt, Homo sapiens
cuucucgccccucagug

SEQ ID NO: 1757905 - RNA, 20 nt, Homo sapiens
aacaucccuuauaccacugu

SEQ ID NO: 1757906 - RNA, 20 nt, Homo sapiens
auugccugaaacccauuuac

SEQ ID NO: 1757907 - RNA, 21 nt, Homo sapiens
cucugcaagacagaaaccucc

SEQ ID NO: 1757908 - RNA, 12 nt, Homo sapiens
gcugcuacugcu

SEQ ID NO: 1757909 - RNA, 21 nt, Homo sapiens
uggauguugcuuuugcaccua

SEQ ID NO: 1757910 - RNA, 23 nt, Homo sapiens
agggacuccccauagcaaagggu

SEQ ID NO: 1757911 - RNA, 21 nt, Homo sapiens
acuucugucuucacaacagau

SEQ ID NO: 1757912 - RNA, 13 nt, Homo sapiens
acgcaugcagugu

SEQ ID NO: 1757913 - RNA, 23 nt, Homo sapiens
uguuuuguccccuccaaaucuca

SEQ ID NO: 1757914 - RNA, 16 nt, Homo sapiens
agaauuagaaacaaca

SEQ ID NO: 1757915 - RNA, 21 nt, Homo sapiens
aggaugucccugggccagggu

SEQ ID NO: 1757916 - RNA, 16 nt, Homo sapiens
cggauuccagcccaca

SEQ ID NO: 1757917 - RNA, 21 nt, Homo sapiens
ugcccgguuuuucucuucaau

SEQ ID NO: 1757918 - RNA, 18 nt, Homo sapiens
acucagcacuguuuucau

SEQ ID NO: 1757919 - RNA, 13 nt, Homo sapiens
acacacuccauca

SEQ ID NO: 1757920 - RNA, 20 nt, Homo sapiens
cccagccaaacccugucuga

SEQ ID NO: 1757921 - RNA, 18 nt, Homo sapiens
uuuuguuccacaaguuaa

SEQ ID NO: 1757922 - RNA, 15 nt, Homo sapiens
aaauaccacuguaau

SEQ ID NO: 1757923 - RNA, 15 nt, Homo sapiens
aaauaacacuguacu

SEQ ID NO: 1757924 - RNA, 18 nt, Homo sapiens
aagcagaguucuuugcaa

SEQ ID NO: 1757925 - RNA, 19 nt, Homo sapiens
ugaguggcuuuaaugaaua

SEQ ID NO: 1757926 - RNA, 21 nt, Homo sapiens
ucuggcccuguugugggggug

SEQ ID NO: 1757927 - RNA, 21 nt, Homo sapiens
gaguacagauguaaaugccac

SEQ ID NO: 1757928 - RNA, 20 nt, Homo sapiens
cuuuaagagaaaugagcugc

SEQ ID NO: 1757929 - RNA, 17 nt, Homo sapiens
gcugggauuacaggugu

SEQ ID NO: 1757930 - RNA, 17 nt, Homo sapiens
uuucucuagggagaaaa

SEQ ID NO: 1757931 - RNA, 21 nt, Homo sapiens
ccaacacugucacuagucuca

SEQ ID NO: 1757932 - RNA, 15 nt, Homo sapiens
cgucagccaccuggg

SEQ ID NO: 1757933 - RNA, 16 nt, Homo sapiens
guguaccacugggaua

SEQ ID NO: 1757934 - RNA, 14 nt, Homo sapiens
aaaaugccuacaca

SEQ ID NO: 1757935 - RNA, 17 nt, Homo sapiens
gaaguaggcauauauca

SEQ ID NO: 1757936 - RNA, 21 nt, Homo sapiens
ucuucagggaacugcauagau

SEQ ID NO: 1757937 - RNA, 17 nt, Homo sapiens
agaaaauauguauuaac

SEQ ID NO: 1757938 - RNA, 17 nt, Homo sapiens
guagggcuuggugaaug

SEQ ID NO: 1757939 - RNA, 14 nt, Homo sapiens
acccaguauuccau

SEQ ID NO: 1757940 - RNA, 16 nt, Homo sapiens
uuccucuugaaccaga

SEQ ID NO: 1757941 - RNA, 14 nt, Homo sapiens
cgaccccaaaggaa

SEQ ID NO: 1757942 - RNA, 15 nt, Homo sapiens
gacuccggcccuccu

SEQ ID NO: 1757943 - RNA, 14 nt, Homo sapiens
ggcuucugggagau

SEQ ID NO: 1757944 - RNA, 23 nt, Homo sapiens
ccuauggucacagacuucuggcc

SEQ ID NO: 1757945 - RNA, 18 nt, Homo sapiens
gcacuguaaaugcagccu

SEQ ID NO: 1757946 - RNA, 21 nt, Homo sapiens
guaagccaaggucaugccacu

SEQ ID NO: 1757947 - RNA, 17 nt, Homo sapiens
uuagaaguguuguaaaa

SEQ ID NO: 1757948 - RNA, 12 nt, Homo sapiens
acagcgauuccc

SEQ ID NO: 1757949 - RNA, 15 nt, Homo sapiens
agcugucgacuucau

SEQ ID NO: 1757950 - RNA, 19 nt, Homo sapiens
cagggagaggucaccagcu

SEQ ID NO: 1757951 - RNA, 16 nt, Homo sapiens
uauaguuauaaucuga

SEQ ID NO: 1757952 - RNA, 12 nt, Homo sapiens
uaugaaguacuu

SEQ ID NO: 1757953 - RNA, 20 nt, Homo sapiens
auuuagaaaaaaguuuacaa

SEQ ID NO: 1757954 - RNA, 23 nt, Homo sapiens
ugcugauacuaucucuugucaua

SEQ ID NO: 1757955 - RNA, 21 nt, Homo sapiens
uuuucugagcuuuucauggaa

SEQ ID NO: 1757956 - RNA, 14 nt, Homo sapiens
cuaguuuucaauca

SEQ ID NO: 1757957 - RNA, 15 nt, Homo sapiens
auaguauugugcaua

SEQ ID NO: 1757958 - RNA, 18 nt, Homo sapiens
acagaauugugucugcag

SEQ ID NO: 1757959 - RNA, 15 nt, Homo sapiens
agcaaauaggcaaaa

SEQ ID NO: 1757960 - RNA, 15 nt, Homo sapiens
auuucauaguuucaa

SEQ ID NO: 1757961 - RNA, 21 nt, Homo sapiens
aagcuacuauguacugccuua

SEQ ID NO: 1757962 - RNA, 19 nt, Homo sapiens
cagcuuguaaauagcucag

SEQ ID NO: 1757963 - RNA, 11 nt, Homo sapiens
ccacucaaugu

SEQ ID NO: 1757964 - RNA, 18 nt, Homo sapiens
ugccguaggaaaaauaaa

SEQ ID NO: 1757965 - RNA, 16 nt, Homo sapiens
ucccaaagaccuccac

SEQ ID NO: 1757966 - RNA, 19 nt, Homo sapiens
ugcuuucugauacaucugu

SEQ ID NO: 1757967 - RNA, 13 nt, Homo sapiens
uuaauccaaacau

SEQ ID NO: 1757968 - RNA, 18 nt, Homo sapiens
aguucuaaacuaucaaua

SEQ ID NO: 1757969 - RNA, 13 nt, Homo sapiens
uuugaagagacca

SEQ ID NO: 1757970 - RNA, 22 nt, Homo sapiens
ccugaccucaaguaauccaccu

SEQ ID NO: 1757971 - RNA, 22 nt, Homo sapiens
aauacuaggauacagaaaugca

SEQ ID NO: 1757972 - RNA, 13 nt, Homo sapiens
uuucucagacuca

SEQ ID NO: 1757973 - RNA, 13 nt, Homo sapiens
uacuguucuugcu

SEQ ID NO: 1757974 - RNA, 20 nt, Homo sapiens
gcagcacugcccaucaguga

SEQ ID NO: 1757975 - RNA, 18 nt, Homo sapiens
aggguccuaaaacuugga

SEQ ID NO: 1757976 - RNA, 14 nt, Homo sapiens
cugccaacauacuu

SEQ ID NO: 1757977 - RNA, 18 nt, Homo sapiens
ccaaccuuccaaguguaa

SEQ ID NO: 1757978 - RNA, 17 nt, Homo sapiens
uguaaaugaccaagaaa

SEQ ID NO: 1757979 - RNA, 19 nt, Homo sapiens
ugaaaucaguaaacacugu

SEQ ID NO: 1757980 - RNA, 18 nt, Homo sapiens
gaugcaucuuguuucaua

SEQ ID NO: 1757981 - RNA, 23 nt, Homo sapiens
agcucugaaaccaguguuaggga

SEQ ID NO: 1757982 - RNA, 13 nt, Homo sapiens
cagugccauucca

SEQ ID NO: 1757983 - RNA, 23 nt, Homo sapiens
guuuucuggggaaaggggacaag

SEQ ID NO: 1757984 - RNA, 14 nt, Homo sapiens
auuccagucuacuu

SEQ ID NO: 1757985 - RNA, 21 nt, Homo sapiens
auaaauuaauuugaccaucuc

SEQ ID NO: 1757986 - RNA, 22 nt, Homo sapiens
ugaagcugcuguaacuaaagga

SEQ ID NO: 1757987 - RNA, 23 nt, Homo sapiens
cccccacccgggagcaguguccu

SEQ ID NO: 1757988 - RNA, 19 nt, Homo sapiens
auaaacaagaucgucagga

SEQ ID NO: 1757989 - RNA, 20 nt, Homo sapiens
agaugccucgcucuuuucaa

SEQ ID NO: 1757990 - RNA, 14 nt, Homo sapiens
acaauuuuuuguuc

SEQ ID NO: 1757991 - RNA, 19 nt, Homo sapiens
aaagcagcccucugccucc

SEQ ID NO: 1757992 - RNA, 22 nt, Homo sapiens
auaguuuguuuuuaaacuaaua

SEQ ID NO: 1757993 - RNA, 17 nt, Homo sapiens
gcuuccgccgucucaac

SEQ ID NO: 1757994 - RNA, 15 nt, Homo sapiens
cacgugccugugauc

SEQ ID NO: 1757995 - RNA, 15 nt, Homo sapiens
ucacuccagcagcac

SEQ ID NO: 1757996 - RNA, 19 nt, Homo sapiens
agucuuguagaaaucucag

SEQ ID NO: 1757997 - RNA, 21 nt, Homo sapiens
aauuaaucacccuaccaacuu

SEQ ID NO: 1757998 - RNA, 18 nt, Homo sapiens
accgucacacucuucagu

SEQ ID NO: 1757999 - RNA, 16 nt, Homo sapiens
accagccuacaagcug

SEQ ID NO: 1758000 - RNA, 23 nt, Homo sapiens
gacacuaaaacaagaggacacaa

SEQ ID NO: 1758001 - RNA, 17 nt, Homo sapiens
aacauuggagacaucac

SEQ ID NO: 1758002 - RNA, 14 nt, Homo sapiens
cucuugcagggucu

SEQ ID NO: 1758003 - RNA, 19 nt, Homo sapiens
ugggaccugauuuauugaa

SEQ ID NO: 1758004 - RNA, 16 nt, Homo sapiens
cucaaacuuccaguca

SEQ ID NO: 1758005 - RNA, 14 nt, Homo sapiens
cugacgcucaguaa

SEQ ID NO: 1758006 - RNA, 22 nt, Homo sapiens
uuucuguggucuuacugaucuu

SEQ ID NO: 1758007 - RNA, 21 nt, Homo sapiens
uguugggggggggguuugcaa

SEQ ID NO: 1758008 - RNA, 17 nt, Homo sapiens
caaaaaaucugaccaaa

SEQ ID NO: 1758009 - RNA, 17 nt, Homo sapiens
acaaccugaauguccca

SEQ ID NO: 1758010 - RNA, 15 nt, Homo sapiens
ccaaugccacccuca

SEQ ID NO: 1758011 - RNA, 20 nt, Homo sapiens
ucuuccugaguggugccaaa

SEQ ID NO: 1758012 - RNA, 17 nt, Homo sapiens
aacaauaugcacugaau

SEQ ID NO: 1758013 - RNA, 17 nt, Homo sapiens
gauuuaaaaaaagaaca

SEQ ID NO: 1758014 - RNA, 16 nt, Homo sapiens
uaauuuugcaguguuu

SEQ ID NO: 1758015 - RNA, 15 nt, Homo sapiens
gaagugaccaaggag

SEQ ID NO: 1758016 - RNA, 19 nt, Homo sapiens
uuaccaaggaaagaacaaa

SEQ ID NO: 1758017 - RNA, 21 nt, Homo sapiens
guacccuccauguaccuugug

SEQ ID NO: 1758018 - RNA, 17 nt, Homo sapiens
aguuuccauauguuaua

SEQ ID NO: 1758019 - RNA, 15 nt, Homo sapiens
gcccagaagcccagu

SEQ ID NO: 1758020 - RNA, 22 nt, Homo sapiens
cuaacaaguagcacacugaguu

SEQ ID NO: 1758021 - RNA, 15 nt, Homo sapiens
gcuggaaggggucca

SEQ ID NO: 1758022 - RNA, 13 nt, Homo sapiens
aucuccaguaucc

SEQ ID NO: 1758023 - RNA, 16 nt, Homo sapiens
gcacugcacccuguuu

SEQ ID NO: 1758024 - RNA, 17 nt, Homo sapiens
acacccaugcacacuca

SEQ ID NO: 1758025 - RNA, 14 nt, Homo sapiens
gcuucagugcagug

SEQ ID NO: 1758026 - RNA, 15 nt, Homo sapiens
guggucaucauggcc

SEQ ID NO: 1758027 - RNA, 12 nt, Homo sapiens
cacuuugcaaag

SEQ ID NO: 1758028 - RNA, 23 nt, Homo sapiens
gaugaagacagcccgauccuccc

SEQ ID NO: 1758029 - RNA, 21 nt, Homo sapiens
auaaaucugagccuaaaucua

SEQ ID NO: 1758030 - RNA, 18 nt, Homo sapiens
ccauguaccaguguacug

SEQ ID NO: 1758031 - RNA, 19 nt, Homo sapiens
augucucucuugagcuaca

SEQ ID NO: 1758032 - RNA, 11 nt, Homo sapiens
aaggaucucug

SEQ ID NO: 1758033 - RNA, 16 nt, Homo sapiens
ugaccugauguccauu

SEQ ID NO: 1758034 - RNA, 14 nt, Homo sapiens
guuguccagaucac

SEQ ID NO: 1758035 - RNA, 20 nt, Homo sapiens
ggcaacugcugaugcucaug

SEQ ID NO: 1758036 - RNA, 14 nt, Homo sapiens
cuuguacagccuuu

SEQ ID NO: 1758037 - RNA, 22 nt, Homo sapiens
ccuugggcagggucucugcucc

SEQ ID NO: 1758038 - RNA, 13 nt, Homo sapiens
cauggugcacuga

SEQ ID NO: 1758039 - RNA, 15 nt, Homo sapiens
gcagaggaagcccag

SEQ ID NO: 1758040 - RNA, 15 nt, Homo sapiens
ugcugucaccuugcu

SEQ ID NO: 1758041 - RNA, 14 nt, Homo sapiens
gaaacacacauuuc

SEQ ID NO: 1758042 - RNA, 23 nt, Homo sapiens
ggucugaauucuggaaucacaaa

SEQ ID NO: 1758043 - RNA, 15 nt, Homo sapiens
gugcuucacaguaga

SEQ ID NO: 1758044 - RNA, 18 nt, Homo sapiens
aaucauugugugucuuca

SEQ ID NO: 1758045 - RNA, 20 nt, Homo sapiens
gaccacucuuccugaguuca

SEQ ID NO: 1758046 - RNA, 16 nt, Homo sapiens
gcuaaaauuaguuuua

SEQ ID NO: 1758047 - RNA, 14 nt, Homo sapiens
gcaguggugccauc

SEQ ID NO: 1758048 - RNA, 13 nt, Homo sapiens
gaauauagagggu

SEQ ID NO: 1758049 - RNA, 16 nt, Homo sapiens
gaagguucucugugcu

SEQ ID NO: 1758050 - RNA, 23 nt, Homo sapiens
cauuucagagaggccuuuuggaa

SEQ ID NO: 1758051 - RNA, 16 nt, Homo sapiens
gacugcagacauucuc

SEQ ID NO: 1758052 - RNA, 19 nt, Homo sapiens
ggaccuggcaacccaggaa

SEQ ID NO: 1758053 - RNA, 19 nt, Homo sapiens
gaagcaccaagacugagaa

SEQ ID NO: 1758054 - RNA, 17 nt, Homo sapiens
ccgggaaaagggaacca

SEQ ID NO: 1758055 - RNA, 15 nt, Homo sapiens
cugugcuuugacuca

SEQ ID NO: 1758056 - RNA, 16 nt, Homo sapiens
aaguaucacacuguau

SEQ ID NO: 1758057 - RNA, 13 nt, Homo sapiens
gggaaagcauuua

SEQ ID NO: 1758058 - RNA, 14 nt, Homo sapiens
aaauucacuucccc

SEQ ID NO: 1758059 - RNA, 13 nt, Homo sapiens
cuuugacaguguu

SEQ ID NO: 1758060 - RNA, 13 nt, Homo sapiens
auaaucaaugaag

SEQ ID NO: 1758061 - RNA, 13 nt, Homo sapiens
uccaauuucaaga

SEQ ID NO: 1758062 - RNA, 18 nt, Homo sapiens
acucacuucucuuccuug

SEQ ID NO: 1758063 - RNA, 20 nt, Homo sapiens
ucaugcuacagaaagcugcu

SEQ ID NO: 1758064 - RNA, 18 nt, Homo sapiens
ccaucaggucaccgcgag

SEQ ID NO: 1758065 - RNA, 20 nt, Homo sapiens
guuuuuuccuuuauaagguu

SEQ ID NO: 1758066 - RNA, 18 nt, Homo sapiens
guucuaugaagaguauua

SEQ ID NO: 1758067 - RNA, 13 nt, Homo sapiens
guucaauguucca

SEQ ID NO: 1758068 - RNA, 18 nt, Homo sapiens
uaaaaucuuuccaucuca

SEQ ID NO: 1758069 - RNA, 16 nt, Homo sapiens
uuccuaaaauggugau

SEQ ID NO: 1758070 - RNA, 21 nt, Homo sapiens
cucaacagagaggaccaacau

SEQ ID NO: 1758071 - RNA, 17 nt, Homo sapiens
auccuugucugaaugua

SEQ ID NO: 1758072 - RNA, 20 nt, Homo sapiens
agagcuccacagaagacacg

SEQ ID NO: 1758073 - RNA, 13 nt, Homo sapiens
gaaaacaguccca

SEQ ID NO: 1758074 - RNA, 15 nt, Homo sapiens
uguggguauguguuu

SEQ ID NO: 1758075 - RNA, 13 nt, Homo sapiens
aacuuaccuuguu

SEQ ID NO: 1758076 - RNA, 21 nt, Homo sapiens
caaugcuggagaaaaauaucu

SEQ ID NO: 1758077 - RNA, 16 nt, Homo sapiens
accucaccaagacauc

SEQ ID NO: 1758078 - RNA, 20 nt, Homo sapiens
gcagggcucucuguaucagu

SEQ ID NO: 1758079 - RNA, 23 nt, Homo sapiens
aacuaguucuuaggaacagacuc

SEQ ID NO: 1758080 - RNA, 15 nt, Homo sapiens
aacacacucucaccu

SEQ ID NO: 1758081 - RNA, 20 nt, Homo sapiens
uugucuaaaguuacuacuga

SEQ ID NO: 1758082 - RNA, 21 nt, Homo sapiens
ucacacacuggaccccacugg

SEQ ID NO: 1758083 - RNA, 17 nt, Homo sapiens
caaaaacagaauuugag

SEQ ID NO: 1758084 - RNA, 15 nt, Homo sapiens
ugacuuguguuuuau

SEQ ID NO: 1758085 - RNA, 13 nt, Homo sapiens
caaucacuguaua

SEQ ID NO: 1758086 - RNA, 14 nt, Homo sapiens
gacccuauugcugc

SEQ ID NO: 1758087 - RNA, 19 nt, Homo sapiens
aauucuggacaacccaagu

SEQ ID NO: 1758088 - RNA, 22 nt, Homo sapiens
ucaggcccugaucuagugcagu

SEQ ID NO: 1758089 - RNA, 22 nt, Homo sapiens
cagcuacucaggaggcugagac

SEQ ID NO: 1758090 - RNA, 20 nt, Homo sapiens
uguugggauuauaggaguga

SEQ ID NO: 1758091 - RNA, 20 nt, Homo sapiens
auucuuguaucaaauucaau

SEQ ID NO: 1758092 - RNA, 23 nt, Homo sapiens
uguuuuacucagaggagcugcaa

SEQ ID NO: 1758093 - RNA, 20 nt, Homo sapiens
acaccucccccugcugcugc

SEQ ID NO: 1758094 - RNA, 22 nt, Homo sapiens
ucagccacccuuggucucaugc

SEQ ID NO: 1758095 - RNA, 16 nt, Homo sapiens
agggaaugugagcaca

SEQ ID NO: 1758096 - RNA, 15 nt, Homo sapiens
augcaaucaggauuu

SEQ ID NO: 1758097 - RNA, 14 nt, Homo sapiens
aacaaggugucuuu

SEQ ID NO: 1758098 - RNA, 22 nt, Homo sapiens
cuaaugauuuagugaucaaauu

SEQ ID NO: 1758099 - RNA, 21 nt, Homo sapiens
cauuuguuggaaugaauuaaa

SEQ ID NO: 1758100 - RNA, 21 nt, Homo sapiens
ucaugccuucacgugucuguu

SEQ ID NO: 1758101 - RNA, 13 nt, Homo sapiens
cgccgcuagcccg

SEQ ID NO: 1758102 - RNA, 22 nt, Homo sapiens
uagccagccccucuuccccaau

SEQ ID NO: 1758103 - RNA, 14 nt, Homo sapiens
aggugaggcccaag

SEQ ID NO: 1758104 - RNA, 12 nt, Homo sapiens
agcagaccuccu

SEQ ID NO: 1758105 - RNA, 17 nt, Homo sapiens
aagggugcccaccucuu

SEQ ID NO: 1758106 - RNA, 15 nt, Homo sapiens
caacgaucacaaaug

SEQ ID NO: 1758107 - RNA, 21 nt, Homo sapiens
ccagggcagcaggccagagaa

SEQ ID NO: 1758108 - RNA, 23 nt, Homo sapiens
aaucucucuagguccauuuuccu

SEQ ID NO: 1758109 - RNA, 13 nt, Homo sapiens
aacauugcugauu

SEQ ID NO: 1758110 - RNA, 15 nt, Homo sapiens
gccucucccaucacu

SEQ ID NO: 1758111 - RNA, 18 nt, Homo sapiens
cugucucucaugaaccuc

SEQ ID NO: 1758112 - RNA, 20 nt, Homo sapiens
acuacaugcaaggcacugua

SEQ ID NO: 1758113 - RNA, 15 nt, Homo sapiens
aggcagccacagaca

SEQ ID NO: 1758114 - RNA, 21 nt, Homo sapiens
caguguuugcuccaccuucau

SEQ ID NO: 1758115 - RNA, 22 nt, Homo sapiens
uugacuucauagauuaugcuuu

SEQ ID NO: 1758116 - RNA, 20 nt, Homo sapiens
ggucuugaggagagagacag

SEQ ID NO: 1758117 - RNA, 23 nt, Homo sapiens
agccaggcuuuucucaggagcuu

SEQ ID NO: 1758118 - RNA, 22 nt, Homo sapiens
auacaggacauucucaucacca

SEQ ID NO: 1758119 - RNA, 17 nt, Homo sapiens
cuggaaucuggagacca

SEQ ID NO: 1758120 - RNA, 18 nt, Homo sapiens
caggaggaaggcuuacac

SEQ ID NO: 1758121 - RNA, 18 nt, Homo sapiens
cugccaucgcugugaugc

SEQ ID NO: 1758122 - RNA, 14 nt, Homo sapiens
caaccugaagacac

SEQ ID NO: 1758123 - RNA, 16 nt, Homo sapiens
acgcucgcugccauca

SEQ ID NO: 1758124 - RNA, 11 nt, Homo sapiens
cagacuugcca

SEQ ID NO: 1758125 - RNA, 15 nt, Homo sapiens
ugcugaguagugaca

SEQ ID NO: 1758126 - RNA, 16 nt, Homo sapiens
gcaauuuugcacugaa

SEQ ID NO: 1758127 - RNA, 23 nt, Homo sapiens
cauccaaauggacuggccagcgu

SEQ ID NO: 1758128 - RNA, 24 nt, Homo sapiens
aucuucuucagauucagcauuugu

SEQ ID NO: 1758129 - RNA, 15 nt, Homo sapiens
auuuugguacuguga

SEQ ID NO: 1758130 - RNA, 14 nt, Homo sapiens
cuucuucucaagca

SEQ ID NO: 1758131 - RNA, 12 nt, Homo sapiens
gaucugcauaac

SEQ ID NO: 1758132 - RNA, 18 nt, Homo sapiens
ucuuugaggguuccaugg

SEQ ID NO: 1758133 - RNA, 17 nt, Homo sapiens
aguugcuguaagcaccu

SEQ ID NO: 1758134 - RNA, 19 nt, Homo sapiens
caccuuguaaccagugcag

SEQ ID NO: 1758135 - RNA, 23 nt, Homo sapiens
aaauugccugcaaaaaugaaauc

SEQ ID NO: 1758136 - RNA, 17 nt, Homo sapiens
guaaagggcgcaaaggg

SEQ ID NO: 1758137 - RNA, 19 nt, Homo sapiens
cuucccuccucccauguca

SEQ ID NO: 1758138 - RNA, 20 nt, Homo sapiens
uauugaucccacauuuccau

SEQ ID NO: 1758139 - RNA, 17 nt, Homo sapiens
uuaauguggacuggaac

SEQ ID NO: 1758140 - RNA, 15 nt, Homo sapiens
aauggacguacuggu

SEQ ID NO: 1758141 - RNA, 15 nt, Homo sapiens
accuugugucuguac

SEQ ID NO: 1758142 - RNA, 23 nt, Homo sapiens
uucaauuuggacuggugugcucu

SEQ ID NO: 1758143 - RNA, 14 nt, Homo sapiens
aaaaguuguuuguu

SEQ ID NO: 1758144 - RNA, 20 nt, Homo sapiens
agaucgugccacugcacucc

SEQ ID NO: 1758145 - RNA, 12 nt, Homo sapiens
gaggguugcuau

SEQ ID NO: 1758146 - RNA, 20 nt, Homo sapiens
uauaaggaauaaagccuuuu

SEQ ID NO: 1758147 - RNA, 13 nt, Homo sapiens
uuuucagggcugg

SEQ ID NO: 1758148 - RNA, 19 nt, Homo sapiens
ucucaaauccugaugcugu

SEQ ID NO: 1758149 - RNA, 17 nt, Homo sapiens
aacucaaaacucuugaa

SEQ ID NO: 1758150 - RNA, 20 nt, Homo sapiens
auggcaaaggaagguggaug

SEQ ID NO: 1758151 - RNA, 22 nt, Homo sapiens
agauguauguacuucaugcugu

SEQ ID NO: 1758152 - RNA, 20 nt, Homo sapiens
accaaguccuccgaaggcau

SEQ ID NO: 1758153 - RNA, 14 nt, Homo sapiens
gggagcauguucau

SEQ ID NO: 1758154 - RNA, 20 nt, Homo sapiens
gcaggaguagcugagcucac

SEQ ID NO: 1758155 - RNA, 14 nt, Homo sapiens
ugagggucacagua

SEQ ID NO: 1758156 - RNA, 19 nt, Homo sapiens
uauaugcuuuuucucagau

SEQ ID NO: 1758157 - RNA, 14 nt, Homo sapiens
cccaguccacugag

SEQ ID NO: 1758158 - RNA, 19 nt, Homo sapiens
ccaagaauccacauuucua

SEQ ID NO: 1758159 - RNA, 18 nt, Homo sapiens
acccugcaggacuugcca

SEQ ID NO: 1758160 - RNA, 18 nt, Homo sapiens
ugugcucuaaaauucuau

SEQ ID NO: 1758161 - RNA, 20 nt, Homo sapiens
caguuguugaaacacuuugc

SEQ ID NO: 1758162 - RNA, 12 nt, Homo sapiens
acaacagauuug

SEQ ID NO: 1758163 - RNA, 12 nt, Homo sapiens
ucaacagaauug

SEQ ID NO: 1758164 - RNA, 15 nt, Homo sapiens
agaauauauuuccuu

SEQ ID NO: 1758165 - RNA, 18 nt, Homo sapiens
aguuacuguguaaacuca

SEQ ID NO: 1758166 - RNA, 19 nt, Homo sapiens
acuugagaaaaugcaggag

SEQ ID NO: 1758167 - RNA, 16 nt, Homo sapiens
acacuggugacuccag

SEQ ID NO: 1758168 - RNA, 22 nt, Homo sapiens
agcauaugaguuucauagcuaa

SEQ ID NO: 1758169 - RNA, 16 nt, Homo sapiens
aauuuacgaaaccaaa

SEQ ID NO: 1758170 - RNA, 19 nt, Homo sapiens
gacacaggauccuggccug

SEQ ID NO: 1758171 - RNA, 14 nt, Homo sapiens
ucaccauguuggcc

SEQ ID NO: 1758172 - RNA, 11 nt, Homo sapiens
ucgaacaaagg

SEQ ID NO: 1758173 - RNA, 14 nt, Homo sapiens
agcuagauacugga

SEQ ID NO: 1758174 - RNA, 22 nt, Homo sapiens
gagugggccccgggcuggagaa

SEQ ID NO: 1758175 - RNA, 20 nt, Homo sapiens
uaaauguacuacauuugcau

SEQ ID NO: 1758176 - RNA, 13 nt, Homo sapiens
cuaccucuuggcu

SEQ ID NO: 1758177 - RNA, 18 nt, Homo sapiens
guuggagugcucuuccca

SEQ ID NO: 1758178 - RNA, 20 nt, Homo sapiens
uggauucccagggacuucag

SEQ ID NO: 1758179 - RNA, 19 nt, Homo sapiens
aaagguagcuuaccugaca

SEQ ID NO: 1758180 - RNA, 18 nt, Homo sapiens
ccugacagaaggacucag

SEQ ID NO: 1758181 - RNA, 13 nt, Homo sapiens
acucuacugcaag

SEQ ID NO: 1758182 - RNA, 15 nt, Homo sapiens
gugcuucagccugag

SEQ ID NO: 1758183 - RNA, 22 nt, Homo sapiens
gccagggugggaagagaagaaa

SEQ ID NO: 1758184 - RNA, 15 nt, Homo sapiens
caccuuccguucccc

SEQ ID NO: 1758185 - RNA, 17 nt, Homo sapiens
cauguacuauaauguga

SEQ ID NO: 1758186 - RNA, 15 nt, Homo sapiens
cuccucugcaucuug

SEQ ID NO: 1758187 - RNA, 18 nt, Homo sapiens
cagagcaggaagcauuca

SEQ ID NO: 1758188 - RNA, 14 nt, Homo sapiens
uaucauucucucac

SEQ ID NO: 1758189 - RNA, 14 nt, Homo sapiens
ucuguuucuauguc

SEQ ID NO: 1758190 - RNA, 17 nt, Homo sapiens
cgcagagaaugugaaca

SEQ ID NO: 1758191 - RNA, 21 nt, Homo sapiens
cagccccuuauuugcacuuca

SEQ ID NO: 1758192 - RNA, 17 nt, Homo sapiens
ucuugauucagucacau

SEQ ID NO: 1758193 - RNA, 17 nt, Homo sapiens
agauuagagaguguuga

SEQ ID NO: 1758194 - RNA, 14 nt, Homo sapiens
uacuggacucagga

SEQ ID NO: 1758195 - RNA, 23 nt, Homo sapiens
gcaguggcuaguggggugaacag

SEQ ID NO: 1758196 - RNA, 22 nt, Homo sapiens
ugaaucuauaaaagaauugcac

SEQ ID NO: 1758197 - RNA, 21 nt, Homo sapiens
gacuugcaaagaccuaccucc

SEQ ID NO: 1758198 - RNA, 13 nt, Homo sapiens
gagaguccaucag

SEQ ID NO: 1758199 - RNA, 17 nt, Homo sapiens
agcagaggcggucuuca

SEQ ID NO: 1758200 - RNA, 11 nt, Homo sapiens
aauucauuugu

SEQ ID NO: 1758201 - RNA, 17 nt, Homo sapiens
aaucacagaugcauaua

SEQ ID NO: 1758202 - RNA, 13 nt, Homo sapiens
uagcauuugccac

SEQ ID NO: 1758203 - RNA, 15 nt, Homo sapiens
uguucuuaauuguga

SEQ ID NO: 1758204 - RNA, 20 nt, Homo sapiens
cgaauuagcaauaacauaca

SEQ ID NO: 1758205 - RNA, 19 nt, Homo sapiens
cuuuuuuuuuuugguccaa

SEQ ID NO: 1758206 - RNA, 13 nt, Homo sapiens
cagagaaaagagu

SEQ ID NO: 1758207 - RNA, 19 nt, Homo sapiens
cacugccaggccagccucc

SEQ ID NO: 1758208 - RNA, 10 nt, Homo sapiens
gaaacuuccc

SEQ ID NO: 1758209 - RNA, 16 nt, Homo sapiens
caauugcacuaggcaa

SEQ ID NO: 1758210 - RNA, 20 nt, Homo sapiens
cugagcagaagcuggaggca

SEQ ID NO: 1758211 - RNA, 13 nt, Homo sapiens
agaccccagcugg

SEQ ID NO: 1758212 - RNA, 17 nt, Homo sapiens
cagaugguuaaauauca

SEQ ID NO: 1758213 - RNA, 18 nt, Homo sapiens
uaugucuugcaaagccuu

SEQ ID NO: 1758214 - RNA, 22 nt, Homo sapiens
agcuuguuuuauuuugugcuau

SEQ ID NO: 1758215 - RNA, 16 nt, Homo sapiens
uaaauguauuccugua

SEQ ID NO: 1758216 - RNA, 19 nt, Homo sapiens
auuuaguguuuuuaccucu

SEQ ID NO: 1758217 - RNA, 15 nt, Homo sapiens
uaaaucacacauuca

SEQ ID NO: 1758218 - RNA, 14 nt, Homo sapiens
cacgaggugcagua

SEQ ID NO: 1758219 - RNA, 14 nt, Homo sapiens
guaaaaaaauauga

SEQ ID NO: 1758220 - RNA, 17 nt, Homo sapiens
cuagucuggaacugcug

SEQ ID NO: 1758221 - RNA, 15 nt, Homo sapiens
uguguagccugugca

SEQ ID NO: 1758222 - RNA, 18 nt, Homo sapiens
auaaaaugucuucuccca

SEQ ID NO: 1758223 - RNA, 22 nt, Homo sapiens
cucaauggagccccggauccca

SEQ ID NO: 1758224 - RNA, 14 nt, Homo sapiens
auccaaacaugcau

SEQ ID NO: 1758225 - RNA, 16 nt, Homo sapiens
auccucacaggagcag

SEQ ID NO: 1758226 - RNA, 13 nt, Homo sapiens
aaaacaugaauuu

SEQ ID NO: 1758227 - RNA, 22 nt, Homo sapiens
ugaagcugugaugugccuacuc

SEQ ID NO: 1758228 - RNA, 19 nt, Homo sapiens
uuuggcaaaacucaggcag

SEQ ID NO: 1758229 - RNA, 16 nt, Homo sapiens
ucccuguccuugcccu

SEQ ID NO: 1758230 - RNA, 19 nt, Homo sapiens
ugguggccccaaccacagg

SEQ ID NO: 1758231 - RNA, 20 nt, Homo sapiens
gauacuaacauuuucauuga

SEQ ID NO: 1758232 - RNA, 20 nt, Homo sapiens
guagaacuggcuauccuugg

SEQ ID NO: 1758233 - RNA, 23 nt, Homo sapiens
cucagggccuggcaggccagugu

SEQ ID NO: 1758234 - RNA, 13 nt, Homo sapiens
cagccaaguguga

SEQ ID NO: 1758235 - RNA, 18 nt, Homo sapiens
auugaauaguuuauuucu

SEQ ID NO: 1758236 - RNA, 23 nt, Homo sapiens
uauaaacauugguauauuuccau

SEQ ID NO: 1758237 - RNA, 16 nt, Homo sapiens
ugccaagauaccuuca

SEQ ID NO: 1758238 - RNA, 22 nt, Homo sapiens
gccccacccaccccacaccugc

SEQ ID NO: 1758239 - RNA, 16 nt, Homo sapiens
ucagcuuggauaacca

SEQ ID NO: 1758240 - RNA, 13 nt, Homo sapiens
aaacuauauucuc

SEQ ID NO: 1758241 - RNA, 13 nt, Homo sapiens
aauaaaugaguag

SEQ ID NO: 1758242 - RNA, 13 nt, Homo sapiens
uugagcaugugau

SEQ ID NO: 1758243 - RNA, 13 nt, Homo sapiens
ucaagcaugcaau

SEQ ID NO: 1758244 - RNA, 15 nt, Homo sapiens
agagcaggggcucca

SEQ ID NO: 1758245 - RNA, 22 nt, Homo sapiens
caacugaguggggaaaacagac

SEQ ID NO: 1758246 - RNA, 22 nt, Homo sapiens
cuggauuuccuaggcugacuaa

SEQ ID NO: 1758247 - RNA, 22 nt, Homo sapiens
cccagagguaagaauagaauuu

SEQ ID NO: 1758248 - RNA, 20 nt, Homo sapiens
gaauuccacuccuuccagaa

SEQ ID NO: 1758249 - RNA, 22 nt, Homo sapiens
aauuuguauaauaaagcuuuca

SEQ ID NO: 1758250 - RNA, 18 nt, Homo sapiens
aguauuauggaaauccac

SEQ ID NO: 1758251 - RNA, 12 nt, Homo sapiens
cccccacagugc

SEQ ID NO: 1758252 - RNA, 22 nt, Homo sapiens
aaguuuucaccuaucuggaaaa

SEQ ID NO: 1758253 - RNA, 23 nt, Homo sapiens
uuagagggacagccaaaaguaag

SEQ ID NO: 1758254 - RNA, 20 nt, Homo sapiens
ugauuguuuaaagguuucua

SEQ ID NO: 1758255 - RNA, 14 nt, Homo sapiens
guaccccucuagcu

SEQ ID NO: 1758256 - RNA, 20 nt, Homo sapiens
cauaaguuuaggauaaaaua

SEQ ID NO: 1758257 - RNA, 14 nt, Homo sapiens
auacagacaucuaa

SEQ ID NO: 1758258 - RNA, 19 nt, Homo sapiens
aagaugucuauguagcuga

SEQ ID NO: 1758259 - RNA, 19 nt, Homo sapiens
ccaggcccaccaucaccac

SEQ ID NO: 1758260 - RNA, 18 nt, Homo sapiens
gcuaaagcuggagcaguu

SEQ ID NO: 1758261 - RNA, 22 nt, Homo sapiens
caaaaucaauuuuuugcuaaac

SEQ ID NO: 1758262 - RNA, 16 nt, Homo sapiens
ccaagugccaauauuu

SEQ ID NO: 1758263 - RNA, 15 nt, Homo sapiens
cuuccugacugggaa

SEQ ID NO: 1758264 - RNA, 14 nt, Homo sapiens
acaugggagcucuu

SEQ ID NO: 1758265 - RNA, 16 nt, Homo sapiens
uaacuuuuugcacuau

SEQ ID NO: 1758266 - RNA, 19 nt, Homo sapiens
uaucaugcccugugcaacc

SEQ ID NO: 1758267 - RNA, 16 nt, Homo sapiens
uccagucccucccuca

SEQ ID NO: 1758268 - RNA, 17 nt, Homo sapiens
gccaccuccucuguucu

SEQ ID NO: 1758269 - RNA, 15 nt, Homo sapiens
uccccuaaaauaaca

SEQ ID NO: 1758270 - RNA, 23 nt, Homo sapiens
ccaguauuacugcugcugugcuu

SEQ ID NO: 1758271 - RNA, 21 nt, Homo sapiens
uugucauucucauccaaaagu

SEQ ID NO: 1758272 - RNA, 23 nt, Homo sapiens
uccugcccuugcuccagccugac

SEQ ID NO: 1758273 - RNA, 15 nt, Homo sapiens
ccuccuagagugcag

SEQ ID NO: 1758274 - RNA, 12 nt, Homo sapiens
cugaaauccaua

SEQ ID NO: 1758275 - RNA, 13 nt, Homo sapiens
guaauauucucug

SEQ ID NO: 1758276 - RNA, 13 nt, Homo sapiens
cagacugaaaaac

SEQ ID NO: 1758277 - RNA, 20 nt, Homo sapiens
aauggagggaauaauaccua

SEQ ID NO: 1758278 - RNA, 18 nt, Homo sapiens
aguucugaauaacuugaa

SEQ ID NO: 1758279 - RNA, 12 nt, Homo sapiens
acauucccaagu

SEQ ID NO: 1758280 - RNA, 17 nt, Homo sapiens
uuuaccuuuaucuuuca

SEQ ID NO: 1758281 - RNA, 12 nt, Homo sapiens
cuuuaucacaac

SEQ ID NO: 1758282 - RNA, 16 nt, Homo sapiens
uaaauacaauauugca

SEQ ID NO: 1758283 - RNA, 16 nt, Homo sapiens
gggccacaugggucca

SEQ ID NO: 1758284 - RNA, 17 nt, Homo sapiens
aaaacauaccauuucua

SEQ ID NO: 1758285 - RNA, 20 nt, Homo sapiens
uaaaccagugaacaguguga

SEQ ID NO: 1758286 - RNA, 13 nt, Homo sapiens
caaggaugaucca

SEQ ID NO: 1758287 - RNA, 12 nt, Homo sapiens
cucuacccugag

SEQ ID NO: 1758288 - RNA, 20 nt, Homo sapiens
cugaauguuagauaguuacu

SEQ ID NO: 1758289 - RNA, 19 nt, Homo sapiens
guuaucuguguagcaagcu

SEQ ID NO: 1758290 - RNA, 14 nt, Homo sapiens
agccuuugccuuua

SEQ ID NO: 1758291 - RNA, 16 nt, Homo sapiens
gcucugguugaagcuu

SEQ ID NO: 1758292 - RNA, 21 nt, Homo sapiens
aauguauuugucaaugcauca

SEQ ID NO: 1758293 - RNA, 17 nt, Homo sapiens
gaagucucccuuggaaa

SEQ ID NO: 1758294 - RNA, 23 nt, Homo sapiens
uugcccauugcacuuacauacca

SEQ ID NO: 1758295 - RNA, 18 nt, Homo sapiens
guuaaaaguaucuacuua

SEQ ID NO: 1758296 - RNA, 18 nt, Homo sapiens
acaugcccaucccagugu

SEQ ID NO: 1758297 - RNA, 20 nt, Homo sapiens
ugcuuugaaugcauguguga

SEQ ID NO: 1758298 - RNA, 20 nt, Homo sapiens
agaacauggacuacacacaa

SEQ ID NO: 1758299 - RNA, 17 nt, Homo sapiens
ucuaugcccacauaccc

SEQ ID NO: 1758300 - RNA, 15 nt, Homo sapiens
agaugugggcucaga

SEQ ID NO: 1758301 - RNA, 13 nt, Homo sapiens
ucccugccuccac

SEQ ID NO: 1758302 - RNA, 20 nt, Homo sapiens
aaauuccacacuaccacauu

SEQ ID NO: 1758303 - RNA, 23 nt, Homo sapiens
gaaugacggcaaacucagucaua

SEQ ID NO: 1758304 - RNA, 11 nt, Homo sapiens
agagagcaaac

SEQ ID NO: 1758305 - RNA, 15 nt, Homo sapiens
uggacgcaugcaggg

SEQ ID NO: 1758306 - RNA, 21 nt, Homo sapiens
aguccaaggccaguccccauu

SEQ ID NO: 1758307 - RNA, 13 nt, Homo sapiens
agggaacaggaaa

SEQ ID NO: 1758308 - RNA, 23 nt, Homo sapiens
ugagaccaggggaccagagggau

SEQ ID NO: 1758309 - RNA, 15 nt, Homo sapiens
uuucucucaggguuc

SEQ ID NO: 1758310 - RNA, 19 nt, Homo sapiens
aagaacuuggcacacucuc

SEQ ID NO: 1758311 - RNA, 17 nt, Homo sapiens
ucaaaagagguuacuuu

SEQ ID NO: 1758312 - RNA, 17 nt, Homo sapiens
cagauggaaaaacugag

SEQ ID NO: 1758313 - RNA, 19 nt, Homo sapiens
ucuucaacuuuugugcucc

SEQ ID NO: 1758314 - RNA, 13 nt, Homo sapiens
aauauaucaguaa

SEQ ID NO: 1758315 - RNA, 19 nt, Homo sapiens
uuugcauaacgucugccuu

SEQ ID NO: 1758316 - RNA, 12 nt, Homo sapiens
ucaacauugcau

SEQ ID NO: 1758317 - RNA, 12 nt, Homo sapiens
guaacauuuuau

SEQ ID NO: 1758318 - RNA, 14 nt, Homo sapiens
agcagguugcuuca

SEQ ID NO: 1758319 - RNA, 17 nt, Homo sapiens
gcgccaggggaguuccu

SEQ ID NO: 1758320 - RNA, 14 nt, Homo sapiens
aacacuuaccugga

SEQ ID NO: 1758321 - RNA, 15 nt, Homo sapiens
acuguaauaauaccu

SEQ ID NO: 1758322 - RNA, 16 nt, Homo sapiens
uauuuuuuaaacauac

SEQ ID NO: 1758323 - RNA, 13 nt, Homo sapiens
aauggcugaagaa

SEQ ID NO: 1758324 - RNA, 14 nt, Homo sapiens
accaaccaaugaaa

SEQ ID NO: 1758325 - RNA, 19 nt, Homo sapiens
ucagucucuauaccaauaa

SEQ ID NO: 1758326 - RNA, 21 nt, Homo sapiens
cacuguccugggccugcagaa

SEQ ID NO: 1758327 - RNA, 22 nt, Homo sapiens
ggaagcccucggccuccagacu

SEQ ID NO: 1758328 - RNA, 22 nt, Homo sapiens
acccuaaugccaguuccagcuu

SEQ ID NO: 1758329 - RNA, 15 nt, Homo sapiens
cuuuuccaagcuccu

SEQ ID NO: 1758330 - RNA, 23 nt, Homo sapiens
augcugcugagguuuugaaagaa

SEQ ID NO: 1758331 - RNA, 20 nt, Homo sapiens
ugccacguucuggacugucu

SEQ ID NO: 1758332 - RNA, 16 nt, Homo sapiens
uuaugucucagaccac

SEQ ID NO: 1758333 - RNA, 14 nt, Homo sapiens
aguggccaggccac

SEQ ID NO: 1758334 - RNA, 20 nt, Homo sapiens
cugugcaacgugggcaaguc

SEQ ID NO: 1758335 - RNA, 13 nt, Homo sapiens
aaacccaauccaa

SEQ ID NO: 1758336 - RNA, 13 nt, Homo sapiens
ucacccaaaacaa

SEQ ID NO: 1758337 - RNA, 13 nt, Homo sapiens
acccacaauaaac

SEQ ID NO: 1758338 - RNA, 21 nt, Homo sapiens
aacuuagaugggcaugguggu

SEQ ID NO: 1758339 - RNA, 17 nt, Homo sapiens
gaugaguuaacugugaa

SEQ ID NO: 1758340 - RNA, 21 nt, Homo sapiens
auugacuucauuuuauauuua

SEQ ID NO: 1758341 - RNA, 13 nt, Homo sapiens
gguuggauggugg

SEQ ID NO: 1758342 - RNA, 19 nt, Homo sapiens
gaagacacuaauuccuuaa

SEQ ID NO: 1758343 - RNA, 22 nt, Homo sapiens
aggcugggaaggggaacacaga

SEQ ID NO: 1758344 - RNA, 17 nt, Homo sapiens
gaauugauugucagcca

SEQ ID NO: 1758345 - RNA, 19 nt, Homo sapiens
cagagcacugcuccagugg

SEQ ID NO: 1758346 - RNA, 15 nt, Homo sapiens
uaauugccagcaaau

SEQ ID NO: 1758347 - RNA, 12 nt, Homo sapiens
ccgaauauugag

SEQ ID NO: 1758348 - RNA, 11 nt, Homo sapiens
uagcugcuaua

SEQ ID NO: 1758349 - RNA, 17 nt, Homo sapiens
aauaaaggaguuauuug

SEQ ID NO: 1758350 - RNA, 20 nt, Homo sapiens
ggaccaugcgacacugggag

SEQ ID NO: 1758351 - RNA, 13 nt, Homo sapiens
agauaagugcagu

SEQ ID NO: 1758352 - RNA, 13 nt, Homo sapiens
ccaaaguuugcuc

SEQ ID NO: 1758353 - RNA, 12 nt, Homo sapiens
aguccucugcau

SEQ ID NO: 1758354 - RNA, 16 nt, Homo sapiens
ugaaaucuguaucugu

SEQ ID NO: 1758355 - RNA, 12 nt, Homo sapiens
gggcacugucug

SEQ ID NO: 1758356 - RNA, 15 nt, Homo sapiens
cuucccuuaccucaa

SEQ ID NO: 1758357 - RNA, 21 nt, Homo sapiens
cugauucauacuccuuuuggc

SEQ ID NO: 1758358 - RNA, 19 nt, Homo sapiens
ucaagaacaugaugggccu

SEQ ID NO: 1758359 - RNA, 17 nt, Homo sapiens
ugcuggcagaaagcaaa

SEQ ID NO: 1758360 - RNA, 17 nt, Homo sapiens
ggccaggagcccacagu

SEQ ID NO: 1758361 - RNA, 13 nt, Homo sapiens
ccucuuuguagca

SEQ ID NO: 1758362 - RNA, 12 nt, Homo sapiens
cuuuacaauaaa

SEQ ID NO: 1758363 - RNA, 18 nt, Homo sapiens
uggccauguucauucaca

SEQ ID NO: 1758364 - RNA, 16 nt, Homo sapiens
gaaaagaagccucagc

SEQ ID NO: 1758365 - RNA, 18 nt, Homo sapiens
cuagaguuuagcuggaaa

SEQ ID NO: 1758366 - RNA, 18 nt, Homo sapiens
cugccuggagagggucuc

SEQ ID NO: 1758367 - RNA, 21 nt, Homo sapiens
auucccccaucuucaucccaa

SEQ ID NO: 1758368 - RNA, 16 nt, Homo sapiens
aagcaucuaaggacaa

SEQ ID NO: 1758369 - RNA, 22 nt, Homo sapiens
aagggcagggguguccugaugc

SEQ ID NO: 1758370 - RNA, 16 nt, Homo sapiens
auucauaaggauucag

SEQ ID NO: 1758371 - RNA, 15 nt, Homo sapiens
uacucuuacaagagu

SEQ ID NO: 1758372 - RNA, 18 nt, Homo sapiens
aucugugcacacuaagaa

SEQ ID NO: 1758373 - RNA, 15 nt, Homo sapiens
ugaugacgacgacaa

SEQ ID NO: 1758374 - RNA, 23 nt, Homo sapiens
gucccugguccuucacuggcgcc

SEQ ID NO: 1758375 - RNA, 18 nt, Homo sapiens
auuuuccucuauuuccua

SEQ ID NO: 1758376 - RNA, 21 nt, Homo sapiens
gucaucuuuuuccacuuugac

SEQ ID NO: 1758377 - RNA, 17 nt, Homo sapiens
ggcccuuugaagccuca

SEQ ID NO: 1758378 - RNA, 21 nt, Homo sapiens
agaaaaccuguucuaccaagc

SEQ ID NO: 1758379 - RNA, 16 nt, Homo sapiens
gaggcugccccucuca

SEQ ID NO: 1758380 - RNA, 21 nt, Homo sapiens
ucuuucgcacauucuccugau

SEQ ID NO: 1758381 - RNA, 18 nt, Homo sapiens
guaaggagggucacuggg

SEQ ID NO: 1758382 - RNA, 20 nt, Homo sapiens
cccuagaugcacguggggcc

SEQ ID NO: 1758383 - RNA, 24 nt, Homo sapiens
gcagagcgaucucggcucacugca

SEQ ID NO: 1758384 - RNA, 22 nt, Homo sapiens
ucucaaaaugugccgucuuugg

SEQ ID NO: 1758385 - RNA, 14 nt, Homo sapiens
caauguaacacugg

SEQ ID NO: 1758386 - RNA, 14 nt, Homo sapiens
ggaaggaaggcagu

SEQ ID NO: 1758387 - RNA, 14 nt, Homo sapiens
ugcaagaaugaaau

SEQ ID NO: 1758388 - RNA, 15 nt, Homo sapiens
cuccagcacucccuc

SEQ ID NO: 1758389 - RNA, 22 nt, Homo sapiens
cugaggacguggugacuuccug

SEQ ID NO: 1758390 - RNA, 18 nt, Homo sapiens
aaagucaagccacauggu

SEQ ID NO: 1758391 - RNA, 12 nt, Homo sapiens
uggucucagugu

SEQ ID NO: 1758392 - RNA, 20 nt, Homo sapiens
caaugagccacagcaaaaag

SEQ ID NO: 1758393 - RNA, 18 nt, Homo sapiens
cagggcuuaccuguacac

SEQ ID NO: 1758394 - RNA, 16 nt, Homo sapiens
ucuucuuuuaaaccau

SEQ ID NO: 1758395 - RNA, 13 nt, Homo sapiens
cuuucucacaugu

SEQ ID NO: 1758396 - RNA, 15 nt, Homo sapiens
cuuuugaacccagga

SEQ ID NO: 1758397 - RNA, 12 nt, Homo sapiens
auaccuuuccag

SEQ ID NO: 1758398 - RNA, 12 nt, Homo sapiens
uacauucaugag

SEQ ID NO: 1758399 - RNA, 20 nt, Homo sapiens
ggcuaugaaaaugagcccug

SEQ ID NO: 1758400 - RNA, 14 nt, Homo sapiens
gcuggcugcagcgg

SEQ ID NO: 1758401 - RNA, 14 nt, Homo sapiens
caaccccaucaucc

SEQ ID NO: 1758402 - RNA, 19 nt, Homo sapiens
acgucccgggcacugucau

SEQ ID NO: 1758403 - RNA, 17 nt, Homo sapiens
cuguuuucuuuggggaa

SEQ ID NO: 1758404 - RNA, 20 nt, Homo sapiens
cccaucacugcgccacugcu

SEQ ID NO: 1758405 - RNA, 14 nt, Homo sapiens
cucccacaaaggag

SEQ ID NO: 1758406 - RNA, 15 nt, Homo sapiens
cauuauggaaucaug

SEQ ID NO: 1758407 - RNA, 13 nt, Homo sapiens
ccauggugccauc

SEQ ID NO: 1758408 - RNA, 15 nt, Homo sapiens
cuauuaaagugccau

SEQ ID NO: 1758409 - RNA, 20 nt, Homo sapiens
uuuauauguacauacauaua

SEQ ID NO: 1758410 - RNA, 23 nt, Homo sapiens
caccauacuccuugcuuccugau

SEQ ID NO: 1758411 - RNA, 23 nt, Homo sapiens
cugcgaaacccagcguucuucag

SEQ ID NO: 1758412 - RNA, 20 nt, Homo sapiens
gcuugaucaaaggcacacag

SEQ ID NO: 1758413 - RNA, 20 nt, Homo sapiens
aauuuauugaguuuuuacaa

SEQ ID NO: 1758414 - RNA, 16 nt, Homo sapiens
gcaagagacuuuguca

SEQ ID NO: 1758415 - RNA, 22 nt, Homo sapiens
uacauccaaagcagacagcucc

SEQ ID NO: 1758416 - RNA, 22 nt, Homo sapiens
gaguuuaauuuuugaaaacugg

SEQ ID NO: 1758417 - RNA, 15 nt, Homo sapiens
ugucccucauccaua

SEQ ID NO: 1758418 - RNA, 20 nt, Homo sapiens
uccaaagcauuuuugaucaa

SEQ ID NO: 1758419 - RNA, 12 nt, Homo sapiens
agagauccauca

SEQ ID NO: 1758420 - RNA, 16 nt, Homo sapiens
ggaaguaacauuugcc

SEQ ID NO: 1758421 - RNA, 19 nt, Homo sapiens
ccugggcaacacagugaga

SEQ ID NO: 1758422 - RNA, 18 nt, Homo sapiens
uuucuuccuuaaacuccu

SEQ ID NO: 1758423 - RNA, 19 nt, Homo sapiens
aguugcaguccagcucuuu

SEQ ID NO: 1758424 - RNA, 12 nt, Homo sapiens
guaaaacagggc

SEQ ID NO: 1758425 - RNA, 19 nt, Homo sapiens
ggcuggccugcaggcugca

SEQ ID NO: 1758426 - RNA, 16 nt, Homo sapiens
cuagucugcuuuggua

SEQ ID NO: 1758427 - RNA, 18 nt, Homo sapiens
aaaggauuuuggaaaaga

SEQ ID NO: 1758428 - RNA, 17 nt, Homo sapiens
ucuuagacuuugaaugu

SEQ ID NO: 1758429 - RNA, 17 nt, Homo sapiens
ugguuugugaauccauc

SEQ ID NO: 1758430 - RNA, 22 nt, Homo sapiens
aauuuagugaucuuagcauagc

SEQ ID NO: 1758431 - RNA, 19 nt, Homo sapiens
agucacugccacuuugcac

SEQ ID NO: 1758432 - RNA, 22 nt, Homo sapiens
agugaaguagccucuuguguaa

SEQ ID NO: 1758433 - RNA, 12 nt, Homo sapiens
ccccgcacugug

SEQ ID NO: 1758434 - RNA, 19 nt, Homo sapiens
agaauucuggacaacccaa

SEQ ID NO: 1758435 - RNA, 19 nt, Homo sapiens
aacaacuaaauaacuguau

SEQ ID NO: 1758436 - RNA, 19 nt, Homo sapiens
caugugcgcgcgugcaugu

SEQ ID NO: 1758437 - RNA, 20 nt, Homo sapiens
ugaguaauuguuauuuauuc

SEQ ID NO: 1758438 - RNA, 16 nt, Homo sapiens
guaaauggaacaaaca

SEQ ID NO: 1758439 - RNA, 15 nt, Homo sapiens
augugucuugucucc

SEQ ID NO: 1758440 - RNA, 23 nt, Homo sapiens
ucugccuugcacaaaaagcacaa

SEQ ID NO: 1758441 - RNA, 19 nt, Homo sapiens
acaccuaggucgccaguga

SEQ ID NO: 1758442 - RNA, 13 nt, Homo sapiens
aaacagcaaaagu

SEQ ID NO: 1758443 - RNA, 13 nt, Homo sapiens
ucucugcaucuga

SEQ ID NO: 1758444 - RNA, 18 nt, Homo sapiens
aaaagcaguaacugacaa

SEQ ID NO: 1758445 - RNA, 15 nt, Homo sapiens
auuucagcuugaccu

SEQ ID NO: 1758446 - RNA, 13 nt, Homo sapiens
acaaaaugcagac

SEQ ID NO: 1758447 - RNA, 18 nt, Homo sapiens
gcuccuccuucccaggga

SEQ ID NO: 1758448 - RNA, 14 nt, Homo sapiens
uguuuuaaguacua

SEQ ID NO: 1758449 - RNA, 13 nt, Homo sapiens
gaggaacaagcau

SEQ ID NO: 1758450 - RNA, 21 nt, Homo sapiens
cauauaaaaggugagcucagc

SEQ ID NO: 1758451 - RNA, 17 nt, Homo sapiens
aacaggacuugaauuca

SEQ ID NO: 1758452 - RNA, 20 nt, Homo sapiens
gccacucaggcccaaagccu

SEQ ID NO: 1758453 - RNA, 14 nt, Homo sapiens
auuuauaccucagu

SEQ ID NO: 1758454 - RNA, 16 nt, Homo sapiens
acuuuaagaaguaauu

SEQ ID NO: 1758455 - RNA, 17 nt, Homo sapiens
auagcuauauccaugua

SEQ ID NO: 1758456 - RNA, 17 nt, Homo sapiens
gguuauuuuacauuaag

SEQ ID NO: 1758457 - RNA, 23 nt, Homo sapiens
acccggagcucuacgugcuccuc

SEQ ID NO: 1758458 - RNA, 11 nt, Homo sapiens
aggucccugag

SEQ ID NO: 1758459 - RNA, 13 nt, Homo sapiens
cuucguggagcuc

SEQ ID NO: 1758460 - RNA, 21 nt, Homo sapiens
uuauuugcacuaugagccuau

SEQ ID NO: 1758461 - RNA, 20 nt, Homo sapiens
uaaaagcauuguuugugaua

SEQ ID NO: 1758462 - RNA, 21 nt, Homo sapiens
acccuuaaacaguugcacagc

SEQ ID NO: 1758463 - RNA, 14 nt, Homo sapiens
acuuaauaaucuca

SEQ ID NO: 1758464 - RNA, 13 nt, Homo sapiens
agaucuacaugaa

SEQ ID NO: 1758465 - RNA, 12 nt, Homo sapiens
ggcauguaugca

SEQ ID NO: 1758466 - RNA, 16 nt, Homo sapiens
gauaaauuccacugga

SEQ ID NO: 1758467 - RNA, 16 nt, Homo sapiens
uucuugaaccaauaau

SEQ ID NO: 1758468 - RNA, 21 nt, Homo sapiens
agauauuucaagcucauguca

SEQ ID NO: 1758469 - RNA, 15 nt, Homo sapiens
ugaagaauucagauu

SEQ ID NO: 1758470 - RNA, 17 nt, Homo sapiens
cuuaccuagugaaacuu

SEQ ID NO: 1758471 - RNA, 21 nt, Homo sapiens
ucaauauuuuuauaucaugca

SEQ ID NO: 1758472 - RNA, 14 nt, Homo sapiens
ucuuagugacuuag

SEQ ID NO: 1758473 - RNA, 20 nt, Homo sapiens
uuuaaaaaaaaagucagaga

SEQ ID NO: 1758474 - RNA, 23 nt, Homo sapiens
ccacacauuuaaaacauuugaag

SEQ ID NO: 1758475 - RNA, 12 nt, Homo sapiens
caaagacaucaa

SEQ ID NO: 1758476 - RNA, 14 nt, Homo sapiens
caggaggccuagga

SEQ ID NO: 1758477 - RNA, 12 nt, Homo sapiens
cuccccucaaaa

SEQ ID NO: 1758478 - RNA, 19 nt, Homo sapiens
cagggcuccaaaucugccu

SEQ ID NO: 1758479 - RNA, 20 nt, Homo sapiens
gcccaccuccuccaccacag

SEQ ID NO: 1758480 - RNA, 17 nt, Homo sapiens
aguaggaguugcuccua

SEQ ID NO: 1758481 - RNA, 14 nt, Homo sapiens
acuaucacauacaa

SEQ ID NO: 1758482 - RNA, 15 nt, Homo sapiens
gauucuaugucucau

SEQ ID NO: 1758483 - RNA, 16 nt, Homo sapiens
cauaauaaccaaacau

SEQ ID NO: 1758484 - RNA, 16 nt, Homo sapiens
caggcaugcaccagug

SEQ ID NO: 1758485 - RNA, 22 nt, Homo sapiens
aauucaaugccgcaacauauag

SEQ ID NO: 1758486 - RNA, 22 nt, Homo sapiens
uggaggaucucacuuaauucuc

SEQ ID NO: 1758487 - RNA, 15 nt, Homo sapiens
gaugaguugcaguuu

SEQ ID NO: 1758488 - RNA, 23 nt, Homo sapiens
uacacgggaccagcucacguaau

SEQ ID NO: 1758489 - RNA, 14 nt, Homo sapiens
gugugucucgucuc

SEQ ID NO: 1758490 - RNA, 23 nt, Homo sapiens
ccauuggaauaauaaauuugaua

SEQ ID NO: 1758491 - RNA, 20 nt, Homo sapiens
cuuuuauucauuagcuguga

SEQ ID NO: 1758492 - RNA, 18 nt, Homo sapiens
gcacugugccuacaggug

SEQ ID NO: 1758493 - RNA, 22 nt, Homo sapiens
cauaauaaauaauuaaccacca

SEQ ID NO: 1758494 - RNA, 22 nt, Homo sapiens
caacaccuauauauccaagaag

SEQ ID NO: 1758495 - RNA, 15 nt, Homo sapiens
auuuuuguacauuau

SEQ ID NO: 1758496 - RNA, 21 nt, Homo sapiens
acuacagaauaauguguuaaa

SEQ ID NO: 1758497 - RNA, 15 nt, Homo sapiens
agaaucugcugcaua

SEQ ID NO: 1758498 - RNA, 18 nt, Homo sapiens
ugaggggcucucucauga

SEQ ID NO: 1758499 - RNA, 14 nt, Homo sapiens
ugucggugugcugu

SEQ ID NO: 1758500 - RNA, 20 nt, Homo sapiens
ggcaacaggucauguucaau

SEQ ID NO: 1758501 - RNA, 19 nt, Homo sapiens
augacauucccugcuaaua

SEQ ID NO: 1758502 - RNA, 18 nt, Homo sapiens
ugccuuaaaaccaaagag

SEQ ID NO: 1758503 - RNA, 21 nt, Homo sapiens
ccaugccaaggccucccucag

SEQ ID NO: 1758504 - RNA, 16 nt, Homo sapiens
uugggcugcuccucau

SEQ ID NO: 1758505 - RNA, 19 nt, Homo sapiens
cuuugugcaggguccuccg

SEQ ID NO: 1758506 - RNA, 14 nt, Homo sapiens
uagcugcucacuua

SEQ ID NO: 1758507 - RNA, 14 nt, Homo sapiens
agaugggauuucau

SEQ ID NO: 1758508 - RNA, 13 nt, Homo sapiens
uuaguacaugcuc

SEQ ID NO: 1758509 - RNA, 20 nt, Homo sapiens
uggacuccugcacacgcucc

SEQ ID NO: 1758510 - RNA, 21 nt, Homo sapiens
cuuuaggcgugggcugaccag

SEQ ID NO: 1758511 - RNA, 19 nt, Homo sapiens
cugcagccccagcugacac

SEQ ID NO: 1758512 - RNA, 18 nt, Homo sapiens
uuccaaauuaggaagugu

SEQ ID NO: 1758513 - RNA, 22 nt, Homo sapiens
uccuuaggaaaaacaugagcau

SEQ ID NO: 1758514 - RNA, 20 nt, Homo sapiens
accccuuuccacgagcuaua

SEQ ID NO: 1758515 - RNA, 12 nt, Homo sapiens
guuggcuucuaa

SEQ ID NO: 1758516 - RNA, 13 nt, Homo sapiens
aacucuccccagu

SEQ ID NO: 1758517 - RNA, 16 nt, Homo sapiens
ucagagugacagucau

SEQ ID NO: 1758518 - RNA, 23 nt, Homo sapiens
ugcccuggggcaucaugggcaac

SEQ ID NO: 1758519 - RNA, 18 nt, Homo sapiens
aagcucacuaagaagcuu

SEQ ID NO: 1758520 - RNA, 19 nt, Homo sapiens
auggggucugugacuggau

SEQ ID NO: 1758521 - RNA, 16 nt, Homo sapiens
uccugaguagcaguga

SEQ ID NO: 1758522 - RNA, 15 nt, Homo sapiens
auacuauugccucau

SEQ ID NO: 1758523 - RNA, 14 nt, Homo sapiens
auccauuuuacaca

SEQ ID NO: 1758524 - RNA, 16 nt, Homo sapiens
ggaggccagccaguga

SEQ ID NO: 1758525 - RNA, 14 nt, Homo sapiens
caauuccaccaggg

SEQ ID NO: 1758526 - RNA, 20 nt, Homo sapiens
agggugggguacuggaguua

SEQ ID NO: 1758527 - RNA, 23 nt, Homo sapiens
cuagcaggccuaagacaugugag

SEQ ID NO: 1758528 - RNA, 19 nt, Homo sapiens
cagacagccguuuguucua

SEQ ID NO: 1758529 - RNA, 15 nt, Homo sapiens
agaaaguaaacugua

SEQ ID NO: 1758530 - RNA, 18 nt, Homo sapiens
agcauaccuuggacugac

SEQ ID NO: 1758531 - RNA, 16 nt, Homo sapiens
cuccagaggccaagga

SEQ ID NO: 1758532 - RNA, 21 nt, Homo sapiens
cuacacucuugacuagugcaa

SEQ ID NO: 1758533 - RNA, 20 nt, Homo sapiens
gcaaaaucuuguuaauguca

SEQ ID NO: 1758534 - RNA, 13 nt, Homo sapiens
cuaguucuaccuc

SEQ ID NO: 1758535 - RNA, 22 nt, Homo sapiens
agaagagacugcuacagugcau

SEQ ID NO: 1758536 - RNA, 18 nt, Homo sapiens
cagugcucgcuguugcug

SEQ ID NO: 1758537 - RNA, 20 nt, Homo sapiens
ccgauaauagguagccugcu

SEQ ID NO: 1758538 - RNA, 23 nt, Homo sapiens
ccugccauaauccuuuggaaaag

SEQ ID NO: 1758539 - RNA, 24 nt, Homo sapiens
ccugcaacacaacauuugugucac

SEQ ID NO: 1758540 - RNA, 23 nt, Homo sapiens
auggugcaaaaaugaguuuucac

SEQ ID NO: 1758541 - RNA, 18 nt, Homo sapiens
ugcagaaauauuugugac

SEQ ID NO: 1758542 - RNA, 18 nt, Homo sapiens
aggcgugagccaccacgc

SEQ ID NO: 1758543 - RNA, 17 nt, Homo sapiens
gugggaccacagacuca

SEQ ID NO: 1758544 - RNA, 16 nt, Homo sapiens
aagagaucacccacuc

SEQ ID NO: 1758545 - RNA, 23 nt, Homo sapiens
aggucugagccacagcagcauuu

SEQ ID NO: 1758546 - RNA, 16 nt, Homo sapiens
gcccuaugcaagcaaa

SEQ ID NO: 1758547 - RNA, 19 nt, Homo sapiens
aaugucuuuuuaagcuuau

SEQ ID NO: 1758548 - RNA, 18 nt, Homo sapiens
uccagaucaaagaacuca

SEQ ID NO: 1758549 - RNA, 18 nt, Homo sapiens
uucaaagaagucauggcc

SEQ ID NO: 1758550 - RNA, 19 nt, Homo sapiens
ggcacaguaggaauuggaa

SEQ ID NO: 1758551 - RNA, 17 nt, Homo sapiens
auugaaggaaagcuaua

SEQ ID NO: 1758552 - RNA, 22 nt, Homo sapiens
caagguuuugaaauuuucugua

SEQ ID NO: 1758553 - RNA, 17 nt, Homo sapiens
caggggaucacacgagc

SEQ ID NO: 1758554 - RNA, 19 nt, Homo sapiens
guuuuuaaaaaacugcuga

SEQ ID NO: 1758555 - RNA, 13 nt, Homo sapiens
cggagucuucucg

SEQ ID NO: 1758556 - RNA, 13 nt, Homo sapiens
uuaaaauugguaa

SEQ ID NO: 1758557 - RNA, 15 nt, Homo sapiens
uaauaaaguauauaa

SEQ ID NO: 1758558 - RNA, 23 nt, Homo sapiens
aaaguuuaagcaauucauucucu

SEQ ID NO: 1758559 - RNA, 22 nt, Homo sapiens
cuuucugugccacacaauggau

SEQ ID NO: 1758560 - RNA, 21 nt, Homo sapiens
cauguugccaugaggccuuuc

SEQ ID NO: 1758561 - RNA, 19 nt, Homo sapiens
ucuccccagugccugccac

SEQ ID NO: 1758562 - RNA, 20 nt, Homo sapiens
uacuucuugauaccugggau

SEQ ID NO: 1758563 - RNA, 15 nt, Homo sapiens
uacagguuaagacaa

SEQ ID NO: 1758564 - RNA, 15 nt, Homo sapiens
cagaugauucaaaua

SEQ ID NO: 1758565 - RNA, 16 nt, Homo sapiens
auucaacacugugcac

SEQ ID NO: 1758566 - RNA, 21 nt, Homo sapiens
gccuuaguugcuaguuuagua

SEQ ID NO: 1758567 - RNA, 13 nt, Homo sapiens
ucaguauagcauu

SEQ ID NO: 1758568 - RNA, 19 nt, Homo sapiens
ugcccgccaccacacccaa

SEQ ID NO: 1758569 - RNA, 22 nt, Homo sapiens
cuacaccacucuggcagccaca

SEQ ID NO: 1758570 - RNA, 18 nt, Homo sapiens
aggggugguacuuggcac

SEQ ID NO: 1758571 - RNA, 17 nt, Homo sapiens
aggaugacccggggcag

SEQ ID NO: 1758572 - RNA, 16 nt, Homo sapiens
ggcuucaguggcagcu

SEQ ID NO: 1758573 - RNA, 21 nt, Homo sapiens
ccugaaguaagcaaagacuuu

SEQ ID NO: 1758574 - RNA, 22 nt, Homo sapiens
aguaaaugcuagguuaauucca

SEQ ID NO: 1758575 - RNA, 18 nt, Homo sapiens
caugggggaggcucugaa

SEQ ID NO: 1758576 - RNA, 17 nt, Homo sapiens
aagagcauagaacucaa

SEQ ID NO: 1758577 - RNA, 14 nt, Homo sapiens
aaagccagucauca

SEQ ID NO: 1758578 - RNA, 20 nt, Homo sapiens
uauuaacagcugauacaggu

SEQ ID NO: 1758579 - RNA, 14 nt, Homo sapiens
caguggcacaauca

SEQ ID NO: 1758580 - RNA, 14 nt, Homo sapiens
ggaaggcagggaca

SEQ ID NO: 1758581 - RNA, 21 nt, Homo sapiens
auuugcaaauauacuuuacuu

SEQ ID NO: 1758582 - RNA, 16 nt, Homo sapiens
cauuugaaccagugau

SEQ ID NO: 1758583 - RNA, 16 nt, Homo sapiens
ucugaaucuguuucua

SEQ ID NO: 1758584 - RNA, 17 nt, Homo sapiens
ggccuggucguuuucaa

SEQ ID NO: 1758585 - RNA, 11 nt, Homo sapiens
agaaauucugu

SEQ ID NO: 1758586 - RNA, 23 nt, Homo sapiens
gcuucucuucuuuauugcacuag

SEQ ID NO: 1758587 - RNA, 17 nt, Homo sapiens
cugauuauuuagagcca

SEQ ID NO: 1758588 - RNA, 15 nt, Homo sapiens
uugcuguugugugau

SEQ ID NO: 1758589 - RNA, 18 nt, Homo sapiens
cauaauaaaguggugauu

SEQ ID NO: 1758590 - RNA, 15 nt, Homo sapiens
ugcuaaaccauucau

SEQ ID NO: 1758591 - RNA, 17 nt, Homo sapiens
uuuuacacaccaccagc

SEQ ID NO: 1758592 - RNA, 15 nt, Homo sapiens
aaagaaaugguaugu

SEQ ID NO: 1758593 - RNA, 17 nt, Homo sapiens
cuucaguuugcagagua

SEQ ID NO: 1758594 - RNA, 16 nt, Homo sapiens
gggaaaaugcacacau

SEQ ID NO: 1758595 - RNA, 18 nt, Homo sapiens
cuugauuuuauuguacaa

SEQ ID NO: 1758596 - RNA, 23 nt, Homo sapiens
acaguaugagaagaaaaauggaa

SEQ ID NO: 1758597 - RNA, 15 nt, Homo sapiens
cuacuuuuugcaccu

SEQ ID NO: 1758598 - RNA, 14 nt, Homo sapiens
uuggcccacacuga

SEQ ID NO: 1758599 - RNA, 14 nt, Homo sapiens
cuggaccagccugu

SEQ ID NO: 1758600 - RNA, 14 nt, Homo sapiens
auucuuugcaagau

SEQ ID NO: 1758601 - RNA, 14 nt, Homo sapiens
auucaaugcaagua

SEQ ID NO: 1758602 - RNA, 14 nt, Homo sapiens
caaugaaaccaaag

SEQ ID NO: 1758603 - RNA, 21 nt, Homo sapiens
guugucuaaagcuaaacaaaa

SEQ ID NO: 1758604 - RNA, 21 nt, Homo sapiens
caggguagguuugugucuuaa

SEQ ID NO: 1758605 - RNA, 16 nt, Homo sapiens
auugguguuauguuua

SEQ ID NO: 1758606 - RNA, 18 nt, Homo sapiens
aaguaacuuaaggaccuu

SEQ ID NO: 1758607 - RNA, 14 nt, Homo sapiens
ccagaauacugggu

SEQ ID NO: 1758608 - RNA, 20 nt, Homo sapiens
guuacucugucccacgucca

SEQ ID NO: 1758609 - RNA, 13 nt, Homo sapiens
cgggcaccuguag

SEQ ID NO: 1758610 - RNA, 17 nt, Homo sapiens
ucauugcuuugaagcag

SEQ ID NO: 1758611 - RNA, 15 nt, Homo sapiens
ucccuuuggaacuau

SEQ ID NO: 1758612 - RNA, 14 nt, Homo sapiens
uauguccacuguuc

SEQ ID NO: 1758613 - RNA, 14 nt, Homo sapiens
auuccugagccagu

SEQ ID NO: 1758614 - RNA, 20 nt, Homo sapiens
ucuuccaaagaacuguauaa

SEQ ID NO: 1758615 - RNA, 23 nt, Homo sapiens
ucauaagccuaccaauguagaca

SEQ ID NO: 1758616 - RNA, 22 nt, Homo sapiens
auggaaaaucagcugcucagca

SEQ ID NO: 1758617 - RNA, 14 nt, Homo sapiens
aacaacuccaaaac

SEQ ID NO: 1758618 - RNA, 13 nt, Homo sapiens
ucacauucaugca

SEQ ID NO: 1758619 - RNA, 16 nt, Homo sapiens
caaucugugucauaua

SEQ ID NO: 1758620 - RNA, 23 nt, Homo sapiens
uaacuauuuauuuuuucuaagug

SEQ ID NO: 1758621 - RNA, 18 nt, Homo sapiens
aaaugccaaaggaaguuu

SEQ ID NO: 1758622 - RNA, 16 nt, Homo sapiens
agucaucucauuccac

SEQ ID NO: 1758623 - RNA, 17 nt, Homo sapiens
aucguguccugaaaauc

SEQ ID NO: 1758624 - RNA, 21 nt, Homo sapiens
gaagagcaggcaccagcagca

SEQ ID NO: 1758625 - RNA, 15 nt, Homo sapiens
aauaaccauugucau

SEQ ID NO: 1758626 - RNA, 14 nt, Homo sapiens
ggggcagcacuccc

SEQ ID NO: 1758627 - RNA, 19 nt, Homo sapiens
aaguucagcaaguagagca

SEQ ID NO: 1758628 - RNA, 20 nt, Homo sapiens
augagaggaaaucaccgaaa

SEQ ID NO: 1758629 - RNA, 13 nt, Homo sapiens
ggaacuaaacguc

SEQ ID NO: 1758630 - RNA, 16 nt, Homo sapiens
gcucuucauccaggga

SEQ ID NO: 1758631 - RNA, 23 nt, Homo sapiens
cauguggcuccucccagcccaua

SEQ ID NO: 1758632 - RNA, 18 nt, Homo sapiens
aaaauaaacuucuuaaca

SEQ ID NO: 1758633 - RNA, 22 nt, Homo sapiens
ggcucugggagacuuugaagac

SEQ ID NO: 1758634 - RNA, 16 nt, Homo sapiens
acagcugagcacauuc

SEQ ID NO: 1758635 - RNA, 13 nt, Homo sapiens
ucagaaacaucug

SEQ ID NO: 1758636 - RNA, 21 nt, Homo sapiens
acugcaauuuaauucuuguuc

SEQ ID NO: 1758637 - RNA, 20 nt, Homo sapiens
caggucuccggaggagacac

SEQ ID NO: 1758638 - RNA, 20 nt, Homo sapiens
ugagcaguuagcucauuuga

SEQ ID NO: 1758639 - RNA, 17 nt, Homo sapiens
guuccuuuuucuucugu

SEQ ID NO: 1758640 - RNA, 22 nt, Homo sapiens
aucaaacacaauuaaaucucuc

SEQ ID NO: 1758641 - RNA, 17 nt, Homo sapiens
ccggccgauggagacac

SEQ ID NO: 1758642 - RNA, 17 nt, Homo sapiens
ccuucucaggcuggcau

SEQ ID NO: 1758643 - RNA, 17 nt, Homo sapiens
auaugaagaacugagga

SEQ ID NO: 1758644 - RNA, 13 nt, Homo sapiens
ugugcccgugugu

SEQ ID NO: 1758645 - RNA, 20 nt, Homo sapiens
ucaaugguugggacaauggc

SEQ ID NO: 1758646 - RNA, 17 nt, Homo sapiens
ccaacccaugagugcua

SEQ ID NO: 1758647 - RNA, 20 nt, Homo sapiens
ucauccacguccugucuguu

SEQ ID NO: 1758648 - RNA, 16 nt, Homo sapiens
ugucaaaaugagauuc

SEQ ID NO: 1758649 - RNA, 18 nt, Homo sapiens
cugaaccauguggauaac

SEQ ID NO: 1758650 - RNA, 11 nt, Homo sapiens
aggaaaccaca

SEQ ID NO: 1758651 - RNA, 21 nt, Homo sapiens
uuccacugaaauagagugaau

SEQ ID NO: 1758652 - RNA, 14 nt, Homo sapiens
cuggagccuuugaa

SEQ ID NO: 1758653 - RNA, 21 nt, Homo sapiens
agaauggugcucuuaucuuuc

SEQ ID NO: 1758654 - RNA, 18 nt, Homo sapiens
acuacagacccagcccca

SEQ ID NO: 1758655 - RNA, 15 nt, Homo sapiens
uggaaagagaaccau

SEQ ID NO: 1758656 - RNA, 15 nt, Homo sapiens
gcaaaguccagcuca

SEQ ID NO: 1758657 - RNA, 13 nt, Homo sapiens
aagccauguguau

SEQ ID NO: 1758658 - RNA, 16 nt, Homo sapiens
uaaaguugcuccauac

SEQ ID NO: 1758659 - RNA, 20 nt, Homo sapiens
cacaaagcccauagcacugg

SEQ ID NO: 1758660 - RNA, 15 nt, Homo sapiens
auuuucaaaccucaa

SEQ ID NO: 1758661 - RNA, 18 nt, Homo sapiens
aauuagguuuuguacaau

SEQ ID NO: 1758662 - RNA, 14 nt, Homo sapiens
gcaguggugugaaa

SEQ ID NO: 1758663 - RNA, 17 nt, Homo sapiens
caguuuggaaguguuaa

SEQ ID NO: 1758664 - RNA, 20 nt, Homo sapiens
acacagacccaagauucaua

SEQ ID NO: 1758665 - RNA, 17 nt, Homo sapiens
augguucccaagcguca

SEQ ID NO: 1758666 - RNA, 14 nt, Homo sapiens
gacagaaaugccac

SEQ ID NO: 1758667 - RNA, 21 nt, Homo sapiens
gcuuaaacccuuuagugcuuu

SEQ ID NO: 1758668 - RNA, 12 nt, Homo sapiens
cgauuugaggga

SEQ ID NO: 1758669 - RNA, 22 nt, Homo sapiens
ggaaagcagaacugaagccacu

SEQ ID NO: 1758670 - RNA, 14 nt, Homo sapiens
gaaggcuaugggga

SEQ ID NO: 1758671 - RNA, 20 nt, Homo sapiens
gccuugucugucucagcuca

SEQ ID NO: 1758672 - RNA, 17 nt, Homo sapiens
uccuugaccuaugagcc

SEQ ID NO: 1758673 - RNA, 14 nt, Homo sapiens
auaggaaaacauug

SEQ ID NO: 1758674 - RNA, 12 nt, Homo sapiens
gcuuuguucuga

SEQ ID NO: 1758675 - RNA, 19 nt, Homo sapiens
uaauucauccuagcaaauu

SEQ ID NO: 1758676 - RNA, 18 nt, Homo sapiens
agguccuaaagaugcuga

SEQ ID NO: 1758677 - RNA, 13 nt, Homo sapiens
gaacgcgugucaa

SEQ ID NO: 1758678 - RNA, 12 nt, Homo sapiens
guccagccagcu

SEQ ID NO: 1758679 - RNA, 19 nt, Homo sapiens
caagucuugaaacaagcaa

SEQ ID NO: 1758680 - RNA, 15 nt, Homo sapiens
cagccuugguuccug

SEQ ID NO: 1758681 - RNA, 20 nt, Homo sapiens
aauaaaaagauggacaagaa

SEQ ID NO: 1758682 - RNA, 21 nt, Homo sapiens
cuuuguaaagaaaguggcuug

SEQ ID NO: 1758683 - RNA, 22 nt, Homo sapiens
cugcuuaguacauuugaugcaa

SEQ ID NO: 1758684 - RNA, 15 nt, Homo sapiens
ccuucagucaagaaa

SEQ ID NO: 1758685 - RNA, 15 nt, Homo sapiens
cagccuuaccaaagc

SEQ ID NO: 1758686 - RNA, 16 nt, Homo sapiens
caggauguuauucuuc

SEQ ID NO: 1758687 - RNA, 23 nt, Homo sapiens
ugcacuuaaagaaguauuuuuag

SEQ ID NO: 1758688 - RNA, 19 nt, Homo sapiens
uugggggaggcuucagggg

SEQ ID NO: 1758689 - RNA, 22 nt, Homo sapiens
gaagcucagcugccuuccuggg

SEQ ID NO: 1758690 - RNA, 13 nt, Homo sapiens
augcaaauucauc

SEQ ID NO: 1758691 - RNA, 14 nt, Homo sapiens
ggacgccuguguca

SEQ ID NO: 1758692 - RNA, 17 nt, Homo sapiens
ucucuacuaaaaguaca

SEQ ID NO: 1758693 - RNA, 22 nt, Homo sapiens
cuguccagacaagcccugcuug

SEQ ID NO: 1758694 - RNA, 20 nt, Homo sapiens
acugucauuguguguggaau

SEQ ID NO: 1758695 - RNA, 16 nt, Homo sapiens
gacugucuaugaacuu

SEQ ID NO: 1758696 - RNA, 14 nt, Homo sapiens
uaagaaccugaaua

SEQ ID NO: 1758697 - RNA, 17 nt, Homo sapiens
caaauaaacucuaaaca

SEQ ID NO: 1758698 - RNA, 22 nt, Homo sapiens
gcucagccccagcuuaucuccu

SEQ ID NO: 1758699 - RNA, 13 nt, Homo sapiens
gcuugaucacagc

SEQ ID NO: 1758700 - RNA, 17 nt, Homo sapiens
aaaauacaaaaagcaaa

SEQ ID NO: 1758701 - RNA, 18 nt, Homo sapiens
acauacuauucuuacuaa

SEQ ID NO: 1758702 - RNA, 15 nt, Homo sapiens
auugcaugugacucu

SEQ ID NO: 1758703 - RNA, 12 nt, Homo sapiens
uaagugugcaug

SEQ ID NO: 1758704 - RNA, 14 nt, Homo sapiens
acauuagugaauua

SEQ ID NO: 1758705 - RNA, 17 nt, Homo sapiens
ucaaaauuguguccaca

SEQ ID NO: 1758706 - RNA, 23 nt, Homo sapiens
ccaacacaugggaccuauaacug

SEQ ID NO: 1758707 - RNA, 14 nt, Homo sapiens
cugaggugacuuaa

SEQ ID NO: 1758708 - RNA, 17 nt, Homo sapiens
cuaagcuggagugcagu

SEQ ID NO: 1758709 - RNA, 15 nt, Homo sapiens
gaauuaacacaugau

SEQ ID NO: 1758710 - RNA, 15 nt, Homo sapiens
ggcuuggaguggcca

SEQ ID NO: 1758711 - RNA, 18 nt, Homo sapiens
ugaaucaaagacauuuca

SEQ ID NO: 1758712 - RNA, 18 nt, Homo sapiens
uguggaugauaaaacaca

SEQ ID NO: 1758713 - RNA, 17 nt, Homo sapiens
uuuuguaucuacaucuu

SEQ ID NO: 1758714 - RNA, 15 nt, Homo sapiens
aauagugcaacuaug

SEQ ID NO: 1758715 - RNA, 22 nt, Homo sapiens
uaggaaggggccucaggagcag

SEQ ID NO: 1758716 - RNA, 22 nt, Homo sapiens
cagagguccacaacacacagau

SEQ ID NO: 1758717 - RNA, 20 nt, Homo sapiens
uaagguauugcaaggucacu

SEQ ID NO: 1758718 - RNA, 13 nt, Homo sapiens
uuuguucuguaua

SEQ ID NO: 1758719 - RNA, 15 nt, Homo sapiens
acuauggugccaaug

SEQ ID NO: 1758720 - RNA, 20 nt, Homo sapiens
gcugcggguggguaucccac

SEQ ID NO: 1758721 - RNA, 14 nt, Homo sapiens
uggcagaccaucuc

SEQ ID NO: 1758722 - RNA, 15 nt, Homo sapiens
acuuuuaaaacuaua

SEQ ID NO: 1758723 - RNA, 21 nt, Homo sapiens
uccugccaaggccgagccaca

SEQ ID NO: 1758724 - RNA, 16 nt, Homo sapiens
caguaacacagugcag

SEQ ID NO: 1758725 - RNA, 14 nt, Homo sapiens
aaaguaccuugacu

SEQ ID NO: 1758726 - RNA, 21 nt, Homo sapiens
gcucuuucagaacaaacauua

SEQ ID NO: 1758727 - RNA, 12 nt, Homo sapiens
guuaaugucauu

SEQ ID NO: 1758728 - RNA, 14 nt, Homo sapiens
uuaguuucacauug

SEQ ID NO: 1758729 - RNA, 19 nt, Homo sapiens
ugaucucccucuaagcaca

SEQ ID NO: 1758730 - RNA, 22 nt, Homo sapiens
gaagguuaugcuccuggcacag

SEQ ID NO: 1758731 - RNA, 18 nt, Homo sapiens
ucagaaugaugaguccag

SEQ ID NO: 1758732 - RNA, 16 nt, Homo sapiens
ggcugagaaucugggg

SEQ ID NO: 1758733 - RNA, 18 nt, Homo sapiens
uucacuauaaaugguguu

SEQ ID NO: 1758734 - RNA, 14 nt, Homo sapiens
accaggggaccaga

SEQ ID NO: 1758735 - RNA, 12 nt, Homo sapiens
acagacacugca

SEQ ID NO: 1758736 - RNA, 20 nt, Homo sapiens
aggaacugcuugugcacugg

SEQ ID NO: 1758737 - RNA, 15 nt, Homo sapiens
aaauaaaggaguuau

SEQ ID NO: 1758738 - RNA, 17 nt, Homo sapiens
guagacuagugccguag

SEQ ID NO: 1758739 - RNA, 14 nt, Homo sapiens
accaaucaaauguc

SEQ ID NO: 1758740 - RNA, 22 nt, Homo sapiens
uugcccaggcuagagugcaaug

SEQ ID NO: 1758741 - RNA, 20 nt, Homo sapiens
aaguuuuauguucugcucac

SEQ ID NO: 1758742 - RNA, 12 nt, Homo sapiens
aagggacuugaa

SEQ ID NO: 1758743 - RNA, 18 nt, Homo sapiens
caaacacaguuacacuug

SEQ ID NO: 1758744 - RNA, 17 nt, Homo sapiens
cugagcccuaaacacac

SEQ ID NO: 1758745 - RNA, 19 nt, Homo sapiens
aguaaucaauacagacaag

SEQ ID NO: 1758746 - RNA, 13 nt, Homo sapiens
caugaccuaucag

SEQ ID NO: 1758747 - RNA, 13 nt, Homo sapiens
auagcagugcuag

SEQ ID NO: 1758748 - RNA, 18 nt, Homo sapiens
aauacacauauuugcaca

SEQ ID NO: 1758749 - RNA, 16 nt, Homo sapiens
gcacuguggucaggcc

SEQ ID NO: 1758750 - RNA, 14 nt, Homo sapiens
gccucuacugggaa

SEQ ID NO: 1758751 - RNA, 17 nt, Homo sapiens
ugugaguaucagaauug

SEQ ID NO: 1758752 - RNA, 18 nt, Homo sapiens
cagaugccagcgccaugc

SEQ ID NO: 1758753 - RNA, 24 nt, Homo sapiens
caaagaacugaaagcacuagagca

SEQ ID NO: 1758754 - RNA, 16 nt, Homo sapiens
cauugcuguucuacuu

SEQ ID NO: 1758755 - RNA, 17 nt, Homo sapiens
cgagaggcucugagggu

SEQ ID NO: 1758756 - RNA, 17 nt, Homo sapiens
ggaacugcccuacuggg

SEQ ID NO: 1758757 - RNA, 17 nt, Homo sapiens
gcaauaaacucagucaa

SEQ ID NO: 1758758 - RNA, 13 nt, Homo sapiens
aacacagaacuga

SEQ ID NO: 1758759 - RNA, 13 nt, Homo sapiens
agccaagucgcca

SEQ ID NO: 1758760 - RNA, 18 nt, Homo sapiens
aggccuuaacuuucccau

SEQ ID NO: 1758761 - RNA, 16 nt, Homo sapiens
accuuguuauuucuca

SEQ ID NO: 1758762 - RNA, 15 nt, Homo sapiens
ugcaaggcaaauguu

SEQ ID NO: 1758763 - RNA, 14 nt, Homo sapiens
ggagagacugugag

SEQ ID NO: 1758764 - RNA, 13 nt, Homo sapiens
uuuuccuaaaaau

SEQ ID NO: 1758765 - RNA, 19 nt, Homo sapiens
ccaaauccccucccuguga

SEQ ID NO: 1758766 - RNA, 19 nt, Homo sapiens
uccuggggccugugcacug

SEQ ID NO: 1758767 - RNA, 17 nt, Homo sapiens
ccaucccucuccucugc

SEQ ID NO: 1758768 - RNA, 16 nt, Homo sapiens
cccaggaguguggcca

SEQ ID NO: 1758769 - RNA, 16 nt, Homo sapiens
cugcauuccuagaaau

SEQ ID NO: 1758770 - RNA, 18 nt, Homo sapiens
uggauucaucagcauuug

SEQ ID NO: 1758771 - RNA, 18 nt, Homo sapiens
cgcucuccuccuucucug

SEQ ID NO: 1758772 - RNA, 20 nt, Homo sapiens
accagaaugaaaacuguaaa

SEQ ID NO: 1758773 - RNA, 13 nt, Homo sapiens
uaauaauggaaug

SEQ ID NO: 1758774 - RNA, 20 nt, Homo sapiens
agcucaauuguuaaugugau

SEQ ID NO: 1758775 - RNA, 16 nt, Homo sapiens
uccagaccccuacccu

SEQ ID NO: 1758776 - RNA, 17 nt, Homo sapiens
gugucucugcaugugua

SEQ ID NO: 1758777 - RNA, 22 nt, Homo sapiens
uccucuggguaggaaucagcaa

SEQ ID NO: 1758778 - RNA, 20 nt, Homo sapiens
cacuaaccaaaucucucaaa

SEQ ID NO: 1758779 - RNA, 16 nt, Homo sapiens
gaugaugacuauggaa

SEQ ID NO: 1758780 - RNA, 19 nt, Homo sapiens
ucaacagugagagacucca

SEQ ID NO: 1758781 - RNA, 13 nt, Homo sapiens
gagauuguucuau

SEQ ID NO: 1758782 - RNA, 15 nt, Homo sapiens
cuccaacuccauacu

SEQ ID NO: 1758783 - RNA, 15 nt, Homo sapiens
caggcgcaugugcca

SEQ ID NO: 1758784 - RNA, 14 nt, Homo sapiens
cuuucauaaucuuu

SEQ ID NO: 1758785 - RNA, 22 nt, Homo sapiens
aucauaugguugacaguaugca

SEQ ID NO: 1758786 - RNA, 20 nt, Homo sapiens
cuguugaccugugcaccuac

SEQ ID NO: 1758787 - RNA, 14 nt, Homo sapiens
aauuaagguuugcc

SEQ ID NO: 1758788 - RNA, 22 nt, Homo sapiens
cuacccuuugucccuguagccu

SEQ ID NO: 1758789 - RNA, 21 nt, Homo sapiens
uagcauaguaccucugcuauu

SEQ ID NO: 1758790 - RNA, 16 nt, Homo sapiens
uguuugggggaaaaaa

SEQ ID NO: 1758791 - RNA, 18 nt, Homo sapiens
aaaacggcccucuugaag

SEQ ID NO: 1758792 - RNA, 18 nt, Homo sapiens
ugcuuugccuauggagua

SEQ ID NO: 1758793 - RNA, 22 nt, Homo sapiens
gccucccacacugaaaccaaaa

SEQ ID NO: 1758794 - RNA, 14 nt, Homo sapiens
cccaguuagcacca

SEQ ID NO: 1758795 - RNA, 14 nt, Homo sapiens
agguguaaccguaa

SEQ ID NO: 1758796 - RNA, 16 nt, Homo sapiens
uaucugucaucucucu

SEQ ID NO: 1758797 - RNA, 21 nt, Homo sapiens
uccccucguuaacacauggcu

SEQ ID NO: 1758798 - RNA, 23 nt, Homo sapiens
aauucauagugauagagugcagu

SEQ ID NO: 1758799 - RNA, 22 nt, Homo sapiens
uauaauguuguauuuaauuuua

SEQ ID NO: 1758800 - RNA, 21 nt, Homo sapiens
acagaaagcuccuuccagacc

SEQ ID NO: 1758801 - RNA, 20 nt, Homo sapiens
augcuuugugacuuaagcag

SEQ ID NO: 1758802 - RNA, 19 nt, Homo sapiens
cccgagcuagagugcagug

SEQ ID NO: 1758803 - RNA, 13 nt, Homo sapiens
agcagccaggaga

SEQ ID NO: 1758804 - RNA, 20 nt, Homo sapiens
gagaagccaggaauuuccca

SEQ ID NO: 1758805 - RNA, 16 nt, Homo sapiens
cgaguggucacuguca

SEQ ID NO: 1758806 - RNA, 13 nt, Homo sapiens
cguuccuccucag

SEQ ID NO: 1758807 - RNA, 23 nt, Homo sapiens
ucucacugccaucaaacuguaaa

SEQ ID NO: 1758808 - RNA, 13 nt, Homo sapiens
aauaauccagaaa

SEQ ID NO: 1758809 - RNA, 14 nt, Homo sapiens
ucccgaggaacucg

SEQ ID NO: 1758810 - RNA, 14 nt, Homo sapiens
ccaaauguuuauaa

SEQ ID NO: 1758811 - RNA, 19 nt, Homo sapiens
aauauuuuuggucauugua

SEQ ID NO: 1758812 - RNA, 21 nt, Homo sapiens
ucugaggaucagcacugccag

SEQ ID NO: 1758813 - RNA, 22 nt, Homo sapiens
auuuaaaggggagauacucucc

SEQ ID NO: 1758814 - RNA, 16 nt, Homo sapiens
auucugcaccacaccu

SEQ ID NO: 1758815 - RNA, 20 nt, Homo sapiens
aauaguguccuaugcaauaa

SEQ ID NO: 1758816 - RNA, 14 nt, Homo sapiens
cccgucagcaucac

SEQ ID NO: 1758817 - RNA, 15 nt, Homo sapiens
uccugagacacaugg

SEQ ID NO: 1758818 - RNA, 21 nt, Homo sapiens
aagucuuguagaaaucucaga

SEQ ID NO: 1758819 - RNA, 21 nt, Homo sapiens
gagaaaacaugcagaacaaau

SEQ ID NO: 1758820 - RNA, 22 nt, Homo sapiens
ccucaugccuguaaucccagca

SEQ ID NO: 1758821 - RNA, 22 nt, Homo sapiens
agauuagcccuuccuugccagu

SEQ ID NO: 1758822 - RNA, 16 nt, Homo sapiens
acuuugaucucugcuu

SEQ ID NO: 1758823 - RNA, 21 nt, Homo sapiens
gcauuaaaguucuaggcauac

SEQ ID NO: 1758824 - RNA, 13 nt, Homo sapiens
cccaaagagcugu

SEQ ID NO: 1758825 - RNA, 14 nt, Homo sapiens
gaagagggucccuc

SEQ ID NO: 1758826 - RNA, 17 nt, Homo sapiens
ugcguaacuggcugugu

SEQ ID NO: 1758827 - RNA, 13 nt, Homo sapiens
ccacucaaaauag

SEQ ID NO: 1758828 - RNA, 15 nt, Homo sapiens
gaccucagcugcuuc

SEQ ID NO: 1758829 - RNA, 20 nt, Homo sapiens
agaguagcugggacuacaaa

SEQ ID NO: 1758830 - RNA, 23 nt, Homo sapiens
ucugcaggcuggggaggugcugg

SEQ ID NO: 1758831 - RNA, 20 nt, Homo sapiens
auaugauauauaaaugugau

SEQ ID NO: 1758832 - RNA, 22 nt, Homo sapiens
gcccuauccauucucuccuucc

SEQ ID NO: 1758833 - RNA, 13 nt, Homo sapiens
uuuaagcuguaaa

SEQ ID NO: 1758834 - RNA, 14 nt, Homo sapiens
uggagaaaaugggc

SEQ ID NO: 1758835 - RNA, 19 nt, Homo sapiens
gauuguaaaguagcuguaa

SEQ ID NO: 1758836 - RNA, 19 nt, Homo sapiens
guuucuuguuuaccaaaga

SEQ ID NO: 1758837 - RNA, 15 nt, Homo sapiens
uagaacagucauuaa

SEQ ID NO: 1758838 - RNA, 19 nt, Homo sapiens
agcaaaaacauguaugugc

SEQ ID NO: 1758839 - RNA, 20 nt, Homo sapiens
uuugccaaauaaaauauauu

SEQ ID NO: 1758840 - RNA, 19 nt, Homo sapiens
accaggggaccagagggau

SEQ ID NO: 1758841 - RNA, 14 nt, Homo sapiens
uuccuaaagccaaa

SEQ ID NO: 1758842 - RNA, 14 nt, Homo sapiens
ucaauaaaguacaa

SEQ ID NO: 1758843 - RNA, 19 nt, Homo sapiens
ucaagugaggugacacucc

SEQ ID NO: 1758844 - RNA, 19 nt, Homo sapiens
auaacaacacuguguuaua

SEQ ID NO: 1758845 - RNA, 21 nt, Homo sapiens
gaagcauuucagguugugcau

SEQ ID NO: 1758846 - RNA, 22 nt, Homo sapiens
caugacaggaguuugugugcaa

SEQ ID NO: 1758847 - RNA, 19 nt, Homo sapiens
uauaauuaaagaugccaua

SEQ ID NO: 1758848 - RNA, 16 nt, Homo sapiens
ugggcugcuagaagca

SEQ ID NO: 1758849 - RNA, 20 nt, Homo sapiens
aaguucagcaacuguuuaac

SEQ ID NO: 1758850 - RNA, 16 nt, Homo sapiens
cugugcguggggcucc

SEQ ID NO: 1758851 - RNA, 15 nt, Homo sapiens
cacugggagcacagc

SEQ ID NO: 1758852 - RNA, 18 nt, Homo sapiens
aacugagaccuccagaaa

SEQ ID NO: 1758853 - RNA, 21 nt, Homo sapiens
uauaucauagcaaauaaguca

SEQ ID NO: 1758854 - RNA, 13 nt, Homo sapiens
caauauaccuauc

SEQ ID NO: 1758855 - RNA, 12 nt, Homo sapiens
aaggauccucau

SEQ ID NO: 1758856 - RNA, 13 nt, Homo sapiens
uuccugagaccuc

SEQ ID NO: 1758857 - RNA, 22 nt, Homo sapiens
ugcuugagcucgggaguuugag

SEQ ID NO: 1758858 - RNA, 18 nt, Homo sapiens
ucuaugcagaacagugag

SEQ ID NO: 1758859 - RNA, 17 nt, Homo sapiens
cuugaaugugcaccuga

SEQ ID NO: 1758860 - RNA, 18 nt, Homo sapiens
uaagguuuguuuucauua

SEQ ID NO: 1758861 - RNA, 21 nt, Homo sapiens
cuaagauaauuaaaugaaaua

SEQ ID NO: 1758862 - RNA, 13 nt, Homo sapiens
cauuuuuaucccu

SEQ ID NO: 1758863 - RNA, 19 nt, Homo sapiens
ugggagcccaguuucacug

SEQ ID NO: 1758864 - RNA, 18 nt, Homo sapiens
aagaucugcaacuacuau

SEQ ID NO: 1758865 - RNA, 22 nt, Homo sapiens
cuggguaagaagaaagcaaaag

SEQ ID NO: 1758866 - RNA, 15 nt, Homo sapiens
ccauagucacauggc

SEQ ID NO: 1758867 - RNA, 18 nt, Homo sapiens
acuugugcccuuguauag

SEQ ID NO: 1758868 - RNA, 21 nt, Homo sapiens
aaauuuucuggugcuaagucu

SEQ ID NO: 1758869 - RNA, 16 nt, Homo sapiens
uguacccugcuguaua

SEQ ID NO: 1758870 - RNA, 23 nt, Homo sapiens
aguuaucaucucaccacaccaca

SEQ ID NO: 1758871 - RNA, 18 nt, Homo sapiens
caaccugggacuuccuaa

SEQ ID NO: 1758872 - RNA, 23 nt, Homo sapiens
ucuccccaugggaucuugaggga

SEQ ID NO: 1758873 - RNA, 18 nt, Homo sapiens
cuccacaaccaccuccag

SEQ ID NO: 1758874 - RNA, 17 nt, Homo sapiens
uguauacacacauauac

SEQ ID NO: 1758875 - RNA, 15 nt, Homo sapiens
agccaucuugaauau

SEQ ID NO: 1758876 - RNA, 22 nt, Homo sapiens
cagaugucuucugccuguuaua

SEQ ID NO: 1758877 - RNA, 15 nt, Homo sapiens
gacagaggaugagcu

SEQ ID NO: 1758878 - RNA, 14 nt, Homo sapiens
guuuguaagacuua

SEQ ID NO: 1758879 - RNA, 14 nt, Homo sapiens
ucuacuagccauug

SEQ ID NO: 1758880 - RNA, 12 nt, Homo sapiens
caaaauguguaa

SEQ ID NO: 1758881 - RNA, 22 nt, Homo sapiens
ucuugaagaagcucuuuugggu

SEQ ID NO: 1758882 - RNA, 14 nt, Homo sapiens
aacuuggacaugaa

SEQ ID NO: 1758883 - RNA, 20 nt, Homo sapiens
cucaacaaaacccaugcauu

SEQ ID NO: 1758884 - RNA, 18 nt, Homo sapiens
uucacugucgacauuuuc

SEQ ID NO: 1758885 - RNA, 12 nt, Homo sapiens
uuuaaggauaaa

SEQ ID NO: 1758886 - RNA, 16 nt, Homo sapiens
cagguuuguucucagg

SEQ ID NO: 1758887 - RNA, 16 nt, Homo sapiens
gaaacucuuucauucu

SEQ ID NO: 1758888 - RNA, 20 nt, Homo sapiens
gacuucuggcuuaugcucag

SEQ ID NO: 1758889 - RNA, 18 nt, Homo sapiens
uccagcaauacaguuuac

SEQ ID NO: 1758890 - RNA, 12 nt, Homo sapiens
acagaaugagac

SEQ ID NO: 1758891 - RNA, 20 nt, Homo sapiens
aaaagaauuacagacucuga

SEQ ID NO: 1758892 - RNA, 21 nt, Homo sapiens
uccaucuauugauaguuucau

SEQ ID NO: 1758893 - RNA, 21 nt, Homo sapiens
acaguaugagaagaaaaaugg

SEQ ID NO: 1758894 - RNA, 21 nt, Homo sapiens
aagcugugagacagugggaaa

SEQ ID NO: 1758895 - RNA, 22 nt, Homo sapiens
aagagcuggcaaagguggcucu

SEQ ID NO: 1758896 - RNA, 22 nt, Homo sapiens
cugacauggugcugugugugag

SEQ ID NO: 1758897 - RNA, 21 nt, Homo sapiens
uccaaaguuuuaaaccuguua

SEQ ID NO: 1758898 - RNA, 23 nt, Homo sapiens
ccauuuagaauaucuagcaugua

SEQ ID NO: 1758899 - RNA, 19 nt, Homo sapiens
acgacuaaucaccuacuca

SEQ ID NO: 1758900 - RNA, 19 nt, Homo sapiens
accaaagccaccaagacag

SEQ ID NO: 1758901 - RNA, 21 nt, Homo sapiens
ucacguuugaaucuaccauuc

SEQ ID NO: 1758902 - RNA, 18 nt, Homo sapiens
gcuagucugucagggccu

SEQ ID NO: 1758903 - RNA, 19 nt, Homo sapiens
uuuaauccuuaacacauuc

SEQ ID NO: 1758904 - RNA, 15 nt, Homo sapiens
uggagagguuuguca

SEQ ID NO: 1758905 - RNA, 16 nt, Homo sapiens
ucucuugcauugugac

SEQ ID NO: 1758906 - RNA, 17 nt, Homo sapiens
uaaaugauguacuacau

SEQ ID NO: 1758907 - RNA, 15 nt, Homo sapiens
gagagaaacacugcu

SEQ ID NO: 1758908 - RNA, 20 nt, Homo sapiens
uguagauucagguaauacaa

SEQ ID NO: 1758909 - RNA, 15 nt, Homo sapiens
aggugggcacuggag

SEQ ID NO: 1758910 - RNA, 13 nt, Homo sapiens
aaacuucagggau

SEQ ID NO: 1758911 - RNA, 16 nt, Homo sapiens
acuugucacccaaagc

SEQ ID NO: 1758912 - RNA, 24 nt, Homo sapiens
aacggcucagacaggcagauuuga

SEQ ID NO: 1758913 - RNA, 20 nt, Homo sapiens
aggcaaugauauggcauguc

SEQ ID NO: 1758914 - RNA, 23 nt, Homo sapiens
gaaaagaagacucugaccuguac

SEQ ID NO: 1758915 - RNA, 15 nt, Homo sapiens
acuugacuuugccac

SEQ ID NO: 1758916 - RNA, 18 nt, Homo sapiens
aguugauuuuacaauuga

SEQ ID NO: 1758917 - RNA, 20 nt, Homo sapiens
acucucuuccuuucauucua

SEQ ID NO: 1758918 - RNA, 20 nt, Homo sapiens
aauauuucccccuuacuacu

SEQ ID NO: 1758919 - RNA, 19 nt, Homo sapiens
uaaguaucuugugcuucuu

SEQ ID NO: 1758920 - RNA, 14 nt, Homo sapiens
acagugccauguua

SEQ ID NO: 1758921 - RNA, 21 nt, Homo sapiens
uaaagccaggaacagggacca

SEQ ID NO: 1758922 - RNA, 19 nt, Homo sapiens
acauucagauuuaccauaa

SEQ ID NO: 1758923 - RNA, 20 nt, Homo sapiens
uguguuguauuaacaaaagu

SEQ ID NO: 1758924 - RNA, 16 nt, Homo sapiens
aucaauuaaaggcaaa

SEQ ID NO: 1758925 - RNA, 19 nt, Homo sapiens
gagguggagucuugcucug

SEQ ID NO: 1758926 - RNA, 23 nt, Homo sapiens
uacuacuuuuacuacagugacaa

SEQ ID NO: 1758927 - RNA, 15 nt, Homo sapiens
ugacagcgcacagcu

SEQ ID NO: 1758928 - RNA, 20 nt, Homo sapiens
agaaaacguaaauaaacuaa

SEQ ID NO: 1758929 - RNA, 12 nt, Homo sapiens
ugguaaccucuu

SEQ ID NO: 1758930 - RNA, 17 nt, Homo sapiens
caaaaagaggcuaugug

SEQ ID NO: 1758931 - RNA, 13 nt, Homo sapiens
agggaaaagcagc

SEQ ID NO: 1758932 - RNA, 12 nt, Homo sapiens
ggacuccaugcu

SEQ ID NO: 1758933 - RNA, 14 nt, Homo sapiens
ggacagaacccucc

SEQ ID NO: 1758934 - RNA, 13 nt, Homo sapiens
aauugacuaaaaa

SEQ ID NO: 1758935 - RNA, 14 nt, Homo sapiens
ugccucauuucccu

SEQ ID NO: 1758936 - RNA, 16 nt, Homo sapiens
uaaaauaaaacacauu

SEQ ID NO: 1758937 - RNA, 17 nt, Homo sapiens
gagccuugucagugugu

SEQ ID NO: 1758938 - RNA, 17 nt, Homo sapiens
acuguuuauuacuucca

SEQ ID NO: 1758939 - RNA, 21 nt, Homo sapiens
uaggcuuuaggagcucuguaa

SEQ ID NO: 1758940 - RNA, 23 nt, Homo sapiens
aagcuuucuauugugacuuuuau

SEQ ID NO: 1758941 - RNA, 13 nt, Homo sapiens
ugauaaaccaaaa

SEQ ID NO: 1758942 - RNA, 13 nt, Homo sapiens
aauaaaacugugc

SEQ ID NO: 1758943 - RNA, 14 nt, Homo sapiens
ucucaacaaaugga

SEQ ID NO: 1758944 - RNA, 21 nt, Homo sapiens
uacguggaaacaauccuguua

SEQ ID NO: 1758945 - RNA, 20 nt, Homo sapiens
cuggcacuguggcacugcca

SEQ ID NO: 1758946 - RNA, 23 nt, Homo sapiens
caucaggguaggggagcauucug

SEQ ID NO: 1758947 - RNA, 17 nt, Homo sapiens
accacaagaaggaugau

SEQ ID NO: 1758948 - RNA, 21 nt, Homo sapiens
aaaagucauucaagagucuca

SEQ ID NO: 1758949 - RNA, 16 nt, Homo sapiens
uuccagcacuuugcaa

SEQ ID NO: 1758950 - RNA, 19 nt, Homo sapiens
auuuuuguacauuauguua

SEQ ID NO: 1758951 - RNA, 15 nt, Homo sapiens
aaguaaaacuuaaga

SEQ ID NO: 1758952 - RNA, 15 nt, Homo sapiens
auguagcacauaaac

SEQ ID NO: 1758953 - RNA, 14 nt, Homo sapiens
auauugugccccau

SEQ ID NO: 1758954 - RNA, 17 nt, Homo sapiens
ggacaaagugccaaaga

SEQ ID NO: 1758955 - RNA, 17 nt, Homo sapiens
gcuuuuugugauaugca

SEQ ID NO: 1758956 - RNA, 20 nt, Homo sapiens
cagaucacacacaugcacac

SEQ ID NO: 1758957 - RNA, 21 nt, Homo sapiens
ccaaguaacauuuugugguga

SEQ ID NO: 1758958 - RNA, 14 nt, Homo sapiens
agauugacaacgcc

SEQ ID NO: 1758959 - RNA, 13 nt, Homo sapiens
aaagauacuguau

SEQ ID NO: 1758960 - RNA, 18 nt, Homo sapiens
gaaaacugccauaacaua

SEQ ID NO: 1758961 - RNA, 15 nt, Homo sapiens
cagcggacaguggca

SEQ ID NO: 1758962 - RNA, 17 nt, Homo sapiens
cuugcucugagcacagg

SEQ ID NO: 1758963 - RNA, 15 nt, Homo sapiens
gacgacucugaccuc

SEQ ID NO: 1758964 - RNA, 18 nt, Homo sapiens
uauuguugacaacuguga

SEQ ID NO: 1758965 - RNA, 14 nt, Homo sapiens
ugcacacuuugcca

SEQ ID NO: 1758966 - RNA, 16 nt, Homo sapiens
uugcucucaaugcagg

SEQ ID NO: 1758967 - RNA, 11 nt, Homo sapiens
gaucacauugc

SEQ ID NO: 1758968 - RNA, 17 nt, Homo sapiens
ggucugggcagcaccuc

SEQ ID NO: 1758969 - RNA, 16 nt, Homo sapiens
auuucaagucuucuau

SEQ ID NO: 1758970 - RNA, 19 nt, Homo sapiens
ucaagaagucacugucaga

SEQ ID NO: 1758971 - RNA, 17 nt, Homo sapiens
caaaaugucuuguguau

SEQ ID NO: 1758972 - RNA, 14 nt, Homo sapiens
gccaaggcucucuc

SEQ ID NO: 1758973 - RNA, 20 nt, Homo sapiens
gacaacacagcaggacucca

SEQ ID NO: 1758974 - RNA, 14 nt, Homo sapiens
gaauaauaccuaag

SEQ ID NO: 1758975 - RNA, 14 nt, Homo sapiens
cauauguagcauua

SEQ ID NO: 1758976 - RNA, 17 nt, Homo sapiens
uguggaggacuuugaau

SEQ ID NO: 1758977 - RNA, 14 nt, Homo sapiens
ugaaauacugucua

SEQ ID NO: 1758978 - RNA, 15 nt, Homo sapiens
aucccuggggaugug

SEQ ID NO: 1758979 - RNA, 23 nt, Homo sapiens
acuacuugauauaauuacuuaau

SEQ ID NO: 1758980 - RNA, 17 nt, Homo sapiens
auguagaaagugaucca

SEQ ID NO: 1758981 - RNA, 19 nt, Homo sapiens
ugccagggcccaccccagc

SEQ ID NO: 1758982 - RNA, 20 nt, Homo sapiens
cacaggugcgggaccaucug

SEQ ID NO: 1758983 - RNA, 21 nt, Homo sapiens
guuucagcuaaaugcagggaa

SEQ ID NO: 1758984 - RNA, 16 nt, Homo sapiens
aauauaaacuauaauu

SEQ ID NO: 1758985 - RNA, 13 nt, Homo sapiens
auuucccuaaaaa

SEQ ID NO: 1758986 - RNA, 16 nt, Homo sapiens
aagcagguucuuguua

SEQ ID NO: 1758987 - RNA, 19 nt, Homo sapiens
ucuccagaauaauucuuaa

SEQ ID NO: 1758988 - RNA, 22 nt, Homo sapiens
auggaaugaccagccuguccaa

SEQ ID NO: 1758989 - RNA, 22 nt, Homo sapiens
cuucugucuguaucuaucucac

SEQ ID NO: 1758990 - RNA, 21 nt, Homo sapiens
ugaaggaaauucuuauaacuc

SEQ ID NO: 1758991 - RNA, 19 nt, Homo sapiens
guugcauagaauucacaau

SEQ ID NO: 1758992 - RNA, 14 nt, Homo sapiens
aagacucuuuauga

SEQ ID NO: 1758993 - RNA, 15 nt, Homo sapiens
uaauuggcaugaagg

SEQ ID NO: 1758994 - RNA, 21 nt, Homo sapiens
ccuauucugaaaaagacauaa

SEQ ID NO: 1758995 - RNA, 12 nt, Homo sapiens
agagacugagcc

SEQ ID NO: 1758996 - RNA, 11 nt, Homo sapiens
cacacacuccu

SEQ ID NO: 1758997 - RNA, 19 nt, Homo sapiens
accuugaugugccugugaa

SEQ ID NO: 1758998 - RNA, 19 nt, Homo sapiens
ccacuuaugcugcugugaa

SEQ ID NO: 1758999 - RNA, 18 nt, Homo sapiens
ugcuuuagccauacacau

SEQ ID NO: 1759000 - RNA, 17 nt, Homo sapiens
aaaggaggcucuucuca

SEQ ID NO: 1759001 - RNA, 14 nt, Homo sapiens
ucucuuuugcucau

SEQ ID NO: 1759002 - RNA, 23 nt, Homo sapiens
aaucucagauucuucacugguga

SEQ ID NO: 1759003 - RNA, 18 nt, Homo sapiens
uaaauacuguaacacugu

SEQ ID NO: 1759004 - RNA, 14 nt, Homo sapiens
uucaaauccugcca

SEQ ID NO: 1759005 - RNA, 19 nt, Homo sapiens
uuccaaauaauuugaacag

SEQ ID NO: 1759006 - RNA, 18 nt, Homo sapiens
uucuuucaaccuauacaa

SEQ ID NO: 1759007 - RNA, 20 nt, Homo sapiens
uggucauagaaacaauaaau

SEQ ID NO: 1759008 - RNA, 14 nt, Homo sapiens
cuugaagacuuccc

SEQ ID NO: 1759009 - RNA, 16 nt, Homo sapiens
ccccauuuuacagagg

SEQ ID NO: 1759010 - RNA, 16 nt, Homo sapiens
cuaaguuaccuuucua

SEQ ID NO: 1759011 - RNA, 21 nt, Homo sapiens
agagaaacucaccacaguguu

SEQ ID NO: 1759012 - RNA, 18 nt, Homo sapiens
acauagguaaaaacugga

SEQ ID NO: 1759013 - RNA, 23 nt, Homo sapiens
augaaccuggcaagucacaggac

SEQ ID NO: 1759014 - RNA, 12 nt, Homo sapiens
cuacuugagaua

SEQ ID NO: 1759015 - RNA, 16 nt, Homo sapiens
ccauuccaaagcuuua

SEQ ID NO: 1759016 - RNA, 16 nt, Homo sapiens
ccacccuaaagucuca

SEQ ID NO: 1759017 - RNA, 18 nt, Homo sapiens
gaaccauggugaacucca

SEQ ID NO: 1759018 - RNA, 15 nt, Homo sapiens
uucaacaaaccuuaa

SEQ ID NO: 1759019 - RNA, 13 nt, Homo sapiens
cacucuauccaaa

SEQ ID NO: 1759020 - RNA, 11 nt, Homo sapiens
uucugcugcuu

SEQ ID NO: 1759021 - RNA, 15 nt, Homo sapiens
uggucuggaauggac

SEQ ID NO: 1759022 - RNA, 20 nt, Homo sapiens
caaauccugucggucuccag

SEQ ID NO: 1759023 - RNA, 22 nt, Homo sapiens
gucuccugucuucagagcaaaa

SEQ ID NO: 1759024 - RNA, 22 nt, Homo sapiens
ugaaaagauucuucuguguuua

SEQ ID NO: 1759025 - RNA, 20 nt, Homo sapiens
ucaggagagugugcaacugg

SEQ ID NO: 1759026 - RNA, 14 nt, Homo sapiens
uaguaacaauacau

SEQ ID NO: 1759027 - RNA, 19 nt, Homo sapiens
cguguucacucagcacuuu

SEQ ID NO: 1759028 - RNA, 14 nt, Homo sapiens
aaaaaccagccacu

SEQ ID NO: 1759029 - RNA, 14 nt, Homo sapiens
aacuaaauaaagcu

SEQ ID NO: 1759030 - RNA, 15 nt, Homo sapiens
caaucagugcaguga

SEQ ID NO: 1759031 - RNA, 18 nt, Homo sapiens
ucccagcucagugccaaa

SEQ ID NO: 1759032 - RNA, 22 nt, Homo sapiens
aucuccaggccccuuaccugca

SEQ ID NO: 1759033 - RNA, 13 nt, Homo sapiens
cugaaaauucaac

SEQ ID NO: 1759034 - RNA, 22 nt, Homo sapiens
uuucuaaagcucugaacaaaag

SEQ ID NO: 1759035 - RNA, 18 nt, Homo sapiens
agauagaugguacucucc

SEQ ID NO: 1759036 - RNA, 17 nt, Homo sapiens
uguaauauauaaucaaa

SEQ ID NO: 1759037 - RNA, 15 nt, Homo sapiens
ugacugguugucaga

SEQ ID NO: 1759038 - RNA, 16 nt, Homo sapiens
auucacagauaccucu

SEQ ID NO: 1759039 - RNA, 14 nt, Homo sapiens
uggcucacugcaac

SEQ ID NO: 1759040 - RNA, 17 nt, Homo sapiens
gugcauuuaugagcucu

SEQ ID NO: 1759041 - RNA, 13 nt, Homo sapiens
uaaaauacaaaca

SEQ ID NO: 1759042 - RNA, 13 nt, Homo sapiens
cuuuuuugccaaa

SEQ ID NO: 1759043 - RNA, 14 nt, Homo sapiens
uuugaaauccaaag

SEQ ID NO: 1759044 - RNA, 21 nt, Homo sapiens
auauauaucccuuuacauaua

SEQ ID NO: 1759045 - RNA, 21 nt, Homo sapiens
ugccaggcacuguucaucuca

SEQ ID NO: 1759046 - RNA, 17 nt, Homo sapiens
auuaacaugauguacua

SEQ ID NO: 1759047 - RNA, 17 nt, Homo sapiens
aucugucccacugggac

SEQ ID NO: 1759048 - RNA, 22 nt, Homo sapiens
ggcacaaacugcagcugugagu

SEQ ID NO: 1759049 - RNA, 15 nt, Homo sapiens
auauucuggccagac

SEQ ID NO: 1759050 - RNA, 21 nt, Homo sapiens
gaaagaaauucuuuucaaaag

SEQ ID NO: 1759051 - RNA, 13 nt, Homo sapiens
gcuguuaaacugu

SEQ ID NO: 1759052 - RNA, 14 nt, Homo sapiens
caauaaaggcaccu

SEQ ID NO: 1759053 - RNA, 21 nt, Homo sapiens
ugccuuccaaccccuuuccac

SEQ ID NO: 1759054 - RNA, 12 nt, Homo sapiens
accggggaaccc

SEQ ID NO: 1759055 - RNA, 21 nt, Homo sapiens
agaaaagugcauauuuaucca

SEQ ID NO: 1759056 - RNA, 17 nt, Homo sapiens
auuugcauugggcauua

SEQ ID NO: 1759057 - RNA, 19 nt, Homo sapiens
uauuuauuggggaucugca

SEQ ID NO: 1759058 - RNA, 16 nt, Homo sapiens
aauuaagaauguucuc

SEQ ID NO: 1759059 - RNA, 17 nt, Homo sapiens
ccauuagcccacugccu

SEQ ID NO: 1759060 - RNA, 14 nt, Homo sapiens
cuacuaacagauua

SEQ ID NO: 1759061 - RNA, 23 nt, Homo sapiens
gaagccuuuuuuuaguaaauccu

SEQ ID NO: 1759062 - RNA, 12 nt, Homo sapiens
aaaggacgaugg

SEQ ID NO: 1759063 - RNA, 23 nt, Homo sapiens
gauguauauuugaacuccucuca

SEQ ID NO: 1759064 - RNA, 21 nt, Homo sapiens
cauggugacuaacaguuacau

SEQ ID NO: 1759065 - RNA, 16 nt, Homo sapiens
ugucuacucauccaga

SEQ ID NO: 1759066 - RNA, 22 nt, Homo sapiens
acuguggccucauuagauuaca

SEQ ID NO: 1759067 - RNA, 20 nt, Homo sapiens
gcuauagaaugagugcaggu

SEQ ID NO: 1759068 - RNA, 17 nt, Homo sapiens
cggguaccaugcugccc

SEQ ID NO: 1759069 - RNA, 12 nt, Homo sapiens
ugcaaagccagu

SEQ ID NO: 1759070 - RNA, 21 nt, Homo sapiens
cagucaugcguccacuuuccc

SEQ ID NO: 1759071 - RNA, 22 nt, Homo sapiens
ucuggucauaaugaacacucau

SEQ ID NO: 1759072 - RNA, 20 nt, Homo sapiens
gaauagccauauuuguaaaa

SEQ ID NO: 1759073 - RNA, 16 nt, Homo sapiens
aauugucuuuugucau

SEQ ID NO: 1759074 - RNA, 21 nt, Homo sapiens
uucaaaauaagaaaauaaccu

SEQ ID NO: 1759075 - RNA, 22 nt, Homo sapiens
gucccuuugagcagaaauuuau

SEQ ID NO: 1759076 - RNA, 16 nt, Homo sapiens
gaguuuugcaaagugc

SEQ ID NO: 1759077 - RNA, 15 nt, Homo sapiens
uaaaccacagcacua

SEQ ID NO: 1759078 - RNA, 23 nt, Homo sapiens
agugaugucaaauugacuguaau

SEQ ID NO: 1759079 - RNA, 17 nt, Homo sapiens
cugcuuuggaaaucaca

SEQ ID NO: 1759080 - RNA, 18 nt, Homo sapiens
ggaaaauucucuuaauca

SEQ ID NO: 1759081 - RNA, 17 nt, Homo sapiens
ucagugaaguugcugcu

SEQ ID NO: 1759082 - RNA, 17 nt, Homo sapiens
uuguaucaaagugugau

SEQ ID NO: 1759083 - RNA, 17 nt, Homo sapiens
aaauauguauaugucua

SEQ ID NO: 1759084 - RNA, 13 nt, Homo sapiens
uccaagcuguguu

SEQ ID NO: 1759085 - RNA, 17 nt, Homo sapiens
agacugaaucuaccugc

SEQ ID NO: 1759086 - RNA, 23 nt, Homo sapiens
acugguggaucuaagaagggcug

SEQ ID NO: 1759087 - RNA, 16 nt, Homo sapiens
aaguguuuagcuguca

SEQ ID NO: 1759088 - RNA, 19 nt, Homo sapiens
agaaaaucaaauauauaac

SEQ ID NO: 1759089 - RNA, 16 nt, Homo sapiens
gaugcuauuuaugcaa

SEQ ID NO: 1759090 - RNA, 18 nt, Homo sapiens
caggaaaguggcaccugu

SEQ ID NO: 1759091 - RNA, 16 nt, Homo sapiens
ccauggggaagggaua

SEQ ID NO: 1759092 - RNA, 19 nt, Homo sapiens
cagaaggcaaaaagacauu

SEQ ID NO: 1759093 - RNA, 15 nt, Homo sapiens
uaccauucagcauga

SEQ ID NO: 1759094 - RNA, 23 nt, Homo sapiens
gcuggcagcuucgugugcagcua

SEQ ID NO: 1759095 - RNA, 17 nt, Homo sapiens
cucccagaacacacucc

SEQ ID NO: 1759096 - RNA, 12 nt, Homo sapiens
uaaaccaaaaau

SEQ ID NO: 1759097 - RNA, 18 nt, Homo sapiens
uucuucagauauacugga

SEQ ID NO: 1759098 - RNA, 22 nt, Homo sapiens
auaacuguauuugaaauaagaa

SEQ ID NO: 1759099 - RNA, 18 nt, Homo sapiens
ucacccagccucuuuauu

SEQ ID NO: 1759100 - RNA, 15 nt, Homo sapiens
agaauuaacagagau

SEQ ID NO: 1759101 - RNA, 20 nt, Homo sapiens
uccuguauuuaacaaaaagu

SEQ ID NO: 1759102 - RNA, 15 nt, Homo sapiens
uauuguuaguucuca

SEQ ID NO: 1759103 - RNA, 22 nt, Homo sapiens
augagauaugcaauaaauauua

SEQ ID NO: 1759104 - RNA, 18 nt, Homo sapiens
gugugacuucuuacacau

SEQ ID NO: 1759105 - RNA, 17 nt, Homo sapiens
auugcaacaaaauacau

SEQ ID NO: 1759106 - RNA, 13 nt, Homo sapiens
uccaaaagccagu

SEQ ID NO: 1759107 - RNA, 14 nt, Homo sapiens
auugacccuagcca

SEQ ID NO: 1759108 - RNA, 17 nt, Homo sapiens
uaagaaacuagcagauu

SEQ ID NO: 1759109 - RNA, 20 nt, Homo sapiens
auuucaaaugugcugucaaa

SEQ ID NO: 1759110 - RNA, 19 nt, Homo sapiens
cagaaacagugcaaggaag

SEQ ID NO: 1759111 - RNA, 23 nt, Homo sapiens
ccagugccucucccugcugcucc

SEQ ID NO: 1759112 - RNA, 18 nt, Homo sapiens
accucguacucaggagcc

SEQ ID NO: 1759113 - RNA, 20 nt, Homo sapiens
acaugcuaccugaucccacu

SEQ ID NO: 1759114 - RNA, 23 nt, Homo sapiens
cauaagggguuugccauuugaua

SEQ ID NO: 1759115 - RNA, 16 nt, Homo sapiens
auacuagacucauacu

SEQ ID NO: 1759116 - RNA, 18 nt, Homo sapiens
gaaugcagaggucuccaa

SEQ ID NO: 1759117 - RNA, 23 nt, Homo sapiens
uguucaguguugacauagccuuu

SEQ ID NO: 1759118 - RNA, 20 nt, Homo sapiens
aagccagcaggcucucaggc

SEQ ID NO: 1759119 - RNA, 22 nt, Homo sapiens
uuucacaaucauguacugggaa

SEQ ID NO: 1759120 - RNA, 19 nt, Homo sapiens
cuuucccuuuaucaguuug

SEQ ID NO: 1759121 - RNA, 17 nt, Homo sapiens
ccugccuuugaaauucc

SEQ ID NO: 1759122 - RNA, 23 nt, Homo sapiens
ugaagaacugcaggcccuggccu

SEQ ID NO: 1759123 - RNA, 15 nt, Homo sapiens
uccuggcuacuccau

SEQ ID NO: 1759124 - RNA, 20 nt, Homo sapiens
uacauaacuccugucccuuu

SEQ ID NO: 1759125 - RNA, 14 nt, Homo sapiens
uuguaaacauuucu

SEQ ID NO: 1759126 - RNA, 21 nt, Homo sapiens
ugacauaccuaccaguauuau

SEQ ID NO: 1759127 - RNA, 23 nt, Homo sapiens
uuuaaucaaucuuugugccucaa

SEQ ID NO: 1759128 - RNA, 14 nt, Homo sapiens
guuaauauuugaau

SEQ ID NO: 1759129 - RNA, 17 nt, Homo sapiens
caugcuugacauaccua

SEQ ID NO: 1759130 - RNA, 18 nt, Homo sapiens
cuaacacaguugacccua

SEQ ID NO: 1759131 - RNA, 18 nt, Homo sapiens
aggcauccucugacucca

SEQ ID NO: 1759132 - RNA, 22 nt, Homo sapiens
uguaugagacaggaaaaaccaa

SEQ ID NO: 1759133 - RNA, 14 nt, Homo sapiens
acagagggccagua

SEQ ID NO: 1759134 - RNA, 20 nt, Homo sapiens
acugccucucccucuggucc

SEQ ID NO: 1759135 - RNA, 13 nt, Homo sapiens
aauuaaaccagac

SEQ ID NO: 1759136 - RNA, 21 nt, Homo sapiens
acuuagguggcaagcugugac

SEQ ID NO: 1759137 - RNA, 23 nt, Homo sapiens
cagcuuaauaaguauuuauugca

SEQ ID NO: 1759138 - RNA, 23 nt, Homo sapiens
uauuaacacuaauaauaguacua

SEQ ID NO: 1759139 - RNA, 14 nt, Homo sapiens
augcccacugagga

SEQ ID NO: 1759140 - RNA, 14 nt, Homo sapiens
uguucccugacucc

SEQ ID NO: 1759141 - RNA, 17 nt, Homo sapiens
auaaacuuguacuuaca

SEQ ID NO: 1759142 - RNA, 22 nt, Homo sapiens
aggacaugauacugaugccaug

SEQ ID NO: 1759143 - RNA, 22 nt, Homo sapiens
gugagagugggagggagguaac

SEQ ID NO: 1759144 - RNA, 20 nt, Homo sapiens
auugucuccuugguuauauu

SEQ ID NO: 1759145 - RNA, 13 nt, Homo sapiens
caaauaaaaucua

SEQ ID NO: 1759146 - RNA, 17 nt, Homo sapiens
ccuggguugugcugaca

SEQ ID NO: 1759147 - RNA, 20 nt, Homo sapiens
uuuaccauagaaagaugaca

SEQ ID NO: 1759148 - RNA, 19 nt, Homo sapiens
aauuuaaaggguguacuua

SEQ ID NO: 1759149 - RNA, 16 nt, Homo sapiens
gaagucugucucagga

SEQ ID NO: 1759150 - RNA, 15 nt, Homo sapiens
gcauaccacaagaca

SEQ ID NO: 1759151 - RNA, 21 nt, Homo sapiens
ccuuuaauuugcuacugucau

SEQ ID NO: 1759152 - RNA, 22 nt, Homo sapiens
cuuggacaggagucagugucug

SEQ ID NO: 1759153 - RNA, 21 nt, Homo sapiens
ucauuuuuuuuuuaucagagu

SEQ ID NO: 1759154 - RNA, 20 nt, Homo sapiens
gccagucaggcccaggcacu

SEQ ID NO: 1759155 - RNA, 13 nt, Homo sapiens
cgccggcuuucag

SEQ ID NO: 1759156 - RNA, 19 nt, Homo sapiens
cccugaaacaucucaacaa

SEQ ID NO: 1759157 - RNA, 16 nt, Homo sapiens
guaagaaacacacuga

SEQ ID NO: 1759158 - RNA, 12 nt, Homo sapiens
gcuuccauucca

SEQ ID NO: 1759159 - RNA, 22 nt, Homo sapiens
ucuuccuuagcuaaaugcaauu

SEQ ID NO: 1759160 - RNA, 14 nt, Homo sapiens
agaaucaaaaugca

SEQ ID NO: 1759161 - RNA, 19 nt, Homo sapiens
ugcagcaccucucaggauu

SEQ ID NO: 1759162 - RNA, 17 nt, Homo sapiens
cacuuuaacacaguguc

SEQ ID NO: 1759163 - RNA, 15 nt, Homo sapiens
ggcucuaacgccuga

SEQ ID NO: 1759164 - RNA, 17 nt, Homo sapiens
ugggaacugaauugugu

SEQ ID NO: 1759165 - RNA, 13 nt, Homo sapiens
gaaacccacaguu

SEQ ID NO: 1759166 - RNA, 13 nt, Homo sapiens
augugccauuuau

SEQ ID NO: 1759167 - RNA, 18 nt, Homo sapiens
auuguguuggcuuuacaa

SEQ ID NO: 1759168 - RNA, 18 nt, Homo sapiens
gucauacgaaccuaaaga

SEQ ID NO: 1759169 - RNA, 21 nt, Homo sapiens
ucuuauccuagcacaugcuuc

SEQ ID NO: 1759170 - RNA, 15 nt, Homo sapiens
aauauauuuugccau

SEQ ID NO: 1759171 - RNA, 15 nt, Homo sapiens
aaguaagagcucuaa

SEQ ID NO: 1759172 - RNA, 18 nt, Homo sapiens
auucuacuucagcuuugg

SEQ ID NO: 1759173 - RNA, 14 nt, Homo sapiens
acggaggccugcga

SEQ ID NO: 1759174 - RNA, 18 nt, Homo sapiens
ucuucaagacgacagcuc

SEQ ID NO: 1759175 - RNA, 16 nt, Homo sapiens
uguuguucugcucaau

SEQ ID NO: 1759176 - RNA, 15 nt, Homo sapiens
uaucuacagaacugg

SEQ ID NO: 1759177 - RNA, 19 nt, Homo sapiens
cagguucucuuugagucaa

SEQ ID NO: 1759178 - RNA, 14 nt, Homo sapiens
cuaauuucauucaa

SEQ ID NO: 1759179 - RNA, 16 nt, Homo sapiens
uuuaggagaaagugua

SEQ ID NO: 1759180 - RNA, 11 nt, Homo sapiens
uugacccugca

SEQ ID NO: 1759181 - RNA, 21 nt, Homo sapiens
guugguuguuuuuuccuuugc

SEQ ID NO: 1759182 - RNA, 16 nt, Homo sapiens
ucaucaaaaacacucu

SEQ ID NO: 1759183 - RNA, 16 nt, Homo sapiens
gccacagucacuggau

SEQ ID NO: 1759184 - RNA, 23 nt, Homo sapiens
gaggcagcaccaccacacaguca

SEQ ID NO: 1759185 - RNA, 20 nt, Homo sapiens
caugacucguauaugucuca

SEQ ID NO: 1759186 - RNA, 16 nt, Homo sapiens
uuuucauuuuccaaua

SEQ ID NO: 1759187 - RNA, 15 nt, Homo sapiens
agccacaccaggaua

SEQ ID NO: 1759188 - RNA, 17 nt, Homo sapiens
agguuuccuaggucuga

SEQ ID NO: 1759189 - RNA, 13 nt, Homo sapiens
gugaugcauguag

SEQ ID NO: 1759190 - RNA, 22 nt, Homo sapiens
agauaacagcuuaacauuuaca

SEQ ID NO: 1759191 - RNA, 21 nt, Homo sapiens
gaacagcuucauguucccaaa

SEQ ID NO: 1759192 - RNA, 15 nt, Homo sapiens
ccaugaucucaauag

SEQ ID NO: 1759193 - RNA, 16 nt, Homo sapiens
ugccugagaaagcaua

SEQ ID NO: 1759194 - RNA, 23 nt, Homo sapiens
acucaaagaaaacugucugggag

SEQ ID NO: 1759195 - RNA, 21 nt, Homo sapiens
uuguuguuucuuaauuuggaa

SEQ ID NO: 1759196 - RNA, 14 nt, Homo sapiens
accauucucaggug

SEQ ID NO: 1759197 - RNA, 16 nt, Homo sapiens
agacagagacagagag

SEQ ID NO: 1759198 - RNA, 22 nt, Homo sapiens
ccaccaaugggccuccagagac

SEQ ID NO: 1759199 - RNA, 23 nt, Homo sapiens
uuggagaaggcccacugaggcag

SEQ ID NO: 1759200 - RNA, 21 nt, Homo sapiens
uagaaugagcacccauuccaa

SEQ ID NO: 1759201 - RNA, 17 nt, Homo sapiens
gaauugugucugcagga

SEQ ID NO: 1759202 - RNA, 15 nt, Homo sapiens
ccaucuguacuuugg

SEQ ID NO: 1759203 - RNA, 16 nt, Homo sapiens
aagaauguacauuacc

SEQ ID NO: 1759204 - RNA, 15 nt, Homo sapiens
uaguuuucagccuug

SEQ ID NO: 1759205 - RNA, 21 nt, Homo sapiens
uauaaauuuuauaacagaauu

SEQ ID NO: 1759206 - RNA, 16 nt, Homo sapiens
acacacacacacaucc

SEQ ID NO: 1759207 - RNA, 19 nt, Homo sapiens
cccucaaaaaaagccuuua

SEQ ID NO: 1759208 - RNA, 23 nt, Homo sapiens
uaacagggucucuagugcuguga

SEQ ID NO: 1759209 - RNA, 18 nt, Homo sapiens
guucuguaucuacuuuaa

SEQ ID NO: 1759210 - RNA, 21 nt, Homo sapiens
ugccucccacccuucucaggg

SEQ ID NO: 1759211 - RNA, 13 nt, Homo sapiens
cauaaagcauuuu

SEQ ID NO: 1759212 - RNA, 23 nt, Homo sapiens
ugugacucuaagcucagugcucu

SEQ ID NO: 1759213 - RNA, 17 nt, Homo sapiens
uggcauuuguugugacu

SEQ ID NO: 1759214 - RNA, 22 nt, Homo sapiens
agauguguucaggcauuccagg

SEQ ID NO: 1759215 - RNA, 21 nt, Homo sapiens
uccugccacuguguaacauag

SEQ ID NO: 1759216 - RNA, 15 nt, Homo sapiens
uguccuucauccaau

SEQ ID NO: 1759217 - RNA, 22 nt, Homo sapiens
uuacugugucaggaaacauauu

SEQ ID NO: 1759218 - RNA, 16 nt, Homo sapiens
aaaguaggaaagaauu

SEQ ID NO: 1759219 - RNA, 20 nt, Homo sapiens
uagauuuuguuauguucaau

SEQ ID NO: 1759220 - RNA, 21 nt, Homo sapiens
ucugugcagaugcuuugccca

SEQ ID NO: 1759221 - RNA, 17 nt, Homo sapiens
ucccuuucucccaguga

SEQ ID NO: 1759222 - RNA, 15 nt, Homo sapiens
uaacucuggugcucu

SEQ ID NO: 1759223 - RNA, 23 nt, Homo sapiens
accaggaggguuugguuagcuca

SEQ ID NO: 1759224 - RNA, 10 nt, Homo sapiens
aagcccucca

SEQ ID NO: 1759225 - RNA, 16 nt, Homo sapiens
ggagacuuuacaugga

SEQ ID NO: 1759226 - RNA, 19 nt, Homo sapiens
auacaauuauuuuuacagu

SEQ ID NO: 1759227 - RNA, 17 nt, Homo sapiens
ugcccaggaagagccau

SEQ ID NO: 1759228 - RNA, 18 nt, Homo sapiens
cacuggcagcaucuucac

SEQ ID NO: 1759229 - RNA, 16 nt, Homo sapiens
cauccccaacuccaug

SEQ ID NO: 1759230 - RNA, 21 nt, Homo sapiens
uggguccucggucuuaccccc

SEQ ID NO: 1759231 - RNA, 16 nt, Homo sapiens
augaagggaagugcau

SEQ ID NO: 1759232 - RNA, 23 nt, Homo sapiens
aguggggcccuucucugcaguca

SEQ ID NO: 1759233 - RNA, 20 nt, Homo sapiens
caaauuuguaauaaaacuau

SEQ ID NO: 1759234 - RNA, 17 nt, Homo sapiens
ucucguugccucugauu

SEQ ID NO: 1759235 - RNA, 14 nt, Homo sapiens
cacaacuccuucca

SEQ ID NO: 1759236 - RNA, 18 nt, Homo sapiens
uggagaugaggugcucaa

SEQ ID NO: 1759237 - RNA, 21 nt, Homo sapiens
auaaaguaccacacauauugc

SEQ ID NO: 1759238 - RNA, 10 nt, Homo sapiens
uccaaaaaga

SEQ ID NO: 1759239 - RNA, 19 nt, Homo sapiens
gccaccucccucugccagu

SEQ ID NO: 1759240 - RNA, 20 nt, Homo sapiens
uagauaaagauuucuaguag

SEQ ID NO: 1759241 - RNA, 13 nt, Homo sapiens
ucacucacauuga

SEQ ID NO: 1759242 - RNA, 20 nt, Homo sapiens
uauuaaaaauaggugugauu

SEQ ID NO: 1759243 - RNA, 13 nt, Homo sapiens
augaagugcuaca

SEQ ID NO: 1759244 - RNA, 14 nt, Homo sapiens
gcaucuccccucag

SEQ ID NO: 1759245 - RNA, 20 nt, Homo sapiens
gcgagcacuuuccacuucca

SEQ ID NO: 1759246 - RNA, 14 nt, Homo sapiens
cuucacgucccugg

SEQ ID NO: 1759247 - RNA, 18 nt, Homo sapiens
ucaguuacucagcccugg

SEQ ID NO: 1759248 - RNA, 14 nt, Homo sapiens
cuucaagcagggaa

SEQ ID NO: 1759249 - RNA, 22 nt, Homo sapiens
gaugugaguuuaaucuuuucag

SEQ ID NO: 1759250 - RNA, 14 nt, Homo sapiens
auguguauaaacug

SEQ ID NO: 1759251 - RNA, 19 nt, Homo sapiens
agggaugggagaguggcuu

SEQ ID NO: 1759252 - RNA, 14 nt, Homo sapiens
ugcuaauaccaaaa

SEQ ID NO: 1759253 - RNA, 21 nt, Homo sapiens
uugaauggguccauuuugccc

SEQ ID NO: 1759254 - RNA, 13 nt, Homo sapiens
auauguccaguca

SEQ ID NO: 1759255 - RNA, 18 nt, Homo sapiens
aacauuaaacacuguaau

SEQ ID NO: 1759256 - RNA, 18 nt, Homo sapiens
cucauuuacaacugaaac

SEQ ID NO: 1759257 - RNA, 21 nt, Homo sapiens
aaccccuagagacagugaugc

SEQ ID NO: 1759258 - RNA, 16 nt, Homo sapiens
uugacauaauuucacu

SEQ ID NO: 1759259 - RNA, 17 nt, Homo sapiens
ggagaaccaccauucac

SEQ ID NO: 1759260 - RNA, 22 nt, Homo sapiens
ccauaggcccagugagaugcau

SEQ ID NO: 1759261 - RNA, 16 nt, Homo sapiens
aucuuugggccugucc

SEQ ID NO: 1759262 - RNA, 13 nt, Homo sapiens
ggccaagccacuc

SEQ ID NO: 1759263 - RNA, 14 nt, Homo sapiens
uuuaauugagauga

SEQ ID NO: 1759264 - RNA, 13 nt, Homo sapiens
auuguaacuaaua

SEQ ID NO: 1759265 - RNA, 19 nt, Homo sapiens
gaggggaaggacgccucca

SEQ ID NO: 1759266 - RNA, 12 nt, Homo sapiens
cuuccuacccug

SEQ ID NO: 1759267 - RNA, 16 nt, Homo sapiens
ccuaggagacuaggag

SEQ ID NO: 1759268 - RNA, 16 nt, Homo sapiens
cugcacacaugcacac

SEQ ID NO: 1759269 - RNA, 19 nt, Homo sapiens
cacagauuauguuccugcu

SEQ ID NO: 1759270 - RNA, 18 nt, Homo sapiens
agauaauuaaaauucaua

SEQ ID NO: 1759271 - RNA, 13 nt, Homo sapiens
aggagguggcuuc

SEQ ID NO: 1759272 - RNA, 17 nt, Homo sapiens
uggguuagcuaaaccaa

SEQ ID NO: 1759273 - RNA, 17 nt, Homo sapiens
caaaauauagcuuucau

SEQ ID NO: 1759274 - RNA, 21 nt, Homo sapiens
gggaagggagccaagggaugg

SEQ ID NO: 1759275 - RNA, 13 nt, Homo sapiens
aagacuagccugg

SEQ ID NO: 1759276 - RNA, 14 nt, Homo sapiens
ucacucuuguggau

SEQ ID NO: 1759277 - RNA, 22 nt, Homo sapiens
aaaaguugaaccauuauacuuu

SEQ ID NO: 1759278 - RNA, 13 nt, Homo sapiens
uauuuugaauuca

SEQ ID NO: 1759279 - RNA, 18 nt, Homo sapiens
agacaccuguucacagaa

SEQ ID NO: 1759280 - RNA, 23 nt, Homo sapiens
aaagcuacaauauucucucuuau

SEQ ID NO: 1759281 - RNA, 14 nt, Homo sapiens
ccacuugucaucca

SEQ ID NO: 1759282 - RNA, 22 nt, Homo sapiens
auguaugcaaaccucaucuuuc

SEQ ID NO: 1759283 - RNA, 19 nt, Homo sapiens
ucacuuuagaaagccagca

SEQ ID NO: 1759284 - RNA, 14 nt, Homo sapiens
ccugcucccacaga

SEQ ID NO: 1759285 - RNA, 23 nt, Homo sapiens
ccaucgaccuggagacugacaac

SEQ ID NO: 1759286 - RNA, 21 nt, Homo sapiens
aacucuggagaguaagaauau

SEQ ID NO: 1759287 - RNA, 18 nt, Homo sapiens
cucaugaccucucagaau

SEQ ID NO: 1759288 - RNA, 14 nt, Homo sapiens
ucagucuuggaguu

SEQ ID NO: 1759289 - RNA, 22 nt, Homo sapiens
gucuaacuggggauauaauacu

SEQ ID NO: 1759290 - RNA, 14 nt, Homo sapiens
uuaaaugcuacuga

SEQ ID NO: 1759291 - RNA, 23 nt, Homo sapiens
aauucagugauggcaacacugaa

SEQ ID NO: 1759292 - RNA, 21 nt, Homo sapiens
aacaaccagcaucccuugacc

SEQ ID NO: 1759293 - RNA, 15 nt, Homo sapiens
agauguggagcuauu

SEQ ID NO: 1759294 - RNA, 12 nt, Homo sapiens
caauaaucucac

SEQ ID NO: 1759295 - RNA, 14 nt, Homo sapiens
agccgaaguugcac

SEQ ID NO: 1759296 - RNA, 19 nt, Homo sapiens
gaaguuccaguguucucuc

SEQ ID NO: 1759297 - RNA, 12 nt, Homo sapiens
ccucccauguca

SEQ ID NO: 1759298 - RNA, 12 nt, Homo sapiens
gcucuggcaaga

SEQ ID NO: 1759299 - RNA, 15 nt, Homo sapiens
aacacccuuaugaau

SEQ ID NO: 1759300 - RNA, 14 nt, Homo sapiens
agaagcaaaccgcc

SEQ ID NO: 1759301 - RNA, 21 nt, Homo sapiens
agaucucccuuaauaaacuca

SEQ ID NO: 1759302 - RNA, 16 nt, Homo sapiens
ugcauuuuugugaaau

SEQ ID NO: 1759303 - RNA, 19 nt, Homo sapiens
ucauauuauaaauuucuaa

SEQ ID NO: 1759304 - RNA, 18 nt, Homo sapiens
ccacaggcccuuuccuca

SEQ ID NO: 1759305 - RNA, 22 nt, Homo sapiens
ucaaucaugcuguguaauauca

SEQ ID NO: 1759306 - RNA, 21 nt, Homo sapiens
uaaacacacaaguagauugau

SEQ ID NO: 1759307 - RNA, 20 nt, Homo sapiens
ugacuguguguggaggaguc

SEQ ID NO: 1759308 - RNA, 17 nt, Homo sapiens
gcucucaucacuaccuu

SEQ ID NO: 1759309 - RNA, 13 nt, Homo sapiens
caagaaaaauaau

SEQ ID NO: 1759310 - RNA, 17 nt, Homo sapiens
aauucuauucugaucuu

SEQ ID NO: 1759311 - RNA, 20 nt, Homo sapiens
ugaauccagugaaaauaagc

SEQ ID NO: 1759312 - RNA, 22 nt, Homo sapiens
guuuacaggcccugcuccugca

SEQ ID NO: 1759313 - RNA, 21 nt, Homo sapiens
accuuacuuucccauuguaac

SEQ ID NO: 1759314 - RNA, 15 nt, Homo sapiens
agcuucuuugccaag

SEQ ID NO: 1759315 - RNA, 14 nt, Homo sapiens
gcagcuucugggac

SEQ ID NO: 1759316 - RNA, 11 nt, Homo sapiens
uuuaugugcaa

SEQ ID NO: 1759317 - RNA, 18 nt, Homo sapiens
caaaaguuucuuacucaa

SEQ ID NO: 1759318 - RNA, 21 nt, Homo sapiens
cuguugcugaaaccauacagc

SEQ ID NO: 1759319 - RNA, 22 nt, Homo sapiens
uccaacucagauugagcccuac

SEQ ID NO: 1759320 - RNA, 21 nt, Homo sapiens
gaaaaaaaaaagaaaugcaaa

SEQ ID NO: 1759321 - RNA, 12 nt, Homo sapiens
auuuaagugaau

SEQ ID NO: 1759322 - RNA, 15 nt, Homo sapiens
gagauggccaugcuc

SEQ ID NO: 1759323 - RNA, 16 nt, Homo sapiens
gccuaaucaagucaaa

SEQ ID NO: 1759324 - RNA, 19 nt, Homo sapiens
uggaagagggcgaguucag

SEQ ID NO: 1759325 - RNA, 15 nt, Homo sapiens
ccagagccucaguga

SEQ ID NO: 1759326 - RNA, 19 nt, Homo sapiens
cagaucuggacuuggcaac

SEQ ID NO: 1759327 - RNA, 19 nt, Homo sapiens
gcuuucccggacugcaagc

SEQ ID NO: 1759328 - RNA, 17 nt, Homo sapiens
cagcuuuuuguccugua

SEQ ID NO: 1759329 - RNA, 17 nt, Homo sapiens
gagcuaauuuacuggac

SEQ ID NO: 1759330 - RNA, 19 nt, Homo sapiens
aagucagagacagauaccu

SEQ ID NO: 1759331 - RNA, 17 nt, Homo sapiens
uagaguuuccacuaucc

SEQ ID NO: 1759332 - RNA, 20 nt, Homo sapiens
uaaagccagucuuguucaca

SEQ ID NO: 1759333 - RNA, 12 nt, Homo sapiens
uucuguuuccca

SEQ ID NO: 1759334 - RNA, 20 nt, Homo sapiens
cacgucccucgagcucugua

SEQ ID NO: 1759335 - RNA, 20 nt, Homo sapiens
cuguuauugccaauguuccu

SEQ ID NO: 1759336 - RNA, 20 nt, Homo sapiens
cacugcuucucggaggccag

SEQ ID NO: 1759337 - RNA, 21 nt, Homo sapiens
ccgaaaacuucacugugcuca

SEQ ID NO: 1759338 - RNA, 19 nt, Homo sapiens
cuuuauuugaauaacaagg

SEQ ID NO: 1759339 - RNA, 18 nt, Homo sapiens
uuaccaagcccaccacau

SEQ ID NO: 1759340 - RNA, 13 nt, Homo sapiens
uauuccaugacug

SEQ ID NO: 1759341 - RNA, 16 nt, Homo sapiens
cugggauuaaggggau

SEQ ID NO: 1759342 - RNA, 16 nt, Homo sapiens
aaaugugaccauguga

SEQ ID NO: 1759343 - RNA, 21 nt, Homo sapiens
gccaucuaaaguaaaaaggga

SEQ ID NO: 1759344 - RNA, 17 nt, Homo sapiens
auucaaucccaggaugu

SEQ ID NO: 1759345 - RNA, 20 nt, Homo sapiens
uuuaagucucugacucuugc

SEQ ID NO: 1759346 - RNA, 23 nt, Homo sapiens
uuauuuaccugaaauaaaauuca

SEQ ID NO: 1759347 - RNA, 18 nt, Homo sapiens
gccacgaaugaaugaauu

SEQ ID NO: 1759348 - RNA, 23 nt, Homo sapiens
caaccuguaauaaauaugagugc

SEQ ID NO: 1759349 - RNA, 14 nt, Homo sapiens
uauggguacauucc

SEQ ID NO: 1759350 - RNA, 18 nt, Homo sapiens
aauuugacucaugaacua

SEQ ID NO: 1759351 - RNA, 18 nt, Homo sapiens
agcauugagucauuguca

SEQ ID NO: 1759352 - RNA, 13 nt, Homo sapiens
acacacucaguga

SEQ ID NO: 1759353 - RNA, 16 nt, Homo sapiens
aaauugagacagugca

SEQ ID NO: 1759354 - RNA, 12 nt, Homo sapiens
uaagugcugcug

SEQ ID NO: 1759355 - RNA, 12 nt, Homo sapiens
uaucugcugcac

SEQ ID NO: 1759356 - RNA, 12 nt, Homo sapiens
ucacugcugauc

SEQ ID NO: 1759357 - RNA, 18 nt, Homo sapiens
augcacccgcauguacaa

SEQ ID NO: 1759358 - RNA, 12 nt, Homo sapiens
ccagcugaccug

SEQ ID NO: 1759359 - RNA, 21 nt, Homo sapiens
cagaggugaaugcacagugaa

SEQ ID NO: 1759360 - RNA, 17 nt, Homo sapiens
ggccuccaaacacagau

SEQ ID NO: 1759361 - RNA, 21 nt, Homo sapiens
ucaauccuaaaagcaugucaa

SEQ ID NO: 1759362 - RNA, 16 nt, Homo sapiens
gggacaaaggagccug

SEQ ID NO: 1759363 - RNA, 21 nt, Homo sapiens
ccaucaggcagauaacugcug

SEQ ID NO: 1759364 - RNA, 15 nt, Homo sapiens
uucugcacucuugua

SEQ ID NO: 1759365 - RNA, 15 nt, Homo sapiens
ucccuuccuuucucc

SEQ ID NO: 1759366 - RNA, 20 nt, Homo sapiens
uuuaaaauaaaaaagcaaaa

SEQ ID NO: 1759367 - RNA, 20 nt, Homo sapiens
aagugccuuagcauguguug

SEQ ID NO: 1759368 - RNA, 21 nt, Homo sapiens
ccuaagagaugggacuaggac

SEQ ID NO: 1759369 - RNA, 21 nt, Homo sapiens
aauugcugcaccaaugcacug

SEQ ID NO: 1759370 - RNA, 15 nt, Homo sapiens
agugaaaaacaucca

SEQ ID NO: 1759371 - RNA, 20 nt, Homo sapiens
ugcuaugucccaagagccau

SEQ ID NO: 1759372 - RNA, 15 nt, Homo sapiens
ccugugcuaccucua

SEQ ID NO: 1759373 - RNA, 13 nt, Homo sapiens
aguaacauuugcc

SEQ ID NO: 1759374 - RNA, 14 nt, Homo sapiens
uaaauguccacuua

SEQ ID NO: 1759375 - RNA, 18 nt, Homo sapiens
agaaggaaggcuccaucu

SEQ ID NO: 1759376 - RNA, 20 nt, Homo sapiens
aaccuaggcaaagaguauau

SEQ ID NO: 1759377 - RNA, 17 nt, Homo sapiens
aacugaaggcuaaaaag

SEQ ID NO: 1759378 - RNA, 23 nt, Homo sapiens
uccccgauugaaagaaccagaga

SEQ ID NO: 1759379 - RNA, 22 nt, Homo sapiens
uuccugccacuguguacugugg

SEQ ID NO: 1759380 - RNA, 15 nt, Homo sapiens
ggcucagauggggcc

SEQ ID NO: 1759381 - RNA, 20 nt, Homo sapiens
uuggaucauacuggugauua

SEQ ID NO: 1759382 - RNA, 18 nt, Homo sapiens
cuggcugagcugaaccca

SEQ ID NO: 1759383 - RNA, 15 nt, Homo sapiens
aauaaaaaacaagaa

SEQ ID NO: 1759384 - RNA, 22 nt, Homo sapiens
cugcucagcgcgucucagcuca

SEQ ID NO: 1759385 - RNA, 17 nt, Homo sapiens
aagauauuguauuauca

SEQ ID NO: 1759386 - RNA, 17 nt, Homo sapiens
gcaauaagaauuacuuu

SEQ ID NO: 1759387 - RNA, 13 nt, Homo sapiens
cuauuggucaugc

SEQ ID NO: 1759388 - RNA, 14 nt, Homo sapiens
ggaucgaugugcuc

SEQ ID NO: 1759389 - RNA, 21 nt, Homo sapiens
uuacacuccucguccauuuua

SEQ ID NO: 1759390 - RNA, 17 nt, Homo sapiens
auaacauccacaaagag

SEQ ID NO: 1759391 - RNA, 18 nt, Homo sapiens
cugaagaaauugguccca

SEQ ID NO: 1759392 - RNA, 15 nt, Homo sapiens
ggccaggccucugcu

SEQ ID NO: 1759393 - RNA, 12 nt, Homo sapiens
auaaaauagcca

SEQ ID NO: 1759394 - RNA, 22 nt, Homo sapiens
uucagcuguacauacucaguaa

SEQ ID NO: 1759395 - RNA, 18 nt, Homo sapiens
auauauuuacucagucuu

SEQ ID NO: 1759396 - RNA, 21 nt, Homo sapiens
acauaugguuaaguaauugca

SEQ ID NO: 1759397 - RNA, 17 nt, Homo sapiens
uggaaugaagguaauau

SEQ ID NO: 1759398 - RNA, 24 nt, Homo sapiens
aaaguuugaauaccagcuuucuau

SEQ ID NO: 1759399 - RNA, 18 nt, Homo sapiens
uacaaauauugugaugca

SEQ ID NO: 1759400 - RNA, 19 nt, Homo sapiens
cccucuuuguuucugcuuc

SEQ ID NO: 1759401 - RNA, 21 nt, Homo sapiens
uccuagagucuuaaagcauuu

SEQ ID NO: 1759402 - RNA, 21 nt, Homo sapiens
cccaggagaaaagaagacauu

SEQ ID NO: 1759403 - RNA, 22 nt, Homo sapiens
cccaggcugcuggagugcagug

SEQ ID NO: 1759404 - RNA, 13 nt, Homo sapiens
gagccuacugucu

SEQ ID NO: 1759405 - RNA, 14 nt, Homo sapiens
gacaaguacuguau

SEQ ID NO: 1759406 - RNA, 12 nt, Homo sapiens
acagccacuuuu

SEQ ID NO: 1759407 - RNA, 14 nt, Homo sapiens
cagcaguaauuugu

SEQ ID NO: 1759408 - RNA, 21 nt, Homo sapiens
gaccaugcucaucugcugguc

SEQ ID NO: 1759409 - RNA, 22 nt, Homo sapiens
augcucaguaacacagugcagu

SEQ ID NO: 1759410 - RNA, 16 nt, Homo sapiens
cuccccacacuaaccu

SEQ ID NO: 1759411 - RNA, 14 nt, Homo sapiens
gcugagcuuuccag

SEQ ID NO: 1759412 - RNA, 14 nt, Homo sapiens
acaacacaguucuc

SEQ ID NO: 1759413 - RNA, 18 nt, Homo sapiens
ggcaacuggaugggagac

SEQ ID NO: 1759414 - RNA, 18 nt, Homo sapiens
guuuuuccacuacugcua

SEQ ID NO: 1759415 - RNA, 21 nt, Homo sapiens
aaagcccuuaaaaauaugugu

SEQ ID NO: 1759416 - RNA, 16 nt, Homo sapiens
ucccacccacauguga

SEQ ID NO: 1759417 - RNA, 20 nt, Homo sapiens
uaaguacuauguaucaauga

SEQ ID NO: 1759418 - RNA, 20 nt, Homo sapiens
aagacgaggcggcaaagauc

SEQ ID NO: 1759419 - RNA, 19 nt, Homo sapiens
caccauccuuuacuauuaa

SEQ ID NO: 1759420 - RNA, 12 nt, Homo sapiens
aagaauugccaa

SEQ ID NO: 1759421 - RNA, 16 nt, Homo sapiens
agccacuagcuugauu

SEQ ID NO: 1759422 - RNA, 18 nt, Homo sapiens
ccuuuccaagucacuaga

SEQ ID NO: 1759423 - RNA, 16 nt, Homo sapiens
uaaaauaagugaaucu

SEQ ID NO: 1759424 - RNA, 13 nt, Homo sapiens
aaucuaaccacuu

SEQ ID NO: 1759425 - RNA, 19 nt, Homo sapiens
aguuacuuuagauggcaag

SEQ ID NO: 1759426 - RNA, 23 nt, Homo sapiens
cuuaaaccgccaaggcuggggga

SEQ ID NO: 1759427 - RNA, 19 nt, Homo sapiens
ggcagcagauuuuaggaaa

SEQ ID NO: 1759428 - RNA, 11 nt, Homo sapiens
agaacuacuuc

SEQ ID NO: 1759429 - RNA, 21 nt, Homo sapiens
uccuacuguuuaaauucccau

SEQ ID NO: 1759430 - RNA, 20 nt, Homo sapiens
ucccauuuuugcuuagcuca

SEQ ID NO: 1759431 - RNA, 21 nt, Homo sapiens
agcuauuccccacacucuccu

SEQ ID NO: 1759432 - RNA, 16 nt, Homo sapiens
cugacgcaaaaccacu

SEQ ID NO: 1759433 - RNA, 22 nt, Homo sapiens
uccccagacaucuggacacugg

SEQ ID NO: 1759434 - RNA, 13 nt, Homo sapiens
guaugggaucuga

SEQ ID NO: 1759435 - RNA, 12 nt, Homo sapiens
cuaguugcuugu

SEQ ID NO: 1759436 - RNA, 22 nt, Homo sapiens
aggaaacucaucuccuuccuga

SEQ ID NO: 1759437 - RNA, 19 nt, Homo sapiens
cuuagguaagacauauaac

SEQ ID NO: 1759438 - RNA, 20 nt, Homo sapiens
aauccauuuacccuacaggu

SEQ ID NO: 1759439 - RNA, 14 nt, Homo sapiens
uuuuaaauucuuac

SEQ ID NO: 1759440 - RNA, 13 nt, Homo sapiens
aguuuguguuaga

SEQ ID NO: 1759441 - RNA, 21 nt, Homo sapiens
caugcauuacugcaugcacuu

SEQ ID NO: 1759442 - RNA, 18 nt, Homo sapiens
acaugugggucauaccuu

SEQ ID NO: 1759443 - RNA, 16 nt, Homo sapiens
acugaaucuaaccaua

SEQ ID NO: 1759444 - RNA, 19 nt, Homo sapiens
uacauucuuuaucuugaca

SEQ ID NO: 1759445 - RNA, 17 nt, Homo sapiens
gccaauaacacacagcu

SEQ ID NO: 1759446 - RNA, 15 nt, Homo sapiens
uaggauggggcuccc

SEQ ID NO: 1759447 - RNA, 14 nt, Homo sapiens
aagucucuuuauau

SEQ ID NO: 1759448 - RNA, 14 nt, Homo sapiens
gugaauugucuuug

SEQ ID NO: 1759449 - RNA, 21 nt, Homo sapiens
agaaaucuguccuguggcaug

SEQ ID NO: 1759450 - RNA, 23 nt, Homo sapiens
uggcugugaggcccucagggcag

SEQ ID NO: 1759451 - RNA, 18 nt, Homo sapiens
aucaggagcugcucaggc

SEQ ID NO: 1759452 - RNA, 16 nt, Homo sapiens
aggugcccagggccag

SEQ ID NO: 1759453 - RNA, 14 nt, Homo sapiens
gcagauacuuugaa

SEQ ID NO: 1759454 - RNA, 22 nt, Homo sapiens
cauucacagcccagaaccacag

SEQ ID NO: 1759455 - RNA, 12 nt, Homo sapiens
aaagcucugugg

SEQ ID NO: 1759456 - RNA, 20 nt, Homo sapiens
ucccauccccuggacuggga

SEQ ID NO: 1759457 - RNA, 12 nt, Homo sapiens
cuguucugcaca

SEQ ID NO: 1759458 - RNA, 22 nt, Homo sapiens
aaaugcguuccucauccaugca

SEQ ID NO: 1759459 - RNA, 23 nt, Homo sapiens
uggauaccagauauuugaaucuu

SEQ ID NO: 1759460 - RNA, 16 nt, Homo sapiens
uccugcaaaauuaccu

SEQ ID NO: 1759461 - RNA, 16 nt, Homo sapiens
uagcauugggaggaag

SEQ ID NO: 1759462 - RNA, 20 nt, Homo sapiens
uaacauuuaaauuccacaga

SEQ ID NO: 1759463 - RNA, 16 nt, Homo sapiens
aggaagccagcuggcu

SEQ ID NO: 1759464 - RNA, 19 nt, Homo sapiens
uauaggcauuucacaaaaa

SEQ ID NO: 1759465 - RNA, 18 nt, Homo sapiens
cacuugaauccauugaaa

SEQ ID NO: 1759466 - RNA, 14 nt, Homo sapiens
cuauuacaguguug

SEQ ID NO: 1759467 - RNA, 12 nt, Homo sapiens
acaucucagggg

SEQ ID NO: 1759468 - RNA, 19 nt, Homo sapiens
agucuauagaaaugaucau

SEQ ID NO: 1759469 - RNA, 18 nt, Homo sapiens
cuaugccuguauuuccaa

SEQ ID NO: 1759470 - RNA, 16 nt, Homo sapiens
cauaguacauacaaaa

SEQ ID NO: 1759471 - RNA, 14 nt, Homo sapiens
uuguucuucaggag

SEQ ID NO: 1759472 - RNA, 15 nt, Homo sapiens
uuacauuccauuuca

SEQ ID NO: 1759473 - RNA, 12 nt, Homo sapiens
uaauguucacau

SEQ ID NO: 1759474 - RNA, 23 nt, Homo sapiens
auaaaauccaaugcuucugcaua

SEQ ID NO: 1759475 - RNA, 23 nt, Homo sapiens
uccauauuggacauccccagaaa

SEQ ID NO: 1759476 - RNA, 22 nt, Homo sapiens
uucugggaaaggugcucaaaga

SEQ ID NO: 1759477 - RNA, 12 nt, Homo sapiens
caaaccucugcc

SEQ ID NO: 1759478 - RNA, 20 nt, Homo sapiens
cagcacuggaagccagagaa

SEQ ID NO: 1759479 - RNA, 13 nt, Homo sapiens
ucacaccacugua

SEQ ID NO: 1759480 - RNA, 19 nt, Homo sapiens
cauaguaaguucagcacuu

SEQ ID NO: 1759481 - RNA, 14 nt, Homo sapiens
aaucagaaaaccca

SEQ ID NO: 1759482 - RNA, 18 nt, Homo sapiens
uuccucucucuaccaguc

SEQ ID NO: 1759483 - RNA, 18 nt, Homo sapiens
cagagugguuucauugcc

SEQ ID NO: 1759484 - RNA, 19 nt, Homo sapiens
ccugcugaaagcaguguau

SEQ ID NO: 1759485 - RNA, 19 nt, Homo sapiens
agcaugcuucccagaggga

SEQ ID NO: 1759486 - RNA, 16 nt, Homo sapiens
aaaaagaaauuugaug

SEQ ID NO: 1759487 - RNA, 15 nt, Homo sapiens
gcgggcgcgugagug

SEQ ID NO: 1759488 - RNA, 12 nt, Homo sapiens
accaaauugcuu

SEQ ID NO: 1759489 - RNA, 13 nt, Homo sapiens
agcgguccaaagu

SEQ ID NO: 1759490 - RNA, 20 nt, Homo sapiens
gauuaaacaaacaaacaauu

SEQ ID NO: 1759491 - RNA, 21 nt, Homo sapiens
uaauuggaaucuucaccucag

SEQ ID NO: 1759492 - RNA, 17 nt, Homo sapiens
uccuggcccgcccucac

SEQ ID NO: 1759493 - RNA, 16 nt, Homo sapiens
acagucucuuucuucc

SEQ ID NO: 1759494 - RNA, 16 nt, Homo sapiens
aacuugggcuacugaa

SEQ ID NO: 1759495 - RNA, 15 nt, Homo sapiens
cugaagauaaucuua

SEQ ID NO: 1759496 - RNA, 22 nt, Homo sapiens
aggaccuacuguucggacaaaa

SEQ ID NO: 1759497 - RNA, 18 nt, Homo sapiens
gugauagagugcagugau

SEQ ID NO: 1759498 - RNA, 17 nt, Homo sapiens
ggggccaugggugcaug

SEQ ID NO: 1759499 - RNA, 15 nt, Homo sapiens
auguauugauuacaa

SEQ ID NO: 1759500 - RNA, 16 nt, Homo sapiens
gcugcuggaaaggccc

SEQ ID NO: 1759501 - RNA, 13 nt, Homo sapiens
agaagugcuuucu

SEQ ID NO: 1759502 - RNA, 21 nt, Homo sapiens
cuuauauauuugauacauaua

SEQ ID NO: 1759503 - RNA, 22 nt, Homo sapiens
ucugggaagacuguugugcucc

SEQ ID NO: 1759504 - RNA, 20 nt, Homo sapiens
uggacgcuggccugggauga

SEQ ID NO: 1759505 - RNA, 19 nt, Homo sapiens
uggcuagguuaaaggccag

SEQ ID NO: 1759506 - RNA, 19 nt, Homo sapiens
ucuccccaguguaugucuu

SEQ ID NO: 1759507 - RNA, 15 nt, Homo sapiens
uuuuucacaauguga

SEQ ID NO: 1759508 - RNA, 19 nt, Homo sapiens
gagccgagaucaugccauu

SEQ ID NO: 1759509 - RNA, 23 nt, Homo sapiens
gcugggacguggcucagccagca

SEQ ID NO: 1759510 - RNA, 14 nt, Homo sapiens
cugaauccaagaca

SEQ ID NO: 1759511 - RNA, 21 nt, Homo sapiens
cugagcacugaaccacauuca

SEQ ID NO: 1759512 - RNA, 13 nt, Homo sapiens
uuuauggccucag

SEQ ID NO: 1759513 - RNA, 17 nt, Homo sapiens
augggaaaccaguucau

SEQ ID NO: 1759514 - RNA, 23 nt, Homo sapiens
auuugcaaggugaacacuuccuu

SEQ ID NO: 1759515 - RNA, 15 nt, Homo sapiens
gaugaggcuuuccau

SEQ ID NO: 1759516 - RNA, 18 nt, Homo sapiens
gugauuagccauuugacu

SEQ ID NO: 1759517 - RNA, 15 nt, Homo sapiens
gcccugggucuugcc

SEQ ID NO: 1759518 - RNA, 15 nt, Homo sapiens
uaagccacauaucua

SEQ ID NO: 1759519 - RNA, 19 nt, Homo sapiens
auaauaaaaagacuauuaa

SEQ ID NO: 1759520 - RNA, 17 nt, Homo sapiens
uguggauggucauugca

SEQ ID NO: 1759521 - RNA, 16 nt, Homo sapiens
uuggccccacuuugaa

SEQ ID NO: 1759522 - RNA, 15 nt, Homo sapiens
ugaagagcaacuggg

SEQ ID NO: 1759523 - RNA, 20 nt, Homo sapiens
auucuuacacugccuguaua

SEQ ID NO: 1759524 - RNA, 18 nt, Homo sapiens
caggacuccccaggagca

SEQ ID NO: 1759525 - RNA, 16 nt, Homo sapiens
ccauuuuugaaaccaa

SEQ ID NO: 1759526 - RNA, 14 nt, Homo sapiens
uaaaauaaauuccu

SEQ ID NO: 1759527 - RNA, 19 nt, Homo sapiens
uucuauugccuucuuugaa

SEQ ID NO: 1759528 - RNA, 15 nt, Homo sapiens
ccagcaucuggagac

SEQ ID NO: 1759529 - RNA, 19 nt, Homo sapiens
guugucucugaugcagcuu

SEQ ID NO: 1759530 - RNA, 17 nt, Homo sapiens
guuugaacagaggccac

SEQ ID NO: 1759531 - RNA, 14 nt, Homo sapiens
ccacccauaucaug

SEQ ID NO: 1759532 - RNA, 14 nt, Homo sapiens
cugaagucacauca

SEQ ID NO: 1759533 - RNA, 22 nt, Homo sapiens
uaauagaaauaaaccuaugaau

SEQ ID NO: 1759534 - RNA, 20 nt, Homo sapiens
gcauaaguucuuaaugucaa

SEQ ID NO: 1759535 - RNA, 13 nt, Homo sapiens
cacagugggaacu

SEQ ID NO: 1759536 - RNA, 18 nt, Homo sapiens
gcccacccgaguaccucc

SEQ ID NO: 1759537 - RNA, 23 nt, Homo sapiens
uucucaccuaaacccucugugaa

SEQ ID NO: 1759538 - RNA, 19 nt, Homo sapiens
cucaaaaucuuuccaaaua

SEQ ID NO: 1759539 - RNA, 15 nt, Homo sapiens
cguguccugccuuga

SEQ ID NO: 1759540 - RNA, 17 nt, Homo sapiens
uggacuauuuucuuuca

SEQ ID NO: 1759541 - RNA, 20 nt, Homo sapiens
cauugcuuaugucaaaugga

SEQ ID NO: 1759542 - RNA, 16 nt, Homo sapiens
ugcuaguuuauauaga

SEQ ID NO: 1759543 - RNA, 21 nt, Homo sapiens
uauucugggcaccacaaaaua

SEQ ID NO: 1759544 - RNA, 15 nt, Homo sapiens
cuuguugaugacauu

SEQ ID NO: 1759545 - RNA, 22 nt, Homo sapiens
cugggagacccugaacucagaa

SEQ ID NO: 1759546 - RNA, 24 nt, Homo sapiens
caagccagcccccuccagcucaug

SEQ ID NO: 1759547 - RNA, 13 nt, Homo sapiens
gcccccauuucac

SEQ ID NO: 1759548 - RNA, 19 nt, Homo sapiens
ccaaagagcugccuaagag

SEQ ID NO: 1759549 - RNA, 15 nt, Homo sapiens
caggugaaacccagu

SEQ ID NO: 1759550 - RNA, 19 nt, Homo sapiens
aacuccaugcaaaccaugc

SEQ ID NO: 1759551 - RNA, 16 nt, Homo sapiens
acagugcccagcauga

SEQ ID NO: 1759552 - RNA, 18 nt, Homo sapiens
auucauaaaucacaaaua

SEQ ID NO: 1759553 - RNA, 17 nt, Homo sapiens
ucccagaauguuacuga

SEQ ID NO: 1759554 - RNA, 16 nt, Homo sapiens
aggccgaggaccacca

SEQ ID NO: 1759555 - RNA, 18 nt, Homo sapiens
augcuuuucucaaagccc

SEQ ID NO: 1759556 - RNA, 22 nt, Homo sapiens
cuguaauaaauaaauauacuca

SEQ ID NO: 1759557 - RNA, 21 nt, Homo sapiens
auugucuaaaguuacuacuga

SEQ ID NO: 1759558 - RNA, 19 nt, Homo sapiens
caucagggcccugccccag

SEQ ID NO: 1759559 - RNA, 20 nt, Homo sapiens
ugucuaagguccccacugcc

SEQ ID NO: 1759560 - RNA, 19 nt, Homo sapiens
gaucacaccacuguacucc

SEQ ID NO: 1759561 - RNA, 15 nt, Homo sapiens
gaugcagcuucaaga

SEQ ID NO: 1759562 - RNA, 11 nt, Homo sapiens
caucuuucauu

SEQ ID NO: 1759563 - RNA, 23 nt, Homo sapiens
auguagcuauuuuucuuguugca

SEQ ID NO: 1759564 - RNA, 20 nt, Homo sapiens
ugcuucagugccauugcagc

SEQ ID NO: 1759565 - RNA, 20 nt, Homo sapiens
ccuguuuguggaacaaaagu

SEQ ID NO: 1759566 - RNA, 20 nt, Homo sapiens
caaaucagaccuggcugcuu

SEQ ID NO: 1759567 - RNA, 15 nt, Homo sapiens
ugcuccuaccuauca

SEQ ID NO: 1759568 - RNA, 14 nt, Homo sapiens
uucuaaugugccua

SEQ ID NO: 1759569 - RNA, 15 nt, Homo sapiens
ccuuuccauccaugg

SEQ ID NO: 1759570 - RNA, 15 nt, Homo sapiens
agaaagagucaggcc

SEQ ID NO: 1759571 - RNA, 16 nt, Homo sapiens
uucugauaaaguuccu

SEQ ID NO: 1759572 - RNA, 15 nt, Homo sapiens
agcagggacagauca

SEQ ID NO: 1759573 - RNA, 16 nt, Homo sapiens
aauucaucuucagucu

SEQ ID NO: 1759574 - RNA, 16 nt, Homo sapiens
acuaagcccugccgug

SEQ ID NO: 1759575 - RNA, 16 nt, Homo sapiens
aaacaauaucauauca

SEQ ID NO: 1759576 - RNA, 14 nt, Homo sapiens
auguccggcuuuaa

SEQ ID NO: 1759577 - RNA, 19 nt, Homo sapiens
aggguguuggaagaugcau

SEQ ID NO: 1759578 - RNA, 21 nt, Homo sapiens
guauuauauuuuggccuuaca

SEQ ID NO: 1759579 - RNA, 18 nt, Homo sapiens
uggggcaugaccucaguc

SEQ ID NO: 1759580 - RNA, 17 nt, Homo sapiens
uccuuuagaguugcaug

SEQ ID NO: 1759581 - RNA, 19 nt, Homo sapiens
cuuugcugguguagucuuu

SEQ ID NO: 1759582 - RNA, 13 nt, Homo sapiens
cagagcccagcuc

SEQ ID NO: 1759583 - RNA, 23 nt, Homo sapiens
acuggggaagccaguuuccacag

SEQ ID NO: 1759584 - RNA, 23 nt, Homo sapiens
cccuacuuccagguucugguuag

SEQ ID NO: 1759585 - RNA, 17 nt, Homo sapiens
uaaaauuucaaguuuaa

SEQ ID NO: 1759586 - RNA, 15 nt, Homo sapiens
acucuuaaagacauc

SEQ ID NO: 1759587 - RNA, 17 nt, Homo sapiens
acuuuguaaauucugau

SEQ ID NO: 1759588 - RNA, 15 nt, Homo sapiens
augaagugugugagg

SEQ ID NO: 1759589 - RNA, 21 nt, Homo sapiens
auauaccuggcuuuuacuuua

SEQ ID NO: 1759590 - RNA, 13 nt, Homo sapiens
aucacugcuccug

SEQ ID NO: 1759591 - RNA, 14 nt, Homo sapiens
cuuccgacaccucu

SEQ ID NO: 1759592 - RNA, 21 nt, Homo sapiens
guaucacugcuuuuuccuuag

SEQ ID NO: 1759593 - RNA, 18 nt, Homo sapiens
ggagaagccagugucuag

SEQ ID NO: 1759594 - RNA, 20 nt, Homo sapiens
ucuccagucauuauguuaau

SEQ ID NO: 1759595 - RNA, 18 nt, Homo sapiens
guccaaaaauagucaaaa

SEQ ID NO: 1759596 - RNA, 17 nt, Homo sapiens
agcagugggcagguggc

SEQ ID NO: 1759597 - RNA, 14 nt, Homo sapiens
gcucggagucugag

SEQ ID NO: 1759598 - RNA, 18 nt, Homo sapiens
gacuguggcacuugccug

SEQ ID NO: 1759599 - RNA, 18 nt, Homo sapiens
cuucagcccuggccaagc

SEQ ID NO: 1759600 - RNA, 14 nt, Homo sapiens
augcaaccuaguca

SEQ ID NO: 1759601 - RNA, 18 nt, Homo sapiens
caaaguuaaggcuugaua

SEQ ID NO: 1759602 - RNA, 11 nt, Homo sapiens
cccagcacugc

SEQ ID NO: 1759603 - RNA, 18 nt, Homo sapiens
auuuacagaacaguuuaa

SEQ ID NO: 1759604 - RNA, 18 nt, Homo sapiens
aggguccagacuguccac

SEQ ID NO: 1759605 - RNA, 19 nt, Homo sapiens
agauguuguagacugagau

SEQ ID NO: 1759606 - RNA, 17 nt, Homo sapiens
cuguaauaauaccucaa

SEQ ID NO: 1759607 - RNA, 22 nt, Homo sapiens
ugagaguaucaggucucccacg

SEQ ID NO: 1759608 - RNA, 14 nt, Homo sapiens
gaacuaccaggugg

SEQ ID NO: 1759609 - RNA, 23 nt, Homo sapiens
ggaugucagcagacacacauggg

SEQ ID NO: 1759610 - RNA, 17 nt, Homo sapiens
gggcugaccgugucucu

SEQ ID NO: 1759611 - RNA, 13 nt, Homo sapiens
uauaaauguuugu

SEQ ID NO: 1759612 - RNA, 20 nt, Homo sapiens
auaauuuuccucaaucacac

SEQ ID NO: 1759613 - RNA, 17 nt, Homo sapiens
uaagcccccacuacaag

SEQ ID NO: 1759614 - RNA, 20 nt, Homo sapiens
ugaaucauauucauaugcag

SEQ ID NO: 1759615 - RNA, 14 nt, Homo sapiens
acgacgcccugggc

SEQ ID NO: 1759616 - RNA, 22 nt, Homo sapiens
cucuugcacagucacugcucuu

SEQ ID NO: 1759617 - RNA, 18 nt, Homo sapiens
agacauaaauuacuuuuu

SEQ ID NO: 1759618 - RNA, 16 nt, Homo sapiens
uguauuuucagcucaa

SEQ ID NO: 1759619 - RNA, 18 nt, Homo sapiens
cagcagugaguaaucaau

SEQ ID NO: 1759620 - RNA, 21 nt, Homo sapiens
aacuaaugguccacacccaau

SEQ ID NO: 1759621 - RNA, 16 nt, Homo sapiens
aggcugaccaagagag

SEQ ID NO: 1759622 - RNA, 13 nt, Homo sapiens
uggugcucauuua

SEQ ID NO: 1759623 - RNA, 13 nt, Homo sapiens
uuuaacucaggag

SEQ ID NO: 1759624 - RNA, 13 nt, Homo sapiens
ccucccugcuuca

SEQ ID NO: 1759625 - RNA, 17 nt, Homo sapiens
uucuugcagucaucaga

SEQ ID NO: 1759626 - RNA, 16 nt, Homo sapiens
ucuaacucauucuuca

SEQ ID NO: 1759627 - RNA, 23 nt, Homo sapiens
accuggggauccaauugauguau

SEQ ID NO: 1759628 - RNA, 18 nt, Homo sapiens
uccuuccuugaccagcag

SEQ ID NO: 1759629 - RNA, 22 nt, Homo sapiens
caugugucuguauucauacagc

SEQ ID NO: 1759630 - RNA, 17 nt, Homo sapiens
gaaaauguguucucgga

SEQ ID NO: 1759631 - RNA, 22 nt, Homo sapiens
ggauuuuuuuccuccccaccuu

SEQ ID NO: 1759632 - RNA, 17 nt, Homo sapiens
uaaaguacagacuuuuu

SEQ ID NO: 1759633 - RNA, 14 nt, Homo sapiens
ucaacucauugcau

SEQ ID NO: 1759634 - RNA, 14 nt, Homo sapiens
cauuccagcucugc

SEQ ID NO: 1759635 - RNA, 22 nt, Homo sapiens
aucucggcucacugcaaccucu

SEQ ID NO: 1759636 - RNA, 16 nt, Homo sapiens
cuuuagaguugcauga

SEQ ID NO: 1759637 - RNA, 22 nt, Homo sapiens
auaccuccaacccugccgucac

SEQ ID NO: 1759638 - RNA, 15 nt, Homo sapiens
cuugccaaauuccau

SEQ ID NO: 1759639 - RNA, 13 nt, Homo sapiens
aaauagucuucca

SEQ ID NO: 1759640 - RNA, 12 nt, Homo sapiens
agaaggccagug

SEQ ID NO: 1759641 - RNA, 23 nt, Homo sapiens
aaagcaauucugacuguccagga

SEQ ID NO: 1759642 - RNA, 13 nt, Homo sapiens
caggagacauaua

SEQ ID NO: 1759643 - RNA, 22 nt, Homo sapiens
ugaagcaaggcgguggacuuga

SEQ ID NO: 1759644 - RNA, 15 nt, Homo sapiens
cacacuuucugacug

SEQ ID NO: 1759645 - RNA, 19 nt, Homo sapiens
cacuauagccuaggugaca

SEQ ID NO: 1759646 - RNA, 19 nt, Homo sapiens
acaggagaugggugcaacu

SEQ ID NO: 1759647 - RNA, 23 nt, Homo sapiens
aauuuuuucaugcacacuguugg

SEQ ID NO: 1759648 - RNA, 16 nt, Homo sapiens
gcaguauucuugcacu

SEQ ID NO: 1759649 - RNA, 17 nt, Homo sapiens
auuggugcauagcagau

SEQ ID NO: 1759650 - RNA, 13 nt, Homo sapiens
cuggcuucauaca

SEQ ID NO: 1759651 - RNA, 22 nt, Homo sapiens
gagcagggguuggucaaggcca

SEQ ID NO: 1759652 - RNA, 16 nt, Homo sapiens
gaaggacaugugcuau

SEQ ID NO: 1759653 - RNA, 16 nt, Homo sapiens
aaaucaacccuuccua

SEQ ID NO: 1759654 - RNA, 16 nt, Homo sapiens
uacauaucuuuauuaa

SEQ ID NO: 1759655 - RNA, 22 nt, Homo sapiens
gagccuacugucuccuucccac

SEQ ID NO: 1759656 - RNA, 14 nt, Homo sapiens
agcugccucucuca

SEQ ID NO: 1759657 - RNA, 19 nt, Homo sapiens
caggguaucccagaccccu

SEQ ID NO: 1759658 - RNA, 14 nt, Homo sapiens
ucaccgacaacaug

SEQ ID NO: 1759659 - RNA, 19 nt, Homo sapiens
ugacacaggggacacugaa

SEQ ID NO: 1759660 - RNA, 16 nt, Homo sapiens
guacaauacaauguac

SEQ ID NO: 1759661 - RNA, 15 nt, Homo sapiens
ucuaauaauuauuca

SEQ ID NO: 1759662 - RNA, 13 nt, Homo sapiens
ugagcuucuuuag

SEQ ID NO: 1759663 - RNA, 23 nt, Homo sapiens
uaccacuacuuagagauauguau

SEQ ID NO: 1759664 - RNA, 21 nt, Homo sapiens
agaggcugccccucucaccaa

SEQ ID NO: 1759665 - RNA, 16 nt, Homo sapiens
gaucucgccuggaaac

SEQ ID NO: 1759666 - RNA, 14 nt, Homo sapiens
auauuuauuuccag

SEQ ID NO: 1759667 - RNA, 16 nt, Homo sapiens
auuaauuaauauucau

SEQ ID NO: 1759668 - RNA, 15 nt, Homo sapiens
ucgaaguugaugcaa

SEQ ID NO: 1759669 - RNA, 16 nt, Homo sapiens
cuuagggaacuuugau

SEQ ID NO: 1759670 - RNA, 14 nt, Homo sapiens
aaaugggugaaaaa

SEQ ID NO: 1759671 - RNA, 15 nt, Homo sapiens
gccgcacaucucacu

SEQ ID NO: 1759672 - RNA, 14 nt, Homo sapiens
augauuccaggugg

SEQ ID NO: 1759673 - RNA, 20 nt, Homo sapiens
uuucugaauacaaagugaug

SEQ ID NO: 1759674 - RNA, 18 nt, Homo sapiens
cugggggagguccaagca

SEQ ID NO: 1759675 - RNA, 21 nt, Homo sapiens
aaccuggaaucuacaagccaa

SEQ ID NO: 1759676 - RNA, 11 nt, Homo sapiens
uuuugcuggag

SEQ ID NO: 1759677 - RNA, 14 nt, Homo sapiens
ucaaagaagacuca

SEQ ID NO: 1759678 - RNA, 13 nt, Homo sapiens
gugccccaugccu

SEQ ID NO: 1759679 - RNA, 16 nt, Homo sapiens
aaaagagaugcuggau

SEQ ID NO: 1759680 - RNA, 18 nt, Homo sapiens
guagaccaaaucuuguua

SEQ ID NO: 1759681 - RNA, 13 nt, Homo sapiens
cugucgcaucuca

SEQ ID NO: 1759682 - RNA, 18 nt, Homo sapiens
agaucgcgccacugcacu

SEQ ID NO: 1759683 - RNA, 14 nt, Homo sapiens
guaucaguguuuua

SEQ ID NO: 1759684 - RNA, 17 nt, Homo sapiens
gaauaauaguaugagua

SEQ ID NO: 1759685 - RNA, 18 nt, Homo sapiens
auaugccuuuuugaagca

SEQ ID NO: 1759686 - RNA, 18 nt, Homo sapiens
aguugggauuacagguga

SEQ ID NO: 1759687 - RNA, 16 nt, Homo sapiens
aauguucacugaauaa

SEQ ID NO: 1759688 - RNA, 14 nt, Homo sapiens
guacuacauuugca

SEQ ID NO: 1759689 - RNA, 14 nt, Homo sapiens
uaagcacagaucua

SEQ ID NO: 1759690 - RNA, 18 nt, Homo sapiens
aucauccgaggcaaagag

SEQ ID NO: 1759691 - RNA, 19 nt, Homo sapiens
uggagugcaguggugcgau

SEQ ID NO: 1759692 - RNA, 23 nt, Homo sapiens
uuaaauuacagcuuuuauggaug

SEQ ID NO: 1759693 - RNA, 17 nt, Homo sapiens
cuuguguuacuugccaa

SEQ ID NO: 1759694 - RNA, 23 nt, Homo sapiens
cuaucaaaaagauaucaaaggca

SEQ ID NO: 1759695 - RNA, 19 nt, Homo sapiens
cugugcgucuguguguuua

SEQ ID NO: 1759696 - RNA, 13 nt, Homo sapiens
gggaggaacaaag

SEQ ID NO: 1759697 - RNA, 13 nt, Homo sapiens
acuuuugaagucc

SEQ ID NO: 1759698 - RNA, 15 nt, Homo sapiens
gacuaagcauugagc

SEQ ID NO: 1759699 - RNA, 19 nt, Homo sapiens
cucaguccuguacucuggg

SEQ ID NO: 1759700 - RNA, 19 nt, Homo sapiens
ucguccuuagaauacugua

SEQ ID NO: 1759701 - RNA, 14 nt, Homo sapiens
uuacaugcauuuga

SEQ ID NO: 1759702 - RNA, 22 nt, Homo sapiens
gaaacagcagcugaagccagcu

SEQ ID NO: 1759703 - RNA, 23 nt, Homo sapiens
acaauuaaaagugucuugagacu

SEQ ID NO: 1759704 - RNA, 12 nt, Homo sapiens
aauuguaggcag

SEQ ID NO: 1759705 - RNA, 12 nt, Homo sapiens
cuuucucuaaaa

SEQ ID NO: 1759706 - RNA, 21 nt, Homo sapiens
cacaguagggcuuggugaaug

SEQ ID NO: 1759707 - RNA, 14 nt, Homo sapiens
aguuccuagcacug

SEQ ID NO: 1759708 - RNA, 20 nt, Homo sapiens
gagugauagcuacuguagaa

SEQ ID NO: 1759709 - RNA, 13 nt, Homo sapiens
uucgagucuugcu

SEQ ID NO: 1759710 - RNA, 13 nt, Homo sapiens
cccaucaccagag

SEQ ID NO: 1759711 - RNA, 17 nt, Homo sapiens
cuaccuucucuacccau

SEQ ID NO: 1759712 - RNA, 23 nt, Homo sapiens
ucaaauuauuuccaagagagauu

SEQ ID NO: 1759713 - RNA, 20 nt, Homo sapiens
cuauauaguuccuugccuua

SEQ ID NO: 1759714 - RNA, 16 nt, Homo sapiens
gcuuucuguucaucuc

SEQ ID NO: 1759715 - RNA, 21 nt, Homo sapiens
ccauggcagggugcuaguggu

SEQ ID NO: 1759716 - RNA, 15 nt, Homo sapiens
caaauaaagugcagu

SEQ ID NO: 1759717 - RNA, 15 nt, Homo sapiens
cugaaaaagaacugu

SEQ ID NO: 1759718 - RNA, 22 nt, Homo sapiens
gcaggugcugacuucaucuccc

SEQ ID NO: 1759719 - RNA, 20 nt, Homo sapiens
cuugaagauaucuugaaaug

SEQ ID NO: 1759720 - RNA, 18 nt, Homo sapiens
auucugguuuugacauca

SEQ ID NO: 1759721 - RNA, 13 nt, Homo sapiens
guuaguaauaccu

SEQ ID NO: 1759722 - RNA, 22 nt, Homo sapiens
ucccaagcuagacugugucuga

SEQ ID NO: 1759723 - RNA, 13 nt, Homo sapiens
aaagagaagccaa

SEQ ID NO: 1759724 - RNA, 20 nt, Homo sapiens
cugggugggcaucucaguua

SEQ ID NO: 1759725 - RNA, 15 nt, Homo sapiens
gacaaaggagccugu

SEQ ID NO: 1759726 - RNA, 17 nt, Homo sapiens
augucaccaauuaacca

SEQ ID NO: 1759727 - RNA, 14 nt, Homo sapiens
gcuugaaccuggga

SEQ ID NO: 1759728 - RNA, 15 nt, Homo sapiens
ugauuagaggaacuu

SEQ ID NO: 1759729 - RNA, 17 nt, Homo sapiens
gggccauguccaaagag

SEQ ID NO: 1759730 - RNA, 22 nt, Homo sapiens
uguuaacagaugauccauuuga

SEQ ID NO: 1759731 - RNA, 20 nt, Homo sapiens
agacucagggccccagcacu

SEQ ID NO: 1759732 - RNA, 14 nt, Homo sapiens
ucuuuccuugucuc

SEQ ID NO: 1759733 - RNA, 14 nt, Homo sapiens
accuuucuagccuu

SEQ ID NO: 1759734 - RNA, 22 nt, Homo sapiens
uggccuuuaaaaaugcaccacu

SEQ ID NO: 1759735 - RNA, 18 nt, Homo sapiens
ccagagcccaagugccau

SEQ ID NO: 1759736 - RNA, 21 nt, Homo sapiens
ucccaugugagucccugugau

SEQ ID NO: 1759737 - RNA, 16 nt, Homo sapiens
auauccucugcuuaaa

SEQ ID NO: 1759738 - RNA, 16 nt, Homo sapiens
ugacauggaaaggguc

SEQ ID NO: 1759739 - RNA, 15 nt, Homo sapiens
uugcuaccucaaggg

SEQ ID NO: 1759740 - RNA, 13 nt, Homo sapiens
cucugaugcagug

SEQ ID NO: 1759741 - RNA, 13 nt, Homo sapiens
cugacaugcacac

SEQ ID NO: 1759742 - RNA, 22 nt, Homo sapiens
cugccaacacgcccggcuaauu

SEQ ID NO: 1759743 - RNA, 21 nt, Homo sapiens
gcccccuucaagccugugcaa

SEQ ID NO: 1759744 - RNA, 17 nt, Homo sapiens
auaugacacucuaguca

SEQ ID NO: 1759745 - RNA, 21 nt, Homo sapiens
uuaaugugguucgaaagacuc

SEQ ID NO: 1759746 - RNA, 12 nt, Homo sapiens
uccuucauuucc

SEQ ID NO: 1759747 - RNA, 22 nt, Homo sapiens
gguucccaauaaaagugacucu

SEQ ID NO: 1759748 - RNA, 18 nt, Homo sapiens
acaaaugaacgauaugua

SEQ ID NO: 1759749 - RNA, 15 nt, Homo sapiens
aacucaaaacaccca

SEQ ID NO: 1759750 - RNA, 22 nt, Homo sapiens
cuucucugcaaugcuucuguag

SEQ ID NO: 1759751 - RNA, 16 nt, Homo sapiens
cuguaaaacagguuau

SEQ ID NO: 1759752 - RNA, 16 nt, Homo sapiens
agaacauggacuacac

SEQ ID NO: 1759753 - RNA, 19 nt, Homo sapiens
acuggaaauguagcacuua

SEQ ID NO: 1759754 - RNA, 14 nt, Homo sapiens
acaguggccggggc

SEQ ID NO: 1759755 - RNA, 13 nt, Homo sapiens
gauccagacugua

SEQ ID NO: 1759756 - RNA, 20 nt, Homo sapiens
cauggguuuccuuauugaaa

SEQ ID NO: 1759757 - RNA, 16 nt, Homo sapiens
cuccagccagcaauga

SEQ ID NO: 1759758 - RNA, 16 nt, Homo sapiens
auaucaugaugugcaa

SEQ ID NO: 1759759 - RNA, 14 nt, Homo sapiens
gaaucggugcuguc

SEQ ID NO: 1759760 - RNA, 16 nt, Homo sapiens
uacaaaagcuuugaau

SEQ ID NO: 1759761 - RNA, 13 nt, Homo sapiens
cacugcauaccaa

SEQ ID NO: 1759762 - RNA, 17 nt, Homo sapiens
gaugguuuaauagguaa

SEQ ID NO: 1759763 - RNA, 20 nt, Homo sapiens
gagccccauuauucauucuc

SEQ ID NO: 1759764 - RNA, 21 nt, Homo sapiens
cuuuugagcuauucaccucag

SEQ ID NO: 1759765 - RNA, 23 nt, Homo sapiens
acaaacuggcugcuuuguucaau

SEQ ID NO: 1759766 - RNA, 15 nt, Homo sapiens
uacucaccaauuuau

SEQ ID NO: 1759767 - RNA, 17 nt, Homo sapiens
caagagcuggcaaaggu

SEQ ID NO: 1759768 - RNA, 20 nt, Homo sapiens
ccuacagaccuggcucucag

SEQ ID NO: 1759769 - RNA, 16 nt, Homo sapiens
aaagaaauuuugccug

SEQ ID NO: 1759770 - RNA, 22 nt, Homo sapiens
ugccuggaggagcugugcugcc

SEQ ID NO: 1759771 - RNA, 20 nt, Homo sapiens
uauacuuccuuaugcuucuu

SEQ ID NO: 1759772 - RNA, 15 nt, Homo sapiens
uuacacguaccucuc

SEQ ID NO: 1759773 - RNA, 14 nt, Homo sapiens
uccagcaguacaau

SEQ ID NO: 1759774 - RNA, 18 nt, Homo sapiens
gcuucaguggcagcugcu

SEQ ID NO: 1759775 - RNA, 19 nt, Homo sapiens
ugauuucaauagcuuugua

SEQ ID NO: 1759776 - RNA, 19 nt, Homo sapiens
ccaugacgacauacaugcu

SEQ ID NO: 1759777 - RNA, 17 nt, Homo sapiens
uagcgaccccagacugu

SEQ ID NO: 1759778 - RNA, 17 nt, Homo sapiens
ugauuucauguacugca

SEQ ID NO: 1759779 - RNA, 21 nt, Homo sapiens
aacuccugaccucaggugauc

SEQ ID NO: 1759780 - RNA, 21 nt, Homo sapiens
cagggacagccugcacagugg

SEQ ID NO: 1759781 - RNA, 20 nt, Homo sapiens
uuugccaguucaagaauuua

SEQ ID NO: 1759782 - RNA, 16 nt, Homo sapiens
agugauagagugcagu

SEQ ID NO: 1759783 - RNA, 17 nt, Homo sapiens
aucuggguaucuuucca

SEQ ID NO: 1759784 - RNA, 17 nt, Homo sapiens
ucugaagccucacuuau

SEQ ID NO: 1759785 - RNA, 21 nt, Homo sapiens
aaagaagagccuucacaugaa

SEQ ID NO: 1759786 - RNA, 16 nt, Homo sapiens
cacugaaaaugugcuc

SEQ ID NO: 1759787 - RNA, 19 nt, Homo sapiens
gcuuccaugaugcacagua

SEQ ID NO: 1759788 - RNA, 20 nt, Homo sapiens
ugguaguggaauagugaaua

SEQ ID NO: 1759789 - RNA, 17 nt, Homo sapiens
aucaucuguagauacua

SEQ ID NO: 1759790 - RNA, 20 nt, Homo sapiens
uugacacauaugaacacaga

SEQ ID NO: 1759791 - RNA, 17 nt, Homo sapiens
aucuuccagaagcugua

SEQ ID NO: 1759792 - RNA, 23 nt, Homo sapiens
acuaggcacuguggcucugcaug

SEQ ID NO: 1759793 - RNA, 22 nt, Homo sapiens
gacguggccccugcccacucac

SEQ ID NO: 1759794 - RNA, 16 nt, Homo sapiens
gcggguaaagugcaau

SEQ ID NO: 1759795 - RNA, 23 nt, Homo sapiens
gaacccuagaaauauauccugug

SEQ ID NO: 1759796 - RNA, 15 nt, Homo sapiens
acguguccuacagcc

SEQ ID NO: 1759797 - RNA, 20 nt, Homo sapiens
ccugcaagacagcacaggca

SEQ ID NO: 1759798 - RNA, 20 nt, Homo sapiens
aguauuacaaaaacauggcc

SEQ ID NO: 1759799 - RNA, 17 nt, Homo sapiens
caaacucuacuauccaa

SEQ ID NO: 1759800 - RNA, 18 nt, Homo sapiens
ccuguuccucccaagagg

SEQ ID NO: 1759801 - RNA, 17 nt, Homo sapiens
auuuuuaaaggacaaac

SEQ ID NO: 1759802 - RNA, 21 nt, Homo sapiens
aaauccccucccugugacccg

SEQ ID NO: 1759803 - RNA, 21 nt, Homo sapiens
cagggcagaugaugcuuugag

SEQ ID NO: 1759804 - RNA, 17 nt, Homo sapiens
gcaaguaaguuauagaa

SEQ ID NO: 1759805 - RNA, 18 nt, Homo sapiens
gcagaaugaacccauagg

SEQ ID NO: 1759806 - RNA, 16 nt, Homo sapiens
uguccaugaagcacug

SEQ ID NO: 1759807 - RNA, 17 nt, Homo sapiens
aaaugcagaaauaagaa

SEQ ID NO: 1759808 - RNA, 16 nt, Homo sapiens
gccaaaccugccuugc

SEQ ID NO: 1759809 - RNA, 16 nt, Homo sapiens
accucugaauuuacuu

SEQ ID NO: 1759810 - RNA, 14 nt, Homo sapiens
auauuuauguagau

SEQ ID NO: 1759811 - RNA, 16 nt, Homo sapiens
cugccacucacacagc

SEQ ID NO: 1759812 - RNA, 22 nt, Homo sapiens
cacuuguuguugaacauggcua

SEQ ID NO: 1759813 - RNA, 17 nt, Homo sapiens
cccuggaccaguggucu

SEQ ID NO: 1759814 - RNA, 14 nt, Homo sapiens
agaaaucaauggua

SEQ ID NO: 1759815 - RNA, 17 nt, Homo sapiens
acacauuaaaauguuag

SEQ ID NO: 1759816 - RNA, 23 nt, Homo sapiens
uacuggcgauuuuacucauuguc

SEQ ID NO: 1759817 - RNA, 17 nt, Homo sapiens
uaucaccgugggcuccc

SEQ ID NO: 1759818 - RNA, 14 nt, Homo sapiens
cuuuucccaaccau

SEQ ID NO: 1759819 - RNA, 14 nt, Homo sapiens
agagagggggccac

SEQ ID NO: 1759820 - RNA, 19 nt, Homo sapiens
aggaggaaugcaccacggc

SEQ ID NO: 1759821 - RNA, 14 nt, Homo sapiens
ccuuguuacacauu

SEQ ID NO: 1759822 - RNA, 19 nt, Homo sapiens
augaauacuuugcagcaca

SEQ ID NO: 1759823 - RNA, 18 nt, Homo sapiens
cagccucugccgcugcca

SEQ ID NO: 1759824 - RNA, 20 nt, Homo sapiens
agcaccgugucaagcugcuc

SEQ ID NO: 1759825 - RNA, 17 nt, Homo sapiens
uucagagaucaaguccu

SEQ ID NO: 1759826 - RNA, 19 nt, Homo sapiens
gacuagggcuuauccaugc

SEQ ID NO: 1759827 - RNA, 21 nt, Homo sapiens
aaacugugugcaacagacaaa

SEQ ID NO: 1759828 - RNA, 14 nt, Homo sapiens
aauaaucaaccugg

SEQ ID NO: 1759829 - RNA, 18 nt, Homo sapiens
ggauacgacaacuugcac

SEQ ID NO: 1759830 - RNA, 22 nt, Homo sapiens
cacuuugaagguaauaaauaca

SEQ ID NO: 1759831 - RNA, 19 nt, Homo sapiens
cauggaucaucaaggugaa

SEQ ID NO: 1759832 - RNA, 16 nt, Homo sapiens
augcccucaucccgac

SEQ ID NO: 1759833 - RNA, 22 nt, Homo sapiens
guauaggccaucuguaaauauc

SEQ ID NO: 1759834 - RNA, 18 nt, Homo sapiens
aguacucuucuagcauuu

SEQ ID NO: 1759835 - RNA, 18 nt, Homo sapiens
caagaagaauugacugau

SEQ ID NO: 1759836 - RNA, 16 nt, Homo sapiens
auuguucgaagacaca

SEQ ID NO: 1759837 - RNA, 14 nt, Homo sapiens
cgagggcggccagg

SEQ ID NO: 1759838 - RNA, 22 nt, Homo sapiens
ccaaagccaccaagacaggcuc

SEQ ID NO: 1759839 - RNA, 20 nt, Homo sapiens
aaugauaugcaagugcaaaa

SEQ ID NO: 1759840 - RNA, 16 nt, Homo sapiens
gccccagcacauggaa

SEQ ID NO: 1759841 - RNA, 19 nt, Homo sapiens
aaacugugucacaguuuca

SEQ ID NO: 1759842 - RNA, 18 nt, Homo sapiens
aggugggggagccuggag

SEQ ID NO: 1759843 - RNA, 12 nt, Homo sapiens
caugucaggcca

SEQ ID NO: 1759844 - RNA, 16 nt, Homo sapiens
uaaucuaaauucauac

SEQ ID NO: 1759845 - RNA, 21 nt, Homo sapiens
ccaaccgaacaugaccaaaaa

SEQ ID NO: 1759846 - RNA, 21 nt, Homo sapiens
cugccccuggcucugaccgaa

SEQ ID NO: 1759847 - RNA, 20 nt, Homo sapiens
aaaugaggugccacccagua

SEQ ID NO: 1759848 - RNA, 23 nt, Homo sapiens
acaggaccuaggauaucuucucc

SEQ ID NO: 1759849 - RNA, 13 nt, Homo sapiens
ccacacagguguu

SEQ ID NO: 1759850 - RNA, 14 nt, Homo sapiens
uggaaaaggaagac

SEQ ID NO: 1759851 - RNA, 14 nt, Homo sapiens
gagagcagugagga

SEQ ID NO: 1759852 - RNA, 15 nt, Homo sapiens
acuguacuacaucua

SEQ ID NO: 1759853 - RNA, 15 nt, Homo sapiens
uuacugauuaacuca

SEQ ID NO: 1759854 - RNA, 17 nt, Homo sapiens
ugcucucucucccugcc

SEQ ID NO: 1759855 - RNA, 14 nt, Homo sapiens
cuaguaaccaaggc

SEQ ID NO: 1759856 - RNA, 15 nt, Homo sapiens
ccgugggaguacaaa

SEQ ID NO: 1759857 - RNA, 17 nt, Homo sapiens
caaagugugugugugca

SEQ ID NO: 1759858 - RNA, 18 nt, Homo sapiens
uuguagccuaauauucau

SEQ ID NO: 1759859 - RNA, 14 nt, Homo sapiens
aagauauggcugcu

SEQ ID NO: 1759860 - RNA, 14 nt, Homo sapiens
ggaucagaauauca

SEQ ID NO: 1759861 - RNA, 16 nt, Homo sapiens
gcugggaugagaggaa

SEQ ID NO: 1759862 - RNA, 18 nt, Homo sapiens
auuuuuuuuaaaucaaaa

SEQ ID NO: 1759863 - RNA, 17 nt, Homo sapiens
agauggagucucacucu

SEQ ID NO: 1759864 - RNA, 16 nt, Homo sapiens
gugcucugauuugaua

SEQ ID NO: 1759865 - RNA, 21 nt, Homo sapiens
gaagauaggagagauaccuug

SEQ ID NO: 1759866 - RNA, 12 nt, Homo sapiens
agaaaacaagua

SEQ ID NO: 1759867 - RNA, 12 nt, Homo sapiens
uguaaacaugaa

SEQ ID NO: 1759868 - RNA, 23 nt, Homo sapiens
auuacauguguuuauucauccag

SEQ ID NO: 1759869 - RNA, 22 nt, Homo sapiens
cauuuauaauguagcagcucau

SEQ ID NO: 1759870 - RNA, 15 nt, Homo sapiens
accauguacauagcu

SEQ ID NO: 1759871 - RNA, 13 nt, Homo sapiens
caacaauacaugc

SEQ ID NO: 1759872 - RNA, 12 nt, Homo sapiens
aucagaauauca

SEQ ID NO: 1759873 - RNA, 22 nt, Homo sapiens
gugacccgugaaaaggacaaau

SEQ ID NO: 1759874 - RNA, 14 nt, Homo sapiens
agugcuagucucag

SEQ ID NO: 1759875 - RNA, 14 nt, Homo sapiens
ugccaaaacaaugc

SEQ ID NO: 1759876 - RNA, 17 nt, Homo sapiens
cagaguggauucuugaa

SEQ ID NO: 1759877 - RNA, 16 nt, Homo sapiens
auauuuuuguaaaaaa

SEQ ID NO: 1759878 - RNA, 22 nt, Homo sapiens
uccccuugggcucucaccacuu

SEQ ID NO: 1759879 - RNA, 14 nt, Homo sapiens
uaauccucuaugug

SEQ ID NO: 1759880 - RNA, 13 nt, Homo sapiens
ucugaagagccug

SEQ ID NO: 1759881 - RNA, 15 nt, Homo sapiens
aucauuggaauuccu

SEQ ID NO: 1759882 - RNA, 21 nt, Homo sapiens
ccauuagcccuucaccaucua

SEQ ID NO: 1759883 - RNA, 22 nt, Homo sapiens
augucauagccuuaugaguuag

SEQ ID NO: 1759884 - RNA, 16 nt, Homo sapiens
uauccauugaacuaaa

SEQ ID NO: 1759885 - RNA, 13 nt, Homo sapiens
uauucaaguauuc

SEQ ID NO: 1759886 - RNA, 13 nt, Homo sapiens
acacaaagacaca

SEQ ID NO: 1759887 - RNA, 22 nt, Homo sapiens
uccacguuuuuggaaaauguau

SEQ ID NO: 1759888 - RNA, 15 nt, Homo sapiens
uauguugaguguuca

SEQ ID NO: 1759889 - RNA, 23 nt, Homo sapiens
agugagguucuuaaaguuugcag

SEQ ID NO: 1759890 - RNA, 14 nt, Homo sapiens
ucuucuaaacuucc

SEQ ID NO: 1759891 - RNA, 11 nt, Homo sapiens
gggagcacugc

SEQ ID NO: 1759892 - RNA, 14 nt, Homo sapiens
cugcuuucuuguug

SEQ ID NO: 1759893 - RNA, 21 nt, Homo sapiens
ccuaaauagguuuuucuugcu

SEQ ID NO: 1759894 - RNA, 19 nt, Homo sapiens
auucaaaaauuaucuauag

SEQ ID NO: 1759895 - RNA, 22 nt, Homo sapiens
uagaaaggaagccuugcucauu

SEQ ID NO: 1759896 - RNA, 20 nt, Homo sapiens
aucuaaauuacagugcaguu

SEQ ID NO: 1759897 - RNA, 21 nt, Homo sapiens
uccaaaguaauguagcaugau

SEQ ID NO: 1759898 - RNA, 12 nt, Homo sapiens
uccugcuguauu

SEQ ID NO: 1759899 - RNA, 16 nt, Homo sapiens
ccuggccucugccauc

SEQ ID NO: 1759900 - RNA, 14 nt, Homo sapiens
caguccaaggggac

SEQ ID NO: 1759901 - RNA, 20 nt, Homo sapiens
auacacuuaaugauacaugu

SEQ ID NO: 1759902 - RNA, 12 nt, Homo sapiens
agagcaauguuu

SEQ ID NO: 1759903 - RNA, 16 nt, Homo sapiens
ccucucccuaggagaa

SEQ ID NO: 1759904 - RNA, 15 nt, Homo sapiens
gccucauuacuuuac

SEQ ID NO: 1759905 - RNA, 15 nt, Homo sapiens
aucucacuguuuuau

SEQ ID NO: 1759906 - RNA, 21 nt, Homo sapiens
accuuuggaaacaacauuuaa

SEQ ID NO: 1759907 - RNA, 15 nt, Homo sapiens
aggaacauacuucag

SEQ ID NO: 1759908 - RNA, 16 nt, Homo sapiens
ugugaauaaaaacccu

SEQ ID NO: 1759909 - RNA, 20 nt, Homo sapiens
augugggguccccaucaucc

SEQ ID NO: 1759910 - RNA, 14 nt, Homo sapiens
cuggggcuaugcau

SEQ ID NO: 1759911 - RNA, 18 nt, Homo sapiens
acuuucuguuccuuccuc

SEQ ID NO: 1759912 - RNA, 13 nt, Homo sapiens
acaaagcuucuau

SEQ ID NO: 1759913 - RNA, 13 nt, Homo sapiens
aguuugcuugaua

SEQ ID NO: 1759914 - RNA, 15 nt, Homo sapiens
uucuaucuaauccuu

SEQ ID NO: 1759915 - RNA, 20 nt, Homo sapiens
auaauuacuaauuaaucaca

SEQ ID NO: 1759916 - RNA, 18 nt, Homo sapiens
aggacucagaacagucug

SEQ ID NO: 1759917 - RNA, 15 nt, Homo sapiens
ugaaaaggguguugc

SEQ ID NO: 1759918 - RNA, 23 nt, Homo sapiens
uaaaaguucauaacagugccauu

SEQ ID NO: 1759919 - RNA, 16 nt, Homo sapiens
auaaguaccucagcau

SEQ ID NO: 1759920 - RNA, 17 nt, Homo sapiens
caaaacggaugaguuau

SEQ ID NO: 1759921 - RNA, 15 nt, Homo sapiens
ggacugugauuugaa

SEQ ID NO: 1759922 - RNA, 21 nt, Homo sapiens
uccaacaccaagcacagcagc

SEQ ID NO: 1759923 - RNA, 18 nt, Homo sapiens
gcucucccucucucucau

SEQ ID NO: 1759924 - RNA, 16 nt, Homo sapiens
cucauuguucagaaaa

SEQ ID NO: 1759925 - RNA, 16 nt, Homo sapiens
ucacagugaacauaac

SEQ ID NO: 1759926 - RNA, 18 nt, Homo sapiens
ucaguaagacgacaagga

SEQ ID NO: 1759927 - RNA, 20 nt, Homo sapiens
agagucuuguuuuuuauuca

SEQ ID NO: 1759928 - RNA, 15 nt, Homo sapiens
cugaaaaucuaauau

SEQ ID NO: 1759929 - RNA, 14 nt, Homo sapiens
ucuagaaacucugg

SEQ ID NO: 1759930 - RNA, 13 nt, Homo sapiens
ugauacugcaaua

SEQ ID NO: 1759931 - RNA, 13 nt, Homo sapiens
caagucugugagu

SEQ ID NO: 1759932 - RNA, 13 nt, Homo sapiens
cagagcuguggag

SEQ ID NO: 1759933 - RNA, 13 nt, Homo sapiens
caguucugugguu

SEQ ID NO: 1759934 - RNA, 17 nt, Homo sapiens
uccagucuucuuuauca

SEQ ID NO: 1759935 - RNA, 17 nt, Homo sapiens
acacagcaggacuccau

SEQ ID NO: 1759936 - RNA, 17 nt, Homo sapiens
ugccuccaacccagcag

SEQ ID NO: 1759937 - RNA, 13 nt, Homo sapiens
gugauauguuggu

SEQ ID NO: 1759938 - RNA, 15 nt, Homo sapiens
acuucgaugaugaug

SEQ ID NO: 1759939 - RNA, 20 nt, Homo sapiens
acgcuuuaugcccuugccuc

SEQ ID NO: 1759940 - RNA, 13 nt, Homo sapiens
ugccccuucuuau

SEQ ID NO: 1759941 - RNA, 11 nt, Homo sapiens
aaaauccauuu

SEQ ID NO: 1759942 - RNA, 16 nt, Homo sapiens
gcuggaagucuaccug

SEQ ID NO: 1759943 - RNA, 14 nt, Homo sapiens
ucuugcauugcaaa

SEQ ID NO: 1759944 - RNA, 14 nt, Homo sapiens
agaacugacaugca

SEQ ID NO: 1759945 - RNA, 14 nt, Homo sapiens
gaaugggacuguga

SEQ ID NO: 1759946 - RNA, 13 nt, Homo sapiens
cagaccugcaugg

SEQ ID NO: 1759947 - RNA, 13 nt, Homo sapiens
aagaaacuuuguu

SEQ ID NO: 1759948 - RNA, 16 nt, Homo sapiens
uagggaaggacaaagg

SEQ ID NO: 1759949 - RNA, 13 nt, Homo sapiens
caaauaguuguaa

SEQ ID NO: 1759950 - RNA, 16 nt, Homo sapiens
agcccuaauagcagaa

SEQ ID NO: 1759951 - RNA, 20 nt, Homo sapiens
aggugugagccaccgugccc

SEQ ID NO: 1759952 - RNA, 20 nt, Homo sapiens
aggcgugagccaccgugccu

SEQ ID NO: 1759953 - RNA, 21 nt, Homo sapiens
aaaaugucucaauggugcuau

SEQ ID NO: 1759954 - RNA, 20 nt, Homo sapiens
aauaguggaucucaguuuuu

SEQ ID NO: 1759955 - RNA, 23 nt, Homo sapiens
acaucucauccaucaaguugcac

SEQ ID NO: 1759956 - RNA, 22 nt, Homo sapiens
aaaguuccacuuagagaacaaa

SEQ ID NO: 1759957 - RNA, 14 nt, Homo sapiens
aauaaaaaucacuu

SEQ ID NO: 1759958 - RNA, 19 nt, Homo sapiens
aaguucaaaagcugguggu

SEQ ID NO: 1759959 - RNA, 13 nt, Homo sapiens
cucaucacauaaa

SEQ ID NO: 1759960 - RNA, 13 nt, Homo sapiens
cacgucacaaaga

SEQ ID NO: 1759961 - RNA, 17 nt, Homo sapiens
auaaaaugauccugcca

SEQ ID NO: 1759962 - RNA, 14 nt, Homo sapiens
aaucuccaguuuuc

SEQ ID NO: 1759963 - RNA, 15 nt, Homo sapiens
accagcaacauuaua

SEQ ID NO: 1759964 - RNA, 16 nt, Homo sapiens
agaguggagucugagu

SEQ ID NO: 1759965 - RNA, 13 nt, Homo sapiens
acugaaacuggaa

SEQ ID NO: 1759966 - RNA, 18 nt, Homo sapiens
ugggcuccuccagggugu

SEQ ID NO: 1759967 - RNA, 20 nt, Homo sapiens
uagauuguccuuuugcaaag

SEQ ID NO: 1759968 - RNA, 21 nt, Homo sapiens
cucugcauacccucaucaaaa

SEQ ID NO: 1759969 - RNA, 21 nt, Homo sapiens
agguauuuuguagaugugauu

SEQ ID NO: 1759970 - RNA, 18 nt, Homo sapiens
agaauaaaaacuuccuuc

SEQ ID NO: 1759971 - RNA, 15 nt, Homo sapiens
ucagaagacacagag

SEQ ID NO: 1759972 - RNA, 20 nt, Homo sapiens
acugaccugcccauguccag

SEQ ID NO: 1759973 - RNA, 16 nt, Homo sapiens
aaucaaugugacaugu

SEQ ID NO: 1759974 - RNA, 21 nt, Homo sapiens
caaagauuaaaugugucauug

SEQ ID NO: 1759975 - RNA, 15 nt, Homo sapiens
ccauuucauugcuca

SEQ ID NO: 1759976 - RNA, 15 nt, Homo sapiens
uccccugguccugca

SEQ ID NO: 1759977 - RNA, 14 nt, Homo sapiens
aauuacccuuuugu

SEQ ID NO: 1759978 - RNA, 18 nt, Homo sapiens
caauuccaccagggccag

SEQ ID NO: 1759979 - RNA, 15 nt, Homo sapiens
agaguauccuaccca

SEQ ID NO: 1759980 - RNA, 16 nt, Homo sapiens
cccuggccauccacaa

SEQ ID NO: 1759981 - RNA, 18 nt, Homo sapiens
uucuagguaauuugccac

SEQ ID NO: 1759982 - RNA, 18 nt, Homo sapiens
accccgauccguuugcaa

SEQ ID NO: 1759983 - RNA, 13 nt, Homo sapiens
ggagaaacccuuc

SEQ ID NO: 1759984 - RNA, 19 nt, Homo sapiens
aacaaauauguucucugaa

SEQ ID NO: 1759985 - RNA, 19 nt, Homo sapiens
acaggcucugagauuucac

SEQ ID NO: 1759986 - RNA, 21 nt, Homo sapiens
uugcaccaggcacugcugcac

SEQ ID NO: 1759987 - RNA, 14 nt, Homo sapiens
uucuggacaugacg

SEQ ID NO: 1759988 - RNA, 20 nt, Homo sapiens
uaacuuuauuggucuugccc

SEQ ID NO: 1759989 - RNA, 17 nt, Homo sapiens
cagcggcuccaacuccu

SEQ ID NO: 1759990 - RNA, 22 nt, Homo sapiens
uacaggcuggagauuuucacau

SEQ ID NO: 1759991 - RNA, 21 nt, Homo sapiens
auaugcacuuucccuagaaag

SEQ ID NO: 1759992 - RNA, 15 nt, Homo sapiens
ucuucauucuuugaa

SEQ ID NO: 1759993 - RNA, 19 nt, Homo sapiens
guguuugucaaaaagucau

SEQ ID NO: 1759994 - RNA, 13 nt, Homo sapiens
ugcgcucuuggga

SEQ ID NO: 1759995 - RNA, 13 nt, Homo sapiens
ccagugcugccac

SEQ ID NO: 1759996 - RNA, 16 nt, Homo sapiens
cucugauugcuuuauc

SEQ ID NO: 1759997 - RNA, 20 nt, Homo sapiens
ucuuugauucaaagcacugu

SEQ ID NO: 1759998 - RNA, 13 nt, Homo sapiens
aaucaaggauaaa

SEQ ID NO: 1759999 - RNA, 19 nt, Homo sapiens
acguagugucauguucugu

SEQ ID NO: 1760000 - RNA, 18 nt, Homo sapiens
ggaggagagaaguggcca

SEQ ID NO: 1760001 - RNA, 16 nt, Homo sapiens
gaaugaugcucaaaau

SEQ ID NO: 1760002 - RNA, 20 nt, Homo sapiens
agggguuuucccaugacucu

SEQ ID NO: 1760003 - RNA, 17 nt, Homo sapiens
gggugggauaauggacu

SEQ ID NO: 1760004 - RNA, 17 nt, Homo sapiens
aggaguuagaaccacag

SEQ ID NO: 1760005 - RNA, 19 nt, Homo sapiens
ucagaggggaggcucagga

SEQ ID NO: 1760006 - RNA, 17 nt, Homo sapiens
agguauuuacacauaca

SEQ ID NO: 1760007 - RNA, 22 nt, Homo sapiens
cuacagguccaggguuguuaga

SEQ ID NO: 1760008 - RNA, 20 nt, Homo sapiens
cuuauuaugcauaaagccaa

SEQ ID NO: 1760009 - RNA, 16 nt, Homo sapiens
gauucucugaguggug

SEQ ID NO: 1760010 - RNA, 14 nt, Homo sapiens
gaccugugugccag

SEQ ID NO: 1760011 - RNA, 18 nt, Homo sapiens
uuaagcacacuaaaccaa

SEQ ID NO: 1760012 - RNA, 15 nt, Homo sapiens
aucacggugugaguu

SEQ ID NO: 1760013 - RNA, 22 nt, Homo sapiens
uuacagauguagauauaaauau

SEQ ID NO: 1760014 - RNA, 16 nt, Homo sapiens
aagugaguacuguuaa

SEQ ID NO: 1760015 - RNA, 18 nt, Homo sapiens
cuucucuucacagucaca

SEQ ID NO: 1760016 - RNA, 22 nt, Homo sapiens
ucaaacuguaaaaauaacauaa

SEQ ID NO: 1760017 - RNA, 15 nt, Homo sapiens
acaucauaauuacau

SEQ ID NO: 1760018 - RNA, 22 nt, Homo sapiens
uauccacaaaugacugcaaaag

SEQ ID NO: 1760019 - RNA, 12 nt, Homo sapiens
caugaucucaau

SEQ ID NO: 1760020 - RNA, 17 nt, Homo sapiens
ggcaugauucuacccuu

SEQ ID NO: 1760021 - RNA, 14 nt, Homo sapiens
gauugcccgugaag

SEQ ID NO: 1760022 - RNA, 18 nt, Homo sapiens
gaaugaggcuugcugaga

SEQ ID NO: 1760023 - RNA, 16 nt, Homo sapiens
cgcaugugcagcuauu

SEQ ID NO: 1760024 - RNA, 15 nt, Homo sapiens
gcugcuccgguuugg

SEQ ID NO: 1760025 - RNA, 14 nt, Homo sapiens
ccugacaugucuca

SEQ ID NO: 1760026 - RNA, 21 nt, Homo sapiens
uuccgauggaugaaucuccca

SEQ ID NO: 1760027 - RNA, 14 nt, Homo sapiens
ccuuacuguuuaca

SEQ ID NO: 1760028 - RNA, 20 nt, Homo sapiens
auguuuuucuguauaacagc

SEQ ID NO: 1760029 - RNA, 20 nt, Homo sapiens
ugccuucaaaucaaucugua

SEQ ID NO: 1760030 - RNA, 12 nt, Homo sapiens
cuuugugcccua

SEQ ID NO: 1760031 - RNA, 19 nt, Homo sapiens
cugauuugcaaaugcacau

SEQ ID NO: 1760032 - RNA, 22 nt, Homo sapiens
aauucugauuuauuccuacauu

SEQ ID NO: 1760033 - RNA, 19 nt, Homo sapiens
cucaacaggccucagggcu

SEQ ID NO: 1760034 - RNA, 19 nt, Homo sapiens
uccucaguucucaaaugug

SEQ ID NO: 1760035 - RNA, 17 nt, Homo sapiens
auucuaguggcuguuca

SEQ ID NO: 1760036 - RNA, 18 nt, Homo sapiens
auuauuuuuccacuuugu

SEQ ID NO: 1760037 - RNA, 19 nt, Homo sapiens
aacaaauauauauauguau

SEQ ID NO: 1760038 - RNA, 19 nt, Homo sapiens
aaugaugccccagagcucu

SEQ ID NO: 1760039 - RNA, 18 nt, Homo sapiens
guuaaagguucacagggg

SEQ ID NO: 1760040 - RNA, 16 nt, Homo sapiens
ugcccagaugaacugg

SEQ ID NO: 1760041 - RNA, 14 nt, Homo sapiens
uucuaagauucuaa

SEQ ID NO: 1760042 - RNA, 14 nt, Homo sapiens
gaaaaugagaaaau

SEQ ID NO: 1760043 - RNA, 14 nt, Homo sapiens
cuccuggacuccug

SEQ ID NO: 1760044 - RNA, 14 nt, Homo sapiens
caguaugacaguau

SEQ ID NO: 1760045 - RNA, 17 nt, Homo sapiens
uugagauacuaucauua

SEQ ID NO: 1760046 - RNA, 18 nt, Homo sapiens
ugcaacaaaaagucauuu

SEQ ID NO: 1760047 - RNA, 20 nt, Homo sapiens
cuuaacuguuucaaagccaa

SEQ ID NO: 1760048 - RNA, 24 nt, Homo sapiens
cacccacgugcauucacauugacc

SEQ ID NO: 1760049 - RNA, 21 nt, Homo sapiens
guuuaccucacuggugcauuu

SEQ ID NO: 1760050 - RNA, 18 nt, Homo sapiens
guaaugaaacaccuucuc

SEQ ID NO: 1760051 - RNA, 21 nt, Homo sapiens
ugaccucucagggccuggcag

SEQ ID NO: 1760052 - RNA, 16 nt, Homo sapiens
ccagcuuagaguucuu

SEQ ID NO: 1760053 - RNA, 21 nt, Homo sapiens
gccugcccgccuccuauagca

SEQ ID NO: 1760054 - RNA, 18 nt, Homo sapiens
ugagcaugcacagcugcu

SEQ ID NO: 1760055 - RNA, 14 nt, Homo sapiens
aaagccucuggaaa

SEQ ID NO: 1760056 - RNA, 15 nt, Homo sapiens
gggcccccacaggag

SEQ ID NO: 1760057 - RNA, 23 nt, Homo sapiens
gcccuccccaggcgauggacaau

SEQ ID NO: 1760058 - RNA, 22 nt, Homo sapiens
cuaguacaaccuuguugcuuua

SEQ ID NO: 1760059 - RNA, 13 nt, Homo sapiens
uuaacugaugaca

SEQ ID NO: 1760060 - RNA, 15 nt, Homo sapiens
caguaaggcagugca

SEQ ID NO: 1760061 - RNA, 12 nt, Homo sapiens
uuuaagaagcau

SEQ ID NO: 1760062 - RNA, 14 nt, Homo sapiens
cacgcccuccucag

SEQ ID NO: 1760063 - RNA, 20 nt, Homo sapiens
cagcaagcccuacagagcug

SEQ ID NO: 1760064 - RNA, 21 nt, Homo sapiens
acugacaaaucaaguuuccaa

SEQ ID NO: 1760065 - RNA, 22 nt, Homo sapiens
augaaugacaguagucacacau

SEQ ID NO: 1760066 - RNA, 20 nt, Homo sapiens
aucugguuauaucauucugg

SEQ ID NO: 1760067 - RNA, 13 nt, Homo sapiens
acugaacuugaag

SEQ ID NO: 1760068 - RNA, 19 nt, Homo sapiens
gcagguguucuucauuacc

SEQ ID NO: 1760069 - RNA, 12 nt, Homo sapiens
uaauaacuuugc

SEQ ID NO: 1760070 - RNA, 13 nt, Homo sapiens
ucuacaguauuau

SEQ ID NO: 1760071 - RNA, 17 nt, Homo sapiens
cuuauccaugccuggga

SEQ ID NO: 1760072 - RNA, 17 nt, Homo sapiens
ugccccccaugaggaag

SEQ ID NO: 1760073 - RNA, 17 nt, Homo sapiens
auuuuuaacugcuucaa

SEQ ID NO: 1760074 - RNA, 17 nt, Homo sapiens
cauggcuguguuugcag

SEQ ID NO: 1760075 - RNA, 18 nt, Homo sapiens
uuguaaaauggugugacc

SEQ ID NO: 1760076 - RNA, 19 nt, Homo sapiens
cucuaaagaauucuugaaa

SEQ ID NO: 1760077 - RNA, 18 nt, Homo sapiens
uaucaccucuuaugcaca

SEQ ID NO: 1760078 - RNA, 18 nt, Homo sapiens
uaaaucaauuacagauua

SEQ ID NO: 1760079 - RNA, 15 nt, Homo sapiens
uccaacuccaggaua

SEQ ID NO: 1760080 - RNA, 18 nt, Homo sapiens
acuucaugaggaggucag

SEQ ID NO: 1760081 - RNA, 14 nt, Homo sapiens
aaaugaucaugaaa

SEQ ID NO: 1760082 - RNA, 13 nt, Homo sapiens
cuacacugaugca

SEQ ID NO: 1760083 - RNA, 16 nt, Homo sapiens
uucaauuugaacucag

SEQ ID NO: 1760084 - RNA, 21 nt, Homo sapiens
gaaaaucuaccaagaacagag

SEQ ID NO: 1760085 - RNA, 21 nt, Homo sapiens
uugugaaaacgcaaacaugaa

SEQ ID NO: 1760086 - RNA, 13 nt, Homo sapiens
gcuuugauaaugu

SEQ ID NO: 1760087 - RNA, 15 nt, Homo sapiens
auuuuacauuuaucu

SEQ ID NO: 1760088 - RNA, 18 nt, Homo sapiens
acucuccucgcugacccu

SEQ ID NO: 1760089 - RNA, 13 nt, Homo sapiens
uguucacacugca

SEQ ID NO: 1760090 - RNA, 15 nt, Homo sapiens
ucaagccccauuucc

SEQ ID NO: 1760091 - RNA, 23 nt, Homo sapiens
ucaaguacuguaacugugucaug

SEQ ID NO: 1760092 - RNA, 23 nt, Homo sapiens
ugaacagguucucuuccuggcau

SEQ ID NO: 1760093 - RNA, 16 nt, Homo sapiens
agccaacuuuaauugc

SEQ ID NO: 1760094 - RNA, 24 nt, Homo sapiens
cuggaaguggagaggauccuucug

SEQ ID NO: 1760095 - RNA, 18 nt, Homo sapiens
gacagaaugagaccaaac

SEQ ID NO: 1760096 - RNA, 18 nt, Homo sapiens
gacagaacacccaauuca

SEQ ID NO: 1760097 - RNA, 13 nt, Homo sapiens
gacuacagacauu

SEQ ID NO: 1760098 - RNA, 17 nt, Homo sapiens
gcucccacaggggccau

SEQ ID NO: 1760099 - RNA, 22 nt, Homo sapiens
aaaugcuguauuagucacagag

SEQ ID NO: 1760100 - RNA, 13 nt, Homo sapiens
uuuauugcaaugc

SEQ ID NO: 1760101 - RNA, 12 nt, Homo sapiens
ugaaaaaagccu

SEQ ID NO: 1760102 - RNA, 15 nt, Homo sapiens
aaguacuaaaucuca

SEQ ID NO: 1760103 - RNA, 13 nt, Homo sapiens
uccagaacacucu

SEQ ID NO: 1760104 - RNA, 22 nt, Homo sapiens
acacugaguucuaucaguuauc

SEQ ID NO: 1760105 - RNA, 19 nt, Homo sapiens
ccuauaauaaaauggcacc

SEQ ID NO: 1760106 - RNA, 18 nt, Homo sapiens
uucuuacacugugucauu

SEQ ID NO: 1760107 - RNA, 20 nt, Homo sapiens
cgugaggccccugugcagua

SEQ ID NO: 1760108 - RNA, 19 nt, Homo sapiens
ggaggccagccagugaccu

SEQ ID NO: 1760109 - RNA, 19 nt, Homo sapiens
cgacccuugagaagcugcc

SEQ ID NO: 1760110 - RNA, 17 nt, Homo sapiens
uccagccaguacaguau

SEQ ID NO: 1760111 - RNA, 14 nt, Homo sapiens
uccaaaggaucuua

SEQ ID NO: 1760112 - RNA, 17 nt, Homo sapiens
aaauugauuucuucuca

SEQ ID NO: 1760113 - RNA, 22 nt, Homo sapiens
cugcccugagcccuccacguca

SEQ ID NO: 1760114 - RNA, 23 nt, Homo sapiens
gcacggccuuguucuaacccgga

SEQ ID NO: 1760115 - RNA, 12 nt, Homo sapiens
agcccuguaaca

SEQ ID NO: 1760116 - RNA, 14 nt, Homo sapiens
cugaggguuuccac

SEQ ID NO: 1760117 - RNA, 21 nt, Homo sapiens
uaaaaauaucacacugaauaa

SEQ ID NO: 1760118 - RNA, 19 nt, Homo sapiens
uuaauaaagaauuaacaga

SEQ ID NO: 1760119 - RNA, 14 nt, Homo sapiens
auuuuaggcuauua

SEQ ID NO: 1760120 - RNA, 20 nt, Homo sapiens
acauaucaccucauggccua

SEQ ID NO: 1760121 - RNA, 18 nt, Homo sapiens
ugaauuuuaaaaugcaaa

SEQ ID NO: 1760122 - RNA, 15 nt, Homo sapiens
ucacugcagccucag

SEQ ID NO: 1760123 - RNA, 12 nt, Homo sapiens
uuaauauugaua

SEQ ID NO: 1760124 - RNA, 17 nt, Homo sapiens
cagggguggggggugca

SEQ ID NO: 1760125 - RNA, 14 nt, Homo sapiens
uuggugggggagcc

SEQ ID NO: 1760126 - RNA, 22 nt, Homo sapiens
auauguccacuguucuguucuc

SEQ ID NO: 1760127 - RNA, 20 nt, Homo sapiens
cuugagcaagaugauguaau

SEQ ID NO: 1760128 - RNA, 15 nt, Homo sapiens
gagcugaguaaaaug

SEQ ID NO: 1760129 - RNA, 15 nt, Homo sapiens
ucuuacauuagugau

SEQ ID NO: 1760130 - RNA, 15 nt, Homo sapiens
gaaaugaacauucca

SEQ ID NO: 1760131 - RNA, 21 nt, Homo sapiens
uccugcaucccgauaccucag

SEQ ID NO: 1760132 - RNA, 15 nt, Homo sapiens
aaauuacacaauaaa

SEQ ID NO: 1760133 - RNA, 21 nt, Homo sapiens
aucaucuauguauucaaguaa

SEQ ID NO: 1760134 - RNA, 19 nt, Homo sapiens
uaauaaaacuaaacuuuca

SEQ ID NO: 1760135 - RNA, 23 nt, Homo sapiens
guaucugucuuuccacucuggau

SEQ ID NO: 1760136 - RNA, 19 nt, Homo sapiens
auuguacauaaguaccuca

SEQ ID NO: 1760137 - RNA, 19 nt, Homo sapiens
ggccucucugccugggaug

SEQ ID NO: 1760138 - RNA, 21 nt, Homo sapiens
uuaaaaagccaguuuggguaa

SEQ ID NO: 1760139 - RNA, 15 nt, Homo sapiens
cuaccccuuuacaaa

SEQ ID NO: 1760140 - RNA, 15 nt, Homo sapiens
uguguaaauacaauu

SEQ ID NO: 1760141 - RNA, 17 nt, Homo sapiens
gccuuggaggacccagc

SEQ ID NO: 1760142 - RNA, 15 nt, Homo sapiens
ccgaaaaucauauaa

SEQ ID NO: 1760143 - RNA, 21 nt, Homo sapiens
ccuaucauuuccguuuugccu

SEQ ID NO: 1760144 - RNA, 10 nt, Homo sapiens
accucugcau

SEQ ID NO: 1760145 - RNA, 17 nt, Homo sapiens
uuuaccuucaaacuuua

SEQ ID NO: 1760146 - RNA, 17 nt, Homo sapiens
aaauccgcuuuucugcc

SEQ ID NO: 1760147 - RNA, 13 nt, Homo sapiens
aaaauguuaacaa

SEQ ID NO: 1760148 - RNA, 22 nt, Homo sapiens
uucaauugcuucugugcaauaa

SEQ ID NO: 1760149 - RNA, 16 nt, Homo sapiens
cacauucuuaucucca

SEQ ID NO: 1760150 - RNA, 20 nt, Homo sapiens
augauaauaaucaugaucac

SEQ ID NO: 1760151 - RNA, 22 nt, Homo sapiens
cucccagaggagccaccaguuc

SEQ ID NO: 1760152 - RNA, 14 nt, Homo sapiens
acaaaaaaccacaa

SEQ ID NO: 1760153 - RNA, 14 nt, Homo sapiens
cuaaaaaaauacaa

SEQ ID NO: 1760154 - RNA, 16 nt, Homo sapiens
ggccagcgcgaugaac

SEQ ID NO: 1760155 - RNA, 15 nt, Homo sapiens
uuuuagcuacaucua

SEQ ID NO: 1760156 - RNA, 14 nt, Homo sapiens
gcugaacaugccug

SEQ ID NO: 1760157 - RNA, 20 nt, Homo sapiens
augcuucacaucucuucacu

SEQ ID NO: 1760158 - RNA, 15 nt, Homo sapiens
aucucaaagaaggca

SEQ ID NO: 1760159 - RNA, 21 nt, Homo sapiens
acagaggggcucgguggccca

SEQ ID NO: 1760160 - RNA, 15 nt, Homo sapiens
gcuaggaacaugugg

SEQ ID NO: 1760161 - RNA, 19 nt, Homo sapiens
agcccugugucuguauaca

SEQ ID NO: 1760162 - RNA, 20 nt, Homo sapiens
auaagggaaaaaucaaguau

SEQ ID NO: 1760163 - RNA, 14 nt, Homo sapiens
auaaaacugaaucu

SEQ ID NO: 1760164 - RNA, 17 nt, Homo sapiens
gaaaauaucagcuuuuc

SEQ ID NO: 1760165 - RNA, 20 nt, Homo sapiens
acuuuaaaagcuucugcaau

SEQ ID NO: 1760166 - RNA, 18 nt, Homo sapiens
cuagugacuuccugguga

SEQ ID NO: 1760167 - RNA, 17 nt, Homo sapiens
auacauuagugccauag

SEQ ID NO: 1760168 - RNA, 18 nt, Homo sapiens
acuacugcccacaccaac

SEQ ID NO: 1760169 - RNA, 20 nt, Homo sapiens
aucacuuucucaguuuucau

SEQ ID NO: 1760170 - RNA, 18 nt, Homo sapiens
gcacacaccacacacagc

SEQ ID NO: 1760171 - RNA, 21 nt, Homo sapiens
gccggaaaaggcgcaucuaac

SEQ ID NO: 1760172 - RNA, 17 nt, Homo sapiens
cucagagugguggggga

SEQ ID NO: 1760173 - RNA, 17 nt, Homo sapiens
aggaaaaggcugguaca

SEQ ID NO: 1760174 - RNA, 16 nt, Homo sapiens
ugaggaaaagacugug

SEQ ID NO: 1760175 - RNA, 23 nt, Homo sapiens
agacucccuugcuuuuugcugug

SEQ ID NO: 1760176 - RNA, 23 nt, Homo sapiens
ugagaucgugccauuacacucca

SEQ ID NO: 1760177 - RNA, 13 nt, Homo sapiens
cucucauguuccu

SEQ ID NO: 1760178 - RNA, 21 nt, Homo sapiens
aaagggaagucuagaguuccu

SEQ ID NO: 1760179 - RNA, 22 nt, Homo sapiens
gaaacauaguaauuaguagaaa

SEQ ID NO: 1760180 - RNA, 16 nt, Homo sapiens
cccuagccaaugucuc

SEQ ID NO: 1760181 - RNA, 22 nt, Homo sapiens
gaacacguuuuuucacuauuaa

SEQ ID NO: 1760182 - RNA, 15 nt, Homo sapiens
auauuccaugacuca

SEQ ID NO: 1760183 - RNA, 14 nt, Homo sapiens
ugacgcagcacaag

SEQ ID NO: 1760184 - RNA, 18 nt, Homo sapiens
guuucuauggauucacuu

SEQ ID NO: 1760185 - RNA, 23 nt, Homo sapiens
aggacugcgggacuugggucuca

SEQ ID NO: 1760186 - RNA, 20 nt, Homo sapiens
cuaguaagaugcacugaaaa

SEQ ID NO: 1760187 - RNA, 14 nt, Homo sapiens
gagaguuucuggau

SEQ ID NO: 1760188 - RNA, 13 nt, Homo sapiens
cauuuagucuucc

SEQ ID NO: 1760189 - RNA, 22 nt, Homo sapiens
gcccaaggaugccuuagcaugu

SEQ ID NO: 1760190 - RNA, 13 nt, Homo sapiens
uuaguaauuguaa

SEQ ID NO: 1760191 - RNA, 16 nt, Homo sapiens
ggcuaucugcauuuau

SEQ ID NO: 1760192 - RNA, 15 nt, Homo sapiens
ucuuuguuucugcuu

SEQ ID NO: 1760193 - RNA, 14 nt, Homo sapiens
ugaccauucugccu

SEQ ID NO: 1760194 - RNA, 17 nt, Homo sapiens
gcaugccuggucuuucc

SEQ ID NO: 1760195 - RNA, 15 nt, Homo sapiens
cauacacaugagaua

SEQ ID NO: 1760196 - RNA, 15 nt, Homo sapiens
caagcacauguaaua

SEQ ID NO: 1760197 - RNA, 20 nt, Homo sapiens
ucuggcuccuguguggaguu

SEQ ID NO: 1760198 - RNA, 13 nt, Homo sapiens
uccacagugccua

SEQ ID NO: 1760199 - RNA, 17 nt, Homo sapiens
ggcugcaaggagcaaca

SEQ ID NO: 1760200 - RNA, 22 nt, Homo sapiens
ugcccaucccuggaaggugcug

SEQ ID NO: 1760201 - RNA, 15 nt, Homo sapiens
augucgaacucugaa

SEQ ID NO: 1760202 - RNA, 12 nt, Homo sapiens
gcuagggguccu

SEQ ID NO: 1760203 - RNA, 23 nt, Homo sapiens
ggaagguuaugcuccuggcacag

SEQ ID NO: 1760204 - RNA, 19 nt, Homo sapiens
uuauuggcugagauaugaa

SEQ ID NO: 1760205 - RNA, 12 nt, Homo sapiens
auuguccaggcu

SEQ ID NO: 1760206 - RNA, 21 nt, Homo sapiens
caguacucaggcagugcagua

SEQ ID NO: 1760207 - RNA, 16 nt, Homo sapiens
ugcuuacaaaguauau

SEQ ID NO: 1760208 - RNA, 17 nt, Homo sapiens
uaauauuuucuguguaa

SEQ ID NO: 1760209 - RNA, 21 nt, Homo sapiens
uaauaacuuucucugugaaag

SEQ ID NO: 1760210 - RNA, 14 nt, Homo sapiens
aaauuuccagagaa

SEQ ID NO: 1760211 - RNA, 16 nt, Homo sapiens
uuguaucguguggugu

SEQ ID NO: 1760212 - RNA, 22 nt, Homo sapiens
aagagcaaaucaauucuaguca

SEQ ID NO: 1760213 - RNA, 22 nt, Homo sapiens
ggaucucaccaggcagccucug

SEQ ID NO: 1760214 - RNA, 16 nt, Homo sapiens
agaaacaaaagugcau

SEQ ID NO: 1760215 - RNA, 18 nt, Homo sapiens
cuccugggcuaagugauc

SEQ ID NO: 1760216 - RNA, 20 nt, Homo sapiens
ugccagucucuucugauuaa

SEQ ID NO: 1760217 - RNA, 16 nt, Homo sapiens
cugccuaaaaugaauu

SEQ ID NO: 1760218 - RNA, 20 nt, Homo sapiens
acuuccuagagcaucugucc

SEQ ID NO: 1760219 - RNA, 16 nt, Homo sapiens
caguaacauuucauua

SEQ ID NO: 1760220 - RNA, 15 nt, Homo sapiens
gcacuaaaugcacaa

SEQ ID NO: 1760221 - RNA, 19 nt, Homo sapiens
aaauaaauucaaauuauuc

SEQ ID NO: 1760222 - RNA, 13 nt, Homo sapiens
uagaggaagaaua

SEQ ID NO: 1760223 - RNA, 19 nt, Homo sapiens
uuauaagcauacaacugga

SEQ ID NO: 1760224 - RNA, 20 nt, Homo sapiens
uagcaguucugcaaauagaa

SEQ ID NO: 1760225 - RNA, 16 nt, Homo sapiens
gugccaaauuauucuc

SEQ ID NO: 1760226 - RNA, 12 nt, Homo sapiens
uguuacauuagg

SEQ ID NO: 1760227 - RNA, 16 nt, Homo sapiens
cuuugcccacgugucc

SEQ ID NO: 1760228 - RNA, 23 nt, Homo sapiens
uucagauaauugaauaaguaccu

SEQ ID NO: 1760229 - RNA, 17 nt, Homo sapiens
uuaauggauucaguauu

SEQ ID NO: 1760230 - RNA, 16 nt, Homo sapiens
aaguuucagauuugcc

SEQ ID NO: 1760231 - RNA, 20 nt, Homo sapiens
uaccuacacccaagguuguc

SEQ ID NO: 1760232 - RNA, 16 nt, Homo sapiens
cacucauacaucuggc

SEQ ID NO: 1760233 - RNA, 12 nt, Homo sapiens
aaacaaaaagcc

SEQ ID NO: 1760234 - RNA, 17 nt, Homo sapiens
ccugcuauguauuugca

SEQ ID NO: 1760235 - RNA, 14 nt, Homo sapiens
ggccaccucucagg

SEQ ID NO: 1760236 - RNA, 13 nt, Homo sapiens
acaauaagcagag

SEQ ID NO: 1760237 - RNA, 17 nt, Homo sapiens
aggaagcuccacuguca

SEQ ID NO: 1760238 - RNA, 22 nt, Homo sapiens
uggguuucacgaguguuccugu

SEQ ID NO: 1760239 - RNA, 14 nt, Homo sapiens
ucacuuucccugau

SEQ ID NO: 1760240 - RNA, 14 nt, Homo sapiens
uaacauuccauguu

SEQ ID NO: 1760241 - RNA, 22 nt, Homo sapiens
ccaucauacauuagugccauag

SEQ ID NO: 1760242 - RNA, 14 nt, Homo sapiens
guaaugaaacaaag

SEQ ID NO: 1760243 - RNA, 18 nt, Homo sapiens
uuccuggcugaugaucca

SEQ ID NO: 1760244 - RNA, 20 nt, Homo sapiens
uuaauagcuuuagggguaca

SEQ ID NO: 1760245 - RNA, 15 nt, Homo sapiens
aacacuauccaauga

SEQ ID NO: 1760246 - RNA, 13 nt, Homo sapiens
uaaauuucugcuu

SEQ ID NO: 1760247 - RNA, 12 nt, Homo sapiens
acugucacauaa

SEQ ID NO: 1760248 - RNA, 12 nt, Homo sapiens
ccuuguaaaaua

SEQ ID NO: 1760249 - RNA, 17 nt, Homo sapiens
caacaugguuaccucug

SEQ ID NO: 1760250 - RNA, 19 nt, Homo sapiens
auacuuuauuucugaucua

SEQ ID NO: 1760251 - RNA, 18 nt, Homo sapiens
cuuuugcacaaggaaaua

SEQ ID NO: 1760252 - RNA, 20 nt, Homo sapiens
uuauuauggucauauuucac

SEQ ID NO: 1760253 - RNA, 13 nt, Homo sapiens
uuuugaaauccaa

SEQ ID NO: 1760254 - RNA, 14 nt, Homo sapiens
uuguuuaucuagca

SEQ ID NO: 1760255 - RNA, 14 nt, Homo sapiens
augcugaccugugu

SEQ ID NO: 1760256 - RNA, 13 nt, Homo sapiens
agauuuuccauug

SEQ ID NO: 1760257 - RNA, 20 nt, Homo sapiens
guauugaaucuaaaaccaaa

SEQ ID NO: 1760258 - RNA, 19 nt, Homo sapiens
auucccuugaaauuuagau

SEQ ID NO: 1760259 - RNA, 19 nt, Homo sapiens
cauagaauggcacauguca

SEQ ID NO: 1760260 - RNA, 14 nt, Homo sapiens
ugcauugcucuuau

SEQ ID NO: 1760261 - RNA, 14 nt, Homo sapiens
cagaacucuuucaa

SEQ ID NO: 1760262 - RNA, 15 nt, Homo sapiens
acugaucuuacucac

SEQ ID NO: 1760263 - RNA, 17 nt, Homo sapiens
cuuggacguuggggcaa

SEQ ID NO: 1760264 - RNA, 15 nt, Homo sapiens
uggauuuuuccuuaa

SEQ ID NO: 1760265 - RNA, 18 nt, Homo sapiens
augugcugguauccacag

SEQ ID NO: 1760266 - RNA, 17 nt, Homo sapiens
aauuggcuuccagauuu

SEQ ID NO: 1760267 - RNA, 20 nt, Homo sapiens
uccacguaagucacugaaaa

SEQ ID NO: 1760268 - RNA, 15 nt, Homo sapiens
acauugucaccauuu

SEQ ID NO: 1760269 - RNA, 15 nt, Homo sapiens
ggaaagaaauacagu

SEQ ID NO: 1760270 - RNA, 20 nt, Homo sapiens
acacaguccaacucuuccac

SEQ ID NO: 1760271 - RNA, 11 nt, Homo sapiens
uuugugugauc

SEQ ID NO: 1760272 - RNA, 15 nt, Homo sapiens
auuccuucuacaugu

SEQ ID NO: 1760273 - RNA, 10 nt, Homo sapiens
cauguguuag

SEQ ID NO: 1760274 - RNA, 13 nt, Homo sapiens
gcuuuccccaugu

SEQ ID NO: 1760275 - RNA, 16 nt, Homo sapiens
auuuaugaaucacagu

SEQ ID NO: 1760276 - RNA, 15 nt, Homo sapiens
agaacuaaaguaucu

SEQ ID NO: 1760277 - RNA, 21 nt, Homo sapiens
ccuguucuguuuugccugaag

SEQ ID NO: 1760278 - RNA, 22 nt, Homo sapiens
cucuccccauccccacccaguc

SEQ ID NO: 1760279 - RNA, 19 nt, Homo sapiens
uacaacucuauuuaauuaa

SEQ ID NO: 1760280 - RNA, 16 nt, Homo sapiens
ugguuccaagucuuug

SEQ ID NO: 1760281 - RNA, 14 nt, Homo sapiens
caggcccuguggca

SEQ ID NO: 1760282 - RNA, 14 nt, Homo sapiens
uucaugcagccuaa

SEQ ID NO: 1760283 - RNA, 23 nt, Homo sapiens
gagggauccaccgccacacuggc

SEQ ID NO: 1760284 - RNA, 14 nt, Homo sapiens
aaggugaccagagu

SEQ ID NO: 1760285 - RNA, 21 nt, Homo sapiens
ggaucugauaaggaucuagga

SEQ ID NO: 1760286 - RNA, 16 nt, Homo sapiens
caguaguuagcuuucu

SEQ ID NO: 1760287 - RNA, 17 nt, Homo sapiens
guugauguguccgugaa

SEQ ID NO: 1760288 - RNA, 14 nt, Homo sapiens
uaagaaagcacuua

SEQ ID NO: 1760289 - RNA, 21 nt, Homo sapiens
ugaggucacuggguucuagaa

SEQ ID NO: 1760290 - RNA, 14 nt, Homo sapiens
cuaggcacaugugg

SEQ ID NO: 1760291 - RNA, 15 nt, Homo sapiens
auacugagccugcca

SEQ ID NO: 1760292 - RNA, 17 nt, Homo sapiens
agcuauuagaacuaaua

SEQ ID NO: 1760293 - RNA, 23 nt, Homo sapiens
agacaaauccuaggcuccuggga

SEQ ID NO: 1760294 - RNA, 19 nt, Homo sapiens
auuugcaauucauguaaca

SEQ ID NO: 1760295 - RNA, 11 nt, Homo sapiens
uuagugcuugu

SEQ ID NO: 1760296 - RNA, 20 nt, Homo sapiens
aauucacuccagucaacaga

SEQ ID NO: 1760297 - RNA, 18 nt, Homo sapiens
acacuggcagacaucuag

SEQ ID NO: 1760298 - RNA, 15 nt, Homo sapiens
aacacuuaacuaaaa

SEQ ID NO: 1760299 - RNA, 20 nt, Homo sapiens
uaguuagacuuaaaaacuug

SEQ ID NO: 1760300 - RNA, 19 nt, Homo sapiens
cuccauguagaagccacua

SEQ ID NO: 1760301 - RNA, 15 nt, Homo sapiens
acuaaaguaguugaa

SEQ ID NO: 1760302 - RNA, 21 nt, Homo sapiens
uguucuagcccucccuggcau

SEQ ID NO: 1760303 - RNA, 19 nt, Homo sapiens
ggagccccagcuuccugug

SEQ ID NO: 1760304 - RNA, 18 nt, Homo sapiens
gcagaacuuuccagggau

SEQ ID NO: 1760305 - RNA, 23 nt, Homo sapiens
uaguuuuuucuuucccauguauu

SEQ ID NO: 1760306 - RNA, 23 nt, Homo sapiens
agggaauaugcauugucugcaau

SEQ ID NO: 1760307 - RNA, 16 nt, Homo sapiens
gguugccucucuugcc

SEQ ID NO: 1760308 - RNA, 14 nt, Homo sapiens
uuaaaccuuucaua

SEQ ID NO: 1760309 - RNA, 13 nt, Homo sapiens
gcagagcuuccac

SEQ ID NO: 1760310 - RNA, 14 nt, Homo sapiens
augaacccucuugc

SEQ ID NO: 1760311 - RNA, 22 nt, Homo sapiens
caaacugcugucccaaacaugc

SEQ ID NO: 1760312 - RNA, 13 nt, Homo sapiens
acuauaugaucag

SEQ ID NO: 1760313 - RNA, 17 nt, Homo sapiens
aguucuccagacagggu

SEQ ID NO: 1760314 - RNA, 18 nt, Homo sapiens
cacguugugcacauguac

SEQ ID NO: 1760315 - RNA, 20 nt, Homo sapiens
ucaaaggcaaugcucaaaca

SEQ ID NO: 1760316 - RNA, 18 nt, Homo sapiens
uguaugacuucugcugaa

SEQ ID NO: 1760317 - RNA, 20 nt, Homo sapiens
cacugugugccuucugccaa

SEQ ID NO: 1760318 - RNA, 22 nt, Homo sapiens
uguaugugcgugugugcaagug

SEQ ID NO: 1760319 - RNA, 22 nt, Homo sapiens
aaaggcaaugcucaaacaccca

SEQ ID NO: 1760320 - RNA, 16 nt, Homo sapiens
agaauaaagcauuuca

SEQ ID NO: 1760321 - RNA, 16 nt, Homo sapiens
ugccacacccagguga

SEQ ID NO: 1760322 - RNA, 20 nt, Homo sapiens
cacaagcuuguauauacaua

SEQ ID NO: 1760323 - RNA, 20 nt, Homo sapiens
gacaagaccaccaacguguc

SEQ ID NO: 1760324 - RNA, 15 nt, Homo sapiens
cagaggacgugcaga

SEQ ID NO: 1760325 - RNA, 19 nt, Homo sapiens
gggcccagcggucccugca

SEQ ID NO: 1760326 - RNA, 13 nt, Homo sapiens
gaggccacagaau

SEQ ID NO: 1760327 - RNA, 18 nt, Homo sapiens
ucaguuguuccuacucag

SEQ ID NO: 1760328 - RNA, 23 nt, Homo sapiens
uagccuggugggaaaaugcacac

SEQ ID NO: 1760329 - RNA, 21 nt, Homo sapiens
gaguuggagugagaugaagga

SEQ ID NO: 1760330 - RNA, 16 nt, Homo sapiens
cauagcugugcuauga

SEQ ID NO: 1760331 - RNA, 13 nt, Homo sapiens
aaaguacaaagca

SEQ ID NO: 1760332 - RNA, 22 nt, Homo sapiens
ccuggaauugccacauaauuca

SEQ ID NO: 1760333 - RNA, 19 nt, Homo sapiens
aagauagaugcacuuaugc

SEQ ID NO: 1760334 - RNA, 14 nt, Homo sapiens
caccuaucaacaga

SEQ ID NO: 1760335 - RNA, 22 nt, Homo sapiens
ucagcaauacauagaacugaaa

SEQ ID NO: 1760336 - RNA, 18 nt, Homo sapiens
uaccgcuggcccugccgu

SEQ ID NO: 1760337 - RNA, 20 nt, Homo sapiens
ccuccaggguggcagcaaca

SEQ ID NO: 1760338 - RNA, 20 nt, Homo sapiens
cuccucacuguauccagguu

SEQ ID NO: 1760339 - RNA, 19 nt, Homo sapiens
agaccccacccugaggucc

SEQ ID NO: 1760340 - RNA, 18 nt, Homo sapiens
ugugaaaguaugugauau

SEQ ID NO: 1760341 - RNA, 17 nt, Homo sapiens
cugauauccaugaugcu

SEQ ID NO: 1760342 - RNA, 18 nt, Homo sapiens
uuuauaugaaauguuuca

SEQ ID NO: 1760343 - RNA, 21 nt, Homo sapiens
uucuaggcaguucaaagcagg

SEQ ID NO: 1760344 - RNA, 19 nt, Homo sapiens
accugcccacccacuccuu

SEQ ID NO: 1760345 - RNA, 21 nt, Homo sapiens
acaggaggaacugguccaggc

SEQ ID NO: 1760346 - RNA, 16 nt, Homo sapiens
uuuuugucauagcagc

SEQ ID NO: 1760347 - RNA, 20 nt, Homo sapiens
cccgccagagggcuugugaa

SEQ ID NO: 1760348 - RNA, 18 nt, Homo sapiens
augagcaaggacaaccug

SEQ ID NO: 1760349 - RNA, 14 nt, Homo sapiens
uaaaauguguugaa

SEQ ID NO: 1760350 - RNA, 22 nt, Homo sapiens
aguaguaaauuuugugaugaau

SEQ ID NO: 1760351 - RNA, 17 nt, Homo sapiens
aguccacccccauugug

SEQ ID NO: 1760352 - RNA, 14 nt, Homo sapiens
uuuuguugcucagu

SEQ ID NO: 1760353 - RNA, 17 nt, Homo sapiens
uacuuguggacacagcu

SEQ ID NO: 1760354 - RNA, 21 nt, Homo sapiens
ucagugaaggaagaaccugua

SEQ ID NO: 1760355 - RNA, 14 nt, Homo sapiens
uuucugacugcaac

SEQ ID NO: 1760356 - RNA, 13 nt, Homo sapiens
cuucuauuaauca

SEQ ID NO: 1760357 - RNA, 22 nt, Homo sapiens
caggugccccgugguacauuca

SEQ ID NO: 1760358 - RNA, 22 nt, Homo sapiens
ugucacagucucuacuguuauu

SEQ ID NO: 1760359 - RNA, 19 nt, Homo sapiens
ggugcuacagggaauuugu

SEQ ID NO: 1760360 - RNA, 15 nt, Homo sapiens
ugauuaugaauacag

SEQ ID NO: 1760361 - RNA, 16 nt, Homo sapiens
cuguacuucauucaaa

SEQ ID NO: 1760362 - RNA, 16 nt, Homo sapiens
ucauucucaguaucca

SEQ ID NO: 1760363 - RNA, 16 nt, Homo sapiens
cagaauguuacugacu

SEQ ID NO: 1760364 - RNA, 17 nt, Homo sapiens
cucagccuguugcggau

SEQ ID NO: 1760365 - RNA, 16 nt, Homo sapiens
uggaaaguaacuguga

SEQ ID NO: 1760366 - RNA, 11 nt, Homo sapiens
auccuaaaaaa

SEQ ID NO: 1760367 - RNA, 20 nt, Homo sapiens
cagagaccaggcugugaaau

SEQ ID NO: 1760368 - RNA, 17 nt, Homo sapiens
auuguuaauucuuccua

SEQ ID NO: 1760369 - RNA, 17 nt, Homo sapiens
aaugucauuacuuucaa

SEQ ID NO: 1760370 - RNA, 17 nt, Homo sapiens
cagcagcugauuccaga

SEQ ID NO: 1760371 - RNA, 17 nt, Homo sapiens
ccacuauuuucaaagaa

SEQ ID NO: 1760372 - RNA, 16 nt, Homo sapiens
uuagcugcucacuuaa

SEQ ID NO: 1760373 - RNA, 19 nt, Homo sapiens
aauauaauucuguuucuga

SEQ ID NO: 1760374 - RNA, 20 nt, Homo sapiens
guuucagcggaagaccugaa

SEQ ID NO: 1760375 - RNA, 19 nt, Homo sapiens
ggaccaccuccucugccag

SEQ ID NO: 1760376 - RNA, 16 nt, Homo sapiens
uucccauuugugccag

SEQ ID NO: 1760377 - RNA, 20 nt, Homo sapiens
caccuccuccugcugcucac

SEQ ID NO: 1760378 - RNA, 17 nt, Homo sapiens
uaauuuccuuuuugaca

SEQ ID NO: 1760379 - RNA, 14 nt, Homo sapiens
cagggaaugaaggu

SEQ ID NO: 1760380 - RNA, 17 nt, Homo sapiens
aguuugaaaauaguuac

SEQ ID NO: 1760381 - RNA, 20 nt, Homo sapiens
uugacacuugaaaaaagaua

SEQ ID NO: 1760382 - RNA, 20 nt, Homo sapiens
ugaccucaagugaucugccc

SEQ ID NO: 1760383 - RNA, 14 nt, Homo sapiens
ugagacacugucaa

SEQ ID NO: 1760384 - RNA, 14 nt, Homo sapiens
uacuuuuaacuaau

SEQ ID NO: 1760385 - RNA, 16 nt, Homo sapiens
auacuaucucuuguca

SEQ ID NO: 1760386 - RNA, 17 nt, Homo sapiens
aaaucacccugacugug

SEQ ID NO: 1760387 - RNA, 21 nt, Homo sapiens
uaagaugguuuccgugagcua

SEQ ID NO: 1760388 - RNA, 17 nt, Homo sapiens
gucucauacucaccuca

SEQ ID NO: 1760389 - RNA, 18 nt, Homo sapiens
ugccugugccuuuugcca

SEQ ID NO: 1760390 - RNA, 14 nt, Homo sapiens
aaacaucauuacag

SEQ ID NO: 1760391 - RNA, 11 nt, Homo sapiens
aaucuuuccag

SEQ ID NO: 1760392 - RNA, 16 nt, Homo sapiens
cgugaacugcagugau

SEQ ID NO: 1760393 - RNA, 20 nt, Homo sapiens
uccuuggcuucuuuacuuag

SEQ ID NO: 1760394 - RNA, 18 nt, Homo sapiens
uuuaccuuugaacuuuca

SEQ ID NO: 1760395 - RNA, 23 nt, Homo sapiens
uagaggauauugggucucagccc

SEQ ID NO: 1760396 - RNA, 14 nt, Homo sapiens
cagcacggcccuga

SEQ ID NO: 1760397 - RNA, 22 nt, Homo sapiens
gggaaugauuaagggagcugcu

SEQ ID NO: 1760398 - RNA, 14 nt, Homo sapiens
ugcucucugcucac

SEQ ID NO: 1760399 - RNA, 18 nt, Homo sapiens
gguguauugaaguccucc

SEQ ID NO: 1760400 - RNA, 15 nt, Homo sapiens
auuucccauuaaaga

SEQ ID NO: 1760401 - RNA, 16 nt, Homo sapiens
auaauaugagaaucag

SEQ ID NO: 1760402 - RNA, 22 nt, Homo sapiens
auucacagcuacgugugccccu

SEQ ID NO: 1760403 - RNA, 19 nt, Homo sapiens
auuacuaaaguacagacau

SEQ ID NO: 1760404 - RNA, 15 nt, Homo sapiens
uguuacugucauucc

SEQ ID NO: 1760405 - RNA, 17 nt, Homo sapiens
ccaagccauucacuucc

SEQ ID NO: 1760406 - RNA, 16 nt, Homo sapiens
ucauccccccugcugc

SEQ ID NO: 1760407 - RNA, 14 nt, Homo sapiens
gaaagcccuaaaau

SEQ ID NO: 1760408 - RNA, 18 nt, Homo sapiens
caaguagguuuacauuac

SEQ ID NO: 1760409 - RNA, 20 nt, Homo sapiens
ucugguuuuaacaauuuccu

SEQ ID NO: 1760410 - RNA, 22 nt, Homo sapiens
acuguagccugaguguccacag

SEQ ID NO: 1760411 - RNA, 20 nt, Homo sapiens
aggcaugagaaucacuugaa

SEQ ID NO: 1760412 - RNA, 20 nt, Homo sapiens
ucacggaggguccagacugu

SEQ ID NO: 1760413 - RNA, 15 nt, Homo sapiens
auuguagcucaauac

SEQ ID NO: 1760414 - RNA, 19 nt, Homo sapiens
uugauacggagccauguca

SEQ ID NO: 1760415 - RNA, 13 nt, Homo sapiens
aggcagccuccag

SEQ ID NO: 1760416 - RNA, 15 nt, Homo sapiens
cuaaaguacugggau

SEQ ID NO: 1760417 - RNA, 23 nt, Homo sapiens
aaauguuccauauguggguguca

SEQ ID NO: 1760418 - RNA, 20 nt, Homo sapiens
cucuuauggccaaauucaaa

SEQ ID NO: 1760419 - RNA, 17 nt, Homo sapiens
auauggacagcuuuauu

SEQ ID NO: 1760420 - RNA, 15 nt, Homo sapiens
auguaaacugugcac

SEQ ID NO: 1760421 - RNA, 20 nt, Homo sapiens
ccagcuagggggcguuauuu

SEQ ID NO: 1760422 - RNA, 18 nt, Homo sapiens
uggcuugaagcugcucac

SEQ ID NO: 1760423 - RNA, 19 nt, Homo sapiens
uagaagucuguccaaauuu

SEQ ID NO: 1760424 - RNA, 16 nt, Homo sapiens
ucuccaguacauuccg

SEQ ID NO: 1760425 - RNA, 15 nt, Homo sapiens
ugugucaucugucag

SEQ ID NO: 1760426 - RNA, 18 nt, Homo sapiens
ucccuguaugucuaccuc

SEQ ID NO: 1760427 - RNA, 19 nt, Homo sapiens
augcuuuagcauacuagaa

SEQ ID NO: 1760428 - RNA, 14 nt, Homo sapiens
cuuagccagaguua

SEQ ID NO: 1760429 - RNA, 18 nt, Homo sapiens
ucccuuccaagcuguguu

SEQ ID NO: 1760430 - RNA, 15 nt, Homo sapiens
acugcacuccagucu

SEQ ID NO: 1760431 - RNA, 14 nt, Homo sapiens
agguacaaccuguu

SEQ ID NO: 1760432 - RNA, 18 nt, Homo sapiens
uccauucuccucucucua

SEQ ID NO: 1760433 - RNA, 18 nt, Homo sapiens
gcuuccuaccacagauuc

SEQ ID NO: 1760434 - RNA, 15 nt, Homo sapiens
aagaaaauuauguau

SEQ ID NO: 1760435 - RNA, 12 nt, Homo sapiens
aagauucaguga

SEQ ID NO: 1760436 - RNA, 19 nt, Homo sapiens
gcagagcaugaccugagga

SEQ ID NO: 1760437 - RNA, 22 nt, Homo sapiens
agcacaauuaauuaaaagugaa

SEQ ID NO: 1760438 - RNA, 21 nt, Homo sapiens
guguucaguguugacauagcc

SEQ ID NO: 1760439 - RNA, 19 nt, Homo sapiens
uaaauauuuagucugcauu

SEQ ID NO: 1760440 - RNA, 19 nt, Homo sapiens
cugaaauguggaugugauu

SEQ ID NO: 1760441 - RNA, 18 nt, Homo sapiens
aggcuggcaccaugguga

SEQ ID NO: 1760442 - RNA, 13 nt, Homo sapiens
uaaaaguaguauu

SEQ ID NO: 1760443 - RNA, 14 nt, Homo sapiens
ggcugagcucuuau

SEQ ID NO: 1760444 - RNA, 13 nt, Homo sapiens
auaaauacuguca

SEQ ID NO: 1760445 - RNA, 13 nt, Homo sapiens
agaaauacuuuca

SEQ ID NO: 1760446 - RNA, 17 nt, Homo sapiens
aauucucaauauauuca

SEQ ID NO: 1760447 - RNA, 19 nt, Homo sapiens
uaacuugauccauuucuaa

SEQ ID NO: 1760448 - RNA, 13 nt, Homo sapiens
auagguagaguca

SEQ ID NO: 1760449 - RNA, 15 nt, Homo sapiens
uggcucucagaaggu

SEQ ID NO: 1760450 - RNA, 17 nt, Homo sapiens
cauaugucuuacuacuu

SEQ ID NO: 1760451 - RNA, 16 nt, Homo sapiens
auuaaauuagauaucu

SEQ ID NO: 1760452 - RNA, 19 nt, Homo sapiens
uucagugagguaugaugug

SEQ ID NO: 1760453 - RNA, 15 nt, Homo sapiens
acguggccgcugccc

SEQ ID NO: 1760454 - RNA, 21 nt, Homo sapiens
uggcacuaaagaauacauuua

SEQ ID NO: 1760455 - RNA, 15 nt, Homo sapiens
agagguucugccucu

SEQ ID NO: 1760456 - RNA, 17 nt, Homo sapiens
ucccucccccccaugca

SEQ ID NO: 1760457 - RNA, 13 nt, Homo sapiens
guguggcugugaa

SEQ ID NO: 1760458 - RNA, 21 nt, Homo sapiens
uggagucaaaaggcaaaucau

SEQ ID NO: 1760459 - RNA, 19 nt, Homo sapiens
caggacucugacgucucuu

SEQ ID NO: 1760460 - RNA, 19 nt, Homo sapiens
caggcaaagacugcaguau

SEQ ID NO: 1760461 - RNA, 14 nt, Homo sapiens
gggagacugggaca

SEQ ID NO: 1760462 - RNA, 18 nt, Homo sapiens
gggcugguucagggcuga

SEQ ID NO: 1760463 - RNA, 16 nt, Homo sapiens
guggauguuacuccaa

SEQ ID NO: 1760464 - RNA, 13 nt, Homo sapiens
uuuuuguuauuaa

SEQ ID NO: 1760465 - RNA, 13 nt, Homo sapiens
acaggaaagggca

SEQ ID NO: 1760466 - RNA, 21 nt, Homo sapiens
ggccaccccagagugggagag

SEQ ID NO: 1760467 - RNA, 16 nt, Homo sapiens
aauucuuagucaagga

SEQ ID NO: 1760468 - RNA, 14 nt, Homo sapiens
gauauuuuacuuga

SEQ ID NO: 1760469 - RNA, 19 nt, Homo sapiens
ccuguguuaucugugguuu

SEQ ID NO: 1760470 - RNA, 13 nt, Homo sapiens
acuuaagaugaaa

SEQ ID NO: 1760471 - RNA, 21 nt, Homo sapiens
cuccucaugcccccucaguga

SEQ ID NO: 1760472 - RNA, 22 nt, Homo sapiens
uuuccucauuuuuauauucauu

SEQ ID NO: 1760473 - RNA, 20 nt, Homo sapiens
uguagagaaaauaagacuuc

SEQ ID NO: 1760474 - RNA, 17 nt, Homo sapiens
ccuuguaaccagugcag

SEQ ID NO: 1760475 - RNA, 17 nt, Homo sapiens
accucuacaggcauuua

SEQ ID NO: 1760476 - RNA, 22 nt, Homo sapiens
cccuccuuuggaaugcuguauu

SEQ ID NO: 1760477 - RNA, 16 nt, Homo sapiens
cuauuuuaaugaauga

SEQ ID NO: 1760478 - RNA, 14 nt, Homo sapiens
cuacauucaaggag

SEQ ID NO: 1760479 - RNA, 15 nt, Homo sapiens
aaccuccuguggaac

SEQ ID NO: 1760480 - RNA, 21 nt, Homo sapiens
ugaacacguuuuuucacuauu

SEQ ID NO: 1760481 - RNA, 23 nt, Homo sapiens
cuuaauucccgccuuaugccuca

SEQ ID NO: 1760482 - RNA, 17 nt, Homo sapiens
aauuauuuuagcacaaa

SEQ ID NO: 1760483 - RNA, 16 nt, Homo sapiens
ucuuaguuuacuggau

SEQ ID NO: 1760484 - RNA, 14 nt, Homo sapiens
aggccagggacuca

SEQ ID NO: 1760485 - RNA, 14 nt, Homo sapiens
uuccaagcuguuag

SEQ ID NO: 1760486 - RNA, 23 nt, Homo sapiens
ccccagacgcacgugggucuuca

SEQ ID NO: 1760487 - RNA, 15 nt, Homo sapiens
uauuagccaacuguu

SEQ ID NO: 1760488 - RNA, 15 nt, Homo sapiens
ggaaaaaaaugaaug

SEQ ID NO: 1760489 - RNA, 19 nt, Homo sapiens
accugcuuugugagccagc

SEQ ID NO: 1760490 - RNA, 19 nt, Homo sapiens
uucuugucccucuguauac

SEQ ID NO: 1760491 - RNA, 15 nt, Homo sapiens
agaucaccaccugaa

SEQ ID NO: 1760492 - RNA, 14 nt, Homo sapiens
ucauucaaaacaac

SEQ ID NO: 1760493 - RNA, 20 nt, Homo sapiens
acaagugcaggcgacuggag

SEQ ID NO: 1760494 - RNA, 16 nt, Homo sapiens
cucagaccagcuccca

SEQ ID NO: 1760495 - RNA, 23 nt, Homo sapiens
ucucuccgucuguuuuugcaacu

SEQ ID NO: 1760496 - RNA, 13 nt, Homo sapiens
aauuuuuugcucu

SEQ ID NO: 1760497 - RNA, 18 nt, Homo sapiens
cuugcugguagaagcuga

SEQ ID NO: 1760498 - RNA, 12 nt, Homo sapiens
guggaccaggcc

SEQ ID NO: 1760499 - RNA, 16 nt, Homo sapiens
cacugcccuccagggc

SEQ ID NO: 1760500 - RNA, 16 nt, Homo sapiens
gugcacccaacgugau

SEQ ID NO: 1760501 - RNA, 14 nt, Homo sapiens
acagguuagaagca

SEQ ID NO: 1760502 - RNA, 14 nt, Homo sapiens
agugaugaugcaug

SEQ ID NO: 1760503 - RNA, 23 nt, Homo sapiens
gaguccacuguggcacuggccac

SEQ ID NO: 1760504 - RNA, 19 nt, Homo sapiens
uuacaugcaugagcaccuu

SEQ ID NO: 1760505 - RNA, 17 nt, Homo sapiens
caaaauauuuauuuguu

SEQ ID NO: 1760506 - RNA, 21 nt, Homo sapiens
uacuuaaaaugacaaagccau

SEQ ID NO: 1760507 - RNA, 23 nt, Homo sapiens
gaguugcauagcugauaugucag

SEQ ID NO: 1760508 - RNA, 23 nt, Homo sapiens
cuacgugauuuggcugcacuuga

SEQ ID NO: 1760509 - RNA, 20 nt, Homo sapiens
uugcauaauaaaugcuucag

SEQ ID NO: 1760510 - RNA, 18 nt, Homo sapiens
uacccauccccugaugcc

SEQ ID NO: 1760511 - RNA, 14 nt, Homo sapiens
agcacggacucucc

SEQ ID NO: 1760512 - RNA, 15 nt, Homo sapiens
ucuagaaacagaucu

SEQ ID NO: 1760513 - RNA, 16 nt, Homo sapiens
uaaaauguaaagccau

SEQ ID NO: 1760514 - RNA, 22 nt, Homo sapiens
guuaccugaaaacacugugcac

SEQ ID NO: 1760515 - RNA, 16 nt, Homo sapiens
acugucuaugaacuug

SEQ ID NO: 1760516 - RNA, 17 nt, Homo sapiens
ccucccugggggcggga

SEQ ID NO: 1760517 - RNA, 22 nt, Homo sapiens
gccauaaaggggagggacucau

SEQ ID NO: 1760518 - RNA, 19 nt, Homo sapiens
cuaggcuggaagccauggu

SEQ ID NO: 1760519 - RNA, 14 nt, Homo sapiens
accuuuccugaugc

SEQ ID NO: 1760520 - RNA, 14 nt, Homo sapiens
gaugagcaguaccg

SEQ ID NO: 1760521 - RNA, 19 nt, Homo sapiens
cuauggugagaugcagcug

SEQ ID NO: 1760522 - RNA, 15 nt, Homo sapiens
auagcaccuccacau

SEQ ID NO: 1760523 - RNA, 18 nt, Homo sapiens
acacccuuucaucucaga

SEQ ID NO: 1760524 - RNA, 14 nt, Homo sapiens
auuuucagcucaau

SEQ ID NO: 1760525 - RNA, 14 nt, Homo sapiens
ucagcacacaugca

SEQ ID NO: 1760526 - RNA, 21 nt, Homo sapiens
cagucuuauuuccaaguaaga

SEQ ID NO: 1760527 - RNA, 18 nt, Homo sapiens
ccgacuuccccugggcaa

SEQ ID NO: 1760528 - RNA, 20 nt, Homo sapiens
ucucuuaaguggucuaguca

SEQ ID NO: 1760529 - RNA, 11 nt, Homo sapiens
aacuuccccac

SEQ ID NO: 1760530 - RNA, 11 nt, Homo sapiens
aaauuccccaa

SEQ ID NO: 1760531 - RNA, 18 nt, Homo sapiens
cucaaggcaaugggcuac

SEQ ID NO: 1760532 - RNA, 11 nt, Homo sapiens
uauuccugcug

SEQ ID NO: 1760533 - RNA, 17 nt, Homo sapiens
uuuuuccaugacauuuu

SEQ ID NO: 1760534 - RNA, 18 nt, Homo sapiens
ugggcaacauaguaagac

SEQ ID NO: 1760535 - RNA, 22 nt, Homo sapiens
aguuaugguuuccucauuuuac

SEQ ID NO: 1760536 - RNA, 17 nt, Homo sapiens
caagugcgugacuguau

SEQ ID NO: 1760537 - RNA, 22 nt, Homo sapiens
uaccuucaggcagccaguguga

SEQ ID NO: 1760538 - RNA, 22 nt, Homo sapiens
gagucuggauaauuuguauaag

SEQ ID NO: 1760539 - RNA, 21 nt, Homo sapiens
ucaucuucaaaacugccauua

SEQ ID NO: 1760540 - RNA, 23 nt, Homo sapiens
ucauucgccucuggaucugcugc

SEQ ID NO: 1760541 - RNA, 20 nt, Homo sapiens
guucagugagguucuugggu

SEQ ID NO: 1760542 - RNA, 21 nt, Homo sapiens
ucauuguuuauuguauacugc

SEQ ID NO: 1760543 - RNA, 21 nt, Homo sapiens
gguucauuagcgauccaugua

SEQ ID NO: 1760544 - RNA, 11 nt, Homo sapiens
ucugugcagcu

SEQ ID NO: 1760545 - RNA, 23 nt, Homo sapiens
aggauuugccauuguccaggaaa

SEQ ID NO: 1760546 - RNA, 14 nt, Homo sapiens
cgcugccuugccau

SEQ ID NO: 1760547 - RNA, 16 nt, Homo sapiens
caauuagggaugcuca

SEQ ID NO: 1760548 - RNA, 22 nt, Homo sapiens
cuuugucaccacguggggcuca

SEQ ID NO: 1760549 - RNA, 23 nt, Homo sapiens
gaagaaacgcuuggagugcuucu

SEQ ID NO: 1760550 - RNA, 15 nt, Homo sapiens
agaaaagacucugac

SEQ ID NO: 1760551 - RNA, 16 nt, Homo sapiens
gaagacuacaugaaca

SEQ ID NO: 1760552 - RNA, 23 nt, Homo sapiens
gugaagcauucuccccaguguau

SEQ ID NO: 1760553 - RNA, 19 nt, Homo sapiens
cuugaguugaguauuacac

SEQ ID NO: 1760554 - RNA, 15 nt, Homo sapiens
aguucuugugccaua

SEQ ID NO: 1760555 - RNA, 20 nt, Homo sapiens
ugugacucccccucuuucac

SEQ ID NO: 1760556 - RNA, 14 nt, Homo sapiens
gcgcucuggugcug

SEQ ID NO: 1760557 - RNA, 14 nt, Homo sapiens
ccugugugcuuguc

SEQ ID NO: 1760558 - RNA, 14 nt, Homo sapiens
aucuccugaccucg

SEQ ID NO: 1760559 - RNA, 15 nt, Homo sapiens
uuuccacgagcuaua

SEQ ID NO: 1760560 - RNA, 23 nt, Homo sapiens
aaugcacauuucagaaauuccaa

SEQ ID NO: 1760561 - RNA, 13 nt, Homo sapiens
ggucacauuacau

SEQ ID NO: 1760562 - RNA, 20 nt, Homo sapiens
uaguuucccuugcaugguuu

SEQ ID NO: 1760563 - RNA, 22 nt, Homo sapiens
gaacauguccuacaacagccug

SEQ ID NO: 1760564 - RNA, 17 nt, Homo sapiens
agaugcuggacuugccu

SEQ ID NO: 1760565 - RNA, 15 nt, Homo sapiens
ugguuaaaacauagc

SEQ ID NO: 1760566 - RNA, 14 nt, Homo sapiens
gaucugcugcugag

SEQ ID NO: 1760567 - RNA, 21 nt, Homo sapiens
ugacauggcucuggacucuaa

SEQ ID NO: 1760568 - RNA, 21 nt, Homo sapiens
acccacccagugucuuucgag

SEQ ID NO: 1760569 - RNA, 13 nt, Homo sapiens
agaaagggccuug

SEQ ID NO: 1760570 - RNA, 16 nt, Homo sapiens
uauaguagccaugaca

SEQ ID NO: 1760571 - RNA, 13 nt, Homo sapiens
uguaauguguaca

SEQ ID NO: 1760572 - RNA, 21 nt, Homo sapiens
agcuuuguuuuuggcauuucg

SEQ ID NO: 1760573 - RNA, 18 nt, Homo sapiens
cugaaaaaaacauaucca

SEQ ID NO: 1760574 - RNA, 16 nt, Homo sapiens
cacugaauuagccaaa

SEQ ID NO: 1760575 - RNA, 22 nt, Homo sapiens
aaaacuggguaugcguuucaug

SEQ ID NO: 1760576 - RNA, 12 nt, Homo sapiens
aauuuccagggu

SEQ ID NO: 1760577 - RNA, 18 nt, Homo sapiens
aacaaauuucauugcacu

SEQ ID NO: 1760578 - RNA, 19 nt, Homo sapiens
uacugaauguguuugaaca

SEQ ID NO: 1760579 - RNA, 21 nt, Homo sapiens
uggacuacauauuugcacuga

SEQ ID NO: 1760580 - RNA, 19 nt, Homo sapiens
uuaacuggucuccuugcuu

SEQ ID NO: 1760581 - RNA, 18 nt, Homo sapiens
ucauuugucuuugaacgu

SEQ ID NO: 1760582 - RNA, 17 nt, Homo sapiens
uuuggcaucuacuuaga

SEQ ID NO: 1760583 - RNA, 15 nt, Homo sapiens
aagugagaacaaauu

SEQ ID NO: 1760584 - RNA, 15 nt, Homo sapiens
cuuuaauguugccca

SEQ ID NO: 1760585 - RNA, 15 nt, Homo sapiens
cugcacuguuuucaa

SEQ ID NO: 1760586 - RNA, 13 nt, Homo sapiens
ugaccugguacug

SEQ ID NO: 1760587 - RNA, 16 nt, Homo sapiens
aucuaccaucuaaucu

SEQ ID NO: 1760588 - RNA, 16 nt, Homo sapiens
uccauuauuccucuca

SEQ ID NO: 1760589 - RNA, 15 nt, Homo sapiens
cuuucuucaauacaa

SEQ ID NO: 1760590 - RNA, 15 nt, Homo sapiens
augauaaguuccaaa

SEQ ID NO: 1760591 - RNA, 19 nt, Homo sapiens
cuacacacccccaagccac

SEQ ID NO: 1760592 - RNA, 16 nt, Homo sapiens
ugccaucugugggaaa

SEQ ID NO: 1760593 - RNA, 20 nt, Homo sapiens
uuacuuuccccccauguauu

SEQ ID NO: 1760594 - RNA, 14 nt, Homo sapiens
guccaugcuucuag

SEQ ID NO: 1760595 - RNA, 12 nt, Homo sapiens
aacgggcauuuc

SEQ ID NO: 1760596 - RNA, 19 nt, Homo sapiens
aggacucacccuccacaaa

SEQ ID NO: 1760597 - RNA, 14 nt, Homo sapiens
gggcaacacaguga

SEQ ID NO: 1760598 - RNA, 17 nt, Homo sapiens
gaacuaccaucugaugu

SEQ ID NO: 1760599 - RNA, 21 nt, Homo sapiens
ugcauucuucugagcacuguu

SEQ ID NO: 1760600 - RNA, 23 nt, Homo sapiens
ccccugucauccucaugcugcuc

SEQ ID NO: 1760601 - RNA, 12 nt, Homo sapiens
augucaaaggcu

SEQ ID NO: 1760602 - RNA, 17 nt, Homo sapiens
uaaaacggauaccaagu

SEQ ID NO: 1760603 - RNA, 14 nt, Homo sapiens
ugugguagcucaca

SEQ ID NO: 1760604 - RNA, 20 nt, Homo sapiens
ccaggaugaaggcgugcaag

SEQ ID NO: 1760605 - RNA, 11 nt, Homo sapiens
agcuuaggcag

SEQ ID NO: 1760606 - RNA, 19 nt, Homo sapiens
aagcuuuuuacucaaagag

SEQ ID NO: 1760607 - RNA, 19 nt, Homo sapiens
cuguaaugauacugauuau

SEQ ID NO: 1760608 - RNA, 14 nt, Homo sapiens
accuaauccaggca

SEQ ID NO: 1760609 - RNA, 23 nt, Homo sapiens
uagaauggaggaagaacaacaaa

SEQ ID NO: 1760610 - RNA, 20 nt, Homo sapiens
guucuuuucuccuuuaccag

SEQ ID NO: 1760611 - RNA, 13 nt, Homo sapiens
gaacuuccaacaa

SEQ ID NO: 1760612 - RNA, 13 nt, Homo sapiens
caguaugucacuc

SEQ ID NO: 1760613 - RNA, 15 nt, Homo sapiens
aaucaucuuacauuu

SEQ ID NO: 1760614 - RNA, 18 nt, Homo sapiens
cagauccuuuuccagaaa

SEQ ID NO: 1760615 - RNA, 21 nt, Homo sapiens
uuguagagacagggucucacu

SEQ ID NO: 1760616 - RNA, 16 nt, Homo sapiens
gcugugucuuuagaca

SEQ ID NO: 1760617 - RNA, 18 nt, Homo sapiens
aaccuuauuguaccucuc

SEQ ID NO: 1760618 - RNA, 19 nt, Homo sapiens
gguuaacgccuucauuuau

SEQ ID NO: 1760619 - RNA, 21 nt, Homo sapiens
ucgaugccacuccugcuucuc

SEQ ID NO: 1760620 - RNA, 18 nt, Homo sapiens
gauaaacucagaucugau

SEQ ID NO: 1760621 - RNA, 11 nt, Homo sapiens
accaugaagcu

SEQ ID NO: 1760622 - RNA, 15 nt, Homo sapiens
aauccccacagggaa

SEQ ID NO: 1760623 - RNA, 13 nt, Homo sapiens
uaagcaacacuuu

SEQ ID NO: 1760624 - RNA, 23 nt, Homo sapiens
cuuagagcuuuaccuaaauauga

SEQ ID NO: 1760625 - RNA, 14 nt, Homo sapiens
cgauauaagccaua

SEQ ID NO: 1760626 - RNA, 15 nt, Homo sapiens
aaaguuaaacgugau

SEQ ID NO: 1760627 - RNA, 19 nt, Homo sapiens
gauaaguguucuucagugu

SEQ ID NO: 1760628 - RNA, 18 nt, Homo sapiens
uauauacugcuauuuaca

SEQ ID NO: 1760629 - RNA, 13 nt, Homo sapiens
aaaaugacuggcu

SEQ ID NO: 1760630 - RNA, 20 nt, Homo sapiens
ucagcaguggugucucugaa

SEQ ID NO: 1760631 - RNA, 18 nt, Homo sapiens
augcuucccagagggagc

SEQ ID NO: 1760632 - RNA, 18 nt, Homo sapiens
cugugauuagccauuuga

SEQ ID NO: 1760633 - RNA, 16 nt, Homo sapiens
uguuuuauauguugcu

SEQ ID NO: 1760634 - RNA, 16 nt, Homo sapiens
ucuucagggccagucc

SEQ ID NO: 1760635 - RNA, 19 nt, Homo sapiens
ggaagcccuucagugcccu

SEQ ID NO: 1760636 - RNA, 14 nt, Homo sapiens
auuuucaaguuuac

SEQ ID NO: 1760637 - RNA, 12 nt, Homo sapiens
uccugacacccc

SEQ ID NO: 1760638 - RNA, 14 nt, Homo sapiens
accagagcacugua

SEQ ID NO: 1760639 - RNA, 23 nt, Homo sapiens
auggcagggccaggccucugcug

SEQ ID NO: 1760640 - RNA, 23 nt, Homo sapiens
aacccauuuuuguuuauuuuccu

SEQ ID NO: 1760641 - RNA, 20 nt, Homo sapiens
guuaagugggcauuuugaca

SEQ ID NO: 1760642 - RNA, 15 nt, Homo sapiens
uaaauaaauuuccca

SEQ ID NO: 1760643 - RNA, 16 nt, Homo sapiens
uuaaaacaaggcuuaa

SEQ ID NO: 1760644 - RNA, 15 nt, Homo sapiens
cacagcugugugagc

SEQ ID NO: 1760645 - RNA, 22 nt, Homo sapiens
caaaaccuacgcacauaccuuc

SEQ ID NO: 1760646 - RNA, 21 nt, Homo sapiens
gaagauucccucuuccugcca

SEQ ID NO: 1760647 - RNA, 18 nt, Homo sapiens
gauacuguuucuugcacu

SEQ ID NO: 1760648 - RNA, 13 nt, Homo sapiens
ccccgaguuuaaa

SEQ ID NO: 1760649 - RNA, 21 nt, Homo sapiens
cugugcaggcauggucccuua

SEQ ID NO: 1760650 - RNA, 22 nt, Homo sapiens
aaacuguuggaaguucacugga

SEQ ID NO: 1760651 - RNA, 15 nt, Homo sapiens
guggaagucccucag

SEQ ID NO: 1760652 - RNA, 15 nt, Homo sapiens
aaagauaagugcagu

SEQ ID NO: 1760653 - RNA, 19 nt, Homo sapiens
cugucuucagagaacccac

SEQ ID NO: 1760654 - RNA, 15 nt, Homo sapiens
uuccugacuguucuc

SEQ ID NO: 1760655 - RNA, 20 nt, Homo sapiens
acauccaaagcagacagcuc

SEQ ID NO: 1760656 - RNA, 19 nt, Homo sapiens
guugaucaccugaggucag

SEQ ID NO: 1760657 - RNA, 22 nt, Homo sapiens
gaauucugcuaccucacugggg

SEQ ID NO: 1760658 - RNA, 12 nt, Homo sapiens
gcacugugacac

SEQ ID NO: 1760659 - RNA, 17 nt, Homo sapiens
accucuuggcugccuug

SEQ ID NO: 1760660 - RNA, 17 nt, Homo sapiens
cuuaauuugaaauaaca

SEQ ID NO: 1760661 - RNA, 20 nt, Homo sapiens
aggaugucugagaccacuug

SEQ ID NO: 1760662 - RNA, 15 nt, Homo sapiens
aaguggcaagaccaa

SEQ ID NO: 1760663 - RNA, 10 nt, Homo sapiens
acuguaaaau

SEQ ID NO: 1760664 - RNA, 12 nt, Homo sapiens
cccagacaaaaa

SEQ ID NO: 1760665 - RNA, 18 nt, Homo sapiens
auccaccccguugcucaa

SEQ ID NO: 1760666 - RNA, 19 nt, Homo sapiens
gcuuugggaacacuggccu

SEQ ID NO: 1760667 - RNA, 21 nt, Homo sapiens
uggcaugucauuugcacacaa

SEQ ID NO: 1760668 - RNA, 22 nt, Homo sapiens
ucuucaaccucauugacaagaa

SEQ ID NO: 1760669 - RNA, 14 nt, Homo sapiens
ccuuuucaugauuu

SEQ ID NO: 1760670 - RNA, 20 nt, Homo sapiens
uacucccugcuaaagagugu

SEQ ID NO: 1760671 - RNA, 23 nt, Homo sapiens
uacauuuuuugggcagcaauuua

SEQ ID NO: 1760672 - RNA, 16 nt, Homo sapiens
ggccauguccaaagag

SEQ ID NO: 1760673 - RNA, 14 nt, Homo sapiens
agcaagcacugugg

SEQ ID NO: 1760674 - RNA, 21 nt, Homo sapiens
uuuggaaguuuagcucugaga

SEQ ID NO: 1760675 - RNA, 15 nt, Homo sapiens
ucuccugcucucaua

SEQ ID NO: 1760676 - RNA, 14 nt, Homo sapiens
ugauuucucugaac

SEQ ID NO: 1760677 - RNA, 15 nt, Homo sapiens
caacauaacugaagg

SEQ ID NO: 1760678 - RNA, 19 nt, Homo sapiens
ucuuuaacagcuuacacug

SEQ ID NO: 1760679 - RNA, 19 nt, Homo sapiens
cuaagaugaaauugccaaa

SEQ ID NO: 1760680 - RNA, 17 nt, Homo sapiens
cauggauaaauugcaca

SEQ ID NO: 1760681 - RNA, 22 nt, Homo sapiens
gagacucugugaucuaagcagu

SEQ ID NO: 1760682 - RNA, 21 nt, Homo sapiens
ugaguaguaaucucacacuuc

SEQ ID NO: 1760683 - RNA, 22 nt, Homo sapiens
ggagcugcguuuccugugcaug

SEQ ID NO: 1760684 - RNA, 16 nt, Homo sapiens
caagacaaaaccaaaa

SEQ ID NO: 1760685 - RNA, 19 nt, Homo sapiens
gccuuugccucucuugcca

SEQ ID NO: 1760686 - RNA, 12 nt, Homo sapiens
gauuacagguga

SEQ ID NO: 1760687 - RNA, 22 nt, Homo sapiens
auauuguaccaggaugugcuau

SEQ ID NO: 1760688 - RNA, 20 nt, Homo sapiens
agugagccgagaucaugcca

SEQ ID NO: 1760689 - RNA, 18 nt, Homo sapiens
caguuguauggagccucu

SEQ ID NO: 1760690 - RNA, 15 nt, Homo sapiens
gaauuaaauaaugua

SEQ ID NO: 1760691 - RNA, 15 nt, Homo sapiens
uaugcucagaagcca

SEQ ID NO: 1760692 - RNA, 21 nt, Homo sapiens
uuguaauauuuugcugcugaa

SEQ ID NO: 1760693 - RNA, 15 nt, Homo sapiens
ggcugcugaccucca

SEQ ID NO: 1760694 - RNA, 16 nt, Homo sapiens
aacccggccugauuaa

SEQ ID NO: 1760695 - RNA, 19 nt, Homo sapiens
uugauagcaaacacugggg

SEQ ID NO: 1760696 - RNA, 18 nt, Homo sapiens
agguuaucgaaauaacaa

SEQ ID NO: 1760697 - RNA, 21 nt, Homo sapiens
ugcuuaugaaagaaagcuuua

SEQ ID NO: 1760698 - RNA, 21 nt, Homo sapiens
ugaaacuucaucacacacuga

SEQ ID NO: 1760699 - RNA, 15 nt, Homo sapiens
gugcccacaguguca

SEQ ID NO: 1760700 - RNA, 13 nt, Homo sapiens
ugugcgugccauc

SEQ ID NO: 1760701 - RNA, 19 nt, Homo sapiens
agacaucggccuccaugac

SEQ ID NO: 1760702 - RNA, 20 nt, Homo sapiens
augcgguagccagcacacag

SEQ ID NO: 1760703 - RNA, 22 nt, Homo sapiens
gcugggucagggccagacugga

SEQ ID NO: 1760704 - RNA, 19 nt, Homo sapiens
acuguaauguaacuaucuc

SEQ ID NO: 1760705 - RNA, 21 nt, Homo sapiens
ccaauccauccugcucaggaa

SEQ ID NO: 1760706 - RNA, 18 nt, Homo sapiens
uauuugguaccauggugu

SEQ ID NO: 1760707 - RNA, 13 nt, Homo sapiens
cauucccaugaau

SEQ ID NO: 1760708 - RNA, 21 nt, Homo sapiens
aaaauuuggucaagaaaugag

SEQ ID NO: 1760709 - RNA, 17 nt, Homo sapiens
gccagacaugguggcau

SEQ ID NO: 1760710 - RNA, 23 nt, Homo sapiens
acuguaaacucuaucagcauugu

SEQ ID NO: 1760711 - RNA, 13 nt, Homo sapiens
aaauauacucaag

SEQ ID NO: 1760712 - RNA, 13 nt, Homo sapiens
acuaguacuauua

SEQ ID NO: 1760713 - RNA, 13 nt, Homo sapiens
ucguguacaagaa

SEQ ID NO: 1760714 - RNA, 17 nt, Homo sapiens
uacccgugccugagaaa

SEQ ID NO: 1760715 - RNA, 14 nt, Homo sapiens
ugaaaauagcaacc

SEQ ID NO: 1760716 - RNA, 21 nt, Homo sapiens
ugcaccuguccccacccucca

SEQ ID NO: 1760717 - RNA, 15 nt, Homo sapiens
uaagaaaugaucuuu

SEQ ID NO: 1760718 - RNA, 13 nt, Homo sapiens
ugugaacaugccu

SEQ ID NO: 1760719 - RNA, 15 nt, Homo sapiens
agcccagcacuguga

SEQ ID NO: 1760720 - RNA, 11 nt, Homo sapiens
ccccaccagca

SEQ ID NO: 1760721 - RNA, 22 nt, Homo sapiens
agagauaacauccaacuaacuc

SEQ ID NO: 1760722 - RNA, 15 nt, Homo sapiens
uuuguuagaaccagu

SEQ ID NO: 1760723 - RNA, 14 nt, Homo sapiens
accuuaaacaagcu

SEQ ID NO: 1760724 - RNA, 16 nt, Homo sapiens
acaauggcgugaucuc

SEQ ID NO: 1760725 - RNA, 11 nt, Homo sapiens
caacagcacuu

SEQ ID NO: 1760726 - RNA, 18 nt, Homo sapiens
acauuuguuuguauucau

SEQ ID NO: 1760727 - RNA, 22 nt, Homo sapiens
gacucaguuuucuugcagauca

SEQ ID NO: 1760728 - RNA, 20 nt, Homo sapiens
gaacagagggaacuuuggga

SEQ ID NO: 1760729 - RNA, 18 nt, Homo sapiens
ucaccuccaagcauuuca

SEQ ID NO: 1760730 - RNA, 18 nt, Homo sapiens
uccaaacucagaaggcuu

SEQ ID NO: 1760731 - RNA, 21 nt, Homo sapiens
augacaguauuauacgcuggc

SEQ ID NO: 1760732 - RNA, 20 nt, Homo sapiens
gaauucuuagcauacauuca

SEQ ID NO: 1760733 - RNA, 20 nt, Homo sapiens
gcaagauuuugucaaaaacu

SEQ ID NO: 1760734 - RNA, 12 nt, Homo sapiens
uguggcuuugau

SEQ ID NO: 1760735 - RNA, 15 nt, Homo sapiens
auguuuugacaugaa

SEQ ID NO: 1760736 - RNA, 15 nt, Homo sapiens
uuacauaauacuuga

SEQ ID NO: 1760737 - RNA, 19 nt, Homo sapiens
gcccauccgugcuaugaca

SEQ ID NO: 1760738 - RNA, 18 nt, Homo sapiens
ucaacuccagucucggca

SEQ ID NO: 1760739 - RNA, 22 nt, Homo sapiens
auguagaacuugaacuaacaua

SEQ ID NO: 1760740 - RNA, 16 nt, Homo sapiens
ugcaccugagccuguu

SEQ ID NO: 1760741 - RNA, 22 nt, Homo sapiens
aagguuauaucauucacuuuug

SEQ ID NO: 1760742 - RNA, 15 nt, Homo sapiens
cagauccucuucuca

SEQ ID NO: 1760743 - RNA, 16 nt, Homo sapiens
uaugaucucaguauuu

SEQ ID NO: 1760744 - RNA, 14 nt, Homo sapiens
gcaaaaaauucuuu

SEQ ID NO: 1760745 - RNA, 14 nt, Homo sapiens
cuuuaucaccucau

SEQ ID NO: 1760746 - RNA, 14 nt, Homo sapiens
gccccccagucucc

SEQ ID NO: 1760747 - RNA, 20 nt, Homo sapiens
cuagaaaccaccuggguuca

SEQ ID NO: 1760748 - RNA, 21 nt, Homo sapiens
uccuuuuuuggggaguaccug

SEQ ID NO: 1760749 - RNA, 16 nt, Homo sapiens
ugucgauuucaccaag

SEQ ID NO: 1760750 - RNA, 20 nt, Homo sapiens
auucacgugcagcagcaaca

SEQ ID NO: 1760751 - RNA, 23 nt, Homo sapiens
auuuugguggguuuugaacauaa

SEQ ID NO: 1760752 - RNA, 18 nt, Homo sapiens
aacuguaucaucuuugcc

SEQ ID NO: 1760753 - RNA, 17 nt, Homo sapiens
uucauggcuuuucuggu

SEQ ID NO: 1760754 - RNA, 18 nt, Homo sapiens
gcggugggcagccaugag

SEQ ID NO: 1760755 - RNA, 22 nt, Homo sapiens
caagcuaagccaucauaucccc

SEQ ID NO: 1760756 - RNA, 16 nt, Homo sapiens
uauaugagacuuucaa

SEQ ID NO: 1760757 - RNA, 14 nt, Homo sapiens
ccaaggcugcucag

SEQ ID NO: 1760758 - RNA, 12 nt, Homo sapiens
aaucacauuccu

SEQ ID NO: 1760759 - RNA, 20 nt, Homo sapiens
acuucaaaaacugucaaaga

SEQ ID NO: 1760760 - RNA, 16 nt, Homo sapiens
auauuucuucaaguga

SEQ ID NO: 1760761 - RNA, 22 nt, Homo sapiens
cugcucuguaggucauuggcca

SEQ ID NO: 1760762 - RNA, 20 nt, Homo sapiens
agcuccggguguagauuccc

SEQ ID NO: 1760763 - RNA, 16 nt, Homo sapiens
agcaugcacaaagugu

SEQ ID NO: 1760764 - RNA, 18 nt, Homo sapiens
uacauuucaccuacuuug

SEQ ID NO: 1760765 - RNA, 15 nt, Homo sapiens
ugauuacuaugcucu

SEQ ID NO: 1760766 - RNA, 22 nt, Homo sapiens
ucagcuuuuucccucacuugca

SEQ ID NO: 1760767 - RNA, 16 nt, Homo sapiens
cauugggagucuguag

SEQ ID NO: 1760768 - RNA, 14 nt, Homo sapiens
cagcugagguucau

SEQ ID NO: 1760769 - RNA, 18 nt, Homo sapiens
ugaggagcccugaggacc

SEQ ID NO: 1760770 - RNA, 13 nt, Homo sapiens
aagcugcuuugga

SEQ ID NO: 1760771 - RNA, 21 nt, Homo sapiens
uauauuaaauuuauaucuuau

SEQ ID NO: 1760772 - RNA, 17 nt, Homo sapiens
ucagaagcuuggcauga

SEQ ID NO: 1760773 - RNA, 22 nt, Homo sapiens
ccuauagcaucuucucauuccc

SEQ ID NO: 1760774 - RNA, 23 nt, Homo sapiens
cuccucgaagucccggcuuccac

SEQ ID NO: 1760775 - RNA, 17 nt, Homo sapiens
guauccugaaacagugu

SEQ ID NO: 1760776 - RNA, 17 nt, Homo sapiens
ccagcucaccuuuuuau

SEQ ID NO: 1760777 - RNA, 20 nt, Homo sapiens
aaacacugccuuugucuuac

SEQ ID NO: 1760778 - RNA, 23 nt, Homo sapiens
aguuacaguucugugguuucaug

SEQ ID NO: 1760779 - RNA, 19 nt, Homo sapiens
caggagccaguccgugcag

SEQ ID NO: 1760780 - RNA, 22 nt, Homo sapiens
ccaaaugcagggaggggaggca

SEQ ID NO: 1760781 - RNA, 14 nt, Homo sapiens
cuaacacauuucau

SEQ ID NO: 1760782 - RNA, 18 nt, Homo sapiens
aucuuggacaaaucacau

SEQ ID NO: 1760783 - RNA, 22 nt, Homo sapiens
ugcucauaugauguacauguac

SEQ ID NO: 1760784 - RNA, 19 nt, Homo sapiens
gaaucuccugaccacuugu

SEQ ID NO: 1760785 - RNA, 14 nt, Homo sapiens
cucccccaccuuca

SEQ ID NO: 1760786 - RNA, 15 nt, Homo sapiens
caaauauuucacuua

SEQ ID NO: 1760787 - RNA, 16 nt, Homo sapiens
gaacugucagccucag

SEQ ID NO: 1760788 - RNA, 13 nt, Homo sapiens
gguacuuauacua

SEQ ID NO: 1760789 - RNA, 16 nt, Homo sapiens
cuccaccccacucaca

SEQ ID NO: 1760790 - RNA, 20 nt, Homo sapiens
agacaauauacaagccaaag

SEQ ID NO: 1760791 - RNA, 21 nt, Homo sapiens
accuucaggcagccaguguga

SEQ ID NO: 1760792 - RNA, 18 nt, Homo sapiens
ccuguucucugaagaugu

SEQ ID NO: 1760793 - RNA, 21 nt, Homo sapiens
auuuucuauuauuaacacuga

SEQ ID NO: 1760794 - RNA, 19 nt, Homo sapiens
gugccuucauuugggaugc

SEQ ID NO: 1760795 - RNA, 16 nt, Homo sapiens
gaucagccuugcaaau

SEQ ID NO: 1760796 - RNA, 14 nt, Homo sapiens
ucuuuccagcaucc

SEQ ID NO: 1760797 - RNA, 21 nt, Homo sapiens
aaaguaguuagccaauaugca

SEQ ID NO: 1760798 - RNA, 12 nt, Homo sapiens
auauuauuuggc

SEQ ID NO: 1760799 - RNA, 18 nt, Homo sapiens
cugccuucucacuagcug

SEQ ID NO: 1760800 - RNA, 20 nt, Homo sapiens
cuguauuuugccagacuuaa

SEQ ID NO: 1760801 - RNA, 15 nt, Homo sapiens
uaauuuuaguuucau

SEQ ID NO: 1760802 - RNA, 18 nt, Homo sapiens
aguugcauuuagaaauca

SEQ ID NO: 1760803 - RNA, 19 nt, Homo sapiens
cccaucaucccuucuucca

SEQ ID NO: 1760804 - RNA, 14 nt, Homo sapiens
guaauauguuacaa

SEQ ID NO: 1760805 - RNA, 19 nt, Homo sapiens
uuacaucuaucccagagua

SEQ ID NO: 1760806 - RNA, 19 nt, Homo sapiens
accugaaauuuauucacau

SEQ ID NO: 1760807 - RNA, 12 nt, Homo sapiens
ugcagagcaaug

SEQ ID NO: 1760808 - RNA, 14 nt, Homo sapiens
auaaaugugacuca

SEQ ID NO: 1760809 - RNA, 22 nt, Homo sapiens
aagcacaccaaucuuacuuugu

SEQ ID NO: 1760810 - RNA, 14 nt, Homo sapiens
auggggacccucca

SEQ ID NO: 1760811 - RNA, 23 nt, Homo sapiens
caauaaauggcccggacaugucu

SEQ ID NO: 1760812 - RNA, 20 nt, Homo sapiens
augacgguguuaauuuugcu

SEQ ID NO: 1760813 - RNA, 15 nt, Homo sapiens
gggcaucauccucag

SEQ ID NO: 1760814 - RNA, 23 nt, Homo sapiens
guccagacgcacugaucuuugca

SEQ ID NO: 1760815 - RNA, 15 nt, Homo sapiens
uacgggccaguuucu

SEQ ID NO: 1760816 - RNA, 17 nt, Homo sapiens
agauaccauucaaccca

SEQ ID NO: 1760817 - RNA, 17 nt, Homo sapiens
gacgaagaagagccaca

SEQ ID NO: 1760818 - RNA, 21 nt, Homo sapiens
gagcaaaggcugagaacacug

SEQ ID NO: 1760819 - RNA, 16 nt, Homo sapiens
ccaguuuugcugcuau

SEQ ID NO: 1760820 - RNA, 11 nt, Homo sapiens
caaaugugcug

SEQ ID NO: 1760821 - RNA, 11 nt, Homo sapiens
aaaaugugaug

SEQ ID NO: 1760822 - RNA, 11 nt, Homo sapiens
cuaaugugcag

SEQ ID NO: 1760823 - RNA, 20 nt, Homo sapiens
gagugcugauucaaaccaaa

SEQ ID NO: 1760824 - RNA, 21 nt, Homo sapiens
ccuuucugccuuggccucggc

SEQ ID NO: 1760825 - RNA, 23 nt, Homo sapiens
ucaaagcucuauuaagauuucca

SEQ ID NO: 1760826 - RNA, 17 nt, Homo sapiens
gaugguuagucaccugc

SEQ ID NO: 1760827 - RNA, 20 nt, Homo sapiens
cauacuuuuucuuugaauuu

SEQ ID NO: 1760828 - RNA, 19 nt, Homo sapiens
auugugaugcauuuaucuu

SEQ ID NO: 1760829 - RNA, 13 nt, Homo sapiens
ccugucucagggu

SEQ ID NO: 1760830 - RNA, 13 nt, Homo sapiens
ccucccucaggcc

SEQ ID NO: 1760831 - RNA, 16 nt, Homo sapiens
uagucuguacuucauc

SEQ ID NO: 1760832 - RNA, 16 nt, Homo sapiens
cagaugcuuuacaguc

SEQ ID NO: 1760833 - RNA, 11 nt, Homo sapiens
agugagcaaac

SEQ ID NO: 1760834 - RNA, 20 nt, Homo sapiens
acuuuuuaaaucauguuccc

SEQ ID NO: 1760835 - RNA, 20 nt, Homo sapiens
uuuauuuugugaacacuuuu

SEQ ID NO: 1760836 - RNA, 16 nt, Homo sapiens
uaggaacugggccuug

SEQ ID NO: 1760837 - RNA, 13 nt, Homo sapiens
uauaaugcuauuu

SEQ ID NO: 1760838 - RNA, 19 nt, Homo sapiens
cagauacauaucuguguau

SEQ ID NO: 1760839 - RNA, 21 nt, Homo sapiens
ccacuaccagccagccucaga

SEQ ID NO: 1760840 - RNA, 16 nt, Homo sapiens
caccaccgacugaagu

SEQ ID NO: 1760841 - RNA, 14 nt, Homo sapiens
uccaucagauucug

SEQ ID NO: 1760842 - RNA, 23 nt, Homo sapiens
cuuaacauuccuaaaaugcuuca

SEQ ID NO: 1760843 - RNA, 13 nt, Homo sapiens
augcaguuuucau

SEQ ID NO: 1760844 - RNA, 17 nt, Homo sapiens
cagguuuauccagauga

SEQ ID NO: 1760845 - RNA, 16 nt, Homo sapiens
gacuuucuccaaaggc

SEQ ID NO: 1760846 - RNA, 17 nt, Homo sapiens
cccacuuucuucuacca

SEQ ID NO: 1760847 - RNA, 20 nt, Homo sapiens
cccacugaagcccauuucuc

SEQ ID NO: 1760848 - RNA, 17 nt, Homo sapiens
uggaguucaguggugca

SEQ ID NO: 1760849 - RNA, 19 nt, Homo sapiens
aacuccuuccauccuugac

SEQ ID NO: 1760850 - RNA, 19 nt, Homo sapiens
agaauggagcuauggacgu

SEQ ID NO: 1760851 - RNA, 14 nt, Homo sapiens
uuuuugaaagucag

SEQ ID NO: 1760852 - RNA, 19 nt, Homo sapiens
aaaccagcuacuugaugua

SEQ ID NO: 1760853 - RNA, 16 nt, Homo sapiens
acacauuaaacaggau

SEQ ID NO: 1760854 - RNA, 15 nt, Homo sapiens
gggaaaucuuauauu

SEQ ID NO: 1760855 - RNA, 18 nt, Homo sapiens
caacaacaccagaacugu

SEQ ID NO: 1760856 - RNA, 13 nt, Homo sapiens
guccuaugcgcuc

SEQ ID NO: 1760857 - RNA, 14 nt, Homo sapiens
uuacucucacaccu

SEQ ID NO: 1760858 - RNA, 14 nt, Homo sapiens
acccucucuucccu

SEQ ID NO: 1760859 - RNA, 20 nt, Homo sapiens
ucgaacuccugaccucaggu

SEQ ID NO: 1760860 - RNA, 17 nt, Homo sapiens
cuuaaucacuacuguau

SEQ ID NO: 1760861 - RNA, 19 nt, Homo sapiens
acaaguggcucaucaucaa

SEQ ID NO: 1760862 - RNA, 21 nt, Homo sapiens
uugcaaccuuguacuuuacaa

SEQ ID NO: 1760863 - RNA, 21 nt, Homo sapiens
uucacaucuguauaucagcuc

SEQ ID NO: 1760864 - RNA, 17 nt, Homo sapiens
cugcuccgcugccugga

SEQ ID NO: 1760865 - RNA, 16 nt, Homo sapiens
ucugccauaaagccau

SEQ ID NO: 1760866 - RNA, 19 nt, Homo sapiens
aaccuccagugucaggguc

SEQ ID NO: 1760867 - RNA, 21 nt, Homo sapiens
cauaagaaauaaaaucuaauu

SEQ ID NO: 1760868 - RNA, 15 nt, Homo sapiens
aacuacuacaaugau

SEQ ID NO: 1760869 - RNA, 17 nt, Homo sapiens
cuuaaauauuaugugaa

SEQ ID NO: 1760870 - RNA, 15 nt, Homo sapiens
auaaucgaaguaauu

SEQ ID NO: 1760871 - RNA, 18 nt, Homo sapiens
aacuucagauacuuguga

SEQ ID NO: 1760872 - RNA, 21 nt, Homo sapiens
cucagcuuuccuuaaggauau

SEQ ID NO: 1760873 - RNA, 20 nt, Homo sapiens
ccauguggaguggacauuca

SEQ ID NO: 1760874 - RNA, 13 nt, Homo sapiens
uaaauauuuccau

SEQ ID NO: 1760875 - RNA, 23 nt, Homo sapiens
uccuuccuacuuugcuucucucc

SEQ ID NO: 1760876 - RNA, 18 nt, Homo sapiens
cugugagcuuacauugaa

SEQ ID NO: 1760877 - RNA, 14 nt, Homo sapiens
gucagcacuguaac

SEQ ID NO: 1760878 - RNA, 21 nt, Homo sapiens
aauaaagugacccugcucuca

SEQ ID NO: 1760879 - RNA, 22 nt, Homo sapiens
ugcugugucucacagaggcagu

SEQ ID NO: 1760880 - RNA, 15 nt, Homo sapiens
ugugugugugcacau

SEQ ID NO: 1760881 - RNA, 15 nt, Homo sapiens
caugugcgcacacac

SEQ ID NO: 1760882 - RNA, 17 nt, Homo sapiens
aaauuagacuuccugua

SEQ ID NO: 1760883 - RNA, 16 nt, Homo sapiens
aaaauguaacuugaaa

SEQ ID NO: 1760884 - RNA, 18 nt, Homo sapiens
cuggcaguuuugacauca

SEQ ID NO: 1760885 - RNA, 15 nt, Homo sapiens
ugcuucucaccacgg

SEQ ID NO: 1760886 - RNA, 20 nt, Homo sapiens
gacuuguuuuaugcucaggg

SEQ ID NO: 1760887 - RNA, 14 nt, Homo sapiens
cgcugcaaagccau

SEQ ID NO: 1760888 - RNA, 17 nt, Homo sapiens
uaccgcugugugcauuc

SEQ ID NO: 1760889 - RNA, 20 nt, Homo sapiens
augguggggcaugccuguag

SEQ ID NO: 1760890 - RNA, 20 nt, Homo sapiens
gcagacagacagauggaccg

SEQ ID NO: 1760891 - RNA, 13 nt, Homo sapiens
caaauuugcuuua

SEQ ID NO: 1760892 - RNA, 13 nt, Homo sapiens
gcauggaugaaua

SEQ ID NO: 1760893 - RNA, 20 nt, Homo sapiens
ccucuggaauggcucaggga

SEQ ID NO: 1760894 - RNA, 20 nt, Homo sapiens
uaagaggcugacagcuucua

SEQ ID NO: 1760895 - RNA, 17 nt, Homo sapiens
ccugaucugcacauuuc

SEQ ID NO: 1760896 - RNA, 23 nt, Homo sapiens
ccaauuuauaaugaauacuuucu

SEQ ID NO: 1760897 - RNA, 22 nt, Homo sapiens
uccauuuccauguccccuccca

SEQ ID NO: 1760898 - RNA, 15 nt, Homo sapiens
aguuaugacaagcuu

SEQ ID NO: 1760899 - RNA, 13 nt, Homo sapiens
uuucucaauaagc

SEQ ID NO: 1760900 - RNA, 17 nt, Homo sapiens
uugucauauacccagcu

SEQ ID NO: 1760901 - RNA, 20 nt, Homo sapiens
caaaaauaaacuaguuucca

SEQ ID NO: 1760902 - RNA, 13 nt, Homo sapiens
ccugcccagacaa

SEQ ID NO: 1760903 - RNA, 21 nt, Homo sapiens
acuacaugcacuuggcugcau

SEQ ID NO: 1760904 - RNA, 20 nt, Homo sapiens
ucagaggggacucugaccac

SEQ ID NO: 1760905 - RNA, 18 nt, Homo sapiens
uccuucuauucuagccug

SEQ ID NO: 1760906 - RNA, 15 nt, Homo sapiens
ugggcaucuauggga

SEQ ID NO: 1760907 - RNA, 13 nt, Homo sapiens
cuuagacuuugaa

SEQ ID NO: 1760908 - RNA, 20 nt, Homo sapiens
aacgcacaacaggaaacugg

SEQ ID NO: 1760909 - RNA, 19 nt, Homo sapiens
ugauaucuauaguagacac

SEQ ID NO: 1760910 - RNA, 13 nt, Homo sapiens
aguaucaugaagc

SEQ ID NO: 1760911 - RNA, 15 nt, Homo sapiens
aaaggucagcccguu

SEQ ID NO: 1760912 - RNA, 15 nt, Homo sapiens
gacgugugccuauag

SEQ ID NO: 1760913 - RNA, 24 nt, Homo sapiens
cuugugaagauuggggacacucau

SEQ ID NO: 1760914 - RNA, 13 nt, Homo sapiens
cccagccuaguca

SEQ ID NO: 1760915 - RNA, 14 nt, Homo sapiens
uccuccagcaauag

SEQ ID NO: 1760916 - RNA, 21 nt, Homo sapiens
cagggcagcaagggaccugcu

SEQ ID NO: 1760917 - RNA, 15 nt, Homo sapiens
cgucagagcagugac

SEQ ID NO: 1760918 - RNA, 20 nt, Homo sapiens
ugcgugccucguacgugugu

SEQ ID NO: 1760919 - RNA, 16 nt, Homo sapiens
caugguucaccaugca

SEQ ID NO: 1760920 - RNA, 16 nt, Homo sapiens
uaugaaagccacacuu

SEQ ID NO: 1760921 - RNA, 16 nt, Homo sapiens
uguggugagaucaugc

SEQ ID NO: 1760922 - RNA, 16 nt, Homo sapiens
ggaauauaaauaucac

SEQ ID NO: 1760923 - RNA, 20 nt, Homo sapiens
aaauuugugucauaccagaa

SEQ ID NO: 1760924 - RNA, 22 nt, Homo sapiens
uauugcagagacucauuucaca

SEQ ID NO: 1760925 - RNA, 15 nt, Homo sapiens
ugcauuccccgcugc

SEQ ID NO: 1760926 - RNA, 22 nt, Homo sapiens
aguuauaaaucaaugucacuua

SEQ ID NO: 1760927 - RNA, 16 nt, Homo sapiens
aauuucacaagcuauu

SEQ ID NO: 1760928 - RNA, 16 nt, Homo sapiens
guuuguuaccuaccuu

SEQ ID NO: 1760929 - RNA, 20 nt, Homo sapiens
ccuuugugugguaguucuaa

SEQ ID NO: 1760930 - RNA, 13 nt, Homo sapiens
gcugcuaaugugu

SEQ ID NO: 1760931 - RNA, 17 nt, Homo sapiens
cugaggcaaauggcaca

SEQ ID NO: 1760932 - RNA, 17 nt, Homo sapiens
cuuuggagaucaaggag

SEQ ID NO: 1760933 - RNA, 15 nt, Homo sapiens
uuaaaucagccuucc

SEQ ID NO: 1760934 - RNA, 14 nt, Homo sapiens
agucccacacugug

SEQ ID NO: 1760935 - RNA, 14 nt, Homo sapiens
acucuuggggacca

SEQ ID NO: 1760936 - RNA, 11 nt, Homo sapiens
ggaaaugucac

SEQ ID NO: 1760937 - RNA, 19 nt, Homo sapiens
caggccccaggcaucuuuc

SEQ ID NO: 1760938 - RNA, 23 nt, Homo sapiens
gagcggcaggacuggauggagcu

SEQ ID NO: 1760939 - RNA, 15 nt, Homo sapiens
cuacacccagcaaua

SEQ ID NO: 1760940 - RNA, 23 nt, Homo sapiens
cacugccaugcagggccucacac

SEQ ID NO: 1760941 - RNA, 13 nt, Homo sapiens
agccacugugcuu

SEQ ID NO: 1760942 - RNA, 22 nt, Homo sapiens
ugaguuggguguauugugcgcu

SEQ ID NO: 1760943 - RNA, 13 nt, Homo sapiens
gaauuugaggcag

SEQ ID NO: 1760944 - RNA, 16 nt, Homo sapiens
caguagguuggcagua

SEQ ID NO: 1760945 - RNA, 19 nt, Homo sapiens
aauaaauucaucagaaucc

SEQ ID NO: 1760946 - RNA, 16 nt, Homo sapiens
gaaaugcauuuugcua

SEQ ID NO: 1760947 - RNA, 17 nt, Homo sapiens
gaaugaauacugggaau

SEQ ID NO: 1760948 - RNA, 14 nt, Homo sapiens
cccgaggucaucac

SEQ ID NO: 1760949 - RNA, 21 nt, Homo sapiens
aaauauuuauaaaacuucuca

SEQ ID NO: 1760950 - RNA, 19 nt, Homo sapiens
ugcuuucugugaaagccuu

SEQ ID NO: 1760951 - RNA, 18 nt, Homo sapiens
auagccuggguuaaguau

SEQ ID NO: 1760952 - RNA, 22 nt, Homo sapiens
ccucaagugcaaggaccaaagg

SEQ ID NO: 1760953 - RNA, 23 nt, Homo sapiens
aaguguggguuugguuagaggaa

SEQ ID NO: 1760954 - RNA, 17 nt, Homo sapiens
uaaaauaacuaagcaag

SEQ ID NO: 1760955 - RNA, 17 nt, Homo sapiens
aucugugcaaauccuug

SEQ ID NO: 1760956 - RNA, 17 nt, Homo sapiens
gggcucccagcccgugc

SEQ ID NO: 1760957 - RNA, 22 nt, Homo sapiens
gagagucagacccuucaaugga

SEQ ID NO: 1760958 - RNA, 17 nt, Homo sapiens
uagcagccucacacugg

SEQ ID NO: 1760959 - RNA, 14 nt, Homo sapiens
uaauucugcugucu

SEQ ID NO: 1760960 - RNA, 15 nt, Homo sapiens
ugggcagcaggggua

SEQ ID NO: 1760961 - RNA, 14 nt, Homo sapiens
gccggucacugcag

SEQ ID NO: 1760962 - RNA, 19 nt, Homo sapiens
uugcucuacaaugacacac

SEQ ID NO: 1760963 - RNA, 16 nt, Homo sapiens
uuuuaaauuuugacaa

SEQ ID NO: 1760964 - RNA, 20 nt, Homo sapiens
ccacugucaaguguuuuacu

SEQ ID NO: 1760965 - RNA, 16 nt, Homo sapiens
ugaccuccauuuccca

SEQ ID NO: 1760966 - RNA, 20 nt, Homo sapiens
acuguuacacgugccuguag

SEQ ID NO: 1760967 - RNA, 17 nt, Homo sapiens
ucccccuaauauuaggg

SEQ ID NO: 1760968 - RNA, 17 nt, Homo sapiens
uucugauauguauccau

SEQ ID NO: 1760969 - RNA, 18 nt, Homo sapiens
auaacccuacacccagac

SEQ ID NO: 1760970 - RNA, 11 nt, Homo sapiens
augcugcuaug

SEQ ID NO: 1760971 - RNA, 19 nt, Homo sapiens
uuagugugaauauuccuuu

SEQ ID NO: 1760972 - RNA, 18 nt, Homo sapiens
auucucuccucagacugc

SEQ ID NO: 1760973 - RNA, 12 nt, Homo sapiens
aaugaagaccua

SEQ ID NO: 1760974 - RNA, 20 nt, Homo sapiens
uggcccaggaaaaaccugug

SEQ ID NO: 1760975 - RNA, 16 nt, Homo sapiens
ugaaguuuuuauuuag

SEQ ID NO: 1760976 - RNA, 19 nt, Homo sapiens
cagcauuguuggcuguucc

SEQ ID NO: 1760977 - RNA, 12 nt, Homo sapiens
ugugcaugaccu

SEQ ID NO: 1760978 - RNA, 14 nt, Homo sapiens
ccaccucaagugcc

SEQ ID NO: 1760979 - RNA, 17 nt, Homo sapiens
ggaguaccauguggcaa

SEQ ID NO: 1760980 - RNA, 11 nt, Homo sapiens
gggaggacaaa

SEQ ID NO: 1760981 - RNA, 16 nt, Homo sapiens
auaaacacaaaaacac

SEQ ID NO: 1760982 - RNA, 16 nt, Homo sapiens
agcagaaggccuugcc

SEQ ID NO: 1760983 - RNA, 19 nt, Homo sapiens
ccaaaacuggaccaccaga

SEQ ID NO: 1760984 - RNA, 15 nt, Homo sapiens
ucccuccuaaccuag

SEQ ID NO: 1760985 - RNA, 20 nt, Homo sapiens
ugcccacagugucaggcacu

SEQ ID NO: 1760986 - RNA, 21 nt, Homo sapiens
aucaagucccgaggcagcaac

SEQ ID NO: 1760987 - RNA, 15 nt, Homo sapiens
aaguccagcuaacau

SEQ ID NO: 1760988 - RNA, 16 nt, Homo sapiens
acacaccugaacacau

SEQ ID NO: 1760989 - RNA, 23 nt, Homo sapiens
uauuguaaaacuuuggugcauug

SEQ ID NO: 1760990 - RNA, 16 nt, Homo sapiens
uaaucugagaguuuuc

SEQ ID NO: 1760991 - RNA, 17 nt, Homo sapiens
cagucuccucacucugu

SEQ ID NO: 1760992 - RNA, 21 nt, Homo sapiens
ccucugcaaaaagauuuaaca

SEQ ID NO: 1760993 - RNA, 22 nt, Homo sapiens
ccacccagaugggggaaagcac

SEQ ID NO: 1760994 - RNA, 20 nt, Homo sapiens
ucuugaucuuugagcccauu

SEQ ID NO: 1760995 - RNA, 20 nt, Homo sapiens
ugcuaauuucuguccagaaa

SEQ ID NO: 1760996 - RNA, 15 nt, Homo sapiens
agagggagaaacuuc

SEQ ID NO: 1760997 - RNA, 15 nt, Homo sapiens
gugugugacaauucu

SEQ ID NO: 1760998 - RNA, 19 nt, Homo sapiens
uuuguauuuuuacuuuuaa

SEQ ID NO: 1760999 - RNA, 15 nt, Homo sapiens
cuccaucaugcuuga

SEQ ID NO: 1761000 - RNA, 15 nt, Homo sapiens
auaaagcacauucca

SEQ ID NO: 1761001 - RNA, 11 nt, Homo sapiens
cacuaucccau

SEQ ID NO: 1761002 - RNA, 11 nt, Homo sapiens
aaguuugcaac

SEQ ID NO: 1761003 - RNA, 21 nt, Homo sapiens
uucgcaccgugcugggcuccc

SEQ ID NO: 1761004 - RNA, 23 nt, Homo sapiens
ccaaagucagaauugcucaaaga

SEQ ID NO: 1761005 - RNA, 14 nt, Homo sapiens
acauggaauuaccu

SEQ ID NO: 1761006 - RNA, 11 nt, Homo sapiens
ucucacugugu

SEQ ID NO: 1761007 - RNA, 11 nt, Homo sapiens
gcccacugggc

SEQ ID NO: 1761008 - RNA, 20 nt, Homo sapiens
acugggagaaaugacuuuga

SEQ ID NO: 1761009 - RNA, 13 nt, Homo sapiens
uaagaacugugca

SEQ ID NO: 1761010 - RNA, 14 nt, Homo sapiens
gacuuucuacaccu

SEQ ID NO: 1761011 - RNA, 21 nt, Homo sapiens
agguuggugacugaaacauuc

SEQ ID NO: 1761012 - RNA, 21 nt, Homo sapiens
aaauuaauaucuuucugcaca

SEQ ID NO: 1761013 - RNA, 21 nt, Homo sapiens
aaagccagugcugucugggau

SEQ ID NO: 1761014 - RNA, 15 nt, Homo sapiens
uuugaaucacaugaa

SEQ ID NO: 1761015 - RNA, 15 nt, Homo sapiens
accuucugaccuccc

SEQ ID NO: 1761016 - RNA, 13 nt, Homo sapiens
uaaguaacauaua

SEQ ID NO: 1761017 - RNA, 15 nt, Homo sapiens
gacccaaaaggcaga

SEQ ID NO: 1761018 - RNA, 15 nt, Homo sapiens
gacaaggaaggacag

SEQ ID NO: 1761019 - RNA, 12 nt, Homo sapiens
ucuuccugucuc

SEQ ID NO: 1761020 - RNA, 12 nt, Homo sapiens
ugacccugugau

SEQ ID NO: 1761021 - RNA, 18 nt, Homo sapiens
gaaaauacaaaagguaaa

SEQ ID NO: 1761022 - RNA, 21 nt, Homo sapiens
acgcaugugguaaggugugua

SEQ ID NO: 1761023 - RNA, 16 nt, Homo sapiens
acccuguccuaugacu

SEQ ID NO: 1761024 - RNA, 17 nt, Homo sapiens
gcaucgguucgcauuau

SEQ ID NO: 1761025 - RNA, 12 nt, Homo sapiens
acugacuuucau

SEQ ID NO: 1761026 - RNA, 17 nt, Homo sapiens
uaauuuugaacuguuua

SEQ ID NO: 1761027 - RNA, 17 nt, Homo sapiens
agagaaaucaaugaagc

SEQ ID NO: 1761028 - RNA, 18 nt, Homo sapiens
ccccaauaaaggcagcug

SEQ ID NO: 1761029 - RNA, 16 nt, Homo sapiens
ugcagcaggugaccuc

SEQ ID NO: 1761030 - RNA, 23 nt, Homo sapiens
agccccuuacuaugaucucagga

SEQ ID NO: 1761031 - RNA, 16 nt, Homo sapiens
auaucacaagugauug

SEQ ID NO: 1761032 - RNA, 21 nt, Homo sapiens
guggauccucaaacaacacug

SEQ ID NO: 1761033 - RNA, 23 nt, Homo sapiens
auuuccaaaacuuuaaugaacua

SEQ ID NO: 1761034 - RNA, 13 nt, Homo sapiens
uguguagcuccca

SEQ ID NO: 1761035 - RNA, 21 nt, Homo sapiens
cuucugucccucacagcacua

SEQ ID NO: 1761036 - RNA, 12 nt, Homo sapiens
auccgagcucag

SEQ ID NO: 1761037 - RNA, 19 nt, Homo sapiens
aguguucuaaaaugaaaua

SEQ ID NO: 1761038 - RNA, 14 nt, Homo sapiens
gaaccccuucugac

SEQ ID NO: 1761039 - RNA, 20 nt, Homo sapiens
auccgggugaagacauguac

SEQ ID NO: 1761040 - RNA, 23 nt, Homo sapiens
uuuuggcaaugacucaaagucug

SEQ ID NO: 1761041 - RNA, 16 nt, Homo sapiens
ucuauuuccuuuccag

SEQ ID NO: 1761042 - RNA, 18 nt, Homo sapiens
cuugguguuugacuguaa

SEQ ID NO: 1761043 - RNA, 18 nt, Homo sapiens
caacuguauguacauacc

SEQ ID NO: 1761044 - RNA, 21 nt, Homo sapiens
ucccuuuucuugacuauugga

SEQ ID NO: 1761045 - RNA, 20 nt, Homo sapiens
gacauaacugguuugacucu

SEQ ID NO: 1761046 - RNA, 11 nt, Homo sapiens
uugggggaaau

SEQ ID NO: 1761047 - RNA, 18 nt, Homo sapiens
ugugcuuagaauugcugg

SEQ ID NO: 1761048 - RNA, 23 nt, Homo sapiens
agccugugcgucccagcugaagg

SEQ ID NO: 1761049 - RNA, 22 nt, Homo sapiens
ucaggacauaggcacaggcaaa

SEQ ID NO: 1761050 - RNA, 22 nt, Homo sapiens
gugugaaacacacaauguggac

SEQ ID NO: 1761051 - RNA, 18 nt, Homo sapiens
uguggaggagcucaggac

SEQ ID NO: 1761052 - RNA, 20 nt, Homo sapiens
aaggggagccaaaaucucaa

SEQ ID NO: 1761053 - RNA, 13 nt, Homo sapiens
gcucugagcauau

SEQ ID NO: 1761054 - RNA, 22 nt, Homo sapiens
aaggaagcaaguuuucuuccau

SEQ ID NO: 1761055 - RNA, 16 nt, Homo sapiens
ugaggcccugcccaau

SEQ ID NO: 1761056 - RNA, 17 nt, Homo sapiens
cauggaaaagcccagug

SEQ ID NO: 1761057 - RNA, 22 nt, Homo sapiens
cggccuggggcgagcacuguga

SEQ ID NO: 1761058 - RNA, 16 nt, Homo sapiens
caucaaaaagccuuau

SEQ ID NO: 1761059 - RNA, 21 nt, Homo sapiens
uaaauacacauuaucacugaa

SEQ ID NO: 1761060 - RNA, 17 nt, Homo sapiens
augugacauuugucauu

SEQ ID NO: 1761061 - RNA, 17 nt, Homo sapiens
accuucaagcacccugu

SEQ ID NO: 1761062 - RNA, 24 nt, Homo sapiens
guuucuugccugaacuccugccau

SEQ ID NO: 1761063 - RNA, 12 nt, Homo sapiens
agaagcaauggg

SEQ ID NO: 1761064 - RNA, 15 nt, Homo sapiens
acuucuuuaguauua

SEQ ID NO: 1761065 - RNA, 15 nt, Homo sapiens
ugacagggccagugc

SEQ ID NO: 1761066 - RNA, 18 nt, Homo sapiens
guccagcuugcucuucag

SEQ ID NO: 1761067 - RNA, 12 nt, Homo sapiens
aagaacaaugcc

SEQ ID NO: 1761068 - RNA, 20 nt, Homo sapiens
ggagaugaggccagaccaug

SEQ ID NO: 1761069 - RNA, 13 nt, Homo sapiens
uuuaacauauaua

SEQ ID NO: 1761070 - RNA, 22 nt, Homo sapiens
aguuuucaggaugagaugacag

SEQ ID NO: 1761071 - RNA, 17 nt, Homo sapiens
cuuguugcugcaucucc

SEQ ID NO: 1761072 - RNA, 14 nt, Homo sapiens
cuuuaucauugcua

SEQ ID NO: 1761073 - RNA, 13 nt, Homo sapiens
cccuggaaaugga

SEQ ID NO: 1761074 - RNA, 14 nt, Homo sapiens
ucuuggaccccuga

SEQ ID NO: 1761075 - RNA, 19 nt, Homo sapiens
aauugucgaaaagagucuu

SEQ ID NO: 1761076 - RNA, 15 nt, Homo sapiens
uaaagccucauuuga

SEQ ID NO: 1761077 - RNA, 15 nt, Homo sapiens
gauucugauugcuau

SEQ ID NO: 1761078 - RNA, 16 nt, Homo sapiens
gguuaacuauguacaa

SEQ ID NO: 1761079 - RNA, 18 nt, Homo sapiens
auguuaauguuauaucau

SEQ ID NO: 1761080 - RNA, 15 nt, Homo sapiens
cagugcccacagcca

SEQ ID NO: 1761081 - RNA, 15 nt, Homo sapiens
cacacacacaugcac

SEQ ID NO: 1761082 - RNA, 15 nt, Homo sapiens
aauguuuaaacauuu

SEQ ID NO: 1761083 - RNA, 14 nt, Homo sapiens
gaugaggcuggaua

SEQ ID NO: 1761084 - RNA, 23 nt, Homo sapiens
aacccccacccccacugccaggu

SEQ ID NO: 1761085 - RNA, 18 nt, Homo sapiens
caguugagaaacaguucc

SEQ ID NO: 1761086 - RNA, 20 nt, Homo sapiens
gugaugucaaauugacugua

SEQ ID NO: 1761087 - RNA, 16 nt, Homo sapiens
ucaccaacuacagaaa

SEQ ID NO: 1761088 - RNA, 15 nt, Homo sapiens
ucaguaagucucaua

SEQ ID NO: 1761089 - RNA, 11 nt, Homo sapiens
aguaacacuga

SEQ ID NO: 1761090 - RNA, 11 nt, Homo sapiens
uuaaacacauu

SEQ ID NO: 1761091 - RNA, 13 nt, Homo sapiens
aguggcuagcgca

SEQ ID NO: 1761092 - RNA, 20 nt, Homo sapiens
ucgcuccuccuucccaggga

SEQ ID NO: 1761093 - RNA, 15 nt, Homo sapiens
auuguugaccuaaga

SEQ ID NO: 1761094 - RNA, 16 nt, Homo sapiens
ccuaaggucacagcua

SEQ ID NO: 1761095 - RNA, 23 nt, Homo sapiens
ucugagaagacacaaggugauuu

SEQ ID NO: 1761096 - RNA, 15 nt, Homo sapiens
uagaauacucaggga

SEQ ID NO: 1761097 - RNA, 20 nt, Homo sapiens
cagccaccccaccccugagc

SEQ ID NO: 1761098 - RNA, 15 nt, Homo sapiens
gcacuuuccacugga

SEQ ID NO: 1761099 - RNA, 18 nt, Homo sapiens
ucaggugugacucuagca

SEQ ID NO: 1761100 - RNA, 19 nt, Homo sapiens
aaccaaauauuccagagac

SEQ ID NO: 1761101 - RNA, 19 nt, Homo sapiens
ugguaacuguagucaucuu

SEQ ID NO: 1761102 - RNA, 14 nt, Homo sapiens
ggagccagugugcc

SEQ ID NO: 1761103 - RNA, 15 nt, Homo sapiens
uagguuucucucuuc

SEQ ID NO: 1761104 - RNA, 20 nt, Homo sapiens
agaguuauucaaaugaaggu

SEQ ID NO: 1761105 - RNA, 17 nt, Homo sapiens
uggaagcaauaagccau

SEQ ID NO: 1761106 - RNA, 22 nt, Homo sapiens
ucugaaggacacuuccugccua

SEQ ID NO: 1761107 - RNA, 14 nt, Homo sapiens
gcugccgucugucc

SEQ ID NO: 1761108 - RNA, 14 nt, Homo sapiens
cuuggacuacacaa

SEQ ID NO: 1761109 - RNA, 18 nt, Homo sapiens
caggaaauggcuguggag

SEQ ID NO: 1761110 - RNA, 17 nt, Homo sapiens
ccauguuaauauuugaa

SEQ ID NO: 1761111 - RNA, 14 nt, Homo sapiens
agcuccauguugcu

SEQ ID NO: 1761112 - RNA, 19 nt, Homo sapiens
ggcugaauagcuucuccaa

SEQ ID NO: 1761113 - RNA, 23 nt, Homo sapiens
ccauuuguuaaaaagacuguuau

SEQ ID NO: 1761114 - RNA, 17 nt, Homo sapiens
augaagcaaacacacag

SEQ ID NO: 1761115 - RNA, 17 nt, Homo sapiens
guaaaauucuacuguau

SEQ ID NO: 1761116 - RNA, 16 nt, Homo sapiens
uuguauagacaucugc

SEQ ID NO: 1761117 - RNA, 16 nt, Homo sapiens
caguuugccucugcac

SEQ ID NO: 1761118 - RNA, 20 nt, Homo sapiens
gcuggaaaucaauacugcac

SEQ ID NO: 1761119 - RNA, 11 nt, Homo sapiens
ugugugcauuu

SEQ ID NO: 1761120 - RNA, 16 nt, Homo sapiens
uuuuaauuugggaaaa

SEQ ID NO: 1761121 - RNA, 17 nt, Homo sapiens
uuuagaacuguauguca

SEQ ID NO: 1761122 - RNA, 16 nt, Homo sapiens
aagaacucauuugaau

SEQ ID NO: 1761123 - RNA, 15 nt, Homo sapiens
ugaagagcucuuggc

SEQ ID NO: 1761124 - RNA, 14 nt, Homo sapiens
gccagcgcugcaac

SEQ ID NO: 1761125 - RNA, 20 nt, Homo sapiens
aggcccgcuagguccagaga

SEQ ID NO: 1761126 - RNA, 13 nt, Homo sapiens
aagaaaaccaaac

SEQ ID NO: 1761127 - RNA, 13 nt, Homo sapiens
cagccaacaaaca

SEQ ID NO: 1761128 - RNA, 17 nt, Homo sapiens
aggggauuuugcugaug

SEQ ID NO: 1761129 - RNA, 18 nt, Homo sapiens
ugaagggggcggccuaug

SEQ ID NO: 1761130 - RNA, 16 nt, Homo sapiens
uagcugcucacuuaaa

SEQ ID NO: 1761131 - RNA, 21 nt, Homo sapiens
aagacuuaagcccagugcacu

SEQ ID NO: 1761132 - RNA, 18 nt, Homo sapiens
uacaauguaucaacauau

SEQ ID NO: 1761133 - RNA, 13 nt, Homo sapiens
uuuugugauugcc

SEQ ID NO: 1761134 - RNA, 16 nt, Homo sapiens
augcaaugaacacuua

SEQ ID NO: 1761135 - RNA, 17 nt, Homo sapiens
gggaagcugaccuuuaa

SEQ ID NO: 1761136 - RNA, 15 nt, Homo sapiens
gaauuuuacuugcac

SEQ ID NO: 1761137 - RNA, 23 nt, Homo sapiens
gugagagaaagagagaagccagc

SEQ ID NO: 1761138 - RNA, 14 nt, Homo sapiens
cugcauguacugua

SEQ ID NO: 1761139 - RNA, 13 nt, Homo sapiens
ugucaugcccuua

SEQ ID NO: 1761140 - RNA, 21 nt, Homo sapiens
ccaccucggcacacacugugc

SEQ ID NO: 1761141 - RNA, 20 nt, Homo sapiens
auaugcauugucugcaaugg

SEQ ID NO: 1761142 - RNA, 16 nt, Homo sapiens
cugaaccuugagcaaa

SEQ ID NO: 1761143 - RNA, 23 nt, Homo sapiens
cauucucagugagggcucuggau

SEQ ID NO: 1761144 - RNA, 17 nt, Homo sapiens
acguucauccacucugc

SEQ ID NO: 1761145 - RNA, 13 nt, Homo sapiens
aguaagcaucuac

SEQ ID NO: 1761146 - RNA, 16 nt, Homo sapiens
gcauauauacuugcaa

SEQ ID NO: 1761147 - RNA, 16 nt, Homo sapiens
ggagguuaagugacuu

SEQ ID NO: 1761148 - RNA, 16 nt, Homo sapiens
aaacagaaauugcaau

SEQ ID NO: 1761149 - RNA, 14 nt, Homo sapiens
ccacaaacagcaga

SEQ ID NO: 1761150 - RNA, 14 nt, Homo sapiens
ccacacacagcagc

SEQ ID NO: 1761151 - RNA, 19 nt, Homo sapiens
agagugguggccuauuuca

SEQ ID NO: 1761152 - RNA, 21 nt, Homo sapiens
aaucucaguuguuugcuucuu

SEQ ID NO: 1761153 - RNA, 19 nt, Homo sapiens
auggaccaggaagcccuga

SEQ ID NO: 1761154 - RNA, 18 nt, Homo sapiens
aaguacccucuuuuacca

SEQ ID NO: 1761155 - RNA, 15 nt, Homo sapiens
cuggggcggggccca

SEQ ID NO: 1761156 - RNA, 16 nt, Homo sapiens
agaccucugugcacuu

SEQ ID NO: 1761157 - RNA, 22 nt, Homo sapiens
agcagcucuugcuaaucagugu

SEQ ID NO: 1761158 - RNA, 16 nt, Homo sapiens
acccaggcauagccug

SEQ ID NO: 1761159 - RNA, 23 nt, Homo sapiens
auugcauacaacugugcauuaca

SEQ ID NO: 1761160 - RNA, 17 nt, Homo sapiens
ugcccaaacuaaugagu

SEQ ID NO: 1761161 - RNA, 22 nt, Homo sapiens
uucuacuuuaauauaaacccau

SEQ ID NO: 1761162 - RNA, 14 nt, Homo sapiens
aagcaaaagcaagg

SEQ ID NO: 1761163 - RNA, 17 nt, Homo sapiens
ugaacacacauggaugc

SEQ ID NO: 1761164 - RNA, 20 nt, Homo sapiens
uuucacuccgcaaauauccu

SEQ ID NO: 1761165 - RNA, 13 nt, Homo sapiens
aggcacucauggg

SEQ ID NO: 1761166 - RNA, 17 nt, Homo sapiens
cuaacgcugaacugaca

SEQ ID NO: 1761167 - RNA, 13 nt, Homo sapiens
ucugcauaagauu

SEQ ID NO: 1761168 - RNA, 14 nt, Homo sapiens
gaggcaccucaaga

SEQ ID NO: 1761169 - RNA, 17 nt, Homo sapiens
auuacaauacaguauuu

SEQ ID NO: 1761170 - RNA, 20 nt, Homo sapiens
gacagaucaagcugugagac

SEQ ID NO: 1761171 - RNA, 19 nt, Homo sapiens
gaccaggcaggcaaaggcc

SEQ ID NO: 1761172 - RNA, 23 nt, Homo sapiens
auggacaccccuuauccaggacu

SEQ ID NO: 1761173 - RNA, 18 nt, Homo sapiens
ugucacuugacucuugaa

SEQ ID NO: 1761174 - RNA, 15 nt, Homo sapiens
auuuugcucugugaa

SEQ ID NO: 1761175 - RNA, 20 nt, Homo sapiens
cacccaagccugauccagcc

SEQ ID NO: 1761176 - RNA, 15 nt, Homo sapiens
aaauugaugccagug

SEQ ID NO: 1761177 - RNA, 22 nt, Homo sapiens
uguuauuucuuaaaauucagug

SEQ ID NO: 1761178 - RNA, 20 nt, Homo sapiens
uccaaugccacauacuugca

SEQ ID NO: 1761179 - RNA, 16 nt, Homo sapiens
aggaccccaaccccuc

SEQ ID NO: 1761180 - RNA, 22 nt, Homo sapiens
gguugaaaaauggcaaagaauu

SEQ ID NO: 1761181 - RNA, 13 nt, Homo sapiens
ccuggagggccag

SEQ ID NO: 1761182 - RNA, 12 nt, Homo sapiens
gaaggcuuuauu

SEQ ID NO: 1761183 - RNA, 23 nt, Homo sapiens
ugccaugccagcuuaucucaggg

SEQ ID NO: 1761184 - RNA, 21 nt, Homo sapiens
acuguagacucuggaaguaua

SEQ ID NO: 1761185 - RNA, 13 nt, Homo sapiens
ucauuacugugag

SEQ ID NO: 1761186 - RNA, 13 nt, Homo sapiens
gguguaggggcca

SEQ ID NO: 1761187 - RNA, 16 nt, Homo sapiens
aucgagucuaccucuu

SEQ ID NO: 1761188 - RNA, 19 nt, Homo sapiens
uuaucuggaaauaauauca

SEQ ID NO: 1761189 - RNA, 17 nt, Homo sapiens
aacuguuaacuaugaca

SEQ ID NO: 1761190 - RNA, 17 nt, Homo sapiens
uuaagcucugcuauuag

SEQ ID NO: 1761191 - RNA, 18 nt, Homo sapiens
gcacaaaauuaugcaaau

SEQ ID NO: 1761192 - RNA, 22 nt, Homo sapiens
aaaaccaaguaucacacuuuaa

SEQ ID NO: 1761193 - RNA, 17 nt, Homo sapiens
uuuugaguagcauauua

SEQ ID NO: 1761194 - RNA, 11 nt, Homo sapiens
cacacauauac

SEQ ID NO: 1761195 - RNA, 19 nt, Homo sapiens
cucagacccugcuuaggau

SEQ ID NO: 1761196 - RNA, 16 nt, Homo sapiens
cacugcggaagccaaa

SEQ ID NO: 1761197 - RNA, 17 nt, Homo sapiens
ucauuccccagcuccau

SEQ ID NO: 1761198 - RNA, 15 nt, Homo sapiens
cuacuaacagauuau

SEQ ID NO: 1761199 - RNA, 20 nt, Homo sapiens
aauugauaaaauguuuucac

SEQ ID NO: 1761200 - RNA, 18 nt, Homo sapiens
gcagaagcagaagugcaa

SEQ ID NO: 1761201 - RNA, 21 nt, Homo sapiens
gaguaaaauuccuucugauga

SEQ ID NO: 1761202 - RNA, 18 nt, Homo sapiens
gccuucuccaugcugaga

SEQ ID NO: 1761203 - RNA, 16 nt, Homo sapiens
cugcccgaggucgcug

SEQ ID NO: 1761204 - RNA, 19 nt, Homo sapiens
guagcuguucaguugccac

SEQ ID NO: 1761205 - RNA, 14 nt, Homo sapiens
aucaacccacuuaa

SEQ ID NO: 1761206 - RNA, 16 nt, Homo sapiens
ccugggacagccacug

SEQ ID NO: 1761207 - RNA, 14 nt, Homo sapiens
acaaagcauuuuca

SEQ ID NO: 1761208 - RNA, 12 nt, Homo sapiens
ccccacagccca

SEQ ID NO: 1761209 - RNA, 23 nt, Homo sapiens
uuccauucagacaauauaucaua

SEQ ID NO: 1761210 - RNA, 22 nt, Homo sapiens
caccuccguugcggcugugcuc

SEQ ID NO: 1761211 - RNA, 22 nt, Homo sapiens
ugcaacagcuacagucuaaaau

SEQ ID NO: 1761212 - RNA, 14 nt, Homo sapiens
cacuccccagccuc

SEQ ID NO: 1761213 - RNA, 16 nt, Homo sapiens
auaaauuucaauuaga

SEQ ID NO: 1761214 - RNA, 17 nt, Homo sapiens
ccucaguggcucugggu

SEQ ID NO: 1761215 - RNA, 17 nt, Homo sapiens
ucucaggaccucuguag

SEQ ID NO: 1761216 - RNA, 23 nt, Homo sapiens
agcggcauagcacccguggugca

SEQ ID NO: 1761217 - RNA, 21 nt, Homo sapiens
ugagcagaacccagacccuga

SEQ ID NO: 1761218 - RNA, 19 nt, Homo sapiens
guauauuuuugaucuuuga

SEQ ID NO: 1761219 - RNA, 20 nt, Homo sapiens
aauguuuuaaagaaguccau

SEQ ID NO: 1761220 - RNA, 17 nt, Homo sapiens
accgugcaugugcaguc

SEQ ID NO: 1761221 - RNA, 18 nt, Homo sapiens
cugcagcucccagaagcu

SEQ ID NO: 1761222 - RNA, 11 nt, Homo sapiens
ggaggggccca

SEQ ID NO: 1761223 - RNA, 13 nt, Homo sapiens
uagauuucuccuc

SEQ ID NO: 1761224 - RNA, 14 nt, Homo sapiens
cuuaacuauucaau

SEQ ID NO: 1761225 - RNA, 14 nt, Homo sapiens
uucuguuacuuugc

SEQ ID NO: 1761226 - RNA, 23 nt, Homo sapiens
gccaugcagcggccugagcagua

SEQ ID NO: 1761227 - RNA, 17 nt, Homo sapiens
ugcccuccaagaccuuc

SEQ ID NO: 1761228 - RNA, 18 nt, Homo sapiens
cuaauuuaaguacuugag

SEQ ID NO: 1761229 - RNA, 22 nt, Homo sapiens
auguguccccucacucugucag

SEQ ID NO: 1761230 - RNA, 15 nt, Homo sapiens
ugagggccgcuuuga

SEQ ID NO: 1761231 - RNA, 13 nt, Homo sapiens
gcagaacugaaga

SEQ ID NO: 1761232 - RNA, 13 nt, Homo sapiens
gcgagacugagag

SEQ ID NO: 1761233 - RNA, 19 nt, Homo sapiens
guccccccgcugucuuuga

SEQ ID NO: 1761234 - RNA, 16 nt, Homo sapiens
augacccaaagaccaa

SEQ ID NO: 1761235 - RNA, 19 nt, Homo sapiens
agucauaauugcauugacu

SEQ ID NO: 1761236 - RNA, 23 nt, Homo sapiens
caaaugcuuuuugaucuguugau

SEQ ID NO: 1761237 - RNA, 21 nt, Homo sapiens
ucaaaaucuuaaccugaugcu

SEQ ID NO: 1761238 - RNA, 18 nt, Homo sapiens
caguucaaaaacaagaca

SEQ ID NO: 1761239 - RNA, 12 nt, Homo sapiens
uaaaaguaccac

SEQ ID NO: 1761240 - RNA, 16 nt, Homo sapiens
cugacuguucuuccca

SEQ ID NO: 1761241 - RNA, 13 nt, Homo sapiens
ucuugccugcaug

SEQ ID NO: 1761242 - RNA, 20 nt, Homo sapiens
accuagaguuuggacuucca

SEQ ID NO: 1761243 - RNA, 22 nt, Homo sapiens
ggaggcuccaggacuccacugg

SEQ ID NO: 1761244 - RNA, 18 nt, Homo sapiens
uuugaaugacaagauuag

SEQ ID NO: 1761245 - RNA, 14 nt, Homo sapiens
ggguuuugcuacau

SEQ ID NO: 1761246 - RNA, 18 nt, Homo sapiens
uauagaugaguuuugcca

SEQ ID NO: 1761247 - RNA, 19 nt, Homo sapiens
acucgcuagguucuuauca

SEQ ID NO: 1761248 - RNA, 13 nt, Homo sapiens
uaucugaucagaa

SEQ ID NO: 1761249 - RNA, 14 nt, Homo sapiens
ugauggaccaaagc

SEQ ID NO: 1761250 - RNA, 14 nt, Homo sapiens
gcaagauacaacag

SEQ ID NO: 1761251 - RNA, 11 nt, Homo sapiens
ggaaugggcug

SEQ ID NO: 1761252 - RNA, 18 nt, Homo sapiens
ggacaggauggcugugug

SEQ ID NO: 1761253 - RNA, 15 nt, Homo sapiens
ugcugcugccuuuag

SEQ ID NO: 1761254 - RNA, 20 nt, Homo sapiens
guagccaucaagcacuuccc

SEQ ID NO: 1761255 - RNA, 12 nt, Homo sapiens
aauaucagucac

SEQ ID NO: 1761256 - RNA, 15 nt, Homo sapiens
cuguuuaaaguguca

SEQ ID NO: 1761257 - RNA, 13 nt, Homo sapiens
ccagcaacugccc

SEQ ID NO: 1761258 - RNA, 19 nt, Homo sapiens
cucuuagccucuggaucua

SEQ ID NO: 1761259 - RNA, 17 nt, Homo sapiens
cugcacguugugcacau

SEQ ID NO: 1761260 - RNA, 16 nt, Homo sapiens
cagaaaugugcugcaa

SEQ ID NO: 1761261 - RNA, 16 nt, Homo sapiens
gccauguuuuugccaa

SEQ ID NO: 1761262 - RNA, 18 nt, Homo sapiens
acaguccccagacucagc

SEQ ID NO: 1761263 - RNA, 19 nt, Homo sapiens
acuuuaaagcguuugcaca

SEQ ID NO: 1761264 - RNA, 20 nt, Homo sapiens
gaagaugaaagauucaguga

SEQ ID NO: 1761265 - RNA, 18 nt, Homo sapiens
guguuuguagucuugucu

SEQ ID NO: 1761266 - RNA, 11 nt, Homo sapiens
uuacagaauuu

SEQ ID NO: 1761267 - RNA, 19 nt, Homo sapiens
ucuucccugggcugccacc

SEQ ID NO: 1761268 - RNA, 22 nt, Homo sapiens
gccugaggcaauuagacacuuu

SEQ ID NO: 1761269 - RNA, 22 nt, Homo sapiens
uuuuaaugauauuggaggaaua

SEQ ID NO: 1761270 - RNA, 17 nt, Homo sapiens
uacauuauguugcuuaa

SEQ ID NO: 1761271 - RNA, 15 nt, Homo sapiens
ugagcacuguuuaua

SEQ ID NO: 1761272 - RNA, 22 nt, Homo sapiens
agcuucaggagggaaccagcuu

SEQ ID NO: 1761273 - RNA, 20 nt, Homo sapiens
uuccuucuugacauuuauca

SEQ ID NO: 1761274 - RNA, 23 nt, Homo sapiens
aaggauuauauguauuaauacuu

SEQ ID NO: 1761275 - RNA, 14 nt, Homo sapiens
ggcggccucuugcu

SEQ ID NO: 1761276 - RNA, 22 nt, Homo sapiens
gaggccgcugcaggguggcauc

SEQ ID NO: 1761277 - RNA, 14 nt, Homo sapiens
ugaaguugcugcuu

SEQ ID NO: 1761278 - RNA, 13 nt, Homo sapiens
caagccacagccu

SEQ ID NO: 1761279 - RNA, 18 nt, Homo sapiens
cuguggccuuaugagcuc

SEQ ID NO: 1761280 - RNA, 23 nt, Homo sapiens
agaaaauauauucuuucaaagga

SEQ ID NO: 1761281 - RNA, 18 nt, Homo sapiens
uguuucucccacauauuc

SEQ ID NO: 1761282 - RNA, 20 nt, Homo sapiens
cagccaccgaauugcuuuua

SEQ ID NO: 1761283 - RNA, 13 nt, Homo sapiens
uuuaaaagucauu

SEQ ID NO: 1761284 - RNA, 17 nt, Homo sapiens
ugaaauaaaauuaguuc

SEQ ID NO: 1761285 - RNA, 16 nt, Homo sapiens
ucccacccccacuuca

SEQ ID NO: 1761286 - RNA, 22 nt, Homo sapiens
caagagugagacuccaccucaa

SEQ ID NO: 1761287 - RNA, 20 nt, Homo sapiens
guccacccacccucucucug

SEQ ID NO: 1761288 - RNA, 13 nt, Homo sapiens
acaggcucugaga

SEQ ID NO: 1761289 - RNA, 11 nt, Homo sapiens
uggaggcuucc

SEQ ID NO: 1761290 - RNA, 23 nt, Homo sapiens
uucaauuuucuucacacuaucaa

SEQ ID NO: 1761291 - RNA, 15 nt, Homo sapiens
cugugcuuucccuga

SEQ ID NO: 1761292 - RNA, 18 nt, Homo sapiens
cgcuugcuggaacacagg

SEQ ID NO: 1761293 - RNA, 13 nt, Homo sapiens
uaauuauugcacu

SEQ ID NO: 1761294 - RNA, 11 nt, Homo sapiens
aggcauguaau

SEQ ID NO: 1761295 - RNA, 15 nt, Homo sapiens
cacccaucagugcuc

SEQ ID NO: 1761296 - RNA, 19 nt, Homo sapiens
ccagaacaauucugcagag

SEQ ID NO: 1761297 - RNA, 23 nt, Homo sapiens
auaaaauauuuuugaaaggcaug

SEQ ID NO: 1761298 - RNA, 18 nt, Homo sapiens
cugaaaccuuaaauauca

SEQ ID NO: 1761299 - RNA, 14 nt, Homo sapiens
ucuucagcucugaa

SEQ ID NO: 1761300 - RNA, 14 nt, Homo sapiens
auugaagcauuuca

SEQ ID NO: 1761301 - RNA, 14 nt, Homo sapiens
acauucuguuaauc

SEQ ID NO: 1761302 - RNA, 21 nt, Homo sapiens
aaggcgcuuugaaacaggggc

SEQ ID NO: 1761303 - RNA, 13 nt, Homo sapiens
agaccagccagug

SEQ ID NO: 1761304 - RNA, 15 nt, Homo sapiens
uaccagaucacucaa

SEQ ID NO: 1761305 - RNA, 14 nt, Homo sapiens
uuucuuacauuagc

SEQ ID NO: 1761306 - RNA, 14 nt, Homo sapiens
uaccacaauucauu

SEQ ID NO: 1761307 - RNA, 20 nt, Homo sapiens
ucccucggggccauacuucu

SEQ ID NO: 1761308 - RNA, 17 nt, Homo sapiens
gaugucggucuugcaaa

SEQ ID NO: 1761309 - RNA, 16 nt, Homo sapiens
guugucccaucugccc

SEQ ID NO: 1761310 - RNA, 22 nt, Homo sapiens
gccaagcuuccugugcccucac

SEQ ID NO: 1761311 - RNA, 16 nt, Homo sapiens
augagacuuacugcuc

SEQ ID NO: 1761312 - RNA, 21 nt, Homo sapiens
aaggauuguacacgcugauga

SEQ ID NO: 1761313 - RNA, 19 nt, Homo sapiens
aaaguaauuuaauuuguaa

SEQ ID NO: 1761314 - RNA, 21 nt, Homo sapiens
uuuuuagacuguuagacaaaa

SEQ ID NO: 1761315 - RNA, 16 nt, Homo sapiens
gacccacaaggccagg

SEQ ID NO: 1761316 - RNA, 23 nt, Homo sapiens
acaauugggagauuaucuuucaa

SEQ ID NO: 1761317 - RNA, 13 nt, Homo sapiens
cugcacacuaaua

SEQ ID NO: 1761318 - RNA, 11 nt, Homo sapiens
accccaugcug

SEQ ID NO: 1761319 - RNA, 13 nt, Homo sapiens
uuauacaccagca

SEQ ID NO: 1761320 - RNA, 20 nt, Homo sapiens
ccugcucagcccauccccug

SEQ ID NO: 1761321 - RNA, 15 nt, Homo sapiens
uucauauauacaggc

SEQ ID NO: 1761322 - RNA, 23 nt, Homo sapiens
aagccuggacgcagccacacagu

SEQ ID NO: 1761323 - RNA, 21 nt, Homo sapiens
agaaagauguuccagugagga

SEQ ID NO: 1761324 - RNA, 14 nt, Homo sapiens
gcuauuuaugcaag

SEQ ID NO: 1761325 - RNA, 18 nt, Homo sapiens
uaaacuaucuguauuuau

SEQ ID NO: 1761326 - RNA, 23 nt, Homo sapiens
cuguaauagugaacauauggaaa

SEQ ID NO: 1761327 - RNA, 17 nt, Homo sapiens
uggaagcauauuguuau

SEQ ID NO: 1761328 - RNA, 19 nt, Homo sapiens
acagaaggugaacuuugug

SEQ ID NO: 1761329 - RNA, 16 nt, Homo sapiens
uaucagauucuuggcu

SEQ ID NO: 1761330 - RNA, 22 nt, Homo sapiens
cacccagaugggggaaagcaca

SEQ ID NO: 1761331 - RNA, 14 nt, Homo sapiens
ucucaacaaccuga

SEQ ID NO: 1761332 - RNA, 23 nt, Homo sapiens
acuccccuacaucaaaugcucaa

SEQ ID NO: 1761333 - RNA, 23 nt, Homo sapiens
ggaauauagucaguaauuuaucu

SEQ ID NO: 1761334 - RNA, 12 nt, Homo sapiens
auccacacugag

SEQ ID NO: 1761335 - RNA, 13 nt, Homo sapiens
agucucacuuugg

SEQ ID NO: 1761336 - RNA, 19 nt, Homo sapiens
ucacccaaaagaauuauca

SEQ ID NO: 1761337 - RNA, 14 nt, Homo sapiens
uaaugucaauguua

SEQ ID NO: 1761338 - RNA, 20 nt, Homo sapiens
ucuuucacuggggaagccag

SEQ ID NO: 1761339 - RNA, 16 nt, Homo sapiens
uccauucaacugaaaa

SEQ ID NO: 1761340 - RNA, 22 nt, Homo sapiens
aagagugccagucagcagucau

SEQ ID NO: 1761341 - RNA, 18 nt, Homo sapiens
aaauauuugacaggcuua

SEQ ID NO: 1761342 - RNA, 13 nt, Homo sapiens
uguacauaccuug

SEQ ID NO: 1761343 - RNA, 13 nt, Homo sapiens
uacucuguguaaa

SEQ ID NO: 1761344 - RNA, 13 nt, Homo sapiens
uuauaugugacac

SEQ ID NO: 1761345 - RNA, 11 nt, Homo sapiens
cuugugcaugu

SEQ ID NO: 1761346 - RNA, 17 nt, Homo sapiens
ucuguuaucgaacacau

SEQ ID NO: 1761347 - RNA, 19 nt, Homo sapiens
ugguccccuccuucccaag

SEQ ID NO: 1761348 - RNA, 14 nt, Homo sapiens
agcuaugcaaaaag

SEQ ID NO: 1761349 - RNA, 20 nt, Homo sapiens
auuuuaaguaucccaucuaa

SEQ ID NO: 1761350 - RNA, 17 nt, Homo sapiens
ugcaacuuuuaauuacu

SEQ ID NO: 1761351 - RNA, 19 nt, Homo sapiens
aaccaugguaauaaaauau

SEQ ID NO: 1761352 - RNA, 19 nt, Homo sapiens
cagaaagagcucuccagaa

SEQ ID NO: 1761353 - RNA, 19 nt, Homo sapiens
caggagcuccaguguccug

SEQ ID NO: 1761354 - RNA, 16 nt, Homo sapiens
uuaaagaaacacuaaa

SEQ ID NO: 1761355 - RNA, 13 nt, Homo sapiens
ucacuuccaugac

SEQ ID NO: 1761356 - RNA, 13 nt, Homo sapiens
aacugugcaucuc

SEQ ID NO: 1761357 - RNA, 19 nt, Homo sapiens
ccaaaguuugcucaaggag

SEQ ID NO: 1761358 - RNA, 22 nt, Homo sapiens
aggauagcgagaagaugcucug

SEQ ID NO: 1761359 - RNA, 14 nt, Homo sapiens
ucucacauguggca

SEQ ID NO: 1761360 - RNA, 21 nt, Homo sapiens
uuuaagacugauaauuuuaca

SEQ ID NO: 1761361 - RNA, 18 nt, Homo sapiens
cuggcgcaucauaugcag

SEQ ID NO: 1761362 - RNA, 20 nt, Homo sapiens
auagcagccucacacuggcg

SEQ ID NO: 1761363 - RNA, 23 nt, Homo sapiens
uaacuguuaacuaugacagauau

SEQ ID NO: 1761364 - RNA, 16 nt, Homo sapiens
gggcucuggggcagcu

SEQ ID NO: 1761365 - RNA, 19 nt, Homo sapiens
ucauagggaugcugugagc

SEQ ID NO: 1761366 - RNA, 18 nt, Homo sapiens
caaagugcugagauuaca

SEQ ID NO: 1761367 - RNA, 17 nt, Homo sapiens
cagugcgugaagaccaa

SEQ ID NO: 1761368 - RNA, 18 nt, Homo sapiens
ccaagggcagaggggugc

SEQ ID NO: 1761369 - RNA, 16 nt, Homo sapiens
agccuuaccaaagcag

SEQ ID NO: 1761370 - RNA, 12 nt, Homo sapiens
aagggucuuccu

SEQ ID NO: 1761371 - RNA, 22 nt, Homo sapiens
caucccuuccuggaaacagcau

SEQ ID NO: 1761372 - RNA, 13 nt, Homo sapiens
gccucacucagcu

SEQ ID NO: 1761373 - RNA, 20 nt, Homo sapiens
uuacaguauauguugcaaaa

SEQ ID NO: 1761374 - RNA, 15 nt, Homo sapiens
uaacuacuuccugau

SEQ ID NO: 1761375 - RNA, 14 nt, Homo sapiens
caaucaaccaaagu

SEQ ID NO: 1761376 - RNA, 17 nt, Homo sapiens
gguguuaauuuugcuaa

SEQ ID NO: 1761377 - RNA, 22 nt, Homo sapiens
agcuucagcucaacucacagcu

SEQ ID NO: 1761378 - RNA, 14 nt, Homo sapiens
agcagcuuuaaaca

SEQ ID NO: 1761379 - RNA, 14 nt, Homo sapiens
uaguuucaaagucu

SEQ ID NO: 1761380 - RNA, 17 nt, Homo sapiens
ccagugcuuuaauggca

SEQ ID NO: 1761381 - RNA, 15 nt, Homo sapiens
gcaacaacagauucu

SEQ ID NO: 1761382 - RNA, 21 nt, Homo sapiens
acuauggagugcaccaaagag

SEQ ID NO: 1761383 - RNA, 20 nt, Homo sapiens
uuggaggagcaaaguuaaaa

SEQ ID NO: 1761384 - RNA, 24 nt, Homo sapiens
cuacaaacauaucaaacauaugua

SEQ ID NO: 1761385 - RNA, 13 nt, Homo sapiens
cuuggaagccagg

SEQ ID NO: 1761386 - RNA, 18 nt, Homo sapiens
acuaaugcuuucugugga

SEQ ID NO: 1761387 - RNA, 22 nt, Homo sapiens
gagacagaagccuggacucugc

SEQ ID NO: 1761388 - RNA, 15 nt, Homo sapiens
uagucucauucuguc

SEQ ID NO: 1761389 - RNA, 14 nt, Homo sapiens
ugcccccuccacug

SEQ ID NO: 1761390 - RNA, 19 nt, Homo sapiens
gacuuuacgcccaucucag

SEQ ID NO: 1761391 - RNA, 16 nt, Homo sapiens
gaguguauaugaauga

SEQ ID NO: 1761392 - RNA, 14 nt, Homo sapiens
cuccaaaagcacuu

SEQ ID NO: 1761393 - RNA, 20 nt, Homo sapiens
aauaaaguauucgcauuaua

SEQ ID NO: 1761394 - RNA, 13 nt, Homo sapiens
aucccucccugac

SEQ ID NO: 1761395 - RNA, 21 nt, Homo sapiens
aaaaagguuggagcagugcuu

SEQ ID NO: 1761396 - RNA, 22 nt, Homo sapiens
gagccagaccuucggagaguaa

SEQ ID NO: 1761397 - RNA, 15 nt, Homo sapiens
ggugucgucugugaa

SEQ ID NO: 1761398 - RNA, 14 nt, Homo sapiens
uuauggaaauacca

SEQ ID NO: 1761399 - RNA, 23 nt, Homo sapiens
ucauuguauuuuuaacaccagaa

SEQ ID NO: 1761400 - RNA, 11 nt, Homo sapiens
uuaugaaucuc

SEQ ID NO: 1761401 - RNA, 17 nt, Homo sapiens
uugcuacuucccucacc

SEQ ID NO: 1761402 - RNA, 14 nt, Homo sapiens
ucacccucaugaaa

SEQ ID NO: 1761403 - RNA, 12 nt, Homo sapiens
gaccucugugac

SEQ ID NO: 1761404 - RNA, 12 nt, Homo sapiens
uacgucugggag

SEQ ID NO: 1761405 - RNA, 14 nt, Homo sapiens
uggauugggguccc

SEQ ID NO: 1761406 - RNA, 19 nt, Homo sapiens
cagcaugcauucauaacag

SEQ ID NO: 1761407 - RNA, 21 nt, Homo sapiens
aaauguagacuuuugcuuuau

SEQ ID NO: 1761408 - RNA, 20 nt, Homo sapiens
gaaggaacucaagguggcug

SEQ ID NO: 1761409 - RNA, 19 nt, Homo sapiens
agggaagggcugguguuga

SEQ ID NO: 1761410 - RNA, 12 nt, Homo sapiens
gucucucugucu

SEQ ID NO: 1761411 - RNA, 16 nt, Homo sapiens
uaaugggaaguguaca

SEQ ID NO: 1761412 - RNA, 17 nt, Homo sapiens
uucaauguaguuuucca

SEQ ID NO: 1761413 - RNA, 15 nt, Homo sapiens
uacaaaaacacagca

SEQ ID NO: 1761414 - RNA, 19 nt, Homo sapiens
cugugaauggcagccugag

SEQ ID NO: 1761415 - RNA, 22 nt, Homo sapiens
cuaacagacauagacugcaaaa

SEQ ID NO: 1761416 - RNA, 14 nt, Homo sapiens
ugaacuaccaucug

SEQ ID NO: 1761417 - RNA, 18 nt, Homo sapiens
ucucucuugcuuacaaau

SEQ ID NO: 1761418 - RNA, 17 nt, Homo sapiens
uuacuuaacuuaauuca

SEQ ID NO: 1761419 - RNA, 16 nt, Homo sapiens
ggggcucucagcucag

SEQ ID NO: 1761420 - RNA, 11 nt, Homo sapiens
ucucuguaaaa

SEQ ID NO: 1761421 - RNA, 13 nt, Homo sapiens
aauagaaacaaca

SEQ ID NO: 1761422 - RNA, 15 nt, Homo sapiens
cugcagacagaccuc

SEQ ID NO: 1761423 - RNA, 17 nt, Homo sapiens
aucuauggcgaacacag

SEQ ID NO: 1761424 - RNA, 20 nt, Homo sapiens
ggagccuucugugcugugag

SEQ ID NO: 1761425 - RNA, 17 nt, Homo sapiens
gcuccuuccaucugccu

SEQ ID NO: 1761426 - RNA, 19 nt, Homo sapiens
uaacaaacaggauauccaa

SEQ ID NO: 1761427 - RNA, 15 nt, Homo sapiens
augcuuuaagacaga

SEQ ID NO: 1761428 - RNA, 21 nt, Homo sapiens
caauuagcaauugacugucac

SEQ ID NO: 1761429 - RNA, 14 nt, Homo sapiens
uggacauguacaaa

SEQ ID NO: 1761430 - RNA, 22 nt, Homo sapiens
aaacaugcagaagauguuuaaa

SEQ ID NO: 1761431 - RNA, 15 nt, Homo sapiens
ccugagacaaaugga

SEQ ID NO: 1761432 - RNA, 14 nt, Homo sapiens
cuagguugcaaggu

SEQ ID NO: 1761433 - RNA, 14 nt, Homo sapiens
uucuuuuguacuuu

SEQ ID NO: 1761434 - RNA, 14 nt, Homo sapiens
cuguccugcagucc

SEQ ID NO: 1761435 - RNA, 14 nt, Homo sapiens
cuagugugcaagug

SEQ ID NO: 1761436 - RNA, 18 nt, Homo sapiens
guagccacucucugccca

SEQ ID NO: 1761437 - RNA, 19 nt, Homo sapiens
uggaguagagguacuagaa

SEQ ID NO: 1761438 - RNA, 18 nt, Homo sapiens
gaaagcaccgcagcaugu

SEQ ID NO: 1761439 - RNA, 13 nt, Homo sapiens
gaguuagccaaac

SEQ ID NO: 1761440 - RNA, 15 nt, Homo sapiens
auuuaagauauguaa

SEQ ID NO: 1761441 - RNA, 23 nt, Homo sapiens
gaauaguguuggaaaaugugcaa

SEQ ID NO: 1761442 - RNA, 22 nt, Homo sapiens
cuggaggguaacuggggggcca

SEQ ID NO: 1761443 - RNA, 18 nt, Homo sapiens
cuaguguucuguuuguua

SEQ ID NO: 1761444 - RNA, 19 nt, Homo sapiens
gauucuagcuaccuguauu

SEQ ID NO: 1761445 - RNA, 17 nt, Homo sapiens
uuuaauggauauuucuc

SEQ ID NO: 1761446 - RNA, 17 nt, Homo sapiens
uccaagacucagaugau

SEQ ID NO: 1761447 - RNA, 12 nt, Homo sapiens
uucaguguaaau

SEQ ID NO: 1761448 - RNA, 12 nt, Homo sapiens
aaauguguuuca

SEQ ID NO: 1761449 - RNA, 16 nt, Homo sapiens
aaaguauaacugaguu

SEQ ID NO: 1761450 - RNA, 11 nt, Homo sapiens
guaacacuggc

SEQ ID NO: 1761451 - RNA, 19 nt, Homo sapiens
cagcucccaggaccacagg

SEQ ID NO: 1761452 - RNA, 20 nt, Homo sapiens
caggagccggacacuucuca

SEQ ID NO: 1761453 - RNA, 21 nt, Homo sapiens
acagauuuuugguaguuucug

SEQ ID NO: 1761454 - RNA, 18 nt, Homo sapiens
aggauggcgugugugccg

SEQ ID NO: 1761455 - RNA, 13 nt, Homo sapiens
cggaguuccagca

SEQ ID NO: 1761456 - RNA, 23 nt, Homo sapiens
acgaaacacaaaccacaacugac

SEQ ID NO: 1761457 - RNA, 20 nt, Homo sapiens
accucccaacgucccuagcc

SEQ ID NO: 1761458 - RNA, 17 nt, Homo sapiens
uaaagaugcuauucuuc

SEQ ID NO: 1761459 - RNA, 19 nt, Homo sapiens
gucucuauaccaauaaagu

SEQ ID NO: 1761460 - RNA, 22 nt, Homo sapiens
agucuuccaguuuaaugaacua

SEQ ID NO: 1761461 - RNA, 12 nt, Homo sapiens
ggccacauucaa

SEQ ID NO: 1761462 - RNA, 14 nt, Homo sapiens
gugaaagcuuucau

SEQ ID NO: 1761463 - RNA, 22 nt, Homo sapiens
caggaggccaauaaaaaguuca

SEQ ID NO: 1761464 - RNA, 16 nt, Homo sapiens
uaauuucuugcaauuu

SEQ ID NO: 1761465 - RNA, 11 nt, Homo sapiens
ugccauuccac

SEQ ID NO: 1761466 - RNA, 18 nt, Homo sapiens
aggggccucaucuucccc

SEQ ID NO: 1761467 - RNA, 19 nt, Homo sapiens
uggacaccccugcuauaua

SEQ ID NO: 1761468 - RNA, 22 nt, Homo sapiens
auucuauugggauauccuuuca

SEQ ID NO: 1761469 - RNA, 11 nt, Homo sapiens
aaggguucugu

SEQ ID NO: 1761470 - RNA, 14 nt, Homo sapiens
agcccaggcagcua

SEQ ID NO: 1761471 - RNA, 18 nt, Homo sapiens
ugaggaugugagccugau

SEQ ID NO: 1761472 - RNA, 15 nt, Homo sapiens
uccccuggacuggga

SEQ ID NO: 1761473 - RNA, 18 nt, Homo sapiens
agauucuucccucugagu

SEQ ID NO: 1761474 - RNA, 17 nt, Homo sapiens
cagggccucaguuucau

SEQ ID NO: 1761475 - RNA, 21 nt, Homo sapiens
caaaaucuccuggcuuuacag

SEQ ID NO: 1761476 - RNA, 13 nt, Homo sapiens
uagacuagucuca

SEQ ID NO: 1761477 - RNA, 20 nt, Homo sapiens
uaauuguaaaggugaugaau

SEQ ID NO: 1761478 - RNA, 16 nt, Homo sapiens
cugaaacucacaguaa

SEQ ID NO: 1761479 - RNA, 14 nt, Homo sapiens
uugugcccauuccu

SEQ ID NO: 1761480 - RNA, 22 nt, Homo sapiens
aauguuuguuauuuacacuggu

SEQ ID NO: 1761481 - RNA, 14 nt, Homo sapiens
acuuuaaacuuaau

SEQ ID NO: 1761482 - RNA, 17 nt, Homo sapiens
cuucagaauuguuuuua

SEQ ID NO: 1761483 - RNA, 18 nt, Homo sapiens
cuguugguuaaaugacaa

SEQ ID NO: 1761484 - RNA, 19 nt, Homo sapiens
cuguuuucucucuguuaca

SEQ ID NO: 1761485 - RNA, 15 nt, Homo sapiens
aagcucauaauggaa

SEQ ID NO: 1761486 - RNA, 22 nt, Homo sapiens
ucuaacaggaaaagagggagaa

SEQ ID NO: 1761487 - RNA, 15 nt, Homo sapiens
aaaccgaauuuucac

SEQ ID NO: 1761488 - RNA, 17 nt, Homo sapiens
cuguaaucccaguacuu

SEQ ID NO: 1761489 - RNA, 12 nt, Homo sapiens
uuuuguguccuc

SEQ ID NO: 1761490 - RNA, 17 nt, Homo sapiens
agaggaucggaggcuug

SEQ ID NO: 1761491 - RNA, 19 nt, Homo sapiens
cuugaaucuguuacugaaa

SEQ ID NO: 1761492 - RNA, 17 nt, Homo sapiens
uguugaaucuauuucac

SEQ ID NO: 1761493 - RNA, 18 nt, Homo sapiens
cuguuucuuagauucuga

SEQ ID NO: 1761494 - RNA, 13 nt, Homo sapiens
ccaguguucugca

SEQ ID NO: 1761495 - RNA, 21 nt, Homo sapiens
gcuuaccagaagcuuccauag

SEQ ID NO: 1761496 - RNA, 15 nt, Homo sapiens
agcuaaaacuggccc

SEQ ID NO: 1761497 - RNA, 12 nt, Homo sapiens
uucuggcugugc

SEQ ID NO: 1761498 - RNA, 12 nt, Homo sapiens
acaagagcugcu

SEQ ID NO: 1761499 - RNA, 18 nt, Homo sapiens
ugcuggccacacagcagc

SEQ ID NO: 1761500 - RNA, 11 nt, Homo sapiens
gugcacuucaa

SEQ ID NO: 1761501 - RNA, 11 nt, Homo sapiens
caaaugaugcc

SEQ ID NO: 1761502 - RNA, 13 nt, Homo sapiens
cuguaguguacca

SEQ ID NO: 1761503 - RNA, 17 nt, Homo sapiens
aacggaagcugacauaa

SEQ ID NO: 1761504 - RNA, 15 nt, Homo sapiens
acuuuucccauucag

SEQ ID NO: 1761505 - RNA, 23 nt, Homo sapiens
uuauucuuaaguaaggacaaaga

SEQ ID NO: 1761506 - RNA, 13 nt, Homo sapiens
augacagccagag

SEQ ID NO: 1761507 - RNA, 13 nt, Homo sapiens
aucaggucccauc

SEQ ID NO: 1761508 - RNA, 13 nt, Homo sapiens
aagggacauggga

SEQ ID NO: 1761509 - RNA, 22 nt, Homo sapiens
cacaggccccaguuauugugaa

SEQ ID NO: 1761510 - RNA, 22 nt, Homo sapiens
auaucacaaaguuguuuaacua

SEQ ID NO: 1761511 - RNA, 23 nt, Homo sapiens
uguaaaauuuaaaucauauccua

SEQ ID NO: 1761512 - RNA, 18 nt, Homo sapiens
agugccaucggucuagaa

SEQ ID NO: 1761513 - RNA, 16 nt, Homo sapiens
uccucacucaccuuca

SEQ ID NO: 1761514 - RNA, 20 nt, Homo sapiens
ugucugcugcucccagccac

SEQ ID NO: 1761515 - RNA, 19 nt, Homo sapiens
acaagugacuuauuugcuc

SEQ ID NO: 1761516 - RNA, 23 nt, Homo sapiens
aggguuuuaaacacuaaucacaa

SEQ ID NO: 1761517 - RNA, 23 nt, Homo sapiens
cuguauuuugauauaauuguacu

SEQ ID NO: 1761518 - RNA, 21 nt, Homo sapiens
cuuccuauaccggagcuccag

SEQ ID NO: 1761519 - RNA, 17 nt, Homo sapiens
uuguuuuuuucuccauc

SEQ ID NO: 1761520 - RNA, 18 nt, Homo sapiens
cacgcagcuggugacugg

SEQ ID NO: 1761521 - RNA, 16 nt, Homo sapiens
agucacucagccauuu

SEQ ID NO: 1761522 - RNA, 16 nt, Homo sapiens
aauaucccaacauucu

SEQ ID NO: 1761523 - RNA, 14 nt, Homo sapiens
agaaaacugugauu

SEQ ID NO: 1761524 - RNA, 21 nt, Homo sapiens
caggcuuuuguguucucuaaa

SEQ ID NO: 1761525 - RNA, 23 nt, Homo sapiens
uggccaccuccagggacaaagag

SEQ ID NO: 1761526 - RNA, 18 nt, Homo sapiens
ccauauuuuacugaucuc

SEQ ID NO: 1761527 - RNA, 18 nt, Homo sapiens
uucacccaccaggccagc

SEQ ID NO: 1761528 - RNA, 15 nt, Homo sapiens
ucagcaucucgguuc

SEQ ID NO: 1761529 - RNA, 20 nt, Homo sapiens
aucucaugagugccaagcaa

SEQ ID NO: 1761530 - RNA, 12 nt, Homo sapiens
aaaaaauuauua

SEQ ID NO: 1761531 - RNA, 15 nt, Homo sapiens
aggaagccucugggu

SEQ ID NO: 1761532 - RNA, 18 nt, Homo sapiens
ccugggccccaccaccua

SEQ ID NO: 1761533 - RNA, 14 nt, Homo sapiens
uugcauuuucacaa

SEQ ID NO: 1761534 - RNA, 20 nt, Homo sapiens
ugcuccauugucaugagucc

SEQ ID NO: 1761535 - RNA, 13 nt, Homo sapiens
ggaauaaacuguu

SEQ ID NO: 1761536 - RNA, 12 nt, Homo sapiens
cccacuggguuu

SEQ ID NO: 1761537 - RNA, 15 nt, Homo sapiens
cagcacagcugccaa

SEQ ID NO: 1761538 - RNA, 19 nt, Homo sapiens
auuuaagaaugacaggcuu

SEQ ID NO: 1761539 - RNA, 15 nt, Homo sapiens
uccaaauggacauaa

SEQ ID NO: 1761540 - RNA, 16 nt, Homo sapiens
ggcucuagccacugag

SEQ ID NO: 1761541 - RNA, 15 nt, Homo sapiens
gccaucguucaucca

SEQ ID NO: 1761542 - RNA, 15 nt, Homo sapiens
cuacaugaacacaaa

SEQ ID NO: 1761543 - RNA, 22 nt, Homo sapiens
gcuaagauccuccugaccucaa

SEQ ID NO: 1761544 - RNA, 16 nt, Homo sapiens
ucauacucaccucacc

SEQ ID NO: 1761545 - RNA, 19 nt, Homo sapiens
cagccucgcgggugucaca

SEQ ID NO: 1761546 - RNA, 19 nt, Homo sapiens
ucagagagggcaggcauga

SEQ ID NO: 1761547 - RNA, 15 nt, Homo sapiens
uuguaaaacugugac

SEQ ID NO: 1761548 - RNA, 17 nt, Homo sapiens
agaugugcuuugcugca

SEQ ID NO: 1761549 - RNA, 21 nt, Homo sapiens
cucacugugggaaggccagcu

SEQ ID NO: 1761550 - RNA, 15 nt, Homo sapiens
caucaaaaagaacaa

SEQ ID NO: 1761551 - RNA, 22 nt, Homo sapiens
agaccucucaauuucuggaaaa

SEQ ID NO: 1761552 - RNA, 16 nt, Homo sapiens
aaucugcugcauuuca

SEQ ID NO: 1761553 - RNA, 13 nt, Homo sapiens
acuguuuuaucuc

SEQ ID NO: 1761554 - RNA, 18 nt, Homo sapiens
agauugaaccugaauauu

SEQ ID NO: 1761555 - RNA, 16 nt, Homo sapiens
uugcugucccuuuucc

SEQ ID NO: 1761556 - RNA, 23 nt, Homo sapiens
agaaaaaaaaaaaaaaucacugu

SEQ ID NO: 1761557 - RNA, 22 nt, Homo sapiens
aauuacuuugauuccauuuuaa

SEQ ID NO: 1761558 - RNA, 22 nt, Homo sapiens
uacuugaaacagucacuaucau

SEQ ID NO: 1761559 - RNA, 20 nt, Homo sapiens
ucaggccugcuagucacugg

SEQ ID NO: 1761560 - RNA, 20 nt, Homo sapiens
agcuucccucugccugaccc

SEQ ID NO: 1761561 - RNA, 15 nt, Homo sapiens
auggccacuaagugu

SEQ ID NO: 1761562 - RNA, 22 nt, Homo sapiens
aucauuaggcuuacguacuacu

SEQ ID NO: 1761563 - RNA, 20 nt, Homo sapiens
cuggcagagagguaaagggu

SEQ ID NO: 1761564 - RNA, 22 nt, Homo sapiens
aaagacauaggaacauguaguu

SEQ ID NO: 1761565 - RNA, 12 nt, Homo sapiens
aaauagugucug

SEQ ID NO: 1761566 - RNA, 21 nt, Homo sapiens
ugggauuuggggccucaagaa

SEQ ID NO: 1761567 - RNA, 16 nt, Homo sapiens
aacuacuacuggugau

SEQ ID NO: 1761568 - RNA, 23 nt, Homo sapiens
cguccauaguucugaggucccug

SEQ ID NO: 1761569 - RNA, 13 nt, Homo sapiens
ucaaguugugaua

SEQ ID NO: 1761570 - RNA, 13 nt, Homo sapiens
acacagugaugaa

SEQ ID NO: 1761571 - RNA, 18 nt, Homo sapiens
agagucacaauuugcaaa

SEQ ID NO: 1761572 - RNA, 18 nt, Homo sapiens
uugccuauggaguagcca

SEQ ID NO: 1761573 - RNA, 18 nt, Homo sapiens
caggcacuaucuggguuu

SEQ ID NO: 1761574 - RNA, 16 nt, Homo sapiens
cauuuugugugaugca

SEQ ID NO: 1761575 - RNA, 12 nt, Homo sapiens
gcagcugugaug

SEQ ID NO: 1761576 - RNA, 12 nt, Homo sapiens
aauacuguacaa

SEQ ID NO: 1761577 - RNA, 12 nt, Homo sapiens
aaaggagcugcu

SEQ ID NO: 1761578 - RNA, 17 nt, Homo sapiens
ugaaaaauaaaaguaua

SEQ ID NO: 1761579 - RNA, 22 nt, Homo sapiens
guuuacccucaacccuauucau

SEQ ID NO: 1761580 - RNA, 16 nt, Homo sapiens
agcugggggaagaagg

SEQ ID NO: 1761581 - RNA, 15 nt, Homo sapiens
aagaaaaugaugcug

SEQ ID NO: 1761582 - RNA, 22 nt, Homo sapiens
aagcaaucugagagauuugaau

SEQ ID NO: 1761583 - RNA, 22 nt, Homo sapiens
aucuucaaugaacugugcuuuu

SEQ ID NO: 1761584 - RNA, 21 nt, Homo sapiens
guuuuaggguacaugugcaca

SEQ ID NO: 1761585 - RNA, 16 nt, Homo sapiens
uccuagcaaccuccac

SEQ ID NO: 1761586 - RNA, 22 nt, Homo sapiens
cacagcuuauggcaucucauug

SEQ ID NO: 1761587 - RNA, 20 nt, Homo sapiens
ccucucccaaguccagugug

SEQ ID NO: 1761588 - RNA, 21 nt, Homo sapiens
cccaagaccugcgauggacuu

SEQ ID NO: 1761589 - RNA, 14 nt, Homo sapiens
uuucaugacauaau

SEQ ID NO: 1761590 - RNA, 16 nt, Homo sapiens
ugccccuggaugcacu

SEQ ID NO: 1761591 - RNA, 12 nt, Homo sapiens
gcauguauccau

SEQ ID NO: 1761592 - RNA, 22 nt, Homo sapiens
uagucccugcacagugacuucu

SEQ ID NO: 1761593 - RNA, 18 nt, Homo sapiens
aggaaaagggagcuauga

SEQ ID NO: 1761594 - RNA, 19 nt, Homo sapiens
agucagcccuuauggccaa

SEQ ID NO: 1761595 - RNA, 18 nt, Homo sapiens
caccagaugaugucccac

SEQ ID NO: 1761596 - RNA, 18 nt, Homo sapiens
uaaggucuaaucagugau

SEQ ID NO: 1761597 - RNA, 15 nt, Homo sapiens
gagauuuuucaugau

SEQ ID NO: 1761598 - RNA, 19 nt, Homo sapiens
caguggcauucacaucuca

SEQ ID NO: 1761599 - RNA, 13 nt, Homo sapiens
ggcaguaccauuc

SEQ ID NO: 1761600 - RNA, 14 nt, Homo sapiens
acuugguucaguac

SEQ ID NO: 1761601 - RNA, 18 nt, Homo sapiens
cauugagcaguuagcuca

SEQ ID NO: 1761602 - RNA, 21 nt, Homo sapiens
gggccccucaacagccaagug

SEQ ID NO: 1761603 - RNA, 20 nt, Homo sapiens
acuaaacuacagaaaccuag

SEQ ID NO: 1761604 - RNA, 17 nt, Homo sapiens
uuuauauguacaugaga

SEQ ID NO: 1761605 - RNA, 22 nt, Homo sapiens
cauugucguauaggcauguaaa

SEQ ID NO: 1761606 - RNA, 20 nt, Homo sapiens
caaacaauaguaauucucag

SEQ ID NO: 1761607 - RNA, 20 nt, Homo sapiens
cuuacacuuuaugcacaaaa

SEQ ID NO: 1761608 - RNA, 22 nt, Homo sapiens
auguaccaccaacuacuaccug

SEQ ID NO: 1761609 - RNA, 12 nt, Homo sapiens
acugugacagac

SEQ ID NO: 1761610 - RNA, 15 nt, Homo sapiens
cugacagcacuccuc

SEQ ID NO: 1761611 - RNA, 13 nt, Homo sapiens
gcucuguacccau

SEQ ID NO: 1761612 - RNA, 16 nt, Homo sapiens
uuagaauaucuagcau

SEQ ID NO: 1761613 - RNA, 17 nt, Homo sapiens
aaagcaaaauaacaaaa

SEQ ID NO: 1761614 - RNA, 16 nt, Homo sapiens
guuauaaaaggcuuua

SEQ ID NO: 1761615 - RNA, 21 nt, Homo sapiens
agagcuuccagaaaugccaca

SEQ ID NO: 1761616 - RNA, 13 nt, Homo sapiens
agacgccuuccuc

SEQ ID NO: 1761617 - RNA, 17 nt, Homo sapiens
augcccccucagugagg

SEQ ID NO: 1761618 - RNA, 15 nt, Homo sapiens
ugaaguccacagaag

SEQ ID NO: 1761619 - RNA, 19 nt, Homo sapiens
ccaucggugaaacuaacag

SEQ ID NO: 1761620 - RNA, 24 nt, Homo sapiens
guauuccaugguguauaugugcca

SEQ ID NO: 1761621 - RNA, 15 nt, Homo sapiens
acucccccauugugu

SEQ ID NO: 1761622 - RNA, 20 nt, Homo sapiens
ugcagccacuuucugccagc

SEQ ID NO: 1761623 - RNA, 18 nt, Homo sapiens
uaaagagcacuuacugua

SEQ ID NO: 1761624 - RNA, 14 nt, Homo sapiens
ugcaacagugccau

SEQ ID NO: 1761625 - RNA, 23 nt, Homo sapiens
gacgggcugaagcgagcccucag

SEQ ID NO: 1761626 - RNA, 13 nt, Homo sapiens
uggaugucuuccu

SEQ ID NO: 1761627 - RNA, 23 nt, Homo sapiens
cagugaggccugccaggccuccc

SEQ ID NO: 1761628 - RNA, 19 nt, Homo sapiens
cacuuaaccaccccauacc

SEQ ID NO: 1761629 - RNA, 23 nt, Homo sapiens
uguuugguaguuagccaucuaau

SEQ ID NO: 1761630 - RNA, 16 nt, Homo sapiens
acuucacccccaacuu

SEQ ID NO: 1761631 - RNA, 18 nt, Homo sapiens
auacagagcucucugagg

SEQ ID NO: 1761632 - RNA, 13 nt, Homo sapiens
cccuacugcugug

SEQ ID NO: 1761633 - RNA, 17 nt, Homo sapiens
uugccuaaauccaaaga

SEQ ID NO: 1761634 - RNA, 19 nt, Homo sapiens
gagccuuuuaacugugcaa

SEQ ID NO: 1761635 - RNA, 19 nt, Homo sapiens
ggaggggucccugcaaaac

SEQ ID NO: 1761636 - RNA, 19 nt, Homo sapiens
caaugggaccgugccccac

SEQ ID NO: 1761637 - RNA, 13 nt, Homo sapiens
uaaauguuugaca

SEQ ID NO: 1761638 - RNA, 21 nt, Homo sapiens
uaaagcuggaacauuugauau

SEQ ID NO: 1761639 - RNA, 17 nt, Homo sapiens
uagccagcugugcacuu

SEQ ID NO: 1761640 - RNA, 18 nt, Homo sapiens
acuuaagucuuccuuaaa

SEQ ID NO: 1761641 - RNA, 18 nt, Homo sapiens
aaggucaucaugcuccac

SEQ ID NO: 1761642 - RNA, 18 nt, Homo sapiens
cacaggcagguccagggu

SEQ ID NO: 1761643 - RNA, 18 nt, Homo sapiens
aaacuaaugguccacacc

SEQ ID NO: 1761644 - RNA, 14 nt, Homo sapiens
gcugggcucugcca

SEQ ID NO: 1761645 - RNA, 19 nt, Homo sapiens
gaaagugcauuaaacugaa

SEQ ID NO: 1761646 - RNA, 21 nt, Homo sapiens
uggucuuucugaauugcacau

SEQ ID NO: 1761647 - RNA, 19 nt, Homo sapiens
cuauccuggagacuuaaua

SEQ ID NO: 1761648 - RNA, 23 nt, Homo sapiens
aagaccagucacagccauuucaa

SEQ ID NO: 1761649 - RNA, 20 nt, Homo sapiens
auggucacuuaaaaugugca

SEQ ID NO: 1761650 - RNA, 16 nt, Homo sapiens
gucacgagacccagag

SEQ ID NO: 1761651 - RNA, 16 nt, Homo sapiens
gccagagccucuggcc

SEQ ID NO: 1761652 - RNA, 17 nt, Homo sapiens
gacuggaagacacuuca

SEQ ID NO: 1761653 - RNA, 22 nt, Homo sapiens
cuagggacccauuccuguguaa

SEQ ID NO: 1761654 - RNA, 17 nt, Homo sapiens
gaagugaguguaaucca

SEQ ID NO: 1761655 - RNA, 21 nt, Homo sapiens
caggccacccccauggaagca

SEQ ID NO: 1761656 - RNA, 13 nt, Homo sapiens
agaacaaucucaa

SEQ ID NO: 1761657 - RNA, 19 nt, Homo sapiens
cuguuggccccucugcugu

SEQ ID NO: 1761658 - RNA, 21 nt, Homo sapiens
uauaugcuucacauagcaugu

SEQ ID NO: 1761659 - RNA, 11 nt, Homo sapiens
cuuuuucacag

SEQ ID NO: 1761660 - RNA, 19 nt, Homo sapiens
auuagccauuucacucuca

SEQ ID NO: 1761661 - RNA, 20 nt, Homo sapiens
cagcuguuuaugcauagaua

SEQ ID NO: 1761662 - RNA, 21 nt, Homo sapiens
aaagggaccuucgugcaacug

SEQ ID NO: 1761663 - RNA, 22 nt, Homo sapiens
gaauaugaucagguaacuuucg

SEQ ID NO: 1761664 - RNA, 12 nt, Homo sapiens
uuaucauaugcu

SEQ ID NO: 1761665 - RNA, 22 nt, Homo sapiens
auuaugugaaaugcuuaugcuu

SEQ ID NO: 1761666 - RNA, 12 nt, Homo sapiens
auggccauuucu

SEQ ID NO: 1761667 - RNA, 15 nt, Homo sapiens
gcuucuuggaccuug

SEQ ID NO: 1761668 - RNA, 22 nt, Homo sapiens
gaagaccagucacagccauuuc

SEQ ID NO: 1761669 - RNA, 14 nt, Homo sapiens
ugccugcucaggug

SEQ ID NO: 1761670 - RNA, 17 nt, Homo sapiens
uggaccucugcuucccc

SEQ ID NO: 1761671 - RNA, 17 nt, Homo sapiens
auggaacaagagaagua

SEQ ID NO: 1761672 - RNA, 17 nt, Homo sapiens
accaccaacaaauauag

SEQ ID NO: 1761673 - RNA, 21 nt, Homo sapiens
cagggccccccaacuguggua

SEQ ID NO: 1761674 - RNA, 14 nt, Homo sapiens
aaaucguccaggga

SEQ ID NO: 1761675 - RNA, 22 nt, Homo sapiens
cuuguacagugucugugccaug

SEQ ID NO: 1761676 - RNA, 15 nt, Homo sapiens
ggcuacucuggaaug

SEQ ID NO: 1761677 - RNA, 20 nt, Homo sapiens
ugucauagccaaagccaggc

SEQ ID NO: 1761678 - RNA, 20 nt, Homo sapiens
gugacacucuccuugcaguu

SEQ ID NO: 1761679 - RNA, 20 nt, Homo sapiens
ccuucugacgcagccugaga

SEQ ID NO: 1761680 - RNA, 21 nt, Homo sapiens
ccccagcauucucaggcacca

SEQ ID NO: 1761681 - RNA, 23 nt, Homo sapiens
ugcagcacggacaauaaaccucc

SEQ ID NO: 1761682 - RNA, 24 nt, Homo sapiens
cagagcugcugcacacacucaccu

SEQ ID NO: 1761683 - RNA, 19 nt, Homo sapiens
cuaacuaaucacuuuccca

SEQ ID NO: 1761684 - RNA, 22 nt, Homo sapiens
uccacagccccuuccucugcca

SEQ ID NO: 1761685 - RNA, 17 nt, Homo sapiens
gagccuagcuccugcca

SEQ ID NO: 1761686 - RNA, 13 nt, Homo sapiens
uagauuacugaug

SEQ ID NO: 1761687 - RNA, 17 nt, Homo sapiens
auaauaaagaucaugua

SEQ ID NO: 1761688 - RNA, 14 nt, Homo sapiens
ggaccaggaugaca

SEQ ID NO: 1761689 - RNA, 19 nt, Homo sapiens
acauuucuuugcauuccag

SEQ ID NO: 1761690 - RNA, 17 nt, Homo sapiens
caguucacuugcccuga

SEQ ID NO: 1761691 - RNA, 11 nt, Homo sapiens
agauaugcaaa

SEQ ID NO: 1761692 - RNA, 12 nt, Homo sapiens
ccaaaaauuuga

SEQ ID NO: 1761693 - RNA, 13 nt, Homo sapiens
aauaaagcacaaa

SEQ ID NO: 1761694 - RNA, 17 nt, Homo sapiens
auuuauuuacagaugaa

SEQ ID NO: 1761695 - RNA, 17 nt, Homo sapiens
ugccuccaggaccuugc

SEQ ID NO: 1761696 - RNA, 12 nt, Homo sapiens
aaugugucacua

SEQ ID NO: 1761697 - RNA, 20 nt, Homo sapiens
uuucauccuauaagcuuaaa

SEQ ID NO: 1761698 - RNA, 22 nt, Homo sapiens
aaggccuuuuguacuacacacc

SEQ ID NO: 1761699 - RNA, 16 nt, Homo sapiens
aggcauccugugugcu

SEQ ID NO: 1761700 - RNA, 19 nt, Homo sapiens
aucaguuacacaugaucau

SEQ ID NO: 1761701 - RNA, 15 nt, Homo sapiens
ucaauguauaguuag

SEQ ID NO: 1761702 - RNA, 17 nt, Homo sapiens
caaauaaauguguaaau

SEQ ID NO: 1761703 - RNA, 13 nt, Homo sapiens
gcuugaagauuca

SEQ ID NO: 1761704 - RNA, 22 nt, Homo sapiens
ugauacuuauauuuucguauga

SEQ ID NO: 1761705 - RNA, 14 nt, Homo sapiens
auuuucacauaggu

SEQ ID NO: 1761706 - RNA, 17 nt, Homo sapiens
cacuaugagcuuucaga

SEQ ID NO: 1761707 - RNA, 21 nt, Homo sapiens
aaauguaaaauccuacaguga

SEQ ID NO: 1761708 - RNA, 14 nt, Homo sapiens
uuaucagucauaac

SEQ ID NO: 1761709 - RNA, 15 nt, Homo sapiens
gaaauccccuaacug

SEQ ID NO: 1761710 - RNA, 17 nt, Homo sapiens
uuuauaauuuuaucugu

SEQ ID NO: 1761711 - RNA, 12 nt, Homo sapiens
uuaacauauguc

SEQ ID NO: 1761712 - RNA, 20 nt, Homo sapiens
guguugauuguauaaaugca

SEQ ID NO: 1761713 - RNA, 16 nt, Homo sapiens
ccuacuuugacuuuuu

SEQ ID NO: 1761714 - RNA, 16 nt, Homo sapiens
cagaugauuguucaaa

SEQ ID NO: 1761715 - RNA, 17 nt, Homo sapiens
cauugccuuuccagggu

SEQ ID NO: 1761716 - RNA, 17 nt, Homo sapiens
aggccuggcccacagca

SEQ ID NO: 1761717 - RNA, 16 nt, Homo sapiens
aacuccuacuaaaucc

SEQ ID NO: 1761718 - RNA, 21 nt, Homo sapiens
uuaacugcuucaaguguuacc

SEQ ID NO: 1761719 - RNA, 22 nt, Homo sapiens
ugggguuuaaaagaacugucuc

SEQ ID NO: 1761720 - RNA, 23 nt, Homo sapiens
acucauauaaaaggugagcucag

SEQ ID NO: 1761721 - RNA, 17 nt, Homo sapiens
uggacagaagcagcucu

SEQ ID NO: 1761722 - RNA, 15 nt, Homo sapiens
uauugcugcugguaa

SEQ ID NO: 1761723 - RNA, 18 nt, Homo sapiens
cugaguaagcccucagga

SEQ ID NO: 1761724 - RNA, 22 nt, Homo sapiens
aagugauaucccccagccucaa

SEQ ID NO: 1761725 - RNA, 21 nt, Homo sapiens
uagcauuuucuugaaccaaua

SEQ ID NO: 1761726 - RNA, 21 nt, Homo sapiens
agagccauucuggcacuuuaa

SEQ ID NO: 1761727 - RNA, 16 nt, Homo sapiens
uggccaggcacggugg

SEQ ID NO: 1761728 - RNA, 12 nt, Homo sapiens
cugcucugaggu

SEQ ID NO: 1761729 - RNA, 21 nt, Homo sapiens
agccccuggagcuccugcugg

SEQ ID NO: 1761730 - RNA, 12 nt, Homo sapiens
aagugcuacuuu

SEQ ID NO: 1761731 - RNA, 16 nt, Homo sapiens
gcaugaaccacugcac

SEQ ID NO: 1761732 - RNA, 16 nt, Homo sapiens
uguucugggacacagu

SEQ ID NO: 1761733 - RNA, 21 nt, Homo sapiens
gcugccugccccccagucucc

SEQ ID NO: 1761734 - RNA, 15 nt, Homo sapiens
ucaguaauaacucua

SEQ ID NO: 1761735 - RNA, 15 nt, Homo sapiens
ggggacacggugucc

SEQ ID NO: 1761736 - RNA, 13 nt, Homo sapiens
uauauucccacau

SEQ ID NO: 1761737 - RNA, 18 nt, Homo sapiens
acuuaaacucaucuaucc

SEQ ID NO: 1761738 - RNA, 18 nt, Homo sapiens
ucagauaccaugcaauaa

SEQ ID NO: 1761739 - RNA, 15 nt, Homo sapiens
ucccucuacagguca

SEQ ID NO: 1761740 - RNA, 20 nt, Homo sapiens
uuaguauugcagccaaagaa

SEQ ID NO: 1761741 - RNA, 15 nt, Homo sapiens
uuuauuccuuugaau

SEQ ID NO: 1761742 - RNA, 20 nt, Homo sapiens
uggccccacccuuuccucuu

SEQ ID NO: 1761743 - RNA, 14 nt, Homo sapiens
aagcagacacacac

SEQ ID NO: 1761744 - RNA, 20 nt, Homo sapiens
caaacaaccccccaucacaa

SEQ ID NO: 1761745 - RNA, 21 nt, Homo sapiens
cuuagacccucaugcugccaa

SEQ ID NO: 1761746 - RNA, 19 nt, Homo sapiens
uggcagacucaccaccuau

SEQ ID NO: 1761747 - RNA, 17 nt, Homo sapiens
agcccggaaacuccaca

SEQ ID NO: 1761748 - RNA, 17 nt, Homo sapiens
uuuguaaaggucagagu

SEQ ID NO: 1761749 - RNA, 14 nt, Homo sapiens
cuacagcccagugg

SEQ ID NO: 1761750 - RNA, 14 nt, Homo sapiens
acauaucauucaga

SEQ ID NO: 1761751 - RNA, 22 nt, Homo sapiens
uacugaauaaauacaaagcaaa

SEQ ID NO: 1761752 - RNA, 15 nt, Homo sapiens
uaacucagacauucc

SEQ ID NO: 1761753 - RNA, 21 nt, Homo sapiens
cagccauaguguguguuuaga

SEQ ID NO: 1761754 - RNA, 20 nt, Homo sapiens
gaaacuuuaaugaggaaaaa

SEQ ID NO: 1761755 - RNA, 12 nt, Homo sapiens
acucaagggaaa

SEQ ID NO: 1761756 - RNA, 12 nt, Homo sapiens
aaucaagggcaa

SEQ ID NO: 1761757 - RNA, 23 nt, Homo sapiens
ccagcccuacagggacugggcaa

SEQ ID NO: 1761758 - RNA, 12 nt, Homo sapiens
cuuggugccaca

SEQ ID NO: 1761759 - RNA, 12 nt, Homo sapiens
uaacucuacugu

SEQ ID NO: 1761760 - RNA, 20 nt, Homo sapiens
caagugcucagggaaauggc

SEQ ID NO: 1761761 - RNA, 18 nt, Homo sapiens
auguugagcugaguuccu

SEQ ID NO: 1761762 - RNA, 11 nt, Homo sapiens
aaugugucaua

SEQ ID NO: 1761763 - RNA, 22 nt, Homo sapiens
auguagccuuuacuguuugaua

SEQ ID NO: 1761764 - RNA, 17 nt, Homo sapiens
ucauuguaaucuuucau

SEQ ID NO: 1761765 - RNA, 16 nt, Homo sapiens
acuuuuaaacuuugau

SEQ ID NO: 1761766 - RNA, 17 nt, Homo sapiens
uguccaaauacucugaa

SEQ ID NO: 1761767 - RNA, 20 nt, Homo sapiens
cuccugaccucaaguaaucc

SEQ ID NO: 1761768 - RNA, 12 nt, Homo sapiens
uaucuaccuucc

SEQ ID NO: 1761769 - RNA, 19 nt, Homo sapiens
ucagaugcaauugcuccca

SEQ ID NO: 1761770 - RNA, 14 nt, Homo sapiens
ugcaugucucaggc

SEQ ID NO: 1761771 - RNA, 12 nt, Homo sapiens
agucacugugag

SEQ ID NO: 1761772 - RNA, 14 nt, Homo sapiens
uagaggugagggaa

SEQ ID NO: 1761773 - RNA, 21 nt, Homo sapiens
uccaggcuuaagcgauucuca

SEQ ID NO: 1761774 - RNA, 17 nt, Homo sapiens
ucuuucucugccaguga

SEQ ID NO: 1761775 - RNA, 20 nt, Homo sapiens
ucuucacugcagauuucuca

SEQ ID NO: 1761776 - RNA, 23 nt, Homo sapiens
ucgguaaaccgaggacccaugaa

SEQ ID NO: 1761777 - RNA, 15 nt, Homo sapiens
uugauauugugaaca

SEQ ID NO: 1761778 - RNA, 22 nt, Homo sapiens
uucaguguacauggaauaacau

SEQ ID NO: 1761779 - RNA, 17 nt, Homo sapiens
cuaguuaauccaaacau

SEQ ID NO: 1761780 - RNA, 19 nt, Homo sapiens
aggugcaagccacuauguc

SEQ ID NO: 1761781 - RNA, 15 nt, Homo sapiens
gucagguucuuuaca

SEQ ID NO: 1761782 - RNA, 23 nt, Homo sapiens
accuccccucuccccgggaccgc

SEQ ID NO: 1761783 - RNA, 18 nt, Homo sapiens
aaccuccauccugccagg

SEQ ID NO: 1761784 - RNA, 17 nt, Homo sapiens
accccgauagugacaca

SEQ ID NO: 1761785 - RNA, 17 nt, Homo sapiens
agcugcagaccaugcca

SEQ ID NO: 1761786 - RNA, 14 nt, Homo sapiens
ccacccauaccagc

SEQ ID NO: 1761787 - RNA, 17 nt, Homo sapiens
gcuacaggucaguuuau

SEQ ID NO: 1761788 - RNA, 19 nt, Homo sapiens
uuuccaaagggcaguaaag

SEQ ID NO: 1761789 - RNA, 13 nt, Homo sapiens
ccaccaaccaaga

SEQ ID NO: 1761790 - RNA, 21 nt, Homo sapiens
aggaauccuggcagcccagag

SEQ ID NO: 1761791 - RNA, 16 nt, Homo sapiens
uccuuauucagaauuu

SEQ ID NO: 1761792 - RNA, 19 nt, Homo sapiens
cauauauuuuuaccaucug

SEQ ID NO: 1761793 - RNA, 21 nt, Homo sapiens
aauaguaggcuaaaaacauuu

SEQ ID NO: 1761794 - RNA, 12 nt, Homo sapiens
ugaggauuucaa

SEQ ID NO: 1761795 - RNA, 15 nt, Homo sapiens
cauaucuacaguacu

SEQ ID NO: 1761796 - RNA, 11 nt, Homo sapiens
accaagagauu

SEQ ID NO: 1761797 - RNA, 15 nt, Homo sapiens
uugaaguaacuauaa

SEQ ID NO: 1761798 - RNA, 20 nt, Homo sapiens
uguucuauucaucucaagga

SEQ ID NO: 1761799 - RNA, 14 nt, Homo sapiens
ugccuuaaggccac

SEQ ID NO: 1761800 - RNA, 23 nt, Homo sapiens
acagauguuuguuuucaaaauac

SEQ ID NO: 1761801 - RNA, 22 nt, Homo sapiens
uuuaacgacagaagguugccag

SEQ ID NO: 1761802 - RNA, 23 nt, Homo sapiens
cuggaggggagaggucagccuug

SEQ ID NO: 1761803 - RNA, 14 nt, Homo sapiens
agaauuuagcugua

SEQ ID NO: 1761804 - RNA, 14 nt, Homo sapiens
uugguucuuugguc

SEQ ID NO: 1761805 - RNA, 14 nt, Homo sapiens
caggcucucaggcc

SEQ ID NO: 1761806 - RNA, 16 nt, Homo sapiens
ucaucacacaacucag

SEQ ID NO: 1761807 - RNA, 15 nt, Homo sapiens
cuuuucaugucauuu

SEQ ID NO: 1761808 - RNA, 13 nt, Homo sapiens
cagccaccuccca

SEQ ID NO: 1761809 - RNA, 16 nt, Homo sapiens
gaacccuucuccauac

SEQ ID NO: 1761810 - RNA, 21 nt, Homo sapiens
gagacuguagggaugaaauaa

SEQ ID NO: 1761811 - RNA, 14 nt, Homo sapiens
cauuuaccaguaua

SEQ ID NO: 1761812 - RNA, 17 nt, Homo sapiens
ucaaccugauacauuua

SEQ ID NO: 1761813 - RNA, 21 nt, Homo sapiens
cucugauuaguugacaguauu

SEQ ID NO: 1761814 - RNA, 15 nt, Homo sapiens
agaaauaaaugaaac

SEQ ID NO: 1761815 - RNA, 17 nt, Homo sapiens
gcacacgaguuccagac

SEQ ID NO: 1761816 - RNA, 16 nt, Homo sapiens
aacccagcaguucucu

SEQ ID NO: 1761817 - RNA, 12 nt, Homo sapiens
acauugcaauuu

SEQ ID NO: 1761818 - RNA, 20 nt, Homo sapiens
acaggucggggaccaaaggc

SEQ ID NO: 1761819 - RNA, 15 nt, Homo sapiens
aauaaaaaugucuca

SEQ ID NO: 1761820 - RNA, 17 nt, Homo sapiens
ugcucuuaaguugugga

SEQ ID NO: 1761821 - RNA, 11 nt, Homo sapiens
ggaauuacuuu

SEQ ID NO: 1761822 - RNA, 14 nt, Homo sapiens
uccuuggaacacau

SEQ ID NO: 1761823 - RNA, 23 nt, Homo sapiens
caggccacugggcccugagccag

SEQ ID NO: 1761824 - RNA, 20 nt, Homo sapiens
cauccaucccuggugaaaga

SEQ ID NO: 1761825 - RNA, 20 nt, Homo sapiens
augcaaucacuuuuggacau

SEQ ID NO: 1761826 - RNA, 12 nt, Homo sapiens
auaaaaugaggg

SEQ ID NO: 1761827 - RNA, 13 nt, Homo sapiens
ugauuucaagacc

SEQ ID NO: 1761828 - RNA, 22 nt, Homo sapiens
uuagaacucauuagcuguguga

SEQ ID NO: 1761829 - RNA, 18 nt, Homo sapiens
guguucacucagcacuuu

SEQ ID NO: 1761830 - RNA, 22 nt, Homo sapiens
ugccagugccuuaccuccugcc

SEQ ID NO: 1761831 - RNA, 14 nt, Homo sapiens
gaccuccugucacu

SEQ ID NO: 1761832 - RNA, 17 nt, Homo sapiens
uguuccugaaaauugca

SEQ ID NO: 1761833 - RNA, 18 nt, Homo sapiens
aaugagaggagaacagua

SEQ ID NO: 1761834 - RNA, 18 nt, Homo sapiens
guacaaguggcucaucau

SEQ ID NO: 1761835 - RNA, 14 nt, Homo sapiens
agucuuugcaguuc

SEQ ID NO: 1761836 - RNA, 14 nt, Homo sapiens
ugagccacagacca

SEQ ID NO: 1761837 - RNA, 14 nt, Homo sapiens
aauguaacuaucuc

SEQ ID NO: 1761838 - RNA, 21 nt, Homo sapiens
cuggguuaggguguguguuca

SEQ ID NO: 1761839 - RNA, 21 nt, Homo sapiens
agaaagucuaucuaaugacau

SEQ ID NO: 1761840 - RNA, 18 nt, Homo sapiens
agugauccauguccugaa

SEQ ID NO: 1761841 - RNA, 14 nt, Homo sapiens
cuagaauacuaaua

SEQ ID NO: 1761842 - RNA, 22 nt, Homo sapiens
cuagggucaggcggggugcugu

SEQ ID NO: 1761843 - RNA, 15 nt, Homo sapiens
cauaaagucagugcc

SEQ ID NO: 1761844 - RNA, 17 nt, Homo sapiens
uaugucuuuugaugaau

SEQ ID NO: 1761845 - RNA, 21 nt, Homo sapiens
ucuuacagccacaggcacugu

SEQ ID NO: 1761846 - RNA, 18 nt, Homo sapiens
cuucacacaguaaaagca

SEQ ID NO: 1761847 - RNA, 13 nt, Homo sapiens
uccugcaguuccc

SEQ ID NO: 1761848 - RNA, 13 nt, Homo sapiens
gucaaucacugca

SEQ ID NO: 1761849 - RNA, 21 nt, Homo sapiens
accccagcuccauccuugcau

SEQ ID NO: 1761850 - RNA, 16 nt, Homo sapiens
aacauugacgauuccu

SEQ ID NO: 1761851 - RNA, 17 nt, Homo sapiens
aaagcggcugccuccau

SEQ ID NO: 1761852 - RNA, 17 nt, Homo sapiens
acauaguugaaauauca

SEQ ID NO: 1761853 - RNA, 23 nt, Homo sapiens
ugccccaggcugcggcuugccca

SEQ ID NO: 1761854 - RNA, 17 nt, Homo sapiens
cauucaguuagcaaaga

SEQ ID NO: 1761855 - RNA, 13 nt, Homo sapiens
acugagaucuguu

SEQ ID NO: 1761856 - RNA, 21 nt, Homo sapiens
uggccgaaaaggauaugcagu

SEQ ID NO: 1761857 - RNA, 21 nt, Homo sapiens
aggcuggagagaacacagugc

SEQ ID NO: 1761858 - RNA, 20 nt, Homo sapiens
ugaguauuccaccacaggaa

SEQ ID NO: 1761859 - RNA, 19 nt, Homo sapiens
gucuacccgugucuagagg

SEQ ID NO: 1761860 - RNA, 11 nt, Homo sapiens
guuaugccaug

SEQ ID NO: 1761861 - RNA, 21 nt, Homo sapiens
auguuuuagccauuguuggcu

SEQ ID NO: 1761862 - RNA, 15 nt, Homo sapiens
ggacaagggcccaug

SEQ ID NO: 1761863 - RNA, 19 nt, Homo sapiens
ugccaacaguggcuaauaa

SEQ ID NO: 1761864 - RNA, 14 nt, Homo sapiens
cacuuggucuguga

SEQ ID NO: 1761865 - RNA, 21 nt, Homo sapiens
guucucacagugggagccagg

SEQ ID NO: 1761866 - RNA, 21 nt, Homo sapiens
cacuuuuauuuagcaccaggg

SEQ ID NO: 1761867 - RNA, 20 nt, Homo sapiens
aaaaacuuucucuuugccau

SEQ ID NO: 1761868 - RNA, 14 nt, Homo sapiens
cagagucucaggac

SEQ ID NO: 1761869 - RNA, 16 nt, Homo sapiens
aguaagaacugcucua

SEQ ID NO: 1761870 - RNA, 19 nt, Homo sapiens
cugcuuuucugaggacuca

SEQ ID NO: 1761871 - RNA, 15 nt, Homo sapiens
uuacugauucaauua

SEQ ID NO: 1761872 - RNA, 23 nt, Homo sapiens
gaauuucuuugauuuaacugacu

SEQ ID NO: 1761873 - RNA, 16 nt, Homo sapiens
uuauuccaagucagaa

SEQ ID NO: 1761874 - RNA, 18 nt, Homo sapiens
guaaagagauauuuucca

SEQ ID NO: 1761875 - RNA, 22 nt, Homo sapiens
ccugcugaccucccagugaccc

SEQ ID NO: 1761876 - RNA, 18 nt, Homo sapiens
ugcccccagggcacuuca

SEQ ID NO: 1761877 - RNA, 22 nt, Homo sapiens
auccaggaauauaugucaguga

SEQ ID NO: 1761878 - RNA, 15 nt, Homo sapiens
uuggaacucuugcua

SEQ ID NO: 1761879 - RNA, 17 nt, Homo sapiens
aagaggcugcugagaaa

SEQ ID NO: 1761880 - RNA, 11 nt, Homo sapiens
caccaccaggg

SEQ ID NO: 1761881 - RNA, 23 nt, Homo sapiens
auuuacugcaagaaguacaugaa

SEQ ID NO: 1761882 - RNA, 16 nt, Homo sapiens
cacaaagaaccaccag

SEQ ID NO: 1761883 - RNA, 18 nt, Homo sapiens
uaaugaauuuucuuuaca

SEQ ID NO: 1761884 - RNA, 22 nt, Homo sapiens
gccagaguuccauguuuguacu

SEQ ID NO: 1761885 - RNA, 17 nt, Homo sapiens
aacuggaaauaaaagau

SEQ ID NO: 1761886 - RNA, 16 nt, Homo sapiens
cacaauuccauuucca

SEQ ID NO: 1761887 - RNA, 23 nt, Homo sapiens
ccuuggggcaugacccagugaag

SEQ ID NO: 1761888 - RNA, 17 nt, Homo sapiens
ucguagagccuugacaa

SEQ ID NO: 1761889 - RNA, 18 nt, Homo sapiens
uacaggcuccugccacca

SEQ ID NO: 1761890 - RNA, 13 nt, Homo sapiens
auuuaaacuucuu

SEQ ID NO: 1761891 - RNA, 21 nt, Homo sapiens
uaaauagaaauuuuguuaaca

SEQ ID NO: 1761892 - RNA, 13 nt, Homo sapiens
uuuaaaacaucau

SEQ ID NO: 1761893 - RNA, 22 nt, Homo sapiens
aauguuguuuuaggaauacaua

SEQ ID NO: 1761894 - RNA, 17 nt, Homo sapiens
ugcuaaaagcauguaua

SEQ ID NO: 1761895 - RNA, 17 nt, Homo sapiens
acaugucuugcuaacag

SEQ ID NO: 1761896 - RNA, 21 nt, Homo sapiens
gcagccggaagucuguucuca

SEQ ID NO: 1761897 - RNA, 14 nt, Homo sapiens
uccccucacucugu

SEQ ID NO: 1761898 - RNA, 21 nt, Homo sapiens
gcaauacggaacacugucaau

SEQ ID NO: 1761899 - RNA, 19 nt, Homo sapiens
cugggcaucucugagcaau

SEQ ID NO: 1761900 - RNA, 12 nt, Homo sapiens
agcucaaacccu

SEQ ID NO: 1761901 - RNA, 22 nt, Homo sapiens
caugaaaugucuggucugucca

SEQ ID NO: 1761902 - RNA, 17 nt, Homo sapiens
cagccugcccaccucuc

SEQ ID NO: 1761903 - RNA, 20 nt, Homo sapiens
ucuugaacucauagauuauu

SEQ ID NO: 1761904 - RNA, 15 nt, Homo sapiens
uuccagaugagucag

SEQ ID NO: 1761905 - RNA, 17 nt, Homo sapiens
ugagaugauacauccaa

SEQ ID NO: 1761906 - RNA, 16 nt, Homo sapiens
gccugggagccagggu

SEQ ID NO: 1761907 - RNA, 16 nt, Homo sapiens
acaauaaaacauuaau

SEQ ID NO: 1761908 - RNA, 21 nt, Homo sapiens
ccaccaucgucuucuuggcca

SEQ ID NO: 1761909 - RNA, 14 nt, Homo sapiens
aaguuacuugaauu

SEQ ID NO: 1761910 - RNA, 14 nt, Homo sapiens
aacagcaaguguga

SEQ ID NO: 1761911 - RNA, 16 nt, Homo sapiens
cacgucuguaauccca

SEQ ID NO: 1761912 - RNA, 15 nt, Homo sapiens
cuacauuuuaaugca

SEQ ID NO: 1761913 - RNA, 15 nt, Homo sapiens
aacacccaaaagaau

SEQ ID NO: 1761914 - RNA, 14 nt, Homo sapiens
auaugaggggaccc

SEQ ID NO: 1761915 - RNA, 14 nt, Homo sapiens
gacucacaagaaga

SEQ ID NO: 1761916 - RNA, 14 nt, Homo sapiens
gccucuaugugcaa

SEQ ID NO: 1761917 - RNA, 19 nt, Homo sapiens
ugccuucagccaagaccau

SEQ ID NO: 1761918 - RNA, 13 nt, Homo sapiens
uaaccucugagga

SEQ ID NO: 1761919 - RNA, 23 nt, Homo sapiens
gguucuuauucacugagucucau

SEQ ID NO: 1761920 - RNA, 15 nt, Homo sapiens
ucaguguucuucuca

SEQ ID NO: 1761921 - RNA, 16 nt, Homo sapiens
aggcuggagugcaaug

SEQ ID NO: 1761922 - RNA, 15 nt, Homo sapiens
gggagcaggagccug

SEQ ID NO: 1761923 - RNA, 14 nt, Homo sapiens
auaaagauauacca

SEQ ID NO: 1761924 - RNA, 12 nt, Homo sapiens
ugguccaaaaau

SEQ ID NO: 1761925 - RNA, 16 nt, Homo sapiens
cuaaacggauuccaaa

SEQ ID NO: 1761926 - RNA, 11 nt, Homo sapiens
acacccaaaaa

SEQ ID NO: 1761927 - RNA, 20 nt, Homo sapiens
agaucguaccuauugcacuc

SEQ ID NO: 1761928 - RNA, 15 nt, Homo sapiens
aggaguaacuugcaa

SEQ ID NO: 1761929 - RNA, 22 nt, Homo sapiens
uuugaaugguuuucuaauaucu

SEQ ID NO: 1761930 - RNA, 13 nt, Homo sapiens
gauaaauguccau

SEQ ID NO: 1761931 - RNA, 21 nt, Homo sapiens
aauugaauucuggaaacuccu

SEQ ID NO: 1761932 - RNA, 21 nt, Homo sapiens
auguuuauaaaucuuaugcuc

SEQ ID NO: 1761933 - RNA, 22 nt, Homo sapiens
cucaacaaugguugaaugaaua

SEQ ID NO: 1761934 - RNA, 18 nt, Homo sapiens
ucaccuuuucuaaaaagu

SEQ ID NO: 1761935 - RNA, 20 nt, Homo sapiens
ugcagaugccacccuagcca

SEQ ID NO: 1761936 - RNA, 14 nt, Homo sapiens
ucuggcucuugagg

SEQ ID NO: 1761937 - RNA, 11 nt, Homo sapiens
uaucaguuccc

SEQ ID NO: 1761938 - RNA, 21 nt, Homo sapiens
uuccugugccugugacucucc

SEQ ID NO: 1761939 - RNA, 20 nt, Homo sapiens
ccugacggcuggggacccac

SEQ ID NO: 1761940 - RNA, 12 nt, Homo sapiens
uuaagcauuugc

SEQ ID NO: 1761941 - RNA, 18 nt, Homo sapiens
aacauacaagagacauau

SEQ ID NO: 1761942 - RNA, 13 nt, Homo sapiens
gguaucaggugcu

SEQ ID NO: 1761943 - RNA, 23 nt, Homo sapiens
acccacaauugaacuuccaggaa

SEQ ID NO: 1761944 - RNA, 15 nt, Homo sapiens
gauuccccaucucag

SEQ ID NO: 1761945 - RNA, 13 nt, Homo sapiens
aggagcagugcag

SEQ ID NO: 1761946 - RNA, 13 nt, Homo sapiens
acaagccaaagag

SEQ ID NO: 1761947 - RNA, 19 nt, Homo sapiens
uucuggauuccccaucuca

SEQ ID NO: 1761948 - RNA, 14 nt, Homo sapiens
auuuuccaauuaau

SEQ ID NO: 1761949 - RNA, 22 nt, Homo sapiens
gcccuuccccucugcagcuucc

SEQ ID NO: 1761950 - RNA, 14 nt, Homo sapiens
ucuccuugcacuuu

SEQ ID NO: 1761951 - RNA, 15 nt, Homo sapiens
cggaggagguggaca

SEQ ID NO: 1761952 - RNA, 18 nt, Homo sapiens
augaaguuauucuugaca

SEQ ID NO: 1761953 - RNA, 18 nt, Homo sapiens
acuacaguaacugugacu

SEQ ID NO: 1761954 - RNA, 20 nt, Homo sapiens
auaaaccaaaggacauuaug

SEQ ID NO: 1761955 - RNA, 18 nt, Homo sapiens
gcagcuagccagugcuca

SEQ ID NO: 1761956 - RNA, 23 nt, Homo sapiens
gauuaacuaaagaagaggagaaa

SEQ ID NO: 1761957 - RNA, 16 nt, Homo sapiens
aagggacaaguauuaa

SEQ ID NO: 1761958 - RNA, 14 nt, Homo sapiens
caacucuugcacag

SEQ ID NO: 1761959 - RNA, 19 nt, Homo sapiens
uuuauaggcauaccuccua

SEQ ID NO: 1761960 - RNA, 15 nt, Homo sapiens
uuugauaccauggca

SEQ ID NO: 1761961 - RNA, 22 nt, Homo sapiens
uguucucgaacuccugaccuca

SEQ ID NO: 1761962 - RNA, 21 nt, Homo sapiens
aguuuagggaaaaaaaacagg

SEQ ID NO: 1761963 - RNA, 18 nt, Homo sapiens
aaaaacccguaagauucc

SEQ ID NO: 1761964 - RNA, 22 nt, Homo sapiens
auuccagagugcugaggccagg

SEQ ID NO: 1761965 - RNA, 16 nt, Homo sapiens
ucuuaacuauucaaug

SEQ ID NO: 1761966 - RNA, 21 nt, Homo sapiens
ccuacaaaggauaugaacuca

SEQ ID NO: 1761967 - RNA, 14 nt, Homo sapiens
cuagcaguaaauac

SEQ ID NO: 1761968 - RNA, 14 nt, Homo sapiens
aaugaagucuuucc

SEQ ID NO: 1761969 - RNA, 18 nt, Homo sapiens
acccugagguugugugug

SEQ ID NO: 1761970 - RNA, 12 nt, Homo sapiens
uuauauuacuug

SEQ ID NO: 1761971 - RNA, 16 nt, Homo sapiens
agcauguuuagacuuu

SEQ ID NO: 1761972 - RNA, 18 nt, Homo sapiens
aauuaaguccuacuuuac

SEQ ID NO: 1761973 - RNA, 20 nt, Homo sapiens
acagggacaugcccugugug

SEQ ID NO: 1761974 - RNA, 20 nt, Homo sapiens
ugaggcaggaggaucauuug

SEQ ID NO: 1761975 - RNA, 18 nt, Homo sapiens
acuuuuaucuacuucucu

SEQ ID NO: 1761976 - RNA, 12 nt, Homo sapiens
accucuucacuc

SEQ ID NO: 1761977 - RNA, 12 nt, Homo sapiens
cuuccuuccucu

SEQ ID NO: 1761978 - RNA, 18 nt, Homo sapiens
accuuuaaaaauguauaa

SEQ ID NO: 1761979 - RNA, 13 nt, Homo sapiens
caucuccagcuau

SEQ ID NO: 1761980 - RNA, 17 nt, Homo sapiens
acuuuagcaacaguuau

SEQ ID NO: 1761981 - RNA, 18 nt, Homo sapiens
ucgcucagucagugcacu

SEQ ID NO: 1761982 - RNA, 21 nt, Homo sapiens
cuaauucuguaggacuuugaa

SEQ ID NO: 1761983 - RNA, 15 nt, Homo sapiens
gaggccugcacagcu

SEQ ID NO: 1761984 - RNA, 16 nt, Homo sapiens
gaccaaagugauaaau

SEQ ID NO: 1761985 - RNA, 14 nt, Homo sapiens
uacauauuaucuca

SEQ ID NO: 1761986 - RNA, 14 nt, Homo sapiens
acacagcuaccucu

SEQ ID NO: 1761987 - RNA, 17 nt, Homo sapiens
aaaauaagcuucaucuc

SEQ ID NO: 1761988 - RNA, 22 nt, Homo sapiens
ggagcuuguauauacuucacuc

SEQ ID NO: 1761989 - RNA, 15 nt, Homo sapiens
acagcugaguuauga

SEQ ID NO: 1761990 - RNA, 23 nt, Homo sapiens
caaguauuaauaguucaguguau

SEQ ID NO: 1761991 - RNA, 19 nt, Homo sapiens
auuuguuacuguauccuca

SEQ ID NO: 1761992 - RNA, 18 nt, Homo sapiens
ucucuuaaauucauauca

SEQ ID NO: 1761993 - RNA, 18 nt, Homo sapiens
cagggugaagcagcucau

SEQ ID NO: 1761994 - RNA, 22 nt, Homo sapiens
aguacaaagguugcagugcuga

SEQ ID NO: 1761995 - RNA, 17 nt, Homo sapiens
gcucguucccccagggg

SEQ ID NO: 1761996 - RNA, 23 nt, Homo sapiens
gaggggagggugaggagcuggag

SEQ ID NO: 1761997 - RNA, 16 nt, Homo sapiens
cucuugccagcauuuu

SEQ ID NO: 1761998 - RNA, 12 nt, Homo sapiens
aggugcuggcau

SEQ ID NO: 1761999 - RNA, 16 nt, Homo sapiens
aaauacuguaacacug

SEQ ID NO: 1762000 - RNA, 20 nt, Homo sapiens
ucauggagaaucugcugcau

SEQ ID NO: 1762001 - RNA, 21 nt, Homo sapiens
ccucuauuuuaauuacugcua

SEQ ID NO: 1762002 - RNA, 14 nt, Homo sapiens
uagaauuucuacaa

SEQ ID NO: 1762003 - RNA, 21 nt, Homo sapiens
cugucaaaugaugugcaaaac

SEQ ID NO: 1762004 - RNA, 15 nt, Homo sapiens
aggaaacucaucucc

SEQ ID NO: 1762005 - RNA, 19 nt, Homo sapiens
cuuuaauuaccaguuuucc

SEQ ID NO: 1762006 - RNA, 17 nt, Homo sapiens
cugaaacaaaaaugcca

SEQ ID NO: 1762007 - RNA, 19 nt, Homo sapiens
aauacugucuaucucuaau

SEQ ID NO: 1762008 - RNA, 16 nt, Homo sapiens
gcuggcuggugccuga

SEQ ID NO: 1762009 - RNA, 20 nt, Homo sapiens
uccaggacagggaagggagc

SEQ ID NO: 1762010 - RNA, 20 nt, Homo sapiens
auuauacaggaaagcaauau

SEQ ID NO: 1762011 - RNA, 16 nt, Homo sapiens
ggagugguugcuauac

SEQ ID NO: 1762012 - RNA, 20 nt, Homo sapiens
aauauuaccaacuacauugg

SEQ ID NO: 1762013 - RNA, 19 nt, Homo sapiens
gcuguggguuuuggugugg

SEQ ID NO: 1762014 - RNA, 17 nt, Homo sapiens
ugcagacauuuacaugu

SEQ ID NO: 1762015 - RNA, 17 nt, Homo sapiens
acagaaggguaaugcgu

SEQ ID NO: 1762016 - RNA, 23 nt, Homo sapiens
gauguuguguuucuguucaccuu

SEQ ID NO: 1762017 - RNA, 12 nt, Homo sapiens
uccacagaggac

SEQ ID NO: 1762018 - RNA, 19 nt, Homo sapiens
uugacaaagucaagccaca

SEQ ID NO: 1762019 - RNA, 19 nt, Homo sapiens
uaggcaccacagagaagac

SEQ ID NO: 1762020 - RNA, 23 nt, Homo sapiens
cuggaaaggcucagucucaggag

SEQ ID NO: 1762021 - RNA, 13 nt, Homo sapiens
cucauuccuguag

SEQ ID NO: 1762022 - RNA, 23 nt, Homo sapiens
cagcggaaagcccugugcuccau

SEQ ID NO: 1762023 - RNA, 17 nt, Homo sapiens
ugccaccccuaaacucc

SEQ ID NO: 1762024 - RNA, 17 nt, Homo sapiens
auccuccaagaaucuau

SEQ ID NO: 1762025 - RNA, 10 nt, Homo sapiens
augagcucug

SEQ ID NO: 1762026 - RNA, 18 nt, Homo sapiens
uagauuugaaaauuguau

SEQ ID NO: 1762027 - RNA, 19 nt, Homo sapiens
auuuaauaagaaacaugau

SEQ ID NO: 1762028 - RNA, 14 nt, Homo sapiens
ggugaaaccaaaca

SEQ ID NO: 1762029 - RNA, 19 nt, Homo sapiens
aggugggcggaucacuuga

SEQ ID NO: 1762030 - RNA, 14 nt, Homo sapiens
aauuucagcauuau

SEQ ID NO: 1762031 - RNA, 14 nt, Homo sapiens
uguuggugggaccc

SEQ ID NO: 1762032 - RNA, 15 nt, Homo sapiens
aaaugucuugcuuga

SEQ ID NO: 1762033 - RNA, 22 nt, Homo sapiens
ggacaaccaugcaaauugugaa

SEQ ID NO: 1762034 - RNA, 20 nt, Homo sapiens
agauccugagcucacagagu

SEQ ID NO: 1762035 - RNA, 20 nt, Homo sapiens
agagagccauuuugugaaug

SEQ ID NO: 1762036 - RNA, 13 nt, Homo sapiens
aaaucacuugcca

SEQ ID NO: 1762037 - RNA, 16 nt, Homo sapiens
acugcaaccucugccu

SEQ ID NO: 1762038 - RNA, 20 nt, Homo sapiens
ugcauauagacacacauaca

SEQ ID NO: 1762039 - RNA, 18 nt, Homo sapiens
gaaagaagagagaccgag

SEQ ID NO: 1762040 - RNA, 19 nt, Homo sapiens
agcuggcauuggucugcug

SEQ ID NO: 1762041 - RNA, 15 nt, Homo sapiens
gccuuaguuguuauc

SEQ ID NO: 1762042 - RNA, 14 nt, Homo sapiens
cuaaaguucuaaga

SEQ ID NO: 1762043 - RNA, 19 nt, Homo sapiens
aacagagaugccaugauau

SEQ ID NO: 1762044 - RNA, 15 nt, Homo sapiens
acagcccgcucucug

SEQ ID NO: 1762045 - RNA, 13 nt, Homo sapiens
ucugcaucaaagg

SEQ ID NO: 1762046 - RNA, 15 nt, Homo sapiens
agaggacaucaccug

SEQ ID NO: 1762047 - RNA, 21 nt, Homo sapiens
guuuagagcauuucuuuugaa

SEQ ID NO: 1762048 - RNA, 19 nt, Homo sapiens
uuacagaaaagacucugac

SEQ ID NO: 1762049 - RNA, 11 nt, Homo sapiens
gaaacugcucc

SEQ ID NO: 1762050 - RNA, 18 nt, Homo sapiens
auauguaaagcacaucag

SEQ ID NO: 1762051 - RNA, 18 nt, Homo sapiens
cacugcugauuauucacu

SEQ ID NO: 1762052 - RNA, 17 nt, Homo sapiens
guuuaguuuuacauuuu

SEQ ID NO: 1762053 - RNA, 15 nt, Homo sapiens
uaacgauaaaagaca

SEQ ID NO: 1762054 - RNA, 18 nt, Homo sapiens
aaggaaaaaauaaaagau

SEQ ID NO: 1762055 - RNA, 15 nt, Homo sapiens
augcauuucauaaac

SEQ ID NO: 1762056 - RNA, 12 nt, Homo sapiens
accuaaauggag

SEQ ID NO: 1762057 - RNA, 20 nt, Homo sapiens
ugaucgugggguugaccaac

SEQ ID NO: 1762058 - RNA, 17 nt, Homo sapiens
uaaacucugaccaacag

SEQ ID NO: 1762059 - RNA, 17 nt, Homo sapiens
agcacacuugacaucaa

SEQ ID NO: 1762060 - RNA, 22 nt, Homo sapiens
agacaugaaauaaaagcuuugc

SEQ ID NO: 1762061 - RNA, 21 nt, Homo sapiens
gcuuccuucucaucuugccuc

SEQ ID NO: 1762062 - RNA, 21 nt, Homo sapiens
cucauucauuuauucauucau

SEQ ID NO: 1762063 - RNA, 21 nt, Homo sapiens
cacauuugaauucuugaucuc

SEQ ID NO: 1762064 - RNA, 18 nt, Homo sapiens
gagugacucgaggguugg

SEQ ID NO: 1762065 - RNA, 19 nt, Homo sapiens
acuaaauuacaaaugcaau

SEQ ID NO: 1762066 - RNA, 20 nt, Homo sapiens
cccagguggaaggcagacag

SEQ ID NO: 1762067 - RNA, 17 nt, Homo sapiens
uuugcauaugagccgug

SEQ ID NO: 1762068 - RNA, 22 nt, Homo sapiens
acaguaaucugcaucauaagcu

SEQ ID NO: 1762069 - RNA, 19 nt, Homo sapiens
agccucugaucaguuucac

SEQ ID NO: 1762070 - RNA, 15 nt, Homo sapiens
caggacacugaucca

SEQ ID NO: 1762071 - RNA, 12 nt, Homo sapiens
gcgcauggugca

SEQ ID NO: 1762072 - RNA, 18 nt, Homo sapiens
ggcucagugcaaccucug

SEQ ID NO: 1762073 - RNA, 11 nt, Homo sapiens
uuuuucugggg

SEQ ID NO: 1762074 - RNA, 17 nt, Homo sapiens
aaaacguuuuauugugu

SEQ ID NO: 1762075 - RNA, 15 nt, Homo sapiens
gaagugcgugaaugu

SEQ ID NO: 1762076 - RNA, 17 nt, Homo sapiens
ggccucucucauggcac

SEQ ID NO: 1762077 - RNA, 15 nt, Homo sapiens
ugucacagggccaac

SEQ ID NO: 1762078 - RNA, 15 nt, Homo sapiens
cuuacuuugugcaaa

SEQ ID NO: 1762079 - RNA, 17 nt, Homo sapiens
uguuugacacaauugga

SEQ ID NO: 1762080 - RNA, 21 nt, Homo sapiens
cccucaggggaaaacuguuac

SEQ ID NO: 1762081 - RNA, 16 nt, Homo sapiens
aaucaucaaguaauac

SEQ ID NO: 1762082 - RNA, 19 nt, Homo sapiens
ucccaggcccagugcaguc

SEQ ID NO: 1762083 - RNA, 16 nt, Homo sapiens
gcuaacuggguuaaau

SEQ ID NO: 1762084 - RNA, 15 nt, Homo sapiens
cauccauaccagcuc

SEQ ID NO: 1762085 - RNA, 15 nt, Homo sapiens
caaucucaauuccau

SEQ ID NO: 1762086 - RNA, 14 nt, Homo sapiens
auuauauguucaga

SEQ ID NO: 1762087 - RNA, 16 nt, Homo sapiens
uguaacuuuacaguua

SEQ ID NO: 1762088 - RNA, 17 nt, Homo sapiens
ccauuaaagagccaguu

SEQ ID NO: 1762089 - RNA, 21 nt, Homo sapiens
cuucucuguucauuuccucaa

SEQ ID NO: 1762090 - RNA, 15 nt, Homo sapiens
aacugaaagcuuuaa

SEQ ID NO: 1762091 - RNA, 12 nt, Homo sapiens
augugcucuuaa

SEQ ID NO: 1762092 - RNA, 14 nt, Homo sapiens
uccuguauucuaca

SEQ ID NO: 1762093 - RNA, 14 nt, Homo sapiens
aauuucaguccuua

SEQ ID NO: 1762094 - RNA, 18 nt, Homo sapiens
cuuuacuccucacacuua

SEQ ID NO: 1762095 - RNA, 19 nt, Homo sapiens
uaauuuucuagauuuucua

SEQ ID NO: 1762096 - RNA, 20 nt, Homo sapiens
ccgaugugcgcacacacaga

SEQ ID NO: 1762097 - RNA, 12 nt, Homo sapiens
aaacaguucugc

SEQ ID NO: 1762098 - RNA, 18 nt, Homo sapiens
gcgggggagcaggcagug

SEQ ID NO: 1762099 - RNA, 15 nt, Homo sapiens
cucaaguaccaccaa

SEQ ID NO: 1762100 - RNA, 13 nt, Homo sapiens
ugaaggacuguga

SEQ ID NO: 1762101 - RNA, 16 nt, Homo sapiens
cuguagagucacugac

SEQ ID NO: 1762102 - RNA, 15 nt, Homo sapiens
cugugcuugcuccua

SEQ ID NO: 1762103 - RNA, 15 nt, Homo sapiens
uuuugacacuuuuaa

SEQ ID NO: 1762104 - RNA, 14 nt, Homo sapiens
agcucugccuguua

SEQ ID NO: 1762105 - RNA, 21 nt, Homo sapiens
gcucaguaaccaugcaaaauu

SEQ ID NO: 1762106 - RNA, 21 nt, Homo sapiens
cagcgcgucaugacgugcaug

SEQ ID NO: 1762107 - RNA, 17 nt, Homo sapiens
caagcgucugugcauuu

SEQ ID NO: 1762108 - RNA, 19 nt, Homo sapiens
auucacagaauagcacaaa

SEQ ID NO: 1762109 - RNA, 19 nt, Homo sapiens
aggcaaggcuaugugauua

SEQ ID NO: 1762110 - RNA, 18 nt, Homo sapiens
uaggugauggccagucau

SEQ ID NO: 1762111 - RNA, 16 nt, Homo sapiens
gcaauucuucuucuca

SEQ ID NO: 1762112 - RNA, 23 nt, Homo sapiens
aggcugaggcaggagaauggcau

SEQ ID NO: 1762113 - RNA, 15 nt, Homo sapiens
cauauccaccaccuc

SEQ ID NO: 1762114 - RNA, 13 nt, Homo sapiens
auaagucuuucau

SEQ ID NO: 1762115 - RNA, 12 nt, Homo sapiens
gagccaugccag

SEQ ID NO: 1762116 - RNA, 14 nt, Homo sapiens
ccucuccuaacaua

SEQ ID NO: 1762117 - RNA, 11 nt, Homo sapiens
cuuagccauuu

SEQ ID NO: 1762118 - RNA, 15 nt, Homo sapiens
cuugggucccggagu

SEQ ID NO: 1762119 - RNA, 15 nt, Homo sapiens
gaagaaucuaaugaa

SEQ ID NO: 1762120 - RNA, 17 nt, Homo sapiens
ugcacgucuugcuauuu

SEQ ID NO: 1762121 - RNA, 15 nt, Homo sapiens
accuauguuugcuca

SEQ ID NO: 1762122 - RNA, 14 nt, Homo sapiens
aaauccuacaguga

SEQ ID NO: 1762123 - RNA, 16 nt, Homo sapiens
acuuguaaacuugaaa

SEQ ID NO: 1762124 - RNA, 14 nt, Homo sapiens
aaguuagucaaucc

SEQ ID NO: 1762125 - RNA, 17 nt, Homo sapiens
agcaaaggugcacucca

SEQ ID NO: 1762126 - RNA, 15 nt, Homo sapiens
gacauggaaagggag

SEQ ID NO: 1762127 - RNA, 18 nt, Homo sapiens
cuugugccuggcucagag

SEQ ID NO: 1762128 - RNA, 16 nt, Homo sapiens
ugcaaaaguacaaggg

SEQ ID NO: 1762129 - RNA, 20 nt, Homo sapiens
cugcugcccuuaggccacau

SEQ ID NO: 1762130 - RNA, 21 nt, Homo sapiens
auuuaaucuguacuauccagu

SEQ ID NO: 1762131 - RNA, 15 nt, Homo sapiens
uccaaauguccucca

SEQ ID NO: 1762132 - RNA, 15 nt, Homo sapiens
uucaaauguucucca

SEQ ID NO: 1762133 - RNA, 15 nt, Homo sapiens
agaaacagagaucau

SEQ ID NO: 1762134 - RNA, 12 nt, Homo sapiens
auuagaauauaa

SEQ ID NO: 1762135 - RNA, 20 nt, Homo sapiens
caggaggagucauguagccc

SEQ ID NO: 1762136 - RNA, 13 nt, Homo sapiens
ccaggcaaagugc

SEQ ID NO: 1762137 - RNA, 16 nt, Homo sapiens
cuaaaacuuaaaguau

SEQ ID NO: 1762138 - RNA, 12 nt, Homo sapiens
gaauaaagccac

SEQ ID NO: 1762139 - RNA, 21 nt, Homo sapiens
cuaggagcugguguggccaag

SEQ ID NO: 1762140 - RNA, 15 nt, Homo sapiens
agccuggggacccca

SEQ ID NO: 1762141 - RNA, 15 nt, Homo sapiens
ucccacgacuguugu

SEQ ID NO: 1762142 - RNA, 21 nt, Homo sapiens
gauuagaggcaugugccauca

SEQ ID NO: 1762143 - RNA, 17 nt, Homo sapiens
aggcagucugggcacuu

SEQ ID NO: 1762144 - RNA, 12 nt, Homo sapiens
uuuuagaguaug

SEQ ID NO: 1762145 - RNA, 20 nt, Homo sapiens
ugcauccaggacugugccag

SEQ ID NO: 1762146 - RNA, 14 nt, Homo sapiens
uuaauauacaaucu

SEQ ID NO: 1762147 - RNA, 20 nt, Homo sapiens
cuggagucccuucugagcga

SEQ ID NO: 1762148 - RNA, 14 nt, Homo sapiens
cugcccagcacagg

SEQ ID NO: 1762149 - RNA, 20 nt, Homo sapiens
cagaggcucagcacuuugga

SEQ ID NO: 1762150 - RNA, 13 nt, Homo sapiens
uccuccagucuug

SEQ ID NO: 1762151 - RNA, 19 nt, Homo sapiens
gauaaauagaguuccaaau

SEQ ID NO: 1762152 - RNA, 23 nt, Homo sapiens
cccaagagucuggggaccagcuu

SEQ ID NO: 1762153 - RNA, 20 nt, Homo sapiens
acucagaaauguaguuugca

SEQ ID NO: 1762154 - RNA, 19 nt, Homo sapiens
acauuuuugucuguccuac

SEQ ID NO: 1762155 - RNA, 19 nt, Homo sapiens
ccaaucuuaaacauaauaa

SEQ ID NO: 1762156 - RNA, 18 nt, Homo sapiens
agagaucacccacuccua

SEQ ID NO: 1762157 - RNA, 14 nt, Homo sapiens
ucccagagcuuccc

SEQ ID NO: 1762158 - RNA, 20 nt, Homo sapiens
augggaaaaacugcagucau

SEQ ID NO: 1762159 - RNA, 15 nt, Homo sapiens
gaaugcuuggcacuc

SEQ ID NO: 1762160 - RNA, 18 nt, Homo sapiens
gcagauagugccucugca

SEQ ID NO: 1762161 - RNA, 20 nt, Homo sapiens
gggucucacuauguugccca

SEQ ID NO: 1762162 - RNA, 21 nt, Homo sapiens
ccaaggucagcucccaucuca

SEQ ID NO: 1762163 - RNA, 19 nt, Homo sapiens
ucaguguuuuugugaauug

SEQ ID NO: 1762164 - RNA, 21 nt, Homo sapiens
uguugcaggcuguaaggcaug

SEQ ID NO: 1762165 - RNA, 17 nt, Homo sapiens
uguuuccagcuugcauu

SEQ ID NO: 1762166 - RNA, 16 nt, Homo sapiens
caugucagccacugug

SEQ ID NO: 1762167 - RNA, 14 nt, Homo sapiens
acaacauuuuauua

SEQ ID NO: 1762168 - RNA, 15 nt, Homo sapiens
auucuguucugcaac

SEQ ID NO: 1762169 - RNA, 15 nt, Homo sapiens
agcugccucugggcc

SEQ ID NO: 1762170 - RNA, 22 nt, Homo sapiens
cauacugguguuaacagucaca

SEQ ID NO: 1762171 - RNA, 22 nt, Homo sapiens
cacaaaauuaugcugcauuugg

SEQ ID NO: 1762172 - RNA, 18 nt, Homo sapiens
auauuguguugugcagca

SEQ ID NO: 1762173 - RNA, 14 nt, Homo sapiens
cuguauuccaaggc

SEQ ID NO: 1762174 - RNA, 22 nt, Homo sapiens
ugaacaaucagauuagacacua

SEQ ID NO: 1762175 - RNA, 17 nt, Homo sapiens
aagaauuuacuuuggaa

SEQ ID NO: 1762176 - RNA, 14 nt, Homo sapiens
ucucuaauugauuc

SEQ ID NO: 1762177 - RNA, 24 nt, Homo sapiens
accuuacugacacauugcugauau

SEQ ID NO: 1762178 - RNA, 23 nt, Homo sapiens
uauugguucagggaacucuggca

SEQ ID NO: 1762179 - RNA, 21 nt, Homo sapiens
uccauaaacaugaaaacacuu

SEQ ID NO: 1762180 - RNA, 15 nt, Homo sapiens
uugagcaaaccacau

SEQ ID NO: 1762181 - RNA, 10 nt, Homo sapiens
ccagaggcac

SEQ ID NO: 1762182 - RNA, 19 nt, Homo sapiens
aaugugugaaguaugcacu

SEQ ID NO: 1762183 - RNA, 15 nt, Homo sapiens
gaaacuaaacucuua

SEQ ID NO: 1762184 - RNA, 13 nt, Homo sapiens
aguugaucaugca

SEQ ID NO: 1762185 - RNA, 16 nt, Homo sapiens
cucugaccuuccagag

SEQ ID NO: 1762186 - RNA, 12 nt, Homo sapiens
gauucuccagua

SEQ ID NO: 1762187 - RNA, 16 nt, Homo sapiens
aggguuggcaccugca

SEQ ID NO: 1762188 - RNA, 19 nt, Homo sapiens
aagccaaaguuucuguuga

SEQ ID NO: 1762189 - RNA, 19 nt, Homo sapiens
ugacagaguucacuauaaa

SEQ ID NO: 1762190 - RNA, 22 nt, Homo sapiens
ucuuaaacuaaaugugcaauag

SEQ ID NO: 1762191 - RNA, 18 nt, Homo sapiens
cagacaucucuggagcca

SEQ ID NO: 1762192 - RNA, 18 nt, Homo sapiens
ggacaaaccgagugcaau

SEQ ID NO: 1762193 - RNA, 16 nt, Homo sapiens
uuauaccaguuuucuu

SEQ ID NO: 1762194 - RNA, 22 nt, Homo sapiens
cagccauggcuggaugugcauc

SEQ ID NO: 1762195 - RNA, 16 nt, Homo sapiens
uggugucuagcauuaa

SEQ ID NO: 1762196 - RNA, 22 nt, Homo sapiens
gagugccguaacaacugugguc

SEQ ID NO: 1762197 - RNA, 13 nt, Homo sapiens
agucuucccauuu

SEQ ID NO: 1762198 - RNA, 20 nt, Homo sapiens
ugugacgcacagcacuccug

SEQ ID NO: 1762199 - RNA, 21 nt, Homo sapiens
aucauugugcuuaauaauacc

SEQ ID NO: 1762200 - RNA, 22 nt, Homo sapiens
uauuuugcauaguaccaaucau

SEQ ID NO: 1762201 - RNA, 21 nt, Homo sapiens
caaagugcaugucacaugcca

SEQ ID NO: 1762202 - RNA, 17 nt, Homo sapiens
agauaaauauuuugcau

SEQ ID NO: 1762203 - RNA, 21 nt, Homo sapiens
ucaaagugguaaauacuguga

SEQ ID NO: 1762204 - RNA, 21 nt, Homo sapiens
gccuugggaagaagugauucu

SEQ ID NO: 1762205 - RNA, 22 nt, Homo sapiens
ucucuuacaaucuguuuuagac

SEQ ID NO: 1762206 - RNA, 16 nt, Homo sapiens
aaacucccgaccucag

SEQ ID NO: 1762207 - RNA, 17 nt, Homo sapiens
agagccccuacuguggg

SEQ ID NO: 1762208 - RNA, 16 nt, Homo sapiens
cagcaaaaugucuccu

SEQ ID NO: 1762209 - RNA, 18 nt, Homo sapiens
ugagaaggagucagaaac

SEQ ID NO: 1762210 - RNA, 23 nt, Homo sapiens
accgcauccucacugggcucacu

SEQ ID NO: 1762211 - RNA, 23 nt, Homo sapiens
cccauguguguguacaacacugg

SEQ ID NO: 1762212 - RNA, 13 nt, Homo sapiens
gacugaauaccua

SEQ ID NO: 1762213 - RNA, 21 nt, Homo sapiens
agcuucuuaaaugagaaggaa

SEQ ID NO: 1762214 - RNA, 16 nt, Homo sapiens
guuuguuucauauaua

SEQ ID NO: 1762215 - RNA, 23 nt, Homo sapiens
ccuucugucguccccagaccagu

SEQ ID NO: 1762216 - RNA, 13 nt, Homo sapiens
cccguggcacuca

SEQ ID NO: 1762217 - RNA, 16 nt, Homo sapiens
auuuucuauuuaugua

SEQ ID NO: 1762218 - RNA, 23 nt, Homo sapiens
auuuugugaauugugacauaaua

SEQ ID NO: 1762219 - RNA, 14 nt, Homo sapiens
cagcccuugcuugg

SEQ ID NO: 1762220 - RNA, 16 nt, Homo sapiens
aauagacuuuguauga

SEQ ID NO: 1762221 - RNA, 22 nt, Homo sapiens
uuaagguuugcccugccugcag

SEQ ID NO: 1762222 - RNA, 12 nt, Homo sapiens
acucauaauucu

SEQ ID NO: 1762223 - RNA, 15 nt, Homo sapiens
uuucacauaaaaccu

SEQ ID NO: 1762224 - RNA, 19 nt, Homo sapiens
auauguuagaaucaaauac

SEQ ID NO: 1762225 - RNA, 18 nt, Homo sapiens
uccuuccucucugugaug

SEQ ID NO: 1762226 - RNA, 14 nt, Homo sapiens
ugaucuucagggcu

SEQ ID NO: 1762227 - RNA, 17 nt, Homo sapiens
caauaaaaagcucuuaa

SEQ ID NO: 1762228 - RNA, 13 nt, Homo sapiens
cucuucugaccca

SEQ ID NO: 1762229 - RNA, 16 nt, Homo sapiens
cucaggagaaggccug

SEQ ID NO: 1762230 - RNA, 18 nt, Homo sapiens
guacaguagauuuuccaa

SEQ ID NO: 1762231 - RNA, 22 nt, Homo sapiens
gacugcccucuuacuguuuuga

SEQ ID NO: 1762232 - RNA, 14 nt, Homo sapiens
gcuaauugagacca

SEQ ID NO: 1762233 - RNA, 19 nt, Homo sapiens
guucauagcaacauuauuu

SEQ ID NO: 1762234 - RNA, 15 nt, Homo sapiens
aagcccaccugggcu

SEQ ID NO: 1762235 - RNA, 11 nt, Homo sapiens
ccauccucacc

SEQ ID NO: 1762236 - RNA, 21 nt, Homo sapiens
cuuauacgaguaauaugccug

SEQ ID NO: 1762237 - RNA, 15 nt, Homo sapiens
acacaggcagcuucc

SEQ ID NO: 1762238 - RNA, 18 nt, Homo sapiens
gaucaauaaaaugugauu

SEQ ID NO: 1762239 - RNA, 21 nt, Homo sapiens
caucccugggccugcugcuga

SEQ ID NO: 1762240 - RNA, 21 nt, Homo sapiens
agaucuuuucuugaccuagua

SEQ ID NO: 1762241 - RNA, 16 nt, Homo sapiens
aacauuguauucagcu

SEQ ID NO: 1762242 - RNA, 17 nt, Homo sapiens
cagugugcaguggugca

SEQ ID NO: 1762243 - RNA, 17 nt, Homo sapiens
caugucaaggguucaag

SEQ ID NO: 1762244 - RNA, 14 nt, Homo sapiens
cugucuuuguggac

SEQ ID NO: 1762245 - RNA, 20 nt, Homo sapiens
gagggaggguuucucuccca

SEQ ID NO: 1762246 - RNA, 13 nt, Homo sapiens
uccuuuuccuuau

SEQ ID NO: 1762247 - RNA, 21 nt, Homo sapiens
uagacuuccuguagggggcga

SEQ ID NO: 1762248 - RNA, 23 nt, Homo sapiens
cuguguggacugugaugccacac

SEQ ID NO: 1762249 - RNA, 23 nt, Homo sapiens
cuccuuuugcuugaaaccaaaga

SEQ ID NO: 1762250 - RNA, 15 nt, Homo sapiens
acacaaucugaaaca

SEQ ID NO: 1762251 - RNA, 22 nt, Homo sapiens
auguuucugucacaucagcucc

SEQ ID NO: 1762252 - RNA, 21 nt, Homo sapiens
aaggcacccgcccuuuccuug

SEQ ID NO: 1762253 - RNA, 19 nt, Homo sapiens
aaauguucuaaguuucuaa

SEQ ID NO: 1762254 - RNA, 15 nt, Homo sapiens
auggcagugaugaau

SEQ ID NO: 1762255 - RNA, 21 nt, Homo sapiens
ucccgggcacugucaugccca

SEQ ID NO: 1762256 - RNA, 12 nt, Homo sapiens
gcuuucucugag

SEQ ID NO: 1762257 - RNA, 21 nt, Homo sapiens
uucacauuugauguacaugug

SEQ ID NO: 1762258 - RNA, 17 nt, Homo sapiens
gucuucucucaaaggga

SEQ ID NO: 1762259 - RNA, 20 nt, Homo sapiens
agaaaacagagccugccuaa

SEQ ID NO: 1762260 - RNA, 20 nt, Homo sapiens
ugcuccguaugccaagagga

SEQ ID NO: 1762261 - RNA, 15 nt, Homo sapiens
uugcuggaugcauuu

SEQ ID NO: 1762262 - RNA, 16 nt, Homo sapiens
cagcggcucugguccu

SEQ ID NO: 1762263 - RNA, 21 nt, Homo sapiens
auuuguggucacagccaugaa

SEQ ID NO: 1762264 - RNA, 15 nt, Homo sapiens
uauaauaauuacuua

SEQ ID NO: 1762265 - RNA, 15 nt, Homo sapiens
cuacaauacauauau

SEQ ID NO: 1762266 - RNA, 20 nt, Homo sapiens
gcaaagagagguccagaguc

SEQ ID NO: 1762267 - RNA, 13 nt, Homo sapiens
caggucacuuuac

SEQ ID NO: 1762268 - RNA, 15 nt, Homo sapiens
ugaaacccugucuug

SEQ ID NO: 1762269 - RNA, 17 nt, Homo sapiens
guuuuuguuuuuuucca

SEQ ID NO: 1762270 - RNA, 18 nt, Homo sapiens
auucuacugaacacuuca

SEQ ID NO: 1762271 - RNA, 13 nt, Homo sapiens
uugaagcugcuca

SEQ ID NO: 1762272 - RNA, 23 nt, Homo sapiens
acuaccauuccuucuuuaaacac

SEQ ID NO: 1762273 - RNA, 22 nt, Homo sapiens
cuaauuguccacauacguggaa

SEQ ID NO: 1762274 - RNA, 19 nt, Homo sapiens
caagagaugggacaagcag

SEQ ID NO: 1762275 - RNA, 14 nt, Homo sapiens
ugcugcgugacaua

SEQ ID NO: 1762276 - RNA, 18 nt, Homo sapiens
guuggccaggcuguucuc

SEQ ID NO: 1762277 - RNA, 16 nt, Homo sapiens
guuuccccaucucugu

SEQ ID NO: 1762278 - RNA, 20 nt, Homo sapiens
gcaguagaaauaauaugcau

SEQ ID NO: 1762279 - RNA, 23 nt, Homo sapiens
ccucugaaugucccagaggcuag

SEQ ID NO: 1762280 - RNA, 15 nt, Homo sapiens
uuaauugccagcaaa

SEQ ID NO: 1762281 - RNA, 23 nt, Homo sapiens
auuauucugggcaccacaaaaua

SEQ ID NO: 1762282 - RNA, 22 nt, Homo sapiens
uuaaccugccaacauacuuuaa

SEQ ID NO: 1762283 - RNA, 22 nt, Homo sapiens
ucucccaguccauuuccaaaug

SEQ ID NO: 1762284 - RNA, 19 nt, Homo sapiens
accuggcauggugcaggga

SEQ ID NO: 1762285 - RNA, 19 nt, Homo sapiens
ccaagguuuuggagucagu

SEQ ID NO: 1762286 - RNA, 16 nt, Homo sapiens
cucucagagcaccucu

SEQ ID NO: 1762287 - RNA, 19 nt, Homo sapiens
uccaccuccggguucaagc

SEQ ID NO: 1762288 - RNA, 15 nt, Homo sapiens
ucaagauacacuugu

SEQ ID NO: 1762289 - RNA, 18 nt, Homo sapiens
uguaauugacacuauaua

SEQ ID NO: 1762290 - RNA, 18 nt, Homo sapiens
uugaggcaggaccauaca

SEQ ID NO: 1762291 - RNA, 18 nt, Homo sapiens
ucucuaaaggggacuuga

SEQ ID NO: 1762292 - RNA, 17 nt, Homo sapiens
auguaaacagugccugc

SEQ ID NO: 1762293 - RNA, 13 nt, Homo sapiens
ucuuaaaauaucu

SEQ ID NO: 1762294 - RNA, 19 nt, Homo sapiens
ucccccugcuuccaccuca

SEQ ID NO: 1762295 - RNA, 16 nt, Homo sapiens
caggggcaaaagucau

SEQ ID NO: 1762296 - RNA, 23 nt, Homo sapiens
cucaccucauagcuaauuuuugc

SEQ ID NO: 1762297 - RNA, 20 nt, Homo sapiens
gaaauuauaaauaaauaucu

SEQ ID NO: 1762298 - RNA, 23 nt, Homo sapiens
cccaguuccacagcagugucaca

SEQ ID NO: 1762299 - RNA, 17 nt, Homo sapiens
ggguccccuugaaagaa

SEQ ID NO: 1762300 - RNA, 11 nt, Homo sapiens
ccucuacugcu

SEQ ID NO: 1762301 - RNA, 13 nt, Homo sapiens
auguaaauacugu

SEQ ID NO: 1762302 - RNA, 14 nt, Homo sapiens
acuaauagccuaaa

SEQ ID NO: 1762303 - RNA, 18 nt, Homo sapiens
auuugcuauuuauuaaau

SEQ ID NO: 1762304 - RNA, 16 nt, Homo sapiens
aauucauaaccaaaga

SEQ ID NO: 1762305 - RNA, 20 nt, Homo sapiens
ucauugcgugauucaaugaa

SEQ ID NO: 1762306 - RNA, 17 nt, Homo sapiens
agauuacugaugugaua

SEQ ID NO: 1762307 - RNA, 23 nt, Homo sapiens
aaugagacccucguggccuuccc

SEQ ID NO: 1762308 - RNA, 21 nt, Homo sapiens
ccugcucagcagccagucuca

SEQ ID NO: 1762309 - RNA, 19 nt, Homo sapiens
ucccucugugucugcucuc

SEQ ID NO: 1762310 - RNA, 11 nt, Homo sapiens
cuaccuuguga

SEQ ID NO: 1762311 - RNA, 15 nt, Homo sapiens
cuaucugcacucuaa

SEQ ID NO: 1762312 - RNA, 19 nt, Homo sapiens
aaauuuuuugugauuucaa

SEQ ID NO: 1762313 - RNA, 21 nt, Homo sapiens
ccacuuccuuuguguuuauau

SEQ ID NO: 1762314 - RNA, 23 nt, Homo sapiens
cagccccuccuccccuuccugca

SEQ ID NO: 1762315 - RNA, 21 nt, Homo sapiens
ucuucuacagaugagucacac

SEQ ID NO: 1762316 - RNA, 22 nt, Homo sapiens
accucugccugaagucacacag

SEQ ID NO: 1762317 - RNA, 22 nt, Homo sapiens
accaaagggaugguauugagaa

SEQ ID NO: 1762318 - RNA, 16 nt, Homo sapiens
auccucccuacuucca

SEQ ID NO: 1762319 - RNA, 21 nt, Homo sapiens
cucuacucuagggaaaaacca

SEQ ID NO: 1762320 - RNA, 14 nt, Homo sapiens
augggagcuccucu

SEQ ID NO: 1762321 - RNA, 21 nt, Homo sapiens
gggaggacaaaggugauuuuc

SEQ ID NO: 1762322 - RNA, 13 nt, Homo sapiens
uccacauccucua

SEQ ID NO: 1762323 - RNA, 18 nt, Homo sapiens
ccgcucugaggcaacccc

SEQ ID NO: 1762324 - RNA, 21 nt, Homo sapiens
uauggacuuucuugcaagcaa

SEQ ID NO: 1762325 - RNA, 18 nt, Homo sapiens
ggaagccagugggguccc

SEQ ID NO: 1762326 - RNA, 14 nt, Homo sapiens
gccuggacugacca

SEQ ID NO: 1762327 - RNA, 22 nt, Homo sapiens
ugauucuaaggcaggaauuuga

SEQ ID NO: 1762328 - RNA, 13 nt, Homo sapiens
cacaggcagccag

SEQ ID NO: 1762329 - RNA, 12 nt, Homo sapiens
aauaaagacagg

SEQ ID NO: 1762330 - RNA, 21 nt, Homo sapiens
gugagggaacagagagguuaa

SEQ ID NO: 1762331 - RNA, 17 nt, Homo sapiens
gagccgggucugccucu

SEQ ID NO: 1762332 - RNA, 22 nt, Homo sapiens
gaaugaccaagcucaguucaau

SEQ ID NO: 1762333 - RNA, 12 nt, Homo sapiens
gacaaagccaaa

SEQ ID NO: 1762334 - RNA, 22 nt, Homo sapiens
ucuguaucuuugacaauucugg

SEQ ID NO: 1762335 - RNA, 12 nt, Homo sapiens
guaggcacagac

SEQ ID NO: 1762336 - RNA, 15 nt, Homo sapiens
uauccagguucuaau

SEQ ID NO: 1762337 - RNA, 16 nt, Homo sapiens
acauuugcuguuuuaa

SEQ ID NO: 1762338 - RNA, 16 nt, Homo sapiens
uccugccuagucucac

SEQ ID NO: 1762339 - RNA, 21 nt, Homo sapiens
agacuguugggacagccauuu

SEQ ID NO: 1762340 - RNA, 16 nt, Homo sapiens
ugggaaagggcuguua

SEQ ID NO: 1762341 - RNA, 16 nt, Homo sapiens
uucucuaugacaugaa

SEQ ID NO: 1762342 - RNA, 13 nt, Homo sapiens
uuucgcucuuuga

SEQ ID NO: 1762343 - RNA, 22 nt, Homo sapiens
ccagagcuggaccugagcuauu

SEQ ID NO: 1762344 - RNA, 19 nt, Homo sapiens
agugagugaucacugguau

SEQ ID NO: 1762345 - RNA, 21 nt, Homo sapiens
gcccuuucaccccucuuccca

SEQ ID NO: 1762346 - RNA, 21 nt, Homo sapiens
cuuucccacgucacuugacaa

SEQ ID NO: 1762347 - RNA, 16 nt, Homo sapiens
gucagggaacauauuu

SEQ ID NO: 1762348 - RNA, 24 nt, Homo sapiens
cugggcgcugucuugugucuccua

SEQ ID NO: 1762349 - RNA, 13 nt, Homo sapiens
ucccauuuuacag

SEQ ID NO: 1762350 - RNA, 15 nt, Homo sapiens
ggcgggggucuauac

SEQ ID NO: 1762351 - RNA, 18 nt, Homo sapiens
ucucugucugauccuguc

SEQ ID NO: 1762352 - RNA, 15 nt, Homo sapiens
gggcuccuugcucca

SEQ ID NO: 1762353 - RNA, 13 nt, Homo sapiens
cggaggacugagc

SEQ ID NO: 1762354 - RNA, 21 nt, Homo sapiens
gaucuuugcuuccuugcuuuu

SEQ ID NO: 1762355 - RNA, 18 nt, Homo sapiens
ugaacuggcuuguacauu

SEQ ID NO: 1762356 - RNA, 15 nt, Homo sapiens
uuccccccauguugu

SEQ ID NO: 1762357 - RNA, 21 nt, Homo sapiens
cccaacccugcccacuucagc

SEQ ID NO: 1762358 - RNA, 12 nt, Homo sapiens
gcagucacugga

SEQ ID NO: 1762359 - RNA, 15 nt, Homo sapiens
agcuguuucucauga

SEQ ID NO: 1762360 - RNA, 21 nt, Homo sapiens
ggaaggaacucaagguggcug

SEQ ID NO: 1762361 - RNA, 21 nt, Homo sapiens
acccccacuucaugcccacug

SEQ ID NO: 1762362 - RNA, 20 nt, Homo sapiens
aguggagauuuacacuacau

SEQ ID NO: 1762363 - RNA, 21 nt, Homo sapiens
gccucccuccccagugcaaau

SEQ ID NO: 1762364 - RNA, 12 nt, Homo sapiens
aacucagggaca

SEQ ID NO: 1762365 - RNA, 16 nt, Homo sapiens
aaaucugucacuacaa

SEQ ID NO: 1762366 - RNA, 22 nt, Homo sapiens
gaacagguuuuguguuuuguca

SEQ ID NO: 1762367 - RNA, 22 nt, Homo sapiens
uuccuuuaaugauaacuaaaau

SEQ ID NO: 1762368 - RNA, 14 nt, Homo sapiens
ggagccgcugcuga

SEQ ID NO: 1762369 - RNA, 14 nt, Homo sapiens
gaacaacaaggaca

SEQ ID NO: 1762370 - RNA, 22 nt, Homo sapiens
cauaguuuuguuuaauuugcuu

SEQ ID NO: 1762371 - RNA, 22 nt, Homo sapiens
aggguggguuuaauaacauauu

SEQ ID NO: 1762372 - RNA, 23 nt, Homo sapiens
cccagguggcccuaaaggacucu

SEQ ID NO: 1762373 - RNA, 19 nt, Homo sapiens
augaugauagucaucauca

SEQ ID NO: 1762374 - RNA, 18 nt, Homo sapiens
cauuccaggaaaacuggg

SEQ ID NO: 1762375 - RNA, 21 nt, Homo sapiens
uaagaugugauauucuaagac

SEQ ID NO: 1762376 - RNA, 16 nt, Homo sapiens
uuggaggaaaugugcu

SEQ ID NO: 1762377 - RNA, 14 nt, Homo sapiens
uuguauauuacaca

SEQ ID NO: 1762378 - RNA, 18 nt, Homo sapiens
agccaucugcgacaccac

SEQ ID NO: 1762379 - RNA, 22 nt, Homo sapiens
accucaucagcugccuaacuua

SEQ ID NO: 1762380 - RNA, 16 nt, Homo sapiens
gagcuggcaaccagcc

SEQ ID NO: 1762381 - RNA, 15 nt, Homo sapiens
uaugagaugccugaa

SEQ ID NO: 1762382 - RNA, 15 nt, Homo sapiens
cuuugcucaguggau

SEQ ID NO: 1762383 - RNA, 15 nt, Homo sapiens
uagaaugaaccacug

SEQ ID NO: 1762384 - RNA, 12 nt, Homo sapiens
ccuuauaguguu

SEQ ID NO: 1762385 - RNA, 11 nt, Homo sapiens
ucaugggaccu

SEQ ID NO: 1762386 - RNA, 20 nt, Homo sapiens
ugauaacaccaagaguagca

SEQ ID NO: 1762387 - RNA, 22 nt, Homo sapiens
gauuccucugcugccauuugaa

SEQ ID NO: 1762388 - RNA, 12 nt, Homo sapiens
guuuuaacugua

SEQ ID NO: 1762389 - RNA, 20 nt, Homo sapiens
auuuaaaaucagacucuuua

SEQ ID NO: 1762390 - RNA, 14 nt, Homo sapiens
uuuuguauauacag

SEQ ID NO: 1762391 - RNA, 14 nt, Homo sapiens
caaguugauauuuc

SEQ ID NO: 1762392 - RNA, 15 nt, Homo sapiens
uguggaaaacucaca

SEQ ID NO: 1762393 - RNA, 12 nt, Homo sapiens
uuuuaacaucuc

SEQ ID NO: 1762394 - RNA, 15 nt, Homo sapiens
agcucuguugaauca

SEQ ID NO: 1762395 - RNA, 22 nt, Homo sapiens
uaccagucgcccucugugccua

SEQ ID NO: 1762396 - RNA, 14 nt, Homo sapiens
uggggucaaagacu

SEQ ID NO: 1762397 - RNA, 14 nt, Homo sapiens
aaaggacaugaaca

SEQ ID NO: 1762398 - RNA, 14 nt, Homo sapiens
uggccuccaugugg

SEQ ID NO: 1762399 - RNA, 22 nt, Homo sapiens
uuguaaaggauaucaaugccuu

SEQ ID NO: 1762400 - RNA, 20 nt, Homo sapiens
aaccuccgccuccuggguuc

SEQ ID NO: 1762401 - RNA, 14 nt, Homo sapiens
uccaauucagaaug

SEQ ID NO: 1762402 - RNA, 23 nt, Homo sapiens
ugcacuguagccuuagugucacc

SEQ ID NO: 1762403 - RNA, 19 nt, Homo sapiens
caaggcaguguuccucacc

SEQ ID NO: 1762404 - RNA, 14 nt, Homo sapiens
ugagacuacuucag

SEQ ID NO: 1762405 - RNA, 16 nt, Homo sapiens
gcaucacuagugacaa

SEQ ID NO: 1762406 - RNA, 19 nt, Homo sapiens
cugcuccauggaugcaugc

SEQ ID NO: 1762407 - RNA, 23 nt, Homo sapiens
aaccuguucacgugacuccucaa

SEQ ID NO: 1762408 - RNA, 14 nt, Homo sapiens
ucccuggagcugcu

SEQ ID NO: 1762409 - RNA, 15 nt, Homo sapiens
agcugagagacuuuu

SEQ ID NO: 1762410 - RNA, 15 nt, Homo sapiens
acaauuguauuccca

SEQ ID NO: 1762411 - RNA, 22 nt, Homo sapiens
gguagaaacuuuggaaguuuua

SEQ ID NO: 1762412 - RNA, 17 nt, Homo sapiens
gggacaccugcccagug

SEQ ID NO: 1762413 - RNA, 20 nt, Homo sapiens
uguauagguuuuaaagaccu

SEQ ID NO: 1762414 - RNA, 13 nt, Homo sapiens
gaaaaaagcaagu

SEQ ID NO: 1762415 - RNA, 15 nt, Homo sapiens
caaaguccaggcuaa

SEQ ID NO: 1762416 - RNA, 20 nt, Homo sapiens
uuuaaaaaaacucccauuaa

SEQ ID NO: 1762417 - RNA, 13 nt, Homo sapiens
aaaauacuucuuu

SEQ ID NO: 1762418 - RNA, 18 nt, Homo sapiens
ucgucagcuggcacuguc

SEQ ID NO: 1762419 - RNA, 21 nt, Homo sapiens
agccagcaguucagagcugcc

SEQ ID NO: 1762420 - RNA, 16 nt, Homo sapiens
auaaagccaguggaaa

SEQ ID NO: 1762421 - RNA, 23 nt, Homo sapiens
aagguugcuguugugcagugugc

SEQ ID NO: 1762422 - RNA, 16 nt, Homo sapiens
agcccccugaccuucc

SEQ ID NO: 1762423 - RNA, 13 nt, Homo sapiens
guaauuauuuucc

SEQ ID NO: 1762424 - RNA, 16 nt, Homo sapiens
cagaauccccugggga

SEQ ID NO: 1762425 - RNA, 22 nt, Homo sapiens
uuuugcacauaacaugcuuuag

SEQ ID NO: 1762426 - RNA, 15 nt, Homo sapiens
ugcuccccucugcac

SEQ ID NO: 1762427 - RNA, 16 nt, Homo sapiens
aucuaguuccugauag

SEQ ID NO: 1762428 - RNA, 21 nt, Homo sapiens
gaggcaggagaauggugugaa

SEQ ID NO: 1762429 - RNA, 12 nt, Homo sapiens
cucaucuugccc

SEQ ID NO: 1762430 - RNA, 13 nt, Homo sapiens
gaaggauuaccug

SEQ ID NO: 1762431 - RNA, 21 nt, Homo sapiens
agcccugaacaaagcaccuca

SEQ ID NO: 1762432 - RNA, 17 nt, Homo sapiens
ggaaccuguccuaagga

SEQ ID NO: 1762433 - RNA, 20 nt, Homo sapiens
uggaucaggguuguucuggg

SEQ ID NO: 1762434 - RNA, 17 nt, Homo sapiens
ucagaggcgcacuguga

SEQ ID NO: 1762435 - RNA, 15 nt, Homo sapiens
uuccauuauguucau

SEQ ID NO: 1762436 - RNA, 17 nt, Homo sapiens
ucaucucccaaagugcu

SEQ ID NO: 1762437 - RNA, 20 nt, Homo sapiens
uagucauacucccuggugua

SEQ ID NO: 1762438 - RNA, 17 nt, Homo sapiens
gaccuguaaucauauaa

SEQ ID NO: 1762439 - RNA, 17 nt, Homo sapiens
guuaagaacaucaaaac

SEQ ID NO: 1762440 - RNA, 14 nt, Homo sapiens
aaagaaaaaucaga

SEQ ID NO: 1762441 - RNA, 14 nt, Homo sapiens
cuacauacacagug

SEQ ID NO: 1762442 - RNA, 23 nt, Homo sapiens
ucagaguguuuaauuguacucaa

SEQ ID NO: 1762443 - RNA, 19 nt, Homo sapiens
cugcauguuaagugccauu

SEQ ID NO: 1762444 - RNA, 21 nt, Homo sapiens
caaacucacacaaccaugacg

SEQ ID NO: 1762445 - RNA, 16 nt, Homo sapiens
uggucgagugacacac

SEQ ID NO: 1762446 - RNA, 22 nt, Homo sapiens
cugaaaucauacuucuuagggu

SEQ ID NO: 1762447 - RNA, 13 nt, Homo sapiens
acgugacaggcuc

SEQ ID NO: 1762448 - RNA, 22 nt, Homo sapiens
ccaugugugagugugugcaagu

SEQ ID NO: 1762449 - RNA, 15 nt, Homo sapiens
aauaauaaagcauuu

SEQ ID NO: 1762450 - RNA, 19 nt, Homo sapiens
agcuugggcaacagagcaa

SEQ ID NO: 1762451 - RNA, 17 nt, Homo sapiens
agauugcgccauugcac

SEQ ID NO: 1762452 - RNA, 14 nt, Homo sapiens
uaaauagaugaguc

SEQ ID NO: 1762453 - RNA, 13 nt, Homo sapiens
aaaauaaauucaa

SEQ ID NO: 1762454 - RNA, 17 nt, Homo sapiens
cuucaaugcaaaauaca

SEQ ID NO: 1762455 - RNA, 18 nt, Homo sapiens
uccauuugugugugugca

SEQ ID NO: 1762456 - RNA, 19 nt, Homo sapiens
acguaaaguacuuguaguu

SEQ ID NO: 1762457 - RNA, 15 nt, Homo sapiens
acugaucaucugcug

SEQ ID NO: 1762458 - RNA, 21 nt, Homo sapiens
aauauuaggagacacagggaa

SEQ ID NO: 1762459 - RNA, 22 nt, Homo sapiens
uuccauauuuaaccuauuucca

SEQ ID NO: 1762460 - RNA, 20 nt, Homo sapiens
aauuucauuaucaucaagca

SEQ ID NO: 1762461 - RNA, 20 nt, Homo sapiens
gcauccagcagcagcacuua

SEQ ID NO: 1762462 - RNA, 21 nt, Homo sapiens
agcaucgugcuguuugccuug

SEQ ID NO: 1762463 - RNA, 14 nt, Homo sapiens
ggucuuacauugga

SEQ ID NO: 1762464 - RNA, 21 nt, Homo sapiens
ugggggccucuuucugugcuu

SEQ ID NO: 1762465 - RNA, 13 nt, Homo sapiens
aaucucacacuuc

SEQ ID NO: 1762466 - RNA, 15 nt, Homo sapiens
agacugaagaccagu

SEQ ID NO: 1762467 - RNA, 23 nt, Homo sapiens
uauaguuguuuuauauguugcua

SEQ ID NO: 1762468 - RNA, 22 nt, Homo sapiens
ucauagcuaauuuuugcaaaua

SEQ ID NO: 1762469 - RNA, 12 nt, Homo sapiens
gauuugaacccc

SEQ ID NO: 1762470 - RNA, 20 nt, Homo sapiens
uguaagacacacagccuuuc

SEQ ID NO: 1762471 - RNA, 19 nt, Homo sapiens
ugacaauugggagcugcca

SEQ ID NO: 1762472 - RNA, 17 nt, Homo sapiens
agccagacuuguucuca

SEQ ID NO: 1762473 - RNA, 19 nt, Homo sapiens
gccuauaaauaaauuccaa

SEQ ID NO: 1762474 - RNA, 19 nt, Homo sapiens
aauucuaaugguaacuuuu

SEQ ID NO: 1762475 - RNA, 13 nt, Homo sapiens
uggucucuacugu

SEQ ID NO: 1762476 - RNA, 15 nt, Homo sapiens
aaucugaauggugcu

SEQ ID NO: 1762477 - RNA, 16 nt, Homo sapiens
ucucuuggaugcagcu

SEQ ID NO: 1762478 - RNA, 17 nt, Homo sapiens
aaguuacauguuugcac

SEQ ID NO: 1762479 - RNA, 18 nt, Homo sapiens
cucuccacuguuucauga

SEQ ID NO: 1762480 - RNA, 22 nt, Homo sapiens
aauuucacgcuuuuaauucuca

SEQ ID NO: 1762481 - RNA, 15 nt, Homo sapiens
uccuuuagucuuuuc

SEQ ID NO: 1762482 - RNA, 14 nt, Homo sapiens
auugccauucugau

SEQ ID NO: 1762483 - RNA, 16 nt, Homo sapiens
aaguggggcucuggga

SEQ ID NO: 1762484 - RNA, 21 nt, Homo sapiens
guaccggcuuccauccuguca

SEQ ID NO: 1762485 - RNA, 21 nt, Homo sapiens
aaacccugaagccauuggaga

SEQ ID NO: 1762486 - RNA, 17 nt, Homo sapiens
cugagaugcaggugaug

SEQ ID NO: 1762487 - RNA, 12 nt, Homo sapiens
aacuacuucuua

SEQ ID NO: 1762488 - RNA, 14 nt, Homo sapiens
uuacuaucauguca

SEQ ID NO: 1762489 - RNA, 21 nt, Homo sapiens
ucauaacuagaguauaaagua

SEQ ID NO: 1762490 - RNA, 17 nt, Homo sapiens
ugaaauuuaacuuugua

SEQ ID NO: 1762491 - RNA, 23 nt, Homo sapiens
uuagcgucaagacauuugcugaa

SEQ ID NO: 1762492 - RNA, 18 nt, Homo sapiens
uacacggugggcugagua

SEQ ID NO: 1762493 - RNA, 13 nt, Homo sapiens
guaaaauaaucca

SEQ ID NO: 1762494 - RNA, 17 nt, Homo sapiens
uccuggcauaccuuuaa

SEQ ID NO: 1762495 - RNA, 18 nt, Homo sapiens
uuaguuugaaacagauuc

SEQ ID NO: 1762496 - RNA, 16 nt, Homo sapiens
aaaugaaaacagugug

SEQ ID NO: 1762497 - RNA, 17 nt, Homo sapiens
ugacacugacauuucac

SEQ ID NO: 1762498 - RNA, 14 nt, Homo sapiens
cuucuagaucucau

SEQ ID NO: 1762499 - RNA, 20 nt, Homo sapiens
acaacauguaccuguauuaa

SEQ ID NO: 1762500 - RNA, 21 nt, Homo sapiens
uucuuuuggaaaguacuauga

SEQ ID NO: 1762501 - RNA, 16 nt, Homo sapiens
uucaagucuuccugau

SEQ ID NO: 1762502 - RNA, 16 nt, Homo sapiens
ucuacagacuccaaaa

SEQ ID NO: 1762503 - RNA, 21 nt, Homo sapiens
acaaaaguuaaugaauaugcc

SEQ ID NO: 1762504 - RNA, 14 nt, Homo sapiens
ccuguggugcaaaa

SEQ ID NO: 1762505 - RNA, 15 nt, Homo sapiens
cacacuugugugugg

SEQ ID NO: 1762506 - RNA, 12 nt, Homo sapiens
acuccauucaaa

SEQ ID NO: 1762507 - RNA, 22 nt, Homo sapiens
cagagaaagcaaaggugcacuc

SEQ ID NO: 1762508 - RNA, 14 nt, Homo sapiens
acacggcagguagc

SEQ ID NO: 1762509 - RNA, 20 nt, Homo sapiens
ccuggcugaaggacugugac

SEQ ID NO: 1762510 - RNA, 14 nt, Homo sapiens
uacucacauauaac

SEQ ID NO: 1762511 - RNA, 21 nt, Homo sapiens
aggcuccacuuggucugugag

SEQ ID NO: 1762512 - RNA, 21 nt, Homo sapiens
augacccccgcaaguuugcac

SEQ ID NO: 1762513 - RNA, 16 nt, Homo sapiens
cuacagaaaaaggaaa

SEQ ID NO: 1762514 - RNA, 20 nt, Homo sapiens
augacucauaggucccugac

SEQ ID NO: 1762515 - RNA, 14 nt, Homo sapiens
ccugguuuuacccc

SEQ ID NO: 1762516 - RNA, 21 nt, Homo sapiens
gagacauacaccuaugucauu

SEQ ID NO: 1762517 - RNA, 20 nt, Homo sapiens
aaagcuuaaugauucugaua

SEQ ID NO: 1762518 - RNA, 19 nt, Homo sapiens
accacugagccauccucag

SEQ ID NO: 1762519 - RNA, 17 nt, Homo sapiens
cacucaaaagacaaaca

SEQ ID NO: 1762520 - RNA, 22 nt, Homo sapiens
gggucccauagaggugagggaa

SEQ ID NO: 1762521 - RNA, 22 nt, Homo sapiens
ggccucccacagugcugggauu

SEQ ID NO: 1762522 - RNA, 12 nt, Homo sapiens
gcucacuacuga

SEQ ID NO: 1762523 - RNA, 13 nt, Homo sapiens
cuaaggaaccuuc

SEQ ID NO: 1762524 - RNA, 12 nt, Homo sapiens
gcaccaacauca

SEQ ID NO: 1762525 - RNA, 19 nt, Homo sapiens
augaaaaaacggucugccg

SEQ ID NO: 1762526 - RNA, 20 nt, Homo sapiens
gaccauaaacguuguguuca

SEQ ID NO: 1762527 - RNA, 21 nt, Homo sapiens
uggaucacucaccauucccag

SEQ ID NO: 1762528 - RNA, 12 nt, Homo sapiens
cuaggcaucucc

SEQ ID NO: 1762529 - RNA, 19 nt, Homo sapiens
aggaaccucucgccaugau

SEQ ID NO: 1762530 - RNA, 18 nt, Homo sapiens
caauuauugaaacaggau

SEQ ID NO: 1762531 - RNA, 16 nt, Homo sapiens
agcucaccucucccuu

SEQ ID NO: 1762532 - RNA, 18 nt, Homo sapiens
uaccuaauguuaaaugac

SEQ ID NO: 1762533 - RNA, 21 nt, Homo sapiens
aggaaggaacagcaauggugu

SEQ ID NO: 1762534 - RNA, 22 nt, Homo sapiens
uccagcacaucccccucuccuc

SEQ ID NO: 1762535 - RNA, 14 nt, Homo sapiens
auggggcaugugcc

SEQ ID NO: 1762536 - RNA, 13 nt, Homo sapiens
cagccuagcacag

SEQ ID NO: 1762537 - RNA, 12 nt, Homo sapiens
aguacugggaag

SEQ ID NO: 1762538 - RNA, 15 nt, Homo sapiens
ugaggcccagugcau

SEQ ID NO: 1762539 - RNA, 17 nt, Homo sapiens
aaaacaaaggccuaauu

SEQ ID NO: 1762540 - RNA, 18 nt, Homo sapiens
cuccuggucugugcugcc

SEQ ID NO: 1762541 - RNA, 22 nt, Homo sapiens
ugcagauagcccaggagcaaca

SEQ ID NO: 1762542 - RNA, 23 nt, Homo sapiens
guggauuauguguguuuugcuaa

SEQ ID NO: 1762543 - RNA, 22 nt, Homo sapiens
augauacuccacucccagcagc

SEQ ID NO: 1762544 - RNA, 18 nt, Homo sapiens
aaaccuugcucuccucau

SEQ ID NO: 1762545 - RNA, 11 nt, Homo sapiens
acacaaugugg

SEQ ID NO: 1762546 - RNA, 17 nt, Homo sapiens
auuuuggaaauaggcau

SEQ ID NO: 1762547 - RNA, 12 nt, Homo sapiens
gaaauaauguga

SEQ ID NO: 1762548 - RNA, 16 nt, Homo sapiens
cauucauauuucauau

SEQ ID NO: 1762549 - RNA, 15 nt, Homo sapiens
ucucauuuaagggaa

SEQ ID NO: 1762550 - RNA, 12 nt, Homo sapiens
gugaagccuuua

SEQ ID NO: 1762551 - RNA, 19 nt, Homo sapiens
uacuuacauuuccauuuau

SEQ ID NO: 1762552 - RNA, 13 nt, Homo sapiens
aaaauaaaccaaa

SEQ ID NO: 1762553 - RNA, 23 nt, Homo sapiens
cuauuuauuuauuauaugugcac

SEQ ID NO: 1762554 - RNA, 12 nt, Homo sapiens
auauuuugccac

SEQ ID NO: 1762555 - RNA, 16 nt, Homo sapiens
guauuuuuaguagaga

SEQ ID NO: 1762556 - RNA, 14 nt, Homo sapiens
cagcacuaauucaa

SEQ ID NO: 1762557 - RNA, 14 nt, Homo sapiens
augauucaagccau

SEQ ID NO: 1762558 - RNA, 16 nt, Homo sapiens
caucucccaucuuccu

SEQ ID NO: 1762559 - RNA, 17 nt, Homo sapiens
uuuuaauggaauguggu

SEQ ID NO: 1762560 - RNA, 21 nt, Homo sapiens
aauuguaauuccaaaauccaa

SEQ ID NO: 1762561 - RNA, 20 nt, Homo sapiens
cugggauccgggaucaaagu

SEQ ID NO: 1762562 - RNA, 17 nt, Homo sapiens
uacaagacacagugacc

SEQ ID NO: 1762563 - RNA, 18 nt, Homo sapiens
auaaagcuauguauauaa

SEQ ID NO: 1762564 - RNA, 23 nt, Homo sapiens
acagcaucaaagagauggugcua

SEQ ID NO: 1762565 - RNA, 19 nt, Homo sapiens
uacguuugaaauaguugau

SEQ ID NO: 1762566 - RNA, 16 nt, Homo sapiens
ucucaggccagcugcu

SEQ ID NO: 1762567 - RNA, 14 nt, Homo sapiens
uacucugagcucau

SEQ ID NO: 1762568 - RNA, 17 nt, Homo sapiens
gcuuauauucagucugu

SEQ ID NO: 1762569 - RNA, 23 nt, Homo sapiens
gaauucaccccucccaccucuuu

SEQ ID NO: 1762570 - RNA, 15 nt, Homo sapiens
ugagcacucuacugc

SEQ ID NO: 1762571 - RNA, 15 nt, Homo sapiens
agacgcugcugucac

SEQ ID NO: 1762572 - RNA, 19 nt, Homo sapiens
uggaucuucagaaggcuag

SEQ ID NO: 1762573 - RNA, 15 nt, Homo sapiens
aaauauuuuugccau

SEQ ID NO: 1762574 - RNA, 14 nt, Homo sapiens
cccaacacaggcaa

SEQ ID NO: 1762575 - RNA, 19 nt, Homo sapiens
cuguaauauggcuguauca

SEQ ID NO: 1762576 - RNA, 21 nt, Homo sapiens
uaaacuuucucaaauuauuaa

SEQ ID NO: 1762577 - RNA, 15 nt, Homo sapiens
ucugcaucaguucac

SEQ ID NO: 1762578 - RNA, 16 nt, Homo sapiens
gaaacagccucuccaa

SEQ ID NO: 1762579 - RNA, 13 nt, Homo sapiens
cugcuugguuaaa

SEQ ID NO: 1762580 - RNA, 17 nt, Homo sapiens
cggcuccaucaccagcc

SEQ ID NO: 1762581 - RNA, 15 nt, Homo sapiens
auuuauaagccaaag

SEQ ID NO: 1762582 - RNA, 20 nt, Homo sapiens
cucaugcggcccagccaugg

SEQ ID NO: 1762583 - RNA, 16 nt, Homo sapiens
uaaaaguugaucauaa

SEQ ID NO: 1762584 - RNA, 21 nt, Homo sapiens
acuuguuagaucaaccuccaa

SEQ ID NO: 1762585 - RNA, 20 nt, Homo sapiens
cugaagauugcgguuuacag

SEQ ID NO: 1762586 - RNA, 14 nt, Homo sapiens
uaugugaugccucu

SEQ ID NO: 1762587 - RNA, 16 nt, Homo sapiens
uguugcaaacuaugca

SEQ ID NO: 1762588 - RNA, 15 nt, Homo sapiens
ggaaauaacugccuu

SEQ ID NO: 1762589 - RNA, 17 nt, Homo sapiens
uagcagacaugccacac

SEQ ID NO: 1762590 - RNA, 12 nt, Homo sapiens
cauuuaugugcu

SEQ ID NO: 1762591 - RNA, 16 nt, Homo sapiens
cgugugggcaauguuc

SEQ ID NO: 1762592 - RNA, 23 nt, Homo sapiens
aggcucguguuugcuacaaauag

SEQ ID NO: 1762593 - RNA, 21 nt, Homo sapiens
ugccgaagaugagacugccca

SEQ ID NO: 1762594 - RNA, 15 nt, Homo sapiens
uccaacaucccuuau

SEQ ID NO: 1762595 - RNA, 16 nt, Homo sapiens
agucauuuccuacccu

SEQ ID NO: 1762596 - RNA, 17 nt, Homo sapiens
cugccucugccucccaa

SEQ ID NO: 1762597 - RNA, 15 nt, Homo sapiens
ugccuggccuggcac

SEQ ID NO: 1762598 - RNA, 17 nt, Homo sapiens
uugucaacaaaccaagc

SEQ ID NO: 1762599 - RNA, 23 nt, Homo sapiens
aacugcauaagugaaaaucuuac

SEQ ID NO: 1762600 - RNA, 14 nt, Homo sapiens
ucuaaaggcuugau

SEQ ID NO: 1762601 - RNA, 14 nt, Homo sapiens
aaagacugcauuua

SEQ ID NO: 1762602 - RNA, 19 nt, Homo sapiens
uaauaaaauagucacugcc

SEQ ID NO: 1762603 - RNA, 17 nt, Homo sapiens
ugcagacgggcaagaag

SEQ ID NO: 1762604 - RNA, 19 nt, Homo sapiens
aaaugacauuucacuaaaa

SEQ ID NO: 1762605 - RNA, 18 nt, Homo sapiens
accggcucucaccuggcc

SEQ ID NO: 1762606 - RNA, 16 nt, Homo sapiens
aaagaaagcugugaaa

SEQ ID NO: 1762607 - RNA, 20 nt, Homo sapiens
cauuaauaccuaaacuguau

SEQ ID NO: 1762608 - RNA, 14 nt, Homo sapiens
aggcagggucucac

SEQ ID NO: 1762609 - RNA, 19 nt, Homo sapiens
accacuuugucucugagaa

SEQ ID NO: 1762610 - RNA, 20 nt, Homo sapiens
auaggaauguccaccaugaa

SEQ ID NO: 1762611 - RNA, 14 nt, Homo sapiens
ggcauagaugcagg

SEQ ID NO: 1762612 - RNA, 18 nt, Homo sapiens
agcauuuuugcacuggau

SEQ ID NO: 1762613 - RNA, 18 nt, Homo sapiens
uaauauuucaagugccua

SEQ ID NO: 1762614 - RNA, 22 nt, Homo sapiens
gacucuuuaauaaauugcuuac

SEQ ID NO: 1762615 - RNA, 21 nt, Homo sapiens
caaugcacccccaaccuccau

SEQ ID NO: 1762616 - RNA, 20 nt, Homo sapiens
auacauaaaacaaaagcauu

SEQ ID NO: 1762617 - RNA, 20 nt, Homo sapiens
uccagcaagcagugcccucu

SEQ ID NO: 1762618 - RNA, 15 nt, Homo sapiens
guauaaauaagcacu

SEQ ID NO: 1762619 - RNA, 18 nt, Homo sapiens
ucaugggucugcccuuga

SEQ ID NO: 1762620 - RNA, 23 nt, Homo sapiens
ccaccgguguccuguuccugcca

SEQ ID NO: 1762621 - RNA, 13 nt, Homo sapiens
gaaguccagagcu

SEQ ID NO: 1762622 - RNA, 22 nt, Homo sapiens
uccuggggccugugcacuguug

SEQ ID NO: 1762623 - RNA, 12 nt, Homo sapiens
aaggacacaaac

SEQ ID NO: 1762624 - RNA, 15 nt, Homo sapiens
ucccaaagcaucccu

SEQ ID NO: 1762625 - RNA, 15 nt, Homo sapiens
cguaauuaaauccaa

SEQ ID NO: 1762626 - RNA, 12 nt, Homo sapiens
gacacaguauug

SEQ ID NO: 1762627 - RNA, 20 nt, Homo sapiens
gaccauaagagaaaccugcc

SEQ ID NO: 1762628 - RNA, 19 nt, Homo sapiens
gagggggcuugaagccaaa

SEQ ID NO: 1762629 - RNA, 18 nt, Homo sapiens
cugugauacgaugcuuca

SEQ ID NO: 1762630 - RNA, 15 nt, Homo sapiens
cugaaaacuggaaua

SEQ ID NO: 1762631 - RNA, 14 nt, Homo sapiens
ggcugcugcaguga

SEQ ID NO: 1762632 - RNA, 21 nt, Homo sapiens
uauccuuucauuaggcaaagu

SEQ ID NO: 1762633 - RNA, 18 nt, Homo sapiens
cucucuggacuuucucca

SEQ ID NO: 1762634 - RNA, 15 nt, Homo sapiens
aaucauaaauacugc

SEQ ID NO: 1762635 - RNA, 22 nt, Homo sapiens
ucaacagaagggauaccgucuc

SEQ ID NO: 1762636 - RNA, 14 nt, Homo sapiens
accgagagccaaac

SEQ ID NO: 1762637 - RNA, 20 nt, Homo sapiens
ucuuggccaaagaccaaauu

SEQ ID NO: 1762638 - RNA, 14 nt, Homo sapiens
uguaauugcuacau

SEQ ID NO: 1762639 - RNA, 17 nt, Homo sapiens
cggcugcauacccgggc

SEQ ID NO: 1762640 - RNA, 23 nt, Homo sapiens
ucacacacacccccccacaagga

SEQ ID NO: 1762641 - RNA, 15 nt, Homo sapiens
uagacuacaguucug

SEQ ID NO: 1762642 - RNA, 16 nt, Homo sapiens
ucaacaccacuaggaa

SEQ ID NO: 1762643 - RNA, 16 nt, Homo sapiens
uguugaaaguugcagu

SEQ ID NO: 1762644 - RNA, 22 nt, Homo sapiens
aaagaagcugcuguucuuagca

SEQ ID NO: 1762645 - RNA, 12 nt, Homo sapiens
ucggcuugauca

SEQ ID NO: 1762646 - RNA, 22 nt, Homo sapiens
gauauuucccaauacauaccac

SEQ ID NO: 1762647 - RNA, 20 nt, Homo sapiens
acuucagagacuaucugauu

SEQ ID NO: 1762648 - RNA, 15 nt, Homo sapiens
aggcugaacuggauu

SEQ ID NO: 1762649 - RNA, 19 nt, Homo sapiens
gaacucauuugaaugcuua

SEQ ID NO: 1762650 - RNA, 12 nt, Homo sapiens
gcuuuaugcaaa

SEQ ID NO: 1762651 - RNA, 13 nt, Homo sapiens
acaaauuguuaag

SEQ ID NO: 1762652 - RNA, 18 nt, Homo sapiens
gauuauuuuuuauacugu

SEQ ID NO: 1762653 - RNA, 18 nt, Homo sapiens
cccaggccagagugcagu

SEQ ID NO: 1762654 - RNA, 22 nt, Homo sapiens
agcugcgggcacccauccgcuc

SEQ ID NO: 1762655 - RNA, 21 nt, Homo sapiens
ggcuucccugucuauugccuu

SEQ ID NO: 1762656 - RNA, 16 nt, Homo sapiens
ucggcuggccagcuga

SEQ ID NO: 1762657 - RNA, 20 nt, Homo sapiens
cucuucagagcaagcacugg

SEQ ID NO: 1762658 - RNA, 18 nt, Homo sapiens
gggaaagcuucauucucc

SEQ ID NO: 1762659 - RNA, 14 nt, Homo sapiens
auugcuaguuuaaa

SEQ ID NO: 1762660 - RNA, 15 nt, Homo sapiens
caagucauucucacc

SEQ ID NO: 1762661 - RNA, 15 nt, Homo sapiens
uaagaauaauggacu

SEQ ID NO: 1762662 - RNA, 14 nt, Homo sapiens
gaaagaacugucau

SEQ ID NO: 1762663 - RNA, 20 nt, Homo sapiens
ccaaaaagagcagcacagga

SEQ ID NO: 1762664 - RNA, 15 nt, Homo sapiens
uaauacaucaaagag

SEQ ID NO: 1762665 - RNA, 23 nt, Homo sapiens
gcugagguugggaaggcaccugc

SEQ ID NO: 1762666 - RNA, 19 nt, Homo sapiens
uuacagcugagcacauucu

SEQ ID NO: 1762667 - RNA, 19 nt, Homo sapiens
gugguguuaaucauuucau

SEQ ID NO: 1762668 - RNA, 21 nt, Homo sapiens
caacaugaugaaaucccaucu

SEQ ID NO: 1762669 - RNA, 23 nt, Homo sapiens
cugaccugugcacaccccacucc

SEQ ID NO: 1762670 - RNA, 18 nt, Homo sapiens
guuuuuguuuuuugccau

SEQ ID NO: 1762671 - RNA, 19 nt, Homo sapiens
cauguuuuuaaagggcuau

SEQ ID NO: 1762672 - RNA, 22 nt, Homo sapiens
uuauacucaccugcguuuucau

SEQ ID NO: 1762673 - RNA, 15 nt, Homo sapiens
gcuuuggcaacagaa

SEQ ID NO: 1762674 - RNA, 14 nt, Homo sapiens
uuauuuccugcuua

SEQ ID NO: 1762675 - RNA, 21 nt, Homo sapiens
cucagcggagccgcagacugu

SEQ ID NO: 1762676 - RNA, 22 nt, Homo sapiens
aagugaagagugacuaguacaa

SEQ ID NO: 1762677 - RNA, 17 nt, Homo sapiens
aagauuuaauuugccaa

SEQ ID NO: 1762678 - RNA, 23 nt, Homo sapiens
aaguuucauaccaaauauuugaa

SEQ ID NO: 1762679 - RNA, 21 nt, Homo sapiens
aaauccuuuuaaaucuugaua

SEQ ID NO: 1762680 - RNA, 21 nt, Homo sapiens
agcugcuacaaagaagacaug

SEQ ID NO: 1762681 - RNA, 21 nt, Homo sapiens
cacaaauugugaagauuucau

SEQ ID NO: 1762682 - RNA, 12 nt, Homo sapiens
gcaucuacucua

SEQ ID NO: 1762683 - RNA, 15 nt, Homo sapiens
ugcccaauaugcagu

SEQ ID NO: 1762684 - RNA, 20 nt, Homo sapiens
gauucagacuuggacuauga

SEQ ID NO: 1762685 - RNA, 18 nt, Homo sapiens
uucuggacacugucauaa

SEQ ID NO: 1762686 - RNA, 14 nt, Homo sapiens
uuuaugagcucuuc

SEQ ID NO: 1762687 - RNA, 23 nt, Homo sapiens
uuuucuaaaacagggauuuugaa

SEQ ID NO: 1762688 - RNA, 21 nt, Homo sapiens
caaguugugacagucacugca

SEQ ID NO: 1762689 - RNA, 16 nt, Homo sapiens
cgcuacaagaggccac

SEQ ID NO: 1762690 - RNA, 11 nt, Homo sapiens
acuugcacaaa

SEQ ID NO: 1762691 - RNA, 18 nt, Homo sapiens
uuacaagagagugaaauu

SEQ ID NO: 1762692 - RNA, 23 nt, Homo sapiens
aauaacgauaaaagacagugaaa

SEQ ID NO: 1762693 - RNA, 22 nt, Homo sapiens
ggaucauguaaaugcucaaaga

SEQ ID NO: 1762694 - RNA, 17 nt, Homo sapiens
acugacugccuugcuaa

SEQ ID NO: 1762695 - RNA, 13 nt, Homo sapiens
uaauauguugacu

SEQ ID NO: 1762696 - RNA, 19 nt, Homo sapiens
gcuuguaaugcucacuuau

SEQ ID NO: 1762697 - RNA, 12 nt, Homo sapiens
ccaaaauuugau

SEQ ID NO: 1762698 - RNA, 13 nt, Homo sapiens
ucacccugccuua

SEQ ID NO: 1762699 - RNA, 14 nt, Homo sapiens
agaagagacuggga

SEQ ID NO: 1762700 - RNA, 18 nt, Homo sapiens
caaagccugcguucucau

SEQ ID NO: 1762701 - RNA, 21 nt, Homo sapiens
aagucuuuauuauuuacuuug

SEQ ID NO: 1762702 - RNA, 15 nt, Homo sapiens
cucuccaacucccuc

SEQ ID NO: 1762703 - RNA, 18 nt, Homo sapiens
ucauucccccaccuaucc

SEQ ID NO: 1762704 - RNA, 21 nt, Homo sapiens
gcauuuuguggcugauuucaa

SEQ ID NO: 1762705 - RNA, 15 nt, Homo sapiens
ugugaagacaaguag

SEQ ID NO: 1762706 - RNA, 19 nt, Homo sapiens
agcugcugugaacauuugu

SEQ ID NO: 1762707 - RNA, 13 nt, Homo sapiens
uucccgacaccag

SEQ ID NO: 1762708 - RNA, 23 nt, Homo sapiens
uaccauuuuuuaaggaaacaaua

SEQ ID NO: 1762709 - RNA, 20 nt, Homo sapiens
uguucuguuuggcacuugua

SEQ ID NO: 1762710 - RNA, 15 nt, Homo sapiens
agcugugacuucuau

SEQ ID NO: 1762711 - RNA, 15 nt, Homo sapiens
acacggacugugcau

SEQ ID NO: 1762712 - RNA, 14 nt, Homo sapiens
uaccaugccucucc

SEQ ID NO: 1762713 - RNA, 14 nt, Homo sapiens
cacugcuccagugg

SEQ ID NO: 1762714 - RNA, 16 nt, Homo sapiens
guaguuuucaaaacac

SEQ ID NO: 1762715 - RNA, 21 nt, Homo sapiens
uggcagcggguggcauccagg

SEQ ID NO: 1762716 - RNA, 22 nt, Homo sapiens
ggccuuauaucauuucauauaa

SEQ ID NO: 1762717 - RNA, 14 nt, Homo sapiens
aucuaccauugaag

SEQ ID NO: 1762718 - RNA, 19 nt, Homo sapiens
caaucuuaaaacaaauuca

SEQ ID NO: 1762719 - RNA, 16 nt, Homo sapiens
cacaggaauucucaag

SEQ ID NO: 1762720 - RNA, 15 nt, Homo sapiens
cuuuauauaucugcu

SEQ ID NO: 1762721 - RNA, 14 nt, Homo sapiens
gccaucccuguguc

SEQ ID NO: 1762722 - RNA, 22 nt, Homo sapiens
caacagaaugaaaaaugaaaga

SEQ ID NO: 1762723 - RNA, 12 nt, Homo sapiens
uaagaaggugcg

SEQ ID NO: 1762724 - RNA, 12 nt, Homo sapiens
cuaaaaaagcau

SEQ ID NO: 1762725 - RNA, 18 nt, Homo sapiens
ugaaauuuugcaccagcg

SEQ ID NO: 1762726 - RNA, 21 nt, Homo sapiens
caaaaccaaugcugaugaccu

SEQ ID NO: 1762727 - RNA, 16 nt, Homo sapiens
augauuaauacaauau

SEQ ID NO: 1762728 - RNA, 21 nt, Homo sapiens
agacaagcuguauaaacagaa

SEQ ID NO: 1762729 - RNA, 13 nt, Homo sapiens
uaaagagcacugg

SEQ ID NO: 1762730 - RNA, 17 nt, Homo sapiens
agucucacauuucucaa

SEQ ID NO: 1762731 - RNA, 15 nt, Homo sapiens
cagaucguacuugaa

SEQ ID NO: 1762732 - RNA, 21 nt, Homo sapiens
cacuugggagcugcugggcua

SEQ ID NO: 1762733 - RNA, 21 nt, Homo sapiens
aaauaguuuggauuacuuaaa

SEQ ID NO: 1762734 - RNA, 17 nt, Homo sapiens
aaugcauuuucugggug

SEQ ID NO: 1762735 - RNA, 16 nt, Homo sapiens
gguguacuguacugaa

SEQ ID NO: 1762736 - RNA, 22 nt, Homo sapiens
acacccccaccccuugcucuca

SEQ ID NO: 1762737 - RNA, 15 nt, Homo sapiens
ggauccaggcauuuc

SEQ ID NO: 1762738 - RNA, 22 nt, Homo sapiens
acggacagcguguggcaguguu

SEQ ID NO: 1762739 - RNA, 19 nt, Homo sapiens
acuuaaccagcacauuucu

SEQ ID NO: 1762740 - RNA, 16 nt, Homo sapiens
agcauaacuguucuca

SEQ ID NO: 1762741 - RNA, 20 nt, Homo sapiens
guaaauggaacaaacaauga

SEQ ID NO: 1762742 - RNA, 15 nt, Homo sapiens
gccacuggcuucaca

SEQ ID NO: 1762743 - RNA, 17 nt, Homo sapiens
cugcauugaguccagcu

SEQ ID NO: 1762744 - RNA, 18 nt, Homo sapiens
aggggugauucugaaacc

SEQ ID NO: 1762745 - RNA, 15 nt, Homo sapiens
ucaggagcacagcca

SEQ ID NO: 1762746 - RNA, 17 nt, Homo sapiens
cuguacauagccuauau

SEQ ID NO: 1762747 - RNA, 19 nt, Homo sapiens
cccuguacaguuugcuuau

SEQ ID NO: 1762748 - RNA, 16 nt, Homo sapiens
uugaaaauaaccuaau

SEQ ID NO: 1762749 - RNA, 18 nt, Homo sapiens
auuggucauaacucagcc

SEQ ID NO: 1762750 - RNA, 15 nt, Homo sapiens
uguuggcaaacgaga

SEQ ID NO: 1762751 - RNA, 12 nt, Homo sapiens
aaaaauuacuua

SEQ ID NO: 1762752 - RNA, 21 nt, Homo sapiens
cagggcucaugauuuuuuaca

SEQ ID NO: 1762753 - RNA, 18 nt, Homo sapiens
guaauaccugauugauca

SEQ ID NO: 1762754 - RNA, 22 nt, Homo sapiens
ccucucuugauucucuccuacu

SEQ ID NO: 1762755 - RNA, 15 nt, Homo sapiens
cuacagagcagccag

SEQ ID NO: 1762756 - RNA, 13 nt, Homo sapiens
aaguuccaaaaau

SEQ ID NO: 1762757 - RNA, 19 nt, Homo sapiens
gcauacuuugacaaggaaa

SEQ ID NO: 1762758 - RNA, 20 nt, Homo sapiens
cucuguagagcaugguucca

SEQ ID NO: 1762759 - RNA, 19 nt, Homo sapiens
cccugucccuagcucacac

SEQ ID NO: 1762760 - RNA, 21 nt, Homo sapiens
ucagugcuucgcagauguccu

SEQ ID NO: 1762761 - RNA, 18 nt, Homo sapiens
guauugaaauguuugcau

SEQ ID NO: 1762762 - RNA, 19 nt, Homo sapiens
gaucugcaacuacuaucca

SEQ ID NO: 1762763 - RNA, 11 nt, Homo sapiens
acaagauuccc

SEQ ID NO: 1762764 - RNA, 19 nt, Homo sapiens
gucucuucuuaacccugaa

SEQ ID NO: 1762765 - RNA, 17 nt, Homo sapiens
ucuguccccugcuacua

SEQ ID NO: 1762766 - RNA, 13 nt, Homo sapiens
auuaaccucagca

SEQ ID NO: 1762767 - RNA, 15 nt, Homo sapiens
auucaucaaauggaa

SEQ ID NO: 1762768 - RNA, 19 nt, Homo sapiens
auauauuauuuuacugcuu

SEQ ID NO: 1762769 - RNA, 17 nt, Homo sapiens
cuguccuuucuugcaga

SEQ ID NO: 1762770 - RNA, 14 nt, Homo sapiens
uacaucuguuccag

SEQ ID NO: 1762771 - RNA, 14 nt, Homo sapiens
ugucuggcuucuag

SEQ ID NO: 1762772 - RNA, 23 nt, Homo sapiens
aucacuagccaugauaacugcaa

SEQ ID NO: 1762773 - RNA, 22 nt, Homo sapiens
acucuucaaggaggcccacugu

SEQ ID NO: 1762774 - RNA, 12 nt, Homo sapiens
uaaagauuuauc

SEQ ID NO: 1762775 - RNA, 16 nt, Homo sapiens
acaaucccagcaucug

SEQ ID NO: 1762776 - RNA, 21 nt, Homo sapiens
uuaauguuuauuaauguuuac

SEQ ID NO: 1762777 - RNA, 19 nt, Homo sapiens
ccuauuacuguuucuggag

SEQ ID NO: 1762778 - RNA, 16 nt, Homo sapiens
ucacaauuaggcuuca

SEQ ID NO: 1762779 - RNA, 16 nt, Homo sapiens
cuaugcccacuuuaga

SEQ ID NO: 1762780 - RNA, 16 nt, Homo sapiens
uuccauuuuacuucca

SEQ ID NO: 1762781 - RNA, 19 nt, Homo sapiens
ugugaaauaccaaccugaa

SEQ ID NO: 1762782 - RNA, 15 nt, Homo sapiens
acuuucauagcacug

SEQ ID NO: 1762783 - RNA, 13 nt, Homo sapiens
gcagcucacccag

SEQ ID NO: 1762784 - RNA, 21 nt, Homo sapiens
cacagaaacggucuuuaugaa

SEQ ID NO: 1762785 - RNA, 21 nt, Homo sapiens
aagaaguuuggcaguauuuaa

SEQ ID NO: 1762786 - RNA, 23 nt, Homo sapiens
uuucccauuuuggaaccuaauaa

SEQ ID NO: 1762787 - RNA, 20 nt, Homo sapiens
uggaugguggacccuacuau

SEQ ID NO: 1762788 - RNA, 19 nt, Homo sapiens
caguguauagaaaaaccaa

SEQ ID NO: 1762789 - RNA, 20 nt, Homo sapiens
gcaucauuuucaccuccauu

SEQ ID NO: 1762790 - RNA, 11 nt, Homo sapiens
aaagcauuauc

SEQ ID NO: 1762791 - RNA, 22 nt, Homo sapiens
uuuuauaccuguacacacacag

SEQ ID NO: 1762792 - RNA, 17 nt, Homo sapiens
ucuccagaaagcuaaaa

SEQ ID NO: 1762793 - RNA, 12 nt, Homo sapiens
uauaaaacacau

SEQ ID NO: 1762794 - RNA, 16 nt, Homo sapiens
guuuugacaucaauga

SEQ ID NO: 1762795 - RNA, 12 nt, Homo sapiens
uuaaguuuugau

SEQ ID NO: 1762796 - RNA, 21 nt, Homo sapiens
cauucccugagucaccaggaa

SEQ ID NO: 1762797 - RNA, 14 nt, Homo sapiens
ucugucaacaucaa

SEQ ID NO: 1762798 - RNA, 17 nt, Homo sapiens
agcccugucagcaugaa

SEQ ID NO: 1762799 - RNA, 14 nt, Homo sapiens
auuuucuaauuuca

SEQ ID NO: 1762800 - RNA, 22 nt, Homo sapiens
cauguuggucaggcuggucuca

SEQ ID NO: 1762801 - RNA, 16 nt, Homo sapiens
aaagcaugugucaugc

SEQ ID NO: 1762802 - RNA, 19 nt, Homo sapiens
guauagaacuggauuuuca

SEQ ID NO: 1762803 - RNA, 16 nt, Homo sapiens
ggaaaaggcuggcaag

SEQ ID NO: 1762804 - RNA, 14 nt, Homo sapiens
agcaccccuugccg

SEQ ID NO: 1762805 - RNA, 19 nt, Homo sapiens
aagaacauuuugccugauu

SEQ ID NO: 1762806 - RNA, 13 nt, Homo sapiens
agaucacugccac

SEQ ID NO: 1762807 - RNA, 17 nt, Homo sapiens
uuuaguacuuacaucag

SEQ ID NO: 1762808 - RNA, 16 nt, Homo sapiens
aagagaccacuuccuu

SEQ ID NO: 1762809 - RNA, 15 nt, Homo sapiens
ugaacauccuuccuu

SEQ ID NO: 1762810 - RNA, 13 nt, Homo sapiens
uaaaaaacacugg

SEQ ID NO: 1762811 - RNA, 17 nt, Homo sapiens
uaguauuccauggugua

SEQ ID NO: 1762812 - RNA, 14 nt, Homo sapiens
caugaugagaguuu

SEQ ID NO: 1762813 - RNA, 13 nt, Homo sapiens
ucguguccugcua

SEQ ID NO: 1762814 - RNA, 17 nt, Homo sapiens
ccuuccaugcaaaggcu

SEQ ID NO: 1762815 - RNA, 12 nt, Homo sapiens
acuuauuaccua

SEQ ID NO: 1762816 - RNA, 14 nt, Homo sapiens
agaggguguuugca

SEQ ID NO: 1762817 - RNA, 13 nt, Homo sapiens
cucugcaguauuu

SEQ ID NO: 1762818 - RNA, 15 nt, Homo sapiens
ucauacuguacacau

SEQ ID NO: 1762819 - RNA, 18 nt, Homo sapiens
ccuuucuaaauugcauga

SEQ ID NO: 1762820 - RNA, 15 nt, Homo sapiens
ucccccaggugcagu

SEQ ID NO: 1762821 - RNA, 20 nt, Homo sapiens
cgaggccccugucucagggu

SEQ ID NO: 1762822 - RNA, 21 nt, Homo sapiens
aaaaauggaaacuauauugac

SEQ ID NO: 1762823 - RNA, 16 nt, Homo sapiens
cccaaggaugcuguca

SEQ ID NO: 1762824 - RNA, 22 nt, Homo sapiens
caugcagcggccugagcaguac

SEQ ID NO: 1762825 - RNA, 23 nt, Homo sapiens
auaucuuuuaauuguguauuuaa

SEQ ID NO: 1762826 - RNA, 22 nt, Homo sapiens
uuacaggugugagccaccgugc

SEQ ID NO: 1762827 - RNA, 23 nt, Homo sapiens
cccccgugaggaugucacucaga

SEQ ID NO: 1762828 - RNA, 17 nt, Homo sapiens
auuaaugaacugugaca

SEQ ID NO: 1762829 - RNA, 15 nt, Homo sapiens
ugguuccaucacugc

SEQ ID NO: 1762830 - RNA, 23 nt, Homo sapiens
uauuuacaaauguuuugcucaau

SEQ ID NO: 1762831 - RNA, 22 nt, Homo sapiens
gagcucaccccagguucucacc

SEQ ID NO: 1762832 - RNA, 13 nt, Homo sapiens
uccuggugucacc

SEQ ID NO: 1762833 - RNA, 23 nt, Homo sapiens
uucagagacuggcagccagggag

SEQ ID NO: 1762834 - RNA, 23 nt, Homo sapiens
auucuucaaccucauugacaaga

SEQ ID NO: 1762835 - RNA, 15 nt, Homo sapiens
uugguaaauucacaa

SEQ ID NO: 1762836 - RNA, 12 nt, Homo sapiens
auuccuauuuaa

SEQ ID NO: 1762837 - RNA, 16 nt, Homo sapiens
aagucucaauuaacag

SEQ ID NO: 1762838 - RNA, 20 nt, Homo sapiens
ccagagcugggaggcauggc

SEQ ID NO: 1762839 - RNA, 16 nt, Homo sapiens
uuguaccauucaccgu

SEQ ID NO: 1762840 - RNA, 21 nt, Homo sapiens
cuuaugcaaucuauguuugca

SEQ ID NO: 1762841 - RNA, 14 nt, Homo sapiens
ucaacuucaggaaa

SEQ ID NO: 1762842 - RNA, 18 nt, Homo sapiens
acacacagagauaugcac

SEQ ID NO: 1762843 - RNA, 20 nt, Homo sapiens
gauguuuacagugucugugu

SEQ ID NO: 1762844 - RNA, 18 nt, Homo sapiens
agccaaagauaaucucuc

SEQ ID NO: 1762845 - RNA, 21 nt, Homo sapiens
agccuccuugccuggaacuca

SEQ ID NO: 1762846 - RNA, 15 nt, Homo sapiens
aaaacuacaagccac

SEQ ID NO: 1762847 - RNA, 22 nt, Homo sapiens
cuucguuuacuaugccuguguc

SEQ ID NO: 1762848 - RNA, 12 nt, Homo sapiens
aagguuaauuca

SEQ ID NO: 1762849 - RNA, 19 nt, Homo sapiens
acuucagccuuuaaugccu

SEQ ID NO: 1762850 - RNA, 19 nt, Homo sapiens
cagagaggaccuaucccaa

SEQ ID NO: 1762851 - RNA, 15 nt, Homo sapiens
gucuucagcaaaaaa

SEQ ID NO: 1762852 - RNA, 15 nt, Homo sapiens
aaccagaauagauaa

SEQ ID NO: 1762853 - RNA, 17 nt, Homo sapiens
ucccugugccucuuccc

SEQ ID NO: 1762854 - RNA, 14 nt, Homo sapiens
aaguuacauuguua

SEQ ID NO: 1762855 - RNA, 14 nt, Homo sapiens
uaccugccaugcau

SEQ ID NO: 1762856 - RNA, 21 nt, Homo sapiens
aaaugucagaaaauaacagau

SEQ ID NO: 1762857 - RNA, 12 nt, Homo sapiens
gccaagacuccu

SEQ ID NO: 1762858 - RNA, 13 nt, Homo sapiens
acaauaaauacag

SEQ ID NO: 1762859 - RNA, 15 nt, Homo sapiens
aauucauucauuuca

SEQ ID NO: 1762860 - RNA, 13 nt, Homo sapiens
uucaguaauaacu

SEQ ID NO: 1762861 - RNA, 19 nt, Homo sapiens
guccugcuacccaguaaaa

SEQ ID NO: 1762862 - RNA, 21 nt, Homo sapiens
ccgggaggacagcugccuguu

SEQ ID NO: 1762863 - RNA, 15 nt, Homo sapiens
uuaugguaguaccau

SEQ ID NO: 1762864 - RNA, 15 nt, Homo sapiens
uggaccagugaccaa

SEQ ID NO: 1762865 - RNA, 13 nt, Homo sapiens
uuucucagcauau

SEQ ID NO: 1762866 - RNA, 17 nt, Homo sapiens
ccagcuagugccaaaua

SEQ ID NO: 1762867 - RNA, 19 nt, Homo sapiens
agggcacucucugccagcu

SEQ ID NO: 1762868 - RNA, 18 nt, Homo sapiens
uuaggaaaugucaucaaa

SEQ ID NO: 1762869 - RNA, 13 nt, Homo sapiens
acauaaacuguca

SEQ ID NO: 1762870 - RNA, 17 nt, Homo sapiens
gucagaaggagcuacaa

SEQ ID NO: 1762871 - RNA, 19 nt, Homo sapiens
cuucuuucccuuagugacu

SEQ ID NO: 1762872 - RNA, 16 nt, Homo sapiens
gcuggggccaacugga

SEQ ID NO: 1762873 - RNA, 16 nt, Homo sapiens
cugcugaacacagugu

SEQ ID NO: 1762874 - RNA, 16 nt, Homo sapiens
acuugccaugugacuc

SEQ ID NO: 1762875 - RNA, 18 nt, Homo sapiens
cuccuaggaaaccagcuc

SEQ ID NO: 1762876 - RNA, 22 nt, Homo sapiens
caggcuagagugcaauggugca

SEQ ID NO: 1762877 - RNA, 19 nt, Homo sapiens
guggcugugccaccaagca

SEQ ID NO: 1762878 - RNA, 19 nt, Homo sapiens
aaaauuuuccuuuuagucu

SEQ ID NO: 1762879 - RNA, 23 nt, Homo sapiens
uaggugaccaugagaauugcugu

SEQ ID NO: 1762880 - RNA, 21 nt, Homo sapiens
uccaucuucagaccuuuggac

SEQ ID NO: 1762881 - RNA, 21 nt, Homo sapiens
cauugguacacguguaacaag

SEQ ID NO: 1762882 - RNA, 16 nt, Homo sapiens
agaggaagaaaaccag

SEQ ID NO: 1762883 - RNA, 12 nt, Homo sapiens
gcacugcaguua

SEQ ID NO: 1762884 - RNA, 12 nt, Homo sapiens
cagcugcugaaa

SEQ ID NO: 1762885 - RNA, 15 nt, Homo sapiens
uuauucauaauguga

SEQ ID NO: 1762886 - RNA, 14 nt, Homo sapiens
aagcagucgugccu

SEQ ID NO: 1762887 - RNA, 14 nt, Homo sapiens
agggucacuggccu

SEQ ID NO: 1762888 - RNA, 15 nt, Homo sapiens
acagaaacgcaucca

SEQ ID NO: 1762889 - RNA, 12 nt, Homo sapiens
aagucacauaua

SEQ ID NO: 1762890 - RNA, 12 nt, Homo sapiens
augucacauuua

SEQ ID NO: 1762891 - RNA, 12 nt, Homo sapiens
uugucacaauua

SEQ ID NO: 1762892 - RNA, 21 nt, Homo sapiens
uagaauucacuccacuuggac

SEQ ID NO: 1762893 - RNA, 11 nt, Homo sapiens
ugcuauauucc

SEQ ID NO: 1762894 - RNA, 18 nt, Homo sapiens
uucagucucuauaccaau

SEQ ID NO: 1762895 - RNA, 13 nt, Homo sapiens
cucguuagccuuc

SEQ ID NO: 1762896 - RNA, 22 nt, Homo sapiens
gagacagaaagcagaacaguga

SEQ ID NO: 1762897 - RNA, 20 nt, Homo sapiens
aguccaggcgccuggagcaa

SEQ ID NO: 1762898 - RNA, 23 nt, Homo sapiens
agccucuugagcugaaguaaugu

SEQ ID NO: 1762899 - RNA, 13 nt, Homo sapiens
uacuuuugcuuca

SEQ ID NO: 1762900 - RNA, 13 nt, Homo sapiens
uuucauugcacuu

SEQ ID NO: 1762901 - RNA, 15 nt, Homo sapiens
ggaggggccuuugcu

SEQ ID NO: 1762902 - RNA, 18 nt, Homo sapiens
uuauaggacgaaugccaa

SEQ ID NO: 1762903 - RNA, 16 nt, Homo sapiens
uucaacuggcuacuga

SEQ ID NO: 1762904 - RNA, 15 nt, Homo sapiens
ggagaaacccagaga

SEQ ID NO: 1762905 - RNA, 12 nt, Homo sapiens
uucauuuguaug

SEQ ID NO: 1762906 - RNA, 22 nt, Homo sapiens
gcuggcuuugcacuugaccuca

SEQ ID NO: 1762907 - RNA, 20 nt, Homo sapiens
agugcgugguauaaucucca

SEQ ID NO: 1762908 - RNA, 19 nt, Homo sapiens
ccagcuuuucuugccagcu

SEQ ID NO: 1762909 - RNA, 12 nt, Homo sapiens
gggaaaaccaaa

SEQ ID NO: 1762910 - RNA, 22 nt, Homo sapiens
ucccauuguggcuccuaucugu

SEQ ID NO: 1762911 - RNA, 12 nt, Homo sapiens
aaaaacuuccau

SEQ ID NO: 1762912 - RNA, 20 nt, Homo sapiens
auggugucugugacauuucc

SEQ ID NO: 1762913 - RNA, 22 nt, Homo sapiens
acugccuuccucucucuaccag

SEQ ID NO: 1762914 - RNA, 19 nt, Homo sapiens
agucugauccauccaucuc

SEQ ID NO: 1762915 - RNA, 11 nt, Homo sapiens
gucuuguucug

SEQ ID NO: 1762916 - RNA, 19 nt, Homo sapiens
uacuuaauggguacaaugu

SEQ ID NO: 1762917 - RNA, 22 nt, Homo sapiens
aaggcauaugcuggcccauaaa

SEQ ID NO: 1762918 - RNA, 12 nt, Homo sapiens
guuuagaccaag

SEQ ID NO: 1762919 - RNA, 17 nt, Homo sapiens
uuuuacugcccuuucaa

SEQ ID NO: 1762920 - RNA, 20 nt, Homo sapiens
ggcugcaucuuccagucucu

SEQ ID NO: 1762921 - RNA, 12 nt, Homo sapiens
gcuucuugucau

SEQ ID NO: 1762922 - RNA, 17 nt, Homo sapiens
aggacaguugauuucca

SEQ ID NO: 1762923 - RNA, 17 nt, Homo sapiens
gauugcgccugagauac

SEQ ID NO: 1762924 - RNA, 19 nt, Homo sapiens
uaaaauacuauugccucau

SEQ ID NO: 1762925 - RNA, 20 nt, Homo sapiens
aacagcgcuggguccacccc

SEQ ID NO: 1762926 - RNA, 17 nt, Homo sapiens
cagaaaugcauuuguaa

SEQ ID NO: 1762927 - RNA, 20 nt, Homo sapiens
agguauggcagaggugcaag

SEQ ID NO: 1762928 - RNA, 21 nt, Homo sapiens
agcucaguauacuaaugcccu

SEQ ID NO: 1762929 - RNA, 20 nt, Homo sapiens
ucuugccccagugugguuug

SEQ ID NO: 1762930 - RNA, 19 nt, Homo sapiens
cguguucacaccauucucc

SEQ ID NO: 1762931 - RNA, 16 nt, Homo sapiens
gacaugccuuggugcc

SEQ ID NO: 1762932 - RNA, 17 nt, Homo sapiens
ccccugugccuugucac

SEQ ID NO: 1762933 - RNA, 17 nt, Homo sapiens
gagccaguuagacuagu

SEQ ID NO: 1762934 - RNA, 22 nt, Homo sapiens
ggggcaugugcugccuguuguu

SEQ ID NO: 1762935 - RNA, 11 nt, Homo sapiens
auaacaucacu

SEQ ID NO: 1762936 - RNA, 19 nt, Homo sapiens
auuuucagugcaucauuac

SEQ ID NO: 1762937 - RNA, 18 nt, Homo sapiens
accucuguuguccucccc

SEQ ID NO: 1762938 - RNA, 21 nt, Homo sapiens
uuaauuguuuaaaaaccgaau

SEQ ID NO: 1762939 - RNA, 20 nt, Homo sapiens
ucucuaucggggucacuugc

SEQ ID NO: 1762940 - RNA, 14 nt, Homo sapiens
cauucuacugaaca

SEQ ID NO: 1762941 - RNA, 19 nt, Homo sapiens
aguuuagugcccucaucca

SEQ ID NO: 1762942 - RNA, 11 nt, Homo sapiens
gaaaaauggau

SEQ ID NO: 1762943 - RNA, 23 nt, Homo sapiens
aacuuccuuaaaaaagaauacaa

SEQ ID NO: 1762944 - RNA, 16 nt, Homo sapiens
aagugaugucauuuga

SEQ ID NO: 1762945 - RNA, 14 nt, Homo sapiens
auucuucugacaga

SEQ ID NO: 1762946 - RNA, 22 nt, Homo sapiens
uggggaaauguggagaacauuc

SEQ ID NO: 1762947 - RNA, 19 nt, Homo sapiens
ucagcugaauucacuuaag

SEQ ID NO: 1762948 - RNA, 19 nt, Homo sapiens
gaaauaaugguuauaucua

SEQ ID NO: 1762949 - RNA, 13 nt, Homo sapiens
auaacuuaaaaua

SEQ ID NO: 1762950 - RNA, 13 nt, Homo sapiens
cuuucuuacauaa

SEQ ID NO: 1762951 - RNA, 15 nt, Homo sapiens
ucacuaagaauauaa

SEQ ID NO: 1762952 - RNA, 14 nt, Homo sapiens
ccuggcuuugccuc

SEQ ID NO: 1762953 - RNA, 16 nt, Homo sapiens
acccuggaccauucca

SEQ ID NO: 1762954 - RNA, 22 nt, Homo sapiens
gucauucuaggauguggagcua

SEQ ID NO: 1762955 - RNA, 20 nt, Homo sapiens
gugcugauguagugaccaag

SEQ ID NO: 1762956 - RNA, 19 nt, Homo sapiens
accagaaugaaaacuguaa

SEQ ID NO: 1762957 - RNA, 22 nt, Homo sapiens
agcuuguauauacuucacucac

SEQ ID NO: 1762958 - RNA, 17 nt, Homo sapiens
uguuagaucaaccucca

SEQ ID NO: 1762959 - RNA, 24 nt, Homo sapiens
agcaguuggcuggaauguguucac

SEQ ID NO: 1762960 - RNA, 23 nt, Homo sapiens
cugcucugaauauuuuguaauaa

SEQ ID NO: 1762961 - RNA, 12 nt, Homo sapiens
aaaaaaaagccu

SEQ ID NO: 1762962 - RNA, 23 nt, Homo sapiens
uggagccaucccuucggagccaa

SEQ ID NO: 1762963 - RNA, 23 nt, Homo sapiens
uuucuucauguucagucacaugu

SEQ ID NO: 1762964 - RNA, 14 nt, Homo sapiens
acaaaaccacugga

SEQ ID NO: 1762965 - RNA, 21 nt, Homo sapiens
gcacacacacagagauaugca

SEQ ID NO: 1762966 - RNA, 16 nt, Homo sapiens
caccuaaauaaccaau

SEQ ID NO: 1762967 - RNA, 12 nt, Homo sapiens
cucugcuugcau

SEQ ID NO: 1762968 - RNA, 22 nt, Homo sapiens
aaccuaagggggacacauccau

SEQ ID NO: 1762969 - RNA, 20 nt, Homo sapiens
aaagugcugggauuacaggu

SEQ ID NO: 1762970 - RNA, 18 nt, Homo sapiens
aaccaugaaaauagccaa

SEQ ID NO: 1762971 - RNA, 21 nt, Homo sapiens
auacacuuaaugauacauguu

SEQ ID NO: 1762972 - RNA, 17 nt, Homo sapiens
gagugugugcaugugug

SEQ ID NO: 1762973 - RNA, 15 nt, Homo sapiens
cacuuuucaaaagaa

SEQ ID NO: 1762974 - RNA, 15 nt, Homo sapiens
cgauuccucagggcc

SEQ ID NO: 1762975 - RNA, 17 nt, Homo sapiens
cagggaccguccagggg

SEQ ID NO: 1762976 - RNA, 13 nt, Homo sapiens
guuggaacauccu

SEQ ID NO: 1762977 - RNA, 22 nt, Homo sapiens
augcagcucaagagaucccaag

SEQ ID NO: 1762978 - RNA, 15 nt, Homo sapiens
auugggcaggugaaa

SEQ ID NO: 1762979 - RNA, 13 nt, Homo sapiens
aauauuucacauc

SEQ ID NO: 1762980 - RNA, 14 nt, Homo sapiens
guucaugugccucu

SEQ ID NO: 1762981 - RNA, 17 nt, Homo sapiens
guccuuuaaauuuugca

SEQ ID NO: 1762982 - RNA, 16 nt, Homo sapiens
auaccaugugccacac

SEQ ID NO: 1762983 - RNA, 17 nt, Homo sapiens
gaccaccugccagccau

SEQ ID NO: 1762984 - RNA, 14 nt, Homo sapiens
cuuuccccagggug

SEQ ID NO: 1762985 - RNA, 18 nt, Homo sapiens
uggcucuuuuaccaguau

SEQ ID NO: 1762986 - RNA, 21 nt, Homo sapiens
auaaaugucuuaaucaugaga

SEQ ID NO: 1762987 - RNA, 16 nt, Homo sapiens
caggcagauccaggac

SEQ ID NO: 1762988 - RNA, 13 nt, Homo sapiens
uggagggagcucc

SEQ ID NO: 1762989 - RNA, 17 nt, Homo sapiens
guggaucuuugcuacug

SEQ ID NO: 1762990 - RNA, 14 nt, Homo sapiens
acaaggaaauaccc

SEQ ID NO: 1762991 - RNA, 12 nt, Homo sapiens
cuauauugugcc

SEQ ID NO: 1762992 - RNA, 12 nt, Homo sapiens
aaagacaucaaa

SEQ ID NO: 1762993 - RNA, 23 nt, Homo sapiens
accacagugccaccaagcucaca

SEQ ID NO: 1762994 - RNA, 21 nt, Homo sapiens
uaagucaagaucaacauucca

SEQ ID NO: 1762995 - RNA, 13 nt, Homo sapiens
uggcucaucucuu

SEQ ID NO: 1762996 - RNA, 13 nt, Homo sapiens
ugcuucaucugcu

SEQ ID NO: 1762997 - RNA, 15 nt, Homo sapiens
uuugugcucuacugu

SEQ ID NO: 1762998 - RNA, 10 nt, Homo sapiens
agccaaaaaa

SEQ ID NO: 1762999 - RNA, 19 nt, Homo sapiens
uuuucuggaauacaugaaa

SEQ ID NO: 1763000 - RNA, 17 nt, Homo sapiens
ccauucucauguuuaca

SEQ ID NO: 1763001 - RNA, 18 nt, Homo sapiens
uguugaccggcugccguu

SEQ ID NO: 1763002 - RNA, 16 nt, Homo sapiens
gaaaaauaagucacuu

SEQ ID NO: 1763003 - RNA, 18 nt, Homo sapiens
uucugcuguauacuguac

SEQ ID NO: 1763004 - RNA, 23 nt, Homo sapiens
cuuucccauucuguuuggaucua

SEQ ID NO: 1763005 - RNA, 18 nt, Homo sapiens
caaggagccccccaaaga

SEQ ID NO: 1763006 - RNA, 22 nt, Homo sapiens
gccacagcugcuguucucagga

SEQ ID NO: 1763007 - RNA, 21 nt, Homo sapiens
cacagagacacagggcaucca

SEQ ID NO: 1763008 - RNA, 17 nt, Homo sapiens
ugaccaaguaugacaac

SEQ ID NO: 1763009 - RNA, 20 nt, Homo sapiens
cauggcacugacaaugggca

SEQ ID NO: 1763010 - RNA, 23 nt, Homo sapiens
aagucccgcgaaacccggugcau

SEQ ID NO: 1763011 - RNA, 23 nt, Homo sapiens
auacaugucuaucaaacccagac

SEQ ID NO: 1763012 - RNA, 18 nt, Homo sapiens
uccuggggaagagaagga

SEQ ID NO: 1763013 - RNA, 18 nt, Homo sapiens
uccccgaugcugaccuca

SEQ ID NO: 1763014 - RNA, 14 nt, Homo sapiens
aaaaguggcauuuc

SEQ ID NO: 1763015 - RNA, 20 nt, Homo sapiens
ccgagucucuucuccacugg

SEQ ID NO: 1763016 - RNA, 19 nt, Homo sapiens
cacucugcucucaggagau

SEQ ID NO: 1763017 - RNA, 12 nt, Homo sapiens
auuaaaugccac

SEQ ID NO: 1763018 - RNA, 17 nt, Homo sapiens
auauaaagacugccugc

SEQ ID NO: 1763019 - RNA, 19 nt, Homo sapiens
ucucgaacuccugaccuca

SEQ ID NO: 1763020 - RNA, 16 nt, Homo sapiens
ugagaccaggggacca

SEQ ID NO: 1763021 - RNA, 19 nt, Homo sapiens
agaaacaacgcaaaccucu

SEQ ID NO: 1763022 - RNA, 22 nt, Homo sapiens
ugcugaguuuucuauuuuugca

SEQ ID NO: 1763023 - RNA, 18 nt, Homo sapiens
acucagacuguugcacuc

SEQ ID NO: 1763024 - RNA, 18 nt, Homo sapiens
gaggccagccagugaccu

SEQ ID NO: 1763025 - RNA, 21 nt, Homo sapiens
ugauaugcaccaggucucaag

SEQ ID NO: 1763026 - RNA, 18 nt, Homo sapiens
aagccaacaacucugccu

SEQ ID NO: 1763027 - RNA, 22 nt, Homo sapiens
ugaaaacagucccagaaugacc

SEQ ID NO: 1763028 - RNA, 13 nt, Homo sapiens
gcagugaugucac

SEQ ID NO: 1763029 - RNA, 20 nt, Homo sapiens
acaguauucuguaccauagc

SEQ ID NO: 1763030 - RNA, 14 nt, Homo sapiens
uaaaagugcuuugc

SEQ ID NO: 1763031 - RNA, 12 nt, Homo sapiens
ucacuuugccuu

SEQ ID NO: 1763032 - RNA, 21 nt, Homo sapiens
gcaguguaacgaugcacuuug

SEQ ID NO: 1763033 - RNA, 22 nt, Homo sapiens
aauauacuaguccugacacuga

SEQ ID NO: 1763034 - RNA, 17 nt, Homo sapiens
cacaucucugccuggaa

SEQ ID NO: 1763035 - RNA, 12 nt, Homo sapiens
uugauugggaug

SEQ ID NO: 1763036 - RNA, 18 nt, Homo sapiens
aguuucauuuaugauaca

SEQ ID NO: 1763037 - RNA, 22 nt, Homo sapiens
aguuuuuauggcuuuugugcau

SEQ ID NO: 1763038 - RNA, 22 nt, Homo sapiens
caagaccuucuccccauucugc

SEQ ID NO: 1763039 - RNA, 17 nt, Homo sapiens
gccucaaguuccagugc

SEQ ID NO: 1763040 - RNA, 20 nt, Homo sapiens
agcaguguguacuucuucau

SEQ ID NO: 1763041 - RNA, 14 nt, Homo sapiens
agcaggguaaugua

SEQ ID NO: 1763042 - RNA, 20 nt, Homo sapiens
uacaaaaauuagcugggcau

SEQ ID NO: 1763043 - RNA, 22 nt, Homo sapiens
accagcugagucugaauucugc

SEQ ID NO: 1763044 - RNA, 14 nt, Homo sapiens
cuucucuccagugu

SEQ ID NO: 1763045 - RNA, 19 nt, Homo sapiens
cugguuuuacuagugugca

SEQ ID NO: 1763046 - RNA, 16 nt, Homo sapiens
ccucucagcacuaauu

SEQ ID NO: 1763047 - RNA, 13 nt, Homo sapiens
agccugcaacuca

SEQ ID NO: 1763048 - RNA, 19 nt, Homo sapiens
uggcuuugucccacagcuu

SEQ ID NO: 1763049 - RNA, 14 nt, Homo sapiens
gagaugccuuccag

SEQ ID NO: 1763050 - RNA, 17 nt, Homo sapiens
uugcucuugccaaaaaa

SEQ ID NO: 1763051 - RNA, 14 nt, Homo sapiens
ccucuuccccagaa

SEQ ID NO: 1763052 - RNA, 18 nt, Homo sapiens
ugugaaaagcuacccuga

SEQ ID NO: 1763053 - RNA, 23 nt, Homo sapiens
aagugggauuugcauaaagugaa

SEQ ID NO: 1763054 - RNA, 14 nt, Homo sapiens
aaucagaagcacaa

SEQ ID NO: 1763055 - RNA, 14 nt, Homo sapiens
gaauuaaaacuuug

SEQ ID NO: 1763056 - RNA, 23 nt, Homo sapiens
ccccuucacguuugcaguugaug

SEQ ID NO: 1763057 - RNA, 17 nt, Homo sapiens
uuuucugucuuuaugua

SEQ ID NO: 1763058 - RNA, 17 nt, Homo sapiens
cucuccucuucuacuca

SEQ ID NO: 1763059 - RNA, 17 nt, Homo sapiens
ucuccuuagaaaagcca

SEQ ID NO: 1763060 - RNA, 17 nt, Homo sapiens
ugauaugugaaugcuca

SEQ ID NO: 1763061 - RNA, 21 nt, Homo sapiens
gcccugcgaccacagcaggga

SEQ ID NO: 1763062 - RNA, 17 nt, Homo sapiens
ggccugagccacugugc

SEQ ID NO: 1763063 - RNA, 20 nt, Homo sapiens
aucuugcuucugcuucucau

SEQ ID NO: 1763064 - RNA, 22 nt, Homo sapiens
cccaggaggcccagcugcucag

SEQ ID NO: 1763065 - RNA, 15 nt, Homo sapiens
uguagcuaaccugca

SEQ ID NO: 1763066 - RNA, 16 nt, Homo sapiens
uucuguaguugcagcu

SEQ ID NO: 1763067 - RNA, 19 nt, Homo sapiens
uuuucuggagguugauaac

SEQ ID NO: 1763068 - RNA, 19 nt, Homo sapiens
gccucuuuucucugugcuu

SEQ ID NO: 1763069 - RNA, 18 nt, Homo sapiens
cuucccugacucuucaag

SEQ ID NO: 1763070 - RNA, 19 nt, Homo sapiens
aaugaagccuucugaccug

SEQ ID NO: 1763071 - RNA, 14 nt, Homo sapiens
acagccaugcccuu

SEQ ID NO: 1763072 - RNA, 14 nt, Homo sapiens
aaaauccuuacuuc

SEQ ID NO: 1763073 - RNA, 16 nt, Homo sapiens
gauuuccuugugcaaa

SEQ ID NO: 1763074 - RNA, 21 nt, Homo sapiens
ucaagugaggugacacuccag

SEQ ID NO: 1763075 - RNA, 14 nt, Homo sapiens
agugcagugacaca

SEQ ID NO: 1763076 - RNA, 15 nt, Homo sapiens
agcaucugagcuccu

SEQ ID NO: 1763077 - RNA, 16 nt, Homo sapiens
cuuuaaauuuugcacu

SEQ ID NO: 1763078 - RNA, 16 nt, Homo sapiens
uaagaaaacaaucaca

SEQ ID NO: 1763079 - RNA, 20 nt, Homo sapiens
uauacuuuggucugcuucua

SEQ ID NO: 1763080 - RNA, 16 nt, Homo sapiens
agaaauauagagcauu

SEQ ID NO: 1763081 - RNA, 18 nt, Homo sapiens
gcuucuccaaccaaaaca

SEQ ID NO: 1763082 - RNA, 22 nt, Homo sapiens
gcacccugcccaccaagaagca

SEQ ID NO: 1763083 - RNA, 17 nt, Homo sapiens
uugcacagaagcacaug

SEQ ID NO: 1763084 - RNA, 21 nt, Homo sapiens
acuucuaauuuauauuaucca

SEQ ID NO: 1763085 - RNA, 14 nt, Homo sapiens
agccaccgcugcca

SEQ ID NO: 1763086 - RNA, 21 nt, Homo sapiens
aaauaaggggcaccugggaaa

SEQ ID NO: 1763087 - RNA, 12 nt, Homo sapiens
aaauccaaugac

SEQ ID NO: 1763088 - RNA, 19 nt, Homo sapiens
uggagccgugggcgggacc

SEQ ID NO: 1763089 - RNA, 23 nt, Homo sapiens
gcccgcugcgaugggaacacaag

SEQ ID NO: 1763090 - RNA, 18 nt, Homo sapiens
gucccacgccucccugag

SEQ ID NO: 1763091 - RNA, 18 nt, Homo sapiens
ggccguggcacagcuggg

SEQ ID NO: 1763092 - RNA, 21 nt, Homo sapiens
uaugcugaacgcagaagaaag

SEQ ID NO: 1763093 - RNA, 22 nt, Homo sapiens
auugaaggagaaaaugcauuau

SEQ ID NO: 1763094 - RNA, 17 nt, Homo sapiens
acguauuaguugccaau

SEQ ID NO: 1763095 - RNA, 14 nt, Homo sapiens
acauuuguuccaug

SEQ ID NO: 1763096 - RNA, 9 nt, Homo sapiens
ggacauaug

SEQ ID NO: 1763097 - RNA, 15 nt, Homo sapiens
cauuauucuuucuaa

SEQ ID NO: 1763098 - RNA, 18 nt, Homo sapiens
uucuacuuacuuuuccaa

SEQ ID NO: 1763099 - RNA, 12 nt, Homo sapiens
cacagacagggu

SEQ ID NO: 1763100 - RNA, 13 nt, Homo sapiens
aucacacucucca

SEQ ID NO: 1763101 - RNA, 15 nt, Homo sapiens
gaaaagacugaccuu

SEQ ID NO: 1763102 - RNA, 18 nt, Homo sapiens
aggaaauucagcccacca

SEQ ID NO: 1763103 - RNA, 22 nt, Homo sapiens
uucuaguggguuuaauguuuag

SEQ ID NO: 1763104 - RNA, 20 nt, Homo sapiens
guggugaacagaacaaaagg

SEQ ID NO: 1763105 - RNA, 15 nt, Homo sapiens
uucuggggccaucca

SEQ ID NO: 1763106 - RNA, 15 nt, Homo sapiens
aagaaccggacaaau

SEQ ID NO: 1763107 - RNA, 14 nt, Homo sapiens
uaaaauauggcuau

SEQ ID NO: 1763108 - RNA, 14 nt, Homo sapiens
gacuacauugaaac

SEQ ID NO: 1763109 - RNA, 17 nt, Homo sapiens
uuggcgggcagcccagc

SEQ ID NO: 1763110 - RNA, 19 nt, Homo sapiens
uccgagucucagcccugac

SEQ ID NO: 1763111 - RNA, 13 nt, Homo sapiens
ccuacucuugccu

SEQ ID NO: 1763112 - RNA, 15 nt, Homo sapiens
gccugauuuugggga

SEQ ID NO: 1763113 - RNA, 16 nt, Homo sapiens
uuccucuuaccuguaa

SEQ ID NO: 1763114 - RNA, 13 nt, Homo sapiens
acaguauacacau

SEQ ID NO: 1763115 - RNA, 19 nt, Homo sapiens
uagcaucuuccuugauaau

SEQ ID NO: 1763116 - RNA, 12 nt, Homo sapiens
agauggugaccc

SEQ ID NO: 1763117 - RNA, 20 nt, Homo sapiens
ugccugugaaauaguacugc

SEQ ID NO: 1763118 - RNA, 18 nt, Homo sapiens
cgaggcuugggcucccac

SEQ ID NO: 1763119 - RNA, 15 nt, Homo sapiens
uuaagagaaagucac

SEQ ID NO: 1763120 - RNA, 22 nt, Homo sapiens
aauuauuauauacauacugcau

SEQ ID NO: 1763121 - RNA, 20 nt, Homo sapiens
gaagcuuuggugagaaccug

SEQ ID NO: 1763122 - RNA, 16 nt, Homo sapiens
uaagcagaccacugau

SEQ ID NO: 1763123 - RNA, 17 nt, Homo sapiens
ugcagaagcaugaucac

SEQ ID NO: 1763124 - RNA, 16 nt, Homo sapiens
ugaggaggaugucccu

SEQ ID NO: 1763125 - RNA, 23 nt, Homo sapiens
aaaugcaauuugauaaucaguuu

SEQ ID NO: 1763126 - RNA, 13 nt, Homo sapiens
uaaauuaccuuaa

SEQ ID NO: 1763127 - RNA, 19 nt, Homo sapiens
auaaaccuaauaaucugaa

SEQ ID NO: 1763128 - RNA, 19 nt, Homo sapiens
gaccuuguagagaacacgc

SEQ ID NO: 1763129 - RNA, 22 nt, Homo sapiens
gauucaucauccaggagguuca

SEQ ID NO: 1763130 - RNA, 14 nt, Homo sapiens
guccuguucuuguu

SEQ ID NO: 1763131 - RNA, 18 nt, Homo sapiens
aggaguagugagcuguac

SEQ ID NO: 1763132 - RNA, 15 nt, Homo sapiens
uuaaucugcauuuau

SEQ ID NO: 1763133 - RNA, 15 nt, Homo sapiens
augucgaugcacagu

SEQ ID NO: 1763134 - RNA, 21 nt, Homo sapiens
auguguauauguuuauacaca

SEQ ID NO: 1763135 - RNA, 17 nt, Homo sapiens
agguggucccacggcug

SEQ ID NO: 1763136 - RNA, 21 nt, Homo sapiens
caacugcaucuccaaacauua

SEQ ID NO: 1763137 - RNA, 20 nt, Homo sapiens
acaggaggcaagcaagcucu

SEQ ID NO: 1763138 - RNA, 23 nt, Homo sapiens
uacauauggaaauguuacugucu

SEQ ID NO: 1763139 - RNA, 17 nt, Homo sapiens
uauaauuuaaacgugau

SEQ ID NO: 1763140 - RNA, 14 nt, Homo sapiens
ccagggaucacaga

SEQ ID NO: 1763141 - RNA, 17 nt, Homo sapiens
uggaaagaaguugggga

SEQ ID NO: 1763142 - RNA, 18 nt, Homo sapiens
gacuauaaagcuguuauu

SEQ ID NO: 1763143 - RNA, 12 nt, Homo sapiens
gucacaucucag

SEQ ID NO: 1763144 - RNA, 17 nt, Homo sapiens
agaguguuccugagaca

SEQ ID NO: 1763145 - RNA, 13 nt, Homo sapiens
uguacaacugcac

SEQ ID NO: 1763146 - RNA, 14 nt, Homo sapiens
aacagagugcaacc

SEQ ID NO: 1763147 - RNA, 21 nt, Homo sapiens
ugucccaguaaagccaaugac

SEQ ID NO: 1763148 - RNA, 17 nt, Homo sapiens
uagugauagagugcagu

SEQ ID NO: 1763149 - RNA, 16 nt, Homo sapiens
aagaauguuuaugaau

SEQ ID NO: 1763150 - RNA, 21 nt, Homo sapiens
aauugacaguugaacagagcu

SEQ ID NO: 1763151 - RNA, 22 nt, Homo sapiens
ggcauccuggcuggcugugucc

SEQ ID NO: 1763152 - RNA, 22 nt, Homo sapiens
agcugaagaacuuggcacacuc

SEQ ID NO: 1763153 - RNA, 14 nt, Homo sapiens
uaugucucaugaug

SEQ ID NO: 1763154 - RNA, 15 nt, Homo sapiens
aacguccaucucucu

SEQ ID NO: 1763155 - RNA, 10 nt, Homo sapiens
uaagcuguuu

SEQ ID NO: 1763156 - RNA, 15 nt, Homo sapiens
cuugugucccaugau

SEQ ID NO: 1763157 - RNA, 16 nt, Homo sapiens
auacagcuucauaaau

SEQ ID NO: 1763158 - RNA, 20 nt, Homo sapiens
cggaggccuucccacuccua

SEQ ID NO: 1763159 - RNA, 17 nt, Homo sapiens
accugguugauguguau

SEQ ID NO: 1763160 - RNA, 18 nt, Homo sapiens
gaucucagcucacugcaa

SEQ ID NO: 1763161 - RNA, 23 nt, Homo sapiens
auauguaugcaccucaaggucau

SEQ ID NO: 1763162 - RNA, 15 nt, Homo sapiens
ggcagagcucagagg

SEQ ID NO: 1763163 - RNA, 22 nt, Homo sapiens
aauggugggauucauuggccca

SEQ ID NO: 1763164 - RNA, 13 nt, Homo sapiens
gggguaugggaga

SEQ ID NO: 1763165 - RNA, 15 nt, Homo sapiens
aggcucuugcucaag

SEQ ID NO: 1763166 - RNA, 20 nt, Homo sapiens
ccuccuaguucuucauccca

SEQ ID NO: 1763167 - RNA, 18 nt, Homo sapiens
uaaaugugauccugccuu

SEQ ID NO: 1763168 - RNA, 21 nt, Homo sapiens
gagcacguuggcgaggaaaaa

SEQ ID NO: 1763169 - RNA, 22 nt, Homo sapiens
aggucauaaguuucugagaugg

SEQ ID NO: 1763170 - RNA, 19 nt, Homo sapiens
ucaaguacuguaacugugu

SEQ ID NO: 1763171 - RNA, 16 nt, Homo sapiens
uauuuugucuuuuugc

SEQ ID NO: 1763172 - RNA, 18 nt, Homo sapiens
cuuaucaacuaaugauuu

SEQ ID NO: 1763173 - RNA, 17 nt, Homo sapiens
agcacuaggauugugau

SEQ ID NO: 1763174 - RNA, 16 nt, Homo sapiens
uucauaaagaaaugca

SEQ ID NO: 1763175 - RNA, 18 nt, Homo sapiens
guuaucuacugacuauau

SEQ ID NO: 1763176 - RNA, 19 nt, Homo sapiens
accaggcuacaguugauau

SEQ ID NO: 1763177 - RNA, 15 nt, Homo sapiens
aagcguacaaaguga

SEQ ID NO: 1763178 - RNA, 23 nt, Homo sapiens
uguucaggauacuuaguucaugg

SEQ ID NO: 1763179 - RNA, 18 nt, Homo sapiens
augaaacugacucaucag

SEQ ID NO: 1763180 - RNA, 22 nt, Homo sapiens
cacugcgcccagcuauacugua

SEQ ID NO: 1763181 - RNA, 17 nt, Homo sapiens
ucaguagaaagcuaaag

SEQ ID NO: 1763182 - RNA, 23 nt, Homo sapiens
uuguacuaucgucaggaaaccaa

SEQ ID NO: 1763183 - RNA, 13 nt, Homo sapiens
auuauagcacaaa

SEQ ID NO: 1763184 - RNA, 13 nt, Homo sapiens
agugguuacccag

SEQ ID NO: 1763185 - RNA, 14 nt, Homo sapiens
auucuaauuaaaau

SEQ ID NO: 1763186 - RNA, 22 nt, Homo sapiens
cacagcugcugugccaggacug

SEQ ID NO: 1763187 - RNA, 18 nt, Homo sapiens
agaagucuugucucaaga

SEQ ID NO: 1763188 - RNA, 14 nt, Homo sapiens
aguauuaucagaug

SEQ ID NO: 1763189 - RNA, 15 nt, Homo sapiens
augaguuaucagcuc

SEQ ID NO: 1763190 - RNA, 19 nt, Homo sapiens
cuuaauuuggaaacuaaua

SEQ ID NO: 1763191 - RNA, 17 nt, Homo sapiens
cccuguccugaaagcca

SEQ ID NO: 1763192 - RNA, 23 nt, Homo sapiens
cuaagaugugcagcauuucacuu

SEQ ID NO: 1763193 - RNA, 16 nt, Homo sapiens
cgcucucccuaccuug

SEQ ID NO: 1763194 - RNA, 13 nt, Homo sapiens
cacaccuacccuc

SEQ ID NO: 1763195 - RNA, 21 nt, Homo sapiens
cucuguguggcugugcaauuu

SEQ ID NO: 1763196 - RNA, 21 nt, Homo sapiens
gcaguguuacaaaauguucag

SEQ ID NO: 1763197 - RNA, 17 nt, Homo sapiens
ggaauaaacuccauuua

SEQ ID NO: 1763198 - RNA, 15 nt, Homo sapiens
uucaauucugugaua

SEQ ID NO: 1763199 - RNA, 16 nt, Homo sapiens
aucaaccuaggagcag

SEQ ID NO: 1763200 - RNA, 18 nt, Homo sapiens
accaguaaggaagcaacu

SEQ ID NO: 1763201 - RNA, 17 nt, Homo sapiens
aucucuuuucuacauac

SEQ ID NO: 1763202 - RNA, 21 nt, Homo sapiens
uaagauuccaaaaagcacaua

SEQ ID NO: 1763203 - RNA, 16 nt, Homo sapiens
uauaaauaugugaaaa

SEQ ID NO: 1763204 - RNA, 16 nt, Homo sapiens
augaggcuguugucuu

SEQ ID NO: 1763205 - RNA, 16 nt, Homo sapiens
ucuaugagcccagauc

SEQ ID NO: 1763206 - RNA, 22 nt, Homo sapiens
ucuauugacccacaaaguuuca

SEQ ID NO: 1763207 - RNA, 12 nt, Homo sapiens
uauauacuuaag

SEQ ID NO: 1763208 - RNA, 22 nt, Homo sapiens
uaauuuaacccaggcaugcaau

SEQ ID NO: 1763209 - RNA, 15 nt, Homo sapiens
uaugacaucagcaau

SEQ ID NO: 1763210 - RNA, 14 nt, Homo sapiens
aggcuccaguugaa

SEQ ID NO: 1763211 - RNA, 14 nt, Homo sapiens
aacgccaacaaaaa

SEQ ID NO: 1763212 - RNA, 16 nt, Homo sapiens
cccaaauauaaaaaca

SEQ ID NO: 1763213 - RNA, 19 nt, Homo sapiens
uaauaauuuauauguaugg

SEQ ID NO: 1763214 - RNA, 19 nt, Homo sapiens
aaauccacuuuaucuugaa

SEQ ID NO: 1763215 - RNA, 17 nt, Homo sapiens
cuguuccuuaugauauu

SEQ ID NO: 1763216 - RNA, 16 nt, Homo sapiens
uaaaauguuuaaugaa

SEQ ID NO: 1763217 - RNA, 17 nt, Homo sapiens
guccagaucuacacagc

SEQ ID NO: 1763218 - RNA, 17 nt, Homo sapiens
aauguggaaggucauca

SEQ ID NO: 1763219 - RNA, 14 nt, Homo sapiens
caaaaagcacaaga

SEQ ID NO: 1763220 - RNA, 14 nt, Homo sapiens
cccagggcaacaag

SEQ ID NO: 1763221 - RNA, 19 nt, Homo sapiens
agaugucuucugccuguua

SEQ ID NO: 1763222 - RNA, 16 nt, Homo sapiens
aguaucucuacuuucc

SEQ ID NO: 1763223 - RNA, 22 nt, Homo sapiens
ugaauaacauuuaaauuccaca

SEQ ID NO: 1763224 - RNA, 15 nt, Homo sapiens
aguuuauugacaaua

SEQ ID NO: 1763225 - RNA, 15 nt, Homo sapiens
aggucugauuugcag

SEQ ID NO: 1763226 - RNA, 13 nt, Homo sapiens
ugcugccuagggu

SEQ ID NO: 1763227 - RNA, 18 nt, Homo sapiens
auuuaugaacagacuuuu

SEQ ID NO: 1763228 - RNA, 21 nt, Homo sapiens
gaucuaaggaugucacagggc

SEQ ID NO: 1763229 - RNA, 22 nt, Homo sapiens
agugcuuugagauugugaaauu

SEQ ID NO: 1763230 - RNA, 21 nt, Homo sapiens
gaacuauaccugcuucaguga

SEQ ID NO: 1763231 - RNA, 20 nt, Homo sapiens
ccucccaaaguguugggauu

SEQ ID NO: 1763232 - RNA, 22 nt, Homo sapiens
uggauacaggagaagaaacagc

SEQ ID NO: 1763233 - RNA, 17 nt, Homo sapiens
ugcacucuuguacaaaa

SEQ ID NO: 1763234 - RNA, 16 nt, Homo sapiens
ucucuccccauauaua

SEQ ID NO: 1763235 - RNA, 14 nt, Homo sapiens
uaugucuuggacac

SEQ ID NO: 1763236 - RNA, 20 nt, Homo sapiens
cucucccaaguccaguguga

SEQ ID NO: 1763237 - RNA, 19 nt, Homo sapiens
uugucacuccaaaccuuac

SEQ ID NO: 1763238 - RNA, 14 nt, Homo sapiens
aaugcagccuuaaa

SEQ ID NO: 1763239 - RNA, 15 nt, Homo sapiens
agaguguuuaacuga

SEQ ID NO: 1763240 - RNA, 16 nt, Homo sapiens
aaaagacauaauucac

SEQ ID NO: 1763241 - RNA, 15 nt, Homo sapiens
uauaacaaacuacau

SEQ ID NO: 1763242 - RNA, 20 nt, Homo sapiens
guaacccuuuggaauggaga

SEQ ID NO: 1763243 - RNA, 21 nt, Homo sapiens
agaugugacccaccagugccu

SEQ ID NO: 1763244 - RNA, 22 nt, Homo sapiens
aagacaagaaaaucagguauua

SEQ ID NO: 1763245 - RNA, 16 nt, Homo sapiens
auuugacuuguugcug

SEQ ID NO: 1763246 - RNA, 15 nt, Homo sapiens
cagcaauugucuaca

SEQ ID NO: 1763247 - RNA, 17 nt, Homo sapiens
accuccacccacugucc

SEQ ID NO: 1763248 - RNA, 20 nt, Homo sapiens
aaacucaaugagcucuucca

SEQ ID NO: 1763249 - RNA, 19 nt, Homo sapiens
uccucaguaaaagucuucu

SEQ ID NO: 1763250 - RNA, 15 nt, Homo sapiens
uaaugagagugcacu

SEQ ID NO: 1763251 - RNA, 21 nt, Homo sapiens
agugagcacacccgugugcac

SEQ ID NO: 1763252 - RNA, 17 nt, Homo sapiens
agaacuguucauuucca

SEQ ID NO: 1763253 - RNA, 18 nt, Homo sapiens
uguccaaguuguuucauu

SEQ ID NO: 1763254 - RNA, 21 nt, Homo sapiens
aguaaaaagcuuacuaaagca

SEQ ID NO: 1763255 - RNA, 17 nt, Homo sapiens
agccuccuuacauuaaa

SEQ ID NO: 1763256 - RNA, 19 nt, Homo sapiens
agaauauugucugccuuaa

SEQ ID NO: 1763257 - RNA, 23 nt, Homo sapiens
uaugaaaaggauauuaucuaccu

SEQ ID NO: 1763258 - RNA, 21 nt, Homo sapiens
cuucccaguaacccuaaggaa

SEQ ID NO: 1763259 - RNA, 16 nt, Homo sapiens
uaauuauuuugacaaa

SEQ ID NO: 1763260 - RNA, 13 nt, Homo sapiens
caagaacucccuu

SEQ ID NO: 1763261 - RNA, 14 nt, Homo sapiens
agugaccagauaua

SEQ ID NO: 1763262 - RNA, 20 nt, Homo sapiens
cucuggacaggcauguucuc

SEQ ID NO: 1763263 - RNA, 15 nt, Homo sapiens
gggagagccagaccc

SEQ ID NO: 1763264 - RNA, 23 nt, Homo sapiens
uauugggacguagagcacagccu

SEQ ID NO: 1763265 - RNA, 15 nt, Homo sapiens
augacaguauuccau

SEQ ID NO: 1763266 - RNA, 21 nt, Homo sapiens
gaucccuaaagaaaacaaaca

SEQ ID NO: 1763267 - RNA, 23 nt, Homo sapiens
ugugaaaggaagcuccacuguca

SEQ ID NO: 1763268 - RNA, 17 nt, Homo sapiens
gagucaggcaauugauu

SEQ ID NO: 1763269 - RNA, 20 nt, Homo sapiens
uaguuuuguaucaaccuaaa

SEQ ID NO: 1763270 - RNA, 12 nt, Homo sapiens
cuguuuugccag

SEQ ID NO: 1763271 - RNA, 18 nt, Homo sapiens
augacaugguccaugucu

SEQ ID NO: 1763272 - RNA, 23 nt, Homo sapiens
cagagagggaagaugaccugccc

SEQ ID NO: 1763273 - RNA, 17 nt, Homo sapiens
gacuaugcagaggccug

SEQ ID NO: 1763274 - RNA, 18 nt, Homo sapiens
ugacguauauauaaacag

SEQ ID NO: 1763275 - RNA, 20 nt, Homo sapiens
caggcgcaguggcucaugcc

SEQ ID NO: 1763276 - RNA, 19 nt, Homo sapiens
ccuguaaucccagcacuuu

SEQ ID NO: 1763277 - RNA, 16 nt, Homo sapiens
aaaauagaaacuugcu

SEQ ID NO: 1763278 - RNA, 22 nt, Homo sapiens
aggaauaaugcggacacuuuug

SEQ ID NO: 1763279 - RNA, 15 nt, Homo sapiens
uaauaaaacucugca

SEQ ID NO: 1763280 - RNA, 23 nt, Homo sapiens
gaagucccucuccuggugcucca

SEQ ID NO: 1763281 - RNA, 21 nt, Homo sapiens
aaauuuugcaccagcgaagaa

SEQ ID NO: 1763282 - RNA, 12 nt, Homo sapiens
cuguagucccag

SEQ ID NO: 1763283 - RNA, 15 nt, Homo sapiens
cacagagcaagugau

SEQ ID NO: 1763284 - RNA, 17 nt, Homo sapiens
ccacacacagcuaauuu

SEQ ID NO: 1763285 - RNA, 17 nt, Homo sapiens
guuuggagagagcagac

SEQ ID NO: 1763286 - RNA, 20 nt, Homo sapiens
ggagccccauuauucauucu

SEQ ID NO: 1763287 - RNA, 18 nt, Homo sapiens
ugacagcuguauauugcu

SEQ ID NO: 1763288 - RNA, 21 nt, Homo sapiens
agcaugaaaaucacacugucu

SEQ ID NO: 1763289 - RNA, 17 nt, Homo sapiens
cuuuaaacaaauaugaa

SEQ ID NO: 1763290 - RNA, 16 nt, Homo sapiens
acaagcaaaaccaaag

SEQ ID NO: 1763291 - RNA, 14 nt, Homo sapiens
uagcaugugacucc

SEQ ID NO: 1763292 - RNA, 11 nt, Homo sapiens
ucauugccucu

SEQ ID NO: 1763293 - RNA, 18 nt, Homo sapiens
uccuguauucuucaacca

SEQ ID NO: 1763294 - RNA, 16 nt, Homo sapiens
agaccagagcaguuuc

SEQ ID NO: 1763295 - RNA, 19 nt, Homo sapiens
gggaaugaggcuugcugag

SEQ ID NO: 1763296 - RNA, 18 nt, Homo sapiens
uaucaaauguaacuuacu

SEQ ID NO: 1763297 - RNA, 16 nt, Homo sapiens
cuuuuaacaguguuuu

SEQ ID NO: 1763298 - RNA, 16 nt, Homo sapiens
caucuggguagcugua

SEQ ID NO: 1763299 - RNA, 19 nt, Homo sapiens
uuuaaaaagcuaguucuau

SEQ ID NO: 1763300 - RNA, 19 nt, Homo sapiens
uggaaaugcugacuuuuaa

SEQ ID NO: 1763301 - RNA, 12 nt, Homo sapiens
acaggcacuguc

SEQ ID NO: 1763302 - RNA, 20 nt, Homo sapiens
ccaggcuggagugcagugga

SEQ ID NO: 1763303 - RNA, 20 nt, Homo sapiens
aucuuuguauucuucaugaa

SEQ ID NO: 1763304 - RNA, 23 nt, Homo sapiens
aacuccggaaugaccagcaugau

SEQ ID NO: 1763305 - RNA, 18 nt, Homo sapiens
acuuaauucagucucagc

SEQ ID NO: 1763306 - RNA, 13 nt, Homo sapiens
auucauuugcauc

SEQ ID NO: 1763307 - RNA, 18 nt, Homo sapiens
ccuggcacuaacguugag

SEQ ID NO: 1763308 - RNA, 21 nt, Homo sapiens
aaucuaguugguugaugccuu

SEQ ID NO: 1763309 - RNA, 17 nt, Homo sapiens
ugcuucucuuucuaaaa

SEQ ID NO: 1763310 - RNA, 20 nt, Homo sapiens
uggucuuuucuccuacucuu

SEQ ID NO: 1763311 - RNA, 16 nt, Homo sapiens
cuggucucgaacuccu

SEQ ID NO: 1763312 - RNA, 11 nt, Homo sapiens
acagugcagug

SEQ ID NO: 1763313 - RNA, 19 nt, Homo sapiens
gcaaaucugacaauauaca

SEQ ID NO: 1763314 - RNA, 16 nt, Homo sapiens
gaacucagugccacac

SEQ ID NO: 1763315 - RNA, 23 nt, Homo sapiens
ugaauggggaagggagucucucu

SEQ ID NO: 1763316 - RNA, 15 nt, Homo sapiens
gcaugauaagagcau

SEQ ID NO: 1763317 - RNA, 20 nt, Homo sapiens
aaaacuuaccuauaaauuaa

SEQ ID NO: 1763318 - RNA, 23 nt, Homo sapiens
ugugaauuuuucuaaaggugcua

SEQ ID NO: 1763319 - RNA, 21 nt, Homo sapiens
gcacagacugguccacagggc

SEQ ID NO: 1763320 - RNA, 21 nt, Homo sapiens
aucucuuguuuacgauuucac

SEQ ID NO: 1763321 - RNA, 18 nt, Homo sapiens
uaaccagcagaaaugccu

SEQ ID NO: 1763322 - RNA, 21 nt, Homo sapiens
caacagcuggacccugaccag

SEQ ID NO: 1763323 - RNA, 19 nt, Homo sapiens
gaauuaaggaagugacuca

SEQ ID NO: 1763324 - RNA, 10 nt, Homo sapiens
cuuuccugcc

SEQ ID NO: 1763325 - RNA, 17 nt, Homo sapiens
cagacuugcuuccugca

SEQ ID NO: 1763326 - RNA, 12 nt, Homo sapiens
agcccuauguga

SEQ ID NO: 1763327 - RNA, 13 nt, Homo sapiens
aggucuguauguc

SEQ ID NO: 1763328 - RNA, 13 nt, Homo sapiens
agaaauguauaaa

SEQ ID NO: 1763329 - RNA, 15 nt, Homo sapiens
cgggacccucaggug

SEQ ID NO: 1763330 - RNA, 14 nt, Homo sapiens
cucuuguucccaca

SEQ ID NO: 1763331 - RNA, 16 nt, Homo sapiens
ugccacaaugugauau

SEQ ID NO: 1763332 - RNA, 18 nt, Homo sapiens
cacacucaccucuaaaac

SEQ ID NO: 1763333 - RNA, 17 nt, Homo sapiens
uauaguagacacacuau

SEQ ID NO: 1763334 - RNA, 16 nt, Homo sapiens
ugauauugcaguaaug

SEQ ID NO: 1763335 - RNA, 18 nt, Homo sapiens
caauauguggucaauuaa

SEQ ID NO: 1763336 - RNA, 16 nt, Homo sapiens
agauuuugcugagaug

SEQ ID NO: 1763337 - RNA, 18 nt, Homo sapiens
agucauuggaauaaggca

SEQ ID NO: 1763338 - RNA, 14 nt, Homo sapiens
guaagcaguuucca

SEQ ID NO: 1763339 - RNA, 17 nt, Homo sapiens
ugaacaucuggcccaag

SEQ ID NO: 1763340 - RNA, 17 nt, Homo sapiens
auuuggcaaaacagccc

SEQ ID NO: 1763341 - RNA, 16 nt, Homo sapiens
agaaggugacaugaca

SEQ ID NO: 1763342 - RNA, 23 nt, Homo sapiens
agaacugaagccacuuggcccag

SEQ ID NO: 1763343 - RNA, 20 nt, Homo sapiens
aacaugccagccacugugau

SEQ ID NO: 1763344 - RNA, 14 nt, Homo sapiens
gagaccuuccacaa

SEQ ID NO: 1763345 - RNA, 19 nt, Homo sapiens
agcacacacaaaauaaauc

SEQ ID NO: 1763346 - RNA, 15 nt, Homo sapiens
augcagaggggugcu

SEQ ID NO: 1763347 - RNA, 14 nt, Homo sapiens
ccuccguggcacau

SEQ ID NO: 1763348 - RNA, 20 nt, Homo sapiens
aacuuaauuauaagcuaugu

SEQ ID NO: 1763349 - RNA, 22 nt, Homo sapiens
uaucauuuuuguacaguuugcu

SEQ ID NO: 1763350 - RNA, 14 nt, Homo sapiens
cgggagguggagcu

SEQ ID NO: 1763351 - RNA, 14 nt, Homo sapiens
gccuucuuggaaaa

SEQ ID NO: 1763352 - RNA, 14 nt, Homo sapiens
uggacucucaggga

SEQ ID NO: 1763353 - RNA, 18 nt, Homo sapiens
uugacaggggcucaggau

SEQ ID NO: 1763354 - RNA, 20 nt, Homo sapiens
uguaugaugucacacaagcu

SEQ ID NO: 1763355 - RNA, 22 nt, Homo sapiens
agcuggauugaaaaaacaaaac

SEQ ID NO: 1763356 - RNA, 23 nt, Homo sapiens
caaugccccuggaucuaccagca

SEQ ID NO: 1763357 - RNA, 14 nt, Homo sapiens
cuaguuccauccac

SEQ ID NO: 1763358 - RNA, 22 nt, Homo sapiens
ccuggcuuagaaggcacuggga

SEQ ID NO: 1763359 - RNA, 16 nt, Homo sapiens
caacauuaugaucuaa

SEQ ID NO: 1763360 - RNA, 16 nt, Homo sapiens
ugccuuccucucucua

SEQ ID NO: 1763361 - RNA, 13 nt, Homo sapiens
gcuguaaggcaug

SEQ ID NO: 1763362 - RNA, 19 nt, Homo sapiens
uauauuuacaacacuuuaa

SEQ ID NO: 1763363 - RNA, 17 nt, Homo sapiens
ccgauuuugcucugucu

SEQ ID NO: 1763364 - RNA, 22 nt, Homo sapiens
aacacucucacuaugcugcuau

SEQ ID NO: 1763365 - RNA, 15 nt, Homo sapiens
auccauucacaguuc

SEQ ID NO: 1763366 - RNA, 22 nt, Homo sapiens
uguaaauucuagcuuagucuac

SEQ ID NO: 1763367 - RNA, 19 nt, Homo sapiens
cuaggaucagaauaucaca

SEQ ID NO: 1763368 - RNA, 18 nt, Homo sapiens
cauacaugacucagcaua

SEQ ID NO: 1763369 - RNA, 18 nt, Homo sapiens
ucaaucauaauaccugcu

SEQ ID NO: 1763370 - RNA, 18 nt, Homo sapiens
gaagucuuuguacagaca

SEQ ID NO: 1763371 - RNA, 16 nt, Homo sapiens
cugggagaaggugcuu

SEQ ID NO: 1763372 - RNA, 15 nt, Homo sapiens
uacuguucugagcca

SEQ ID NO: 1763373 - RNA, 19 nt, Homo sapiens
agcaguguugcucagcucc

SEQ ID NO: 1763374 - RNA, 15 nt, Homo sapiens
gaaguuacaugcaua

SEQ ID NO: 1763375 - RNA, 15 nt, Homo sapiens
auguaagggcuuuaa

SEQ ID NO: 1763376 - RNA, 20 nt, Homo sapiens
accuccaccacaucugccag

SEQ ID NO: 1763377 - RNA, 22 nt, Homo sapiens
gaaauuaguaggcucauuuacu

SEQ ID NO: 1763378 - RNA, 22 nt, Homo sapiens
gccaccccaccagaagugcccc

SEQ ID NO: 1763379 - RNA, 20 nt, Homo sapiens
agugcaguggugugaucuca

SEQ ID NO: 1763380 - RNA, 16 nt, Homo sapiens
uuggaacuauuuacaa

SEQ ID NO: 1763381 - RNA, 11 nt, Homo sapiens
ugaaucuuccc

SEQ ID NO: 1763382 - RNA, 11 nt, Homo sapiens
aaaaacaggaa

SEQ ID NO: 1763383 - RNA, 11 nt, Homo sapiens
gaaaacagaaa

SEQ ID NO: 1763384 - RNA, 23 nt, Homo sapiens
uaaaaaaaaaacguauugcauuu

SEQ ID NO: 1763385 - RNA, 20 nt, Homo sapiens
agauugaaucugaaccaugu

SEQ ID NO: 1763386 - RNA, 19 nt, Homo sapiens
ucuggugccagauccucuu

SEQ ID NO: 1763387 - RNA, 20 nt, Homo sapiens
uuguaagcccacaguaggca

SEQ ID NO: 1763388 - RNA, 14 nt, Homo sapiens
cugacaacugugaa

SEQ ID NO: 1763389 - RNA, 15 nt, Homo sapiens
aaauaacuaaugucu

SEQ ID NO: 1763390 - RNA, 20 nt, Homo sapiens
uggaacaagacagccuucac

SEQ ID NO: 1763391 - RNA, 15 nt, Homo sapiens
cuggcuucacauucu

SEQ ID NO: 1763392 - RNA, 15 nt, Homo sapiens
ccaaggacacccucc

SEQ ID NO: 1763393 - RNA, 15 nt, Homo sapiens
gaaauacauggacaa

SEQ ID NO: 1763394 - RNA, 15 nt, Homo sapiens
uuauuugaacuauga

SEQ ID NO: 1763395 - RNA, 16 nt, Homo sapiens
acagugaugaugcaug

SEQ ID NO: 1763396 - RNA, 15 nt, Homo sapiens
ucaaguggguauucu

SEQ ID NO: 1763397 - RNA, 22 nt, Homo sapiens
agugugcugcuguucuguguac

SEQ ID NO: 1763398 - RNA, 16 nt, Homo sapiens
cacagcuggcucugac

SEQ ID NO: 1763399 - RNA, 21 nt, Homo sapiens
ugacacccagucauccagcag

SEQ ID NO: 1763400 - RNA, 16 nt, Homo sapiens
aaugugcugagcauuu

SEQ ID NO: 1763401 - RNA, 17 nt, Homo sapiens
cuggaaugccaauguca

SEQ ID NO: 1763402 - RNA, 15 nt, Homo sapiens
cuuuggccauuccaa

SEQ ID NO: 1763403 - RNA, 10 nt, Homo sapiens
gccacugggc

SEQ ID NO: 1763404 - RNA, 15 nt, Homo sapiens
aucgaggggugcuua

SEQ ID NO: 1763405 - RNA, 14 nt, Homo sapiens
gccaagaccauuuc

SEQ ID NO: 1763406 - RNA, 13 nt, Homo sapiens
uccucauucuucu

SEQ ID NO: 1763407 - RNA, 20 nt, Homo sapiens
ccuagaguauauuccucugc

SEQ ID NO: 1763408 - RNA, 12 nt, Homo sapiens
cucuaacagcac

SEQ ID NO: 1763409 - RNA, 12 nt, Homo sapiens
cuacaacagccu

SEQ ID NO: 1763410 - RNA, 14 nt, Homo sapiens
gugccuuccauaau

SEQ ID NO: 1763411 - RNA, 14 nt, Homo sapiens
cacggccacaguca

SEQ ID NO: 1763412 - RNA, 15 nt, Homo sapiens
auauguuaaauguau

SEQ ID NO: 1763413 - RNA, 20 nt, Homo sapiens
ucugccucuguucacgggga

SEQ ID NO: 1763414 - RNA, 22 nt, Homo sapiens
agggccucaguuucauuaacug

SEQ ID NO: 1763415 - RNA, 18 nt, Homo sapiens
agaauguacacaguuuaa

SEQ ID NO: 1763416 - RNA, 13 nt, Homo sapiens
caggcacuguuca

SEQ ID NO: 1763417 - RNA, 13 nt, Homo sapiens
ggaguacugauga

SEQ ID NO: 1763418 - RNA, 19 nt, Homo sapiens
caguucgcagccacccuga

SEQ ID NO: 1763419 - RNA, 19 nt, Homo sapiens
cugugcccagcuucgucag

SEQ ID NO: 1763420 - RNA, 15 nt, Homo sapiens
accugcugcuugccc

SEQ ID NO: 1763421 - RNA, 19 nt, Homo sapiens
agaauguuccagacauucu

SEQ ID NO: 1763422 - RNA, 15 nt, Homo sapiens
uaaaacacauauuca

SEQ ID NO: 1763423 - RNA, 15 nt, Homo sapiens
acauggccgcugccc

SEQ ID NO: 1763424 - RNA, 18 nt, Homo sapiens
ggaauguuaucaguauua

SEQ ID NO: 1763425 - RNA, 20 nt, Homo sapiens
cuuacuuacccucaccuguc

SEQ ID NO: 1763426 - RNA, 14 nt, Homo sapiens
augauuuacauaaa

SEQ ID NO: 1763427 - RNA, 14 nt, Homo sapiens
augguuuacaugaa

SEQ ID NO: 1763428 - RNA, 16 nt, Homo sapiens
aaugugaacacuggca

SEQ ID NO: 1763429 - RNA, 20 nt, Homo sapiens
uggaagaggagcaacaauca

SEQ ID NO: 1763430 - RNA, 15 nt, Homo sapiens
cgugccaaaaaucuu

SEQ ID NO: 1763431 - RNA, 14 nt, Homo sapiens
caaagagugaagga

SEQ ID NO: 1763432 - RNA, 13 nt, Homo sapiens
auucccccagugc

SEQ ID NO: 1763433 - RNA, 22 nt, Homo sapiens
gcccaccuuccccagaaccagg

SEQ ID NO: 1763434 - RNA, 23 nt, Homo sapiens
ugggucacaggaaggaaacaaca

SEQ ID NO: 1763435 - RNA, 23 nt, Homo sapiens
uguguaauuuuuuuuccuugccu

SEQ ID NO: 1763436 - RNA, 20 nt, Homo sapiens
uagaaccagcagaagccaga

SEQ ID NO: 1763437 - RNA, 18 nt, Homo sapiens
uggggagggagguguuua

SEQ ID NO: 1763438 - RNA, 16 nt, Homo sapiens
guuccuccagccaccu

SEQ ID NO: 1763439 - RNA, 14 nt, Homo sapiens
caaguugcacacuc

SEQ ID NO: 1763440 - RNA, 19 nt, Homo sapiens
acauaauugugaccaauac

SEQ ID NO: 1763441 - RNA, 21 nt, Homo sapiens
auguuaucuucucaaguucua

SEQ ID NO: 1763442 - RNA, 13 nt, Homo sapiens
acagacuccaaaa

SEQ ID NO: 1763443 - RNA, 10 nt, Homo sapiens
cuccaucagg

SEQ ID NO: 1763444 - RNA, 21 nt, Homo sapiens
gaacacauucugcuaugaauu

SEQ ID NO: 1763445 - RNA, 15 nt, Homo sapiens
acacuauuuccaaaa

SEQ ID NO: 1763446 - RNA, 14 nt, Homo sapiens
ucaccagcccugaa

SEQ ID NO: 1763447 - RNA, 14 nt, Homo sapiens
ucuccugcccagau

SEQ ID NO: 1763448 - RNA, 20 nt, Homo sapiens
aucccaggggcuuaucucuu

SEQ ID NO: 1763449 - RNA, 19 nt, Homo sapiens
acuugucuucccuucugau

SEQ ID NO: 1763450 - RNA, 20 nt, Homo sapiens
auuccgucuccugcucugga

SEQ ID NO: 1763451 - RNA, 17 nt, Homo sapiens
ugcagccccugggacca

SEQ ID NO: 1763452 - RNA, 18 nt, Homo sapiens
guuaacauucaguacuuu

SEQ ID NO: 1763453 - RNA, 23 nt, Homo sapiens
acagcuuuugcaacuuaauacuc

SEQ ID NO: 1763454 - RNA, 19 nt, Homo sapiens
gccucgcauccuaugcuua

SEQ ID NO: 1763455 - RNA, 14 nt, Homo sapiens
auucaaucccagga

SEQ ID NO: 1763456 - RNA, 11 nt, Homo sapiens
gaucacuugag

SEQ ID NO: 1763457 - RNA, 13 nt, Homo sapiens
uuccuaaccacaa

SEQ ID NO: 1763458 - RNA, 14 nt, Homo sapiens
uuugugauucccuc

SEQ ID NO: 1763459 - RNA, 14 nt, Homo sapiens
agcugagcuuucca

SEQ ID NO: 1763460 - RNA, 22 nt, Homo sapiens
auuguaaaaugcacccaucagu

SEQ ID NO: 1763461 - RNA, 16 nt, Homo sapiens
agacaguaacacuggc

SEQ ID NO: 1763462 - RNA, 15 nt, Homo sapiens
aguuuucugugcaaa

SEQ ID NO: 1763463 - RNA, 19 nt, Homo sapiens
ucacaggcuauucuacuuu

SEQ ID NO: 1763464 - RNA, 17 nt, Homo sapiens
cucugauuuugagcuca

SEQ ID NO: 1763465 - RNA, 12 nt, Homo sapiens
augccaaagggg

SEQ ID NO: 1763466 - RNA, 14 nt, Homo sapiens
auggacagcuuuau

SEQ ID NO: 1763467 - RNA, 13 nt, Homo sapiens
caaggacauugcc

SEQ ID NO: 1763468 - RNA, 21 nt, Homo sapiens
ugugaccauuagcauuuguca

SEQ ID NO: 1763469 - RNA, 16 nt, Homo sapiens
cauucuacuuuugcac

SEQ ID NO: 1763470 - RNA, 17 nt, Homo sapiens
caaaaaaaccacaaagg

SEQ ID NO: 1763471 - RNA, 19 nt, Homo sapiens
uuguccuccugauccugac

SEQ ID NO: 1763472 - RNA, 22 nt, Homo sapiens
ugagaugaacccuggcauuugg

SEQ ID NO: 1763473 - RNA, 21 nt, Homo sapiens
cuuuaugcagagccacagcug

SEQ ID NO: 1763474 - RNA, 17 nt, Homo sapiens
acagugacacuggacca

SEQ ID NO: 1763475 - RNA, 16 nt, Homo sapiens
guucuuguguaccuac

SEQ ID NO: 1763476 - RNA, 15 nt, Homo sapiens
auguagcccauccuu

SEQ ID NO: 1763477 - RNA, 18 nt, Homo sapiens
auugacugauggugaaau

SEQ ID NO: 1763478 - RNA, 22 nt, Homo sapiens
aggaacuagauuauaagccuua

SEQ ID NO: 1763479 - RNA, 18 nt, Homo sapiens
gauggauagucuguccaa

SEQ ID NO: 1763480 - RNA, 18 nt, Homo sapiens
uuaguuuuuaaaauacug

SEQ ID NO: 1763481 - RNA, 17 nt, Homo sapiens
gggcugggucacaggaa

SEQ ID NO: 1763482 - RNA, 19 nt, Homo sapiens
cuucauauaugcuuugcag

SEQ ID NO: 1763483 - RNA, 19 nt, Homo sapiens
cugaauauaugauuugcau

SEQ ID NO: 1763484 - RNA, 16 nt, Homo sapiens
aauugacaagucacag

SEQ ID NO: 1763485 - RNA, 16 nt, Homo sapiens
gccggaucugagggag

SEQ ID NO: 1763486 - RNA, 21 nt, Homo sapiens
aucccauggccaggugguugu

SEQ ID NO: 1763487 - RNA, 23 nt, Homo sapiens
gcuaucagacuguaggauuugaa

SEQ ID NO: 1763488 - RNA, 22 nt, Homo sapiens
cauuguuuagaaagaauauuca

SEQ ID NO: 1763489 - RNA, 20 nt, Homo sapiens
ucaaagcagcaggacugugg

SEQ ID NO: 1763490 - RNA, 19 nt, Homo sapiens
ccuguucaaagaugcauuu

SEQ ID NO: 1763491 - RNA, 15 nt, Homo sapiens
cugauaauaauugau

SEQ ID NO: 1763492 - RNA, 22 nt, Homo sapiens
auccccauucucugccuguacu

SEQ ID NO: 1763493 - RNA, 23 nt, Homo sapiens
ugggcaaaggcagggccacuuuu

SEQ ID NO: 1763494 - RNA, 11 nt, Homo sapiens
ggaaaucacac

SEQ ID NO: 1763495 - RNA, 18 nt, Homo sapiens
ucucacacucaugcauug

SEQ ID NO: 1763496 - RNA, 16 nt, Homo sapiens
gccuggccagugcccu

SEQ ID NO: 1763497 - RNA, 12 nt, Homo sapiens
uuugggaggcca

SEQ ID NO: 1763498 - RNA, 13 nt, Homo sapiens
acuccucuuggug

SEQ ID NO: 1763499 - RNA, 15 nt, Homo sapiens
aggacagguccugaa

SEQ ID NO: 1763500 - RNA, 16 nt, Homo sapiens
aaguugcaccaacuuu

SEQ ID NO: 1763501 - RNA, 15 nt, Homo sapiens
cugaucaaugacaga

SEQ ID NO: 1763502 - RNA, 19 nt, Homo sapiens
agacaauguuuucuucaac

SEQ ID NO: 1763503 - RNA, 15 nt, Homo sapiens
gaacaguaacugcca

SEQ ID NO: 1763504 - RNA, 14 nt, Homo sapiens
gcugccagcccaga

SEQ ID NO: 1763505 - RNA, 18 nt, Homo sapiens
aguaccacauuccaugac

SEQ ID NO: 1763506 - RNA, 18 nt, Homo sapiens
augaacacaggcaaugac

SEQ ID NO: 1763507 - RNA, 16 nt, Homo sapiens
aacauagacagaagaa

SEQ ID NO: 1763508 - RNA, 20 nt, Homo sapiens
gcaaucucggcucauagcaa

SEQ ID NO: 1763509 - RNA, 13 nt, Homo sapiens
uguuccauugaau

SEQ ID NO: 1763510 - RNA, 18 nt, Homo sapiens
cguauuuauacucacuga

SEQ ID NO: 1763511 - RNA, 13 nt, Homo sapiens
ugggccacugcca

SEQ ID NO: 1763512 - RNA, 19 nt, Homo sapiens
gccaucagaggccuaguca

SEQ ID NO: 1763513 - RNA, 21 nt, Homo sapiens
cuguguugugauuccccggag

SEQ ID NO: 1763514 - RNA, 12 nt, Homo sapiens
acguguguaaau

SEQ ID NO: 1763515 - RNA, 21 nt, Homo sapiens
cauguuaaugacaauauucca

SEQ ID NO: 1763516 - RNA, 19 nt, Homo sapiens
cccacuggagcguguacua

SEQ ID NO: 1763517 - RNA, 20 nt, Homo sapiens
aauuguuuuuuaaagcaagu

SEQ ID NO: 1763518 - RNA, 20 nt, Homo sapiens
aucaaacacggacccauaga

SEQ ID NO: 1763519 - RNA, 20 nt, Homo sapiens
caagcauaccaacacgagca

SEQ ID NO: 1763520 - RNA, 19 nt, Homo sapiens
auggcaggcaucuguaaga

SEQ ID NO: 1763521 - RNA, 20 nt, Homo sapiens
ugcuuuaauuuucacucugg

SEQ ID NO: 1763522 - RNA, 17 nt, Homo sapiens
ccagaacaguuuguaca

SEQ ID NO: 1763523 - RNA, 15 nt, Homo sapiens
agccugcuguuucca

SEQ ID NO: 1763524 - RNA, 14 nt, Homo sapiens
aagacuacaugaac

SEQ ID NO: 1763525 - RNA, 14 nt, Homo sapiens
ugggggacacccgg

SEQ ID NO: 1763526 - RNA, 19 nt, Homo sapiens
cucugauucaccucuuccu

SEQ ID NO: 1763527 - RNA, 17 nt, Homo sapiens
ugcaagucaaaaucaca

SEQ ID NO: 1763528 - RNA, 17 nt, Homo sapiens
acagaaauuaccccggg

SEQ ID NO: 1763529 - RNA, 16 nt, Homo sapiens
uccuggaaccugucuc

SEQ ID NO: 1763530 - RNA, 15 nt, Homo sapiens
cccugaagauuucag

SEQ ID NO: 1763531 - RNA, 12 nt, Homo sapiens
gagauaguucua

SEQ ID NO: 1763532 - RNA, 21 nt, Homo sapiens
uaaaugucuucuguauucacu

SEQ ID NO: 1763533 - RNA, 18 nt, Homo sapiens
ggcugaaccgagcuggag

SEQ ID NO: 1763534 - RNA, 22 nt, Homo sapiens
aaguacuguaacugugucauga

SEQ ID NO: 1763535 - RNA, 15 nt, Homo sapiens
uaaaucaucccuuaa

SEQ ID NO: 1763536 - RNA, 18 nt, Homo sapiens
aaaugacaacaaggcccu

SEQ ID NO: 1763537 - RNA, 16 nt, Homo sapiens
ucccuuugcugcugau

SEQ ID NO: 1763538 - RNA, 17 nt, Homo sapiens
gcuaaagaauccauaaa

SEQ ID NO: 1763539 - RNA, 11 nt, Homo sapiens
gaaucauuugc

SEQ ID NO: 1763540 - RNA, 19 nt, Homo sapiens
caagcagaauguacuugau

SEQ ID NO: 1763541 - RNA, 23 nt, Homo sapiens
caaaaugccaagggggugacugg

SEQ ID NO: 1763542 - RNA, 15 nt, Homo sapiens
aguuuuauuacacau

SEQ ID NO: 1763543 - RNA, 16 nt, Homo sapiens
uggaggccgcagccaa

SEQ ID NO: 1763544 - RNA, 12 nt, Homo sapiens
caauucugugac

SEQ ID NO: 1763545 - RNA, 15 nt, Homo sapiens
uguaaaaacuuuuaa

SEQ ID NO: 1763546 - RNA, 14 nt, Homo sapiens
agcccaauccaggu

SEQ ID NO: 1763547 - RNA, 16 nt, Homo sapiens
uauuuuuucuaugaac

SEQ ID NO: 1763548 - RNA, 19 nt, Homo sapiens
acccucaauaaauguugcu

SEQ ID NO: 1763549 - RNA, 15 nt, Homo sapiens
aaauuaggacuguau

SEQ ID NO: 1763550 - RNA, 13 nt, Homo sapiens
agugguugaauau

SEQ ID NO: 1763551 - RNA, 13 nt, Homo sapiens
uacguuugugcag

SEQ ID NO: 1763552 - RNA, 17 nt, Homo sapiens
ucuuguuuaaaaaaaga

SEQ ID NO: 1763553 - RNA, 18 nt, Homo sapiens
gaucggcggccacugcgc

SEQ ID NO: 1763554 - RNA, 22 nt, Homo sapiens
ugauucaauuugauguggugaa

SEQ ID NO: 1763555 - RNA, 22 nt, Homo sapiens
uuugacgacagugcauuugccu

SEQ ID NO: 1763556 - RNA, 20 nt, Homo sapiens
auccagggcagcaggccaga

SEQ ID NO: 1763557 - RNA, 15 nt, Homo sapiens
ccucugcuggucucu

SEQ ID NO: 1763558 - RNA, 19 nt, Homo sapiens
ugcucaagguuacugggag

SEQ ID NO: 1763559 - RNA, 12 nt, Homo sapiens
ucucaggccagc

SEQ ID NO: 1763560 - RNA, 23 nt, Homo sapiens
ccaagagccgacaaugcccugcu

SEQ ID NO: 1763561 - RNA, 14 nt, Homo sapiens
ucucaguugcagcc

SEQ ID NO: 1763562 - RNA, 16 nt, Homo sapiens
ccacgaggaggaacca

SEQ ID NO: 1763563 - RNA, 14 nt, Homo sapiens
guucagcaugaagg

SEQ ID NO: 1763564 - RNA, 19 nt, Homo sapiens
gaauauuuuagaaccacaa

SEQ ID NO: 1763565 - RNA, 21 nt, Homo sapiens
guuggaguugauucaugugcu

SEQ ID NO: 1763566 - RNA, 22 nt, Homo sapiens
aacuucacggggucauacuaca

SEQ ID NO: 1763567 - RNA, 22 nt, Homo sapiens
cauccuuucccucucccagucc

SEQ ID NO: 1763568 - RNA, 19 nt, Homo sapiens
ugcacuacagcccuggccu

SEQ ID NO: 1763569 - RNA, 19 nt, Homo sapiens
uccugagggccccgacuuu

SEQ ID NO: 1763570 - RNA, 18 nt, Homo sapiens
aagguggggauugcccau

SEQ ID NO: 1763571 - RNA, 17 nt, Homo sapiens
aguaauuauuuucuucc

SEQ ID NO: 1763572 - RNA, 15 nt, Homo sapiens
ucacucuucacuuga

SEQ ID NO: 1763573 - RNA, 21 nt, Homo sapiens
cagggcggucuucugcuccau

SEQ ID NO: 1763574 - RNA, 13 nt, Homo sapiens
gcagucugcuuca

SEQ ID NO: 1763575 - RNA, 20 nt, Homo sapiens
aaacuugugaaugcuucuca

SEQ ID NO: 1763576 - RNA, 15 nt, Homo sapiens
cuaacuagcauugua

SEQ ID NO: 1763577 - RNA, 16 nt, Homo sapiens
ucccuauuaaccuaga

SEQ ID NO: 1763578 - RNA, 18 nt, Homo sapiens
acuaagauugugcucaau

SEQ ID NO: 1763579 - RNA, 16 nt, Homo sapiens
gucaucucaaacacug

SEQ ID NO: 1763580 - RNA, 14 nt, Homo sapiens
agcuauaacauuug

SEQ ID NO: 1763581 - RNA, 18 nt, Homo sapiens
aaggugacccaaugauuc

SEQ ID NO: 1763582 - RNA, 21 nt, Homo sapiens
auguacagauaugcaaauucc

SEQ ID NO: 1763583 - RNA, 13 nt, Homo sapiens
aaaucacuuuaau

SEQ ID NO: 1763584 - RNA, 18 nt, Homo sapiens
gaauaaauaaauguaucu

SEQ ID NO: 1763585 - RNA, 18 nt, Homo sapiens
uuccagcauguugcaucu

SEQ ID NO: 1763586 - RNA, 22 nt, Homo sapiens
acuaaggugugcucugaucauc

SEQ ID NO: 1763587 - RNA, 19 nt, Homo sapiens
ccugcccagccaccccuca

SEQ ID NO: 1763588 - RNA, 16 nt, Homo sapiens
gcaguuaacaaguaua

SEQ ID NO: 1763589 - RNA, 20 nt, Homo sapiens
guaacuuugguuaaaaucuc

SEQ ID NO: 1763590 - RNA, 17 nt, Homo sapiens
gaucagcccugccaggu

SEQ ID NO: 1763591 - RNA, 18 nt, Homo sapiens
cagggcucgccucaggaa

SEQ ID NO: 1763592 - RNA, 13 nt, Homo sapiens
cugaugacuuuau

SEQ ID NO: 1763593 - RNA, 18 nt, Homo sapiens
aaaugaguagacauugug

SEQ ID NO: 1763594 - RNA, 15 nt, Homo sapiens
acucuuucuaaaaau

SEQ ID NO: 1763595 - RNA, 14 nt, Homo sapiens
uuaauuaaucauga

SEQ ID NO: 1763596 - RNA, 15 nt, Homo sapiens
ccucagguaguacug

SEQ ID NO: 1763597 - RNA, 19 nt, Homo sapiens
ccuggcuggaagaggguga

SEQ ID NO: 1763598 - RNA, 16 nt, Homo sapiens
acuuagguguggggga

SEQ ID NO: 1763599 - RNA, 15 nt, Homo sapiens
uaacugucaagucau

SEQ ID NO: 1763600 - RNA, 21 nt, Homo sapiens
accgcauccucagcuucuucc

SEQ ID NO: 1763601 - RNA, 17 nt, Homo sapiens
uuuucauuggaugcagu

SEQ ID NO: 1763602 - RNA, 22 nt, Homo sapiens
aagauguuguuaaaaacaugug

SEQ ID NO: 1763603 - RNA, 23 nt, Homo sapiens
cagcaaaagaagacaacauuucu

SEQ ID NO: 1763604 - RNA, 20 nt, Homo sapiens
gcuguauuccuuuauacaaa

SEQ ID NO: 1763605 - RNA, 18 nt, Homo sapiens
aauuacagucaucugucu

SEQ ID NO: 1763606 - RNA, 19 nt, Homo sapiens
uccugggugcugucaugcc

SEQ ID NO: 1763607 - RNA, 20 nt, Homo sapiens
cugaggaaugcgguucaggg

SEQ ID NO: 1763608 - RNA, 14 nt, Homo sapiens
uggggaagggaguc

SEQ ID NO: 1763609 - RNA, 20 nt, Homo sapiens
ccucagcaccugggacccaa

SEQ ID NO: 1763610 - RNA, 13 nt, Homo sapiens
aaguguggaugca

SEQ ID NO: 1763611 - RNA, 19 nt, Homo sapiens
aacuuuauguugcaggaaa

SEQ ID NO: 1763612 - RNA, 15 nt, Homo sapiens
uuucaggaaucagaa

SEQ ID NO: 1763613 - RNA, 19 nt, Homo sapiens
uacuuacuccccacugaug

SEQ ID NO: 1763614 - RNA, 15 nt, Homo sapiens
guuucggaagagcug

SEQ ID NO: 1763615 - RNA, 14 nt, Homo sapiens
accauuuacaguau

SEQ ID NO: 1763616 - RNA, 18 nt, Homo sapiens
caguugggacuacaggcg

SEQ ID NO: 1763617 - RNA, 21 nt, Homo sapiens
caaagucccuuccugcuuccu

SEQ ID NO: 1763618 - RNA, 21 nt, Homo sapiens
cagagacugggaugggaacac

SEQ ID NO: 1763619 - RNA, 18 nt, Homo sapiens
gcuacuauagguccagaa

SEQ ID NO: 1763620 - RNA, 19 nt, Homo sapiens
caugucugccaaaaugcaa

SEQ ID NO: 1763621 - RNA, 17 nt, Homo sapiens
auggcuucugccuaaua

SEQ ID NO: 1763622 - RNA, 17 nt, Homo sapiens
aucaguaugaagacacu

SEQ ID NO: 1763623 - RNA, 23 nt, Homo sapiens
aggcccggccaaaauaaugcacc

SEQ ID NO: 1763624 - RNA, 16 nt, Homo sapiens
aauuuuugaaaacugg

SEQ ID NO: 1763625 - RNA, 16 nt, Homo sapiens
gcccaggccaucacca

SEQ ID NO: 1763626 - RNA, 17 nt, Homo sapiens
uagauuugaaacauuua

SEQ ID NO: 1763627 - RNA, 21 nt, Homo sapiens
uacuguguuucgcauuaagca

SEQ ID NO: 1763628 - RNA, 14 nt, Homo sapiens
acgcaccacaucuc

SEQ ID NO: 1763629 - RNA, 15 nt, Homo sapiens
gccgcagaccuggag

SEQ ID NO: 1763630 - RNA, 18 nt, Homo sapiens
acuuuuaaugccuuccac

SEQ ID NO: 1763631 - RNA, 20 nt, Homo sapiens
gaacucaaauaaaaugcccc

SEQ ID NO: 1763632 - RNA, 16 nt, Homo sapiens
ugcucaaccacugugg

SEQ ID NO: 1763633 - RNA, 13 nt, Homo sapiens
gggcagggugacc

SEQ ID NO: 1763634 - RNA, 23 nt, Homo sapiens
cauaauuaugggaacaaguguac

SEQ ID NO: 1763635 - RNA, 18 nt, Homo sapiens
gucucuugaggcacagaa

SEQ ID NO: 1763636 - RNA, 18 nt, Homo sapiens
aucuuuguauauuacaua

SEQ ID NO: 1763637 - RNA, 20 nt, Homo sapiens
gcucucccucucugcaccug

SEQ ID NO: 1763638 - RNA, 16 nt, Homo sapiens
ugagaacauuuacaca

SEQ ID NO: 1763639 - RNA, 19 nt, Homo sapiens
agacaaggccgucaggacc

SEQ ID NO: 1763640 - RNA, 18 nt, Homo sapiens
cuucacucugacaguauu

SEQ ID NO: 1763641 - RNA, 12 nt, Homo sapiens
cccaccagugcc

SEQ ID NO: 1763642 - RNA, 21 nt, Homo sapiens
uaagauaaauucaugcacuuu

SEQ ID NO: 1763643 - RNA, 15 nt, Homo sapiens
uccugaauccagcau

SEQ ID NO: 1763644 - RNA, 18 nt, Homo sapiens
caggccucucucugcucc

SEQ ID NO: 1763645 - RNA, 16 nt, Homo sapiens
caccuuggaauucgcu

SEQ ID NO: 1763646 - RNA, 15 nt, Homo sapiens
aaauuccuugcccca

SEQ ID NO: 1763647 - RNA, 14 nt, Homo sapiens
uaaaauaagcacag

SEQ ID NO: 1763648 - RNA, 14 nt, Homo sapiens
uccaagaagaccau

SEQ ID NO: 1763649 - RNA, 16 nt, Homo sapiens
uauucacauguucuaa

SEQ ID NO: 1763650 - RNA, 15 nt, Homo sapiens
agacacaugggugcu

SEQ ID NO: 1763651 - RNA, 15 nt, Homo sapiens
ccacuaaccaucccc

SEQ ID NO: 1763652 - RNA, 20 nt, Homo sapiens
gagggaaaguaaauauuuca

SEQ ID NO: 1763653 - RNA, 16 nt, Homo sapiens
uuugaaagaacaucag

SEQ ID NO: 1763654 - RNA, 18 nt, Homo sapiens
aauuucagccuacauuga

SEQ ID NO: 1763655 - RNA, 18 nt, Homo sapiens
ucuuucuaaugugugaau

SEQ ID NO: 1763656 - RNA, 22 nt, Homo sapiens
uguguugucaacaaaccaagca

SEQ ID NO: 1763657 - RNA, 19 nt, Homo sapiens
uaugaaaaaucaaugucaa

SEQ ID NO: 1763658 - RNA, 22 nt, Homo sapiens
aggaaacccccaguguaauaau

SEQ ID NO: 1763659 - RNA, 17 nt, Homo sapiens
ugugguaaucuacacca

SEQ ID NO: 1763660 - RNA, 14 nt, Homo sapiens
gcgguugaggagaa

SEQ ID NO: 1763661 - RNA, 21 nt, Homo sapiens
accacguccuuauuggaauaa

SEQ ID NO: 1763662 - RNA, 13 nt, Homo sapiens
ccugauccucacc

SEQ ID NO: 1763663 - RNA, 14 nt, Homo sapiens
gccacgaccugggg

SEQ ID NO: 1763664 - RNA, 21 nt, Homo sapiens
cccuugccgaaccaggagcug

SEQ ID NO: 1763665 - RNA, 20 nt, Homo sapiens
gcccuugucugagaugcugg

SEQ ID NO: 1763666 - RNA, 13 nt, Homo sapiens
ccagagguccagg

SEQ ID NO: 1763667 - RNA, 12 nt, Homo sapiens
cucaauguuuga

SEQ ID NO: 1763668 - RNA, 17 nt, Homo sapiens
aaauacaguauaucuaa

SEQ ID NO: 1763669 - RNA, 21 nt, Homo sapiens
agcucacccugcccgcuccca

SEQ ID NO: 1763670 - RNA, 15 nt, Homo sapiens
gugcugacucuggcc

SEQ ID NO: 1763671 - RNA, 17 nt, Homo sapiens
gacaacugacaauauga

SEQ ID NO: 1763672 - RNA, 20 nt, Homo sapiens
gugguauguaauuuaugcaa

SEQ ID NO: 1763673 - RNA, 12 nt, Homo sapiens
uagcuugcuccc

SEQ ID NO: 1763674 - RNA, 14 nt, Homo sapiens
uccugugacuguuu

SEQ ID NO: 1763675 - RNA, 22 nt, Homo sapiens
accccuagagacagugaugccu

SEQ ID NO: 1763676 - RNA, 23 nt, Homo sapiens
guggagccauugaacagcuguga

SEQ ID NO: 1763677 - RNA, 21 nt, Homo sapiens
cuggaaaaaaaaaaauaugag

SEQ ID NO: 1763678 - RNA, 17 nt, Homo sapiens
ccaaggccccacuuuca

SEQ ID NO: 1763679 - RNA, 17 nt, Homo sapiens
aaugaaacugcugugaa

SEQ ID NO: 1763680 - RNA, 18 nt, Homo sapiens
cugucaccugagacccaa

SEQ ID NO: 1763681 - RNA, 15 nt, Homo sapiens
caagcgccgcuguga

SEQ ID NO: 1763682 - RNA, 19 nt, Homo sapiens
caacccagccugagugcac

SEQ ID NO: 1763683 - RNA, 18 nt, Homo sapiens
gauugagaaggagcuccc

SEQ ID NO: 1763684 - RNA, 17 nt, Homo sapiens
gggaaugaaccauggca

SEQ ID NO: 1763685 - RNA, 23 nt, Homo sapiens
acuugcucucuuucccacuccua

SEQ ID NO: 1763686 - RNA, 13 nt, Homo sapiens
guuuggggagcag

SEQ ID NO: 1763687 - RNA, 17 nt, Homo sapiens
uuaugguuaauacuauu

SEQ ID NO: 1763688 - RNA, 23 nt, Homo sapiens
auucccaucacaacauuccucag

SEQ ID NO: 1763689 - RNA, 20 nt, Homo sapiens
gaucacgccauugcacucca

SEQ ID NO: 1763690 - RNA, 18 nt, Homo sapiens
ggauggccucuggggcag

SEQ ID NO: 1763691 - RNA, 18 nt, Homo sapiens
uggccucccaccaggaau

SEQ ID NO: 1763692 - RNA, 13 nt, Homo sapiens
cagggccagucuu

SEQ ID NO: 1763693 - RNA, 22 nt, Homo sapiens
gguggucaguaguuucauuucc

SEQ ID NO: 1763694 - RNA, 23 nt, Homo sapiens
aguuucuugcuuggaagccaggu

SEQ ID NO: 1763695 - RNA, 19 nt, Homo sapiens
uauccaagaaucagugaag

SEQ ID NO: 1763696 - RNA, 16 nt, Homo sapiens
uggcaguuccuggcau

SEQ ID NO: 1763697 - RNA, 23 nt, Homo sapiens
cguguguauguguauguguguga

SEQ ID NO: 1763698 - RNA, 15 nt, Homo sapiens
aacauuuacauguau

SEQ ID NO: 1763699 - RNA, 19 nt, Homo sapiens
acccucuggagauaaaaua

SEQ ID NO: 1763700 - RNA, 21 nt, Homo sapiens
auuagcauaauuuuguguugu

SEQ ID NO: 1763701 - RNA, 21 nt, Homo sapiens
ggagaaaagggauggagcuga

SEQ ID NO: 1763702 - RNA, 20 nt, Homo sapiens
uguuaucaccuaagcacuuc

SEQ ID NO: 1763703 - RNA, 22 nt, Homo sapiens
aguagaauuaagucagagccaa

SEQ ID NO: 1763704 - RNA, 15 nt, Homo sapiens
auuuuguaacuucca

SEQ ID NO: 1763705 - RNA, 14 nt, Homo sapiens
acaauggucucagc

SEQ ID NO: 1763706 - RNA, 20 nt, Homo sapiens
uuucaguguuggcaagcucu

SEQ ID NO: 1763707 - RNA, 22 nt, Homo sapiens
cauuauaaauaaauaccaaaaa

SEQ ID NO: 1763708 - RNA, 16 nt, Homo sapiens
acucuaagcucagugc

SEQ ID NO: 1763709 - RNA, 14 nt, Homo sapiens
cucagaacaaugaa

SEQ ID NO: 1763710 - RNA, 20 nt, Homo sapiens
ccggucguggggaaaucuca

SEQ ID NO: 1763711 - RNA, 19 nt, Homo sapiens
caaucucuuuauuacugag

SEQ ID NO: 1763712 - RNA, 17 nt, Homo sapiens
acaaugaaaacaaauaa

SEQ ID NO: 1763713 - RNA, 15 nt, Homo sapiens
cuaaaauacauuuau

SEQ ID NO: 1763714 - RNA, 18 nt, Homo sapiens
acaaucaugaaauaugca

SEQ ID NO: 1763715 - RNA, 16 nt, Homo sapiens
accugucccccugaca

SEQ ID NO: 1763716 - RNA, 11 nt, Homo sapiens
agaaugcagua

SEQ ID NO: 1763717 - RNA, 15 nt, Homo sapiens
uucagucuuguagug

SEQ ID NO: 1763718 - RNA, 17 nt, Homo sapiens
uuccuguguauucucau

SEQ ID NO: 1763719 - RNA, 16 nt, Homo sapiens
ggucccacgagggugc

SEQ ID NO: 1763720 - RNA, 16 nt, Homo sapiens
aagcauuuugugaugu

SEQ ID NO: 1763721 - RNA, 19 nt, Homo sapiens
ugugaaagcuagacugaac

SEQ ID NO: 1763722 - RNA, 12 nt, Homo sapiens
ugcaaugugauc

SEQ ID NO: 1763723 - RNA, 13 nt, Homo sapiens
accguucccucac

SEQ ID NO: 1763724 - RNA, 24 nt, Homo sapiens
cauuuaucuguacauacuuuuuca

SEQ ID NO: 1763725 - RNA, 11 nt, Homo sapiens
uuccugugaaa

SEQ ID NO: 1763726 - RNA, 19 nt, Homo sapiens
ggccauaaacgguuccugg

SEQ ID NO: 1763727 - RNA, 12 nt, Homo sapiens
ugggugggacca

SEQ ID NO: 1763728 - RNA, 22 nt, Homo sapiens
cacagagugcuggacuguucca

SEQ ID NO: 1763729 - RNA, 21 nt, Homo sapiens
ucacauuggcaaguguaaaaa

SEQ ID NO: 1763730 - RNA, 19 nt, Homo sapiens
acuaguggcaaaugaccuu

SEQ ID NO: 1763731 - RNA, 20 nt, Homo sapiens
aagaaaaggacaaauaucuu

SEQ ID NO: 1763732 - RNA, 20 nt, Homo sapiens
uagauuuugaaaaauuaccu

SEQ ID NO: 1763733 - RNA, 21 nt, Homo sapiens
agcuacguuuacucacagcca

SEQ ID NO: 1763734 - RNA, 19 nt, Homo sapiens
acaaauagaccuaaauuaa

SEQ ID NO: 1763735 - RNA, 13 nt, Homo sapiens
ccuguuuucacuc

SEQ ID NO: 1763736 - RNA, 16 nt, Homo sapiens
gaacaccugcauucuu

SEQ ID NO: 1763737 - RNA, 17 nt, Homo sapiens
caauuauacugaagcua

SEQ ID NO: 1763738 - RNA, 13 nt, Homo sapiens
aaaguuaagcaaa

SEQ ID NO: 1763739 - RNA, 16 nt, Homo sapiens
auuucaccagucacug

SEQ ID NO: 1763740 - RNA, 16 nt, Homo sapiens
caaccugaauguccca

SEQ ID NO: 1763741 - RNA, 20 nt, Homo sapiens
uugcaagaugugaauuauug

SEQ ID NO: 1763742 - RNA, 23 nt, Homo sapiens
gcaaaauguuagcauguaugaca

SEQ ID NO: 1763743 - RNA, 18 nt, Homo sapiens
ucuguguccuuccuugaa

SEQ ID NO: 1763744 - RNA, 22 nt, Homo sapiens
ccccaccgccgggguccuggga

SEQ ID NO: 1763745 - RNA, 19 nt, Homo sapiens
uccucucuugauucucucc

SEQ ID NO: 1763746 - RNA, 23 nt, Homo sapiens
caaucgcuuuccuaaaacaguag

SEQ ID NO: 1763747 - RNA, 18 nt, Homo sapiens
ucuguagcuuucuggaau

SEQ ID NO: 1763748 - RNA, 18 nt, Homo sapiens
uaaguaucacacuguaua

SEQ ID NO: 1763749 - RNA, 14 nt, Homo sapiens
agaaaucugaaaag

SEQ ID NO: 1763750 - RNA, 14 nt, Homo sapiens
agccuucugaccug

SEQ ID NO: 1763751 - RNA, 13 nt, Homo sapiens
gcuauagcuuuag

SEQ ID NO: 1763752 - RNA, 18 nt, Homo sapiens
gaacucuguaaaaccuca

SEQ ID NO: 1763753 - RNA, 22 nt, Homo sapiens
uuuccuguucuauuaauacaua

SEQ ID NO: 1763754 - RNA, 20 nt, Homo sapiens
aaaaaccccguuucccugaa

SEQ ID NO: 1763755 - RNA, 15 nt, Homo sapiens
uccacucagcacucu

SEQ ID NO: 1763756 - RNA, 20 nt, Homo sapiens
cgugcaaacccagugagaca

SEQ ID NO: 1763757 - RNA, 19 nt, Homo sapiens
cugucaugguguccagaca

SEQ ID NO: 1763758 - RNA, 13 nt, Homo sapiens
gucaucacuuuua

SEQ ID NO: 1763759 - RNA, 15 nt, Homo sapiens
uuccucccugcuuaa

SEQ ID NO: 1763760 - RNA, 18 nt, Homo sapiens
caucaguaacaguauuca

SEQ ID NO: 1763761 - RNA, 15 nt, Homo sapiens
ggaugccuguggaag

SEQ ID NO: 1763762 - RNA, 18 nt, Homo sapiens
agagaaaggucuaugcag

SEQ ID NO: 1763763 - RNA, 17 nt, Homo sapiens
ugagauucaauauugaa

SEQ ID NO: 1763764 - RNA, 14 nt, Homo sapiens
guauaacaacuuug

SEQ ID NO: 1763765 - RNA, 20 nt, Homo sapiens
cagcuucccucugccugacc

SEQ ID NO: 1763766 - RNA, 21 nt, Homo sapiens
aauguuagauaguuacuauau

SEQ ID NO: 1763767 - RNA, 14 nt, Homo sapiens
uuuaccguucacuu

SEQ ID NO: 1763768 - RNA, 13 nt, Homo sapiens
cacugucaucuuc

SEQ ID NO: 1763769 - RNA, 23 nt, Homo sapiens
uuuuccuucuacagcagcacugu

SEQ ID NO: 1763770 - RNA, 13 nt, Homo sapiens
gcuucuacacugg

SEQ ID NO: 1763771 - RNA, 14 nt, Homo sapiens
uucaucuacuacag

SEQ ID NO: 1763772 - RNA, 16 nt, Homo sapiens
ccacaucgcucuagga

SEQ ID NO: 1763773 - RNA, 19 nt, Homo sapiens
ucaugcuguuccaccuccc

SEQ ID NO: 1763774 - RNA, 16 nt, Homo sapiens
uuuccauccaguuccu

SEQ ID NO: 1763775 - RNA, 15 nt, Homo sapiens
aagacuuagugcugu

SEQ ID NO: 1763776 - RNA, 13 nt, Homo sapiens
acuggaagcuuug

SEQ ID NO: 1763777 - RNA, 13 nt, Homo sapiens
cuaugaagacagg

SEQ ID NO: 1763778 - RNA, 14 nt, Homo sapiens
auuaagcacuuuaa

SEQ ID NO: 1763779 - RNA, 18 nt, Homo sapiens
ggcuccuaccagcaaaca

SEQ ID NO: 1763780 - RNA, 14 nt, Homo sapiens
aaguguguuugcaa

SEQ ID NO: 1763781 - RNA, 17 nt, Homo sapiens
agguccaggcuugccuc

SEQ ID NO: 1763782 - RNA, 21 nt, Homo sapiens
gccacaaccugaaagacaaaa

SEQ ID NO: 1763783 - RNA, 16 nt, Homo sapiens
gagugaauucccucac

SEQ ID NO: 1763784 - RNA, 21 nt, Homo sapiens
auuuccagucuccaccaggaa

SEQ ID NO: 1763785 - RNA, 19 nt, Homo sapiens
gacuggaguucaguggugc

SEQ ID NO: 1763786 - RNA, 12 nt, Homo sapiens
aaucuaaacuuu

SEQ ID NO: 1763787 - RNA, 19 nt, Homo sapiens
ggccaagccugccccggcc

SEQ ID NO: 1763788 - RNA, 13 nt, Homo sapiens
aaaaagugaacag

SEQ ID NO: 1763789 - RNA, 13 nt, Homo sapiens
auaaagugaucag

SEQ ID NO: 1763790 - RNA, 22 nt, Homo sapiens
gacagaggacaauggcuuccau

SEQ ID NO: 1763791 - RNA, 16 nt, Homo sapiens
auucuguuucaggcaa

SEQ ID NO: 1763792 - RNA, 18 nt, Homo sapiens
gggagaggccucauccag

SEQ ID NO: 1763793 - RNA, 18 nt, Homo sapiens
caaaucuaccacuguaug

SEQ ID NO: 1763794 - RNA, 11 nt, Homo sapiens
gaaacauuuac

SEQ ID NO: 1763795 - RNA, 12 nt, Homo sapiens
cuggugcuccaa

SEQ ID NO: 1763796 - RNA, 13 nt, Homo sapiens
uuguucuguauau

SEQ ID NO: 1763797 - RNA, 22 nt, Homo sapiens
acucuaucggagaacaugaauc

SEQ ID NO: 1763798 - RNA, 17 nt, Homo sapiens
agaagugucacagccau

SEQ ID NO: 1763799 - RNA, 15 nt, Homo sapiens
ccccagugcccacag

SEQ ID NO: 1763800 - RNA, 20 nt, Homo sapiens
cauaggacuggaaguuugcc

SEQ ID NO: 1763801 - RNA, 21 nt, Homo sapiens
cugaagucaccucuugguuac

SEQ ID NO: 1763802 - RNA, 15 nt, Homo sapiens
cugggccguggcaca

SEQ ID NO: 1763803 - RNA, 18 nt, Homo sapiens
guacucaggcagugcagu

SEQ ID NO: 1763804 - RNA, 19 nt, Homo sapiens
gguucaaaaccuugcacag

SEQ ID NO: 1763805 - RNA, 18 nt, Homo sapiens
gacauuaaaucuaugaag

SEQ ID NO: 1763806 - RNA, 22 nt, Homo sapiens
cauucucuaauaagaaaaccac

SEQ ID NO: 1763807 - RNA, 13 nt, Homo sapiens
uaccugaaaggaa

SEQ ID NO: 1763808 - RNA, 11 nt, Homo sapiens
uugcuugccuc

SEQ ID NO: 1763809 - RNA, 18 nt, Homo sapiens
augucacaugacauccac

SEQ ID NO: 1763810 - RNA, 21 nt, Homo sapiens
uuuaucuauggcacccaugca

SEQ ID NO: 1763811 - RNA, 18 nt, Homo sapiens
agccuaauugucacauca

SEQ ID NO: 1763812 - RNA, 22 nt, Homo sapiens
uugauaauuuugaaaugauuca

SEQ ID NO: 1763813 - RNA, 15 nt, Homo sapiens
gcccuggugcgaaug

SEQ ID NO: 1763814 - RNA, 24 nt, Homo sapiens
caccccagugcacccacucugcuu

SEQ ID NO: 1763815 - RNA, 19 nt, Homo sapiens
acuaucucagcaucagaau

SEQ ID NO: 1763816 - RNA, 20 nt, Homo sapiens
uccaugugaaacauguugcc

SEQ ID NO: 1763817 - RNA, 19 nt, Homo sapiens
uaagacaauggacccuuuu

SEQ ID NO: 1763818 - RNA, 18 nt, Homo sapiens
auuuggaggcuaccucac

SEQ ID NO: 1763819 - RNA, 13 nt, Homo sapiens
augaggauaucau

SEQ ID NO: 1763820 - RNA, 16 nt, Homo sapiens
uuuuauaaauauguga

SEQ ID NO: 1763821 - RNA, 14 nt, Homo sapiens
gucaaugugcagug

SEQ ID NO: 1763822 - RNA, 22 nt, Homo sapiens
cuuccucucucggagcccucag

SEQ ID NO: 1763823 - RNA, 17 nt, Homo sapiens
ccuccggugugagauau

SEQ ID NO: 1763824 - RNA, 17 nt, Homo sapiens
cuuagcuuagaccucag

SEQ ID NO: 1763825 - RNA, 15 nt, Homo sapiens
gucgcccuacucacc

SEQ ID NO: 1763826 - RNA, 23 nt, Homo sapiens
auauuugcauaauaugcauauau

SEQ ID NO: 1763827 - RNA, 20 nt, Homo sapiens
gauuugcguggaaaucucag

SEQ ID NO: 1763828 - RNA, 18 nt, Homo sapiens
aaaccaaagagggcuucc

SEQ ID NO: 1763829 - RNA, 13 nt, Homo sapiens
uaggugcaaaaau

SEQ ID NO: 1763830 - RNA, 14 nt, Homo sapiens
ggccgccuguccuu

SEQ ID NO: 1763831 - RNA, 19 nt, Homo sapiens
cagcauggguuagugcuau

SEQ ID NO: 1763832 - RNA, 16 nt, Homo sapiens
gugggcugaguacagu

SEQ ID NO: 1763833 - RNA, 13 nt, Homo sapiens
cuuaaaauguaau

SEQ ID NO: 1763834 - RNA, 16 nt, Homo sapiens
caggcagacacaugcu

SEQ ID NO: 1763835 - RNA, 16 nt, Homo sapiens
ggaaaaccgaguaucu

SEQ ID NO: 1763836 - RNA, 13 nt, Homo sapiens
ccaccuaauauca

SEQ ID NO: 1763837 - RNA, 22 nt, Homo sapiens
ccucuuccccagaaaggagacu

SEQ ID NO: 1763838 - RNA, 22 nt, Homo sapiens
cugaucaaggugcucuucucau

SEQ ID NO: 1763839 - RNA, 16 nt, Homo sapiens
acuuugaagcaacugu

SEQ ID NO: 1763840 - RNA, 13 nt, Homo sapiens
uguagacaggaaa

SEQ ID NO: 1763841 - RNA, 9 nt, Homo sapiens
aagaacaag

SEQ ID NO: 1763842 - RNA, 11 nt, Homo sapiens
augucuguccu

SEQ ID NO: 1763843 - RNA, 18 nt, Homo sapiens
guuuauuucaacuauuua

SEQ ID NO: 1763844 - RNA, 20 nt, Homo sapiens
uaccaacugggccucugaug

SEQ ID NO: 1763845 - RNA, 12 nt, Homo sapiens
aagauucaugug

SEQ ID NO: 1763846 - RNA, 12 nt, Homo sapiens
gaaucaucucaa

SEQ ID NO: 1763847 - RNA, 14 nt, Homo sapiens
uggcagcucaaaau

SEQ ID NO: 1763848 - RNA, 18 nt, Homo sapiens
aaacauucuuuaacauac

SEQ ID NO: 1763849 - RNA, 17 nt, Homo sapiens
acuuuaccugaaagaca

SEQ ID NO: 1763850 - RNA, 20 nt, Homo sapiens
accauucuugagucauggau

SEQ ID NO: 1763851 - RNA, 15 nt, Homo sapiens
ugggaggccagugag

SEQ ID NO: 1763852 - RNA, 17 nt, Homo sapiens
aaacuccugacuuugug

SEQ ID NO: 1763853 - RNA, 23 nt, Homo sapiens
gaaugagccguauacaaggaaua

SEQ ID NO: 1763854 - RNA, 19 nt, Homo sapiens
cacuccagugcccaucagc

SEQ ID NO: 1763855 - RNA, 21 nt, Homo sapiens
uacagucuaaaauugcuucuu

SEQ ID NO: 1763856 - RNA, 19 nt, Homo sapiens
cuucucacauggaaugagg

SEQ ID NO: 1763857 - RNA, 21 nt, Homo sapiens
uccaguacugguuuuccaacu

SEQ ID NO: 1763858 - RNA, 22 nt, Homo sapiens
gugccagugucauccgggccua

SEQ ID NO: 1763859 - RNA, 17 nt, Homo sapiens
uuccuagaggagacagc

SEQ ID NO: 1763860 - RNA, 16 nt, Homo sapiens
cauucuguguggcacc

SEQ ID NO: 1763861 - RNA, 18 nt, Homo sapiens
gggcagccuccuugccug

SEQ ID NO: 1763862 - RNA, 14 nt, Homo sapiens
agacaccuagacuc

SEQ ID NO: 1763863 - RNA, 14 nt, Homo sapiens
ccaguccuccagac

SEQ ID NO: 1763864 - RNA, 13 nt, Homo sapiens
ugcuucuguagaa

SEQ ID NO: 1763865 - RNA, 16 nt, Homo sapiens
gacugugaccaaagca

SEQ ID NO: 1763866 - RNA, 20 nt, Homo sapiens
guaacaaucacuguucuaua

SEQ ID NO: 1763867 - RNA, 18 nt, Homo sapiens
uagcagcacagcugccaa

SEQ ID NO: 1763868 - RNA, 17 nt, Homo sapiens
uaauaucacagcauaac

SEQ ID NO: 1763869 - RNA, 16 nt, Homo sapiens
auauuuaggguacuau

SEQ ID NO: 1763870 - RNA, 18 nt, Homo sapiens
aaauguagcgacugucaa

SEQ ID NO: 1763871 - RNA, 17 nt, Homo sapiens
uaaauguauacuauagu

SEQ ID NO: 1763872 - RNA, 23 nt, Homo sapiens
auuuaaaaaagaaaaaaguccag

SEQ ID NO: 1763873 - RNA, 18 nt, Homo sapiens
aaauuugauugauuugaa

SEQ ID NO: 1763874 - RNA, 16 nt, Homo sapiens
gucgggaaauucugcu

SEQ ID NO: 1763875 - RNA, 19 nt, Homo sapiens
uaguuguccucagguucaa

SEQ ID NO: 1763876 - RNA, 17 nt, Homo sapiens
uacauggaauagcaccu

SEQ ID NO: 1763877 - RNA, 20 nt, Homo sapiens
cagagcgagauucugccuca

SEQ ID NO: 1763878 - RNA, 18 nt, Homo sapiens
cuguaaucccagcacuuu

SEQ ID NO: 1763879 - RNA, 17 nt, Homo sapiens
cucauccaugcacuuua

SEQ ID NO: 1763880 - RNA, 20 nt, Homo sapiens
ggaaugggaagaaguaguuu

SEQ ID NO: 1763881 - RNA, 19 nt, Homo sapiens
ucuggagcacuuguuuuaa

SEQ ID NO: 1763882 - RNA, 14 nt, Homo sapiens
ccagcaguuaggca

SEQ ID NO: 1763883 - RNA, 22 nt, Homo sapiens
uuaauuugaccagaaaauauga

SEQ ID NO: 1763884 - RNA, 16 nt, Homo sapiens
cuuuaugcccuugccu

SEQ ID NO: 1763885 - RNA, 13 nt, Homo sapiens
cuccaaguggucc

SEQ ID NO: 1763886 - RNA, 18 nt, Homo sapiens
aaccaguuaugugaauga

SEQ ID NO: 1763887 - RNA, 17 nt, Homo sapiens
ugcacagauugcugaaa

SEQ ID NO: 1763888 - RNA, 16 nt, Homo sapiens
acuuauccuguucucu

SEQ ID NO: 1763889 - RNA, 17 nt, Homo sapiens
uuuuccaugaccuuaag

SEQ ID NO: 1763890 - RNA, 17 nt, Homo sapiens
uuucccauuacuuuaau

SEQ ID NO: 1763891 - RNA, 21 nt, Homo sapiens
gaauucugggcaagucaccca

SEQ ID NO: 1763892 - RNA, 21 nt, Homo sapiens
cugacaugcucacacauuaca

SEQ ID NO: 1763893 - RNA, 20 nt, Homo sapiens
auaccucaaacuaucuggcc

SEQ ID NO: 1763894 - RNA, 15 nt, Homo sapiens
gauuucuggggcccc

SEQ ID NO: 1763895 - RNA, 22 nt, Homo sapiens
gaccauuuuuacauccaugaaa

SEQ ID NO: 1763896 - RNA, 15 nt, Homo sapiens
ccgagggauggugcc

SEQ ID NO: 1763897 - RNA, 18 nt, Homo sapiens
ucagcaaacuaaccagca

SEQ ID NO: 1763898 - RNA, 12 nt, Homo sapiens
ccacagcacuau

SEQ ID NO: 1763899 - RNA, 23 nt, Homo sapiens
cacucccuaauuuaugugcuaua

SEQ ID NO: 1763900 - RNA, 14 nt, Homo sapiens
ucaaagauugaaca

SEQ ID NO: 1763901 - RNA, 15 nt, Homo sapiens
uuguaagaguguaga

SEQ ID NO: 1763902 - RNA, 16 nt, Homo sapiens
ucuuauaaaaucaaua

SEQ ID NO: 1763903 - RNA, 22 nt, Homo sapiens
aggccuuugcuuuacagcacug

SEQ ID NO: 1763904 - RNA, 19 nt, Homo sapiens
caagcugggaacuucuaaa

SEQ ID NO: 1763905 - RNA, 13 nt, Homo sapiens
aggacaaguuuua

SEQ ID NO: 1763906 - RNA, 24 nt, Homo sapiens
ugagaaacaaugacuaauucuugc

SEQ ID NO: 1763907 - RNA, 17 nt, Homo sapiens
aguuuugucacaauuau

SEQ ID NO: 1763908 - RNA, 23 nt, Homo sapiens
gugaucaaagguaacucgaggug

SEQ ID NO: 1763909 - RNA, 22 nt, Homo sapiens
agccaacgagacacauugccuu

SEQ ID NO: 1763910 - RNA, 14 nt, Homo sapiens
ucuauaacuccuug

SEQ ID NO: 1763911 - RNA, 20 nt, Homo sapiens
uauuuuauauauuaugucau

SEQ ID NO: 1763912 - RNA, 14 nt, Homo sapiens
aaaaugcuacuuaa

SEQ ID NO: 1763913 - RNA, 23 nt, Homo sapiens
agaaaucuugcuucagaccauca

SEQ ID NO: 1763914 - RNA, 19 nt, Homo sapiens
ccuccugugacccgugaau

SEQ ID NO: 1763915 - RNA, 22 nt, Homo sapiens
uuauucucguuuuaaaacccau

SEQ ID NO: 1763916 - RNA, 13 nt, Homo sapiens
gugccuggagcua

SEQ ID NO: 1763917 - RNA, 17 nt, Homo sapiens
cugugcggacagcccuu

SEQ ID NO: 1763918 - RNA, 20 nt, Homo sapiens
agggagccggggcugugaga

SEQ ID NO: 1763919 - RNA, 14 nt, Homo sapiens
uaaauaaguuuucc

SEQ ID NO: 1763920 - RNA, 13 nt, Homo sapiens
gccuccugugguc

SEQ ID NO: 1763921 - RNA, 12 nt, Homo sapiens
aacauuauucca

SEQ ID NO: 1763922 - RNA, 15 nt, Homo sapiens
caguuggugcugcuu

SEQ ID NO: 1763923 - RNA, 15 nt, Homo sapiens
uugcagcuaagcuca

SEQ ID NO: 1763924 - RNA, 13 nt, Homo sapiens
ucugccugagcuu

SEQ ID NO: 1763925 - RNA, 15 nt, Homo sapiens
agugauggucauuca

SEQ ID NO: 1763926 - RNA, 16 nt, Homo sapiens
aauaccaguacuugag

SEQ ID NO: 1763927 - RNA, 17 nt, Homo sapiens
aaagguaaggugaaggu

SEQ ID NO: 1763928 - RNA, 17 nt, Homo sapiens
acccaugaaacagcagc

SEQ ID NO: 1763929 - RNA, 17 nt, Homo sapiens
cacacugaguugcacau

SEQ ID NO: 1763930 - RNA, 22 nt, Homo sapiens
aaguuuucuuuuacuaucuuuu

SEQ ID NO: 1763931 - RNA, 15 nt, Homo sapiens
ugauacaagagucag

SEQ ID NO: 1763932 - RNA, 16 nt, Homo sapiens
cugcaggccaccagcu

SEQ ID NO: 1763933 - RNA, 18 nt, Homo sapiens
guauguagacaugcacac

SEQ ID NO: 1763934 - RNA, 16 nt, Homo sapiens
cgcacagcacugccug

SEQ ID NO: 1763935 - RNA, 18 nt, Homo sapiens
uuaaguaagucucaaggu

SEQ ID NO: 1763936 - RNA, 12 nt, Homo sapiens
agauacaugucu

SEQ ID NO: 1763937 - RNA, 13 nt, Homo sapiens
cuuuaugaacucc

SEQ ID NO: 1763938 - RNA, 19 nt, Homo sapiens
cuguagcagcauuacagaa

SEQ ID NO: 1763939 - RNA, 14 nt, Homo sapiens
cauuuacuugauca

SEQ ID NO: 1763940 - RNA, 21 nt, Homo sapiens
gacccugggagagugagguca

SEQ ID NO: 1763941 - RNA, 16 nt, Homo sapiens
auugauaaguucauac

SEQ ID NO: 1763942 - RNA, 16 nt, Homo sapiens
acacacaagcagacac

SEQ ID NO: 1763943 - RNA, 14 nt, Homo sapiens
cacauuugauucug

SEQ ID NO: 1763944 - RNA, 15 nt, Homo sapiens
aaggacgugucucag

SEQ ID NO: 1763945 - RNA, 10 nt, Homo sapiens
caaaaacugu

SEQ ID NO: 1763946 - RNA, 15 nt, Homo sapiens
ucuugccagccacau

SEQ ID NO: 1763947 - RNA, 12 nt, Homo sapiens
gauacugucucu

SEQ ID NO: 1763948 - RNA, 20 nt, Homo sapiens
acagacgagacaacagcaca

SEQ ID NO: 1763949 - RNA, 12 nt, Homo sapiens
uacuaaaugcag

SEQ ID NO: 1763950 - RNA, 19 nt, Homo sapiens
aauggaucuuaaagcauuc

SEQ ID NO: 1763951 - RNA, 19 nt, Homo sapiens
aucaagugacuucugccca

SEQ ID NO: 1763952 - RNA, 15 nt, Homo sapiens
cauguuaugccuguu

SEQ ID NO: 1763953 - RNA, 18 nt, Homo sapiens
aguucuuugaaccacagc

SEQ ID NO: 1763954 - RNA, 11 nt, Homo sapiens
augacagugaa

SEQ ID NO: 1763955 - RNA, 16 nt, Homo sapiens
acuuguagcauauucu

SEQ ID NO: 1763956 - RNA, 21 nt, Homo sapiens
uucucuggcucuuguccaucu

SEQ ID NO: 1763957 - RNA, 21 nt, Homo sapiens
cuguaauauuguaaauacugg

SEQ ID NO: 1763958 - RNA, 20 nt, Homo sapiens
ugaagaagaaaacaugucug

SEQ ID NO: 1763959 - RNA, 17 nt, Homo sapiens
uaauaaacauccuucaa

SEQ ID NO: 1763960 - RNA, 21 nt, Homo sapiens
uauagauucuuuauuagugaa

SEQ ID NO: 1763961 - RNA, 15 nt, Homo sapiens
acacugaaauugccu

SEQ ID NO: 1763962 - RNA, 18 nt, Homo sapiens
auggcggucagccccuuc

SEQ ID NO: 1763963 - RNA, 20 nt, Homo sapiens
aaugcccaguucacuucuuu

SEQ ID NO: 1763964 - RNA, 17 nt, Homo sapiens
cuuuucucccacacaaa

SEQ ID NO: 1763965 - RNA, 15 nt, Homo sapiens
gguccucccauuucu

SEQ ID NO: 1763966 - RNA, 22 nt, Homo sapiens
cuauaggugacuuuugcaauuc

SEQ ID NO: 1763967 - RNA, 14 nt, Homo sapiens
agacauguaugugu

SEQ ID NO: 1763968 - RNA, 12 nt, Homo sapiens
ugcugcugugca

SEQ ID NO: 1763969 - RNA, 19 nt, Homo sapiens
auagcugggauuugaacug

SEQ ID NO: 1763970 - RNA, 15 nt, Homo sapiens
auuaggacauaacag

SEQ ID NO: 1763971 - RNA, 20 nt, Homo sapiens
gugcacuccccguguucaua

SEQ ID NO: 1763972 - RNA, 13 nt, Homo sapiens
aauuuuacuucca

SEQ ID NO: 1763973 - RNA, 12 nt, Homo sapiens
gccgacacuguu

SEQ ID NO: 1763974 - RNA, 16 nt, Homo sapiens
ggcacaaagaugggug

SEQ ID NO: 1763975 - RNA, 20 nt, Homo sapiens
cuuagaaaauucaagcauuu

SEQ ID NO: 1763976 - RNA, 14 nt, Homo sapiens
aauacacuguuauc

SEQ ID NO: 1763977 - RNA, 11 nt, Homo sapiens
gaggacacaau

SEQ ID NO: 1763978 - RNA, 14 nt, Homo sapiens
ucuaaauuacugau

SEQ ID NO: 1763979 - RNA, 21 nt, Homo sapiens
cucagucugggugggacuuau

SEQ ID NO: 1763980 - RNA, 19 nt, Homo sapiens
aguaucugggaacugugcc

SEQ ID NO: 1763981 - RNA, 14 nt, Homo sapiens
ucucacugacuauu

SEQ ID NO: 1763982 - RNA, 21 nt, Homo sapiens
ccugagcccaaggcacugaga

SEQ ID NO: 1763983 - RNA, 18 nt, Homo sapiens
auaaagcuucucucugag

SEQ ID NO: 1763984 - RNA, 23 nt, Homo sapiens
ggauggacgaacaggggccaaac

SEQ ID NO: 1763985 - RNA, 13 nt, Homo sapiens
auccucacugggc

SEQ ID NO: 1763986 - RNA, 20 nt, Homo sapiens
ugcuucucaucccaaccucu

SEQ ID NO: 1763987 - RNA, 23 nt, Homo sapiens
cucaucaggccauugucccugaa

SEQ ID NO: 1763988 - RNA, 16 nt, Homo sapiens
aaauuucauugcacuu

SEQ ID NO: 1763989 - RNA, 18 nt, Homo sapiens
acaauaaggucaaugcca

SEQ ID NO: 1763990 - RNA, 22 nt, Homo sapiens
gagacugggagccacuucuccc

SEQ ID NO: 1763991 - RNA, 15 nt, Homo sapiens
accaaguggcuccca

SEQ ID NO: 1763992 - RNA, 15 nt, Homo sapiens
cucugaaagaccuau

SEQ ID NO: 1763993 - RNA, 16 nt, Homo sapiens
uggaaggggcaaagaa

SEQ ID NO: 1763994 - RNA, 19 nt, Homo sapiens
uguucuucuucauauucua

SEQ ID NO: 1763995 - RNA, 21 nt, Homo sapiens
caggaaacuccacaucugccu

SEQ ID NO: 1763996 - RNA, 21 nt, Homo sapiens
ucccagcugaaauacugaggg

SEQ ID NO: 1763997 - RNA, 20 nt, Homo sapiens
cagauguccaucagaugaca

SEQ ID NO: 1763998 - RNA, 23 nt, Homo sapiens
cucucugacgcuugugacagugc

SEQ ID NO: 1763999 - RNA, 19 nt, Homo sapiens
auuaauaauagcuaauaau

SEQ ID NO: 1764000 - RNA, 21 nt, Homo sapiens
ugugaacguggggugagggau

SEQ ID NO: 1764001 - RNA, 21 nt, Homo sapiens
cuucaagagcaucuggaacaa

SEQ ID NO: 1764002 - RNA, 22 nt, Homo sapiens
ggugcugguuuauguucuagga

SEQ ID NO: 1764003 - RNA, 21 nt, Homo sapiens
auuuuugguaguuucuggguc

SEQ ID NO: 1764004 - RNA, 14 nt, Homo sapiens
uguuaaagcuauuu

SEQ ID NO: 1764005 - RNA, 23 nt, Homo sapiens
ucugucuugaugugucaucuaau

SEQ ID NO: 1764006 - RNA, 15 nt, Homo sapiens
auuuuagccaugccu

SEQ ID NO: 1764007 - RNA, 18 nt, Homo sapiens
aauggaggcaacgccaga

SEQ ID NO: 1764008 - RNA, 20 nt, Homo sapiens
cacguucuagugaaacugca

SEQ ID NO: 1764009 - RNA, 17 nt, Homo sapiens
gagcuauggugaggugu

SEQ ID NO: 1764010 - RNA, 18 nt, Homo sapiens
auugccucuaugugcaac

SEQ ID NO: 1764011 - RNA, 16 nt, Homo sapiens
agagcccaagugccau

SEQ ID NO: 1764012 - RNA, 18 nt, Homo sapiens
cuguauucccaguuacuu

SEQ ID NO: 1764013 - RNA, 21 nt, Homo sapiens
gggaggcucggggcuccccac

SEQ ID NO: 1764014 - RNA, 20 nt, Homo sapiens
auguaaauaaauuguaauau

SEQ ID NO: 1764015 - RNA, 19 nt, Homo sapiens
uacccauuugggugggagu

SEQ ID NO: 1764016 - RNA, 20 nt, Homo sapiens
gcagcccuuguuuauaugcc

SEQ ID NO: 1764017 - RNA, 22 nt, Homo sapiens
ccaaauaggagggagacugugg

SEQ ID NO: 1764018 - RNA, 20 nt, Homo sapiens
cacacccuauaucuccgugu

SEQ ID NO: 1764019 - RNA, 11 nt, Homo sapiens
gugauuugccu

SEQ ID NO: 1764020 - RNA, 14 nt, Homo sapiens
uguuuuuaaguccu

SEQ ID NO: 1764021 - RNA, 21 nt, Homo sapiens
agcugcccccuccaggccagu

SEQ ID NO: 1764022 - RNA, 16 nt, Homo sapiens
gccgucucugauucuc

SEQ ID NO: 1764023 - RNA, 17 nt, Homo sapiens
agagaaauauaauuccu

SEQ ID NO: 1764024 - RNA, 22 nt, Homo sapiens
ugagaucugugguggucuucaa

SEQ ID NO: 1764025 - RNA, 19 nt, Homo sapiens
aucacagcagggccuucug

SEQ ID NO: 1764026 - RNA, 22 nt, Homo sapiens
cugaaaugcaagaccccaagag

SEQ ID NO: 1764027 - RNA, 20 nt, Homo sapiens
ccccagagggccuggcucuc

SEQ ID NO: 1764028 - RNA, 18 nt, Homo sapiens
uaagcccccuucccuucc

SEQ ID NO: 1764029 - RNA, 16 nt, Homo sapiens
gggaaaaggggcuccu

SEQ ID NO: 1764030 - RNA, 21 nt, Homo sapiens
gcccauacuuguaaucccagc

SEQ ID NO: 1764031 - RNA, 21 nt, Homo sapiens
aaacacuucugcuuucacuua

SEQ ID NO: 1764032 - RNA, 19 nt, Homo sapiens
aaguguuguguuccuggcu

SEQ ID NO: 1764033 - RNA, 13 nt, Homo sapiens
aaauguggauuaa

SEQ ID NO: 1764034 - RNA, 12 nt, Homo sapiens
acuggaugcauc

SEQ ID NO: 1764035 - RNA, 15 nt, Homo sapiens
caaaguacuugucau

SEQ ID NO: 1764036 - RNA, 16 nt, Homo sapiens
gaaaaguuuaaccuaa

SEQ ID NO: 1764037 - RNA, 16 nt, Homo sapiens
ucugcauuuucugggu

SEQ ID NO: 1764038 - RNA, 19 nt, Homo sapiens
acuccuggacuacuuucau

SEQ ID NO: 1764039 - RNA, 21 nt, Homo sapiens
ugcuccucaccccuguaggga

SEQ ID NO: 1764040 - RNA, 16 nt, Homo sapiens
uguguggggaucucaa

SEQ ID NO: 1764041 - RNA, 19 nt, Homo sapiens
uccugccuccagcacuccc

SEQ ID NO: 1764042 - RNA, 16 nt, Homo sapiens
aaucucggcucacuga

SEQ ID NO: 1764043 - RNA, 14 nt, Homo sapiens
cuauuuacuauuca

SEQ ID NO: 1764044 - RNA, 21 nt, Homo sapiens
cuucucaaaacuggacaguca

SEQ ID NO: 1764045 - RNA, 16 nt, Homo sapiens
uguuuucccauugcag

SEQ ID NO: 1764046 - RNA, 16 nt, Homo sapiens
aagggauggugcccug

SEQ ID NO: 1764047 - RNA, 21 nt, Homo sapiens
uguacagaaacaacugccaaa

SEQ ID NO: 1764048 - RNA, 13 nt, Homo sapiens
uuacacauuccau

SEQ ID NO: 1764049 - RNA, 16 nt, Homo sapiens
accugggcugugaugu

SEQ ID NO: 1764050 - RNA, 19 nt, Homo sapiens
auaugaggggacugcaugc

SEQ ID NO: 1764051 - RNA, 16 nt, Homo sapiens
aaaggaaaacgugaac

SEQ ID NO: 1764052 - RNA, 14 nt, Homo sapiens
auaagucacuuaaa

SEQ ID NO: 1764053 - RNA, 16 nt, Homo sapiens
ucaaaccaauuucaaa

SEQ ID NO: 1764054 - RNA, 13 nt, Homo sapiens
uacaauuugccau

SEQ ID NO: 1764055 - RNA, 20 nt, Homo sapiens
cuggaaguuucuggugccau

SEQ ID NO: 1764056 - RNA, 15 nt, Homo sapiens
gaucuuaacuucacu

SEQ ID NO: 1764057 - RNA, 21 nt, Homo sapiens
accucaagcaaccaugaacuc

SEQ ID NO: 1764058 - RNA, 17 nt, Homo sapiens
aaggcaaaguuuacaga

SEQ ID NO: 1764059 - RNA, 16 nt, Homo sapiens
acuugucucauuuuaa

SEQ ID NO: 1764060 - RNA, 22 nt, Homo sapiens
cccaugggaucuugagggacca

SEQ ID NO: 1764061 - RNA, 19 nt, Homo sapiens
ugccuucugugcauccuca

SEQ ID NO: 1764062 - RNA, 17 nt, Homo sapiens
uguacacugauuccuuu

SEQ ID NO: 1764063 - RNA, 21 nt, Homo sapiens
ccagaaguucgagacuagccu

SEQ ID NO: 1764064 - RNA, 19 nt, Homo sapiens
aucacugaacuacuaaagu

SEQ ID NO: 1764065 - RNA, 13 nt, Homo sapiens
auggugaacucca

SEQ ID NO: 1764066 - RNA, 19 nt, Homo sapiens
acuugcacagggauucuca

SEQ ID NO: 1764067 - RNA, 23 nt, Homo sapiens
accccugucucuagccacuuugg

SEQ ID NO: 1764068 - RNA, 17 nt, Homo sapiens
auauaucuuuauacuua

SEQ ID NO: 1764069 - RNA, 19 nt, Homo sapiens
uguaaauaaaaucauguau

SEQ ID NO: 1764070 - RNA, 19 nt, Homo sapiens
aggacccaggaggugugau

SEQ ID NO: 1764071 - RNA, 13 nt, Homo sapiens
cgagaauuguuac

SEQ ID NO: 1764072 - RNA, 19 nt, Homo sapiens
ugauguuuggggaucgaug

SEQ ID NO: 1764073 - RNA, 14 nt, Homo sapiens
uuaaugucagugac

SEQ ID NO: 1764074 - RNA, 18 nt, Homo sapiens
gcuuuccaauguagcuca

SEQ ID NO: 1764075 - RNA, 14 nt, Homo sapiens
caaacaaauaugca

SEQ ID NO: 1764076 - RNA, 14 nt, Homo sapiens
ucugcaaaccaaca

SEQ ID NO: 1764077 - RNA, 22 nt, Homo sapiens
uuaguagagacgggguuucacc

SEQ ID NO: 1764078 - RNA, 22 nt, Homo sapiens
accuaccccaguucaucucugc

SEQ ID NO: 1764079 - RNA, 22 nt, Homo sapiens
accuucaucugaaacccacaga

SEQ ID NO: 1764080 - RNA, 21 nt, Homo sapiens
auucacaguaauaugguuccc

SEQ ID NO: 1764081 - RNA, 16 nt, Homo sapiens
agcaaaauccaaacug

SEQ ID NO: 1764082 - RNA, 14 nt, Homo sapiens
aaauacaugcacag

SEQ ID NO: 1764083 - RNA, 18 nt, Homo sapiens
ccugguuucugggugcua

SEQ ID NO: 1764084 - RNA, 19 nt, Homo sapiens
uaaaauagcauacugugua

SEQ ID NO: 1764085 - RNA, 17 nt, Homo sapiens
guuuuauuuuaucacuu

SEQ ID NO: 1764086 - RNA, 22 nt, Homo sapiens
ccuaaugaaggccaucaucucu

SEQ ID NO: 1764087 - RNA, 19 nt, Homo sapiens
ucuaaagaaaaaauaaaua

SEQ ID NO: 1764088 - RNA, 14 nt, Homo sapiens
cacaaaucuuaacu

SEQ ID NO: 1764089 - RNA, 23 nt, Homo sapiens
aacugugaacccuugugccucuc

SEQ ID NO: 1764090 - RNA, 19 nt, Homo sapiens
uccccuacggccacagggg

SEQ ID NO: 1764091 - RNA, 21 nt, Homo sapiens
ucaugggaauauucaaauauc

SEQ ID NO: 1764092 - RNA, 22 nt, Homo sapiens
auuuguauguauuaaacuuuuc

SEQ ID NO: 1764093 - RNA, 16 nt, Homo sapiens
uucaaugugaaacaca

SEQ ID NO: 1764094 - RNA, 17 nt, Homo sapiens
gccugaggcucacggua

SEQ ID NO: 1764095 - RNA, 22 nt, Homo sapiens
ccuguaauaaauaugagugcca

SEQ ID NO: 1764096 - RNA, 13 nt, Homo sapiens
agggccagccacu

SEQ ID NO: 1764097 - RNA, 22 nt, Homo sapiens
agcauauaggugauguuugcuc

SEQ ID NO: 1764098 - RNA, 14 nt, Homo sapiens
aguauuuauuguca

SEQ ID NO: 1764099 - RNA, 16 nt, Homo sapiens
agaaauccuacagcau

SEQ ID NO: 1764100 - RNA, 20 nt, Homo sapiens
uaaggguuaguuuacaauca

SEQ ID NO: 1764101 - RNA, 12 nt, Homo sapiens
guagcugaugaa

SEQ ID NO: 1764102 - RNA, 19 nt, Homo sapiens
agcugguggcccugugccu

SEQ ID NO: 1764103 - RNA, 16 nt, Homo sapiens
aauaagcaacuguaaa

SEQ ID NO: 1764104 - RNA, 12 nt, Homo sapiens
ugggaguaauac

SEQ ID NO: 1764105 - RNA, 16 nt, Homo sapiens
acccaccuguacucug

SEQ ID NO: 1764106 - RNA, 14 nt, Homo sapiens
ccgggacuaccugg

SEQ ID NO: 1764107 - RNA, 14 nt, Homo sapiens
aacggacucagugg

SEQ ID NO: 1764108 - RNA, 14 nt, Homo sapiens
ugauuagacagaac

SEQ ID NO: 1764109 - RNA, 12 nt, Homo sapiens
ccucuuccccag

SEQ ID NO: 1764110 - RNA, 14 nt, Homo sapiens
uauauaaaaauggg

SEQ ID NO: 1764111 - RNA, 21 nt, Homo sapiens
caacuuacugucuucuucaug

SEQ ID NO: 1764112 - RNA, 14 nt, Homo sapiens
gaaaauaguuugca

SEQ ID NO: 1764113 - RNA, 21 nt, Homo sapiens
gaacacuggccugggucuccc

SEQ ID NO: 1764114 - RNA, 15 nt, Homo sapiens
uaugcuguugucuua

SEQ ID NO: 1764115 - RNA, 17 nt, Homo sapiens
acaccacacccagcuaa

SEQ ID NO: 1764116 - RNA, 14 nt, Homo sapiens
ccaggccugccaag

SEQ ID NO: 1764117 - RNA, 17 nt, Homo sapiens
aguauguuaagcucuuu

SEQ ID NO: 1764118 - RNA, 17 nt, Homo sapiens
ugucaaauaaacacugu

SEQ ID NO: 1764119 - RNA, 15 nt, Homo sapiens
ccacugccaaagaac

SEQ ID NO: 1764120 - RNA, 14 nt, Homo sapiens
agugcccagugaug

SEQ ID NO: 1764121 - RNA, 19 nt, Homo sapiens
uccucuguccaggcacugc

SEQ ID NO: 1764122 - RNA, 13 nt, Homo sapiens
agaauacauucaa

SEQ ID NO: 1764123 - RNA, 15 nt, Homo sapiens
gaaacccucugucau

SEQ ID NO: 1764124 - RNA, 14 nt, Homo sapiens
uuaaaaaacugaca

SEQ ID NO: 1764125 - RNA, 23 nt, Homo sapiens
uguccugucuaaaaaugauucuc

SEQ ID NO: 1764126 - RNA, 17 nt, Homo sapiens
uuccuuuccugaucacu

SEQ ID NO: 1764127 - RNA, 12 nt, Homo sapiens
aauguagacuuu

SEQ ID NO: 1764128 - RNA, 16 nt, Homo sapiens
uauacaacgauuguau

SEQ ID NO: 1764129 - RNA, 14 nt, Homo sapiens
uuugguuaaucucu

SEQ ID NO: 1764130 - RNA, 18 nt, Homo sapiens
ccuguggccaacugcaaa

SEQ ID NO: 1764131 - RNA, 20 nt, Homo sapiens
acccuagcccuugcugccac

SEQ ID NO: 1764132 - RNA, 19 nt, Homo sapiens
aacaucagcucugugccac

SEQ ID NO: 1764133 - RNA, 13 nt, Homo sapiens
agucuauuuccac

SEQ ID NO: 1764134 - RNA, 13 nt, Homo sapiens
ucaaaauucucau

SEQ ID NO: 1764135 - RNA, 14 nt, Homo sapiens
guuggugaccaguu

SEQ ID NO: 1764136 - RNA, 17 nt, Homo sapiens
cacucagcaccacucaa

SEQ ID NO: 1764137 - RNA, 18 nt, Homo sapiens
ugcuacuuuauaauaaga

SEQ ID NO: 1764138 - RNA, 14 nt, Homo sapiens
agaaaaagguuuaa

SEQ ID NO: 1764139 - RNA, 21 nt, Homo sapiens
aguaagacagugcagugcuca

SEQ ID NO: 1764140 - RNA, 23 nt, Homo sapiens
aacuucccugauugaccugcucc

SEQ ID NO: 1764141 - RNA, 14 nt, Homo sapiens
aaagagaaugagaa

SEQ ID NO: 1764142 - RNA, 16 nt, Homo sapiens
caccacauugagauca

SEQ ID NO: 1764143 - RNA, 12 nt, Homo sapiens
ccuccagccuuc

SEQ ID NO: 1764144 - RNA, 14 nt, Homo sapiens
caaaacacccaaaa

SEQ ID NO: 1764145 - RNA, 14 nt, Homo sapiens
guugaaaacccaga

SEQ ID NO: 1764146 - RNA, 21 nt, Homo sapiens
gucucggccccucugauuguu

SEQ ID NO: 1764147 - RNA, 16 nt, Homo sapiens
cuugacauuuaucacc

SEQ ID NO: 1764148 - RNA, 13 nt, Homo sapiens
uugcccagugugu

SEQ ID NO: 1764149 - RNA, 16 nt, Homo sapiens
aaccuguuacacuggg

SEQ ID NO: 1764150 - RNA, 14 nt, Homo sapiens
uucaaaaugcagau

SEQ ID NO: 1764151 - RNA, 15 nt, Homo sapiens
caacccuaaaaagca

SEQ ID NO: 1764152 - RNA, 21 nt, Homo sapiens
aguuccucuaacauuugcaaa

SEQ ID NO: 1764153 - RNA, 15 nt, Homo sapiens
auugaagaaucugcc

SEQ ID NO: 1764154 - RNA, 22 nt, Homo sapiens
uagcauguucguauuacaagag

SEQ ID NO: 1764155 - RNA, 19 nt, Homo sapiens
ugcauuguuguaaaguauu

SEQ ID NO: 1764156 - RNA, 19 nt, Homo sapiens
uacauuccucagcugccaa

SEQ ID NO: 1764157 - RNA, 17 nt, Homo sapiens
cggccucccaaagugcu

SEQ ID NO: 1764158 - RNA, 15 nt, Homo sapiens
uggggaacacagcua

SEQ ID NO: 1764159 - RNA, 15 nt, Homo sapiens
ugggagagggagacc

SEQ ID NO: 1764160 - RNA, 15 nt, Homo sapiens
agggauugcugugaa

SEQ ID NO: 1764161 - RNA, 13 nt, Homo sapiens
ugguuaacgccuu

SEQ ID NO: 1764162 - RNA, 14 nt, Homo sapiens
ucauuucaaaggga

SEQ ID NO: 1764163 - RNA, 23 nt, Homo sapiens
gacagaauaaugaauggacucaa

SEQ ID NO: 1764164 - RNA, 16 nt, Homo sapiens
cucagauagaucugug

SEQ ID NO: 1764165 - RNA, 14 nt, Homo sapiens
gguggucccugggu

SEQ ID NO: 1764166 - RNA, 19 nt, Homo sapiens
acaacauuucucaaaugca

SEQ ID NO: 1764167 - RNA, 18 nt, Homo sapiens
caaccgagaagguuuauc

SEQ ID NO: 1764168 - RNA, 16 nt, Homo sapiens
agcaagucacuggcca

SEQ ID NO: 1764169 - RNA, 17 nt, Homo sapiens
cagaagggagcagcaca

SEQ ID NO: 1764170 - RNA, 18 nt, Homo sapiens
cucuaaucuaauauauaa

SEQ ID NO: 1764171 - RNA, 16 nt, Homo sapiens
ccuugcagaacugcca

SEQ ID NO: 1764172 - RNA, 17 nt, Homo sapiens
uagugacagaggagaaa

SEQ ID NO: 1764173 - RNA, 21 nt, Homo sapiens
aacauuuugauuauaguuaau

SEQ ID NO: 1764174 - RNA, 22 nt, Homo sapiens
uaugcauguaauggacuaugca

SEQ ID NO: 1764175 - RNA, 18 nt, Homo sapiens
ugccagaaaaaaauaacu

SEQ ID NO: 1764176 - RNA, 11 nt, Homo sapiens
cagcucagggg

SEQ ID NO: 1764177 - RNA, 15 nt, Homo sapiens
gccaugugcugugca

SEQ ID NO: 1764178 - RNA, 16 nt, Homo sapiens
ugcaaagcgacagauu

SEQ ID NO: 1764179 - RNA, 20 nt, Homo sapiens
ugaaauuauauauauacaca

SEQ ID NO: 1764180 - RNA, 21 nt, Homo sapiens
ugagggcaagagggggaccug

SEQ ID NO: 1764181 - RNA, 19 nt, Homo sapiens
acccuccugcugagcugcc

SEQ ID NO: 1764182 - RNA, 20 nt, Homo sapiens
uguacaaucaugaacagcuc

SEQ ID NO: 1764183 - RNA, 14 nt, Homo sapiens
aauuauuacauaug

SEQ ID NO: 1764184 - RNA, 17 nt, Homo sapiens
gagcagcuagcucuuug

SEQ ID NO: 1764185 - RNA, 14 nt, Homo sapiens
gcagaggccagagg

SEQ ID NO: 1764186 - RNA, 13 nt, Homo sapiens
uauauuuugcaau

SEQ ID NO: 1764187 - RNA, 19 nt, Homo sapiens
cucaauaaggcagugcagu

SEQ ID NO: 1764188 - RNA, 17 nt, Homo sapiens
uuggcagagcuucuucc

SEQ ID NO: 1764189 - RNA, 15 nt, Homo sapiens
auaacugagcacuuu

SEQ ID NO: 1764190 - RNA, 19 nt, Homo sapiens
gauucugccuuguuucaua

SEQ ID NO: 1764191 - RNA, 17 nt, Homo sapiens
ugcgugccaccacacca

SEQ ID NO: 1764192 - RNA, 22 nt, Homo sapiens
uacuucagugcaccuacugcuu

SEQ ID NO: 1764193 - RNA, 22 nt, Homo sapiens
gcucagcaaaagaugcuucuca

SEQ ID NO: 1764194 - RNA, 23 nt, Homo sapiens
aacccuuuuacagucacauucag

SEQ ID NO: 1764195 - RNA, 18 nt, Homo sapiens
caaaccauaaacuucaug

SEQ ID NO: 1764196 - RNA, 12 nt, Homo sapiens
gcucuccaucau

SEQ ID NO: 1764197 - RNA, 15 nt, Homo sapiens
cugcagaagauguga

SEQ ID NO: 1764198 - RNA, 19 nt, Homo sapiens
aauauuuuguaaugcugca

SEQ ID NO: 1764199 - RNA, 21 nt, Homo sapiens
ccuauggcccagccacugcag

SEQ ID NO: 1764200 - RNA, 15 nt, Homo sapiens
agugauguguggucu

SEQ ID NO: 1764201 - RNA, 22 nt, Homo sapiens
cuggcaggaagggacugccaaa

SEQ ID NO: 1764202 - RNA, 21 nt, Homo sapiens
gguaugucugccauguugccc

SEQ ID NO: 1764203 - RNA, 15 nt, Homo sapiens
cuaagucaaauucca

SEQ ID NO: 1764204 - RNA, 22 nt, Homo sapiens
agaaggguuacaugguguaaau

SEQ ID NO: 1764205 - RNA, 13 nt, Homo sapiens
cuucccccagcaa

SEQ ID NO: 1764206 - RNA, 14 nt, Homo sapiens
agauaaaugugcug

SEQ ID NO: 1764207 - RNA, 14 nt, Homo sapiens
agauccaguauuug

SEQ ID NO: 1764208 - RNA, 22 nt, Homo sapiens
aucuuaauuuuuuuuaauguac

SEQ ID NO: 1764209 - RNA, 20 nt, Homo sapiens
gggggccaggcgguggcuuc

SEQ ID NO: 1764210 - RNA, 18 nt, Homo sapiens
ggaugaugaaacauucau

SEQ ID NO: 1764211 - RNA, 18 nt, Homo sapiens
guucugagcgggucaugg

SEQ ID NO: 1764212 - RNA, 20 nt, Homo sapiens
cauucacucauacaucuggc

SEQ ID NO: 1764213 - RNA, 14 nt, Homo sapiens
acagagggaagcca

SEQ ID NO: 1764214 - RNA, 24 nt, Homo sapiens
ggcugcuagaggugcucauccuca

SEQ ID NO: 1764215 - RNA, 21 nt, Homo sapiens
caggacaaggccuugcucacu

SEQ ID NO: 1764216 - RNA, 13 nt, Homo sapiens
acugcaaaugcua

SEQ ID NO: 1764217 - RNA, 23 nt, Homo sapiens
cugcacaugucuuguacaugugu

SEQ ID NO: 1764218 - RNA, 14 nt, Homo sapiens
acuggcaucuguua

SEQ ID NO: 1764219 - RNA, 14 nt, Homo sapiens
cuuacaauucccuc

SEQ ID NO: 1764220 - RNA, 14 nt, Homo sapiens
auucugacucauau

SEQ ID NO: 1764221 - RNA, 17 nt, Homo sapiens
aguugcacagcaucuca

SEQ ID NO: 1764222 - RNA, 20 nt, Homo sapiens
gccuuuggaaagacuugaau

SEQ ID NO: 1764223 - RNA, 15 nt, Homo sapiens
uuuggggcaggagua

SEQ ID NO: 1764224 - RNA, 14 nt, Homo sapiens
agacacauucacac

SEQ ID NO: 1764225 - RNA, 18 nt, Homo sapiens
auuuggagauauaccuaa

SEQ ID NO: 1764226 - RNA, 15 nt, Homo sapiens
cgcaucucagugcag

SEQ ID NO: 1764227 - RNA, 19 nt, Homo sapiens
aaugcauaaugucuuuaaa

SEQ ID NO: 1764228 - RNA, 13 nt, Homo sapiens
augugccaggccu

SEQ ID NO: 1764229 - RNA, 20 nt, Homo sapiens
uaagcucuacugaggugcua

SEQ ID NO: 1764230 - RNA, 22 nt, Homo sapiens
agugcugaauuaagcagcucac

SEQ ID NO: 1764231 - RNA, 23 nt, Homo sapiens
gaaagaauuauuuuuguguuucu

SEQ ID NO: 1764232 - RNA, 13 nt, Homo sapiens
aguggggauuugu

SEQ ID NO: 1764233 - RNA, 22 nt, Homo sapiens
auguguguugauacuguugcac

SEQ ID NO: 1764234 - RNA, 16 nt, Homo sapiens
cugugguucugagaag

SEQ ID NO: 1764235 - RNA, 15 nt, Homo sapiens
cuguuuccaguggua

SEQ ID NO: 1764236 - RNA, 22 nt, Homo sapiens
gaaaguguuacauauucuuuca

SEQ ID NO: 1764237 - RNA, 12 nt, Homo sapiens
agccugccaaau

SEQ ID NO: 1764238 - RNA, 18 nt, Homo sapiens
accuucucaccugugaga

SEQ ID NO: 1764239 - RNA, 19 nt, Homo sapiens
agcaccuacuuacaugcau

SEQ ID NO: 1764240 - RNA, 11 nt, Homo sapiens
uacugcuaccc

SEQ ID NO: 1764241 - RNA, 14 nt, Homo sapiens
gguaguuugcaaac

SEQ ID NO: 1764242 - RNA, 23 nt, Homo sapiens
cagguagauaacugcauuuugua

SEQ ID NO: 1764243 - RNA, 15 nt, Homo sapiens
aaggaaugauccaua

SEQ ID NO: 1764244 - RNA, 23 nt, Homo sapiens
caaggcgggagggccugcaguga

SEQ ID NO: 1764245 - RNA, 20 nt, Homo sapiens
uguuccucuaguaguauauu

SEQ ID NO: 1764246 - RNA, 23 nt, Homo sapiens
ugugagacuguaaguuacaugaa

SEQ ID NO: 1764247 - RNA, 23 nt, Homo sapiens
auccuuuuuucucuucuguccau

SEQ ID NO: 1764248 - RNA, 20 nt, Homo sapiens
cuuacuuauuaucuucagga

SEQ ID NO: 1764249 - RNA, 12 nt, Homo sapiens
cccccaguguaa

SEQ ID NO: 1764250 - RNA, 15 nt, Homo sapiens
gcuaccaacuuguau

SEQ ID NO: 1764251 - RNA, 24 nt, Homo sapiens
gggccaggagcccacagugccugu

SEQ ID NO: 1764252 - RNA, 22 nt, Homo sapiens
agcaugauaggauuuggggcag

SEQ ID NO: 1764253 - RNA, 19 nt, Homo sapiens
auauacaaaaauuaacuca

SEQ ID NO: 1764254 - RNA, 18 nt, Homo sapiens
acaguguagaguaacaca

SEQ ID NO: 1764255 - RNA, 17 nt, Homo sapiens
uccuguccuaucacucu

SEQ ID NO: 1764256 - RNA, 22 nt, Homo sapiens
aaguuuaaauaccaguacuuga

SEQ ID NO: 1764257 - RNA, 22 nt, Homo sapiens
ucagcaagaggaggacagaauu

SEQ ID NO: 1764258 - RNA, 20 nt, Homo sapiens
ugaauagugugguucaguga

SEQ ID NO: 1764259 - RNA, 20 nt, Homo sapiens
ccugccccaccccauccagc

SEQ ID NO: 1764260 - RNA, 23 nt, Homo sapiens
uuagagcccauuucaauucucaa

SEQ ID NO: 1764261 - RNA, 15 nt, Homo sapiens
cuugaugugccauuu

SEQ ID NO: 1764262 - RNA, 21 nt, Homo sapiens
aggugcccucggagugccaca

SEQ ID NO: 1764263 - RNA, 20 nt, Homo sapiens
ugauuaguaaagaaaugaca

SEQ ID NO: 1764264 - RNA, 16 nt, Homo sapiens
ggauggagaggugaga

SEQ ID NO: 1764265 - RNA, 20 nt, Homo sapiens
ccagagacaugcaagucaug

SEQ ID NO: 1764266 - RNA, 22 nt, Homo sapiens
uucccuguguauucuagugaau

SEQ ID NO: 1764267 - RNA, 11 nt, Homo sapiens
uaccacuugaa

SEQ ID NO: 1764268 - RNA, 15 nt, Homo sapiens
cagauacaucacugc

SEQ ID NO: 1764269 - RNA, 14 nt, Homo sapiens
aggcucagauuaaa

SEQ ID NO: 1764270 - RNA, 16 nt, Homo sapiens
gcccaguguccccuuu

SEQ ID NO: 1764271 - RNA, 18 nt, Homo sapiens
aucugccugccaacccau

SEQ ID NO: 1764272 - RNA, 16 nt, Homo sapiens
cugggaaccacuccca

SEQ ID NO: 1764273 - RNA, 16 nt, Homo sapiens
agaacucuaucugugg

SEQ ID NO: 1764274 - RNA, 12 nt, Homo sapiens
ucucauccugca

SEQ ID NO: 1764275 - RNA, 19 nt, Homo sapiens
cuugagguuuucugugcuu

SEQ ID NO: 1764276 - RNA, 21 nt, Homo sapiens
cuuuugauagagguaacuuaa

SEQ ID NO: 1764277 - RNA, 17 nt, Homo sapiens
caagugucaucacuuuu

SEQ ID NO: 1764278 - RNA, 18 nt, Homo sapiens
uggagaaggguucugccc

SEQ ID NO: 1764279 - RNA, 14 nt, Homo sapiens
acagcuggugcuua

SEQ ID NO: 1764280 - RNA, 18 nt, Homo sapiens
ucaauaccuguacuauga

SEQ ID NO: 1764281 - RNA, 16 nt, Homo sapiens
ugaaguagugugcagu

SEQ ID NO: 1764282 - RNA, 23 nt, Homo sapiens
cuugccugugacauuuugccacu

SEQ ID NO: 1764283 - RNA, 18 nt, Homo sapiens
auguccugacaccugcuu

SEQ ID NO: 1764284 - RNA, 15 nt, Homo sapiens
cauaaccugucucac

SEQ ID NO: 1764285 - RNA, 19 nt, Homo sapiens
uuuuaaugggagccuuucc

SEQ ID NO: 1764286 - RNA, 22 nt, Homo sapiens
cacuugcuagcgguugaaucuu

SEQ ID NO: 1764287 - RNA, 17 nt, Homo sapiens
caucuuuuagcauguga

SEQ ID NO: 1764288 - RNA, 18 nt, Homo sapiens
ucaacaacagugugauca

SEQ ID NO: 1764289 - RNA, 18 nt, Homo sapiens
agcccgggauccugaugg

SEQ ID NO: 1764290 - RNA, 21 nt, Homo sapiens
caccuccccagccuuugauca

SEQ ID NO: 1764291 - RNA, 18 nt, Homo sapiens
uucagcaacaaccaucuc

SEQ ID NO: 1764292 - RNA, 16 nt, Homo sapiens
uuugaacaaagcucaa

SEQ ID NO: 1764293 - RNA, 22 nt, Homo sapiens
ucaaaauaccaugccauuuaaa

SEQ ID NO: 1764294 - RNA, 19 nt, Homo sapiens
uccucugugaccaaugucu

SEQ ID NO: 1764295 - RNA, 17 nt, Homo sapiens
ucccuuuuuacacuuua

SEQ ID NO: 1764296 - RNA, 23 nt, Homo sapiens
aagagggagccgguuugggagag

SEQ ID NO: 1764297 - RNA, 23 nt, Homo sapiens
uuuaaaaauaagccacauaucua

SEQ ID NO: 1764298 - RNA, 15 nt, Homo sapiens
aagucaaauaccaca

SEQ ID NO: 1764299 - RNA, 20 nt, Homo sapiens
auuaaguaugucaacagcca

SEQ ID NO: 1764300 - RNA, 21 nt, Homo sapiens
ucacacuuuguaauuugcaaa

SEQ ID NO: 1764301 - RNA, 17 nt, Homo sapiens
auuugccaugacauuuc

SEQ ID NO: 1764302 - RNA, 13 nt, Homo sapiens
uuucuuucaacau

SEQ ID NO: 1764303 - RNA, 11 nt, Homo sapiens
uggaagcaaag

SEQ ID NO: 1764304 - RNA, 12 nt, Homo sapiens
uuuggaaacaca

SEQ ID NO: 1764305 - RNA, 22 nt, Homo sapiens
aaccaccuguguagucucucua

SEQ ID NO: 1764306 - RNA, 20 nt, Homo sapiens
uuauugaauguuauaucauc

SEQ ID NO: 1764307 - RNA, 11 nt, Homo sapiens
uguauggacaa

SEQ ID NO: 1764308 - RNA, 23 nt, Homo sapiens
gugcaguaagccuguuggauaaa

SEQ ID NO: 1764309 - RNA, 21 nt, Homo sapiens
acagucacuugggagcugcug

SEQ ID NO: 1764310 - RNA, 16 nt, Homo sapiens
ggacagcuuugauaau

SEQ ID NO: 1764311 - RNA, 21 nt, Homo sapiens
ugcccgccucgaccucucuca

SEQ ID NO: 1764312 - RNA, 18 nt, Homo sapiens
acuucagauacuugugaa

SEQ ID NO: 1764313 - RNA, 13 nt, Homo sapiens
ucaccugcuggag

SEQ ID NO: 1764314 - RNA, 15 nt, Homo sapiens
gcaggcaauuucacc

SEQ ID NO: 1764315 - RNA, 21 nt, Homo sapiens
ugccccuccuccgcaugccaa

SEQ ID NO: 1764316 - RNA, 17 nt, Homo sapiens
acaauaaaaacauugcc

SEQ ID NO: 1764317 - RNA, 13 nt, Homo sapiens
acuuuucccucac

SEQ ID NO: 1764318 - RNA, 20 nt, Homo sapiens
caugcugcuggggaagacag

SEQ ID NO: 1764319 - RNA, 18 nt, Homo sapiens
ucagaaaaugcagccuua

SEQ ID NO: 1764320 - RNA, 22 nt, Homo sapiens
cuuugucauucaguucuaggcc

SEQ ID NO: 1764321 - RNA, 17 nt, Homo sapiens
gaaucucuauguauauu

SEQ ID NO: 1764322 - RNA, 14 nt, Homo sapiens
gccucaaagcaagc

SEQ ID NO: 1764323 - RNA, 14 nt, Homo sapiens
aucuauauacaaag

SEQ ID NO: 1764324 - RNA, 19 nt, Homo sapiens
ggugaaaaauauucaguaa

SEQ ID NO: 1764325 - RNA, 23 nt, Homo sapiens
acuucuaacuagaaaucugccaa

SEQ ID NO: 1764326 - RNA, 15 nt, Homo sapiens
gcugcucacuaccuc

SEQ ID NO: 1764327 - RNA, 23 nt, Homo sapiens
caucuggcuuuuucugccacuga

SEQ ID NO: 1764328 - RNA, 17 nt, Homo sapiens
acacugccgacaucagc

SEQ ID NO: 1764329 - RNA, 17 nt, Homo sapiens
ccuuuguagccuauguc

SEQ ID NO: 1764330 - RNA, 19 nt, Homo sapiens
guguagaggguguuugcag

SEQ ID NO: 1764331 - RNA, 22 nt, Homo sapiens
aagcaacuggaaaaguguuccu

SEQ ID NO: 1764332 - RNA, 15 nt, Homo sapiens
aaugaugggacaaua

SEQ ID NO: 1764333 - RNA, 22 nt, Homo sapiens
cuucaaggcccauaucugugaa

SEQ ID NO: 1764334 - RNA, 19 nt, Homo sapiens
uuuuaauugaaagggacaa

SEQ ID NO: 1764335 - RNA, 18 nt, Homo sapiens
gcuucccugaaagacuga

SEQ ID NO: 1764336 - RNA, 20 nt, Homo sapiens
uaaauguauugagguauuau

SEQ ID NO: 1764337 - RNA, 23 nt, Homo sapiens
ucuucugagcuaaggcagccuuc

SEQ ID NO: 1764338 - RNA, 13 nt, Homo sapiens
auagcaccuuuca

SEQ ID NO: 1764339 - RNA, 19 nt, Homo sapiens
ggacuauccucuuuggaaa

SEQ ID NO: 1764340 - RNA, 17 nt, Homo sapiens
ggguuggugcacaguga

SEQ ID NO: 1764341 - RNA, 20 nt, Homo sapiens
gugcuccuccuuggugccug

SEQ ID NO: 1764342 - RNA, 13 nt, Homo sapiens
augaggucuuccc

SEQ ID NO: 1764343 - RNA, 22 nt, Homo sapiens
aaaauguaacaucauaauuaca

SEQ ID NO: 1764344 - RNA, 21 nt, Homo sapiens
ugcgcccaccccgcucugcau

SEQ ID NO: 1764345 - RNA, 18 nt, Homo sapiens
ugucuuuuaauuuagcuu

SEQ ID NO: 1764346 - RNA, 16 nt, Homo sapiens
auccagcaggcagcug

SEQ ID NO: 1764347 - RNA, 21 nt, Homo sapiens
ugauauagaacagugcuugcc

SEQ ID NO: 1764348 - RNA, 17 nt, Homo sapiens
aaaugguccaguacaaa

SEQ ID NO: 1764349 - RNA, 14 nt, Homo sapiens
ucauaauacugaaa

SEQ ID NO: 1764350 - RNA, 11 nt, Homo sapiens
gcuaguauuug

SEQ ID NO: 1764351 - RNA, 15 nt, Homo sapiens
gcaaaaguguaacaa

SEQ ID NO: 1764352 - RNA, 22 nt, Homo sapiens
gccuccucgggggaaagcacac

SEQ ID NO: 1764353 - RNA, 19 nt, Homo sapiens
acuuccacaagagugaauu

SEQ ID NO: 1764354 - RNA, 16 nt, Homo sapiens
ucagaauuaagcagaa

SEQ ID NO: 1764355 - RNA, 12 nt, Homo sapiens
caggucuuuucu

SEQ ID NO: 1764356 - RNA, 18 nt, Homo sapiens
guaccagaugcagcucaa

SEQ ID NO: 1764357 - RNA, 17 nt, Homo sapiens
cuagacuguuacuuugg

SEQ ID NO: 1764358 - RNA, 16 nt, Homo sapiens
cagcccagcaagaagg

SEQ ID NO: 1764359 - RNA, 23 nt, Homo sapiens
gagauacagcucagagugccacg

SEQ ID NO: 1764360 - RNA, 20 nt, Homo sapiens
ugcuuccuuuucagcauggu

SEQ ID NO: 1764361 - RNA, 23 nt, Homo sapiens
caggacugagcccucucacucca

SEQ ID NO: 1764362 - RNA, 23 nt, Homo sapiens
aaggcagguuugggaagguguuu

SEQ ID NO: 1764363 - RNA, 17 nt, Homo sapiens
ggaccaaugaggugagg

SEQ ID NO: 1764364 - RNA, 14 nt, Homo sapiens
aagaucucuugcua

SEQ ID NO: 1764365 - RNA, 14 nt, Homo sapiens
aacauuaaagcaau

SEQ ID NO: 1764366 - RNA, 18 nt, Homo sapiens
caagugugugcaugugug

SEQ ID NO: 1764367 - RNA, 15 nt, Homo sapiens
gggaagaaggggcca

SEQ ID NO: 1764368 - RNA, 23 nt, Homo sapiens
ggcaauugagggacugagccaga

SEQ ID NO: 1764369 - RNA, 20 nt, Homo sapiens
uuaaagucaggaguccaaga

SEQ ID NO: 1764370 - RNA, 23 nt, Homo sapiens
cucagauuccaccuagagcuaga

SEQ ID NO: 1764371 - RNA, 23 nt, Homo sapiens
gugcaugcuuuucucuugcuaau

SEQ ID NO: 1764372 - RNA, 14 nt, Homo sapiens
uggacaucuuguca

SEQ ID NO: 1764373 - RNA, 17 nt, Homo sapiens
ucccagcguuaacacaa

SEQ ID NO: 1764374 - RNA, 20 nt, Homo sapiens
augcuuccuauacaguucua

SEQ ID NO: 1764375 - RNA, 22 nt, Homo sapiens
aaugaagcuaauaauucuucac

SEQ ID NO: 1764376 - RNA, 18 nt, Homo sapiens
uaggcaauacauguaucu

SEQ ID NO: 1764377 - RNA, 14 nt, Homo sapiens
uguggaaaagccaa

SEQ ID NO: 1764378 - RNA, 14 nt, Homo sapiens
aauggaaauaccaa

SEQ ID NO: 1764379 - RNA, 10 nt, Homo sapiens
agcugccauu

SEQ ID NO: 1764380 - RNA, 18 nt, Homo sapiens
aggaagccgccaguacuu

SEQ ID NO: 1764381 - RNA, 18 nt, Homo sapiens
aucuccccucagauucca

SEQ ID NO: 1764382 - RNA, 19 nt, Homo sapiens
agaacauauguugcaagac

SEQ ID NO: 1764383 - RNA, 20 nt, Homo sapiens
gacugagggcagcuuugcaa

SEQ ID NO: 1764384 - RNA, 21 nt, Homo sapiens
gcauuccaccacacauggcua

SEQ ID NO: 1764385 - RNA, 18 nt, Homo sapiens
caaaaagaacacccaucg

SEQ ID NO: 1764386 - RNA, 12 nt, Homo sapiens
uggucuuugaaa

SEQ ID NO: 1764387 - RNA, 19 nt, Homo sapiens
ucgcugcccucucugccag

SEQ ID NO: 1764388 - RNA, 16 nt, Homo sapiens
gaggcugagcuggauc

SEQ ID NO: 1764389 - RNA, 13 nt, Homo sapiens
ugccuugcucauu

SEQ ID NO: 1764390 - RNA, 19 nt, Homo sapiens
auccuggcccucuguguug

SEQ ID NO: 1764391 - RNA, 21 nt, Homo sapiens
uucacuaauaaacauuuggca

SEQ ID NO: 1764392 - RNA, 21 nt, Homo sapiens
ucccuguguauucuagugaau

SEQ ID NO: 1764393 - RNA, 13 nt, Homo sapiens
caaauggacuguu

SEQ ID NO: 1764394 - RNA, 13 nt, Homo sapiens
augagggaaaaug

SEQ ID NO: 1764395 - RNA, 15 nt, Homo sapiens
cauuggcuagaauca

SEQ ID NO: 1764396 - RNA, 23 nt, Homo sapiens
uauucacauauaucaaagugaga

SEQ ID NO: 1764397 - RNA, 14 nt, Homo sapiens
accugugaccagca

SEQ ID NO: 1764398 - RNA, 14 nt, Homo sapiens
uuaacagugcugua

SEQ ID NO: 1764399 - RNA, 13 nt, Homo sapiens
caggacucagaag

SEQ ID NO: 1764400 - RNA, 13 nt, Homo sapiens
uagauuuucaccu

SEQ ID NO: 1764401 - RNA, 15 nt, Homo sapiens
auuguuaauuaucua

SEQ ID NO: 1764402 - RNA, 19 nt, Homo sapiens
ccaccauaaaucacaucau

SEQ ID NO: 1764403 - RNA, 14 nt, Homo sapiens
gcauauagacugua

SEQ ID NO: 1764404 - RNA, 11 nt, Homo sapiens
caauguuccau

SEQ ID NO: 1764405 - RNA, 13 nt, Homo sapiens
aauacaguauuau

SEQ ID NO: 1764406 - RNA, 14 nt, Homo sapiens
uucaauuuugaaaa

SEQ ID NO: 1764407 - RNA, 14 nt, Homo sapiens
auagaaaaaccaaa

SEQ ID NO: 1764408 - RNA, 16 nt, Homo sapiens
cccuuucacacuggau

SEQ ID NO: 1764409 - RNA, 23 nt, Homo sapiens
acauuuuggaaacaacauauuac

SEQ ID NO: 1764410 - RNA, 17 nt, Homo sapiens
gucaagaucaacauucc

SEQ ID NO: 1764411 - RNA, 19 nt, Homo sapiens
ggcuaugcgggggugccua

SEQ ID NO: 1764412 - RNA, 15 nt, Homo sapiens
ucccaaagugcuagu

SEQ ID NO: 1764413 - RNA, 17 nt, Homo sapiens
gauuuccucacuaccug

SEQ ID NO: 1764414 - RNA, 18 nt, Homo sapiens
uccuuuggcaugggaugg

SEQ ID NO: 1764415 - RNA, 20 nt, Homo sapiens
auuuuuauaauaaacauaau

SEQ ID NO: 1764416 - RNA, 15 nt, Homo sapiens
gaagccccaagccau

SEQ ID NO: 1764417 - RNA, 21 nt, Homo sapiens
aaggugugcucugagccacag

SEQ ID NO: 1764418 - RNA, 21 nt, Homo sapiens
ggcauucuaagucacaggaug

SEQ ID NO: 1764419 - RNA, 17 nt, Homo sapiens
ucugcaucaucaucaca

SEQ ID NO: 1764420 - RNA, 10 nt, Homo sapiens
aaaauacuug

SEQ ID NO: 1764421 - RNA, 19 nt, Homo sapiens
ggggucuccucugcagcuc

SEQ ID NO: 1764422 - RNA, 16 nt, Homo sapiens
uccuuagacucuuuuc

SEQ ID NO: 1764423 - RNA, 12 nt, Homo sapiens
cugagccaguca

SEQ ID NO: 1764424 - RNA, 14 nt, Homo sapiens
cuggaucagggaau

SEQ ID NO: 1764425 - RNA, 13 nt, Homo sapiens
uuuaugacucuua

SEQ ID NO: 1764426 - RNA, 18 nt, Homo sapiens
ccugacgugcagccacac

SEQ ID NO: 1764427 - RNA, 16 nt, Homo sapiens
ucccuccccugggcac

SEQ ID NO: 1764428 - RNA, 15 nt, Homo sapiens
ugucccugacuguaa

SEQ ID NO: 1764429 - RNA, 15 nt, Homo sapiens
gcucaaaugaucaau

SEQ ID NO: 1764430 - RNA, 14 nt, Homo sapiens
ucaacaguauaagu

SEQ ID NO: 1764431 - RNA, 18 nt, Homo sapiens
gcuggcccaguuguccau

SEQ ID NO: 1764432 - RNA, 13 nt, Homo sapiens
ucucucuccaugu

SEQ ID NO: 1764433 - RNA, 15 nt, Homo sapiens
uuuuauuggagauca

SEQ ID NO: 1764434 - RNA, 20 nt, Homo sapiens
agggcccugccaaaaaaaga

SEQ ID NO: 1764435 - RNA, 19 nt, Homo sapiens
agugcaaaaagcuucugug

SEQ ID NO: 1764436 - RNA, 14 nt, Homo sapiens
gacucugaucucug

SEQ ID NO: 1764437 - RNA, 11 nt, Homo sapiens
cauuuugccaa

SEQ ID NO: 1764438 - RNA, 17 nt, Homo sapiens
aaguucaccuaucccau

SEQ ID NO: 1764439 - RNA, 18 nt, Homo sapiens
ccuuuagagccagcccau

SEQ ID NO: 1764440 - RNA, 23 nt, Homo sapiens
uaaguacuguaauaauaccucaa

SEQ ID NO: 1764441 - RNA, 11 nt, Homo sapiens
ugaacagccaa

SEQ ID NO: 1764442 - RNA, 17 nt, Homo sapiens
ucuuugguacaaguuua

SEQ ID NO: 1764443 - RNA, 22 nt, Homo sapiens
cuagaacaaugggaggcuguga

SEQ ID NO: 1764444 - RNA, 18 nt, Homo sapiens
uccacgugggguggaauu

SEQ ID NO: 1764445 - RNA, 16 nt, Homo sapiens
uccugccuucauggaa

SEQ ID NO: 1764446 - RNA, 17 nt, Homo sapiens
cauaucagcacauauuu

SEQ ID NO: 1764447 - RNA, 18 nt, Homo sapiens
cacaagauacacgucaca

SEQ ID NO: 1764448 - RNA, 15 nt, Homo sapiens
gccuucgugcuccga

SEQ ID NO: 1764449 - RNA, 13 nt, Homo sapiens
caguggcccugag

SEQ ID NO: 1764450 - RNA, 16 nt, Homo sapiens
uucuauggauucacuu

SEQ ID NO: 1764451 - RNA, 14 nt, Homo sapiens
gagauuuaccuguu

SEQ ID NO: 1764452 - RNA, 13 nt, Homo sapiens
uagaaccaggcaa

SEQ ID NO: 1764453 - RNA, 15 nt, Homo sapiens
agugacccucagcug

SEQ ID NO: 1764454 - RNA, 22 nt, Homo sapiens
agacauccauaaagaagcaaua

SEQ ID NO: 1764455 - RNA, 14 nt, Homo sapiens
uauucugacaugua

SEQ ID NO: 1764456 - RNA, 20 nt, Homo sapiens
aauggcucaucaacaaucac

SEQ ID NO: 1764457 - RNA, 14 nt, Homo sapiens
cagacuccaaaagg

SEQ ID NO: 1764458 - RNA, 14 nt, Homo sapiens
cuuguacuuuacaa

SEQ ID NO: 1764459 - RNA, 23 nt, Homo sapiens
ggauccccaacccugagcacucu

SEQ ID NO: 1764460 - RNA, 13 nt, Homo sapiens
acuuuaagucuca

SEQ ID NO: 1764461 - RNA, 20 nt, Homo sapiens
cugccaccaggcacugccug

SEQ ID NO: 1764462 - RNA, 23 nt, Homo sapiens
auuacaaaugguuaccuuguuau

SEQ ID NO: 1764463 - RNA, 11 nt, Homo sapiens
cauucuuguuc

SEQ ID NO: 1764464 - RNA, 15 nt, Homo sapiens
uaaaacugaaucuca

SEQ ID NO: 1764465 - RNA, 21 nt, Homo sapiens
aagacugaauuccaaacaugg

SEQ ID NO: 1764466 - RNA, 22 nt, Homo sapiens
aagagcaaaccuaacaggagaa

SEQ ID NO: 1764467 - RNA, 19 nt, Homo sapiens
aagauagguuugagggcau

SEQ ID NO: 1764468 - RNA, 22 nt, Homo sapiens
ccccagagcuuuacagugccac

SEQ ID NO: 1764469 - RNA, 18 nt, Homo sapiens
augcagauucagugcaau

SEQ ID NO: 1764470 - RNA, 14 nt, Homo sapiens
agacgccaccauuc

SEQ ID NO: 1764471 - RNA, 17 nt, Homo sapiens
ugacuugccacugccau

SEQ ID NO: 1764472 - RNA, 22 nt, Homo sapiens
aaugacaaaugacugucucuug

SEQ ID NO: 1764473 - RNA, 22 nt, Homo sapiens
uugucugaacuugcauugugau

SEQ ID NO: 1764474 - RNA, 19 nt, Homo sapiens
gccagcccuccuugaccca

SEQ ID NO: 1764475 - RNA, 15 nt, Homo sapiens
cagggagcagggcag

SEQ ID NO: 1764476 - RNA, 14 nt, Homo sapiens
cugccuuuguucac

SEQ ID NO: 1764477 - RNA, 13 nt, Homo sapiens
guagcagcaguug

SEQ ID NO: 1764478 - RNA, 14 nt, Homo sapiens
guucuuccugcaac

SEQ ID NO: 1764479 - RNA, 21 nt, Homo sapiens
gacuguugaugaaagggacag

SEQ ID NO: 1764480 - RNA, 20 nt, Homo sapiens
caaauauugguuaguauuua

SEQ ID NO: 1764481 - RNA, 18 nt, Homo sapiens
cacauuuccauucaugga

SEQ ID NO: 1764482 - RNA, 21 nt, Homo sapiens
auucccugcccccaauuuccc

SEQ ID NO: 1764483 - RNA, 17 nt, Homo sapiens
auuguagauaacacuga

SEQ ID NO: 1764484 - RNA, 19 nt, Homo sapiens
auggaauaucaaugcccaa

SEQ ID NO: 1764485 - RNA, 15 nt, Homo sapiens
aagaaaaaagugcaa

SEQ ID NO: 1764486 - RNA, 19 nt, Homo sapiens
cuggaagcauccugugcug

SEQ ID NO: 1764487 - RNA, 16 nt, Homo sapiens
auauguaaacagugag

SEQ ID NO: 1764488 - RNA, 14 nt, Homo sapiens
ugaccuugagcaaa

SEQ ID NO: 1764489 - RNA, 23 nt, Homo sapiens
cuaaacaagaaucagucuaucca

SEQ ID NO: 1764490 - RNA, 21 nt, Homo sapiens
cuucaggaagcauaaagcaau

SEQ ID NO: 1764491 - RNA, 13 nt, Homo sapiens
uaauuuguaaaac

SEQ ID NO: 1764492 - RNA, 19 nt, Homo sapiens
uguuucuucuuugacuaua

SEQ ID NO: 1764493 - RNA, 23 nt, Homo sapiens
gauuuccuugaauguggcuugag

SEQ ID NO: 1764494 - RNA, 16 nt, Homo sapiens
ugacucgggagcugca

SEQ ID NO: 1764495 - RNA, 13 nt, Homo sapiens
aauucaacuuugu

SEQ ID NO: 1764496 - RNA, 17 nt, Homo sapiens
gagccuggcuggcacag

SEQ ID NO: 1764497 - RNA, 20 nt, Homo sapiens
ucucagaacaccaaguaaau

SEQ ID NO: 1764498 - RNA, 17 nt, Homo sapiens
aauugccaauaaugugu

SEQ ID NO: 1764499 - RNA, 19 nt, Homo sapiens
cacgccugguucuguacau

SEQ ID NO: 1764500 - RNA, 13 nt, Homo sapiens
agauuaauggcac

SEQ ID NO: 1764501 - RNA, 23 nt, Homo sapiens
caaugccacagcccugucagcau

SEQ ID NO: 1764502 - RNA, 12 nt, Homo sapiens
uagaaugcacac

SEQ ID NO: 1764503 - RNA, 22 nt, Homo sapiens
uucuuuagaauuuuuacccaau

SEQ ID NO: 1764504 - RNA, 23 nt, Homo sapiens
auccauagugacuuuucaaguau

SEQ ID NO: 1764505 - RNA, 23 nt, Homo sapiens
uugcauuuuugcaggagcaguau

SEQ ID NO: 1764506 - RNA, 18 nt, Homo sapiens
cauaauuugaauggugca

SEQ ID NO: 1764507 - RNA, 20 nt, Homo sapiens
aaaaugggaauucugacuua

SEQ ID NO: 1764508 - RNA, 16 nt, Homo sapiens
aacuggaggccaggaa

SEQ ID NO: 1764509 - RNA, 18 nt, Homo sapiens
ucagaaccaaaagggagg

SEQ ID NO: 1764510 - RNA, 21 nt, Homo sapiens
uacacauuggaaggcucccua

SEQ ID NO: 1764511 - RNA, 23 nt, Homo sapiens
auaaaucagagagcaaggcaucg

SEQ ID NO: 1764512 - RNA, 15 nt, Homo sapiens
ucaguccaguccuca

SEQ ID NO: 1764513 - RNA, 11 nt, Homo sapiens
ccuccauuuca

SEQ ID NO: 1764514 - RNA, 14 nt, Homo sapiens
uguuuuuaaacuaa

SEQ ID NO: 1764515 - RNA, 17 nt, Homo sapiens
gccacuaugccugacua

SEQ ID NO: 1764516 - RNA, 23 nt, Homo sapiens
cacaugaaucccacccacaugug

SEQ ID NO: 1764517 - RNA, 21 nt, Homo sapiens
gagaggaucuaggaugggaga

SEQ ID NO: 1764518 - RNA, 22 nt, Homo sapiens
aguucagaaucacuucugagaa

SEQ ID NO: 1764519 - RNA, 23 nt, Homo sapiens
cuagacguucauuugugugcuca

SEQ ID NO: 1764520 - RNA, 23 nt, Homo sapiens
agcacauccaccaaacuccugcc

SEQ ID NO: 1764521 - RNA, 20 nt, Homo sapiens
aaauuaagauguugucuugc

SEQ ID NO: 1764522 - RNA, 22 nt, Homo sapiens
gccagcccucccuggcugugag

SEQ ID NO: 1764523 - RNA, 18 nt, Homo sapiens
aaccccagggcacugcca

SEQ ID NO: 1764524 - RNA, 17 nt, Homo sapiens
cuuccaaaugugucaga

SEQ ID NO: 1764525 - RNA, 14 nt, Homo sapiens
aucgaacacauuca

SEQ ID NO: 1764526 - RNA, 15 nt, Homo sapiens
agcaucccaucucag

SEQ ID NO: 1764527 - RNA, 19 nt, Homo sapiens
gcccucaggccagugccag

SEQ ID NO: 1764528 - RNA, 19 nt, Homo sapiens
acgagcagcccagggccua

SEQ ID NO: 1764529 - RNA, 14 nt, Homo sapiens
acucugaccuguac

SEQ ID NO: 1764530 - RNA, 12 nt, Homo sapiens
uccaaagaggcu

SEQ ID NO: 1764531 - RNA, 19 nt, Homo sapiens
cucccuccccugcucagaa

SEQ ID NO: 1764532 - RNA, 22 nt, Homo sapiens
accugaaauuccaaagucucua

SEQ ID NO: 1764533 - RNA, 18 nt, Homo sapiens
auuuugcuccccagugaa

SEQ ID NO: 1764534 - RNA, 19 nt, Homo sapiens
cagucaaguucccuccugc

SEQ ID NO: 1764535 - RNA, 15 nt, Homo sapiens
cccaaccaacuuucc

SEQ ID NO: 1764536 - RNA, 17 nt, Homo sapiens
ucaaaacacccaaaaau

SEQ ID NO: 1764537 - RNA, 17 nt, Homo sapiens
gcacugaagcagaauug

SEQ ID NO: 1764538 - RNA, 23 nt, Homo sapiens
ccuaauucacacaaagacuccuu

SEQ ID NO: 1764539 - RNA, 20 nt, Homo sapiens
caaaaaucccaaauucacuu

SEQ ID NO: 1764540 - RNA, 14 nt, Homo sapiens
uccacuucuggcau

SEQ ID NO: 1764541 - RNA, 23 nt, Homo sapiens
uauucaggcuguuguuggcuuag

SEQ ID NO: 1764542 - RNA, 19 nt, Homo sapiens
ucugaauauuaaagcucuu

SEQ ID NO: 1764543 - RNA, 20 nt, Homo sapiens
aaugaaaccuuccucuugag

SEQ ID NO: 1764544 - RNA, 19 nt, Homo sapiens
ugaacaaucaaagcacuug

SEQ ID NO: 1764545 - RNA, 13 nt, Homo sapiens
uggaguccagcuc

SEQ ID NO: 1764546 - RNA, 12 nt, Homo sapiens
ucccccauaggu

SEQ ID NO: 1764547 - RNA, 17 nt, Homo sapiens
ugccaagccaccuucca

SEQ ID NO: 1764548 - RNA, 22 nt, Homo sapiens
gaaucaaagcaguuaacuuuaa

SEQ ID NO: 1764549 - RNA, 13 nt, Homo sapiens
ucuccccacugua

SEQ ID NO: 1764550 - RNA, 16 nt, Homo sapiens
aucugccauugggacc

SEQ ID NO: 1764551 - RNA, 18 nt, Homo sapiens
ugaagugaacaaauuuca

SEQ ID NO: 1764552 - RNA, 17 nt, Homo sapiens
uguccaccugugcugcu

SEQ ID NO: 1764553 - RNA, 14 nt, Homo sapiens
ccacgacugccaug

SEQ ID NO: 1764554 - RNA, 17 nt, Homo sapiens
aguccuguaugucuguc

SEQ ID NO: 1764555 - RNA, 18 nt, Homo sapiens
gccucgcagccuccggaa

SEQ ID NO: 1764556 - RNA, 17 nt, Homo sapiens
auugagauguguucaca

SEQ ID NO: 1764557 - RNA, 14 nt, Homo sapiens
ugcaucuucccaca

SEQ ID NO: 1764558 - RNA, 19 nt, Homo sapiens
agaucgccccacugcacuc

SEQ ID NO: 1764559 - RNA, 19 nt, Homo sapiens
gaacagcaauggugucagu

SEQ ID NO: 1764560 - RNA, 15 nt, Homo sapiens
cacaauccuccaaga

SEQ ID NO: 1764561 - RNA, 16 nt, Homo sapiens
aaucaagagacaauaa

SEQ ID NO: 1764562 - RNA, 19 nt, Homo sapiens
gacagacucauuaaauauu

SEQ ID NO: 1764563 - RNA, 14 nt, Homo sapiens
uuagugucauguca

SEQ ID NO: 1764564 - RNA, 19 nt, Homo sapiens
gacauauuugaaugacugc

SEQ ID NO: 1764565 - RNA, 13 nt, Homo sapiens
gaaccagcaguug

SEQ ID NO: 1764566 - RNA, 18 nt, Homo sapiens
gcaaacucacugcucaag

SEQ ID NO: 1764567 - RNA, 22 nt, Homo sapiens
auccacccagcaggcagagugg

SEQ ID NO: 1764568 - RNA, 18 nt, Homo sapiens
aaaacauugaaguauuag

SEQ ID NO: 1764569 - RNA, 16 nt, Homo sapiens
ccucuggagcccuaac

SEQ ID NO: 1764570 - RNA, 10 nt, Homo sapiens
guauccucca

SEQ ID NO: 1764571 - RNA, 20 nt, Homo sapiens
aaagcauguggcauguucau

SEQ ID NO: 1764572 - RNA, 22 nt, Homo sapiens
gauccagucuggaaaacagaaa

SEQ ID NO: 1764573 - RNA, 10 nt, Homo sapiens
ugacaaaagg

SEQ ID NO: 1764574 - RNA, 21 nt, Homo sapiens
ccuuaagccaauauuuacuca

SEQ ID NO: 1764575 - RNA, 17 nt, Homo sapiens
cuauaacaugucuuuca

SEQ ID NO: 1764576 - RNA, 18 nt, Homo sapiens
caucauggcuaucugugg

SEQ ID NO: 1764577 - RNA, 23 nt, Homo sapiens
cuguuuugugcuucuccuaacuc

SEQ ID NO: 1764578 - RNA, 14 nt, Homo sapiens
aagaaacaguagcc

SEQ ID NO: 1764579 - RNA, 12 nt, Homo sapiens
gaugagggccac

SEQ ID NO: 1764580 - RNA, 16 nt, Homo sapiens
agugaagagcauuugg

SEQ ID NO: 1764581 - RNA, 11 nt, Homo sapiens
gaauagcugug

SEQ ID NO: 1764582 - RNA, 19 nt, Homo sapiens
cauguuacuaagcaggcca

SEQ ID NO: 1764583 - RNA, 20 nt, Homo sapiens
accucagccuggccagacac

SEQ ID NO: 1764584 - RNA, 22 nt, Homo sapiens
agaacauguuacgugugcaaca

SEQ ID NO: 1764585 - RNA, 23 nt, Homo sapiens
aaaacagcccuauuucuugauaa

SEQ ID NO: 1764586 - RNA, 17 nt, Homo sapiens
ugucugauuuuggccau

SEQ ID NO: 1764587 - RNA, 23 nt, Homo sapiens
guugucucucuaaacccaaauaa

SEQ ID NO: 1764588 - RNA, 14 nt, Homo sapiens
accucauaugcuau

SEQ ID NO: 1764589 - RNA, 14 nt, Homo sapiens
cuccgucucaaaaa

SEQ ID NO: 1764590 - RNA, 19 nt, Homo sapiens
ugacagaggcaaggaggca

SEQ ID NO: 1764591 - RNA, 20 nt, Homo sapiens
cacgucccgggcacugucau

SEQ ID NO: 1764592 - RNA, 20 nt, Homo sapiens
auccucaaaucagucuuccu

SEQ ID NO: 1764593 - RNA, 13 nt, Homo sapiens
gcacucuauguuc

SEQ ID NO: 1764594 - RNA, 16 nt, Homo sapiens
agccucccgaaugaag

SEQ ID NO: 1764595 - RNA, 17 nt, Homo sapiens
cucagggacagagccau

SEQ ID NO: 1764596 - RNA, 14 nt, Homo sapiens
cuaguguuuguuaa

SEQ ID NO: 1764597 - RNA, 19 nt, Homo sapiens
cuacaguauuacucuuaca

SEQ ID NO: 1764598 - RNA, 12 nt, Homo sapiens
uacuuccaugau

SEQ ID NO: 1764599 - RNA, 21 nt, Homo sapiens
agagggugauggaacaagaga

SEQ ID NO: 1764600 - RNA, 18 nt, Homo sapiens
cuggggggcaauuuugca

SEQ ID NO: 1764601 - RNA, 24 nt, Homo sapiens
uguguauuuccagugcaauuguag

SEQ ID NO: 1764602 - RNA, 13 nt, Homo sapiens
agguuccugugga

SEQ ID NO: 1764603 - RNA, 17 nt, Homo sapiens
aauuagggaugcucaaa

SEQ ID NO: 1764604 - RNA, 17 nt, Homo sapiens
ucuugccuaaaucccaa

SEQ ID NO: 1764605 - RNA, 16 nt, Homo sapiens
gucauggccugagaug

SEQ ID NO: 1764606 - RNA, 17 nt, Homo sapiens
gagugugggugaucaga

SEQ ID NO: 1764607 - RNA, 21 nt, Homo sapiens
gagaagauggcacuguccagg

SEQ ID NO: 1764608 - RNA, 15 nt, Homo sapiens
acucauuucaucuca

SEQ ID NO: 1764609 - RNA, 22 nt, Homo sapiens
uguuugcugauccccaaccugc

SEQ ID NO: 1764610 - RNA, 18 nt, Homo sapiens
ucuugguuuaugucuugu

SEQ ID NO: 1764611 - RNA, 16 nt, Homo sapiens
aucauaagaauagcug

SEQ ID NO: 1764612 - RNA, 15 nt, Homo sapiens
uaauuacaacagcac

SEQ ID NO: 1764613 - RNA, 18 nt, Homo sapiens
cacgccauugcacuccag

SEQ ID NO: 1764614 - RNA, 17 nt, Homo sapiens
uguggcucacgugugug

SEQ ID NO: 1764615 - RNA, 21 nt, Homo sapiens
gcacuaggaauucuuugcauu

SEQ ID NO: 1764616 - RNA, 16 nt, Homo sapiens
agcugacaucuugcac

SEQ ID NO: 1764617 - RNA, 18 nt, Homo sapiens
aaaucuguuucaacagau

SEQ ID NO: 1764618 - RNA, 16 nt, Homo sapiens
uggcuuucagagccag

SEQ ID NO: 1764619 - RNA, 21 nt, Homo sapiens
aucuacacauauaaacacagu

SEQ ID NO: 1764620 - RNA, 21 nt, Homo sapiens
guacgugaaaugacuuuucca

SEQ ID NO: 1764621 - RNA, 22 nt, Homo sapiens
aauuauuccuuuccuagacuaa

SEQ ID NO: 1764622 - RNA, 20 nt, Homo sapiens
agccauuucccccuccucag

SEQ ID NO: 1764623 - RNA, 18 nt, Homo sapiens
gucaggccuuugagcuca

SEQ ID NO: 1764624 - RNA, 15 nt, Homo sapiens
cgggggccuguggug

SEQ ID NO: 1764625 - RNA, 19 nt, Homo sapiens
aaggcaacauaauucuucc

SEQ ID NO: 1764626 - RNA, 19 nt, Homo sapiens
ggcuggccuuucaggucca

SEQ ID NO: 1764627 - RNA, 14 nt, Homo sapiens
agccacagccugac

SEQ ID NO: 1764628 - RNA, 16 nt, Homo sapiens
uauccaagaccugaaa

SEQ ID NO: 1764629 - RNA, 17 nt, Homo sapiens
agacagugcacaugaac

SEQ ID NO: 1764630 - RNA, 17 nt, Homo sapiens
uagacaucugcuguuau

SEQ ID NO: 1764631 - RNA, 14 nt, Homo sapiens
gcacuguccagggc

SEQ ID NO: 1764632 - RNA, 20 nt, Homo sapiens
ugaaucacugugcucagcca

SEQ ID NO: 1764633 - RNA, 18 nt, Homo sapiens
acagugggaacucugaca

SEQ ID NO: 1764634 - RNA, 20 nt, Homo sapiens
ucugcuugccgaaacuggaa

SEQ ID NO: 1764635 - RNA, 22 nt, Homo sapiens
aguauggccagcagacaggcug

SEQ ID NO: 1764636 - RNA, 20 nt, Homo sapiens
cucugagugaaguccaguga

SEQ ID NO: 1764637 - RNA, 18 nt, Homo sapiens
gguaauucuauugggaua

SEQ ID NO: 1764638 - RNA, 17 nt, Homo sapiens
uagaauaccucccucau

SEQ ID NO: 1764639 - RNA, 19 nt, Homo sapiens
gacaaucugcaaaauggag

SEQ ID NO: 1764640 - RNA, 18 nt, Homo sapiens
aacuguaaauaugucacu

SEQ ID NO: 1764641 - RNA, 12 nt, Homo sapiens
cauugcuguuca

SEQ ID NO: 1764642 - RNA, 11 nt, Homo sapiens
cuccccaacuc

SEQ ID NO: 1764643 - RNA, 20 nt, Homo sapiens
gacagcugcuucugugcauu

SEQ ID NO: 1764644 - RNA, 17 nt, Homo sapiens
gaacacaggcaaugacu

SEQ ID NO: 1764645 - RNA, 17 nt, Homo sapiens
ugaacauguucuccauu

SEQ ID NO: 1764646 - RNA, 21 nt, Homo sapiens
accgauugccuuuauuuugcu

SEQ ID NO: 1764647 - RNA, 23 nt, Homo sapiens
cgucccuguuagcauaaugugag

SEQ ID NO: 1764648 - RNA, 14 nt, Homo sapiens
ugcccagacacaga

SEQ ID NO: 1764649 - RNA, 20 nt, Homo sapiens
cacaguauuaugacacuccc

SEQ ID NO: 1764650 - RNA, 13 nt, Homo sapiens
agugaaacagcug

SEQ ID NO: 1764651 - RNA, 13 nt, Homo sapiens
cauggaaccacua

SEQ ID NO: 1764652 - RNA, 11 nt, Homo sapiens
aucagugcagu

SEQ ID NO: 1764653 - RNA, 22 nt, Homo sapiens
cacacagcuacucuccccacga

SEQ ID NO: 1764654 - RNA, 22 nt, Homo sapiens
agaauugcucccuaccagcuga

SEQ ID NO: 1764655 - RNA, 14 nt, Homo sapiens
uacagaagcauuuu

SEQ ID NO: 1764656 - RNA, 16 nt, Homo sapiens
gcagucucuauaccaa

SEQ ID NO: 1764657 - RNA, 21 nt, Homo sapiens
auaaggcuaaauguaaaacac

SEQ ID NO: 1764658 - RNA, 15 nt, Homo sapiens
augggguccagguca

SEQ ID NO: 1764659 - RNA, 21 nt, Homo sapiens
uucucuaagccuggcuuagaa

SEQ ID NO: 1764660 - RNA, 14 nt, Homo sapiens
gaauugacaguuga

SEQ ID NO: 1764661 - RNA, 22 nt, Homo sapiens
uacuggagaugacagugaugcu

SEQ ID NO: 1764662 - RNA, 13 nt, Homo sapiens
ggugaaccaaaga

SEQ ID NO: 1764663 - RNA, 16 nt, Homo sapiens
caugaucaagauauau

SEQ ID NO: 1764664 - RNA, 15 nt, Homo sapiens
auuaaaauucaggaa

SEQ ID NO: 1764665 - RNA, 13 nt, Homo sapiens
gucuguuuuccca

SEQ ID NO: 1764666 - RNA, 18 nt, Homo sapiens
acuucauauugcugagag

SEQ ID NO: 1764667 - RNA, 14 nt, Homo sapiens
cauccacacaugaa

SEQ ID NO: 1764668 - RNA, 21 nt, Homo sapiens
acacugcaaauaaacuuggua

SEQ ID NO: 1764669 - RNA, 23 nt, Homo sapiens
cuucacuccccuaucccauucuc

SEQ ID NO: 1764670 - RNA, 18 nt, Homo sapiens
aggggcagauaggagcug

SEQ ID NO: 1764671 - RNA, 20 nt, Homo sapiens
cuaacccaaugccugugaag

SEQ ID NO: 1764672 - RNA, 20 nt, Homo sapiens
cucuuaagaaaaugaugcug

SEQ ID NO: 1764673 - RNA, 18 nt, Homo sapiens
gaaccucgccauaaggca

SEQ ID NO: 1764674 - RNA, 15 nt, Homo sapiens
ucuuugccaagggag

SEQ ID NO: 1764675 - RNA, 18 nt, Homo sapiens
cuucuggguucaagcgau

SEQ ID NO: 1764676 - RNA, 17 nt, Homo sapiens
ccucauaggucagggag

SEQ ID NO: 1764677 - RNA, 19 nt, Homo sapiens
ggacuacaaacguguguca

SEQ ID NO: 1764678 - RNA, 14 nt, Homo sapiens
agauagucacugga

SEQ ID NO: 1764679 - RNA, 19 nt, Homo sapiens
gcaugcauaccacaagaca

SEQ ID NO: 1764680 - RNA, 21 nt, Homo sapiens
gauuccagucuucucuuugaa

SEQ ID NO: 1764681 - RNA, 22 nt, Homo sapiens
gcugugggaccaggucugugga

SEQ ID NO: 1764682 - RNA, 15 nt, Homo sapiens
uaucaaaaaguauua

SEQ ID NO: 1764683 - RNA, 20 nt, Homo sapiens
uuugucagauucacacaugc

SEQ ID NO: 1764684 - RNA, 17 nt, Homo sapiens
agucuuuagggguuggg

SEQ ID NO: 1764685 - RNA, 23 nt, Homo sapiens
ucccagugaagagccacugccau

SEQ ID NO: 1764686 - RNA, 20 nt, Homo sapiens
ggcacagccuucuccacugg

SEQ ID NO: 1764687 - RNA, 15 nt, Homo sapiens
ccuguuagacucuua

SEQ ID NO: 1764688 - RNA, 20 nt, Homo sapiens
cugugauguucccaccugcu

SEQ ID NO: 1764689 - RNA, 17 nt, Homo sapiens
ugguacccgcccuuccg

SEQ ID NO: 1764690 - RNA, 17 nt, Homo sapiens
agcuuugacacuggaau

SEQ ID NO: 1764691 - RNA, 22 nt, Homo sapiens
uauuauuuggacgucagccugu

SEQ ID NO: 1764692 - RNA, 15 nt, Homo sapiens
gacaccaccaaggcu

SEQ ID NO: 1764693 - RNA, 23 nt, Homo sapiens
cuaguugccguggcaacugugga

SEQ ID NO: 1764694 - RNA, 13 nt, Homo sapiens
accccaacauuga

SEQ ID NO: 1764695 - RNA, 17 nt, Homo sapiens
gcucucgcggccucuuc

SEQ ID NO: 1764696 - RNA, 16 nt, Homo sapiens
augguguuuugucaga

SEQ ID NO: 1764697 - RNA, 15 nt, Homo sapiens
aucccauguauuuau

SEQ ID NO: 1764698 - RNA, 15 nt, Homo sapiens
acaauguaagagccu

SEQ ID NO: 1764699 - RNA, 19 nt, Homo sapiens
uaauucuguauuaacugaa

SEQ ID NO: 1764700 - RNA, 22 nt, Homo sapiens
aucauauaugcuuuuuugcaau

SEQ ID NO: 1764701 - RNA, 16 nt, Homo sapiens
ucgggauuguguuuga

SEQ ID NO: 1764702 - RNA, 13 nt, Homo sapiens
gccuguaauccca

SEQ ID NO: 1764703 - RNA, 13 nt, Homo sapiens
aaugguacuucau

SEQ ID NO: 1764704 - RNA, 16 nt, Homo sapiens
uuucccauaguuuauu

SEQ ID NO: 1764705 - RNA, 16 nt, Homo sapiens
aagcucacugcugauc

SEQ ID NO: 1764706 - RNA, 13 nt, Homo sapiens
caggacuugcaca

SEQ ID NO: 1764707 - RNA, 19 nt, Homo sapiens
aucaauaucccaacauucu

SEQ ID NO: 1764708 - RNA, 19 nt, Homo sapiens
uaaaacuuauaaauuucau

SEQ ID NO: 1764709 - RNA, 17 nt, Homo sapiens
gacacagccuuggauca

SEQ ID NO: 1764710 - RNA, 21 nt, Homo sapiens
cuuuucaccaaugagccuuag

SEQ ID NO: 1764711 - RNA, 17 nt, Homo sapiens
cagcggggcuacagucc

SEQ ID NO: 1764712 - RNA, 22 nt, Homo sapiens
caguuggcacuguaaggugcuu

SEQ ID NO: 1764713 - RNA, 23 nt, Homo sapiens
cauugaauguagagaauguagcc

SEQ ID NO: 1764714 - RNA, 10 nt, Homo sapiens
gugugcuugu

SEQ ID NO: 1764715 - RNA, 21 nt, Homo sapiens
cuaugccaagucccuggaaaa

SEQ ID NO: 1764716 - RNA, 21 nt, Homo sapiens
gaagacaggaaaguucagagu

SEQ ID NO: 1764717 - RNA, 13 nt, Homo sapiens
cgggaacaguguu

SEQ ID NO: 1764718 - RNA, 16 nt, Homo sapiens
ugccccaaggaccuua

SEQ ID NO: 1764719 - RNA, 17 nt, Homo sapiens
ucaagggcugcuucaaa

SEQ ID NO: 1764720 - RNA, 22 nt, Homo sapiens
accuuccggggccgcaucccuu

SEQ ID NO: 1764721 - RNA, 17 nt, Homo sapiens
gucgucaaguugcagau

SEQ ID NO: 1764722 - RNA, 17 nt, Homo sapiens
auggcaaaguggaucca

SEQ ID NO: 1764723 - RNA, 21 nt, Homo sapiens
cauuguauauauguguaugca

SEQ ID NO: 1764724 - RNA, 21 nt, Homo sapiens
caaaaagaugccuuuuaccau

SEQ ID NO: 1764725 - RNA, 14 nt, Homo sapiens
agagccaagcccug

SEQ ID NO: 1764726 - RNA, 16 nt, Homo sapiens
gcacaugacauagcac

SEQ ID NO: 1764727 - RNA, 16 nt, Homo sapiens
ggcugcugcugugcag

SEQ ID NO: 1764728 - RNA, 19 nt, Homo sapiens
accauccaauuagcuuaug

SEQ ID NO: 1764729 - RNA, 23 nt, Homo sapiens
caagaucaaacuuccauagcuuc

SEQ ID NO: 1764730 - RNA, 12 nt, Homo sapiens
caaaaugcagac

SEQ ID NO: 1764731 - RNA, 18 nt, Homo sapiens
gccuccuuuugcuugaaa

SEQ ID NO: 1764732 - RNA, 20 nt, Homo sapiens
cuggcagagaaggcuuccuc

SEQ ID NO: 1764733 - RNA, 21 nt, Homo sapiens
uaccugcuccuuggccuaguc

SEQ ID NO: 1764734 - RNA, 14 nt, Homo sapiens
ccgagccucuguca

SEQ ID NO: 1764735 - RNA, 17 nt, Homo sapiens
ucacggggucaggagau

SEQ ID NO: 1764736 - RNA, 21 nt, Homo sapiens
cagauuacugcccaauaugca

SEQ ID NO: 1764737 - RNA, 19 nt, Homo sapiens
cagaaugacucuggaacca

SEQ ID NO: 1764738 - RNA, 17 nt, Homo sapiens
aaaacaucgucuaaacu

SEQ ID NO: 1764739 - RNA, 18 nt, Homo sapiens
agcaaacuauuugcgacu

SEQ ID NO: 1764740 - RNA, 13 nt, Homo sapiens
ugacacacagcuc

SEQ ID NO: 1764741 - RNA, 20 nt, Homo sapiens
uuuaagaguagauugauuca

SEQ ID NO: 1764742 - RNA, 17 nt, Homo sapiens
aaauuaacuuacuucca

SEQ ID NO: 1764743 - RNA, 18 nt, Homo sapiens
uacuuugaaaacaauuca

SEQ ID NO: 1764744 - RNA, 18 nt, Homo sapiens
uaaaguacuggagugaaa

SEQ ID NO: 1764745 - RNA, 19 nt, Homo sapiens
cacacuucccauuuacucu

SEQ ID NO: 1764746 - RNA, 17 nt, Homo sapiens
auaaaccagauuccaga

SEQ ID NO: 1764747 - RNA, 13 nt, Homo sapiens
ccaaaaauuugaa

SEQ ID NO: 1764748 - RNA, 15 nt, Homo sapiens
aggcaauggccuaaa

SEQ ID NO: 1764749 - RNA, 14 nt, Homo sapiens
cugccuaugcacug

SEQ ID NO: 1764750 - RNA, 14 nt, Homo sapiens
cugcucugccugga

SEQ ID NO: 1764751 - RNA, 22 nt, Homo sapiens
aaauaacuauauaagacauuaa

SEQ ID NO: 1764752 - RNA, 12 nt, Homo sapiens
gaauuugagugc

SEQ ID NO: 1764753 - RNA, 15 nt, Homo sapiens
uucccugacacuguc

SEQ ID NO: 1764754 - RNA, 13 nt, Homo sapiens
cuaugcaagcaaa

SEQ ID NO: 1764755 - RNA, 14 nt, Homo sapiens
gucuuaacugucac

SEQ ID NO: 1764756 - RNA, 18 nt, Homo sapiens
uguagcugaaacaaaaau

SEQ ID NO: 1764757 - RNA, 14 nt, Homo sapiens
uacauagcauuugu

SEQ ID NO: 1764758 - RNA, 17 nt, Homo sapiens
cugagaaggcccugugc

SEQ ID NO: 1764759 - RNA, 19 nt, Homo sapiens
acagcuucuucaucuuuaa

SEQ ID NO: 1764760 - RNA, 17 nt, Homo sapiens
uaggcucugggugcagu

SEQ ID NO: 1764761 - RNA, 15 nt, Homo sapiens
ucaccuaggggucuu

SEQ ID NO: 1764762 - RNA, 20 nt, Homo sapiens
aagggcacuaaccccauuca

SEQ ID NO: 1764763 - RNA, 16 nt, Homo sapiens
uauaacgagggauaaa

SEQ ID NO: 1764764 - RNA, 14 nt, Homo sapiens
aguaaaaacaauuc

SEQ ID NO: 1764765 - RNA, 19 nt, Homo sapiens
uuuccagucuucuuuauca

SEQ ID NO: 1764766 - RNA, 18 nt, Homo sapiens
accuuauuaacaaaauag

SEQ ID NO: 1764767 - RNA, 16 nt, Homo sapiens
cucuggaccagccugu

SEQ ID NO: 1764768 - RNA, 23 nt, Homo sapiens
uuuugaccaaauaaaguaccauu

SEQ ID NO: 1764769 - RNA, 23 nt, Homo sapiens
ucaauuggaaguaguucuaugaa

SEQ ID NO: 1764770 - RNA, 15 nt, Homo sapiens
gcuaauuuuuugcau

SEQ ID NO: 1764771 - RNA, 18 nt, Homo sapiens
ccagcacccagaaucuca

SEQ ID NO: 1764772 - RNA, 20 nt, Homo sapiens
uacucaaguguuaaauuauu

SEQ ID NO: 1764773 - RNA, 17 nt, Homo sapiens
auuuugaguacagaauu

SEQ ID NO: 1764774 - RNA, 18 nt, Homo sapiens
gcaggaaauggcugugga

SEQ ID NO: 1764775 - RNA, 24 nt, Homo sapiens
ccuuucuuugcaacuucccagcaa

SEQ ID NO: 1764776 - RNA, 21 nt, Homo sapiens
gagaugcuucucuccuugccc

SEQ ID NO: 1764777 - RNA, 22 nt, Homo sapiens
gaccucucagcagaaacacaca

SEQ ID NO: 1764778 - RNA, 15 nt, Homo sapiens
agccacagaagccag

SEQ ID NO: 1764779 - RNA, 13 nt, Homo sapiens
aucacaggcaucu

SEQ ID NO: 1764780 - RNA, 13 nt, Homo sapiens
gcaaaugacuguc

SEQ ID NO: 1764781 - RNA, 21 nt, Homo sapiens
uggcccccacccaguccugca

SEQ ID NO: 1764782 - RNA, 23 nt, Homo sapiens
cauucagacguuuuuucugcaca

SEQ ID NO: 1764783 - RNA, 17 nt, Homo sapiens
gaaauucguuguuccca

SEQ ID NO: 1764784 - RNA, 20 nt, Homo sapiens
aagcaaaaagagaugcugga

SEQ ID NO: 1764785 - RNA, 18 nt, Homo sapiens
uaauacauuuauaaucua

SEQ ID NO: 1764786 - RNA, 13 nt, Homo sapiens
agcugaaccuggg

SEQ ID NO: 1764787 - RNA, 16 nt, Homo sapiens
cuugaggcaacucauc

SEQ ID NO: 1764788 - RNA, 16 nt, Homo sapiens
guuucuuagcuuuuua

SEQ ID NO: 1764789 - RNA, 19 nt, Homo sapiens
uuaaaaggaaagucaagaa

SEQ ID NO: 1764790 - RNA, 15 nt, Homo sapiens
ugacaagugccuuca

SEQ ID NO: 1764791 - RNA, 20 nt, Homo sapiens
ugcccugugagggcucacuc

SEQ ID NO: 1764792 - RNA, 20 nt, Homo sapiens
aaccuaauuuuauccaugga

SEQ ID NO: 1764793 - RNA, 16 nt, Homo sapiens
uagucucagcuacuua

SEQ ID NO: 1764794 - RNA, 16 nt, Homo sapiens
aaauucucucuuguca

SEQ ID NO: 1764795 - RNA, 17 nt, Homo sapiens
uccuguucacaccagag

SEQ ID NO: 1764796 - RNA, 12 nt, Homo sapiens
cuccaucaugcc

SEQ ID NO: 1764797 - RNA, 17 nt, Homo sapiens
gguggauuccaugccgc

SEQ ID NO: 1764798 - RNA, 15 nt, Homo sapiens
ugcauauguaugacu

SEQ ID NO: 1764799 - RNA, 18 nt, Homo sapiens
gcaugcaauaaugugcaa

SEQ ID NO: 1764800 - RNA, 14 nt, Homo sapiens
gccauuucuuccca

SEQ ID NO: 1764801 - RNA, 23 nt, Homo sapiens
ucaguguaccgcgucuacccugg

SEQ ID NO: 1764802 - RNA, 17 nt, Homo sapiens
caaauagauuucuuugc

SEQ ID NO: 1764803 - RNA, 15 nt, Homo sapiens
auuugauguugugaa

SEQ ID NO: 1764804 - RNA, 15 nt, Homo sapiens
aaggugcaguugaau

SEQ ID NO: 1764805 - RNA, 18 nt, Homo sapiens
uuccccuucccacacugu

SEQ ID NO: 1764806 - RNA, 16 nt, Homo sapiens
agaacacaaggucauu

SEQ ID NO: 1764807 - RNA, 16 nt, Homo sapiens
cuuugcaggcaugcau

SEQ ID NO: 1764808 - RNA, 16 nt, Homo sapiens
gcagcccucuugcccg

SEQ ID NO: 1764809 - RNA, 18 nt, Homo sapiens
ugccuugguauagcauau

SEQ ID NO: 1764810 - RNA, 15 nt, Homo sapiens
gcagucacuguggug

SEQ ID NO: 1764811 - RNA, 20 nt, Homo sapiens
agugccuggagucagguguc

SEQ ID NO: 1764812 - RNA, 19 nt, Homo sapiens
uucaaacagucucaggaaa

SEQ ID NO: 1764813 - RNA, 17 nt, Homo sapiens
gugucuaauaaacacag

SEQ ID NO: 1764814 - RNA, 15 nt, Homo sapiens
ucaguaaauuuugga

SEQ ID NO: 1764815 - RNA, 20 nt, Homo sapiens
accucuggcuagaggacaua

SEQ ID NO: 1764816 - RNA, 19 nt, Homo sapiens
cccuaagucaacuuagcau

SEQ ID NO: 1764817 - RNA, 18 nt, Homo sapiens
ggucuuuauuccucccuc

SEQ ID NO: 1764818 - RNA, 13 nt, Homo sapiens
ucucagagcaugu

SEQ ID NO: 1764819 - RNA, 16 nt, Homo sapiens
uuugcucagaacacau

SEQ ID NO: 1764820 - RNA, 21 nt, Homo sapiens
acucacuccagcccaacagaa

SEQ ID NO: 1764821 - RNA, 14 nt, Homo sapiens
ggccgucauuucau

SEQ ID NO: 1764822 - RNA, 12 nt, Homo sapiens
ucugcacugggu

SEQ ID NO: 1764823 - RNA, 13 nt, Homo sapiens
gaagcaaggaaau

SEQ ID NO: 1764824 - RNA, 13 nt, Homo sapiens
uugguuaaucagu

SEQ ID NO: 1764825 - RNA, 14 nt, Homo sapiens
gggaggaacaaaga

SEQ ID NO: 1764826 - RNA, 17 nt, Homo sapiens
gcaucagaaacaucuga

SEQ ID NO: 1764827 - RNA, 17 nt, Homo sapiens
accaacuacuaccugua

SEQ ID NO: 1764828 - RNA, 15 nt, Homo sapiens
caagagaugggacaa

SEQ ID NO: 1764829 - RNA, 20 nt, Homo sapiens
ucaauacccuuggcacugau

SEQ ID NO: 1764830 - RNA, 21 nt, Homo sapiens
uggaaacaugggaaggugcca

SEQ ID NO: 1764831 - RNA, 14 nt, Homo sapiens
cuaacauacuauau

SEQ ID NO: 1764832 - RNA, 20 nt, Homo sapiens
cuuugugcuugucauuccag

SEQ ID NO: 1764833 - RNA, 13 nt, Homo sapiens
uguuuuacaguau

SEQ ID NO: 1764834 - RNA, 13 nt, Homo sapiens
acauauacucaaa

SEQ ID NO: 1764835 - RNA, 13 nt, Homo sapiens
uuuaauacauuua

SEQ ID NO: 1764836 - RNA, 14 nt, Homo sapiens
augugacuuugaaa

SEQ ID NO: 1764837 - RNA, 18 nt, Homo sapiens
uuauuccccccuacuuga

SEQ ID NO: 1764838 - RNA, 18 nt, Homo sapiens
ccuccaguuuuagguccu

SEQ ID NO: 1764839 - RNA, 20 nt, Homo sapiens
agagaaacuugaaugcucca

SEQ ID NO: 1764840 - RNA, 15 nt, Homo sapiens
uccaugugugugcaa

SEQ ID NO: 1764841 - RNA, 15 nt, Homo sapiens
aucuaacugugcuca

SEQ ID NO: 1764842 - RNA, 16 nt, Homo sapiens
ccagccccacugccag

SEQ ID NO: 1764843 - RNA, 15 nt, Homo sapiens
uguagacacagguca

SEQ ID NO: 1764844 - RNA, 14 nt, Homo sapiens
uuuccauagucaca

SEQ ID NO: 1764845 - RNA, 17 nt, Homo sapiens
cauaggcgcaggugcac

SEQ ID NO: 1764846 - RNA, 18 nt, Homo sapiens
aggagaccacggggagca

SEQ ID NO: 1764847 - RNA, 18 nt, Homo sapiens
ggcuuaggaaagugauau

SEQ ID NO: 1764848 - RNA, 17 nt, Homo sapiens
guaugucuuaaaaccug

SEQ ID NO: 1764849 - RNA, 19 nt, Homo sapiens
auuccagaaugcuguacau

SEQ ID NO: 1764850 - RNA, 19 nt, Homo sapiens
ucagaauuucuuugucauu

SEQ ID NO: 1764851 - RNA, 19 nt, Homo sapiens
uaguuuuuucuccucaugg

SEQ ID NO: 1764852 - RNA, 22 nt, Homo sapiens
uguccuuguggucuuugcugcu

SEQ ID NO: 1764853 - RNA, 21 nt, Homo sapiens
guuugguuuuaaaauacugua

SEQ ID NO: 1764854 - RNA, 16 nt, Homo sapiens
acuuccugccauggau

SEQ ID NO: 1764855 - RNA, 21 nt, Homo sapiens
gaagagguaauuuuucaccuu

SEQ ID NO: 1764856 - RNA, 23 nt, Homo sapiens
cugaguaaaguguuaauaccaua

SEQ ID NO: 1764857 - RNA, 15 nt, Homo sapiens
accuauuugacuuac

SEQ ID NO: 1764858 - RNA, 15 nt, Homo sapiens
ugagcaaaaaugcca

SEQ ID NO: 1764859 - RNA, 18 nt, Homo sapiens
uagcaggcaaugcuguac

SEQ ID NO: 1764860 - RNA, 20 nt, Homo sapiens
ccugggcugaucuuugcccc

SEQ ID NO: 1764861 - RNA, 15 nt, Homo sapiens
cuuucuagccuuaga

SEQ ID NO: 1764862 - RNA, 16 nt, Homo sapiens
agccauuggcacugug

SEQ ID NO: 1764863 - RNA, 22 nt, Homo sapiens
cacaguuaucuuagcuggauau

SEQ ID NO: 1764864 - RNA, 21 nt, Homo sapiens
auguggguagucauucuuaca

SEQ ID NO: 1764865 - RNA, 12 nt, Homo sapiens
gcacggacaaua

SEQ ID NO: 1764866 - RNA, 15 nt, Homo sapiens
uccuuuuugucaugc

SEQ ID NO: 1764867 - RNA, 19 nt, Homo sapiens
uuuuccccaaccacagaga

SEQ ID NO: 1764868 - RNA, 19 nt, Homo sapiens
uguggauacagucauuauu

SEQ ID NO: 1764869 - RNA, 19 nt, Homo sapiens
cugucaaucacagucucag

SEQ ID NO: 1764870 - RNA, 23 nt, Homo sapiens
cagacccacugaaaugaccaaga

SEQ ID NO: 1764871 - RNA, 23 nt, Homo sapiens
aguaacacccccaucaccuucuc

SEQ ID NO: 1764872 - RNA, 21 nt, Homo sapiens
aguuuggcaguaccucaaaaa

SEQ ID NO: 1764873 - RNA, 20 nt, Homo sapiens
cauuugauggccaccagcuu

SEQ ID NO: 1764874 - RNA, 23 nt, Homo sapiens
gaagggucccuuuugcauugcca

SEQ ID NO: 1764875 - RNA, 19 nt, Homo sapiens
ugaaucauauucauaugca

SEQ ID NO: 1764876 - RNA, 14 nt, Homo sapiens
ccuccagcacacac

SEQ ID NO: 1764877 - RNA, 17 nt, Homo sapiens
cuuuuuaaaaaauacca

SEQ ID NO: 1764878 - RNA, 19 nt, Homo sapiens
gcacggcccaaggggcuuc

SEQ ID NO: 1764879 - RNA, 15 nt, Homo sapiens
cagcuggaucuccau

SEQ ID NO: 1764880 - RNA, 23 nt, Homo sapiens
gaggggaaacgcaaaaccugcag

SEQ ID NO: 1764881 - RNA, 21 nt, Homo sapiens
aguugccuuuauuugcuguua

SEQ ID NO: 1764882 - RNA, 16 nt, Homo sapiens
aaacaaagacuuugau

SEQ ID NO: 1764883 - RNA, 13 nt, Homo sapiens
caggauaugacaa

SEQ ID NO: 1764884 - RNA, 12 nt, Homo sapiens
uggaccacugca

SEQ ID NO: 1764885 - RNA, 15 nt, Homo sapiens
uuaaagaugguuuau

SEQ ID NO: 1764886 - RNA, 17 nt, Homo sapiens
acccugaaccuaugugu

SEQ ID NO: 1764887 - RNA, 18 nt, Homo sapiens
uggcuaguaaaagccauc

SEQ ID NO: 1764888 - RNA, 16 nt, Homo sapiens
agauaauaucugugag

SEQ ID NO: 1764889 - RNA, 13 nt, Homo sapiens
uccucccagugag

SEQ ID NO: 1764890 - RNA, 15 nt, Homo sapiens
gacuuauugccaaaa

SEQ ID NO: 1764891 - RNA, 20 nt, Homo sapiens
uggcagugauccugcaaguu

SEQ ID NO: 1764892 - RNA, 22 nt, Homo sapiens
cuuaggugccaggcauguccua

SEQ ID NO: 1764893 - RNA, 23 nt, Homo sapiens
ccucucucauggcacccaggcag

SEQ ID NO: 1764894 - RNA, 22 nt, Homo sapiens
augcaauuagucugucacucca

SEQ ID NO: 1764895 - RNA, 15 nt, Homo sapiens
uaauaucgcugauau

SEQ ID NO: 1764896 - RNA, 20 nt, Homo sapiens
accaggaggcggcagugcaa

SEQ ID NO: 1764897 - RNA, 18 nt, Homo sapiens
uugaauuccgcagcagca

SEQ ID NO: 1764898 - RNA, 19 nt, Homo sapiens
auuugcuggaacacaaaga

SEQ ID NO: 1764899 - RNA, 16 nt, Homo sapiens
aauacuuuuccuuaau

SEQ ID NO: 1764900 - RNA, 17 nt, Homo sapiens
acuuuauuucugaucua

SEQ ID NO: 1764901 - RNA, 19 nt, Homo sapiens
acaggucugggagaggcag

SEQ ID NO: 1764902 - RNA, 16 nt, Homo sapiens
cagugccaaaaacaac

SEQ ID NO: 1764903 - RNA, 22 nt, Homo sapiens
cuccagcugggagacacagcaa

SEQ ID NO: 1764904 - RNA, 15 nt, Homo sapiens
auuuccuuccacugu

SEQ ID NO: 1764905 - RNA, 21 nt, Homo sapiens
aguaaaaaauuaaagcccaua

SEQ ID NO: 1764906 - RNA, 23 nt, Homo sapiens
cagagucuaggcuaagcacuuua

SEQ ID NO: 1764907 - RNA, 12 nt, Homo sapiens
auuugugucauu

SEQ ID NO: 1764908 - RNA, 16 nt, Homo sapiens
ccaucaaaguggcaaa

SEQ ID NO: 1764909 - RNA, 14 nt, Homo sapiens
acuugaagauuucu

SEQ ID NO: 1764910 - RNA, 21 nt, Homo sapiens
aaacuuuucauuacacuaaag

SEQ ID NO: 1764911 - RNA, 16 nt, Homo sapiens
uuguuuagagagccug

SEQ ID NO: 1764912 - RNA, 22 nt, Homo sapiens
ccuggcacguccuccaccggug

SEQ ID NO: 1764913 - RNA, 14 nt, Homo sapiens
uugauugcacuuga

SEQ ID NO: 1764914 - RNA, 18 nt, Homo sapiens
acccugccaggcacaggc

SEQ ID NO: 1764915 - RNA, 12 nt, Homo sapiens
ccagcuuucuaa

SEQ ID NO: 1764916 - RNA, 14 nt, Homo sapiens
aaaccuauguuugc

SEQ ID NO: 1764917 - RNA, 22 nt, Homo sapiens
uaaaacucaaaacacccaaaaa

SEQ ID NO: 1764918 - RNA, 23 nt, Homo sapiens
auuuaguugugcagucaguguca

SEQ ID NO: 1764919 - RNA, 16 nt, Homo sapiens
acuuucucuuugccau

SEQ ID NO: 1764920 - RNA, 16 nt, Homo sapiens
ugaaaugacuuuucca

SEQ ID NO: 1764921 - RNA, 19 nt, Homo sapiens
cuccuuguaaagacuguag

SEQ ID NO: 1764922 - RNA, 18 nt, Homo sapiens
cuggagucaguagccaga

SEQ ID NO: 1764923 - RNA, 20 nt, Homo sapiens
cuuaauaaauauuacaguga

SEQ ID NO: 1764924 - RNA, 16 nt, Homo sapiens
gcuucauuaugcagcu

SEQ ID NO: 1764925 - RNA, 16 nt, Homo sapiens
ggauaaagaugagaug

SEQ ID NO: 1764926 - RNA, 19 nt, Homo sapiens
gccaggauuggcacaagcu

SEQ ID NO: 1764927 - RNA, 17 nt, Homo sapiens
cccaaaggucuaucuac

SEQ ID NO: 1764928 - RNA, 17 nt, Homo sapiens
agagcauaucuguuaua

SEQ ID NO: 1764929 - RNA, 15 nt, Homo sapiens
cgugccuguguccug

SEQ ID NO: 1764930 - RNA, 22 nt, Homo sapiens
aaaaguaaugaagaaaauugag

SEQ ID NO: 1764931 - RNA, 16 nt, Homo sapiens
auauggugaagggaag

SEQ ID NO: 1764932 - RNA, 20 nt, Homo sapiens
auacaguuugucacaugaaa

SEQ ID NO: 1764933 - RNA, 15 nt, Homo sapiens
caugcagucugggag

SEQ ID NO: 1764934 - RNA, 20 nt, Homo sapiens
uggcagaggcagggaagcuc

SEQ ID NO: 1764935 - RNA, 12 nt, Homo sapiens
ugccuggaagaa

SEQ ID NO: 1764936 - RNA, 14 nt, Homo sapiens
cuugauaucauuca

SEQ ID NO: 1764937 - RNA, 18 nt, Homo sapiens
uggaugucgaugacuuca

SEQ ID NO: 1764938 - RNA, 19 nt, Homo sapiens
gucuccaccucaggggaga

SEQ ID NO: 1764939 - RNA, 22 nt, Homo sapiens
acagugacauuuauuuuucuca

SEQ ID NO: 1764940 - RNA, 21 nt, Homo sapiens
gcugcagggcugggucagggg

SEQ ID NO: 1764941 - RNA, 21 nt, Homo sapiens
uguugacugucuugacuguca

SEQ ID NO: 1764942 - RNA, 22 nt, Homo sapiens
cuuguagguaugucugugccau

SEQ ID NO: 1764943 - RNA, 15 nt, Homo sapiens
cugaagcaaauacca

SEQ ID NO: 1764944 - RNA, 20 nt, Homo sapiens
cacgauuuaaaucuuuucaa

SEQ ID NO: 1764945 - RNA, 23 nt, Homo sapiens
uuuggcgaccuccuuucaucaca

SEQ ID NO: 1764946 - RNA, 20 nt, Homo sapiens
auauuuuuaaaaguauacau

SEQ ID NO: 1764947 - RNA, 20 nt, Homo sapiens
caccauguacauagcuugau

SEQ ID NO: 1764948 - RNA, 18 nt, Homo sapiens
ccauugggacaugaaguu

SEQ ID NO: 1764949 - RNA, 14 nt, Homo sapiens
aauagaauaccucc

SEQ ID NO: 1764950 - RNA, 23 nt, Homo sapiens
cgggaggauugagaagggacaag

SEQ ID NO: 1764951 - RNA, 21 nt, Homo sapiens
ccucuggcuggcuaacuggaa

SEQ ID NO: 1764952 - RNA, 14 nt, Homo sapiens
aagcaccaagcuca

SEQ ID NO: 1764953 - RNA, 19 nt, Homo sapiens
uguuauauacauacuauga

SEQ ID NO: 1764954 - RNA, 14 nt, Homo sapiens
agaguaaacagaca

SEQ ID NO: 1764955 - RNA, 17 nt, Homo sapiens
gaaacugaguauaauca

SEQ ID NO: 1764956 - RNA, 13 nt, Homo sapiens
cucucugaaaguu

SEQ ID NO: 1764957 - RNA, 16 nt, Homo sapiens
gacccaggucauggaa

SEQ ID NO: 1764958 - RNA, 19 nt, Homo sapiens
gaauuuauggaaucuacca

SEQ ID NO: 1764959 - RNA, 15 nt, Homo sapiens
cuuggacucuuuccc

SEQ ID NO: 1764960 - RNA, 16 nt, Homo sapiens
auauccagauggcaug

SEQ ID NO: 1764961 - RNA, 13 nt, Homo sapiens
ucuaugcacagcu

SEQ ID NO: 1764962 - RNA, 23 nt, Homo sapiens
gaugacguggguuugauuucuaa

SEQ ID NO: 1764963 - RNA, 17 nt, Homo sapiens
cuccaccuagacuguaa

SEQ ID NO: 1764964 - RNA, 17 nt, Homo sapiens
cugaaauagagugaauu

SEQ ID NO: 1764965 - RNA, 17 nt, Homo sapiens
agaaguacugccaauac

SEQ ID NO: 1764966 - RNA, 21 nt, Homo sapiens
ucagucugcuuauccuuccac

SEQ ID NO: 1764967 - RNA, 14 nt, Homo sapiens
auuuccauagucaa

SEQ ID NO: 1764968 - RNA, 18 nt, Homo sapiens
acggcaacugaagcggcu

SEQ ID NO: 1764969 - RNA, 20 nt, Homo sapiens
gaaacacuuugguauucuuu

SEQ ID NO: 1764970 - RNA, 22 nt, Homo sapiens
aaacacuucaauaauuguccau

SEQ ID NO: 1764971 - RNA, 16 nt, Homo sapiens
auuuuuaauuaauuuc

SEQ ID NO: 1764972 - RNA, 15 nt, Homo sapiens
cuuuaacacauucuu

SEQ ID NO: 1764973 - RNA, 18 nt, Homo sapiens
uggugcuaagcccgggcg

SEQ ID NO: 1764974 - RNA, 21 nt, Homo sapiens
caggcucugcuggaugugagu

SEQ ID NO: 1764975 - RNA, 17 nt, Homo sapiens
uugcaccuaucucagcc

SEQ ID NO: 1764976 - RNA, 22 nt, Homo sapiens
augccucugcucccaacuucgc

SEQ ID NO: 1764977 - RNA, 17 nt, Homo sapiens
gugcaccuguaauccca

SEQ ID NO: 1764978 - RNA, 22 nt, Homo sapiens
uggucugcaggcagggcugacu

SEQ ID NO: 1764979 - RNA, 11 nt, Homo sapiens
gccucaucucu

SEQ ID NO: 1764980 - RNA, 19 nt, Homo sapiens
caaauccauggaccuauga

SEQ ID NO: 1764981 - RNA, 17 nt, Homo sapiens
caaauaaauccaagacu

SEQ ID NO: 1764982 - RNA, 16 nt, Homo sapiens
ggcuaagcaucuucaa

SEQ ID NO: 1764983 - RNA, 16 nt, Homo sapiens
auuuaaaaaacuguau

SEQ ID NO: 1764984 - RNA, 23 nt, Homo sapiens
aguagcuuaccagaagcuuccau

SEQ ID NO: 1764985 - RNA, 19 nt, Homo sapiens
cuucgccagccuccaaugu

SEQ ID NO: 1764986 - RNA, 21 nt, Homo sapiens
ccaacuuccuguugauguuca

SEQ ID NO: 1764987 - RNA, 16 nt, Homo sapiens
auucaaaucacaugga

SEQ ID NO: 1764988 - RNA, 21 nt, Homo sapiens
guaacagcaauuuucauaaua

SEQ ID NO: 1764989 - RNA, 14 nt, Homo sapiens
aucaguuaacuauu

SEQ ID NO: 1764990 - RNA, 20 nt, Homo sapiens
aaucaauccugggcaaucag

SEQ ID NO: 1764991 - RNA, 16 nt, Homo sapiens
aauuguaauugucuca

SEQ ID NO: 1764992 - RNA, 22 nt, Homo sapiens
agcccaaaggggacaggccuca

SEQ ID NO: 1764993 - RNA, 17 nt, Homo sapiens
guauuucagaacuuuga

SEQ ID NO: 1764994 - RNA, 19 nt, Homo sapiens
cugccauauucuguuggcc

SEQ ID NO: 1764995 - RNA, 21 nt, Homo sapiens
gauuauuggauucacacccag

SEQ ID NO: 1764996 - RNA, 13 nt, Homo sapiens
gcaguuaccaagu

SEQ ID NO: 1764997 - RNA, 14 nt, Homo sapiens
agaaagccauauuc

SEQ ID NO: 1764998 - RNA, 19 nt, Homo sapiens
cacauuugcccaauuccag

SEQ ID NO: 1764999 - RNA, 18 nt, Homo sapiens
cuugacuaccuacuggug

SEQ ID NO: 1765000 - RNA, 22 nt, Homo sapiens
cuggguguguucuuacugacac

SEQ ID NO: 1765001 - RNA, 20 nt, Homo sapiens
agcuuguggccccuuuuacu

SEQ ID NO: 1765002 - RNA, 15 nt, Homo sapiens
auacaaccuauguaa

SEQ ID NO: 1765003 - RNA, 19 nt, Homo sapiens
uacauaauugcuguucugc

SEQ ID NO: 1765004 - RNA, 22 nt, Homo sapiens
auggagucucgcucuguugccc

SEQ ID NO: 1765005 - RNA, 22 nt, Homo sapiens
cagcaaagggaggaggugcaca

SEQ ID NO: 1765006 - RNA, 20 nt, Homo sapiens
uauauguaguacuaacuaag

SEQ ID NO: 1765007 - RNA, 13 nt, Homo sapiens
cuuuccuguaaag

SEQ ID NO: 1765008 - RNA, 16 nt, Homo sapiens
ucacucucaaacuuca

SEQ ID NO: 1765009 - RNA, 20 nt, Homo sapiens
accauauaccaucuccagcu

SEQ ID NO: 1765010 - RNA, 19 nt, Homo sapiens
uaggucuuucucucaguga

SEQ ID NO: 1765011 - RNA, 22 nt, Homo sapiens
uagaagaugcaguucaaaaaca

SEQ ID NO: 1765012 - RNA, 18 nt, Homo sapiens
cagagaaacuuaagcaaa

SEQ ID NO: 1765013 - RNA, 13 nt, Homo sapiens
auugggcaugcca

SEQ ID NO: 1765014 - RNA, 19 nt, Homo sapiens
guauuuuguagaugugauu

SEQ ID NO: 1765015 - RNA, 15 nt, Homo sapiens
aguaaguaucuggag

SEQ ID NO: 1765016 - RNA, 18 nt, Homo sapiens
aaaauucuuucacuugau

SEQ ID NO: 1765017 - RNA, 16 nt, Homo sapiens
auaggcaccucuucaa

SEQ ID NO: 1765018 - RNA, 21 nt, Homo sapiens
ugccagggcgcacuuuccacu

SEQ ID NO: 1765019 - RNA, 15 nt, Homo sapiens
ccagcuaauaagaag

SEQ ID NO: 1765020 - RNA, 19 nt, Homo sapiens
aguggcuuggccucaagag

SEQ ID NO: 1765021 - RNA, 20 nt, Homo sapiens
uguuucuugccugaacuccu

SEQ ID NO: 1765022 - RNA, 23 nt, Homo sapiens
auuuuaugacauuuuacaaugua

SEQ ID NO: 1765023 - RNA, 17 nt, Homo sapiens
aauaaaccaaacccagc

SEQ ID NO: 1765024 - RNA, 20 nt, Homo sapiens
aagggggcggggacugcugg

SEQ ID NO: 1765025 - RNA, 16 nt, Homo sapiens
uuucacuucuuccuau

SEQ ID NO: 1765026 - RNA, 20 nt, Homo sapiens
uccuagacuugaaaguuuuc

SEQ ID NO: 1765027 - RNA, 18 nt, Homo sapiens
gcauuuuucuacugcucu

SEQ ID NO: 1765028 - RNA, 16 nt, Homo sapiens
ugcagcauuucacuua

SEQ ID NO: 1765029 - RNA, 14 nt, Homo sapiens
agacagugcccuug

SEQ ID NO: 1765030 - RNA, 20 nt, Homo sapiens
cugcugagcagaaugccuua

SEQ ID NO: 1765031 - RNA, 16 nt, Homo sapiens
augcaguuuuccuuaa

SEQ ID NO: 1765032 - RNA, 14 nt, Homo sapiens
agagaaacaaauaa

SEQ ID NO: 1765033 - RNA, 17 nt, Homo sapiens
cugacacuuaccugcuu

SEQ ID NO: 1765034 - RNA, 18 nt, Homo sapiens
cagccuggauguuuuuuc

SEQ ID NO: 1765035 - RNA, 20 nt, Homo sapiens
ccugguccuuccacugugca

SEQ ID NO: 1765036 - RNA, 13 nt, Homo sapiens
uauucauguguac

SEQ ID NO: 1765037 - RNA, 14 nt, Homo sapiens
uguuagguucacac

SEQ ID NO: 1765038 - RNA, 18 nt, Homo sapiens
cuggcaauaaacuuuuag

SEQ ID NO: 1765039 - RNA, 15 nt, Homo sapiens
uugugaauuugggua

SEQ ID NO: 1765040 - RNA, 17 nt, Homo sapiens
aacuuagaaugcuucaa

SEQ ID NO: 1765041 - RNA, 15 nt, Homo sapiens
auuucuuuauugcau

SEQ ID NO: 1765042 - RNA, 18 nt, Homo sapiens
cauccaaggagaaacaga

SEQ ID NO: 1765043 - RNA, 14 nt, Homo sapiens
auacauccuaguga

SEQ ID NO: 1765044 - RNA, 23 nt, Homo sapiens
aucaucaacuaccauucuauucc

SEQ ID NO: 1765045 - RNA, 15 nt, Homo sapiens
aaucaggcucaaaac

SEQ ID NO: 1765046 - RNA, 16 nt, Homo sapiens
gauaaaguuugcuaag

SEQ ID NO: 1765047 - RNA, 13 nt, Homo sapiens
agggcuaucucag

SEQ ID NO: 1765048 - RNA, 22 nt, Homo sapiens
acugugcaaauauaucugcuau

SEQ ID NO: 1765049 - RNA, 16 nt, Homo sapiens
acaccagaagugccau

SEQ ID NO: 1765050 - RNA, 19 nt, Homo sapiens
uucaaacugcaugauucau

SEQ ID NO: 1765051 - RNA, 15 nt, Homo sapiens
cugcuaauaauaaau

SEQ ID NO: 1765052 - RNA, 15 nt, Homo sapiens
cugauauuaaucaaa

SEQ ID NO: 1765053 - RNA, 15 nt, Homo sapiens
cuuauauuaagcaaa

SEQ ID NO: 1765054 - RNA, 14 nt, Homo sapiens
aggcacaggcuccu

SEQ ID NO: 1765055 - RNA, 21 nt, Homo sapiens
cagauuaccgacacugucacu

SEQ ID NO: 1765056 - RNA, 23 nt, Homo sapiens
gggaaauggcuugaagccaaguc

SEQ ID NO: 1765057 - RNA, 13 nt, Homo sapiens
guguuuucauucc

SEQ ID NO: 1765058 - RNA, 13 nt, Homo sapiens
uggacacugugga

SEQ ID NO: 1765059 - RNA, 15 nt, Homo sapiens
auguaggaguguuua

SEQ ID NO: 1765060 - RNA, 21 nt, Homo sapiens
uuuaaaaaaaggagacugugu

SEQ ID NO: 1765061 - RNA, 14 nt, Homo sapiens
auaucaucagcaua

SEQ ID NO: 1765062 - RNA, 24 nt, Homo sapiens
uuugcaggcccagaggagccaagu

SEQ ID NO: 1765063 - RNA, 15 nt, Homo sapiens
agcccgcaucagcug

SEQ ID NO: 1765064 - RNA, 16 nt, Homo sapiens
ccucccccccaugcac

SEQ ID NO: 1765065 - RNA, 21 nt, Homo sapiens
ccaguggaauuccaacuugaa

SEQ ID NO: 1765066 - RNA, 22 nt, Homo sapiens
ucugauaugcaguuuuccuuaa

SEQ ID NO: 1765067 - RNA, 18 nt, Homo sapiens
uucuuacccaauuuccca

SEQ ID NO: 1765068 - RNA, 22 nt, Homo sapiens
guucaaagugugacauucagug

SEQ ID NO: 1765069 - RNA, 16 nt, Homo sapiens
cuauuuauauaucaua

SEQ ID NO: 1765070 - RNA, 18 nt, Homo sapiens
ugaaagaggcagcuugaa

SEQ ID NO: 1765071 - RNA, 17 nt, Homo sapiens
uuuuaaaaaguugcaca

SEQ ID NO: 1765072 - RNA, 19 nt, Homo sapiens
acuguaaaaauaacauaau

SEQ ID NO: 1765073 - RNA, 12 nt, Homo sapiens
gaucacuacuca

SEQ ID NO: 1765074 - RNA, 19 nt, Homo sapiens
agccacagcagguccucca

SEQ ID NO: 1765075 - RNA, 17 nt, Homo sapiens
acuucuaauaucauuca

SEQ ID NO: 1765076 - RNA, 15 nt, Homo sapiens
cacaauuucccuuca

SEQ ID NO: 1765077 - RNA, 17 nt, Homo sapiens
uucauuuguauaagucc

SEQ ID NO: 1765078 - RNA, 18 nt, Homo sapiens
agcaaauaccuaugucaa

SEQ ID NO: 1765079 - RNA, 20 nt, Homo sapiens
aggccuggcacgucaaagag

SEQ ID NO: 1765080 - RNA, 15 nt, Homo sapiens
cuuccuccagaggag

SEQ ID NO: 1765081 - RNA, 15 nt, Homo sapiens
aggcgauccaccugu

SEQ ID NO: 1765082 - RNA, 16 nt, Homo sapiens
uuguggauaacaaaga

SEQ ID NO: 1765083 - RNA, 16 nt, Homo sapiens
uggaaucuaagcuguu

SEQ ID NO: 1765084 - RNA, 23 nt, Homo sapiens
agugccaacuguggcugguccuc

SEQ ID NO: 1765085 - RNA, 15 nt, Homo sapiens
gcuggggaacagagc

SEQ ID NO: 1765086 - RNA, 14 nt, Homo sapiens
ccacaagaccaucu

SEQ ID NO: 1765087 - RNA, 23 nt, Homo sapiens
cucauagggugcucugaggucaa

SEQ ID NO: 1765088 - RNA, 14 nt, Homo sapiens
ucuccuuuugacca

SEQ ID NO: 1765089 - RNA, 17 nt, Homo sapiens
gaccauucaggacacag

SEQ ID NO: 1765090 - RNA, 15 nt, Homo sapiens
gacgccgcgcacuca

SEQ ID NO: 1765091 - RNA, 20 nt, Homo sapiens
aggaaauaccaaaugcauug

SEQ ID NO: 1765092 - RNA, 12 nt, Homo sapiens
aagaaugcugaa

SEQ ID NO: 1765093 - RNA, 16 nt, Homo sapiens
uggaaagcacuggaau

SEQ ID NO: 1765094 - RNA, 18 nt, Homo sapiens
auuaucuagauacuguau

SEQ ID NO: 1765095 - RNA, 16 nt, Homo sapiens
ccugccgucugugcuu

SEQ ID NO: 1765096 - RNA, 19 nt, Homo sapiens
caguugcuagcaacaacuu

SEQ ID NO: 1765097 - RNA, 21 nt, Homo sapiens
gugccuuuaauuugcuacugu

SEQ ID NO: 1765098 - RNA, 15 nt, Homo sapiens
aacccuuccacacgu

SEQ ID NO: 1765099 - RNA, 13 nt, Homo sapiens
ccauuuucauucu

SEQ ID NO: 1765100 - RNA, 18 nt, Homo sapiens
uacacguuucaaccucuc

SEQ ID NO: 1765101 - RNA, 21 nt, Homo sapiens
uaggggugugggucaaaccaa

SEQ ID NO: 1765102 - RNA, 20 nt, Homo sapiens
gacagcuggcggaggcugcu

SEQ ID NO: 1765103 - RNA, 18 nt, Homo sapiens
acaggugcgguuccucau

SEQ ID NO: 1765104 - RNA, 23 nt, Homo sapiens
cuucuguggcaacuuguacugaa

SEQ ID NO: 1765105 - RNA, 13 nt, Homo sapiens
caacagacuugaa

SEQ ID NO: 1765106 - RNA, 20 nt, Homo sapiens
uuccccuugccuuaucccau

SEQ ID NO: 1765107 - RNA, 21 nt, Homo sapiens
guauacuuuuagcuuguaguu

SEQ ID NO: 1765108 - RNA, 14 nt, Homo sapiens
auaauuugcacuua

SEQ ID NO: 1765109 - RNA, 14 nt, Homo sapiens
auuaaguaacuuau

SEQ ID NO: 1765110 - RNA, 14 nt, Homo sapiens
ucuugucaccuuaa

SEQ ID NO: 1765111 - RNA, 14 nt, Homo sapiens
cacagacauacaau

SEQ ID NO: 1765112 - RNA, 21 nt, Homo sapiens
gauucauuuauuugacauaga

SEQ ID NO: 1765113 - RNA, 22 nt, Homo sapiens
gcaucguggugugucaaugcca

SEQ ID NO: 1765114 - RNA, 19 nt, Homo sapiens
aauauuuucugcaauccaa

SEQ ID NO: 1765115 - RNA, 15 nt, Homo sapiens
uagcugagaagcaau

SEQ ID NO: 1765116 - RNA, 18 nt, Homo sapiens
uauugaaaaugucacugu

SEQ ID NO: 1765117 - RNA, 13 nt, Homo sapiens
cccagaacuagga

SEQ ID NO: 1765118 - RNA, 17 nt, Homo sapiens
uuuauaaauguauugau

SEQ ID NO: 1765119 - RNA, 16 nt, Homo sapiens
aaauaauacaacaauc

SEQ ID NO: 1765120 - RNA, 13 nt, Homo sapiens
cuguaguccaguc

SEQ ID NO: 1765121 - RNA, 19 nt, Homo sapiens
aagccccuuaguccccaag

SEQ ID NO: 1765122 - RNA, 19 nt, Homo sapiens
uaauuaguaagcuagcaaa

SEQ ID NO: 1765123 - RNA, 19 nt, Homo sapiens
ucuucacaccuacccuccu

SEQ ID NO: 1765124 - RNA, 21 nt, Homo sapiens
aaguguacaauuuucauccca

SEQ ID NO: 1765125 - RNA, 21 nt, Homo sapiens
gcugagauuacucugaaaaug

SEQ ID NO: 1765126 - RNA, 17 nt, Homo sapiens
acuuucugucuagguua

SEQ ID NO: 1765127 - RNA, 23 nt, Homo sapiens
agggauggggcagucucugccca

SEQ ID NO: 1765128 - RNA, 18 nt, Homo sapiens
aauauaaauuuaagcaaa

SEQ ID NO: 1765129 - RNA, 20 nt, Homo sapiens
caaacacugcaggcaucaca

SEQ ID NO: 1765130 - RNA, 14 nt, Homo sapiens
uucacuuuacaaau

SEQ ID NO: 1765131 - RNA, 14 nt, Homo sapiens
auauaauuuccuca

SEQ ID NO: 1765132 - RNA, 14 nt, Homo sapiens
ucuaccaguuuauu

SEQ ID NO: 1765133 - RNA, 17 nt, Homo sapiens
uguccccuccacuguca

SEQ ID NO: 1765134 - RNA, 14 nt, Homo sapiens
uccuuacucuugau

SEQ ID NO: 1765135 - RNA, 23 nt, Homo sapiens
caacagcaccaauuguacauucc

SEQ ID NO: 1765136 - RNA, 23 nt, Homo sapiens
aaggaaaaaacuuugacuuugcc

SEQ ID NO: 1765137 - RNA, 14 nt, Homo sapiens
ucugcuuaccacau

SEQ ID NO: 1765138 - RNA, 21 nt, Homo sapiens
aucuuaacuucacuuccauua

SEQ ID NO: 1765139 - RNA, 17 nt, Homo sapiens
gugauucggccucucca

SEQ ID NO: 1765140 - RNA, 15 nt, Homo sapiens
agcggcccugacacg

SEQ ID NO: 1765141 - RNA, 21 nt, Homo sapiens
uacaaauguuaaaauguguug

SEQ ID NO: 1765142 - RNA, 15 nt, Homo sapiens
ccugaggaagaugac

SEQ ID NO: 1765143 - RNA, 16 nt, Homo sapiens
aagggagugucagccu

SEQ ID NO: 1765144 - RNA, 15 nt, Homo sapiens
uacuucucgugacac

SEQ ID NO: 1765145 - RNA, 17 nt, Homo sapiens
uggacagcaaaaccauu

SEQ ID NO: 1765146 - RNA, 14 nt, Homo sapiens
ccaggagaaggggg

SEQ ID NO: 1765147 - RNA, 16 nt, Homo sapiens
aguuguacacugugua

SEQ ID NO: 1765148 - RNA, 21 nt, Homo sapiens
uguauuuuuauuuuugcacaa

SEQ ID NO: 1765149 - RNA, 15 nt, Homo sapiens
ccacuccagcuccuu

SEQ ID NO: 1765150 - RNA, 15 nt, Homo sapiens
ugauauugcauaugc

SEQ ID NO: 1765151 - RNA, 16 nt, Homo sapiens
aauacugcgugugaua

SEQ ID NO: 1765152 - RNA, 13 nt, Homo sapiens
cuggcacugcugg

SEQ ID NO: 1765153 - RNA, 13 nt, Homo sapiens
ggcagugcugauu

SEQ ID NO: 1765154 - RNA, 18 nt, Homo sapiens
aguaucucuucagucucu

SEQ ID NO: 1765155 - RNA, 20 nt, Homo sapiens
uccaguuuaaugaacuacca

SEQ ID NO: 1765156 - RNA, 15 nt, Homo sapiens
guacuugucaaagaa

SEQ ID NO: 1765157 - RNA, 10 nt, Homo sapiens
ugacacugaa

SEQ ID NO: 1765158 - RNA, 15 nt, Homo sapiens
acucgaugcaagugu

SEQ ID NO: 1765159 - RNA, 22 nt, Homo sapiens
guccauacacuuuguugcaaga

SEQ ID NO: 1765160 - RNA, 13 nt, Homo sapiens
aaaaagcuacuua

SEQ ID NO: 1765161 - RNA, 14 nt, Homo sapiens
accacaagugugca

SEQ ID NO: 1765162 - RNA, 16 nt, Homo sapiens
caucuguuacacaaag

SEQ ID NO: 1765163 - RNA, 18 nt, Homo sapiens
aauccauccugcucuucc

SEQ ID NO: 1765164 - RNA, 13 nt, Homo sapiens
aucccaugucacc

SEQ ID NO: 1765165 - RNA, 14 nt, Homo sapiens
acccucgaugaagc

SEQ ID NO: 1765166 - RNA, 16 nt, Homo sapiens
ccaucuguuugauaca

SEQ ID NO: 1765167 - RNA, 20 nt, Homo sapiens
cagguggcccgguugaacuc

SEQ ID NO: 1765168 - RNA, 16 nt, Homo sapiens
cuguuccaccaaauac

SEQ ID NO: 1765169 - RNA, 17 nt, Homo sapiens
agccuuaaaaugcauug

SEQ ID NO: 1765170 - RNA, 15 nt, Homo sapiens
ugcauccuacuccua

SEQ ID NO: 1765171 - RNA, 23 nt, Homo sapiens
caaagaugucuuaaccucaggga

SEQ ID NO: 1765172 - RNA, 12 nt, Homo sapiens
uagcaugcugcu

SEQ ID NO: 1765173 - RNA, 17 nt, Homo sapiens
uuccucuacagauuguc

SEQ ID NO: 1765174 - RNA, 20 nt, Homo sapiens
uaaagaaauauauaugauau

SEQ ID NO: 1765175 - RNA, 20 nt, Homo sapiens
caugggauggggaugaagua

SEQ ID NO: 1765176 - RNA, 18 nt, Homo sapiens
cuuuugcuugauccagaa

SEQ ID NO: 1765177 - RNA, 21 nt, Homo sapiens
cuuauccugacacauuuucaa

SEQ ID NO: 1765178 - RNA, 13 nt, Homo sapiens
uugauacauucag

SEQ ID NO: 1765179 - RNA, 20 nt, Homo sapiens
ucuggaauuuaagcuauucu

SEQ ID NO: 1765180 - RNA, 15 nt, Homo sapiens
caggagguuguggau

SEQ ID NO: 1765181 - RNA, 17 nt, Homo sapiens
caaaguaaucuacugua

SEQ ID NO: 1765182 - RNA, 16 nt, Homo sapiens
cccccuggucuuugag

SEQ ID NO: 1765183 - RNA, 16 nt, Homo sapiens
caguuaugugaccuca

SEQ ID NO: 1765184 - RNA, 21 nt, Homo sapiens
ccuaccaagauauaccugaua

SEQ ID NO: 1765185 - RNA, 13 nt, Homo sapiens
ugucucacaucua

SEQ ID NO: 1765186 - RNA, 11 nt, Homo sapiens
gccaccuuccc

SEQ ID NO: 1765187 - RNA, 17 nt, Homo sapiens
uaguaaugcucugacca

SEQ ID NO: 1765188 - RNA, 15 nt, Homo sapiens
agcugaauucacuua

SEQ ID NO: 1765189 - RNA, 20 nt, Homo sapiens
caucucuuuagauccaaaau

SEQ ID NO: 1765190 - RNA, 17 nt, Homo sapiens
ccaucaugcuugauuga

SEQ ID NO: 1765191 - RNA, 16 nt, Homo sapiens
auaccugcuucaguga

SEQ ID NO: 1765192 - RNA, 16 nt, Homo sapiens
uuacgcucaucaccua

SEQ ID NO: 1765193 - RNA, 11 nt, Homo sapiens
cugucuucccc

SEQ ID NO: 1765194 - RNA, 18 nt, Homo sapiens
acuccuccgugagcacca

SEQ ID NO: 1765195 - RNA, 19 nt, Homo sapiens
cugcagcagaggcacuggg

SEQ ID NO: 1765196 - RNA, 21 nt, Homo sapiens
ucagcaauauugccugugcuu

SEQ ID NO: 1765197 - RNA, 20 nt, Homo sapiens
uugcacaagcuuguauauac

SEQ ID NO: 1765198 - RNA, 21 nt, Homo sapiens
gaccacuuuucaguucagugg

SEQ ID NO: 1765199 - RNA, 23 nt, Homo sapiens
cugagcuuaaauaacaaaacugu

SEQ ID NO: 1765200 - RNA, 19 nt, Homo sapiens
auuacuccauuacuaaaga

SEQ ID NO: 1765201 - RNA, 18 nt, Homo sapiens
guuuucccaaagcacuuu

SEQ ID NO: 1765202 - RNA, 14 nt, Homo sapiens
uacaauaauguacu

SEQ ID NO: 1765203 - RNA, 23 nt, Homo sapiens
uaaaucaaucuuauuacugagag

SEQ ID NO: 1765204 - RNA, 20 nt, Homo sapiens
gcccaggggcccacagggaa

SEQ ID NO: 1765205 - RNA, 13 nt, Homo sapiens
ugggcagugccac

SEQ ID NO: 1765206 - RNA, 23 nt, Homo sapiens
ugacaacaacuaucaccaaaaga

SEQ ID NO: 1765207 - RNA, 17 nt, Homo sapiens
gaagggccacgugcuuu

SEQ ID NO: 1765208 - RNA, 22 nt, Homo sapiens
aggaacccagcggcucuagcca

SEQ ID NO: 1765209 - RNA, 19 nt, Homo sapiens
gaaacagggaaaaugaagc

SEQ ID NO: 1765210 - RNA, 18 nt, Homo sapiens
uggauuuuccaccaaauu

SEQ ID NO: 1765211 - RNA, 17 nt, Homo sapiens
accagaucugucuccaa

SEQ ID NO: 1765212 - RNA, 16 nt, Homo sapiens
aauccuaaaaaacacu

SEQ ID NO: 1765213 - RNA, 20 nt, Homo sapiens
uccauccauggggcugauug

SEQ ID NO: 1765214 - RNA, 15 nt, Homo sapiens
gggcuccauguagaa

SEQ ID NO: 1765215 - RNA, 13 nt, Homo sapiens
uuaaguggcagaa

SEQ ID NO: 1765216 - RNA, 16 nt, Homo sapiens
gccucuggacagccag

SEQ ID NO: 1765217 - RNA, 17 nt, Homo sapiens
ucccacucaggugaaaa

SEQ ID NO: 1765218 - RNA, 18 nt, Homo sapiens
gauggugacauugcaccu

SEQ ID NO: 1765219 - RNA, 20 nt, Homo sapiens
ugucccuggcgcugugcuag

SEQ ID NO: 1765220 - RNA, 18 nt, Homo sapiens
aaugguuuguuuucuaca

SEQ ID NO: 1765221 - RNA, 19 nt, Homo sapiens
uaccauauucagcauuuga

SEQ ID NO: 1765222 - RNA, 19 nt, Homo sapiens
uaccugaaguacaguauau

SEQ ID NO: 1765223 - RNA, 16 nt, Homo sapiens
aggcuggaaaugguuu

SEQ ID NO: 1765224 - RNA, 15 nt, Homo sapiens
cuacagcagcacugu

SEQ ID NO: 1765225 - RNA, 15 nt, Homo sapiens
ucucacacagcagua

SEQ ID NO: 1765226 - RNA, 17 nt, Homo sapiens
aaacaaccguauaccug

SEQ ID NO: 1765227 - RNA, 21 nt, Homo sapiens
ugaauaaagcacgugcaagga

SEQ ID NO: 1765228 - RNA, 15 nt, Homo sapiens
ccacaggaaccacaa

SEQ ID NO: 1765229 - RNA, 15 nt, Homo sapiens
aaaaauuuauacuua

SEQ ID NO: 1765230 - RNA, 16 nt, Homo sapiens
cugaucaguugccaaa

SEQ ID NO: 1765231 - RNA, 22 nt, Homo sapiens
uuucaaacuuaaacaaaaaacu

SEQ ID NO: 1765232 - RNA, 14 nt, Homo sapiens
ccuaggcagaucac

SEQ ID NO: 1765233 - RNA, 18 nt, Homo sapiens
cagaaaucuaaucucugu

SEQ ID NO: 1765234 - RNA, 14 nt, Homo sapiens
cugugcacuguugc

SEQ ID NO: 1765235 - RNA, 14 nt, Homo sapiens
cugaaaacuguaaa

SEQ ID NO: 1765236 - RNA, 17 nt, Homo sapiens
gaauugaggacuaugga

SEQ ID NO: 1765237 - RNA, 10 nt, Homo sapiens
uagacaccaa

SEQ ID NO: 1765238 - RNA, 22 nt, Homo sapiens
gcugcagggcugggucaggggu

SEQ ID NO: 1765239 - RNA, 18 nt, Homo sapiens
cuuggaucagaugaacuc

SEQ ID NO: 1765240 - RNA, 19 nt, Homo sapiens
agccagacuggacaggcaa

SEQ ID NO: 1765241 - RNA, 14 nt, Homo sapiens
gaugugugaugucu

SEQ ID NO: 1765242 - RNA, 12 nt, Homo sapiens
gaaaacaauuca

SEQ ID NO: 1765243 - RNA, 17 nt, Homo sapiens
caaauguuuugcucaau

SEQ ID NO: 1765244 - RNA, 14 nt, Homo sapiens
aucugacuaugaca

SEQ ID NO: 1765245 - RNA, 17 nt, Homo sapiens
cuuuaugguuucuccag

SEQ ID NO: 1765246 - RNA, 18 nt, Homo sapiens
guucaagacuuagcuccu

SEQ ID NO: 1765247 - RNA, 17 nt, Homo sapiens
auuuacaggacuucucu

SEQ ID NO: 1765248 - RNA, 22 nt, Homo sapiens
uggaaacagggccaggugcuuu

SEQ ID NO: 1765249 - RNA, 17 nt, Homo sapiens
uagauauguuaagcaug

SEQ ID NO: 1765250 - RNA, 14 nt, Homo sapiens
uaagccaaaaacaa

SEQ ID NO: 1765251 - RNA, 22 nt, Homo sapiens
augaacugucuuuuaaugugua

SEQ ID NO: 1765252 - RNA, 17 nt, Homo sapiens
auaguccauggacaaua

SEQ ID NO: 1765253 - RNA, 14 nt, Homo sapiens
aaguuguacaugau

SEQ ID NO: 1765254 - RNA, 20 nt, Homo sapiens
gguggguuuugaacauaaag

SEQ ID NO: 1765255 - RNA, 22 nt, Homo sapiens
ggagaccuguaucaaacugcuu

SEQ ID NO: 1765256 - RNA, 13 nt, Homo sapiens
cugauguuuauaa

SEQ ID NO: 1765257 - RNA, 18 nt, Homo sapiens
ucccuuccucccaaaagu

SEQ ID NO: 1765258 - RNA, 17 nt, Homo sapiens
uaacgaccacagggucu

SEQ ID NO: 1765259 - RNA, 14 nt, Homo sapiens
gcucccagggccau

SEQ ID NO: 1765260 - RNA, 16 nt, Homo sapiens
agacucgacucugugc

SEQ ID NO: 1765261 - RNA, 14 nt, Homo sapiens
ugagucccugugau

SEQ ID NO: 1765262 - RNA, 15 nt, Homo sapiens
ccauuaauuacauac

SEQ ID NO: 1765263 - RNA, 17 nt, Homo sapiens
uuauccuugaccaauuu

SEQ ID NO: 1765264 - RNA, 21 nt, Homo sapiens
cacuaaaacccuggauugaaa

SEQ ID NO: 1765265 - RNA, 14 nt, Homo sapiens
caucuuuucuugcc

SEQ ID NO: 1765266 - RNA, 17 nt, Homo sapiens
uguuuuccccaguugua

SEQ ID NO: 1765267 - RNA, 12 nt, Homo sapiens
ucuuuugagggc

SEQ ID NO: 1765268 - RNA, 14 nt, Homo sapiens
cuccuagagugcag

SEQ ID NO: 1765269 - RNA, 21 nt, Homo sapiens
cucccugccuggauccagcuc

SEQ ID NO: 1765270 - RNA, 14 nt, Homo sapiens
gaggaccuccuacc

SEQ ID NO: 1765271 - RNA, 12 nt, Homo sapiens
gcaggugcugcc

SEQ ID NO: 1765272 - RNA, 22 nt, Homo sapiens
aagccacucggggcaggccagc

SEQ ID NO: 1765273 - RNA, 22 nt, Homo sapiens
uaggucccuuggucuguacaaa

SEQ ID NO: 1765274 - RNA, 15 nt, Homo sapiens
uuauggaaguuuucu

SEQ ID NO: 1765275 - RNA, 21 nt, Homo sapiens
cucuggauuccauuuggguca

SEQ ID NO: 1765276 - RNA, 16 nt, Homo sapiens
agucguacuguucaca

SEQ ID NO: 1765277 - RNA, 17 nt, Homo sapiens
aaaugcuccagcacuca

SEQ ID NO: 1765278 - RNA, 21 nt, Homo sapiens
gauuauuuuaugcacaccuaa

SEQ ID NO: 1765279 - RNA, 14 nt, Homo sapiens
guagaguuuuguca

SEQ ID NO: 1765280 - RNA, 21 nt, Homo sapiens
gacaagcccuugagaagccaa

SEQ ID NO: 1765281 - RNA, 15 nt, Homo sapiens
auacaacaggcagug

SEQ ID NO: 1765282 - RNA, 17 nt, Homo sapiens
cuuauuucuaacuauua

SEQ ID NO: 1765283 - RNA, 15 nt, Homo sapiens
uacucgauguaaggg

SEQ ID NO: 1765284 - RNA, 16 nt, Homo sapiens
cuggcagaagcauugc

SEQ ID NO: 1765285 - RNA, 20 nt, Homo sapiens
acagacuugaacauuugcag

SEQ ID NO: 1765286 - RNA, 14 nt, Homo sapiens
aggaagaacaucug

SEQ ID NO: 1765287 - RNA, 19 nt, Homo sapiens
agagcaggcguucagcuca

SEQ ID NO: 1765288 - RNA, 14 nt, Homo sapiens
ccuauucaugucuc

SEQ ID NO: 1765289 - RNA, 17 nt, Homo sapiens
cagguggccccaguuca

SEQ ID NO: 1765290 - RNA, 20 nt, Homo sapiens
ucuguucacagucucuggaa

SEQ ID NO: 1765291 - RNA, 16 nt, Homo sapiens
ggacuuuccugcaacu

SEQ ID NO: 1765292 - RNA, 13 nt, Homo sapiens
guuaauacuauau

SEQ ID NO: 1765293 - RNA, 17 nt, Homo sapiens
uucugucagaaucacau

SEQ ID NO: 1765294 - RNA, 18 nt, Homo sapiens
ucaaggcugcagugagcc

SEQ ID NO: 1765295 - RNA, 18 nt, Homo sapiens
cugggccauguccaaaga

SEQ ID NO: 1765296 - RNA, 14 nt, Homo sapiens
uguuaacugaaugc

SEQ ID NO: 1765297 - RNA, 18 nt, Homo sapiens
aauaguaaacacagggaa

SEQ ID NO: 1765298 - RNA, 16 nt, Homo sapiens
cuuaaacgaaagaaua

SEQ ID NO: 1765299 - RNA, 20 nt, Homo sapiens
uucuuaaaacuuaaauugcu

SEQ ID NO: 1765300 - RNA, 14 nt, Homo sapiens
gaaacaaaaagccc

SEQ ID NO: 1765301 - RNA, 18 nt, Homo sapiens
agacccccugagccacag

SEQ ID NO: 1765302 - RNA, 20 nt, Homo sapiens
auggugugugucucugacaa

SEQ ID NO: 1765303 - RNA, 18 nt, Homo sapiens
agccacauguacacuaca

SEQ ID NO: 1765304 - RNA, 15 nt, Homo sapiens
uugucaaaaagucau

SEQ ID NO: 1765305 - RNA, 21 nt, Homo sapiens
uagauaaauaaauauaugauu

SEQ ID NO: 1765306 - RNA, 20 nt, Homo sapiens
uuuugggaccaucacugaga

SEQ ID NO: 1765307 - RNA, 16 nt, Homo sapiens
cauucaucucauucca

SEQ ID NO: 1765308 - RNA, 13 nt, Homo sapiens
aucuaagaacuug

SEQ ID NO: 1765309 - RNA, 15 nt, Homo sapiens
gaaaaugugcaauau

SEQ ID NO: 1765310 - RNA, 23 nt, Homo sapiens
gccuggggccaagcagacgggca

SEQ ID NO: 1765311 - RNA, 13 nt, Homo sapiens
augcaugaacaag

SEQ ID NO: 1765312 - RNA, 23 nt, Homo sapiens
aaaaugaaauacuaaaucuuucu

SEQ ID NO: 1765313 - RNA, 22 nt, Homo sapiens
cacacuguaaauauccacagac

SEQ ID NO: 1765314 - RNA, 14 nt, Homo sapiens
aggaauaaugauac

SEQ ID NO: 1765315 - RNA, 15 nt, Homo sapiens
agauccucucuccca

SEQ ID NO: 1765316 - RNA, 14 nt, Homo sapiens
gaaaaauguguuag

SEQ ID NO: 1765317 - RNA, 19 nt, Homo sapiens
ugauucauacauuaucuca

SEQ ID NO: 1765318 - RNA, 15 nt, Homo sapiens
gaacuucacagagac

SEQ ID NO: 1765319 - RNA, 16 nt, Homo sapiens
uguuuguucacacucc

SEQ ID NO: 1765320 - RNA, 13 nt, Homo sapiens
cuuuuccccucau

SEQ ID NO: 1765321 - RNA, 19 nt, Homo sapiens
aguaugcucugaguagcuu

SEQ ID NO: 1765322 - RNA, 19 nt, Homo sapiens
cuccacugcgcuuacuccu

SEQ ID NO: 1765323 - RNA, 21 nt, Homo sapiens
acaaugcaaccaacuauccaa

SEQ ID NO: 1765324 - RNA, 23 nt, Homo sapiens
uucuaaaaugucucaagugcaau

SEQ ID NO: 1765325 - RNA, 14 nt, Homo sapiens
guauuauacaugug

SEQ ID NO: 1765326 - RNA, 23 nt, Homo sapiens
caguguccagacuuucuguaauc

SEQ ID NO: 1765327 - RNA, 13 nt, Homo sapiens
ucgugacagccuc

SEQ ID NO: 1765328 - RNA, 13 nt, Homo sapiens
uucucacagugug

SEQ ID NO: 1765329 - RNA, 12 nt, Homo sapiens
ucaguauccacu

SEQ ID NO: 1765330 - RNA, 16 nt, Homo sapiens
cuacaaaugccuguca

SEQ ID NO: 1765331 - RNA, 23 nt, Homo sapiens
gagaccacugaguaccaggggcu

SEQ ID NO: 1765332 - RNA, 17 nt, Homo sapiens
caauguaccauguugcc

SEQ ID NO: 1765333 - RNA, 16 nt, Homo sapiens
guauuccagcugguga

SEQ ID NO: 1765334 - RNA, 21 nt, Homo sapiens
cguccuggggccugugcacug

SEQ ID NO: 1765335 - RNA, 14 nt, Homo sapiens
cucagaacccaucc

SEQ ID NO: 1765336 - RNA, 11 nt, Homo sapiens
aaaaagacaua

SEQ ID NO: 1765337 - RNA, 16 nt, Homo sapiens
agcugcugucuucccc

SEQ ID NO: 1765338 - RNA, 15 nt, Homo sapiens
gguugucaguuacau

SEQ ID NO: 1765339 - RNA, 12 nt, Homo sapiens
uguuucuuuaua

SEQ ID NO: 1765340 - RNA, 17 nt, Homo sapiens
gaaagcaucacugccuu

SEQ ID NO: 1765341 - RNA, 19 nt, Homo sapiens
gccaaacugucucugccuc

SEQ ID NO: 1765342 - RNA, 22 nt, Homo sapiens
uccuguucucagagcuccacag

SEQ ID NO: 1765343 - RNA, 13 nt, Homo sapiens
gcucaucauucuc

SEQ ID NO: 1765344 - RNA, 19 nt, Homo sapiens
aaucaguggaacucaauau

SEQ ID NO: 1765345 - RNA, 13 nt, Homo sapiens
accugcaugugcu

SEQ ID NO: 1765346 - RNA, 20 nt, Homo sapiens
ccauguucacaccgcugcac

SEQ ID NO: 1765347 - RNA, 21 nt, Homo sapiens
aaagcguuucuuuacuucuca

SEQ ID NO: 1765348 - RNA, 16 nt, Homo sapiens
gucuggcccacugugc

SEQ ID NO: 1765349 - RNA, 23 nt, Homo sapiens
cauguuuaauaauauguacaaau

SEQ ID NO: 1765350 - RNA, 16 nt, Homo sapiens
auuacuggaaguaaga

SEQ ID NO: 1765351 - RNA, 19 nt, Homo sapiens
cuucaucugacuaugacau

SEQ ID NO: 1765352 - RNA, 13 nt, Homo sapiens
uagauucuuuauu

SEQ ID NO: 1765353 - RNA, 18 nt, Homo sapiens
gagacugcccuucucacg

SEQ ID NO: 1765354 - RNA, 21 nt, Homo sapiens
cuccucgaagucccggcuucc

SEQ ID NO: 1765355 - RNA, 14 nt, Homo sapiens
agacugcaucucaa

SEQ ID NO: 1765356 - RNA, 13 nt, Homo sapiens
gccugagacaccc

SEQ ID NO: 1765357 - RNA, 20 nt, Homo sapiens
cugacauguacgauucacuc

SEQ ID NO: 1765358 - RNA, 13 nt, Homo sapiens
agcaggagcagcu

SEQ ID NO: 1765359 - RNA, 15 nt, Homo sapiens
uuucaacucauugca

SEQ ID NO: 1765360 - RNA, 14 nt, Homo sapiens
acauauacauauga

SEQ ID NO: 1765361 - RNA, 19 nt, Homo sapiens
ucacccaccucuugugcaa

SEQ ID NO: 1765362 - RNA, 14 nt, Homo sapiens
gcuggagagcugcu

SEQ ID NO: 1765363 - RNA, 14 nt, Homo sapiens
uagguuuacauuca

SEQ ID NO: 1765364 - RNA, 20 nt, Homo sapiens
cugacugcaccuucugugcc

SEQ ID NO: 1765365 - RNA, 22 nt, Homo sapiens
gacggcgugccuggacacugua

SEQ ID NO: 1765366 - RNA, 16 nt, Homo sapiens
uacugcccaggccuau

SEQ ID NO: 1765367 - RNA, 14 nt, Homo sapiens
ucucuuucucaccu

SEQ ID NO: 1765368 - RNA, 15 nt, Homo sapiens
uagggacuuugggcu

SEQ ID NO: 1765369 - RNA, 14 nt, Homo sapiens
augagcauucauaa

SEQ ID NO: 1765370 - RNA, 19 nt, Homo sapiens
aguacucaguaacacaggg

SEQ ID NO: 1765371 - RNA, 13 nt, Homo sapiens
uggaaaugccauu

SEQ ID NO: 1765372 - RNA, 21 nt, Homo sapiens
aaggaggaggcucccacugga

SEQ ID NO: 1765373 - RNA, 16 nt, Homo sapiens
cagagccccuggcaca

SEQ ID NO: 1765374 - RNA, 17 nt, Homo sapiens
cuuuuaagugccuugga

SEQ ID NO: 1765375 - RNA, 15 nt, Homo sapiens
gcaaugugacuuaau

SEQ ID NO: 1765376 - RNA, 15 nt, Homo sapiens
aucaggggccagaga

SEQ ID NO: 1765377 - RNA, 22 nt, Homo sapiens
cuaccauuugcagaguccugca

SEQ ID NO: 1765378 - RNA, 16 nt, Homo sapiens
aggcauuuggucucac

SEQ ID NO: 1765379 - RNA, 22 nt, Homo sapiens
auacugaaaacuuuuaaggugg

SEQ ID NO: 1765380 - RNA, 20 nt, Homo sapiens
aaaucauccaagacaguuau

SEQ ID NO: 1765381 - RNA, 23 nt, Homo sapiens
ccuuaaacucagggagcauuuau

SEQ ID NO: 1765382 - RNA, 13 nt, Homo sapiens
ucccauugcaguu

SEQ ID NO: 1765383 - RNA, 18 nt, Homo sapiens
aguggucaggcaucuucc

SEQ ID NO: 1765384 - RNA, 16 nt, Homo sapiens
gcaugaaauuuugccu

SEQ ID NO: 1765385 - RNA, 21 nt, Homo sapiens
gacacccccugggauggcuca

SEQ ID NO: 1765386 - RNA, 16 nt, Homo sapiens
cucacagcauuugcca

SEQ ID NO: 1765387 - RNA, 21 nt, Homo sapiens
ucuuuauuuuuguuaauauua

SEQ ID NO: 1765388 - RNA, 22 nt, Homo sapiens
cuccacuggucugucuuuggau

SEQ ID NO: 1765389 - RNA, 15 nt, Homo sapiens
cgaggauguguccua

SEQ ID NO: 1765390 - RNA, 14 nt, Homo sapiens
gaauugacauugaa

SEQ ID NO: 1765391 - RNA, 17 nt, Homo sapiens
uauuugcuaaaugcugu

SEQ ID NO: 1765392 - RNA, 20 nt, Homo sapiens
aacauccacucucucuuguu

SEQ ID NO: 1765393 - RNA, 23 nt, Homo sapiens
uucagauauaaaagacugaccaa

SEQ ID NO: 1765394 - RNA, 13 nt, Homo sapiens
aaaaaucauauaa

SEQ ID NO: 1765395 - RNA, 15 nt, Homo sapiens
ugggggaacacugag

SEQ ID NO: 1765396 - RNA, 17 nt, Homo sapiens
aucagaaggacauggug

SEQ ID NO: 1765397 - RNA, 13 nt, Homo sapiens
acuuugcagcaua

SEQ ID NO: 1765398 - RNA, 13 nt, Homo sapiens
ggugugcaagaga

SEQ ID NO: 1765399 - RNA, 17 nt, Homo sapiens
agcuccaaaacuggacc

SEQ ID NO: 1765400 - RNA, 22 nt, Homo sapiens
cuuucucacugcugucagccaa

SEQ ID NO: 1765401 - RNA, 21 nt, Homo sapiens
caaacuguagcaagaugcaaa

SEQ ID NO: 1765402 - RNA, 14 nt, Homo sapiens
uuugcacaugggau

SEQ ID NO: 1765403 - RNA, 20 nt, Homo sapiens
guuugccacacccaggugau

SEQ ID NO: 1765404 - RNA, 23 nt, Homo sapiens
ugaaauauuuagaagugcuaauu

SEQ ID NO: 1765405 - RNA, 14 nt, Homo sapiens
agcagaugauuccc

SEQ ID NO: 1765406 - RNA, 22 nt, Homo sapiens
auuauuuuuauuuuuaaacagg

SEQ ID NO: 1765407 - RNA, 16 nt, Homo sapiens
gaaacaugucuugacu

SEQ ID NO: 1765408 - RNA, 14 nt, Homo sapiens
uuggggacuaaccc

SEQ ID NO: 1765409 - RNA, 13 nt, Homo sapiens
uuuucaccccacc

SEQ ID NO: 1765410 - RNA, 18 nt, Homo sapiens
aaaaccugagcagcaacu

SEQ ID NO: 1765411 - RNA, 15 nt, Homo sapiens
ccucuggcuccagca

SEQ ID NO: 1765412 - RNA, 13 nt, Homo sapiens
cuuggcaccaaag

SEQ ID NO: 1765413 - RNA, 19 nt, Homo sapiens
acuugauauaauuacuuaa

SEQ ID NO: 1765414 - RNA, 20 nt, Homo sapiens
uuuuaaacucugagugcaaa

SEQ ID NO: 1765415 - RNA, 15 nt, Homo sapiens
aagggccacugggac

SEQ ID NO: 1765416 - RNA, 13 nt, Homo sapiens
aaugcauccaaau

SEQ ID NO: 1765417 - RNA, 14 nt, Homo sapiens
gcggacaguggcag

SEQ ID NO: 1765418 - RNA, 23 nt, Homo sapiens
cagaggaggccggugaagugcau

SEQ ID NO: 1765419 - RNA, 23 nt, Homo sapiens
guccaggcuuuuuuaucauguga

SEQ ID NO: 1765420 - RNA, 20 nt, Homo sapiens
uaugaacuugagaucuguau

SEQ ID NO: 1765421 - RNA, 11 nt, Homo sapiens
gaaacuuuccu

SEQ ID NO: 1765422 - RNA, 21 nt, Homo sapiens
ucugcccuaaccugacagagg

SEQ ID NO: 1765423 - RNA, 19 nt, Homo sapiens
ugggaaggcuaaguucagu

SEQ ID NO: 1765424 - RNA, 17 nt, Homo sapiens
aucuauugauaguuuca

SEQ ID NO: 1765425 - RNA, 20 nt, Homo sapiens
cauuuacagcccucagcaau

SEQ ID NO: 1765426 - RNA, 15 nt, Homo sapiens
uuucuccuuucacca

SEQ ID NO: 1765427 - RNA, 15 nt, Homo sapiens
uauauucuuacccua

SEQ ID NO: 1765428 - RNA, 18 nt, Homo sapiens
cugcagaaagaaauugag

SEQ ID NO: 1765429 - RNA, 14 nt, Homo sapiens
cucccuucucucuc

SEQ ID NO: 1765430 - RNA, 17 nt, Homo sapiens
gaaaagauuucugucca

SEQ ID NO: 1765431 - RNA, 14 nt, Homo sapiens
accacgaggaaaag

SEQ ID NO: 1765432 - RNA, 20 nt, Homo sapiens
uaguguucacaaacugugaa

SEQ ID NO: 1765433 - RNA, 15 nt, Homo sapiens
gcaacuugcuucuaa

SEQ ID NO: 1765434 - RNA, 15 nt, Homo sapiens
ucuaagaaagaaauu

SEQ ID NO: 1765435 - RNA, 13 nt, Homo sapiens
gcucaagugaucu

SEQ ID NO: 1765436 - RNA, 18 nt, Homo sapiens
ggaaucuuuuacugugga

SEQ ID NO: 1765437 - RNA, 16 nt, Homo sapiens
augcuacaaucugugu

SEQ ID NO: 1765438 - RNA, 22 nt, Homo sapiens
ggagucuugcucugucacccag

SEQ ID NO: 1765439 - RNA, 15 nt, Homo sapiens
uggacuuaccgagca

SEQ ID NO: 1765440 - RNA, 20 nt, Homo sapiens
gucaaaccgcacucacccau

SEQ ID NO: 1765441 - RNA, 13 nt, Homo sapiens
ugucagucugucc

SEQ ID NO: 1765442 - RNA, 13 nt, Homo sapiens
ccuuccaccucag

SEQ ID NO: 1765443 - RNA, 13 nt, Homo sapiens
cugcaucucaaaa

SEQ ID NO: 1765444 - RNA, 20 nt, Homo sapiens
uuucuaaaaacacacacaaa

SEQ ID NO: 1765445 - RNA, 13 nt, Homo sapiens
cgcaccagguguc

SEQ ID NO: 1765446 - RNA, 12 nt, Homo sapiens
cccacaaaauau

SEQ ID NO: 1765447 - RNA, 18 nt, Homo sapiens
gacccucggggcaggaag

SEQ ID NO: 1765448 - RNA, 15 nt, Homo sapiens
gaagucuaacgcuga

SEQ ID NO: 1765449 - RNA, 14 nt, Homo sapiens
agccuccagcaccu

SEQ ID NO: 1765450 - RNA, 15 nt, Homo sapiens
uuaccauguauguau

SEQ ID NO: 1765451 - RNA, 14 nt, Homo sapiens
gacaagcugcaaau

SEQ ID NO: 1765452 - RNA, 18 nt, Homo sapiens
uuuuagcguuaaagucag

SEQ ID NO: 1765453 - RNA, 22 nt, Homo sapiens
uuuugacagcaugaaauguccu

SEQ ID NO: 1765454 - RNA, 17 nt, Homo sapiens
gagauauuugguaccau

SEQ ID NO: 1765455 - RNA, 17 nt, Homo sapiens
cuuuacuaucauucuca

SEQ ID NO: 1765456 - RNA, 17 nt, Homo sapiens
cuucuggcucacaggaa

SEQ ID NO: 1765457 - RNA, 22 nt, Homo sapiens
uuugacuagccaucucaagcaa

SEQ ID NO: 1765458 - RNA, 14 nt, Homo sapiens
gaaaaccuccagua

SEQ ID NO: 1765459 - RNA, 12 nt, Homo sapiens
auccccaaaggu

SEQ ID NO: 1765460 - RNA, 16 nt, Homo sapiens
uuucugcggccuucca

SEQ ID NO: 1765461 - RNA, 12 nt, Homo sapiens
acccaggaguuu

SEQ ID NO: 1765462 - RNA, 12 nt, Homo sapiens
aaugucaugauu

SEQ ID NO: 1765463 - RNA, 22 nt, Homo sapiens
acauuaucaucugaaaaucugg

SEQ ID NO: 1765464 - RNA, 20 nt, Homo sapiens
gagcucgggguccaccagug

SEQ ID NO: 1765465 - RNA, 20 nt, Homo sapiens
uccagcaauucuccugccuc

SEQ ID NO: 1765466 - RNA, 21 nt, Homo sapiens
uauuggcugcuuugccucuac

SEQ ID NO: 1765467 - RNA, 17 nt, Homo sapiens
acuaaagugucauccac

SEQ ID NO: 1765468 - RNA, 13 nt, Homo sapiens
agccaguugaauu

SEQ ID NO: 1765469 - RNA, 19 nt, Homo sapiens
acuuagcuugcacaugaau

SEQ ID NO: 1765470 - RNA, 14 nt, Homo sapiens
cagggcauugcuca

SEQ ID NO: 1765471 - RNA, 18 nt, Homo sapiens
cccucuccccucauggag

SEQ ID NO: 1765472 - RNA, 15 nt, Homo sapiens
cucuuuuucuagucu

SEQ ID NO: 1765473 - RNA, 17 nt, Homo sapiens
uauauaugaaaacuaag

SEQ ID NO: 1765474 - RNA, 15 nt, Homo sapiens
caugaugcagucucc

SEQ ID NO: 1765475 - RNA, 15 nt, Homo sapiens
uuccauuucuuccac

SEQ ID NO: 1765476 - RNA, 12 nt, Homo sapiens
agauugaacuuu

SEQ ID NO: 1765477 - RNA, 11 nt, Homo sapiens
cccugcaaaac

SEQ ID NO: 1765478 - RNA, 14 nt, Homo sapiens
aaccuaccacauuc

SEQ ID NO: 1765479 - RNA, 17 nt, Homo sapiens
uaaguaucacacuguau

SEQ ID NO: 1765480 - RNA, 15 nt, Homo sapiens
acgugaugagacaaa

SEQ ID NO: 1765481 - RNA, 14 nt, Homo sapiens
ccuuugagguugau

SEQ ID NO: 1765482 - RNA, 21 nt, Homo sapiens
uuucaucagaacagcuguuga

SEQ ID NO: 1765483 - RNA, 15 nt, Homo sapiens
cagcacaugguguug

SEQ ID NO: 1765484 - RNA, 20 nt, Homo sapiens
ccuuucuugagggaguucaa

SEQ ID NO: 1765485 - RNA, 16 nt, Homo sapiens
gaccuugaccauuaau

SEQ ID NO: 1765486 - RNA, 16 nt, Homo sapiens
caaaaaacuaauguga

SEQ ID NO: 1765487 - RNA, 19 nt, Homo sapiens
uaaaacaaaagcucaucca

SEQ ID NO: 1765488 - RNA, 13 nt, Homo sapiens
auccuccuccugc

SEQ ID NO: 1765489 - RNA, 21 nt, Homo sapiens
gaaaauaauaaaagaaucauu

SEQ ID NO: 1765490 - RNA, 13 nt, Homo sapiens
auccacugugcca

SEQ ID NO: 1765491 - RNA, 18 nt, Homo sapiens
uaaauauacuucugcugu

SEQ ID NO: 1765492 - RNA, 17 nt, Homo sapiens
aguaaaggcugcugcua

SEQ ID NO: 1765493 - RNA, 18 nt, Homo sapiens
aaaugaacuaacugccau

SEQ ID NO: 1765494 - RNA, 17 nt, Homo sapiens
aucuuaggauuuaccaa

SEQ ID NO: 1765495 - RNA, 17 nt, Homo sapiens
gaaggccuucuuucuag

SEQ ID NO: 1765496 - RNA, 12 nt, Homo sapiens
auggacuuuguu

SEQ ID NO: 1765497 - RNA, 23 nt, Homo sapiens
cuagcauuguaaaauuauuucau

SEQ ID NO: 1765498 - RNA, 21 nt, Homo sapiens
ucauguaucgcuucauguaac

SEQ ID NO: 1765499 - RNA, 17 nt, Homo sapiens
agucugaacguggaauu

SEQ ID NO: 1765500 - RNA, 15 nt, Homo sapiens
cauaagaaaagauua

SEQ ID NO: 1765501 - RNA, 23 nt, Homo sapiens
cuggaguacaauggcgugaucuc

SEQ ID NO: 1765502 - RNA, 14 nt, Homo sapiens
caccgugugccaua

SEQ ID NO: 1765503 - RNA, 14 nt, Homo sapiens
ccauuuaaguaucu

SEQ ID NO: 1765504 - RNA, 12 nt, Homo sapiens
auuaauucaccu

SEQ ID NO: 1765505 - RNA, 12 nt, Homo sapiens
cuuagugacaaa

SEQ ID NO: 1765506 - RNA, 19 nt, Homo sapiens
gcucccgcgggaagccagc

SEQ ID NO: 1765507 - RNA, 18 nt, Homo sapiens
acacucuacuacauguga

SEQ ID NO: 1765508 - RNA, 21 nt, Homo sapiens
gcucacccaagcaaggccaaa

SEQ ID NO: 1765509 - RNA, 19 nt, Homo sapiens
ccaaaggacccaaguacuu

SEQ ID NO: 1765510 - RNA, 22 nt, Homo sapiens
gccuagauaugaauauauggca

SEQ ID NO: 1765511 - RNA, 17 nt, Homo sapiens
ccuucagcauaauucgg

SEQ ID NO: 1765512 - RNA, 21 nt, Homo sapiens
gcugucacagguuuucagaga

SEQ ID NO: 1765513 - RNA, 20 nt, Homo sapiens
gccagcugggagcacuggug

SEQ ID NO: 1765514 - RNA, 15 nt, Homo sapiens
gcucuggcaccacua

SEQ ID NO: 1765515 - RNA, 23 nt, Homo sapiens
ugcagcuucuaacugguaaaaag

SEQ ID NO: 1765516 - RNA, 15 nt, Homo sapiens
aucaacugaucucau

SEQ ID NO: 1765517 - RNA, 20 nt, Homo sapiens
uauuuuuuaaaaaucuauau

SEQ ID NO: 1765518 - RNA, 18 nt, Homo sapiens
agcaggggaguaugcaaa

SEQ ID NO: 1765519 - RNA, 23 nt, Homo sapiens
ccaaacagugggagggaauuccu

SEQ ID NO: 1765520 - RNA, 17 nt, Homo sapiens
gcucccaccuguagucc

SEQ ID NO: 1765521 - RNA, 14 nt, Homo sapiens
uuggcugcugccac

SEQ ID NO: 1765522 - RNA, 20 nt, Homo sapiens
caguguggugggaggggugu

SEQ ID NO: 1765523 - RNA, 14 nt, Homo sapiens
agccagacccugca

SEQ ID NO: 1765524 - RNA, 17 nt, Homo sapiens
ugaauuuugucuuuaug

SEQ ID NO: 1765525 - RNA, 23 nt, Homo sapiens
acccuaauguggcagcugucuca

SEQ ID NO: 1765526 - RNA, 23 nt, Homo sapiens
ggcgaacccugggccauccucac

SEQ ID NO: 1765527 - RNA, 13 nt, Homo sapiens
gaacagugcccaa

SEQ ID NO: 1765528 - RNA, 23 nt, Homo sapiens
aauuaaaggagaagauuccugaa

SEQ ID NO: 1765529 - RNA, 16 nt, Homo sapiens
uuagauaauucuuaaa

SEQ ID NO: 1765530 - RNA, 20 nt, Homo sapiens
uaaauuccacagauuaucaa

SEQ ID NO: 1765531 - RNA, 13 nt, Homo sapiens
aaucccugagaca

SEQ ID NO: 1765532 - RNA, 13 nt, Homo sapiens
ugaaccuguauaa

SEQ ID NO: 1765533 - RNA, 23 nt, Homo sapiens
acacauucauuuggaugcaguga

SEQ ID NO: 1765534 - RNA, 23 nt, Homo sapiens
ugaacuucgcaucaaaagacaau

SEQ ID NO: 1765535 - RNA, 17 nt, Homo sapiens
agcgcucagaacaguau

SEQ ID NO: 1765536 - RNA, 16 nt, Homo sapiens
ccucaaccugugauga

SEQ ID NO: 1765537 - RNA, 15 nt, Homo sapiens
acuugccacauggug

SEQ ID NO: 1765538 - RNA, 19 nt, Homo sapiens
uauacgcuggcaacacaga

SEQ ID NO: 1765539 - RNA, 16 nt, Homo sapiens
ugaauagcgcccucaa

SEQ ID NO: 1765540 - RNA, 18 nt, Homo sapiens
acaagacccccagcacuu

SEQ ID NO: 1765541 - RNA, 14 nt, Homo sapiens
ccaguuaugaauca

SEQ ID NO: 1765542 - RNA, 19 nt, Homo sapiens
aagguacucuggacuuucu

SEQ ID NO: 1765543 - RNA, 23 nt, Homo sapiens
aacagauggggucugugacugga

SEQ ID NO: 1765544 - RNA, 22 nt, Homo sapiens
augagguucuggccccugucau

SEQ ID NO: 1765545 - RNA, 13 nt, Homo sapiens
auuugggacauca

SEQ ID NO: 1765546 - RNA, 20 nt, Homo sapiens
uaucuucaggacuauuucac

SEQ ID NO: 1765547 - RNA, 20 nt, Homo sapiens
caauagaacuggucuuccau

SEQ ID NO: 1765548 - RNA, 13 nt, Homo sapiens
aaugcucucucuu

SEQ ID NO: 1765549 - RNA, 13 nt, Homo sapiens
acuugaauuucaa

SEQ ID NO: 1765550 - RNA, 16 nt, Homo sapiens
cagcaguuucagguag

SEQ ID NO: 1765551 - RNA, 13 nt, Homo sapiens
ucccugggcauug

SEQ ID NO: 1765552 - RNA, 14 nt, Homo sapiens
cccauuucuuacca

SEQ ID NO: 1765553 - RNA, 14 nt, Homo sapiens
acaguauguucaaa

SEQ ID NO: 1765554 - RNA, 16 nt, Homo sapiens
gaucaucuuuccuguu

SEQ ID NO: 1765555 - RNA, 22 nt, Homo sapiens
acguugaggacuuuucgaccaa

SEQ ID NO: 1765556 - RNA, 20 nt, Homo sapiens
ggaggaggcucccacuggau

SEQ ID NO: 1765557 - RNA, 20 nt, Homo sapiens
gcuggacuguuccaggcccu

SEQ ID NO: 1765558 - RNA, 20 nt, Homo sapiens
cuuacugucuucuucauguc

SEQ ID NO: 1765559 - RNA, 23 nt, Homo sapiens
cagaacuucaucugccacugguu

SEQ ID NO: 1765560 - RNA, 19 nt, Homo sapiens
aaggucuccaaaccagacg

SEQ ID NO: 1765561 - RNA, 12 nt, Homo sapiens
aaaaauguucua

SEQ ID NO: 1765562 - RNA, 12 nt, Homo sapiens
aaacauguucuc

SEQ ID NO: 1765563 - RNA, 23 nt, Homo sapiens
agcuuugcaaaaugagacuuucu

SEQ ID NO: 1765564 - RNA, 16 nt, Homo sapiens
cuugcucccucuccaa

SEQ ID NO: 1765565 - RNA, 15 nt, Homo sapiens
uuggugguuaugucc

SEQ ID NO: 1765566 - RNA, 17 nt, Homo sapiens
auuuaucgcaacaugaa

SEQ ID NO: 1765567 - RNA, 12 nt, Homo sapiens
agaaccaugaau

SEQ ID NO: 1765568 - RNA, 20 nt, Homo sapiens
agcaaaauaauaaaauacuu

SEQ ID NO: 1765569 - RNA, 21 nt, Homo sapiens
uuaacauuguuuuuguauauu

SEQ ID NO: 1765570 - RNA, 16 nt, Homo sapiens
cacaauguacuauaug

SEQ ID NO: 1765571 - RNA, 13 nt, Homo sapiens
cuccagcccuuca

SEQ ID NO: 1765572 - RNA, 19 nt, Homo sapiens
cagcuagacucccauggaa

SEQ ID NO: 1765573 - RNA, 17 nt, Homo sapiens
gcggcacauuggcagug

SEQ ID NO: 1765574 - RNA, 16 nt, Homo sapiens
uaccuuguuuugccag

SEQ ID NO: 1765575 - RNA, 16 nt, Homo sapiens
ucuuacuuaucaaaag

SEQ ID NO: 1765576 - RNA, 18 nt, Homo sapiens
ggagacaguaacacuggc

SEQ ID NO: 1765577 - RNA, 22 nt, Homo sapiens
aaaccuuccaugucaagauuca

SEQ ID NO: 1765578 - RNA, 14 nt, Homo sapiens
gccauaccauuccc

SEQ ID NO: 1765579 - RNA, 20 nt, Homo sapiens
gaugucuugguuuccaucaa

SEQ ID NO: 1765580 - RNA, 12 nt, Homo sapiens
uuaacaaucaaa

SEQ ID NO: 1765581 - RNA, 18 nt, Homo sapiens
auuaauauccaagacuua

SEQ ID NO: 1765582 - RNA, 18 nt, Homo sapiens
caaugucaugucugugau

SEQ ID NO: 1765583 - RNA, 15 nt, Homo sapiens
uaagccuaaaugccu

SEQ ID NO: 1765584 - RNA, 20 nt, Homo sapiens
acacccacccugugccauca

SEQ ID NO: 1765585 - RNA, 23 nt, Homo sapiens
aaguguggguuuauauaaggaau

SEQ ID NO: 1765586 - RNA, 20 nt, Homo sapiens
aggcuggaaaagggcucaga

SEQ ID NO: 1765587 - RNA, 23 nt, Homo sapiens
gcuucuggccuuguaucuugcau

SEQ ID NO: 1765588 - RNA, 15 nt, Homo sapiens
gauugaacuucaaua

SEQ ID NO: 1765589 - RNA, 18 nt, Homo sapiens
agacgcaaggaucacuug

SEQ ID NO: 1765590 - RNA, 18 nt, Homo sapiens
uuaccacaggaugcauau

SEQ ID NO: 1765591 - RNA, 13 nt, Homo sapiens
cuugggaaacuuc

SEQ ID NO: 1765592 - RNA, 22 nt, Homo sapiens
uuuuaggaaaagugaaucuugc

SEQ ID NO: 1765593 - RNA, 23 nt, Homo sapiens
cccugaauucauugucucaguga

SEQ ID NO: 1765594 - RNA, 19 nt, Homo sapiens
auaacacuggcuucaggca

SEQ ID NO: 1765595 - RNA, 20 nt, Homo sapiens
ucaauaauaaacauauuucc

SEQ ID NO: 1765596 - RNA, 22 nt, Homo sapiens
ugggugagagugagacucaguc

SEQ ID NO: 1765597 - RNA, 16 nt, Homo sapiens
aggcugacuacucacu

SEQ ID NO: 1765598 - RNA, 21 nt, Homo sapiens
agccagaguuuuuaaagccuu

SEQ ID NO: 1765599 - RNA, 14 nt, Homo sapiens
agggucaagccucu

SEQ ID NO: 1765600 - RNA, 22 nt, Homo sapiens
ccagaagccuccuuacauuaaa

SEQ ID NO: 1765601 - RNA, 16 nt, Homo sapiens
acacaauccuccaaga

SEQ ID NO: 1765602 - RNA, 15 nt, Homo sapiens
ccacaccacagcaga

SEQ ID NO: 1765603 - RNA, 20 nt, Homo sapiens
cauaauggaaaacauuuaca

SEQ ID NO: 1765604 - RNA, 19 nt, Homo sapiens
ugacuagccaucucaagca

SEQ ID NO: 1765605 - RNA, 13 nt, Homo sapiens
accagccuugaca

SEQ ID NO: 1765606 - RNA, 20 nt, Homo sapiens
acugccaaauaaacagcuau

SEQ ID NO: 1765607 - RNA, 22 nt, Homo sapiens
uuuucaauaaugugaaugcuau

SEQ ID NO: 1765608 - RNA, 18 nt, Homo sapiens
acaggagaaacacuugaa

SEQ ID NO: 1765609 - RNA, 20 nt, Homo sapiens
uucccuugccuauuugcuga

SEQ ID NO: 1765610 - RNA, 19 nt, Homo sapiens
cuaacuaaccacauuuuag

SEQ ID NO: 1765611 - RNA, 16 nt, Homo sapiens
agacccucaccuuccu

SEQ ID NO: 1765612 - RNA, 18 nt, Homo sapiens
cuaucuggggagcuccug

SEQ ID NO: 1765613 - RNA, 19 nt, Homo sapiens
ugguaugguuguauacaca

SEQ ID NO: 1765614 - RNA, 17 nt, Homo sapiens
ccucccuucaugcaugg

SEQ ID NO: 1765615 - RNA, 14 nt, Homo sapiens
agcucucugugcac

SEQ ID NO: 1765616 - RNA, 20 nt, Homo sapiens
cacacugcacacaugcacac

SEQ ID NO: 1765617 - RNA, 21 nt, Homo sapiens
cccauuuuuaaaauacauugu

SEQ ID NO: 1765618 - RNA, 11 nt, Homo sapiens
gugguucucaa

SEQ ID NO: 1765619 - RNA, 13 nt, Homo sapiens
uuugucucagaag

SEQ ID NO: 1765620 - RNA, 14 nt, Homo sapiens
cuuuggcuuugcaa

SEQ ID NO: 1765621 - RNA, 18 nt, Homo sapiens
gagcagcucuucagcaca

SEQ ID NO: 1765622 - RNA, 21 nt, Homo sapiens
ugaacuauuucuacacagugg

SEQ ID NO: 1765623 - RNA, 19 nt, Homo sapiens
ggacuguguggaccaagga

SEQ ID NO: 1765624 - RNA, 13 nt, Homo sapiens
gcugugaugaugu

SEQ ID NO: 1765625 - RNA, 14 nt, Homo sapiens
uuagugcaugucac

SEQ ID NO: 1765626 - RNA, 17 nt, Homo sapiens
auuaucaugguauuuga

SEQ ID NO: 1765627 - RNA, 23 nt, Homo sapiens
ccucacauuuggaugauugucau

SEQ ID NO: 1765628 - RNA, 15 nt, Homo sapiens
uccuucugcuggaua

SEQ ID NO: 1765629 - RNA, 23 nt, Homo sapiens
ugaaagguacuauauuugcuaga

SEQ ID NO: 1765630 - RNA, 19 nt, Homo sapiens
aaauugaaaacacacucaa

SEQ ID NO: 1765631 - RNA, 17 nt, Homo sapiens
uggggagcccgucucag

SEQ ID NO: 1765632 - RNA, 22 nt, Homo sapiens
acugaacccccucaaaagccaa

SEQ ID NO: 1765633 - RNA, 18 nt, Homo sapiens
gugguaugaaaugucuga

SEQ ID NO: 1765634 - RNA, 12 nt, Homo sapiens
gacaccaugaca

SEQ ID NO: 1765635 - RNA, 12 nt, Homo sapiens
gaaaccaugaaa

SEQ ID NO: 1765636 - RNA, 12 nt, Homo sapiens
aacugugcucuu

SEQ ID NO: 1765637 - RNA, 16 nt, Homo sapiens
acaaauuauaagcaua

SEQ ID NO: 1765638 - RNA, 13 nt, Homo sapiens
gcaggaucucagc

SEQ ID NO: 1765639 - RNA, 13 nt, Homo sapiens
ggcccaucugccg

SEQ ID NO: 1765640 - RNA, 18 nt, Homo sapiens
auggcaaaaacaaagguc

SEQ ID NO: 1765641 - RNA, 19 nt, Homo sapiens
uucccaauagcacuuucau

SEQ ID NO: 1765642 - RNA, 21 nt, Homo sapiens
uucuaaauccgacuugaauau

SEQ ID NO: 1765643 - RNA, 21 nt, Homo sapiens
auuccuugcuuagacauuaca

SEQ ID NO: 1765644 - RNA, 22 nt, Homo sapiens
cauaaaaagaaaugugaaguuu

SEQ ID NO: 1765645 - RNA, 13 nt, Homo sapiens
aguguaugauuac

SEQ ID NO: 1765646 - RNA, 19 nt, Homo sapiens
cugucugaaggacacuucc

SEQ ID NO: 1765647 - RNA, 19 nt, Homo sapiens
caaaagagaaauacauaaa

SEQ ID NO: 1765648 - RNA, 24 nt, Homo sapiens
uacauaauugccaauaauguguga

SEQ ID NO: 1765649 - RNA, 13 nt, Homo sapiens
uccauugcauuca

SEQ ID NO: 1765650 - RNA, 16 nt, Homo sapiens
accagauaacugagga

SEQ ID NO: 1765651 - RNA, 17 nt, Homo sapiens
gcuuuguccugaaggaa

SEQ ID NO: 1765652 - RNA, 13 nt, Homo sapiens
caggucugagaua

SEQ ID NO: 1765653 - RNA, 20 nt, Homo sapiens
cauguacagacauacauuua

SEQ ID NO: 1765654 - RNA, 17 nt, Homo sapiens
gaaacagacaugaaaua

SEQ ID NO: 1765655 - RNA, 11 nt, Homo sapiens
ggcuguucucc

SEQ ID NO: 1765656 - RNA, 13 nt, Homo sapiens
caucuuucacuau

SEQ ID NO: 1765657 - RNA, 23 nt, Homo sapiens
auuacugauaucagaguuauuua

SEQ ID NO: 1765658 - RNA, 15 nt, Homo sapiens
uucuaucauggaaua

SEQ ID NO: 1765659 - RNA, 21 nt, Homo sapiens
cacguuuaaucccagcacuuu

SEQ ID NO: 1765660 - RNA, 17 nt, Homo sapiens
cuaaugcucguaucucc

SEQ ID NO: 1765661 - RNA, 17 nt, Homo sapiens
ggagagggcagaggucc

SEQ ID NO: 1765662 - RNA, 14 nt, Homo sapiens
caaacaaaauggac

SEQ ID NO: 1765663 - RNA, 15 nt, Homo sapiens
cuuccuguguccuga

SEQ ID NO: 1765664 - RNA, 15 nt, Homo sapiens
uuucuaccagcucau

SEQ ID NO: 1765665 - RNA, 23 nt, Homo sapiens
agaauguucuuauguugcccagu

SEQ ID NO: 1765666 - RNA, 15 nt, Homo sapiens
cugugaaauaucauc

SEQ ID NO: 1765667 - RNA, 10 nt, Homo sapiens
aauggcaaca

SEQ ID NO: 1765668 - RNA, 15 nt, Homo sapiens
cugaugagcacaucu

SEQ ID NO: 1765669 - RNA, 15 nt, Homo sapiens
caguagagcucuacu

SEQ ID NO: 1765670 - RNA, 21 nt, Homo sapiens
gucacgcacaagggcacguga

SEQ ID NO: 1765671 - RNA, 21 nt, Homo sapiens
uuuaaaguauguuauugcaua

SEQ ID NO: 1765672 - RNA, 22 nt, Homo sapiens
aggagccuugauaauacuugac

SEQ ID NO: 1765673 - RNA, 19 nt, Homo sapiens
aaaaagagaauauacauga

SEQ ID NO: 1765674 - RNA, 13 nt, Homo sapiens
gacaaauguuucu

SEQ ID NO: 1765675 - RNA, 13 nt, Homo sapiens
aagaagggcugca

SEQ ID NO: 1765676 - RNA, 17 nt, Homo sapiens
acacguaccucucauca

SEQ ID NO: 1765677 - RNA, 21 nt, Homo sapiens
cuguucucuuguauagcugaa

SEQ ID NO: 1765678 - RNA, 22 nt, Homo sapiens
gacacauuuagaugcacuacca

SEQ ID NO: 1765679 - RNA, 23 nt, Homo sapiens
ucauuguuguguauaauuuaccu

SEQ ID NO: 1765680 - RNA, 21 nt, Homo sapiens
cagugaauuaaauuuucacua

SEQ ID NO: 1765681 - RNA, 18 nt, Homo sapiens
acuacaaggaaaacaaug

SEQ ID NO: 1765682 - RNA, 23 nt, Homo sapiens
cuuauaaguaaagacagcuuuaa

SEQ ID NO: 1765683 - RNA, 17 nt, Homo sapiens
cgcacugggcacaggcc

SEQ ID NO: 1765684 - RNA, 12 nt, Homo sapiens
augugucagcca

SEQ ID NO: 1765685 - RNA, 23 nt, Homo sapiens
ucacucuggcuucaaaaagccac

SEQ ID NO: 1765686 - RNA, 20 nt, Homo sapiens
uucacgaaguguugcaugga

SEQ ID NO: 1765687 - RNA, 19 nt, Homo sapiens
gaacugagaccuccagaaa

SEQ ID NO: 1765688 - RNA, 15 nt, Homo sapiens
cauuugccuaauucc

SEQ ID NO: 1765689 - RNA, 18 nt, Homo sapiens
aacgacagucccaguucc

SEQ ID NO: 1765690 - RNA, 22 nt, Homo sapiens
ccuuugguaccuuaauuugacu

SEQ ID NO: 1765691 - RNA, 22 nt, Homo sapiens
aauaacuaagcaaguauauuua

SEQ ID NO: 1765692 - RNA, 13 nt, Homo sapiens
uaaguuugcacuc

SEQ ID NO: 1765693 - RNA, 23 nt, Homo sapiens
auacacauauauacccacaugua

SEQ ID NO: 1765694 - RNA, 22 nt, Homo sapiens
acuacaccacacacaacagcca

SEQ ID NO: 1765695 - RNA, 21 nt, Homo sapiens
cuaaaaguuacuuaccacaga

SEQ ID NO: 1765696 - RNA, 14 nt, Homo sapiens
ugagacuccaccuc

SEQ ID NO: 1765697 - RNA, 13 nt, Homo sapiens
uaacaagauuugu

SEQ ID NO: 1765698 - RNA, 18 nt, Homo sapiens
augacuucccugcuccaa

SEQ ID NO: 1765699 - RNA, 16 nt, Homo sapiens
aucagccccugggaac

SEQ ID NO: 1765700 - RNA, 15 nt, Homo sapiens
acuauguugcccagg

SEQ ID NO: 1765701 - RNA, 15 nt, Homo sapiens
auuggaccuguucaa

SEQ ID NO: 1765702 - RNA, 22 nt, Homo sapiens
auguguaguuauaaaccaauga

SEQ ID NO: 1765703 - RNA, 21 nt, Homo sapiens
gcucagacaccugugugcugu

SEQ ID NO: 1765704 - RNA, 15 nt, Homo sapiens
gcagcccgaagccca

SEQ ID NO: 1765705 - RNA, 21 nt, Homo sapiens
cacuacugggugucauuucau

SEQ ID NO: 1765706 - RNA, 14 nt, Homo sapiens
caucaaagcacugu

SEQ ID NO: 1765707 - RNA, 18 nt, Homo sapiens
auauuuaauucaccucag

SEQ ID NO: 1765708 - RNA, 20 nt, Homo sapiens
gccuccccagcaccuaggug

SEQ ID NO: 1765709 - RNA, 21 nt, Homo sapiens
aaaaguuaggccucucagagu

SEQ ID NO: 1765710 - RNA, 15 nt, Homo sapiens
aggguacauacgcua

SEQ ID NO: 1765711 - RNA, 21 nt, Homo sapiens
ccuuccugcuguccuucuccg

SEQ ID NO: 1765712 - RNA, 19 nt, Homo sapiens
cagaacuucagcauuguaa

SEQ ID NO: 1765713 - RNA, 20 nt, Homo sapiens
cugauccugacacauucuga

SEQ ID NO: 1765714 - RNA, 16 nt, Homo sapiens
gccauaccaggugcua

SEQ ID NO: 1765715 - RNA, 15 nt, Homo sapiens
cauuuauguguagaa

SEQ ID NO: 1765716 - RNA, 17 nt, Homo sapiens
gcccaucaagugcaguc

SEQ ID NO: 1765717 - RNA, 12 nt, Homo sapiens
cacccacugacc

SEQ ID NO: 1765718 - RNA, 17 nt, Homo sapiens
uuggccugugagccauu

SEQ ID NO: 1765719 - RNA, 19 nt, Homo sapiens
guuuaaaaauccccaaaaa

SEQ ID NO: 1765720 - RNA, 14 nt, Homo sapiens
aggauaacuuccuu

SEQ ID NO: 1765721 - RNA, 22 nt, Homo sapiens
cccagauuacuccuuccuucca

SEQ ID NO: 1765722 - RNA, 20 nt, Homo sapiens
ggaacuuugaagaguacaaa

SEQ ID NO: 1765723 - RNA, 19 nt, Homo sapiens
aucuuguuagauuuuuaac

SEQ ID NO: 1765724 - RNA, 17 nt, Homo sapiens
ugaugguggacuaagca

SEQ ID NO: 1765725 - RNA, 21 nt, Homo sapiens
auuuaaaaaacuaacacccag

SEQ ID NO: 1765726 - RNA, 21 nt, Homo sapiens
ccauguacauaauucuugcua

SEQ ID NO: 1765727 - RNA, 15 nt, Homo sapiens
cauaagucuuuggua

SEQ ID NO: 1765728 - RNA, 14 nt, Homo sapiens
uacuagcauuuucc

SEQ ID NO: 1765729 - RNA, 21 nt, Homo sapiens
caggaaaggacggcugagcau

SEQ ID NO: 1765730 - RNA, 20 nt, Homo sapiens
ugaauaugcugcucaucccc

SEQ ID NO: 1765731 - RNA, 11 nt, Homo sapiens
caccaugcaag

SEQ ID NO: 1765732 - RNA, 16 nt, Homo sapiens
aacuauaaaacuaggu

SEQ ID NO: 1765733 - RNA, 23 nt, Homo sapiens
ccagcuccacaguguugccagag

SEQ ID NO: 1765734 - RNA, 14 nt, Homo sapiens
aaugggcaaaacug

SEQ ID NO: 1765735 - RNA, 10 nt, Homo sapiens
gcaugcacag

SEQ ID NO: 1765736 - RNA, 14 nt, Homo sapiens
cagaagacaaaaag

SEQ ID NO: 1765737 - RNA, 14 nt, Homo sapiens
cuaaagacaugaag

SEQ ID NO: 1765738 - RNA, 14 nt, Homo sapiens
cagaaaacaaaaaa

SEQ ID NO: 1765739 - RNA, 19 nt, Homo sapiens
ugauuggacauuuucuuca

SEQ ID NO: 1765740 - RNA, 20 nt, Homo sapiens
gugucuggcacuugggacaa

SEQ ID NO: 1765741 - RNA, 23 nt, Homo sapiens
cauaaugugaauaugccagugac

SEQ ID NO: 1765742 - RNA, 20 nt, Homo sapiens
gccacuaccuucugaccucc

SEQ ID NO: 1765743 - RNA, 23 nt, Homo sapiens
acacaccgauguacacacacaga

SEQ ID NO: 1765744 - RNA, 14 nt, Homo sapiens
ccaucaaaugcugu

SEQ ID NO: 1765745 - RNA, 14 nt, Homo sapiens
ugaagaccaugccu

SEQ ID NO: 1765746 - RNA, 18 nt, Homo sapiens
auuuugggaagaaaaccu

SEQ ID NO: 1765747 - RNA, 17 nt, Homo sapiens
aauuuguagacauacuu

SEQ ID NO: 1765748 - RNA, 15 nt, Homo sapiens
gcucuuuaccaagga

SEQ ID NO: 1765749 - RNA, 23 nt, Homo sapiens
gagggucugaaaagggcaucuca

SEQ ID NO: 1765750 - RNA, 11 nt, Homo sapiens
ggaugugauga

SEQ ID NO: 1765751 - RNA, 15 nt, Homo sapiens
caaaacuaauuuccu

SEQ ID NO: 1765752 - RNA, 15 nt, Homo sapiens
auaaaaaacauucaa

SEQ ID NO: 1765753 - RNA, 18 nt, Homo sapiens
uuauaauaaacuguuuaa

SEQ ID NO: 1765754 - RNA, 19 nt, Homo sapiens
uaauucaagaaaacaacuu

SEQ ID NO: 1765755 - RNA, 15 nt, Homo sapiens
agcugccaugucaga

SEQ ID NO: 1765756 - RNA, 16 nt, Homo sapiens
agauuuucuuuugccu

SEQ ID NO: 1765757 - RNA, 19 nt, Homo sapiens
gaagagacucucuuaggga

SEQ ID NO: 1765758 - RNA, 18 nt, Homo sapiens
uaggucacauuacauuaa

SEQ ID NO: 1765759 - RNA, 15 nt, Homo sapiens
gaacacauuugccca

SEQ ID NO: 1765760 - RNA, 13 nt, Homo sapiens
aauagucaauuuc

SEQ ID NO: 1765761 - RNA, 13 nt, Homo sapiens
cagacucacugug

SEQ ID NO: 1765762 - RNA, 20 nt, Homo sapiens
auuguuaggagaugucauca

SEQ ID NO: 1765763 - RNA, 19 nt, Homo sapiens
ugcagggugaaguguacag

SEQ ID NO: 1765764 - RNA, 15 nt, Homo sapiens
acacacacacuuuug

SEQ ID NO: 1765765 - RNA, 21 nt, Homo sapiens
cucaaguugaaggacauucua

SEQ ID NO: 1765766 - RNA, 12 nt, Homo sapiens
cuuugcaaagac

SEQ ID NO: 1765767 - RNA, 22 nt, Homo sapiens
uaaguggcuuuuuaacaugaaa

SEQ ID NO: 1765768 - RNA, 15 nt, Homo sapiens
uuaugaauugucuaa

SEQ ID NO: 1765769 - RNA, 13 nt, Homo sapiens
auuuccuugccuu

SEQ ID NO: 1765770 - RNA, 23 nt, Homo sapiens
cagauugaaaagaccuacagacu

SEQ ID NO: 1765771 - RNA, 17 nt, Homo sapiens
gggaccacagaggcugu

SEQ ID NO: 1765772 - RNA, 22 nt, Homo sapiens
agcgaccgcccccuccucuagc

SEQ ID NO: 1765773 - RNA, 17 nt, Homo sapiens
ccauuuuggaaccuaau

SEQ ID NO: 1765774 - RNA, 23 nt, Homo sapiens
agacugcagccccggcugacacc

SEQ ID NO: 1765775 - RNA, 17 nt, Homo sapiens
cuggaggugggagacaa

SEQ ID NO: 1765776 - RNA, 15 nt, Homo sapiens
caguuaauucuugcc

SEQ ID NO: 1765777 - RNA, 16 nt, Homo sapiens
cauuucucauguugaa

SEQ ID NO: 1765778 - RNA, 21 nt, Homo sapiens
gcaaucaaaaauauguguuuu

SEQ ID NO: 1765779 - RNA, 20 nt, Homo sapiens
agccuuuggauggcuaugga

SEQ ID NO: 1765780 - RNA, 17 nt, Homo sapiens
auuuaaguucaagagaa

SEQ ID NO: 1765781 - RNA, 22 nt, Homo sapiens
gcaguguuccuugugcccgugg

SEQ ID NO: 1765782 - RNA, 14 nt, Homo sapiens
uuuauacacuguaa

SEQ ID NO: 1765783 - RNA, 20 nt, Homo sapiens
aagucacauaaaaugcggca

SEQ ID NO: 1765784 - RNA, 22 nt, Homo sapiens
ccacaccagccucccaaaauac

SEQ ID NO: 1765785 - RNA, 15 nt, Homo sapiens
agaaccccguggggu

SEQ ID NO: 1765786 - RNA, 13 nt, Homo sapiens
uuaagaauuucaa

SEQ ID NO: 1765787 - RNA, 15 nt, Homo sapiens
ucucauugaggacaa

SEQ ID NO: 1765788 - RNA, 11 nt, Homo sapiens
gcccauugcac

SEQ ID NO: 1765789 - RNA, 18 nt, Homo sapiens
uuucauaaagucuugccu

SEQ ID NO: 1765790 - RNA, 22 nt, Homo sapiens
augggugcuuaguaaguacuua

SEQ ID NO: 1765791 - RNA, 22 nt, Homo sapiens
gauggcucccugggcuggcaug

SEQ ID NO: 1765792 - RNA, 21 nt, Homo sapiens
cugcaguauggccaugggcug

SEQ ID NO: 1765793 - RNA, 18 nt, Homo sapiens
gcccuccacgucagugcc

SEQ ID NO: 1765794 - RNA, 19 nt, Homo sapiens
caccauuccucagguauaa

SEQ ID NO: 1765795 - RNA, 24 nt, Homo sapiens
cauaaugugcaaagucaucaaaga

SEQ ID NO: 1765796 - RNA, 21 nt, Homo sapiens
aggauaggaguucacuucauc

SEQ ID NO: 1765797 - RNA, 14 nt, Homo sapiens
gaaagucacccaaa

SEQ ID NO: 1765798 - RNA, 16 nt, Homo sapiens
gugauuccugcugccu

SEQ ID NO: 1765799 - RNA, 16 nt, Homo sapiens
uagauuguuuugccac

SEQ ID NO: 1765800 - RNA, 16 nt, Homo sapiens
aguaagacccagcauu

SEQ ID NO: 1765801 - RNA, 19 nt, Homo sapiens
gugcaguagagagccuuuc

SEQ ID NO: 1765802 - RNA, 20 nt, Homo sapiens
aaagguuucguugcauggua

SEQ ID NO: 1765803 - RNA, 14 nt, Homo sapiens
uaucacaaggccag

SEQ ID NO: 1765804 - RNA, 19 nt, Homo sapiens
gaucugaggguauaaagac

SEQ ID NO: 1765805 - RNA, 16 nt, Homo sapiens
gauugcugaauggagu

SEQ ID NO: 1765806 - RNA, 12 nt, Homo sapiens
uccucacaauga

SEQ ID NO: 1765807 - RNA, 20 nt, Homo sapiens
agccaugaucgagccacugc

SEQ ID NO: 1765808 - RNA, 19 nt, Homo sapiens
gggcacugucuguguccuu

SEQ ID NO: 1765809 - RNA, 18 nt, Homo sapiens
cgccaggacuuggccuca

SEQ ID NO: 1765810 - RNA, 23 nt, Homo sapiens
agcugggauuacaggcuccugcc

SEQ ID NO: 1765811 - RNA, 17 nt, Homo sapiens
uacucacugaguaacag

SEQ ID NO: 1765812 - RNA, 15 nt, Homo sapiens
aaggagcugccugga

SEQ ID NO: 1765813 - RNA, 20 nt, Homo sapiens
gcaaaaucuggaucuuggga

SEQ ID NO: 1765814 - RNA, 15 nt, Homo sapiens
ugcacguaacacucc

SEQ ID NO: 1765815 - RNA, 17 nt, Homo sapiens
uguaagauuuagcaccc

SEQ ID NO: 1765816 - RNA, 17 nt, Homo sapiens
cuuccacaccuagcauc

SEQ ID NO: 1765817 - RNA, 24 nt, Homo sapiens
agcaauuuaauauuuugcacaguu

SEQ ID NO: 1765818 - RNA, 15 nt, Homo sapiens
cuccaagaauuucua

SEQ ID NO: 1765819 - RNA, 21 nt, Homo sapiens
ucuccuacuguagcaaccuga

SEQ ID NO: 1765820 - RNA, 23 nt, Homo sapiens
gccuaauaguaacugguuaaaaa

SEQ ID NO: 1765821 - RNA, 13 nt, Homo sapiens
caaagacuguauu

SEQ ID NO: 1765822 - RNA, 16 nt, Homo sapiens
cccccuccuuuuccca

SEQ ID NO: 1765823 - RNA, 11 nt, Homo sapiens
cagugcaguuu

SEQ ID NO: 1765824 - RNA, 13 nt, Homo sapiens
aaaguacuuuaau

SEQ ID NO: 1765825 - RNA, 13 nt, Homo sapiens
auuaaacuuauga

SEQ ID NO: 1765826 - RNA, 21 nt, Homo sapiens
caucccacucacaacagcugc

SEQ ID NO: 1765827 - RNA, 13 nt, Homo sapiens
cagauucuuucag

SEQ ID NO: 1765828 - RNA, 13 nt, Homo sapiens
auauauaaucauc

SEQ ID NO: 1765829 - RNA, 14 nt, Homo sapiens
ggagacgggacccu

SEQ ID NO: 1765830 - RNA, 12 nt, Homo sapiens
aauugcaauaca

SEQ ID NO: 1765831 - RNA, 19 nt, Homo sapiens
cugagccauuugcugcauu

SEQ ID NO: 1765832 - RNA, 21 nt, Homo sapiens
gcaaauuggcuaaagugcauu

SEQ ID NO: 1765833 - RNA, 16 nt, Homo sapiens
aaccguaucucuaaua

SEQ ID NO: 1765834 - RNA, 19 nt, Homo sapiens
auaugcaagugcaaaagaa

SEQ ID NO: 1765835 - RNA, 16 nt, Homo sapiens
aaaccuugcagcauuu

SEQ ID NO: 1765836 - RNA, 22 nt, Homo sapiens
cagggcaaaugacaugcacuga

SEQ ID NO: 1765837 - RNA, 17 nt, Homo sapiens
aauaauucauauucuuc

SEQ ID NO: 1765838 - RNA, 19 nt, Homo sapiens
ccuaaccuaggagggcucu

SEQ ID NO: 1765839 - RNA, 15 nt, Homo sapiens
acauuuucucuuuaa

SEQ ID NO: 1765840 - RNA, 19 nt, Homo sapiens
gcgccuggaggacgggaca

SEQ ID NO: 1765841 - RNA, 19 nt, Homo sapiens
cacgaugguggaaacagug

SEQ ID NO: 1765842 - RNA, 16 nt, Homo sapiens
cacgaauauugcugau

SEQ ID NO: 1765843 - RNA, 19 nt, Homo sapiens
gaucuacacccaccagagu

SEQ ID NO: 1765844 - RNA, 22 nt, Homo sapiens
guucaagagauucuccugccuc

SEQ ID NO: 1765845 - RNA, 16 nt, Homo sapiens
ucacaugauaccccuu

SEQ ID NO: 1765846 - RNA, 21 nt, Homo sapiens
agaacuauugugcucagagac

SEQ ID NO: 1765847 - RNA, 23 nt, Homo sapiens
gugagaacagcauuuagugaagu

SEQ ID NO: 1765848 - RNA, 14 nt, Homo sapiens
ccuugucugcugcu

SEQ ID NO: 1765849 - RNA, 22 nt, Homo sapiens
cgaugagauaauaugagauuuc

SEQ ID NO: 1765850 - RNA, 18 nt, Homo sapiens
agauggauagucugucca

SEQ ID NO: 1765851 - RNA, 17 nt, Homo sapiens
gcgccacuaagccaaga

SEQ ID NO: 1765852 - RNA, 12 nt, Homo sapiens
auuuacugagag

SEQ ID NO: 1765853 - RNA, 20 nt, Homo sapiens
ucaaaaacaaccugaaagag

SEQ ID NO: 1765854 - RNA, 18 nt, Homo sapiens
cuauuuccaaaagcacau

SEQ ID NO: 1765855 - RNA, 18 nt, Homo sapiens
uacuuucccacagcacua

SEQ ID NO: 1765856 - RNA, 14 nt, Homo sapiens
cagaaucuuuucaa

SEQ ID NO: 1765857 - RNA, 20 nt, Homo sapiens
ucuuccuuacccugcgauuu

SEQ ID NO: 1765858 - RNA, 17 nt, Homo sapiens
agugaaaacaucugcac

SEQ ID NO: 1765859 - RNA, 19 nt, Homo sapiens
gucuguguucucaacacac

SEQ ID NO: 1765860 - RNA, 19 nt, Homo sapiens
cuagcaacauuuguuuuag

SEQ ID NO: 1765861 - RNA, 20 nt, Homo sapiens
ucuggauauggugcaaaaau

SEQ ID NO: 1765862 - RNA, 18 nt, Homo sapiens
ucaagggugugugcagca

SEQ ID NO: 1765863 - RNA, 12 nt, Homo sapiens
ucaaaugggcug

SEQ ID NO: 1765864 - RNA, 22 nt, Homo sapiens
caccauuuaauuucauguauau

SEQ ID NO: 1765865 - RNA, 17 nt, Homo sapiens
gaccccuggccggccca

SEQ ID NO: 1765866 - RNA, 18 nt, Homo sapiens
uccacuuguucauucugu

SEQ ID NO: 1765867 - RNA, 14 nt, Homo sapiens
acaggugcugagua

SEQ ID NO: 1765868 - RNA, 13 nt, Homo sapiens
aucugggugcaug

SEQ ID NO: 1765869 - RNA, 17 nt, Homo sapiens
cccaaccuagaccugua

SEQ ID NO: 1765870 - RNA, 14 nt, Homo sapiens
gaauacucuugguc

SEQ ID NO: 1765871 - RNA, 14 nt, Homo sapiens
uagcauugaaaaau

SEQ ID NO: 1765872 - RNA, 19 nt, Homo sapiens
caauuaagugcuuuaccua

SEQ ID NO: 1765873 - RNA, 20 nt, Homo sapiens
uguccuucccacggccacug

SEQ ID NO: 1765874 - RNA, 22 nt, Homo sapiens
cccuggccccacaagccaggac

SEQ ID NO: 1765875 - RNA, 13 nt, Homo sapiens
gccagaauacugg

SEQ ID NO: 1765876 - RNA, 12 nt, Homo sapiens
caagcuauucaa

SEQ ID NO: 1765877 - RNA, 15 nt, Homo sapiens
agaugcugggccagu

SEQ ID NO: 1765878 - RNA, 15 nt, Homo sapiens
aggagucacugagac

SEQ ID NO: 1765879 - RNA, 23 nt, Homo sapiens
ucagcccccagccccucccccau

SEQ ID NO: 1765880 - RNA, 12 nt, Homo sapiens
aagugucuuugu

SEQ ID NO: 1765881 - RNA, 14 nt, Homo sapiens
cucccagcuccuuu

SEQ ID NO: 1765882 - RNA, 13 nt, Homo sapiens
aguaccuugacuu

SEQ ID NO: 1765883 - RNA, 23 nt, Homo sapiens
cuagagauauggcagcgaaagga

SEQ ID NO: 1765884 - RNA, 23 nt, Homo sapiens
cagugcuaaaauucagaugcugu

SEQ ID NO: 1765885 - RNA, 16 nt, Homo sapiens
cugacuaauuaggcaa

SEQ ID NO: 1765886 - RNA, 20 nt, Homo sapiens
aggccucacuggcucaugcc

SEQ ID NO: 1765887 - RNA, 15 nt, Homo sapiens
cagaaggggguggug

SEQ ID NO: 1765888 - RNA, 18 nt, Homo sapiens
gcuaaaggaagugaaucu

SEQ ID NO: 1765889 - RNA, 22 nt, Homo sapiens
aguuaucuguuuccuguucucu

SEQ ID NO: 1765890 - RNA, 22 nt, Homo sapiens
auguaccuccccugccuugcug

SEQ ID NO: 1765891 - RNA, 22 nt, Homo sapiens
cuaaaucuccaaaaacagugau

SEQ ID NO: 1765892 - RNA, 15 nt, Homo sapiens
aauacagacaucuaa

SEQ ID NO: 1765893 - RNA, 22 nt, Homo sapiens
cugggccccuccccucagagcc

SEQ ID NO: 1765894 - RNA, 14 nt, Homo sapiens
uguaguuacaguaa

SEQ ID NO: 1765895 - RNA, 19 nt, Homo sapiens
ugcuguugauuccacugaa

SEQ ID NO: 1765896 - RNA, 14 nt, Homo sapiens
acccucggaaauca

SEQ ID NO: 1765897 - RNA, 18 nt, Homo sapiens
aggucucuaacauaccuu

SEQ ID NO: 1765898 - RNA, 23 nt, Homo sapiens
uugaagauggauguuugucaaaa

SEQ ID NO: 1765899 - RNA, 20 nt, Homo sapiens
gagaaggaaaaggcuggcaa

SEQ ID NO: 1765900 - RNA, 16 nt, Homo sapiens
aggcagggucucacuc

SEQ ID NO: 1765901 - RNA, 16 nt, Homo sapiens
ccuucaucugggacaa

SEQ ID NO: 1765902 - RNA, 20 nt, Homo sapiens
uugcaaauuauucuagucaa

SEQ ID NO: 1765903 - RNA, 17 nt, Homo sapiens
gaauggccuuucaccuu

SEQ ID NO: 1765904 - RNA, 13 nt, Homo sapiens
gacagagucucac

SEQ ID NO: 1765905 - RNA, 14 nt, Homo sapiens
acucugaguccacu

SEQ ID NO: 1765906 - RNA, 19 nt, Homo sapiens
ccuagggguccacgggaag

SEQ ID NO: 1765907 - RNA, 16 nt, Homo sapiens
gauaaaucaugggcau

SEQ ID NO: 1765908 - RNA, 15 nt, Homo sapiens
ccccacccuugagaa

SEQ ID NO: 1765909 - RNA, 13 nt, Homo sapiens
auaauugacaaac

SEQ ID NO: 1765910 - RNA, 12 nt, Homo sapiens
cauauccaaaau

SEQ ID NO: 1765911 - RNA, 23 nt, Homo sapiens
gagcacauacuaccuagaaguaa

SEQ ID NO: 1765912 - RNA, 21 nt, Homo sapiens
aaugauggaaccaaaaaucac

SEQ ID NO: 1765913 - RNA, 13 nt, Homo sapiens
uugaaguggagcc

SEQ ID NO: 1765914 - RNA, 23 nt, Homo sapiens
ggagugguggcucaugccuguaa

SEQ ID NO: 1765915 - RNA, 12 nt, Homo sapiens
cucggggacaaa

SEQ ID NO: 1765916 - RNA, 11 nt, Homo sapiens
cucugaaguca

SEQ ID NO: 1765917 - RNA, 13 nt, Homo sapiens
auuuuccauuaaa

SEQ ID NO: 1765918 - RNA, 12 nt, Homo sapiens
agagaaacugug

SEQ ID NO: 1765919 - RNA, 15 nt, Homo sapiens
aaaauuucaccugca

SEQ ID NO: 1765920 - RNA, 15 nt, Homo sapiens
acccuuccucaccac

SEQ ID NO: 1765921 - RNA, 20 nt, Homo sapiens
cccagccuguggugcuugaa

SEQ ID NO: 1765922 - RNA, 16 nt, Homo sapiens
cuuuccaaaaccuucc

SEQ ID NO: 1765923 - RNA, 23 nt, Homo sapiens
ccccuguggucacuuauccugac

SEQ ID NO: 1765924 - RNA, 21 nt, Homo sapiens
ugguggacgcuggccugggau

SEQ ID NO: 1765925 - RNA, 18 nt, Homo sapiens
gcucugcaguccuacuca

SEQ ID NO: 1765926 - RNA, 22 nt, Homo sapiens
acacucgugugcaugagaaugu

SEQ ID NO: 1765927 - RNA, 17 nt, Homo sapiens
cccuucauugauuuccu

SEQ ID NO: 1765928 - RNA, 20 nt, Homo sapiens
aagucagagacagauaccuc

SEQ ID NO: 1765929 - RNA, 23 nt, Homo sapiens
cguauacauaggcaucauuucac

SEQ ID NO: 1765930 - RNA, 14 nt, Homo sapiens
accgacuagccagg

SEQ ID NO: 1765931 - RNA, 17 nt, Homo sapiens
ucagcuucuuaauauaa

SEQ ID NO: 1765932 - RNA, 15 nt, Homo sapiens
gaaaaucugaacucu

SEQ ID NO: 1765933 - RNA, 18 nt, Homo sapiens
ggcggccugcaguggugu

SEQ ID NO: 1765934 - RNA, 11 nt, Homo sapiens
ggcauugcaca

SEQ ID NO: 1765935 - RNA, 22 nt, Homo sapiens
ucaguucugaaguuauaaacuu

SEQ ID NO: 1765936 - RNA, 14 nt, Homo sapiens
uuguuuggugaauu

SEQ ID NO: 1765937 - RNA, 12 nt, Homo sapiens
augugugugagu

SEQ ID NO: 1765938 - RNA, 19 nt, Homo sapiens
accuccaggcuuucccacu

SEQ ID NO: 1765939 - RNA, 20 nt, Homo sapiens
auaagguuggguuagcaaua

SEQ ID NO: 1765940 - RNA, 18 nt, Homo sapiens
cugaaaauguccuuguga

SEQ ID NO: 1765941 - RNA, 24 nt, Homo sapiens
gggaguccaggguggaugaucuca

SEQ ID NO: 1765942 - RNA, 19 nt, Homo sapiens
acaaaggcugaacuggauu

SEQ ID NO: 1765943 - RNA, 18 nt, Homo sapiens
cugccuuuuuuaacacua

SEQ ID NO: 1765944 - RNA, 17 nt, Homo sapiens
agaguggagagugacau

SEQ ID NO: 1765945 - RNA, 22 nt, Homo sapiens
augccugauuuuaaaagguuga

SEQ ID NO: 1765946 - RNA, 14 nt, Homo sapiens
ugaguucuggugag

SEQ ID NO: 1765947 - RNA, 22 nt, Homo sapiens
guuuccucgcugaucgauuucu

SEQ ID NO: 1765948 - RNA, 16 nt, Homo sapiens
ccuuuauuccuuucag

SEQ ID NO: 1765949 - RNA, 22 nt, Homo sapiens
agcuugcacagccaacgagaca

SEQ ID NO: 1765950 - RNA, 19 nt, Homo sapiens
caaacuguguaacugccca

SEQ ID NO: 1765951 - RNA, 23 nt, Homo sapiens
caggcugucccaagcucccaaga

SEQ ID NO: 1765952 - RNA, 23 nt, Homo sapiens
ucugcuguauacuguacugagac

SEQ ID NO: 1765953 - RNA, 14 nt, Homo sapiens
gacccccagcacuu

SEQ ID NO: 1765954 - RNA, 20 nt, Homo sapiens
ucaggcccaggaguccaggc

SEQ ID NO: 1765955 - RNA, 15 nt, Homo sapiens
gaauguaauuggaau

SEQ ID NO: 1765956 - RNA, 21 nt, Homo sapiens
uaaaauugauuuuucucuuca

SEQ ID NO: 1765957 - RNA, 21 nt, Homo sapiens
uugugccaaauuauucuccua

SEQ ID NO: 1765958 - RNA, 13 nt, Homo sapiens
aacacucucacua

SEQ ID NO: 1765959 - RNA, 13 nt, Homo sapiens
cuucugggcccua

SEQ ID NO: 1765960 - RNA, 18 nt, Homo sapiens
cuaagcaguugcaaugau

SEQ ID NO: 1765961 - RNA, 14 nt, Homo sapiens
cagcccuauuucag

SEQ ID NO: 1765962 - RNA, 21 nt, Homo sapiens
ccgagcaacccucugaagaag

SEQ ID NO: 1765963 - RNA, 14 nt, Homo sapiens
uccaagaccagaga

SEQ ID NO: 1765964 - RNA, 15 nt, Homo sapiens
gaguuucuauggauu

SEQ ID NO: 1765965 - RNA, 21 nt, Homo sapiens
aagaugcuaauagaaaacugu

SEQ ID NO: 1765966 - RNA, 21 nt, Homo sapiens
acuggaauaagaagcaaauaa

SEQ ID NO: 1765967 - RNA, 17 nt, Homo sapiens
acuuuuggccccagcgc

SEQ ID NO: 1765968 - RNA, 15 nt, Homo sapiens
uuucaaucaacuuua

SEQ ID NO: 1765969 - RNA, 23 nt, Homo sapiens
ccaauuugguaaaaaugcugcuc

SEQ ID NO: 1765970 - RNA, 17 nt, Homo sapiens
cuaacaggagaaugcac

SEQ ID NO: 1765971 - RNA, 20 nt, Homo sapiens
uccuguuuguugagugcacu

SEQ ID NO: 1765972 - RNA, 20 nt, Homo sapiens
cccaacaagaacugcaucug

SEQ ID NO: 1765973 - RNA, 20 nt, Homo sapiens
uacagcagcacgcauguccc

SEQ ID NO: 1765974 - RNA, 15 nt, Homo sapiens
ccuaugcagaggucc

SEQ ID NO: 1765975 - RNA, 22 nt, Homo sapiens
cauacaucuaagucaguuucac

SEQ ID NO: 1765976 - RNA, 17 nt, Homo sapiens
uucaggaauacuuggac

SEQ ID NO: 1765977 - RNA, 15 nt, Homo sapiens
aagucagaaagugca

SEQ ID NO: 1765978 - RNA, 15 nt, Homo sapiens
gaagcagcacuguga

SEQ ID NO: 1765979 - RNA, 18 nt, Homo sapiens
ucuuuccuuuugcaacaa

SEQ ID NO: 1765980 - RNA, 18 nt, Homo sapiens
ccugcacguugugcacau

SEQ ID NO: 1765981 - RNA, 13 nt, Homo sapiens
uaugggaacaauu

SEQ ID NO: 1765982 - RNA, 20 nt, Homo sapiens
uacagcuaucgaacuucaca

SEQ ID NO: 1765983 - RNA, 18 nt, Homo sapiens
uguccuguggcaugcaaa

SEQ ID NO: 1765984 - RNA, 23 nt, Homo sapiens
gacuuugaaacuaucucaugcca

SEQ ID NO: 1765985 - RNA, 19 nt, Homo sapiens
uaaugagaauuccuuagca

SEQ ID NO: 1765986 - RNA, 13 nt, Homo sapiens
accaaaaacuggg

SEQ ID NO: 1765987 - RNA, 20 nt, Homo sapiens
cugaggacccgugugacucg

SEQ ID NO: 1765988 - RNA, 14 nt, Homo sapiens
cuguuuacuuuagg

SEQ ID NO: 1765989 - RNA, 18 nt, Homo sapiens
cucaaggucaucaaacau

SEQ ID NO: 1765990 - RNA, 13 nt, Homo sapiens
gaacucauuugaa

SEQ ID NO: 1765991 - RNA, 13 nt, Homo sapiens
gaaaacauuugcu

SEQ ID NO: 1765992 - RNA, 18 nt, Homo sapiens
aaaauacaacacugagcc

SEQ ID NO: 1765993 - RNA, 15 nt, Homo sapiens
aaccuaauaaucuga

SEQ ID NO: 1765994 - RNA, 23 nt, Homo sapiens
augaaccacccagaguggcccaa

SEQ ID NO: 1765995 - RNA, 21 nt, Homo sapiens
cauauguagccuucacacaga

SEQ ID NO: 1765996 - RNA, 14 nt, Homo sapiens
caaauacacauuuc

SEQ ID NO: 1765997 - RNA, 12 nt, Homo sapiens
ucacuacuggug

SEQ ID NO: 1765998 - RNA, 19 nt, Homo sapiens
aucccaugggggugcugca

SEQ ID NO: 1765999 - RNA, 19 nt, Homo sapiens
ggauaauaacuagaucucc

SEQ ID NO: 1766000 - RNA, 19 nt, Homo sapiens
ugaccaauugugcugccau

SEQ ID NO: 1766001 - RNA, 16 nt, Homo sapiens
agcaucucugccucca

SEQ ID NO: 1766002 - RNA, 13 nt, Homo sapiens
cacaauaaccaag

SEQ ID NO: 1766003 - RNA, 14 nt, Homo sapiens
aaugucuucacucu

SEQ ID NO: 1766004 - RNA, 20 nt, Homo sapiens
augugacgacugcaaagcca

SEQ ID NO: 1766005 - RNA, 15 nt, Homo sapiens
aaagagauuguucua

SEQ ID NO: 1766006 - RNA, 17 nt, Homo sapiens
acaccucacucugcuac

SEQ ID NO: 1766007 - RNA, 18 nt, Homo sapiens
agcacaauaaauauacuu

SEQ ID NO: 1766008 - RNA, 14 nt, Homo sapiens
aagaguuaaacuua

SEQ ID NO: 1766009 - RNA, 14 nt, Homo sapiens
aucauuuaauguga

SEQ ID NO: 1766010 - RNA, 17 nt, Homo sapiens
guaucagcagcucuuuu

SEQ ID NO: 1766011 - RNA, 10 nt, Homo sapiens
caaugccauc

SEQ ID NO: 1766012 - RNA, 23 nt, Homo sapiens
cuucuggagauggauccuuccau

SEQ ID NO: 1766013 - RNA, 20 nt, Homo sapiens
uagaaugcugcgcuuaccuu

SEQ ID NO: 1766014 - RNA, 19 nt, Homo sapiens
aacuugagauucaagacaa

SEQ ID NO: 1766015 - RNA, 19 nt, Homo sapiens
caccugcaugaacacagug

SEQ ID NO: 1766016 - RNA, 16 nt, Homo sapiens
uucuccuuguacuuga

SEQ ID NO: 1766017 - RNA, 23 nt, Homo sapiens
ccuguccagcagguaguggguga

SEQ ID NO: 1766018 - RNA, 14 nt, Homo sapiens
guguuauuugcaca

SEQ ID NO: 1766019 - RNA, 15 nt, Homo sapiens
auguacagacauauu

SEQ ID NO: 1766020 - RNA, 17 nt, Homo sapiens
caggagggugcauccaa

SEQ ID NO: 1766021 - RNA, 13 nt, Homo sapiens
uaaauagaugaca

SEQ ID NO: 1766022 - RNA, 15 nt, Homo sapiens
auaaaauuauuugca

SEQ ID NO: 1766023 - RNA, 14 nt, Homo sapiens
acagccaaguguga

SEQ ID NO: 1766024 - RNA, 13 nt, Homo sapiens
aauucagaguggu

SEQ ID NO: 1766025 - RNA, 16 nt, Homo sapiens
ggaauagugaauacuu

SEQ ID NO: 1766026 - RNA, 14 nt, Homo sapiens
uccucuuguuuacg

SEQ ID NO: 1766027 - RNA, 14 nt, Homo sapiens
cucaagugccuuau

SEQ ID NO: 1766028 - RNA, 19 nt, Homo sapiens
gugaucaagguuaacaaag

SEQ ID NO: 1766029 - RNA, 20 nt, Homo sapiens
uaaaacaaaccuugugcucu

SEQ ID NO: 1766030 - RNA, 15 nt, Homo sapiens
ucuucacucccaaua

SEQ ID NO: 1766031 - RNA, 17 nt, Homo sapiens
uccacuccuccuacugu

SEQ ID NO: 1766032 - RNA, 22 nt, Homo sapiens
uaucuaccaucuaaucuaugca

SEQ ID NO: 1766033 - RNA, 13 nt, Homo sapiens
cuucuuuucaaug

SEQ ID NO: 1766034 - RNA, 16 nt, Homo sapiens
uuaaaagcuguucuca

SEQ ID NO: 1766035 - RNA, 17 nt, Homo sapiens
uguguacaaacccagau

SEQ ID NO: 1766036 - RNA, 22 nt, Homo sapiens
uacgcaaccuccuuaucugcua

SEQ ID NO: 1766037 - RNA, 19 nt, Homo sapiens
acucugcucuaugccaggc

SEQ ID NO: 1766038 - RNA, 22 nt, Homo sapiens
cacauauaucaaagugagaaaa

SEQ ID NO: 1766039 - RNA, 12 nt, Homo sapiens
ucacaugcacag

SEQ ID NO: 1766040 - RNA, 15 nt, Homo sapiens
gccugcaaaccuucc

SEQ ID NO: 1766041 - RNA, 19 nt, Homo sapiens
auaaauaaucuacuguaca

SEQ ID NO: 1766042 - RNA, 20 nt, Homo sapiens
acuuuuaaugccuuccacau

SEQ ID NO: 1766043 - RNA, 23 nt, Homo sapiens
gccuucaguuuccauccccagga

SEQ ID NO: 1766044 - RNA, 23 nt, Homo sapiens
uguuucagaaaacauaauauagc

SEQ ID NO: 1766045 - RNA, 13 nt, Homo sapiens
ugcuugucaucca

SEQ ID NO: 1766046 - RNA, 12 nt, Homo sapiens
cauccuacccua

SEQ ID NO: 1766047 - RNA, 18 nt, Homo sapiens
ucccagcccccugaccac

SEQ ID NO: 1766048 - RNA, 22 nt, Homo sapiens
augaugcccagaugcucuacuu

SEQ ID NO: 1766049 - RNA, 17 nt, Homo sapiens
gaaggaagaagccagac

SEQ ID NO: 1766050 - RNA, 24 nt, Homo sapiens
aaugagcaugaacuguccuuccau

SEQ ID NO: 1766051 - RNA, 22 nt, Homo sapiens
ugcuauuuacaaaugaaguauu

SEQ ID NO: 1766052 - RNA, 15 nt, Homo sapiens
ucgggccacagggcg

SEQ ID NO: 1766053 - RNA, 17 nt, Homo sapiens
gcaugaagguuucugaa

SEQ ID NO: 1766054 - RNA, 22 nt, Homo sapiens
augaaguacagcagaagcccca

SEQ ID NO: 1766055 - RNA, 23 nt, Homo sapiens
auccuucaucacagcaugugcaa

SEQ ID NO: 1766056 - RNA, 21 nt, Homo sapiens
uaaauaagauuuaauucacau

SEQ ID NO: 1766057 - RNA, 12 nt, Homo sapiens
gcagcacaagcu

SEQ ID NO: 1766058 - RNA, 12 nt, Homo sapiens
gcaguuggucua

SEQ ID NO: 1766059 - RNA, 19 nt, Homo sapiens
ugaaauaauuaaaaaccac

SEQ ID NO: 1766060 - RNA, 16 nt, Homo sapiens
caagguauugagacau

SEQ ID NO: 1766061 - RNA, 16 nt, Homo sapiens
cuguaaucacaacuca

SEQ ID NO: 1766062 - RNA, 19 nt, Homo sapiens
uguggccacuucuguccau

SEQ ID NO: 1766063 - RNA, 15 nt, Homo sapiens
cgccauaggccaagg

SEQ ID NO: 1766064 - RNA, 12 nt, Homo sapiens
ccuggaauucac

SEQ ID NO: 1766065 - RNA, 22 nt, Homo sapiens
gaguggaguuacugaacaguaa

SEQ ID NO: 1766066 - RNA, 16 nt, Homo sapiens
cugccuucaccccacu

SEQ ID NO: 1766067 - RNA, 16 nt, Homo sapiens
ucugcucuauacugug

SEQ ID NO: 1766068 - RNA, 14 nt, Homo sapiens
ccagucucagacac

SEQ ID NO: 1766069 - RNA, 18 nt, Homo sapiens
uguauacuguacugagac

SEQ ID NO: 1766070 - RNA, 20 nt, Homo sapiens
cagcauguuucucccauuua

SEQ ID NO: 1766071 - RNA, 16 nt, Homo sapiens
ggcuguuauucuucca

SEQ ID NO: 1766072 - RNA, 19 nt, Homo sapiens
aauuauaaagauaaagcug

SEQ ID NO: 1766073 - RNA, 16 nt, Homo sapiens
gcacuggguuugcucc

SEQ ID NO: 1766074 - RNA, 16 nt, Homo sapiens
caauucauucauuugc

SEQ ID NO: 1766075 - RNA, 19 nt, Homo sapiens
aguuuuccuucuguuaaaa

SEQ ID NO: 1766076 - RNA, 21 nt, Homo sapiens
augguauaucaguaucugaga

SEQ ID NO: 1766077 - RNA, 16 nt, Homo sapiens
cuaaguuggugcuuuu

SEQ ID NO: 1766078 - RNA, 16 nt, Homo sapiens
gaggucaggaagcagg

SEQ ID NO: 1766079 - RNA, 23 nt, Homo sapiens
ucaacaagagacuggaaggacca

SEQ ID NO: 1766080 - RNA, 16 nt, Homo sapiens
agcugacaccuggauu

SEQ ID NO: 1766081 - RNA, 24 nt, Homo sapiens
uuaugucuggggcagaaacacuca

SEQ ID NO: 1766082 - RNA, 15 nt, Homo sapiens
agaauaaagucuugu

SEQ ID NO: 1766083 - RNA, 15 nt, Homo sapiens
agccaacaacucugc

SEQ ID NO: 1766084 - RNA, 17 nt, Homo sapiens
aaaauacagauuugaau

SEQ ID NO: 1766085 - RNA, 18 nt, Homo sapiens
uucccacucuagggcagu

SEQ ID NO: 1766086 - RNA, 18 nt, Homo sapiens
gcuuuagaaacagugcaa

SEQ ID NO: 1766087 - RNA, 19 nt, Homo sapiens
augcaccucaaggucauca

SEQ ID NO: 1766088 - RNA, 20 nt, Homo sapiens
gccauucucaagcccugcag

SEQ ID NO: 1766089 - RNA, 13 nt, Homo sapiens
ggaccauggagug

SEQ ID NO: 1766090 - RNA, 13 nt, Homo sapiens
gguucugugcaaa

SEQ ID NO: 1766091 - RNA, 12 nt, Homo sapiens
cuuuuccagaag

SEQ ID NO: 1766092 - RNA, 18 nt, Homo sapiens
aaguccuuagaaugaggg

SEQ ID NO: 1766093 - RNA, 18 nt, Homo sapiens
uuaacaugggcucuucac

SEQ ID NO: 1766094 - RNA, 22 nt, Homo sapiens
uuccuggggaaaagaagcaccc

SEQ ID NO: 1766095 - RNA, 14 nt, Homo sapiens
uccuguccagacac

SEQ ID NO: 1766096 - RNA, 14 nt, Homo sapiens
uggggaguaccugu

SEQ ID NO: 1766097 - RNA, 21 nt, Homo sapiens
ccaggaacccuccuccuguca

SEQ ID NO: 1766098 - RNA, 22 nt, Homo sapiens
caugcccagccccugguggugg

SEQ ID NO: 1766099 - RNA, 19 nt, Homo sapiens
gaacaucauaacccaugaa

SEQ ID NO: 1766100 - RNA, 17 nt, Homo sapiens
uuuaccuaccaccuucc

SEQ ID NO: 1766101 - RNA, 21 nt, Homo sapiens
auguccuacugagacagcaca

SEQ ID NO: 1766102 - RNA, 14 nt, Homo sapiens
uaaaugcaauaaga

SEQ ID NO: 1766103 - RNA, 13 nt, Homo sapiens
agagggcuuucag

SEQ ID NO: 1766104 - RNA, 19 nt, Homo sapiens
ggacaggcuucgucucaga

SEQ ID NO: 1766105 - RNA, 19 nt, Homo sapiens
gcccuuccuccugccuuuc

SEQ ID NO: 1766106 - RNA, 21 nt, Homo sapiens
acagagagagauacucuggga

SEQ ID NO: 1766107 - RNA, 16 nt, Homo sapiens
uugaaauuugacucau

SEQ ID NO: 1766108 - RNA, 14 nt, Homo sapiens
aagacuauggugcu

SEQ ID NO: 1766109 - RNA, 19 nt, Homo sapiens
ggagcagaguguucccuga

SEQ ID NO: 1766110 - RNA, 13 nt, Homo sapiens
cacccuuuccucu

SEQ ID NO: 1766111 - RNA, 22 nt, Homo sapiens
augagcuucaauauaagaagca

SEQ ID NO: 1766112 - RNA, 21 nt, Homo sapiens
caggugugacccacugcgcac

SEQ ID NO: 1766113 - RNA, 16 nt, Homo sapiens
aauuacaaaacucaga

SEQ ID NO: 1766114 - RNA, 17 nt, Homo sapiens
ccuucccccugcaaaaa

SEQ ID NO: 1766115 - RNA, 15 nt, Homo sapiens
acccugcgccuccag

SEQ ID NO: 1766116 - RNA, 22 nt, Homo sapiens
agcuuucagagccagugaagga

SEQ ID NO: 1766117 - RNA, 16 nt, Homo sapiens
agaugcccuuuggaaa

SEQ ID NO: 1766118 - RNA, 23 nt, Homo sapiens
ucuuaauucccaaucccauuccu

SEQ ID NO: 1766119 - RNA, 12 nt, Homo sapiens
ccaccaugacug

SEQ ID NO: 1766120 - RNA, 16 nt, Homo sapiens
ccgugcuaacugugug

SEQ ID NO: 1766121 - RNA, 20 nt, Homo sapiens
uaaauagcuuuugugucuua

SEQ ID NO: 1766122 - RNA, 19 nt, Homo sapiens
caacagcaguguucugggu

SEQ ID NO: 1766123 - RNA, 14 nt, Homo sapiens
ucucuuuaaaucaa

SEQ ID NO: 1766124 - RNA, 14 nt, Homo sapiens
aaauaauaucauuu

SEQ ID NO: 1766125 - RNA, 16 nt, Homo sapiens
uuuauuaccucugaua

SEQ ID NO: 1766126 - RNA, 14 nt, Homo sapiens
cauaauaugaugca

SEQ ID NO: 1766127 - RNA, 18 nt, Homo sapiens
guggaaaccuugcugcua

SEQ ID NO: 1766128 - RNA, 18 nt, Homo sapiens
gccucucggugaccuccg

SEQ ID NO: 1766129 - RNA, 23 nt, Homo sapiens
agaaguaguuuacuuuggacuaa

SEQ ID NO: 1766130 - RNA, 20 nt, Homo sapiens
aguucauauuucauuuccaa

SEQ ID NO: 1766131 - RNA, 23 nt, Homo sapiens
ugcaagugcuaugccaagccaug

SEQ ID NO: 1766132 - RNA, 17 nt, Homo sapiens
cugcuguguagcucugu

SEQ ID NO: 1766133 - RNA, 16 nt, Homo sapiens
uuaugugcaaguuuau

SEQ ID NO: 1766134 - RNA, 20 nt, Homo sapiens
aaauguccucuugaagcaua

SEQ ID NO: 1766135 - RNA, 20 nt, Homo sapiens
uuaaaaggucaaaacugaag

SEQ ID NO: 1766136 - RNA, 17 nt, Homo sapiens
ccucaacugacaugaaa

SEQ ID NO: 1766137 - RNA, 16 nt, Homo sapiens
agaacccaggcuucua

SEQ ID NO: 1766138 - RNA, 19 nt, Homo sapiens
gcuucugcaccuuaucuua

SEQ ID NO: 1766139 - RNA, 13 nt, Homo sapiens
cuuccaucaugga

SEQ ID NO: 1766140 - RNA, 17 nt, Homo sapiens
auaaaucuaguauacau

SEQ ID NO: 1766141 - RNA, 18 nt, Homo sapiens
gugcuugucucagucaaa

SEQ ID NO: 1766142 - RNA, 15 nt, Homo sapiens
cauuuaccaguauag

SEQ ID NO: 1766143 - RNA, 21 nt, Homo sapiens
ugcaucuguauaaguaagaaa

SEQ ID NO: 1766144 - RNA, 14 nt, Homo sapiens
aaaaggaacugcag

SEQ ID NO: 1766145 - RNA, 23 nt, Homo sapiens
ggcugacacguccaccccagugc

SEQ ID NO: 1766146 - RNA, 22 nt, Homo sapiens
caaacuuaacagaucacaugcc

SEQ ID NO: 1766147 - RNA, 16 nt, Homo sapiens
auuauacucaaaauuc

SEQ ID NO: 1766148 - RNA, 22 nt, Homo sapiens
gaauaaagccacuguaugauuc

SEQ ID NO: 1766149 - RNA, 17 nt, Homo sapiens
cuccuuguguugcacug

SEQ ID NO: 1766150 - RNA, 18 nt, Homo sapiens
uccagagcuggaucucuc

SEQ ID NO: 1766151 - RNA, 20 nt, Homo sapiens
cccgugacgaggcucaaaaa

SEQ ID NO: 1766152 - RNA, 20 nt, Homo sapiens
cuacgccaauguuaugccag

SEQ ID NO: 1766153 - RNA, 14 nt, Homo sapiens
ugacugaaaccacu

SEQ ID NO: 1766154 - RNA, 16 nt, Homo sapiens
ccuggggcugugcauu

SEQ ID NO: 1766155 - RNA, 16 nt, Homo sapiens
gacuccuaacuacagg

SEQ ID NO: 1766156 - RNA, 16 nt, Homo sapiens
uuggaaagaguucaag

SEQ ID NO: 1766157 - RNA, 16 nt, Homo sapiens
uguauucccuuguauu

SEQ ID NO: 1766158 - RNA, 18 nt, Homo sapiens
aggcagagcuguggcaca

SEQ ID NO: 1766159 - RNA, 14 nt, Homo sapiens
acugagaaaggcuc

SEQ ID NO: 1766160 - RNA, 18 nt, Homo sapiens
ucugccaccacaccuggc

SEQ ID NO: 1766161 - RNA, 17 nt, Homo sapiens
gcaguucccuacgugaa

SEQ ID NO: 1766162 - RNA, 13 nt, Homo sapiens
uuaugcagagcca

SEQ ID NO: 1766163 - RNA, 22 nt, Homo sapiens
acuuuuuuaaauuaagacaaaa

SEQ ID NO: 1766164 - RNA, 22 nt, Homo sapiens
agaccaacguuacucagggcuc

SEQ ID NO: 1766165 - RNA, 12 nt, Homo sapiens
augcacugugaa

SEQ ID NO: 1766166 - RNA, 12 nt, Homo sapiens
augaacugugac

SEQ ID NO: 1766167 - RNA, 12 nt, Homo sapiens
ugacacugauga

SEQ ID NO: 1766168 - RNA, 14 nt, Homo sapiens
caggacccugcuga

SEQ ID NO: 1766169 - RNA, 14 nt, Homo sapiens
cugaccugccugua

SEQ ID NO: 1766170 - RNA, 18 nt, Homo sapiens
uuagagcaagaacauuca

SEQ ID NO: 1766171 - RNA, 17 nt, Homo sapiens
gauaguagaaccaguga

SEQ ID NO: 1766172 - RNA, 20 nt, Homo sapiens
uuagaggaagaaaaccagcg

SEQ ID NO: 1766173 - RNA, 15 nt, Homo sapiens
ugugagcacaaagaa

SEQ ID NO: 1766174 - RNA, 23 nt, Homo sapiens
gaguuucccuuccuuaugucucc

SEQ ID NO: 1766175 - RNA, 16 nt, Homo sapiens
ucccgaagaauggaga

SEQ ID NO: 1766176 - RNA, 17 nt, Homo sapiens
ucauagaaauauugacu

SEQ ID NO: 1766177 - RNA, 13 nt, Homo sapiens
cagguucuugccu

SEQ ID NO: 1766178 - RNA, 15 nt, Homo sapiens
gugucaucugucagc

SEQ ID NO: 1766179 - RNA, 22 nt, Homo sapiens
gcugcuccuucgcccucuugua

SEQ ID NO: 1766180 - RNA, 17 nt, Homo sapiens
aaaaucaccucccacca

SEQ ID NO: 1766181 - RNA, 20 nt, Homo sapiens
gagcaacuaacuaaccacau

SEQ ID NO: 1766182 - RNA, 12 nt, Homo sapiens
ugccaggcagug

SEQ ID NO: 1766183 - RNA, 18 nt, Homo sapiens
uaaccaugggcucagggc

SEQ ID NO: 1766184 - RNA, 21 nt, Homo sapiens
aguaauaucuuucaguuauua

SEQ ID NO: 1766185 - RNA, 14 nt, Homo sapiens
gcuuuguugcugga

SEQ ID NO: 1766186 - RNA, 13 nt, Homo sapiens
uaauuucagaaga

SEQ ID NO: 1766187 - RNA, 16 nt, Homo sapiens
ucuuagaccaugcuaa

SEQ ID NO: 1766188 - RNA, 20 nt, Homo sapiens
ccacucaccaggcaccagag

SEQ ID NO: 1766189 - RNA, 14 nt, Homo sapiens
cacucugauagaau

SEQ ID NO: 1766190 - RNA, 21 nt, Homo sapiens
aauaccacaugauuuuacuca

SEQ ID NO: 1766191 - RNA, 20 nt, Homo sapiens
uagccugugauuuugccuug

SEQ ID NO: 1766192 - RNA, 18 nt, Homo sapiens
gaauuccuggaaccugga

SEQ ID NO: 1766193 - RNA, 16 nt, Homo sapiens
cucuaauacauuccaa

SEQ ID NO: 1766194 - RNA, 23 nt, Homo sapiens
ugaacacucuacuacaugugacu

SEQ ID NO: 1766195 - RNA, 14 nt, Homo sapiens
ugcauuaucuauga

SEQ ID NO: 1766196 - RNA, 16 nt, Homo sapiens
acauugcuuuacuguc

SEQ ID NO: 1766197 - RNA, 20 nt, Homo sapiens
ggcaagcccugcccacagaa

SEQ ID NO: 1766198 - RNA, 16 nt, Homo sapiens
guaaguugaccuucuc

SEQ ID NO: 1766199 - RNA, 18 nt, Homo sapiens
cugugcuucgguaggcga

SEQ ID NO: 1766200 - RNA, 16 nt, Homo sapiens
cugcccaccucuccaa

SEQ ID NO: 1766201 - RNA, 21 nt, Homo sapiens
aauaacugaucucaaguauau

SEQ ID NO: 1766202 - RNA, 19 nt, Homo sapiens
aauggucaauaaagcuccu

SEQ ID NO: 1766203 - RNA, 23 nt, Homo sapiens
aaaagaaauauacaguuugacuu

SEQ ID NO: 1766204 - RNA, 20 nt, Homo sapiens
acauguggcacguaaggucu

SEQ ID NO: 1766205 - RNA, 18 nt, Homo sapiens
aagcucggagccagggcu

SEQ ID NO: 1766206 - RNA, 12 nt, Homo sapiens
aguagucucugu

SEQ ID NO: 1766207 - RNA, 18 nt, Homo sapiens
cggguuggggguugcuag

SEQ ID NO: 1766208 - RNA, 23 nt, Homo sapiens
aagaguucuccuuguacuugaau

SEQ ID NO: 1766209 - RNA, 23 nt, Homo sapiens
gucccagggcccuggaugguccu

SEQ ID NO: 1766210 - RNA, 22 nt, Homo sapiens
auaaugaauacauuuccaaaau

SEQ ID NO: 1766211 - RNA, 18 nt, Homo sapiens
agcuuccaugaugcacag

SEQ ID NO: 1766212 - RNA, 12 nt, Homo sapiens
caagcuucacau

SEQ ID NO: 1766213 - RNA, 19 nt, Homo sapiens
auuuacaaaauuacacagu

SEQ ID NO: 1766214 - RNA, 18 nt, Homo sapiens
ccccaggacgcagacuga

SEQ ID NO: 1766215 - RNA, 20 nt, Homo sapiens
caauugagcaagaugcugau

SEQ ID NO: 1766216 - RNA, 17 nt, Homo sapiens
gcugggcgccucugucc

SEQ ID NO: 1766217 - RNA, 12 nt, Homo sapiens
uuuuuuguccau

SEQ ID NO: 1766218 - RNA, 17 nt, Homo sapiens
cuauucucaugccucag

SEQ ID NO: 1766219 - RNA, 15 nt, Homo sapiens
ccugggccuuggcaa

SEQ ID NO: 1766220 - RNA, 22 nt, Homo sapiens
acaguuuauuuuuauacuuuca

SEQ ID NO: 1766221 - RNA, 14 nt, Homo sapiens
gcuuacaugccuac

SEQ ID NO: 1766222 - RNA, 13 nt, Homo sapiens
aaggccacuguuu

SEQ ID NO: 1766223 - RNA, 20 nt, Homo sapiens
ccuucugguuugaaggcgcu

SEQ ID NO: 1766224 - RNA, 13 nt, Homo sapiens
agugaugccaucc

SEQ ID NO: 1766225 - RNA, 12 nt, Homo sapiens
uuuaaaacacaa

SEQ ID NO: 1766226 - RNA, 18 nt, Homo sapiens
uuguuacagcuacuauaa

SEQ ID NO: 1766227 - RNA, 14 nt, Homo sapiens
cauucucuccuucc

SEQ ID NO: 1766228 - RNA, 15 nt, Homo sapiens
caggggaccacaccu

SEQ ID NO: 1766229 - RNA, 22 nt, Homo sapiens
gcaaaauuugaugccaggacac

SEQ ID NO: 1766230 - RNA, 18 nt, Homo sapiens
uaaauuuaaaaaucaaua

SEQ ID NO: 1766231 - RNA, 12 nt, Homo sapiens
cgcuucugggaa

SEQ ID NO: 1766232 - RNA, 19 nt, Homo sapiens
ugauucaggcuuccauuga

SEQ ID NO: 1766233 - RNA, 13 nt, Homo sapiens
agugcaaugggaa

SEQ ID NO: 1766234 - RNA, 16 nt, Homo sapiens
accgcgucccagcucc

SEQ ID NO: 1766235 - RNA, 22 nt, Homo sapiens
caguuacucccuacacugaugc

SEQ ID NO: 1766236 - RNA, 19 nt, Homo sapiens
acaaaaaaaaaauuugcca

SEQ ID NO: 1766237 - RNA, 11 nt, Homo sapiens
acgcacuguau

SEQ ID NO: 1766238 - RNA, 20 nt, Homo sapiens
ccucagugccccauucucac

SEQ ID NO: 1766239 - RNA, 22 nt, Homo sapiens
cugaugaguuucacuguacugc

SEQ ID NO: 1766240 - RNA, 12 nt, Homo sapiens
caugucugcaaa

SEQ ID NO: 1766241 - RNA, 22 nt, Homo sapiens
cuugagggggaaggauucugcu

SEQ ID NO: 1766242 - RNA, 18 nt, Homo sapiens
ugcuaauguugaucagca

SEQ ID NO: 1766243 - RNA, 16 nt, Homo sapiens
ccgaaaaguugcugaa

SEQ ID NO: 1766244 - RNA, 15 nt, Homo sapiens
uaaauccaugguguu

SEQ ID NO: 1766245 - RNA, 23 nt, Homo sapiens
aaccacaaauuuuaaacuuauga

SEQ ID NO: 1766246 - RNA, 21 nt, Homo sapiens
aauucuccugccucagccucc

SEQ ID NO: 1766247 - RNA, 13 nt, Homo sapiens
auuaaauagagaa

SEQ ID NO: 1766248 - RNA, 11 nt, Homo sapiens
aagaguucucc

SEQ ID NO: 1766249 - RNA, 18 nt, Homo sapiens
uauggguuggacaaccuc

SEQ ID NO: 1766250 - RNA, 18 nt, Homo sapiens
ugauuuuaaauggauguc

SEQ ID NO: 1766251 - RNA, 16 nt, Homo sapiens
ucagaaauauaugcag

SEQ ID NO: 1766252 - RNA, 15 nt, Homo sapiens
caggcacgugcacau

SEQ ID NO: 1766253 - RNA, 15 nt, Homo sapiens
augaugauguggaag

SEQ ID NO: 1766254 - RNA, 12 nt, Homo sapiens
ucuuaaccucaa

SEQ ID NO: 1766255 - RNA, 12 nt, Homo sapiens
aauaaaccaaau

SEQ ID NO: 1766256 - RNA, 17 nt, Homo sapiens
ccagcacucacaccacu

SEQ ID NO: 1766257 - RNA, 15 nt, Homo sapiens
ugauuuuuuuccaca

SEQ ID NO: 1766258 - RNA, 18 nt, Homo sapiens
guguuaagugugcaguau

SEQ ID NO: 1766259 - RNA, 20 nt, Homo sapiens
aggaugacuaacaagauuug

SEQ ID NO: 1766260 - RNA, 22 nt, Homo sapiens
gguggucucuucuuggggccca

SEQ ID NO: 1766261 - RNA, 16 nt, Homo sapiens
gagcucuggcugucuc

SEQ ID NO: 1766262 - RNA, 16 nt, Homo sapiens
cuuugucugucaauca

SEQ ID NO: 1766263 - RNA, 16 nt, Homo sapiens
uaaccgcacaugcaca

SEQ ID NO: 1766264 - RNA, 17 nt, Homo sapiens
gagucuugacaaucaca

SEQ ID NO: 1766265 - RNA, 19 nt, Homo sapiens
ucaagcaauucuccugccu

SEQ ID NO: 1766266 - RNA, 21 nt, Homo sapiens
cugcuaaagaaaggaacuaag

SEQ ID NO: 1766267 - RNA, 21 nt, Homo sapiens
auuauggaauuacucuacugu

SEQ ID NO: 1766268 - RNA, 15 nt, Homo sapiens
cccagggcacugcca

SEQ ID NO: 1766269 - RNA, 17 nt, Homo sapiens
cagugaaggcccaugaa

SEQ ID NO: 1766270 - RNA, 22 nt, Homo sapiens
uauaucuguaaauuuaacugca

SEQ ID NO: 1766271 - RNA, 21 nt, Homo sapiens
agagaggcgucugcugucuca

SEQ ID NO: 1766272 - RNA, 21 nt, Homo sapiens
gagugggaaggagauggcaua

SEQ ID NO: 1766273 - RNA, 21 nt, Homo sapiens
gacaucuacgaagccacaggc

SEQ ID NO: 1766274 - RNA, 16 nt, Homo sapiens
agcuguaaacugaaua

SEQ ID NO: 1766275 - RNA, 23 nt, Homo sapiens
ucccccaccgguccagcuggccu

SEQ ID NO: 1766276 - RNA, 14 nt, Homo sapiens
uaagaaugcugguu

SEQ ID NO: 1766277 - RNA, 16 nt, Homo sapiens
acuacuucucuuguua

SEQ ID NO: 1766278 - RNA, 16 nt, Homo sapiens
gaagccacuuggccca

SEQ ID NO: 1766279 - RNA, 17 nt, Homo sapiens
auuugugauauauguau

SEQ ID NO: 1766280 - RNA, 19 nt, Homo sapiens
ugacauggacacaucagga

SEQ ID NO: 1766281 - RNA, 18 nt, Homo sapiens
ccaaugccugugaagcag

SEQ ID NO: 1766282 - RNA, 22 nt, Homo sapiens
gaaaauuuuuaaauauucacaa

SEQ ID NO: 1766283 - RNA, 12 nt, Homo sapiens
uuucacucacau

SEQ ID NO: 1766284 - RNA, 17 nt, Homo sapiens
aguagcugcccuuccug

SEQ ID NO: 1766285 - RNA, 18 nt, Homo sapiens
gccuuuauuuccacugug

SEQ ID NO: 1766286 - RNA, 13 nt, Homo sapiens
cauacugcauaca

SEQ ID NO: 1766287 - RNA, 16 nt, Homo sapiens
cuuuuuauauucugug

SEQ ID NO: 1766288 - RNA, 23 nt, Homo sapiens
ugaugagacccuuuuaucugcug

SEQ ID NO: 1766289 - RNA, 14 nt, Homo sapiens
cuuccagugcccaa

SEQ ID NO: 1766290 - RNA, 20 nt, Homo sapiens
aaaugcagggcacaugaucu

SEQ ID NO: 1766291 - RNA, 18 nt, Homo sapiens
cccccagguuuuugccca

SEQ ID NO: 1766292 - RNA, 21 nt, Homo sapiens
ugcaggacaacaucagcucac

SEQ ID NO: 1766293 - RNA, 15 nt, Homo sapiens
cuuuaaaacuuaucc

SEQ ID NO: 1766294 - RNA, 22 nt, Homo sapiens
cugaagaggaacugggccuguu

SEQ ID NO: 1766295 - RNA, 20 nt, Homo sapiens
ggcaaaaccacuagaacucu

SEQ ID NO: 1766296 - RNA, 18 nt, Homo sapiens
accgagucuugcucuguu

SEQ ID NO: 1766297 - RNA, 19 nt, Homo sapiens
auaugauacucucagauuu

SEQ ID NO: 1766298 - RNA, 23 nt, Homo sapiens
aauuuuuuagagagcuguuccca

SEQ ID NO: 1766299 - RNA, 17 nt, Homo sapiens
cuagcgcguugccuguc

SEQ ID NO: 1766300 - RNA, 18 nt, Homo sapiens
cgcauacagauauucuaa

SEQ ID NO: 1766301 - RNA, 21 nt, Homo sapiens
auuguuuagaugaggcucaga

SEQ ID NO: 1766302 - RNA, 15 nt, Homo sapiens
uguacagacguaugc

SEQ ID NO: 1766303 - RNA, 15 nt, Homo sapiens
cacccacauaccugg

SEQ ID NO: 1766304 - RNA, 22 nt, Homo sapiens
ccucuggagaguagaugcuugc

SEQ ID NO: 1766305 - RNA, 11 nt, Homo sapiens
agcugcacuca

SEQ ID NO: 1766306 - RNA, 19 nt, Homo sapiens
gcagcugagaaaaugagug

SEQ ID NO: 1766307 - RNA, 13 nt, Homo sapiens
cuccaguagaaag

SEQ ID NO: 1766308 - RNA, 17 nt, Homo sapiens
uucccagauagucccag

SEQ ID NO: 1766309 - RNA, 13 nt, Homo sapiens
auguuggccucca

SEQ ID NO: 1766310 - RNA, 15 nt, Homo sapiens
gacuuggagcugucc

SEQ ID NO: 1766311 - RNA, 18 nt, Homo sapiens
aagccucuccagcaauaa

SEQ ID NO: 1766312 - RNA, 15 nt, Homo sapiens
cauuccaacucguau

SEQ ID NO: 1766313 - RNA, 14 nt, Homo sapiens
uacugaagugcagc

SEQ ID NO: 1766314 - RNA, 15 nt, Homo sapiens
cuaguccuugcugca

SEQ ID NO: 1766315 - RNA, 11 nt, Homo sapiens
cacugccuuca

SEQ ID NO: 1766316 - RNA, 20 nt, Homo sapiens
accugaacacaucgugauga

SEQ ID NO: 1766317 - RNA, 16 nt, Homo sapiens
aaucugcuuuucaugu

SEQ ID NO: 1766318 - RNA, 23 nt, Homo sapiens
accggggccuacuagagucugaa

SEQ ID NO: 1766319 - RNA, 16 nt, Homo sapiens
cacuguaaccucaguc

SEQ ID NO: 1766320 - RNA, 15 nt, Homo sapiens
aggucaggaguucga

SEQ ID NO: 1766321 - RNA, 12 nt, Homo sapiens
gacagcucugcc

SEQ ID NO: 1766322 - RNA, 15 nt, Homo sapiens
gcgcagcugcauuug

SEQ ID NO: 1766323 - RNA, 16 nt, Homo sapiens
ugcugcuuccauuuga

SEQ ID NO: 1766324 - RNA, 23 nt, Homo sapiens
agagcugccugugccuuuugcca

SEQ ID NO: 1766325 - RNA, 21 nt, Homo sapiens
agaccugaccagucagauggu

SEQ ID NO: 1766326 - RNA, 15 nt, Homo sapiens
gcacugaaacauuau

SEQ ID NO: 1766327 - RNA, 22 nt, Homo sapiens
gaugcacaguaucugcuguucu

SEQ ID NO: 1766328 - RNA, 17 nt, Homo sapiens
auuuguauuuugugaug

SEQ ID NO: 1766329 - RNA, 12 nt, Homo sapiens
ucuugaagugau

SEQ ID NO: 1766330 - RNA, 20 nt, Homo sapiens
cuucccagagaguaugugag

SEQ ID NO: 1766331 - RNA, 18 nt, Homo sapiens
aagagaaccgagcaaaga

SEQ ID NO: 1766332 - RNA, 20 nt, Homo sapiens
cagaaaucugcugcauuuca

SEQ ID NO: 1766333 - RNA, 23 nt, Homo sapiens
gcaaacagcccuaaauaaaucua

SEQ ID NO: 1766334 - RNA, 14 nt, Homo sapiens
cuccagggggugcc

SEQ ID NO: 1766335 - RNA, 17 nt, Homo sapiens
gucaugaaggacacucu

SEQ ID NO: 1766336 - RNA, 19 nt, Homo sapiens
auaaauaacuaaugucucu

SEQ ID NO: 1766337 - RNA, 21 nt, Homo sapiens
ggaccauaaacguuguguuca

SEQ ID NO: 1766338 - RNA, 16 nt, Homo sapiens
aucccaucccauccca

SEQ ID NO: 1766339 - RNA, 20 nt, Homo sapiens
ggcaucucuuccccagagag

SEQ ID NO: 1766340 - RNA, 21 nt, Homo sapiens
uuucuucuuccacacaugcaa

SEQ ID NO: 1766341 - RNA, 16 nt, Homo sapiens
cucuucagaacacaca

SEQ ID NO: 1766342 - RNA, 17 nt, Homo sapiens
agccaagggauggacau

SEQ ID NO: 1766343 - RNA, 15 nt, Homo sapiens
aaagaaguacuuuau

SEQ ID NO: 1766344 - RNA, 12 nt, Homo sapiens
acggccagcugc

SEQ ID NO: 1766345 - RNA, 22 nt, Homo sapiens
ccagccugcuaauuccccagau

SEQ ID NO: 1766346 - RNA, 21 nt, Homo sapiens
caggagcagcagccagcacca

SEQ ID NO: 1766347 - RNA, 20 nt, Homo sapiens
auccuguuccgagcaacuuu

SEQ ID NO: 1766348 - RNA, 23 nt, Homo sapiens
auuucccauuugugccagaggaa

SEQ ID NO: 1766349 - RNA, 15 nt, Homo sapiens
aaggggcaggccaga

SEQ ID NO: 1766350 - RNA, 16 nt, Homo sapiens
cucucaggaccagaga

SEQ ID NO: 1766351 - RNA, 16 nt, Homo sapiens
auaugcagccaaccaa

SEQ ID NO: 1766352 - RNA, 12 nt, Homo sapiens
aauccucaggaa

SEQ ID NO: 1766353 - RNA, 18 nt, Homo sapiens
gcugagggacguggugcc

SEQ ID NO: 1766354 - RNA, 13 nt, Homo sapiens
caacuaggccuca

SEQ ID NO: 1766355 - RNA, 13 nt, Homo sapiens
ucugaccagcagc

SEQ ID NO: 1766356 - RNA, 21 nt, Homo sapiens
ggaauccuggggaacauagaa

SEQ ID NO: 1766357 - RNA, 24 nt, Homo sapiens
ucaugucuauuuuugaugacucau

SEQ ID NO: 1766358 - RNA, 21 nt, Homo sapiens
ucaguuccaaagucacaggaa

SEQ ID NO: 1766359 - RNA, 23 nt, Homo sapiens
agcacaggcaacauuacaaacaa

SEQ ID NO: 1766360 - RNA, 14 nt, Homo sapiens
aaccuaaugcacuc

SEQ ID NO: 1766361 - RNA, 16 nt, Homo sapiens
uggucagcguugcaug

SEQ ID NO: 1766362 - RNA, 18 nt, Homo sapiens
guuuucauaacaacuuau

SEQ ID NO: 1766363 - RNA, 20 nt, Homo sapiens
cccucaccugggcaccuggg

SEQ ID NO: 1766364 - RNA, 17 nt, Homo sapiens
cuaacuuacaaacuggu

SEQ ID NO: 1766365 - RNA, 22 nt, Homo sapiens
aacuucccagagaguaucugag

SEQ ID NO: 1766366 - RNA, 16 nt, Homo sapiens
gaaccuggaccccagc

SEQ ID NO: 1766367 - RNA, 21 nt, Homo sapiens
auuggcuuuucauagugcuca

SEQ ID NO: 1766368 - RNA, 22 nt, Homo sapiens
gaguccaggguggaugaucuca

SEQ ID NO: 1766369 - RNA, 17 nt, Homo sapiens
gugaugaugcugugaca

SEQ ID NO: 1766370 - RNA, 14 nt, Homo sapiens
cccucuucaaagca

SEQ ID NO: 1766371 - RNA, 15 nt, Homo sapiens
caucucugccuggaa

SEQ ID NO: 1766372 - RNA, 16 nt, Homo sapiens
guccacagcaaagggc

SEQ ID NO: 1766373 - RNA, 19 nt, Homo sapiens
uuccuguguaccucuagaa

SEQ ID NO: 1766374 - RNA, 14 nt, Homo sapiens
gucccagcuaccca

SEQ ID NO: 1766375 - RNA, 22 nt, Homo sapiens
agcauaggcuggggacacagga

SEQ ID NO: 1766376 - RNA, 16 nt, Homo sapiens
aaauuauaaagauaaa

SEQ ID NO: 1766377 - RNA, 19 nt, Homo sapiens
auuuaauguuuuuaaucac

SEQ ID NO: 1766378 - RNA, 17 nt, Homo sapiens
caagagaagaaagugaa

SEQ ID NO: 1766379 - RNA, 14 nt, Homo sapiens
aacuuauuugcccu

SEQ ID NO: 1766380 - RNA, 13 nt, Homo sapiens
auucaauuucuca

SEQ ID NO: 1766381 - RNA, 18 nt, Homo sapiens
cuuucucccuaaccacua

SEQ ID NO: 1766382 - RNA, 15 nt, Homo sapiens
aggcuggcagugaca

SEQ ID NO: 1766383 - RNA, 18 nt, Homo sapiens
cucuccccacugcucauu

SEQ ID NO: 1766384 - RNA, 15 nt, Homo sapiens
cugccugaacacugc

SEQ ID NO: 1766385 - RNA, 22 nt, Homo sapiens
cauuuguguuauuauuuugcac

SEQ ID NO: 1766386 - RNA, 16 nt, Homo sapiens
ccaaggcuacuacaga

SEQ ID NO: 1766387 - RNA, 15 nt, Homo sapiens
gcaccuagcugugca

SEQ ID NO: 1766388 - RNA, 23 nt, Homo sapiens
cacaagguccggaugucacucau

SEQ ID NO: 1766389 - RNA, 14 nt, Homo sapiens
aagcaucccuguga

SEQ ID NO: 1766390 - RNA, 17 nt, Homo sapiens
aucuggcuuagugccac

SEQ ID NO: 1766391 - RNA, 18 nt, Homo sapiens
cauuaaaauaaaccaaau

SEQ ID NO: 1766392 - RNA, 22 nt, Homo sapiens
uacauauguauacaugugccau

SEQ ID NO: 1766393 - RNA, 22 nt, Homo sapiens
uggcucacaaaagguuaaugga

SEQ ID NO: 1766394 - RNA, 16 nt, Homo sapiens
cugggaccaacccugg

SEQ ID NO: 1766395 - RNA, 12 nt, Homo sapiens
aagcacagaucu

SEQ ID NO: 1766396 - RNA, 15 nt, Homo sapiens
cuuugcggugggacc

SEQ ID NO: 1766397 - RNA, 13 nt, Homo sapiens
agaggcagcuuca

SEQ ID NO: 1766398 - RNA, 14 nt, Homo sapiens
cuaacccccaaaua

SEQ ID NO: 1766399 - RNA, 12 nt, Homo sapiens
ugccccaugugu

SEQ ID NO: 1766400 - RNA, 22 nt, Homo sapiens
augcacacacauggaugagcac

SEQ ID NO: 1766401 - RNA, 14 nt, Homo sapiens
augaagcucacugg

SEQ ID NO: 1766402 - RNA, 14 nt, Homo sapiens
augacaugcacuga

SEQ ID NO: 1766403 - RNA, 13 nt, Homo sapiens
uuagaauaaugaa

SEQ ID NO: 1766404 - RNA, 18 nt, Homo sapiens
gaucauucucaguaucca

SEQ ID NO: 1766405 - RNA, 23 nt, Homo sapiens
ccagagccuggggauuccagcug

SEQ ID NO: 1766406 - RNA, 14 nt, Homo sapiens
ggcaggagagucac

SEQ ID NO: 1766407 - RNA, 16 nt, Homo sapiens
aacauguaugugcauu

SEQ ID NO: 1766408 - RNA, 21 nt, Homo sapiens
auugcuguccuggaggggcug

SEQ ID NO: 1766409 - RNA, 22 nt, Homo sapiens
uccuguuugaaagccucugcgu

SEQ ID NO: 1766410 - RNA, 16 nt, Homo sapiens
agcaagugugcacucc

SEQ ID NO: 1766411 - RNA, 16 nt, Homo sapiens
aaaaaggccccugugg

SEQ ID NO: 1766412 - RNA, 19 nt, Homo sapiens
uuacaguuuaucuauggca

SEQ ID NO: 1766413 - RNA, 14 nt, Homo sapiens
uuuuaaaagugcac

SEQ ID NO: 1766414 - RNA, 11 nt, Homo sapiens
gcagugcugau

SEQ ID NO: 1766415 - RNA, 20 nt, Homo sapiens
ggcaggaaggggaaacacag

SEQ ID NO: 1766416 - RNA, 19 nt, Homo sapiens
gagucaaugagauuuugcc

SEQ ID NO: 1766417 - RNA, 15 nt, Homo sapiens
uccgugcuaugacau

SEQ ID NO: 1766418 - RNA, 22 nt, Homo sapiens
caccccucuguccagccagcuc

SEQ ID NO: 1766419 - RNA, 15 nt, Homo sapiens
auuuuuguuuaugua

SEQ ID NO: 1766420 - RNA, 19 nt, Homo sapiens
aacagauauuuagcucugu

SEQ ID NO: 1766421 - RNA, 17 nt, Homo sapiens
acuaauugacuugcaaa

SEQ ID NO: 1766422 - RNA, 17 nt, Homo sapiens
ggucauuucauuugaaa

SEQ ID NO: 1766423 - RNA, 19 nt, Homo sapiens
uccuugacuucuuugagaa

SEQ ID NO: 1766424 - RNA, 24 nt, Homo sapiens
uaauaaaggucuuugcacauguga

SEQ ID NO: 1766425 - RNA, 16 nt, Homo sapiens
auggcagaaccaaagc

SEQ ID NO: 1766426 - RNA, 14 nt, Homo sapiens
cccaccuaccuuca

SEQ ID NO: 1766427 - RNA, 16 nt, Homo sapiens
agggguauccuccuaa

SEQ ID NO: 1766428 - RNA, 15 nt, Homo sapiens
gcacugacaaugggc

SEQ ID NO: 1766429 - RNA, 22 nt, Homo sapiens
acaaaaaauugcuccuaacucc

SEQ ID NO: 1766430 - RNA, 16 nt, Homo sapiens
acucauugucugugga

SEQ ID NO: 1766431 - RNA, 16 nt, Homo sapiens
caaauaauauugccuu

SEQ ID NO: 1766432 - RNA, 22 nt, Homo sapiens
ccuuugaaguagacucauucuu

SEQ ID NO: 1766433 - RNA, 23 nt, Homo sapiens
auaagcagucauccucagaucau

SEQ ID NO: 1766434 - RNA, 16 nt, Homo sapiens
gacagagauaccauuc

SEQ ID NO: 1766435 - RNA, 20 nt, Homo sapiens
gcuguccuccuggcaccuga

SEQ ID NO: 1766436 - RNA, 19 nt, Homo sapiens
cagguuacaugagagcaau

SEQ ID NO: 1766437 - RNA, 14 nt, Homo sapiens
acugaaaauacuua

SEQ ID NO: 1766438 - RNA, 17 nt, Homo sapiens
aauugauguuacuguau

SEQ ID NO: 1766439 - RNA, 15 nt, Homo sapiens
cggcauuaaagccau

SEQ ID NO: 1766440 - RNA, 21 nt, Homo sapiens
caaguugaaaucagaagccua

SEQ ID NO: 1766441 - RNA, 15 nt, Homo sapiens
ccuguccauaaagua

SEQ ID NO: 1766442 - RNA, 18 nt, Homo sapiens
uuaucucacuugugccaa

SEQ ID NO: 1766443 - RNA, 18 nt, Homo sapiens
aaaucucccaugugcaua

SEQ ID NO: 1766444 - RNA, 16 nt, Homo sapiens
uggauggaaagggagg

SEQ ID NO: 1766445 - RNA, 19 nt, Homo sapiens
gcaugugaaagugcacuua

SEQ ID NO: 1766446 - RNA, 23 nt, Homo sapiens
acacaaucuuuccuugucucuca

SEQ ID NO: 1766447 - RNA, 15 nt, Homo sapiens
guucaacuuccaaag

SEQ ID NO: 1766448 - RNA, 18 nt, Homo sapiens
cuuauugccucacuucag

SEQ ID NO: 1766449 - RNA, 21 nt, Homo sapiens
ccuuggaaaugaccaggccaa

SEQ ID NO: 1766450 - RNA, 18 nt, Homo sapiens
guuuuauaaguucacaaa

SEQ ID NO: 1766451 - RNA, 22 nt, Homo sapiens
ccugaguuggggggaauucuca

SEQ ID NO: 1766452 - RNA, 11 nt, Homo sapiens
aaaagcacaga

SEQ ID NO: 1766453 - RNA, 11 nt, Homo sapiens
agaagcacaaa

SEQ ID NO: 1766454 - RNA, 21 nt, Homo sapiens
uugaaaaaaaaaaacacaaaa

SEQ ID NO: 1766455 - RNA, 18 nt, Homo sapiens
ugugaaguuugcuuugua

SEQ ID NO: 1766456 - RNA, 14 nt, Homo sapiens
uaagaaggaaaaga

SEQ ID NO: 1766457 - RNA, 23 nt, Homo sapiens
ucuauauauacaaugaguaaaau

SEQ ID NO: 1766458 - RNA, 20 nt, Homo sapiens
gacugugaaaguaugugaua

SEQ ID NO: 1766459 - RNA, 17 nt, Homo sapiens
ucugcuccuuauuccca

SEQ ID NO: 1766460 - RNA, 17 nt, Homo sapiens
ugucucauccaaaaagu

SEQ ID NO: 1766461 - RNA, 18 nt, Homo sapiens
gcaaacaaauaaaaugaa

SEQ ID NO: 1766462 - RNA, 22 nt, Homo sapiens
ugagaggguuuccuaacagcuu

SEQ ID NO: 1766463 - RNA, 21 nt, Homo sapiens
ugacucuuccccauaaucacu

SEQ ID NO: 1766464 - RNA, 15 nt, Homo sapiens
auggcaggugccugu

SEQ ID NO: 1766465 - RNA, 20 nt, Homo sapiens
uuucgacguuugacuagcca

SEQ ID NO: 1766466 - RNA, 18 nt, Homo sapiens
cucugacuuaagcugccu

SEQ ID NO: 1766467 - RNA, 13 nt, Homo sapiens
gaaccauggaccu

SEQ ID NO: 1766468 - RNA, 15 nt, Homo sapiens
caauaaacauaacag

SEQ ID NO: 1766469 - RNA, 17 nt, Homo sapiens
ugcagcgaguacuuccc

SEQ ID NO: 1766470 - RNA, 21 nt, Homo sapiens
aauuugugucuguguuuaaua

SEQ ID NO: 1766471 - RNA, 17 nt, Homo sapiens
aguuucuggcucuugag

SEQ ID NO: 1766472 - RNA, 22 nt, Homo sapiens
ggaccagccuguaccuugcugu

SEQ ID NO: 1766473 - RNA, 23 nt, Homo sapiens
cucuucugagcaccuacuuacau

SEQ ID NO: 1766474 - RNA, 17 nt, Homo sapiens
ucuucaucaugagacaa

SEQ ID NO: 1766475 - RNA, 14 nt, Homo sapiens
uuaaguagggauaa

SEQ ID NO: 1766476 - RNA, 23 nt, Homo sapiens
agacucuuuggguccauucagau

SEQ ID NO: 1766477 - RNA, 22 nt, Homo sapiens
aauauucucuccgccauugaga

SEQ ID NO: 1766478 - RNA, 23 nt, Homo sapiens
agagauuuugucgggacagagag

SEQ ID NO: 1766479 - RNA, 18 nt, Homo sapiens
cuuaaaauacaagacugc

SEQ ID NO: 1766480 - RNA, 20 nt, Homo sapiens
cagauucugccucucuggaa

SEQ ID NO: 1766481 - RNA, 17 nt, Homo sapiens
ccuuggcccaucccgcc

SEQ ID NO: 1766482 - RNA, 23 nt, Homo sapiens
ucaauuccagaaaaacucaugga

SEQ ID NO: 1766483 - RNA, 13 nt, Homo sapiens
uccacaaagccaa

SEQ ID NO: 1766484 - RNA, 23 nt, Homo sapiens
cauuaagagguuuauuuggguac

SEQ ID NO: 1766485 - RNA, 21 nt, Homo sapiens
ucacauggaaucuacaugugu

SEQ ID NO: 1766486 - RNA, 14 nt, Homo sapiens
cuaguaaauuuaau

SEQ ID NO: 1766487 - RNA, 13 nt, Homo sapiens
ugauggaugucuu

SEQ ID NO: 1766488 - RNA, 22 nt, Homo sapiens
uauccuguuccgagcaacuuuu

SEQ ID NO: 1766489 - RNA, 21 nt, Homo sapiens
ggacuccagaaucuaaagcca

SEQ ID NO: 1766490 - RNA, 16 nt, Homo sapiens
acaaagaccgagcaaa

SEQ ID NO: 1766491 - RNA, 14 nt, Homo sapiens
aaggcagggcccuu

SEQ ID NO: 1766492 - RNA, 17 nt, Homo sapiens
agguuaaacugaagcaa

SEQ ID NO: 1766493 - RNA, 21 nt, Homo sapiens
cucccagggccuuaaaagcca

SEQ ID NO: 1766494 - RNA, 21 nt, Homo sapiens
gacucccacaacaacaaaagc

SEQ ID NO: 1766495 - RNA, 11 nt, Homo sapiens
aggucauggcc

SEQ ID NO: 1766496 - RNA, 15 nt, Homo sapiens
uuuccugugcaaaaa

SEQ ID NO: 1766497 - RNA, 23 nt, Homo sapiens
aagaauuggucuuaauguugaau

SEQ ID NO: 1766498 - RNA, 15 nt, Homo sapiens
gcugaaacccaauga

SEQ ID NO: 1766499 - RNA, 12 nt, Homo sapiens
uccaggugcaga

SEQ ID NO: 1766500 - RNA, 20 nt, Homo sapiens
augugucccagccacagugu

SEQ ID NO: 1766501 - RNA, 23 nt, Homo sapiens
uagugcuuuaagaaugaacacaa

SEQ ID NO: 1766502 - RNA, 14 nt, Homo sapiens
gcugaaaagggcac

SEQ ID NO: 1766503 - RNA, 11 nt, Homo sapiens
ucauugcugag

SEQ ID NO: 1766504 - RNA, 21 nt, Homo sapiens
uaggaaaauauggguugcauu

SEQ ID NO: 1766505 - RNA, 20 nt, Homo sapiens
aagaagcccaagauaucagc

SEQ ID NO: 1766506 - RNA, 15 nt, Homo sapiens
cuauauugugccaag

SEQ ID NO: 1766507 - RNA, 14 nt, Homo sapiens
uuguaauaaauacu

SEQ ID NO: 1766508 - RNA, 16 nt, Homo sapiens
gcuccaaccugcaaag

SEQ ID NO: 1766509 - RNA, 19 nt, Homo sapiens
aagcugauuuugcuuacuu

SEQ ID NO: 1766510 - RNA, 23 nt, Homo sapiens
ggggcugucccggaggcgguggg

SEQ ID NO: 1766511 - RNA, 20 nt, Homo sapiens
ugguguaaauauuagugcag

SEQ ID NO: 1766512 - RNA, 20 nt, Homo sapiens
gucaucgcgccacuaagcca

SEQ ID NO: 1766513 - RNA, 13 nt, Homo sapiens
uacagacugggga

SEQ ID NO: 1766514 - RNA, 12 nt, Homo sapiens
aacauucaggaa

SEQ ID NO: 1766515 - RNA, 19 nt, Homo sapiens
gcugagaggcuaaaacuca

SEQ ID NO: 1766516 - RNA, 21 nt, Homo sapiens
agacaugauuuccuugaaugu

SEQ ID NO: 1766517 - RNA, 20 nt, Homo sapiens
aauccugcggcaggacugca

SEQ ID NO: 1766518 - RNA, 20 nt, Homo sapiens
agcccccaccggaacugggc

SEQ ID NO: 1766519 - RNA, 17 nt, Homo sapiens
auaauaugaagccuuug

SEQ ID NO: 1766520 - RNA, 21 nt, Homo sapiens
uuccagauaagcagaguugcu

SEQ ID NO: 1766521 - RNA, 21 nt, Homo sapiens
uacauuauuuucauagauuaa

SEQ ID NO: 1766522 - RNA, 20 nt, Homo sapiens
agccgcuggcaacaacagcu

SEQ ID NO: 1766523 - RNA, 15 nt, Homo sapiens
guugugagagccugu

SEQ ID NO: 1766524 - RNA, 14 nt, Homo sapiens
ggcagcaucuucac

SEQ ID NO: 1766525 - RNA, 16 nt, Homo sapiens
cccgacuccaguccaa

SEQ ID NO: 1766526 - RNA, 19 nt, Homo sapiens
gcugggaguucuagaacca

SEQ ID NO: 1766527 - RNA, 14 nt, Homo sapiens
ucuuuacuccauga

SEQ ID NO: 1766528 - RNA, 11 nt, Homo sapiens
cuaacuccugu

SEQ ID NO: 1766529 - RNA, 14 nt, Homo sapiens
cugaggaucagaaa

SEQ ID NO: 1766530 - RNA, 18 nt, Homo sapiens
auuaagugcacaccgugu

SEQ ID NO: 1766531 - RNA, 18 nt, Homo sapiens
uggaggaaagugauaucc

SEQ ID NO: 1766532 - RNA, 20 nt, Homo sapiens
uucuugaagaauaaauucua

SEQ ID NO: 1766533 - RNA, 23 nt, Homo sapiens
aaggaaagcuauaucuauuugag

SEQ ID NO: 1766534 - RNA, 18 nt, Homo sapiens
ccucuuccccuugcccuu

SEQ ID NO: 1766535 - RNA, 16 nt, Homo sapiens
cacacaaggugcaaau

SEQ ID NO: 1766536 - RNA, 14 nt, Homo sapiens
uauugcugaucuuu

SEQ ID NO: 1766537 - RNA, 15 nt, Homo sapiens
ccagccauagagauu

SEQ ID NO: 1766538 - RNA, 13 nt, Homo sapiens
acccguccauuca

SEQ ID NO: 1766539 - RNA, 13 nt, Homo sapiens
aagugauuaucuc

SEQ ID NO: 1766540 - RNA, 16 nt, Homo sapiens
gcugcauaugccuaca

SEQ ID NO: 1766541 - RNA, 14 nt, Homo sapiens
aggaggaacugguc

SEQ ID NO: 1766542 - RNA, 16 nt, Homo sapiens
ggucuaaucagugauu

SEQ ID NO: 1766543 - RNA, 15 nt, Homo sapiens
ccacccaagagagaa

SEQ ID NO: 1766544 - RNA, 14 nt, Homo sapiens
aucucaaaacugua

SEQ ID NO: 1766545 - RNA, 12 nt, Homo sapiens
cuuugcacuguu

SEQ ID NO: 1766546 - RNA, 14 nt, Homo sapiens
cuuguggguccaug

SEQ ID NO: 1766547 - RNA, 11 nt, Homo sapiens
gaaauccaaac

SEQ ID NO: 1766548 - RNA, 13 nt, Homo sapiens
auuuuccuacauu

SEQ ID NO: 1766549 - RNA, 23 nt, Homo sapiens
auggggguguaguauuuuugcca

SEQ ID NO: 1766550 - RNA, 21 nt, Homo sapiens
gaaccuuuaaaguaaaggccu

SEQ ID NO: 1766551 - RNA, 22 nt, Homo sapiens
cugccuucgcaccuugcugugu

SEQ ID NO: 1766552 - RNA, 12 nt, Homo sapiens
uuuguaucucau

SEQ ID NO: 1766553 - RNA, 20 nt, Homo sapiens
uuaaucuaccuugcagugua

SEQ ID NO: 1766554 - RNA, 12 nt, Homo sapiens
agugacauuugu

SEQ ID NO: 1766555 - RNA, 18 nt, Homo sapiens
ccagggcugcagccugag

SEQ ID NO: 1766556 - RNA, 23 nt, Homo sapiens
guaaaacuauauucucaguguag

SEQ ID NO: 1766557 - RNA, 18 nt, Homo sapiens
ucuugucaacaugcauug

SEQ ID NO: 1766558 - RNA, 15 nt, Homo sapiens
aauaaauuaugagcu

SEQ ID NO: 1766559 - RNA, 18 nt, Homo sapiens
guggccacguucagggag

SEQ ID NO: 1766560 - RNA, 17 nt, Homo sapiens
aauucuguaucuguaga

SEQ ID NO: 1766561 - RNA, 20 nt, Homo sapiens
aggaaaaguccacaagaaca

SEQ ID NO: 1766562 - RNA, 14 nt, Homo sapiens
aggaauauagucag

SEQ ID NO: 1766563 - RNA, 17 nt, Homo sapiens
ugagccaagauugcacc

SEQ ID NO: 1766564 - RNA, 14 nt, Homo sapiens
gauaaaguaguaaa

SEQ ID NO: 1766565 - RNA, 14 nt, Homo sapiens
gccuccgucaucca

SEQ ID NO: 1766566 - RNA, 14 nt, Homo sapiens
caaagaugacuggu

SEQ ID NO: 1766567 - RNA, 18 nt, Homo sapiens
cuccacucagguucuuca

SEQ ID NO: 1766568 - RNA, 18 nt, Homo sapiens
ugcgcucaccucagagca

SEQ ID NO: 1766569 - RNA, 15 nt, Homo sapiens
ggcucugaggcugca

SEQ ID NO: 1766570 - RNA, 13 nt, Homo sapiens
agugaggccauag

SEQ ID NO: 1766571 - RNA, 13 nt, Homo sapiens
ggggugagggagu

SEQ ID NO: 1766572 - RNA, 18 nt, Homo sapiens
gcuucuuaaucuuuucac

SEQ ID NO: 1766573 - RNA, 12 nt, Homo sapiens
acuguagaugau

SEQ ID NO: 1766574 - RNA, 22 nt, Homo sapiens
guuuucccugaaguuaugugua

SEQ ID NO: 1766575 - RNA, 12 nt, Homo sapiens
aacaacauaucu

SEQ ID NO: 1766576 - RNA, 12 nt, Homo sapiens
gauuacauguua

SEQ ID NO: 1766577 - RNA, 20 nt, Homo sapiens
uccuggagaaggcauuccag

SEQ ID NO: 1766578 - RNA, 17 nt, Homo sapiens
gaaccaagaagggcuag

SEQ ID NO: 1766579 - RNA, 15 nt, Homo sapiens
uauuuaaaacauuuc

SEQ ID NO: 1766580 - RNA, 12 nt, Homo sapiens
uuacacugcgga

SEQ ID NO: 1766581 - RNA, 12 nt, Homo sapiens
ugcucacagugu

SEQ ID NO: 1766582 - RNA, 12 nt, Homo sapiens
ugcacacaguga

SEQ ID NO: 1766583 - RNA, 14 nt, Homo sapiens
cagccuccucagua

SEQ ID NO: 1766584 - RNA, 13 nt, Homo sapiens
cuguuaauaguca

SEQ ID NO: 1766585 - RNA, 22 nt, Homo sapiens
gcucaaucucagcuaacauucc

SEQ ID NO: 1766586 - RNA, 12 nt, Homo sapiens
cucuaaugagcu

SEQ ID NO: 1766587 - RNA, 16 nt, Homo sapiens
aaccccuggggaccau

SEQ ID NO: 1766588 - RNA, 20 nt, Homo sapiens
uguuacacaugacacucuuc

SEQ ID NO: 1766589 - RNA, 15 nt, Homo sapiens
uuccuuaaguauuau

SEQ ID NO: 1766590 - RNA, 19 nt, Homo sapiens
ccugggugcaggacacugg

SEQ ID NO: 1766591 - RNA, 22 nt, Homo sapiens
gcuggcagaugcuuuacaguca

SEQ ID NO: 1766592 - RNA, 20 nt, Homo sapiens
aucugucuagaauccugcuu

SEQ ID NO: 1766593 - RNA, 14 nt, Homo sapiens
gcuguaaaauggaa

SEQ ID NO: 1766594 - RNA, 15 nt, Homo sapiens
auguaugaguggcuu

SEQ ID NO: 1766595 - RNA, 19 nt, Homo sapiens
uugcacaaggaaauaaagc

SEQ ID NO: 1766596 - RNA, 15 nt, Homo sapiens
ccuuuccaauuccaa

SEQ ID NO: 1766597 - RNA, 13 nt, Homo sapiens
uugacuugccacu

SEQ ID NO: 1766598 - RNA, 22 nt, Homo sapiens
gggcuagggagaaugcagagag

SEQ ID NO: 1766599 - RNA, 14 nt, Homo sapiens
uuaaaaacacugcu

SEQ ID NO: 1766600 - RNA, 22 nt, Homo sapiens
caucucuuguaaauacaugucc

SEQ ID NO: 1766601 - RNA, 20 nt, Homo sapiens
gcacaagacuggcccagugc

SEQ ID NO: 1766602 - RNA, 12 nt, Homo sapiens
cuucucagggac

SEQ ID NO: 1766603 - RNA, 20 nt, Homo sapiens
ccgcccuaaaagcacacuca

SEQ ID NO: 1766604 - RNA, 19 nt, Homo sapiens
gcucacaaaccaugcaaau

SEQ ID NO: 1766605 - RNA, 16 nt, Homo sapiens
ucuuuaucuccuggga

SEQ ID NO: 1766606 - RNA, 15 nt, Homo sapiens
uggggacauugcucu

SEQ ID NO: 1766607 - RNA, 22 nt, Homo sapiens
cagauuaugagagcaucagagu

SEQ ID NO: 1766608 - RNA, 14 nt, Homo sapiens
gacaugcacuauga

SEQ ID NO: 1766609 - RNA, 16 nt, Homo sapiens
cuccuguuccauuuca

SEQ ID NO: 1766610 - RNA, 14 nt, Homo sapiens
aaaauuguuauuuc

SEQ ID NO: 1766611 - RNA, 16 nt, Homo sapiens
aggucugaaucuucac

SEQ ID NO: 1766612 - RNA, 22 nt, Homo sapiens
acacauuuacacuagaggccag

SEQ ID NO: 1766613 - RNA, 19 nt, Homo sapiens
cuuugggccagacaugcca

SEQ ID NO: 1766614 - RNA, 19 nt, Homo sapiens
uuguaggacaacuuugaau

SEQ ID NO: 1766615 - RNA, 21 nt, Homo sapiens
acauaaauuacuuuuucauuc

SEQ ID NO: 1766616 - RNA, 22 nt, Homo sapiens
ucacugucuauuuaagugcaau

SEQ ID NO: 1766617 - RNA, 12 nt, Homo sapiens
aaacagcagcug

SEQ ID NO: 1766618 - RNA, 22 nt, Homo sapiens
uggccuuuagcaaaacuggaca

SEQ ID NO: 1766619 - RNA, 21 nt, Homo sapiens
uguucacacuguaaacauuca

SEQ ID NO: 1766620 - RNA, 13 nt, Homo sapiens
guaagaaguaaua

SEQ ID NO: 1766621 - RNA, 14 nt, Homo sapiens
gcuggcugugacaa

SEQ ID NO: 1766622 - RNA, 20 nt, Homo sapiens
gcugggacuucuuacccaaa

SEQ ID NO: 1766623 - RNA, 14 nt, Homo sapiens
gcugaagucucccc

SEQ ID NO: 1766624 - RNA, 21 nt, Homo sapiens
ugcuaauaaaugaccaguuua

SEQ ID NO: 1766625 - RNA, 22 nt, Homo sapiens
agccaauaggcagcuuucuuaa

SEQ ID NO: 1766626 - RNA, 14 nt, Homo sapiens
acggugggcauuug

SEQ ID NO: 1766627 - RNA, 14 nt, Homo sapiens
ugcucucaugccug

SEQ ID NO: 1766628 - RNA, 17 nt, Homo sapiens
cugcggcagcucuggua

SEQ ID NO: 1766629 - RNA, 19 nt, Homo sapiens
uugagucuccauagaguaa

SEQ ID NO: 1766630 - RNA, 21 nt, Homo sapiens
uaacccccaguucaagacuua

SEQ ID NO: 1766631 - RNA, 21 nt, Homo sapiens
caggugcagccagaggcaccu

SEQ ID NO: 1766632 - RNA, 15 nt, Homo sapiens
gugcagggcacagaa

SEQ ID NO: 1766633 - RNA, 21 nt, Homo sapiens
acaaugcccugcuggccuguc

SEQ ID NO: 1766634 - RNA, 20 nt, Homo sapiens
ucaguguuauaaaaucugua

SEQ ID NO: 1766635 - RNA, 21 nt, Homo sapiens
uucacauacaaaucauccauc

SEQ ID NO: 1766636 - RNA, 17 nt, Homo sapiens
aacugcggugaugaugu

SEQ ID NO: 1766637 - RNA, 21 nt, Homo sapiens
cugaggcccagaaagaggcag

SEQ ID NO: 1766638 - RNA, 22 nt, Homo sapiens
ucaaagugggguacaguaaaga

SEQ ID NO: 1766639 - RNA, 14 nt, Homo sapiens
ugagacaggcaguu

SEQ ID NO: 1766640 - RNA, 13 nt, Homo sapiens
cgccugagcucac

SEQ ID NO: 1766641 - RNA, 21 nt, Homo sapiens
aaagggugacuuuucaucuga

SEQ ID NO: 1766642 - RNA, 19 nt, Homo sapiens
auugaagcauguacaaauu

SEQ ID NO: 1766643 - RNA, 19 nt, Homo sapiens
agguaggggcacagugaau

SEQ ID NO: 1766644 - RNA, 12 nt, Homo sapiens
cugccuccucau

SEQ ID NO: 1766645 - RNA, 15 nt, Homo sapiens
uaaaugaccaaagau

SEQ ID NO: 1766646 - RNA, 18 nt, Homo sapiens
uggagacccugcaaacag

SEQ ID NO: 1766647 - RNA, 22 nt, Homo sapiens
uuugaccuuucuagguucaaaa

SEQ ID NO: 1766648 - RNA, 14 nt, Homo sapiens
ucaagaaaauggau

SEQ ID NO: 1766649 - RNA, 20 nt, Homo sapiens
acucagccgcagacaaguaa

SEQ ID NO: 1766650 - RNA, 22 nt, Homo sapiens
uguaaaggaaauaauugccaaa

SEQ ID NO: 1766651 - RNA, 16 nt, Homo sapiens
ugccccucaugccaac

SEQ ID NO: 1766652 - RNA, 14 nt, Homo sapiens
ugggaaaggugcuc

SEQ ID NO: 1766653 - RNA, 17 nt, Homo sapiens
gucugcuguuccagugg

SEQ ID NO: 1766654 - RNA, 19 nt, Homo sapiens
uuguucauccuauuguuga

SEQ ID NO: 1766655 - RNA, 20 nt, Homo sapiens
aaagaaugagcauugagacg

SEQ ID NO: 1766656 - RNA, 13 nt, Homo sapiens
cuugguugccagu

SEQ ID NO: 1766657 - RNA, 19 nt, Homo sapiens
cuguguguuacaaugauau

SEQ ID NO: 1766658 - RNA, 19 nt, Homo sapiens
gcagggcaaaugacaugca

SEQ ID NO: 1766659 - RNA, 22 nt, Homo sapiens
cuauaauuguauauaugccuuu

SEQ ID NO: 1766660 - RNA, 17 nt, Homo sapiens
acuuguaguuccacuua

SEQ ID NO: 1766661 - RNA, 23 nt, Homo sapiens
agccaccuagcccuaucaagcca

SEQ ID NO: 1766662 - RNA, 15 nt, Homo sapiens
aggaggugccugaga

SEQ ID NO: 1766663 - RNA, 23 nt, Homo sapiens
auguuaugugacuaucuuuauga

SEQ ID NO: 1766664 - RNA, 14 nt, Homo sapiens
aauaacaggcauuu

SEQ ID NO: 1766665 - RNA, 15 nt, Homo sapiens
uucgaguccaggaca

SEQ ID NO: 1766666 - RNA, 13 nt, Homo sapiens
gggguugcugaag

SEQ ID NO: 1766667 - RNA, 19 nt, Homo sapiens
gaugccagcauauacugaa

SEQ ID NO: 1766668 - RNA, 22 nt, Homo sapiens
gacaagccaggcccucucugca

SEQ ID NO: 1766669 - RNA, 22 nt, Homo sapiens
aaaauggagggagccaucccuu

SEQ ID NO: 1766670 - RNA, 18 nt, Homo sapiens
gaguaauaguaaacacag

SEQ ID NO: 1766671 - RNA, 13 nt, Homo sapiens
cuccucugugaaa

SEQ ID NO: 1766672 - RNA, 19 nt, Homo sapiens
augcuuuuacuaagcacug

SEQ ID NO: 1766673 - RNA, 18 nt, Homo sapiens
auuugcucuuucaucucu

SEQ ID NO: 1766674 - RNA, 14 nt, Homo sapiens
uuacuugacagggu

SEQ ID NO: 1766675 - RNA, 16 nt, Homo sapiens
uuuacuuccaugauac

SEQ ID NO: 1766676 - RNA, 20 nt, Homo sapiens
ugaguccuuaauucugccua

SEQ ID NO: 1766677 - RNA, 22 nt, Homo sapiens
uccuagaugccaaagggguucc

SEQ ID NO: 1766678 - RNA, 18 nt, Homo sapiens
cucagaucaguguaccau

SEQ ID NO: 1766679 - RNA, 16 nt, Homo sapiens
ggacuuaaacugcuga

SEQ ID NO: 1766680 - RNA, 17 nt, Homo sapiens
gagacguggaaccucug

SEQ ID NO: 1766681 - RNA, 23 nt, Homo sapiens
acuaucugugcguagaaguucua

SEQ ID NO: 1766682 - RNA, 12 nt, Homo sapiens
uacaucuccaaa

SEQ ID NO: 1766683 - RNA, 23 nt, Homo sapiens
acugaaugagaaccaacaaguaa

SEQ ID NO: 1766684 - RNA, 15 nt, Homo sapiens
acaagagaucuacac

SEQ ID NO: 1766685 - RNA, 22 nt, Homo sapiens
uagauauaacacuauguuuauu

SEQ ID NO: 1766686 - RNA, 20 nt, Homo sapiens
aaaauuaacugcuaacuucu

SEQ ID NO: 1766687 - RNA, 18 nt, Homo sapiens
gucauaggggacugagga

SEQ ID NO: 1766688 - RNA, 18 nt, Homo sapiens
agugucuccccguguccu

SEQ ID NO: 1766689 - RNA, 11 nt, Homo sapiens
uaaaugaucau

SEQ ID NO: 1766690 - RNA, 12 nt, Homo sapiens
cuugucaaggaa

SEQ ID NO: 1766691 - RNA, 14 nt, Homo sapiens
agaugguuaaguca

SEQ ID NO: 1766692 - RNA, 14 nt, Homo sapiens
agauguuuauuuca

SEQ ID NO: 1766693 - RNA, 18 nt, Homo sapiens
auucugugucaaacaccu

SEQ ID NO: 1766694 - RNA, 20 nt, Homo sapiens
gcuuauucaggaugguuucu

SEQ ID NO: 1766695 - RNA, 14 nt, Homo sapiens
gucauuauguuaau

SEQ ID NO: 1766696 - RNA, 20 nt, Homo sapiens
agguaucuuuuuuaaaugaa

SEQ ID NO: 1766697 - RNA, 21 nt, Homo sapiens
ucaaagauguacugagaggag

SEQ ID NO: 1766698 - RNA, 13 nt, Homo sapiens
uggcuguguccuc

SEQ ID NO: 1766699 - RNA, 16 nt, Homo sapiens
gccuuaacacacuggc

SEQ ID NO: 1766700 - RNA, 21 nt, Homo sapiens
aggcugaggugguaggaucac

SEQ ID NO: 1766701 - RNA, 17 nt, Homo sapiens
uuuaaaguauucuccau

SEQ ID NO: 1766702 - RNA, 13 nt, Homo sapiens
gaagcuuccauaa

SEQ ID NO: 1766703 - RNA, 20 nt, Homo sapiens
augccacguggucacugugc

SEQ ID NO: 1766704 - RNA, 16 nt, Homo sapiens
aacaaggaaggacauu

SEQ ID NO: 1766705 - RNA, 12 nt, Homo sapiens
auggccaaagca

SEQ ID NO: 1766706 - RNA, 12 nt, Homo sapiens
ucugugugcuga

SEQ ID NO: 1766707 - RNA, 19 nt, Homo sapiens
acaguuauagaaagcaaga

SEQ ID NO: 1766708 - RNA, 22 nt, Homo sapiens
cauucagucugcagcuauucac

SEQ ID NO: 1766709 - RNA, 16 nt, Homo sapiens
ugggagaugcucucug

SEQ ID NO: 1766710 - RNA, 16 nt, Homo sapiens
gccuuccccuggcacu

SEQ ID NO: 1766711 - RNA, 16 nt, Homo sapiens
gguauuagccaagcug

SEQ ID NO: 1766712 - RNA, 12 nt, Homo sapiens
aauauacaugua

SEQ ID NO: 1766713 - RNA, 20 nt, Homo sapiens
caccuuccuaauaugcuuua

SEQ ID NO: 1766714 - RNA, 13 nt, Homo sapiens
acauguguauauu

SEQ ID NO: 1766715 - RNA, 20 nt, Homo sapiens
aaauaagauuuaauucacau

SEQ ID NO: 1766716 - RNA, 18 nt, Homo sapiens
auuucucuucaguguguu

SEQ ID NO: 1766717 - RNA, 14 nt, Homo sapiens
caccagcccugaag

SEQ ID NO: 1766718 - RNA, 13 nt, Homo sapiens
aacaaagaagaca

SEQ ID NO: 1766719 - RNA, 13 nt, Homo sapiens
ccuaacaaaagau

SEQ ID NO: 1766720 - RNA, 17 nt, Homo sapiens
aucuuuagcaguacccu

SEQ ID NO: 1766721 - RNA, 19 nt, Homo sapiens
ugccccccacucugcacag

SEQ ID NO: 1766722 - RNA, 18 nt, Homo sapiens
auucaagguugguucaac

SEQ ID NO: 1766723 - RNA, 13 nt, Homo sapiens
agagaguggcucc

SEQ ID NO: 1766724 - RNA, 22 nt, Homo sapiens
agagaaaauugugaaagugacu

SEQ ID NO: 1766725 - RNA, 13 nt, Homo sapiens
cacaacauucugg

SEQ ID NO: 1766726 - RNA, 23 nt, Homo sapiens
gccaccugcaggucacugaaacu

SEQ ID NO: 1766727 - RNA, 18 nt, Homo sapiens
gcacauagcuaucaagug

SEQ ID NO: 1766728 - RNA, 15 nt, Homo sapiens
ucagugcaccugccu

SEQ ID NO: 1766729 - RNA, 17 nt, Homo sapiens
acccaacugacuuguau

SEQ ID NO: 1766730 - RNA, 17 nt, Homo sapiens
ccauaggugagauucaa

SEQ ID NO: 1766731 - RNA, 13 nt, Homo sapiens
gcauucccaugag

SEQ ID NO: 1766732 - RNA, 12 nt, Homo sapiens
acagcucugggc

SEQ ID NO: 1766733 - RNA, 19 nt, Homo sapiens
cuguggucugugugugaca

SEQ ID NO: 1766734 - RNA, 15 nt, Homo sapiens
uucagauguggcaau

SEQ ID NO: 1766735 - RNA, 23 nt, Homo sapiens
ucauguaaguuuaauuaucugca

SEQ ID NO: 1766736 - RNA, 18 nt, Homo sapiens
accccugauaagcaaauu

SEQ ID NO: 1766737 - RNA, 19 nt, Homo sapiens
caggaagggagaacuugaa

SEQ ID NO: 1766738 - RNA, 15 nt, Homo sapiens
caccacgcccggcua

SEQ ID NO: 1766739 - RNA, 18 nt, Homo sapiens
ugaggaaagcacacaguc

SEQ ID NO: 1766740 - RNA, 18 nt, Homo sapiens
gaagaaaguaaacuguaa

SEQ ID NO: 1766741 - RNA, 22 nt, Homo sapiens
gugaguuuuacucuuaaaucau

SEQ ID NO: 1766742 - RNA, 16 nt, Homo sapiens
cuagacaguauugcca

SEQ ID NO: 1766743 - RNA, 20 nt, Homo sapiens
guucacuucuaaaccaaaaa

SEQ ID NO: 1766744 - RNA, 17 nt, Homo sapiens
uguauuuuagacuuccu

SEQ ID NO: 1766745 - RNA, 18 nt, Homo sapiens
cuucuacgggauggccag

SEQ ID NO: 1766746 - RNA, 17 nt, Homo sapiens
ugcugcuuuaacagugg

SEQ ID NO: 1766747 - RNA, 18 nt, Homo sapiens
cccauguccucagcauuu

SEQ ID NO: 1766748 - RNA, 18 nt, Homo sapiens
auuuuguuacuugcacuu

SEQ ID NO: 1766749 - RNA, 19 nt, Homo sapiens
gauaugcacaauguagaua

SEQ ID NO: 1766750 - RNA, 20 nt, Homo sapiens
cagucuggccacugucaagg

SEQ ID NO: 1766751 - RNA, 20 nt, Homo sapiens
uuagagcuggcaccagaacu

SEQ ID NO: 1766752 - RNA, 18 nt, Homo sapiens
aaaauacugccagaugcu

SEQ ID NO: 1766753 - RNA, 16 nt, Homo sapiens
ucacuugaaccuggga

SEQ ID NO: 1766754 - RNA, 23 nt, Homo sapiens
cagugcucggcuguaaacagcuc

SEQ ID NO: 1766755 - RNA, 15 nt, Homo sapiens
gggguggggagcaug

SEQ ID NO: 1766756 - RNA, 16 nt, Homo sapiens
uuagaacugauuacau

SEQ ID NO: 1766757 - RNA, 17 nt, Homo sapiens
aggagggagcugcucag

SEQ ID NO: 1766758 - RNA, 21 nt, Homo sapiens
acuaucauugcccucuucaag

SEQ ID NO: 1766759 - RNA, 16 nt, Homo sapiens
gucugggccacucagg

SEQ ID NO: 1766760 - RNA, 21 nt, Homo sapiens
uuuuuucacucauagccacuu

SEQ ID NO: 1766761 - RNA, 19 nt, Homo sapiens
accucaagggacagggaau

SEQ ID NO: 1766762 - RNA, 18 nt, Homo sapiens
agaagcaaaaucuaccag

SEQ ID NO: 1766763 - RNA, 16 nt, Homo sapiens
aagccuaaaugccuua

SEQ ID NO: 1766764 - RNA, 21 nt, Homo sapiens
uacaaccauauaaaugaaggc

SEQ ID NO: 1766765 - RNA, 20 nt, Homo sapiens
aguauauucuuugguuguga

SEQ ID NO: 1766766 - RNA, 21 nt, Homo sapiens
gaauauaguucuguguagaga

SEQ ID NO: 1766767 - RNA, 19 nt, Homo sapiens
auggacagaaugugucuca

SEQ ID NO: 1766768 - RNA, 13 nt, Homo sapiens
cgacauaccccac

SEQ ID NO: 1766769 - RNA, 19 nt, Homo sapiens
gacuucccaacagccuuag

SEQ ID NO: 1766770 - RNA, 21 nt, Homo sapiens
ggcagucuuuugugucagugu

SEQ ID NO: 1766771 - RNA, 18 nt, Homo sapiens
auuuguuaaaauuaucaa

SEQ ID NO: 1766772 - RNA, 20 nt, Homo sapiens
acuaaagaaggugugggcca

SEQ ID NO: 1766773 - RNA, 18 nt, Homo sapiens
cauaauguuaagcuuuau

SEQ ID NO: 1766774 - RNA, 13 nt, Homo sapiens
cauuaaaagcuac

SEQ ID NO: 1766775 - RNA, 22 nt, Homo sapiens
cacauaagggagauuguauaca

SEQ ID NO: 1766776 - RNA, 21 nt, Homo sapiens
uggaccaggaggauugccuuu

SEQ ID NO: 1766777 - RNA, 17 nt, Homo sapiens
guguacaacuccacgag

SEQ ID NO: 1766778 - RNA, 21 nt, Homo sapiens
cugcaguagucucugugcuuu

SEQ ID NO: 1766779 - RNA, 19 nt, Homo sapiens
ugucacgcaggcugagugc

SEQ ID NO: 1766780 - RNA, 16 nt, Homo sapiens
acucuuaaguuucuca

SEQ ID NO: 1766781 - RNA, 23 nt, Homo sapiens
gaaaaaugcugcuucuccuccca

SEQ ID NO: 1766782 - RNA, 14 nt, Homo sapiens
guaacaagccagau

SEQ ID NO: 1766783 - RNA, 21 nt, Homo sapiens
guaucagaucuaucuugucaa

SEQ ID NO: 1766784 - RNA, 23 nt, Homo sapiens
accccuagagacagugaugccug

SEQ ID NO: 1766785 - RNA, 19 nt, Homo sapiens
cggcucccaccggugccaa

SEQ ID NO: 1766786 - RNA, 20 nt, Homo sapiens
uggaacaguguuuacuuuaa

SEQ ID NO: 1766787 - RNA, 22 nt, Homo sapiens
uuuguauauuuguaaacuacaa

SEQ ID NO: 1766788 - RNA, 17 nt, Homo sapiens
aggaaacaacagcuuua

SEQ ID NO: 1766789 - RNA, 14 nt, Homo sapiens
ucccuuguaaauag

SEQ ID NO: 1766790 - RNA, 21 nt, Homo sapiens
accacgugagaucauucacuc

SEQ ID NO: 1766791 - RNA, 15 nt, Homo sapiens
acgaggcucaaaaac

SEQ ID NO: 1766792 - RNA, 18 nt, Homo sapiens
aacugaggaguagcugag

SEQ ID NO: 1766793 - RNA, 13 nt, Homo sapiens
uggacaagguguc

SEQ ID NO: 1766794 - RNA, 14 nt, Homo sapiens
aggaauccagugaa

SEQ ID NO: 1766795 - RNA, 14 nt, Homo sapiens
aguugaggacuucu

SEQ ID NO: 1766796 - RNA, 15 nt, Homo sapiens
ugagauuucacaggu

SEQ ID NO: 1766797 - RNA, 24 nt, Homo sapiens
ucuccauacucuguaacaguugca

SEQ ID NO: 1766798 - RNA, 18 nt, Homo sapiens
agacugcagcugcugaag

SEQ ID NO: 1766799 - RNA, 14 nt, Homo sapiens
aggccuuucccuaa

SEQ ID NO: 1766800 - RNA, 15 nt, Homo sapiens
cuaguuaacauuuca

SEQ ID NO: 1766801 - RNA, 16 nt, Homo sapiens
ugcuguccugcccugg

SEQ ID NO: 1766802 - RNA, 19 nt, Homo sapiens
aaacaacccaacccacgag

SEQ ID NO: 1766803 - RNA, 16 nt, Homo sapiens
cugagcugcuaaaaua

SEQ ID NO: 1766804 - RNA, 19 nt, Homo sapiens
auggcaggagcuacugaga

SEQ ID NO: 1766805 - RNA, 22 nt, Homo sapiens
uauaaucaucaaguaauacaaa

SEQ ID NO: 1766806 - RNA, 17 nt, Homo sapiens
accugaagacugaggac

SEQ ID NO: 1766807 - RNA, 18 nt, Homo sapiens
uaguuuauuuacucacuu

SEQ ID NO: 1766808 - RNA, 19 nt, Homo sapiens
cuggggucacaugcuuugu

SEQ ID NO: 1766809 - RNA, 14 nt, Homo sapiens
uuauuucugaucua

SEQ ID NO: 1766810 - RNA, 22 nt, Homo sapiens
guauuuucaucaaguagcguug

SEQ ID NO: 1766811 - RNA, 17 nt, Homo sapiens
gagauuuuugauaucuc

SEQ ID NO: 1766812 - RNA, 16 nt, Homo sapiens
aaggggauacuguaau

SEQ ID NO: 1766813 - RNA, 17 nt, Homo sapiens
guaccacguggguccuc

SEQ ID NO: 1766814 - RNA, 20 nt, Homo sapiens
auccucaauucaucaauaug

SEQ ID NO: 1766815 - RNA, 19 nt, Homo sapiens
uuuaagaacaaacucugaa

SEQ ID NO: 1766816 - RNA, 16 nt, Homo sapiens
uacaaucguucugugu

SEQ ID NO: 1766817 - RNA, 13 nt, Homo sapiens
ucaaaacugccau

SEQ ID NO: 1766818 - RNA, 19 nt, Homo sapiens
aguuccuucuauacauguu

SEQ ID NO: 1766819 - RNA, 18 nt, Homo sapiens
gagauauguguguguuug

SEQ ID NO: 1766820 - RNA, 15 nt, Homo sapiens
cgaguuacagacaaa

SEQ ID NO: 1766821 - RNA, 23 nt, Homo sapiens
acaaguacaucacccagugguau

SEQ ID NO: 1766822 - RNA, 17 nt, Homo sapiens
ucuccccaggcauuugc

SEQ ID NO: 1766823 - RNA, 17 nt, Homo sapiens
acacuguggcagcagga

SEQ ID NO: 1766824 - RNA, 19 nt, Homo sapiens
guguaaagaauaaaugaau

SEQ ID NO: 1766825 - RNA, 22 nt, Homo sapiens
agaaucuguauucagacccugg

SEQ ID NO: 1766826 - RNA, 18 nt, Homo sapiens
cccuguggcccuggccac

SEQ ID NO: 1766827 - RNA, 18 nt, Homo sapiens
uuuagaaagaauauucau

SEQ ID NO: 1766828 - RNA, 18 nt, Homo sapiens
gauaauaaucaugaucac

SEQ ID NO: 1766829 - RNA, 22 nt, Homo sapiens
cguuucuccaccuagacuguaa

SEQ ID NO: 1766830 - RNA, 18 nt, Homo sapiens
ugaucagaucugacauga

SEQ ID NO: 1766831 - RNA, 15 nt, Homo sapiens
uuaaugucagugaca

SEQ ID NO: 1766832 - RNA, 23 nt, Homo sapiens
guucucugauuuguaaugagcac

SEQ ID NO: 1766833 - RNA, 17 nt, Homo sapiens
cccuggccucacgccca

SEQ ID NO: 1766834 - RNA, 22 nt, Homo sapiens
ucaccuuggcaccagacaccca

SEQ ID NO: 1766835 - RNA, 20 nt, Homo sapiens
ucccaugugagucccuguga

SEQ ID NO: 1766836 - RNA, 20 nt, Homo sapiens
ugauggcucauuuacacuca

SEQ ID NO: 1766837 - RNA, 19 nt, Homo sapiens
aaauauauaucacucuaga

SEQ ID NO: 1766838 - RNA, 23 nt, Homo sapiens
uuccaugucagauaaguguaaau

SEQ ID NO: 1766839 - RNA, 14 nt, Homo sapiens
aaugagacuuacuu

SEQ ID NO: 1766840 - RNA, 20 nt, Homo sapiens
ccagggcagggucugggcug

SEQ ID NO: 1766841 - RNA, 21 nt, Homo sapiens
cuaucuccagcggcccuguca

SEQ ID NO: 1766842 - RNA, 15 nt, Homo sapiens
cgcucaucuugcaaa

SEQ ID NO: 1766843 - RNA, 22 nt, Homo sapiens
cugaagcaggagaaucacuuga

SEQ ID NO: 1766844 - RNA, 17 nt, Homo sapiens
aaaaugucccaguguca

SEQ ID NO: 1766845 - RNA, 17 nt, Homo sapiens
agucucuucugcuggca

SEQ ID NO: 1766846 - RNA, 20 nt, Homo sapiens
caaucacaaaagguucuucu

SEQ ID NO: 1766847 - RNA, 20 nt, Homo sapiens
gucggaacccaagcuuagaa

SEQ ID NO: 1766848 - RNA, 14 nt, Homo sapiens
cuuucauauaguua

SEQ ID NO: 1766849 - RNA, 23 nt, Homo sapiens
cccucuuccuacuggucucucua

SEQ ID NO: 1766850 - RNA, 23 nt, Homo sapiens
gcccuguccccuacccccaguaa

SEQ ID NO: 1766851 - RNA, 20 nt, Homo sapiens
gcccuagugagggcagaaga

SEQ ID NO: 1766852 - RNA, 18 nt, Homo sapiens
guuuaaaaaaaguauaua

SEQ ID NO: 1766853 - RNA, 18 nt, Homo sapiens
ucuuuuaagcuaucuaua

SEQ ID NO: 1766854 - RNA, 14 nt, Homo sapiens
gugaccaacugugu

SEQ ID NO: 1766855 - RNA, 15 nt, Homo sapiens
auggcccaaauccag

SEQ ID NO: 1766856 - RNA, 21 nt, Homo sapiens
gagccgggccgcagacuugac

SEQ ID NO: 1766857 - RNA, 20 nt, Homo sapiens
auucccaggaguucugcuca

SEQ ID NO: 1766858 - RNA, 21 nt, Homo sapiens
agacaucauguaucgcauauu

SEQ ID NO: 1766859 - RNA, 21 nt, Homo sapiens
ugcugugacaagccaauguga

SEQ ID NO: 1766860 - RNA, 15 nt, Homo sapiens
ccaaucagcacugaa

SEQ ID NO: 1766861 - RNA, 13 nt, Homo sapiens
ccucagagugcaa

SEQ ID NO: 1766862 - RNA, 22 nt, Homo sapiens
uacagaaaauuugcaacauaua

SEQ ID NO: 1766863 - RNA, 15 nt, Homo sapiens
acuugccuugugaua

SEQ ID NO: 1766864 - RNA, 12 nt, Homo sapiens
uucccauucucc

SEQ ID NO: 1766865 - RNA, 12 nt, Homo sapiens
ccaucauuucau

SEQ ID NO: 1766866 - RNA, 15 nt, Homo sapiens
cgagguuugcaaauc

SEQ ID NO: 1766867 - RNA, 17 nt, Homo sapiens
uauggauugaaggauug

SEQ ID NO: 1766868 - RNA, 19 nt, Homo sapiens
ugaccagccuugacacucc

SEQ ID NO: 1766869 - RNA, 15 nt, Homo sapiens
gaauguuaagcagau

SEQ ID NO: 1766870 - RNA, 22 nt, Homo sapiens
uacccuuuggccccacuuugaa

SEQ ID NO: 1766871 - RNA, 17 nt, Homo sapiens
cucccaggaaccaaaaa

SEQ ID NO: 1766872 - RNA, 14 nt, Homo sapiens
cacgccuccugcca

SEQ ID NO: 1766873 - RNA, 16 nt, Homo sapiens
ccccuaagucaacuua

SEQ ID NO: 1766874 - RNA, 16 nt, Homo sapiens
aaggacuaugacaaau

SEQ ID NO: 1766875 - RNA, 16 nt, Homo sapiens
ccaagguaaacaguuu

SEQ ID NO: 1766876 - RNA, 13 nt, Homo sapiens
uuggaaugaagga

SEQ ID NO: 1766877 - RNA, 18 nt, Homo sapiens
auagcauugcuuucgugu

SEQ ID NO: 1766878 - RNA, 18 nt, Homo sapiens
gugcugagugagcuggug

SEQ ID NO: 1766879 - RNA, 20 nt, Homo sapiens
agaccaaguuaucaucucac

SEQ ID NO: 1766880 - RNA, 16 nt, Homo sapiens
acuguauacauuacaa

SEQ ID NO: 1766881 - RNA, 12 nt, Homo sapiens
gaaaaauaauca

SEQ ID NO: 1766882 - RNA, 12 nt, Homo sapiens
uuuguuugaaaa

SEQ ID NO: 1766883 - RNA, 22 nt, Homo sapiens
aggucaggugccucccagcccu

SEQ ID NO: 1766884 - RNA, 11 nt, Homo sapiens
ugcuugcugaa

SEQ ID NO: 1766885 - RNA, 21 nt, Homo sapiens
ugcaugcgagugcucauuuca

SEQ ID NO: 1766886 - RNA, 16 nt, Homo sapiens
uacaguaacaaucugc

SEQ ID NO: 1766887 - RNA, 20 nt, Homo sapiens
gguuugacuuguuugugcau

SEQ ID NO: 1766888 - RNA, 18 nt, Homo sapiens
caaauucucuauguacag

SEQ ID NO: 1766889 - RNA, 17 nt, Homo sapiens
agccuggggaggccagg

SEQ ID NO: 1766890 - RNA, 21 nt, Homo sapiens
guccuccuuucuuauucugug

SEQ ID NO: 1766891 - RNA, 16 nt, Homo sapiens
caaccaaagaugcuua

SEQ ID NO: 1766892 - RNA, 14 nt, Homo sapiens
ucuugaauacucug

SEQ ID NO: 1766893 - RNA, 18 nt, Homo sapiens
aaucauuuggacaaucug

SEQ ID NO: 1766894 - RNA, 15 nt, Homo sapiens
gcccacagcaggugc

SEQ ID NO: 1766895 - RNA, 14 nt, Homo sapiens
uggaccaggccauu

SEQ ID NO: 1766896 - RNA, 18 nt, Homo sapiens
agccugcagacucacugu

SEQ ID NO: 1766897 - RNA, 19 nt, Homo sapiens
cacaugacuuuuccauuga

SEQ ID NO: 1766898 - RNA, 13 nt, Homo sapiens
gugagcucuggga

SEQ ID NO: 1766899 - RNA, 18 nt, Homo sapiens
aaggaugaacaguucucc

SEQ ID NO: 1766900 - RNA, 18 nt, Homo sapiens
cuggaacauuaguaguua

SEQ ID NO: 1766901 - RNA, 13 nt, Homo sapiens
uaaaaaggccuuu

SEQ ID NO: 1766902 - RNA, 14 nt, Homo sapiens
gaaaaguuagucaa

SEQ ID NO: 1766903 - RNA, 23 nt, Homo sapiens
ugaauuucuagacaguauugcca

SEQ ID NO: 1766904 - RNA, 13 nt, Homo sapiens
aguaguacuugaa

SEQ ID NO: 1766905 - RNA, 16 nt, Homo sapiens
acgcgcucugcaugcu

SEQ ID NO: 1766906 - RNA, 20 nt, Homo sapiens
gcacgcugcccaggggcuuc

SEQ ID NO: 1766907 - RNA, 19 nt, Homo sapiens
gcugaagccuggacgcagc

SEQ ID NO: 1766908 - RNA, 18 nt, Homo sapiens
uuuuacaaguaacaaaaa

SEQ ID NO: 1766909 - RNA, 13 nt, Homo sapiens
ugacaaauucugu

SEQ ID NO: 1766910 - RNA, 23 nt, Homo sapiens
cuagcccuuccagccugggacac

SEQ ID NO: 1766911 - RNA, 17 nt, Homo sapiens
guauuaaaauaucccaa

SEQ ID NO: 1766912 - RNA, 16 nt, Homo sapiens
caucuacaagcauuug

SEQ ID NO: 1766913 - RNA, 15 nt, Homo sapiens
agaaagccuucauaa

SEQ ID NO: 1766914 - RNA, 20 nt, Homo sapiens
ccuguaggucuaugaugucc

SEQ ID NO: 1766915 - RNA, 17 nt, Homo sapiens
uaucauaaaaaugagug

SEQ ID NO: 1766916 - RNA, 15 nt, Homo sapiens
gagccgagcucuccu

SEQ ID NO: 1766917 - RNA, 17 nt, Homo sapiens
agugcaacggcaugauu

SEQ ID NO: 1766918 - RNA, 23 nt, Homo sapiens
cuaucccccgcagcgcucuccuu

SEQ ID NO: 1766919 - RNA, 16 nt, Homo sapiens
gcaauauaagcauaaa

SEQ ID NO: 1766920 - RNA, 16 nt, Homo sapiens
agaaaauugccaaaau

SEQ ID NO: 1766921 - RNA, 18 nt, Homo sapiens
cauuugggacugucuuga

SEQ ID NO: 1766922 - RNA, 15 nt, Homo sapiens
uccuguguaacacuu

SEQ ID NO: 1766923 - RNA, 13 nt, Homo sapiens
aucuacacauguu

SEQ ID NO: 1766924 - RNA, 15 nt, Homo sapiens
uugugagccaccacg

SEQ ID NO: 1766925 - RNA, 13 nt, Homo sapiens
aaaauugcucccu

SEQ ID NO: 1766926 - RNA, 23 nt, Homo sapiens
gaggaauaagaauggagcaguac

SEQ ID NO: 1766927 - RNA, 12 nt, Homo sapiens
agcugaagugaa

SEQ ID NO: 1766928 - RNA, 17 nt, Homo sapiens
caagugauucuugugcc

SEQ ID NO: 1766929 - RNA, 21 nt, Homo sapiens
uaaacuuucucugcaaagacu

SEQ ID NO: 1766930 - RNA, 22 nt, Homo sapiens
gccugaguccuggucccucuga

SEQ ID NO: 1766931 - RNA, 18 nt, Homo sapiens
ccuacaaguuaaccaguu

SEQ ID NO: 1766932 - RNA, 19 nt, Homo sapiens
uuaucaacuucgcuagaaa

SEQ ID NO: 1766933 - RNA, 15 nt, Homo sapiens
cauuugccagauugc

SEQ ID NO: 1766934 - RNA, 18 nt, Homo sapiens
uuccuccagagacacuga

SEQ ID NO: 1766935 - RNA, 15 nt, Homo sapiens
gccugccuggugugc

SEQ ID NO: 1766936 - RNA, 13 nt, Homo sapiens
uggaccaaagcug

SEQ ID NO: 1766937 - RNA, 17 nt, Homo sapiens
uccaugugugugcaagu

SEQ ID NO: 1766938 - RNA, 17 nt, Homo sapiens
gcagggcccccacagga

SEQ ID NO: 1766939 - RNA, 20 nt, Homo sapiens
agcuuuaucugucuugacuu

SEQ ID NO: 1766940 - RNA, 19 nt, Homo sapiens
ggagaaagcccaagaguua

SEQ ID NO: 1766941 - RNA, 17 nt, Homo sapiens
ugcugggugccaggugc

SEQ ID NO: 1766942 - RNA, 11 nt, Homo sapiens
uaggaauuugu

SEQ ID NO: 1766943 - RNA, 20 nt, Homo sapiens
uugcaucuguuuugugaccu

SEQ ID NO: 1766944 - RNA, 15 nt, Homo sapiens
cacacucacagaugu

SEQ ID NO: 1766945 - RNA, 15 nt, Homo sapiens
uccccugaagacuua

SEQ ID NO: 1766946 - RNA, 18 nt, Homo sapiens
uuauaacccauauuuucc

SEQ ID NO: 1766947 - RNA, 16 nt, Homo sapiens
aguuaagucuaucugg

SEQ ID NO: 1766948 - RNA, 19 nt, Homo sapiens
ccaguuuucccucugggag

SEQ ID NO: 1766949 - RNA, 19 nt, Homo sapiens
ggaaaaguuagucaauccu

SEQ ID NO: 1766950 - RNA, 17 nt, Homo sapiens
uuugcaauaaugcagua

SEQ ID NO: 1766951 - RNA, 18 nt, Homo sapiens
aucuguacaugacuguau

SEQ ID NO: 1766952 - RNA, 19 nt, Homo sapiens
cuuuuggggcucuugauca

SEQ ID NO: 1766953 - RNA, 17 nt, Homo sapiens
accuggcuuuuacuuua

SEQ ID NO: 1766954 - RNA, 16 nt, Homo sapiens
cauggcacauaccaaa

SEQ ID NO: 1766955 - RNA, 17 nt, Homo sapiens
ggcccaagccuggucuc

SEQ ID NO: 1766956 - RNA, 15 nt, Homo sapiens
uccguuccuccucag

SEQ ID NO: 1766957 - RNA, 19 nt, Homo sapiens
aaaauuuaaaaaaacagac

SEQ ID NO: 1766958 - RNA, 14 nt, Homo sapiens
augaaaaucugcca

SEQ ID NO: 1766959 - RNA, 18 nt, Homo sapiens
cuaauauuaaaagucaca

SEQ ID NO: 1766960 - RNA, 13 nt, Homo sapiens
cucccucauuuaa

SEQ ID NO: 1766961 - RNA, 21 nt, Homo sapiens
cugcagucaacaguucaaaga

SEQ ID NO: 1766962 - RNA, 15 nt, Homo sapiens
augaaacaaacugga

SEQ ID NO: 1766963 - RNA, 14 nt, Homo sapiens
gcuggagugcagua

SEQ ID NO: 1766964 - RNA, 14 nt, Homo sapiens
gcaggggugcugug

SEQ ID NO: 1766965 - RNA, 18 nt, Homo sapiens
gaagaucaauuucuccca

SEQ ID NO: 1766966 - RNA, 19 nt, Homo sapiens
auuucaucuacuacagggu

SEQ ID NO: 1766967 - RNA, 18 nt, Homo sapiens
cauauugugccaauaugu

SEQ ID NO: 1766968 - RNA, 14 nt, Homo sapiens
uuugcuacauucua

SEQ ID NO: 1766969 - RNA, 21 nt, Homo sapiens
gcuuauuuaagaucacaguga

SEQ ID NO: 1766970 - RNA, 21 nt, Homo sapiens
gaaaucauucauuuucugggu

SEQ ID NO: 1766971 - RNA, 16 nt, Homo sapiens
auguaaauauacaaaa

SEQ ID NO: 1766972 - RNA, 17 nt, Homo sapiens
uucaaaugucagcuuaa

SEQ ID NO: 1766973 - RNA, 21 nt, Homo sapiens
cuagaguaauuaucugugaug

SEQ ID NO: 1766974 - RNA, 22 nt, Homo sapiens
uucugaugacaguguuauccca

SEQ ID NO: 1766975 - RNA, 19 nt, Homo sapiens
ugacauccaauacagaguu

SEQ ID NO: 1766976 - RNA, 18 nt, Homo sapiens
caacauuuuuguacauua

SEQ ID NO: 1766977 - RNA, 13 nt, Homo sapiens
uggcccacgcacu

SEQ ID NO: 1766978 - RNA, 16 nt, Homo sapiens
uucuucugcuauguga

SEQ ID NO: 1766979 - RNA, 23 nt, Homo sapiens
accugggcucauucuucuuggcu

SEQ ID NO: 1766980 - RNA, 20 nt, Homo sapiens
auuuaaugaaacccuaugga

SEQ ID NO: 1766981 - RNA, 16 nt, Homo sapiens
uguccaaguguuucuu

SEQ ID NO: 1766982 - RNA, 19 nt, Homo sapiens
ucuuuccuaaaccauucac

SEQ ID NO: 1766983 - RNA, 21 nt, Homo sapiens
aauucuagaggauguaucuca

SEQ ID NO: 1766984 - RNA, 11 nt, Homo sapiens
uuucuuugaag

SEQ ID NO: 1766985 - RNA, 16 nt, Homo sapiens
aauagacuaucuagaa

SEQ ID NO: 1766986 - RNA, 16 nt, Homo sapiens
agauguguauacagaa

SEQ ID NO: 1766987 - RNA, 19 nt, Homo sapiens
aacagucagaaccacuaau

SEQ ID NO: 1766988 - RNA, 15 nt, Homo sapiens
auuggcaucagcuga

SEQ ID NO: 1766989 - RNA, 12 nt, Homo sapiens
caacuacccacc

SEQ ID NO: 1766990 - RNA, 19 nt, Homo sapiens
ugucucacuucacagcccu

SEQ ID NO: 1766991 - RNA, 13 nt, Homo sapiens
acauuacauguaa

SEQ ID NO: 1766992 - RNA, 15 nt, Homo sapiens
cagagcacuguauac

SEQ ID NO: 1766993 - RNA, 20 nt, Homo sapiens
cuggugcagaugguugacau

SEQ ID NO: 1766994 - RNA, 22 nt, Homo sapiens
gaauuuuuuuguaauaagcaau

SEQ ID NO: 1766995 - RNA, 17 nt, Homo sapiens
aggaaggacuaugacaa

SEQ ID NO: 1766996 - RNA, 14 nt, Homo sapiens
cucauacaaugaua

SEQ ID NO: 1766997 - RNA, 17 nt, Homo sapiens
auuaagguuaugcacug

SEQ ID NO: 1766998 - RNA, 18 nt, Homo sapiens
gaggucaggaguugaaga

SEQ ID NO: 1766999 - RNA, 23 nt, Homo sapiens
auugaaugcauacucugugcaag

SEQ ID NO: 1767000 - RNA, 22 nt, Homo sapiens
ggacugcagcucccgaagccug

SEQ ID NO: 1767001 - RNA, 21 nt, Homo sapiens
auggagaauauaaacauauac

SEQ ID NO: 1767002 - RNA, 13 nt, Homo sapiens
gaacugucccaca

SEQ ID NO: 1767003 - RNA, 23 nt, Homo sapiens
aacuuagagcacuagaagcacag

SEQ ID NO: 1767004 - RNA, 20 nt, Homo sapiens
acaagauuugcugcauuucc

SEQ ID NO: 1767005 - RNA, 22 nt, Homo sapiens
caguagagcucuacugccucaa

SEQ ID NO: 1767006 - RNA, 19 nt, Homo sapiens
ggcacacgccucccacugg

SEQ ID NO: 1767007 - RNA, 21 nt, Homo sapiens
uguucauccucauugccuccu

SEQ ID NO: 1767008 - RNA, 22 nt, Homo sapiens
aucuagcucuccauacuuugaa

SEQ ID NO: 1767009 - RNA, 16 nt, Homo sapiens
cagcaguuuccagaga

SEQ ID NO: 1767010 - RNA, 21 nt, Homo sapiens
cagugaaagcuuucaugacca

SEQ ID NO: 1767011 - RNA, 16 nt, Homo sapiens
caaguccagauuuaca

SEQ ID NO: 1767012 - RNA, 21 nt, Homo sapiens
uauguuggaggcaugcuaaga

SEQ ID NO: 1767013 - RNA, 21 nt, Homo sapiens
cucccacagaccugcagugag

SEQ ID NO: 1767014 - RNA, 20 nt, Homo sapiens
uucccacgucuaacuggaaa

SEQ ID NO: 1767015 - RNA, 22 nt, Homo sapiens
ccuuuuucuucacuuacaagaa

SEQ ID NO: 1767016 - RNA, 13 nt, Homo sapiens
auugcuuugguca

SEQ ID NO: 1767017 - RNA, 18 nt, Homo sapiens
acgauuccgccacacauc

SEQ ID NO: 1767018 - RNA, 16 nt, Homo sapiens
aggggcagccaggaca

SEQ ID NO: 1767019 - RNA, 16 nt, Homo sapiens
agcugugacuucucca

SEQ ID NO: 1767020 - RNA, 19 nt, Homo sapiens
uaagaacuguacauuguga

SEQ ID NO: 1767021 - RNA, 13 nt, Homo sapiens
uguaguuacucaa

SEQ ID NO: 1767022 - RNA, 17 nt, Homo sapiens
cccuagucuuuuaaaca

SEQ ID NO: 1767023 - RNA, 22 nt, Homo sapiens
agauuuagaaaaaaguuuacaa

SEQ ID NO: 1767024 - RNA, 16 nt, Homo sapiens
uaauuccagcacuuca

SEQ ID NO: 1767025 - RNA, 18 nt, Homo sapiens
cucauaaugaagacauag

SEQ ID NO: 1767026 - RNA, 18 nt, Homo sapiens
gaaucgcuugaacccagg

SEQ ID NO: 1767027 - RNA, 20 nt, Homo sapiens
uguuuauucauaugcauauu

SEQ ID NO: 1767028 - RNA, 15 nt, Homo sapiens
uguacugagcacuga

SEQ ID NO: 1767029 - RNA, 15 nt, Homo sapiens
uucgaggagugccgu

SEQ ID NO: 1767030 - RNA, 22 nt, Homo sapiens
auggacgugugugaaugguugu

SEQ ID NO: 1767031 - RNA, 16 nt, Homo sapiens
ucccauucuccacuca

SEQ ID NO: 1767032 - RNA, 16 nt, Homo sapiens
agccaucaagcacuuc

SEQ ID NO: 1767033 - RNA, 20 nt, Homo sapiens
uaacccuaggcaucacaugc

SEQ ID NO: 1767034 - RNA, 14 nt, Homo sapiens
auguagagaaagaa

SEQ ID NO: 1767035 - RNA, 21 nt, Homo sapiens
cugaaagucuguguccaauua

SEQ ID NO: 1767036 - RNA, 15 nt, Homo sapiens
gagaagauucuugua

SEQ ID NO: 1767037 - RNA, 13 nt, Homo sapiens
aaaaggauuaugu

SEQ ID NO: 1767038 - RNA, 15 nt, Homo sapiens
ucuagccagugaaca

SEQ ID NO: 1767039 - RNA, 16 nt, Homo sapiens
ugguauaaagcucuca

SEQ ID NO: 1767040 - RNA, 20 nt, Homo sapiens
aaauuaaccucucacaguua

SEQ ID NO: 1767041 - RNA, 15 nt, Homo sapiens
cuguucuuuugcaau

SEQ ID NO: 1767042 - RNA, 18 nt, Homo sapiens
uaagaguaacaguuugau

SEQ ID NO: 1767043 - RNA, 20 nt, Homo sapiens
uggggaugcuucgccagcca

SEQ ID NO: 1767044 - RNA, 22 nt, Homo sapiens
caugguguauaugugccacauu

SEQ ID NO: 1767045 - RNA, 15 nt, Homo sapiens
cauggagaaacaucc

SEQ ID NO: 1767046 - RNA, 21 nt, Homo sapiens
aaguugauauagaacagugcu

SEQ ID NO: 1767047 - RNA, 18 nt, Homo sapiens
cuaauucuuauuuuauaa

SEQ ID NO: 1767048 - RNA, 19 nt, Homo sapiens
aacugccugggccaugcga

SEQ ID NO: 1767049 - RNA, 18 nt, Homo sapiens
uguuaaauugcuguguau

SEQ ID NO: 1767050 - RNA, 21 nt, Homo sapiens
ugcaccucuggcuagagccga

SEQ ID NO: 1767051 - RNA, 15 nt, Homo sapiens
cacuacucuuacaug

SEQ ID NO: 1767052 - RNA, 22 nt, Homo sapiens
acaaaugaaauaaauauugugu

SEQ ID NO: 1767053 - RNA, 14 nt, Homo sapiens
cucagggacaacau

SEQ ID NO: 1767054 - RNA, 17 nt, Homo sapiens
aauaauuuggaaucagc

SEQ ID NO: 1767055 - RNA, 21 nt, Homo sapiens
auaaaacaaaauguuuuggag

SEQ ID NO: 1767056 - RNA, 17 nt, Homo sapiens
ucaacugcccuaagucc

SEQ ID NO: 1767057 - RNA, 20 nt, Homo sapiens
guaagcuauaacauauuuau

SEQ ID NO: 1767058 - RNA, 15 nt, Homo sapiens
uugucugauguggca

SEQ ID NO: 1767059 - RNA, 19 nt, Homo sapiens
aggugauccgccuaccuca

SEQ ID NO: 1767060 - RNA, 16 nt, Homo sapiens
uuuggugaacuguugg

SEQ ID NO: 1767061 - RNA, 14 nt, Homo sapiens
aggaggugaaagaa

SEQ ID NO: 1767062 - RNA, 20 nt, Homo sapiens
augccagugggcagugcaug

SEQ ID NO: 1767063 - RNA, 22 nt, Homo sapiens
agccaguuaauuuuaagaauuu

SEQ ID NO: 1767064 - RNA, 12 nt, Homo sapiens
uguggaccugga

SEQ ID NO: 1767065 - RNA, 16 nt, Homo sapiens
acagcucucugggcac

SEQ ID NO: 1767066 - RNA, 15 nt, Homo sapiens
uuguccaauggggcu

SEQ ID NO: 1767067 - RNA, 13 nt, Homo sapiens
auuaaauaaucuc

SEQ ID NO: 1767068 - RNA, 19 nt, Homo sapiens
aggggagaaccugguugca

SEQ ID NO: 1767069 - RNA, 20 nt, Homo sapiens
cucccugcuguuugcugaga

SEQ ID NO: 1767070 - RNA, 11 nt, Homo sapiens
ugaagacauaa

SEQ ID NO: 1767071 - RNA, 11 nt, Homo sapiens
cgcagacacac

SEQ ID NO: 1767072 - RNA, 23 nt, Homo sapiens
aucucccuagccugcuuuugucc

SEQ ID NO: 1767073 - RNA, 19 nt, Homo sapiens
caauaaagccuucaaacuc

SEQ ID NO: 1767074 - RNA, 19 nt, Homo sapiens
cuugcugccccacaacaca

SEQ ID NO: 1767075 - RNA, 18 nt, Homo sapiens
cugcccugguggcccucu

SEQ ID NO: 1767076 - RNA, 15 nt, Homo sapiens
ucuguaaugugaauu

SEQ ID NO: 1767077 - RNA, 21 nt, Homo sapiens
ugcaaaccacuucuccaugcu

SEQ ID NO: 1767078 - RNA, 14 nt, Homo sapiens
gaaguuuguuguuu

SEQ ID NO: 1767079 - RNA, 21 nt, Homo sapiens
cuccccaugggcacaguggug

SEQ ID NO: 1767080 - RNA, 19 nt, Homo sapiens
gacugaauucaaauauucu

SEQ ID NO: 1767081 - RNA, 20 nt, Homo sapiens
cuggaucguuugacgggacu

SEQ ID NO: 1767082 - RNA, 20 nt, Homo sapiens
cauuucacgaacuguucaca

SEQ ID NO: 1767083 - RNA, 22 nt, Homo sapiens
gucacugaacaccuauugcacu

SEQ ID NO: 1767084 - RNA, 14 nt, Homo sapiens
cgaaguguugcaug

SEQ ID NO: 1767085 - RNA, 20 nt, Homo sapiens
gaaaagcugaucauaaguga

SEQ ID NO: 1767086 - RNA, 17 nt, Homo sapiens
gccugcaggaccucgug

SEQ ID NO: 1767087 - RNA, 18 nt, Homo sapiens
cuucccuguauuaccucc

SEQ ID NO: 1767088 - RNA, 20 nt, Homo sapiens
gcagaaccggagagccagcu

SEQ ID NO: 1767089 - RNA, 14 nt, Homo sapiens
uuauauucauucuu

SEQ ID NO: 1767090 - RNA, 21 nt, Homo sapiens
cugcauuucauauuauuuuag

SEQ ID NO: 1767091 - RNA, 14 nt, Homo sapiens
cuccucugcuccaa

SEQ ID NO: 1767092 - RNA, 13 nt, Homo sapiens
aacaauucaagca

SEQ ID NO: 1767093 - RNA, 22 nt, Homo sapiens
gcaucauucuuucugcuauauu

SEQ ID NO: 1767094 - RNA, 16 nt, Homo sapiens
gcugccagccacuuca

SEQ ID NO: 1767095 - RNA, 18 nt, Homo sapiens
agaggcucccucuugacg

SEQ ID NO: 1767096 - RNA, 23 nt, Homo sapiens
ugccaagcccucaauaagccagc

SEQ ID NO: 1767097 - RNA, 22 nt, Homo sapiens
uaucuuaggauuuaccaaauag

SEQ ID NO: 1767098 - RNA, 20 nt, Homo sapiens
ccucugucagucacagccac

SEQ ID NO: 1767099 - RNA, 13 nt, Homo sapiens
acaaauugcuuga

SEQ ID NO: 1767100 - RNA, 20 nt, Homo sapiens
ugcacgcacaugccaaugca

SEQ ID NO: 1767101 - RNA, 20 nt, Homo sapiens
ccaaagccaauaacacacag

SEQ ID NO: 1767102 - RNA, 16 nt, Homo sapiens
gacuuaaaacaaaagg

SEQ ID NO: 1767103 - RNA, 18 nt, Homo sapiens
gccacauggggcugggca

SEQ ID NO: 1767104 - RNA, 13 nt, Homo sapiens
aguaggucuggga

SEQ ID NO: 1767105 - RNA, 18 nt, Homo sapiens
ggauugucccuguguugu

SEQ ID NO: 1767106 - RNA, 20 nt, Homo sapiens
gcuacuuagcuggccaagga

SEQ ID NO: 1767107 - RNA, 20 nt, Homo sapiens
ugacuugagaaacaaauaau

SEQ ID NO: 1767108 - RNA, 19 nt, Homo sapiens
ugccauggucaccaaacag

SEQ ID NO: 1767109 - RNA, 13 nt, Homo sapiens
aacccucugugaa

SEQ ID NO: 1767110 - RNA, 22 nt, Homo sapiens
cauguccuauccaaaggaauca

SEQ ID NO: 1767111 - RNA, 16 nt, Homo sapiens
uauaugcacuauguau

SEQ ID NO: 1767112 - RNA, 18 nt, Homo sapiens
ugccuuucgaggccugaa

SEQ ID NO: 1767113 - RNA, 16 nt, Homo sapiens
accuuugaaauauuaa

SEQ ID NO: 1767114 - RNA, 17 nt, Homo sapiens
uuccacuuugcauauga

SEQ ID NO: 1767115 - RNA, 19 nt, Homo sapiens
cacccuacaaaccuguauu

SEQ ID NO: 1767116 - RNA, 19 nt, Homo sapiens
cacccaccauauuguuuga

SEQ ID NO: 1767117 - RNA, 21 nt, Homo sapiens
aaaaaggauaugguagcauuu

SEQ ID NO: 1767118 - RNA, 18 nt, Homo sapiens
ucuuuuacccugugucag

SEQ ID NO: 1767119 - RNA, 16 nt, Homo sapiens
ccugcccugcugccgc

SEQ ID NO: 1767120 - RNA, 19 nt, Homo sapiens
cuguauccuuuaauuucag

SEQ ID NO: 1767121 - RNA, 22 nt, Homo sapiens
ccuccuguaaaugguguacaua

SEQ ID NO: 1767122 - RNA, 22 nt, Homo sapiens
cacaguugcucuaugcuuucca

SEQ ID NO: 1767123 - RNA, 18 nt, Homo sapiens
uaaacccuuuagugcuuu

SEQ ID NO: 1767124 - RNA, 19 nt, Homo sapiens
uuaucaugacaaauauuac

SEQ ID NO: 1767125 - RNA, 19 nt, Homo sapiens
gucuauauuuuaaccugca

SEQ ID NO: 1767126 - RNA, 23 nt, Homo sapiens
gcaaugaugacccacuaaagagu

SEQ ID NO: 1767127 - RNA, 14 nt, Homo sapiens
uagguguacuguac

SEQ ID NO: 1767128 - RNA, 20 nt, Homo sapiens
caguugguggggccaggcca

SEQ ID NO: 1767129 - RNA, 21 nt, Homo sapiens
ccuuaucagcuucauacuuca

SEQ ID NO: 1767130 - RNA, 23 nt, Homo sapiens
ucucuaaaauucuagucucugau

SEQ ID NO: 1767131 - RNA, 22 nt, Homo sapiens
aucagauguguguucucaguga

SEQ ID NO: 1767132 - RNA, 15 nt, Homo sapiens
augguuugacucauc

SEQ ID NO: 1767133 - RNA, 16 nt, Homo sapiens
ggcugagacagguuaa

SEQ ID NO: 1767134 - RNA, 13 nt, Homo sapiens
gacaggaagacug

SEQ ID NO: 1767135 - RNA, 14 nt, Homo sapiens
gauaaaugauucaa

SEQ ID NO: 1767136 - RNA, 18 nt, Homo sapiens
auuuuuuuuccuugccug

SEQ ID NO: 1767137 - RNA, 16 nt, Homo sapiens
gagaccuggaaccaga

SEQ ID NO: 1767138 - RNA, 17 nt, Homo sapiens
gcagucugcuucagugc

SEQ ID NO: 1767139 - RNA, 13 nt, Homo sapiens
gccucaaugccag

SEQ ID NO: 1767140 - RNA, 18 nt, Homo sapiens
ggcagagguuucuagggu

SEQ ID NO: 1767141 - RNA, 21 nt, Homo sapiens
gccugguucuaggcugcugca

SEQ ID NO: 1767142 - RNA, 15 nt, Homo sapiens
cuuugcaaauggugg

SEQ ID NO: 1767143 - RNA, 22 nt, Homo sapiens
uccaugcaacuggaguuccuua

SEQ ID NO: 1767144 - RNA, 23 nt, Homo sapiens
aaaguugucuggcuuuuugcacg

SEQ ID NO: 1767145 - RNA, 23 nt, Homo sapiens
guaauuuaauggggucuguaaau

SEQ ID NO: 1767146 - RNA, 16 nt, Homo sapiens
auuauuuucacuguag

SEQ ID NO: 1767147 - RNA, 14 nt, Homo sapiens
guguuaucuuuuga

SEQ ID NO: 1767148 - RNA, 12 nt, Homo sapiens
gacuuacugcuc

SEQ ID NO: 1767149 - RNA, 11 nt, Homo sapiens
cuuugcaaaau

SEQ ID NO: 1767150 - RNA, 11 nt, Homo sapiens
aacugcaacuc

SEQ ID NO: 1767151 - RNA, 14 nt, Homo sapiens
gcuccuugacuccu

SEQ ID NO: 1767152 - RNA, 13 nt, Homo sapiens
ccagcugcagcug

SEQ ID NO: 1767153 - RNA, 15 nt, Homo sapiens
ucucaaacgugcgcu

SEQ ID NO: 1767154 - RNA, 17 nt, Homo sapiens
augaucuggauccacca

SEQ ID NO: 1767155 - RNA, 15 nt, Homo sapiens
gcccuuggggguccu

SEQ ID NO: 1767156 - RNA, 17 nt, Homo sapiens
ugugauuuuuuucacau

SEQ ID NO: 1767157 - RNA, 14 nt, Homo sapiens
gagagaacagggau

SEQ ID NO: 1767158 - RNA, 17 nt, Homo sapiens
cuccgucauccaugccc

SEQ ID NO: 1767159 - RNA, 19 nt, Homo sapiens
gcaagagugauugcagcuu

SEQ ID NO: 1767160 - RNA, 23 nt, Homo sapiens
uggaggcccagauacagcacauc

SEQ ID NO: 1767161 - RNA, 20 nt, Homo sapiens
ugacaccggggggcucccag

SEQ ID NO: 1767162 - RNA, 15 nt, Homo sapiens
agccccuugcuucua

SEQ ID NO: 1767163 - RNA, 13 nt, Homo sapiens
ccagagcuuuaca

SEQ ID NO: 1767164 - RNA, 22 nt, Homo sapiens
uccuuuaaagugaguacuguua

SEQ ID NO: 1767165 - RNA, 16 nt, Homo sapiens
gaacgcuaucugggaa

SEQ ID NO: 1767166 - RNA, 14 nt, Homo sapiens
cuguuuucuaccuc

SEQ ID NO: 1767167 - RNA, 21 nt, Homo sapiens
caacugacuucauuugugcca

SEQ ID NO: 1767168 - RNA, 21 nt, Homo sapiens
gagauccaaaguccugugguu

SEQ ID NO: 1767169 - RNA, 17 nt, Homo sapiens
aggccccaauaccccau

SEQ ID NO: 1767170 - RNA, 17 nt, Homo sapiens
ugaccaaaaugccaaaa

SEQ ID NO: 1767171 - RNA, 17 nt, Homo sapiens
cuguaucuugauaucuc

SEQ ID NO: 1767172 - RNA, 22 nt, Homo sapiens
uuagcugauaaggaaacuuuau

SEQ ID NO: 1767173 - RNA, 17 nt, Homo sapiens
guugcuauuuguauuuc

SEQ ID NO: 1767174 - RNA, 13 nt, Homo sapiens
aacaauagcacaa

SEQ ID NO: 1767175 - RNA, 22 nt, Homo sapiens
ggaucugcccccuuuacuccuc

SEQ ID NO: 1767176 - RNA, 20 nt, Homo sapiens
uaaaaguuacauugugcuug

SEQ ID NO: 1767177 - RNA, 16 nt, Homo sapiens
agcccuucuaccccac

SEQ ID NO: 1767178 - RNA, 22 nt, Homo sapiens
cacuuaggaugugaucacuuuc

SEQ ID NO: 1767179 - RNA, 16 nt, Homo sapiens
uuugcuggucacugcc

SEQ ID NO: 1767180 - RNA, 15 nt, Homo sapiens
uucugcucccaucca

SEQ ID NO: 1767181 - RNA, 15 nt, Homo sapiens
aaauuuuuaccuuua

SEQ ID NO: 1767182 - RNA, 15 nt, Homo sapiens
aacuauuuacauaua

SEQ ID NO: 1767183 - RNA, 18 nt, Homo sapiens
acccuguaccucauccca

SEQ ID NO: 1767184 - RNA, 18 nt, Homo sapiens
acccugcaccucauucca

SEQ ID NO: 1767185 - RNA, 20 nt, Homo sapiens
agaagguggguuuucaucaa

SEQ ID NO: 1767186 - RNA, 11 nt, Homo sapiens
ugaaaccaaaa

SEQ ID NO: 1767187 - RNA, 14 nt, Homo sapiens
uuaguauaaguaca

SEQ ID NO: 1767188 - RNA, 17 nt, Homo sapiens
ugcuuuuuuucagggaa

SEQ ID NO: 1767189 - RNA, 21 nt, Homo sapiens
gcgccaggugaugggcugcac

SEQ ID NO: 1767190 - RNA, 23 nt, Homo sapiens
cuucuuuccaugggcguguucua

SEQ ID NO: 1767191 - RNA, 21 nt, Homo sapiens
aguugagucuccucucugaga

SEQ ID NO: 1767192 - RNA, 16 nt, Homo sapiens
auggaagaaaugggag

SEQ ID NO: 1767193 - RNA, 13 nt, Homo sapiens
cagcuaugaaggc

SEQ ID NO: 1767194 - RNA, 15 nt, Homo sapiens
cauucuucugaucac

SEQ ID NO: 1767195 - RNA, 17 nt, Homo sapiens
caugguuguugcauaua

SEQ ID NO: 1767196 - RNA, 19 nt, Homo sapiens
gauauuuugggcauguggg

SEQ ID NO: 1767197 - RNA, 21 nt, Homo sapiens
gcccaguguuguuuguaaaua

SEQ ID NO: 1767198 - RNA, 19 nt, Homo sapiens
gucaggaggugccugagag

SEQ ID NO: 1767199 - RNA, 18 nt, Homo sapiens
aucuugaucuguguuuua

SEQ ID NO: 1767200 - RNA, 23 nt, Homo sapiens
uuccaacaagaagggacugagag

SEQ ID NO: 1767201 - RNA, 20 nt, Homo sapiens
aacauccuccaauuccacag

SEQ ID NO: 1767202 - RNA, 15 nt, Homo sapiens
gcacugcacccuguu

SEQ ID NO: 1767203 - RNA, 18 nt, Homo sapiens
guuuuauguucuagugau

SEQ ID NO: 1767204 - RNA, 17 nt, Homo sapiens
cucaccucucaccuccc

SEQ ID NO: 1767205 - RNA, 23 nt, Homo sapiens
aaagauccccaaaacaggccagg

SEQ ID NO: 1767206 - RNA, 14 nt, Homo sapiens
agguggaaguugca

SEQ ID NO: 1767207 - RNA, 19 nt, Homo sapiens
acauuguaaaguaugugag

SEQ ID NO: 1767208 - RNA, 19 nt, Homo sapiens
ucugaauccuuuuaaucua

SEQ ID NO: 1767209 - RNA, 22 nt, Homo sapiens
gcaguggaguaaguauuuagaa

SEQ ID NO: 1767210 - RNA, 23 nt, Homo sapiens
agauccuuuuuccaucauuuuac

SEQ ID NO: 1767211 - RNA, 12 nt, Homo sapiens
uccggcugccuc

SEQ ID NO: 1767212 - RNA, 23 nt, Homo sapiens
ccaguucuacuauggcugaguuc

SEQ ID NO: 1767213 - RNA, 22 nt, Homo sapiens
cucacugcuaagaauauuugaa

SEQ ID NO: 1767214 - RNA, 15 nt, Homo sapiens
uucugaaaaagacau

SEQ ID NO: 1767215 - RNA, 22 nt, Homo sapiens
agccucuagaacagccagaccc

SEQ ID NO: 1767216 - RNA, 13 nt, Homo sapiens
guacaaaaacaca

SEQ ID NO: 1767217 - RNA, 14 nt, Homo sapiens
uagaguuaccacac

SEQ ID NO: 1767218 - RNA, 14 nt, Homo sapiens
aaacacccaugccc

SEQ ID NO: 1767219 - RNA, 14 nt, Homo sapiens
aaaacaccaugaaa

SEQ ID NO: 1767220 - RNA, 19 nt, Homo sapiens
ccauacagugacaauacaa

SEQ ID NO: 1767221 - RNA, 23 nt, Homo sapiens
aagcuguccuugagcuguccuau

SEQ ID NO: 1767222 - RNA, 15 nt, Homo sapiens
cgugcgcgugcacag

SEQ ID NO: 1767223 - RNA, 19 nt, Homo sapiens
aaacuacucuugaauuccu

SEQ ID NO: 1767224 - RNA, 18 nt, Homo sapiens
caguggugcgaucuuggc

SEQ ID NO: 1767225 - RNA, 15 nt, Homo sapiens
ccauuuuaguuuuaa

SEQ ID NO: 1767226 - RNA, 20 nt, Homo sapiens
auuccucuuuucucugccau

SEQ ID NO: 1767227 - RNA, 20 nt, Homo sapiens
acucucugucuucucuccac

SEQ ID NO: 1767228 - RNA, 17 nt, Homo sapiens
aaagguagggacuggag

SEQ ID NO: 1767229 - RNA, 11 nt, Homo sapiens
aaagcauuuac

SEQ ID NO: 1767230 - RNA, 20 nt, Homo sapiens
agcuacguguacauauuuga

SEQ ID NO: 1767231 - RNA, 13 nt, Homo sapiens
ucuccucuuguaa

SEQ ID NO: 1767232 - RNA, 21 nt, Homo sapiens
aauucauuuuuuaaagccagu

SEQ ID NO: 1767233 - RNA, 19 nt, Homo sapiens
ggugaaacagggcuugucc

SEQ ID NO: 1767234 - RNA, 15 nt, Homo sapiens
gcugaguacagucau

SEQ ID NO: 1767235 - RNA, 16 nt, Homo sapiens
guacauguguguacau

SEQ ID NO: 1767236 - RNA, 19 nt, Homo sapiens
caacuaggauacuuucuac

SEQ ID NO: 1767237 - RNA, 21 nt, Homo sapiens
uuaauugguuugugccuuaca

SEQ ID NO: 1767238 - RNA, 20 nt, Homo sapiens
acacucuugucaacucucca

SEQ ID NO: 1767239 - RNA, 14 nt, Homo sapiens
augucauuugcuaa

SEQ ID NO: 1767240 - RNA, 17 nt, Homo sapiens
cuuaacccugugcuguc

SEQ ID NO: 1767241 - RNA, 15 nt, Homo sapiens
uucagugcugcugaa

SEQ ID NO: 1767242 - RNA, 13 nt, Homo sapiens
ucauacacuuauu

SEQ ID NO: 1767243 - RNA, 22 nt, Homo sapiens
aaauuaccccggggcacccuua

SEQ ID NO: 1767244 - RNA, 14 nt, Homo sapiens
aaggcaacugugag

SEQ ID NO: 1767245 - RNA, 17 nt, Homo sapiens
auggaaaaaaugaacuu

SEQ ID NO: 1767246 - RNA, 14 nt, Homo sapiens
uguaugugaacaaa

SEQ ID NO: 1767247 - RNA, 16 nt, Homo sapiens
cucucacuauuaucua

SEQ ID NO: 1767248 - RNA, 17 nt, Homo sapiens
ucucuaauuuaacuuau

SEQ ID NO: 1767249 - RNA, 17 nt, Homo sapiens
aauguacaguauucaau

SEQ ID NO: 1767250 - RNA, 22 nt, Homo sapiens
uacaguuuggcuuuuuucacau

SEQ ID NO: 1767251 - RNA, 17 nt, Homo sapiens
ccuauugggagagguca

SEQ ID NO: 1767252 - RNA, 21 nt, Homo sapiens
acaggcccccuugaguggggu

SEQ ID NO: 1767253 - RNA, 23 nt, Homo sapiens
ggccugacggggaggaaccacug

SEQ ID NO: 1767254 - RNA, 14 nt, Homo sapiens
acuauccuacccca

SEQ ID NO: 1767255 - RNA, 23 nt, Homo sapiens
acauaacuaguggcucucaguua

SEQ ID NO: 1767256 - RNA, 20 nt, Homo sapiens
caucauguuccuuauaugaa

SEQ ID NO: 1767257 - RNA, 18 nt, Homo sapiens
aguggccacguucaggga

SEQ ID NO: 1767258 - RNA, 23 nt, Homo sapiens
gagugaccucacuucuggcacug

SEQ ID NO: 1767259 - RNA, 22 nt, Homo sapiens
guguggcaaacuugcaguuuaa

SEQ ID NO: 1767260 - RNA, 21 nt, Homo sapiens
ccguuaaggcacguucuuucc

SEQ ID NO: 1767261 - RNA, 22 nt, Homo sapiens
cuacuguaaggcaaucauggug

SEQ ID NO: 1767262 - RNA, 22 nt, Homo sapiens
cugaccgccgcuuccagcuucc

SEQ ID NO: 1767263 - RNA, 20 nt, Homo sapiens
auaucugaagagcuauuaua

SEQ ID NO: 1767264 - RNA, 15 nt, Homo sapiens
aaaauguaaugauca

SEQ ID NO: 1767265 - RNA, 21 nt, Homo sapiens
uguugcucucugugucugaga

SEQ ID NO: 1767266 - RNA, 18 nt, Homo sapiens
acucuauacucaaucaag

SEQ ID NO: 1767267 - RNA, 22 nt, Homo sapiens
uauaauuacaaugcacaauuua

SEQ ID NO: 1767268 - RNA, 11 nt, Homo sapiens
ugugcugccau

SEQ ID NO: 1767269 - RNA, 19 nt, Homo sapiens
uuagaagaucugcuucccu

SEQ ID NO: 1767270 - RNA, 16 nt, Homo sapiens
gcauguaugugcacau

SEQ ID NO: 1767271 - RNA, 15 nt, Homo sapiens
acugccuaugccaag

SEQ ID NO: 1767272 - RNA, 20 nt, Homo sapiens
uuugggcucccaaaacaccu

SEQ ID NO: 1767273 - RNA, 18 nt, Homo sapiens
ggagccaaaaucucaaga

SEQ ID NO: 1767274 - RNA, 18 nt, Homo sapiens
aaugcuuuggacuuuuga

SEQ ID NO: 1767275 - RNA, 11 nt, Homo sapiens
caggucuuccu

SEQ ID NO: 1767276 - RNA, 21 nt, Homo sapiens
caccacagccggucagaggag

SEQ ID NO: 1767277 - RNA, 11 nt, Homo sapiens
caugacacuga

SEQ ID NO: 1767278 - RNA, 20 nt, Homo sapiens
agugggaauguccuuggcau

SEQ ID NO: 1767279 - RNA, 22 nt, Homo sapiens
cugccaaagaagccuugccauc

SEQ ID NO: 1767280 - RNA, 22 nt, Homo sapiens
caugcugcuccccuaaagccag

SEQ ID NO: 1767281 - RNA, 13 nt, Homo sapiens
gcccgcacugggg

SEQ ID NO: 1767282 - RNA, 16 nt, Homo sapiens
gcgucugugcauuuau

SEQ ID NO: 1767283 - RNA, 16 nt, Homo sapiens
gaaaaugaaugcugcu

SEQ ID NO: 1767284 - RNA, 18 nt, Homo sapiens
gaggaguuagccaaacaa

SEQ ID NO: 1767285 - RNA, 13 nt, Homo sapiens
gcaggcuuucaag

SEQ ID NO: 1767286 - RNA, 12 nt, Homo sapiens
cuauuaaagguu

SEQ ID NO: 1767287 - RNA, 17 nt, Homo sapiens
cuaucugaaaucccaac

SEQ ID NO: 1767288 - RNA, 20 nt, Homo sapiens
uuacauacauugauucaugu

SEQ ID NO: 1767289 - RNA, 21 nt, Homo sapiens
cuucugugcccagaauacuga

SEQ ID NO: 1767290 - RNA, 21 nt, Homo sapiens
ggaaaggagggaggaugcugu

SEQ ID NO: 1767291 - RNA, 22 nt, Homo sapiens
aagacuucaguauguugucaaa

SEQ ID NO: 1767292 - RNA, 11 nt, Homo sapiens
ggaaacagcau

SEQ ID NO: 1767293 - RNA, 11 nt, Homo sapiens
caaaacagggu

SEQ ID NO: 1767294 - RNA, 16 nt, Homo sapiens
caguauucucagagca

SEQ ID NO: 1767295 - RNA, 21 nt, Homo sapiens
gcuucucuucuuuauugcacu

SEQ ID NO: 1767296 - RNA, 23 nt, Homo sapiens
augccuuguugaugaagcacauu

SEQ ID NO: 1767297 - RNA, 18 nt, Homo sapiens
gaaguauagaugguagaa

SEQ ID NO: 1767298 - RNA, 20 nt, Homo sapiens
gacuggcaauaaacuccuac

SEQ ID NO: 1767299 - RNA, 16 nt, Homo sapiens
auuagauaaacacagg

SEQ ID NO: 1767300 - RNA, 23 nt, Homo sapiens
ugggaagacuccuagcuguccuu

SEQ ID NO: 1767301 - RNA, 17 nt, Homo sapiens
uggccaugguccccaag

SEQ ID NO: 1767302 - RNA, 20 nt, Homo sapiens
cauuagcgauccauguaauc

SEQ ID NO: 1767303 - RNA, 22 nt, Homo sapiens
cuucccuuauucuaaagcugcc

SEQ ID NO: 1767304 - RNA, 21 nt, Homo sapiens
aaauguucagcuucagacuuu

SEQ ID NO: 1767305 - RNA, 16 nt, Homo sapiens
ugcagggauuacaggc

SEQ ID NO: 1767306 - RNA, 16 nt, Homo sapiens
auguaccaguguacug

SEQ ID NO: 1767307 - RNA, 22 nt, Homo sapiens
uuaaaaaauggacucuugaaau

SEQ ID NO: 1767308 - RNA, 20 nt, Homo sapiens
gcgcugguggaccacaggca

SEQ ID NO: 1767309 - RNA, 14 nt, Homo sapiens
aaccauuucucacu

SEQ ID NO: 1767310 - RNA, 13 nt, Homo sapiens
agggauguaucaa

SEQ ID NO: 1767311 - RNA, 14 nt, Homo sapiens
gcuuguacuaagcc

SEQ ID NO: 1767312 - RNA, 22 nt, Homo sapiens
gagggcacuuccuccacagucc

SEQ ID NO: 1767313 - RNA, 16 nt, Homo sapiens
cacaaagcauuuucau

SEQ ID NO: 1767314 - RNA, 21 nt, Homo sapiens
cuguagucccagccacucggg

SEQ ID NO: 1767315 - RNA, 18 nt, Homo sapiens
auucauaggaagguguuu

SEQ ID NO: 1767316 - RNA, 21 nt, Homo sapiens
gcuuuaauuuuuuuaaccaaa

SEQ ID NO: 1767317 - RNA, 17 nt, Homo sapiens
aucaggaguuccagugc

SEQ ID NO: 1767318 - RNA, 22 nt, Homo sapiens
agcuuuauuuuuuaaguauuua

SEQ ID NO: 1767319 - RNA, 17 nt, Homo sapiens
aggcaauacauguaucu

SEQ ID NO: 1767320 - RNA, 23 nt, Homo sapiens
uuauucagaaccuaaaaguauua

SEQ ID NO: 1767321 - RNA, 16 nt, Homo sapiens
uuaauuugcacagugu

SEQ ID NO: 1767322 - RNA, 16 nt, Homo sapiens
uccaguacaguauucu

SEQ ID NO: 1767323 - RNA, 13 nt, Homo sapiens
aguuaagaaccug

SEQ ID NO: 1767324 - RNA, 15 nt, Homo sapiens
uguggccacaaucca

SEQ ID NO: 1767325 - RNA, 22 nt, Homo sapiens
gagguuuuguauugagggccag

SEQ ID NO: 1767326 - RNA, 14 nt, Homo sapiens
ucaaaauaguucua

SEQ ID NO: 1767327 - RNA, 16 nt, Homo sapiens
ccuggccaaaaugcag

SEQ ID NO: 1767328 - RNA, 16 nt, Homo sapiens
ugcaugugugugcuca

SEQ ID NO: 1767329 - RNA, 20 nt, Homo sapiens
aaaugaggagguacauugaa

SEQ ID NO: 1767330 - RNA, 22 nt, Homo sapiens
caaaaucugauuagaaguauaa

SEQ ID NO: 1767331 - RNA, 13 nt, Homo sapiens
gccuacacugcca

SEQ ID NO: 1767332 - RNA, 18 nt, Homo sapiens
aaaauaguuauucaguua

SEQ ID NO: 1767333 - RNA, 13 nt, Homo sapiens
aauccagccauga

SEQ ID NO: 1767334 - RNA, 22 nt, Homo sapiens
auuagauguuucaacugugcuc

SEQ ID NO: 1767335 - RNA, 11 nt, Homo sapiens
accgucuuccu

SEQ ID NO: 1767336 - RNA, 15 nt, Homo sapiens
guuucaucccaugua

SEQ ID NO: 1767337 - RNA, 19 nt, Homo sapiens
ugugucaaugccugucuua

SEQ ID NO: 1767338 - RNA, 17 nt, Homo sapiens
ucaaacucccgaccuca

SEQ ID NO: 1767339 - RNA, 15 nt, Homo sapiens
ucacagcaccaaaau

SEQ ID NO: 1767340 - RNA, 22 nt, Homo sapiens
gcgacagauucauaaaguaaug

SEQ ID NO: 1767341 - RNA, 18 nt, Homo sapiens
aaugaagaaggucucauu

SEQ ID NO: 1767342 - RNA, 14 nt, Homo sapiens
ugucugugugcuac

SEQ ID NO: 1767343 - RNA, 14 nt, Homo sapiens
uggcucccaggaca

SEQ ID NO: 1767344 - RNA, 12 nt, Homo sapiens
ugaaaugauuca

SEQ ID NO: 1767345 - RNA, 22 nt, Homo sapiens
ccaacuagcucuauguuuacaa

SEQ ID NO: 1767346 - RNA, 20 nt, Homo sapiens
acuguguguucgacagugaa

SEQ ID NO: 1767347 - RNA, 21 nt, Homo sapiens
aaauuacccccuccuccagau

SEQ ID NO: 1767348 - RNA, 15 nt, Homo sapiens
uuuucaaaaaguaaa

SEQ ID NO: 1767349 - RNA, 21 nt, Homo sapiens
agacuuagaaaaauccuacaa

SEQ ID NO: 1767350 - RNA, 16 nt, Homo sapiens
gcagacucaccaccua

SEQ ID NO: 1767351 - RNA, 16 nt, Homo sapiens
ggaacaaaagcgaaac

SEQ ID NO: 1767352 - RNA, 15 nt, Homo sapiens
gugggacaacaaaga

SEQ ID NO: 1767353 - RNA, 18 nt, Homo sapiens
caaacacaauuaaaucuc

SEQ ID NO: 1767354 - RNA, 14 nt, Homo sapiens
acaaagggcacuua

SEQ ID NO: 1767355 - RNA, 12 nt, Homo sapiens
agauacucuggg

SEQ ID NO: 1767356 - RNA, 15 nt, Homo sapiens
ccgcugaccuugcac

SEQ ID NO: 1767357 - RNA, 18 nt, Homo sapiens
agaaaguucuuaaacuca

SEQ ID NO: 1767358 - RNA, 22 nt, Homo sapiens
ggaaccgagguguugccagugc

SEQ ID NO: 1767359 - RNA, 20 nt, Homo sapiens
acguauguaaauguauauac

SEQ ID NO: 1767360 - RNA, 15 nt, Homo sapiens
uacaucugcaauaug

SEQ ID NO: 1767361 - RNA, 14 nt, Homo sapiens
cugggcauuucacg

SEQ ID NO: 1767362 - RNA, 18 nt, Homo sapiens
acucucugguuuacuuca

SEQ ID NO: 1767363 - RNA, 16 nt, Homo sapiens
cuaauagcagaaauaa

SEQ ID NO: 1767364 - RNA, 14 nt, Homo sapiens
cuggaggcucccau

SEQ ID NO: 1767365 - RNA, 23 nt, Homo sapiens
acuaagaagugguguuccaugac

SEQ ID NO: 1767366 - RNA, 16 nt, Homo sapiens
ggccagccagugccau

SEQ ID NO: 1767367 - RNA, 18 nt, Homo sapiens
agagauacaguauaccug

SEQ ID NO: 1767368 - RNA, 22 nt, Homo sapiens
cuuccuccugguucaagcgauu

SEQ ID NO: 1767369 - RNA, 22 nt, Homo sapiens
aaugguuugggggcagacucuu

SEQ ID NO: 1767370 - RNA, 19 nt, Homo sapiens
uuccugacaucacagcagc

SEQ ID NO: 1767371 - RNA, 15 nt, Homo sapiens
uccuauuauguguuc

SEQ ID NO: 1767372 - RNA, 19 nt, Homo sapiens
aucaugcuguguaauauca

SEQ ID NO: 1767373 - RNA, 16 nt, Homo sapiens
agcgaacugucagccu

SEQ ID NO: 1767374 - RNA, 21 nt, Homo sapiens
caucugucacuugcauuccac

SEQ ID NO: 1767375 - RNA, 15 nt, Homo sapiens
gugucuggacauuca

SEQ ID NO: 1767376 - RNA, 14 nt, Homo sapiens
aggaccaacaucca

SEQ ID NO: 1767377 - RNA, 14 nt, Homo sapiens
cuggacaacacagc

SEQ ID NO: 1767378 - RNA, 18 nt, Homo sapiens
gagcaucacuagugacaa

SEQ ID NO: 1767379 - RNA, 20 nt, Homo sapiens
cacuuucaagaaucagacag

SEQ ID NO: 1767380 - RNA, 22 nt, Homo sapiens
ugaaggaaauucuuauaacuca

SEQ ID NO: 1767381 - RNA, 17 nt, Homo sapiens
ucucuucagucucuaua

SEQ ID NO: 1767382 - RNA, 16 nt, Homo sapiens
uuaaacagugucauau

SEQ ID NO: 1767383 - RNA, 14 nt, Homo sapiens
agcucuggaccagc

SEQ ID NO: 1767384 - RNA, 14 nt, Homo sapiens
ucuuuuaaaccauu

SEQ ID NO: 1767385 - RNA, 18 nt, Homo sapiens
ccuacaacucacauuaga

SEQ ID NO: 1767386 - RNA, 14 nt, Homo sapiens
ucuuuaaaaccaua

SEQ ID NO: 1767387 - RNA, 18 nt, Homo sapiens
uugucacuagucuuugag

SEQ ID NO: 1767388 - RNA, 19 nt, Homo sapiens
gaaacuccacauccugugg

SEQ ID NO: 1767389 - RNA, 13 nt, Homo sapiens
aaaacacugugga

SEQ ID NO: 1767390 - RNA, 18 nt, Homo sapiens
ugagcacagucaggggcu

SEQ ID NO: 1767391 - RNA, 20 nt, Homo sapiens
uaucaugguagucacuaaca

SEQ ID NO: 1767392 - RNA, 20 nt, Homo sapiens
gucacuugacaauuucuuuu

SEQ ID NO: 1767393 - RNA, 16 nt, Homo sapiens
ccucucuuauagaaua

SEQ ID NO: 1767394 - RNA, 17 nt, Homo sapiens
ugcuccagucauugcac

SEQ ID NO: 1767395 - RNA, 17 nt, Homo sapiens
cucugaaaccaguguua

SEQ ID NO: 1767396 - RNA, 12 nt, Homo sapiens
ccacugcuccau

SEQ ID NO: 1767397 - RNA, 20 nt, Homo sapiens
cagcccacagagccugaauu

SEQ ID NO: 1767398 - RNA, 19 nt, Homo sapiens
gaauaaagccuuuguaucu

SEQ ID NO: 1767399 - RNA, 18 nt, Homo sapiens
cuuaguguccuucuuaac

SEQ ID NO: 1767400 - RNA, 22 nt, Homo sapiens
uuuuccaagacagagucuugcu

SEQ ID NO: 1767401 - RNA, 19 nt, Homo sapiens
acggugcucacucccaagg

SEQ ID NO: 1767402 - RNA, 23 nt, Homo sapiens
ucuuccucugcaggacacagauc

SEQ ID NO: 1767403 - RNA, 17 nt, Homo sapiens
ccugacucccaugcaag

SEQ ID NO: 1767404 - RNA, 16 nt, Homo sapiens
ucucccugcuuugguc

SEQ ID NO: 1767405 - RNA, 20 nt, Homo sapiens
augauaaauuugacuguuau

SEQ ID NO: 1767406 - RNA, 13 nt, Homo sapiens
aaucccuuugcaa

SEQ ID NO: 1767407 - RNA, 14 nt, Homo sapiens
augguagaacuaaa

SEQ ID NO: 1767408 - RNA, 18 nt, Homo sapiens
uuaagccuaaaugccuua

SEQ ID NO: 1767409 - RNA, 23 nt, Homo sapiens
ugcuggcuuucuuuucucuauga

SEQ ID NO: 1767410 - RNA, 22 nt, Homo sapiens
caguauggaauuccagugccag

SEQ ID NO: 1767411 - RNA, 20 nt, Homo sapiens
gggcagaagagaaaccaucc

SEQ ID NO: 1767412 - RNA, 16 nt, Homo sapiens
aaggcauccaggccag

SEQ ID NO: 1767413 - RNA, 13 nt, Homo sapiens
guggggugcacuc

SEQ ID NO: 1767414 - RNA, 16 nt, Homo sapiens
acuggcucccuggaag

SEQ ID NO: 1767415 - RNA, 16 nt, Homo sapiens
ugacacugucccucuu

SEQ ID NO: 1767416 - RNA, 15 nt, Homo sapiens
cugcuggaaaaagcc

SEQ ID NO: 1767417 - RNA, 16 nt, Homo sapiens
ugcuuuagucauauau

SEQ ID NO: 1767418 - RNA, 21 nt, Homo sapiens
acuaaggucuuauaguccaaa

SEQ ID NO: 1767419 - RNA, 20 nt, Homo sapiens
gaggccugccuggcaggugu

SEQ ID NO: 1767420 - RNA, 13 nt, Homo sapiens
aguuuucaaagau

SEQ ID NO: 1767421 - RNA, 23 nt, Homo sapiens
ccacggggaggcccccccagaag

SEQ ID NO: 1767422 - RNA, 23 nt, Homo sapiens
ucuccugcgcccuucauugccac

SEQ ID NO: 1767423 - RNA, 16 nt, Homo sapiens
gggcugagcaccucuc

SEQ ID NO: 1767424 - RNA, 15 nt, Homo sapiens
acacuggcagacugu

SEQ ID NO: 1767425 - RNA, 16 nt, Homo sapiens
aaguaccacacauauu

SEQ ID NO: 1767426 - RNA, 12 nt, Homo sapiens
aguccuaaaaag

SEQ ID NO: 1767427 - RNA, 16 nt, Homo sapiens
uggaguugacugcuca

SEQ ID NO: 1767428 - RNA, 16 nt, Homo sapiens
gccauccccaccuuca

SEQ ID NO: 1767429 - RNA, 14 nt, Homo sapiens
caggaugacuuuac

SEQ ID NO: 1767430 - RNA, 16 nt, Homo sapiens
agcucugaacaaaagc

SEQ ID NO: 1767431 - RNA, 23 nt, Homo sapiens
uuucucagauguugaaacuuuga

SEQ ID NO: 1767432 - RNA, 23 nt, Homo sapiens
gucauccccuugggcucucacca

SEQ ID NO: 1767433 - RNA, 22 nt, Homo sapiens
agugugcaaagaaaagaacugc

SEQ ID NO: 1767434 - RNA, 21 nt, Homo sapiens
augcuuauguguugcauaaac

SEQ ID NO: 1767435 - RNA, 19 nt, Homo sapiens
ucuuugucaccacgugggg

SEQ ID NO: 1767436 - RNA, 19 nt, Homo sapiens
ccuguaguguaccauucuc

SEQ ID NO: 1767437 - RNA, 17 nt, Homo sapiens
cuaaaaaguuccaugaa

SEQ ID NO: 1767438 - RNA, 22 nt, Homo sapiens
cuacgugggagucugugcauuu

SEQ ID NO: 1767439 - RNA, 18 nt, Homo sapiens
ucaaagaugcguuugccu

SEQ ID NO: 1767440 - RNA, 14 nt, Homo sapiens
gaagccuuugccag

SEQ ID NO: 1767441 - RNA, 15 nt, Homo sapiens
uaucacaaaaccacc

SEQ ID NO: 1767442 - RNA, 20 nt, Homo sapiens
gauauacuauuuucauucuc

SEQ ID NO: 1767443 - RNA, 19 nt, Homo sapiens
cacggaacuggagaaggag

SEQ ID NO: 1767444 - RNA, 19 nt, Homo sapiens
ugugacauugauuugcucu

SEQ ID NO: 1767445 - RNA, 20 nt, Homo sapiens
uuccuauuuuagauggaaua

SEQ ID NO: 1767446 - RNA, 22 nt, Homo sapiens
aaagguuuaaugucagggucaa

SEQ ID NO: 1767447 - RNA, 22 nt, Homo sapiens
ggucuuugucagacauucugga

SEQ ID NO: 1767448 - RNA, 14 nt, Homo sapiens
ugugcuucugcuca

SEQ ID NO: 1767449 - RNA, 23 nt, Homo sapiens
gacauuaacaguuuuccaugaaa

SEQ ID NO: 1767450 - RNA, 17 nt, Homo sapiens
cuucauucacauucaga

SEQ ID NO: 1767451 - RNA, 15 nt, Homo sapiens
augauacagucucca

SEQ ID NO: 1767452 - RNA, 19 nt, Homo sapiens
acauugauuggcauauuaa

SEQ ID NO: 1767453 - RNA, 13 nt, Homo sapiens
uauggaggacugu

SEQ ID NO: 1767454 - RNA, 20 nt, Homo sapiens
gcacugaugcugccccucau

SEQ ID NO: 1767455 - RNA, 13 nt, Homo sapiens
uccuucuccggcc

SEQ ID NO: 1767456 - RNA, 21 nt, Homo sapiens
cccagauagguggugccagug

SEQ ID NO: 1767457 - RNA, 16 nt, Homo sapiens
ucuuugcaacugucuc

SEQ ID NO: 1767458 - RNA, 19 nt, Homo sapiens
gcugcuuugguuaaucucu

SEQ ID NO: 1767459 - RNA, 20 nt, Homo sapiens
aacugucacucauugcugag

SEQ ID NO: 1767460 - RNA, 21 nt, Homo sapiens
ccagccugcccaacgugguga

SEQ ID NO: 1767461 - RNA, 22 nt, Homo sapiens
aaacagagccuccuagauguaa

SEQ ID NO: 1767462 - RNA, 17 nt, Homo sapiens
uggagagaaagugacau

SEQ ID NO: 1767463 - RNA, 17 nt, Homo sapiens
cuaugacggugacucuu

SEQ ID NO: 1767464 - RNA, 21 nt, Homo sapiens
ucccacggggaccacugggcc

SEQ ID NO: 1767465 - RNA, 17 nt, Homo sapiens
ugggauuacaggcuccu

SEQ ID NO: 1767466 - RNA, 19 nt, Homo sapiens
cuggugcuucgugugcucc

SEQ ID NO: 1767467 - RNA, 22 nt, Homo sapiens
ccuaaaacucaaaacacccaaa

SEQ ID NO: 1767468 - RNA, 22 nt, Homo sapiens
caccuugcgauucugcagccac

SEQ ID NO: 1767469 - RNA, 18 nt, Homo sapiens
gggcuccgugugggagac

SEQ ID NO: 1767470 - RNA, 15 nt, Homo sapiens
uuuuaauagcacuaa

SEQ ID NO: 1767471 - RNA, 20 nt, Homo sapiens
ccugaaccagggccagauaa

SEQ ID NO: 1767472 - RNA, 19 nt, Homo sapiens
aacuuuuucuaagcuguuu

SEQ ID NO: 1767473 - RNA, 12 nt, Homo sapiens
caggcuggagcu

SEQ ID NO: 1767474 - RNA, 23 nt, Homo sapiens
uaaccccagauucaugcacugua

SEQ ID NO: 1767475 - RNA, 16 nt, Homo sapiens
acuuuuagacaguggu

SEQ ID NO: 1767476 - RNA, 18 nt, Homo sapiens
agccucccuucugccuug

SEQ ID NO: 1767477 - RNA, 24 nt, Homo sapiens
caugaacguuauuauauugucgaa

SEQ ID NO: 1767478 - RNA, 22 nt, Homo sapiens
caaugacugugcuacugucuuu

SEQ ID NO: 1767479 - RNA, 17 nt, Homo sapiens
guuuccugcuccagugu

SEQ ID NO: 1767480 - RNA, 13 nt, Homo sapiens
cgaggggcgcgau

SEQ ID NO: 1767481 - RNA, 17 nt, Homo sapiens
auuccaaauggugugaa

SEQ ID NO: 1767482 - RNA, 15 nt, Homo sapiens
uaucaauuaccacac

SEQ ID NO: 1767483 - RNA, 20 nt, Homo sapiens
uaauguggcagcugucucaa

SEQ ID NO: 1767484 - RNA, 14 nt, Homo sapiens
cauagcaugacauu

SEQ ID NO: 1767485 - RNA, 18 nt, Homo sapiens
accucauccaugcacuuu

SEQ ID NO: 1767486 - RNA, 20 nt, Homo sapiens
cucugaucccuuccuuguua

SEQ ID NO: 1767487 - RNA, 18 nt, Homo sapiens
cucuuacaagaguggacu

SEQ ID NO: 1767488 - RNA, 19 nt, Homo sapiens
ugucaguuauucuugcaaa

SEQ ID NO: 1767489 - RNA, 12 nt, Homo sapiens
cccaaagcuuua

SEQ ID NO: 1767490 - RNA, 19 nt, Homo sapiens
gcuguacuuuuaccaguuu

SEQ ID NO: 1767491 - RNA, 15 nt, Homo sapiens
gaaauaaagaucuca

SEQ ID NO: 1767492 - RNA, 20 nt, Homo sapiens
cagaaagagagaaccaagcu

SEQ ID NO: 1767493 - RNA, 17 nt, Homo sapiens
gacauucuucacugucu

SEQ ID NO: 1767494 - RNA, 19 nt, Homo sapiens
uaugaucucucuagcuuug

SEQ ID NO: 1767495 - RNA, 16 nt, Homo sapiens
augucuacuccucaca

SEQ ID NO: 1767496 - RNA, 21 nt, Homo sapiens
cagcccagagacuuuguagau

SEQ ID NO: 1767497 - RNA, 13 nt, Homo sapiens
aauuuaagacuug

SEQ ID NO: 1767498 - RNA, 13 nt, Homo sapiens
ucuuuaaguauug

SEQ ID NO: 1767499 - RNA, 13 nt, Homo sapiens
gaaggaaggcagu

SEQ ID NO: 1767500 - RNA, 18 nt, Homo sapiens
cucaggggacacuggccc

SEQ ID NO: 1767501 - RNA, 22 nt, Homo sapiens
agacaggcaaauguacuucuca

SEQ ID NO: 1767502 - RNA, 20 nt, Homo sapiens
ccaaccccccagcacugagg

SEQ ID NO: 1767503 - RNA, 23 nt, Homo sapiens
ccugucuaaagccuuaacuaaga

SEQ ID NO: 1767504 - RNA, 19 nt, Homo sapiens
cauggauauguuauacuga

SEQ ID NO: 1767505 - RNA, 13 nt, Homo sapiens
ugugcccagagau

SEQ ID NO: 1767506 - RNA, 16 nt, Homo sapiens
caucaaaaacaucacu

SEQ ID NO: 1767507 - RNA, 23 nt, Homo sapiens
uuuauauguguugaaaaccaaaa

SEQ ID NO: 1767508 - RNA, 15 nt, Homo sapiens
uauuaacggugguga

SEQ ID NO: 1767509 - RNA, 19 nt, Homo sapiens
aaggccccgagcucagggc

SEQ ID NO: 1767510 - RNA, 20 nt, Homo sapiens
ccuccucgugaaagugcauu

SEQ ID NO: 1767511 - RNA, 13 nt, Homo sapiens
gauaugcacacac

SEQ ID NO: 1767512 - RNA, 16 nt, Homo sapiens
ccuguguuucaagcua

SEQ ID NO: 1767513 - RNA, 17 nt, Homo sapiens
ucagggaaaaggaguag

SEQ ID NO: 1767514 - RNA, 18 nt, Homo sapiens
acuaguaucucuggccuc

SEQ ID NO: 1767515 - RNA, 16 nt, Homo sapiens
ugucaaaggucuaaaa

SEQ ID NO: 1767516 - RNA, 23 nt, Homo sapiens
caccuccgccagauccugcagaa

SEQ ID NO: 1767517 - RNA, 15 nt, Homo sapiens
agacaaaugucuuga

SEQ ID NO: 1767518 - RNA, 19 nt, Homo sapiens
auaaaguugcacugugacu

SEQ ID NO: 1767519 - RNA, 14 nt, Homo sapiens
uuaauagacauuuu

SEQ ID NO: 1767520 - RNA, 13 nt, Homo sapiens
uaauaaagacacu

SEQ ID NO: 1767521 - RNA, 18 nt, Homo sapiens
agcuuaauuuucugugga

SEQ ID NO: 1767522 - RNA, 15 nt, Homo sapiens
caacuaccauuccuu

SEQ ID NO: 1767523 - RNA, 12 nt, Homo sapiens
gaaggugucaua

SEQ ID NO: 1767524 - RNA, 14 nt, Homo sapiens
cuucuggcuguaga

SEQ ID NO: 1767525 - RNA, 17 nt, Homo sapiens
accaucggguguaggug

SEQ ID NO: 1767526 - RNA, 17 nt, Homo sapiens
uucuugugaaggccaug

SEQ ID NO: 1767527 - RNA, 21 nt, Homo sapiens
uuagucuccuaauaaguuccu

SEQ ID NO: 1767528 - RNA, 18 nt, Homo sapiens
cauaaaaccaaguuuuac

SEQ ID NO: 1767529 - RNA, 13 nt, Homo sapiens
auguggucaugga

SEQ ID NO: 1767530 - RNA, 21 nt, Homo sapiens
cucuauuucuagagacaacaa

SEQ ID NO: 1767531 - RNA, 21 nt, Homo sapiens
cgcuaaggugaaaaggggugu

SEQ ID NO: 1767532 - RNA, 21 nt, Homo sapiens
acuuguaauuucuaacuccuu

SEQ ID NO: 1767533 - RNA, 21 nt, Homo sapiens
acaugcucugcaguccuggcc

SEQ ID NO: 1767534 - RNA, 15 nt, Homo sapiens
auucugaggcaggua

SEQ ID NO: 1767535 - RNA, 19 nt, Homo sapiens
caaugugaaacacaugcca

SEQ ID NO: 1767536 - RNA, 20 nt, Homo sapiens
auguaccacauaacaacauc

SEQ ID NO: 1767537 - RNA, 13 nt, Homo sapiens
uaacagcugggga

SEQ ID NO: 1767538 - RNA, 22 nt, Homo sapiens
cuucagagaucauggaacacaa

SEQ ID NO: 1767539 - RNA, 18 nt, Homo sapiens
uauuugcagaagcuguga

SEQ ID NO: 1767540 - RNA, 19 nt, Homo sapiens
aaagugucguaucugggag

SEQ ID NO: 1767541 - RNA, 15 nt, Homo sapiens
agaugaaauugccaa

SEQ ID NO: 1767542 - RNA, 13 nt, Homo sapiens
ccucuccuggacu

SEQ ID NO: 1767543 - RNA, 15 nt, Homo sapiens
aagauggccaugccc

SEQ ID NO: 1767544 - RNA, 15 nt, Homo sapiens
gaucuggugccucca

SEQ ID NO: 1767545 - RNA, 18 nt, Homo sapiens
aguugcugaauguugcau

SEQ ID NO: 1767546 - RNA, 15 nt, Homo sapiens
gaaggugacacugcu

SEQ ID NO: 1767547 - RNA, 18 nt, Homo sapiens
cugagaaugaaugaguag

SEQ ID NO: 1767548 - RNA, 14 nt, Homo sapiens
gccucgagugcccc

SEQ ID NO: 1767549 - RNA, 20 nt, Homo sapiens
cccucggugcagagugcaga

SEQ ID NO: 1767550 - RNA, 23 nt, Homo sapiens
ucucauuguguggucauaucuag

SEQ ID NO: 1767551 - RNA, 15 nt, Homo sapiens
caucagcauaccuuu

SEQ ID NO: 1767552 - RNA, 12 nt, Homo sapiens
auucucccugga

SEQ ID NO: 1767553 - RNA, 20 nt, Homo sapiens
caaacccuggugcuuuccuu

SEQ ID NO: 1767554 - RNA, 21 nt, Homo sapiens
guucagccuucguguggcucc

SEQ ID NO: 1767555 - RNA, 16 nt, Homo sapiens
augaaacgucaugugu

SEQ ID NO: 1767556 - RNA, 17 nt, Homo sapiens
ucgcccgaaacaccaag

SEQ ID NO: 1767557 - RNA, 14 nt, Homo sapiens
aauauuaaagccau

SEQ ID NO: 1767558 - RNA, 18 nt, Homo sapiens
gaauauaugucagugaug

SEQ ID NO: 1767559 - RNA, 16 nt, Homo sapiens
ugacaagccuucuuaa

SEQ ID NO: 1767560 - RNA, 13 nt, Homo sapiens
cauguucuuguca

SEQ ID NO: 1767561 - RNA, 12 nt, Homo sapiens
cacacacuggcu

SEQ ID NO: 1767562 - RNA, 19 nt, Homo sapiens
aguuucuaucccuuaccug

SEQ ID NO: 1767563 - RNA, 21 nt, Homo sapiens
auuuauaaaacuucucaagau

SEQ ID NO: 1767564 - RNA, 17 nt, Homo sapiens
accgcaauaaugaauga

SEQ ID NO: 1767565 - RNA, 21 nt, Homo sapiens
aggcaccguggcucacgucug

SEQ ID NO: 1767566 - RNA, 16 nt, Homo sapiens
caucauuaaccaguaa

SEQ ID NO: 1767567 - RNA, 13 nt, Homo sapiens
uacacgacucagu

SEQ ID NO: 1767568 - RNA, 23 nt, Homo sapiens
uugcccaggcuggagugcaaugg

SEQ ID NO: 1767569 - RNA, 20 nt, Homo sapiens
agcccaggcuggagugcaau

SEQ ID NO: 1767570 - RNA, 18 nt, Homo sapiens
acaggaauacuuaacuca

SEQ ID NO: 1767571 - RNA, 21 nt, Homo sapiens
auagcauuuggagauauaccu

SEQ ID NO: 1767572 - RNA, 14 nt, Homo sapiens
guuacucauuuuau

SEQ ID NO: 1767573 - RNA, 13 nt, Homo sapiens
aaucuaccaagaa

SEQ ID NO: 1767574 - RNA, 16 nt, Homo sapiens
uaacuccagugaagua

SEQ ID NO: 1767575 - RNA, 13 nt, Homo sapiens
uggcuaccuguaa

SEQ ID NO: 1767576 - RNA, 18 nt, Homo sapiens
augcuguguccacggggu

SEQ ID NO: 1767577 - RNA, 15 nt, Homo sapiens
cucuuuucuacauac

SEQ ID NO: 1767578 - RNA, 16 nt, Homo sapiens
cuuuaaaaugcaaaau

SEQ ID NO: 1767579 - RNA, 22 nt, Homo sapiens
gcugagacaggaggauugccug

SEQ ID NO: 1767580 - RNA, 21 nt, Homo sapiens
aaacguaaguacuccauugua

SEQ ID NO: 1767581 - RNA, 19 nt, Homo sapiens
gagauuauaaguuugacac

SEQ ID NO: 1767582 - RNA, 14 nt, Homo sapiens
caugugcacaugca

SEQ ID NO: 1767583 - RNA, 14 nt, Homo sapiens
ugugcacaugugug

SEQ ID NO: 1767584 - RNA, 17 nt, Homo sapiens
aaugucaggaacagaag

SEQ ID NO: 1767585 - RNA, 15 nt, Homo sapiens
auucuuuuaagaaca

SEQ ID NO: 1767586 - RNA, 16 nt, Homo sapiens
accagguuugcaggag

SEQ ID NO: 1767587 - RNA, 14 nt, Homo sapiens
uuguguuugugcca

SEQ ID NO: 1767588 - RNA, 17 nt, Homo sapiens
agauaucaugauuuuau

SEQ ID NO: 1767589 - RNA, 22 nt, Homo sapiens
uaacaguuugauauuuuguuaa

SEQ ID NO: 1767590 - RNA, 16 nt, Homo sapiens
gaagcacacagaauua

SEQ ID NO: 1767591 - RNA, 17 nt, Homo sapiens
ggcgcucucccuaccuu

SEQ ID NO: 1767592 - RNA, 18 nt, Homo sapiens
aacauggcaauugcacuc

SEQ ID NO: 1767593 - RNA, 19 nt, Homo sapiens
uuaacaaguuagaaaauuc

SEQ ID NO: 1767594 - RNA, 19 nt, Homo sapiens
ccagguuuuaauaaccaca

SEQ ID NO: 1767595 - RNA, 17 nt, Homo sapiens
cauaaaaaaacuuccau

SEQ ID NO: 1767596 - RNA, 12 nt, Homo sapiens
auguuugcaaug

SEQ ID NO: 1767597 - RNA, 12 nt, Homo sapiens
ucugaaccuguc

SEQ ID NO: 1767598 - RNA, 19 nt, Homo sapiens
caucccacuccacuauguu

SEQ ID NO: 1767599 - RNA, 15 nt, Homo sapiens
uggugcucauuucau

SEQ ID NO: 1767600 - RNA, 15 nt, Homo sapiens
caaagaguuauauga

SEQ ID NO: 1767601 - RNA, 23 nt, Homo sapiens
aagacugucaaaugaacuuuuac

SEQ ID NO: 1767602 - RNA, 14 nt, Homo sapiens
auccguucauucau

SEQ ID NO: 1767603 - RNA, 11 nt, Homo sapiens
gacaacaggca

SEQ ID NO: 1767604 - RNA, 19 nt, Homo sapiens
gcuuuacagaugacucacu

SEQ ID NO: 1767605 - RNA, 21 nt, Homo sapiens
cuuauucacugaaguucuccu

SEQ ID NO: 1767606 - RNA, 15 nt, Homo sapiens
gguaugaaagugccu

SEQ ID NO: 1767607 - RNA, 14 nt, Homo sapiens
cuuccagugcucag

SEQ ID NO: 1767608 - RNA, 15 nt, Homo sapiens
cuugccaugugcugg

SEQ ID NO: 1767609 - RNA, 18 nt, Homo sapiens
gacgcggcaggcuucuca

SEQ ID NO: 1767610 - RNA, 12 nt, Homo sapiens
acagccaugauu

SEQ ID NO: 1767611 - RNA, 20 nt, Homo sapiens
cuccaagauuuaaccugcaa

SEQ ID NO: 1767612 - RNA, 18 nt, Homo sapiens
guggguguggccagcaca

SEQ ID NO: 1767613 - RNA, 15 nt, Homo sapiens
ugcggaguccaggcu

SEQ ID NO: 1767614 - RNA, 19 nt, Homo sapiens
caaauacuuagacaguaug

SEQ ID NO: 1767615 - RNA, 15 nt, Homo sapiens
guccuggugucucca

SEQ ID NO: 1767616 - RNA, 18 nt, Homo sapiens
uuuggcaguucaaaagac

SEQ ID NO: 1767617 - RNA, 17 nt, Homo sapiens
cacaacauuacagggaa

SEQ ID NO: 1767618 - RNA, 20 nt, Homo sapiens
gccuggggguuuuccaagcc

SEQ ID NO: 1767619 - RNA, 22 nt, Homo sapiens
ucaagcagacgugagugugacu

SEQ ID NO: 1767620 - RNA, 14 nt, Homo sapiens
ccaucaagugcagu

SEQ ID NO: 1767621 - RNA, 19 nt, Homo sapiens
ucccccauggaaacugccc

SEQ ID NO: 1767622 - RNA, 9 nt, Homo sapiens
acucucuuc

SEQ ID NO: 1767623 - RNA, 18 nt, Homo sapiens
aaucuguugauaaaucca

SEQ ID NO: 1767624 - RNA, 22 nt, Homo sapiens
gacaaugggagacuccaucuca

SEQ ID NO: 1767625 - RNA, 13 nt, Homo sapiens
auuccagcauuug

SEQ ID NO: 1767626 - RNA, 13 nt, Homo sapiens
ugcugagcugccc

SEQ ID NO: 1767627 - RNA, 21 nt, Homo sapiens
ucagugaagcccaggaggacc

SEQ ID NO: 1767628 - RNA, 19 nt, Homo sapiens
gagcauuuauaaauggaca

SEQ ID NO: 1767629 - RNA, 22 nt, Homo sapiens
uaauuagugaaaauuuuacaca

SEQ ID NO: 1767630 - RNA, 16 nt, Homo sapiens
ucacuuuaaauaugaa

SEQ ID NO: 1767631 - RNA, 14 nt, Homo sapiens
auccuaccaaccuc

SEQ ID NO: 1767632 - RNA, 18 nt, Homo sapiens
caaccugccugacauuug

SEQ ID NO: 1767633 - RNA, 18 nt, Homo sapiens
aaugaaugaaugagccaa

SEQ ID NO: 1767634 - RNA, 17 nt, Homo sapiens
aaucagauuagacacua

SEQ ID NO: 1767635 - RNA, 14 nt, Homo sapiens
cucacagcuguaau

SEQ ID NO: 1767636 - RNA, 17 nt, Homo sapiens
acuacaaacacaagcaa

SEQ ID NO: 1767637 - RNA, 15 nt, Homo sapiens
ccuggaggcacugaa

SEQ ID NO: 1767638 - RNA, 23 nt, Homo sapiens
caugcuuucccaccagcauguca

SEQ ID NO: 1767639 - RNA, 16 nt, Homo sapiens
auucaugaaaugugga

SEQ ID NO: 1767640 - RNA, 23 nt, Homo sapiens
uucugcccgggaaggucaccagc

SEQ ID NO: 1767641 - RNA, 12 nt, Homo sapiens
cuaugucuguga

SEQ ID NO: 1767642 - RNA, 19 nt, Homo sapiens
ucaggugcauuccaccaca

SEQ ID NO: 1767643 - RNA, 12 nt, Homo sapiens
ucugacucucca

SEQ ID NO: 1767644 - RNA, 22 nt, Homo sapiens
uaccacuguggaagucccucag

SEQ ID NO: 1767645 - RNA, 18 nt, Homo sapiens
ugaaaaaagaacaggaua

SEQ ID NO: 1767646 - RNA, 23 nt, Homo sapiens
uacuacauacaagcauaagcaaa

SEQ ID NO: 1767647 - RNA, 17 nt, Homo sapiens
gaaucaaaucucuucca

SEQ ID NO: 1767648 - RNA, 14 nt, Homo sapiens
uauucaaccaugga

SEQ ID NO: 1767649 - RNA, 14 nt, Homo sapiens
uguagaccuuucuc

SEQ ID NO: 1767650 - RNA, 12 nt, Homo sapiens
gaaucugaugaa

SEQ ID NO: 1767651 - RNA, 12 nt, Homo sapiens
cacauucuuaga

SEQ ID NO: 1767652 - RNA, 19 nt, Homo sapiens
auuuucuacaguacaugac

SEQ ID NO: 1767653 - RNA, 20 nt, Homo sapiens
agggcuaugccuccauuuca

SEQ ID NO: 1767654 - RNA, 19 nt, Homo sapiens
ucuuauucccaaacuacag

SEQ ID NO: 1767655 - RNA, 19 nt, Homo sapiens
aggagaaacuggaacucuc

SEQ ID NO: 1767656 - RNA, 18 nt, Homo sapiens
uuacaguauuauugugaa

SEQ ID NO: 1767657 - RNA, 17 nt, Homo sapiens
gcugucccgugcauggg

SEQ ID NO: 1767658 - RNA, 12 nt, Homo sapiens
cuccugaccucg

SEQ ID NO: 1767659 - RNA, 19 nt, Homo sapiens
uaaucuguaaucacauuuc

SEQ ID NO: 1767660 - RNA, 19 nt, Homo sapiens
uauucugauuacacaaaac

SEQ ID NO: 1767661 - RNA, 16 nt, Homo sapiens
aagagaaccgagcaaa

SEQ ID NO: 1767662 - RNA, 16 nt, Homo sapiens
caaacaacaggggaaa

SEQ ID NO: 1767663 - RNA, 11 nt, Homo sapiens
agcaacaaaga

SEQ ID NO: 1767664 - RNA, 11 nt, Homo sapiens
gccaacaagca

SEQ ID NO: 1767665 - RNA, 21 nt, Homo sapiens
caucugugcacugcccaugga

SEQ ID NO: 1767666 - RNA, 16 nt, Homo sapiens
uggaauauaaauauca

SEQ ID NO: 1767667 - RNA, 17 nt, Homo sapiens
uagaagaaaagcacugg

SEQ ID NO: 1767668 - RNA, 21 nt, Homo sapiens
cugcacaccaguuacuguuca

SEQ ID NO: 1767669 - RNA, 14 nt, Homo sapiens
aaauacucugcuau

SEQ ID NO: 1767670 - RNA, 23 nt, Homo sapiens
gaagagacucuguuugcuugugu

SEQ ID NO: 1767671 - RNA, 12 nt, Homo sapiens
ccugaaucacaa

SEQ ID NO: 1767672 - RNA, 22 nt, Homo sapiens
augaggaauuucuguucuucca

SEQ ID NO: 1767673 - RNA, 20 nt, Homo sapiens
uagaaagcuuugaaugcaga

SEQ ID NO: 1767674 - RNA, 16 nt, Homo sapiens
agcauauuaccagcua

SEQ ID NO: 1767675 - RNA, 14 nt, Homo sapiens
cauuaccacacuca

SEQ ID NO: 1767676 - RNA, 14 nt, Homo sapiens
ugucaccaugccca

SEQ ID NO: 1767677 - RNA, 21 nt, Homo sapiens
uauguuuuauuagcauuuuca

SEQ ID NO: 1767678 - RNA, 20 nt, Homo sapiens
gugacaaguagggcacaaaa

SEQ ID NO: 1767679 - RNA, 18 nt, Homo sapiens
ucucuccaucuaccuucc

SEQ ID NO: 1767680 - RNA, 20 nt, Homo sapiens
aauugaagcaacuacaacuu

SEQ ID NO: 1767681 - RNA, 21 nt, Homo sapiens
caaagugccagagucuaggcu

SEQ ID NO: 1767682 - RNA, 15 nt, Homo sapiens
acacuugaaccuaau

SEQ ID NO: 1767683 - RNA, 23 nt, Homo sapiens
caaaguuaugcaagggacugugu

SEQ ID NO: 1767684 - RNA, 21 nt, Homo sapiens
caguaguucacauacaaauca

SEQ ID NO: 1767685 - RNA, 23 nt, Homo sapiens
cccaacuaaaauuugaaguaguu

SEQ ID NO: 1767686 - RNA, 22 nt, Homo sapiens
agauccugcagaaguacuccua

SEQ ID NO: 1767687 - RNA, 14 nt, Homo sapiens
agcccgugccccac

SEQ ID NO: 1767688 - RNA, 12 nt, Homo sapiens
uggaccaguaga

SEQ ID NO: 1767689 - RNA, 22 nt, Homo sapiens
acagaugaccguguacaauacc

SEQ ID NO: 1767690 - RNA, 14 nt, Homo sapiens
agaguuugucauua

SEQ ID NO: 1767691 - RNA, 22 nt, Homo sapiens
aggacccugaaggggccaugau

SEQ ID NO: 1767692 - RNA, 15 nt, Homo sapiens
ucacaugacauccac

SEQ ID NO: 1767693 - RNA, 14 nt, Homo sapiens
gggccggccagugg

SEQ ID NO: 1767694 - RNA, 15 nt, Homo sapiens
acaaauaacaucuca

SEQ ID NO: 1767695 - RNA, 23 nt, Homo sapiens
ucauaacagaacuuauucuccau

SEQ ID NO: 1767696 - RNA, 19 nt, Homo sapiens
accucgagcagaugaugcc

SEQ ID NO: 1767697 - RNA, 23 nt, Homo sapiens
gaaagggagcagagaaggccagg

SEQ ID NO: 1767698 - RNA, 19 nt, Homo sapiens
ggaagccaaaguauucaua

SEQ ID NO: 1767699 - RNA, 22 nt, Homo sapiens
auagcaauuccccuacaucaaa

SEQ ID NO: 1767700 - RNA, 22 nt, Homo sapiens
gacagaaccacugagucuuuug

SEQ ID NO: 1767701 - RNA, 21 nt, Homo sapiens
aggcaaggggugccugggaac

SEQ ID NO: 1767702 - RNA, 14 nt, Homo sapiens
uuuaggaguauuau

SEQ ID NO: 1767703 - RNA, 21 nt, Homo sapiens
uccuuggaagagaaugucuga

SEQ ID NO: 1767704 - RNA, 14 nt, Homo sapiens
cugagagaggccau

SEQ ID NO: 1767705 - RNA, 15 nt, Homo sapiens
guguugcaccaggca

SEQ ID NO: 1767706 - RNA, 14 nt, Homo sapiens
cuuuuuuucuguca

SEQ ID NO: 1767707 - RNA, 17 nt, Homo sapiens
gcuuuaaacucagggac

SEQ ID NO: 1767708 - RNA, 18 nt, Homo sapiens
agaagauggcccagcucc

SEQ ID NO: 1767709 - RNA, 15 nt, Homo sapiens
cugugcaguaagccu

SEQ ID NO: 1767710 - RNA, 14 nt, Homo sapiens
cccacuccagucca

SEQ ID NO: 1767711 - RNA, 16 nt, Homo sapiens
gccuauuuaccugcag

SEQ ID NO: 1767712 - RNA, 23 nt, Homo sapiens
augaaaaauaguguguccaugca

SEQ ID NO: 1767713 - RNA, 24 nt, Homo sapiens
ccaauuaauuccuguuugucuaca

SEQ ID NO: 1767714 - RNA, 14 nt, Homo sapiens
uccuaaauuuuccu

SEQ ID NO: 1767715 - RNA, 14 nt, Homo sapiens
gucucaaugcucau

SEQ ID NO: 1767716 - RNA, 14 nt, Homo sapiens
uacaaucucaaauu

SEQ ID NO: 1767717 - RNA, 21 nt, Homo sapiens
ugucccucuccuauguggcag

SEQ ID NO: 1767718 - RNA, 21 nt, Homo sapiens
ccccacugccugucccagaga

SEQ ID NO: 1767719 - RNA, 21 nt, Homo sapiens
cacugggguuggaagugcaga

SEQ ID NO: 1767720 - RNA, 20 nt, Homo sapiens
cucucccaccccggccucca

SEQ ID NO: 1767721 - RNA, 16 nt, Homo sapiens
uguuacugaucaugca

SEQ ID NO: 1767722 - RNA, 23 nt, Homo sapiens
cacugauuccuuuaugaugacug

SEQ ID NO: 1767723 - RNA, 16 nt, Homo sapiens
ucauuucugccaugau

SEQ ID NO: 1767724 - RNA, 15 nt, Homo sapiens
aaggauucuauauca

SEQ ID NO: 1767725 - RNA, 14 nt, Homo sapiens
caacucuacuguug

SEQ ID NO: 1767726 - RNA, 21 nt, Homo sapiens
gcucuguccuaaauaucucaa

SEQ ID NO: 1767727 - RNA, 22 nt, Homo sapiens
ggacucugcagccucagagaca

SEQ ID NO: 1767728 - RNA, 12 nt, Homo sapiens
cucuuuuaccaa

SEQ ID NO: 1767729 - RNA, 22 nt, Homo sapiens
guuuacaaguaaauaguuugaa

SEQ ID NO: 1767730 - RNA, 15 nt, Homo sapiens
caagauuaaauaucc

SEQ ID NO: 1767731 - RNA, 22 nt, Homo sapiens
ucccugagaagccucaugggag

SEQ ID NO: 1767732 - RNA, 17 nt, Homo sapiens
gccagugacuccaggag

SEQ ID NO: 1767733 - RNA, 18 nt, Homo sapiens
caaugugaaaaauguguc

SEQ ID NO: 1767734 - RNA, 13 nt, Homo sapiens
cucuugaagcaua

SEQ ID NO: 1767735 - RNA, 13 nt, Homo sapiens
cuccagaagcacu

SEQ ID NO: 1767736 - RNA, 15 nt, Homo sapiens
ccgcugucucugagg

SEQ ID NO: 1767737 - RNA, 19 nt, Homo sapiens
cuucuauuuaaugcuucca

SEQ ID NO: 1767738 - RNA, 22 nt, Homo sapiens
uuagcagggauguuccuuacca

SEQ ID NO: 1767739 - RNA, 20 nt, Homo sapiens
aaaaauaaauucaaauuauu

SEQ ID NO: 1767740 - RNA, 17 nt, Homo sapiens
guggugggacacugggc

SEQ ID NO: 1767741 - RNA, 15 nt, Homo sapiens
ccaugcaugugcaua

SEQ ID NO: 1767742 - RNA, 13 nt, Homo sapiens
uauaucucuguaa

SEQ ID NO: 1767743 - RNA, 14 nt, Homo sapiens
cauuuuauugacug

SEQ ID NO: 1767744 - RNA, 20 nt, Homo sapiens
uauauugaagacaauuugau

SEQ ID NO: 1767745 - RNA, 14 nt, Homo sapiens
ugagccuacugucu

SEQ ID NO: 1767746 - RNA, 13 nt, Homo sapiens
gaaucaaauccaa

SEQ ID NO: 1767747 - RNA, 23 nt, Homo sapiens
uucaugaaacuguccaccaagau

SEQ ID NO: 1767748 - RNA, 13 nt, Homo sapiens
uucaaauaucaaa

SEQ ID NO: 1767749 - RNA, 21 nt, Homo sapiens
agugggagaguaccugugugu

SEQ ID NO: 1767750 - RNA, 12 nt, Homo sapiens
uaguaaccaagg

SEQ ID NO: 1767751 - RNA, 14 nt, Homo sapiens
cagccuuuaucaag

SEQ ID NO: 1767752 - RNA, 11 nt, Homo sapiens
uuuccuaggau

SEQ ID NO: 1767753 - RNA, 11 nt, Homo sapiens
uacaucuccaa

SEQ ID NO: 1767754 - RNA, 18 nt, Homo sapiens
ggcguggaggaggaggga

SEQ ID NO: 1767755 - RNA, 20 nt, Homo sapiens
ccuuuuugaaaguugccuuu

SEQ ID NO: 1767756 - RNA, 20 nt, Homo sapiens
uccuacuuauugccaugugg

SEQ ID NO: 1767757 - RNA, 21 nt, Homo sapiens
cacagcagccccugcacaaag

SEQ ID NO: 1767758 - RNA, 18 nt, Homo sapiens
cagagaucucccuucuca

SEQ ID NO: 1767759 - RNA, 12 nt, Homo sapiens
uaggucugcauu

SEQ ID NO: 1767760 - RNA, 19 nt, Homo sapiens
cacucuguaguuacugugg

SEQ ID NO: 1767761 - RNA, 16 nt, Homo sapiens
gaugcugccugaguca

SEQ ID NO: 1767762 - RNA, 15 nt, Homo sapiens
aguguaaguucacaa

SEQ ID NO: 1767763 - RNA, 17 nt, Homo sapiens
caaucggguccagagac

SEQ ID NO: 1767764 - RNA, 13 nt, Homo sapiens
aaggaaccaacca

SEQ ID NO: 1767765 - RNA, 16 nt, Homo sapiens
ccgcccccagcagcuc

SEQ ID NO: 1767766 - RNA, 23 nt, Homo sapiens
uaggugaucucaguucucuuuca

SEQ ID NO: 1767767 - RNA, 17 nt, Homo sapiens
aguaugccuuaagcaga

SEQ ID NO: 1767768 - RNA, 14 nt, Homo sapiens
caggcacugcugca

SEQ ID NO: 1767769 - RNA, 14 nt, Homo sapiens
agccaucucaagca

SEQ ID NO: 1767770 - RNA, 13 nt, Homo sapiens
cauggaaggcaag

SEQ ID NO: 1767771 - RNA, 19 nt, Homo sapiens
cugccuguuauaacucugc

SEQ ID NO: 1767772 - RNA, 18 nt, Homo sapiens
caauaaucucuauuugag

SEQ ID NO: 1767773 - RNA, 18 nt, Homo sapiens
caauuaaacccagaacca

SEQ ID NO: 1767774 - RNA, 15 nt, Homo sapiens
gggaaggccucccag

SEQ ID NO: 1767775 - RNA, 13 nt, Homo sapiens
auagcccacagcu

SEQ ID NO: 1767776 - RNA, 16 nt, Homo sapiens
gccugaguccuggucc

SEQ ID NO: 1767777 - RNA, 21 nt, Homo sapiens
guuugagauggacacacuggu

SEQ ID NO: 1767778 - RNA, 22 nt, Homo sapiens
gcaucuauucuuuguaccaucu

SEQ ID NO: 1767779 - RNA, 17 nt, Homo sapiens
aaaaauagcaacuugug

SEQ ID NO: 1767780 - RNA, 18 nt, Homo sapiens
ggaaaugagaggcauuuc

SEQ ID NO: 1767781 - RNA, 16 nt, Homo sapiens
uauauuaugauugcau

SEQ ID NO: 1767782 - RNA, 22 nt, Homo sapiens
cuacugugucagggaacauauu

SEQ ID NO: 1767783 - RNA, 19 nt, Homo sapiens
gaaauaaaucacagaugca

SEQ ID NO: 1767784 - RNA, 21 nt, Homo sapiens
cuuucuuccuccaauccccag

SEQ ID NO: 1767785 - RNA, 15 nt, Homo sapiens
cuuuuauacaauaau

SEQ ID NO: 1767786 - RNA, 15 nt, Homo sapiens
auaaaucaaauauuc

SEQ ID NO: 1767787 - RNA, 24 nt, Homo sapiens
cuaaagaaucuaauucuguugauu

SEQ ID NO: 1767788 - RNA, 17 nt, Homo sapiens
ccccuaacugauuucca

SEQ ID NO: 1767789 - RNA, 20 nt, Homo sapiens
ucucuccacugugcuuucag

SEQ ID NO: 1767790 - RNA, 18 nt, Homo sapiens
agauuaaauaugaucacu

SEQ ID NO: 1767791 - RNA, 22 nt, Homo sapiens
ggagcagcuauuuuaagccauc

SEQ ID NO: 1767792 - RNA, 18 nt, Homo sapiens
ucaccccaacuaguagcu

SEQ ID NO: 1767793 - RNA, 15 nt, Homo sapiens
ugccuucagccaaga

SEQ ID NO: 1767794 - RNA, 19 nt, Homo sapiens
uuggcuuuuucagagucau

SEQ ID NO: 1767795 - RNA, 20 nt, Homo sapiens
uuguugauaaggaacauuua

SEQ ID NO: 1767796 - RNA, 15 nt, Homo sapiens
ccuugccugcacaaa

SEQ ID NO: 1767797 - RNA, 13 nt, Homo sapiens
aagaccaccacuu

SEQ ID NO: 1767798 - RNA, 21 nt, Homo sapiens
gaguccgcccaucccugacca

SEQ ID NO: 1767799 - RNA, 19 nt, Homo sapiens
cagccucccaaguagcugg

SEQ ID NO: 1767800 - RNA, 15 nt, Homo sapiens
accacaaccuugcag

SEQ ID NO: 1767801 - RNA, 14 nt, Homo sapiens
uucugcuagcuaua

SEQ ID NO: 1767802 - RNA, 21 nt, Homo sapiens
accuuuguguaaagaagggaa

SEQ ID NO: 1767803 - RNA, 13 nt, Homo sapiens
agugaaaaaucug

SEQ ID NO: 1767804 - RNA, 15 nt, Homo sapiens
ccaugggacagggag

SEQ ID NO: 1767805 - RNA, 16 nt, Homo sapiens
ugaaugaaagucuugu

SEQ ID NO: 1767806 - RNA, 19 nt, Homo sapiens
uuucuaaccaaagagucuc

SEQ ID NO: 1767807 - RNA, 14 nt, Homo sapiens
auuauuuuaaucua

SEQ ID NO: 1767808 - RNA, 14 nt, Homo sapiens
guuucuucuuguca

SEQ ID NO: 1767809 - RNA, 21 nt, Homo sapiens
auuucauaccuaucaucuuaa

SEQ ID NO: 1767810 - RNA, 16 nt, Homo sapiens
uugcagcaggugguaa

SEQ ID NO: 1767811 - RNA, 17 nt, Homo sapiens
ccagaaggcgugcuggc

SEQ ID NO: 1767812 - RNA, 19 nt, Homo sapiens
ugccuuccucucucuacca

SEQ ID NO: 1767813 - RNA, 15 nt, Homo sapiens
cugaaagcaacagcu

SEQ ID NO: 1767814 - RNA, 15 nt, Homo sapiens
cagucccagccucug

SEQ ID NO: 1767815 - RNA, 18 nt, Homo sapiens
guguugugggaugaccgc

SEQ ID NO: 1767816 - RNA, 16 nt, Homo sapiens
guuauuauuauuauau

SEQ ID NO: 1767817 - RNA, 16 nt, Homo sapiens
gaaccauuuacaugca

SEQ ID NO: 1767818 - RNA, 14 nt, Homo sapiens
ugauagagccuuug

SEQ ID NO: 1767819 - RNA, 16 nt, Homo sapiens
uaaagacaaauuuugc

SEQ ID NO: 1767820 - RNA, 14 nt, Homo sapiens
aguuucuuccauuc

SEQ ID NO: 1767821 - RNA, 21 nt, Homo sapiens
uguacagaguuuuguaacaaa

SEQ ID NO: 1767822 - RNA, 18 nt, Homo sapiens
ucuagaguucagaguccu

SEQ ID NO: 1767823 - RNA, 18 nt, Homo sapiens
gaaaucuguaaagccagu

SEQ ID NO: 1767824 - RNA, 21 nt, Homo sapiens
uguacaguauguucaaaguca

SEQ ID NO: 1767825 - RNA, 15 nt, Homo sapiens
agaccaggagggcac

SEQ ID NO: 1767826 - RNA, 12 nt, Homo sapiens
auugugaugcuc

SEQ ID NO: 1767827 - RNA, 13 nt, Homo sapiens
ucacccuccucau

SEQ ID NO: 1767828 - RNA, 13 nt, Homo sapiens
cuucauagcugca

SEQ ID NO: 1767829 - RNA, 13 nt, Homo sapiens
gccauagaacaag

SEQ ID NO: 1767830 - RNA, 22 nt, Homo sapiens
ccauggaaggaagaaaagcugc

SEQ ID NO: 1767831 - RNA, 23 nt, Homo sapiens
uaauggucacaauaaaugccacu

SEQ ID NO: 1767832 - RNA, 22 nt, Homo sapiens
agucccuucugagcgagcacac

SEQ ID NO: 1767833 - RNA, 16 nt, Homo sapiens
uccacaccuggucuga

SEQ ID NO: 1767834 - RNA, 17 nt, Homo sapiens
cugcccaggacugcauu

SEQ ID NO: 1767835 - RNA, 16 nt, Homo sapiens
acaguucugucauaug

SEQ ID NO: 1767836 - RNA, 20 nt, Homo sapiens
ugaugggaggugugccagaa

SEQ ID NO: 1767837 - RNA, 14 nt, Homo sapiens
aauugguuuuccag

SEQ ID NO: 1767838 - RNA, 19 nt, Homo sapiens
guguggugucgucugugaa

SEQ ID NO: 1767839 - RNA, 13 nt, Homo sapiens
agccaagugcagg

SEQ ID NO: 1767840 - RNA, 17 nt, Homo sapiens
ugaagcuaugucucuag

SEQ ID NO: 1767841 - RNA, 22 nt, Homo sapiens
cuucaaugcaaaguacauguau

SEQ ID NO: 1767842 - RNA, 19 nt, Homo sapiens
uuaacuuuuuuucuucuac

SEQ ID NO: 1767843 - RNA, 23 nt, Homo sapiens
gugauuuuucugcacuaauauaa

SEQ ID NO: 1767844 - RNA, 21 nt, Homo sapiens
cacuggcuguuaaucuuucaa

SEQ ID NO: 1767845 - RNA, 19 nt, Homo sapiens
accuuugauuuuugcccag

SEQ ID NO: 1767846 - RNA, 12 nt, Homo sapiens
aaacuuugcaga

SEQ ID NO: 1767847 - RNA, 22 nt, Homo sapiens
cacuuggugauauguccuauau

SEQ ID NO: 1767848 - RNA, 18 nt, Homo sapiens
agagcccagucauuguac

SEQ ID NO: 1767849 - RNA, 19 nt, Homo sapiens
uuugagacggagucucgcu

SEQ ID NO: 1767850 - RNA, 19 nt, Homo sapiens
ccuuuuggguuugccuuaa

SEQ ID NO: 1767851 - RNA, 18 nt, Homo sapiens
caguuugugaacuucaca

SEQ ID NO: 1767852 - RNA, 12 nt, Homo sapiens
gguaguggguga

SEQ ID NO: 1767853 - RNA, 19 nt, Homo sapiens
uccaacuggaaggcuuuau

SEQ ID NO: 1767854 - RNA, 16 nt, Homo sapiens
ugcaccugccagccug

SEQ ID NO: 1767855 - RNA, 16 nt, Homo sapiens
cccgggggugaagggg

SEQ ID NO: 1767856 - RNA, 13 nt, Homo sapiens
cuguugccaggag

SEQ ID NO: 1767857 - RNA, 15 nt, Homo sapiens
gcauucacauugacc

SEQ ID NO: 1767858 - RNA, 20 nt, Homo sapiens
cauaugcccucaucauccca

SEQ ID NO: 1767859 - RNA, 16 nt, Homo sapiens
ucuuguagaugcauua

SEQ ID NO: 1767860 - RNA, 21 nt, Homo sapiens
ucauauuagauuacuaaguca

SEQ ID NO: 1767861 - RNA, 15 nt, Homo sapiens
gaucugcucagcccu

SEQ ID NO: 1767862 - RNA, 21 nt, Homo sapiens
cacgaugacgccucuggaccu

SEQ ID NO: 1767863 - RNA, 17 nt, Homo sapiens
acuucccgccuccauga

SEQ ID NO: 1767864 - RNA, 22 nt, Homo sapiens
ucacaugcccucggucacugag

SEQ ID NO: 1767865 - RNA, 16 nt, Homo sapiens
ucguuaacacauggcu

SEQ ID NO: 1767866 - RNA, 23 nt, Homo sapiens
uuaguggguaaagaccagggaug

SEQ ID NO: 1767867 - RNA, 14 nt, Homo sapiens
ugccuuaacuggag

SEQ ID NO: 1767868 - RNA, 21 nt, Homo sapiens
ucaucagagccuuuccucaaa

SEQ ID NO: 1767869 - RNA, 16 nt, Homo sapiens
ucaucucggaguucca

SEQ ID NO: 1767870 - RNA, 16 nt, Homo sapiens
acaugaaauacuuuaa

SEQ ID NO: 1767871 - RNA, 12 nt, Homo sapiens
caaaagguuaag

SEQ ID NO: 1767872 - RNA, 16 nt, Homo sapiens
gucucucuaagacaaa

SEQ ID NO: 1767873 - RNA, 13 nt, Homo sapiens
aaagguaugcauu

SEQ ID NO: 1767874 - RNA, 15 nt, Homo sapiens
accgugaggccaaga

SEQ ID NO: 1767875 - RNA, 23 nt, Homo sapiens
ucuaaaccccggcgugugcagug

SEQ ID NO: 1767876 - RNA, 17 nt, Homo sapiens
acaaaccacuguacaua

SEQ ID NO: 1767877 - RNA, 22 nt, Homo sapiens
aaauccucaccauccacagcaa

SEQ ID NO: 1767878 - RNA, 23 nt, Homo sapiens
uaccugaagggguuuucuugaua

SEQ ID NO: 1767879 - RNA, 15 nt, Homo sapiens
caauaacaguagugu

SEQ ID NO: 1767880 - RNA, 20 nt, Homo sapiens
gggagacagagguugcagug

SEQ ID NO: 1767881 - RNA, 16 nt, Homo sapiens
caaccuagaaacacac

SEQ ID NO: 1767882 - RNA, 20 nt, Homo sapiens
augaguauaaugaacacuca

SEQ ID NO: 1767883 - RNA, 17 nt, Homo sapiens
agugccuuacuauaugu

SEQ ID NO: 1767884 - RNA, 11 nt, Homo sapiens
aaugucacugg

SEQ ID NO: 1767885 - RNA, 12 nt, Homo sapiens
cuggcucaggaa

SEQ ID NO: 1767886 - RNA, 21 nt, Homo sapiens
guauccuggcaaauaauacua

SEQ ID NO: 1767887 - RNA, 22 nt, Homo sapiens
gcuaccaugacaaaaaggccaa

SEQ ID NO: 1767888 - RNA, 18 nt, Homo sapiens
uaacaacacuguguuaua

SEQ ID NO: 1767889 - RNA, 13 nt, Homo sapiens
cuuccuugccagu

SEQ ID NO: 1767890 - RNA, 12 nt, Homo sapiens
acccacagaugu

SEQ ID NO: 1767891 - RNA, 13 nt, Homo sapiens
guuaccuuuucau

SEQ ID NO: 1767892 - RNA, 16 nt, Homo sapiens
gacacucuccuugcag

SEQ ID NO: 1767893 - RNA, 23 nt, Homo sapiens
uaaacuuguguauugagucuuaa

SEQ ID NO: 1767894 - RNA, 19 nt, Homo sapiens
aagucaaguuuguggcuua

SEQ ID NO: 1767895 - RNA, 21 nt, Homo sapiens
ccuuaagcagaacaaaugugu

SEQ ID NO: 1767896 - RNA, 21 nt, Homo sapiens
cuauuaaagugccauuuccug

SEQ ID NO: 1767897 - RNA, 18 nt, Homo sapiens
ucucgccacugcacucca

SEQ ID NO: 1767898 - RNA, 16 nt, Homo sapiens
gugggcacugugccaa

SEQ ID NO: 1767899 - RNA, 21 nt, Homo sapiens
uggaauugcagcuguacugag

SEQ ID NO: 1767900 - RNA, 19 nt, Homo sapiens
gcaaaggcucucacuccag

SEQ ID NO: 1767901 - RNA, 14 nt, Homo sapiens
agcccagccuggga

SEQ ID NO: 1767902 - RNA, 18 nt, Homo sapiens
cuuucuuugcaccaaaga

SEQ ID NO: 1767903 - RNA, 15 nt, Homo sapiens
caccacccacuugau

SEQ ID NO: 1767904 - RNA, 15 nt, Homo sapiens
ucacagaagaugaag

SEQ ID NO: 1767905 - RNA, 17 nt, Homo sapiens
caaaacuagcauucuua

SEQ ID NO: 1767906 - RNA, 16 nt, Homo sapiens
acacauuaagccuucc

SEQ ID NO: 1767907 - RNA, 14 nt, Homo sapiens
uaauuccucaagca

SEQ ID NO: 1767908 - RNA, 16 nt, Homo sapiens
cugccagcuucaggug

SEQ ID NO: 1767909 - RNA, 11 nt, Homo sapiens
aauacaaggag

SEQ ID NO: 1767910 - RNA, 15 nt, Homo sapiens
uguaccugaugcuau

SEQ ID NO: 1767911 - RNA, 14 nt, Homo sapiens
acuuaccuaccaca

SEQ ID NO: 1767912 - RNA, 23 nt, Homo sapiens
auguaacuuaauuauaagcuaug

SEQ ID NO: 1767913 - RNA, 17 nt, Homo sapiens
uucccauuuuugcuuag

SEQ ID NO: 1767914 - RNA, 23 nt, Homo sapiens
gagauccuuuagugcacccagug

SEQ ID NO: 1767915 - RNA, 18 nt, Homo sapiens
cagcaccccuccuagcaa

SEQ ID NO: 1767916 - RNA, 13 nt, Homo sapiens
gcaucaucuaugg

SEQ ID NO: 1767917 - RNA, 18 nt, Homo sapiens
uccccagcaccuuccuga

SEQ ID NO: 1767918 - RNA, 17 nt, Homo sapiens
gguuguauaaagcaaaa

SEQ ID NO: 1767919 - RNA, 13 nt, Homo sapiens
uauuauguccauu

SEQ ID NO: 1767920 - RNA, 18 nt, Homo sapiens
cuaugaaaucaacugaca

SEQ ID NO: 1767921 - RNA, 15 nt, Homo sapiens
uggagaagaggaaga

SEQ ID NO: 1767922 - RNA, 15 nt, Homo sapiens
cugacucaccccaaa

SEQ ID NO: 1767923 - RNA, 20 nt, Homo sapiens
cuucagaucucuaacuucac

SEQ ID NO: 1767924 - RNA, 17 nt, Homo sapiens
ugccaugacugagaagg

SEQ ID NO: 1767925 - RNA, 21 nt, Homo sapiens
caggcuaucauauauacugua

SEQ ID NO: 1767926 - RNA, 14 nt, Homo sapiens
uugcuagccagcau

SEQ ID NO: 1767927 - RNA, 18 nt, Homo sapiens
agugggucccacuucccc

SEQ ID NO: 1767928 - RNA, 17 nt, Homo sapiens
ggcaacagauugaaaag

SEQ ID NO: 1767929 - RNA, 19 nt, Homo sapiens
ugucgccgucccucugccu

SEQ ID NO: 1767930 - RNA, 20 nt, Homo sapiens
ugauuaacaucuacaaucag

SEQ ID NO: 1767931 - RNA, 19 nt, Homo sapiens
cgggacugcugcucuccca

SEQ ID NO: 1767932 - RNA, 19 nt, Homo sapiens
aggaaauguaagauuucau

SEQ ID NO: 1767933 - RNA, 18 nt, Homo sapiens
aggcaggggaguagugga

SEQ ID NO: 1767934 - RNA, 17 nt, Homo sapiens
uaacucauguucauuca

SEQ ID NO: 1767935 - RNA, 13 nt, Homo sapiens
agguuuccugccu

SEQ ID NO: 1767936 - RNA, 20 nt, Homo sapiens
agcccauuucuccauacgca

SEQ ID NO: 1767937 - RNA, 20 nt, Homo sapiens
ucucggcucacugcauccuc

SEQ ID NO: 1767938 - RNA, 23 nt, Homo sapiens
accaguccuagccgcgugugaca

SEQ ID NO: 1767939 - RNA, 13 nt, Homo sapiens
cacucuacuacau

SEQ ID NO: 1767940 - RNA, 14 nt, Homo sapiens
agcaugcuuaccuu

SEQ ID NO: 1767941 - RNA, 20 nt, Homo sapiens
aacagcuguggcucacguga

SEQ ID NO: 1767942 - RNA, 16 nt, Homo sapiens
auuuagccauuaccca

SEQ ID NO: 1767943 - RNA, 20 nt, Homo sapiens
gaggagauaagguggcuucu

SEQ ID NO: 1767944 - RNA, 20 nt, Homo sapiens
uaugcccugcccuuccucag

SEQ ID NO: 1767945 - RNA, 20 nt, Homo sapiens
guauucugaucaguugccaa

SEQ ID NO: 1767946 - RNA, 13 nt, Homo sapiens
ucaugaaaguggg

SEQ ID NO: 1767947 - RNA, 15 nt, Homo sapiens
cuggcaggaccugcc

SEQ ID NO: 1767948 - RNA, 14 nt, Homo sapiens
ccuaagaaaaucau

SEQ ID NO: 1767949 - RNA, 15 nt, Homo sapiens
gaaaaguauuuccaa

SEQ ID NO: 1767950 - RNA, 16 nt, Homo sapiens
guccccucuugaccca

SEQ ID NO: 1767951 - RNA, 18 nt, Homo sapiens
gcuccuguucacaccaga

SEQ ID NO: 1767952 - RNA, 15 nt, Homo sapiens
aacuugcaauaccaa

SEQ ID NO: 1767953 - RNA, 14 nt, Homo sapiens
aucuaucaacuaua

SEQ ID NO: 1767954 - RNA, 16 nt, Homo sapiens
cugugcugaaagucag

SEQ ID NO: 1767955 - RNA, 19 nt, Homo sapiens
ccggcugugccagggugag

SEQ ID NO: 1767956 - RNA, 17 nt, Homo sapiens
aacucuuuuaagugccu

SEQ ID NO: 1767957 - RNA, 17 nt, Homo sapiens
accucagacaauccacu

SEQ ID NO: 1767958 - RNA, 20 nt, Homo sapiens
gcucuugaucagugugcuaa

SEQ ID NO: 1767959 - RNA, 10 nt, Homo sapiens
agagccucag

SEQ ID NO: 1767960 - RNA, 13 nt, Homo sapiens
uuuguauuugcca

SEQ ID NO: 1767961 - RNA, 22 nt, Homo sapiens
ugaaaaauucucagucaguaau

SEQ ID NO: 1767962 - RNA, 18 nt, Homo sapiens
aaaccaaaagugcauuca

SEQ ID NO: 1767963 - RNA, 13 nt, Homo sapiens
gcugaagucauug

SEQ ID NO: 1767964 - RNA, 16 nt, Homo sapiens
cacccucuuccuguga

SEQ ID NO: 1767965 - RNA, 22 nt, Homo sapiens
auguuuggggaucgaugugcuc

SEQ ID NO: 1767966 - RNA, 17 nt, Homo sapiens
uaucaccccuuccuccu

SEQ ID NO: 1767967 - RNA, 20 nt, Homo sapiens
cucagccucccaaaguucug

SEQ ID NO: 1767968 - RNA, 15 nt, Homo sapiens
acucagaaccugcuc

SEQ ID NO: 1767969 - RNA, 17 nt, Homo sapiens
cccgggagacucaaagg

SEQ ID NO: 1767970 - RNA, 12 nt, Homo sapiens
aacaguugcauu

SEQ ID NO: 1767971 - RNA, 18 nt, Homo sapiens
agcacuagccaaaccuca

SEQ ID NO: 1767972 - RNA, 17 nt, Homo sapiens
uugaaaauguccaggaa

SEQ ID NO: 1767973 - RNA, 15 nt, Homo sapiens
gaaagaggaagcaaa

SEQ ID NO: 1767974 - RNA, 11 nt, Homo sapiens
gggaaccucac

SEQ ID NO: 1767975 - RNA, 22 nt, Homo sapiens
agaaaccuacagaauacuagcc

SEQ ID NO: 1767976 - RNA, 15 nt, Homo sapiens
aucccaugagccuca

SEQ ID NO: 1767977 - RNA, 23 nt, Homo sapiens
accuuacauuugaaaucuaugaa

SEQ ID NO: 1767978 - RNA, 20 nt, Homo sapiens
aauccuggaccaagcacaaa

SEQ ID NO: 1767979 - RNA, 20 nt, Homo sapiens
ucaccuggucgccaauccau

SEQ ID NO: 1767980 - RNA, 14 nt, Homo sapiens
agcuuauacaauua

SEQ ID NO: 1767981 - RNA, 14 nt, Homo sapiens
cuggaugauucagg

SEQ ID NO: 1767982 - RNA, 21 nt, Homo sapiens
ugggggcauccuugaggaccu

SEQ ID NO: 1767983 - RNA, 22 nt, Homo sapiens
cugcauuauauuuauuacugua

SEQ ID NO: 1767984 - RNA, 19 nt, Homo sapiens
uaccuaugucaacaguaua

SEQ ID NO: 1767985 - RNA, 19 nt, Homo sapiens
gcagauccuuugucuacag

SEQ ID NO: 1767986 - RNA, 16 nt, Homo sapiens
augucucuuggaaaug

SEQ ID NO: 1767987 - RNA, 16 nt, Homo sapiens
uguugcuucugaauca

SEQ ID NO: 1767988 - RNA, 15 nt, Homo sapiens
aaaaagcuucugugg

SEQ ID NO: 1767989 - RNA, 15 nt, Homo sapiens
gugcagucacuggag

SEQ ID NO: 1767990 - RNA, 13 nt, Homo sapiens
aguggguggugga

SEQ ID NO: 1767991 - RNA, 16 nt, Homo sapiens
uuugacuuucugugua

SEQ ID NO: 1767992 - RNA, 22 nt, Homo sapiens
ccauuaagugguaguaauuucc

SEQ ID NO: 1767993 - RNA, 21 nt, Homo sapiens
ucaucuucccugccccugugc

SEQ ID NO: 1767994 - RNA, 14 nt, Homo sapiens
uccucucucccugc

SEQ ID NO: 1767995 - RNA, 23 nt, Homo sapiens
guuucuggauuucauacuguaac

SEQ ID NO: 1767996 - RNA, 16 nt, Homo sapiens
ucacauccuugacuuu

SEQ ID NO: 1767997 - RNA, 18 nt, Homo sapiens
ggaugaauaaauguuaua

SEQ ID NO: 1767998 - RNA, 20 nt, Homo sapiens
aacauuggacagugagguca

SEQ ID NO: 1767999 - RNA, 19 nt, Homo sapiens
cuggcacaauguuggagca

SEQ ID NO: 1768000 - RNA, 17 nt, Homo sapiens
uugaacuaacauaaucu

SEQ ID NO: 1768001 - RNA, 12 nt, Homo sapiens
uugcugacaggu

SEQ ID NO: 1768002 - RNA, 15 nt, Homo sapiens
auucuccugccucac

SEQ ID NO: 1768003 - RNA, 14 nt, Homo sapiens
guauauggacaaaa

SEQ ID NO: 1768004 - RNA, 14 nt, Homo sapiens
cucaucaacaaaga

SEQ ID NO: 1768005 - RNA, 17 nt, Homo sapiens
acucuccuggacugccu

SEQ ID NO: 1768006 - RNA, 21 nt, Homo sapiens
cagcccaagaggacugagacu

SEQ ID NO: 1768007 - RNA, 13 nt, Homo sapiens
aacggcacugugg

SEQ ID NO: 1768008 - RNA, 19 nt, Homo sapiens
uaauaauaagucaguguua

SEQ ID NO: 1768009 - RNA, 19 nt, Homo sapiens
auuauguuuuaauuccaag

SEQ ID NO: 1768010 - RNA, 17 nt, Homo sapiens
ugacuugaaaugcucuu

SEQ ID NO: 1768011 - RNA, 21 nt, Homo sapiens
cugcaccagagcaaccucuca

SEQ ID NO: 1768012 - RNA, 13 nt, Homo sapiens
aguuaaucuucau

SEQ ID NO: 1768013 - RNA, 19 nt, Homo sapiens
uggaauacagucauuccaa

SEQ ID NO: 1768014 - RNA, 23 nt, Homo sapiens
cugguugcugggccucauucuag

SEQ ID NO: 1768015 - RNA, 20 nt, Homo sapiens
ggaacauauagaaugcagag

SEQ ID NO: 1768016 - RNA, 16 nt, Homo sapiens
cucagcucccauuucu

SEQ ID NO: 1768017 - RNA, 22 nt, Homo sapiens
uuucuggaugaaugcccaguga

SEQ ID NO: 1768018 - RNA, 22 nt, Homo sapiens
ugaggcaggagaauuacuugaa

SEQ ID NO: 1768019 - RNA, 15 nt, Homo sapiens
caacuucaucagugu

SEQ ID NO: 1768020 - RNA, 20 nt, Homo sapiens
acgaaacuccaucucaaaac

SEQ ID NO: 1768021 - RNA, 12 nt, Homo sapiens
cagacagagauu

SEQ ID NO: 1768022 - RNA, 19 nt, Homo sapiens
ugcccaggauugaaggugu

SEQ ID NO: 1768023 - RNA, 19 nt, Homo sapiens
uuaauggaaucagauauug

SEQ ID NO: 1768024 - RNA, 18 nt, Homo sapiens
aguguaugacugcacaug

SEQ ID NO: 1768025 - RNA, 18 nt, Homo sapiens
acuauauguuuacacaau

SEQ ID NO: 1768026 - RNA, 19 nt, Homo sapiens
ucucuaacauaccuuguca

SEQ ID NO: 1768027 - RNA, 20 nt, Homo sapiens
ucacaauaaaugccacuuca

SEQ ID NO: 1768028 - RNA, 20 nt, Homo sapiens
ucagccucccaaagugcuga

SEQ ID NO: 1768029 - RNA, 15 nt, Homo sapiens
cccugccucacugug

SEQ ID NO: 1768030 - RNA, 17 nt, Homo sapiens
uacagacugcagacauu

SEQ ID NO: 1768031 - RNA, 20 nt, Homo sapiens
auguugugaaauaacauucg

SEQ ID NO: 1768032 - RNA, 15 nt, Homo sapiens
gauuucaaagcaagu

SEQ ID NO: 1768033 - RNA, 14 nt, Homo sapiens
aaugggcacuggga

SEQ ID NO: 1768034 - RNA, 16 nt, Homo sapiens
gaacgucuaguacaau

SEQ ID NO: 1768035 - RNA, 19 nt, Homo sapiens
cagcuagaaauaagcccaa

SEQ ID NO: 1768036 - RNA, 14 nt, Homo sapiens
uuaccucuuuggaa

SEQ ID NO: 1768037 - RNA, 12 nt, Homo sapiens
aagaaaugaaua

SEQ ID NO: 1768038 - RNA, 13 nt, Homo sapiens
guagagccuugac

SEQ ID NO: 1768039 - RNA, 20 nt, Homo sapiens
cauuauaauauucaugcgcu

SEQ ID NO: 1768040 - RNA, 13 nt, Homo sapiens
agccccaucagcu

SEQ ID NO: 1768041 - RNA, 16 nt, Homo sapiens
uccuaccugagcaaca

SEQ ID NO: 1768042 - RNA, 21 nt, Homo sapiens
gaacagaagaaaauaauauga

SEQ ID NO: 1768043 - RNA, 15 nt, Homo sapiens
aucuccagugugcca

SEQ ID NO: 1768044 - RNA, 12 nt, Homo sapiens
acuuuuucacau

SEQ ID NO: 1768045 - RNA, 18 nt, Homo sapiens
ccaacuauuaaagugcca

SEQ ID NO: 1768046 - RNA, 16 nt, Homo sapiens
ccccaggcuguucucc

SEQ ID NO: 1768047 - RNA, 12 nt, Homo sapiens
agucaucuauag

SEQ ID NO: 1768048 - RNA, 22 nt, Homo sapiens
cuaagucacccagagcacagga

SEQ ID NO: 1768049 - RNA, 15 nt, Homo sapiens
gacuuacaaaaugcc

SEQ ID NO: 1768050 - RNA, 23 nt, Homo sapiens
cucucaggaucaagaaaguguug

SEQ ID NO: 1768051 - RNA, 18 nt, Homo sapiens
uugguggggccaggccag

SEQ ID NO: 1768052 - RNA, 17 nt, Homo sapiens
ccugcacagauaccuca

SEQ ID NO: 1768053 - RNA, 22 nt, Homo sapiens
aaucucugacuaaaaauacuua

SEQ ID NO: 1768054 - RNA, 16 nt, Homo sapiens
uaaaaugcaaucaauu

SEQ ID NO: 1768055 - RNA, 13 nt, Homo sapiens
acaaaagcaagaa

SEQ ID NO: 1768056 - RNA, 22 nt, Homo sapiens
auuucuagggcugggaaacacu

SEQ ID NO: 1768057 - RNA, 13 nt, Homo sapiens
aucaugucuguau

SEQ ID NO: 1768058 - RNA, 16 nt, Homo sapiens
ggaucaucucugugac

SEQ ID NO: 1768059 - RNA, 13 nt, Homo sapiens
gcaaucuguguac

SEQ ID NO: 1768060 - RNA, 12 nt, Homo sapiens
gggcaagcuuug

SEQ ID NO: 1768061 - RNA, 15 nt, Homo sapiens
cauucaacucggaaa

SEQ ID NO: 1768062 - RNA, 20 nt, Homo sapiens
aucacauaauuccagucaca

SEQ ID NO: 1768063 - RNA, 17 nt, Homo sapiens
uucuuguaccacuucau

SEQ ID NO: 1768064 - RNA, 19 nt, Homo sapiens
caaguucuagggccgucag

SEQ ID NO: 1768065 - RNA, 12 nt, Homo sapiens
caucauggccag

SEQ ID NO: 1768066 - RNA, 21 nt, Homo sapiens
cuggucauccuuggugcucuu

SEQ ID NO: 1768067 - RNA, 17 nt, Homo sapiens
caagugcugcacaaaag

SEQ ID NO: 1768068 - RNA, 13 nt, Homo sapiens
aaauaaacacaca

SEQ ID NO: 1768069 - RNA, 13 nt, Homo sapiens
uaauaaacucaca

SEQ ID NO: 1768070 - RNA, 19 nt, Homo sapiens
agaaucgcuuaaacccagg

SEQ ID NO: 1768071 - RNA, 17 nt, Homo sapiens
agccuuaauuugcacag

SEQ ID NO: 1768072 - RNA, 17 nt, Homo sapiens
ugcagggacggagcuga

SEQ ID NO: 1768073 - RNA, 18 nt, Homo sapiens
cagauuacacuccagccu

SEQ ID NO: 1768074 - RNA, 18 nt, Homo sapiens
auaguuguugaguauucc

SEQ ID NO: 1768075 - RNA, 21 nt, Homo sapiens
ucaccuuuauauauguacuag

SEQ ID NO: 1768076 - RNA, 21 nt, Homo sapiens
cuguaucuccagccacuccaa

SEQ ID NO: 1768077 - RNA, 14 nt, Homo sapiens
ggccaacagcaccu

SEQ ID NO: 1768078 - RNA, 16 nt, Homo sapiens
gccgagaguccaucag

SEQ ID NO: 1768079 - RNA, 15 nt, Homo sapiens
aacuuuuaccacaaa

SEQ ID NO: 1768080 - RNA, 21 nt, Homo sapiens
uaacuuguuuacauagcauuu

SEQ ID NO: 1768081 - RNA, 23 nt, Homo sapiens
uccuuuaagaaaaacaucuggau

SEQ ID NO: 1768082 - RNA, 12 nt, Homo sapiens
gacagcaugugc

SEQ ID NO: 1768083 - RNA, 21 nt, Homo sapiens
cuuuaaaggauaauuauccaa

SEQ ID NO: 1768084 - RNA, 16 nt, Homo sapiens
gaacaaagagugaaau

SEQ ID NO: 1768085 - RNA, 17 nt, Homo sapiens
ugcugacccagccuguu

SEQ ID NO: 1768086 - RNA, 14 nt, Homo sapiens
ugcauguaucuucu

SEQ ID NO: 1768087 - RNA, 19 nt, Homo sapiens
aaagaauaugaaacauaga

SEQ ID NO: 1768088 - RNA, 21 nt, Homo sapiens
ccccuccaguuuugccugaga

SEQ ID NO: 1768089 - RNA, 14 nt, Homo sapiens
ucggggugugauga

SEQ ID NO: 1768090 - RNA, 13 nt, Homo sapiens
cacgacaaagcag

SEQ ID NO: 1768091 - RNA, 16 nt, Homo sapiens
auugcuaguucuaauu

SEQ ID NO: 1768092 - RNA, 17 nt, Homo sapiens
uggugggacaacaaaga

SEQ ID NO: 1768093 - RNA, 13 nt, Homo sapiens
gugccauauuugu

SEQ ID NO: 1768094 - RNA, 22 nt, Homo sapiens
agucucccugauggacccucag

SEQ ID NO: 1768095 - RNA, 13 nt, Homo sapiens
ucaacaugcauug

SEQ ID NO: 1768096 - RNA, 14 nt, Homo sapiens
cagaauuaaaaggc

SEQ ID NO: 1768097 - RNA, 20 nt, Homo sapiens
cucuucugggaacuuccuca

SEQ ID NO: 1768098 - RNA, 13 nt, Homo sapiens
agugcccaugaau

SEQ ID NO: 1768099 - RNA, 21 nt, Homo sapiens
gaccaggcaccaggcaggguc

SEQ ID NO: 1768100 - RNA, 16 nt, Homo sapiens
agucaucaaugcaaua

SEQ ID NO: 1768101 - RNA, 20 nt, Homo sapiens
aauauauauaaccuuguuau

SEQ ID NO: 1768102 - RNA, 16 nt, Homo sapiens
ccacagucucugggag

SEQ ID NO: 1768103 - RNA, 14 nt, Homo sapiens
cuauuuuacuuugu

SEQ ID NO: 1768104 - RNA, 22 nt, Homo sapiens
ugugucccauggcagacaaagc

SEQ ID NO: 1768105 - RNA, 18 nt, Homo sapiens
gcugagugaaugaacaaa

SEQ ID NO: 1768106 - RNA, 14 nt, Homo sapiens
agguccaccugcua

SEQ ID NO: 1768107 - RNA, 18 nt, Homo sapiens
ccucccagaacacacucc

SEQ ID NO: 1768108 - RNA, 17 nt, Homo sapiens
guuucuccagagggaau

SEQ ID NO: 1768109 - RNA, 19 nt, Homo sapiens
acaagcuguaucacugccu

SEQ ID NO: 1768110 - RNA, 20 nt, Homo sapiens
auggauuuuucuuuaacugc

SEQ ID NO: 1768111 - RNA, 17 nt, Homo sapiens
gccuuggccuugcagcu

SEQ ID NO: 1768112 - RNA, 22 nt, Homo sapiens
gugccauuaagacaacuacagc

SEQ ID NO: 1768113 - RNA, 19 nt, Homo sapiens
ucuuuaggagacuaaugga

SEQ ID NO: 1768114 - RNA, 15 nt, Homo sapiens
ucacaugaugcauac

SEQ ID NO: 1768115 - RNA, 14 nt, Homo sapiens
ucuuucugugcugg

SEQ ID NO: 1768116 - RNA, 15 nt, Homo sapiens
gacgcggcucccggg

SEQ ID NO: 1768117 - RNA, 17 nt, Homo sapiens
acaacauaaggagaaug

SEQ ID NO: 1768118 - RNA, 21 nt, Homo sapiens
auuuaccaaaauuugugcaca

SEQ ID NO: 1768119 - RNA, 23 nt, Homo sapiens
ugcuuguauaaaugucagauaau

SEQ ID NO: 1768120 - RNA, 21 nt, Homo sapiens
gaccuccccugaggcucaggg

SEQ ID NO: 1768121 - RNA, 22 nt, Homo sapiens
gaacagauaaucagugugucua

SEQ ID NO: 1768122 - RNA, 19 nt, Homo sapiens
gucccucaggcuuguugcc

SEQ ID NO: 1768123 - RNA, 22 nt, Homo sapiens
agugauaucaccucucuucagc

SEQ ID NO: 1768124 - RNA, 21 nt, Homo sapiens
ugacccaugcugcccugugag

SEQ ID NO: 1768125 - RNA, 19 nt, Homo sapiens
cagccaucaaauagugaau

SEQ ID NO: 1768126 - RNA, 22 nt, Homo sapiens
uuucuguaucaagccccugucu

SEQ ID NO: 1768127 - RNA, 20 nt, Homo sapiens
ucaggcuucugcaguucuca

SEQ ID NO: 1768128 - RNA, 23 nt, Homo sapiens
aacauuuuauuuuuaaaauauua

SEQ ID NO: 1768129 - RNA, 16 nt, Homo sapiens
accucauaugugaaau

SEQ ID NO: 1768130 - RNA, 17 nt, Homo sapiens
uuauccuguauguaaua

SEQ ID NO: 1768131 - RNA, 18 nt, Homo sapiens
uaauagguguuuguuuaa

SEQ ID NO: 1768132 - RNA, 19 nt, Homo sapiens
gauuugaggacugaagcug

SEQ ID NO: 1768133 - RNA, 18 nt, Homo sapiens
cagcauuccaugaccaga

SEQ ID NO: 1768134 - RNA, 21 nt, Homo sapiens
uggaugcuagugcuguagagu

SEQ ID NO: 1768135 - RNA, 22 nt, Homo sapiens
acauucccucuaauuugaacug

SEQ ID NO: 1768136 - RNA, 20 nt, Homo sapiens
ucccagggagcaagggcagg

SEQ ID NO: 1768137 - RNA, 21 nt, Homo sapiens
ggcauccgugaggcagggaca

SEQ ID NO: 1768138 - RNA, 17 nt, Homo sapiens
ccuggaaauucugcugc

SEQ ID NO: 1768139 - RNA, 19 nt, Homo sapiens
aaaagaugguaaaccagau

SEQ ID NO: 1768140 - RNA, 13 nt, Homo sapiens
cuggcaccaacac

SEQ ID NO: 1768141 - RNA, 14 nt, Homo sapiens
augaugaagaccaa

SEQ ID NO: 1768142 - RNA, 19 nt, Homo sapiens
aaugaacuccauugcuuaa

SEQ ID NO: 1768143 - RNA, 14 nt, Homo sapiens
uacuaguuuucaau

SEQ ID NO: 1768144 - RNA, 13 nt, Homo sapiens
aucucccuugucc

SEQ ID NO: 1768145 - RNA, 20 nt, Homo sapiens
ccaaagacuuaucagaugcu

SEQ ID NO: 1768146 - RNA, 16 nt, Homo sapiens
gguuggguuugggagu

SEQ ID NO: 1768147 - RNA, 18 nt, Homo sapiens
caucagacauuauaagua

SEQ ID NO: 1768148 - RNA, 21 nt, Homo sapiens
cauaauaaaaaauuaugacaa

SEQ ID NO: 1768149 - RNA, 21 nt, Homo sapiens
guuaaccccugcgcucucuuu

SEQ ID NO: 1768150 - RNA, 15 nt, Homo sapiens
cuggccaaaaugcag

SEQ ID NO: 1768151 - RNA, 21 nt, Homo sapiens
uucaguagugcuggccaggga

SEQ ID NO: 1768152 - RNA, 20 nt, Homo sapiens
acaacaacauguaccuguau

SEQ ID NO: 1768153 - RNA, 17 nt, Homo sapiens
ggauuacagacaugaac

SEQ ID NO: 1768154 - RNA, 18 nt, Homo sapiens
ugagugaggaauggcagu

SEQ ID NO: 1768155 - RNA, 12 nt, Homo sapiens
uucauacauauu

SEQ ID NO: 1768156 - RNA, 12 nt, Homo sapiens
cucuuacacaua

SEQ ID NO: 1768157 - RNA, 14 nt, Homo sapiens
uuugcuucaagugu

SEQ ID NO: 1768158 - RNA, 18 nt, Homo sapiens
uuuccucuaguaucacuu

SEQ ID NO: 1768159 - RNA, 21 nt, Homo sapiens
cugaguuuuguuucacuuuga

SEQ ID NO: 1768160 - RNA, 18 nt, Homo sapiens
aauaaaacuuaaaucuca

SEQ ID NO: 1768161 - RNA, 20 nt, Homo sapiens
aggccaaggaaauauuuugu

SEQ ID NO: 1768162 - RNA, 15 nt, Homo sapiens
aguguaauugagaag

SEQ ID NO: 1768163 - RNA, 17 nt, Homo sapiens
cccagggaaauaucagc

SEQ ID NO: 1768164 - RNA, 19 nt, Homo sapiens
gcacccaccacaucuggcu

SEQ ID NO: 1768165 - RNA, 20 nt, Homo sapiens
ugaagacagagcuacacagg

SEQ ID NO: 1768166 - RNA, 15 nt, Homo sapiens
aguggaggcacuuua

SEQ ID NO: 1768167 - RNA, 12 nt, Homo sapiens
cacuagccagac

SEQ ID NO: 1768168 - RNA, 16 nt, Homo sapiens
auguauccccacuuau

SEQ ID NO: 1768169 - RNA, 14 nt, Homo sapiens
ccugcccuagcucc

SEQ ID NO: 1768170 - RNA, 13 nt, Homo sapiens
agaauacuugacu

SEQ ID NO: 1768171 - RNA, 13 nt, Homo sapiens
gcugagcagucag

SEQ ID NO: 1768172 - RNA, 21 nt, Homo sapiens
gacgguuucaaaccaggauuu

SEQ ID NO: 1768173 - RNA, 17 nt, Homo sapiens
guccccguaccugucau

SEQ ID NO: 1768174 - RNA, 20 nt, Homo sapiens
agucccagaauuguaucuca

SEQ ID NO: 1768175 - RNA, 13 nt, Homo sapiens
ugagaaaacagau

SEQ ID NO: 1768176 - RNA, 13 nt, Homo sapiens
aagauauaaguaa

SEQ ID NO: 1768177 - RNA, 19 nt, Homo sapiens
aaaaaguuacugcaacuua

SEQ ID NO: 1768178 - RNA, 19 nt, Homo sapiens
aagaucgcgccacugcacu

SEQ ID NO: 1768179 - RNA, 16 nt, Homo sapiens
aucuuaagauccacaa

SEQ ID NO: 1768180 - RNA, 16 nt, Homo sapiens
acacacugacauuaua

SEQ ID NO: 1768181 - RNA, 11 nt, Homo sapiens
uuggccuccau

SEQ ID NO: 1768182 - RNA, 18 nt, Homo sapiens
gcuauuaagaaaaucaca

SEQ ID NO: 1768183 - RNA, 21 nt, Homo sapiens
cucagugaccagugccuguga

SEQ ID NO: 1768184 - RNA, 15 nt, Homo sapiens
ucuguaucuaucuca

SEQ ID NO: 1768185 - RNA, 17 nt, Homo sapiens
cacucauaugaguaucu

SEQ ID NO: 1768186 - RNA, 14 nt, Homo sapiens
gcaugugugugaug

SEQ ID NO: 1768187 - RNA, 15 nt, Homo sapiens
ggcugguugcuguag

SEQ ID NO: 1768188 - RNA, 16 nt, Homo sapiens
caucugacuugaacuc

SEQ ID NO: 1768189 - RNA, 20 nt, Homo sapiens
acaauuauuugaagauuuaa

SEQ ID NO: 1768190 - RNA, 19 nt, Homo sapiens
acccuccuggccucauaca

SEQ ID NO: 1768191 - RNA, 16 nt, Homo sapiens
aggugcaaacaaacaa

SEQ ID NO: 1768192 - RNA, 13 nt, Homo sapiens
gaagcauccuccc

SEQ ID NO: 1768193 - RNA, 16 nt, Homo sapiens
ccuuucccaucuucca

SEQ ID NO: 1768194 - RNA, 17 nt, Homo sapiens
ugcuucagugcagugaa

SEQ ID NO: 1768195 - RNA, 11 nt, Homo sapiens
aucacaaugag

SEQ ID NO: 1768196 - RNA, 14 nt, Homo sapiens
ggggucugagcaug

SEQ ID NO: 1768197 - RNA, 12 nt, Homo sapiens
ugaccucagcug

SEQ ID NO: 1768198 - RNA, 15 nt, Homo sapiens
aagaaggggacaaug

SEQ ID NO: 1768199 - RNA, 15 nt, Homo sapiens
aguguaccagagaag

SEQ ID NO: 1768200 - RNA, 20 nt, Homo sapiens
cugugggggaagagcacagc

SEQ ID NO: 1768201 - RNA, 23 nt, Homo sapiens
uuucccuuguccuuucucucuaa

SEQ ID NO: 1768202 - RNA, 16 nt, Homo sapiens
acauuuaaauuccaca

SEQ ID NO: 1768203 - RNA, 17 nt, Homo sapiens
caguauucuugucaaaa

SEQ ID NO: 1768204 - RNA, 20 nt, Homo sapiens
auggacuauugcaauacauu

SEQ ID NO: 1768205 - RNA, 20 nt, Homo sapiens
uaagacacaaacaaaccauu

SEQ ID NO: 1768206 - RNA, 17 nt, Homo sapiens
cgaugggaucauuauuu

SEQ ID NO: 1768207 - RNA, 21 nt, Homo sapiens
cccuacugaagcccuugugaa

SEQ ID NO: 1768208 - RNA, 14 nt, Homo sapiens
aacauuaacucuaa

SEQ ID NO: 1768209 - RNA, 14 nt, Homo sapiens
uugugcccacuuca

SEQ ID NO: 1768210 - RNA, 20 nt, Homo sapiens
uaacacuaccaauuucccau

SEQ ID NO: 1768211 - RNA, 17 nt, Homo sapiens
uagagcuugcagugaag

SEQ ID NO: 1768212 - RNA, 13 nt, Homo sapiens
aaagcuacuaugu

SEQ ID NO: 1768213 - RNA, 20 nt, Homo sapiens
caaacaggguuugauagcac

SEQ ID NO: 1768214 - RNA, 15 nt, Homo sapiens
cagaccuuuuaacuc

SEQ ID NO: 1768215 - RNA, 21 nt, Homo sapiens
uguacaggcugagacacagcc

SEQ ID NO: 1768216 - RNA, 21 nt, Homo sapiens
agacaaaugggccugccaaac

SEQ ID NO: 1768217 - RNA, 12 nt, Homo sapiens
gcagcugugacc

SEQ ID NO: 1768218 - RNA, 20 nt, Homo sapiens
gcggggcuacaguccuucca

SEQ ID NO: 1768219 - RNA, 13 nt, Homo sapiens
gaacagaaggaug

SEQ ID NO: 1768220 - RNA, 19 nt, Homo sapiens
uaccucugaucaaguauuu

SEQ ID NO: 1768221 - RNA, 17 nt, Homo sapiens
uucaaugaauuauauuc

SEQ ID NO: 1768222 - RNA, 19 nt, Homo sapiens
gcacacacaccgaugcuga

SEQ ID NO: 1768223 - RNA, 15 nt, Homo sapiens
accaccuaguucucc

SEQ ID NO: 1768224 - RNA, 18 nt, Homo sapiens
aaucagacaugaguccac

SEQ ID NO: 1768225 - RNA, 14 nt, Homo sapiens
uuccagaguaugca

SEQ ID NO: 1768226 - RNA, 19 nt, Homo sapiens
auuugcuaacaggaccagg

SEQ ID NO: 1768227 - RNA, 12 nt, Homo sapiens
aguugccaaagu

SEQ ID NO: 1768228 - RNA, 16 nt, Homo sapiens
uuccuaccucugguga

SEQ ID NO: 1768229 - RNA, 15 nt, Homo sapiens
auuuuuaagacuuuu

SEQ ID NO: 1768230 - RNA, 19 nt, Homo sapiens
uuguucgccgcguggaaug

SEQ ID NO: 1768231 - RNA, 11 nt, Homo sapiens
uaaugacccag

SEQ ID NO: 1768232 - RNA, 21 nt, Homo sapiens
ccacuuagacacuuuaccucu

SEQ ID NO: 1768233 - RNA, 18 nt, Homo sapiens
ucuuagcagugucucuca

SEQ ID NO: 1768234 - RNA, 14 nt, Homo sapiens
uuuccaaagagccg

SEQ ID NO: 1768235 - RNA, 15 nt, Homo sapiens
aucuuagugccuuua

SEQ ID NO: 1768236 - RNA, 19 nt, Homo sapiens
acuggauccauccguccag

SEQ ID NO: 1768237 - RNA, 23 nt, Homo sapiens
acuucucauuuuuuaaaaaagcu

SEQ ID NO: 1768238 - RNA, 19 nt, Homo sapiens
cuccaggagccuacccccu

SEQ ID NO: 1768239 - RNA, 22 nt, Homo sapiens
cagacaauauggucccaaauga

SEQ ID NO: 1768240 - RNA, 23 nt, Homo sapiens
gccacugcgcccagcuauacugu

SEQ ID NO: 1768241 - RNA, 18 nt, Homo sapiens
aaacucuuauuacuguug

SEQ ID NO: 1768242 - RNA, 20 nt, Homo sapiens
ggcuucuuaaucuuuucaca

SEQ ID NO: 1768243 - RNA, 19 nt, Homo sapiens
uuuuauccacuuaccuaga

SEQ ID NO: 1768244 - RNA, 21 nt, Homo sapiens
cagauagcacugggugugaga

SEQ ID NO: 1768245 - RNA, 18 nt, Homo sapiens
gccagugucuuucuuugg

SEQ ID NO: 1768246 - RNA, 16 nt, Homo sapiens
acccuauaaaagugau

SEQ ID NO: 1768247 - RNA, 18 nt, Homo sapiens
ugagacuccugauugcuc

SEQ ID NO: 1768248 - RNA, 18 nt, Homo sapiens
uucaucucucuaccucca

SEQ ID NO: 1768249 - RNA, 18 nt, Homo sapiens
acagcuccgcgcucgggg

SEQ ID NO: 1768250 - RNA, 20 nt, Homo sapiens
uccauauggcaauaggugug

SEQ ID NO: 1768251 - RNA, 13 nt, Homo sapiens
cuuagacaguccc

SEQ ID NO: 1768252 - RNA, 17 nt, Homo sapiens
ugaacacacccugaaga

SEQ ID NO: 1768253 - RNA, 14 nt, Homo sapiens
aauugugcuuucac

SEQ ID NO: 1768254 - RNA, 12 nt, Homo sapiens
cagcacugccca

SEQ ID NO: 1768255 - RNA, 18 nt, Homo sapiens
cauugcccagucuuucau

SEQ ID NO: 1768256 - RNA, 15 nt, Homo sapiens
ggcagauggggcacu

SEQ ID NO: 1768257 - RNA, 16 nt, Homo sapiens
uaucugcgugcacuuc

SEQ ID NO: 1768258 - RNA, 20 nt, Homo sapiens
aucugccaggacacugccuu

SEQ ID NO: 1768259 - RNA, 21 nt, Homo sapiens
ucuggccuguacccaguagau

SEQ ID NO: 1768260 - RNA, 16 nt, Homo sapiens
acaaaaagauaccuua

SEQ ID NO: 1768261 - RNA, 15 nt, Homo sapiens
auagacacaguauug

SEQ ID NO: 1768262 - RNA, 21 nt, Homo sapiens
acaguaugcauacugguguua

SEQ ID NO: 1768263 - RNA, 12 nt, Homo sapiens
acacacuugacc

SEQ ID NO: 1768264 - RNA, 14 nt, Homo sapiens
ugaauaacugagcu

SEQ ID NO: 1768265 - RNA, 14 nt, Homo sapiens
cagaccaccaucca

SEQ ID NO: 1768266 - RNA, 22 nt, Homo sapiens
ccaggggaaugaucucugauga

SEQ ID NO: 1768267 - RNA, 22 nt, Homo sapiens
cccaggaggauuugucugagac

SEQ ID NO: 1768268 - RNA, 16 nt, Homo sapiens
guuaucuuagcuggau

SEQ ID NO: 1768269 - RNA, 16 nt, Homo sapiens
ccuucacaccacuugu

SEQ ID NO: 1768270 - RNA, 14 nt, Homo sapiens
acgugugguucauc

SEQ ID NO: 1768271 - RNA, 15 nt, Homo sapiens
aggacccgugugacu

SEQ ID NO: 1768272 - RNA, 16 nt, Homo sapiens
gaguuaguuugaguua

SEQ ID NO: 1768273 - RNA, 22 nt, Homo sapiens
agacacuuuaaaagcuucugca

SEQ ID NO: 1768274 - RNA, 21 nt, Homo sapiens
uaaguaugcuuucuccugaaa

SEQ ID NO: 1768275 - RNA, 14 nt, Homo sapiens
gcugaaacuugaac

SEQ ID NO: 1768276 - RNA, 13 nt, Homo sapiens
auuuaaagcauca

SEQ ID NO: 1768277 - RNA, 16 nt, Homo sapiens
acccagccccuucccc

SEQ ID NO: 1768278 - RNA, 15 nt, Homo sapiens
ucuaagugugcugca

SEQ ID NO: 1768279 - RNA, 21 nt, Homo sapiens
aagccucagagaauugcugau

SEQ ID NO: 1768280 - RNA, 13 nt, Homo sapiens
gggaaggcuuccu

SEQ ID NO: 1768281 - RNA, 22 nt, Homo sapiens
uaaccugcuagacacauuuuua

SEQ ID NO: 1768282 - RNA, 12 nt, Homo sapiens
gggaagaacucu

SEQ ID NO: 1768283 - RNA, 23 nt, Homo sapiens
ugauuccguguguguacugauuc

SEQ ID NO: 1768284 - RNA, 17 nt, Homo sapiens
gcagaauugagagugau

SEQ ID NO: 1768285 - RNA, 16 nt, Homo sapiens
cugaaucucccaagga

SEQ ID NO: 1768286 - RNA, 21 nt, Homo sapiens
guaauuauguuuucaacacuu

SEQ ID NO: 1768287 - RNA, 15 nt, Homo sapiens
cugugaaaaaccuga

SEQ ID NO: 1768288 - RNA, 16 nt, Homo sapiens
accuuuuaacuccuca

SEQ ID NO: 1768289 - RNA, 14 nt, Homo sapiens
ugacauucacugag

SEQ ID NO: 1768290 - RNA, 18 nt, Homo sapiens
ugccaggaaaagaaaaau

SEQ ID NO: 1768291 - RNA, 19 nt, Homo sapiens
uccguuaugccaccuggag

SEQ ID NO: 1768292 - RNA, 15 nt, Homo sapiens
cuccaaaucuugcca

SEQ ID NO: 1768293 - RNA, 16 nt, Homo sapiens
ggugaggguuggcgcu

SEQ ID NO: 1768294 - RNA, 15 nt, Homo sapiens
cacccaugaaucaaa

SEQ ID NO: 1768295 - RNA, 16 nt, Homo sapiens
auguccauaugcaucu

SEQ ID NO: 1768296 - RNA, 18 nt, Homo sapiens
auaaaucucaaugaauuc

SEQ ID NO: 1768297 - RNA, 17 nt, Homo sapiens
auggucauagcccagau

SEQ ID NO: 1768298 - RNA, 22 nt, Homo sapiens
cuuaugacuccccccuuccaaa

SEQ ID NO: 1768299 - RNA, 17 nt, Homo sapiens
gaguuaccacaccccau

SEQ ID NO: 1768300 - RNA, 22 nt, Homo sapiens
auggugacagcugcaagccagg

SEQ ID NO: 1768301 - RNA, 23 nt, Homo sapiens
cagagaggacuguugacauccaa

SEQ ID NO: 1768302 - RNA, 18 nt, Homo sapiens
gcuaauaaauguugccau

SEQ ID NO: 1768303 - RNA, 18 nt, Homo sapiens
ucugcuuuuuauuuuaca

SEQ ID NO: 1768304 - RNA, 23 nt, Homo sapiens
cugccauaaaaucucacgcugcc

SEQ ID NO: 1768305 - RNA, 22 nt, Homo sapiens
uaggaaggcagcauuccaugac

SEQ ID NO: 1768306 - RNA, 16 nt, Homo sapiens
aaaaggagagauuaaa

SEQ ID NO: 1768307 - RNA, 21 nt, Homo sapiens
ccuggacaaccuggacccaga

SEQ ID NO: 1768308 - RNA, 18 nt, Homo sapiens
ccagccccuuugccauag

SEQ ID NO: 1768309 - RNA, 21 nt, Homo sapiens
ucaagaauuuuuugacuugaa

SEQ ID NO: 1768310 - RNA, 15 nt, Homo sapiens
aacuuacuagcuuua

SEQ ID NO: 1768311 - RNA, 19 nt, Homo sapiens
ccacuuugcacauuuugau

SEQ ID NO: 1768312 - RNA, 23 nt, Homo sapiens
ugcuauuauguaacauccagaag

SEQ ID NO: 1768313 - RNA, 17 nt, Homo sapiens
gaaaguauaaugcagua

SEQ ID NO: 1768314 - RNA, 12 nt, Homo sapiens
cugacuguaaau

SEQ ID NO: 1768315 - RNA, 21 nt, Homo sapiens
caguuuaauaaauagcaucua

SEQ ID NO: 1768316 - RNA, 14 nt, Homo sapiens
auuuuauacugaca

SEQ ID NO: 1768317 - RNA, 22 nt, Homo sapiens
cccuauggaagcauauuguuau

SEQ ID NO: 1768318 - RNA, 14 nt, Homo sapiens
ucucugaagggagg

SEQ ID NO: 1768319 - RNA, 14 nt, Homo sapiens
aguacuauugcuau

SEQ ID NO: 1768320 - RNA, 16 nt, Homo sapiens
ccucuaguaucacuuu

SEQ ID NO: 1768321 - RNA, 18 nt, Homo sapiens
auaauaaccacgauucca

SEQ ID NO: 1768322 - RNA, 17 nt, Homo sapiens
uaauccaggacagcauu

SEQ ID NO: 1768323 - RNA, 16 nt, Homo sapiens
caggucccagagggug

SEQ ID NO: 1768324 - RNA, 15 nt, Homo sapiens
uaauaaaauaauugu

SEQ ID NO: 1768325 - RNA, 20 nt, Homo sapiens
ccaauuacagggugacucac

SEQ ID NO: 1768326 - RNA, 15 nt, Homo sapiens
uuacuagcaccugcc

SEQ ID NO: 1768327 - RNA, 17 nt, Homo sapiens
gaugugguuuuuugcca

SEQ ID NO: 1768328 - RNA, 19 nt, Homo sapiens
cuggcugugcacauucucc

SEQ ID NO: 1768329 - RNA, 15 nt, Homo sapiens
uaauuaaacugaaga

SEQ ID NO: 1768330 - RNA, 16 nt, Homo sapiens
agcagaugcaggggug

SEQ ID NO: 1768331 - RNA, 21 nt, Homo sapiens
cuuuuuuucccuuuucuuucc

SEQ ID NO: 1768332 - RNA, 15 nt, Homo sapiens
caagucacacugcau

SEQ ID NO: 1768333 - RNA, 21 nt, Homo sapiens
uauuaccuuuaaauauuucac

SEQ ID NO: 1768334 - RNA, 18 nt, Homo sapiens
uagagacuuugaggaaga

SEQ ID NO: 1768335 - RNA, 21 nt, Homo sapiens
auccagaggacccaacugaac

SEQ ID NO: 1768336 - RNA, 15 nt, Homo sapiens
ugggugaauguguga

SEQ ID NO: 1768337 - RNA, 20 nt, Homo sapiens
ccugaugacagaacacagau

SEQ ID NO: 1768338 - RNA, 14 nt, Homo sapiens
uaacuucaugaaga

SEQ ID NO: 1768339 - RNA, 16 nt, Homo sapiens
aauuuugcuugcugaa

SEQ ID NO: 1768340 - RNA, 15 nt, Homo sapiens
ggaacccaccaaacc

SEQ ID NO: 1768341 - RNA, 14 nt, Homo sapiens
uuaaugauuugcuu

SEQ ID NO: 1768342 - RNA, 21 nt, Homo sapiens
augugcaccaacaggcaugac

SEQ ID NO: 1768343 - RNA, 21 nt, Homo sapiens
caggccugcagacagaccuca

SEQ ID NO: 1768344 - RNA, 21 nt, Homo sapiens
ccaacaugugauguguugcuc

SEQ ID NO: 1768345 - RNA, 16 nt, Homo sapiens
agcacauagcacuggg

SEQ ID NO: 1768346 - RNA, 20 nt, Homo sapiens
ucauccuacccuaaugccag

SEQ ID NO: 1768347 - RNA, 22 nt, Homo sapiens
uguaaggggaagagggaaaugu

SEQ ID NO: 1768348 - RNA, 14 nt, Homo sapiens
gcugauggcugcug

SEQ ID NO: 1768349 - RNA, 17 nt, Homo sapiens
uaacuuuuaauguggca

SEQ ID NO: 1768350 - RNA, 14 nt, Homo sapiens
aggacgcaugcagg

SEQ ID NO: 1768351 - RNA, 17 nt, Homo sapiens
augcuugcucaggcuca

SEQ ID NO: 1768352 - RNA, 12 nt, Homo sapiens
gaguccaagacc

SEQ ID NO: 1768353 - RNA, 13 nt, Homo sapiens
cuccccaggggag

SEQ ID NO: 1768354 - RNA, 16 nt, Homo sapiens
aauaaagauacaugau

SEQ ID NO: 1768355 - RNA, 17 nt, Homo sapiens
accacacuagaauucau

SEQ ID NO: 1768356 - RNA, 16 nt, Homo sapiens
uccccuggacugggag

SEQ ID NO: 1768357 - RNA, 23 nt, Homo sapiens
uaaaguuuaaauaccaguacuug

SEQ ID NO: 1768358 - RNA, 16 nt, Homo sapiens
auuaagcucacaauaa

SEQ ID NO: 1768359 - RNA, 15 nt, Homo sapiens
auggacaucuuguca

SEQ ID NO: 1768360 - RNA, 21 nt, Homo sapiens
agaagucauggcccaaaucca

SEQ ID NO: 1768361 - RNA, 22 nt, Homo sapiens
agaaggggugcagaguguuuac

SEQ ID NO: 1768362 - RNA, 18 nt, Homo sapiens
ucccuuucuuuucaugcc

SEQ ID NO: 1768363 - RNA, 21 nt, Homo sapiens
cuggcgcuguuggggcugcuc

SEQ ID NO: 1768364 - RNA, 19 nt, Homo sapiens
ucuaugcuggauaagaaau

SEQ ID NO: 1768365 - RNA, 17 nt, Homo sapiens
agcagaaugaagaccua

SEQ ID NO: 1768366 - RNA, 20 nt, Homo sapiens
ucaauucugauuccaaauaa

SEQ ID NO: 1768367 - RNA, 13 nt, Homo sapiens
augaauagccagg

SEQ ID NO: 1768368 - RNA, 14 nt, Homo sapiens
agcucaggcauuug

SEQ ID NO: 1768369 - RNA, 13 nt, Homo sapiens
uaccacauucacu

SEQ ID NO: 1768370 - RNA, 13 nt, Homo sapiens
uaccucauucaca

SEQ ID NO: 1768371 - RNA, 20 nt, Homo sapiens
cgcacaacaggaaacuggga

SEQ ID NO: 1768372 - RNA, 13 nt, Homo sapiens
acugagcacuguu

SEQ ID NO: 1768373 - RNA, 20 nt, Homo sapiens
gauuucacuguguuagccag

SEQ ID NO: 1768374 - RNA, 20 nt, Homo sapiens
gucucaaaauaaaaccagaa

SEQ ID NO: 1768375 - RNA, 19 nt, Homo sapiens
cuuguccaaggucucauga

SEQ ID NO: 1768376 - RNA, 17 nt, Homo sapiens
acaagacuggcagucca

SEQ ID NO: 1768377 - RNA, 18 nt, Homo sapiens
ggacuugcugaauucucu

SEQ ID NO: 1768378 - RNA, 18 nt, Homo sapiens
uuaacaaaugugcugcuu

SEQ ID NO: 1768379 - RNA, 23 nt, Homo sapiens
acagccuuggccauccuggcuca

SEQ ID NO: 1768380 - RNA, 21 nt, Homo sapiens
uuagcuccaaaccuucacaca

SEQ ID NO: 1768381 - RNA, 17 nt, Homo sapiens
gcaguuuugacaucagc

SEQ ID NO: 1768382 - RNA, 12 nt, Homo sapiens
ccuguugaauaa

SEQ ID NO: 1768383 - RNA, 14 nt, Homo sapiens
gaugggagugggca

SEQ ID NO: 1768384 - RNA, 21 nt, Homo sapiens
ucuguuuguuuuauacaaaug

SEQ ID NO: 1768385 - RNA, 18 nt, Homo sapiens
gacuuacaaaaugccaag

SEQ ID NO: 1768386 - RNA, 11 nt, Homo sapiens
ccaagccaugg

SEQ ID NO: 1768387 - RNA, 22 nt, Homo sapiens
aacccauaggcacuugggaugu

SEQ ID NO: 1768388 - RNA, 19 nt, Homo sapiens
aucuggcccucgacacuca

SEQ ID NO: 1768389 - RNA, 17 nt, Homo sapiens
caacuuauuaacaauua

SEQ ID NO: 1768390 - RNA, 22 nt, Homo sapiens
cuuuauuauggaaaacauuuca

SEQ ID NO: 1768391 - RNA, 13 nt, Homo sapiens
ugcagccuccaca

SEQ ID NO: 1768392 - RNA, 14 nt, Homo sapiens
guuugcuagcagaa

SEQ ID NO: 1768393 - RNA, 18 nt, Homo sapiens
acaggcucugaggggcac

SEQ ID NO: 1768394 - RNA, 16 nt, Homo sapiens
cucaagggaugucuca

SEQ ID NO: 1768395 - RNA, 15 nt, Homo sapiens
gguucccaccauucc

SEQ ID NO: 1768396 - RNA, 23 nt, Homo sapiens
guggaaugcaguccucaucucca

SEQ ID NO: 1768397 - RNA, 15 nt, Homo sapiens
caguccaacaaacca

SEQ ID NO: 1768398 - RNA, 17 nt, Homo sapiens
uuugguuaccaauuuaa

SEQ ID NO: 1768399 - RNA, 17 nt, Homo sapiens
gaagucuuaaggacaaa

SEQ ID NO: 1768400 - RNA, 12 nt, Homo sapiens
uuuggucucucc

SEQ ID NO: 1768401 - RNA, 23 nt, Homo sapiens
ggacuaagaugaaaugcacugua

SEQ ID NO: 1768402 - RNA, 17 nt, Homo sapiens
uggcaaacaugugcaac

SEQ ID NO: 1768403 - RNA, 11 nt, Homo sapiens
gacuccauuuc

SEQ ID NO: 1768404 - RNA, 20 nt, Homo sapiens
gaggcaggagaauugcuuga

SEQ ID NO: 1768405 - RNA, 15 nt, Homo sapiens
caauggucucagccu

SEQ ID NO: 1768406 - RNA, 21 nt, Homo sapiens
uuaaaacgauagcuauauuca

SEQ ID NO: 1768407 - RNA, 18 nt, Homo sapiens
ggagcagccagccauuug

SEQ ID NO: 1768408 - RNA, 18 nt, Homo sapiens
cacccaucagcacucugu

SEQ ID NO: 1768409 - RNA, 17 nt, Homo sapiens
ggugcauuugcccucau

SEQ ID NO: 1768410 - RNA, 19 nt, Homo sapiens
caagcgauugucugaggaa

SEQ ID NO: 1768411 - RNA, 16 nt, Homo sapiens
aguauuccuaaccugu

SEQ ID NO: 1768412 - RNA, 13 nt, Homo sapiens
caugggaccuccu

SEQ ID NO: 1768413 - RNA, 23 nt, Homo sapiens
aucuaaaagaauuuuaccauuca

SEQ ID NO: 1768414 - RNA, 20 nt, Homo sapiens
ucccgaagaauggagaggaa

SEQ ID NO: 1768415 - RNA, 22 nt, Homo sapiens
acccccacuaaaugaucugauu

SEQ ID NO: 1768416 - RNA, 20 nt, Homo sapiens
ggacaaaugaugccauggca

SEQ ID NO: 1768417 - RNA, 22 nt, Homo sapiens
cuaaacuggcaucugcucuaga

SEQ ID NO: 1768418 - RNA, 16 nt, Homo sapiens
uaugcuguauccacaa

SEQ ID NO: 1768419 - RNA, 17 nt, Homo sapiens
agaaggaagcccucuca

SEQ ID NO: 1768420 - RNA, 23 nt, Homo sapiens
caaaaaggcuguaagauagucaa

SEQ ID NO: 1768421 - RNA, 19 nt, Homo sapiens
gaaaggaggaaggagccua

SEQ ID NO: 1768422 - RNA, 14 nt, Homo sapiens
cuuuaucagugaug

SEQ ID NO: 1768423 - RNA, 15 nt, Homo sapiens
gaaccucuccaaaga

SEQ ID NO: 1768424 - RNA, 20 nt, Homo sapiens
gcacucacgcccuaagcgca

SEQ ID NO: 1768425 - RNA, 21 nt, Homo sapiens
ucucuguccgagugugccaca

SEQ ID NO: 1768426 - RNA, 14 nt, Homo sapiens
agaugaaacaucau

SEQ ID NO: 1768427 - RNA, 15 nt, Homo sapiens
gcucauugaacuuua

SEQ ID NO: 1768428 - RNA, 16 nt, Homo sapiens
guuucuacauucucua

SEQ ID NO: 1768429 - RNA, 21 nt, Homo sapiens
ccauccaacuccucuagucag

SEQ ID NO: 1768430 - RNA, 17 nt, Homo sapiens
agcagacaucaagcuca

SEQ ID NO: 1768431 - RNA, 21 nt, Homo sapiens
gaauuuuuauauccacuaaaa

SEQ ID NO: 1768432 - RNA, 16 nt, Homo sapiens
uucacaucagcuuuag

SEQ ID NO: 1768433 - RNA, 14 nt, Homo sapiens
aguggcaugaucuc

SEQ ID NO: 1768434 - RNA, 22 nt, Homo sapiens
gugauucaucuucacagcacau

SEQ ID NO: 1768435 - RNA, 14 nt, Homo sapiens
caauuuaugcugcu

SEQ ID NO: 1768436 - RNA, 12 nt, Homo sapiens
ccacaguaggca

SEQ ID NO: 1768437 - RNA, 21 nt, Homo sapiens
cugguauuccugccuccauau

SEQ ID NO: 1768438 - RNA, 18 nt, Homo sapiens
gaaucuucugaaaccaaa

SEQ ID NO: 1768439 - RNA, 20 nt, Homo sapiens
gcacuguccagcugguugua

SEQ ID NO: 1768440 - RNA, 16 nt, Homo sapiens
uguaaggaacuggaac

SEQ ID NO: 1768441 - RNA, 12 nt, Homo sapiens
gaguguagccua

SEQ ID NO: 1768442 - RNA, 13 nt, Homo sapiens
agggauacagggg

SEQ ID NO: 1768443 - RNA, 13 nt, Homo sapiens
ucaaguacucaaa

SEQ ID NO: 1768444 - RNA, 12 nt, Homo sapiens
cuaguauacauu

SEQ ID NO: 1768445 - RNA, 12 nt, Homo sapiens
ccuggggaccau

SEQ ID NO: 1768446 - RNA, 21 nt, Homo sapiens
ucucugauguaguuaaguauu

SEQ ID NO: 1768447 - RNA, 15 nt, Homo sapiens
agcaggcucucaggc

SEQ ID NO: 1768448 - RNA, 20 nt, Homo sapiens
aauaauagcuagcuauuacu

SEQ ID NO: 1768449 - RNA, 18 nt, Homo sapiens
aaugagcuugugugcccu

SEQ ID NO: 1768450 - RNA, 19 nt, Homo sapiens
ucugcaauuuuacugugaa

SEQ ID NO: 1768451 - RNA, 16 nt, Homo sapiens
uggaaaaagucacauu

SEQ ID NO: 1768452 - RNA, 21 nt, Homo sapiens
aaaauugcaguuucauguaug

SEQ ID NO: 1768453 - RNA, 14 nt, Homo sapiens
guuaugguguuucu

SEQ ID NO: 1768454 - RNA, 14 nt, Homo sapiens
ugggggcaggacaa

SEQ ID NO: 1768455 - RNA, 16 nt, Homo sapiens
gguaaaugacauagac

SEQ ID NO: 1768456 - RNA, 14 nt, Homo sapiens
aaguuuccuuccag

SEQ ID NO: 1768457 - RNA, 16 nt, Homo sapiens
uggugagaaaccaacu

SEQ ID NO: 1768458 - RNA, 17 nt, Homo sapiens
uaucaaauacuaguauu

SEQ ID NO: 1768459 - RNA, 14 nt, Homo sapiens
aucauuuuauguca

SEQ ID NO: 1768460 - RNA, 14 nt, Homo sapiens
ucauacuacugaaa

SEQ ID NO: 1768461 - RNA, 15 nt, Homo sapiens
gaaaagagaagaaga

SEQ ID NO: 1768462 - RNA, 14 nt, Homo sapiens
ccuucucucaucuc

SEQ ID NO: 1768463 - RNA, 12 nt, Homo sapiens
aaccuauuuuca

SEQ ID NO: 1768464 - RNA, 21 nt, Homo sapiens
aguggucagaacagagccuuu

SEQ ID NO: 1768465 - RNA, 12 nt, Homo sapiens
uaggaugugaug

SEQ ID NO: 1768466 - RNA, 16 nt, Homo sapiens
uuacuaucauggcaua

SEQ ID NO: 1768467 - RNA, 14 nt, Homo sapiens
agccucagcucuca

SEQ ID NO: 1768468 - RNA, 20 nt, Homo sapiens
aaauggcccggacaugucuu

SEQ ID NO: 1768469 - RNA, 18 nt, Homo sapiens
ucaaguguuaccuaacaa

SEQ ID NO: 1768470 - RNA, 15 nt, Homo sapiens
cgauguggaccucua

SEQ ID NO: 1768471 - RNA, 15 nt, Homo sapiens
acacacaaagcacau

SEQ ID NO: 1768472 - RNA, 13 nt, Homo sapiens
uaauacauucacc

SEQ ID NO: 1768473 - RNA, 14 nt, Homo sapiens
ggaaauacacuguu

SEQ ID NO: 1768474 - RNA, 18 nt, Homo sapiens
ugguccccuccuucccaa

SEQ ID NO: 1768475 - RNA, 16 nt, Homo sapiens
uuggcccgcacagagc

SEQ ID NO: 1768476 - RNA, 22 nt, Homo sapiens
cagcguucauguucugugauag

SEQ ID NO: 1768477 - RNA, 20 nt, Homo sapiens
uaaauuuugugauucuauaa

SEQ ID NO: 1768478 - RNA, 17 nt, Homo sapiens
guucauauuaagacaua

SEQ ID NO: 1768479 - RNA, 19 nt, Homo sapiens
cuccccagacagggcucca

SEQ ID NO: 1768480 - RNA, 20 nt, Homo sapiens
cuuucuaaguaggaugaauc

SEQ ID NO: 1768481 - RNA, 19 nt, Homo sapiens
ucauucugccugcuccauc

SEQ ID NO: 1768482 - RNA, 22 nt, Homo sapiens
uccggagggguugcgggggagc

SEQ ID NO: 1768483 - RNA, 22 nt, Homo sapiens
aaaccuggcaagucaccugcag

SEQ ID NO: 1768484 - RNA, 17 nt, Homo sapiens
cagcuuuucccaggaga

SEQ ID NO: 1768485 - RNA, 22 nt, Homo sapiens
gccggggaaggaggccguccau

SEQ ID NO: 1768486 - RNA, 23 nt, Homo sapiens
cuggugggccuuucuguguccua

SEQ ID NO: 1768487 - RNA, 20 nt, Homo sapiens
agggccuucuccacagggac

SEQ ID NO: 1768488 - RNA, 13 nt, Homo sapiens
uaguuugcacuau

SEQ ID NO: 1768489 - RNA, 17 nt, Homo sapiens
guuacuuuacauccuac

SEQ ID NO: 1768490 - RNA, 17 nt, Homo sapiens
uacuauuucaauacuua

SEQ ID NO: 1768491 - RNA, 17 nt, Homo sapiens
aggauuacacauuucac

SEQ ID NO: 1768492 - RNA, 19 nt, Homo sapiens
ccacagcgcuggccgggac

SEQ ID NO: 1768493 - RNA, 23 nt, Homo sapiens
agaaggucuguggugcagugugu

SEQ ID NO: 1768494 - RNA, 22 nt, Homo sapiens
cugauuugauaccauggcacug

SEQ ID NO: 1768495 - RNA, 13 nt, Homo sapiens
caacagauucucu

SEQ ID NO: 1768496 - RNA, 22 nt, Homo sapiens
uugauuuacaauuuaaugcacu

SEQ ID NO: 1768497 - RNA, 18 nt, Homo sapiens
uugugucuuuugcaugau

SEQ ID NO: 1768498 - RNA, 20 nt, Homo sapiens
ucagcagaugcuguugugaa

SEQ ID NO: 1768499 - RNA, 15 nt, Homo sapiens
ccacaggucuaagag

SEQ ID NO: 1768500 - RNA, 14 nt, Homo sapiens
gaagcauacaaagc

SEQ ID NO: 1768501 - RNA, 18 nt, Homo sapiens
aucaacucucacuccuga

SEQ ID NO: 1768502 - RNA, 16 nt, Homo sapiens
cagagacuaucugauu

SEQ ID NO: 1768503 - RNA, 13 nt, Homo sapiens
augauucaagcca

SEQ ID NO: 1768504 - RNA, 15 nt, Homo sapiens
uguaucaaacugcuu

SEQ ID NO: 1768505 - RNA, 14 nt, Homo sapiens
aucuguuuuagaca

SEQ ID NO: 1768506 - RNA, 14 nt, Homo sapiens
acuucuacauucaa

SEQ ID NO: 1768507 - RNA, 21 nt, Homo sapiens
ccagcuuguuugugaaacaaa

SEQ ID NO: 1768508 - RNA, 15 nt, Homo sapiens
ccagaagugaauuau

SEQ ID NO: 1768509 - RNA, 16 nt, Homo sapiens
auuugauuaacaaaua

SEQ ID NO: 1768510 - RNA, 13 nt, Homo sapiens
ccacaugggaccu

SEQ ID NO: 1768511 - RNA, 13 nt, Homo sapiens
uaaaccauucacc

SEQ ID NO: 1768512 - RNA, 13 nt, Homo sapiens
cuuuugacuccag

SEQ ID NO: 1768513 - RNA, 18 nt, Homo sapiens
cuggguuugcccaguccu

SEQ ID NO: 1768514 - RNA, 22 nt, Homo sapiens
agugauuuccuguauaauuuaa

SEQ ID NO: 1768515 - RNA, 15 nt, Homo sapiens
ccuuuuugacacuga

SEQ ID NO: 1768516 - RNA, 12 nt, Homo sapiens
caagaaauuacu

SEQ ID NO: 1768517 - RNA, 21 nt, Homo sapiens
acugacagacuuagaaccuga

SEQ ID NO: 1768518 - RNA, 16 nt, Homo sapiens
uucuaucccuuaccug

SEQ ID NO: 1768519 - RNA, 12 nt, Homo sapiens
gggaagccaguc

SEQ ID NO: 1768520 - RNA, 18 nt, Homo sapiens
uauaauuucagugcagua

SEQ ID NO: 1768521 - RNA, 15 nt, Homo sapiens
gcuguauacaaacag

SEQ ID NO: 1768522 - RNA, 17 nt, Homo sapiens
auguaccuccaugagcu

SEQ ID NO: 1768523 - RNA, 19 nt, Homo sapiens
gccaggacaaaaugcagac

SEQ ID NO: 1768524 - RNA, 14 nt, Homo sapiens
aaaaaccccagugu

SEQ ID NO: 1768525 - RNA, 16 nt, Homo sapiens
uuacuaaggaagauua

SEQ ID NO: 1768526 - RNA, 15 nt, Homo sapiens
caucccaagccagaa

SEQ ID NO: 1768527 - RNA, 14 nt, Homo sapiens
caaucccauuccug

SEQ ID NO: 1768528 - RNA, 17 nt, Homo sapiens
uaguuaugacagccauu

SEQ ID NO: 1768529 - RNA, 15 nt, Homo sapiens
cuagaugugucuuac

SEQ ID NO: 1768530 - RNA, 23 nt, Homo sapiens
ucaccaagcucaacggcuccauc

SEQ ID NO: 1768531 - RNA, 16 nt, Homo sapiens
uuaaauaugaaugaac

SEQ ID NO: 1768532 - RNA, 15 nt, Homo sapiens
gcacacugcacacau

SEQ ID NO: 1768533 - RNA, 11 nt, Homo sapiens
gauauauuugu

SEQ ID NO: 1768534 - RNA, 12 nt, Homo sapiens
agacauuccaag

SEQ ID NO: 1768535 - RNA, 23 nt, Homo sapiens
ggaaagaaaacuaacaaccaacc

SEQ ID NO: 1768536 - RNA, 20 nt, Homo sapiens
accagaugaaauaauguucu

SEQ ID NO: 1768537 - RNA, 18 nt, Homo sapiens
ccccucugucugcccuca

SEQ ID NO: 1768538 - RNA, 21 nt, Homo sapiens
gacuggaaguucauaccuaag

SEQ ID NO: 1768539 - RNA, 22 nt, Homo sapiens
cuaauuuacuggacaaagaauu

SEQ ID NO: 1768540 - RNA, 15 nt, Homo sapiens
gaugcuggucauccu

SEQ ID NO: 1768541 - RNA, 23 nt, Homo sapiens
guguugggaauugcaugccaucu

SEQ ID NO: 1768542 - RNA, 21 nt, Homo sapiens
cauuccuuacuugcacuguua

SEQ ID NO: 1768543 - RNA, 20 nt, Homo sapiens
gguguauccuggcccugggg

SEQ ID NO: 1768544 - RNA, 13 nt, Homo sapiens
aaaauuggacaga

SEQ ID NO: 1768545 - RNA, 14 nt, Homo sapiens
agcacacauuuuaa

SEQ ID NO: 1768546 - RNA, 23 nt, Homo sapiens
acaacuggacucauuaucacagu

SEQ ID NO: 1768547 - RNA, 12 nt, Homo sapiens
acacacaauuaa

SEQ ID NO: 1768548 - RNA, 18 nt, Homo sapiens
cauaaaagauauguugaa

SEQ ID NO: 1768549 - RNA, 20 nt, Homo sapiens
uauuugcauaauaugcauau

SEQ ID NO: 1768550 - RNA, 15 nt, Homo sapiens
uagaguauaccuccu

SEQ ID NO: 1768551 - RNA, 13 nt, Homo sapiens
acuggaccuggug

SEQ ID NO: 1768552 - RNA, 21 nt, Homo sapiens
auaccucaacccccauuucua

SEQ ID NO: 1768553 - RNA, 14 nt, Homo sapiens
ccuagcccucauuu

SEQ ID NO: 1768554 - RNA, 13 nt, Homo sapiens
guuaggcauuaau

SEQ ID NO: 1768555 - RNA, 21 nt, Homo sapiens
cucucccaaaaaacuacuucu

SEQ ID NO: 1768556 - RNA, 15 nt, Homo sapiens
auuuuccuaaccaca

SEQ ID NO: 1768557 - RNA, 24 nt, Homo sapiens
ccccagagccacuaccuuugucca

SEQ ID NO: 1768558 - RNA, 16 nt, Homo sapiens
gcugagcaccagggga

SEQ ID NO: 1768559 - RNA, 23 nt, Homo sapiens
acauugugucagauuaccaguua

SEQ ID NO: 1768560 - RNA, 18 nt, Homo sapiens
acagaccgggguggaguc

SEQ ID NO: 1768561 - RNA, 18 nt, Homo sapiens
cauugcacucuagccugg

SEQ ID NO: 1768562 - RNA, 10 nt, Homo sapiens
gccuccacuc

SEQ ID NO: 1768563 - RNA, 23 nt, Homo sapiens
aaagucuagcacaguuccuugca

SEQ ID NO: 1768564 - RNA, 14 nt, Homo sapiens
ucuauauugcagug

SEQ ID NO: 1768565 - RNA, 14 nt, Homo sapiens
acacauggaugcac

SEQ ID NO: 1768566 - RNA, 14 nt, Homo sapiens
ucauacgguuguau

SEQ ID NO: 1768567 - RNA, 18 nt, Homo sapiens
auuaauuuuguguuuaag

SEQ ID NO: 1768568 - RNA, 19 nt, Homo sapiens
uugcaauuugcaaggauua

SEQ ID NO: 1768569 - RNA, 13 nt, Homo sapiens
uacccuccaugua

SEQ ID NO: 1768570 - RNA, 18 nt, Homo sapiens
gacucugagaacuccuca

SEQ ID NO: 1768571 - RNA, 17 nt, Homo sapiens
ucuuuguuagauauuag

SEQ ID NO: 1768572 - RNA, 15 nt, Homo sapiens
uuccuguccagcucc

SEQ ID NO: 1768573 - RNA, 23 nt, Homo sapiens
uucaagccuaaagacaauucauu

SEQ ID NO: 1768574 - RNA, 11 nt, Homo sapiens
cauaucugacu

SEQ ID NO: 1768575 - RNA, 21 nt, Homo sapiens
gacauaaaugaggaaacucca

SEQ ID NO: 1768576 - RNA, 19 nt, Homo sapiens
ucaaaaucugggaccaaaa

SEQ ID NO: 1768577 - RNA, 12 nt, Homo sapiens
uggguuuuacca

SEQ ID NO: 1768578 - RNA, 18 nt, Homo sapiens
cuuucccugcauaugcuu

SEQ ID NO: 1768579 - RNA, 12 nt, Homo sapiens
aauccauaucag

SEQ ID NO: 1768580 - RNA, 11 nt, Homo sapiens
gagaauggagg

SEQ ID NO: 1768581 - RNA, 15 nt, Homo sapiens
cuucacuaccaaaug

SEQ ID NO: 1768582 - RNA, 9 nt, Homo sapiens
uguguauga

SEQ ID NO: 1768583 - RNA, 12 nt, Homo sapiens
accugacaaaug

SEQ ID NO: 1768584 - RNA, 15 nt, Homo sapiens
cuugcauaaugguca

SEQ ID NO: 1768585 - RNA, 19 nt, Homo sapiens
ugcaucuggccuaugaccc

SEQ ID NO: 1768586 - RNA, 21 nt, Homo sapiens
cuuuaaucaugaaacaccuua

SEQ ID NO: 1768587 - RNA, 21 nt, Homo sapiens
cauaccgcuggggaacagagc

SEQ ID NO: 1768588 - RNA, 12 nt, Homo sapiens
uauuacuguugc

SEQ ID NO: 1768589 - RNA, 22 nt, Homo sapiens
cccuaccccagggcccuggcca

SEQ ID NO: 1768590 - RNA, 19 nt, Homo sapiens
cccacaaaacuucagugug

SEQ ID NO: 1768591 - RNA, 21 nt, Homo sapiens
uugcaugacuuguagcauauu

SEQ ID NO: 1768592 - RNA, 21 nt, Homo sapiens
agauugggguagagggaaaag

SEQ ID NO: 1768593 - RNA, 21 nt, Homo sapiens
cgagugcuaaguguaggauau

SEQ ID NO: 1768594 - RNA, 13 nt, Homo sapiens
agcauuuucauuc

SEQ ID NO: 1768595 - RNA, 18 nt, Homo sapiens
aggaacauugcagagcua

SEQ ID NO: 1768596 - RNA, 17 nt, Homo sapiens
aguccuugaaucaccug

SEQ ID NO: 1768597 - RNA, 16 nt, Homo sapiens
acauagaaacauacac

SEQ ID NO: 1768598 - RNA, 15 nt, Homo sapiens
aauaauuaccaauau

SEQ ID NO: 1768599 - RNA, 18 nt, Homo sapiens
acacaauuggaagucuaa

SEQ ID NO: 1768600 - RNA, 17 nt, Homo sapiens
ccugccucuuuucccca

SEQ ID NO: 1768601 - RNA, 19 nt, Homo sapiens
agcuaggaugguucuguga

SEQ ID NO: 1768602 - RNA, 15 nt, Homo sapiens
ucugccucucuugua

SEQ ID NO: 1768603 - RNA, 19 nt, Homo sapiens
auauuugaaagaagucaaa

SEQ ID NO: 1768604 - RNA, 19 nt, Homo sapiens
ugaggaggucccacuugca

SEQ ID NO: 1768605 - RNA, 16 nt, Homo sapiens
ggaaggaagggacaca

SEQ ID NO: 1768606 - RNA, 15 nt, Homo sapiens
cccacaccguguaaa

SEQ ID NO: 1768607 - RNA, 13 nt, Homo sapiens
ucacucuugccaa

SEQ ID NO: 1768608 - RNA, 16 nt, Homo sapiens
caaaaagagucagaca

SEQ ID NO: 1768609 - RNA, 11 nt, Homo sapiens
gggcaggguga

SEQ ID NO: 1768610 - RNA, 17 nt, Homo sapiens
ugagcccacaaagccuu

SEQ ID NO: 1768611 - RNA, 14 nt, Homo sapiens
auuuugccuaauac

SEQ ID NO: 1768612 - RNA, 18 nt, Homo sapiens
agcuacucaggaggcuga

SEQ ID NO: 1768613 - RNA, 23 nt, Homo sapiens
ugaaugaaaaaauaaacgaguga

SEQ ID NO: 1768614 - RNA, 23 nt, Homo sapiens
caauacucagugcgguacucagu

SEQ ID NO: 1768615 - RNA, 24 nt, Homo sapiens
cugcuauaugccuuaagccaauau

SEQ ID NO: 1768616 - RNA, 22 nt, Homo sapiens
aauaagcuuuuaaacaagucau

SEQ ID NO: 1768617 - RNA, 13 nt, Homo sapiens
ugaaagugcugcu

SEQ ID NO: 1768618 - RNA, 21 nt, Homo sapiens
auacuguugucagguacagua

SEQ ID NO: 1768619 - RNA, 15 nt, Homo sapiens
uaucuuaguugguau

SEQ ID NO: 1768620 - RNA, 18 nt, Homo sapiens
gaaaaugugucauucauu

SEQ ID NO: 1768621 - RNA, 14 nt, Homo sapiens
ugcugauacugggu

SEQ ID NO: 1768622 - RNA, 14 nt, Homo sapiens
auucuaaaacauuc

SEQ ID NO: 1768623 - RNA, 14 nt, Homo sapiens
aaugacaugaauuu

SEQ ID NO: 1768624 - RNA, 14 nt, Homo sapiens
aacauuacucugaa

SEQ ID NO: 1768625 - RNA, 15 nt, Homo sapiens
gacgagcaugagcug

SEQ ID NO: 1768626 - RNA, 17 nt, Homo sapiens
uuuccaaauuauggcaa

SEQ ID NO: 1768627 - RNA, 19 nt, Homo sapiens
cccuccagccaauaggcag

SEQ ID NO: 1768628 - RNA, 15 nt, Homo sapiens
gcuccuuccagaccu

SEQ ID NO: 1768629 - RNA, 23 nt, Homo sapiens
ucucugauagguagcauuuucca

SEQ ID NO: 1768630 - RNA, 21 nt, Homo sapiens
cagacuguuagaaaauggaca

SEQ ID NO: 1768631 - RNA, 17 nt, Homo sapiens
cucauccuuaccgcaca

SEQ ID NO: 1768632 - RNA, 20 nt, Homo sapiens
cauauuccucucaguccuuc

SEQ ID NO: 1768633 - RNA, 19 nt, Homo sapiens
aauaacaacagaucugcag

SEQ ID NO: 1768634 - RNA, 18 nt, Homo sapiens
cuggugaugcgcaguugc

SEQ ID NO: 1768635 - RNA, 14 nt, Homo sapiens
uguuugcacaccca

SEQ ID NO: 1768636 - RNA, 16 nt, Homo sapiens
aaucucucaacaugau

SEQ ID NO: 1768637 - RNA, 18 nt, Homo sapiens
uagcgagaagaugcucug

SEQ ID NO: 1768638 - RNA, 11 nt, Homo sapiens
uccccucacag

SEQ ID NO: 1768639 - RNA, 16 nt, Homo sapiens
ucaagucuacugccac

SEQ ID NO: 1768640 - RNA, 21 nt, Homo sapiens
guaggcuuuguauucaaaaau

SEQ ID NO: 1768641 - RNA, 19 nt, Homo sapiens
aaaguugcagucucagaaa

SEQ ID NO: 1768642 - RNA, 20 nt, Homo sapiens
cugaggacccggcgcugagu

SEQ ID NO: 1768643 - RNA, 23 nt, Homo sapiens
aacucagaagaaagcucagaguu

SEQ ID NO: 1768644 - RNA, 15 nt, Homo sapiens
ccucuguccaaccac

SEQ ID NO: 1768645 - RNA, 18 nt, Homo sapiens
uucaucuucacugcaauu

SEQ ID NO: 1768646 - RNA, 20 nt, Homo sapiens
ucagagguguacacuaacau

SEQ ID NO: 1768647 - RNA, 16 nt, Homo sapiens
ugccaaugcacgcaca

SEQ ID NO: 1768648 - RNA, 17 nt, Homo sapiens
ccugacuuuuaauguca

SEQ ID NO: 1768649 - RNA, 22 nt, Homo sapiens
caggcccaauucugccacuucu

SEQ ID NO: 1768650 - RNA, 18 nt, Homo sapiens
gauggccgggcugcugcu

SEQ ID NO: 1768651 - RNA, 20 nt, Homo sapiens
gccauucuuuuuuucuuggc

SEQ ID NO: 1768652 - RNA, 17 nt, Homo sapiens
cuuaccugggaccucac

SEQ ID NO: 1768653 - RNA, 23 nt, Homo sapiens
acaacaggcauagcaaaugacau

SEQ ID NO: 1768654 - RNA, 19 nt, Homo sapiens
acugcgaggacaucaaagu

SEQ ID NO: 1768655 - RNA, 22 nt, Homo sapiens
aagacauuuauaauacaaauaa

SEQ ID NO: 1768656 - RNA, 14 nt, Homo sapiens
auucaauaagagau

SEQ ID NO: 1768657 - RNA, 16 nt, Homo sapiens
cccagagacaugcaag

SEQ ID NO: 1768658 - RNA, 21 nt, Homo sapiens
ccugaguuggcguugugggca

SEQ ID NO: 1768659 - RNA, 23 nt, Homo sapiens
auuuagcaucuuccuugauaaua

SEQ ID NO: 1768660 - RNA, 19 nt, Homo sapiens
gaucagacagcuugaauca

SEQ ID NO: 1768661 - RNA, 19 nt, Homo sapiens
caggagcuuggcagagaga

SEQ ID NO: 1768662 - RNA, 20 nt, Homo sapiens
caucuucacucuucacuuga

SEQ ID NO: 1768663 - RNA, 13 nt, Homo sapiens
gcacucccaguua

SEQ ID NO: 1768664 - RNA, 16 nt, Homo sapiens
guuagggaaggacaaa

SEQ ID NO: 1768665 - RNA, 19 nt, Homo sapiens
uuucaggcuccccagauca

SEQ ID NO: 1768666 - RNA, 18 nt, Homo sapiens
ugagggcucacucagcca

SEQ ID NO: 1768667 - RNA, 16 nt, Homo sapiens
uauuuuggaacuauga

SEQ ID NO: 1768668 - RNA, 18 nt, Homo sapiens
gcacaagaaucacuugaa

SEQ ID NO: 1768669 - RNA, 16 nt, Homo sapiens
auguaagagcuuuaca

SEQ ID NO: 1768670 - RNA, 15 nt, Homo sapiens
aguagcaaugacaau

SEQ ID NO: 1768671 - RNA, 16 nt, Homo sapiens
aauguagaaccucaaa

SEQ ID NO: 1768672 - RNA, 12 nt, Homo sapiens
gagugcauuuag

SEQ ID NO: 1768673 - RNA, 16 nt, Homo sapiens
uaagcuuuccuguuga

SEQ ID NO: 1768674 - RNA, 16 nt, Homo sapiens
acauccccagccagaa

SEQ ID NO: 1768675 - RNA, 19 nt, Homo sapiens
ucccagccucccggagcuc

SEQ ID NO: 1768676 - RNA, 17 nt, Homo sapiens
gccccuuugccugucaa

SEQ ID NO: 1768677 - RNA, 15 nt, Homo sapiens
ugccaacuucccaca

SEQ ID NO: 1768678 - RNA, 17 nt, Homo sapiens
gccagugccagcaccug

SEQ ID NO: 1768679 - RNA, 17 nt, Homo sapiens
cugcuacuuaauuccuu

SEQ ID NO: 1768680 - RNA, 19 nt, Homo sapiens
gcaggcuuuuguguucucu

SEQ ID NO: 1768681 - RNA, 20 nt, Homo sapiens
cuaacugggcggcugaggca

SEQ ID NO: 1768682 - RNA, 16 nt, Homo sapiens
aucuccucuguaauga

SEQ ID NO: 1768683 - RNA, 13 nt, Homo sapiens
agaaucaagauac

SEQ ID NO: 1768684 - RNA, 21 nt, Homo sapiens
uaacauuauauaacaaaaaag

SEQ ID NO: 1768685 - RNA, 18 nt, Homo sapiens
ucccuaaauauacaucug

SEQ ID NO: 1768686 - RNA, 12 nt, Homo sapiens
guggcauuugaa

SEQ ID NO: 1768687 - RNA, 22 nt, Homo sapiens
uacuuacacugaaauccaaaau

SEQ ID NO: 1768688 - RNA, 13 nt, Homo sapiens
ggcuggagcugcc

SEQ ID NO: 1768689 - RNA, 15 nt, Homo sapiens
cuucuugcuuguaaa

SEQ ID NO: 1768690 - RNA, 16 nt, Homo sapiens
aagauuuuuucauuuc

SEQ ID NO: 1768691 - RNA, 19 nt, Homo sapiens
aacuguacaaauugugaug

SEQ ID NO: 1768692 - RNA, 12 nt, Homo sapiens
cuauacauuccu

SEQ ID NO: 1768693 - RNA, 21 nt, Homo sapiens
auaaguggggagagagcccuu

SEQ ID NO: 1768694 - RNA, 18 nt, Homo sapiens
gacguggagcugcucaac

SEQ ID NO: 1768695 - RNA, 23 nt, Homo sapiens
aggggcuagggaggaccaaaggg

SEQ ID NO: 1768696 - RNA, 13 nt, Homo sapiens
cugcuuaguacau

SEQ ID NO: 1768697 - RNA, 19 nt, Homo sapiens
uccucaaugaaugggaugu

SEQ ID NO: 1768698 - RNA, 21 nt, Homo sapiens
caccucgcuccccucuggaau

SEQ ID NO: 1768699 - RNA, 15 nt, Homo sapiens
uuucuguuguuucuu

SEQ ID NO: 1768700 - RNA, 14 nt, Homo sapiens
gcuaucaauccaag

SEQ ID NO: 1768701 - RNA, 15 nt, Homo sapiens
uauuaaagaucugca

SEQ ID NO: 1768702 - RNA, 16 nt, Homo sapiens
ugaacuccugaccuca

SEQ ID NO: 1768703 - RNA, 12 nt, Homo sapiens
caggacaucucc

SEQ ID NO: 1768704 - RNA, 22 nt, Homo sapiens
uccuccugaaccagcacuaauc

SEQ ID NO: 1768705 - RNA, 12 nt, Homo sapiens
caaagcacaaag

SEQ ID NO: 1768706 - RNA, 16 nt, Homo sapiens
gugaugagagaaugga

SEQ ID NO: 1768707 - RNA, 23 nt, Homo sapiens
aaccacauagacuuuaugcaaua

SEQ ID NO: 1768708 - RNA, 18 nt, Homo sapiens
acagagaggaggggacca

SEQ ID NO: 1768709 - RNA, 14 nt, Homo sapiens
cuccagcagggucu

SEQ ID NO: 1768710 - RNA, 14 nt, Homo sapiens
aagguucccagaga

SEQ ID NO: 1768711 - RNA, 15 nt, Homo sapiens
gcgugaaucuguauc

SEQ ID NO: 1768712 - RNA, 20 nt, Homo sapiens
uaagaaauaaauuuauuuca

SEQ ID NO: 1768713 - RNA, 19 nt, Homo sapiens
uaggcaugccugggaaucc

SEQ ID NO: 1768714 - RNA, 20 nt, Homo sapiens
cuuuccccaccagaugcuga

SEQ ID NO: 1768715 - RNA, 18 nt, Homo sapiens
cccugucagcaugaauuu

SEQ ID NO: 1768716 - RNA, 22 nt, Homo sapiens
aauugcguucuaagaggugaag

SEQ ID NO: 1768717 - RNA, 23 nt, Homo sapiens
ccugcuauuguuaauaaccuuaa

SEQ ID NO: 1768718 - RNA, 21 nt, Homo sapiens
gauuaaugucaauucuugcca

SEQ ID NO: 1768719 - RNA, 15 nt, Homo sapiens
gccuuacaucuggcu

SEQ ID NO: 1768720 - RNA, 15 nt, Homo sapiens
uagaaauacauuaug

SEQ ID NO: 1768721 - RNA, 23 nt, Homo sapiens
aucuguauauacaauaacauaau

SEQ ID NO: 1768722 - RNA, 16 nt, Homo sapiens
caauuugaauauaaau

SEQ ID NO: 1768723 - RNA, 19 nt, Homo sapiens
aaccaaguggcucccacac

SEQ ID NO: 1768724 - RNA, 22 nt, Homo sapiens
cacagcuacacagaucacagcu

SEQ ID NO: 1768725 - RNA, 12 nt, Homo sapiens
uguguuguucau

SEQ ID NO: 1768726 - RNA, 23 nt, Homo sapiens
aaaagaagaaauaaauaaucuac

SEQ ID NO: 1768727 - RNA, 18 nt, Homo sapiens
cuuugacacaagguguaa

SEQ ID NO: 1768728 - RNA, 14 nt, Homo sapiens
guuguccgugauaa

SEQ ID NO: 1768729 - RNA, 16 nt, Homo sapiens
uauccaccccauccca

SEQ ID NO: 1768730 - RNA, 21 nt, Homo sapiens
accacaggugcccgccaccac

SEQ ID NO: 1768731 - RNA, 19 nt, Homo sapiens
aaagguuucaagacuugau

SEQ ID NO: 1768732 - RNA, 20 nt, Homo sapiens
aacagggcaccccagcugac

SEQ ID NO: 1768733 - RNA, 15 nt, Homo sapiens
ggagguugaagccaa

SEQ ID NO: 1768734 - RNA, 14 nt, Homo sapiens
uggcccuuggaaua

SEQ ID NO: 1768735 - RNA, 17 nt, Homo sapiens
gagauuucaucugcucu

SEQ ID NO: 1768736 - RNA, 18 nt, Homo sapiens
uuuucaaaauccaaaaag

SEQ ID NO: 1768737 - RNA, 15 nt, Homo sapiens
cucagggaaacuugc

SEQ ID NO: 1768738 - RNA, 19 nt, Homo sapiens
caaugagggagcauguacc

SEQ ID NO: 1768739 - RNA, 13 nt, Homo sapiens
uagucuccaugca

SEQ ID NO: 1768740 - RNA, 15 nt, Homo sapiens
guacauugagcaaau

SEQ ID NO: 1768741 - RNA, 16 nt, Homo sapiens
cugcucuuccauuucu

SEQ ID NO: 1768742 - RNA, 13 nt, Homo sapiens
gguuuuaagccag

SEQ ID NO: 1768743 - RNA, 13 nt, Homo sapiens
agcaguaaacuuu

SEQ ID NO: 1768744 - RNA, 21 nt, Homo sapiens
aauggcuacacucaucugacu

SEQ ID NO: 1768745 - RNA, 17 nt, Homo sapiens
cauuggucauugugaau

SEQ ID NO: 1768746 - RNA, 17 nt, Homo sapiens
aagguauauugugaacc

SEQ ID NO: 1768747 - RNA, 14 nt, Homo sapiens
aaucaucuaaguca

SEQ ID NO: 1768748 - RNA, 22 nt, Homo sapiens
ucacacuuuucuuauaaugcaa

SEQ ID NO: 1768749 - RNA, 20 nt, Homo sapiens
ggcaccacaggcugccucau

SEQ ID NO: 1768750 - RNA, 15 nt, Homo sapiens
cugcccaggccuucc

SEQ ID NO: 1768751 - RNA, 22 nt, Homo sapiens
cucacgggugcaugaaaccacu

SEQ ID NO: 1768752 - RNA, 13 nt, Homo sapiens
acgauuauaguaa

SEQ ID NO: 1768753 - RNA, 17 nt, Homo sapiens
uuccuggaaugcauuca

SEQ ID NO: 1768754 - RNA, 21 nt, Homo sapiens
aucuuuacaaaacuacaugag

SEQ ID NO: 1768755 - RNA, 13 nt, Homo sapiens
gccugacaacuca

SEQ ID NO: 1768756 - RNA, 19 nt, Homo sapiens
aagugaguccuguucuucc

SEQ ID NO: 1768757 - RNA, 17 nt, Homo sapiens
cgcccgcccgcauagca

SEQ ID NO: 1768758 - RNA, 22 nt, Homo sapiens
agugcugaaauaaaaugauaaa

SEQ ID NO: 1768759 - RNA, 23 nt, Homo sapiens
caaguuuuggcagccaugauaau

SEQ ID NO: 1768760 - RNA, 17 nt, Homo sapiens
cuucuggaauacugaaa

SEQ ID NO: 1768761 - RNA, 17 nt, Homo sapiens
acuugcuggcugugaaa

SEQ ID NO: 1768762 - RNA, 14 nt, Homo sapiens
uguucauucacugc

SEQ ID NO: 1768763 - RNA, 18 nt, Homo sapiens
acuugcaauuugccaguu

SEQ ID NO: 1768764 - RNA, 12 nt, Homo sapiens
cucugugcucuu

SEQ ID NO: 1768765 - RNA, 23 nt, Homo sapiens
aucaaacauuggauuuuuccuua

SEQ ID NO: 1768766 - RNA, 15 nt, Homo sapiens
acaugccagggccau

SEQ ID NO: 1768767 - RNA, 17 nt, Homo sapiens
cucauuuuaguugccua

SEQ ID NO: 1768768 - RNA, 23 nt, Homo sapiens
ggccacccaaggaugucugccac

SEQ ID NO: 1768769 - RNA, 20 nt, Homo sapiens
ccagggacccuggaguauuu

SEQ ID NO: 1768770 - RNA, 19 nt, Homo sapiens
accuguagucccaguuacu

SEQ ID NO: 1768771 - RNA, 13 nt, Homo sapiens
aaacacacaugga

SEQ ID NO: 1768772 - RNA, 16 nt, Homo sapiens
uguuccccaucaucug

SEQ ID NO: 1768773 - RNA, 23 nt, Homo sapiens
cuguggcuucuuaaucuuuucac

SEQ ID NO: 1768774 - RNA, 13 nt, Homo sapiens
cccccagcuggaa

SEQ ID NO: 1768775 - RNA, 18 nt, Homo sapiens
cauaggagacccaugugc

SEQ ID NO: 1768776 - RNA, 19 nt, Homo sapiens
agaaaaagcacagcucuca

SEQ ID NO: 1768777 - RNA, 19 nt, Homo sapiens
aaugacuuggguuuaacaa

SEQ ID NO: 1768778 - RNA, 19 nt, Homo sapiens
augcacacacagaugcaca

SEQ ID NO: 1768779 - RNA, 20 nt, Homo sapiens
cucuguagugcuacaggguc

SEQ ID NO: 1768780 - RNA, 22 nt, Homo sapiens
ggcucacgaggcuuggaccugc

SEQ ID NO: 1768781 - RNA, 18 nt, Homo sapiens
uaaucuucugccuucuca

SEQ ID NO: 1768782 - RNA, 17 nt, Homo sapiens
acaauagacauugcaaa

SEQ ID NO: 1768783 - RNA, 13 nt, Homo sapiens
ccacuucaccccc

SEQ ID NO: 1768784 - RNA, 19 nt, Homo sapiens
uacuaauaugcaauuauga

SEQ ID NO: 1768785 - RNA, 16 nt, Homo sapiens
uuccaugaguuaucau

SEQ ID NO: 1768786 - RNA, 17 nt, Homo sapiens
ccuguuucaaucacugu

SEQ ID NO: 1768787 - RNA, 14 nt, Homo sapiens
accccuccaggaau

SEQ ID NO: 1768788 - RNA, 21 nt, Homo sapiens
gaaauuauauaaggcauucug

SEQ ID NO: 1768789 - RNA, 13 nt, Homo sapiens
accacucuugacu

SEQ ID NO: 1768790 - RNA, 20 nt, Homo sapiens
auaauuaaccaccaauccaa

SEQ ID NO: 1768791 - RNA, 21 nt, Homo sapiens
ggagaugcuucucuccuugcc

SEQ ID NO: 1768792 - RNA, 21 nt, Homo sapiens
gaccucugggagcucaaguga

SEQ ID NO: 1768793 - RNA, 17 nt, Homo sapiens
gccucaaguaggaguuu

SEQ ID NO: 1768794 - RNA, 17 nt, Homo sapiens
uaaaggcuaaaagggaa

SEQ ID NO: 1768795 - RNA, 22 nt, Homo sapiens
gccccaugcugcccgcuucuca

SEQ ID NO: 1768796 - RNA, 15 nt, Homo sapiens
cagacccugaaccca

SEQ ID NO: 1768797 - RNA, 13 nt, Homo sapiens
acuuccagcaaaa

SEQ ID NO: 1768798 - RNA, 23 nt, Homo sapiens
agcuggugccagaugugggcuca

SEQ ID NO: 1768799 - RNA, 13 nt, Homo sapiens
agaaccuuguccc

SEQ ID NO: 1768800 - RNA, 17 nt, Homo sapiens
gcuuguggccaaugcau

SEQ ID NO: 1768801 - RNA, 16 nt, Homo sapiens
cagagucuggcucugu

SEQ ID NO: 1768802 - RNA, 22 nt, Homo sapiens
uuuaggacuguauuuccaaauu

SEQ ID NO: 1768803 - RNA, 17 nt, Homo sapiens
aaacuaaacucuuacca

SEQ ID NO: 1768804 - RNA, 17 nt, Homo sapiens
uccacccacaacaucua

SEQ ID NO: 1768805 - RNA, 16 nt, Homo sapiens
aaaagaguuacacugg

SEQ ID NO: 1768806 - RNA, 13 nt, Homo sapiens
caaaggacaguac

SEQ ID NO: 1768807 - RNA, 16 nt, Homo sapiens
aauauagaaugaaaga

SEQ ID NO: 1768808 - RNA, 15 nt, Homo sapiens
gucccuauucugcca

SEQ ID NO: 1768809 - RNA, 17 nt, Homo sapiens
aaaagugggcugugacu

SEQ ID NO: 1768810 - RNA, 20 nt, Homo sapiens
gaguccacugcuccauuuau

SEQ ID NO: 1768811 - RNA, 18 nt, Homo sapiens
ucuccauuacaguguaaa

SEQ ID NO: 1768812 - RNA, 16 nt, Homo sapiens
accaccuuuccagcca

SEQ ID NO: 1768813 - RNA, 15 nt, Homo sapiens
auauugcugugagau

SEQ ID NO: 1768814 - RNA, 10 nt, Homo sapiens
uccucagguu

SEQ ID NO: 1768815 - RNA, 10 nt, Homo sapiens
cccucaggcu

SEQ ID NO: 1768816 - RNA, 16 nt, Homo sapiens
ugcuuugccagagcag

SEQ ID NO: 1768817 - RNA, 23 nt, Homo sapiens
gcauacaaagagguguacaggua

SEQ ID NO: 1768818 - RNA, 18 nt, Homo sapiens
gguuggaagugugacuuc

SEQ ID NO: 1768819 - RNA, 14 nt, Homo sapiens
auuugaaaauggac

SEQ ID NO: 1768820 - RNA, 16 nt, Homo sapiens
cuccccuaacaggugc

SEQ ID NO: 1768821 - RNA, 15 nt, Homo sapiens
agauggagguuuacc

SEQ ID NO: 1768822 - RNA, 23 nt, Homo sapiens
cuucccccaaggcugaugcauuc

SEQ ID NO: 1768823 - RNA, 18 nt, Homo sapiens
uccgugcuuaaccaaaga

SEQ ID NO: 1768824 - RNA, 16 nt, Homo sapiens
cuuguuccccacugac

SEQ ID NO: 1768825 - RNA, 14 nt, Homo sapiens
gaggcaaugggagc

SEQ ID NO: 1768826 - RNA, 22 nt, Homo sapiens
uuauaagguguuuucuguguaa

SEQ ID NO: 1768827 - RNA, 20 nt, Homo sapiens
cugccaaugccaugacugcu

SEQ ID NO: 1768828 - RNA, 20 nt, Homo sapiens
uuuccacucccacugccagg

SEQ ID NO: 1768829 - RNA, 14 nt, Homo sapiens
gucagccaagugca

SEQ ID NO: 1768830 - RNA, 11 nt, Homo sapiens
augaaacuggu

SEQ ID NO: 1768831 - RNA, 21 nt, Homo sapiens
caucauggauucauuacagcu

SEQ ID NO: 1768832 - RNA, 16 nt, Homo sapiens
ggaaguuaaagggcau

SEQ ID NO: 1768833 - RNA, 18 nt, Homo sapiens
cagcgccaugcuuccuau

SEQ ID NO: 1768834 - RNA, 14 nt, Homo sapiens
gagagcacagugau

SEQ ID NO: 1768835 - RNA, 22 nt, Homo sapiens
aaaucucaaugaagccagcuca

SEQ ID NO: 1768836 - RNA, 16 nt, Homo sapiens
cagcacuccucaucau

SEQ ID NO: 1768837 - RNA, 20 nt, Homo sapiens
auuggcaccuaauccaggca

SEQ ID NO: 1768838 - RNA, 12 nt, Homo sapiens
uguuaaguuaaa

SEQ ID NO: 1768839 - RNA, 20 nt, Homo sapiens
uuauuuaacugugcagugac

SEQ ID NO: 1768840 - RNA, 23 nt, Homo sapiens
guguauccgacucuaagcugugu

SEQ ID NO: 1768841 - RNA, 21 nt, Homo sapiens
gaggugggcguaucaccugag

SEQ ID NO: 1768842 - RNA, 17 nt, Homo sapiens
ucuuaauguuuccaaau

SEQ ID NO: 1768843 - RNA, 18 nt, Homo sapiens
ucacuucaaaacaguauu

SEQ ID NO: 1768844 - RNA, 13 nt, Homo sapiens
aggaggaugcuaa

SEQ ID NO: 1768845 - RNA, 17 nt, Homo sapiens
gcucacacaugagaucu

SEQ ID NO: 1768846 - RNA, 21 nt, Homo sapiens
agaacuggaagguacuuuaau

SEQ ID NO: 1768847 - RNA, 16 nt, Homo sapiens
caguauuuaagcuuua

SEQ ID NO: 1768848 - RNA, 13 nt, Homo sapiens
cccaugguggccu

SEQ ID NO: 1768849 - RNA, 19 nt, Homo sapiens
aagaaauccaguuuguguu

SEQ ID NO: 1768850 - RNA, 21 nt, Homo sapiens
acauaguuuucuuccuuugaa

SEQ ID NO: 1768851 - RNA, 21 nt, Homo sapiens
uccuaccuggggacuccucaa

SEQ ID NO: 1768852 - RNA, 16 nt, Homo sapiens
ccauaaccacauuuaa

SEQ ID NO: 1768853 - RNA, 23 nt, Homo sapiens
gucagaauuucuuugucauucaa

SEQ ID NO: 1768854 - RNA, 22 nt, Homo sapiens
gcccccacuggagcguguacua

SEQ ID NO: 1768855 - RNA, 20 nt, Homo sapiens
gucacauauacaaaagcaag

SEQ ID NO: 1768856 - RNA, 14 nt, Homo sapiens
augggugauucucu

SEQ ID NO: 1768857 - RNA, 21 nt, Homo sapiens
gcagaauuuaaguugguaaua

SEQ ID NO: 1768858 - RNA, 22 nt, Homo sapiens
agaaaacagaccuaaugcuccu

SEQ ID NO: 1768859 - RNA, 21 nt, Homo sapiens
accgguggggcugguucugua

SEQ ID NO: 1768860 - RNA, 20 nt, Homo sapiens
cuggcaguacagagugcagc

SEQ ID NO: 1768861 - RNA, 12 nt, Homo sapiens
uuuucaaaaagu

SEQ ID NO: 1768862 - RNA, 13 nt, Homo sapiens
gaaguagguguga

SEQ ID NO: 1768863 - RNA, 16 nt, Homo sapiens
auacagcucagcuuuu

SEQ ID NO: 1768864 - RNA, 20 nt, Homo sapiens
aauauuaggagacacaggga

SEQ ID NO: 1768865 - RNA, 15 nt, Homo sapiens
aagcuagcuuuccaa

SEQ ID NO: 1768866 - RNA, 15 nt, Homo sapiens
auuucagcuaguuaa

SEQ ID NO: 1768867 - RNA, 14 nt, Homo sapiens
cagcugaugcucaa

SEQ ID NO: 1768868 - RNA, 21 nt, Homo sapiens
agaguggccaaucccugugug

SEQ ID NO: 1768869 - RNA, 15 nt, Homo sapiens
agguaucuuacucug

SEQ ID NO: 1768870 - RNA, 20 nt, Homo sapiens
uaucaaaacauaucaauuca

SEQ ID NO: 1768871 - RNA, 17 nt, Homo sapiens
cuuauugcuguugcuua

SEQ ID NO: 1768872 - RNA, 15 nt, Homo sapiens
ugacacgucucgcca

SEQ ID NO: 1768873 - RNA, 16 nt, Homo sapiens
cucagcccaggcacaa

SEQ ID NO: 1768874 - RNA, 21 nt, Homo sapiens
uugaaagacuuccaaagaaug

SEQ ID NO: 1768875 - RNA, 15 nt, Homo sapiens
agucuuccagaaagc

SEQ ID NO: 1768876 - RNA, 15 nt, Homo sapiens
ucucugucucaaauu

SEQ ID NO: 1768877 - RNA, 15 nt, Homo sapiens
caccuaucuggaaaa

SEQ ID NO: 1768878 - RNA, 13 nt, Homo sapiens
ugcugcaucuccc

SEQ ID NO: 1768879 - RNA, 22 nt, Homo sapiens
cucccuaaaauaaaaaccagaa

SEQ ID NO: 1768880 - RNA, 21 nt, Homo sapiens
ucuggggagaaaucccucaga

SEQ ID NO: 1768881 - RNA, 19 nt, Homo sapiens
auggcugaacaucagggug

SEQ ID NO: 1768882 - RNA, 17 nt, Homo sapiens
ccucccugccaccaggc

SEQ ID NO: 1768883 - RNA, 22 nt, Homo sapiens
aaggcgguacuaguucagacac

SEQ ID NO: 1768884 - RNA, 11 nt, Homo sapiens
uaaaaugcaga

SEQ ID NO: 1768885 - RNA, 20 nt, Homo sapiens
ccccagccaucuacuggaua

SEQ ID NO: 1768886 - RNA, 22 nt, Homo sapiens
gcuaaggucuuggaacuugccu

SEQ ID NO: 1768887 - RNA, 17 nt, Homo sapiens
cacgggcaucauucucu

SEQ ID NO: 1768888 - RNA, 19 nt, Homo sapiens
cuaacuucuccaaggagca

SEQ ID NO: 1768889 - RNA, 15 nt, Homo sapiens
cagaaaacaaacaca

SEQ ID NO: 1768890 - RNA, 14 nt, Homo sapiens
augauagcuacugu

SEQ ID NO: 1768891 - RNA, 20 nt, Homo sapiens
cuugauauaauaauuacuua

SEQ ID NO: 1768892 - RNA, 22 nt, Homo sapiens
gaggugcuuuuuaaaaauccaa

SEQ ID NO: 1768893 - RNA, 12 nt, Homo sapiens
gaguaagggaag

SEQ ID NO: 1768894 - RNA, 15 nt, Homo sapiens
acccaaugccuguga

SEQ ID NO: 1768895 - RNA, 19 nt, Homo sapiens
uggaucucacaagcacuuu

SEQ ID NO: 1768896 - RNA, 22 nt, Homo sapiens
auuuucuuugagcagguuuaca

SEQ ID NO: 1768897 - RNA, 12 nt, Homo sapiens
ugacacaacuca

SEQ ID NO: 1768898 - RNA, 20 nt, Homo sapiens
uugaaugauaauagcucaca

SEQ ID NO: 1768899 - RNA, 19 nt, Homo sapiens
accccagcugccaaggaaa

SEQ ID NO: 1768900 - RNA, 15 nt, Homo sapiens
uuaugguaaccauuc

SEQ ID NO: 1768901 - RNA, 23 nt, Homo sapiens
cccaaagucauugauuuugauga

SEQ ID NO: 1768902 - RNA, 21 nt, Homo sapiens
cacaaaacauucauguaacuc

SEQ ID NO: 1768903 - RNA, 11 nt, Homo sapiens
ucaggcagcuc

SEQ ID NO: 1768904 - RNA, 18 nt, Homo sapiens
caacccgguuuaccaguu

SEQ ID NO: 1768905 - RNA, 18 nt, Homo sapiens
ugaaaugugcaagaguau

SEQ ID NO: 1768906 - RNA, 23 nt, Homo sapiens
ugacaugaaaauuacaacagaua

SEQ ID NO: 1768907 - RNA, 13 nt, Homo sapiens
aagcuuaugcuua

SEQ ID NO: 1768908 - RNA, 18 nt, Homo sapiens
cagagacccuggugcugc

SEQ ID NO: 1768909 - RNA, 14 nt, Homo sapiens
cuaaucuaugcaug

SEQ ID NO: 1768910 - RNA, 19 nt, Homo sapiens
aaugcugacaaugcugcca

SEQ ID NO: 1768911 - RNA, 14 nt, Homo sapiens
caagaccagccugg

SEQ ID NO: 1768912 - RNA, 16 nt, Homo sapiens
uucaaggucauuuacu

SEQ ID NO: 1768913 - RNA, 20 nt, Homo sapiens
cuuuccaaaaggaacucuag

SEQ ID NO: 1768914 - RNA, 17 nt, Homo sapiens
ugugucauuccaaauaa

SEQ ID NO: 1768915 - RNA, 15 nt, Homo sapiens
ucuagccacugagcg

SEQ ID NO: 1768916 - RNA, 12 nt, Homo sapiens
acauaucaugug

SEQ ID NO: 1768917 - RNA, 13 nt, Homo sapiens
gagggaugcagug

SEQ ID NO: 1768918 - RNA, 18 nt, Homo sapiens
aagaaauguauuccugaa

SEQ ID NO: 1768919 - RNA, 17 nt, Homo sapiens
gcugauggagacaguaa

SEQ ID NO: 1768920 - RNA, 20 nt, Homo sapiens
uuugauuccauuccauggaa

SEQ ID NO: 1768921 - RNA, 13 nt, Homo sapiens
caaaacugugcuu

SEQ ID NO: 1768922 - RNA, 20 nt, Homo sapiens
acacgugauggaccaaagcc

SEQ ID NO: 1768923 - RNA, 19 nt, Homo sapiens
gguuaccuuuguucccaaa

SEQ ID NO: 1768924 - RNA, 23 nt, Homo sapiens
caggccgagagcagacaccagca

SEQ ID NO: 1768925 - RNA, 20 nt, Homo sapiens
ucauuucuucuacaacucau

SEQ ID NO: 1768926 - RNA, 16 nt, Homo sapiens
ugaaccuugcuaucaa

SEQ ID NO: 1768927 - RNA, 18 nt, Homo sapiens
agugagcagugagcagaa

SEQ ID NO: 1768928 - RNA, 23 nt, Homo sapiens
gagggguucuucuggggugcuaa

SEQ ID NO: 1768929 - RNA, 16 nt, Homo sapiens
agaauggaagccucca

SEQ ID NO: 1768930 - RNA, 15 nt, Homo sapiens
uccaagacagagaca

SEQ ID NO: 1768931 - RNA, 15 nt, Homo sapiens
caccaugcccggcua

SEQ ID NO: 1768932 - RNA, 20 nt, Homo sapiens
auccacuacauucugaaggc

SEQ ID NO: 1768933 - RNA, 17 nt, Homo sapiens
gagcacaucugggaggc

SEQ ID NO: 1768934 - RNA, 19 nt, Homo sapiens
aucacagcuucagccagga

SEQ ID NO: 1768935 - RNA, 14 nt, Homo sapiens
gucuucccuaccuc

SEQ ID NO: 1768936 - RNA, 15 nt, Homo sapiens
gaggcagagccagug

SEQ ID NO: 1768937 - RNA, 21 nt, Homo sapiens
gaaacuuaaaugaacacagcu

SEQ ID NO: 1768938 - RNA, 13 nt, Homo sapiens
ccaaacgcuuauu

SEQ ID NO: 1768939 - RNA, 20 nt, Homo sapiens
uagagagccgccaaacauuc

SEQ ID NO: 1768940 - RNA, 19 nt, Homo sapiens
guugaggaagucaggcugu

SEQ ID NO: 1768941 - RNA, 14 nt, Homo sapiens
gcucccuguccuag

SEQ ID NO: 1768942 - RNA, 24 nt, Homo sapiens
aacuugugcccucccuguccuuag

SEQ ID NO: 1768943 - RNA, 20 nt, Homo sapiens
cccuguaaguuacagucaca

SEQ ID NO: 1768944 - RNA, 21 nt, Homo sapiens
ggaugagggaaaagaaaaaga

SEQ ID NO: 1768945 - RNA, 23 nt, Homo sapiens
auagugauugauagaguguuauc

SEQ ID NO: 1768946 - RNA, 23 nt, Homo sapiens
aucaguccuaccugagcaacaag

SEQ ID NO: 1768947 - RNA, 21 nt, Homo sapiens
cagcaucucagaguccaguca

SEQ ID NO: 1768948 - RNA, 21 nt, Homo sapiens
ucaugggaucccagacuuuuu

SEQ ID NO: 1768949 - RNA, 16 nt, Homo sapiens
ggccccacauugcacu

SEQ ID NO: 1768950 - RNA, 15 nt, Homo sapiens
uccccuuccacugag

SEQ ID NO: 1768951 - RNA, 19 nt, Homo sapiens
gauggggcaugugccauag

SEQ ID NO: 1768952 - RNA, 12 nt, Homo sapiens
gagaacugccuu

SEQ ID NO: 1768953 - RNA, 22 nt, Homo sapiens
uuuaaaaugcucaauuucagca

SEQ ID NO: 1768954 - RNA, 15 nt, Homo sapiens
ugaacucagaccuuu

SEQ ID NO: 1768955 - RNA, 18 nt, Homo sapiens
agacuguugccacuuaac

SEQ ID NO: 1768956 - RNA, 17 nt, Homo sapiens
uacugguugacuuucua

SEQ ID NO: 1768957 - RNA, 14 nt, Homo sapiens
aucucccaccuaaa

SEQ ID NO: 1768958 - RNA, 14 nt, Homo sapiens
gguagacugaggga

SEQ ID NO: 1768959 - RNA, 21 nt, Homo sapiens
ugagauagaagaacugcaaag

SEQ ID NO: 1768960 - RNA, 14 nt, Homo sapiens
augcaaugugcuac

SEQ ID NO: 1768961 - RNA, 19 nt, Homo sapiens
caagugcucaucuguugua

SEQ ID NO: 1768962 - RNA, 19 nt, Homo sapiens
cuuuguguuugguuuacau

SEQ ID NO: 1768963 - RNA, 17 nt, Homo sapiens
uuaccgaguaucuguaa

SEQ ID NO: 1768964 - RNA, 16 nt, Homo sapiens
uaaaacaucuuuccag

SEQ ID NO: 1768965 - RNA, 21 nt, Homo sapiens
cacuuaaacucaucuauccag

SEQ ID NO: 1768966 - RNA, 18 nt, Homo sapiens
agacaaacaagggagaag

SEQ ID NO: 1768967 - RNA, 16 nt, Homo sapiens
cucaagaagugaagaa

SEQ ID NO: 1768968 - RNA, 16 nt, Homo sapiens
cagcaucugaccaucu

SEQ ID NO: 1768969 - RNA, 18 nt, Homo sapiens
ucuagcauggcugccaau

SEQ ID NO: 1768970 - RNA, 20 nt, Homo sapiens
ccuuaaacuugcaguaucuc

SEQ ID NO: 1768971 - RNA, 16 nt, Homo sapiens
caaguuauucucuuca

SEQ ID NO: 1768972 - RNA, 22 nt, Homo sapiens
uguuccccacuguaucuaggca

SEQ ID NO: 1768973 - RNA, 16 nt, Homo sapiens
auguacuuguuugcaa

SEQ ID NO: 1768974 - RNA, 14 nt, Homo sapiens
ggcaacuguaugaa

SEQ ID NO: 1768975 - RNA, 13 nt, Homo sapiens
uuugcauugucua

SEQ ID NO: 1768976 - RNA, 15 nt, Homo sapiens
ugagcaucuccagca

SEQ ID NO: 1768977 - RNA, 21 nt, Homo sapiens
uagacccugcauuuauagcau

SEQ ID NO: 1768978 - RNA, 12 nt, Homo sapiens
acuaaaugcaca

SEQ ID NO: 1768979 - RNA, 18 nt, Homo sapiens
uccauaaacacccaugaa

SEQ ID NO: 1768980 - RNA, 13 nt, Homo sapiens
agugugugcacau

SEQ ID NO: 1768981 - RNA, 14 nt, Homo sapiens
auuuucagcaaaac

SEQ ID NO: 1768982 - RNA, 14 nt, Homo sapiens
aaauuaagcuuaaa

SEQ ID NO: 1768983 - RNA, 22 nt, Homo sapiens
uaaggaaaauaagcuuaucuua

SEQ ID NO: 1768984 - RNA, 13 nt, Homo sapiens
agcgaacaucuuc

SEQ ID NO: 1768985 - RNA, 17 nt, Homo sapiens
ggugggacccguggcug

SEQ ID NO: 1768986 - RNA, 20 nt, Homo sapiens
aauaaaacucccuuccuuau

SEQ ID NO: 1768987 - RNA, 19 nt, Homo sapiens
caaaacaaccaaacuauuu

SEQ ID NO: 1768988 - RNA, 16 nt, Homo sapiens
gauuaucuugauuucc

SEQ ID NO: 1768989 - RNA, 13 nt, Homo sapiens
gcccccacuuccc

SEQ ID NO: 1768990 - RNA, 16 nt, Homo sapiens
ugcacaguaaaaaugg

SEQ ID NO: 1768991 - RNA, 17 nt, Homo sapiens
gacauagcgagacucca

SEQ ID NO: 1768992 - RNA, 17 nt, Homo sapiens
aggccagcagccuucca

SEQ ID NO: 1768993 - RNA, 19 nt, Homo sapiens
ccacugugaagagaaccau

SEQ ID NO: 1768994 - RNA, 16 nt, Homo sapiens
ugcuccgcugcuccuu

SEQ ID NO: 1768995 - RNA, 14 nt, Homo sapiens
aauguuaagcaucu

SEQ ID NO: 1768996 - RNA, 14 nt, Homo sapiens
gcauuaaaaaugca

SEQ ID NO: 1768997 - RNA, 19 nt, Homo sapiens
gggccacaccaaccuucug

SEQ ID NO: 1768998 - RNA, 21 nt, Homo sapiens
gcucaucaguaacaguauuca

SEQ ID NO: 1768999 - RNA, 22 nt, Homo sapiens
ggggagguuuguuugugugaaa

SEQ ID NO: 1769000 - RNA, 20 nt, Homo sapiens
agccucugggucaguggucc

SEQ ID NO: 1769001 - RNA, 16 nt, Homo sapiens
caggauguacaaggac

SEQ ID NO: 1769002 - RNA, 16 nt, Homo sapiens
aucucagaaaauauua

SEQ ID NO: 1769003 - RNA, 18 nt, Homo sapiens
uuauccagaugaacugag

SEQ ID NO: 1769004 - RNA, 18 nt, Homo sapiens
aaaugcucuuuugcacaa

SEQ ID NO: 1769005 - RNA, 15 nt, Homo sapiens
cacuuagugaucauu

SEQ ID NO: 1769006 - RNA, 13 nt, Homo sapiens
uucagagauguac

SEQ ID NO: 1769007 - RNA, 23 nt, Homo sapiens
aaaacagcugcauggcacauacc

SEQ ID NO: 1769008 - RNA, 21 nt, Homo sapiens
gcuuggcacucaggugcugaa

SEQ ID NO: 1769009 - RNA, 16 nt, Homo sapiens
gaagaagcuaugucaa

SEQ ID NO: 1769010 - RNA, 22 nt, Homo sapiens
gcuuuucuuuuuuaauuuccag

SEQ ID NO: 1769011 - RNA, 17 nt, Homo sapiens
ggcuacaaucuucauuu

SEQ ID NO: 1769012 - RNA, 18 nt, Homo sapiens
uugagguaucacugcagu

SEQ ID NO: 1769013 - RNA, 22 nt, Homo sapiens
augagacuaugcaaaaguacaa

SEQ ID NO: 1769014 - RNA, 13 nt, Homo sapiens
accgccugcuuca

SEQ ID NO: 1769015 - RNA, 14 nt, Homo sapiens
agucucauugccaa

SEQ ID NO: 1769016 - RNA, 16 nt, Homo sapiens
aagcaauuuucauuua

SEQ ID NO: 1769017 - RNA, 23 nt, Homo sapiens
ccacacauaacuguuuugcacgu

SEQ ID NO: 1769018 - RNA, 14 nt, Homo sapiens
auuaaacacuguaa

SEQ ID NO: 1769019 - RNA, 23 nt, Homo sapiens
uaguuuuaaacucauuuuugcca

SEQ ID NO: 1769020 - RNA, 16 nt, Homo sapiens
guuaccucugcaugga

SEQ ID NO: 1769021 - RNA, 22 nt, Homo sapiens
cuuaacccccuagaaagacaga

SEQ ID NO: 1769022 - RNA, 18 nt, Homo sapiens
aaaccacugcuaugccau

SEQ ID NO: 1769023 - RNA, 17 nt, Homo sapiens
cuuucuucaauuaaugg

SEQ ID NO: 1769024 - RNA, 21 nt, Homo sapiens
aaacaccgagugaggccauag

SEQ ID NO: 1769025 - RNA, 17 nt, Homo sapiens
agagcuggagccuggug

SEQ ID NO: 1769026 - RNA, 23 nt, Homo sapiens
aaaaugaaaagcuuaggaccaga

SEQ ID NO: 1769027 - RNA, 20 nt, Homo sapiens
auuuguauaaugguguuacu

SEQ ID NO: 1769028 - RNA, 15 nt, Homo sapiens
cccagccucccugaa

SEQ ID NO: 1769029 - RNA, 20 nt, Homo sapiens
aagauguccugacuuugccc

SEQ ID NO: 1769030 - RNA, 22 nt, Homo sapiens
cauauuuuuagauacagugaaa

SEQ ID NO: 1769031 - RNA, 15 nt, Homo sapiens
gaccaauguccuugu

SEQ ID NO: 1769032 - RNA, 20 nt, Homo sapiens
agauggcauaaccugucuca

SEQ ID NO: 1769033 - RNA, 19 nt, Homo sapiens
aucauguuuuuucugcaau

SEQ ID NO: 1769034 - RNA, 11 nt, Homo sapiens
aguacugaaga

SEQ ID NO: 1769035 - RNA, 13 nt, Homo sapiens
guggcacuuccac

SEQ ID NO: 1769036 - RNA, 10 nt, Homo sapiens
ccacauucua

SEQ ID NO: 1769037 - RNA, 15 nt, Homo sapiens
gacaugguaccuaag

SEQ ID NO: 1769038 - RNA, 22 nt, Homo sapiens
cuucacugccccacuucuggca

SEQ ID NO: 1769039 - RNA, 19 nt, Homo sapiens
aagauugugucccauuccc

SEQ ID NO: 1769040 - RNA, 19 nt, Homo sapiens
ugaaacaaauuuacaucag

SEQ ID NO: 1769041 - RNA, 19 nt, Homo sapiens
uauucauacugacauuaga

SEQ ID NO: 1769042 - RNA, 14 nt, Homo sapiens
gcaaucuuugccaa

SEQ ID NO: 1769043 - RNA, 13 nt, Homo sapiens
uucuuugugccuu

SEQ ID NO: 1769044 - RNA, 21 nt, Homo sapiens
ugcucuucagagauguuaaaa

SEQ ID NO: 1769045 - RNA, 18 nt, Homo sapiens
gaacuauuuauuucaccc

SEQ ID NO: 1769046 - RNA, 20 nt, Homo sapiens
caagacgcugugcugcccug

SEQ ID NO: 1769047 - RNA, 16 nt, Homo sapiens
uauugcuaccaaaaac

SEQ ID NO: 1769048 - RNA, 11 nt, Homo sapiens
ugcaagcacuc

SEQ ID NO: 1769049 - RNA, 21 nt, Homo sapiens
uuccuaaauuaugacugcuga

SEQ ID NO: 1769050 - RNA, 13 nt, Homo sapiens
ggacuacagacau

SEQ ID NO: 1769051 - RNA, 23 nt, Homo sapiens
aaucacaggacauuaaggaccaa

SEQ ID NO: 1769052 - RNA, 21 nt, Homo sapiens
uauuauuuuagagcaucucau

SEQ ID NO: 1769053 - RNA, 14 nt, Homo sapiens
auccaugugcugcu

SEQ ID NO: 1769054 - RNA, 20 nt, Homo sapiens
augcagccaaccaagaugca

SEQ ID NO: 1769055 - RNA, 15 nt, Homo sapiens
ugacaaucaugugug

SEQ ID NO: 1769056 - RNA, 15 nt, Homo sapiens
ugcacauauuggcaa

SEQ ID NO: 1769057 - RNA, 22 nt, Homo sapiens
ugcuguuaucccugccuggucc

SEQ ID NO: 1769058 - RNA, 20 nt, Homo sapiens
gucccucuaacaucucccau

SEQ ID NO: 1769059 - RNA, 15 nt, Homo sapiens
gagacccagaucuca

SEQ ID NO: 1769060 - RNA, 21 nt, Homo sapiens
cuuucugaagaagagcaagaa

SEQ ID NO: 1769061 - RNA, 18 nt, Homo sapiens
agacuuaaagcacugaua

SEQ ID NO: 1769062 - RNA, 16 nt, Homo sapiens
uucaaagcaaccaccu

SEQ ID NO: 1769063 - RNA, 12 nt, Homo sapiens
guagcagcaguu

SEQ ID NO: 1769064 - RNA, 14 nt, Homo sapiens
aacaccccacagga

SEQ ID NO: 1769065 - RNA, 16 nt, Homo sapiens
ccagcuauuugggagg

SEQ ID NO: 1769066 - RNA, 20 nt, Homo sapiens
ccugggggcugcugcacugc

SEQ ID NO: 1769067 - RNA, 14 nt, Homo sapiens
agacaccauucauu

SEQ ID NO: 1769068 - RNA, 21 nt, Homo sapiens
uagagaucuaugggcauuugg

SEQ ID NO: 1769069 - RNA, 11 nt, Homo sapiens
acagcacuccu

SEQ ID NO: 1769070 - RNA, 13 nt, Homo sapiens
uuauguacuugau

SEQ ID NO: 1769071 - RNA, 18 nt, Homo sapiens
ccagaggcaccucaagaa

SEQ ID NO: 1769072 - RNA, 20 nt, Homo sapiens
ggccauccauucacagccag

SEQ ID NO: 1769073 - RNA, 22 nt, Homo sapiens
uuaauuuuuaaggauguugcca

SEQ ID NO: 1769074 - RNA, 22 nt, Homo sapiens
accugucccucuccuauguggc

SEQ ID NO: 1769075 - RNA, 19 nt, Homo sapiens
aaauacccacuaacaaaga

SEQ ID NO: 1769076 - RNA, 19 nt, Homo sapiens
uagauauugcuacuauaau

SEQ ID NO: 1769077 - RNA, 19 nt, Homo sapiens
accaggcuggagugcagug

SEQ ID NO: 1769078 - RNA, 19 nt, Homo sapiens
gccaggcuagagugcagug

SEQ ID NO: 1769079 - RNA, 20 nt, Homo sapiens
agaaaggugugcuggucaug

SEQ ID NO: 1769080 - RNA, 17 nt, Homo sapiens
aaguagguuuacauuca

SEQ ID NO: 1769081 - RNA, 15 nt, Homo sapiens
cacaaagaucaaaug

SEQ ID NO: 1769082 - RNA, 16 nt, Homo sapiens
gaaugaugugauacaa

SEQ ID NO: 1769083 - RNA, 17 nt, Homo sapiens
gaaccucccuuucccca

SEQ ID NO: 1769084 - RNA, 21 nt, Homo sapiens
uaaacaaauuagcaaucauuu

SEQ ID NO: 1769085 - RNA, 23 nt, Homo sapiens
cugcaggcaaagugagacugaca

SEQ ID NO: 1769086 - RNA, 19 nt, Homo sapiens
cucugcuccgugugucuca

SEQ ID NO: 1769087 - RNA, 11 nt, Homo sapiens
gauugcaaugc

SEQ ID NO: 1769088 - RNA, 18 nt, Homo sapiens
uuugaagcaucacauaaa

SEQ ID NO: 1769089 - RNA, 14 nt, Homo sapiens
gggggaaggcgcug

SEQ ID NO: 1769090 - RNA, 21 nt, Homo sapiens
acuuuggaguccccucaccuc

SEQ ID NO: 1769091 - RNA, 18 nt, Homo sapiens
ggaaauccccuuaugacu

SEQ ID NO: 1769092 - RNA, 18 nt, Homo sapiens
aggauguaucucacaagu

SEQ ID NO: 1769093 - RNA, 18 nt, Homo sapiens
aagggaagugaggcccaa

SEQ ID NO: 1769094 - RNA, 18 nt, Homo sapiens
uccaccaagaucaagcag

SEQ ID NO: 1769095 - RNA, 14 nt, Homo sapiens
ccugccccacccua

SEQ ID NO: 1769096 - RNA, 22 nt, Homo sapiens
caucuucuggagucuccagugg

SEQ ID NO: 1769097 - RNA, 17 nt, Homo sapiens
caucugcaacaaaaagu

SEQ ID NO: 1769098 - RNA, 23 nt, Homo sapiens
cuuaagagaauccacauaaaaga

SEQ ID NO: 1769099 - RNA, 23 nt, Homo sapiens
acuugagaguggaaccuccuaua

SEQ ID NO: 1769100 - RNA, 15 nt, Homo sapiens
cccagcuuccaugcu

SEQ ID NO: 1769101 - RNA, 21 nt, Homo sapiens
ggcccauuggagcaccugggc

SEQ ID NO: 1769102 - RNA, 21 nt, Homo sapiens
aaucaugaaauaugcaucuca

SEQ ID NO: 1769103 - RNA, 23 nt, Homo sapiens
cugggcccaguaccuagcuggcu

SEQ ID NO: 1769104 - RNA, 22 nt, Homo sapiens
ccagugcuacacguuggaguau

SEQ ID NO: 1769105 - RNA, 23 nt, Homo sapiens
aaagcuguaagaaaaugcuguca

SEQ ID NO: 1769106 - RNA, 15 nt, Homo sapiens
accacacauauugca

SEQ ID NO: 1769107 - RNA, 18 nt, Homo sapiens
gccaguuccgucuucccu

SEQ ID NO: 1769108 - RNA, 16 nt, Homo sapiens
ugcguuuccugugcau

SEQ ID NO: 1769109 - RNA, 19 nt, Homo sapiens
ucuuuguuuacaugaguuc

SEQ ID NO: 1769110 - RNA, 20 nt, Homo sapiens
cuuggggagauggaguucuu

SEQ ID NO: 1769111 - RNA, 19 nt, Homo sapiens
auaagcaaaaacaaaaaga

SEQ ID NO: 1769112 - RNA, 21 nt, Homo sapiens
cccugccugccccgacaccca

SEQ ID NO: 1769113 - RNA, 16 nt, Homo sapiens
cucugaaugaagcuga

SEQ ID NO: 1769114 - RNA, 21 nt, Homo sapiens
ucgaguaaggcacacccaaau

SEQ ID NO: 1769115 - RNA, 21 nt, Homo sapiens
cacagugcccaagaguggggu

SEQ ID NO: 1769116 - RNA, 22 nt, Homo sapiens
uggggcuaggggcuggggccaa

SEQ ID NO: 1769117 - RNA, 16 nt, Homo sapiens
aggauaaauugccaua

SEQ ID NO: 1769118 - RNA, 12 nt, Homo sapiens
gaaaaacuugug

SEQ ID NO: 1769119 - RNA, 13 nt, Homo sapiens
auccaaauccauc

SEQ ID NO: 1769120 - RNA, 17 nt, Homo sapiens
ccaaagagaaugccauu

SEQ ID NO: 1769121 - RNA, 19 nt, Homo sapiens
ccagcugcccuugcagggu

SEQ ID NO: 1769122 - RNA, 21 nt, Homo sapiens
gccauuccacagccccuuccu

SEQ ID NO: 1769123 - RNA, 23 nt, Homo sapiens
uccacuggggaggaauccuggac

SEQ ID NO: 1769124 - RNA, 19 nt, Homo sapiens
ucggcaucgggccaucuca

SEQ ID NO: 1769125 - RNA, 20 nt, Homo sapiens
cgucugccggacccggaggc

SEQ ID NO: 1769126 - RNA, 17 nt, Homo sapiens
gcauuacauuguuuaaa

SEQ ID NO: 1769127 - RNA, 23 nt, Homo sapiens
ucuguauuugcucccguggagcu

SEQ ID NO: 1769128 - RNA, 14 nt, Homo sapiens
guagcauacuggcu

SEQ ID NO: 1769129 - RNA, 17 nt, Homo sapiens
ugccucagugcugcaau

SEQ ID NO: 1769130 - RNA, 20 nt, Homo sapiens
cuuccagauauccacauaaa

SEQ ID NO: 1769131 - RNA, 20 nt, Homo sapiens
uguuccuacucagacuguug

SEQ ID NO: 1769132 - RNA, 12 nt, Homo sapiens
aaaaaagacuug

SEQ ID NO: 1769133 - RNA, 20 nt, Homo sapiens
gaauaacauuuaaauuccac

SEQ ID NO: 1769134 - RNA, 20 nt, Homo sapiens
accucaagaaaaauucacag

SEQ ID NO: 1769135 - RNA, 20 nt, Homo sapiens
aagagguuuguaucuggaaa

SEQ ID NO: 1769136 - RNA, 13 nt, Homo sapiens
agaguuccacaaa

SEQ ID NO: 1769137 - RNA, 15 nt, Homo sapiens
auucacuagaccaga

SEQ ID NO: 1769138 - RNA, 19 nt, Homo sapiens
uugaacuguuagaugcuga

SEQ ID NO: 1769139 - RNA, 16 nt, Homo sapiens
uguguuuuuucggaca

SEQ ID NO: 1769140 - RNA, 12 nt, Homo sapiens
acuuagacuccc

SEQ ID NO: 1769141 - RNA, 22 nt, Homo sapiens
ucugcauccauuugaacacauu

SEQ ID NO: 1769142 - RNA, 16 nt, Homo sapiens
gggaaaaguccuuggc

SEQ ID NO: 1769143 - RNA, 19 nt, Homo sapiens
cuucuccccacucccaucu

SEQ ID NO: 1769144 - RNA, 11 nt, Homo sapiens
ugcagccacac

SEQ ID NO: 1769145 - RNA, 20 nt, Homo sapiens
aaaauggauccccagugaaa

SEQ ID NO: 1769146 - RNA, 13 nt, Homo sapiens
cugauuaaaccaa

SEQ ID NO: 1769147 - RNA, 21 nt, Homo sapiens
cuuuccgaggccccugucuca

SEQ ID NO: 1769148 - RNA, 23 nt, Homo sapiens
cacaugcuagcaacauaccagac

SEQ ID NO: 1769149 - RNA, 20 nt, Homo sapiens
cauuuuguggauauaguuau

SEQ ID NO: 1769150 - RNA, 19 nt, Homo sapiens
cauauuaaagaaagucaua

SEQ ID NO: 1769151 - RNA, 21 nt, Homo sapiens
cuugacaaaggagcauugcag

SEQ ID NO: 1769152 - RNA, 17 nt, Homo sapiens
auauguugaaacuuuaa

SEQ ID NO: 1769153 - RNA, 19 nt, Homo sapiens
ggcagggagugggagccaa

SEQ ID NO: 1769154 - RNA, 17 nt, Homo sapiens
agacugucagcuuccaa

SEQ ID NO: 1769155 - RNA, 20 nt, Homo sapiens
ucuuagaacucugcuuacua

SEQ ID NO: 1769156 - RNA, 14 nt, Homo sapiens
auccuaggugcugg

SEQ ID NO: 1769157 - RNA, 15 nt, Homo sapiens
aacuguagggccagg

SEQ ID NO: 1769158 - RNA, 11 nt, Homo sapiens
guuaugacucc

SEQ ID NO: 1769159 - RNA, 18 nt, Homo sapiens
ccccagaaagcugccaga

SEQ ID NO: 1769160 - RNA, 20 nt, Homo sapiens
ccaugcaggcagccugcaga

SEQ ID NO: 1769161 - RNA, 23 nt, Homo sapiens
aauaaccaguaggauccaaagaa

SEQ ID NO: 1769162 - RNA, 22 nt, Homo sapiens
ccccuauccuuggcaccaaaga

SEQ ID NO: 1769163 - RNA, 13 nt, Homo sapiens
ucaaaaccagguc

SEQ ID NO: 1769164 - RNA, 16 nt, Homo sapiens
aacccagccucuagaa

SEQ ID NO: 1769165 - RNA, 15 nt, Homo sapiens
ugccacucaauggga

SEQ ID NO: 1769166 - RNA, 19 nt, Homo sapiens
ccucuuaauucccaauccc

SEQ ID NO: 1769167 - RNA, 20 nt, Homo sapiens
agcagacucuggaggccugu

SEQ ID NO: 1769168 - RNA, 22 nt, Homo sapiens
uuugaauaaggaaaaacagagu

SEQ ID NO: 1769169 - RNA, 17 nt, Homo sapiens
ggugacaccuccgagag

SEQ ID NO: 1769170 - RNA, 23 nt, Homo sapiens
caagcauggaaaaucagugacau

SEQ ID NO: 1769171 - RNA, 18 nt, Homo sapiens
gaaauuuugccugccauu

SEQ ID NO: 1769172 - RNA, 21 nt, Homo sapiens
agauguguuuuguuuuggacu

SEQ ID NO: 1769173 - RNA, 23 nt, Homo sapiens
ucuauuuaccuccuaauggcaug

SEQ ID NO: 1769174 - RNA, 14 nt, Homo sapiens
gccaucaagggaau

SEQ ID NO: 1769175 - RNA, 14 nt, Homo sapiens
ugggacuuauguau

SEQ ID NO: 1769176 - RNA, 19 nt, Homo sapiens
aagugucuaaaauacuuga

SEQ ID NO: 1769177 - RNA, 19 nt, Homo sapiens
ucaaauacuuuaauaaaga

SEQ ID NO: 1769178 - RNA, 15 nt, Homo sapiens
accccauucugggac

SEQ ID NO: 1769179 - RNA, 13 nt, Homo sapiens
cuguucuguggaa

SEQ ID NO: 1769180 - RNA, 13 nt, Homo sapiens
cuauucugugaaa

SEQ ID NO: 1769181 - RNA, 20 nt, Homo sapiens
agaggugaaaacuugucaga

SEQ ID NO: 1769182 - RNA, 22 nt, Homo sapiens
ugguauaaacguccuacuguau

SEQ ID NO: 1769183 - RNA, 17 nt, Homo sapiens
guccuggggaccauuca

SEQ ID NO: 1769184 - RNA, 22 nt, Homo sapiens
aguucagaagcggagagccugg

SEQ ID NO: 1769185 - RNA, 20 nt, Homo sapiens
uaaaugugacaugcaaagau

SEQ ID NO: 1769186 - RNA, 22 nt, Homo sapiens
accuugagaagacauagaugaa

SEQ ID NO: 1769187 - RNA, 21 nt, Homo sapiens
gccgagaucacgccacugcac

SEQ ID NO: 1769188 - RNA, 13 nt, Homo sapiens
ucauauguggaau

SEQ ID NO: 1769189 - RNA, 19 nt, Homo sapiens
cuauccagcagaucauuua

SEQ ID NO: 1769190 - RNA, 14 nt, Homo sapiens
aggaugguauugaa

SEQ ID NO: 1769191 - RNA, 19 nt, Homo sapiens
cauggucccacaucccugg

SEQ ID NO: 1769192 - RNA, 22 nt, Homo sapiens
auguaguucuuuguuccugcuu

SEQ ID NO: 1769193 - RNA, 19 nt, Homo sapiens
cuuuucauuaagaaaacaa

SEQ ID NO: 1769194 - RNA, 19 nt, Homo sapiens
ggcaggaccgccauggugc

SEQ ID NO: 1769195 - RNA, 15 nt, Homo sapiens
uuuagcuucccuuaa

SEQ ID NO: 1769196 - RNA, 18 nt, Homo sapiens
aagugggcccacccggug

SEQ ID NO: 1769197 - RNA, 17 nt, Homo sapiens
uuagaaacaacauagca

SEQ ID NO: 1769198 - RNA, 18 nt, Homo sapiens
accuagaaauacauggac

SEQ ID NO: 1769199 - RNA, 14 nt, Homo sapiens
cucagaugcucaaa

SEQ ID NO: 1769200 - RNA, 18 nt, Homo sapiens
caaugaugcuauuugcaa

SEQ ID NO: 1769201 - RNA, 20 nt, Homo sapiens
ugaagagugacuaguacaaa

SEQ ID NO: 1769202 - RNA, 19 nt, Homo sapiens
cacauuuauucugcucaca

SEQ ID NO: 1769203 - RNA, 18 nt, Homo sapiens
auaaccugugaauccaau

SEQ ID NO: 1769204 - RNA, 17 nt, Homo sapiens
uacaacagccugaauca

SEQ ID NO: 1769205 - RNA, 17 nt, Homo sapiens
cagauaaagacagcuga

SEQ ID NO: 1769206 - RNA, 17 nt, Homo sapiens
cugagguggcuaagggg

SEQ ID NO: 1769207 - RNA, 11 nt, Homo sapiens
ccaccagugaa

SEQ ID NO: 1769208 - RNA, 15 nt, Homo sapiens
ccuugcucucuucaa

SEQ ID NO: 1769209 - RNA, 23 nt, Homo sapiens
uauuuccaagaaauauuccuuaa

SEQ ID NO: 1769210 - RNA, 15 nt, Homo sapiens
aaggucagagucaaa

SEQ ID NO: 1769211 - RNA, 19 nt, Homo sapiens
cagugcauagcgaagacca

SEQ ID NO: 1769212 - RNA, 16 nt, Homo sapiens
uccuagcuuaucuccc

SEQ ID NO: 1769213 - RNA, 17 nt, Homo sapiens
uggggaccauggucugg

SEQ ID NO: 1769214 - RNA, 21 nt, Homo sapiens
uagaagcugaagauccccaac

SEQ ID NO: 1769215 - RNA, 15 nt, Homo sapiens
agaaaaucaguaauu

SEQ ID NO: 1769216 - RNA, 15 nt, Homo sapiens
accuguacuaaacca

SEQ ID NO: 1769217 - RNA, 18 nt, Homo sapiens
agggaagaagcauacaac

SEQ ID NO: 1769218 - RNA, 22 nt, Homo sapiens
agaguggaaucucuuggaugca

SEQ ID NO: 1769219 - RNA, 12 nt, Homo sapiens
gucagagcuaaa

SEQ ID NO: 1769220 - RNA, 13 nt, Homo sapiens
cuggguccuuaaa

SEQ ID NO: 1769221 - RNA, 12 nt, Homo sapiens
gucuucucaggc

SEQ ID NO: 1769222 - RNA, 14 nt, Homo sapiens
uuagaggagcccac

SEQ ID NO: 1769223 - RNA, 14 nt, Homo sapiens
gauuuaagguuuca

SEQ ID NO: 1769224 - RNA, 16 nt, Homo sapiens
gccccgggcaaagggu

SEQ ID NO: 1769225 - RNA, 13 nt, Homo sapiens
auucuaggcaucc

SEQ ID NO: 1769226 - RNA, 23 nt, Homo sapiens
aaaauuaaaugcauguccucaaa

SEQ ID NO: 1769227 - RNA, 15 nt, Homo sapiens
ucauaagaggaucaa

SEQ ID NO: 1769228 - RNA, 17 nt, Homo sapiens
aaacugcuuugugcaua

SEQ ID NO: 1769229 - RNA, 22 nt, Homo sapiens
uaugucaggcaaagugcugcug

SEQ ID NO: 1769230 - RNA, 16 nt, Homo sapiens
cucacuuuguugccca

SEQ ID NO: 1769231 - RNA, 17 nt, Homo sapiens
uuuccacuuugacuaca

SEQ ID NO: 1769232 - RNA, 19 nt, Homo sapiens
cagaaggaggaaguggaag

SEQ ID NO: 1769233 - RNA, 17 nt, Homo sapiens
acagggucuugcucugu

SEQ ID NO: 1769234 - RNA, 21 nt, Homo sapiens
uuagcuccaaagcauuuccca

SEQ ID NO: 1769235 - RNA, 18 nt, Homo sapiens
aaaauguaagaaaagcug

SEQ ID NO: 1769236 - RNA, 18 nt, Homo sapiens
uuuaaggcaauauauaau

SEQ ID NO: 1769237 - RNA, 14 nt, Homo sapiens
aaucaugugcuuca

SEQ ID NO: 1769238 - RNA, 14 nt, Homo sapiens
ugaguuugccucag

SEQ ID NO: 1769239 - RNA, 19 nt, Homo sapiens
acaauuuaaugcacuaaaa

SEQ ID NO: 1769240 - RNA, 21 nt, Homo sapiens
gagaagaaagugaaagcaaau

SEQ ID NO: 1769241 - RNA, 15 nt, Homo sapiens
aacaagugcacuuga

SEQ ID NO: 1769242 - RNA, 18 nt, Homo sapiens
aaaacugcugaacuugac

SEQ ID NO: 1769243 - RNA, 16 nt, Homo sapiens
gcuccugacacugcug

SEQ ID NO: 1769244 - RNA, 22 nt, Homo sapiens
auaaagcguccucucaguaaug

SEQ ID NO: 1769245 - RNA, 22 nt, Homo sapiens
cuaugucaguacuauucaggua

SEQ ID NO: 1769246 - RNA, 16 nt, Homo sapiens
uucuguacaacuaccu

SEQ ID NO: 1769247 - RNA, 16 nt, Homo sapiens
cagugggaucccagac

SEQ ID NO: 1769248 - RNA, 19 nt, Homo sapiens
uaaacacaaauuucauuuc

SEQ ID NO: 1769249 - RNA, 17 nt, Homo sapiens
ggaaaaaauuagacaag

SEQ ID NO: 1769250 - RNA, 17 nt, Homo sapiens
cccuggggcgugcagca

SEQ ID NO: 1769251 - RNA, 21 nt, Homo sapiens
uccagacaaugccagcauaaa

SEQ ID NO: 1769252 - RNA, 16 nt, Homo sapiens
cggacaccaucuuggg

SEQ ID NO: 1769253 - RNA, 12 nt, Homo sapiens
guucgugcuugu

SEQ ID NO: 1769254 - RNA, 17 nt, Homo sapiens
aaucugagaaaaggcaa

SEQ ID NO: 1769255 - RNA, 16 nt, Homo sapiens
gguugauccugcaucu

SEQ ID NO: 1769256 - RNA, 17 nt, Homo sapiens
aagagaaccaugugcua

SEQ ID NO: 1769257 - RNA, 17 nt, Homo sapiens
guaauauuaauuuccac

SEQ ID NO: 1769258 - RNA, 21 nt, Homo sapiens
ugaaagcguuuacaugagacu

SEQ ID NO: 1769259 - RNA, 21 nt, Homo sapiens
ggucccauggguuaagagcuc

SEQ ID NO: 1769260 - RNA, 21 nt, Homo sapiens
cgugggucuucagggggccag

SEQ ID NO: 1769261 - RNA, 21 nt, Homo sapiens
gucuagaggcaacaguguucu

SEQ ID NO: 1769262 - RNA, 14 nt, Homo sapiens
cuugagaccuggaa

SEQ ID NO: 1769263 - RNA, 22 nt, Homo sapiens
gggcauuccuugggacucagga

SEQ ID NO: 1769264 - RNA, 15 nt, Homo sapiens
gacuucccacuguuc

SEQ ID NO: 1769265 - RNA, 19 nt, Homo sapiens
gacacagagggggccuuca

SEQ ID NO: 1769266 - RNA, 19 nt, Homo sapiens
auuggugaacaguguauag

SEQ ID NO: 1769267 - RNA, 16 nt, Homo sapiens
ugugugaccaacugug

SEQ ID NO: 1769268 - RNA, 12 nt, Homo sapiens
ugguagccuuag

SEQ ID NO: 1769269 - RNA, 16 nt, Homo sapiens
auauaguggaugauau

SEQ ID NO: 1769270 - RNA, 20 nt, Homo sapiens
gcugagugggagaaggcagu

SEQ ID NO: 1769271 - RNA, 19 nt, Homo sapiens
ucagcaugcagaagugcau

SEQ ID NO: 1769272 - RNA, 23 nt, Homo sapiens
cccaggaggucgaccccaaagcc

SEQ ID NO: 1769273 - RNA, 16 nt, Homo sapiens
cuguugguuagauuca

SEQ ID NO: 1769274 - RNA, 17 nt, Homo sapiens
uaauuucauugucucua

SEQ ID NO: 1769275 - RNA, 15 nt, Homo sapiens
aaauaaguugcagaa

SEQ ID NO: 1769276 - RNA, 14 nt, Homo sapiens
agcuccaguuucca

SEQ ID NO: 1769277 - RNA, 17 nt, Homo sapiens
gauggucccuauuccuc

SEQ ID NO: 1769278 - RNA, 18 nt, Homo sapiens
gaggguuucugagcugcu

SEQ ID NO: 1769279 - RNA, 13 nt, Homo sapiens
uaucuguuuugcu

SEQ ID NO: 1769280 - RNA, 22 nt, Homo sapiens
ccacaugaggccaucucaggag

SEQ ID NO: 1769281 - RNA, 22 nt, Homo sapiens
aggaauuuucuugaaacuguga

SEQ ID NO: 1769282 - RNA, 15 nt, Homo sapiens
uguuuuuaacaacua

SEQ ID NO: 1769283 - RNA, 15 nt, Homo sapiens
acuuuuaaugaacuu

SEQ ID NO: 1769284 - RNA, 20 nt, Homo sapiens
agaguuguacauauguuuca

SEQ ID NO: 1769285 - RNA, 13 nt, Homo sapiens
uugcaaauccacu

SEQ ID NO: 1769286 - RNA, 13 nt, Homo sapiens
uugauaauccaaa

SEQ ID NO: 1769287 - RNA, 15 nt, Homo sapiens
auuuuuaagaacuuc

SEQ ID NO: 1769288 - RNA, 15 nt, Homo sapiens
ugcuauuugcauuuc

SEQ ID NO: 1769289 - RNA, 16 nt, Homo sapiens
accauuauacuuuaua

SEQ ID NO: 1769290 - RNA, 16 nt, Homo sapiens
aggcugagcuuucuag

SEQ ID NO: 1769291 - RNA, 22 nt, Homo sapiens
acagcugcuggagacuccuagg

SEQ ID NO: 1769292 - RNA, 14 nt, Homo sapiens
uuauuuuugcaaaa

SEQ ID NO: 1769293 - RNA, 16 nt, Homo sapiens
auuuuuuauacuguau

SEQ ID NO: 1769294 - RNA, 23 nt, Homo sapiens
aaaccaaaacauaaaaaccaaac

SEQ ID NO: 1769295 - RNA, 17 nt, Homo sapiens
uugagaaagccuucaua

SEQ ID NO: 1769296 - RNA, 15 nt, Homo sapiens
uuuauauauuauguc

SEQ ID NO: 1769297 - RNA, 15 nt, Homo sapiens
ucaaauacaucucca

SEQ ID NO: 1769298 - RNA, 24 nt, Homo sapiens
cagauugggcuggcucugaagcca

SEQ ID NO: 1769299 - RNA, 17 nt, Homo sapiens
cacugaagcaccacagg

SEQ ID NO: 1769300 - RNA, 13 nt, Homo sapiens
gcagccaggacac

SEQ ID NO: 1769301 - RNA, 20 nt, Homo sapiens
aacuccugggcucaagcaau

SEQ ID NO: 1769302 - RNA, 19 nt, Homo sapiens
uaucaguguuuuaaauucu

SEQ ID NO: 1769303 - RNA, 18 nt, Homo sapiens
acacaaugauuuuguaca

SEQ ID NO: 1769304 - RNA, 23 nt, Homo sapiens
gaguaagcccucaggagccucug

SEQ ID NO: 1769305 - RNA, 13 nt, Homo sapiens
aaccuacuaccca

SEQ ID NO: 1769306 - RNA, 14 nt, Homo sapiens
ucccugaacacuca

SEQ ID NO: 1769307 - RNA, 15 nt, Homo sapiens
agcccucccagcugg

SEQ ID NO: 1769308 - RNA, 18 nt, Homo sapiens
ugaauguauaaagacacc

SEQ ID NO: 1769309 - RNA, 20 nt, Homo sapiens
cucacucggcuuccagggag

SEQ ID NO: 1769310 - RNA, 14 nt, Homo sapiens
cucaaaguguacaa

SEQ ID NO: 1769311 - RNA, 13 nt, Homo sapiens
ucugcuucugggg

SEQ ID NO: 1769312 - RNA, 18 nt, Homo sapiens
aaauacaaguacuagguu

SEQ ID NO: 1769313 - RNA, 21 nt, Homo sapiens
agaguacaccccaacagcacc

SEQ ID NO: 1769314 - RNA, 23 nt, Homo sapiens
gcagccagucuuuuuugcuucuc

SEQ ID NO: 1769315 - RNA, 18 nt, Homo sapiens
gaauagcgaaucaucuca

SEQ ID NO: 1769316 - RNA, 12 nt, Homo sapiens
uugugacagauu

SEQ ID NO: 1769317 - RNA, 16 nt, Homo sapiens
cugcagucccccgaga

SEQ ID NO: 1769318 - RNA, 22 nt, Homo sapiens
guaaggucuucuuguguccuga

SEQ ID NO: 1769319 - RNA, 21 nt, Homo sapiens
aauacuuacuauaauuugacu

SEQ ID NO: 1769320 - RNA, 18 nt, Homo sapiens
ucuccauggcccugccau

SEQ ID NO: 1769321 - RNA, 20 nt, Homo sapiens
ccagaggugcugucagcuca

SEQ ID NO: 1769322 - RNA, 17 nt, Homo sapiens
ccugaaacugagucugu

SEQ ID NO: 1769323 - RNA, 17 nt, Homo sapiens
aguuucccguccaucuc

SEQ ID NO: 1769324 - RNA, 20 nt, Homo sapiens
uccuaugcucugggugaaua

SEQ ID NO: 1769325 - RNA, 17 nt, Homo sapiens
uaguuuccucuaucuaa

SEQ ID NO: 1769326 - RNA, 21 nt, Homo sapiens
cccuuuggagaacgccagucu

SEQ ID NO: 1769327 - RNA, 22 nt, Homo sapiens
acagacauuccuucuacaugua

SEQ ID NO: 1769328 - RNA, 17 nt, Homo sapiens
ggcuagaaucuggagag

SEQ ID NO: 1769329 - RNA, 23 nt, Homo sapiens
guucuugugcauguuuacuuuau

SEQ ID NO: 1769330 - RNA, 20 nt, Homo sapiens
uccaacccauuuaaucacca

SEQ ID NO: 1769331 - RNA, 21 nt, Homo sapiens
cucaccagaagcagaugccag

SEQ ID NO: 1769332 - RNA, 20 nt, Homo sapiens
uugccaagugccuaugcaaa

SEQ ID NO: 1769333 - RNA, 22 nt, Homo sapiens
uccucccagugccuucugggaa

SEQ ID NO: 1769334 - RNA, 14 nt, Homo sapiens
ccuccuccugacca

SEQ ID NO: 1769335 - RNA, 17 nt, Homo sapiens
uguuaugugcaaguuua

SEQ ID NO: 1769336 - RNA, 16 nt, Homo sapiens
cacgaacccaccugcu

SEQ ID NO: 1769337 - RNA, 17 nt, Homo sapiens
uauuucauauuaugaaa

SEQ ID NO: 1769338 - RNA, 21 nt, Homo sapiens
acacucacuucucuuccuugg

SEQ ID NO: 1769339 - RNA, 18 nt, Homo sapiens
cugcagacggugugguug

SEQ ID NO: 1769340 - RNA, 22 nt, Homo sapiens
aagaugaugcuccuauccuccc

SEQ ID NO: 1769341 - RNA, 13 nt, Homo sapiens
agguagacacaaa

SEQ ID NO: 1769342 - RNA, 20 nt, Homo sapiens
accaggaguggguggggagu

SEQ ID NO: 1769343 - RNA, 14 nt, Homo sapiens
uggugauggucucu

SEQ ID NO: 1769344 - RNA, 22 nt, Homo sapiens
auugaggaaaauuaauaucaca

SEQ ID NO: 1769345 - RNA, 17 nt, Homo sapiens
ucuaaaugaagugcaaa

SEQ ID NO: 1769346 - RNA, 10 nt, Homo sapiens
aaccacagag

SEQ ID NO: 1769347 - RNA, 16 nt, Homo sapiens
aguaaagaaaugcaua

SEQ ID NO: 1769348 - RNA, 13 nt, Homo sapiens
ccagucauggugg

SEQ ID NO: 1769349 - RNA, 22 nt, Homo sapiens
guucucaaauauuugcuaugaa

SEQ ID NO: 1769350 - RNA, 19 nt, Homo sapiens
cuguugaacaauaaguaaa

SEQ ID NO: 1769351 - RNA, 15 nt, Homo sapiens
agugaugugccuaaa

SEQ ID NO: 1769352 - RNA, 15 nt, Homo sapiens
caagcacaggagaac

SEQ ID NO: 1769353 - RNA, 19 nt, Homo sapiens
cugagcagucagaagaccu

SEQ ID NO: 1769354 - RNA, 18 nt, Homo sapiens
agggcuccaaaucugccu

SEQ ID NO: 1769355 - RNA, 16 nt, Homo sapiens
gucaggcuggucucaa

SEQ ID NO: 1769356 - RNA, 12 nt, Homo sapiens
uuuugucaucaa

SEQ ID NO: 1769357 - RNA, 13 nt, Homo sapiens
uguuaaucaucca

SEQ ID NO: 1769358 - RNA, 16 nt, Homo sapiens
ucucuuugagucaaua

SEQ ID NO: 1769359 - RNA, 16 nt, Homo sapiens
uuccccaaugcuccau

SEQ ID NO: 1769360 - RNA, 21 nt, Homo sapiens
gcucucuuugagguccaaaaa

SEQ ID NO: 1769361 - RNA, 19 nt, Homo sapiens
uucuccccgccugcuccca

SEQ ID NO: 1769362 - RNA, 18 nt, Homo sapiens
guucuacauaaguaauuc

SEQ ID NO: 1769363 - RNA, 15 nt, Homo sapiens
ucaugugcacuucaa

SEQ ID NO: 1769364 - RNA, 21 nt, Homo sapiens
aauguucuauuuaacaacugg

SEQ ID NO: 1769365 - RNA, 19 nt, Homo sapiens
uacuaggagaggggggcca

SEQ ID NO: 1769366 - RNA, 19 nt, Homo sapiens
acuuuauuuguauuugcca

SEQ ID NO: 1769367 - RNA, 17 nt, Homo sapiens
augucaagggauuacuu

SEQ ID NO: 1769368 - RNA, 20 nt, Homo sapiens
ccuugcucuccucaucucca

SEQ ID NO: 1769369 - RNA, 18 nt, Homo sapiens
uuuccuacuuucuccuga

SEQ ID NO: 1769370 - RNA, 20 nt, Homo sapiens
ggcggguccgggucgcagga

SEQ ID NO: 1769371 - RNA, 12 nt, Homo sapiens
cuccucagggac

SEQ ID NO: 1769372 - RNA, 16 nt, Homo sapiens
aagguuucacuguuca

SEQ ID NO: 1769373 - RNA, 16 nt, Homo sapiens
uaaaguuggugcaucu

SEQ ID NO: 1769374 - RNA, 17 nt, Homo sapiens
cucugagccuuggugua

SEQ ID NO: 1769375 - RNA, 16 nt, Homo sapiens
acaccucacuuuugaa

SEQ ID NO: 1769376 - RNA, 19 nt, Homo sapiens
ccugaaagccacaaugaga

SEQ ID NO: 1769377 - RNA, 14 nt, Homo sapiens
uccaagagauccau

SEQ ID NO: 1769378 - RNA, 17 nt, Homo sapiens
gcucccauuucuacucu

SEQ ID NO: 1769379 - RNA, 17 nt, Homo sapiens
cagagaaauacaaaaua

SEQ ID NO: 1769380 - RNA, 10 nt, Homo sapiens
ggcuguccag

SEQ ID NO: 1769381 - RNA, 16 nt, Homo sapiens
cugacucugugcugag

SEQ ID NO: 1769382 - RNA, 22 nt, Homo sapiens
uucaguccucccagacuaccug

SEQ ID NO: 1769383 - RNA, 14 nt, Homo sapiens
agcuuagugaaaag

SEQ ID NO: 1769384 - RNA, 19 nt, Homo sapiens
gcuggagugcaguggugca

SEQ ID NO: 1769385 - RNA, 18 nt, Homo sapiens
aauacguguucaaaaauu

SEQ ID NO: 1769386 - RNA, 17 nt, Homo sapiens
auaaaggaaaaugacuu

SEQ ID NO: 1769387 - RNA, 23 nt, Homo sapiens
gaugcagguuggaaggggccuug

SEQ ID NO: 1769388 - RNA, 14 nt, Homo sapiens
uuggugauggaaaa

SEQ ID NO: 1769389 - RNA, 16 nt, Homo sapiens
cucccagugaugcugu

SEQ ID NO: 1769390 - RNA, 17 nt, Homo sapiens
uaaagcuuugugcagau

SEQ ID NO: 1769391 - RNA, 15 nt, Homo sapiens
gucaaaaaguuccau

SEQ ID NO: 1769392 - RNA, 18 nt, Homo sapiens
auuauguauuggcauuua

SEQ ID NO: 1769393 - RNA, 18 nt, Homo sapiens
auaauuugggugacuaga

SEQ ID NO: 1769394 - RNA, 13 nt, Homo sapiens
gggccaguccucc

SEQ ID NO: 1769395 - RNA, 14 nt, Homo sapiens
guuucuauacaaau

SEQ ID NO: 1769396 - RNA, 17 nt, Homo sapiens
uacugggacugugcuca

SEQ ID NO: 1769397 - RNA, 20 nt, Homo sapiens
acuaagcaguaagcuaucuu

SEQ ID NO: 1769398 - RNA, 14 nt, Homo sapiens
gaagcuucaugcca

SEQ ID NO: 1769399 - RNA, 15 nt, Homo sapiens
caacccuucauuuaa

SEQ ID NO: 1769400 - RNA, 21 nt, Homo sapiens
ugcaggaugggugaaaccaca

SEQ ID NO: 1769401 - RNA, 14 nt, Homo sapiens
acugauuucacaac

SEQ ID NO: 1769402 - RNA, 22 nt, Homo sapiens
aaggccguguccccuuguucua

SEQ ID NO: 1769403 - RNA, 20 nt, Homo sapiens
gucaucugccaacuguccua

SEQ ID NO: 1769404 - RNA, 17 nt, Homo sapiens
uauaugccucauacaca

SEQ ID NO: 1769405 - RNA, 23 nt, Homo sapiens
agagaguggcuuugucaguauaa

SEQ ID NO: 1769406 - RNA, 18 nt, Homo sapiens
cccucuuaguagggacuu

SEQ ID NO: 1769407 - RNA, 21 nt, Homo sapiens
aaucuauuuuguuacuugcac

SEQ ID NO: 1769408 - RNA, 19 nt, Homo sapiens
ccuuuuuccugcgucccag

SEQ ID NO: 1769409 - RNA, 13 nt, Homo sapiens
ucaagagccagca

SEQ ID NO: 1769410 - RNA, 16 nt, Homo sapiens
agagcuugcagugaag

SEQ ID NO: 1769411 - RNA, 14 nt, Homo sapiens
cagucaucaucuca

SEQ ID NO: 1769412 - RNA, 14 nt, Homo sapiens
caguccucaucucc

SEQ ID NO: 1769413 - RNA, 20 nt, Homo sapiens
gauaaguucuaguugcuugu

SEQ ID NO: 1769414 - RNA, 20 nt, Homo sapiens
caguguuuuccagccuugua

SEQ ID NO: 1769415 - RNA, 16 nt, Homo sapiens
acucugcggcccgggc

SEQ ID NO: 1769416 - RNA, 16 nt, Homo sapiens
gggagaaaagacaaau

SEQ ID NO: 1769417 - RNA, 23 nt, Homo sapiens
uccuugugguugaaaaccacagu

SEQ ID NO: 1769418 - RNA, 22 nt, Homo sapiens
auccuuguuuugaaaaccuaaa

SEQ ID NO: 1769419 - RNA, 16 nt, Homo sapiens
ugcuuuaaauugugcc

SEQ ID NO: 1769420 - RNA, 18 nt, Homo sapiens
cuggucucuucaccacug

SEQ ID NO: 1769421 - RNA, 14 nt, Homo sapiens
gauuugccauucaa

SEQ ID NO: 1769422 - RNA, 20 nt, Homo sapiens
caggguuaggaaucucuuca

SEQ ID NO: 1769423 - RNA, 19 nt, Homo sapiens
uacauauauauguaugugg

SEQ ID NO: 1769424 - RNA, 14 nt, Homo sapiens
cuuagcuucaggaa

SEQ ID NO: 1769425 - RNA, 12 nt, Homo sapiens
uauuagcagcug

SEQ ID NO: 1769426 - RNA, 17 nt, Homo sapiens
uaaaagcuucugcaaua

SEQ ID NO: 1769427 - RNA, 12 nt, Homo sapiens
ccaugugcagcc

SEQ ID NO: 1769428 - RNA, 20 nt, Homo sapiens
ggcccuuccugcagcgccug

SEQ ID NO: 1769429 - RNA, 21 nt, Homo sapiens
cggaagagagggcugagccau

SEQ ID NO: 1769430 - RNA, 12 nt, Homo sapiens
aaugauuugcuu

SEQ ID NO: 1769431 - RNA, 14 nt, Homo sapiens
cucuacaaccuaaa

SEQ ID NO: 1769432 - RNA, 20 nt, Homo sapiens
uugagggucguuuugacuac

SEQ ID NO: 1769433 - RNA, 19 nt, Homo sapiens
aacaucaauuggguuuuga

SEQ ID NO: 1769434 - RNA, 13 nt, Homo sapiens
acacugaguugca

SEQ ID NO: 1769435 - RNA, 22 nt, Homo sapiens
ugccaggcucucccucucugca

SEQ ID NO: 1769436 - RNA, 16 nt, Homo sapiens
cccuguccuugcccuu

SEQ ID NO: 1769437 - RNA, 16 nt, Homo sapiens
cuuuugaaaugccacg

SEQ ID NO: 1769438 - RNA, 22 nt, Homo sapiens
auuugaggagauaacauuucaa

SEQ ID NO: 1769439 - RNA, 17 nt, Homo sapiens
agagacagaauguaucu

SEQ ID NO: 1769440 - RNA, 14 nt, Homo sapiens
auugucagcuccuu

SEQ ID NO: 1769441 - RNA, 20 nt, Homo sapiens
gauggagcuguucauugaca

SEQ ID NO: 1769442 - RNA, 17 nt, Homo sapiens
uaaagcuucucucugag

SEQ ID NO: 1769443 - RNA, 11 nt, Homo sapiens
cugcaccucau

SEQ ID NO: 1769444 - RNA, 11 nt, Homo sapiens
cuucaccucag

SEQ ID NO: 1769445 - RNA, 16 nt, Homo sapiens
uggagaacaacaaaua

SEQ ID NO: 1769446 - RNA, 18 nt, Homo sapiens
ugccuucuguggggacuc

SEQ ID NO: 1769447 - RNA, 22 nt, Homo sapiens
guuaggaacagcaguguucuca

SEQ ID NO: 1769448 - RNA, 17 nt, Homo sapiens
gcuucagccucucccac

SEQ ID NO: 1769449 - RNA, 19 nt, Homo sapiens
aaggagaacuauccaaaac

SEQ ID NO: 1769450 - RNA, 21 nt, Homo sapiens
ucacgccauuguacuccagcc

SEQ ID NO: 1769451 - RNA, 14 nt, Homo sapiens
agccggacacuucu

SEQ ID NO: 1769452 - RNA, 22 nt, Homo sapiens
aagcugagaugggacaggauca

SEQ ID NO: 1769453 - RNA, 21 nt, Homo sapiens
ccuugugguugaaaaccacag

SEQ ID NO: 1769454 - RNA, 12 nt, Homo sapiens
gaggaagcacau

SEQ ID NO: 1769455 - RNA, 20 nt, Homo sapiens
uuaaacauugugaucauuag

SEQ ID NO: 1769456 - RNA, 23 nt, Homo sapiens
ggaagcagggguggggggugcag

SEQ ID NO: 1769457 - RNA, 16 nt, Homo sapiens
ucauacuguucaaugg

SEQ ID NO: 1769458 - RNA, 20 nt, Homo sapiens
acccuaaugcauaagcuuuu

SEQ ID NO: 1769459 - RNA, 11 nt, Homo sapiens
uaacaaugaag

SEQ ID NO: 1769460 - RNA, 14 nt, Homo sapiens
ggaaauagcuaaua

SEQ ID NO: 1769461 - RNA, 15 nt, Homo sapiens
aauucagugagauau

SEQ ID NO: 1769462 - RNA, 17 nt, Homo sapiens
ggucccaccuccauuug

SEQ ID NO: 1769463 - RNA, 20 nt, Homo sapiens
auuugcagaguccugcacag

SEQ ID NO: 1769464 - RNA, 23 nt, Homo sapiens
auaauucagcucuugagagcauu

SEQ ID NO: 1769465 - RNA, 19 nt, Homo sapiens
cggagccaaugaacagcuc

SEQ ID NO: 1769466 - RNA, 22 nt, Homo sapiens
cuaaagcuuuaggaugacugua

SEQ ID NO: 1769467 - RNA, 19 nt, Homo sapiens
uuaaauauuuauaucucac

SEQ ID NO: 1769468 - RNA, 16 nt, Homo sapiens
uaguauuuuugccaaa

SEQ ID NO: 1769469 - RNA, 20 nt, Homo sapiens
auccucuguauuugucauuc

SEQ ID NO: 1769470 - RNA, 21 nt, Homo sapiens
gauguuucugugaaauucuca

SEQ ID NO: 1769471 - RNA, 15 nt, Homo sapiens
ggucaggcagggugc

SEQ ID NO: 1769472 - RNA, 17 nt, Homo sapiens
cagucuguauuuuccac

SEQ ID NO: 1769473 - RNA, 21 nt, Homo sapiens
caggcaaggaugauccaggga

SEQ ID NO: 1769474 - RNA, 18 nt, Homo sapiens
aucgugaaaccccaucuc

SEQ ID NO: 1769475 - RNA, 16 nt, Homo sapiens
gcacuaccauugcugu

SEQ ID NO: 1769476 - RNA, 16 nt, Homo sapiens
gguacugaauugccug

SEQ ID NO: 1769477 - RNA, 14 nt, Homo sapiens
gcccucucucggga

SEQ ID NO: 1769478 - RNA, 14 nt, Homo sapiens
ucucucccuacccu

SEQ ID NO: 1769479 - RNA, 18 nt, Homo sapiens
aucucugcuuaguacauu

SEQ ID NO: 1769480 - RNA, 12 nt, Homo sapiens
acucugaaaaug

SEQ ID NO: 1769481 - RNA, 13 nt, Homo sapiens
caauacagucaca

SEQ ID NO: 1769482 - RNA, 14 nt, Homo sapiens
aguccaacuacuaa

SEQ ID NO: 1769483 - RNA, 20 nt, Homo sapiens
cuuagaucucuccugcaaaa

SEQ ID NO: 1769484 - RNA, 22 nt, Homo sapiens
guuuguaggguggaugggauac

SEQ ID NO: 1769485 - RNA, 21 nt, Homo sapiens
accgugagugacauagccuca

SEQ ID NO: 1769486 - RNA, 23 nt, Homo sapiens
uuaauguuuuuuaaacuaguuua

SEQ ID NO: 1769487 - RNA, 20 nt, Homo sapiens
uguuuuucuuuuuccacaag

SEQ ID NO: 1769488 - RNA, 18 nt, Homo sapiens
acacuguauaacauuuaa

SEQ ID NO: 1769489 - RNA, 18 nt, Homo sapiens
aaauaaguuuuccuuuug

SEQ ID NO: 1769490 - RNA, 23 nt, Homo sapiens
ugugcacacauauacauguagga

SEQ ID NO: 1769491 - RNA, 16 nt, Homo sapiens
cccacuccagcgcuga

SEQ ID NO: 1769492 - RNA, 16 nt, Homo sapiens
ccaggccccaccccuu

SEQ ID NO: 1769493 - RNA, 23 nt, Homo sapiens
aaauucgcugcaaccuguugaua

SEQ ID NO: 1769494 - RNA, 13 nt, Homo sapiens
uauggcacuggca

SEQ ID NO: 1769495 - RNA, 19 nt, Homo sapiens
cagagagagauacucuggg

SEQ ID NO: 1769496 - RNA, 17 nt, Homo sapiens
agugcaacccagucaca

SEQ ID NO: 1769497 - RNA, 19 nt, Homo sapiens
caucccccaaaguucacaa

SEQ ID NO: 1769498 - RNA, 20 nt, Homo sapiens
ggcaggagaauuacuugaac

SEQ ID NO: 1769499 - RNA, 14 nt, Homo sapiens
ggcuauguaaacaa

SEQ ID NO: 1769500 - RNA, 17 nt, Homo sapiens
gucaaaaagaaccacuu

SEQ ID NO: 1769501 - RNA, 16 nt, Homo sapiens
aaauaauucuuccucu

SEQ ID NO: 1769502 - RNA, 14 nt, Homo sapiens
ggccccauccucau

SEQ ID NO: 1769503 - RNA, 19 nt, Homo sapiens
uaagacauuuguauauugu

SEQ ID NO: 1769504 - RNA, 18 nt, Homo sapiens
aaaaauaaaucuguucug

SEQ ID NO: 1769505 - RNA, 17 nt, Homo sapiens
agguuccugagcccuac

SEQ ID NO: 1769506 - RNA, 22 nt, Homo sapiens
auuucacuaaaagucuccaaaa

SEQ ID NO: 1769507 - RNA, 15 nt, Homo sapiens
uuuaaugacauugau

SEQ ID NO: 1769508 - RNA, 11 nt, Homo sapiens
uuacauuuaau

SEQ ID NO: 1769509 - RNA, 19 nt, Homo sapiens
ccucucaacucucuuugua

SEQ ID NO: 1769510 - RNA, 21 nt, Homo sapiens
aacucuacaucuagcaauuuc

SEQ ID NO: 1769511 - RNA, 16 nt, Homo sapiens
ggaacucuagccaaau

SEQ ID NO: 1769512 - RNA, 20 nt, Homo sapiens
cugaagcuggccuggaccau

SEQ ID NO: 1769513 - RNA, 22 nt, Homo sapiens
gcuccgaaaaacuuuguuauau

SEQ ID NO: 1769514 - RNA, 20 nt, Homo sapiens
uugcuuugggggcuuuacaa

SEQ ID NO: 1769515 - RNA, 14 nt, Homo sapiens
ugggauugcacaga

SEQ ID NO: 1769516 - RNA, 22 nt, Homo sapiens
cugugcccucccauagcacugc

SEQ ID NO: 1769517 - RNA, 13 nt, Homo sapiens
aacugcaaccuca

SEQ ID NO: 1769518 - RNA, 12 nt, Homo sapiens
aggccuguccaa

SEQ ID NO: 1769519 - RNA, 14 nt, Homo sapiens
auuaauaucacagc

SEQ ID NO: 1769520 - RNA, 20 nt, Homo sapiens
auacugcuggaguccagugc

SEQ ID NO: 1769521 - RNA, 11 nt, Homo sapiens
gaugcuuuaac

SEQ ID NO: 1769522 - RNA, 19 nt, Homo sapiens
acacucuccaaacagucac

SEQ ID NO: 1769523 - RNA, 19 nt, Homo sapiens
gcaucagccuuuguacucu

SEQ ID NO: 1769524 - RNA, 19 nt, Homo sapiens
auaucacuugauaugugca

SEQ ID NO: 1769525 - RNA, 23 nt, Homo sapiens
cagagugcaguggcgcgaucuca

SEQ ID NO: 1769526 - RNA, 15 nt, Homo sapiens
auaacaaaagcaaua

SEQ ID NO: 1769527 - RNA, 15 nt, Homo sapiens
ccccuggaccgcuuu

SEQ ID NO: 1769528 - RNA, 19 nt, Homo sapiens
acaccaaucuuacuuugua

SEQ ID NO: 1769529 - RNA, 16 nt, Homo sapiens
gcugccccgugacaca

SEQ ID NO: 1769530 - RNA, 14 nt, Homo sapiens
cuuagcaugcaguu

SEQ ID NO: 1769531 - RNA, 14 nt, Homo sapiens
uugggaagucucag

SEQ ID NO: 1769532 - RNA, 21 nt, Homo sapiens
ugagccacucagucucuucca

SEQ ID NO: 1769533 - RNA, 23 nt, Homo sapiens
uugcuaaaagauuauagaaguag

SEQ ID NO: 1769534 - RNA, 21 nt, Homo sapiens
ugacaucaccaaguguggaau

SEQ ID NO: 1769535 - RNA, 19 nt, Homo sapiens
uccauuacaccacagcauu

SEQ ID NO: 1769536 - RNA, 13 nt, Homo sapiens
uaacuauuuacua

SEQ ID NO: 1769537 - RNA, 14 nt, Homo sapiens
uuugaaugcuuaau

SEQ ID NO: 1769538 - RNA, 14 nt, Homo sapiens
uauaaaugcaugau

SEQ ID NO: 1769539 - RNA, 13 nt, Homo sapiens
agcagcagugcau

SEQ ID NO: 1769540 - RNA, 22 nt, Homo sapiens
cacucccuguagugaauccucu

SEQ ID NO: 1769541 - RNA, 22 nt, Homo sapiens
ugucacuacggugauuguauga

SEQ ID NO: 1769542 - RNA, 14 nt, Homo sapiens
ugcuccaggcuucc

SEQ ID NO: 1769543 - RNA, 17 nt, Homo sapiens
gggaggaagcagguuga

SEQ ID NO: 1769544 - RNA, 10 nt, Homo sapiens
ccucuugccc

SEQ ID NO: 1769545 - RNA, 13 nt, Homo sapiens
aaaugcaagguga

SEQ ID NO: 1769546 - RNA, 15 nt, Homo sapiens
aucaccauuacuuuu

SEQ ID NO: 1769547 - RNA, 23 nt, Homo sapiens
uagauccacacuuucaaagagaa

SEQ ID NO: 1769548 - RNA, 18 nt, Homo sapiens
uaaacuguacaaaugaaa

SEQ ID NO: 1769549 - RNA, 18 nt, Homo sapiens
ccaaaauauuaacauucu

SEQ ID NO: 1769550 - RNA, 16 nt, Homo sapiens
aaucaauaaagaccac

SEQ ID NO: 1769551 - RNA, 14 nt, Homo sapiens
uucuacuacuugga

SEQ ID NO: 1769552 - RNA, 23 nt, Homo sapiens
ugaugccuuccgacaccacuggg

SEQ ID NO: 1769553 - RNA, 13 nt, Homo sapiens
guggagcucagug

SEQ ID NO: 1769554 - RNA, 16 nt, Homo sapiens
ucacuuguaaggggaa

SEQ ID NO: 1769555 - RNA, 20 nt, Homo sapiens
uggguuuugggucuuugaac

SEQ ID NO: 1769556 - RNA, 15 nt, Homo sapiens
gcaacuaggccuuca

SEQ ID NO: 1769557 - RNA, 14 nt, Homo sapiens
gugaagcuaauaca

SEQ ID NO: 1769558 - RNA, 21 nt, Homo sapiens
uucuaauucuucucaugcaua

SEQ ID NO: 1769559 - RNA, 14 nt, Homo sapiens
uuuguggaagcacu

SEQ ID NO: 1769560 - RNA, 12 nt, Homo sapiens
aaacaguucuug

SEQ ID NO: 1769561 - RNA, 20 nt, Homo sapiens
aguaaaucuaucucuauaua

SEQ ID NO: 1769562 - RNA, 15 nt, Homo sapiens
agaucugaguugaga

SEQ ID NO: 1769563 - RNA, 18 nt, Homo sapiens
caacuguauuucauacgu

SEQ ID NO: 1769564 - RNA, 13 nt, Homo sapiens
uggcucaccuuug

SEQ ID NO: 1769565 - RNA, 17 nt, Homo sapiens
ggcugcagcagccggaa

SEQ ID NO: 1769566 - RNA, 19 nt, Homo sapiens
cggcccagcaagaugaaac

SEQ ID NO: 1769567 - RNA, 19 nt, Homo sapiens
aauuuuguuuguugaugug

SEQ ID NO: 1769568 - RNA, 15 nt, Homo sapiens
aacgaacugggaaaa

SEQ ID NO: 1769569 - RNA, 13 nt, Homo sapiens
cucugugcugagc

SEQ ID NO: 1769570 - RNA, 19 nt, Homo sapiens
agcacuauuauggaugaag

SEQ ID NO: 1769571 - RNA, 17 nt, Homo sapiens
ggugugugucugcagca

SEQ ID NO: 1769572 - RNA, 16 nt, Homo sapiens
acauccugugccucca

SEQ ID NO: 1769573 - RNA, 22 nt, Homo sapiens
aggagaggggcagaacagccgc

SEQ ID NO: 1769574 - RNA, 21 nt, Homo sapiens
cugaaaucauacuucuuaggg

SEQ ID NO: 1769575 - RNA, 12 nt, Homo sapiens
gaacaucugugu

SEQ ID NO: 1769576 - RNA, 16 nt, Homo sapiens
ugauauguaaguacuu

SEQ ID NO: 1769577 - RNA, 17 nt, Homo sapiens
acccgggggagcccagu

SEQ ID NO: 1769578 - RNA, 13 nt, Homo sapiens
cagcgacugccac

SEQ ID NO: 1769579 - RNA, 19 nt, Homo sapiens
ucccggaguucuccugcuc

SEQ ID NO: 1769580 - RNA, 18 nt, Homo sapiens
ggcuuucaaaauaaggau

SEQ ID NO: 1769581 - RNA, 17 nt, Homo sapiens
gugauucuugcugcuau

SEQ ID NO: 1769582 - RNA, 21 nt, Homo sapiens
uauuccuccaaaucucuugcu

SEQ ID NO: 1769583 - RNA, 21 nt, Homo sapiens
ugggcucuggugggggcuccu

SEQ ID NO: 1769584 - RNA, 19 nt, Homo sapiens
cuuuaaagagaguuugcca

SEQ ID NO: 1769585 - RNA, 14 nt, Homo sapiens
auacaaggaugcac

SEQ ID NO: 1769586 - RNA, 16 nt, Homo sapiens
cugacaaagaugcauc

SEQ ID NO: 1769587 - RNA, 22 nt, Homo sapiens
aagucugauguucuuuccauga

SEQ ID NO: 1769588 - RNA, 13 nt, Homo sapiens
gcagaagaagcug

SEQ ID NO: 1769589 - RNA, 20 nt, Homo sapiens
aucuucuaucaaagcacaua

SEQ ID NO: 1769590 - RNA, 16 nt, Homo sapiens
gugucuggaagcugag

SEQ ID NO: 1769591 - RNA, 11 nt, Homo sapiens
uaaaagaucuu

SEQ ID NO: 1769592 - RNA, 16 nt, Homo sapiens
acuacauaacuuccua

SEQ ID NO: 1769593 - RNA, 15 nt, Homo sapiens
ugcgccuaauguguu

SEQ ID NO: 1769594 - RNA, 15 nt, Homo sapiens
cgccccggacugccu

SEQ ID NO: 1769595 - RNA, 21 nt, Homo sapiens
ccagccacugcccaaagccau

SEQ ID NO: 1769596 - RNA, 15 nt, Homo sapiens
ggccacacccaggaa

SEQ ID NO: 1769597 - RNA, 18 nt, Homo sapiens
cacauaucuagauuuuuc

SEQ ID NO: 1769598 - RNA, 21 nt, Homo sapiens
gcaggcuucugugugcugcua

SEQ ID NO: 1769599 - RNA, 22 nt, Homo sapiens
ccuugcccacccccaccaugca

SEQ ID NO: 1769600 - RNA, 21 nt, Homo sapiens
aagaacaauuaaaauauucuu

SEQ ID NO: 1769601 - RNA, 15 nt, Homo sapiens
cuuacaaaacauuuu

SEQ ID NO: 1769602 - RNA, 23 nt, Homo sapiens
cagcuuugggaucccacccuggg

SEQ ID NO: 1769603 - RNA, 20 nt, Homo sapiens
aguguccugauuuguguuaa

SEQ ID NO: 1769604 - RNA, 18 nt, Homo sapiens
cugccuguugcgugacac

SEQ ID NO: 1769605 - RNA, 21 nt, Homo sapiens
aacuuccacaagagugaauuu

SEQ ID NO: 1769606 - RNA, 16 nt, Homo sapiens
gagauggaagagucau

SEQ ID NO: 1769607 - RNA, 22 nt, Homo sapiens
auaauauauuuucaaggauguu

SEQ ID NO: 1769608 - RNA, 14 nt, Homo sapiens
aauccauauuucaa

SEQ ID NO: 1769609 - RNA, 14 nt, Homo sapiens
aacccuuauuccau

SEQ ID NO: 1769610 - RNA, 20 nt, Homo sapiens
ucaaguuguugacugugauu

SEQ ID NO: 1769611 - RNA, 13 nt, Homo sapiens
aaaccaugugacu

SEQ ID NO: 1769612 - RNA, 21 nt, Homo sapiens
uauaguuuaaaaaucugccac

SEQ ID NO: 1769613 - RNA, 21 nt, Homo sapiens
aaacuuaccuaagugacauuu

SEQ ID NO: 1769614 - RNA, 16 nt, Homo sapiens
aguguugagaugggga

SEQ ID NO: 1769615 - RNA, 15 nt, Homo sapiens
ucacccucguuucca

SEQ ID NO: 1769616 - RNA, 16 nt, Homo sapiens
aaucuauugucuacuu

SEQ ID NO: 1769617 - RNA, 16 nt, Homo sapiens
auuauuagauucucca

SEQ ID NO: 1769618 - RNA, 19 nt, Homo sapiens
caaacuuauggacacugcc

SEQ ID NO: 1769619 - RNA, 19 nt, Homo sapiens
acugggcccgagccugaac

SEQ ID NO: 1769620 - RNA, 19 nt, Homo sapiens
gccccacuucuggccacau

SEQ ID NO: 1769621 - RNA, 18 nt, Homo sapiens
cuccaaaguccacacaaa

SEQ ID NO: 1769622 - RNA, 15 nt, Homo sapiens
agugcuucagaguuu

SEQ ID NO: 1769623 - RNA, 21 nt, Homo sapiens
aaccacguguuuugacaucau

SEQ ID NO: 1769624 - RNA, 17 nt, Homo sapiens
uaguaugaggcauuugu

SEQ ID NO: 1769625 - RNA, 15 nt, Homo sapiens
ccagacacugagcuu

SEQ ID NO: 1769626 - RNA, 20 nt, Homo sapiens
uuucaaagaaaaagguccau

SEQ ID NO: 1769627 - RNA, 18 nt, Homo sapiens
aacaagaaugcauucccu

SEQ ID NO: 1769628 - RNA, 19 nt, Homo sapiens
ugcaucguuucaucuucca

SEQ ID NO: 1769629 - RNA, 17 nt, Homo sapiens
agcuguccagcugcaaa

SEQ ID NO: 1769630 - RNA, 13 nt, Homo sapiens
auuucaaauaucu

SEQ ID NO: 1769631 - RNA, 13 nt, Homo sapiens
auuuuaaauaucc

SEQ ID NO: 1769632 - RNA, 19 nt, Homo sapiens
cacauuugguuucugaaua

SEQ ID NO: 1769633 - RNA, 16 nt, Homo sapiens
ucacuugacucuugaa

SEQ ID NO: 1769634 - RNA, 23 nt, Homo sapiens
cucccaagggucucacugcucac

SEQ ID NO: 1769635 - RNA, 23 nt, Homo sapiens
gcuuauaaauggcaccacaucuu

SEQ ID NO: 1769636 - RNA, 16 nt, Homo sapiens
ucucauaaauuucucu

SEQ ID NO: 1769637 - RNA, 22 nt, Homo sapiens
ccagggugacagagugagacca

SEQ ID NO: 1769638 - RNA, 13 nt, Homo sapiens
uuaccaaagaaga

SEQ ID NO: 1769639 - RNA, 19 nt, Homo sapiens
gacagccuuguuccucagc

SEQ ID NO: 1769640 - RNA, 15 nt, Homo sapiens
guacugagggacaag

SEQ ID NO: 1769641 - RNA, 18 nt, Homo sapiens
agacaccgcgcaucucuu

SEQ ID NO: 1769642 - RNA, 13 nt, Homo sapiens
aauuguugagaua

SEQ ID NO: 1769643 - RNA, 17 nt, Homo sapiens
agcaccguucugugcac

SEQ ID NO: 1769644 - RNA, 23 nt, Homo sapiens
aaucauauuucccuuacaauuaa

SEQ ID NO: 1769645 - RNA, 22 nt, Homo sapiens
uauagcaauacuucagugagau

SEQ ID NO: 1769646 - RNA, 19 nt, Homo sapiens
uuuaauguuuuuugccaca

SEQ ID NO: 1769647 - RNA, 14 nt, Homo sapiens
aggaaacacuucua

SEQ ID NO: 1769648 - RNA, 16 nt, Homo sapiens
cuuggcuucagacucg

SEQ ID NO: 1769649 - RNA, 14 nt, Homo sapiens
guaugguacaucua

SEQ ID NO: 1769650 - RNA, 17 nt, Homo sapiens
uuguaagaaauacugua

SEQ ID NO: 1769651 - RNA, 17 nt, Homo sapiens
accugcuguggaugucc

SEQ ID NO: 1769652 - RNA, 13 nt, Homo sapiens
acugauccuggag

SEQ ID NO: 1769653 - RNA, 16 nt, Homo sapiens
ugcaguccccagucac

SEQ ID NO: 1769654 - RNA, 18 nt, Homo sapiens
aacuacaaacacaagcaa

SEQ ID NO: 1769655 - RNA, 14 nt, Homo sapiens
aacuaggugaucuc

SEQ ID NO: 1769656 - RNA, 20 nt, Homo sapiens
gcauaaauuacagucaucug

SEQ ID NO: 1769657 - RNA, 19 nt, Homo sapiens
auucagacaaaauggauac

SEQ ID NO: 1769658 - RNA, 22 nt, Homo sapiens
gcugggcugucucucccuucca

SEQ ID NO: 1769659 - RNA, 20 nt, Homo sapiens
ugaagaaaagcacuuuuuaa

SEQ ID NO: 1769660 - RNA, 16 nt, Homo sapiens
aagucagcucuucucc

SEQ ID NO: 1769661 - RNA, 11 nt, Homo sapiens
guaaaugugau

SEQ ID NO: 1769662 - RNA, 14 nt, Homo sapiens
caaagaguaguuaa

SEQ ID NO: 1769663 - RNA, 21 nt, Homo sapiens
gagaaacaaugacuaauucuu

SEQ ID NO: 1769664 - RNA, 15 nt, Homo sapiens
auuaaagagccaguu

SEQ ID NO: 1769665 - RNA, 17 nt, Homo sapiens
cucgcaugccagagccu

SEQ ID NO: 1769666 - RNA, 15 nt, Homo sapiens
aggugugcucugagc

SEQ ID NO: 1769667 - RNA, 18 nt, Homo sapiens
agagaccgagccucuguc

SEQ ID NO: 1769668 - RNA, 21 nt, Homo sapiens
gcaaguagcacaugguuuaaa

SEQ ID NO: 1769669 - RNA, 17 nt, Homo sapiens
gcacuuugggagaccaa

SEQ ID NO: 1769670 - RNA, 19 nt, Homo sapiens
cuucaacguuucuucacuu

SEQ ID NO: 1769671 - RNA, 21 nt, Homo sapiens
gcugcuucugccguugcugcc

SEQ ID NO: 1769672 - RNA, 11 nt, Homo sapiens
gccacugaccu

SEQ ID NO: 1769673 - RNA, 19 nt, Homo sapiens
ggagaacaugaaucaaaag

SEQ ID NO: 1769674 - RNA, 13 nt, Homo sapiens
cacaucugucacg

SEQ ID NO: 1769675 - RNA, 14 nt, Homo sapiens
ggcacugugccuac

SEQ ID NO: 1769676 - RNA, 14 nt, Homo sapiens
ucaacuguugauac

SEQ ID NO: 1769677 - RNA, 15 nt, Homo sapiens
aagaaaucuggccca

SEQ ID NO: 1769678 - RNA, 16 nt, Homo sapiens
ugcagaguaggcagcu

SEQ ID NO: 1769679 - RNA, 20 nt, Homo sapiens
ucucuggagcauucugaaaa

SEQ ID NO: 1769680 - RNA, 15 nt, Homo sapiens
acuggacucaccucc

SEQ ID NO: 1769681 - RNA, 21 nt, Homo sapiens
uccaaggaugggaaucaggca

SEQ ID NO: 1769682 - RNA, 13 nt, Homo sapiens
cuuggccaagaga

SEQ ID NO: 1769683 - RNA, 19 nt, Homo sapiens
ugaaaucuuuaugugauau

SEQ ID NO: 1769684 - RNA, 16 nt, Homo sapiens
ucuggcccacugagcc

SEQ ID NO: 1769685 - RNA, 22 nt, Homo sapiens
ccauuccacuccacucagguuc

SEQ ID NO: 1769686 - RNA, 23 nt, Homo sapiens
gccaugccuggagacauaucacu

SEQ ID NO: 1769687 - RNA, 17 nt, Homo sapiens
acagugccgacagcucu

SEQ ID NO: 1769688 - RNA, 16 nt, Homo sapiens
gaacuguguacuguau

SEQ ID NO: 1769689 - RNA, 17 nt, Homo sapiens
uacauggcuuggcauuu

SEQ ID NO: 1769690 - RNA, 13 nt, Homo sapiens
uccuguguaaaug

SEQ ID NO: 1769691 - RNA, 18 nt, Homo sapiens
uauuacugaaaaugauuc

SEQ ID NO: 1769692 - RNA, 21 nt, Homo sapiens
cgguggggcguagacuugaca

SEQ ID NO: 1769693 - RNA, 16 nt, Homo sapiens
ggcuuauccacuuuga

SEQ ID NO: 1769694 - RNA, 18 nt, Homo sapiens
uuacuaguacuauuacua

SEQ ID NO: 1769695 - RNA, 13 nt, Homo sapiens
cuccacugucaca

SEQ ID NO: 1769696 - RNA, 16 nt, Homo sapiens
augucuauucagcuuc

SEQ ID NO: 1769697 - RNA, 19 nt, Homo sapiens
aagagguugcuaaugccuu

SEQ ID NO: 1769698 - RNA, 14 nt, Homo sapiens
acaaagaaauauua

SEQ ID NO: 1769699 - RNA, 12 nt, Homo sapiens
uugccuuuccag

SEQ ID NO: 1769700 - RNA, 14 nt, Homo sapiens
uacaugcauauaau

SEQ ID NO: 1769701 - RNA, 14 nt, Homo sapiens
aauuuucaaacuag

SEQ ID NO: 1769702 - RNA, 16 nt, Homo sapiens
agugaaagccagauuc

SEQ ID NO: 1769703 - RNA, 22 nt, Homo sapiens
ucuguguaguagcucgugugcu

SEQ ID NO: 1769704 - RNA, 20 nt, Homo sapiens
ucgcuguugucacaucucag

SEQ ID NO: 1769705 - RNA, 18 nt, Homo sapiens
uucuagguggcaggacaa

SEQ ID NO: 1769706 - RNA, 14 nt, Homo sapiens
acagacaguuucug

SEQ ID NO: 1769707 - RNA, 16 nt, Homo sapiens
gccaagucuaaugaag

SEQ ID NO: 1769708 - RNA, 23 nt, Homo sapiens
ggaguuugagaccagccucauca

SEQ ID NO: 1769709 - RNA, 20 nt, Homo sapiens
uggcacacaccaguaauccc

SEQ ID NO: 1769710 - RNA, 17 nt, Homo sapiens
ucagggggagucuuugc

SEQ ID NO: 1769711 - RNA, 16 nt, Homo sapiens
aaauaauaaaucuggu

SEQ ID NO: 1769712 - RNA, 20 nt, Homo sapiens
aauucguucaccuacauuug

SEQ ID NO: 1769713 - RNA, 15 nt, Homo sapiens
uggaacucaguguga

SEQ ID NO: 1769714 - RNA, 17 nt, Homo sapiens
agcuuggugucuuggca

SEQ ID NO: 1769715 - RNA, 16 nt, Homo sapiens
uacaaguuacauacau

SEQ ID NO: 1769716 - RNA, 17 nt, Homo sapiens
cagagaaccagugcaga

SEQ ID NO: 1769717 - RNA, 22 nt, Homo sapiens
uaacucuuuauuuuuugccaua

SEQ ID NO: 1769718 - RNA, 18 nt, Homo sapiens
uguacaauaaagcaaugu

SEQ ID NO: 1769719 - RNA, 14 nt, Homo sapiens
aagguggaaaaugg

SEQ ID NO: 1769720 - RNA, 16 nt, Homo sapiens
ucccugcuugcacacu

SEQ ID NO: 1769721 - RNA, 15 nt, Homo sapiens
ucccuccagcacaaa

SEQ ID NO: 1769722 - RNA, 18 nt, Homo sapiens
uauuuaucccucauucau

SEQ ID NO: 1769723 - RNA, 23 nt, Homo sapiens
aauacaauaguaugcagcuaaaa

SEQ ID NO: 1769724 - RNA, 23 nt, Homo sapiens
cugugcaauagacacauacaugu

SEQ ID NO: 1769725 - RNA, 18 nt, Homo sapiens
ggcuacuguaaugcugcc

SEQ ID NO: 1769726 - RNA, 21 nt, Homo sapiens
uuauuccuaaaucuuccagca

SEQ ID NO: 1769727 - RNA, 13 nt, Homo sapiens
ucacacacuggac

SEQ ID NO: 1769728 - RNA, 19 nt, Homo sapiens
ucaaggcaguuaauucuca

SEQ ID NO: 1769729 - RNA, 23 nt, Homo sapiens
cuaccuuuauauuugggguccuu

SEQ ID NO: 1769730 - RNA, 14 nt, Homo sapiens
ccagauucaugcac

SEQ ID NO: 1769731 - RNA, 14 nt, Homo sapiens
cagagaaaccagcu

SEQ ID NO: 1769732 - RNA, 19 nt, Homo sapiens
uuauuacugagagugcaaa

SEQ ID NO: 1769733 - RNA, 14 nt, Homo sapiens
auuccucauuugga

SEQ ID NO: 1769734 - RNA, 16 nt, Homo sapiens
cuaagaagaaggccag

SEQ ID NO: 1769735 - RNA, 18 nt, Homo sapiens
auugauggacuacucuau

SEQ ID NO: 1769736 - RNA, 22 nt, Homo sapiens
augaaauccugcuucaguguau

SEQ ID NO: 1769737 - RNA, 21 nt, Homo sapiens
caggcaaaggcccccaucaca

SEQ ID NO: 1769738 - RNA, 15 nt, Homo sapiens
uacuugugcacuuag

SEQ ID NO: 1769739 - RNA, 15 nt, Homo sapiens
cauaagaaagcacua

SEQ ID NO: 1769740 - RNA, 21 nt, Homo sapiens
agacagcuggcggaggcugcu

SEQ ID NO: 1769741 - RNA, 12 nt, Homo sapiens
uguggagugucu

SEQ ID NO: 1769742 - RNA, 19 nt, Homo sapiens
auugagauacuaucauuaa

SEQ ID NO: 1769743 - RNA, 16 nt, Homo sapiens
auauuuucuauuacac

SEQ ID NO: 1769744 - RNA, 20 nt, Homo sapiens
ugugcuucagugccauugca

SEQ ID NO: 1769745 - RNA, 16 nt, Homo sapiens
agagugacuaguacaa

SEQ ID NO: 1769746 - RNA, 19 nt, Homo sapiens
augacugcgcagaguggau

SEQ ID NO: 1769747 - RNA, 21 nt, Homo sapiens
aaauccacagaacuagccuua

SEQ ID NO: 1769748 - RNA, 15 nt, Homo sapiens
gaauuaaaggugcca

SEQ ID NO: 1769749 - RNA, 21 nt, Homo sapiens
ucauauuauuuuaguguguaa

SEQ ID NO: 1769750 - RNA, 13 nt, Homo sapiens
uguuuuuauacuu

SEQ ID NO: 1769751 - RNA, 22 nt, Homo sapiens
uuuuuaauccaggccccaucag

SEQ ID NO: 1769752 - RNA, 15 nt, Homo sapiens
ugcaagagacucugg

SEQ ID NO: 1769753 - RNA, 14 nt, Homo sapiens
aacagcaucuuuca

SEQ ID NO: 1769754 - RNA, 15 nt, Homo sapiens
uccccggaguucagu

SEQ ID NO: 1769755 - RNA, 14 nt, Homo sapiens
cugagguuaugaac

SEQ ID NO: 1769756 - RNA, 15 nt, Homo sapiens
ucauuuaucaucaca

SEQ ID NO: 1769757 - RNA, 12 nt, Homo sapiens
ucuuaaacuaca

SEQ ID NO: 1769758 - RNA, 14 nt, Homo sapiens
caaagucguuucaa

SEQ ID NO: 1769759 - RNA, 17 nt, Homo sapiens
ucugaacagaagguaua

SEQ ID NO: 1769760 - RNA, 16 nt, Homo sapiens
aggcuggagugcagug

SEQ ID NO: 1769761 - RNA, 18 nt, Homo sapiens
caauuauuugaagauuua

SEQ ID NO: 1769762 - RNA, 23 nt, Homo sapiens
cagccccccaguguccccagggg

SEQ ID NO: 1769763 - RNA, 15 nt, Homo sapiens
caaggaacagccaca

SEQ ID NO: 1769764 - RNA, 17 nt, Homo sapiens
ugaagucaucagcuuug

SEQ ID NO: 1769765 - RNA, 15 nt, Homo sapiens
uuuuagcucauguau

SEQ ID NO: 1769766 - RNA, 20 nt, Homo sapiens
aaccguuuccuuucauuuac

SEQ ID NO: 1769767 - RNA, 22 nt, Homo sapiens
auccccggugguuuugugcuca

SEQ ID NO: 1769768 - RNA, 16 nt, Homo sapiens
acuaccaagcagcuca

SEQ ID NO: 1769769 - RNA, 17 nt, Homo sapiens
augcccucaaucccagc

SEQ ID NO: 1769770 - RNA, 20 nt, Homo sapiens
caagugaccgacucauuuac

SEQ ID NO: 1769771 - RNA, 17 nt, Homo sapiens
gaggccugaucugccca

SEQ ID NO: 1769772 - RNA, 17 nt, Homo sapiens
uaauuauaaauaucauu

SEQ ID NO: 1769773 - RNA, 22 nt, Homo sapiens
augucuaaagcagggaagugac

SEQ ID NO: 1769774 - RNA, 16 nt, Homo sapiens
ugccacgguccuuuga

SEQ ID NO: 1769775 - RNA, 22 nt, Homo sapiens
caguguaaauuaauuacauaca

SEQ ID NO: 1769776 - RNA, 23 nt, Homo sapiens
caugacuacauaguaaguacaga

SEQ ID NO: 1769777 - RNA, 14 nt, Homo sapiens
cucuagugaaugua

SEQ ID NO: 1769778 - RNA, 15 nt, Homo sapiens
cacacggaugcacag

SEQ ID NO: 1769779 - RNA, 15 nt, Homo sapiens
auuuccacugaacaa

SEQ ID NO: 1769780 - RNA, 19 nt, Homo sapiens
agaauauuuauuaccucug

SEQ ID NO: 1769781 - RNA, 16 nt, Homo sapiens
uuuugguugcuuuaau

SEQ ID NO: 1769782 - RNA, 13 nt, Homo sapiens
cauuuaccuggaa

SEQ ID NO: 1769783 - RNA, 17 nt, Homo sapiens
aggaguggacgcugucc

SEQ ID NO: 1769784 - RNA, 17 nt, Homo sapiens
caggccccuuaccugca

SEQ ID NO: 1769785 - RNA, 19 nt, Homo sapiens
ccugcugcgucagaccagu

SEQ ID NO: 1769786 - RNA, 14 nt, Homo sapiens
aaggacgugggcag

SEQ ID NO: 1769787 - RNA, 13 nt, Homo sapiens
gucugaacaaaac

SEQ ID NO: 1769788 - RNA, 13 nt, Homo sapiens
ucuccaaugcucu

SEQ ID NO: 1769789 - RNA, 20 nt, Homo sapiens
cucacugaggaugcuucugu

SEQ ID NO: 1769790 - RNA, 11 nt, Homo sapiens
aaaugcaauaa

SEQ ID NO: 1769791 - RNA, 18 nt, Homo sapiens
aaugucuucuguauucac

SEQ ID NO: 1769792 - RNA, 20 nt, Homo sapiens
ugagccacuggcagugugcu

SEQ ID NO: 1769793 - RNA, 20 nt, Homo sapiens
aaucuugucuaacauucccg

SEQ ID NO: 1769794 - RNA, 11 nt, Homo sapiens
accagcucaaa

SEQ ID NO: 1769795 - RNA, 21 nt, Homo sapiens
gguauucagguaacucauuua

SEQ ID NO: 1769796 - RNA, 23 nt, Homo sapiens
ccuuccugauuguuuacagucau

SEQ ID NO: 1769797 - RNA, 19 nt, Homo sapiens
cauuuaaccaagcuauuca

SEQ ID NO: 1769798 - RNA, 19 nt, Homo sapiens
aaaauuuuagcucuuccca

SEQ ID NO: 1769799 - RNA, 15 nt, Homo sapiens
cucuuucuuuacucu

SEQ ID NO: 1769800 - RNA, 17 nt, Homo sapiens
cauccaaaccuguaacc

SEQ ID NO: 1769801 - RNA, 18 nt, Homo sapiens
agaccugacaccuuucau

SEQ ID NO: 1769802 - RNA, 18 nt, Homo sapiens
ucaauagcuccaagcugu

SEQ ID NO: 1769803 - RNA, 16 nt, Homo sapiens
gcgguauccaccugca

SEQ ID NO: 1769804 - RNA, 21 nt, Homo sapiens
uaaccccgggaugcaagguag

SEQ ID NO: 1769805 - RNA, 16 nt, Homo sapiens
acagaccacuugccac

SEQ ID NO: 1769806 - RNA, 23 nt, Homo sapiens
gcuccauacucuaacaucuagcu

SEQ ID NO: 1769807 - RNA, 21 nt, Homo sapiens
aaacagcggcuccacuacaga

SEQ ID NO: 1769808 - RNA, 16 nt, Homo sapiens
uguccauuuauaucau

SEQ ID NO: 1769809 - RNA, 22 nt, Homo sapiens
acaagaacucuuuauguagcau

SEQ ID NO: 1769810 - RNA, 19 nt, Homo sapiens
cuaacauaggugaacgugu

SEQ ID NO: 1769811 - RNA, 19 nt, Homo sapiens
auuuauuaagcaguacaaa

SEQ ID NO: 1769812 - RNA, 21 nt, Homo sapiens
ggugauuccauuuuacuucca

SEQ ID NO: 1769813 - RNA, 13 nt, Homo sapiens
ucuucucacuuuc

SEQ ID NO: 1769814 - RNA, 16 nt, Homo sapiens
cauuaauaauuugcuc

SEQ ID NO: 1769815 - RNA, 19 nt, Homo sapiens
gacucaccuugcucugcca

SEQ ID NO: 1769816 - RNA, 15 nt, Homo sapiens
auaacugaugaagga

SEQ ID NO: 1769817 - RNA, 22 nt, Homo sapiens
ggaucaguuaacuauugcauuu

SEQ ID NO: 1769818 - RNA, 18 nt, Homo sapiens
uccuuauuguuaaaaaca

SEQ ID NO: 1769819 - RNA, 17 nt, Homo sapiens
uccugagcuagcaaaua

SEQ ID NO: 1769820 - RNA, 22 nt, Homo sapiens
uauaaucaaagcucauaaugga

SEQ ID NO: 1769821 - RNA, 18 nt, Homo sapiens
ugucauuguaaacaaacu

SEQ ID NO: 1769822 - RNA, 17 nt, Homo sapiens
cacggggcaaagcugcu

SEQ ID NO: 1769823 - RNA, 18 nt, Homo sapiens
cccugugugacaucacag

SEQ ID NO: 1769824 - RNA, 16 nt, Homo sapiens
cacuuugccacuggau

SEQ ID NO: 1769825 - RNA, 19 nt, Homo sapiens
ccuuuggggcuucugugaa

SEQ ID NO: 1769826 - RNA, 16 nt, Homo sapiens
ucccucggagcugcca

SEQ ID NO: 1769827 - RNA, 14 nt, Homo sapiens
gaggcacaaagggc

SEQ ID NO: 1769828 - RNA, 21 nt, Homo sapiens
uauuacgaaguucaagaucaa

SEQ ID NO: 1769829 - RNA, 15 nt, Homo sapiens
aauccuuccaugaaa

SEQ ID NO: 1769830 - RNA, 22 nt, Homo sapiens
uuuguuguuugauucagcaaaa

SEQ ID NO: 1769831 - RNA, 20 nt, Homo sapiens
gagaguggccugggucccag

SEQ ID NO: 1769832 - RNA, 14 nt, Homo sapiens
ggucaggacucaga

SEQ ID NO: 1769833 - RNA, 14 nt, Homo sapiens
uacagcacacacuu

SEQ ID NO: 1769834 - RNA, 18 nt, Homo sapiens
gcuuauuuuuuucuacau

SEQ ID NO: 1769835 - RNA, 13 nt, Homo sapiens
uuaaauaagcagu

SEQ ID NO: 1769836 - RNA, 16 nt, Homo sapiens
guuaaacuagcauauc

SEQ ID NO: 1769837 - RNA, 21 nt, Homo sapiens
augcauucuaucguuauuaua

SEQ ID NO: 1769838 - RNA, 20 nt, Homo sapiens
cuguuguuuggacuguaaca

SEQ ID NO: 1769839 - RNA, 15 nt, Homo sapiens
uuugcagugauuuga

SEQ ID NO: 1769840 - RNA, 18 nt, Homo sapiens
acagcuauuagaacuaau

SEQ ID NO: 1769841 - RNA, 17 nt, Homo sapiens
ggaggccucacacccag

SEQ ID NO: 1769842 - RNA, 21 nt, Homo sapiens
acguaauuguacaagcaguua

SEQ ID NO: 1769843 - RNA, 16 nt, Homo sapiens
uugcuuggugcacaga

SEQ ID NO: 1769844 - RNA, 13 nt, Homo sapiens
agggacugaccag

SEQ ID NO: 1769845 - RNA, 14 nt, Homo sapiens
ccauacacauugga

SEQ ID NO: 1769846 - RNA, 21 nt, Homo sapiens
ucaaaaaaauccuagagauuc

SEQ ID NO: 1769847 - RNA, 19 nt, Homo sapiens
agaaaaaggagcuuaccuc

SEQ ID NO: 1769848 - RNA, 16 nt, Homo sapiens
cugucucuaugagaga

SEQ ID NO: 1769849 - RNA, 18 nt, Homo sapiens
aagccugggcagaaaugu

SEQ ID NO: 1769850 - RNA, 14 nt, Homo sapiens
guggcauccuguga

SEQ ID NO: 1769851 - RNA, 12 nt, Homo sapiens
aucucacuuuau

SEQ ID NO: 1769852 - RNA, 22 nt, Homo sapiens
ucuguaaugauacugauuauga

SEQ ID NO: 1769853 - RNA, 15 nt, Homo sapiens
aaaagucaguaucau

SEQ ID NO: 1769854 - RNA, 16 nt, Homo sapiens
auaauuguguacaaag

SEQ ID NO: 1769855 - RNA, 21 nt, Homo sapiens
augcaacauguguacuuaauu

SEQ ID NO: 1769856 - RNA, 20 nt, Homo sapiens
gucccuguaugucuaccucu

SEQ ID NO: 1769857 - RNA, 19 nt, Homo sapiens
uaucagcauauggcacuaa

SEQ ID NO: 1769858 - RNA, 14 nt, Homo sapiens
uucuuauagaguau

SEQ ID NO: 1769859 - RNA, 12 nt, Homo sapiens
guggacaaaagu

SEQ ID NO: 1769860 - RNA, 21 nt, Homo sapiens
acaccaaaaaauaucuaguaa

SEQ ID NO: 1769861 - RNA, 21 nt, Homo sapiens
uggugggcccagggacaccca

SEQ ID NO: 1769862 - RNA, 15 nt, Homo sapiens
aagugguucucugcc

SEQ ID NO: 1769863 - RNA, 18 nt, Homo sapiens
aggcaccaccucugucac

SEQ ID NO: 1769864 - RNA, 16 nt, Homo sapiens
aucauaaaacuugaug

SEQ ID NO: 1769865 - RNA, 21 nt, Homo sapiens
agcaaacagggcuuuacuauc

SEQ ID NO: 1769866 - RNA, 18 nt, Homo sapiens
gagcuugcaggaaccagc

SEQ ID NO: 1769867 - RNA, 17 nt, Homo sapiens
ccgggaaguucaaggaa

SEQ ID NO: 1769868 - RNA, 11 nt, Homo sapiens
acuuuucccac

SEQ ID NO: 1769869 - RNA, 15 nt, Homo sapiens
aaacauuucccugcu

SEQ ID NO: 1769870 - RNA, 21 nt, Homo sapiens
cuuucuaucuuauauacuuau

SEQ ID NO: 1769871 - RNA, 20 nt, Homo sapiens
accugccucccuucaugcau

SEQ ID NO: 1769872 - RNA, 13 nt, Homo sapiens
guuguaaguaaua

SEQ ID NO: 1769873 - RNA, 15 nt, Homo sapiens
caauaaauuuugcca

SEQ ID NO: 1769874 - RNA, 21 nt, Homo sapiens
gauacagaugacaaugggagc

SEQ ID NO: 1769875 - RNA, 18 nt, Homo sapiens
uaguaaauccaugguguu

SEQ ID NO: 1769876 - RNA, 18 nt, Homo sapiens
agucaauuuuacaauuau

SEQ ID NO: 1769877 - RNA, 18 nt, Homo sapiens
cugggaugggaacacugg

SEQ ID NO: 1769878 - RNA, 13 nt, Homo sapiens
acugacagccgcc

SEQ ID NO: 1769879 - RNA, 15 nt, Homo sapiens
uccccauaggccauu

SEQ ID NO: 1769880 - RNA, 11 nt, Homo sapiens
ggaugaagcuc

SEQ ID NO: 1769881 - RNA, 18 nt, Homo sapiens
uaaaacaugcugaaaacu

SEQ ID NO: 1769882 - RNA, 14 nt, Homo sapiens
uuaaagccuccuca

SEQ ID NO: 1769883 - RNA, 23 nt, Homo sapiens
cuaauauuaguuggcuuucauaa

SEQ ID NO: 1769884 - RNA, 12 nt, Homo sapiens
auuuuucuacuu

SEQ ID NO: 1769885 - RNA, 14 nt, Homo sapiens
uaauaaaguggcau

SEQ ID NO: 1769886 - RNA, 17 nt, Homo sapiens
cuaagcccccacuacaa

SEQ ID NO: 1769887 - RNA, 24 nt, Homo sapiens
aauaaaacccaacagauacuggaa

SEQ ID NO: 1769888 - RNA, 19 nt, Homo sapiens
cugccagccgcuggugccc

SEQ ID NO: 1769889 - RNA, 18 nt, Homo sapiens
ggauugaaucuaguauuu

SEQ ID NO: 1769890 - RNA, 22 nt, Homo sapiens
cugagauuauaggcaugagcca

SEQ ID NO: 1769891 - RNA, 20 nt, Homo sapiens
auacaguagaagcucacaaa

SEQ ID NO: 1769892 - RNA, 14 nt, Homo sapiens
uagugcuacagggu

SEQ ID NO: 1769893 - RNA, 23 nt, Homo sapiens
gcauaaguuuggagcacuaguuu

SEQ ID NO: 1769894 - RNA, 18 nt, Homo sapiens
acauuuagccaaucuuuc

SEQ ID NO: 1769895 - RNA, 13 nt, Homo sapiens
gaaauuccaggaa

SEQ ID NO: 1769896 - RNA, 23 nt, Homo sapiens
ugcugucugggugcuacugggga

SEQ ID NO: 1769897 - RNA, 14 nt, Homo sapiens
ccaaggaagagcca

SEQ ID NO: 1769898 - RNA, 22 nt, Homo sapiens
uuuuaaaguauguuauugcaua

SEQ ID NO: 1769899 - RNA, 14 nt, Homo sapiens
cugaguggcugaaa

SEQ ID NO: 1769900 - RNA, 14 nt, Homo sapiens
gccaagacacagca

SEQ ID NO: 1769901 - RNA, 11 nt, Homo sapiens
gucacuccugg

SEQ ID NO: 1769902 - RNA, 19 nt, Homo sapiens
uggccucagcuggcuguau

SEQ ID NO: 1769903 - RNA, 14 nt, Homo sapiens
uuuaugaugcagca

SEQ ID NO: 1769904 - RNA, 23 nt, Homo sapiens
ucaggagaaccuaacaugcuggu

SEQ ID NO: 1769905 - RNA, 15 nt, Homo sapiens
auauuaccuaaugaa

SEQ ID NO: 1769906 - RNA, 15 nt, Homo sapiens
ucaugcagucuggga

SEQ ID NO: 1769907 - RNA, 21 nt, Homo sapiens
ccaaccaguccucaguucucu

SEQ ID NO: 1769908 - RNA, 17 nt, Homo sapiens
gcagcgccuuucccaac

SEQ ID NO: 1769909 - RNA, 21 nt, Homo sapiens
gcuaauguaauaacugugaag

SEQ ID NO: 1769910 - RNA, 14 nt, Homo sapiens
gaugauccagagac

SEQ ID NO: 1769911 - RNA, 22 nt, Homo sapiens
uagaaacugcuuugacaugacu

SEQ ID NO: 1769912 - RNA, 23 nt, Homo sapiens
ugggcuuguaccacuuuugcaaa

SEQ ID NO: 1769913 - RNA, 19 nt, Homo sapiens
gaaaaguugaaauguguaa

SEQ ID NO: 1769914 - RNA, 18 nt, Homo sapiens
auuugggagaagaucuca

SEQ ID NO: 1769915 - RNA, 17 nt, Homo sapiens
cagaugcaccacccaug

SEQ ID NO: 1769916 - RNA, 14 nt, Homo sapiens
gcauuuuacaggug

SEQ ID NO: 1769917 - RNA, 17 nt, Homo sapiens
gccuuauaucauuucau

SEQ ID NO: 1769918 - RNA, 17 nt, Homo sapiens
uaacuacugcaaaaagu

SEQ ID NO: 1769919 - RNA, 22 nt, Homo sapiens
uugccaccauguauucauccag

SEQ ID NO: 1769920 - RNA, 20 nt, Homo sapiens
cuguuaaaggucauaugcac

SEQ ID NO: 1769921 - RNA, 23 nt, Homo sapiens
uauuugucuguaaaaaauggagc

SEQ ID NO: 1769922 - RNA, 19 nt, Homo sapiens
ucuugaagaaaauucagaa

SEQ ID NO: 1769923 - RNA, 16 nt, Homo sapiens
gauuugggaaccaagc

SEQ ID NO: 1769924 - RNA, 15 nt, Homo sapiens
cugaggaccuccaaa

SEQ ID NO: 1769925 - RNA, 15 nt, Homo sapiens
aacuuuaucacuuaa

SEQ ID NO: 1769926 - RNA, 20 nt, Homo sapiens
uguaaaguagaauaagccuu

SEQ ID NO: 1769927 - RNA, 15 nt, Homo sapiens
acacauauccacaaa

SEQ ID NO: 1769928 - RNA, 12 nt, Homo sapiens
agcaaaaggcau

SEQ ID NO: 1769929 - RNA, 16 nt, Homo sapiens
agauccaccugcacaa

SEQ ID NO: 1769930 - RNA, 14 nt, Homo sapiens
guaauaauaccuca

SEQ ID NO: 1769931 - RNA, 14 nt, Homo sapiens
caguaagauagguu

SEQ ID NO: 1769932 - RNA, 17 nt, Homo sapiens
cuccacaccuaccacga

SEQ ID NO: 1769933 - RNA, 14 nt, Homo sapiens
cagagugacaguca

SEQ ID NO: 1769934 - RNA, 23 nt, Homo sapiens
auuagcagcaucuuuaacacagc

SEQ ID NO: 1769935 - RNA, 15 nt, Homo sapiens
agcuagugauuugcc

SEQ ID NO: 1769936 - RNA, 21 nt, Homo sapiens
acggaaggcaaagagaccacu

SEQ ID NO: 1769937 - RNA, 18 nt, Homo sapiens
aguaguaaugauucucaa

SEQ ID NO: 1769938 - RNA, 15 nt, Homo sapiens
aauagaaaaagugau

SEQ ID NO: 1769939 - RNA, 20 nt, Homo sapiens
cuucuaugugaaacuugaaa

SEQ ID NO: 1769940 - RNA, 18 nt, Homo sapiens
aagagaaaauaagcagga

SEQ ID NO: 1769941 - RNA, 16 nt, Homo sapiens
gcaagcauuuuuccau

SEQ ID NO: 1769942 - RNA, 20 nt, Homo sapiens
gagagccugucaccagagcu

SEQ ID NO: 1769943 - RNA, 15 nt, Homo sapiens
ugccaccugcacagg

SEQ ID NO: 1769944 - RNA, 18 nt, Homo sapiens
ggaauuuaauuaggucau

SEQ ID NO: 1769945 - RNA, 21 nt, Homo sapiens
gcaaagcauugagcaaagggg

SEQ ID NO: 1769946 - RNA, 22 nt, Homo sapiens
uccuagcugugugcagucucuc

SEQ ID NO: 1769947 - RNA, 15 nt, Homo sapiens
aaacaacagauguac

SEQ ID NO: 1769948 - RNA, 20 nt, Homo sapiens
aaucuuugaaaacucauaca

SEQ ID NO: 1769949 - RNA, 22 nt, Homo sapiens
cuauuuguguaaggacuuuggc

SEQ ID NO: 1769950 - RNA, 20 nt, Homo sapiens
uuaauuuacuuaaguguuca

SEQ ID NO: 1769951 - RNA, 17 nt, Homo sapiens
ccugucaauacuaugga

SEQ ID NO: 1769952 - RNA, 14 nt, Homo sapiens
ggcucagccucaaa

SEQ ID NO: 1769953 - RNA, 17 nt, Homo sapiens
uguaaaggcaagccagc

SEQ ID NO: 1769954 - RNA, 18 nt, Homo sapiens
cugauuuaagguccuaaa

SEQ ID NO: 1769955 - RNA, 14 nt, Homo sapiens
uaaauguaucuuau

SEQ ID NO: 1769956 - RNA, 20 nt, Homo sapiens
uucgcaggauucuuccuccc

SEQ ID NO: 1769957 - RNA, 21 nt, Homo sapiens
aagacaaaauaaacauuuuau

SEQ ID NO: 1769958 - RNA, 21 nt, Homo sapiens
uggaacagcauuacccuccuc

SEQ ID NO: 1769959 - RNA, 17 nt, Homo sapiens
gacguuuaacugcaguu

SEQ ID NO: 1769960 - RNA, 10 nt, Homo sapiens
uuuauacaau

SEQ ID NO: 1769961 - RNA, 21 nt, Homo sapiens
uucucaguaguuguccgugau

SEQ ID NO: 1769962 - RNA, 22 nt, Homo sapiens
uguugcaaacucaguuccaaag

SEQ ID NO: 1769963 - RNA, 18 nt, Homo sapiens
aacaucaacuccugaagu

SEQ ID NO: 1769964 - RNA, 19 nt, Homo sapiens
cugucagaaugcuauugaa

SEQ ID NO: 1769965 - RNA, 15 nt, Homo sapiens
acuuaucucucaaaa

SEQ ID NO: 1769966 - RNA, 19 nt, Homo sapiens
ucugcauaguggccuuguc

SEQ ID NO: 1769967 - RNA, 20 nt, Homo sapiens
acauggucuucguccuugac

SEQ ID NO: 1769968 - RNA, 22 nt, Homo sapiens
acagcucuccuccuccaucuca

SEQ ID NO: 1769969 - RNA, 15 nt, Homo sapiens
acuaucuuugcugca

SEQ ID NO: 1769970 - RNA, 19 nt, Homo sapiens
uaugcagcuaucuggucaa

SEQ ID NO: 1769971 - RNA, 14 nt, Homo sapiens
aaguguaauagauu

SEQ ID NO: 1769972 - RNA, 14 nt, Homo sapiens
uucuuuaaaucagu

SEQ ID NO: 1769973 - RNA, 18 nt, Homo sapiens
gacuacuuguuguaucug

SEQ ID NO: 1769974 - RNA, 22 nt, Homo sapiens
cgcccccugccccaaucuccca

SEQ ID NO: 1769975 - RNA, 15 nt, Homo sapiens
cuuuuuucacauuga

SEQ ID NO: 1769976 - RNA, 20 nt, Homo sapiens
augaaucugcacaucuguaa

SEQ ID NO: 1769977 - RNA, 17 nt, Homo sapiens
aguccucccuagcucuu

SEQ ID NO: 1769978 - RNA, 18 nt, Homo sapiens
gccccagccagggcucaa

SEQ ID NO: 1769979 - RNA, 13 nt, Homo sapiens
aaaacuguugcua

SEQ ID NO: 1769980 - RNA, 14 nt, Homo sapiens
ucagauguaaauag

SEQ ID NO: 1769981 - RNA, 18 nt, Homo sapiens
aaaaauauucuccaugga

SEQ ID NO: 1769982 - RNA, 16 nt, Homo sapiens
augaaagugaugacau

SEQ ID NO: 1769983 - RNA, 21 nt, Homo sapiens
uauuaagucguucaauucaug

SEQ ID NO: 1769984 - RNA, 19 nt, Homo sapiens
cccuuuacucauagcacuu

SEQ ID NO: 1769985 - RNA, 13 nt, Homo sapiens
ucuauaggcagcu

SEQ ID NO: 1769986 - RNA, 23 nt, Homo sapiens
gaaguccccaggucaugcugcug

SEQ ID NO: 1769987 - RNA, 18 nt, Homo sapiens
uacaccuaugucauuuca

SEQ ID NO: 1769988 - RNA, 18 nt, Homo sapiens
aucuguaaaaggccuuca

SEQ ID NO: 1769989 - RNA, 21 nt, Homo sapiens
gaacccccucaaaagccaaaa

SEQ ID NO: 1769990 - RNA, 21 nt, Homo sapiens
uggcaaccauuauaaccuuaa

SEQ ID NO: 1769991 - RNA, 17 nt, Homo sapiens
aaugacaucuccuccau

SEQ ID NO: 1769992 - RNA, 14 nt, Homo sapiens
cuuucauucaauuu

SEQ ID NO: 1769993 - RNA, 19 nt, Homo sapiens
aagaaggacugaacuccau

SEQ ID NO: 1769994 - RNA, 14 nt, Homo sapiens
gucaacauaugcaa

SEQ ID NO: 1769995 - RNA, 24 nt, Homo sapiens
cuguguuacccaguaacucaucug

SEQ ID NO: 1769996 - RNA, 20 nt, Homo sapiens
caagagagaagcaaccacca

SEQ ID NO: 1769997 - RNA, 23 nt, Homo sapiens
auuuaaagaaaauaaacaccauu

SEQ ID NO: 1769998 - RNA, 23 nt, Homo sapiens
gcuggaaaaccuccuuuaccaga

SEQ ID NO: 1769999 - RNA, 16 nt, Homo sapiens
agguuugucccaguca

SEQ ID NO: 1770000 - RNA, 15 nt, Homo sapiens
gaaucuaagcuguuu

SEQ ID NO: 1770001 - RNA, 15 nt, Homo sapiens
gcagggccucuguca

SEQ ID NO: 1770002 - RNA, 21 nt, Homo sapiens
acucccucccuggcucugcca

SEQ ID NO: 1770003 - RNA, 15 nt, Homo sapiens
gacacagcaguauug

SEQ ID NO: 1770004 - RNA, 16 nt, Homo sapiens
agaguucuauccccaa

SEQ ID NO: 1770005 - RNA, 14 nt, Homo sapiens
agcucaaacccugu

SEQ ID NO: 1770006 - RNA, 21 nt, Homo sapiens
gacccucccagucucaucucc

SEQ ID NO: 1770007 - RNA, 15 nt, Homo sapiens
uaccuuuccugaugc

SEQ ID NO: 1770008 - RNA, 14 nt, Homo sapiens
cgugugaggacuga

SEQ ID NO: 1770009 - RNA, 19 nt, Homo sapiens
auuuugcacaaaguaagcc

SEQ ID NO: 1770010 - RNA, 14 nt, Homo sapiens
cuuuugucuaauua

SEQ ID NO: 1770011 - RNA, 23 nt, Homo sapiens
ugcacuacuccucugcagugccu

SEQ ID NO: 1770012 - RNA, 15 nt, Homo sapiens
acaagucauggucac

SEQ ID NO: 1770013 - RNA, 17 nt, Homo sapiens
cagauugugccacugcu

SEQ ID NO: 1770014 - RNA, 17 nt, Homo sapiens
aaugucauugcuaaaaa

SEQ ID NO: 1770015 - RNA, 17 nt, Homo sapiens
ccagguccauuuugccu

SEQ ID NO: 1770016 - RNA, 22 nt, Homo sapiens
augugaacgcccagagaacaag

SEQ ID NO: 1770017 - RNA, 14 nt, Homo sapiens
cacuugaggccuga

SEQ ID NO: 1770018 - RNA, 16 nt, Homo sapiens
uugcaggguccucuuc

SEQ ID NO: 1770019 - RNA, 20 nt, Homo sapiens
agagaauucucuuauccaac

SEQ ID NO: 1770020 - RNA, 19 nt, Homo sapiens
uauuggacuccaggccuga

SEQ ID NO: 1770021 - RNA, 16 nt, Homo sapiens
aaauuaugugacauuu

SEQ ID NO: 1770022 - RNA, 20 nt, Homo sapiens
guucaccauuauaaugaauu

SEQ ID NO: 1770023 - RNA, 17 nt, Homo sapiens
ucuaauauuuuguaaca

SEQ ID NO: 1770024 - RNA, 19 nt, Homo sapiens
ucuauauucuuuauucuca

SEQ ID NO: 1770025 - RNA, 23 nt, Homo sapiens
caaaauauuucagugaauuugca

SEQ ID NO: 1770026 - RNA, 22 nt, Homo sapiens
aauuaccagaguuguucugucu

SEQ ID NO: 1770027 - RNA, 20 nt, Homo sapiens
aacuacuuuuuggucaugaa

SEQ ID NO: 1770028 - RNA, 17 nt, Homo sapiens
uagcaaucugccuguau

SEQ ID NO: 1770029 - RNA, 16 nt, Homo sapiens
aagaugugcaacacaa

SEQ ID NO: 1770030 - RNA, 16 nt, Homo sapiens
gcucucaaaaugugaa

SEQ ID NO: 1770031 - RNA, 20 nt, Homo sapiens
uggguuagcuaaaccaagaa

SEQ ID NO: 1770032 - RNA, 15 nt, Homo sapiens
cccuucucuaccuca

SEQ ID NO: 1770033 - RNA, 20 nt, Homo sapiens
gggcgccuggguccucccag

SEQ ID NO: 1770034 - RNA, 20 nt, Homo sapiens
cuuucuucaauacaaaaagc

SEQ ID NO: 1770035 - RNA, 12 nt, Homo sapiens
gcugcaaucaca

SEQ ID NO: 1770036 - RNA, 17 nt, Homo sapiens
cuuuccccgugggccau

SEQ ID NO: 1770037 - RNA, 13 nt, Homo sapiens
aguugcaacuuaa

SEQ ID NO: 1770038 - RNA, 19 nt, Homo sapiens
gacauuuuagaaugucaau

SEQ ID NO: 1770039 - RNA, 18 nt, Homo sapiens
gccuggccucaucucaga

SEQ ID NO: 1770040 - RNA, 11 nt, Homo sapiens
agcugugaugg

SEQ ID NO: 1770041 - RNA, 20 nt, Homo sapiens
uaauuuuaggcacccauccu

SEQ ID NO: 1770042 - RNA, 23 nt, Homo sapiens
gaaaagcuccauuuuuagugaaa

SEQ ID NO: 1770043 - RNA, 19 nt, Homo sapiens
gggagauggcagcagugaa

SEQ ID NO: 1770044 - RNA, 16 nt, Homo sapiens
ccauuuuuaaaauaca

SEQ ID NO: 1770045 - RNA, 19 nt, Homo sapiens
aauuucuggaaaacugccu

SEQ ID NO: 1770046 - RNA, 16 nt, Homo sapiens
acagagacuuuaauca

SEQ ID NO: 1770047 - RNA, 20 nt, Homo sapiens
acuuugagccucuuaggcag

SEQ ID NO: 1770048 - RNA, 15 nt, Homo sapiens
aauuugaaacacuuu

SEQ ID NO: 1770049 - RNA, 15 nt, Homo sapiens
uuacuucacuuuaau

SEQ ID NO: 1770050 - RNA, 20 nt, Homo sapiens
augauuuuugucgaguuuac

SEQ ID NO: 1770051 - RNA, 22 nt, Homo sapiens
aaaauaguguaagaacuguaca

SEQ ID NO: 1770052 - RNA, 13 nt, Homo sapiens
uuuuccucucuca

SEQ ID NO: 1770053 - RNA, 23 nt, Homo sapiens
cugaccccucuccucaagggaag

SEQ ID NO: 1770054 - RNA, 17 nt, Homo sapiens
cuuguagaccacugucc

SEQ ID NO: 1770055 - RNA, 18 nt, Homo sapiens
ugcccauggcaugucuuu

SEQ ID NO: 1770056 - RNA, 11 nt, Homo sapiens
aggucuugacu

SEQ ID NO: 1770057 - RNA, 22 nt, Homo sapiens
acagucacaugcccauucacac

SEQ ID NO: 1770058 - RNA, 18 nt, Homo sapiens
cuuucuuuuuauuuuaaa

SEQ ID NO: 1770059 - RNA, 17 nt, Homo sapiens
ccuccacgccggcucuu

SEQ ID NO: 1770060 - RNA, 13 nt, Homo sapiens
ccucaaguucaau

SEQ ID NO: 1770061 - RNA, 17 nt, Homo sapiens
ggucacccucuccagca

SEQ ID NO: 1770062 - RNA, 23 nt, Homo sapiens
uauucagauauaaaacaguuuug

SEQ ID NO: 1770063 - RNA, 15 nt, Homo sapiens
uacacagcuguuucc

SEQ ID NO: 1770064 - RNA, 23 nt, Homo sapiens
ugcacauaguagguacccaauuc

SEQ ID NO: 1770065 - RNA, 22 nt, Homo sapiens
gaaagugguucucaugaugcuu

SEQ ID NO: 1770066 - RNA, 16 nt, Homo sapiens
uugccuucacccauaa

SEQ ID NO: 1770067 - RNA, 18 nt, Homo sapiens
cagggccucugucaauug

SEQ ID NO: 1770068 - RNA, 21 nt, Homo sapiens
ugagaaaccuguaucuuucua

SEQ ID NO: 1770069 - RNA, 24 nt, Homo sapiens
acucaaauuggugaacaguguaua

SEQ ID NO: 1770070 - RNA, 14 nt, Homo sapiens
acccacuccucacu

SEQ ID NO: 1770071 - RNA, 12 nt, Homo sapiens
gaacuuaucaaa

SEQ ID NO: 1770072 - RNA, 12 nt, Homo sapiens
uccugacuuccc

SEQ ID NO: 1770073 - RNA, 22 nt, Homo sapiens
aauggacacagucuaacaaauu

SEQ ID NO: 1770074 - RNA, 12 nt, Homo sapiens
cacauuacagga

SEQ ID NO: 1770075 - RNA, 15 nt, Homo sapiens
cagcacacgucauuu

SEQ ID NO: 1770076 - RNA, 20 nt, Homo sapiens
cguccagcaagugucaucac

SEQ ID NO: 1770077 - RNA, 14 nt, Homo sapiens
gaaugccacaguga

SEQ ID NO: 1770078 - RNA, 14 nt, Homo sapiens
cuaacgccauccag

SEQ ID NO: 1770079 - RNA, 20 nt, Homo sapiens
uagugcuaaugcauuuugca

SEQ ID NO: 1770080 - RNA, 18 nt, Homo sapiens
cccuucccuguccuugcc

SEQ ID NO: 1770081 - RNA, 16 nt, Homo sapiens
caacaggcccagggag

SEQ ID NO: 1770082 - RNA, 19 nt, Homo sapiens
cuuuuugggagaaugaugu

SEQ ID NO: 1770083 - RNA, 15 nt, Homo sapiens
uaaaaucuacuuuuc

SEQ ID NO: 1770084 - RNA, 22 nt, Homo sapiens
aaauguguaauuuuguuuauau

SEQ ID NO: 1770085 - RNA, 21 nt, Homo sapiens
guuaucaaccgugacugcaag

SEQ ID NO: 1770086 - RNA, 18 nt, Homo sapiens
ugccccuggaugcacuuu

SEQ ID NO: 1770087 - RNA, 13 nt, Homo sapiens
uucauuuugccaa

SEQ ID NO: 1770088 - RNA, 20 nt, Homo sapiens
uaugaucuaugcuauauuca

SEQ ID NO: 1770089 - RNA, 22 nt, Homo sapiens
gcaccaucauuuaaugugacag

SEQ ID NO: 1770090 - RNA, 12 nt, Homo sapiens
gcagugccuugu

SEQ ID NO: 1770091 - RNA, 15 nt, Homo sapiens
cuacguaucugcuac

SEQ ID NO: 1770092 - RNA, 15 nt, Homo sapiens
uggacagauugccug

SEQ ID NO: 1770093 - RNA, 23 nt, Homo sapiens
aagaauuuaagcuguaaauuaca

SEQ ID NO: 1770094 - RNA, 14 nt, Homo sapiens
aaaugacaaaaagc

SEQ ID NO: 1770095 - RNA, 14 nt, Homo sapiens
cauuuacacauauc

SEQ ID NO: 1770096 - RNA, 21 nt, Homo sapiens
cagcgugugugccaccucauu

SEQ ID NO: 1770097 - RNA, 18 nt, Homo sapiens
uaacaaauaugcuaauuu

SEQ ID NO: 1770098 - RNA, 19 nt, Homo sapiens
aacuuggauauucaagccu

SEQ ID NO: 1770099 - RNA, 16 nt, Homo sapiens
uuccaaauaacaucaa

SEQ ID NO: 1770100 - RNA, 17 nt, Homo sapiens
cagugacuuuagaaaca

SEQ ID NO: 1770101 - RNA, 19 nt, Homo sapiens
ugcuucaauuaaaauuaca

SEQ ID NO: 1770102 - RNA, 19 nt, Homo sapiens
acaccaaguaccaguauaa

SEQ ID NO: 1770103 - RNA, 15 nt, Homo sapiens
ucaucuucacugcaa

SEQ ID NO: 1770104 - RNA, 15 nt, Homo sapiens
uuugauacauauaau

SEQ ID NO: 1770105 - RNA, 22 nt, Homo sapiens
caaaucuccaguauucuuguca

SEQ ID NO: 1770106 - RNA, 21 nt, Homo sapiens
cuugguuuuuauaccauucag

SEQ ID NO: 1770107 - RNA, 14 nt, Homo sapiens
uccucuaaugaaga

SEQ ID NO: 1770108 - RNA, 17 nt, Homo sapiens
aaagcauccaaguauau

SEQ ID NO: 1770109 - RNA, 18 nt, Homo sapiens
cagggagcuuccuggcuc

SEQ ID NO: 1770110 - RNA, 23 nt, Homo sapiens
uccuuugaauuuuuuaucugcau

SEQ ID NO: 1770111 - RNA, 19 nt, Homo sapiens
gccucugaccccuccucac

SEQ ID NO: 1770112 - RNA, 12 nt, Homo sapiens
auggcaccugug

SEQ ID NO: 1770113 - RNA, 12 nt, Homo sapiens
aaagccaaaaaa

SEQ ID NO: 1770114 - RNA, 15 nt, Homo sapiens
aacagugcauauucc

SEQ ID NO: 1770115 - RNA, 20 nt, Homo sapiens
ucagggagaguuugggaacu

SEQ ID NO: 1770116 - RNA, 22 nt, Homo sapiens
aucccaguucauguugcucaga

SEQ ID NO: 1770117 - RNA, 15 nt, Homo sapiens
ccuuagucucaaggg

SEQ ID NO: 1770118 - RNA, 14 nt, Homo sapiens
uaucuucaggccau

SEQ ID NO: 1770119 - RNA, 15 nt, Homo sapiens
gagcugugugccaca

SEQ ID NO: 1770120 - RNA, 14 nt, Homo sapiens
ugauguaacugugu

SEQ ID NO: 1770121 - RNA, 13 nt, Homo sapiens
acauuuaacgaca

SEQ ID NO: 1770122 - RNA, 17 nt, Homo sapiens
aggagccucacuggggc

SEQ ID NO: 1770123 - RNA, 15 nt, Homo sapiens
auugcacuccauccu

SEQ ID NO: 1770124 - RNA, 17 nt, Homo sapiens
cccaugggauugcacag

SEQ ID NO: 1770125 - RNA, 20 nt, Homo sapiens
cucaagagacaccccuuccu

SEQ ID NO: 1770126 - RNA, 20 nt, Homo sapiens
auugcuuacaagccuaagaa

SEQ ID NO: 1770127 - RNA, 14 nt, Homo sapiens
auauaagugcugua

SEQ ID NO: 1770128 - RNA, 15 nt, Homo sapiens
gagccugggccagga

SEQ ID NO: 1770129 - RNA, 14 nt, Homo sapiens
aacuaucugaacca

SEQ ID NO: 1770130 - RNA, 16 nt, Homo sapiens
caccacagacacacac

SEQ ID NO: 1770131 - RNA, 16 nt, Homo sapiens
aguuuaaagcuuuuau

SEQ ID NO: 1770132 - RNA, 21 nt, Homo sapiens
uuugaauacaaagaaccaaga

SEQ ID NO: 1770133 - RNA, 13 nt, Homo sapiens
ggugauaggcaag

SEQ ID NO: 1770134 - RNA, 18 nt, Homo sapiens
gauuggcaggaguuggaa

SEQ ID NO: 1770135 - RNA, 12 nt, Homo sapiens
aaugacuuacag

SEQ ID NO: 1770136 - RNA, 14 nt, Homo sapiens
ccaagccacauuca

SEQ ID NO: 1770137 - RNA, 21 nt, Homo sapiens
uggcccaggcuagagugcagu

SEQ ID NO: 1770138 - RNA, 16 nt, Homo sapiens
cgggaaagccagugac

SEQ ID NO: 1770139 - RNA, 21 nt, Homo sapiens
auuccacacaaaaugucacac

SEQ ID NO: 1770140 - RNA, 14 nt, Homo sapiens
auaaaugagugauu

SEQ ID NO: 1770141 - RNA, 22 nt, Homo sapiens
accuggauugcagacucaugaa

SEQ ID NO: 1770142 - RNA, 15 nt, Homo sapiens
ccaugagcucggggu

SEQ ID NO: 1770143 - RNA, 13 nt, Homo sapiens
gccuuguuucaua

SEQ ID NO: 1770144 - RNA, 14 nt, Homo sapiens
uauucgcuugagaa

SEQ ID NO: 1770145 - RNA, 16 nt, Homo sapiens
ccaaaucuuguuauug

SEQ ID NO: 1770146 - RNA, 21 nt, Homo sapiens
gcccucucugagucuggacuu

SEQ ID NO: 1770147 - RNA, 17 nt, Homo sapiens
uaaauauguacacaagu

SEQ ID NO: 1770148 - RNA, 16 nt, Homo sapiens
gcuguugaagauuuga

SEQ ID NO: 1770149 - RNA, 16 nt, Homo sapiens
gcaucuuuagugcuuu

SEQ ID NO: 1770150 - RNA, 16 nt, Homo sapiens
aagaaaaaauaucuug

SEQ ID NO: 1770151 - RNA, 22 nt, Homo sapiens
uucacaaguaaucuguugacag

SEQ ID NO: 1770152 - RNA, 20 nt, Homo sapiens
uccccuccauaauguaagaa

SEQ ID NO: 1770153 - RNA, 13 nt, Homo sapiens
caaucacaagaag

SEQ ID NO: 1770154 - RNA, 20 nt, Homo sapiens
cuaggcaucugcuguaauaa

SEQ ID NO: 1770155 - RNA, 21 nt, Homo sapiens
ccuugauugguguugccaguu

SEQ ID NO: 1770156 - RNA, 15 nt, Homo sapiens
uggaggagacaugag

SEQ ID NO: 1770157 - RNA, 21 nt, Homo sapiens
cuguccuuuuccccuacagaa

SEQ ID NO: 1770158 - RNA, 15 nt, Homo sapiens
uaagaguucuaacca

SEQ ID NO: 1770159 - RNA, 18 nt, Homo sapiens
aaaagccuuccaguuuug

SEQ ID NO: 1770160 - RNA, 17 nt, Homo sapiens
caagugaggagugccag

SEQ ID NO: 1770161 - RNA, 21 nt, Homo sapiens
guuugcccuuuggccagugac

SEQ ID NO: 1770162 - RNA, 21 nt, Homo sapiens
uggccacaaauucuuugacac

SEQ ID NO: 1770163 - RNA, 19 nt, Homo sapiens
gucaguuguacuucugcuc

SEQ ID NO: 1770164 - RNA, 23 nt, Homo sapiens
cccugagggcugggcaugcugag

SEQ ID NO: 1770165 - RNA, 12 nt, Homo sapiens
uccacaacacac

SEQ ID NO: 1770166 - RNA, 22 nt, Homo sapiens
acauuaguaucccacuagccca

SEQ ID NO: 1770167 - RNA, 14 nt, Homo sapiens
ugacagaacacugu

SEQ ID NO: 1770168 - RNA, 19 nt, Homo sapiens
uaacaucaacaacacagca

SEQ ID NO: 1770169 - RNA, 19 nt, Homo sapiens
aaaggaaaacucaccauuu

SEQ ID NO: 1770170 - RNA, 18 nt, Homo sapiens
ccaguaagccacugccac

SEQ ID NO: 1770171 - RNA, 21 nt, Homo sapiens
gcaaaccuuccugggaggaca

SEQ ID NO: 1770172 - RNA, 14 nt, Homo sapiens
caucuccucuguaa

SEQ ID NO: 1770173 - RNA, 21 nt, Homo sapiens
uuagcauguaugacaagacaa

SEQ ID NO: 1770174 - RNA, 18 nt, Homo sapiens
uucucugccuucuuccag

SEQ ID NO: 1770175 - RNA, 16 nt, Homo sapiens
auaaaaacccaauuca

SEQ ID NO: 1770176 - RNA, 23 nt, Homo sapiens
cgcagcucccaggcccuggagac

SEQ ID NO: 1770177 - RNA, 17 nt, Homo sapiens
cccagccuggaugccau

SEQ ID NO: 1770178 - RNA, 17 nt, Homo sapiens
agccuuugccagccauu

SEQ ID NO: 1770179 - RNA, 20 nt, Homo sapiens
augugaauuauuuccugcuu

SEQ ID NO: 1770180 - RNA, 19 nt, Homo sapiens
uugaagucagccacacugg

SEQ ID NO: 1770181 - RNA, 13 nt, Homo sapiens
cacaauacaguau

SEQ ID NO: 1770182 - RNA, 19 nt, Homo sapiens
agacggauccacaguaauc

SEQ ID NO: 1770183 - RNA, 18 nt, Homo sapiens
ccugaaauuuauucacau

SEQ ID NO: 1770184 - RNA, 17 nt, Homo sapiens
agaggcuacucuugacu

SEQ ID NO: 1770185 - RNA, 11 nt, Homo sapiens
gggacucuccu

SEQ ID NO: 1770186 - RNA, 22 nt, Homo sapiens
accuagcugugcccccucuggu

SEQ ID NO: 1770187 - RNA, 19 nt, Homo sapiens
aauuuggcuucuguuguca

SEQ ID NO: 1770188 - RNA, 21 nt, Homo sapiens
uugccuagacagcuuuucuca

SEQ ID NO: 1770189 - RNA, 19 nt, Homo sapiens
auuuuagaaucaguguguu

SEQ ID NO: 1770190 - RNA, 21 nt, Homo sapiens
aaugacaaaaaguguccauaa

SEQ ID NO: 1770191 - RNA, 22 nt, Homo sapiens
gacaaugauaugcaagugcaaa

SEQ ID NO: 1770192 - RNA, 15 nt, Homo sapiens
ucucugcccauuccc

SEQ ID NO: 1770193 - RNA, 19 nt, Homo sapiens
auuguuguaaaauguaaag

SEQ ID NO: 1770194 - RNA, 17 nt, Homo sapiens
gagcccccaacacaggc

SEQ ID NO: 1770195 - RNA, 18 nt, Homo sapiens
uaaucccaauuuccccug

SEQ ID NO: 1770196 - RNA, 17 nt, Homo sapiens
caaccucucuacuagca

SEQ ID NO: 1770197 - RNA, 21 nt, Homo sapiens
uccaacuccuuucagccacau

SEQ ID NO: 1770198 - RNA, 15 nt, Homo sapiens
uacacauuucacugu

SEQ ID NO: 1770199 - RNA, 20 nt, Homo sapiens
ucaaaguguuuaauuguaua

SEQ ID NO: 1770200 - RNA, 16 nt, Homo sapiens
auguacaaauuauaca

SEQ ID NO: 1770201 - RNA, 16 nt, Homo sapiens
uaaaaacaaggucugc

SEQ ID NO: 1770202 - RNA, 15 nt, Homo sapiens
gcuguauugauauca

SEQ ID NO: 1770203 - RNA, 14 nt, Homo sapiens
agccccuuggaugu

SEQ ID NO: 1770204 - RNA, 14 nt, Homo sapiens
auguguuccuccau

SEQ ID NO: 1770205 - RNA, 18 nt, Homo sapiens
uuuuaugauuugucucug

SEQ ID NO: 1770206 - RNA, 22 nt, Homo sapiens
uaaaugucuuguuucccagauu

SEQ ID NO: 1770207 - RNA, 21 nt, Homo sapiens
aagcccaggagccucacuggg

SEQ ID NO: 1770208 - RNA, 22 nt, Homo sapiens
cccccuggugggacaacaaaga

SEQ ID NO: 1770209 - RNA, 19 nt, Homo sapiens
cuggcuuuuaagccaauau

SEQ ID NO: 1770210 - RNA, 15 nt, Homo sapiens
auaaacauccuucaa

SEQ ID NO: 1770211 - RNA, 15 nt, Homo sapiens
ccagggcuaguauaa

SEQ ID NO: 1770212 - RNA, 17 nt, Homo sapiens
auagauuugaccuccuc

SEQ ID NO: 1770213 - RNA, 17 nt, Homo sapiens
aggaaaugugcacaaaa

SEQ ID NO: 1770214 - RNA, 13 nt, Homo sapiens
ucagaaaugacuu

SEQ ID NO: 1770215 - RNA, 21 nt, Homo sapiens
agcuagaagugggccaggaca

SEQ ID NO: 1770216 - RNA, 17 nt, Homo sapiens
uucucugagaucaugag

SEQ ID NO: 1770217 - RNA, 16 nt, Homo sapiens
acaggaccccagcucu

SEQ ID NO: 1770218 - RNA, 12 nt, Homo sapiens
auaauagucaau

SEQ ID NO: 1770219 - RNA, 22 nt, Homo sapiens
gcacuucacagagugugcugga

SEQ ID NO: 1770220 - RNA, 16 nt, Homo sapiens
aagauaucagcccaaa

SEQ ID NO: 1770221 - RNA, 19 nt, Homo sapiens
ugacaacaacuaucaccaa

SEQ ID NO: 1770222 - RNA, 21 nt, Homo sapiens
uggcugaugaugucuucuggu

SEQ ID NO: 1770223 - RNA, 14 nt, Homo sapiens
agccugcagcuuuc

SEQ ID NO: 1770224 - RNA, 20 nt, Homo sapiens
uagcuuggagggauggagag

SEQ ID NO: 1770225 - RNA, 20 nt, Homo sapiens
uaaauuuaauuaauuaauuc

SEQ ID NO: 1770226 - RNA, 15 nt, Homo sapiens
ccuuaagaaagcuau

SEQ ID NO: 1770227 - RNA, 18 nt, Homo sapiens
caaaucaaauacauacaa

SEQ ID NO: 1770228 - RNA, 16 nt, Homo sapiens
ugcaagggacugugug

SEQ ID NO: 1770229 - RNA, 19 nt, Homo sapiens
caaagaguuuucugugcaa

SEQ ID NO: 1770230 - RNA, 21 nt, Homo sapiens
uaacauuuuuauaaagauaua

SEQ ID NO: 1770231 - RNA, 14 nt, Homo sapiens
auguauaugucauc

SEQ ID NO: 1770232 - RNA, 17 nt, Homo sapiens
acccaugagugcuaaga

SEQ ID NO: 1770233 - RNA, 17 nt, Homo sapiens
gacuucccagggcaaga

SEQ ID NO: 1770234 - RNA, 17 nt, Homo sapiens
cauccaagccagaguuu

SEQ ID NO: 1770235 - RNA, 18 nt, Homo sapiens
ucuguggucccuuccaau

SEQ ID NO: 1770236 - RNA, 23 nt, Homo sapiens
cacagugguucguuuaccaaaua

SEQ ID NO: 1770237 - RNA, 22 nt, Homo sapiens
aaaaagggacaagcauguugau

SEQ ID NO: 1770238 - RNA, 18 nt, Homo sapiens
aaguuugccccagugcua

SEQ ID NO: 1770239 - RNA, 21 nt, Homo sapiens
agcaaauggccucaugucaaa

SEQ ID NO: 1770240 - RNA, 18 nt, Homo sapiens
agcaaugagaaggccagg

SEQ ID NO: 1770241 - RNA, 15 nt, Homo sapiens
uuccuuaucugucac

SEQ ID NO: 1770242 - RNA, 15 nt, Homo sapiens
ccaggaccaagccac

SEQ ID NO: 1770243 - RNA, 15 nt, Homo sapiens
cacacagaugucuua

SEQ ID NO: 1770244 - RNA, 18 nt, Homo sapiens
uccaucccgcccuuccca

SEQ ID NO: 1770245 - RNA, 14 nt, Homo sapiens
gucuaugaauauga

SEQ ID NO: 1770246 - RNA, 17 nt, Homo sapiens
ggaagccggcggcccaa

SEQ ID NO: 1770247 - RNA, 19 nt, Homo sapiens
ugaggcccuccacaccugc

SEQ ID NO: 1770248 - RNA, 13 nt, Homo sapiens
agaauguuacagu

SEQ ID NO: 1770249 - RNA, 19 nt, Homo sapiens
ggaugccacagcccagcuu

SEQ ID NO: 1770250 - RNA, 23 nt, Homo sapiens
acagucacgcaagcuaguuccca

SEQ ID NO: 1770251 - RNA, 13 nt, Homo sapiens
agccuaacauugg

SEQ ID NO: 1770252 - RNA, 19 nt, Homo sapiens
aguguccuuuccagagcaa

SEQ ID NO: 1770253 - RNA, 18 nt, Homo sapiens
agcuauaacaacucuauu

SEQ ID NO: 1770254 - RNA, 23 nt, Homo sapiens
ggaaaauguucugacagcauuuc

SEQ ID NO: 1770255 - RNA, 18 nt, Homo sapiens
aucacacuacacaucaca

SEQ ID NO: 1770256 - RNA, 18 nt, Homo sapiens
cagugucaggcacugggc

SEQ ID NO: 1770257 - RNA, 15 nt, Homo sapiens
cauccaaacauguau

SEQ ID NO: 1770258 - RNA, 23 nt, Homo sapiens
cagguuggaacuaugcagugugc

SEQ ID NO: 1770259 - RNA, 14 nt, Homo sapiens
ucggccccaucucu

SEQ ID NO: 1770260 - RNA, 12 nt, Homo sapiens
cuugagaccaag

SEQ ID NO: 1770261 - RNA, 21 nt, Homo sapiens
acuaaguccucagagcuccau

SEQ ID NO: 1770262 - RNA, 13 nt, Homo sapiens
acauguaaagcug

SEQ ID NO: 1770263 - RNA, 14 nt, Homo sapiens
ggugugguggcaug

SEQ ID NO: 1770264 - RNA, 17 nt, Homo sapiens
cagauccucaagcagac

SEQ ID NO: 1770265 - RNA, 20 nt, Homo sapiens
uaacuuauuuuaaauaugcc

SEQ ID NO: 1770266 - RNA, 20 nt, Homo sapiens
agaucgauccuggauucacu

SEQ ID NO: 1770267 - RNA, 21 nt, Homo sapiens
ccuucugguguuggacaagcu

SEQ ID NO: 1770268 - RNA, 12 nt, Homo sapiens
gagggcugguug

SEQ ID NO: 1770269 - RNA, 14 nt, Homo sapiens
cuugcgcauucuca

SEQ ID NO: 1770270 - RNA, 14 nt, Homo sapiens
acuaaaguuuuaca

SEQ ID NO: 1770271 - RNA, 20 nt, Homo sapiens
aaucauguuugucaauggaa

SEQ ID NO: 1770272 - RNA, 23 nt, Homo sapiens
aaacuggaguaucauucuuuaca

SEQ ID NO: 1770273 - RNA, 21 nt, Homo sapiens
agcuuccucuaaacuucucac

SEQ ID NO: 1770274 - RNA, 20 nt, Homo sapiens
acagagucuuccucugucuc

SEQ ID NO: 1770275 - RNA, 20 nt, Homo sapiens
accuaagaaauagcaucgau

SEQ ID NO: 1770276 - RNA, 13 nt, Homo sapiens
auuuucagccaaa

SEQ ID NO: 1770277 - RNA, 15 nt, Homo sapiens
aggggucaaugucau

SEQ ID NO: 1770278 - RNA, 19 nt, Homo sapiens
gauugcgugacccuaugac

SEQ ID NO: 1770279 - RNA, 15 nt, Homo sapiens
cugucauacuuuguu

SEQ ID NO: 1770280 - RNA, 14 nt, Homo sapiens
agacaguauauaac

SEQ ID NO: 1770281 - RNA, 22 nt, Homo sapiens
ugcaucccgagcaacccucuga

SEQ ID NO: 1770282 - RNA, 20 nt, Homo sapiens
gugagaacucugcccaggug

SEQ ID NO: 1770283 - RNA, 21 nt, Homo sapiens
aaugcaccucuuguuacuccc

SEQ ID NO: 1770284 - RNA, 23 nt, Homo sapiens
ugcuaggggagagcucuccuuag

SEQ ID NO: 1770285 - RNA, 15 nt, Homo sapiens
acaugccagugacac

SEQ ID NO: 1770286 - RNA, 20 nt, Homo sapiens
cccaucgucucggccuucac

SEQ ID NO: 1770287 - RNA, 22 nt, Homo sapiens
cugagaccacaguuuaccucag

SEQ ID NO: 1770288 - RNA, 15 nt, Homo sapiens
gaccagugaccaaac

SEQ ID NO: 1770289 - RNA, 19 nt, Homo sapiens
caugaggacucuauucuuu

SEQ ID NO: 1770290 - RNA, 12 nt, Homo sapiens
aggagcaucucc

SEQ ID NO: 1770291 - RNA, 15 nt, Homo sapiens
cagcaaaacuuucca

SEQ ID NO: 1770292 - RNA, 13 nt, Homo sapiens
uguucaagcuuuu

SEQ ID NO: 1770293 - RNA, 21 nt, Homo sapiens
gcugaggggaggaucacugga

SEQ ID NO: 1770294 - RNA, 15 nt, Homo sapiens
guaaagagaugucaa

SEQ ID NO: 1770295 - RNA, 21 nt, Homo sapiens
caguauuuuuuccacuacaca

SEQ ID NO: 1770296 - RNA, 18 nt, Homo sapiens
cauagacuuuaugcaaua

SEQ ID NO: 1770297 - RNA, 13 nt, Homo sapiens
ucaugaaccucaa

SEQ ID NO: 1770298 - RNA, 17 nt, Homo sapiens
caacugaaagaaaaagu

SEQ ID NO: 1770299 - RNA, 15 nt, Homo sapiens
aagcacuugaugcca

SEQ ID NO: 1770300 - RNA, 17 nt, Homo sapiens
uagccagauaguagaac

SEQ ID NO: 1770301 - RNA, 15 nt, Homo sapiens
ugguuggucaaauca

SEQ ID NO: 1770302 - RNA, 13 nt, Homo sapiens
ucacugcaguagu

SEQ ID NO: 1770303 - RNA, 19 nt, Homo sapiens
cuguaagcccagcauuuga

SEQ ID NO: 1770304 - RNA, 23 nt, Homo sapiens
cugugcucugaaugggagccaga

SEQ ID NO: 1770305 - RNA, 15 nt, Homo sapiens
aauuucacugaugua

SEQ ID NO: 1770306 - RNA, 20 nt, Homo sapiens
acagauggggucugugacug

SEQ ID NO: 1770307 - RNA, 19 nt, Homo sapiens
uuggccuagcccacccugc

SEQ ID NO: 1770308 - RNA, 18 nt, Homo sapiens
acauaacauuguaugcau

SEQ ID NO: 1770309 - RNA, 19 nt, Homo sapiens
cucaagauccugucuugcu

SEQ ID NO: 1770310 - RNA, 20 nt, Homo sapiens
cggacucaccaacuugccac

SEQ ID NO: 1770311 - RNA, 20 nt, Homo sapiens
uuccugcuuauucauaauaa

SEQ ID NO: 1770312 - RNA, 21 nt, Homo sapiens
auggacgaccuccagcucuca

SEQ ID NO: 1770313 - RNA, 19 nt, Homo sapiens
uuucaugacagaauauaca

SEQ ID NO: 1770314 - RNA, 23 nt, Homo sapiens
aaagcaguauauaauaacuuuau

SEQ ID NO: 1770315 - RNA, 15 nt, Homo sapiens
gcacuguucacauca

SEQ ID NO: 1770316 - RNA, 19 nt, Homo sapiens
acuacucagcucuccugcu

SEQ ID NO: 1770317 - RNA, 23 nt, Homo sapiens
gaggagccuggagagaaggggca

SEQ ID NO: 1770318 - RNA, 15 nt, Homo sapiens
uaaggugugcaauuu

SEQ ID NO: 1770319 - RNA, 23 nt, Homo sapiens
gcuucaucaauuuuuauacauau

SEQ ID NO: 1770320 - RNA, 11 nt, Homo sapiens
aauucugggaa

SEQ ID NO: 1770321 - RNA, 20 nt, Homo sapiens
cuaugaaaaugagcaucaga

SEQ ID NO: 1770322 - RNA, 14 nt, Homo sapiens
uuauauuaccaaug

SEQ ID NO: 1770323 - RNA, 15 nt, Homo sapiens
cucaaaacacuuucc

SEQ ID NO: 1770324 - RNA, 17 nt, Homo sapiens
ucagaggccaucugauu

SEQ ID NO: 1770325 - RNA, 19 nt, Homo sapiens
gacaaccaaaacauauuca

SEQ ID NO: 1770326 - RNA, 12 nt, Homo sapiens
gaccucuccucu

SEQ ID NO: 1770327 - RNA, 16 nt, Homo sapiens
cucccucucacugucu

SEQ ID NO: 1770328 - RNA, 20 nt, Homo sapiens
cauucccuucgacagcauuu

SEQ ID NO: 1770329 - RNA, 14 nt, Homo sapiens
ccccaccuggcuca

SEQ ID NO: 1770330 - RNA, 20 nt, Homo sapiens
acuuagguaaucauuccagg

SEQ ID NO: 1770331 - RNA, 21 nt, Homo sapiens
ugcuggcccacagcucugcug

SEQ ID NO: 1770332 - RNA, 13 nt, Homo sapiens
ugugcaacacuca

SEQ ID NO: 1770333 - RNA, 17 nt, Homo sapiens
guacacccaguugccaa

SEQ ID NO: 1770334 - RNA, 14 nt, Homo sapiens
cuucuuugaaguua

SEQ ID NO: 1770335 - RNA, 13 nt, Homo sapiens
gaaauacugagau

SEQ ID NO: 1770336 - RNA, 15 nt, Homo sapiens
cuaaaaagagacugu

SEQ ID NO: 1770337 - RNA, 18 nt, Homo sapiens
gucuccccgaaagggaca

SEQ ID NO: 1770338 - RNA, 16 nt, Homo sapiens
cuguaaacuuccaagc

SEQ ID NO: 1770339 - RNA, 11 nt, Homo sapiens
uaaauugugaa

SEQ ID NO: 1770340 - RNA, 11 nt, Homo sapiens
uagauugugag

SEQ ID NO: 1770341 - RNA, 15 nt, Homo sapiens
cacaagucuuuccag

SEQ ID NO: 1770342 - RNA, 18 nt, Homo sapiens
auaaaggcucugugcuug

SEQ ID NO: 1770343 - RNA, 18 nt, Homo sapiens
auaagaaagaucaaagac

SEQ ID NO: 1770344 - RNA, 16 nt, Homo sapiens
guuagucucugaacua

SEQ ID NO: 1770345 - RNA, 14 nt, Homo sapiens
uaaugccucugguc

SEQ ID NO: 1770346 - RNA, 18 nt, Homo sapiens
aucacuucccuacaugga

SEQ ID NO: 1770347 - RNA, 14 nt, Homo sapiens
gcccacuacgugcc

SEQ ID NO: 1770348 - RNA, 22 nt, Homo sapiens
agugagccugaauuuuguugcu

SEQ ID NO: 1770349 - RNA, 16 nt, Homo sapiens
acucugcuccaaagua

SEQ ID NO: 1770350 - RNA, 21 nt, Homo sapiens
agcugcugaaauccacaauaa

SEQ ID NO: 1770351 - RNA, 17 nt, Homo sapiens
uaaaaucaaaugugcau

SEQ ID NO: 1770352 - RNA, 21 nt, Homo sapiens
ugggggacugggagucagagc

SEQ ID NO: 1770353 - RNA, 20 nt, Homo sapiens
caggacuuggaaguggggac

SEQ ID NO: 1770354 - RNA, 23 nt, Homo sapiens
cuuugcagaaugaugcagguuca

SEQ ID NO: 1770355 - RNA, 19 nt, Homo sapiens
ucuuuguucuccuaaugcu

SEQ ID NO: 1770356 - RNA, 17 nt, Homo sapiens
ccaugaauuaguucucc

SEQ ID NO: 1770357 - RNA, 15 nt, Homo sapiens
aguagaauuaccauu

SEQ ID NO: 1770358 - RNA, 18 nt, Homo sapiens
augaccucguacucagga

SEQ ID NO: 1770359 - RNA, 22 nt, Homo sapiens
guguagcucuguccacucugaa

SEQ ID NO: 1770360 - RNA, 23 nt, Homo sapiens
uggggagcgccggauuugcuccc

SEQ ID NO: 1770361 - RNA, 19 nt, Homo sapiens
caacuccccauuggugcua

SEQ ID NO: 1770362 - RNA, 18 nt, Homo sapiens
ucuccccucagagugcaa

SEQ ID NO: 1770363 - RNA, 19 nt, Homo sapiens
aggaguucauagaagggag

SEQ ID NO: 1770364 - RNA, 19 nt, Homo sapiens
uuucccaucagacugucaa

SEQ ID NO: 1770365 - RNA, 14 nt, Homo sapiens
gccuuccucugcag

SEQ ID NO: 1770366 - RNA, 17 nt, Homo sapiens
uugaugacccucugacc

SEQ ID NO: 1770367 - RNA, 19 nt, Homo sapiens
ccugaaucaaggaaagcca

SEQ ID NO: 1770368 - RNA, 13 nt, Homo sapiens
uggccaucauuuc

SEQ ID NO: 1770369 - RNA, 21 nt, Homo sapiens
uguuugaagaaaaaggacaaa

SEQ ID NO: 1770370 - RNA, 22 nt, Homo sapiens
uaaaaugagaucguuguuuaca

SEQ ID NO: 1770371 - RNA, 21 nt, Homo sapiens
auuuuagcaaagauaucucau

SEQ ID NO: 1770372 - RNA, 23 nt, Homo sapiens
uccaaccugaagguccccuggca

SEQ ID NO: 1770373 - RNA, 22 nt, Homo sapiens
ccucucagaugggcagcagcuu

SEQ ID NO: 1770374 - RNA, 16 nt, Homo sapiens
ccagaguagagccagg

SEQ ID NO: 1770375 - RNA, 14 nt, Homo sapiens
cccgggaagccacc

SEQ ID NO: 1770376 - RNA, 15 nt, Homo sapiens
uaacuagcugagcac

SEQ ID NO: 1770377 - RNA, 22 nt, Homo sapiens
auguuauacaaccuucauuuaa

SEQ ID NO: 1770378 - RNA, 15 nt, Homo sapiens
uuuauaaaggccaaa

SEQ ID NO: 1770379 - RNA, 15 nt, Homo sapiens
cucaggggggugguu

SEQ ID NO: 1770380 - RNA, 16 nt, Homo sapiens
acuugccuugugauau

SEQ ID NO: 1770381 - RNA, 21 nt, Homo sapiens
aaaaaacaguucaacugcuua

SEQ ID NO: 1770382 - RNA, 13 nt, Homo sapiens
uggugguauucag

SEQ ID NO: 1770383 - RNA, 18 nt, Homo sapiens
acuggucacauugaaggu

SEQ ID NO: 1770384 - RNA, 23 nt, Homo sapiens
uccccagagcuuuacagugccac

SEQ ID NO: 1770385 - RNA, 19 nt, Homo sapiens
gccacccucccagcucuga

SEQ ID NO: 1770386 - RNA, 16 nt, Homo sapiens
gaagggaccccagaua

SEQ ID NO: 1770387 - RNA, 18 nt, Homo sapiens
uuuuaagcuauauaggaa

SEQ ID NO: 1770388 - RNA, 18 nt, Homo sapiens
ugggcaacauaccaagac

SEQ ID NO: 1770389 - RNA, 23 nt, Homo sapiens
gaguaguaaucucacacuucauc

SEQ ID NO: 1770390 - RNA, 16 nt, Homo sapiens
gcugacaggugaugcu

SEQ ID NO: 1770391 - RNA, 23 nt, Homo sapiens
aaaaugucuaagauaguaacaau

SEQ ID NO: 1770392 - RNA, 16 nt, Homo sapiens
gucccagcagccagcc

SEQ ID NO: 1770393 - RNA, 16 nt, Homo sapiens
ugaaaaagauggaaug

SEQ ID NO: 1770394 - RNA, 23 nt, Homo sapiens
ugaacucccgaccucaagugauc

SEQ ID NO: 1770395 - RNA, 17 nt, Homo sapiens
ugcacacacacagagau

SEQ ID NO: 1770396 - RNA, 16 nt, Homo sapiens
aucaugcuguucucuu

SEQ ID NO: 1770397 - RNA, 23 nt, Homo sapiens
uggauguauggggaaucuaagag

SEQ ID NO: 1770398 - RNA, 16 nt, Homo sapiens
gacccuagaugugcuc

SEQ ID NO: 1770399 - RNA, 15 nt, Homo sapiens
gauaucuuugcugcu

SEQ ID NO: 1770400 - RNA, 15 nt, Homo sapiens
cucaacaaccugaau

SEQ ID NO: 1770401 - RNA, 21 nt, Homo sapiens
cuaucauuguuggacauuugg

SEQ ID NO: 1770402 - RNA, 22 nt, Homo sapiens
caagcagaacuagguagaaaca

SEQ ID NO: 1770403 - RNA, 16 nt, Homo sapiens
acugacacaggccagc

SEQ ID NO: 1770404 - RNA, 13 nt, Homo sapiens
aaagcucacuuca

SEQ ID NO: 1770405 - RNA, 17 nt, Homo sapiens
auggcacugacaauggg

SEQ ID NO: 1770406 - RNA, 22 nt, Homo sapiens
cacugcugcuucauguuugccu

SEQ ID NO: 1770407 - RNA, 14 nt, Homo sapiens
gauacagaaaugca

SEQ ID NO: 1770408 - RNA, 18 nt, Homo sapiens
aggugggauuacaggugc

SEQ ID NO: 1770409 - RNA, 21 nt, Homo sapiens
ucaccaaaagacacugcagaa

SEQ ID NO: 1770410 - RNA, 20 nt, Homo sapiens
uugcauaguaccaaucauuu

SEQ ID NO: 1770411 - RNA, 14 nt, Homo sapiens
ucucagagccucag

SEQ ID NO: 1770412 - RNA, 13 nt, Homo sapiens
uacaauguacaau

SEQ ID NO: 1770413 - RNA, 12 nt, Homo sapiens
ucucucagaaau

SEQ ID NO: 1770414 - RNA, 21 nt, Homo sapiens
acagguaacauuauaaaugac

SEQ ID NO: 1770415 - RNA, 16 nt, Homo sapiens
aaagauauuguaucuc

SEQ ID NO: 1770416 - RNA, 13 nt, Homo sapiens
gcucugugccuug

SEQ ID NO: 1770417 - RNA, 13 nt, Homo sapiens
cagugguggagcu

SEQ ID NO: 1770418 - RNA, 18 nt, Homo sapiens
acauuggagccugggcau

SEQ ID NO: 1770419 - RNA, 19 nt, Homo sapiens
uacaugugagauaguuuuc

SEQ ID NO: 1770420 - RNA, 20 nt, Homo sapiens
agcugccugcuuuucacugc

SEQ ID NO: 1770421 - RNA, 23 nt, Homo sapiens
uccgaaaaauccucuuccucuga

SEQ ID NO: 1770422 - RNA, 15 nt, Homo sapiens
aguggaucacacaca

SEQ ID NO: 1770423 - RNA, 21 nt, Homo sapiens
caaggccccaccuucuaucua

SEQ ID NO: 1770424 - RNA, 16 nt, Homo sapiens
acuccaugguucucaa

SEQ ID NO: 1770425 - RNA, 15 nt, Homo sapiens
ggccugugauguuuu

SEQ ID NO: 1770426 - RNA, 15 nt, Homo sapiens
cauccauaaagaagc

SEQ ID NO: 1770427 - RNA, 19 nt, Homo sapiens
uuccaaacacauacaggaa

SEQ ID NO: 1770428 - RNA, 13 nt, Homo sapiens
gauuuccuuucag

SEQ ID NO: 1770429 - RNA, 14 nt, Homo sapiens
cucacuucuuccau

SEQ ID NO: 1770430 - RNA, 20 nt, Homo sapiens
ucuaguacuucccaggcaaa

SEQ ID NO: 1770431 - RNA, 22 nt, Homo sapiens
gcaaaaggaucuuuguggccaa

SEQ ID NO: 1770432 - RNA, 20 nt, Homo sapiens
ccaaagugcuggaaccacag

SEQ ID NO: 1770433 - RNA, 14 nt, Homo sapiens
agcuuaaauugcuu

SEQ ID NO: 1770434 - RNA, 17 nt, Homo sapiens
cacuucauguaaagugu

SEQ ID NO: 1770435 - RNA, 17 nt, Homo sapiens
gccaggaaguacuucca

SEQ ID NO: 1770436 - RNA, 13 nt, Homo sapiens
gccuguuaauauu

SEQ ID NO: 1770437 - RNA, 17 nt, Homo sapiens
aaaaucuugugcuagaa

SEQ ID NO: 1770438 - RNA, 20 nt, Homo sapiens
caaauggagaaguucaggaa

SEQ ID NO: 1770439 - RNA, 16 nt, Homo sapiens
guaacauuaguuuuaa

SEQ ID NO: 1770440 - RNA, 22 nt, Homo sapiens
uaugaguguaguugaugacugu

SEQ ID NO: 1770441 - RNA, 11 nt, Homo sapiens
caucauucccc

SEQ ID NO: 1770442 - RNA, 20 nt, Homo sapiens
uacccuguacauaucuuuga

SEQ ID NO: 1770443 - RNA, 15 nt, Homo sapiens
acagaaauauccaug

SEQ ID NO: 1770444 - RNA, 22 nt, Homo sapiens
aaggcugaugucuuaacuguca

SEQ ID NO: 1770445 - RNA, 14 nt, Homo sapiens
ugggugaagacaga

SEQ ID NO: 1770446 - RNA, 19 nt, Homo sapiens
cuggguaacugucaaguca

SEQ ID NO: 1770447 - RNA, 18 nt, Homo sapiens
agaucuuggcccuguuaa

SEQ ID NO: 1770448 - RNA, 13 nt, Homo sapiens
gagaccccaaaaa

SEQ ID NO: 1770449 - RNA, 20 nt, Homo sapiens
cagagggagacuccaucuca

SEQ ID NO: 1770450 - RNA, 19 nt, Homo sapiens
gaaaguucaacuuccaaag

SEQ ID NO: 1770451 - RNA, 16 nt, Homo sapiens
gcuuuaucaauagccc

SEQ ID NO: 1770452 - RNA, 17 nt, Homo sapiens
aaauaaauucagaucaa

SEQ ID NO: 1770453 - RNA, 16 nt, Homo sapiens
auaggccaucuguaaa

SEQ ID NO: 1770454 - RNA, 18 nt, Homo sapiens
uuaauuguuuugcacuuu

SEQ ID NO: 1770455 - RNA, 17 nt, Homo sapiens
auagaaacuugcuuauc

SEQ ID NO: 1770456 - RNA, 23 nt, Homo sapiens
caucuuuccuucggguuggcaaa

SEQ ID NO: 1770457 - RNA, 17 nt, Homo sapiens
ucauucuucuaaaacua

SEQ ID NO: 1770458 - RNA, 23 nt, Homo sapiens
uacucccaucugugaaaggaaag

SEQ ID NO: 1770459 - RNA, 16 nt, Homo sapiens
gauguuuaaucaagag

SEQ ID NO: 1770460 - RNA, 21 nt, Homo sapiens
cuccccuguuucaaucacugu

SEQ ID NO: 1770461 - RNA, 19 nt, Homo sapiens
ccuuuaggccaucucagcu

SEQ ID NO: 1770462 - RNA, 18 nt, Homo sapiens
auaauaaaaguuauuacc

SEQ ID NO: 1770463 - RNA, 18 nt, Homo sapiens
acuuuaugugcaucuuau

SEQ ID NO: 1770464 - RNA, 19 nt, Homo sapiens
uuugaagcugcagugagcu

SEQ ID NO: 1770465 - RNA, 19 nt, Homo sapiens
aguaaauguguuucuugcu

SEQ ID NO: 1770466 - RNA, 16 nt, Homo sapiens
aaauucaaugcuugau

SEQ ID NO: 1770467 - RNA, 17 nt, Homo sapiens
gucuuccuugaccaaag

SEQ ID NO: 1770468 - RNA, 22 nt, Homo sapiens
auagcaacuccccuacaucaaa

SEQ ID NO: 1770469 - RNA, 13 nt, Homo sapiens
accucgugccacc

SEQ ID NO: 1770470 - RNA, 18 nt, Homo sapiens
guucaugaaagauucaau

SEQ ID NO: 1770471 - RNA, 13 nt, Homo sapiens
guguacacucaga

SEQ ID NO: 1770472 - RNA, 15 nt, Homo sapiens
gagacauuacuauag

SEQ ID NO: 1770473 - RNA, 17 nt, Homo sapiens
acuaugugccaguuccu

SEQ ID NO: 1770474 - RNA, 18 nt, Homo sapiens
acaugaacagaaacaaua

SEQ ID NO: 1770475 - RNA, 22 nt, Homo sapiens
gaggccaaacacccaagcacaa

SEQ ID NO: 1770476 - RNA, 21 nt, Homo sapiens
uggucaggcacugaagcuccu

SEQ ID NO: 1770477 - RNA, 20 nt, Homo sapiens
gggaccugcuucacaaguua

SEQ ID NO: 1770478 - RNA, 16 nt, Homo sapiens
ugcagaguaaguauua

SEQ ID NO: 1770479 - RNA, 16 nt, Homo sapiens
ccccucccugcuucaa

SEQ ID NO: 1770480 - RNA, 15 nt, Homo sapiens
gcggucaauuugccu

SEQ ID NO: 1770481 - RNA, 19 nt, Homo sapiens
auauaucugcuauucucca

SEQ ID NO: 1770482 - RNA, 17 nt, Homo sapiens
aaacaugaaaacauuga

SEQ ID NO: 1770483 - RNA, 19 nt, Homo sapiens
auuuuugugaaaaugucaa

SEQ ID NO: 1770484 - RNA, 19 nt, Homo sapiens
uaccauuauuaucaaguag

SEQ ID NO: 1770485 - RNA, 22 nt, Homo sapiens
gaggccuggacuuuccugcaac

SEQ ID NO: 1770486 - RNA, 14 nt, Homo sapiens
uucuuaguggguua

SEQ ID NO: 1770487 - RNA, 14 nt, Homo sapiens
aagaugaaucauuu

SEQ ID NO: 1770488 - RNA, 19 nt, Homo sapiens
acuuccguccauccauuca

SEQ ID NO: 1770489 - RNA, 17 nt, Homo sapiens
aauacaguagaagcuca

SEQ ID NO: 1770490 - RNA, 23 nt, Homo sapiens
ucucugauuccccaaaucugcau

SEQ ID NO: 1770491 - RNA, 18 nt, Homo sapiens
uuucugaagggcauacaa

SEQ ID NO: 1770492 - RNA, 14 nt, Homo sapiens
ugaguugagcucua

SEQ ID NO: 1770493 - RNA, 13 nt, Homo sapiens
uucccauggaaug

SEQ ID NO: 1770494 - RNA, 13 nt, Homo sapiens
aaguacagacuuu

SEQ ID NO: 1770495 - RNA, 12 nt, Homo sapiens
gucuguaaaauc

SEQ ID NO: 1770496 - RNA, 15 nt, Homo sapiens
cuagagggucgggga

SEQ ID NO: 1770497 - RNA, 13 nt, Homo sapiens
caguuccaaugag

SEQ ID NO: 1770498 - RNA, 18 nt, Homo sapiens
uucugggcggccagugcg

SEQ ID NO: 1770499 - RNA, 15 nt, Homo sapiens
cucccugccaccagg

SEQ ID NO: 1770500 - RNA, 19 nt, Homo sapiens
agacagauuuaaagcacau

SEQ ID NO: 1770501 - RNA, 19 nt, Homo sapiens
acuugcugaggccaagcca

SEQ ID NO: 1770502 - RNA, 15 nt, Homo sapiens
uguuaaauguauaca

SEQ ID NO: 1770503 - RNA, 13 nt, Homo sapiens
cugugaaugcuuc

SEQ ID NO: 1770504 - RNA, 16 nt, Homo sapiens
auguccccugucccac

SEQ ID NO: 1770505 - RNA, 21 nt, Homo sapiens
gaggcggaucaucuaauucuc

SEQ ID NO: 1770506 - RNA, 12 nt, Homo sapiens
uccauacuuugg

SEQ ID NO: 1770507 - RNA, 16 nt, Homo sapiens
cucuccacaaggggau

SEQ ID NO: 1770508 - RNA, 14 nt, Homo sapiens
uuggcaccagacac

SEQ ID NO: 1770509 - RNA, 24 nt, Homo sapiens
ccucugcccuccgaggccgugcag

SEQ ID NO: 1770510 - RNA, 17 nt, Homo sapiens
aucacucuauacaucuu

SEQ ID NO: 1770511 - RNA, 19 nt, Homo sapiens
gcaccuacacucaccugca

SEQ ID NO: 1770512 - RNA, 16 nt, Homo sapiens
auucuuuucuguuucu

SEQ ID NO: 1770513 - RNA, 17 nt, Homo sapiens
gucaaauguuuccuuaa

SEQ ID NO: 1770514 - RNA, 13 nt, Homo sapiens
uccagaaaccaaa

SEQ ID NO: 1770515 - RNA, 19 nt, Homo sapiens
cagccuguuggacccgcuc

SEQ ID NO: 1770516 - RNA, 15 nt, Homo sapiens
ucagagccagugaag

SEQ ID NO: 1770517 - RNA, 20 nt, Homo sapiens
ccuuugcuuuacagcacugu

SEQ ID NO: 1770518 - RNA, 20 nt, Homo sapiens
ggaauacuagcuaacuaauu

SEQ ID NO: 1770519 - RNA, 19 nt, Homo sapiens
ugaacaaucagcggcauuu

SEQ ID NO: 1770520 - RNA, 20 nt, Homo sapiens
uuauguuaaaacugggacag

SEQ ID NO: 1770521 - RNA, 18 nt, Homo sapiens
accccauguccucagcau

SEQ ID NO: 1770522 - RNA, 12 nt, Homo sapiens
caauuaaugaca

SEQ ID NO: 1770523 - RNA, 14 nt, Homo sapiens
ugccucgaaagugu

SEQ ID NO: 1770524 - RNA, 19 nt, Homo sapiens
gagccuuggcccacacuga

SEQ ID NO: 1770525 - RNA, 20 nt, Homo sapiens
gauuuuacagagaaucugaa

SEQ ID NO: 1770526 - RNA, 16 nt, Homo sapiens
aacugugacuaggcau

SEQ ID NO: 1770527 - RNA, 15 nt, Homo sapiens
cggugcuugugucac

SEQ ID NO: 1770528 - RNA, 18 nt, Homo sapiens
uaauacuugaugcaugca

SEQ ID NO: 1770529 - RNA, 15 nt, Homo sapiens
aguuuuacuccucag

SEQ ID NO: 1770530 - RNA, 14 nt, Homo sapiens
guuuacaaauggac

SEQ ID NO: 1770531 - RNA, 22 nt, Homo sapiens
cucccagaaaaacuggcucuga

SEQ ID NO: 1770532 - RNA, 18 nt, Homo sapiens
ugagguggcucaugccug

SEQ ID NO: 1770533 - RNA, 18 nt, Homo sapiens
gucagggugugaggccac

SEQ ID NO: 1770534 - RNA, 19 nt, Homo sapiens
uaugaauuaacccaaagaa

SEQ ID NO: 1770535 - RNA, 16 nt, Homo sapiens
ugugguacaaucucaa

SEQ ID NO: 1770536 - RNA, 12 nt, Homo sapiens
ccuccaagcaca

SEQ ID NO: 1770537 - RNA, 13 nt, Homo sapiens
aguucugaauaug

SEQ ID NO: 1770538 - RNA, 15 nt, Homo sapiens
ccccuccuugcaacc

SEQ ID NO: 1770539 - RNA, 21 nt, Homo sapiens
caauuuguagacucuugcucc

SEQ ID NO: 1770540 - RNA, 12 nt, Homo sapiens
uuuaauaggacu

SEQ ID NO: 1770541 - RNA, 22 nt, Homo sapiens
guuauuugaaaauuugauuuug

SEQ ID NO: 1770542 - RNA, 18 nt, Homo sapiens
uuaaaugcauguccucaa

SEQ ID NO: 1770543 - RNA, 18 nt, Homo sapiens
aaucacaacgggccagcu

SEQ ID NO: 1770544 - RNA, 16 nt, Homo sapiens
auaauuggcaugucuc

SEQ ID NO: 1770545 - RNA, 14 nt, Homo sapiens
agaugaguccuguu

SEQ ID NO: 1770546 - RNA, 22 nt, Homo sapiens
uagaggguacuugaaucuucag

SEQ ID NO: 1770547 - RNA, 22 nt, Homo sapiens
aagagaugggccuuuucuugaa

SEQ ID NO: 1770548 - RNA, 18 nt, Homo sapiens
auggagccagcucugcau

SEQ ID NO: 1770549 - RNA, 19 nt, Homo sapiens
ugccccaccccaccucaca

SEQ ID NO: 1770550 - RNA, 23 nt, Homo sapiens
gaugauauggagguucaaugaga

SEQ ID NO: 1770551 - RNA, 15 nt, Homo sapiens
caaaaagaagacauu

SEQ ID NO: 1770552 - RNA, 17 nt, Homo sapiens
aguuagaacuagccaaa

SEQ ID NO: 1770553 - RNA, 15 nt, Homo sapiens
aaacccuaucuguga

SEQ ID NO: 1770554 - RNA, 14 nt, Homo sapiens
gaaacuaacacagc

SEQ ID NO: 1770555 - RNA, 12 nt, Homo sapiens
acuuaacagguu

SEQ ID NO: 1770556 - RNA, 19 nt, Homo sapiens
aacaaaccagaaucccucu

SEQ ID NO: 1770557 - RNA, 23 nt, Homo sapiens
acugcaguuagagcugagcacuu

SEQ ID NO: 1770558 - RNA, 19 nt, Homo sapiens
uaaagagagaugaaccaca

SEQ ID NO: 1770559 - RNA, 13 nt, Homo sapiens
aaagaaaacauuc

SEQ ID NO: 1770560 - RNA, 15 nt, Homo sapiens
guuuggaagcacuga

SEQ ID NO: 1770561 - RNA, 11 nt, Homo sapiens
uaaaaugcacc

SEQ ID NO: 1770562 - RNA, 17 nt, Homo sapiens
ugaucacucuuagacca

SEQ ID NO: 1770563 - RNA, 20 nt, Homo sapiens
ugagaggagaacaguaggau

SEQ ID NO: 1770564 - RNA, 13 nt, Homo sapiens
agcugucuaugca

SEQ ID NO: 1770565 - RNA, 21 nt, Homo sapiens
uuuaucucugaggcauggugu

SEQ ID NO: 1770566 - RNA, 22 nt, Homo sapiens
uuggcccaucccgccuucucca

SEQ ID NO: 1770567 - RNA, 13 nt, Homo sapiens
ucaaccuccgccu

SEQ ID NO: 1770568 - RNA, 18 nt, Homo sapiens
uggaguacaguggugcca

SEQ ID NO: 1770569 - RNA, 23 nt, Homo sapiens
cugggauuaacagguaugaacca

SEQ ID NO: 1770570 - RNA, 16 nt, Homo sapiens
acugcaugcaagcuca

SEQ ID NO: 1770571 - RNA, 21 nt, Homo sapiens
aacucagacucuggauucaga

SEQ ID NO: 1770572 - RNA, 22 nt, Homo sapiens
cuugcacaggccacuugcucag

SEQ ID NO: 1770573 - RNA, 12 nt, Homo sapiens
aauccuguucca

SEQ ID NO: 1770574 - RNA, 20 nt, Homo sapiens
aggagaccuggcacuggaug

SEQ ID NO: 1770575 - RNA, 20 nt, Homo sapiens
ccuaaguuaccuuucuaggu

SEQ ID NO: 1770576 - RNA, 13 nt, Homo sapiens
gccaacuucccac

SEQ ID NO: 1770577 - RNA, 14 nt, Homo sapiens
gaaaaaugccauca

SEQ ID NO: 1770578 - RNA, 13 nt, Homo sapiens
ccucugcuucuca

SEQ ID NO: 1770579 - RNA, 15 nt, Homo sapiens
ugaccuuugaccucg

SEQ ID NO: 1770580 - RNA, 13 nt, Homo sapiens
cuuucuccacaga

SEQ ID NO: 1770581 - RNA, 20 nt, Homo sapiens
cagaucagauucuucucuua

SEQ ID NO: 1770582 - RNA, 18 nt, Homo sapiens
gaccuugacuugccauga

SEQ ID NO: 1770583 - RNA, 19 nt, Homo sapiens
caacacauuacuugcacaa

SEQ ID NO: 1770584 - RNA, 16 nt, Homo sapiens
ggucauuguaaucacu

SEQ ID NO: 1770585 - RNA, 20 nt, Homo sapiens
gaauuguagauaauacuguc

SEQ ID NO: 1770586 - RNA, 14 nt, Homo sapiens
cagcuacugcaaau

SEQ ID NO: 1770587 - RNA, 21 nt, Homo sapiens
ccagacaagcgccgcugugag

SEQ ID NO: 1770588 - RNA, 14 nt, Homo sapiens
acuauauaagccag

SEQ ID NO: 1770589 - RNA, 21 nt, Homo sapiens
uuaagagcuugaucugugauu

SEQ ID NO: 1770590 - RNA, 12 nt, Homo sapiens
ucgagcacugaa

SEQ ID NO: 1770591 - RNA, 21 nt, Homo sapiens
uaguguauuaucacugucugu

SEQ ID NO: 1770592 - RNA, 16 nt, Homo sapiens
cucaaaacaggccuga

SEQ ID NO: 1770593 - RNA, 15 nt, Homo sapiens
uguccaguugcagcu

SEQ ID NO: 1770594 - RNA, 13 nt, Homo sapiens
acugaaacauuca

SEQ ID NO: 1770595 - RNA, 13 nt, Homo sapiens
cugagaagacugc

SEQ ID NO: 1770596 - RNA, 20 nt, Homo sapiens
cugaauucuuuuucauuuga

SEQ ID NO: 1770597 - RNA, 22 nt, Homo sapiens
gcucccaccacggggucugcag

SEQ ID NO: 1770598 - RNA, 13 nt, Homo sapiens
gaaaugcuuugag

SEQ ID NO: 1770599 - RNA, 22 nt, Homo sapiens
guagcuacagagaaaccagcuu

SEQ ID NO: 1770600 - RNA, 20 nt, Homo sapiens
aagaacugaggaaccugaga

SEQ ID NO: 1770601 - RNA, 17 nt, Homo sapiens
uguccaggcucugggca

SEQ ID NO: 1770602 - RNA, 16 nt, Homo sapiens
uuuugcagugauuuga

SEQ ID NO: 1770603 - RNA, 18 nt, Homo sapiens
cugucauuuugcacugua

SEQ ID NO: 1770604 - RNA, 22 nt, Homo sapiens
agucccgggucucaacuuuaag

SEQ ID NO: 1770605 - RNA, 17 nt, Homo sapiens
cagccuggccccugugc

SEQ ID NO: 1770606 - RNA, 17 nt, Homo sapiens
uuaacuuugaaccauaa

SEQ ID NO: 1770607 - RNA, 14 nt, Homo sapiens
cagagccaccaggg

SEQ ID NO: 1770608 - RNA, 17 nt, Homo sapiens
aucgacccccaagggac

SEQ ID NO: 1770609 - RNA, 22 nt, Homo sapiens
ggcaauugcggggcccaccuua

SEQ ID NO: 1770610 - RNA, 15 nt, Homo sapiens
cauaauuaaaaucua

SEQ ID NO: 1770611 - RNA, 21 nt, Homo sapiens
uccuugucguaggaaaaccau

SEQ ID NO: 1770612 - RNA, 19 nt, Homo sapiens
cccaaagaggcuacuguaa

SEQ ID NO: 1770613 - RNA, 20 nt, Homo sapiens
uucauuccaaaugcuuucag

SEQ ID NO: 1770614 - RNA, 15 nt, Homo sapiens
acacaagaggggaug

SEQ ID NO: 1770615 - RNA, 23 nt, Homo sapiens
cuuauguuacagguuacaugaga

SEQ ID NO: 1770616 - RNA, 14 nt, Homo sapiens
gaauauuacuccua

SEQ ID NO: 1770617 - RNA, 15 nt, Homo sapiens
cggagaacaaaugug

SEQ ID NO: 1770618 - RNA, 13 nt, Homo sapiens
agagaacaggcag

SEQ ID NO: 1770619 - RNA, 14 nt, Homo sapiens
agccugcugcaugg

SEQ ID NO: 1770620 - RNA, 12 nt, Homo sapiens
ucuggcagcuca

SEQ ID NO: 1770621 - RNA, 15 nt, Homo sapiens
guguuugguuuacau

SEQ ID NO: 1770622 - RNA, 12 nt, Homo sapiens
aaaguugcucac

SEQ ID NO: 1770623 - RNA, 19 nt, Homo sapiens
aaugaaaauaaacauguau

SEQ ID NO: 1770624 - RNA, 18 nt, Homo sapiens
cagccuguccuugucacg

SEQ ID NO: 1770625 - RNA, 15 nt, Homo sapiens
uacaaguuugaacag

SEQ ID NO: 1770626 - RNA, 13 nt, Homo sapiens
ucacauacaaauc

SEQ ID NO: 1770627 - RNA, 17 nt, Homo sapiens
cuuccuguccugccucc

SEQ ID NO: 1770628 - RNA, 13 nt, Homo sapiens
cuucugucuguau

SEQ ID NO: 1770629 - RNA, 21 nt, Homo sapiens
caagguggucaguaaauaaca

SEQ ID NO: 1770630 - RNA, 15 nt, Homo sapiens
aaaggugcugagaaa

SEQ ID NO: 1770631 - RNA, 16 nt, Homo sapiens
gaaaguucagccagaa

SEQ ID NO: 1770632 - RNA, 23 nt, Homo sapiens
aagaucucuugcuagauuuugcu

SEQ ID NO: 1770633 - RNA, 21 nt, Homo sapiens
caaaaauuuuuuaaauucaua

SEQ ID NO: 1770634 - RNA, 18 nt, Homo sapiens
aucuguauuaaugcuuga

SEQ ID NO: 1770635 - RNA, 17 nt, Homo sapiens
acguugucccugagauu

SEQ ID NO: 1770636 - RNA, 19 nt, Homo sapiens
aaauuagccugggccucua

SEQ ID NO: 1770637 - RNA, 14 nt, Homo sapiens
cguccgaagggaaa

SEQ ID NO: 1770638 - RNA, 19 nt, Homo sapiens
gagauguuuggaaaccaca

SEQ ID NO: 1770639 - RNA, 22 nt, Homo sapiens
aaccuccccggcucaagugauc

SEQ ID NO: 1770640 - RNA, 16 nt, Homo sapiens
gcugcaccugccugcc

SEQ ID NO: 1770641 - RNA, 20 nt, Homo sapiens
cucagcauagggucacuuug

SEQ ID NO: 1770642 - RNA, 20 nt, Homo sapiens
ccaaguagaggcgaaagcag

SEQ ID NO: 1770643 - RNA, 14 nt, Homo sapiens
cuauacuacauuau

SEQ ID NO: 1770644 - RNA, 20 nt, Homo sapiens
gagcauugcagcuccaggaa

SEQ ID NO: 1770645 - RNA, 21 nt, Homo sapiens
cgauauaauuuuauuacauau

SEQ ID NO: 1770646 - RNA, 12 nt, Homo sapiens
ggcauaugauuu

SEQ ID NO: 1770647 - RNA, 23 nt, Homo sapiens
cagagacugcagggguccacugu

SEQ ID NO: 1770648 - RNA, 20 nt, Homo sapiens
aggaacccuccagaccuccc

SEQ ID NO: 1770649 - RNA, 11 nt, Homo sapiens
ugcagucauuu

SEQ ID NO: 1770650 - RNA, 14 nt, Homo sapiens
uauuguauguaccu

SEQ ID NO: 1770651 - RNA, 14 nt, Homo sapiens
cuggaggagcccag

SEQ ID NO: 1770652 - RNA, 21 nt, Homo sapiens
aguucucauggguggcacuca

SEQ ID NO: 1770653 - RNA, 13 nt, Homo sapiens
aaagcacaaagca

SEQ ID NO: 1770654 - RNA, 16 nt, Homo sapiens
cuucaccgcauuccag

SEQ ID NO: 1770655 - RNA, 16 nt, Homo sapiens
aaauaaauauaccacu

SEQ ID NO: 1770656 - RNA, 18 nt, Homo sapiens
aguucaacaacaaaacau

SEQ ID NO: 1770657 - RNA, 22 nt, Homo sapiens
gugccucugggacuggacaauu

SEQ ID NO: 1770658 - RNA, 17 nt, Homo sapiens
gcuuaaugcuucuuuca

SEQ ID NO: 1770659 - RNA, 21 nt, Homo sapiens
aaccagaaaucuaaucucugu

SEQ ID NO: 1770660 - RNA, 15 nt, Homo sapiens
ugaccacagcacagc

SEQ ID NO: 1770661 - RNA, 23 nt, Homo sapiens
gugggaacggcugauguggacug

SEQ ID NO: 1770662 - RNA, 18 nt, Homo sapiens
caggguccgcaccagcug

SEQ ID NO: 1770663 - RNA, 13 nt, Homo sapiens
caaguuacauaca

SEQ ID NO: 1770664 - RNA, 16 nt, Homo sapiens
gcccaccuaccuucaa

SEQ ID NO: 1770665 - RNA, 19 nt, Homo sapiens
uagaagaugggaaaaccau

SEQ ID NO: 1770666 - RNA, 16 nt, Homo sapiens
gccuagugaacugcaa

SEQ ID NO: 1770667 - RNA, 10 nt, Homo sapiens
cacuuggcca

SEQ ID NO: 1770668 - RNA, 22 nt, Homo sapiens
aacugagccgugcagcugggau

SEQ ID NO: 1770669 - RNA, 21 nt, Homo sapiens
caccaaacccggccugauuaa

SEQ ID NO: 1770670 - RNA, 22 nt, Homo sapiens
uccaaugcugaaugccuguuag

SEQ ID NO: 1770671 - RNA, 19 nt, Homo sapiens
aggaaaagguccuugccuc

SEQ ID NO: 1770672 - RNA, 12 nt, Homo sapiens
aacaaagacaug

SEQ ID NO: 1770673 - RNA, 12 nt, Homo sapiens
ccugaagaacca

SEQ ID NO: 1770674 - RNA, 22 nt, Homo sapiens
ucugugccugggaucagugggg

SEQ ID NO: 1770675 - RNA, 18 nt, Homo sapiens
cacagugggcagucacac

SEQ ID NO: 1770676 - RNA, 20 nt, Homo sapiens
ucucauugucaccucuguga

SEQ ID NO: 1770677 - RNA, 15 nt, Homo sapiens
uugagcgagcccauu

SEQ ID NO: 1770678 - RNA, 15 nt, Homo sapiens
aaaucuuaaguacca

SEQ ID NO: 1770679 - RNA, 15 nt, Homo sapiens
cucuauuuaaauucu

SEQ ID NO: 1770680 - RNA, 18 nt, Homo sapiens
gagcagucuaucauugca

SEQ ID NO: 1770681 - RNA, 22 nt, Homo sapiens
acagugaagcagcacugugagu

SEQ ID NO: 1770682 - RNA, 17 nt, Homo sapiens
gaagaaucacaauaauu

SEQ ID NO: 1770683 - RNA, 17 nt, Homo sapiens
acuggaccccacuggcu

SEQ ID NO: 1770684 - RNA, 16 nt, Homo sapiens
aguggccagccagugc

SEQ ID NO: 1770685 - RNA, 11 nt, Homo sapiens
ugggcacagug

SEQ ID NO: 1770686 - RNA, 20 nt, Homo sapiens
uguaucuaccaucuaaucua

SEQ ID NO: 1770687 - RNA, 18 nt, Homo sapiens
agaaagcugauggccuug

SEQ ID NO: 1770688 - RNA, 18 nt, Homo sapiens
uaugaggaaaaagcgaga

SEQ ID NO: 1770689 - RNA, 13 nt, Homo sapiens
cauacuuggacag

SEQ ID NO: 1770690 - RNA, 15 nt, Homo sapiens
uuaauuaaaucucaa

SEQ ID NO: 1770691 - RNA, 15 nt, Homo sapiens
cuaauccuccaaguc

SEQ ID NO: 1770692 - RNA, 20 nt, Homo sapiens
uaagcuagauacgaaaucag

SEQ ID NO: 1770693 - RNA, 16 nt, Homo sapiens
uaccuaauacagcaga

SEQ ID NO: 1770694 - RNA, 10 nt, Homo sapiens
cagugcaguu

SEQ ID NO: 1770695 - RNA, 15 nt, Homo sapiens
ugaugucuccaagua

SEQ ID NO: 1770696 - RNA, 17 nt, Homo sapiens
auucgggccacagggcg

SEQ ID NO: 1770697 - RNA, 20 nt, Homo sapiens
agcaagacccuaaacaucca

SEQ ID NO: 1770698 - RNA, 16 nt, Homo sapiens
uauuuuuuuuuugcca

SEQ ID NO: 1770699 - RNA, 15 nt, Homo sapiens
auaaucagaagauga

SEQ ID NO: 1770700 - RNA, 18 nt, Homo sapiens
gacuggcuccaacacugc

SEQ ID NO: 1770701 - RNA, 14 nt, Homo sapiens
gacaaaccagagca

SEQ ID NO: 1770702 - RNA, 21 nt, Homo sapiens
aucugacguuguuauccuguu

SEQ ID NO: 1770703 - RNA, 20 nt, Homo sapiens
aacagguuuguuugugcuuu

SEQ ID NO: 1770704 - RNA, 13 nt, Homo sapiens
auccuagucuuca

SEQ ID NO: 1770705 - RNA, 17 nt, Homo sapiens
ucacaaaccaagccaug

SEQ ID NO: 1770706 - RNA, 23 nt, Homo sapiens
ugaagcaaaugucaugcugccuu

SEQ ID NO: 1770707 - RNA, 23 nt, Homo sapiens
gguaauauuuucuuuuauggcaa

SEQ ID NO: 1770708 - RNA, 14 nt, Homo sapiens
auucugccaaagua

SEQ ID NO: 1770709 - RNA, 13 nt, Homo sapiens
uccgcacugggca

SEQ ID NO: 1770710 - RNA, 14 nt, Homo sapiens
ugauuccuguugaa

SEQ ID NO: 1770711 - RNA, 19 nt, Homo sapiens
uacauucuuaaagugucga

SEQ ID NO: 1770712 - RNA, 22 nt, Homo sapiens
uaaucuuuauacuggguuucaa

SEQ ID NO: 1770713 - RNA, 15 nt, Homo sapiens
aaaugagaaguacuu

SEQ ID NO: 1770714 - RNA, 16 nt, Homo sapiens
ggagcuugcaaugagc

SEQ ID NO: 1770715 - RNA, 13 nt, Homo sapiens
uuaaaacagucua

SEQ ID NO: 1770716 - RNA, 18 nt, Homo sapiens
agccacccaagccugcug

SEQ ID NO: 1770717 - RNA, 16 nt, Homo sapiens
agcugggaagaccaau

SEQ ID NO: 1770718 - RNA, 14 nt, Homo sapiens
uuaaaucaagauua

SEQ ID NO: 1770719 - RNA, 22 nt, Homo sapiens
uuuauuuauguaggaucuguca

SEQ ID NO: 1770720 - RNA, 18 nt, Homo sapiens
agggcucacccacugcug

SEQ ID NO: 1770721 - RNA, 14 nt, Homo sapiens
cagagaacaucugg

SEQ ID NO: 1770722 - RNA, 19 nt, Homo sapiens
aaagucuguugauuaaaga

SEQ ID NO: 1770723 - RNA, 12 nt, Homo sapiens
ucccucuuccaa

SEQ ID NO: 1770724 - RNA, 21 nt, Homo sapiens
cuggggguuuuguuuuugcuu

SEQ ID NO: 1770725 - RNA, 13 nt, Homo sapiens
cacaucagcuuua

SEQ ID NO: 1770726 - RNA, 21 nt, Homo sapiens
acaaccugugaucaagcaaua

SEQ ID NO: 1770727 - RNA, 20 nt, Homo sapiens
aggcgcaguggcucaugccu

SEQ ID NO: 1770728 - RNA, 14 nt, Homo sapiens
cugcuuuuucauca

SEQ ID NO: 1770729 - RNA, 15 nt, Homo sapiens
acuucaaugugucau

SEQ ID NO: 1770730 - RNA, 16 nt, Homo sapiens
ugccucuaccaguugg

SEQ ID NO: 1770731 - RNA, 17 nt, Homo sapiens
ccaagaagcaaaguuca

SEQ ID NO: 1770732 - RNA, 15 nt, Homo sapiens
gaaguaacauuugcc

SEQ ID NO: 1770733 - RNA, 22 nt, Homo sapiens
ucauuugaaugcuuaauucaau

SEQ ID NO: 1770734 - RNA, 14 nt, Homo sapiens
uacauuauguugcu

SEQ ID NO: 1770735 - RNA, 19 nt, Homo sapiens
uuuauaaaucuuaugcucu

SEQ ID NO: 1770736 - RNA, 15 nt, Homo sapiens
aauaaagaccugaga

SEQ ID NO: 1770737 - RNA, 20 nt, Homo sapiens
gagagauuuaacauuaucua

SEQ ID NO: 1770738 - RNA, 17 nt, Homo sapiens
guuuucugugagaauaa

SEQ ID NO: 1770739 - RNA, 22 nt, Homo sapiens
ccaaaaucuuaucauggucuca

SEQ ID NO: 1770740 - RNA, 18 nt, Homo sapiens
cgggggccagacacagau

SEQ ID NO: 1770741 - RNA, 22 nt, Homo sapiens
ucuuggcacaaucucacacagc

SEQ ID NO: 1770742 - RNA, 13 nt, Homo sapiens
ucaguagacugug

SEQ ID NO: 1770743 - RNA, 20 nt, Homo sapiens
ucuggacuuuccagagacca

SEQ ID NO: 1770744 - RNA, 12 nt, Homo sapiens
acaaaugaucac

SEQ ID NO: 1770745 - RNA, 22 nt, Homo sapiens
uuucuggugaaaaaagccagcc

SEQ ID NO: 1770746 - RNA, 13 nt, Homo sapiens
cuccaaaugagau

SEQ ID NO: 1770747 - RNA, 13 nt, Homo sapiens
ggaucccagggaa

SEQ ID NO: 1770748 - RNA, 20 nt, Homo sapiens
agcuugucugugaucucugc

SEQ ID NO: 1770749 - RNA, 18 nt, Homo sapiens
ugcaaggcccacaggagg

SEQ ID NO: 1770750 - RNA, 22 nt, Homo sapiens
gaaugauuuagguacgucaaag

SEQ ID NO: 1770751 - RNA, 22 nt, Homo sapiens
agggaaaauguuuaccagugua

SEQ ID NO: 1770752 - RNA, 14 nt, Homo sapiens
gcuucauacaggga

SEQ ID NO: 1770753 - RNA, 22 nt, Homo sapiens
gaggagccaggcaacuucaguc

SEQ ID NO: 1770754 - RNA, 23 nt, Homo sapiens
uuccaacuauguccagaugugca

SEQ ID NO: 1770755 - RNA, 13 nt, Homo sapiens
uauguauucucaa

SEQ ID NO: 1770756 - RNA, 19 nt, Homo sapiens
uaagaaauguauuccugaa

SEQ ID NO: 1770757 - RNA, 17 nt, Homo sapiens
auuaagguaacuacugc

SEQ ID NO: 1770758 - RNA, 16 nt, Homo sapiens
ugcaacggaagccagg

SEQ ID NO: 1770759 - RNA, 16 nt, Homo sapiens
ugcacaaaaagcacaa

SEQ ID NO: 1770760 - RNA, 17 nt, Homo sapiens
gagagugagcaaccagc

SEQ ID NO: 1770761 - RNA, 17 nt, Homo sapiens
gaacugaagcagaguca

SEQ ID NO: 1770762 - RNA, 13 nt, Homo sapiens
agcugcugggcua

SEQ ID NO: 1770763 - RNA, 16 nt, Homo sapiens
uuacuacuauuaaggu

SEQ ID NO: 1770764 - RNA, 14 nt, Homo sapiens
cauguucacugcaa

SEQ ID NO: 1770765 - RNA, 15 nt, Homo sapiens
aaaaguacauaauga

SEQ ID NO: 1770766 - RNA, 12 nt, Homo sapiens
agugaacauauc

SEQ ID NO: 1770767 - RNA, 22 nt, Homo sapiens
uggcggcaggaagccaaagaga

SEQ ID NO: 1770768 - RNA, 11 nt, Homo sapiens
aauccaaacau

SEQ ID NO: 1770769 - RNA, 22 nt, Homo sapiens
auuuucugaucauugguuucuu

SEQ ID NO: 1770770 - RNA, 14 nt, Homo sapiens
agagacuccgucuc

SEQ ID NO: 1770771 - RNA, 18 nt, Homo sapiens
auuugacauacaaaaagg

SEQ ID NO: 1770772 - RNA, 16 nt, Homo sapiens
aaggugccucauagca

SEQ ID NO: 1770773 - RNA, 11 nt, Homo sapiens
cuaaaauucag

SEQ ID NO: 1770774 - RNA, 21 nt, Homo sapiens
auccaaguguuauaccaacua

SEQ ID NO: 1770775 - RNA, 17 nt, Homo sapiens
ucauuggccuucuuaaa

SEQ ID NO: 1770776 - RNA, 17 nt, Homo sapiens
uggguuauuuuuauuaa

SEQ ID NO: 1770777 - RNA, 15 nt, Homo sapiens
caugaugaauuacuu

SEQ ID NO: 1770778 - RNA, 17 nt, Homo sapiens
ugauagaacuguacugu

SEQ ID NO: 1770779 - RNA, 21 nt, Homo sapiens
acaugcagcaaggggacaucu

SEQ ID NO: 1770780 - RNA, 18 nt, Homo sapiens
agccaccgugcccggcca

SEQ ID NO: 1770781 - RNA, 13 nt, Homo sapiens
agccaccacucag

SEQ ID NO: 1770782 - RNA, 23 nt, Homo sapiens
ccuuccaagaauaaagucuuucc

SEQ ID NO: 1770783 - RNA, 18 nt, Homo sapiens
ucuguuuugggaaacacu

SEQ ID NO: 1770784 - RNA, 18 nt, Homo sapiens
auucagucuuuucucuga

SEQ ID NO: 1770785 - RNA, 14 nt, Homo sapiens
cuugaaugcugcca

SEQ ID NO: 1770786 - RNA, 15 nt, Homo sapiens
gaaugucagggccag

SEQ ID NO: 1770787 - RNA, 16 nt, Homo sapiens
aaaaugggaucuuucu

SEQ ID NO: 1770788 - RNA, 15 nt, Homo sapiens
cucagcacacaugca

SEQ ID NO: 1770789 - RNA, 18 nt, Homo sapiens
acaaagaccuugcugaua

SEQ ID NO: 1770790 - RNA, 15 nt, Homo sapiens
accaugugguuugcu

SEQ ID NO: 1770791 - RNA, 12 nt, Homo sapiens
acaguuugauau

SEQ ID NO: 1770792 - RNA, 23 nt, Homo sapiens
ucucagguaggaagcaacagcuu

SEQ ID NO: 1770793 - RNA, 15 nt, Homo sapiens
cuggggccuccagaa

SEQ ID NO: 1770794 - RNA, 22 nt, Homo sapiens
uuuccacaagauucccagagac

SEQ ID NO: 1770795 - RNA, 18 nt, Homo sapiens
agacagugcacaugaacu

SEQ ID NO: 1770796 - RNA, 15 nt, Homo sapiens
gagcuuucuuugcac

SEQ ID NO: 1770797 - RNA, 22 nt, Homo sapiens
uugucaacacaaacuggcuuaa

SEQ ID NO: 1770798 - RNA, 16 nt, Homo sapiens
uuauucaaguauucau

SEQ ID NO: 1770799 - RNA, 16 nt, Homo sapiens
ucaugugugcauguga

SEQ ID NO: 1770800 - RNA, 16 nt, Homo sapiens
guguguauuuguguaa

SEQ ID NO: 1770801 - RNA, 15 nt, Homo sapiens
ccaauaaaccaauga

SEQ ID NO: 1770802 - RNA, 13 nt, Homo sapiens
uccaggacaugau

SEQ ID NO: 1770803 - RNA, 22 nt, Homo sapiens
cagcugcucagaauucaucuga

SEQ ID NO: 1770804 - RNA, 21 nt, Homo sapiens
ucucaugucuccccaguucca

SEQ ID NO: 1770805 - RNA, 14 nt, Homo sapiens
cucagcucacugca

SEQ ID NO: 1770806 - RNA, 14 nt, Homo sapiens
gauuugaccaaauc

SEQ ID NO: 1770807 - RNA, 19 nt, Homo sapiens
aaauugggacaacagugcu

SEQ ID NO: 1770808 - RNA, 18 nt, Homo sapiens
acaaguagagaugaaguu

SEQ ID NO: 1770809 - RNA, 17 nt, Homo sapiens
uguuccucaagguccau

SEQ ID NO: 1770810 - RNA, 23 nt, Homo sapiens
uuuucccccuugaggauugugga

SEQ ID NO: 1770811 - RNA, 14 nt, Homo sapiens
uucugauggauuca

SEQ ID NO: 1770812 - RNA, 21 nt, Homo sapiens
caguuguuuguuuuugcuugu

SEQ ID NO: 1770813 - RNA, 22 nt, Homo sapiens
guuggaaccguguccagcacag

SEQ ID NO: 1770814 - RNA, 18 nt, Homo sapiens
ccuccaggaaacaugaaa

SEQ ID NO: 1770815 - RNA, 14 nt, Homo sapiens
aagauucuuuguga

SEQ ID NO: 1770816 - RNA, 21 nt, Homo sapiens
uacaaucagcccagugcaaac

SEQ ID NO: 1770817 - RNA, 18 nt, Homo sapiens
uucucagugggacucuga

SEQ ID NO: 1770818 - RNA, 24 nt, Homo sapiens
caacaacauccacuguuagcacau

SEQ ID NO: 1770819 - RNA, 15 nt, Homo sapiens
uuuugaguaauucaa

SEQ ID NO: 1770820 - RNA, 16 nt, Homo sapiens
agaaagaaacacucaa

SEQ ID NO: 1770821 - RNA, 13 nt, Homo sapiens
uuuaguuucauga

SEQ ID NO: 1770822 - RNA, 20 nt, Homo sapiens
uuaaaagcaaaacugcaaau

SEQ ID NO: 1770823 - RNA, 23 nt, Homo sapiens
aauuccaagacagugcccaugaa

SEQ ID NO: 1770824 - RNA, 17 nt, Homo sapiens
cgcgcagcgcgugcaca

SEQ ID NO: 1770825 - RNA, 14 nt, Homo sapiens
cuaguguaguauuc

SEQ ID NO: 1770826 - RNA, 16 nt, Homo sapiens
acgcuucauuuccuug

SEQ ID NO: 1770827 - RNA, 18 nt, Homo sapiens
cauggacggggcccagcu

SEQ ID NO: 1770828 - RNA, 18 nt, Homo sapiens
ugggaaaauggcagaaag

SEQ ID NO: 1770829 - RNA, 14 nt, Homo sapiens
agugaggauuacau

SEQ ID NO: 1770830 - RNA, 19 nt, Homo sapiens
gcuuccucuagaagccaag

SEQ ID NO: 1770831 - RNA, 13 nt, Homo sapiens
gaaagaucaaaga

SEQ ID NO: 1770832 - RNA, 18 nt, Homo sapiens
ucaucugggaacuuguca

SEQ ID NO: 1770833 - RNA, 13 nt, Homo sapiens
ucagugaauuugu

SEQ ID NO: 1770834 - RNA, 14 nt, Homo sapiens
ggaagagauguuua

SEQ ID NO: 1770835 - RNA, 23 nt, Homo sapiens
cauaggacaaaugauaaguacua

SEQ ID NO: 1770836 - RNA, 21 nt, Homo sapiens
acgagggguggugcuagaaga

SEQ ID NO: 1770837 - RNA, 23 nt, Homo sapiens
cugccaugggugcagacccugaa

SEQ ID NO: 1770838 - RNA, 18 nt, Homo sapiens
agaucgcuguguuacuaa

SEQ ID NO: 1770839 - RNA, 15 nt, Homo sapiens
cugcagagcaccuuu

SEQ ID NO: 1770840 - RNA, 20 nt, Homo sapiens
caugaugauuaagugcacac

SEQ ID NO: 1770841 - RNA, 21 nt, Homo sapiens
uacaguaaauguuugugaugu

SEQ ID NO: 1770842 - RNA, 16 nt, Homo sapiens
auaauucucucacaaa

SEQ ID NO: 1770843 - RNA, 18 nt, Homo sapiens
cuccaagccugccuccca

SEQ ID NO: 1770844 - RNA, 19 nt, Homo sapiens
cuccaggcuccucaugagg

SEQ ID NO: 1770845 - RNA, 17 nt, Homo sapiens
cuguaugccugggccaa

SEQ ID NO: 1770846 - RNA, 12 nt, Homo sapiens
cagguucuuagg

SEQ ID NO: 1770847 - RNA, 15 nt, Homo sapiens
cugcugauacugggu

SEQ ID NO: 1770848 - RNA, 16 nt, Homo sapiens
uggcuacugcacucuc

SEQ ID NO: 1770849 - RNA, 21 nt, Homo sapiens
aguauuaagucaagaauauaa

SEQ ID NO: 1770850 - RNA, 13 nt, Homo sapiens
ccaaguccagaau

SEQ ID NO: 1770851 - RNA, 15 nt, Homo sapiens
acaaagaggacacca

SEQ ID NO: 1770852 - RNA, 14 nt, Homo sapiens
uauaucuauuugag

SEQ ID NO: 1770853 - RNA, 15 nt, Homo sapiens
uucugcuuuccacac

SEQ ID NO: 1770854 - RNA, 13 nt, Homo sapiens
aaaauacauuuau

SEQ ID NO: 1770855 - RNA, 15 nt, Homo sapiens
aguuucuuagcuuuu

SEQ ID NO: 1770856 - RNA, 16 nt, Homo sapiens
ccugucacacagggaa

SEQ ID NO: 1770857 - RNA, 16 nt, Homo sapiens
cauaugcuucuuuaaa

SEQ ID NO: 1770858 - RNA, 20 nt, Homo sapiens
ugcuggggcccuaccagcag

SEQ ID NO: 1770859 - RNA, 16 nt, Homo sapiens
aaauaagugcucuguc

SEQ ID NO: 1770860 - RNA, 23 nt, Homo sapiens
agcuggcccaguggguagugaau

SEQ ID NO: 1770861 - RNA, 16 nt, Homo sapiens
guuauccccuccuuua

SEQ ID NO: 1770862 - RNA, 20 nt, Homo sapiens
aagacauaaauuacuuuuuc

SEQ ID NO: 1770863 - RNA, 15 nt, Homo sapiens
uuguccugugcuugc

SEQ ID NO: 1770864 - RNA, 19 nt, Homo sapiens
agaauagcauggggcuugu

SEQ ID NO: 1770865 - RNA, 22 nt, Homo sapiens
aaguaaccucuacaggcauuua

SEQ ID NO: 1770866 - RNA, 13 nt, Homo sapiens
aggacacaucucc

SEQ ID NO: 1770867 - RNA, 11 nt, Homo sapiens
caaaauuacuu

SEQ ID NO: 1770868 - RNA, 19 nt, Homo sapiens
aauuauacagaccuaauau

SEQ ID NO: 1770869 - RNA, 21 nt, Homo sapiens
ucugauaaaagauggccauau

SEQ ID NO: 1770870 - RNA, 13 nt, Homo sapiens
auaggaucacuug

SEQ ID NO: 1770871 - RNA, 22 nt, Homo sapiens
uauuuuauguuauuuauagcug

SEQ ID NO: 1770872 - RNA, 18 nt, Homo sapiens
acuauucauggcuaccuc

SEQ ID NO: 1770873 - RNA, 12 nt, Homo sapiens
cucccaguacua

SEQ ID NO: 1770874 - RNA, 19 nt, Homo sapiens
agcaaaaggggaagggaag

SEQ ID NO: 1770875 - RNA, 12 nt, Homo sapiens
guugcuuuuacg

SEQ ID NO: 1770876 - RNA, 17 nt, Homo sapiens
cugcaauccaaugcacu

SEQ ID NO: 1770877 - RNA, 21 nt, Homo sapiens
gcugcagagugccccaucggu

SEQ ID NO: 1770878 - RNA, 15 nt, Homo sapiens
acuggagaagucuua

SEQ ID NO: 1770879 - RNA, 19 nt, Homo sapiens
agccucaauucuccauuaa

SEQ ID NO: 1770880 - RNA, 18 nt, Homo sapiens
ggcuaugccugccucaaa

SEQ ID NO: 1770881 - RNA, 21 nt, Homo sapiens
guccugcagucccacacugug

SEQ ID NO: 1770882 - RNA, 21 nt, Homo sapiens
aggcuucuaaaggacauacau

SEQ ID NO: 1770883 - RNA, 15 nt, Homo sapiens
uguaccacaaacaca

SEQ ID NO: 1770884 - RNA, 15 nt, Homo sapiens
uaacauucaguacuu

SEQ ID NO: 1770885 - RNA, 22 nt, Homo sapiens
cacauauauauuacaagggaua

SEQ ID NO: 1770886 - RNA, 18 nt, Homo sapiens
augaaaauaaauagcuua

SEQ ID NO: 1770887 - RNA, 19 nt, Homo sapiens
uaggcucagagaugugcac

SEQ ID NO: 1770888 - RNA, 17 nt, Homo sapiens
gaguacacucagccacu

SEQ ID NO: 1770889 - RNA, 14 nt, Homo sapiens
gcucugaacacgaa

SEQ ID NO: 1770890 - RNA, 20 nt, Homo sapiens
aaaaauagcuuucaaaagaa

SEQ ID NO: 1770891 - RNA, 15 nt, Homo sapiens
gaaggagacaggcag

SEQ ID NO: 1770892 - RNA, 15 nt, Homo sapiens
ucuggcgacagggga

SEQ ID NO: 1770893 - RNA, 21 nt, Homo sapiens
acagcugagcacauucuggcu

SEQ ID NO: 1770894 - RNA, 16 nt, Homo sapiens
gggccaaaaccaaugc

SEQ ID NO: 1770895 - RNA, 17 nt, Homo sapiens
aggccagccuggacgac

SEQ ID NO: 1770896 - RNA, 16 nt, Homo sapiens
uugcuucucucucuaa

SEQ ID NO: 1770897 - RNA, 14 nt, Homo sapiens
acaauggcccaggu

SEQ ID NO: 1770898 - RNA, 12 nt, Homo sapiens
ugcagaagccaa

SEQ ID NO: 1770899 - RNA, 13 nt, Homo sapiens
aaucucccaguga

SEQ ID NO: 1770900 - RNA, 17 nt, Homo sapiens
cucaggacugcaacagg

SEQ ID NO: 1770901 - RNA, 21 nt, Homo sapiens
auucugauguuucugugaaau

SEQ ID NO: 1770902 - RNA, 11 nt, Homo sapiens
uaauacuguag

SEQ ID NO: 1770903 - RNA, 11 nt, Homo sapiens
ugguacuguga

SEQ ID NO: 1770904 - RNA, 19 nt, Homo sapiens
uaauuuuccaaugcacagu

SEQ ID NO: 1770905 - RNA, 19 nt, Homo sapiens
agugcagcuugaauuucaa

SEQ ID NO: 1770906 - RNA, 17 nt, Homo sapiens
ucuucgggagacauguu

SEQ ID NO: 1770907 - RNA, 16 nt, Homo sapiens
gagucagaucuuucuc

SEQ ID NO: 1770908 - RNA, 17 nt, Homo sapiens
aauaagagauccuuuag

SEQ ID NO: 1770909 - RNA, 19 nt, Homo sapiens
aguuguccagaucacugaa

SEQ ID NO: 1770910 - RNA, 20 nt, Homo sapiens
gguaccaauucagugucugu

SEQ ID NO: 1770911 - RNA, 15 nt, Homo sapiens
aguacaucucuacua

SEQ ID NO: 1770912 - RNA, 19 nt, Homo sapiens
aggcagauaacugcuguau

SEQ ID NO: 1770913 - RNA, 21 nt, Homo sapiens
uaucgggagcagugucuucca

SEQ ID NO: 1770914 - RNA, 16 nt, Homo sapiens
ucucugagcacccaag

SEQ ID NO: 1770915 - RNA, 14 nt, Homo sapiens
ucccaaagccagaa

SEQ ID NO: 1770916 - RNA, 17 nt, Homo sapiens
agauuccauuuuggaaa

SEQ ID NO: 1770917 - RNA, 23 nt, Homo sapiens
cugugacugaagaagaugagccu

SEQ ID NO: 1770918 - RNA, 14 nt, Homo sapiens
gaauucuuggggcu

SEQ ID NO: 1770919 - RNA, 17 nt, Homo sapiens
accuugacuugccauga

SEQ ID NO: 1770920 - RNA, 23 nt, Homo sapiens
aagagucuuugauucaccaaaca

SEQ ID NO: 1770921 - RNA, 23 nt, Homo sapiens
agacuccaauggggccagcacug

SEQ ID NO: 1770922 - RNA, 22 nt, Homo sapiens
cuaccucaagacucaccucauc

SEQ ID NO: 1770923 - RNA, 17 nt, Homo sapiens
gauuaacaacaggaaau

SEQ ID NO: 1770924 - RNA, 16 nt, Homo sapiens
ugcagaguugaaguuu

SEQ ID NO: 1770925 - RNA, 20 nt, Homo sapiens
ccaaauuacguguacuacaa

SEQ ID NO: 1770926 - RNA, 16 nt, Homo sapiens
caccucaugucauuuc

SEQ ID NO: 1770927 - RNA, 15 nt, Homo sapiens
cuugcuucuucacca

SEQ ID NO: 1770928 - RNA, 15 nt, Homo sapiens
uccugagacagaauu

SEQ ID NO: 1770929 - RNA, 16 nt, Homo sapiens
cuacaaagcugaagaa

SEQ ID NO: 1770930 - RNA, 19 nt, Homo sapiens
aauuguaaauccuguguuu

SEQ ID NO: 1770931 - RNA, 15 nt, Homo sapiens
cucuggcccagugaa

SEQ ID NO: 1770932 - RNA, 15 nt, Homo sapiens
ggacgugucucagga

SEQ ID NO: 1770933 - RNA, 13 nt, Homo sapiens
uguagauugccuu

SEQ ID NO: 1770934 - RNA, 21 nt, Homo sapiens
gaguuccuuaucccucucuuc

SEQ ID NO: 1770935 - RNA, 22 nt, Homo sapiens
cauuucucaaucagugcaguga

SEQ ID NO: 1770936 - RNA, 23 nt, Homo sapiens
accuuuccaguuuauaagacugg

SEQ ID NO: 1770937 - RNA, 16 nt, Homo sapiens
auuauauaguaaugca

SEQ ID NO: 1770938 - RNA, 15 nt, Homo sapiens
uagcugugucagaau

SEQ ID NO: 1770939 - RNA, 14 nt, Homo sapiens
uucauucaccuaac

SEQ ID NO: 1770940 - RNA, 21 nt, Homo sapiens
auucuucuuugguggagauaa

SEQ ID NO: 1770941 - RNA, 23 nt, Homo sapiens
cagaagccccaaaguucacauua

SEQ ID NO: 1770942 - RNA, 13 nt, Homo sapiens
accagagcucaga

SEQ ID NO: 1770943 - RNA, 22 nt, Homo sapiens
ucacaaguggguacccccagga

SEQ ID NO: 1770944 - RNA, 12 nt, Homo sapiens
agaaagccucag

SEQ ID NO: 1770945 - RNA, 15 nt, Homo sapiens
gaccuagagacuuca

SEQ ID NO: 1770946 - RNA, 21 nt, Homo sapiens
ugcaauguuccguucaucuga

SEQ ID NO: 1770947 - RNA, 20 nt, Homo sapiens
aaccuauuuuuaaugaaacu

SEQ ID NO: 1770948 - RNA, 15 nt, Homo sapiens
gaggcugcacuggag

SEQ ID NO: 1770949 - RNA, 22 nt, Homo sapiens
ugugagcagucccucuggaaag

SEQ ID NO: 1770950 - RNA, 15 nt, Homo sapiens
acuguucaaugauua

SEQ ID NO: 1770951 - RNA, 17 nt, Homo sapiens
cuuuuuccuacuuguua

SEQ ID NO: 1770952 - RNA, 17 nt, Homo sapiens
uuuccaucagugaaaac

SEQ ID NO: 1770953 - RNA, 16 nt, Homo sapiens
ugucuauauguuuauu

SEQ ID NO: 1770954 - RNA, 16 nt, Homo sapiens
uuauauaauuacauau

SEQ ID NO: 1770955 - RNA, 23 nt, Homo sapiens
ucacugccagugcagauguuuua

SEQ ID NO: 1770956 - RNA, 17 nt, Homo sapiens
caugacuuuuccaugua

SEQ ID NO: 1770957 - RNA, 16 nt, Homo sapiens
uucuuccauccuuaga

SEQ ID NO: 1770958 - RNA, 18 nt, Homo sapiens
auagagcaaccaguacua

SEQ ID NO: 1770959 - RNA, 22 nt, Homo sapiens
ccucugugaacugugugugaau

SEQ ID NO: 1770960 - RNA, 13 nt, Homo sapiens
gagaugacaggaa

SEQ ID NO: 1770961 - RNA, 18 nt, Homo sapiens
uucuccuguagcacaaag

SEQ ID NO: 1770962 - RNA, 17 nt, Homo sapiens
uaaagacuaugaucuca

SEQ ID NO: 1770963 - RNA, 19 nt, Homo sapiens
acauaucuacacuucgcac

SEQ ID NO: 1770964 - RNA, 19 nt, Homo sapiens
gucucauggcagucccaaa

SEQ ID NO: 1770965 - RNA, 15 nt, Homo sapiens
uaauaaaacugcaca

SEQ ID NO: 1770966 - RNA, 14 nt, Homo sapiens
acauaaguuccuau

SEQ ID NO: 1770967 - RNA, 19 nt, Homo sapiens
uauuaaauguugcuuuaac

SEQ ID NO: 1770968 - RNA, 16 nt, Homo sapiens
uuaaacaugcuguuac

SEQ ID NO: 1770969 - RNA, 15 nt, Homo sapiens
cuccaugauguuaau

SEQ ID NO: 1770970 - RNA, 24 nt, Homo sapiens
aaaugaaagugaugauacuguaac

SEQ ID NO: 1770971 - RNA, 18 nt, Homo sapiens
cacgugguugccgucucu

SEQ ID NO: 1770972 - RNA, 18 nt, Homo sapiens
uauuuuaugacauuuuac

SEQ ID NO: 1770973 - RNA, 23 nt, Homo sapiens
ucaagugaacauuacauugccau

SEQ ID NO: 1770974 - RNA, 10 nt, Homo sapiens
gaagggccag

SEQ ID NO: 1770975 - RNA, 14 nt, Homo sapiens
aucuggaaggacau

SEQ ID NO: 1770976 - RNA, 22 nt, Homo sapiens
gacauaauaacagcaguggagu

SEQ ID NO: 1770977 - RNA, 23 nt, Homo sapiens
aaaaugccaaaacuuaccuauaa

SEQ ID NO: 1770978 - RNA, 16 nt, Homo sapiens
accucuagugcuacug

SEQ ID NO: 1770979 - RNA, 14 nt, Homo sapiens
ucugacauucauuu

SEQ ID NO: 1770980 - RNA, 13 nt, Homo sapiens
ccuacugagacag

SEQ ID NO: 1770981 - RNA, 17 nt, Homo sapiens
agaaaaaaaaaugccau

SEQ ID NO: 1770982 - RNA, 22 nt, Homo sapiens
uauguacaaaaugaauugccuu

SEQ ID NO: 1770983 - RNA, 14 nt, Homo sapiens
uggauaacgaugaa

SEQ ID NO: 1770984 - RNA, 14 nt, Homo sapiens
cucacugcaggcau

SEQ ID NO: 1770985 - RNA, 22 nt, Homo sapiens
auuggagaugcaaauagcaaaa

SEQ ID NO: 1770986 - RNA, 21 nt, Homo sapiens
gcuugggcccaguagccccaa

SEQ ID NO: 1770987 - RNA, 15 nt, Homo sapiens
aggcugucuucucag

SEQ ID NO: 1770988 - RNA, 19 nt, Homo sapiens
agacccauagcagcuuugu

SEQ ID NO: 1770989 - RNA, 10 nt, Homo sapiens
cauggaugau

SEQ ID NO: 1770990 - RNA, 15 nt, Homo sapiens
ggucaagaguuaaac

SEQ ID NO: 1770991 - RNA, 23 nt, Homo sapiens
cugaugaagaaauuuaugaagca

SEQ ID NO: 1770992 - RNA, 19 nt, Homo sapiens
aucaauuauagaaagccaa

SEQ ID NO: 1770993 - RNA, 20 nt, Homo sapiens
agcugauacacaccugauga

SEQ ID NO: 1770994 - RNA, 23 nt, Homo sapiens
uaugcccggaccuccaucagagc

SEQ ID NO: 1770995 - RNA, 21 nt, Homo sapiens
cacaccuggcccuugcaaucu

SEQ ID NO: 1770996 - RNA, 14 nt, Homo sapiens
uuggcgacugucau

SEQ ID NO: 1770997 - RNA, 21 nt, Homo sapiens
aguuguuucagauaaauuuca

SEQ ID NO: 1770998 - RNA, 20 nt, Homo sapiens
acuggcuccucugugguguc

SEQ ID NO: 1770999 - RNA, 22 nt, Homo sapiens
auguguacuucaccucuuggcu

SEQ ID NO: 1771000 - RNA, 14 nt, Homo sapiens
ccucauccauagca

SEQ ID NO: 1771001 - RNA, 19 nt, Homo sapiens
gcgccucaguuacacagga

SEQ ID NO: 1771002 - RNA, 18 nt, Homo sapiens
ucucugcauguguaaaag

SEQ ID NO: 1771003 - RNA, 21 nt, Homo sapiens
ccucaaacgaaucauuggcua

SEQ ID NO: 1771004 - RNA, 23 nt, Homo sapiens
ugguauucaacuaauacaugguu

SEQ ID NO: 1771005 - RNA, 14 nt, Homo sapiens
gaaaaugaacacag

SEQ ID NO: 1771006 - RNA, 15 nt, Homo sapiens
cucguggaacaguua

SEQ ID NO: 1771007 - RNA, 14 nt, Homo sapiens
uaggccaucuguaa

SEQ ID NO: 1771008 - RNA, 14 nt, Homo sapiens
ccacauaaucucuc

SEQ ID NO: 1771009 - RNA, 19 nt, Homo sapiens
ucuuaaaaaucuaugccua

SEQ ID NO: 1771010 - RNA, 18 nt, Homo sapiens
cuguuuucuaguguauca

SEQ ID NO: 1771011 - RNA, 20 nt, Homo sapiens
ggccuuccacgucuuccucc

SEQ ID NO: 1771012 - RNA, 16 nt, Homo sapiens
ggugaucccagccagg

SEQ ID NO: 1771013 - RNA, 17 nt, Homo sapiens
agguugcagugagccaa

SEQ ID NO: 1771014 - RNA, 17 nt, Homo sapiens
aagccacuugucuugaa

SEQ ID NO: 1771015 - RNA, 19 nt, Homo sapiens
uugauauguuuuauuucau

SEQ ID NO: 1771016 - RNA, 19 nt, Homo sapiens
gucuggcaaacaugugcaa

SEQ ID NO: 1771017 - RNA, 15 nt, Homo sapiens
aaaaauaaaguacca

SEQ ID NO: 1771018 - RNA, 16 nt, Homo sapiens
ugucaauauaagcuca

SEQ ID NO: 1771019 - RNA, 23 nt, Homo sapiens
cuguaaucccagcuacuccggga

SEQ ID NO: 1771020 - RNA, 14 nt, Homo sapiens
agcacagggacaga

SEQ ID NO: 1771021 - RNA, 14 nt, Homo sapiens
gauaacuucaugaa

SEQ ID NO: 1771022 - RNA, 13 nt, Homo sapiens
uuuaucugugauu

SEQ ID NO: 1771023 - RNA, 22 nt, Homo sapiens
cugggauucuagaacugugaau

SEQ ID NO: 1771024 - RNA, 20 nt, Homo sapiens
uaaguuuuuguaaaaggaaa

SEQ ID NO: 1771025 - RNA, 15 nt, Homo sapiens
cagaagcagaccuca

SEQ ID NO: 1771026 - RNA, 22 nt, Homo sapiens
uaggccuguguguauagcugug

SEQ ID NO: 1771027 - RNA, 18 nt, Homo sapiens
uaccucuucucucucagu

SEQ ID NO: 1771028 - RNA, 18 nt, Homo sapiens
cacgcuuguuugccugaa

SEQ ID NO: 1771029 - RNA, 18 nt, Homo sapiens
caagcagaaacuuuacaa

SEQ ID NO: 1771030 - RNA, 14 nt, Homo sapiens
ccuuacuacuucuu

SEQ ID NO: 1771031 - RNA, 17 nt, Homo sapiens
agcaucagauggaagcu

SEQ ID NO: 1771032 - RNA, 16 nt, Homo sapiens
agaaaagccagucaaa

SEQ ID NO: 1771033 - RNA, 18 nt, Homo sapiens
augucagcagcucugaga

SEQ ID NO: 1771034 - RNA, 21 nt, Homo sapiens
cucuguggaaugaauacacac

SEQ ID NO: 1771035 - RNA, 20 nt, Homo sapiens
aggguggguguccaugugca

SEQ ID NO: 1771036 - RNA, 9 nt, Homo sapiens
cucucucug

SEQ ID NO: 1771037 - RNA, 14 nt, Homo sapiens
acacgauuagcuuu

SEQ ID NO: 1771038 - RNA, 22 nt, Homo sapiens
ucucuuucacggggccgugaca

SEQ ID NO: 1771039 - RNA, 21 nt, Homo sapiens
uacaucuucauuaauacugug

SEQ ID NO: 1771040 - RNA, 15 nt, Homo sapiens
gcagugacccaucug

SEQ ID NO: 1771041 - RNA, 22 nt, Homo sapiens
caauaaggcagugcagugcuca

SEQ ID NO: 1771042 - RNA, 20 nt, Homo sapiens
agaggagccaccaguucuca

SEQ ID NO: 1771043 - RNA, 19 nt, Homo sapiens
gugcugcuuccuucuaaga

SEQ ID NO: 1771044 - RNA, 17 nt, Homo sapiens
ugacauucuuagcugua

SEQ ID NO: 1771045 - RNA, 17 nt, Homo sapiens
auaacucugcacuacuc

SEQ ID NO: 1771046 - RNA, 20 nt, Homo sapiens
gcugcaugggucacagcggc

SEQ ID NO: 1771047 - RNA, 22 nt, Homo sapiens
ugcgucagaccaguacugggaa

SEQ ID NO: 1771048 - RNA, 20 nt, Homo sapiens
aacccaauucaggacuggcu

SEQ ID NO: 1771049 - RNA, 23 nt, Homo sapiens
gaccaucuuuagcaguuuccuca

SEQ ID NO: 1771050 - RNA, 22 nt, Homo sapiens
cuccuuggugaagaacauccca

SEQ ID NO: 1771051 - RNA, 13 nt, Homo sapiens
cacauuugccuug

SEQ ID NO: 1771052 - RNA, 17 nt, Homo sapiens
gaacuucugacuacuug

SEQ ID NO: 1771053 - RNA, 19 nt, Homo sapiens
gucacugauacacagaaua

SEQ ID NO: 1771054 - RNA, 21 nt, Homo sapiens
aaaguuuaacaaaugacugua

SEQ ID NO: 1771055 - RNA, 14 nt, Homo sapiens
gaugccgccucaag

SEQ ID NO: 1771056 - RNA, 16 nt, Homo sapiens
ccuaacauauauguau

SEQ ID NO: 1771057 - RNA, 15 nt, Homo sapiens
ugugauguacuguaa

SEQ ID NO: 1771058 - RNA, 19 nt, Homo sapiens
gcuacuaccuagggcacuu

SEQ ID NO: 1771059 - RNA, 22 nt, Homo sapiens
gaagcauuucagguugugcauu

SEQ ID NO: 1771060 - RNA, 16 nt, Homo sapiens
gccauugaacacugca

SEQ ID NO: 1771061 - RNA, 16 nt, Homo sapiens
gcgccuccacccugcc

SEQ ID NO: 1771062 - RNA, 22 nt, Homo sapiens
aggaugcccacauacugucuaa

SEQ ID NO: 1771063 - RNA, 21 nt, Homo sapiens
gccuggggcaggucacuuuac

SEQ ID NO: 1771064 - RNA, 15 nt, Homo sapiens
cugucccuacccacu

SEQ ID NO: 1771065 - RNA, 23 nt, Homo sapiens
acaucaguuuaaacaaagggaag

SEQ ID NO: 1771066 - RNA, 17 nt, Homo sapiens
gcucuccugcgugauuc

SEQ ID NO: 1771067 - RNA, 17 nt, Homo sapiens
uccugaacucccaguca

SEQ ID NO: 1771068 - RNA, 21 nt, Homo sapiens
aaugacacgccuaaggucaca

SEQ ID NO: 1771069 - RNA, 15 nt, Homo sapiens
ucugaucugugaauu

SEQ ID NO: 1771070 - RNA, 14 nt, Homo sapiens
aggugugguagcuc

SEQ ID NO: 1771071 - RNA, 15 nt, Homo sapiens
uucuuaccaguguga

SEQ ID NO: 1771072 - RNA, 23 nt, Homo sapiens
gcaccuuuccugaaauucugaca

SEQ ID NO: 1771073 - RNA, 18 nt, Homo sapiens
acuacaugugaacuggga

SEQ ID NO: 1771074 - RNA, 20 nt, Homo sapiens
caaugacugcgcagagugga

SEQ ID NO: 1771075 - RNA, 13 nt, Homo sapiens
uuagcguggguua

SEQ ID NO: 1771076 - RNA, 18 nt, Homo sapiens
agccaauucagacaggca

SEQ ID NO: 1771077 - RNA, 18 nt, Homo sapiens
acaaagggaaggcugcug

SEQ ID NO: 1771078 - RNA, 20 nt, Homo sapiens
auguauuuaaagaacacugc

SEQ ID NO: 1771079 - RNA, 22 nt, Homo sapiens
uaacauuuuugguagucuucaa

SEQ ID NO: 1771080 - RNA, 16 nt, Homo sapiens
gaaauguauaugcuac

SEQ ID NO: 1771081 - RNA, 17 nt, Homo sapiens
cagcccugccgggcaca

SEQ ID NO: 1771082 - RNA, 19 nt, Homo sapiens
aaaacaccagcuguauaua

SEQ ID NO: 1771083 - RNA, 15 nt, Homo sapiens
caaugauuauuugua

SEQ ID NO: 1771084 - RNA, 21 nt, Homo sapiens
acagucuacauugagcauuug

SEQ ID NO: 1771085 - RNA, 19 nt, Homo sapiens
ccuaacucuugaggucucu

SEQ ID NO: 1771086 - RNA, 22 nt, Homo sapiens
gaggaaaaggaaaaaaagcaaa

SEQ ID NO: 1771087 - RNA, 13 nt, Homo sapiens
uaauaacugugaa

SEQ ID NO: 1771088 - RNA, 16 nt, Homo sapiens
uuaugacuccuugaua

SEQ ID NO: 1771089 - RNA, 16 nt, Homo sapiens
gggaccccaagugaag

SEQ ID NO: 1771090 - RNA, 14 nt, Homo sapiens
cuuuaucaucggag

SEQ ID NO: 1771091 - RNA, 19 nt, Homo sapiens
caguuaaagauuauuguga

SEQ ID NO: 1771092 - RNA, 14 nt, Homo sapiens
uuauuugacuaaag

SEQ ID NO: 1771093 - RNA, 19 nt, Homo sapiens
uuacaacaaacacugugau

SEQ ID NO: 1771094 - RNA, 22 nt, Homo sapiens
uuacauuuuccugagaccucaa

SEQ ID NO: 1771095 - RNA, 22 nt, Homo sapiens
acagucauaaauacugucaaac

SEQ ID NO: 1771096 - RNA, 18 nt, Homo sapiens
aggggggggugggugaga

SEQ ID NO: 1771097 - RNA, 19 nt, Homo sapiens
aagugagaaaaguucaaua

SEQ ID NO: 1771098 - RNA, 17 nt, Homo sapiens
uguaguauaauucuugg

SEQ ID NO: 1771099 - RNA, 20 nt, Homo sapiens
cucugagacagcaguaucac

SEQ ID NO: 1771100 - RNA, 20 nt, Homo sapiens
guaaauagcaacaugcuuca

SEQ ID NO: 1771101 - RNA, 23 nt, Homo sapiens
uagaauugugguucccuaaagac

SEQ ID NO: 1771102 - RNA, 14 nt, Homo sapiens
cucaucuaugucau

SEQ ID NO: 1771103 - RNA, 22 nt, Homo sapiens
uaguaaugagugaguucucacu

SEQ ID NO: 1771104 - RNA, 20 nt, Homo sapiens
aacaggacauggggcuccug

SEQ ID NO: 1771105 - RNA, 17 nt, Homo sapiens
ggaauuauuguaccauu

SEQ ID NO: 1771106 - RNA, 16 nt, Homo sapiens
aacaucauucuugaga

SEQ ID NO: 1771107 - RNA, 19 nt, Homo sapiens
guacagaaaaauacuuuga

SEQ ID NO: 1771108 - RNA, 16 nt, Homo sapiens
gucuucccuucuuugc

SEQ ID NO: 1771109 - RNA, 16 nt, Homo sapiens
ugggcuguggggcccu

SEQ ID NO: 1771110 - RNA, 16 nt, Homo sapiens
guaaagcucacuuuac

SEQ ID NO: 1771111 - RNA, 17 nt, Homo sapiens
gaacucugaauaugccu

SEQ ID NO: 1771112 - RNA, 19 nt, Homo sapiens
uuugaaugcuuaauucaau

SEQ ID NO: 1771113 - RNA, 17 nt, Homo sapiens
ucaaaugcacaucucau

SEQ ID NO: 1771114 - RNA, 16 nt, Homo sapiens
ggcagccacaacugca

SEQ ID NO: 1771115 - RNA, 20 nt, Homo sapiens
uagguaaaauaaaagacuau

SEQ ID NO: 1771116 - RNA, 18 nt, Homo sapiens
cuuuaaccucacauaccc

SEQ ID NO: 1771117 - RNA, 18 nt, Homo sapiens
cagugagguuaaacuaag

SEQ ID NO: 1771118 - RNA, 21 nt, Homo sapiens
agcauggagagccccugcuaa

SEQ ID NO: 1771119 - RNA, 14 nt, Homo sapiens
auaaauaguauuuc

SEQ ID NO: 1771120 - RNA, 23 nt, Homo sapiens
caacuuuuccaacauacaauuua

SEQ ID NO: 1771121 - RNA, 22 nt, Homo sapiens
cuuguguuguuuucucugauca

SEQ ID NO: 1771122 - RNA, 14 nt, Homo sapiens
uggcccaaccagac

SEQ ID NO: 1771123 - RNA, 12 nt, Homo sapiens
ucuagaagccaa

SEQ ID NO: 1771124 - RNA, 16 nt, Homo sapiens
aggacaccagccuggu

SEQ ID NO: 1771125 - RNA, 21 nt, Homo sapiens
gacagggacaugcccugugug

SEQ ID NO: 1771126 - RNA, 20 nt, Homo sapiens
ugcuauauaaauaaagcaaa

SEQ ID NO: 1771127 - RNA, 12 nt, Homo sapiens
uacuaauccagc

SEQ ID NO: 1771128 - RNA, 13 nt, Homo sapiens
ggccugggcgggg

SEQ ID NO: 1771129 - RNA, 21 nt, Homo sapiens
acauagucuuuguuuacauga

SEQ ID NO: 1771130 - RNA, 13 nt, Homo sapiens
gcuaagggggacc

SEQ ID NO: 1771131 - RNA, 16 nt, Homo sapiens
ugaucaaauuugaacu

SEQ ID NO: 1771132 - RNA, 17 nt, Homo sapiens
ccuauuguucacuuuau

SEQ ID NO: 1771133 - RNA, 17 nt, Homo sapiens
gauauguucaacuggag

SEQ ID NO: 1771134 - RNA, 18 nt, Homo sapiens
auccuguguuaucugugg

SEQ ID NO: 1771135 - RNA, 21 nt, Homo sapiens
agugcaguggcgcgaucucag

SEQ ID NO: 1771136 - RNA, 17 nt, Homo sapiens
caagugacaaaguuaua

SEQ ID NO: 1771137 - RNA, 15 nt, Homo sapiens
aagagucaugucaaa

SEQ ID NO: 1771138 - RNA, 19 nt, Homo sapiens
acccagaaugagacaucca

SEQ ID NO: 1771139 - RNA, 16 nt, Homo sapiens
gccaggagaccugcuc

SEQ ID NO: 1771140 - RNA, 21 nt, Homo sapiens
gagcugaauuaccuuucacuu

SEQ ID NO: 1771141 - RNA, 19 nt, Homo sapiens
gcuaaucuccacccaauga

SEQ ID NO: 1771142 - RNA, 16 nt, Homo sapiens
acguguaaauugcaca

SEQ ID NO: 1771143 - RNA, 22 nt, Homo sapiens
cccacgaagacaaccaucacac

SEQ ID NO: 1771144 - RNA, 23 nt, Homo sapiens
augccagugaaacuucaagcaaa

SEQ ID NO: 1771145 - RNA, 17 nt, Homo sapiens
agggccugcccagacaa

SEQ ID NO: 1771146 - RNA, 22 nt, Homo sapiens
cucagcucuaggcuguucugua

SEQ ID NO: 1771147 - RNA, 20 nt, Homo sapiens
uacuagacugccacaaggaa

SEQ ID NO: 1771148 - RNA, 18 nt, Homo sapiens
gcauguuuauucuguucc

SEQ ID NO: 1771149 - RNA, 16 nt, Homo sapiens
gucuccuucacaucag

SEQ ID NO: 1771150 - RNA, 15 nt, Homo sapiens
acuaaguuauuguua

SEQ ID NO: 1771151 - RNA, 16 nt, Homo sapiens
ccaugacuuccucaca

SEQ ID NO: 1771152 - RNA, 21 nt, Homo sapiens
ugcaguagugcaccaucucac

SEQ ID NO: 1771153 - RNA, 17 nt, Homo sapiens
uaaauauugcucuaugu

SEQ ID NO: 1771154 - RNA, 18 nt, Homo sapiens
gggucagcccagcaccug

SEQ ID NO: 1771155 - RNA, 18 nt, Homo sapiens
cuaguacaauauagugau

SEQ ID NO: 1771156 - RNA, 18 nt, Homo sapiens
cuugcggccacagcacua

SEQ ID NO: 1771157 - RNA, 20 nt, Homo sapiens
aaggacaccuuuuaacucac

SEQ ID NO: 1771158 - RNA, 15 nt, Homo sapiens
gcugcugucuucccc

SEQ ID NO: 1771159 - RNA, 18 nt, Homo sapiens
agaaaacuugccuuucag

SEQ ID NO: 1771160 - RNA, 17 nt, Homo sapiens
cuuguuuacucauugaa

SEQ ID NO: 1771161 - RNA, 17 nt, Homo sapiens
aggaccucagcugcuuc

SEQ ID NO: 1771162 - RNA, 18 nt, Homo sapiens
gcuuaaggggguguaaug

SEQ ID NO: 1771163 - RNA, 14 nt, Homo sapiens
guuaauaacagcuc

SEQ ID NO: 1771164 - RNA, 19 nt, Homo sapiens
gugaacuuucucagcauau

SEQ ID NO: 1771165 - RNA, 14 nt, Homo sapiens
cauucccaaagggc

SEQ ID NO: 1771166 - RNA, 18 nt, Homo sapiens
aacgacagaagguugcca

SEQ ID NO: 1771167 - RNA, 20 nt, Homo sapiens
gucucauucaaauacuguau

SEQ ID NO: 1771168 - RNA, 13 nt, Homo sapiens
guguagugucugu

SEQ ID NO: 1771169 - RNA, 12 nt, Homo sapiens
aggcccaugccc

SEQ ID NO: 1771170 - RNA, 14 nt, Homo sapiens
aggggacgcaaugg

SEQ ID NO: 1771171 - RNA, 15 nt, Homo sapiens
gcaaaguaguacuuc

SEQ ID NO: 1771172 - RNA, 15 nt, Homo sapiens
ggccaccccacucua

SEQ ID NO: 1771173 - RNA, 14 nt, Homo sapiens
uaacugugcaguga

SEQ ID NO: 1771174 - RNA, 19 nt, Homo sapiens
cuguaaggaacuggaacac

SEQ ID NO: 1771175 - RNA, 23 nt, Homo sapiens
gaugaagcugagcuuuugaugcc

SEQ ID NO: 1771176 - RNA, 11 nt, Homo sapiens
ugaacugccaa

SEQ ID NO: 1771177 - RNA, 19 nt, Homo sapiens
cagcaucacuccccaagga

SEQ ID NO: 1771178 - RNA, 16 nt, Homo sapiens
agacagcuucucugca

SEQ ID NO: 1771179 - RNA, 18 nt, Homo sapiens
ggucugguuguugcacca

SEQ ID NO: 1771180 - RNA, 20 nt, Homo sapiens
uucccaggaguucugcucau

SEQ ID NO: 1771181 - RNA, 23 nt, Homo sapiens
cccauaucugugaaaugcuggca

SEQ ID NO: 1771182 - RNA, 16 nt, Homo sapiens
ucacuaccugccaugc

SEQ ID NO: 1771183 - RNA, 21 nt, Homo sapiens
ggucagcucccaucucauuuc

SEQ ID NO: 1771184 - RNA, 14 nt, Homo sapiens
gccuuucgugaucu

SEQ ID NO: 1771185 - RNA, 18 nt, Homo sapiens
cuaaauaaaugagcuguu

SEQ ID NO: 1771186 - RNA, 16 nt, Homo sapiens
augcacacacagaugc

SEQ ID NO: 1771187 - RNA, 20 nt, Homo sapiens
gcuuuauucugcaagcaauc

SEQ ID NO: 1771188 - RNA, 17 nt, Homo sapiens
uucauuaauuaguucca

SEQ ID NO: 1771189 - RNA, 16 nt, Homo sapiens
ccuggaacccauguca

SEQ ID NO: 1771190 - RNA, 21 nt, Homo sapiens
auccugccagccccacacagc

SEQ ID NO: 1771191 - RNA, 15 nt, Homo sapiens
acuauccuggcuuug

SEQ ID NO: 1771192 - RNA, 19 nt, Homo sapiens
gcuggcccggccacucuga

SEQ ID NO: 1771193 - RNA, 17 nt, Homo sapiens
uggccacggccacagcc

SEQ ID NO: 1771194 - RNA, 14 nt, Homo sapiens
uccucucaucauuu

SEQ ID NO: 1771195 - RNA, 14 nt, Homo sapiens
gaauuacagacuca

SEQ ID NO: 1771196 - RNA, 14 nt, Homo sapiens
cuugccauuuucaa

SEQ ID NO: 1771197 - RNA, 18 nt, Homo sapiens
uugcccaggcuggucuca

SEQ ID NO: 1771198 - RNA, 16 nt, Homo sapiens
aaucauauaagcuaua

SEQ ID NO: 1771199 - RNA, 15 nt, Homo sapiens
caacaccaagcacag

SEQ ID NO: 1771200 - RNA, 22 nt, Homo sapiens
caagugaagaaaagugaaugcu

SEQ ID NO: 1771201 - RNA, 19 nt, Homo sapiens
uuaaaaaaagaacauaaaa

SEQ ID NO: 1771202 - RNA, 12 nt, Homo sapiens
gguuaucaacca

SEQ ID NO: 1771203 - RNA, 20 nt, Homo sapiens
gcucaguggaucacacacau

SEQ ID NO: 1771204 - RNA, 12 nt, Homo sapiens
auuccccaguga

SEQ ID NO: 1771205 - RNA, 13 nt, Homo sapiens
caggcucuucucc

SEQ ID NO: 1771206 - RNA, 17 nt, Homo sapiens
cuagauuacaucugccu

SEQ ID NO: 1771207 - RNA, 21 nt, Homo sapiens
uacacuguguaaauacccaua

SEQ ID NO: 1771208 - RNA, 15 nt, Homo sapiens
aaaagguuguguaca

SEQ ID NO: 1771209 - RNA, 16 nt, Homo sapiens
gcugucaagcaccugc

SEQ ID NO: 1771210 - RNA, 17 nt, Homo sapiens
cugccagcaucugcagc

SEQ ID NO: 1771211 - RNA, 16 nt, Homo sapiens
aguugggagcacugga

SEQ ID NO: 1771212 - RNA, 22 nt, Homo sapiens
aaugaauauagaugcuggccag

SEQ ID NO: 1771213 - RNA, 16 nt, Homo sapiens
agcagaagaacagaau

SEQ ID NO: 1771214 - RNA, 16 nt, Homo sapiens
uacauauuugcauaug

SEQ ID NO: 1771215 - RNA, 12 nt, Homo sapiens
uggaugccaucc

SEQ ID NO: 1771216 - RNA, 15 nt, Homo sapiens
auagucacauggccu

SEQ ID NO: 1771217 - RNA, 13 nt, Homo sapiens
uucuucuauucca

SEQ ID NO: 1771218 - RNA, 22 nt, Homo sapiens
ccauggcuuaaugcuucuuuca

SEQ ID NO: 1771219 - RNA, 14 nt, Homo sapiens
uccuugcaccugca

SEQ ID NO: 1771220 - RNA, 15 nt, Homo sapiens
gaauggaauuggaca

SEQ ID NO: 1771221 - RNA, 19 nt, Homo sapiens
aauguuugucucaucccau

SEQ ID NO: 1771222 - RNA, 18 nt, Homo sapiens
auggucuucguccuugac

SEQ ID NO: 1771223 - RNA, 22 nt, Homo sapiens
uccuucuaacugaaggugcagu

SEQ ID NO: 1771224 - RNA, 21 nt, Homo sapiens
ucagcuaacauuccauguuuc

SEQ ID NO: 1771225 - RNA, 19 nt, Homo sapiens
cuacaaguauaugugaaaa

SEQ ID NO: 1771226 - RNA, 14 nt, Homo sapiens
gcccucagauuccg

SEQ ID NO: 1771227 - RNA, 18 nt, Homo sapiens
gcccuucccccugcaaaa

SEQ ID NO: 1771228 - RNA, 21 nt, Homo sapiens
aauccugcucacaaaaucacu

SEQ ID NO: 1771229 - RNA, 18 nt, Homo sapiens
ugaccugagaugugugau

SEQ ID NO: 1771230 - RNA, 22 nt, Homo sapiens
ugagacaggagaaacacuugaa

SEQ ID NO: 1771231 - RNA, 21 nt, Homo sapiens
gagcugggcagaaggccaaga

SEQ ID NO: 1771232 - RNA, 16 nt, Homo sapiens
aaaauauagacauucu

SEQ ID NO: 1771233 - RNA, 20 nt, Homo sapiens
caggccuaucuggaagccac

SEQ ID NO: 1771234 - RNA, 16 nt, Homo sapiens
aagccugacccuguaa

SEQ ID NO: 1771235 - RNA, 19 nt, Homo sapiens
caaaugcuuuuccaaccca

SEQ ID NO: 1771236 - RNA, 16 nt, Homo sapiens
guggccuauuccagga

SEQ ID NO: 1771237 - RNA, 16 nt, Homo sapiens
agggaauacugugcau

SEQ ID NO: 1771238 - RNA, 22 nt, Homo sapiens
ucuucaaggaggcccacugugu

SEQ ID NO: 1771239 - RNA, 16 nt, Homo sapiens
ccguggacaccccaga

SEQ ID NO: 1771240 - RNA, 14 nt, Homo sapiens
ugccagccaucaca

SEQ ID NO: 1771241 - RNA, 20 nt, Homo sapiens
auuucauucugaaacauaau

SEQ ID NO: 1771242 - RNA, 13 nt, Homo sapiens
augggaaaaccau

SEQ ID NO: 1771243 - RNA, 15 nt, Homo sapiens
ugaauagacuaucua

SEQ ID NO: 1771244 - RNA, 15 nt, Homo sapiens
cccugcaccaugcug

SEQ ID NO: 1771245 - RNA, 20 nt, Homo sapiens
cucucuucaauaaaccacaa

SEQ ID NO: 1771246 - RNA, 19 nt, Homo sapiens
ucgcucuugaggagcucaa

SEQ ID NO: 1771247 - RNA, 15 nt, Homo sapiens
ucauaggaagacaca

SEQ ID NO: 1771248 - RNA, 15 nt, Homo sapiens
ccucuggagaaggcc

SEQ ID NO: 1771249 - RNA, 23 nt, Homo sapiens
cccagguuucuggucucuaggcu

SEQ ID NO: 1771250 - RNA, 14 nt, Homo sapiens
cacucugcuaccuu

SEQ ID NO: 1771251 - RNA, 14 nt, Homo sapiens
uuuucggccuucug

SEQ ID NO: 1771252 - RNA, 14 nt, Homo sapiens
guagcuucugaccu

SEQ ID NO: 1771253 - RNA, 22 nt, Homo sapiens
auucuaccagagugauggauuu

SEQ ID NO: 1771254 - RNA, 13 nt, Homo sapiens
ccacuaagugugu

SEQ ID NO: 1771255 - RNA, 17 nt, Homo sapiens
uauauaagguaugugcu

SEQ ID NO: 1771256 - RNA, 20 nt, Homo sapiens
caccucauggacuccaggau

SEQ ID NO: 1771257 - RNA, 13 nt, Homo sapiens
auucuuuaccuca

SEQ ID NO: 1771258 - RNA, 21 nt, Homo sapiens
caauccuccccaccagucuca

SEQ ID NO: 1771259 - RNA, 15 nt, Homo sapiens
uguugggccagguag

SEQ ID NO: 1771260 - RNA, 20 nt, Homo sapiens
cugaccuuccaaaccucaau

SEQ ID NO: 1771261 - RNA, 15 nt, Homo sapiens
gcugaugcccuauaa

SEQ ID NO: 1771262 - RNA, 20 nt, Homo sapiens
ggccucccggggcccaggac

SEQ ID NO: 1771263 - RNA, 14 nt, Homo sapiens
aaugucucauguca

SEQ ID NO: 1771264 - RNA, 12 nt, Homo sapiens
agcucucuggga

SEQ ID NO: 1771265 - RNA, 22 nt, Homo sapiens
caaagucccccuccucagccag

SEQ ID NO: 1771266 - RNA, 18 nt, Homo sapiens
ugugagcagcacccaucc

SEQ ID NO: 1771267 - RNA, 16 nt, Homo sapiens
uuuuaucauagccuau

SEQ ID NO: 1771268 - RNA, 18 nt, Homo sapiens
aaguccucccuccugcag

SEQ ID NO: 1771269 - RNA, 12 nt, Homo sapiens
uuagaaaccaaa

SEQ ID NO: 1771270 - RNA, 20 nt, Homo sapiens
guugucacaucucagggaac

SEQ ID NO: 1771271 - RNA, 14 nt, Homo sapiens
uaauugugaauuag

SEQ ID NO: 1771272 - RNA, 14 nt, Homo sapiens
ucauaacagucuua

SEQ ID NO: 1771273 - RNA, 14 nt, Homo sapiens
ucaaaacagucaua

SEQ ID NO: 1771274 - RNA, 22 nt, Homo sapiens
agccagcaguucagagcugccc

SEQ ID NO: 1771275 - RNA, 23 nt, Homo sapiens
ugccacagcuuuugcaacuuaau

SEQ ID NO: 1771276 - RNA, 23 nt, Homo sapiens
gcugugccuggccuccgaugccu

SEQ ID NO: 1771277 - RNA, 22 nt, Homo sapiens
uugaacuuccaggaaaguguga

SEQ ID NO: 1771278 - RNA, 16 nt, Homo sapiens
acugucucaacuacuc

SEQ ID NO: 1771279 - RNA, 21 nt, Homo sapiens
aagauuguuggugaauuuuca

SEQ ID NO: 1771280 - RNA, 13 nt, Homo sapiens
uuuuaaacauaag

SEQ ID NO: 1771281 - RNA, 18 nt, Homo sapiens
cugugccuaacaccagcg

SEQ ID NO: 1771282 - RNA, 16 nt, Homo sapiens
aacaucucaauaacaa

SEQ ID NO: 1771283 - RNA, 13 nt, Homo sapiens
cauuaaaccugga

SEQ ID NO: 1771284 - RNA, 20 nt, Homo sapiens
auaauugcucauaagcaaua

SEQ ID NO: 1771285 - RNA, 16 nt, Homo sapiens
cuucaccuuuccucuc

SEQ ID NO: 1771286 - RNA, 10 nt, Homo sapiens
auacaguacu

SEQ ID NO: 1771287 - RNA, 18 nt, Homo sapiens
uaccucacuaugcugcuu

SEQ ID NO: 1771288 - RNA, 16 nt, Homo sapiens
cugggaacucccaaga

SEQ ID NO: 1771289 - RNA, 22 nt, Homo sapiens
gcaaaaaaaaaaauuacauuau

SEQ ID NO: 1771290 - RNA, 20 nt, Homo sapiens
caauugacugucacuguucc

SEQ ID NO: 1771291 - RNA, 22 nt, Homo sapiens
gaggaaaaggccccugcaaugu

SEQ ID NO: 1771292 - RNA, 19 nt, Homo sapiens
cagagauacgcaaacacac

SEQ ID NO: 1771293 - RNA, 15 nt, Homo sapiens
agaccugagcuuucc

SEQ ID NO: 1771294 - RNA, 13 nt, Homo sapiens
aggacacauuucc

SEQ ID NO: 1771295 - RNA, 18 nt, Homo sapiens
auaccaaagacacaagca

SEQ ID NO: 1771296 - RNA, 20 nt, Homo sapiens
accaaugaaaacagucccau

SEQ ID NO: 1771297 - RNA, 22 nt, Homo sapiens
cagagugcccuggggcauccac

SEQ ID NO: 1771298 - RNA, 13 nt, Homo sapiens
cuguaaaccccaa

SEQ ID NO: 1771299 - RNA, 19 nt, Homo sapiens
uccaaggauggaccacaca

SEQ ID NO: 1771300 - RNA, 20 nt, Homo sapiens
acagagggggccuucacagu

SEQ ID NO: 1771301 - RNA, 21 nt, Homo sapiens
uauuauuugcagucauggaga

SEQ ID NO: 1771302 - RNA, 21 nt, Homo sapiens
uuaauucauguugccuugcau

SEQ ID NO: 1771303 - RNA, 23 nt, Homo sapiens
ucacaaagaauuuaaaauaacac

SEQ ID NO: 1771304 - RNA, 22 nt, Homo sapiens
uagaauuauuucacaaauaaua

SEQ ID NO: 1771305 - RNA, 15 nt, Homo sapiens
cuagauuuaucagag

SEQ ID NO: 1771306 - RNA, 16 nt, Homo sapiens
uuuuguauguaugugu

SEQ ID NO: 1771307 - RNA, 22 nt, Homo sapiens
cuuucagagaguuaaguuauuu

SEQ ID NO: 1771308 - RNA, 17 nt, Homo sapiens
cuaagagacacauacag

SEQ ID NO: 1771309 - RNA, 13 nt, Homo sapiens
auuuaaggcaaaa

SEQ ID NO: 1771310 - RNA, 21 nt, Homo sapiens
uaacagagaguaagcacuuaa

SEQ ID NO: 1771311 - RNA, 16 nt, Homo sapiens
gaucacgacaggaaaa

SEQ ID NO: 1771312 - RNA, 18 nt, Homo sapiens
auguuacugacuccucag

SEQ ID NO: 1771313 - RNA, 22 nt, Homo sapiens
gacauuugggacugucuugaga

SEQ ID NO: 1771314 - RNA, 19 nt, Homo sapiens
cugauugaucacacagugu

SEQ ID NO: 1771315 - RNA, 21 nt, Homo sapiens
aguuuuuauuacaaauuuuca

SEQ ID NO: 1771316 - RNA, 16 nt, Homo sapiens
uugugaacaccuccua

SEQ ID NO: 1771317 - RNA, 12 nt, Homo sapiens
ccguggagccuu

SEQ ID NO: 1771318 - RNA, 23 nt, Homo sapiens
guugggggaggggagacuuugau

SEQ ID NO: 1771319 - RNA, 19 nt, Homo sapiens
gaagggaggagcagcaaga

SEQ ID NO: 1771320 - RNA, 18 nt, Homo sapiens
cuaacagccucagcacau

SEQ ID NO: 1771321 - RNA, 17 nt, Homo sapiens
cugcuagugaagaaugc

SEQ ID NO: 1771322 - RNA, 13 nt, Homo sapiens
ggcugcagcucac

SEQ ID NO: 1771323 - RNA, 13 nt, Homo sapiens
cccaaaacugccg

SEQ ID NO: 1771324 - RNA, 14 nt, Homo sapiens
ugcaacaaugugug

SEQ ID NO: 1771325 - RNA, 20 nt, Homo sapiens
accuuuuaacaccugaugug

SEQ ID NO: 1771326 - RNA, 15 nt, Homo sapiens
acauuccguuuacau

SEQ ID NO: 1771327 - RNA, 14 nt, Homo sapiens
cucagcauuuccac

SEQ ID NO: 1771328 - RNA, 18 nt, Homo sapiens
aauagcgaaucaucucaa

SEQ ID NO: 1771329 - RNA, 22 nt, Homo sapiens
agccagcacaccgggccaagug

SEQ ID NO: 1771330 - RNA, 22 nt, Homo sapiens
auaauucuuuucuuuuccauuu

SEQ ID NO: 1771331 - RNA, 21 nt, Homo sapiens
caggggcugacucuccaggga

SEQ ID NO: 1771332 - RNA, 11 nt, Homo sapiens
augcuggaaac

SEQ ID NO: 1771333 - RNA, 16 nt, Homo sapiens
auaaaaguuggcucag

SEQ ID NO: 1771334 - RNA, 18 nt, Homo sapiens
uauuacuguugcauuuac

SEQ ID NO: 1771335 - RNA, 17 nt, Homo sapiens
aacugucucaaaaggau

SEQ ID NO: 1771336 - RNA, 14 nt, Homo sapiens
caaccuugcaucca

SEQ ID NO: 1771337 - RNA, 19 nt, Homo sapiens
agacugcuucauugggaag

SEQ ID NO: 1771338 - RNA, 17 nt, Homo sapiens
aaccgaggacccaugaa

SEQ ID NO: 1771339 - RNA, 22 nt, Homo sapiens
aaugauccucccaccucagccu

SEQ ID NO: 1771340 - RNA, 18 nt, Homo sapiens
aguaucuuugcacuccaa

SEQ ID NO: 1771341 - RNA, 16 nt, Homo sapiens
uuaggaaggccuucag

SEQ ID NO: 1771342 - RNA, 23 nt, Homo sapiens
uuggacugggugcggugacucau

SEQ ID NO: 1771343 - RNA, 14 nt, Homo sapiens
ccauaaauguguuc

SEQ ID NO: 1771344 - RNA, 11 nt, Homo sapiens
gacaaccagac

SEQ ID NO: 1771345 - RNA, 20 nt, Homo sapiens
acggagucucgcucugucac

SEQ ID NO: 1771346 - RNA, 17 nt, Homo sapiens
cagucccagacaauucc

SEQ ID NO: 1771347 - RNA, 22 nt, Homo sapiens
agaauaaauucccaacuucucu

SEQ ID NO: 1771348 - RNA, 17 nt, Homo sapiens
guuugaaucacaguaua

SEQ ID NO: 1771349 - RNA, 22 nt, Homo sapiens
ugaugacuguuuguuagucagu

SEQ ID NO: 1771350 - RNA, 21 nt, Homo sapiens
gaugagucagugccaugacug

SEQ ID NO: 1771351 - RNA, 23 nt, Homo sapiens
gaaaacuguuaagggaagcugau

SEQ ID NO: 1771352 - RNA, 23 nt, Homo sapiens
ggcaacagagcgagauuccaucu

SEQ ID NO: 1771353 - RNA, 15 nt, Homo sapiens
cagauaaguuugcag

SEQ ID NO: 1771354 - RNA, 17 nt, Homo sapiens
aggugcucagacaugaa

SEQ ID NO: 1771355 - RNA, 21 nt, Homo sapiens
gcaugcacaauccugauaaau

SEQ ID NO: 1771356 - RNA, 16 nt, Homo sapiens
gguuuuacugucaagu

SEQ ID NO: 1771357 - RNA, 13 nt, Homo sapiens
cauucacaguucu

SEQ ID NO: 1771358 - RNA, 15 nt, Homo sapiens
ucuauaagauuccaa

SEQ ID NO: 1771359 - RNA, 22 nt, Homo sapiens
ucuugaaauuaguuuaccucau

SEQ ID NO: 1771360 - RNA, 19 nt, Homo sapiens
aggauuauuugcucagggg

SEQ ID NO: 1771361 - RNA, 22 nt, Homo sapiens
acacagucuguuuucuauuugu

SEQ ID NO: 1771362 - RNA, 18 nt, Homo sapiens
ugaacauugucuggauac

SEQ ID NO: 1771363 - RNA, 16 nt, Homo sapiens
ggagggaagcacugcc

SEQ ID NO: 1771364 - RNA, 17 nt, Homo sapiens
gaaagggguugggguga

SEQ ID NO: 1771365 - RNA, 15 nt, Homo sapiens
aaggagagugauuga

SEQ ID NO: 1771366 - RNA, 18 nt, Homo sapiens
uugcauguuuaauaauau

SEQ ID NO: 1771367 - RNA, 11 nt, Homo sapiens
cacacaaugcc

SEQ ID NO: 1771368 - RNA, 23 nt, Homo sapiens
agaagucugucugucugaugaug

SEQ ID NO: 1771369 - RNA, 22 nt, Homo sapiens
uaccuuguggaugcuagugcug

SEQ ID NO: 1771370 - RNA, 20 nt, Homo sapiens
cagguguuacuguaauuccu

SEQ ID NO: 1771371 - RNA, 17 nt, Homo sapiens
cuguaaucccagaacuu

SEQ ID NO: 1771372 - RNA, 13 nt, Homo sapiens
ugcuuugacucac

SEQ ID NO: 1771373 - RNA, 16 nt, Homo sapiens
uguguauauaguauga

SEQ ID NO: 1771374 - RNA, 17 nt, Homo sapiens
gguggugggaaccauga

SEQ ID NO: 1771375 - RNA, 16 nt, Homo sapiens
auucagguauguugcc

SEQ ID NO: 1771376 - RNA, 14 nt, Homo sapiens
caguccaguagggc

SEQ ID NO: 1771377 - RNA, 15 nt, Homo sapiens
auugugauuagacag

SEQ ID NO: 1771378 - RNA, 23 nt, Homo sapiens
agagaggcaaaggcucucacucc

SEQ ID NO: 1771379 - RNA, 15 nt, Homo sapiens
uuccacuacagugag

SEQ ID NO: 1771380 - RNA, 12 nt, Homo sapiens
auaaucugucaa

SEQ ID NO: 1771381 - RNA, 13 nt, Homo sapiens
uuguacauaguag

SEQ ID NO: 1771382 - RNA, 16 nt, Homo sapiens
aaauucauuucuagac

SEQ ID NO: 1771383 - RNA, 19 nt, Homo sapiens
agauuuuagaauucuuucc

SEQ ID NO: 1771384 - RNA, 23 nt, Homo sapiens
cugacugaacauuaguugcacua

SEQ ID NO: 1771385 - RNA, 17 nt, Homo sapiens
uuuacagcccucagcaa

SEQ ID NO: 1771386 - RNA, 15 nt, Homo sapiens
aggccacacccagag

SEQ ID NO: 1771387 - RNA, 18 nt, Homo sapiens
auuuggcuuacaguaaau

SEQ ID NO: 1771388 - RNA, 21 nt, Homo sapiens
aacuaccauguggccauuaac

SEQ ID NO: 1771389 - RNA, 20 nt, Homo sapiens
aaagguagaucaucuugaau

SEQ ID NO: 1771390 - RNA, 22 nt, Homo sapiens
ccuuguggcuugggacauggca

SEQ ID NO: 1771391 - RNA, 19 nt, Homo sapiens
caauuguguauaacuggau

SEQ ID NO: 1771392 - RNA, 13 nt, Homo sapiens
cgccaccugugac

SEQ ID NO: 1771393 - RNA, 16 nt, Homo sapiens
ugggccagugcaccuu

SEQ ID NO: 1771394 - RNA, 14 nt, Homo sapiens
augggcauauucug

SEQ ID NO: 1771395 - RNA, 14 nt, Homo sapiens
gaaaauugccaaaa

SEQ ID NO: 1771396 - RNA, 20 nt, Homo sapiens
gcgcccagggaggagucagu

SEQ ID NO: 1771397 - RNA, 17 nt, Homo sapiens
ucuacuccuaccucagc

SEQ ID NO: 1771398 - RNA, 14 nt, Homo sapiens
cuuggcuucucagc

SEQ ID NO: 1771399 - RNA, 17 nt, Homo sapiens
ggagggaacagugccca

SEQ ID NO: 1771400 - RNA, 22 nt, Homo sapiens
ccugcucuuucuacaugacugg

SEQ ID NO: 1771401 - RNA, 12 nt, Homo sapiens
auugugugaugu

SEQ ID NO: 1771402 - RNA, 21 nt, Homo sapiens
augcuggguucugcacagcug

SEQ ID NO: 1771403 - RNA, 22 nt, Homo sapiens
cucucuuagcauccugccuuag

SEQ ID NO: 1771404 - RNA, 21 nt, Homo sapiens
agcugucgucugacucugggu

SEQ ID NO: 1771405 - RNA, 16 nt, Homo sapiens
cuguacucuuugcuag

SEQ ID NO: 1771406 - RNA, 16 nt, Homo sapiens
aagaacugcuugcauu

SEQ ID NO: 1771407 - RNA, 22 nt, Homo sapiens
caaauaaccaacccuucccuga

SEQ ID NO: 1771408 - RNA, 22 nt, Homo sapiens
uuuuugcaacuauuuccaccuc

SEQ ID NO: 1771409 - RNA, 20 nt, Homo sapiens
ugcccucgccuguuccccaa

SEQ ID NO: 1771410 - RNA, 23 nt, Homo sapiens
cgccugacgaaauggaaacacac

SEQ ID NO: 1771411 - RNA, 14 nt, Homo sapiens
aauacccaugcuuu

SEQ ID NO: 1771412 - RNA, 22 nt, Homo sapiens
aaaauuuuuuuuguaacuggag

SEQ ID NO: 1771413 - RNA, 13 nt, Homo sapiens
agcugcugauaca

SEQ ID NO: 1771414 - RNA, 15 nt, Homo sapiens
uggcuuuuucuccuu

SEQ ID NO: 1771415 - RNA, 18 nt, Homo sapiens
cucuuguucccacacccc

SEQ ID NO: 1771416 - RNA, 15 nt, Homo sapiens
aagguggaaggcagu

SEQ ID NO: 1771417 - RNA, 17 nt, Homo sapiens
aaacuucacuaaugauc

SEQ ID NO: 1771418 - RNA, 14 nt, Homo sapiens
ccugggguuuccac

SEQ ID NO: 1771419 - RNA, 13 nt, Homo sapiens
gacuucacacugc

SEQ ID NO: 1771420 - RNA, 22 nt, Homo sapiens
uucuccggccccgccucugccc

SEQ ID NO: 1771421 - RNA, 21 nt, Homo sapiens
acugaaggcuaaaaagcaaca

SEQ ID NO: 1771422 - RNA, 15 nt, Homo sapiens
caguuuacaguauuu

SEQ ID NO: 1771423 - RNA, 19 nt, Homo sapiens
caccuuuggaaagcucuga

SEQ ID NO: 1771424 - RNA, 13 nt, Homo sapiens
cugggaugacagg

SEQ ID NO: 1771425 - RNA, 13 nt, Homo sapiens
augaaaugccaaa

SEQ ID NO: 1771426 - RNA, 21 nt, Homo sapiens
auuuagcuaaacggauuccaa

SEQ ID NO: 1771427 - RNA, 18 nt, Homo sapiens
ccucagguaguacuggga

SEQ ID NO: 1771428 - RNA, 14 nt, Homo sapiens
uccuugccagugag

SEQ ID NO: 1771429 - RNA, 16 nt, Homo sapiens
guuuucuucugugauu

SEQ ID NO: 1771430 - RNA, 13 nt, Homo sapiens
agugccuuggcca

SEQ ID NO: 1771431 - RNA, 19 nt, Homo sapiens
cacacaugacgcaccaguu

SEQ ID NO: 1771432 - RNA, 15 nt, Homo sapiens
cgugaucaaagccac

SEQ ID NO: 1771433 - RNA, 19 nt, Homo sapiens
agugugagauacuguguau

SEQ ID NO: 1771434 - RNA, 21 nt, Homo sapiens
aggauucauaaucacaaauau

SEQ ID NO: 1771435 - RNA, 12 nt, Homo sapiens
accugucucucu

SEQ ID NO: 1771436 - RNA, 17 nt, Homo sapiens
aagaguagaacccaggu

SEQ ID NO: 1771437 - RNA, 21 nt, Homo sapiens
acuucacgggcaaucaugagc

SEQ ID NO: 1771438 - RNA, 16 nt, Homo sapiens
ugcauugaaaagagcu

SEQ ID NO: 1771439 - RNA, 23 nt, Homo sapiens
uuuggguggaauggacuacucca

SEQ ID NO: 1771440 - RNA, 22 nt, Homo sapiens
ggcaucacacuuauauuuuaug

SEQ ID NO: 1771441 - RNA, 12 nt, Homo sapiens
ccaugacauuuu

SEQ ID NO: 1771442 - RNA, 21 nt, Homo sapiens
aaacaaucagaccacauuuga

SEQ ID NO: 1771443 - RNA, 21 nt, Homo sapiens
aaaacuauguguucaaugaaa

SEQ ID NO: 1771444 - RNA, 20 nt, Homo sapiens
ugcuaccacagcaacuauau

SEQ ID NO: 1771445 - RNA, 13 nt, Homo sapiens
cucaguccucccc

SEQ ID NO: 1771446 - RNA, 13 nt, Homo sapiens
uccccucccucag

SEQ ID NO: 1771447 - RNA, 15 nt, Homo sapiens
gcuuuacucauggca

SEQ ID NO: 1771448 - RNA, 13 nt, Homo sapiens
ugauuauucaaca

SEQ ID NO: 1771449 - RNA, 20 nt, Homo sapiens
aauuauguaauauauuguac

SEQ ID NO: 1771450 - RNA, 15 nt, Homo sapiens
gcccuccccaccugc

SEQ ID NO: 1771451 - RNA, 23 nt, Homo sapiens
ccagugguggguaauuguacaau

SEQ ID NO: 1771452 - RNA, 16 nt, Homo sapiens
cagugccacgacaugg

SEQ ID NO: 1771453 - RNA, 17 nt, Homo sapiens
ugccaggcccuuugcac

SEQ ID NO: 1771454 - RNA, 19 nt, Homo sapiens
aaccaaguaguauucaugu

SEQ ID NO: 1771455 - RNA, 15 nt, Homo sapiens
ggaugugucucaggc

SEQ ID NO: 1771456 - RNA, 23 nt, Homo sapiens
gccacaguuuccucaucugucca

SEQ ID NO: 1771457 - RNA, 18 nt, Homo sapiens
ucuuccaacaugugaugu

SEQ ID NO: 1771458 - RNA, 18 nt, Homo sapiens
ucuaaagccaagcacuuu

SEQ ID NO: 1771459 - RNA, 22 nt, Homo sapiens
aacaaccuggucacaggacucu

SEQ ID NO: 1771460 - RNA, 18 nt, Homo sapiens
uaggcagaucaagguuua

SEQ ID NO: 1771461 - RNA, 17 nt, Homo sapiens
agcuggaugugguggca

SEQ ID NO: 1771462 - RNA, 13 nt, Homo sapiens
gugguuccuuugc

SEQ ID NO: 1771463 - RNA, 18 nt, Homo sapiens
cccucuccaacugccuaa

SEQ ID NO: 1771464 - RNA, 12 nt, Homo sapiens
cucaaaagaaca

SEQ ID NO: 1771465 - RNA, 20 nt, Homo sapiens
accacacuuuccgcuuucac

SEQ ID NO: 1771466 - RNA, 22 nt, Homo sapiens
uguaucagaguugcuuuucuaa

SEQ ID NO: 1771467 - RNA, 19 nt, Homo sapiens
cuauuuccuuccagccuuu

SEQ ID NO: 1771468 - RNA, 13 nt, Homo sapiens
uccccagucccag

SEQ ID NO: 1771469 - RNA, 19 nt, Homo sapiens
ugucagucugggugucuca

SEQ ID NO: 1771470 - RNA, 14 nt, Homo sapiens
guaacuaauuugug

SEQ ID NO: 1771471 - RNA, 21 nt, Homo sapiens
uagaacggauaccugcugcua

SEQ ID NO: 1771472 - RNA, 17 nt, Homo sapiens
cacagucauacaaguca

SEQ ID NO: 1771473 - RNA, 18 nt, Homo sapiens
cacaaacucauccauuaa

SEQ ID NO: 1771474 - RNA, 15 nt, Homo sapiens
auuuucugcauuuaa

SEQ ID NO: 1771475 - RNA, 21 nt, Homo sapiens
auggacuugugauuggcugca

SEQ ID NO: 1771476 - RNA, 17 nt, Homo sapiens
ugaaacuuuaucaucuu

SEQ ID NO: 1771477 - RNA, 17 nt, Homo sapiens
gaaguuucuggugccau

SEQ ID NO: 1771478 - RNA, 21 nt, Homo sapiens
uucugggaacccugugcaauu

SEQ ID NO: 1771479 - RNA, 17 nt, Homo sapiens
cccacgggaaaggagcu

SEQ ID NO: 1771480 - RNA, 22 nt, Homo sapiens
gcuaguuuauuggaaguguuca

SEQ ID NO: 1771481 - RNA, 17 nt, Homo sapiens
aaccuccuccuccaguu

SEQ ID NO: 1771482 - RNA, 15 nt, Homo sapiens
gaaauacaacagaag

SEQ ID NO: 1771483 - RNA, 22 nt, Homo sapiens
auaugacuaauauaacuugaaa

SEQ ID NO: 1771484 - RNA, 20 nt, Homo sapiens
cguguccugaggggcugcuu

SEQ ID NO: 1771485 - RNA, 17 nt, Homo sapiens
agcccacucccugccua

SEQ ID NO: 1771486 - RNA, 14 nt, Homo sapiens
uccugcaccugcug

SEQ ID NO: 1771487 - RNA, 11 nt, Homo sapiens
ggucacaguga

SEQ ID NO: 1771488 - RNA, 19 nt, Homo sapiens
agcugcugucuucuggaca

SEQ ID NO: 1771489 - RNA, 17 nt, Homo sapiens
aggagugugaccacuga

SEQ ID NO: 1771490 - RNA, 20 nt, Homo sapiens
gguggucaccaugccaauga

SEQ ID NO: 1771491 - RNA, 21 nt, Homo sapiens
agacguuccauacccccacau

SEQ ID NO: 1771492 - RNA, 15 nt, Homo sapiens
auuuagcugcuaaca

SEQ ID NO: 1771493 - RNA, 21 nt, Homo sapiens
gaaggagagaaugauuuugcu

SEQ ID NO: 1771494 - RNA, 16 nt, Homo sapiens
uaagggaaacugccag

SEQ ID NO: 1771495 - RNA, 22 nt, Homo sapiens
gucaaggcccggccccaucaga

SEQ ID NO: 1771496 - RNA, 14 nt, Homo sapiens
acccgacugugaaa

SEQ ID NO: 1771497 - RNA, 23 nt, Homo sapiens
ucaagaagucacugucagagaaa

SEQ ID NO: 1771498 - RNA, 20 nt, Homo sapiens
uccuucaacuggcuacugag

SEQ ID NO: 1771499 - RNA, 17 nt, Homo sapiens
caaguccuuaccucuuc

SEQ ID NO: 1771500 - RNA, 11 nt, Homo sapiens
agucagguguc

SEQ ID NO: 1771501 - RNA, 13 nt, Homo sapiens
uggaccacuccag

SEQ ID NO: 1771502 - RNA, 16 nt, Homo sapiens
agaugcagccccaucu

SEQ ID NO: 1771503 - RNA, 19 nt, Homo sapiens
acaagagacugcuugacaa

SEQ ID NO: 1771504 - RNA, 17 nt, Homo sapiens
guuccugaugacccagg

SEQ ID NO: 1771505 - RNA, 17 nt, Homo sapiens
gugcuaucgcaccacug

SEQ ID NO: 1771506 - RNA, 19 nt, Homo sapiens
acaaccaauuccaaguuuu

SEQ ID NO: 1771507 - RNA, 19 nt, Homo sapiens
uacucuauguaugcaucua

SEQ ID NO: 1771508 - RNA, 23 nt, Homo sapiens
aaauuauguuuucauccauuaaa

SEQ ID NO: 1771509 - RNA, 22 nt, Homo sapiens
uauaaaugagcaaauggaacaa

SEQ ID NO: 1771510 - RNA, 16 nt, Homo sapiens
auucugauuacacaaa

SEQ ID NO: 1771511 - RNA, 10 nt, Homo sapiens
ugguuaucau

SEQ ID NO: 1771512 - RNA, 22 nt, Homo sapiens
aggaaaccuggcauggugcuuu

SEQ ID NO: 1771513 - RNA, 14 nt, Homo sapiens
uaaggaaaugugca

SEQ ID NO: 1771514 - RNA, 17 nt, Homo sapiens
caaaguacuugucauag

SEQ ID NO: 1771515 - RNA, 17 nt, Homo sapiens
cgugggccucacauucc

SEQ ID NO: 1771516 - RNA, 19 nt, Homo sapiens
ggaguuguggugaggccac

SEQ ID NO: 1771517 - RNA, 16 nt, Homo sapiens
uggaaucuucaccuca

SEQ ID NO: 1771518 - RNA, 20 nt, Homo sapiens
gaacaauuaaaauauucuuu

SEQ ID NO: 1771519 - RNA, 18 nt, Homo sapiens
guagcagcauuuacagaa

SEQ ID NO: 1771520 - RNA, 17 nt, Homo sapiens
cacuucgugggaucugc

SEQ ID NO: 1771521 - RNA, 18 nt, Homo sapiens
ucacuacucucuacucug

SEQ ID NO: 1771522 - RNA, 13 nt, Homo sapiens
cuuuuucuuugag

SEQ ID NO: 1771523 - RNA, 23 nt, Homo sapiens
augcagcuguggcagaguuacag

SEQ ID NO: 1771524 - RNA, 14 nt, Homo sapiens
augcaccagugccg

SEQ ID NO: 1771525 - RNA, 22 nt, Homo sapiens
acuaaaaauauagcaaaugcag

SEQ ID NO: 1771526 - RNA, 15 nt, Homo sapiens
aaauuagugguacuu

SEQ ID NO: 1771527 - RNA, 19 nt, Homo sapiens
ccucaaaaggcccuagcua

SEQ ID NO: 1771528 - RNA, 21 nt, Homo sapiens
cacuacaaaaagcuagcuuuc

SEQ ID NO: 1771529 - RNA, 22 nt, Homo sapiens
ccaagauggaugcgacccaaga

SEQ ID NO: 1771530 - RNA, 19 nt, Homo sapiens
aucuugaacuccugaccuc

SEQ ID NO: 1771531 - RNA, 21 nt, Homo sapiens
guauauaacuaacaaccaaag

SEQ ID NO: 1771532 - RNA, 22 nt, Homo sapiens
aggugaccgcccgccucugucc

SEQ ID NO: 1771533 - RNA, 14 nt, Homo sapiens
cucuccaagacagc

SEQ ID NO: 1771534 - RNA, 19 nt, Homo sapiens
acagcacccucuccagaug

SEQ ID NO: 1771535 - RNA, 14 nt, Homo sapiens
uuacccaagcugug

SEQ ID NO: 1771536 - RNA, 17 nt, Homo sapiens
gacuaaacuacauuaua

SEQ ID NO: 1771537 - RNA, 14 nt, Homo sapiens
aauauaaagcaaga

SEQ ID NO: 1771538 - RNA, 19 nt, Homo sapiens
aauuuuguuucaaagggau

SEQ ID NO: 1771539 - RNA, 21 nt, Homo sapiens
acuggcuggaggaaguggggu

SEQ ID NO: 1771540 - RNA, 23 nt, Homo sapiens
gcaccaccccauccgcaucucaa

SEQ ID NO: 1771541 - RNA, 18 nt, Homo sapiens
agaggucucucuggaaaa

SEQ ID NO: 1771542 - RNA, 15 nt, Homo sapiens
cuugaccucagugaa

SEQ ID NO: 1771543 - RNA, 16 nt, Homo sapiens
gcucaaagagccucac

SEQ ID NO: 1771544 - RNA, 21 nt, Homo sapiens
ccauugaauuugccuuccuca

SEQ ID NO: 1771545 - RNA, 18 nt, Homo sapiens
caacuuggguucuucuca

SEQ ID NO: 1771546 - RNA, 21 nt, Homo sapiens
agaacgagaccugugugccag

SEQ ID NO: 1771547 - RNA, 23 nt, Homo sapiens
agaauagcauguucguauuacaa

SEQ ID NO: 1771548 - RNA, 17 nt, Homo sapiens
aauacaguaugaucuca

SEQ ID NO: 1771549 - RNA, 19 nt, Homo sapiens
uauauauguauguaugugu

SEQ ID NO: 1771550 - RNA, 16 nt, Homo sapiens
uuagcuucucugccaa

SEQ ID NO: 1771551 - RNA, 22 nt, Homo sapiens
uggagaaauaaaaauaccucuu

SEQ ID NO: 1771552 - RNA, 11 nt, Homo sapiens
cugcugaagag

SEQ ID NO: 1771553 - RNA, 15 nt, Homo sapiens
aaauucuaagccaua

SEQ ID NO: 1771554 - RNA, 22 nt, Homo sapiens
cagugauguuugccauuugcug

SEQ ID NO: 1771555 - RNA, 15 nt, Homo sapiens
uuguccgggcucaga

SEQ ID NO: 1771556 - RNA, 17 nt, Homo sapiens
auuuccauggcucuguu

SEQ ID NO: 1771557 - RNA, 17 nt, Homo sapiens
cuuugacucaccuguua

SEQ ID NO: 1771558 - RNA, 22 nt, Homo sapiens
uauaauucuuucaauacagaua

SEQ ID NO: 1771559 - RNA, 14 nt, Homo sapiens
cuacaaaggccaug

SEQ ID NO: 1771560 - RNA, 16 nt, Homo sapiens
auugaaacaguuuauu

SEQ ID NO: 1771561 - RNA, 12 nt, Homo sapiens
aggcggagcgcc

SEQ ID NO: 1771562 - RNA, 19 nt, Homo sapiens
uggcuguuaacccacugca

SEQ ID NO: 1771563 - RNA, 11 nt, Homo sapiens
aagacauggaa

SEQ ID NO: 1771564 - RNA, 21 nt, Homo sapiens
agaugucuucugccuguuaua

SEQ ID NO: 1771565 - RNA, 18 nt, Homo sapiens
gauucuauaucaugacca

SEQ ID NO: 1771566 - RNA, 14 nt, Homo sapiens
cuacauaaguaauu

SEQ ID NO: 1771567 - RNA, 19 nt, Homo sapiens
ccaggcagcugagaccagg

SEQ ID NO: 1771568 - RNA, 19 nt, Homo sapiens
ucccaaggcuccugaccua

SEQ ID NO: 1771569 - RNA, 17 nt, Homo sapiens
ccagggacagggcccug

SEQ ID NO: 1771570 - RNA, 15 nt, Homo sapiens
aauuugcuuuaucug

SEQ ID NO: 1771571 - RNA, 23 nt, Homo sapiens
cugagugaccuccuucugcaaag

SEQ ID NO: 1771572 - RNA, 16 nt, Homo sapiens
auccccauccuccaga

SEQ ID NO: 1771573 - RNA, 21 nt, Homo sapiens
cuuccuagaggugugcuauac

SEQ ID NO: 1771574 - RNA, 22 nt, Homo sapiens
augugggguccccaucauccca

SEQ ID NO: 1771575 - RNA, 16 nt, Homo sapiens
uuaaauucacaauuga

SEQ ID NO: 1771576 - RNA, 16 nt, Homo sapiens
cgcagggguugcagug

SEQ ID NO: 1771577 - RNA, 19 nt, Homo sapiens
cagacuuucuuuuucuaca

SEQ ID NO: 1771578 - RNA, 21 nt, Homo sapiens
acuaccccaaaguuugcucaa

SEQ ID NO: 1771579 - RNA, 23 nt, Homo sapiens
ggcaguuuuuguuccuuccugcg

SEQ ID NO: 1771580 - RNA, 16 nt, Homo sapiens
caaaaacaucacuccc

SEQ ID NO: 1771581 - RNA, 21 nt, Homo sapiens
gguucaauuucagaaguaaug

SEQ ID NO: 1771582 - RNA, 15 nt, Homo sapiens
cugcuuucuaauuaa

SEQ ID NO: 1771583 - RNA, 17 nt, Homo sapiens
ugcuaaacucuuucauc

SEQ ID NO: 1771584 - RNA, 18 nt, Homo sapiens
gagaaccuuuccacuccc

SEQ ID NO: 1771585 - RNA, 22 nt, Homo sapiens
uuaccugggcauucuuguuuca

SEQ ID NO: 1771586 - RNA, 22 nt, Homo sapiens
caggaaggacuucuuccaggga

SEQ ID NO: 1771587 - RNA, 17 nt, Homo sapiens
ggggcagggacuugccu

SEQ ID NO: 1771588 - RNA, 15 nt, Homo sapiens
aagcaggguacccuu

SEQ ID NO: 1771589 - RNA, 14 nt, Homo sapiens
caagagacacugcu

SEQ ID NO: 1771590 - RNA, 23 nt, Homo sapiens
caugaaagaacccaagacaucau

SEQ ID NO: 1771591 - RNA, 17 nt, Homo sapiens
aaguuuccucauuuggc

SEQ ID NO: 1771592 - RNA, 18 nt, Homo sapiens
ucacagccucaagucacu

SEQ ID NO: 1771593 - RNA, 23 nt, Homo sapiens
cagugugcuaaccucacugccuc

SEQ ID NO: 1771594 - RNA, 18 nt, Homo sapiens
acucugggaaugacaaca

SEQ ID NO: 1771595 - RNA, 13 nt, Homo sapiens
ccauugcaaugaa

SEQ ID NO: 1771596 - RNA, 18 nt, Homo sapiens
auuacccucaggacaaug

SEQ ID NO: 1771597 - RNA, 17 nt, Homo sapiens
caguacccagagaccaa

SEQ ID NO: 1771598 - RNA, 17 nt, Homo sapiens
ugcaaaucacucugcaa

SEQ ID NO: 1771599 - RNA, 21 nt, Homo sapiens
uuuauuacaguuuaucuaugg

SEQ ID NO: 1771600 - RNA, 20 nt, Homo sapiens
auuuucuuuacaauuucacu

SEQ ID NO: 1771601 - RNA, 16 nt, Homo sapiens
uuguaccgaugcagcu

SEQ ID NO: 1771602 - RNA, 19 nt, Homo sapiens
guugcuuuuuuagauuuau

SEQ ID NO: 1771603 - RNA, 14 nt, Homo sapiens
ugauuuuacuuaac

SEQ ID NO: 1771604 - RNA, 18 nt, Homo sapiens
ugugugccgugacagggc

SEQ ID NO: 1771605 - RNA, 13 nt, Homo sapiens
ugaucagugauuu

SEQ ID NO: 1771606 - RNA, 16 nt, Homo sapiens
gugguggcgugcauau

SEQ ID NO: 1771607 - RNA, 22 nt, Homo sapiens
ugaaacagcugccuuagcuuca

SEQ ID NO: 1771608 - RNA, 13 nt, Homo sapiens
uacaucugugaug

SEQ ID NO: 1771609 - RNA, 18 nt, Homo sapiens
aacaguucuugugugguu

SEQ ID NO: 1771610 - RNA, 19 nt, Homo sapiens
ugcaaacauuaccuaaaua

SEQ ID NO: 1771611 - RNA, 18 nt, Homo sapiens
aagaaguacauuguuacc

SEQ ID NO: 1771612 - RNA, 23 nt, Homo sapiens
ucaggaagccauuuuuuauuuca

SEQ ID NO: 1771613 - RNA, 16 nt, Homo sapiens
ucaaagcuuuuugcua

SEQ ID NO: 1771614 - RNA, 13 nt, Homo sapiens
uuucaccuaucca

SEQ ID NO: 1771615 - RNA, 13 nt, Homo sapiens
ucuucccuaccuc

SEQ ID NO: 1771616 - RNA, 21 nt, Homo sapiens
auccugagcaaacaaaaccac

SEQ ID NO: 1771617 - RNA, 16 nt, Homo sapiens
uugaugaacugccaaa

SEQ ID NO: 1771618 - RNA, 14 nt, Homo sapiens
aguuacaagugcag

SEQ ID NO: 1771619 - RNA, 16 nt, Homo sapiens
caccuugucauguacc

SEQ ID NO: 1771620 - RNA, 17 nt, Homo sapiens
agacugguuagacagua

SEQ ID NO: 1771621 - RNA, 21 nt, Homo sapiens
agcaggauggcuggaacacug

SEQ ID NO: 1771622 - RNA, 15 nt, Homo sapiens
ugacacaggggacac

SEQ ID NO: 1771623 - RNA, 17 nt, Homo sapiens
uuugaauugacugagac

SEQ ID NO: 1771624 - RNA, 23 nt, Homo sapiens
aggcuccugugcuacuuugccuu

SEQ ID NO: 1771625 - RNA, 20 nt, Homo sapiens
cacugaaacuuucuguauaa

SEQ ID NO: 1771626 - RNA, 20 nt, Homo sapiens
uacgcuccaucgcugucauc

SEQ ID NO: 1771627 - RNA, 16 nt, Homo sapiens
augauggcagugguuu

SEQ ID NO: 1771628 - RNA, 13 nt, Homo sapiens
aguauucaaguau

SEQ ID NO: 1771629 - RNA, 20 nt, Homo sapiens
ccuaagagagcaccugguga

SEQ ID NO: 1771630 - RNA, 19 nt, Homo sapiens
gaaacuugugaaguggaaa

SEQ ID NO: 1771631 - RNA, 10 nt, Homo sapiens
gaauugccag

SEQ ID NO: 1771632 - RNA, 22 nt, Homo sapiens
auaaaggcagcugccucugcuc

SEQ ID NO: 1771633 - RNA, 19 nt, Homo sapiens
gaaaccccgucucuacuaa

SEQ ID NO: 1771634 - RNA, 20 nt, Homo sapiens
cacuugcucccaacccauuc

SEQ ID NO: 1771635 - RNA, 22 nt, Homo sapiens
acaggcccuuccucuccacugc

SEQ ID NO: 1771636 - RNA, 22 nt, Homo sapiens
ggcuccuccucacccaccucug

SEQ ID NO: 1771637 - RNA, 19 nt, Homo sapiens
cagcuggcggaggcugcuc

SEQ ID NO: 1771638 - RNA, 16 nt, Homo sapiens
gugucauuucuuuuag

SEQ ID NO: 1771639 - RNA, 16 nt, Homo sapiens
aacugaaaagcaguuu

SEQ ID NO: 1771640 - RNA, 13 nt, Homo sapiens
aauuugggaaaag

SEQ ID NO: 1771641 - RNA, 19 nt, Homo sapiens
gaauaaaauauugauuuca

SEQ ID NO: 1771642 - RNA, 13 nt, Homo sapiens
uccugucccucau

SEQ ID NO: 1771643 - RNA, 14 nt, Homo sapiens
ccauggacaggcug

SEQ ID NO: 1771644 - RNA, 14 nt, Homo sapiens
acuuggucaccagc

SEQ ID NO: 1771645 - RNA, 22 nt, Homo sapiens
ugccaucuguacauauuacugu

SEQ ID NO: 1771646 - RNA, 14 nt, Homo sapiens
gcacagaccucaga

SEQ ID NO: 1771647 - RNA, 18 nt, Homo sapiens
ccuuucaucccuucacaa

SEQ ID NO: 1771648 - RNA, 18 nt, Homo sapiens
auuuauuuaacuauucau

SEQ ID NO: 1771649 - RNA, 22 nt, Homo sapiens
acacuagacaagccagaacuug

SEQ ID NO: 1771650 - RNA, 14 nt, Homo sapiens
gucugcuugucaaa

SEQ ID NO: 1771651 - RNA, 22 nt, Homo sapiens
ccagaagaugaaaaaaauuuua

SEQ ID NO: 1771652 - RNA, 16 nt, Homo sapiens
uggggcaccuugcucc

SEQ ID NO: 1771653 - RNA, 21 nt, Homo sapiens
uuuauucuaugugcacacuua

SEQ ID NO: 1771654 - RNA, 17 nt, Homo sapiens
uccugucaccaugacuu

SEQ ID NO: 1771655 - RNA, 20 nt, Homo sapiens
aaggcugagacagugaauuu

SEQ ID NO: 1771656 - RNA, 14 nt, Homo sapiens
auguauuaauacca

SEQ ID NO: 1771657 - RNA, 17 nt, Homo sapiens
auaaagcaaugugguag

SEQ ID NO: 1771658 - RNA, 13 nt, Homo sapiens
gauaugaccaaaa

SEQ ID NO: 1771659 - RNA, 23 nt, Homo sapiens
uuucccccuugaggauuguggaa

SEQ ID NO: 1771660 - RNA, 17 nt, Homo sapiens
uugacugccuaugccaa

SEQ ID NO: 1771661 - RNA, 13 nt, Homo sapiens
gaagggugccugg

SEQ ID NO: 1771662 - RNA, 14 nt, Homo sapiens
ugguggugaugucc

SEQ ID NO: 1771663 - RNA, 16 nt, Homo sapiens
uggaucuguccaagga

SEQ ID NO: 1771664 - RNA, 16 nt, Homo sapiens
acuaaaugacuuucaa

SEQ ID NO: 1771665 - RNA, 18 nt, Homo sapiens
cucagagugcaagccccu

SEQ ID NO: 1771666 - RNA, 16 nt, Homo sapiens
aagucaccuggugcua

SEQ ID NO: 1771667 - RNA, 12 nt, Homo sapiens
cuuuuuuaucuu

SEQ ID NO: 1771668 - RNA, 12 nt, Homo sapiens
ucucuuuacuuc

SEQ ID NO: 1771669 - RNA, 19 nt, Homo sapiens
uaagaguuacucagaugac

SEQ ID NO: 1771670 - RNA, 19 nt, Homo sapiens
ugaggcauuuccagacuug

SEQ ID NO: 1771671 - RNA, 23 nt, Homo sapiens
cagggcugagacagguuaagggg

SEQ ID NO: 1771672 - RNA, 19 nt, Homo sapiens
ugauggaacagaauagaga

SEQ ID NO: 1771673 - RNA, 14 nt, Homo sapiens
aaccuccaguguca

SEQ ID NO: 1771674 - RNA, 16 nt, Homo sapiens
uauggaauacaguguu

SEQ ID NO: 1771675 - RNA, 18 nt, Homo sapiens
acuuuguauagacaucug

SEQ ID NO: 1771676 - RNA, 18 nt, Homo sapiens
agcuacuugggaggcuga

SEQ ID NO: 1771677 - RNA, 18 nt, Homo sapiens
ccuuuuccccagucccag

SEQ ID NO: 1771678 - RNA, 18 nt, Homo sapiens
auagccagagagcccaug

SEQ ID NO: 1771679 - RNA, 21 nt, Homo sapiens
uggucaaccugcucacuguuc

SEQ ID NO: 1771680 - RNA, 12 nt, Homo sapiens
uuucacuacucu

SEQ ID NO: 1771681 - RNA, 19 nt, Homo sapiens
acagcaacaggaaucucag

SEQ ID NO: 1771682 - RNA, 20 nt, Homo sapiens
gguuaaccagacccuuuccu

SEQ ID NO: 1771683 - RNA, 23 nt, Homo sapiens
uccagcaucugaagacucaggca

SEQ ID NO: 1771684 - RNA, 18 nt, Homo sapiens
caucuacuacagcacugu

SEQ ID NO: 1771685 - RNA, 23 nt, Homo sapiens
accccaaaggaacacugacauca

SEQ ID NO: 1771686 - RNA, 23 nt, Homo sapiens
guuggcaugguaguauacaaaaa

SEQ ID NO: 1771687 - RNA, 23 nt, Homo sapiens
aagccccuuacuaugaucucagg

SEQ ID NO: 1771688 - RNA, 15 nt, Homo sapiens
cagccagagcugugc

SEQ ID NO: 1771689 - RNA, 11 nt, Homo sapiens
cuaagagccag

SEQ ID NO: 1771690 - RNA, 13 nt, Homo sapiens
gagcucaucccuc

SEQ ID NO: 1771691 - RNA, 17 nt, Homo sapiens
gacuuugaugcauuucc

SEQ ID NO: 1771692 - RNA, 14 nt, Homo sapiens
uaccugacugccac

SEQ ID NO: 1771693 - RNA, 22 nt, Homo sapiens
uuuugaugugaaaaucaugaaa

SEQ ID NO: 1771694 - RNA, 23 nt, Homo sapiens
aaccaucucagaccuuuacugau

SEQ ID NO: 1771695 - RNA, 20 nt, Homo sapiens
ccaacagcgaagccagucca

SEQ ID NO: 1771696 - RNA, 18 nt, Homo sapiens
ccugcaggcugagccacu

SEQ ID NO: 1771697 - RNA, 15 nt, Homo sapiens
gauuacaggcgugag

SEQ ID NO: 1771698 - RNA, 23 nt, Homo sapiens
ugcuaaacgcacacaguaucuag

SEQ ID NO: 1771699 - RNA, 12 nt, Homo sapiens
cagccaccucuc

SEQ ID NO: 1771700 - RNA, 12 nt, Homo sapiens
ucugcacccagg

SEQ ID NO: 1771701 - RNA, 15 nt, Homo sapiens
ucuccuuuacuaaau

SEQ ID NO: 1771702 - RNA, 22 nt, Homo sapiens
auauccugcggggaugcugggc

SEQ ID NO: 1771703 - RNA, 18 nt, Homo sapiens
ccaauaggcagacugugu

SEQ ID NO: 1771704 - RNA, 14 nt, Homo sapiens
uaacaacugcccag

SEQ ID NO: 1771705 - RNA, 20 nt, Homo sapiens
acuugagccggacaccaagc

SEQ ID NO: 1771706 - RNA, 19 nt, Homo sapiens
gccaagccggcccaaccca

SEQ ID NO: 1771707 - RNA, 18 nt, Homo sapiens
aggcagucucuaauccac

SEQ ID NO: 1771708 - RNA, 14 nt, Homo sapiens
cucccuggcccacc

SEQ ID NO: 1771709 - RNA, 18 nt, Homo sapiens
guaauaguccauggacaa

SEQ ID NO: 1771710 - RNA, 19 nt, Homo sapiens
ccucugaucaaagcaccuu

SEQ ID NO: 1771711 - RNA, 13 nt, Homo sapiens
cugaagcuuuuua

SEQ ID NO: 1771712 - RNA, 15 nt, Homo sapiens
ccuggaggaaugauu

SEQ ID NO: 1771713 - RNA, 12 nt, Homo sapiens
gcgugacaauaa

SEQ ID NO: 1771714 - RNA, 15 nt, Homo sapiens
caaggucucaugacc

SEQ ID NO: 1771715 - RNA, 13 nt, Homo sapiens
ugauuccaaauau

SEQ ID NO: 1771716 - RNA, 13 nt, Homo sapiens
accccaaacccca

SEQ ID NO: 1771717 - RNA, 13 nt, Homo sapiens
acaacaaaccaaa

SEQ ID NO: 1771718 - RNA, 23 nt, Homo sapiens
cuugugccuggcucagagccagu

SEQ ID NO: 1771719 - RNA, 22 nt, Homo sapiens
aucaguuuuuuuuuauacacug

SEQ ID NO: 1771720 - RNA, 17 nt, Homo sapiens
cgucuccgaagauuugg

SEQ ID NO: 1771721 - RNA, 19 nt, Homo sapiens
aacuacaacgaacacaaga

SEQ ID NO: 1771722 - RNA, 17 nt, Homo sapiens
gcaagacuccaucucaa

SEQ ID NO: 1771723 - RNA, 14 nt, Homo sapiens
uucugucuucccac

SEQ ID NO: 1771724 - RNA, 17 nt, Homo sapiens
ugagcaaggacaaccug

SEQ ID NO: 1771725 - RNA, 17 nt, Homo sapiens
caaucagugcagugaua

SEQ ID NO: 1771726 - RNA, 15 nt, Homo sapiens
uaacuauugcauuua

SEQ ID NO: 1771727 - RNA, 21 nt, Homo sapiens
aggcuguuauaaaagcaauaa

SEQ ID NO: 1771728 - RNA, 19 nt, Homo sapiens
uuuaucaggcuuucucugg

SEQ ID NO: 1771729 - RNA, 19 nt, Homo sapiens
aucauauuuaccugugaau

SEQ ID NO: 1771730 - RNA, 14 nt, Homo sapiens
acauauuacuguug

SEQ ID NO: 1771731 - RNA, 23 nt, Homo sapiens
gugagccaccgcgccuggccaaa

SEQ ID NO: 1771732 - RNA, 14 nt, Homo sapiens
cuggcuacucccug

SEQ ID NO: 1771733 - RNA, 17 nt, Homo sapiens
guauuaauuuauguauc

SEQ ID NO: 1771734 - RNA, 17 nt, Homo sapiens
acucuaggucaguauua

SEQ ID NO: 1771735 - RNA, 17 nt, Homo sapiens
acagugguacucugugu

SEQ ID NO: 1771736 - RNA, 20 nt, Homo sapiens
caaaugacauggacacauca

SEQ ID NO: 1771737 - RNA, 11 nt, Homo sapiens
acaucuuccac

SEQ ID NO: 1771738 - RNA, 18 nt, Homo sapiens
aguggcucgaccucgcug

SEQ ID NO: 1771739 - RNA, 20 nt, Homo sapiens
accugcagccccucaugccu

SEQ ID NO: 1771740 - RNA, 20 nt, Homo sapiens
ccuuccucuuugaauucuuc

SEQ ID NO: 1771741 - RNA, 15 nt, Homo sapiens
gugcaugugugcgag

SEQ ID NO: 1771742 - RNA, 15 nt, Homo sapiens
gugcgugugugcaag

SEQ ID NO: 1771743 - RNA, 22 nt, Homo sapiens
uaaaaucaggauuuuagugcuu

SEQ ID NO: 1771744 - RNA, 18 nt, Homo sapiens
gccagcaaugacaucuca

SEQ ID NO: 1771745 - RNA, 22 nt, Homo sapiens
aucuauauguacuugucaaaga

SEQ ID NO: 1771746 - RNA, 15 nt, Homo sapiens
aacaacagaaacuuc

SEQ ID NO: 1771747 - RNA, 16 nt, Homo sapiens
uuaaagaugcuauucu

SEQ ID NO: 1771748 - RNA, 16 nt, Homo sapiens
ccugacgaacuccuug

SEQ ID NO: 1771749 - RNA, 19 nt, Homo sapiens
gauaccaagaugccaucug

SEQ ID NO: 1771750 - RNA, 15 nt, Homo sapiens
gcuugaucugugauu

SEQ ID NO: 1771751 - RNA, 22 nt, Homo sapiens
gugcacaccgugugccauagaa

SEQ ID NO: 1771752 - RNA, 14 nt, Homo sapiens
uaucaucuuggucu

SEQ ID NO: 1771753 - RNA, 18 nt, Homo sapiens
uggcugaguccauuagcu

SEQ ID NO: 1771754 - RNA, 13 nt, Homo sapiens
uggggauugcaga

SEQ ID NO: 1771755 - RNA, 19 nt, Homo sapiens
ggauauccucccuccagau

SEQ ID NO: 1771756 - RNA, 20 nt, Homo sapiens
ugcauuaaaggagaucuucc

SEQ ID NO: 1771757 - RNA, 15 nt, Homo sapiens
uaagcacuugcuuag

SEQ ID NO: 1771758 - RNA, 16 nt, Homo sapiens
aauguguacagugaau

SEQ ID NO: 1771759 - RNA, 17 nt, Homo sapiens
ucaccuaauuaauuuca

SEQ ID NO: 1771760 - RNA, 19 nt, Homo sapiens
uggguuuugccucugcccu

SEQ ID NO: 1771761 - RNA, 20 nt, Homo sapiens
auuuuugauuaacaauguau

SEQ ID NO: 1771762 - RNA, 14 nt, Homo sapiens
ugacucuacuccca

SEQ ID NO: 1771763 - RNA, 19 nt, Homo sapiens
auucagauuucuacacuuu

SEQ ID NO: 1771764 - RNA, 22 nt, Homo sapiens
aauauuuuaaacuacugauuga

SEQ ID NO: 1771765 - RNA, 14 nt, Homo sapiens
ucagcugcucccac

SEQ ID NO: 1771766 - RNA, 21 nt, Homo sapiens
aguuggacaguaagauuuuau

SEQ ID NO: 1771767 - RNA, 21 nt, Homo sapiens
ugacagagaugugcauguggg

SEQ ID NO: 1771768 - RNA, 15 nt, Homo sapiens
accucuucuuuucac

SEQ ID NO: 1771769 - RNA, 21 nt, Homo sapiens
gaccuagaccaguuugcauga

SEQ ID NO: 1771770 - RNA, 15 nt, Homo sapiens
uuggauuguccccga

SEQ ID NO: 1771771 - RNA, 22 nt, Homo sapiens
ccugcggcuccggggccaaggc

SEQ ID NO: 1771772 - RNA, 15 nt, Homo sapiens
aaaaacaagacugcc

SEQ ID NO: 1771773 - RNA, 19 nt, Homo sapiens
aucugcauuuagcacaaaa

SEQ ID NO: 1771774 - RNA, 20 nt, Homo sapiens
caaccugggauguagcggug

SEQ ID NO: 1771775 - RNA, 21 nt, Homo sapiens
agugccucuguuuuccagaag

SEQ ID NO: 1771776 - RNA, 20 nt, Homo sapiens
guaucucuucagucucuaua

SEQ ID NO: 1771777 - RNA, 15 nt, Homo sapiens
agaaauggcuuucca

SEQ ID NO: 1771778 - RNA, 13 nt, Homo sapiens
ccauggugagcuc

SEQ ID NO: 1771779 - RNA, 20 nt, Homo sapiens
cuccaaauuacagcccagga

SEQ ID NO: 1771780 - RNA, 17 nt, Homo sapiens
gcacugggggacauggg

SEQ ID NO: 1771781 - RNA, 22 nt, Homo sapiens
agcauccaaaagcaggaaccca

SEQ ID NO: 1771782 - RNA, 21 nt, Homo sapiens
agguggucagagggcccagug

SEQ ID NO: 1771783 - RNA, 18 nt, Homo sapiens
gggcaaaggaaaaccgag

SEQ ID NO: 1771784 - RNA, 17 nt, Homo sapiens
ucuaaucccagcacuuu

SEQ ID NO: 1771785 - RNA, 17 nt, Homo sapiens
aaaccacuguacauaua

SEQ ID NO: 1771786 - RNA, 20 nt, Homo sapiens
uggggggaugaggaccuccu

SEQ ID NO: 1771787 - RNA, 16 nt, Homo sapiens
cuccagacucacuugc

SEQ ID NO: 1771788 - RNA, 16 nt, Homo sapiens
ucaccuaaaaaaagag

SEQ ID NO: 1771789 - RNA, 20 nt, Homo sapiens
uaguguaccuccucucagug

SEQ ID NO: 1771790 - RNA, 18 nt, Homo sapiens
acacuuccaccauagcuu

SEQ ID NO: 1771791 - RNA, 24 nt, Homo sapiens
ucuucuuugcccacaaugcuuugc

SEQ ID NO: 1771792 - RNA, 13 nt, Homo sapiens
uucauugaugacc

SEQ ID NO: 1771793 - RNA, 15 nt, Homo sapiens
ucagcgugcuuagcc

SEQ ID NO: 1771794 - RNA, 23 nt, Homo sapiens
gaaccauuuuagucccauuugac

SEQ ID NO: 1771795 - RNA, 15 nt, Homo sapiens
uuaggauaacuaaaa

SEQ ID NO: 1771796 - RNA, 23 nt, Homo sapiens
uaugugaaagacaauaaaacacu

SEQ ID NO: 1771797 - RNA, 13 nt, Homo sapiens
cccccucagugag

SEQ ID NO: 1771798 - RNA, 20 nt, Homo sapiens
auauagguuuuucucaugua

SEQ ID NO: 1771799 - RNA, 22 nt, Homo sapiens
gaacccuuucgcuggcuuucca

SEQ ID NO: 1771800 - RNA, 16 nt, Homo sapiens
ggcagagaaguggagu

SEQ ID NO: 1771801 - RNA, 17 nt, Homo sapiens
aaaacccgaaucugaga

SEQ ID NO: 1771802 - RNA, 22 nt, Homo sapiens
acucacugcugugagugcgccu

SEQ ID NO: 1771803 - RNA, 19 nt, Homo sapiens
caggccuaggagacuagga

SEQ ID NO: 1771804 - RNA, 23 nt, Homo sapiens
agcuguugacucuaguacuguga

SEQ ID NO: 1771805 - RNA, 17 nt, Homo sapiens
gcaaaggcccccaucac

SEQ ID NO: 1771806 - RNA, 14 nt, Homo sapiens
ccuaaccuggguug

SEQ ID NO: 1771807 - RNA, 14 nt, Homo sapiens
ugggugggccugac

SEQ ID NO: 1771808 - RNA, 17 nt, Homo sapiens
uuuagauucacuuaaca

SEQ ID NO: 1771809 - RNA, 16 nt, Homo sapiens
gccccagccccuucca

SEQ ID NO: 1771810 - RNA, 21 nt, Homo sapiens
cugucuguagagccgcauggc

SEQ ID NO: 1771811 - RNA, 22 nt, Homo sapiens
cagauacagggugcuccuuguc

SEQ ID NO: 1771812 - RNA, 16 nt, Homo sapiens
cuggugacccagucag

SEQ ID NO: 1771813 - RNA, 16 nt, Homo sapiens
uggccucaaacagcca

SEQ ID NO: 1771814 - RNA, 15 nt, Homo sapiens
gacaggcaaauuuca

SEQ ID NO: 1771815 - RNA, 15 nt, Homo sapiens
gacucaaguguagaa

SEQ ID NO: 1771816 - RNA, 17 nt, Homo sapiens
agggacuagcuaucucu

SEQ ID NO: 1771817 - RNA, 17 nt, Homo sapiens
uuccucaaaacuucaga

SEQ ID NO: 1771818 - RNA, 14 nt, Homo sapiens
ccaacacugagcaa

SEQ ID NO: 1771819 - RNA, 16 nt, Homo sapiens
gucagucucucaccac

SEQ ID NO: 1771820 - RNA, 14 nt, Homo sapiens
caaguuaggagcuu

SEQ ID NO: 1771821 - RNA, 21 nt, Homo sapiens
acaaauuuagugcucuuaacu

SEQ ID NO: 1771822 - RNA, 19 nt, Homo sapiens
aaggagggagcuacucuca

SEQ ID NO: 1771823 - RNA, 20 nt, Homo sapiens
ccugaacucccagaaccacu

SEQ ID NO: 1771824 - RNA, 15 nt, Homo sapiens
gucagccgguccaug

SEQ ID NO: 1771825 - RNA, 20 nt, Homo sapiens
aguguucaguguugacauag

SEQ ID NO: 1771826 - RNA, 18 nt, Homo sapiens
acagggcuagaagcacag

SEQ ID NO: 1771827 - RNA, 19 nt, Homo sapiens
acaccuccaaugcugccug

SEQ ID NO: 1771828 - RNA, 18 nt, Homo sapiens
uacacaaggggcaaauga

SEQ ID NO: 1771829 - RNA, 17 nt, Homo sapiens
ucucauuagcucucauc

SEQ ID NO: 1771830 - RNA, 18 nt, Homo sapiens
aaggauggagccagcucu

SEQ ID NO: 1771831 - RNA, 22 nt, Homo sapiens
aaccagaaguuucuacauucuc

SEQ ID NO: 1771832 - RNA, 15 nt, Homo sapiens
gccaagaccaucucu

SEQ ID NO: 1771833 - RNA, 22 nt, Homo sapiens
ugggccgggaggcagugcugau

SEQ ID NO: 1771834 - RNA, 21 nt, Homo sapiens
uagucgggugccaggacaaug

SEQ ID NO: 1771835 - RNA, 21 nt, Homo sapiens
agcaucccuagucucuaccca

SEQ ID NO: 1771836 - RNA, 23 nt, Homo sapiens
ugggauacuuagugguaugucuc

SEQ ID NO: 1771837 - RNA, 17 nt, Homo sapiens
caagaucuuucaggaaa

SEQ ID NO: 1771838 - RNA, 20 nt, Homo sapiens
cucuuaguuauugcugaaga

SEQ ID NO: 1771839 - RNA, 17 nt, Homo sapiens
aguggggcccauggaug

SEQ ID NO: 1771840 - RNA, 22 nt, Homo sapiens
cuuuaaacuacccuccagagug

SEQ ID NO: 1771841 - RNA, 17 nt, Homo sapiens
gccuguucauggcagau

SEQ ID NO: 1771842 - RNA, 20 nt, Homo sapiens
ccccagauuuaaaaaaagaa

SEQ ID NO: 1771843 - RNA, 20 nt, Homo sapiens
auucccugcacacacaugca

SEQ ID NO: 1771844 - RNA, 14 nt, Homo sapiens
cagccaccacugac

SEQ ID NO: 1771845 - RNA, 19 nt, Homo sapiens
gcuacagaagaaacugggg

SEQ ID NO: 1771846 - RNA, 20 nt, Homo sapiens
gaaacaguccaguacuugac

SEQ ID NO: 1771847 - RNA, 14 nt, Homo sapiens
guaaaacaaugcca

SEQ ID NO: 1771848 - RNA, 15 nt, Homo sapiens
ugucuuuagugcucc

SEQ ID NO: 1771849 - RNA, 15 nt, Homo sapiens
agcuaccagcuaugc

SEQ ID NO: 1771850 - RNA, 20 nt, Homo sapiens
guucagcgucacaucugcag

SEQ ID NO: 1771851 - RNA, 19 nt, Homo sapiens
cugaaacauuugacacaua

SEQ ID NO: 1771852 - RNA, 20 nt, Homo sapiens
gagagcggcugcccgacuca

SEQ ID NO: 1771853 - RNA, 15 nt, Homo sapiens
aauaacagccucauu

SEQ ID NO: 1771854 - RNA, 21 nt, Homo sapiens
uccauccgguggccuauucca

SEQ ID NO: 1771855 - RNA, 19 nt, Homo sapiens
uccccuaacccuacaugca

SEQ ID NO: 1771856 - RNA, 14 nt, Homo sapiens
aucugaggcaaucu

SEQ ID NO: 1771857 - RNA, 21 nt, Homo sapiens
uuucuaaccuugaaugcugcc

SEQ ID NO: 1771858 - RNA, 17 nt, Homo sapiens
guugccucucuugcccc

SEQ ID NO: 1771859 - RNA, 15 nt, Homo sapiens
guuccaggcccucca

SEQ ID NO: 1771860 - RNA, 11 nt, Homo sapiens
caauucucugg

SEQ ID NO: 1771861 - RNA, 22 nt, Homo sapiens
uuuguuaguaugaggcauuugu

SEQ ID NO: 1771862 - RNA, 22 nt, Homo sapiens
cuuuuguguuugugugggauga

SEQ ID NO: 1771863 - RNA, 23 nt, Homo sapiens
ucagaaacaauaauccaaaccaa

SEQ ID NO: 1771864 - RNA, 15 nt, Homo sapiens
accggccacugcaac

SEQ ID NO: 1771865 - RNA, 21 nt, Homo sapiens
acuggaguaucauucuuuaca

SEQ ID NO: 1771866 - RNA, 16 nt, Homo sapiens
gugcauuucugugaug

SEQ ID NO: 1771867 - RNA, 17 nt, Homo sapiens
ucacguccaucacuggc

SEQ ID NO: 1771868 - RNA, 15 nt, Homo sapiens
aacaccaguaccuga

SEQ ID NO: 1771869 - RNA, 19 nt, Homo sapiens
gguguauuugccagcuuua

SEQ ID NO: 1771870 - RNA, 14 nt, Homo sapiens
caguccuagcagaa

SEQ ID NO: 1771871 - RNA, 16 nt, Homo sapiens
uucaaauuuaagguua

SEQ ID NO: 1771872 - RNA, 14 nt, Homo sapiens
gaccucccacuuug

SEQ ID NO: 1771873 - RNA, 12 nt, Homo sapiens
cacaggccucuc

SEQ ID NO: 1771874 - RNA, 13 nt, Homo sapiens
acccuccugccuc

SEQ ID NO: 1771875 - RNA, 12 nt, Homo sapiens
gauuugcauuuc

SEQ ID NO: 1771876 - RNA, 18 nt, Homo sapiens
ugcuguccuaagaacuuc

SEQ ID NO: 1771877 - RNA, 16 nt, Homo sapiens
ggagcucaagcccuug

SEQ ID NO: 1771878 - RNA, 18 nt, Homo sapiens
accagucugaaguuucau

SEQ ID NO: 1771879 - RNA, 20 nt, Homo sapiens
gagcaguucugaaaaaugca

SEQ ID NO: 1771880 - RNA, 16 nt, Homo sapiens
aaaacaaaacaaaaca

SEQ ID NO: 1771881 - RNA, 23 nt, Homo sapiens
aaggggccucaccgagugggggc

SEQ ID NO: 1771882 - RNA, 14 nt, Homo sapiens
caaacuuauggaca

SEQ ID NO: 1771883 - RNA, 18 nt, Homo sapiens
cucuccuuuuugcuuccu

SEQ ID NO: 1771884 - RNA, 13 nt, Homo sapiens
aggauauuaacaa

SEQ ID NO: 1771885 - RNA, 16 nt, Homo sapiens
aauaaacuccuacuaa

SEQ ID NO: 1771886 - RNA, 13 nt, Homo sapiens
guuacuugggagg

SEQ ID NO: 1771887 - RNA, 16 nt, Homo sapiens
uuuaugucuguaauca

SEQ ID NO: 1771888 - RNA, 16 nt, Homo sapiens
uaccccccuaccacac

SEQ ID NO: 1771889 - RNA, 18 nt, Homo sapiens
aaucucuuuauuacugag

SEQ ID NO: 1771890 - RNA, 18 nt, Homo sapiens
agaaaauuaguaauugua

SEQ ID NO: 1771891 - RNA, 22 nt, Homo sapiens
acagguguggggacacagcagu

SEQ ID NO: 1771892 - RNA, 21 nt, Homo sapiens
aggcauguagcuacaggacau

SEQ ID NO: 1771893 - RNA, 11 nt, Homo sapiens
ggaguggcaug

SEQ ID NO: 1771894 - RNA, 12 nt, Homo sapiens
gucaccagagac

SEQ ID NO: 1771895 - RNA, 17 nt, Homo sapiens
agauguuuggaaaccac

SEQ ID NO: 1771896 - RNA, 14 nt, Homo sapiens
gucccucagugaua

SEQ ID NO: 1771897 - RNA, 21 nt, Homo sapiens
uuccaacuugucacuugccag

SEQ ID NO: 1771898 - RNA, 12 nt, Homo sapiens
augcaugugauu

SEQ ID NO: 1771899 - RNA, 20 nt, Homo sapiens
gaacagucacccuucugggc

SEQ ID NO: 1771900 - RNA, 17 nt, Homo sapiens
caagaaccacuccuuca

SEQ ID NO: 1771901 - RNA, 19 nt, Homo sapiens
gccauugauccagcucaga

SEQ ID NO: 1771902 - RNA, 13 nt, Homo sapiens
aaucucaccugcu

SEQ ID NO: 1771903 - RNA, 17 nt, Homo sapiens
uuauccgcuguccagca

SEQ ID NO: 1771904 - RNA, 18 nt, Homo sapiens
agcugcugaaugcauuca

SEQ ID NO: 1771905 - RNA, 13 nt, Homo sapiens
cucccuguuagaa

SEQ ID NO: 1771906 - RNA, 13 nt, Homo sapiens
agaggcugggcug

SEQ ID NO: 1771907 - RNA, 23 nt, Homo sapiens
ucacaagugguguuuauugcaau

SEQ ID NO: 1771908 - RNA, 24 nt, Homo sapiens
agcccagcagacaucaagcucaag

SEQ ID NO: 1771909 - RNA, 14 nt, Homo sapiens
agacugguugcaua

SEQ ID NO: 1771910 - RNA, 13 nt, Homo sapiens
cucaccuccuaaa

SEQ ID NO: 1771911 - RNA, 20 nt, Homo sapiens
cauaaccccacccuuuacau

SEQ ID NO: 1771912 - RNA, 21 nt, Homo sapiens
auguuacucaugacuccuuuc

SEQ ID NO: 1771913 - RNA, 13 nt, Homo sapiens
agccccucagaca

SEQ ID NO: 1771914 - RNA, 19 nt, Homo sapiens
agccugggcaacauaguga

SEQ ID NO: 1771915 - RNA, 23 nt, Homo sapiens
ugcugcauccaggacugugccag

SEQ ID NO: 1771916 - RNA, 23 nt, Homo sapiens
gucaagcuagcaaaaaaacucuu

SEQ ID NO: 1771917 - RNA, 21 nt, Homo sapiens
caagggccagcuggaggugaa

SEQ ID NO: 1771918 - RNA, 24 nt, Homo sapiens
aaugcaugauuuuauacauaguca

SEQ ID NO: 1771919 - RNA, 21 nt, Homo sapiens
ggcuaacuauauuugcuuuuu

SEQ ID NO: 1771920 - RNA, 14 nt, Homo sapiens
aaauuuauauguca

SEQ ID NO: 1771921 - RNA, 22 nt, Homo sapiens
uugaucauucucaguauccacu

SEQ ID NO: 1771922 - RNA, 20 nt, Homo sapiens
ucaucucucacacauuccag

SEQ ID NO: 1771923 - RNA, 13 nt, Homo sapiens
gaaagacacuguu

SEQ ID NO: 1771924 - RNA, 13 nt, Homo sapiens
caucauaucuacu

SEQ ID NO: 1771925 - RNA, 21 nt, Homo sapiens
uauauauucaacagaaaugca

SEQ ID NO: 1771926 - RNA, 19 nt, Homo sapiens
accuugggcacaucugcug

SEQ ID NO: 1771927 - RNA, 16 nt, Homo sapiens
cuguauguacauaccg

SEQ ID NO: 1771928 - RNA, 20 nt, Homo sapiens
auuuugcuaaggagaagcua

SEQ ID NO: 1771929 - RNA, 20 nt, Homo sapiens
ccuuuaaagaugaacucuga

SEQ ID NO: 1771930 - RNA, 15 nt, Homo sapiens
guauucuucaaccuc

SEQ ID NO: 1771931 - RNA, 18 nt, Homo sapiens
caaggacaacuuuaugua

SEQ ID NO: 1771932 - RNA, 19 nt, Homo sapiens
caucucugagcccguguca

SEQ ID NO: 1771933 - RNA, 15 nt, Homo sapiens
cauugaacuguacca

SEQ ID NO: 1771934 - RNA, 18 nt, Homo sapiens
guccacagacaucuuuca

SEQ ID NO: 1771935 - RNA, 11 nt, Homo sapiens
uugcaaacacc

SEQ ID NO: 1771936 - RNA, 21 nt, Homo sapiens
uccucauuagcauuuugcuaa

SEQ ID NO: 1771937 - RNA, 19 nt, Homo sapiens
ugugcucauuuugcaauuu

SEQ ID NO: 1771938 - RNA, 24 nt, Homo sapiens
cccagacucuuuuuuugagugaca

SEQ ID NO: 1771939 - RNA, 19 nt, Homo sapiens
gcaauccagccucauggga

SEQ ID NO: 1771940 - RNA, 16 nt, Homo sapiens
agcuggcccacugcug

SEQ ID NO: 1771941 - RNA, 15 nt, Homo sapiens
aaacuuaauguucuu

SEQ ID NO: 1771942 - RNA, 23 nt, Homo sapiens
acacccccucuucugagcacaga

SEQ ID NO: 1771943 - RNA, 23 nt, Homo sapiens
gcuuuugcuaauaccaaaauuga

SEQ ID NO: 1771944 - RNA, 14 nt, Homo sapiens
gacggauuccuugg

SEQ ID NO: 1771945 - RNA, 20 nt, Homo sapiens
ggguaaaugcaaaguucugu

SEQ ID NO: 1771946 - RNA, 12 nt, Homo sapiens
uauauucccaaa

SEQ ID NO: 1771947 - RNA, 19 nt, Homo sapiens
uaaucugauuauacaccau

SEQ ID NO: 1771948 - RNA, 16 nt, Homo sapiens
uagaagucacacagua

SEQ ID NO: 1771949 - RNA, 20 nt, Homo sapiens
cugcagccucaggacuggga

SEQ ID NO: 1771950 - RNA, 12 nt, Homo sapiens
augcucaagaaa

SEQ ID NO: 1771951 - RNA, 20 nt, Homo sapiens
cuugagcuggauucacuugg

SEQ ID NO: 1771952 - RNA, 12 nt, Homo sapiens
agaaugugauuc

SEQ ID NO: 1771953 - RNA, 21 nt, Homo sapiens
acgugaaauuugccucugucc

SEQ ID NO: 1771954 - RNA, 14 nt, Homo sapiens
ugagaucacuacuc

SEQ ID NO: 1771955 - RNA, 21 nt, Homo sapiens
gcaccgggcccuccuugccug

SEQ ID NO: 1771956 - RNA, 13 nt, Homo sapiens
gucugguuuauuu

SEQ ID NO: 1771957 - RNA, 23 nt, Homo sapiens
uuacggauuuauuauauaaauau

SEQ ID NO: 1771958 - RNA, 18 nt, Homo sapiens
auauuauuugcuaauuaa

SEQ ID NO: 1771959 - RNA, 22 nt, Homo sapiens
cuccccgccaacccugccugcc

SEQ ID NO: 1771960 - RNA, 12 nt, Homo sapiens
cucaauccugca

SEQ ID NO: 1771961 - RNA, 13 nt, Homo sapiens
cuugcguacucag

SEQ ID NO: 1771962 - RNA, 14 nt, Homo sapiens
ugagugauccuccc

SEQ ID NO: 1771963 - RNA, 13 nt, Homo sapiens
cccugcaaucacu

SEQ ID NO: 1771964 - RNA, 19 nt, Homo sapiens
uaucaaaaaguacaauaau

SEQ ID NO: 1771965 - RNA, 19 nt, Homo sapiens
acaagccucaaagucccuu

SEQ ID NO: 1771966 - RNA, 17 nt, Homo sapiens
gaaaaauauagccuuua

SEQ ID NO: 1771967 - RNA, 13 nt, Homo sapiens
gcgugugugcaag

SEQ ID NO: 1771968 - RNA, 16 nt, Homo sapiens
uguuggcccucaccag

SEQ ID NO: 1771969 - RNA, 18 nt, Homo sapiens
acuuauaaaauacaucuc

SEQ ID NO: 1771970 - RNA, 22 nt, Homo sapiens
auucugugagacaccaggcauc

SEQ ID NO: 1771971 - RNA, 17 nt, Homo sapiens
cuucuccacaaccuccu

SEQ ID NO: 1771972 - RNA, 16 nt, Homo sapiens
auguuuggaaaccaca

SEQ ID NO: 1771973 - RNA, 14 nt, Homo sapiens
ugcugggcucccag

SEQ ID NO: 1771974 - RNA, 18 nt, Homo sapiens
acugauagcuuacacuga

SEQ ID NO: 1771975 - RNA, 20 nt, Homo sapiens
uauaaacaggagacagguca

SEQ ID NO: 1771976 - RNA, 17 nt, Homo sapiens
uugagccuuaaaaccca

SEQ ID NO: 1771977 - RNA, 22 nt, Homo sapiens
ccuucaaguugagaacugguca

SEQ ID NO: 1771978 - RNA, 23 nt, Homo sapiens
guuaguucaauccugauucauau

SEQ ID NO: 1771979 - RNA, 20 nt, Homo sapiens
cauauauuuaauaugucaaa

SEQ ID NO: 1771980 - RNA, 14 nt, Homo sapiens
aucucuacuuuccu

SEQ ID NO: 1771981 - RNA, 24 nt, Homo sapiens
uaaagguacgauuauacuugagau

SEQ ID NO: 1771982 - RNA, 13 nt, Homo sapiens
gcuggugaauauu

SEQ ID NO: 1771983 - RNA, 22 nt, Homo sapiens
guuagcuggguuuacaugugau

SEQ ID NO: 1771984 - RNA, 21 nt, Homo sapiens
gauccggcagccucucuucac

SEQ ID NO: 1771985 - RNA, 15 nt, Homo sapiens
uaauccuucuggcaa

SEQ ID NO: 1771986 - RNA, 15 nt, Homo sapiens
augggagacacugau

SEQ ID NO: 1771987 - RNA, 16 nt, Homo sapiens
cacauuacuugcacaa

SEQ ID NO: 1771988 - RNA, 18 nt, Homo sapiens
agaaggugauaaauguca

SEQ ID NO: 1771989 - RNA, 18 nt, Homo sapiens
guuguagaaauuaacaaa

SEQ ID NO: 1771990 - RNA, 18 nt, Homo sapiens
acuauuucugaacaaaga

SEQ ID NO: 1771991 - RNA, 13 nt, Homo sapiens
uaggagauacaaa

SEQ ID NO: 1771992 - RNA, 17 nt, Homo sapiens
gagccuccugcccuuac

SEQ ID NO: 1771993 - RNA, 23 nt, Homo sapiens
gaauauuuuuggcauuccucuaa

SEQ ID NO: 1771994 - RNA, 15 nt, Homo sapiens
agaaccauuuacuua

SEQ ID NO: 1771995 - RNA, 17 nt, Homo sapiens
uaucugaaccuacugag

SEQ ID NO: 1771996 - RNA, 19 nt, Homo sapiens
aaucucuaggaagucaaua

SEQ ID NO: 1771997 - RNA, 22 nt, Homo sapiens
aucauugagaaauaaagcacau

SEQ ID NO: 1771998 - RNA, 11 nt, Homo sapiens
ugacaguauua

SEQ ID NO: 1771999 - RNA, 21 nt, Homo sapiens
caaucagagagccuagaacau

SEQ ID NO: 1772000 - RNA, 12 nt, Homo sapiens
ucugagccaaag

SEQ ID NO: 1772001 - RNA, 21 nt, Homo sapiens
uccaccuguaaaaacugcaca

SEQ ID NO: 1772002 - RNA, 16 nt, Homo sapiens
ugaaagggaucaucau

SEQ ID NO: 1772003 - RNA, 20 nt, Homo sapiens
aacacuauauguauguacuu

SEQ ID NO: 1772004 - RNA, 16 nt, Homo sapiens
ucccggguguguacac

SEQ ID NO: 1772005 - RNA, 18 nt, Homo sapiens
ugcuuccugucugaguaa

SEQ ID NO: 1772006 - RNA, 15 nt, Homo sapiens
cagucuuugcaguuc

SEQ ID NO: 1772007 - RNA, 17 nt, Homo sapiens
ucagcccugcaccaugc

SEQ ID NO: 1772008 - RNA, 17 nt, Homo sapiens
uaaaugggggugcauuu

SEQ ID NO: 1772009 - RNA, 17 nt, Homo sapiens
uaauggauucaguauua

SEQ ID NO: 1772010 - RNA, 19 nt, Homo sapiens
aagauuuugggagaguaaa

SEQ ID NO: 1772011 - RNA, 18 nt, Homo sapiens
uaacuugagauucaagac

SEQ ID NO: 1772012 - RNA, 14 nt, Homo sapiens
gcgggcuaacggga

SEQ ID NO: 1772013 - RNA, 16 nt, Homo sapiens
cuuuccaaccggcuuu

SEQ ID NO: 1772014 - RNA, 21 nt, Homo sapiens
ugaaaucugaggaaggugcuu

SEQ ID NO: 1772015 - RNA, 21 nt, Homo sapiens
gacacagcccacccucuguga

SEQ ID NO: 1772016 - RNA, 19 nt, Homo sapiens
gagagcggggaugugacau

SEQ ID NO: 1772017 - RNA, 19 nt, Homo sapiens
ccagaggccuuggccaagc

SEQ ID NO: 1772018 - RNA, 23 nt, Homo sapiens
cagcugacagcugcucaaaucau

SEQ ID NO: 1772019 - RNA, 21 nt, Homo sapiens
uguccucuucuggcuacugca

SEQ ID NO: 1772020 - RNA, 16 nt, Homo sapiens
gccauuggcuacugac

SEQ ID NO: 1772021 - RNA, 14 nt, Homo sapiens
cucuucuaacacaa

SEQ ID NO: 1772022 - RNA, 18 nt, Homo sapiens
ggaaaugguggugcuuua

SEQ ID NO: 1772023 - RNA, 16 nt, Homo sapiens
acugguauguguggau

SEQ ID NO: 1772024 - RNA, 11 nt, Homo sapiens
cagaagcugcc

SEQ ID NO: 1772025 - RNA, 17 nt, Homo sapiens
aggaccugagaccugaa

SEQ ID NO: 1772026 - RNA, 12 nt, Homo sapiens
agaucugcacug

SEQ ID NO: 1772027 - RNA, 15 nt, Homo sapiens
cuuagccuacagaug

SEQ ID NO: 1772028 - RNA, 22 nt, Homo sapiens
uccuauacuauugaaguaugua

SEQ ID NO: 1772029 - RNA, 20 nt, Homo sapiens
gcuguggguucuuucuccuc

SEQ ID NO: 1772030 - RNA, 15 nt, Homo sapiens
gcauggugcagggag

SEQ ID NO: 1772031 - RNA, 17 nt, Homo sapiens
ccaacauuguucauucu

SEQ ID NO: 1772032 - RNA, 12 nt, Homo sapiens
uggucacaggcu

SEQ ID NO: 1772033 - RNA, 19 nt, Homo sapiens
agauguggccuuuagcaaa

SEQ ID NO: 1772034 - RNA, 22 nt, Homo sapiens
ccaaagugcugggauuacaggu

SEQ ID NO: 1772035 - RNA, 16 nt, Homo sapiens
ucucagaauccaaaga

SEQ ID NO: 1772036 - RNA, 18 nt, Homo sapiens
acucugagucacaggugu

SEQ ID NO: 1772037 - RNA, 12 nt, Homo sapiens
gaauaaauaagu

SEQ ID NO: 1772038 - RNA, 22 nt, Homo sapiens
cacugguccccucuuuucccuu

SEQ ID NO: 1772039 - RNA, 14 nt, Homo sapiens
uaagcuaagccuua

SEQ ID NO: 1772040 - RNA, 16 nt, Homo sapiens
acauaaagacugugcu

SEQ ID NO: 1772041 - RNA, 14 nt, Homo sapiens
auggcucagggugg

SEQ ID NO: 1772042 - RNA, 13 nt, Homo sapiens
gggugggggugga

SEQ ID NO: 1772043 - RNA, 22 nt, Homo sapiens
cuggggccaugggugcauggac

SEQ ID NO: 1772044 - RNA, 18 nt, Homo sapiens
ccucuguucuuggaacaa

SEQ ID NO: 1772045 - RNA, 20 nt, Homo sapiens
ugcaccaacaucuacaagau

SEQ ID NO: 1772046 - RNA, 22 nt, Homo sapiens
uauuuuuuaaaauaacuucaau

SEQ ID NO: 1772047 - RNA, 14 nt, Homo sapiens
accugcacacucca

SEQ ID NO: 1772048 - RNA, 17 nt, Homo sapiens
uccuuuuaagcagugag

SEQ ID NO: 1772049 - RNA, 21 nt, Homo sapiens
uggaauuccagugccaggcca

SEQ ID NO: 1772050 - RNA, 13 nt, Homo sapiens
ccaaguaucuuuc

SEQ ID NO: 1772051 - RNA, 22 nt, Homo sapiens
caaaaaaggaugcaacaauucu

SEQ ID NO: 1772052 - RNA, 19 nt, Homo sapiens
cuaaaauuauguuacugua

SEQ ID NO: 1772053 - RNA, 23 nt, Homo sapiens
cccucgugcccaucaagugcagu

SEQ ID NO: 1772054 - RNA, 23 nt, Homo sapiens
gcuuaucucccugcuucauaucu

SEQ ID NO: 1772055 - RNA, 15 nt, Homo sapiens
uguagcuuugcucuu

SEQ ID NO: 1772056 - RNA, 22 nt, Homo sapiens
ugucugugugugugugugcaua

SEQ ID NO: 1772057 - RNA, 19 nt, Homo sapiens
agaagacuauauuguacac

SEQ ID NO: 1772058 - RNA, 15 nt, Homo sapiens
aaauuaauagcuuuu

SEQ ID NO: 1772059 - RNA, 18 nt, Homo sapiens
aggcuauacuugucuugu

SEQ ID NO: 1772060 - RNA, 13 nt, Homo sapiens
aaauuuauauuca

SEQ ID NO: 1772061 - RNA, 15 nt, Homo sapiens
aaauaauuagcuaua

SEQ ID NO: 1772062 - RNA, 21 nt, Homo sapiens
uucugugaauuauugaauuua

SEQ ID NO: 1772063 - RNA, 16 nt, Homo sapiens
cuaguuucucuuagaa

SEQ ID NO: 1772064 - RNA, 23 nt, Homo sapiens
cucuugagucucuuuaccuaaug

SEQ ID NO: 1772065 - RNA, 15 nt, Homo sapiens
cagaccuucuuccac

SEQ ID NO: 1772066 - RNA, 14 nt, Homo sapiens
ucccuauccauagu

SEQ ID NO: 1772067 - RNA, 15 nt, Homo sapiens
uuggggguauuuucu

SEQ ID NO: 1772068 - RNA, 17 nt, Homo sapiens
accccauuccacagcuc

SEQ ID NO: 1772069 - RNA, 14 nt, Homo sapiens
aaggagccagggaa

SEQ ID NO: 1772070 - RNA, 14 nt, Homo sapiens
aagaagccaggaaa

SEQ ID NO: 1772071 - RNA, 12 nt, Homo sapiens
aagcuguugcua

SEQ ID NO: 1772072 - RNA, 18 nt, Homo sapiens
uaaaaagcgcugcaguag

SEQ ID NO: 1772073 - RNA, 23 nt, Homo sapiens
ugcucucgggugcccugcauuca

SEQ ID NO: 1772074 - RNA, 14 nt, Homo sapiens
cuuaaaaugcaaua

SEQ ID NO: 1772075 - RNA, 17 nt, Homo sapiens
ucagcaaucacaagcca

SEQ ID NO: 1772076 - RNA, 22 nt, Homo sapiens
aaauuguaucaaaugugacauu

SEQ ID NO: 1772077 - RNA, 17 nt, Homo sapiens
uuaagcacacuugacau

SEQ ID NO: 1772078 - RNA, 17 nt, Homo sapiens
auuuucacacaauacaa

SEQ ID NO: 1772079 - RNA, 14 nt, Homo sapiens
gaacauauucaguu

SEQ ID NO: 1772080 - RNA, 19 nt, Homo sapiens
cagugagcaaagauugugc

SEQ ID NO: 1772081 - RNA, 17 nt, Homo sapiens
uucucuuucuuaguccc

SEQ ID NO: 1772082 - RNA, 14 nt, Homo sapiens
gcucuggacaggca

SEQ ID NO: 1772083 - RNA, 17 nt, Homo sapiens
uaaauccuuuacaagau

SEQ ID NO: 1772084 - RNA, 18 nt, Homo sapiens
agguaaucgccaaauagu

SEQ ID NO: 1772085 - RNA, 19 nt, Homo sapiens
gccuagacuuguguguucu

SEQ ID NO: 1772086 - RNA, 14 nt, Homo sapiens
cuuucacaguccug

SEQ ID NO: 1772087 - RNA, 19 nt, Homo sapiens
aggccgggcacaguggcuc

SEQ ID NO: 1772088 - RNA, 17 nt, Homo sapiens
ucugucauccucaggaa

SEQ ID NO: 1772089 - RNA, 20 nt, Homo sapiens
acacagugagaguacucacu

SEQ ID NO: 1772090 - RNA, 14 nt, Homo sapiens
auuuaaaaauaagu

SEQ ID NO: 1772091 - RNA, 20 nt, Homo sapiens
aggaaaagcggacaucagcu

SEQ ID NO: 1772092 - RNA, 17 nt, Homo sapiens
ucaauaugaaccaagua

SEQ ID NO: 1772093 - RNA, 15 nt, Homo sapiens
aaaauaaacaucuga

SEQ ID NO: 1772094 - RNA, 24 nt, Homo sapiens
caugcuacagaaagcugcuugcca

SEQ ID NO: 1772095 - RNA, 22 nt, Homo sapiens
gaugaagaacacagcaugugcc

SEQ ID NO: 1772096 - RNA, 19 nt, Homo sapiens
gcuccagagcaagcauuca

SEQ ID NO: 1772097 - RNA, 23 nt, Homo sapiens
gaacagccgcuccugucugccag

SEQ ID NO: 1772098 - RNA, 21 nt, Homo sapiens
guaaaaccccaucucuacuaa

SEQ ID NO: 1772099 - RNA, 21 nt, Homo sapiens
gugaaaccccgucucuacuaa

SEQ ID NO: 1772100 - RNA, 16 nt, Homo sapiens
ggaggacaguggcaca

SEQ ID NO: 1772101 - RNA, 19 nt, Homo sapiens
ucuucuuacaugcauuuga

SEQ ID NO: 1772102 - RNA, 17 nt, Homo sapiens
cagagugggacuuggag

SEQ ID NO: 1772103 - RNA, 12 nt, Homo sapiens
uccccgucccug

SEQ ID NO: 1772104 - RNA, 16 nt, Homo sapiens
aaggcaccugcuccca

SEQ ID NO: 1772105 - RNA, 18 nt, Homo sapiens
uuaagagucuacucucaa

SEQ ID NO: 1772106 - RNA, 15 nt, Homo sapiens
cacagcagcugaaca

SEQ ID NO: 1772107 - RNA, 15 nt, Homo sapiens
aagaagagaucagga

SEQ ID NO: 1772108 - RNA, 19 nt, Homo sapiens
ucugaaguuauaaacuuau

SEQ ID NO: 1772109 - RNA, 13 nt, Homo sapiens
uuaguuguuauua

SEQ ID NO: 1772110 - RNA, 21 nt, Homo sapiens
uagaagaaagaaaauggaaag

SEQ ID NO: 1772111 - RNA, 16 nt, Homo sapiens
cuauucaacacacaca

SEQ ID NO: 1772112 - RNA, 16 nt, Homo sapiens
aaugcauacucugugc

SEQ ID NO: 1772113 - RNA, 18 nt, Homo sapiens
caaagccaaacucugcca

SEQ ID NO: 1772114 - RNA, 23 nt, Homo sapiens
ucuaaugugcuucuaguaggcac

SEQ ID NO: 1772115 - RNA, 13 nt, Homo sapiens
acugauacugcag

SEQ ID NO: 1772116 - RNA, 12 nt, Homo sapiens
aaacucaucuca

SEQ ID NO: 1772117 - RNA, 19 nt, Homo sapiens
uauauacuuguuguuuaau

SEQ ID NO: 1772118 - RNA, 20 nt, Homo sapiens
aggacuugcuaaagcacuuu

SEQ ID NO: 1772119 - RNA, 14 nt, Homo sapiens
auuucucucuccag

SEQ ID NO: 1772120 - RNA, 19 nt, Homo sapiens
ucagggauuuuuauuugua

SEQ ID NO: 1772121 - RNA, 15 nt, Homo sapiens
cccuggugccucuca

SEQ ID NO: 1772122 - RNA, 16 nt, Homo sapiens
cuggggaagacagugg

SEQ ID NO: 1772123 - RNA, 21 nt, Homo sapiens
auggauuucuaggccugauau

SEQ ID NO: 1772124 - RNA, 21 nt, Homo sapiens
gccugcaggagagagcagcac

SEQ ID NO: 1772125 - RNA, 22 nt, Homo sapiens
ccaugagcugcuccaucaccug

SEQ ID NO: 1772126 - RNA, 19 nt, Homo sapiens
ugaaaucaccuuuucuaaa

SEQ ID NO: 1772127 - RNA, 23 nt, Homo sapiens
uuuucacaccuuguggagaacau

SEQ ID NO: 1772128 - RNA, 22 nt, Homo sapiens
gcagcucauuuugucugguccu

SEQ ID NO: 1772129 - RNA, 17 nt, Homo sapiens
ccccucugucuugugaa

SEQ ID NO: 1772130 - RNA, 15 nt, Homo sapiens
uccucuccaugcaag

SEQ ID NO: 1772131 - RNA, 17 nt, Homo sapiens
auuuauaaauaacaaaa

SEQ ID NO: 1772132 - RNA, 15 nt, Homo sapiens
ggaaaauaaucucaa

SEQ ID NO: 1772133 - RNA, 17 nt, Homo sapiens
ugacaguagcucuuaga

SEQ ID NO: 1772134 - RNA, 20 nt, Homo sapiens
gcccuuagcuccccucccag

SEQ ID NO: 1772135 - RNA, 20 nt, Homo sapiens
uuagacuaguuucuuauuaa

SEQ ID NO: 1772136 - RNA, 15 nt, Homo sapiens
auuguaaucauaaau

SEQ ID NO: 1772137 - RNA, 23 nt, Homo sapiens
ccuaaugaaggaguucacuguaa

SEQ ID NO: 1772138 - RNA, 22 nt, Homo sapiens
cuagagagggaggcaagcccug

SEQ ID NO: 1772139 - RNA, 15 nt, Homo sapiens
gaacaagcuaauugg

SEQ ID NO: 1772140 - RNA, 17 nt, Homo sapiens
uacccuccucuauuucu

SEQ ID NO: 1772141 - RNA, 21 nt, Homo sapiens
ucucaagacggagaugcaugg

SEQ ID NO: 1772142 - RNA, 14 nt, Homo sapiens
acauguauacauau

SEQ ID NO: 1772143 - RNA, 20 nt, Homo sapiens
augucuuaaucaugagauaa

SEQ ID NO: 1772144 - RNA, 13 nt, Homo sapiens
cucaacaaccaag

SEQ ID NO: 1772145 - RNA, 19 nt, Homo sapiens
ccuaccuuccccagacuug

SEQ ID NO: 1772146 - RNA, 15 nt, Homo sapiens
uucagcauguucuca

SEQ ID NO: 1772147 - RNA, 17 nt, Homo sapiens
auaaaaaaagacaaauu

SEQ ID NO: 1772148 - RNA, 12 nt, Homo sapiens
uggcuaauugca

SEQ ID NO: 1772149 - RNA, 16 nt, Homo sapiens
gaccagaaguguuuca

SEQ ID NO: 1772150 - RNA, 13 nt, Homo sapiens
ggcacaguggacu

SEQ ID NO: 1772151 - RNA, 17 nt, Homo sapiens
ccuucggaauccagugc

SEQ ID NO: 1772152 - RNA, 24 nt, Homo sapiens
ucauugcccccagggcacuucaca

SEQ ID NO: 1772153 - RNA, 19 nt, Homo sapiens
gcguggagaaguggugcuc

SEQ ID NO: 1772154 - RNA, 19 nt, Homo sapiens
cuggauuugcauacauucu

SEQ ID NO: 1772155 - RNA, 14 nt, Homo sapiens
ugccgagaccucaa

SEQ ID NO: 1772156 - RNA, 17 nt, Homo sapiens
acaucgccaaggacuga

SEQ ID NO: 1772157 - RNA, 12 nt, Homo sapiens
ggcuuuggccag

SEQ ID NO: 1772158 - RNA, 21 nt, Homo sapiens
cuacuaucacugaacaaacua

SEQ ID NO: 1772159 - RNA, 24 nt, Homo sapiens
caaaauauaaaucacagauuucca

SEQ ID NO: 1772160 - RNA, 23 nt, Homo sapiens
ggcaccuuaagauuuugcaccug

SEQ ID NO: 1772161 - RNA, 18 nt, Homo sapiens
aucccuucucacagcaca

SEQ ID NO: 1772162 - RNA, 16 nt, Homo sapiens
aacuuagaaaccaaau

SEQ ID NO: 1772163 - RNA, 18 nt, Homo sapiens
aauauguugguauucucc

SEQ ID NO: 1772164 - RNA, 16 nt, Homo sapiens
cgaaccacccaaaaca

SEQ ID NO: 1772165 - RNA, 17 nt, Homo sapiens
uuaauugaggcuuacag

SEQ ID NO: 1772166 - RNA, 17 nt, Homo sapiens
uccaugaucccacugac

SEQ ID NO: 1772167 - RNA, 14 nt, Homo sapiens
uucccugauggccu

SEQ ID NO: 1772168 - RNA, 16 nt, Homo sapiens
gaagcuggucuagacu

SEQ ID NO: 1772169 - RNA, 17 nt, Homo sapiens
ccacugcugggcuccac

SEQ ID NO: 1772170 - RNA, 19 nt, Homo sapiens
cuuguagccagaauucugg

SEQ ID NO: 1772171 - RNA, 15 nt, Homo sapiens
cagacaccaugugca

SEQ ID NO: 1772172 - RNA, 13 nt, Homo sapiens
agcucacccaagg

SEQ ID NO: 1772173 - RNA, 19 nt, Homo sapiens
ucuuaguaugugcauuuaa

SEQ ID NO: 1772174 - RNA, 16 nt, Homo sapiens
gauuccucucuaagug

SEQ ID NO: 1772175 - RNA, 13 nt, Homo sapiens
uuuaauaugucaa

SEQ ID NO: 1772176 - RNA, 17 nt, Homo sapiens
cuucuguccuacucugu

SEQ ID NO: 1772177 - RNA, 15 nt, Homo sapiens
acaauugcaacagaa

SEQ ID NO: 1772178 - RNA, 18 nt, Homo sapiens
uuuccucuuaauucccaa

SEQ ID NO: 1772179 - RNA, 20 nt, Homo sapiens
cuacaacuuuuccuaaggca

SEQ ID NO: 1772180 - RNA, 12 nt, Homo sapiens
uuauaaauauca

SEQ ID NO: 1772181 - RNA, 12 nt, Homo sapiens
aaaaaaauuacu

SEQ ID NO: 1772182 - RNA, 12 nt, Homo sapiens
uuaaaaauaucu

SEQ ID NO: 1772183 - RNA, 21 nt, Homo sapiens
guauaguaaaaccaaccagcu

SEQ ID NO: 1772184 - RNA, 15 nt, Homo sapiens
acaugacauccacau

SEQ ID NO: 1772185 - RNA, 20 nt, Homo sapiens
cuucagcuguacauacucag

SEQ ID NO: 1772186 - RNA, 18 nt, Homo sapiens
augauugcuuaucaguag

SEQ ID NO: 1772187 - RNA, 23 nt, Homo sapiens
aaccuugcuguccugaucuguga

SEQ ID NO: 1772188 - RNA, 17 nt, Homo sapiens
uauauaaagccucacau

SEQ ID NO: 1772189 - RNA, 21 nt, Homo sapiens
acuacuaaagugccuacccca

SEQ ID NO: 1772190 - RNA, 11 nt, Homo sapiens
cuuaaaacacu

SEQ ID NO: 1772191 - RNA, 14 nt, Homo sapiens
ccuuuguacuuugu

SEQ ID NO: 1772192 - RNA, 16 nt, Homo sapiens
aagccccggacucagg

SEQ ID NO: 1772193 - RNA, 19 nt, Homo sapiens
auauuuuauuauagucacu

SEQ ID NO: 1772194 - RNA, 16 nt, Homo sapiens
ccuuccuaguggguua

SEQ ID NO: 1772195 - RNA, 19 nt, Homo sapiens
agaagagggucugcauuuu

SEQ ID NO: 1772196 - RNA, 13 nt, Homo sapiens
uaucucaugacaa

SEQ ID NO: 1772197 - RNA, 17 nt, Homo sapiens
ggcuuggggcuggagag

SEQ ID NO: 1772198 - RNA, 22 nt, Homo sapiens
agagaaacuuugaguacagaua

SEQ ID NO: 1772199 - RNA, 21 nt, Homo sapiens
gcgcaggaccauggacugggg

SEQ ID NO: 1772200 - RNA, 17 nt, Homo sapiens
cuuggugcugggaaccu

SEQ ID NO: 1772201 - RNA, 14 nt, Homo sapiens
aguguguucauccc

SEQ ID NO: 1772202 - RNA, 15 nt, Homo sapiens
aaacaaggaagccaa

SEQ ID NO: 1772203 - RNA, 16 nt, Homo sapiens
cucacccuacucugga

SEQ ID NO: 1772204 - RNA, 21 nt, Homo sapiens
ggcuagaagaaaguaaaaaga

SEQ ID NO: 1772205 - RNA, 22 nt, Homo sapiens
acguaccgugcaucugagauaa

SEQ ID NO: 1772206 - RNA, 16 nt, Homo sapiens
auccccaguuuuccau

SEQ ID NO: 1772207 - RNA, 19 nt, Homo sapiens
aaaauacuguacauuguga

SEQ ID NO: 1772208 - RNA, 14 nt, Homo sapiens
uucaaacuacugua

SEQ ID NO: 1772209 - RNA, 23 nt, Homo sapiens
gucauuauuuuuguuagcaaaga

SEQ ID NO: 1772210 - RNA, 17 nt, Homo sapiens
uguaaauguaaacucag

SEQ ID NO: 1772211 - RNA, 19 nt, Homo sapiens
cacugucuuuaaaagucau

SEQ ID NO: 1772212 - RNA, 22 nt, Homo sapiens
cugaccuuaguuugcugccauc

SEQ ID NO: 1772213 - RNA, 19 nt, Homo sapiens
aagguauguaguuacagaa

SEQ ID NO: 1772214 - RNA, 14 nt, Homo sapiens
cauguaaccacugc

SEQ ID NO: 1772215 - RNA, 15 nt, Homo sapiens
cuugcuagacacacu

SEQ ID NO: 1772216 - RNA, 15 nt, Homo sapiens
uuagaaugagccuua

SEQ ID NO: 1772217 - RNA, 18 nt, Homo sapiens
ugagacaggaaaaaccaa

SEQ ID NO: 1772218 - RNA, 17 nt, Homo sapiens
cugcugcaaacauugua

SEQ ID NO: 1772219 - RNA, 14 nt, Homo sapiens
acugcccccgccac

SEQ ID NO: 1772220 - RNA, 21 nt, Homo sapiens
uagaaguucaguuuuuacuga

SEQ ID NO: 1772221 - RNA, 20 nt, Homo sapiens
aggaaaauauugacaaguuu

SEQ ID NO: 1772222 - RNA, 14 nt, Homo sapiens
ucuuuaaaucaaaa

SEQ ID NO: 1772223 - RNA, 14 nt, Homo sapiens
aaaauaaaaauuaa

SEQ ID NO: 1772224 - RNA, 20 nt, Homo sapiens
cuguaugagcuucuaacuca

SEQ ID NO: 1772225 - RNA, 19 nt, Homo sapiens
ccaguuugcuuaguucuca

SEQ ID NO: 1772226 - RNA, 22 nt, Homo sapiens
agacagcccaacagcuguuccu

SEQ ID NO: 1772227 - RNA, 14 nt, Homo sapiens
ugcuguuuguacaa

SEQ ID NO: 1772228 - RNA, 18 nt, Homo sapiens
guggcccaagggugguga

SEQ ID NO: 1772229 - RNA, 18 nt, Homo sapiens
auuucuuuaugaucuuaa

SEQ ID NO: 1772230 - RNA, 15 nt, Homo sapiens
caagcggcucaagaa

SEQ ID NO: 1772231 - RNA, 18 nt, Homo sapiens
cucccaugugugaugcug

SEQ ID NO: 1772232 - RNA, 18 nt, Homo sapiens
cuggcaagucuuccauga

SEQ ID NO: 1772233 - RNA, 16 nt, Homo sapiens
aguuaaagaagcaauc

SEQ ID NO: 1772234 - RNA, 17 nt, Homo sapiens
ucugggagagccagcuu

SEQ ID NO: 1772235 - RNA, 19 nt, Homo sapiens
uccuggugagaacugagga

SEQ ID NO: 1772236 - RNA, 15 nt, Homo sapiens
uuauauuaaaguaaa

SEQ ID NO: 1772237 - RNA, 16 nt, Homo sapiens
cuggaagaggaaccag

SEQ ID NO: 1772238 - RNA, 15 nt, Homo sapiens
uccaucugauuccag

SEQ ID NO: 1772239 - RNA, 20 nt, Homo sapiens
uggaugaaugcccagugaga

SEQ ID NO: 1772240 - RNA, 23 nt, Homo sapiens
acaauuauaaacucauuuugcuu

SEQ ID NO: 1772241 - RNA, 13 nt, Homo sapiens
cucacagugacau

SEQ ID NO: 1772242 - RNA, 17 nt, Homo sapiens
gugcugacuaagccgaa

SEQ ID NO: 1772243 - RNA, 15 nt, Homo sapiens
aagagccauucacuc

SEQ ID NO: 1772244 - RNA, 16 nt, Homo sapiens
uaguuaccuacugagu

SEQ ID NO: 1772245 - RNA, 22 nt, Homo sapiens
uuagcaguaacggguagcagca

SEQ ID NO: 1772246 - RNA, 17 nt, Homo sapiens
caccuuccauagccucc

SEQ ID NO: 1772247 - RNA, 22 nt, Homo sapiens
guucaccuuuauauauguacua

SEQ ID NO: 1772248 - RNA, 19 nt, Homo sapiens
gacuguagcuucucuugcu

SEQ ID NO: 1772249 - RNA, 17 nt, Homo sapiens
aggacgccgcuggugcu

SEQ ID NO: 1772250 - RNA, 16 nt, Homo sapiens
agauuuagaggggaaa

SEQ ID NO: 1772251 - RNA, 19 nt, Homo sapiens
uggcauguguacaaugaaa

SEQ ID NO: 1772252 - RNA, 17 nt, Homo sapiens
acaaaauacacaccccu

SEQ ID NO: 1772253 - RNA, 19 nt, Homo sapiens
cauuuguauuuugugauga

SEQ ID NO: 1772254 - RNA, 18 nt, Homo sapiens
gaucguucucugccucac

SEQ ID NO: 1772255 - RNA, 14 nt, Homo sapiens
aggaagugacucau

SEQ ID NO: 1772256 - RNA, 19 nt, Homo sapiens
aucuuccugccuacuggau

SEQ ID NO: 1772257 - RNA, 13 nt, Homo sapiens
auaaguuuucaca

SEQ ID NO: 1772258 - RNA, 18 nt, Homo sapiens
auccuguugaaaagccau

SEQ ID NO: 1772259 - RNA, 18 nt, Homo sapiens
aggugccgguaccagccu

SEQ ID NO: 1772260 - RNA, 22 nt, Homo sapiens
uccuaucuccagcggcccuguc

SEQ ID NO: 1772261 - RNA, 17 nt, Homo sapiens
uaagaagaggagccuca

SEQ ID NO: 1772262 - RNA, 14 nt, Homo sapiens
cuguuccuucacau

SEQ ID NO: 1772263 - RNA, 18 nt, Homo sapiens
cucacuggggucugugug

SEQ ID NO: 1772264 - RNA, 14 nt, Homo sapiens
aaaacguauugcau

SEQ ID NO: 1772265 - RNA, 18 nt, Homo sapiens
auggccuccauccagaaa

SEQ ID NO: 1772266 - RNA, 17 nt, Homo sapiens
auugaaguccuccagac

SEQ ID NO: 1772267 - RNA, 15 nt, Homo sapiens
gcugaggcuggcaca

SEQ ID NO: 1772268 - RNA, 14 nt, Homo sapiens
ucaaaaccagugaa

SEQ ID NO: 1772269 - RNA, 17 nt, Homo sapiens
gcaauuuuguaaauuga

SEQ ID NO: 1772270 - RNA, 18 nt, Homo sapiens
gagacccguagaugccag

SEQ ID NO: 1772271 - RNA, 19 nt, Homo sapiens
cccucaucgggccucuggg

SEQ ID NO: 1772272 - RNA, 23 nt, Homo sapiens
auguaacaucauaauuacauucc

SEQ ID NO: 1772273 - RNA, 19 nt, Homo sapiens
gcuuuccaauguagcucag

SEQ ID NO: 1772274 - RNA, 21 nt, Homo sapiens
acccauccgcuccgugaccua

SEQ ID NO: 1772275 - RNA, 22 nt, Homo sapiens
gacccuguggccaggugcuuuu

SEQ ID NO: 1772276 - RNA, 16 nt, Homo sapiens
uaaacccuuaaccuaa

SEQ ID NO: 1772277 - RNA, 23 nt, Homo sapiens
cagaguuggacuucuagacucac

SEQ ID NO: 1772278 - RNA, 18 nt, Homo sapiens
ccggaugcuucuccauga

SEQ ID NO: 1772279 - RNA, 17 nt, Homo sapiens
ccauugcaugaauucac

SEQ ID NO: 1772280 - RNA, 21 nt, Homo sapiens
uuaacaugcuuaugacaauga

SEQ ID NO: 1772281 - RNA, 17 nt, Homo sapiens
ucaagagugagugaaca

SEQ ID NO: 1772282 - RNA, 15 nt, Homo sapiens
ggagguucucagagc

SEQ ID NO: 1772283 - RNA, 22 nt, Homo sapiens
caaccgcuucccuauuuauuua

SEQ ID NO: 1772284 - RNA, 16 nt, Homo sapiens
uacagugccacgacau

SEQ ID NO: 1772285 - RNA, 17 nt, Homo sapiens
ccagggacccuggagua

SEQ ID NO: 1772286 - RNA, 21 nt, Homo sapiens
augugucuuuacaccucgcug

SEQ ID NO: 1772287 - RNA, 20 nt, Homo sapiens
aauuuauacaccagcaauuu

SEQ ID NO: 1772288 - RNA, 22 nt, Homo sapiens
accaauauuucuucacaaagga

SEQ ID NO: 1772289 - RNA, 18 nt, Homo sapiens
caacuuguguucuauuaa

SEQ ID NO: 1772290 - RNA, 18 nt, Homo sapiens
acaggagggaacauuucc

SEQ ID NO: 1772291 - RNA, 23 nt, Homo sapiens
acgcaaguucccaguuggagcuc

SEQ ID NO: 1772292 - RNA, 21 nt, Homo sapiens
ugaagauggcauccugugaag

SEQ ID NO: 1772293 - RNA, 18 nt, Homo sapiens
ucucacuguugcccaggc

SEQ ID NO: 1772294 - RNA, 17 nt, Homo sapiens
gaaauuaauuugugaau

SEQ ID NO: 1772295 - RNA, 21 nt, Homo sapiens
uguauauacaguuauuuugga

SEQ ID NO: 1772296 - RNA, 16 nt, Homo sapiens
uucagugguccaggau

SEQ ID NO: 1772297 - RNA, 13 nt, Homo sapiens
ccuggugugaacu

SEQ ID NO: 1772298 - RNA, 21 nt, Homo sapiens
cccaggucuuuucaugugcag

SEQ ID NO: 1772299 - RNA, 19 nt, Homo sapiens
aaauuaucuuuuuucuucc

SEQ ID NO: 1772300 - RNA, 23 nt, Homo sapiens
gcuggcuuaugccccugcacuga

SEQ ID NO: 1772301 - RNA, 16 nt, Homo sapiens
aauaaugaguuguucc

SEQ ID NO: 1772302 - RNA, 12 nt, Homo sapiens
aaagacacugcc

SEQ ID NO: 1772303 - RNA, 22 nt, Homo sapiens
cugacaacagacuucugaaaua

SEQ ID NO: 1772304 - RNA, 19 nt, Homo sapiens
aacccacagaugucucugg

SEQ ID NO: 1772305 - RNA, 18 nt, Homo sapiens
ucacuuccaagagccuuu

SEQ ID NO: 1772306 - RNA, 19 nt, Homo sapiens
cuuacugccuuagucccaa

SEQ ID NO: 1772307 - RNA, 19 nt, Homo sapiens
aaaauugaccaagugaugu

SEQ ID NO: 1772308 - RNA, 10 nt, Homo sapiens
acucaaacau

SEQ ID NO: 1772309 - RNA, 17 nt, Homo sapiens
acauggcaauugcacuc

SEQ ID NO: 1772310 - RNA, 13 nt, Homo sapiens
cuaagccacucuu

SEQ ID NO: 1772311 - RNA, 12 nt, Homo sapiens
uaaaaacugaag

SEQ ID NO: 1772312 - RNA, 14 nt, Homo sapiens
agccaucacccuca

SEQ ID NO: 1772313 - RNA, 14 nt, Homo sapiens
agacaucaccauca

SEQ ID NO: 1772314 - RNA, 19 nt, Homo sapiens
ugguacaaguuuacaugau

SEQ ID NO: 1772315 - RNA, 21 nt, Homo sapiens
gaagcguugccauugaacuca

SEQ ID NO: 1772316 - RNA, 12 nt, Homo sapiens
cacaauacuguu

SEQ ID NO: 1772317 - RNA, 14 nt, Homo sapiens
uuauucugccuucc

SEQ ID NO: 1772318 - RNA, 12 nt, Homo sapiens
uccauguucacc

SEQ ID NO: 1772319 - RNA, 24 nt, Homo sapiens
auaugcuagcauuuuagcugugca

SEQ ID NO: 1772320 - RNA, 14 nt, Homo sapiens
ugggugugggacac

SEQ ID NO: 1772321 - RNA, 15 nt, Homo sapiens
guaguuuggagacaa

SEQ ID NO: 1772322 - RNA, 12 nt, Homo sapiens
gaggagaacaaa

SEQ ID NO: 1772323 - RNA, 21 nt, Homo sapiens
aaaauacuauuuaagauguga

SEQ ID NO: 1772324 - RNA, 20 nt, Homo sapiens
caugauuuuauacauaguca

SEQ ID NO: 1772325 - RNA, 15 nt, Homo sapiens
gaguggaaaugggga

SEQ ID NO: 1772326 - RNA, 16 nt, Homo sapiens
uacccuuguaccccau

SEQ ID NO: 1772327 - RNA, 15 nt, Homo sapiens
gcaacaagacugcca

SEQ ID NO: 1772328 - RNA, 15 nt, Homo sapiens
acuguaaggcaauca

SEQ ID NO: 1772329 - RNA, 14 nt, Homo sapiens
aaggacaugugcua

SEQ ID NO: 1772330 - RNA, 17 nt, Homo sapiens
acuugauacugaaugca

SEQ ID NO: 1772331 - RNA, 13 nt, Homo sapiens
cccucgccuucac

SEQ ID NO: 1772332 - RNA, 14 nt, Homo sapiens
cauaccugugccug

SEQ ID NO: 1772333 - RNA, 17 nt, Homo sapiens
agacuauuuaguggaac

SEQ ID NO: 1772334 - RNA, 12 nt, Homo sapiens
gagaauugccuc

SEQ ID NO: 1772335 - RNA, 21 nt, Homo sapiens
uauuuucagaugugaaccauu

SEQ ID NO: 1772336 - RNA, 20 nt, Homo sapiens
cauuaaauaccuauaugaau

SEQ ID NO: 1772337 - RNA, 15 nt, Homo sapiens
ggcucugguuccucc

SEQ ID NO: 1772338 - RNA, 13 nt, Homo sapiens
cuaggguaggggc

SEQ ID NO: 1772339 - RNA, 18 nt, Homo sapiens
guggcucacccuguccag

SEQ ID NO: 1772340 - RNA, 17 nt, Homo sapiens
cccuguccuaagcacuu

SEQ ID NO: 1772341 - RNA, 17 nt, Homo sapiens
aaugaaagacucuucac

SEQ ID NO: 1772342 - RNA, 22 nt, Homo sapiens
aagucagcuuuacuagugccaa

SEQ ID NO: 1772343 - RNA, 19 nt, Homo sapiens
ucagguucuuucugaaauc

SEQ ID NO: 1772344 - RNA, 16 nt, Homo sapiens
cuguauauaacuaugg

SEQ ID NO: 1772345 - RNA, 16 nt, Homo sapiens
uggcauugagacaucu

SEQ ID NO: 1772346 - RNA, 14 nt, Homo sapiens
aauuuucacaaaau

SEQ ID NO: 1772347 - RNA, 19 nt, Homo sapiens
ucccaaguagcugcaacaa

SEQ ID NO: 1772348 - RNA, 20 nt, Homo sapiens
uuccucacuaccacuuguaa

SEQ ID NO: 1772349 - RNA, 14 nt, Homo sapiens
aacauucaagagag

SEQ ID NO: 1772350 - RNA, 15 nt, Homo sapiens
acuugugcuuacaau

SEQ ID NO: 1772351 - RNA, 20 nt, Homo sapiens
ugcuugaggaauauugcugc

SEQ ID NO: 1772352 - RNA, 15 nt, Homo sapiens
aacuauaacuuaaag

SEQ ID NO: 1772353 - RNA, 22 nt, Homo sapiens
ggauuauuaagugauuauuuaa

SEQ ID NO: 1772354 - RNA, 23 nt, Homo sapiens
cugagauauuauuuuaaauuucu

SEQ ID NO: 1772355 - RNA, 17 nt, Homo sapiens
aucagauuagacacuau

SEQ ID NO: 1772356 - RNA, 19 nt, Homo sapiens
cugcuuuuugacaugaaca

SEQ ID NO: 1772357 - RNA, 12 nt, Homo sapiens
cgaaacaguaag

SEQ ID NO: 1772358 - RNA, 21 nt, Homo sapiens
auguuuccacuggcuuuugcc

SEQ ID NO: 1772359 - RNA, 16 nt, Homo sapiens
ccugaaagcacuguag

SEQ ID NO: 1772360 - RNA, 13 nt, Homo sapiens
uggauugauaucg

SEQ ID NO: 1772361 - RNA, 21 nt, Homo sapiens
cucagaauucggugugcugcc

SEQ ID NO: 1772362 - RNA, 15 nt, Homo sapiens
ugagcugagaccacu

SEQ ID NO: 1772363 - RNA, 13 nt, Homo sapiens
cauaaaugaccua

SEQ ID NO: 1772364 - RNA, 13 nt, Homo sapiens
aggcaagagaaaa

SEQ ID NO: 1772365 - RNA, 17 nt, Homo sapiens
uugaaauaccagugaac

SEQ ID NO: 1772366 - RNA, 20 nt, Homo sapiens
augugaauuauugacacuga

SEQ ID NO: 1772367 - RNA, 14 nt, Homo sapiens
cacauuuucagcca

SEQ ID NO: 1772368 - RNA, 14 nt, Homo sapiens
uggacauuugccuu

SEQ ID NO: 1772369 - RNA, 12 nt, Homo sapiens
cacgugaaggca

SEQ ID NO: 1772370 - RNA, 19 nt, Homo sapiens
cugaaccauuccaacuuca

SEQ ID NO: 1772371 - RNA, 23 nt, Homo sapiens
aggagguuucaaagaaaaggugu

SEQ ID NO: 1772372 - RNA, 14 nt, Homo sapiens
uggcuuagugccac

SEQ ID NO: 1772373 - RNA, 14 nt, Homo sapiens
uugcucaguuccau

SEQ ID NO: 1772374 - RNA, 14 nt, Homo sapiens
agcuaagauauaau

SEQ ID NO: 1772375 - RNA, 13 nt, Homo sapiens
ugaagacugcaca

SEQ ID NO: 1772376 - RNA, 13 nt, Homo sapiens
ugccaacugccag

SEQ ID NO: 1772377 - RNA, 23 nt, Homo sapiens
cagugcaccuacugcuuacuguu

SEQ ID NO: 1772378 - RNA, 20 nt, Homo sapiens
auucaggaaauguucacuga

SEQ ID NO: 1772379 - RNA, 18 nt, Homo sapiens
cugguuuuacuagugugc

SEQ ID NO: 1772380 - RNA, 22 nt, Homo sapiens
gaaucagcaucucuucuucccu

SEQ ID NO: 1772381 - RNA, 19 nt, Homo sapiens
cuaccaucugcauggggcu

SEQ ID NO: 1772382 - RNA, 16 nt, Homo sapiens
uggacuuucuugcaag

SEQ ID NO: 1772383 - RNA, 18 nt, Homo sapiens
aagucaccuuucugggcu

SEQ ID NO: 1772384 - RNA, 19 nt, Homo sapiens
ucugauguuuggguauugu

SEQ ID NO: 1772385 - RNA, 13 nt, Homo sapiens
aagucauggaauu

SEQ ID NO: 1772386 - RNA, 22 nt, Homo sapiens
aaucccguagccagucuagaca

SEQ ID NO: 1772387 - RNA, 23 nt, Homo sapiens
aacacuacucuuacauguauaaa

SEQ ID NO: 1772388 - RNA, 18 nt, Homo sapiens
uuuuagagauggcuuucc

SEQ ID NO: 1772389 - RNA, 18 nt, Homo sapiens
aaucuuuaggcuuucaaa

SEQ ID NO: 1772390 - RNA, 15 nt, Homo sapiens
caagaacauaguuua

SEQ ID NO: 1772391 - RNA, 19 nt, Homo sapiens
cccacacccucccuuaccc

SEQ ID NO: 1772392 - RNA, 20 nt, Homo sapiens
aguuggagggaaagccagcc

SEQ ID NO: 1772393 - RNA, 18 nt, Homo sapiens
aaagaaauuguauuauca

SEQ ID NO: 1772394 - RNA, 14 nt, Homo sapiens
cucccgaguacagu

SEQ ID NO: 1772395 - RNA, 13 nt, Homo sapiens
aaccucuccuucc

SEQ ID NO: 1772396 - RNA, 13 nt, Homo sapiens
ugaaacagauucu

SEQ ID NO: 1772397 - RNA, 19 nt, Homo sapiens
gcuguauuuuugaaauacu

SEQ ID NO: 1772398 - RNA, 15 nt, Homo sapiens
aaacaaauucaucaa

SEQ ID NO: 1772399 - RNA, 18 nt, Homo sapiens
cucaaagugacuauucag

SEQ ID NO: 1772400 - RNA, 16 nt, Homo sapiens
agucaauagcuugucu

SEQ ID NO: 1772401 - RNA, 20 nt, Homo sapiens
acaaaaaauaaaaacacuua

SEQ ID NO: 1772402 - RNA, 12 nt, Homo sapiens
agagucacaagu

SEQ ID NO: 1772403 - RNA, 15 nt, Homo sapiens
accauugugcauucu

SEQ ID NO: 1772404 - RNA, 16 nt, Homo sapiens
cuccaaaaggcccuuu

SEQ ID NO: 1772405 - RNA, 16 nt, Homo sapiens
agcugcuguccaggaa

SEQ ID NO: 1772406 - RNA, 22 nt, Homo sapiens
aaugaauaugaaacacuacaaa

SEQ ID NO: 1772407 - RNA, 18 nt, Homo sapiens
agcagccgccagcuggga

SEQ ID NO: 1772408 - RNA, 23 nt, Homo sapiens
ugagaaaauaucuugcuuucaaa

SEQ ID NO: 1772409 - RNA, 16 nt, Homo sapiens
ugaccagcaaauacuc

SEQ ID NO: 1772410 - RNA, 13 nt, Homo sapiens
gaugaaacuggaa

SEQ ID NO: 1772411 - RNA, 15 nt, Homo sapiens
uauuauuucaaugug

SEQ ID NO: 1772412 - RNA, 23 nt, Homo sapiens
uauacugcacuuacgcuauccag

SEQ ID NO: 1772413 - RNA, 14 nt, Homo sapiens
aauucuuuccccaa

SEQ ID NO: 1772414 - RNA, 22 nt, Homo sapiens
auaauaacccugccagugccag

SEQ ID NO: 1772415 - RNA, 16 nt, Homo sapiens
uaggauacugcugcgu

SEQ ID NO: 1772416 - RNA, 23 nt, Homo sapiens
acugaacguguucuuuugugcuc

SEQ ID NO: 1772417 - RNA, 20 nt, Homo sapiens
gcuguuaccagagccucuuu

SEQ ID NO: 1772418 - RNA, 16 nt, Homo sapiens
cguaaauaaacuaaua

SEQ ID NO: 1772419 - RNA, 13 nt, Homo sapiens
guagaacaaagaa

SEQ ID NO: 1772420 - RNA, 13 nt, Homo sapiens
auagaacagagaa

SEQ ID NO: 1772421 - RNA, 23 nt, Homo sapiens
cauauggucauccaaauggacug

SEQ ID NO: 1772422 - RNA, 15 nt, Homo sapiens
cagauccagacugua

SEQ ID NO: 1772423 - RNA, 16 nt, Homo sapiens
aucauucaacucucca

SEQ ID NO: 1772424 - RNA, 18 nt, Homo sapiens
ucucuagcuuuaggggac

SEQ ID NO: 1772425 - RNA, 14 nt, Homo sapiens
aguaccacacugag

SEQ ID NO: 1772426 - RNA, 19 nt, Homo sapiens
gcuaagccuggaagccauc

SEQ ID NO: 1772427 - RNA, 14 nt, Homo sapiens
aaucugggacugug

SEQ ID NO: 1772428 - RNA, 11 nt, Homo sapiens
acuagcuguaa

SEQ ID NO: 1772429 - RNA, 20 nt, Homo sapiens
uaaacacaggcagguacugu

SEQ ID NO: 1772430 - RNA, 14 nt, Homo sapiens
cagguacgcacaga

SEQ ID NO: 1772431 - RNA, 12 nt, Homo sapiens
uaaacaaaccac

SEQ ID NO: 1772432 - RNA, 23 nt, Homo sapiens
ccugaaggcaccugucaacugga

SEQ ID NO: 1772433 - RNA, 16 nt, Homo sapiens
uaauucuagcuuugag

SEQ ID NO: 1772434 - RNA, 21 nt, Homo sapiens
cuugaaaauaguaauaccuga

SEQ ID NO: 1772435 - RNA, 17 nt, Homo sapiens
ucccauccuugaugcaa

SEQ ID NO: 1772436 - RNA, 20 nt, Homo sapiens
agacccucaccuuccuucug

SEQ ID NO: 1772437 - RNA, 22 nt, Homo sapiens
caggcagacuacacaggaugag

SEQ ID NO: 1772438 - RNA, 15 nt, Homo sapiens
uuaccaaaauucacu

SEQ ID NO: 1772439 - RNA, 16 nt, Homo sapiens
cuacuuuauuugccua

SEQ ID NO: 1772440 - RNA, 14 nt, Homo sapiens
caagguaacuguac

SEQ ID NO: 1772441 - RNA, 16 nt, Homo sapiens
ucccauucagcuguga

SEQ ID NO: 1772442 - RNA, 17 nt, Homo sapiens
gaagacaaugacuuacu

SEQ ID NO: 1772443 - RNA, 18 nt, Homo sapiens
cauacaauuccaaacaca

SEQ ID NO: 1772444 - RNA, 15 nt, Homo sapiens
ccuggggauuccagc

SEQ ID NO: 1772445 - RNA, 13 nt, Homo sapiens
cuugccuggucac

SEQ ID NO: 1772446 - RNA, 13 nt, Homo sapiens
uugacacaggaaa

SEQ ID NO: 1772447 - RNA, 13 nt, Homo sapiens
gccuggcacagac

SEQ ID NO: 1772448 - RNA, 21 nt, Homo sapiens
uccacuucauuuuucccuugu

SEQ ID NO: 1772449 - RNA, 17 nt, Homo sapiens
acucaauacuaccucug

SEQ ID NO: 1772450 - RNA, 15 nt, Homo sapiens
aggcugcaacccugg

SEQ ID NO: 1772451 - RNA, 20 nt, Homo sapiens
agcauuugaaaggugugcua

SEQ ID NO: 1772452 - RNA, 11 nt, Homo sapiens
agcccagugag

SEQ ID NO: 1772453 - RNA, 22 nt, Homo sapiens
aaacccugccucuuuuccccau

SEQ ID NO: 1772454 - RNA, 15 nt, Homo sapiens
uggucagagugccac

SEQ ID NO: 1772455 - RNA, 14 nt, Homo sapiens
ugcauucacauuga

SEQ ID NO: 1772456 - RNA, 16 nt, Homo sapiens
ccuuucacuuucccaa

SEQ ID NO: 1772457 - RNA, 14 nt, Homo sapiens
uccagagaugguca

SEQ ID NO: 1772458 - RNA, 15 nt, Homo sapiens
cccccaguccucacu

SEQ ID NO: 1772459 - RNA, 23 nt, Homo sapiens
uacaauaacauaauuuguacaua

SEQ ID NO: 1772460 - RNA, 13 nt, Homo sapiens
aaaggcauaugca

SEQ ID NO: 1772461 - RNA, 19 nt, Homo sapiens
cacaugcacgugugugcac

SEQ ID NO: 1772462 - RNA, 19 nt, Homo sapiens
uggggagaaaagacaugaa

SEQ ID NO: 1772463 - RNA, 17 nt, Homo sapiens
caucaucaguggagcca

SEQ ID NO: 1772464 - RNA, 21 nt, Homo sapiens
cccagcucugacccugaugcu

SEQ ID NO: 1772465 - RNA, 17 nt, Homo sapiens
gcuacagucucuugucc

SEQ ID NO: 1772466 - RNA, 17 nt, Homo sapiens
cccagggcagccaggga

SEQ ID NO: 1772467 - RNA, 19 nt, Homo sapiens
uaacagauuaguaguuaca

SEQ ID NO: 1772468 - RNA, 16 nt, Homo sapiens
acccugccucuaccca

SEQ ID NO: 1772469 - RNA, 17 nt, Homo sapiens
accucagugucauuuau

SEQ ID NO: 1772470 - RNA, 20 nt, Homo sapiens
aaauauguaaugcuuccaau

SEQ ID NO: 1772471 - RNA, 21 nt, Homo sapiens
ugccucccccuaaauuaauga

SEQ ID NO: 1772472 - RNA, 17 nt, Homo sapiens
ccaaggcugcaaagcaa

SEQ ID NO: 1772473 - RNA, 17 nt, Homo sapiens
cugauccagagcacaga

SEQ ID NO: 1772474 - RNA, 22 nt, Homo sapiens
aaaacacugaaaaauauuccaa

SEQ ID NO: 1772475 - RNA, 16 nt, Homo sapiens
gcccgaccccaucuca

SEQ ID NO: 1772476 - RNA, 12 nt, Homo sapiens
aacaccugaugu

SEQ ID NO: 1772477 - RNA, 21 nt, Homo sapiens
uggccugcugugauuccacua

SEQ ID NO: 1772478 - RNA, 16 nt, Homo sapiens
agcauuuagaucuaca

SEQ ID NO: 1772479 - RNA, 14 nt, Homo sapiens
ugaggggucucgga

SEQ ID NO: 1772480 - RNA, 16 nt, Homo sapiens
augcuguuuaugacac

SEQ ID NO: 1772481 - RNA, 21 nt, Homo sapiens
gacguuuuuccaguucacauu

SEQ ID NO: 1772482 - RNA, 19 nt, Homo sapiens
cguggucuccuugcacuuu

SEQ ID NO: 1772483 - RNA, 18 nt, Homo sapiens
gagacucgcucacuccca

SEQ ID NO: 1772484 - RNA, 14 nt, Homo sapiens
caaagaauauucca

SEQ ID NO: 1772485 - RNA, 15 nt, Homo sapiens
gagcccugguccuag

SEQ ID NO: 1772486 - RNA, 15 nt, Homo sapiens
cuguaacaugcaauu

SEQ ID NO: 1772487 - RNA, 12 nt, Homo sapiens
aaggugugcucg

SEQ ID NO: 1772488 - RNA, 23 nt, Homo sapiens
guucaaguuugcugcaacccaag

SEQ ID NO: 1772489 - RNA, 12 nt, Homo sapiens
cguaaaugcaga

SEQ ID NO: 1772490 - RNA, 15 nt, Homo sapiens
aaugaaauacuugac

SEQ ID NO: 1772491 - RNA, 13 nt, Homo sapiens
auaaacacuggug

SEQ ID NO: 1772492 - RNA, 13 nt, Homo sapiens
uuaugcacaggaa

SEQ ID NO: 1772493 - RNA, 19 nt, Homo sapiens
caaaaugcuucugcacaca

SEQ ID NO: 1772494 - RNA, 14 nt, Homo sapiens
guaagcuaucugug

SEQ ID NO: 1772495 - RNA, 13 nt, Homo sapiens
ucuucccaucuca

SEQ ID NO: 1772496 - RNA, 17 nt, Homo sapiens
ugaaucugaccacagac

SEQ ID NO: 1772497 - RNA, 15 nt, Homo sapiens
uccuggacuguagga

SEQ ID NO: 1772498 - RNA, 22 nt, Homo sapiens
uaguccguuaacacuacuuaaa

SEQ ID NO: 1772499 - RNA, 23 nt, Homo sapiens
augaaccccccgcccaugcuguc

SEQ ID NO: 1772500 - RNA, 15 nt, Homo sapiens
caauuggacaauuau

SEQ ID NO: 1772501 - RNA, 22 nt, Homo sapiens
uguaaacuguacuagucugugu

SEQ ID NO: 1772502 - RNA, 16 nt, Homo sapiens
aagggaaaagcccaug

SEQ ID NO: 1772503 - RNA, 21 nt, Homo sapiens
cauaggugcaguuugcuucua

SEQ ID NO: 1772504 - RNA, 17 nt, Homo sapiens
gacucuuuaugcuugca

SEQ ID NO: 1772505 - RNA, 12 nt, Homo sapiens
gugacacagacg

SEQ ID NO: 1772506 - RNA, 16 nt, Homo sapiens
gacagagggcucaccu

SEQ ID NO: 1772507 - RNA, 21 nt, Homo sapiens
cccagccuggaaaccuacaga

SEQ ID NO: 1772508 - RNA, 22 nt, Homo sapiens
uauacuguguauaucucuguaa

SEQ ID NO: 1772509 - RNA, 18 nt, Homo sapiens
ucgauggcucaaucuauc

SEQ ID NO: 1772510 - RNA, 14 nt, Homo sapiens
aacuguacauguga

SEQ ID NO: 1772511 - RNA, 12 nt, Homo sapiens
ccuagcuaccuu

SEQ ID NO: 1772512 - RNA, 13 nt, Homo sapiens
uacaggaauuauu

SEQ ID NO: 1772513 - RNA, 21 nt, Homo sapiens
cgccauccgucaccagaauua

SEQ ID NO: 1772514 - RNA, 17 nt, Homo sapiens
agacaccagcagcccug

SEQ ID NO: 1772515 - RNA, 16 nt, Homo sapiens
aaacccucagcacugu

SEQ ID NO: 1772516 - RNA, 22 nt, Homo sapiens
ggugccuccagacaugugcaca

SEQ ID NO: 1772517 - RNA, 17 nt, Homo sapiens
gagccuaggccaggugc

SEQ ID NO: 1772518 - RNA, 12 nt, Homo sapiens
aaaccuaugaau

SEQ ID NO: 1772519 - RNA, 11 nt, Homo sapiens
ccaugcucaau

SEQ ID NO: 1772520 - RNA, 17 nt, Homo sapiens
gagauauuuuccauuuu

SEQ ID NO: 1772521 - RNA, 12 nt, Homo sapiens
caauacaauccu

SEQ ID NO: 1772522 - RNA, 21 nt, Homo sapiens
cagagaagauucuuguauuua

SEQ ID NO: 1772523 - RNA, 23 nt, Homo sapiens
uuuucagacaaauuacugauaaa

SEQ ID NO: 1772524 - RNA, 14 nt, Homo sapiens
gacugccaaaaagg

SEQ ID NO: 1772525 - RNA, 20 nt, Homo sapiens
accaaagacuuguuaaaugu

SEQ ID NO: 1772526 - RNA, 17 nt, Homo sapiens
cugggggugaggggcca

SEQ ID NO: 1772527 - RNA, 16 nt, Homo sapiens
uaagaugagggggcca

SEQ ID NO: 1772528 - RNA, 18 nt, Homo sapiens
caucauggaucaaccaag

SEQ ID NO: 1772529 - RNA, 16 nt, Homo sapiens
uuaaggucaccugcac

SEQ ID NO: 1772530 - RNA, 21 nt, Homo sapiens
acuaugguaaauaacugugac

SEQ ID NO: 1772531 - RNA, 20 nt, Homo sapiens
ugccucuaccaguuggcaga

SEQ ID NO: 1772532 - RNA, 16 nt, Homo sapiens
cauggucaccaaacag

SEQ ID NO: 1772533 - RNA, 17 nt, Homo sapiens
cuguaccgacuuugaua

SEQ ID NO: 1772534 - RNA, 19 nt, Homo sapiens
uggggcacuuucauccuca

SEQ ID NO: 1772535 - RNA, 20 nt, Homo sapiens
cggccacggugccuccagau

SEQ ID NO: 1772536 - RNA, 13 nt, Homo sapiens
uuucauuuaucca

SEQ ID NO: 1772537 - RNA, 20 nt, Homo sapiens
aucugaguuugaagcuuucc

SEQ ID NO: 1772538 - RNA, 19 nt, Homo sapiens
cacagaaaauggaagacag

SEQ ID NO: 1772539 - RNA, 17 nt, Homo sapiens
gcacugaaccacauuca

SEQ ID NO: 1772540 - RNA, 14 nt, Homo sapiens
uuuuucugggucuu

SEQ ID NO: 1772541 - RNA, 21 nt, Homo sapiens
ugccagaaggauaauauugau

SEQ ID NO: 1772542 - RNA, 14 nt, Homo sapiens
ccucccaccaggaa

SEQ ID NO: 1772543 - RNA, 15 nt, Homo sapiens
ccuuguuaaaucauu

SEQ ID NO: 1772544 - RNA, 13 nt, Homo sapiens
acuguuucauuca

SEQ ID NO: 1772545 - RNA, 22 nt, Homo sapiens
cacuuguuguuuuacuaaagaa

SEQ ID NO: 1772546 - RNA, 20 nt, Homo sapiens
ugucucuacuuuucccugua

SEQ ID NO: 1772547 - RNA, 17 nt, Homo sapiens
ugaaaaccaucuggccu

SEQ ID NO: 1772548 - RNA, 16 nt, Homo sapiens
aaauaucugaaaugug

SEQ ID NO: 1772549 - RNA, 21 nt, Homo sapiens
ucagagaucuugcauuucugc

SEQ ID NO: 1772550 - RNA, 15 nt, Homo sapiens
caaauugauagucaa

SEQ ID NO: 1772551 - RNA, 21 nt, Homo sapiens
acuuggagggcucagggcagu

SEQ ID NO: 1772552 - RNA, 23 nt, Homo sapiens
gcguuucauguagccagcagaac

SEQ ID NO: 1772553 - RNA, 18 nt, Homo sapiens
agauugauuaaugaacua

SEQ ID NO: 1772554 - RNA, 24 nt, Homo sapiens
agaauuaaguuuuaaauaaaccua

SEQ ID NO: 1772555 - RNA, 17 nt, Homo sapiens
gcaggcucagacucugg

SEQ ID NO: 1772556 - RNA, 17 nt, Homo sapiens
auugugucccccauaaa

SEQ ID NO: 1772557 - RNA, 16 nt, Homo sapiens
uagaauccgaagggaa

SEQ ID NO: 1772558 - RNA, 23 nt, Homo sapiens
uucugaccccacuuaugcugcug

SEQ ID NO: 1772559 - RNA, 18 nt, Homo sapiens
cucagccacagccugaca

SEQ ID NO: 1772560 - RNA, 20 nt, Homo sapiens
gccugcucuucagacuuaaa

SEQ ID NO: 1772561 - RNA, 19 nt, Homo sapiens
uuuaguuuuuuuaaugugu

SEQ ID NO: 1772562 - RNA, 17 nt, Homo sapiens
caaaugcagaaccacaa

SEQ ID NO: 1772563 - RNA, 18 nt, Homo sapiens
auuuggcuuccucugcug

SEQ ID NO: 1772564 - RNA, 12 nt, Homo sapiens
ggagcucuccau

SEQ ID NO: 1772565 - RNA, 16 nt, Homo sapiens
cucgccccagccucau

SEQ ID NO: 1772566 - RNA, 16 nt, Homo sapiens
cccagagggucagggu

SEQ ID NO: 1772567 - RNA, 16 nt, Homo sapiens
ggaugcggccauucaa

SEQ ID NO: 1772568 - RNA, 15 nt, Homo sapiens
caucucacuuuauga

SEQ ID NO: 1772569 - RNA, 18 nt, Homo sapiens
gcaggcuggcccugcccu

SEQ ID NO: 1772570 - RNA, 13 nt, Homo sapiens
uacuagcacuuug

SEQ ID NO: 1772571 - RNA, 19 nt, Homo sapiens
uuuuuggagaaaugucaua

SEQ ID NO: 1772572 - RNA, 20 nt, Homo sapiens
caagauggacacgagccaca

SEQ ID NO: 1772573 - RNA, 23 nt, Homo sapiens
caaucuuugugccucaacauacu

SEQ ID NO: 1772574 - RNA, 20 nt, Homo sapiens
cccgauccccgacaguggcu

SEQ ID NO: 1772575 - RNA, 14 nt, Homo sapiens
ggguuccagacagg

SEQ ID NO: 1772576 - RNA, 15 nt, Homo sapiens
uccucugcauuuaca

SEQ ID NO: 1772577 - RNA, 16 nt, Homo sapiens
cuggcuugcucccgcc

SEQ ID NO: 1772578 - RNA, 22 nt, Homo sapiens
caaaugaaagugaugauacugu

SEQ ID NO: 1772579 - RNA, 20 nt, Homo sapiens
uauaaauguauauacacaua

SEQ ID NO: 1772580 - RNA, 22 nt, Homo sapiens
agcacgccccacgcauggugca

SEQ ID NO: 1772581 - RNA, 18 nt, Homo sapiens
uguagaaaagaacuggaa

SEQ ID NO: 1772582 - RNA, 14 nt, Homo sapiens
agguuggcaaaaag

SEQ ID NO: 1772583 - RNA, 16 nt, Homo sapiens
cuaaaggagcaucuau

SEQ ID NO: 1772584 - RNA, 23 nt, Homo sapiens
ugcauugccuguaacaauguaau

SEQ ID NO: 1772585 - RNA, 12 nt, Homo sapiens
aaugaccucagc

SEQ ID NO: 1772586 - RNA, 17 nt, Homo sapiens
aagagggaacuuagcag

SEQ ID NO: 1772587 - RNA, 15 nt, Homo sapiens
cagcaaacccaaaga

SEQ ID NO: 1772588 - RNA, 16 nt, Homo sapiens
agauaaauagaacuau

SEQ ID NO: 1772589 - RNA, 23 nt, Homo sapiens
uacagauguggggagauguaaua

SEQ ID NO: 1772590 - RNA, 20 nt, Homo sapiens
caguagacauuuuaacaaga

SEQ ID NO: 1772591 - RNA, 17 nt, Homo sapiens
aagggcccaaugaauua

SEQ ID NO: 1772592 - RNA, 22 nt, Homo sapiens
ggcugccggcacggcccguggc

SEQ ID NO: 1772593 - RNA, 14 nt, Homo sapiens
uauuuuaucuguga

SEQ ID NO: 1772594 - RNA, 15 nt, Homo sapiens
aaguugaucucccca

SEQ ID NO: 1772595 - RNA, 22 nt, Homo sapiens
guuuuaucuaacggcuacugaa

SEQ ID NO: 1772596 - RNA, 14 nt, Homo sapiens
cccauuccugaaga

SEQ ID NO: 1772597 - RNA, 16 nt, Homo sapiens
uauauucuuguaaaua

SEQ ID NO: 1772598 - RNA, 17 nt, Homo sapiens
ugaaaggacccugugag

SEQ ID NO: 1772599 - RNA, 15 nt, Homo sapiens
guuuuacuucuggcc

SEQ ID NO: 1772600 - RNA, 21 nt, Homo sapiens
auuugcaacucacugauucuc

SEQ ID NO: 1772601 - RNA, 23 nt, Homo sapiens
uggaaccaacacuaacauauaau

SEQ ID NO: 1772602 - RNA, 14 nt, Homo sapiens
gcagcaucauucag

SEQ ID NO: 1772603 - RNA, 21 nt, Homo sapiens
uucguaacggccuugaucccc

SEQ ID NO: 1772604 - RNA, 19 nt, Homo sapiens
cuguguagagaaugucacu

SEQ ID NO: 1772605 - RNA, 14 nt, Homo sapiens
uccucucuuggcau

SEQ ID NO: 1772606 - RNA, 14 nt, Homo sapiens
guggauaauuccaa

SEQ ID NO: 1772607 - RNA, 14 nt, Homo sapiens
aagccauauuccag

SEQ ID NO: 1772608 - RNA, 16 nt, Homo sapiens
auuuauaaaugagcaa

SEQ ID NO: 1772609 - RNA, 21 nt, Homo sapiens
uaaauaugugaaaaugauuag

SEQ ID NO: 1772610 - RNA, 17 nt, Homo sapiens
aaggagggccucagaga

SEQ ID NO: 1772611 - RNA, 20 nt, Homo sapiens
gugaugaccccauagaccua

SEQ ID NO: 1772612 - RNA, 20 nt, Homo sapiens
gagagauggaauaaagcccu

SEQ ID NO: 1772613 - RNA, 21 nt, Homo sapiens
cuugauauguaaguacuucca

SEQ ID NO: 1772614 - RNA, 21 nt, Homo sapiens
auuuugugaugaaucuacauu

SEQ ID NO: 1772615 - RNA, 12 nt, Homo sapiens
uccuagcacugc

SEQ ID NO: 1772616 - RNA, 12 nt, Homo sapiens
ugcaagcuccau

SEQ ID NO: 1772617 - RNA, 22 nt, Homo sapiens
caagaagaaauaugaaauucca

SEQ ID NO: 1772618 - RNA, 12 nt, Homo sapiens
cuguacauucuu

SEQ ID NO: 1772619 - RNA, 13 nt, Homo sapiens
gauuuuacaugaa

SEQ ID NO: 1772620 - RNA, 17 nt, Homo sapiens
uguaaugucaccaccuu

SEQ ID NO: 1772621 - RNA, 22 nt, Homo sapiens
cuggcccaagugguuugugcua

SEQ ID NO: 1772622 - RNA, 16 nt, Homo sapiens
gccgcaugcauaaagu

SEQ ID NO: 1772623 - RNA, 12 nt, Homo sapiens
gccaccaguguc

SEQ ID NO: 1772624 - RNA, 19 nt, Homo sapiens
cacccagacuggagugcag

SEQ ID NO: 1772625 - RNA, 12 nt, Homo sapiens
gcaguuguuauu

SEQ ID NO: 1772626 - RNA, 14 nt, Homo sapiens
uugcacagccagaa

SEQ ID NO: 1772627 - RNA, 20 nt, Homo sapiens
ggguacagcccuugcacucc

SEQ ID NO: 1772628 - RNA, 17 nt, Homo sapiens
cugagugucaucucaac

SEQ ID NO: 1772629 - RNA, 17 nt, Homo sapiens
cagaccaguacugggaa

SEQ ID NO: 1772630 - RNA, 13 nt, Homo sapiens
cacacacacaugc

SEQ ID NO: 1772631 - RNA, 13 nt, Homo sapiens
uauguacauacau

SEQ ID NO: 1772632 - RNA, 17 nt, Homo sapiens
acaagugcucaguucca

SEQ ID NO: 1772633 - RNA, 14 nt, Homo sapiens
aggccucacuggcu

SEQ ID NO: 1772634 - RNA, 13 nt, Homo sapiens
uucaaaauaguca

SEQ ID NO: 1772635 - RNA, 21 nt, Homo sapiens
caugauaccaccuuuacugug

SEQ ID NO: 1772636 - RNA, 18 nt, Homo sapiens
gagaaacacuaaagcauu

SEQ ID NO: 1772637 - RNA, 15 nt, Homo sapiens
ucuggaugguuccca

SEQ ID NO: 1772638 - RNA, 20 nt, Homo sapiens
gagaccgaggccagaaggca

SEQ ID NO: 1772639 - RNA, 13 nt, Homo sapiens
agccaucagacaa

SEQ ID NO: 1772640 - RNA, 20 nt, Homo sapiens
ccaagacagauggacacugc

SEQ ID NO: 1772641 - RNA, 15 nt, Homo sapiens
uauauaauaugucac

SEQ ID NO: 1772642 - RNA, 12 nt, Homo sapiens
uggagugcaaug

SEQ ID NO: 1772643 - RNA, 14 nt, Homo sapiens
uuaacuaugugaug

SEQ ID NO: 1772644 - RNA, 18 nt, Homo sapiens
gaaacgcuucuuuuccau

SEQ ID NO: 1772645 - RNA, 12 nt, Homo sapiens
gccggcacucca

SEQ ID NO: 1772646 - RNA, 18 nt, Homo sapiens
caguugcagcccuuguga

SEQ ID NO: 1772647 - RNA, 13 nt, Homo sapiens
acacagagugccu

SEQ ID NO: 1772648 - RNA, 12 nt, Homo sapiens
aaacacauuaaa

SEQ ID NO: 1772649 - RNA, 17 nt, Homo sapiens
guagucccagcuacuca

SEQ ID NO: 1772650 - RNA, 14 nt, Homo sapiens
ugaagagaacugca

SEQ ID NO: 1772651 - RNA, 19 nt, Homo sapiens
ugugugccuuuguuuccca

SEQ ID NO: 1772652 - RNA, 19 nt, Homo sapiens
gugggguuuguaacacauu

SEQ ID NO: 1772653 - RNA, 17 nt, Homo sapiens
cuaugacauacauggaa

SEQ ID NO: 1772654 - RNA, 17 nt, Homo sapiens
cuguaguaaauggcaau

SEQ ID NO: 1772655 - RNA, 22 nt, Homo sapiens
gccuucuuauaucugaagauug

SEQ ID NO: 1772656 - RNA, 18 nt, Homo sapiens
aaccuauuucacaaauca

SEQ ID NO: 1772657 - RNA, 14 nt, Homo sapiens
ucauauuggacuga

SEQ ID NO: 1772658 - RNA, 19 nt, Homo sapiens
aguggcuucccagcucuga

SEQ ID NO: 1772659 - RNA, 14 nt, Homo sapiens
gccaucaugugccu

SEQ ID NO: 1772660 - RNA, 22 nt, Homo sapiens
ggcgccugauugcugaguguca

SEQ ID NO: 1772661 - RNA, 16 nt, Homo sapiens
agucugucucugucau

SEQ ID NO: 1772662 - RNA, 20 nt, Homo sapiens
uaaagacauaggaacaugua

SEQ ID NO: 1772663 - RNA, 14 nt, Homo sapiens
ucucuuuuaaucua

SEQ ID NO: 1772664 - RNA, 15 nt, Homo sapiens
uucacuaauacuuac

SEQ ID NO: 1772665 - RNA, 19 nt, Homo sapiens
gguccucugucagucacag

SEQ ID NO: 1772666 - RNA, 23 nt, Homo sapiens
gcgcacuuuccacuggaguucac

SEQ ID NO: 1772667 - RNA, 20 nt, Homo sapiens
caguauuauuuaguaaaauu

SEQ ID NO: 1772668 - RNA, 23 nt, Homo sapiens
gaggaaaauaguggcaggacugu

SEQ ID NO: 1772669 - RNA, 16 nt, Homo sapiens
agaucuucacucuggg

SEQ ID NO: 1772670 - RNA, 19 nt, Homo sapiens
uuaaauguagaaagugauc

SEQ ID NO: 1772671 - RNA, 17 nt, Homo sapiens
acacauucuuaacacau

SEQ ID NO: 1772672 - RNA, 18 nt, Homo sapiens
ggcacuuuugaugaaaua

SEQ ID NO: 1772673 - RNA, 21 nt, Homo sapiens
caacugaguguuauuugcaca

SEQ ID NO: 1772674 - RNA, 22 nt, Homo sapiens
uucacuguucaguuuagcauua

SEQ ID NO: 1772675 - RNA, 15 nt, Homo sapiens
cagaggcuucuucag

SEQ ID NO: 1772676 - RNA, 17 nt, Homo sapiens
uagcccaucucuccaga

SEQ ID NO: 1772677 - RNA, 15 nt, Homo sapiens
gugcuaucacagggu

SEQ ID NO: 1772678 - RNA, 19 nt, Homo sapiens
cccaucgguaggcaaagga

SEQ ID NO: 1772679 - RNA, 10 nt, Homo sapiens
aagcucugcc

SEQ ID NO: 1772680 - RNA, 17 nt, Homo sapiens
caucugaccaucuguga

SEQ ID NO: 1772681 - RNA, 14 nt, Homo sapiens
ugaucuuugcagac

SEQ ID NO: 1772682 - RNA, 12 nt, Homo sapiens
uuaaagcuaaac

SEQ ID NO: 1772683 - RNA, 21 nt, Homo sapiens
agaucccagcucacgucacac

SEQ ID NO: 1772684 - RNA, 15 nt, Homo sapiens
ccuggcccucaguuu

SEQ ID NO: 1772685 - RNA, 22 nt, Homo sapiens
auaaaugagggcugcacauugc

SEQ ID NO: 1772686 - RNA, 21 nt, Homo sapiens
caaaugccugacucagugacc

SEQ ID NO: 1772687 - RNA, 17 nt, Homo sapiens
gaggcgucuucaucucc

SEQ ID NO: 1772688 - RNA, 12 nt, Homo sapiens
accccuacagcc

SEQ ID NO: 1772689 - RNA, 12 nt, Homo sapiens
ugaucuacucau

SEQ ID NO: 1772690 - RNA, 15 nt, Homo sapiens
uuuucauuauugguu

SEQ ID NO: 1772691 - RNA, 15 nt, Homo sapiens
guuucauauucucag

SEQ ID NO: 1772692 - RNA, 20 nt, Homo sapiens
cccuaaucuuucacuugaaa

SEQ ID NO: 1772693 - RNA, 13 nt, Homo sapiens
cagaauguaucug

SEQ ID NO: 1772694 - RNA, 23 nt, Homo sapiens
ccagggcucuaaugugucucuca

SEQ ID NO: 1772695 - RNA, 22 nt, Homo sapiens
gccagaaagcauaaaauucuua

SEQ ID NO: 1772696 - RNA, 23 nt, Homo sapiens
ggaguuuuaauguuagaauuuag

SEQ ID NO: 1772697 - RNA, 22 nt, Homo sapiens
cuuccgacaggagcacugcaug

SEQ ID NO: 1772698 - RNA, 17 nt, Homo sapiens
gccaagugugaccccac

SEQ ID NO: 1772699 - RNA, 16 nt, Homo sapiens
augaaacauuuuguca

SEQ ID NO: 1772700 - RNA, 16 nt, Homo sapiens
aauaaaguuagugugu

SEQ ID NO: 1772701 - RNA, 15 nt, Homo sapiens
guaacuuugcauguu

SEQ ID NO: 1772702 - RNA, 18 nt, Homo sapiens
aacggcuuauuagugaaa

SEQ ID NO: 1772703 - RNA, 13 nt, Homo sapiens
aggauacagaaau

SEQ ID NO: 1772704 - RNA, 22 nt, Homo sapiens
aaguuauguucuucuucauuga

SEQ ID NO: 1772705 - RNA, 13 nt, Homo sapiens
uccauaugcucuu

SEQ ID NO: 1772706 - RNA, 18 nt, Homo sapiens
cccuugcuuguugggauu

SEQ ID NO: 1772707 - RNA, 15 nt, Homo sapiens
ucuaagucauguaug

SEQ ID NO: 1772708 - RNA, 19 nt, Homo sapiens
aagauuuuguuugcaucug

SEQ ID NO: 1772709 - RNA, 22 nt, Homo sapiens
gccccuccccauggugcaguga

SEQ ID NO: 1772710 - RNA, 19 nt, Homo sapiens
agccagcgaacugacauua

SEQ ID NO: 1772711 - RNA, 16 nt, Homo sapiens
aauauuuuuacaugca

SEQ ID NO: 1772712 - RNA, 23 nt, Homo sapiens
caccugcucuucuaccauuugaa

SEQ ID NO: 1772713 - RNA, 14 nt, Homo sapiens
cuucagacauguaa

SEQ ID NO: 1772714 - RNA, 16 nt, Homo sapiens
ggccccagagugccca

SEQ ID NO: 1772715 - RNA, 17 nt, Homo sapiens
agucucuauaccaauaa

SEQ ID NO: 1772716 - RNA, 16 nt, Homo sapiens
ggagcuugcagugagc

SEQ ID NO: 1772717 - RNA, 17 nt, Homo sapiens
ggaggcaacugccucac

SEQ ID NO: 1772718 - RNA, 21 nt, Homo sapiens
uuacuguuugucuucucccca

SEQ ID NO: 1772719 - RNA, 15 nt, Homo sapiens
agcacagcugcauua

SEQ ID NO: 1772720 - RNA, 18 nt, Homo sapiens
uaucagaauacuugcacu

SEQ ID NO: 1772721 - RNA, 14 nt, Homo sapiens
cuggaacagauuca

SEQ ID NO: 1772722 - RNA, 15 nt, Homo sapiens
uggagaaaguauuua

SEQ ID NO: 1772723 - RNA, 16 nt, Homo sapiens
uggcauaugauuuauc

SEQ ID NO: 1772724 - RNA, 13 nt, Homo sapiens
cuccuccuagcca

SEQ ID NO: 1772725 - RNA, 16 nt, Homo sapiens
ccauuccauggaaaua

SEQ ID NO: 1772726 - RNA, 19 nt, Homo sapiens
aggaaacucugucacuccu

SEQ ID NO: 1772727 - RNA, 19 nt, Homo sapiens
agaacccccuuuaccccca

SEQ ID NO: 1772728 - RNA, 20 nt, Homo sapiens
aucaauggagcaugugugca

SEQ ID NO: 1772729 - RNA, 12 nt, Homo sapiens
gcaaugacugug

SEQ ID NO: 1772730 - RNA, 20 nt, Homo sapiens
ugcucuacugcuucaggaag

SEQ ID NO: 1772731 - RNA, 18 nt, Homo sapiens
uugaggagugucccgccu

SEQ ID NO: 1772732 - RNA, 15 nt, Homo sapiens
gggagagguggagca

SEQ ID NO: 1772733 - RNA, 13 nt, Homo sapiens
uccuagagugcag

SEQ ID NO: 1772734 - RNA, 19 nt, Homo sapiens
uugaaaugaaauuuaaaca

SEQ ID NO: 1772735 - RNA, 18 nt, Homo sapiens
uuaaaauaaaaauuuaau

SEQ ID NO: 1772736 - RNA, 11 nt, Homo sapiens
gggaugugcac

SEQ ID NO: 1772737 - RNA, 20 nt, Homo sapiens
ggagcuuuugguaugugaca

SEQ ID NO: 1772738 - RNA, 19 nt, Homo sapiens
ucugagccgucagagcagu

SEQ ID NO: 1772739 - RNA, 14 nt, Homo sapiens
guuaaucugaugua

SEQ ID NO: 1772740 - RNA, 18 nt, Homo sapiens
cuuguaaaacugugacau

SEQ ID NO: 1772741 - RNA, 20 nt, Homo sapiens
cuugauggugacagcugcaa

SEQ ID NO: 1772742 - RNA, 22 nt, Homo sapiens
aggcaccaguuacccugcaugu

SEQ ID NO: 1772743 - RNA, 17 nt, Homo sapiens
cgugguauaaucuccau

SEQ ID NO: 1772744 - RNA, 14 nt, Homo sapiens
guuucauaccaaau

SEQ ID NO: 1772745 - RNA, 14 nt, Homo sapiens
uggggaguuuacua

SEQ ID NO: 1772746 - RNA, 21 nt, Homo sapiens
ggucauacuacauacaagcau

SEQ ID NO: 1772747 - RNA, 23 nt, Homo sapiens
ucuuuaguauaauugaccuacuu

SEQ ID NO: 1772748 - RNA, 14 nt, Homo sapiens
ugacaauacaaaua

SEQ ID NO: 1772749 - RNA, 18 nt, Homo sapiens
gguuuaaacuucucugaa

SEQ ID NO: 1772750 - RNA, 23 nt, Homo sapiens
cugauauaacaaacuacauguaa

SEQ ID NO: 1772751 - RNA, 15 nt, Homo sapiens
ucaucccaguccuga

SEQ ID NO: 1772752 - RNA, 17 nt, Homo sapiens
uggccaugggucccauu

SEQ ID NO: 1772753 - RNA, 14 nt, Homo sapiens
cuuagacucuugaa

SEQ ID NO: 1772754 - RNA, 17 nt, Homo sapiens
gauagacuuacuaauaa

SEQ ID NO: 1772755 - RNA, 13 nt, Homo sapiens
cuagcuauuacug

SEQ ID NO: 1772756 - RNA, 17 nt, Homo sapiens
uuauccuguauucuugu

SEQ ID NO: 1772757 - RNA, 14 nt, Homo sapiens
guuuuuugaugcuu

SEQ ID NO: 1772758 - RNA, 20 nt, Homo sapiens
ucagugcuucucugugcagg

SEQ ID NO: 1772759 - RNA, 20 nt, Homo sapiens
uauguucuuuaguuugcugc

SEQ ID NO: 1772760 - RNA, 20 nt, Homo sapiens
cuggcccucgccagcugcca

SEQ ID NO: 1772761 - RNA, 21 nt, Homo sapiens
aauuauauuaaagaaccaaaa

SEQ ID NO: 1772762 - RNA, 20 nt, Homo sapiens
acacgcacugcacugccauu

SEQ ID NO: 1772763 - RNA, 13 nt, Homo sapiens
ucaaaguguacaa

SEQ ID NO: 1772764 - RNA, 13 nt, Homo sapiens
cacuggugccaug

SEQ ID NO: 1772765 - RNA, 17 nt, Homo sapiens
agaccaauaggugcaaa

SEQ ID NO: 1772766 - RNA, 17 nt, Homo sapiens
caccaauuaucaucuuu

SEQ ID NO: 1772767 - RNA, 16 nt, Homo sapiens
aaggcucacaccucau

SEQ ID NO: 1772768 - RNA, 20 nt, Homo sapiens
uggcucuuagaaacucagga

SEQ ID NO: 1772769 - RNA, 23 nt, Homo sapiens
cagcccuacaacaaccugaagca

SEQ ID NO: 1772770 - RNA, 17 nt, Homo sapiens
uuucuuguuuaacauau

SEQ ID NO: 1772771 - RNA, 20 nt, Homo sapiens
ggaacccccaucucuacuaa

SEQ ID NO: 1772772 - RNA, 21 nt, Homo sapiens
cucagccuugccagagaucca

SEQ ID NO: 1772773 - RNA, 18 nt, Homo sapiens
cacccagagccagugugg

SEQ ID NO: 1772774 - RNA, 15 nt, Homo sapiens
cuuuuuguugccuua

SEQ ID NO: 1772775 - RNA, 22 nt, Homo sapiens
uuaauuuuccuuugucauuucc

SEQ ID NO: 1772776 - RNA, 16 nt, Homo sapiens
ucugcuucuccaagga

SEQ ID NO: 1772777 - RNA, 16 nt, Homo sapiens
ugaagacccaguguaa

SEQ ID NO: 1772778 - RNA, 13 nt, Homo sapiens
uggaggcugcugc

SEQ ID NO: 1772779 - RNA, 15 nt, Homo sapiens
agaugaccugcugcu

SEQ ID NO: 1772780 - RNA, 15 nt, Homo sapiens
ucauuaucaccuucc

SEQ ID NO: 1772781 - RNA, 20 nt, Homo sapiens
aggugucuucuuugacuuaa

SEQ ID NO: 1772782 - RNA, 13 nt, Homo sapiens
gaaucauuuuagc

SEQ ID NO: 1772783 - RNA, 17 nt, Homo sapiens
auucuuuaaaauucacu

SEQ ID NO: 1772784 - RNA, 22 nt, Homo sapiens
aaacagacuauuuaacuugagg

SEQ ID NO: 1772785 - RNA, 19 nt, Homo sapiens
cugaaagacagaaugucac

SEQ ID NO: 1772786 - RNA, 23 nt, Homo sapiens
acaaaucaacagaagcauuugua

SEQ ID NO: 1772787 - RNA, 14 nt, Homo sapiens
uggcucacuacuga

SEQ ID NO: 1772788 - RNA, 22 nt, Homo sapiens
acauguguuuuaauuccaauau

SEQ ID NO: 1772789 - RNA, 14 nt, Homo sapiens
ggaugggaugcacu

SEQ ID NO: 1772790 - RNA, 21 nt, Homo sapiens
caagaacgagaagcagcauuu

SEQ ID NO: 1772791 - RNA, 14 nt, Homo sapiens
auucuaaaggggac

SEQ ID NO: 1772792 - RNA, 22 nt, Homo sapiens
ggcacccaaaacucaagcaaga

SEQ ID NO: 1772793 - RNA, 22 nt, Homo sapiens
uucaaaguuuaagcaauucauu

SEQ ID NO: 1772794 - RNA, 22 nt, Homo sapiens
aaacauguauguaaauagcuaa

SEQ ID NO: 1772795 - RNA, 17 nt, Homo sapiens
cuucaucuggauuccag

SEQ ID NO: 1772796 - RNA, 12 nt, Homo sapiens
uuugaaguagga

SEQ ID NO: 1772797 - RNA, 18 nt, Homo sapiens
acagauccccaagccugg

SEQ ID NO: 1772798 - RNA, 20 nt, Homo sapiens
cacaaccaacgcgaaaccaa

SEQ ID NO: 1772799 - RNA, 22 nt, Homo sapiens
cauuuuaauaucuuaugcuauu

SEQ ID NO: 1772800 - RNA, 21 nt, Homo sapiens
aucuaccacaucuucaugugg

SEQ ID NO: 1772801 - RNA, 21 nt, Homo sapiens
gauacuuaacaaauacauuca

SEQ ID NO: 1772802 - RNA, 18 nt, Homo sapiens
gauucaacacugugcacg

SEQ ID NO: 1772803 - RNA, 14 nt, Homo sapiens
gaugaaggggccag

SEQ ID NO: 1772804 - RNA, 16 nt, Homo sapiens
ucaccaaaaagcuuua

SEQ ID NO: 1772805 - RNA, 19 nt, Homo sapiens
ggcugacagacucacuggg

SEQ ID NO: 1772806 - RNA, 19 nt, Homo sapiens
agagcagccuggcuaacau

SEQ ID NO: 1772807 - RNA, 22 nt, Homo sapiens
aaaaauauguaccaagaaucuu

SEQ ID NO: 1772808 - RNA, 23 nt, Homo sapiens
gucucaccacauaccauguggau

SEQ ID NO: 1772809 - RNA, 15 nt, Homo sapiens
aguggcugugccacc

SEQ ID NO: 1772810 - RNA, 22 nt, Homo sapiens
cucaaucuccucucucuuuccu

SEQ ID NO: 1772811 - RNA, 14 nt, Homo sapiens
cagggcugucuucg

SEQ ID NO: 1772812 - RNA, 16 nt, Homo sapiens
acccucaucacuagga

SEQ ID NO: 1772813 - RNA, 22 nt, Homo sapiens
cacaagucauaccuacauucaa

SEQ ID NO: 1772814 - RNA, 19 nt, Homo sapiens
uauugggacacacaucaaa

SEQ ID NO: 1772815 - RNA, 15 nt, Homo sapiens
accuuuaucuuucca

SEQ ID NO: 1772816 - RNA, 17 nt, Homo sapiens
cuguguccucacaugac

SEQ ID NO: 1772817 - RNA, 13 nt, Homo sapiens
uagaaaggccuuu

SEQ ID NO: 1772818 - RNA, 13 nt, Homo sapiens
uaugugacuguga

SEQ ID NO: 1772819 - RNA, 11 nt, Homo sapiens
acuccaucucu

SEQ ID NO: 1772820 - RNA, 20 nt, Homo sapiens
ccuauucccaaaugccuucu

SEQ ID NO: 1772821 - RNA, 15 nt, Homo sapiens
cucugaucaaguauu

SEQ ID NO: 1772822 - RNA, 20 nt, Homo sapiens
aaaauuaccuuuaaugcaau

SEQ ID NO: 1772823 - RNA, 19 nt, Homo sapiens
uggggaagggagucucucu

SEQ ID NO: 1772824 - RNA, 18 nt, Homo sapiens
ugacaaccgacgaagaaa

SEQ ID NO: 1772825 - RNA, 16 nt, Homo sapiens
aagaucauucugagag

SEQ ID NO: 1772826 - RNA, 21 nt, Homo sapiens
auugugaaaucaaaaucugga

SEQ ID NO: 1772827 - RNA, 17 nt, Homo sapiens
cagauugcggugugaga

SEQ ID NO: 1772828 - RNA, 12 nt, Homo sapiens
ggccaacaaaga

SEQ ID NO: 1772829 - RNA, 12 nt, Homo sapiens
aacaaacagggc

SEQ ID NO: 1772830 - RNA, 21 nt, Homo sapiens
uuccauuuauucuuugaucuu

SEQ ID NO: 1772831 - RNA, 14 nt, Homo sapiens
cuggaaugaguuga

SEQ ID NO: 1772832 - RNA, 19 nt, Homo sapiens
caccuucacucuccagggu

SEQ ID NO: 1772833 - RNA, 21 nt, Homo sapiens
gccguacucuuuggggcagcu

SEQ ID NO: 1772834 - RNA, 15 nt, Homo sapiens
guuaguaccuagugg

SEQ ID NO: 1772835 - RNA, 18 nt, Homo sapiens
uauucagagucucugaua

SEQ ID NO: 1772836 - RNA, 18 nt, Homo sapiens
ccucuguugggaugccag

SEQ ID NO: 1772837 - RNA, 22 nt, Homo sapiens
uggccaacugcaaaaaaagccu

SEQ ID NO: 1772838 - RNA, 17 nt, Homo sapiens
cuaaugacguugagcau

SEQ ID NO: 1772839 - RNA, 21 nt, Homo sapiens
augguuaaaaucacuauugaa

SEQ ID NO: 1772840 - RNA, 21 nt, Homo sapiens
uacugaagucuuacuacagaa

SEQ ID NO: 1772841 - RNA, 17 nt, Homo sapiens
ccauuuuacuuccauga

SEQ ID NO: 1772842 - RNA, 13 nt, Homo sapiens
cugauaagcaaau

SEQ ID NO: 1772843 - RNA, 13 nt, Homo sapiens
cuguuaagcaauu

SEQ ID NO: 1772844 - RNA, 17 nt, Homo sapiens
uucagugcuguacuuga

SEQ ID NO: 1772845 - RNA, 18 nt, Homo sapiens
cuggcauuacagguguga

SEQ ID NO: 1772846 - RNA, 20 nt, Homo sapiens
aauuuuguaaaacaaugcca

SEQ ID NO: 1772847 - RNA, 21 nt, Homo sapiens
gcagcuucaccagagcauuuc

SEQ ID NO: 1772848 - RNA, 12 nt, Homo sapiens
uguggugcauuc

SEQ ID NO: 1772849 - RNA, 12 nt, Homo sapiens
gaaccaagaacu

SEQ ID NO: 1772850 - RNA, 21 nt, Homo sapiens
aucuucaaugaacugugcuuu

SEQ ID NO: 1772851 - RNA, 23 nt, Homo sapiens
agauuaacacucauuuccaauca

SEQ ID NO: 1772852 - RNA, 13 nt, Homo sapiens
aauaaaacaaagg

SEQ ID NO: 1772853 - RNA, 16 nt, Homo sapiens
caagugaaggagccag

SEQ ID NO: 1772854 - RNA, 13 nt, Homo sapiens
caaaaauguaaug

SEQ ID NO: 1772855 - RNA, 20 nt, Homo sapiens
aggaaaaaccaauagcuuua

SEQ ID NO: 1772856 - RNA, 13 nt, Homo sapiens
ugaauaaaagcau

SEQ ID NO: 1772857 - RNA, 21 nt, Homo sapiens
ugcuguaauauuguaaauacu

SEQ ID NO: 1772858 - RNA, 17 nt, Homo sapiens
gacacaggcagcuucca

SEQ ID NO: 1772859 - RNA, 14 nt, Homo sapiens
cuggggggcucuca

SEQ ID NO: 1772860 - RNA, 15 nt, Homo sapiens
cagaggccauggcag

SEQ ID NO: 1772861 - RNA, 18 nt, Homo sapiens
cuuuucagaagcaagcca

SEQ ID NO: 1772862 - RNA, 22 nt, Homo sapiens
ccauggugcccuguuggcauua

SEQ ID NO: 1772863 - RNA, 11 nt, Homo sapiens
agcugugauuu

SEQ ID NO: 1772864 - RNA, 14 nt, Homo sapiens
ugucucugucaugg

SEQ ID NO: 1772865 - RNA, 20 nt, Homo sapiens
caauaugaggggacugcaug

SEQ ID NO: 1772866 - RNA, 23 nt, Homo sapiens
caacagagaggaccaacauccag

SEQ ID NO: 1772867 - RNA, 14 nt, Homo sapiens
uucacucaaucucu

SEQ ID NO: 1772868 - RNA, 19 nt, Homo sapiens
ccuugcugugugggcucaa

SEQ ID NO: 1772869 - RNA, 21 nt, Homo sapiens
aggugcuugacauaauuucac

SEQ ID NO: 1772870 - RNA, 18 nt, Homo sapiens
cccugagacaaauggagg

SEQ ID NO: 1772871 - RNA, 13 nt, Homo sapiens
uagucaauccaag

SEQ ID NO: 1772872 - RNA, 21 nt, Homo sapiens
ccgagggacagcagauuccac

SEQ ID NO: 1772873 - RNA, 20 nt, Homo sapiens
aucauuguaaauuauuucau

SEQ ID NO: 1772874 - RNA, 23 nt, Homo sapiens
aacaguuugccugcuguauuuau

SEQ ID NO: 1772875 - RNA, 18 nt, Homo sapiens
gucccugcgucuccugcc

SEQ ID NO: 1772876 - RNA, 13 nt, Homo sapiens
uuggggucucuuu

SEQ ID NO: 1772877 - RNA, 12 nt, Homo sapiens
acccacucuuca

SEQ ID NO: 1772878 - RNA, 13 nt, Homo sapiens
auauaauauguca

SEQ ID NO: 1772879 - RNA, 21 nt, Homo sapiens
agccucagaaagggauugcuu

SEQ ID NO: 1772880 - RNA, 20 nt, Homo sapiens
gcucugccccgcagacgguc

SEQ ID NO: 1772881 - RNA, 12 nt, Homo sapiens
guaaacaaacuc

SEQ ID NO: 1772882 - RNA, 13 nt, Homo sapiens
acugcagcuguga

SEQ ID NO: 1772883 - RNA, 13 nt, Homo sapiens
gggcagccacgug

SEQ ID NO: 1772884 - RNA, 20 nt, Homo sapiens
gaaaaaugggaacaaggcaa

SEQ ID NO: 1772885 - RNA, 22 nt, Homo sapiens
ugcaaaagcaggcuugugcuuu

SEQ ID NO: 1772886 - RNA, 22 nt, Homo sapiens
acagggaagcaaauaucuuacc

SEQ ID NO: 1772887 - RNA, 13 nt, Homo sapiens
caauaugugaacg

SEQ ID NO: 1772888 - RNA, 17 nt, Homo sapiens
auagaaagaugacaaaa

SEQ ID NO: 1772889 - RNA, 20 nt, Homo sapiens
auuaugucucuucugagcua

SEQ ID NO: 1772890 - RNA, 21 nt, Homo sapiens
aacguucgauuucuaccucag

SEQ ID NO: 1772891 - RNA, 17 nt, Homo sapiens
ugaaccgaggggcucag

SEQ ID NO: 1772892 - RNA, 16 nt, Homo sapiens
ugcaugcuucuucuca

SEQ ID NO: 1772893 - RNA, 21 nt, Homo sapiens
gccugggcucccuugugcgug

SEQ ID NO: 1772894 - RNA, 16 nt, Homo sapiens
gucuguuuuaauuuaa

SEQ ID NO: 1772895 - RNA, 13 nt, Homo sapiens
ccuucaaacuucc

SEQ ID NO: 1772896 - RNA, 12 nt, Homo sapiens
cuguacugagga

SEQ ID NO: 1772897 - RNA, 21 nt, Homo sapiens
acaggcucuuagcagcuucca

SEQ ID NO: 1772898 - RNA, 15 nt, Homo sapiens
gaauugccagucuuu

SEQ ID NO: 1772899 - RNA, 17 nt, Homo sapiens
cuuggucuuuguaucuu

SEQ ID NO: 1772900 - RNA, 22 nt, Homo sapiens
ucucuguacccuuccuggugcu

SEQ ID NO: 1772901 - RNA, 14 nt, Homo sapiens
acccuaccaugaau

SEQ ID NO: 1772902 - RNA, 22 nt, Homo sapiens
uccacuuggagcuaaaacuggc

SEQ ID NO: 1772903 - RNA, 17 nt, Homo sapiens
ccauuuguaaugaauuu

SEQ ID NO: 1772904 - RNA, 22 nt, Homo sapiens
ccaggaguuugaggcugcagug

SEQ ID NO: 1772905 - RNA, 19 nt, Homo sapiens
guccucuuaccaacaucug

SEQ ID NO: 1772906 - RNA, 18 nt, Homo sapiens
caggcugcauagaaggag

SEQ ID NO: 1772907 - RNA, 16 nt, Homo sapiens
uacaucacuuugugaa

SEQ ID NO: 1772908 - RNA, 17 nt, Homo sapiens
cuuucucaacuguccca

SEQ ID NO: 1772909 - RNA, 16 nt, Homo sapiens
auguaaauugcaaaua

SEQ ID NO: 1772910 - RNA, 15 nt, Homo sapiens
gcauuucugucucuc

SEQ ID NO: 1772911 - RNA, 21 nt, Homo sapiens
uaccaauucacccacucccuu

SEQ ID NO: 1772912 - RNA, 15 nt, Homo sapiens
gugaacugaagcaga

SEQ ID NO: 1772913 - RNA, 22 nt, Homo sapiens
uuaccugaaauaaaauucauua

SEQ ID NO: 1772914 - RNA, 12 nt, Homo sapiens
acacacagccau

SEQ ID NO: 1772915 - RNA, 17 nt, Homo sapiens
ugguguugacaugugcu

SEQ ID NO: 1772916 - RNA, 17 nt, Homo sapiens
aggaaugcacaaauuga

SEQ ID NO: 1772917 - RNA, 16 nt, Homo sapiens
aaacagauuucauacc

SEQ ID NO: 1772918 - RNA, 15 nt, Homo sapiens
uacucacaccuguaa

SEQ ID NO: 1772919 - RNA, 23 nt, Homo sapiens
ucaucgggaggagcagccugaac

SEQ ID NO: 1772920 - RNA, 16 nt, Homo sapiens
caugauagacuuguua

SEQ ID NO: 1772921 - RNA, 14 nt, Homo sapiens
cgccucagggccag

SEQ ID NO: 1772922 - RNA, 18 nt, Homo sapiens
agaagcucagcuaugaaa

SEQ ID NO: 1772923 - RNA, 23 nt, Homo sapiens
auccaguuuugucaaugcaguug

SEQ ID NO: 1772924 - RNA, 23 nt, Homo sapiens
ucugucucaucucuguauuccca

SEQ ID NO: 1772925 - RNA, 16 nt, Homo sapiens
auccauuuuacacagc

SEQ ID NO: 1772926 - RNA, 18 nt, Homo sapiens
auucuuauggccacaagc

SEQ ID NO: 1772927 - RNA, 19 nt, Homo sapiens
uaagguugcacacaguaca

SEQ ID NO: 1772928 - RNA, 23 nt, Homo sapiens
uacacucuuauagaaaguucaaa

SEQ ID NO: 1772929 - RNA, 13 nt, Homo sapiens
uucugccaucucu

SEQ ID NO: 1772930 - RNA, 22 nt, Homo sapiens
ugccaggucccuuucauuugcu

SEQ ID NO: 1772931 - RNA, 22 nt, Homo sapiens
aaagcauugccagcucuuccaa

SEQ ID NO: 1772932 - RNA, 14 nt, Homo sapiens
guacuuucuucccu

SEQ ID NO: 1772933 - RNA, 16 nt, Homo sapiens
agacaggaaaaaccaa

SEQ ID NO: 1772934 - RNA, 17 nt, Homo sapiens
caaacacccaugcccag

SEQ ID NO: 1772935 - RNA, 19 nt, Homo sapiens
guacucuucugacugcccc

SEQ ID NO: 1772936 - RNA, 16 nt, Homo sapiens
accgaggcgaugccac

SEQ ID NO: 1772937 - RNA, 21 nt, Homo sapiens
gggagauccgcccugggcucu

SEQ ID NO: 1772938 - RNA, 23 nt, Homo sapiens
ccuaaauaaacuaguaugaaaua

SEQ ID NO: 1772939 - RNA, 12 nt, Homo sapiens
cauuuucauuca

SEQ ID NO: 1772940 - RNA, 12 nt, Homo sapiens
uacauucacuuu

SEQ ID NO: 1772941 - RNA, 20 nt, Homo sapiens
uaacaguuuuagaauacauu

SEQ ID NO: 1772942 - RNA, 18 nt, Homo sapiens
uuuccaaauuauguggau

SEQ ID NO: 1772943 - RNA, 14 nt, Homo sapiens
uuuaagaauuucac

SEQ ID NO: 1772944 - RNA, 21 nt, Homo sapiens
uguugaugaggccucuuggac

SEQ ID NO: 1772945 - RNA, 15 nt, Homo sapiens
ucagggucacugucc

SEQ ID NO: 1772946 - RNA, 17 nt, Homo sapiens
ugaaugaccugcaguca

SEQ ID NO: 1772947 - RNA, 17 nt, Homo sapiens
agaaucacuugcacucc

SEQ ID NO: 1772948 - RNA, 13 nt, Homo sapiens
uaacugacaugau

SEQ ID NO: 1772949 - RNA, 13 nt, Homo sapiens
cauagguucuucu

SEQ ID NO: 1772950 - RNA, 22 nt, Homo sapiens
ccuggcugagugcgaccaccac

SEQ ID NO: 1772951 - RNA, 18 nt, Homo sapiens
gcuuguauuccaagcaua

SEQ ID NO: 1772952 - RNA, 12 nt, Homo sapiens
ccucccacaauu

SEQ ID NO: 1772953 - RNA, 20 nt, Homo sapiens
ugaaguugauucauauugca

SEQ ID NO: 1772954 - RNA, 17 nt, Homo sapiens
aauuuaaguacuugaga

SEQ ID NO: 1772955 - RNA, 13 nt, Homo sapiens
auaccacuguaau

SEQ ID NO: 1772956 - RNA, 15 nt, Homo sapiens
cuaugcccacuuuag

SEQ ID NO: 1772957 - RNA, 16 nt, Homo sapiens
caggagcaacagccua

SEQ ID NO: 1772958 - RNA, 18 nt, Homo sapiens
cacaggauucucuucuca

SEQ ID NO: 1772959 - RNA, 18 nt, Homo sapiens
aaaaagucagagacagau

SEQ ID NO: 1772960 - RNA, 18 nt, Homo sapiens
agccgggcacaguggcgc

SEQ ID NO: 1772961 - RNA, 16 nt, Homo sapiens
gaaaaguacauuuaau

SEQ ID NO: 1772962 - RNA, 15 nt, Homo sapiens
cuuuuaggccaagga

SEQ ID NO: 1772963 - RNA, 22 nt, Homo sapiens
ugagaccgagggaagggcucag

SEQ ID NO: 1772964 - RNA, 17 nt, Homo sapiens
uuugccugcagaguuug

SEQ ID NO: 1772965 - RNA, 14 nt, Homo sapiens
cugucuccaugcug

SEQ ID NO: 1772966 - RNA, 17 nt, Homo sapiens
gaaaaaaaaauggaagc

SEQ ID NO: 1772967 - RNA, 14 nt, Homo sapiens
cuuccuggaccuga

SEQ ID NO: 1772968 - RNA, 19 nt, Homo sapiens
agaccuguaaucauauaau

SEQ ID NO: 1772969 - RNA, 24 nt, Homo sapiens
auuucaucucuuucuacucuccua

SEQ ID NO: 1772970 - RNA, 14 nt, Homo sapiens
caggaggaagugag

SEQ ID NO: 1772971 - RNA, 13 nt, Homo sapiens
aucuucacugcaa

SEQ ID NO: 1772972 - RNA, 13 nt, Homo sapiens
uccugugaugucc

SEQ ID NO: 1772973 - RNA, 22 nt, Homo sapiens
cauguguaaagacugagcagaa

SEQ ID NO: 1772974 - RNA, 23 nt, Homo sapiens
uucugcucccauccaagaaagac

SEQ ID NO: 1772975 - RNA, 17 nt, Homo sapiens
cuuuuacagacuagcag

SEQ ID NO: 1772976 - RNA, 20 nt, Homo sapiens
cuuuucaagcuauaaugcua

SEQ ID NO: 1772977 - RNA, 14 nt, Homo sapiens
ccaaaacuccugcc

SEQ ID NO: 1772978 - RNA, 15 nt, Homo sapiens
ucauuaaauguuuga

SEQ ID NO: 1772979 - RNA, 14 nt, Homo sapiens
aaaggacuugacuu

SEQ ID NO: 1772980 - RNA, 23 nt, Homo sapiens
ugucuaggcuggaagagccaaag

SEQ ID NO: 1772981 - RNA, 21 nt, Homo sapiens
gauccucugggaagcggcccg

SEQ ID NO: 1772982 - RNA, 22 nt, Homo sapiens
gaacauuaauccacauguuuca

SEQ ID NO: 1772983 - RNA, 14 nt, Homo sapiens
ggccugcaggugag

SEQ ID NO: 1772984 - RNA, 15 nt, Homo sapiens
caugaaucacugugc

SEQ ID NO: 1772985 - RNA, 15 nt, Homo sapiens
caagagccacaguau

SEQ ID NO: 1772986 - RNA, 18 nt, Homo sapiens
ugaaauaacauggccuug

SEQ ID NO: 1772987 - RNA, 18 nt, Homo sapiens
uuaguaugcaguugauaa

SEQ ID NO: 1772988 - RNA, 14 nt, Homo sapiens
gacauaacagugca

SEQ ID NO: 1772989 - RNA, 23 nt, Homo sapiens
cacucuccaaacagucaccauac

SEQ ID NO: 1772990 - RNA, 11 nt, Homo sapiens
agaguggugcu

SEQ ID NO: 1772991 - RNA, 22 nt, Homo sapiens
cugccuguuauaacucugcacu

SEQ ID NO: 1772992 - RNA, 21 nt, Homo sapiens
uccaguccaaagccggcuuga

SEQ ID NO: 1772993 - RNA, 18 nt, Homo sapiens
aguucuauuucuauccca

SEQ ID NO: 1772994 - RNA, 22 nt, Homo sapiens
cuuuaugcuaguuugaccucau

SEQ ID NO: 1772995 - RNA, 23 nt, Homo sapiens
guaugccucauuuuauucuguca

SEQ ID NO: 1772996 - RNA, 14 nt, Homo sapiens
ugaacuaaugacaa

SEQ ID NO: 1772997 - RNA, 16 nt, Homo sapiens
ucagggagaagaucau

SEQ ID NO: 1772998 - RNA, 20 nt, Homo sapiens
cccaaacccagaacaugaag

SEQ ID NO: 1772999 - RNA, 22 nt, Homo sapiens
guaugcucauacuuggacaguu

SEQ ID NO: 1773000 - RNA, 21 nt, Homo sapiens
gcaguguuucccguauugaca

SEQ ID NO: 1773001 - RNA, 16 nt, Homo sapiens
uacccaucugccagau

SEQ ID NO: 1773002 - RNA, 13 nt, Homo sapiens
guuagagauuuua

SEQ ID NO: 1773003 - RNA, 18 nt, Homo sapiens
cgugggaucagauuuggu

SEQ ID NO: 1773004 - RNA, 18 nt, Homo sapiens
aagcaaaggaaaccaaag

SEQ ID NO: 1773005 - RNA, 20 nt, Homo sapiens
ugaggagaagcugauccagu

SEQ ID NO: 1773006 - RNA, 13 nt, Homo sapiens
uuaguauugcaaa

SEQ ID NO: 1773007 - RNA, 15 nt, Homo sapiens
cacaaggccuugccu

SEQ ID NO: 1773008 - RNA, 13 nt, Homo sapiens
auuuuguaacuuu

SEQ ID NO: 1773009 - RNA, 15 nt, Homo sapiens
cuugaaugcugccag

SEQ ID NO: 1773010 - RNA, 23 nt, Homo sapiens
acacaaagcuacccaucugccag

SEQ ID NO: 1773011 - RNA, 12 nt, Homo sapiens
ugcuagcuuucc

SEQ ID NO: 1773012 - RNA, 20 nt, Homo sapiens
uguaaucccaacauuuuggg

SEQ ID NO: 1773013 - RNA, 15 nt, Homo sapiens
cauuugagcagcuga

SEQ ID NO: 1773014 - RNA, 22 nt, Homo sapiens
cccccaguccuguccuaucacu

SEQ ID NO: 1773015 - RNA, 15 nt, Homo sapiens
ugcauagcuuugcac

SEQ ID NO: 1773016 - RNA, 12 nt, Homo sapiens
uccccagacuug

SEQ ID NO: 1773017 - RNA, 14 nt, Homo sapiens
cacccugaucuuca

SEQ ID NO: 1773018 - RNA, 15 nt, Homo sapiens
uuacuguagccucag

SEQ ID NO: 1773019 - RNA, 16 nt, Homo sapiens
guuuuuccaguucaca

SEQ ID NO: 1773020 - RNA, 15 nt, Homo sapiens
ccucaaggggccauc

SEQ ID NO: 1773021 - RNA, 21 nt, Homo sapiens
uuguguggucauaucuaguca

SEQ ID NO: 1773022 - RNA, 16 nt, Homo sapiens
acaauacagccacuaa

SEQ ID NO: 1773023 - RNA, 23 nt, Homo sapiens
ggcuacucacucaaguucaagga

SEQ ID NO: 1773024 - RNA, 17 nt, Homo sapiens
auaggcacaugcaucuu

SEQ ID NO: 1773025 - RNA, 13 nt, Homo sapiens
cuuucuguugcca

SEQ ID NO: 1773026 - RNA, 15 nt, Homo sapiens
aaaauuaauggacac

SEQ ID NO: 1773027 - RNA, 23 nt, Homo sapiens
gggcacuugcugaggccaagcca

SEQ ID NO: 1773028 - RNA, 17 nt, Homo sapiens
cugggaucuggugguca

SEQ ID NO: 1773029 - RNA, 23 nt, Homo sapiens
uuuaguauagccacaaaugccuu

SEQ ID NO: 1773030 - RNA, 17 nt, Homo sapiens
uaaccgcacaugcacac

SEQ ID NO: 1773031 - RNA, 16 nt, Homo sapiens
gucuuuuuccaaacaa

SEQ ID NO: 1773032 - RNA, 12 nt, Homo sapiens
gaauuuccuuac

SEQ ID NO: 1773033 - RNA, 18 nt, Homo sapiens
aaaccaggccacuugccu

SEQ ID NO: 1773034 - RNA, 22 nt, Homo sapiens
ugagcucuauuaugaaugugaa

SEQ ID NO: 1773035 - RNA, 18 nt, Homo sapiens
ugacaaaggagcauugca

SEQ ID NO: 1773036 - RNA, 18 nt, Homo sapiens
auguguucauucaagcua

SEQ ID NO: 1773037 - RNA, 23 nt, Homo sapiens
uauugcuaccaaaaacuagacau

SEQ ID NO: 1773038 - RNA, 13 nt, Homo sapiens
cagcgagaaggag

SEQ ID NO: 1773039 - RNA, 20 nt, Homo sapiens
ugguuccugugauacauuuc

SEQ ID NO: 1773040 - RNA, 11 nt, Homo sapiens
gcuuacaggaa

SEQ ID NO: 1773041 - RNA, 20 nt, Homo sapiens
uggaggaaguucuccagcuu

SEQ ID NO: 1773042 - RNA, 22 nt, Homo sapiens
uguacuuuuuuuuacuuuggca

SEQ ID NO: 1773043 - RNA, 17 nt, Homo sapiens
cucucaggugccagucu

SEQ ID NO: 1773044 - RNA, 13 nt, Homo sapiens
aaggugagcagaa

SEQ ID NO: 1773045 - RNA, 20 nt, Homo sapiens
cuuucugcaggaaauaguca

SEQ ID NO: 1773046 - RNA, 19 nt, Homo sapiens
uaaaauguaugaccacugg

SEQ ID NO: 1773047 - RNA, 18 nt, Homo sapiens
aggugagaaaaggggcau

SEQ ID NO: 1773048 - RNA, 17 nt, Homo sapiens
gcaccuucuuucuggac

SEQ ID NO: 1773049 - RNA, 15 nt, Homo sapiens
uaauaaugcuuaaua

SEQ ID NO: 1773050 - RNA, 15 nt, Homo sapiens
cagccagauggcccc

SEQ ID NO: 1773051 - RNA, 15 nt, Homo sapiens
cacaccgaugcacac

SEQ ID NO: 1773052 - RNA, 17 nt, Homo sapiens
aagauggacuuaccugg

SEQ ID NO: 1773053 - RNA, 20 nt, Homo sapiens
ucccuguguacccuccaugu

SEQ ID NO: 1773054 - RNA, 20 nt, Homo sapiens
ugggcgagcgguaaauccua

SEQ ID NO: 1773055 - RNA, 17 nt, Homo sapiens
gauuccauccugugucc

SEQ ID NO: 1773056 - RNA, 18 nt, Homo sapiens
gauuagcucuggaccagc

SEQ ID NO: 1773057 - RNA, 16 nt, Homo sapiens
augcugucaugguccu

SEQ ID NO: 1773058 - RNA, 20 nt, Homo sapiens
cuacauuuuuuaaaacugaa

SEQ ID NO: 1773059 - RNA, 18 nt, Homo sapiens
uaaauguauacaccaagu

SEQ ID NO: 1773060 - RNA, 20 nt, Homo sapiens
uaaaagcaggcuucuaugaa

SEQ ID NO: 1773061 - RNA, 15 nt, Homo sapiens
ucagcagagaacugg

SEQ ID NO: 1773062 - RNA, 16 nt, Homo sapiens
uacagccuauaguaaa

SEQ ID NO: 1773063 - RNA, 18 nt, Homo sapiens
gucuucaacauccugcca

SEQ ID NO: 1773064 - RNA, 18 nt, Homo sapiens
cacuguuuuaucucugug

SEQ ID NO: 1773065 - RNA, 22 nt, Homo sapiens
acucacacuaugugcaaaaauc

SEQ ID NO: 1773066 - RNA, 19 nt, Homo sapiens
ccugaaacccaguaauucu

SEQ ID NO: 1773067 - RNA, 16 nt, Homo sapiens
ugaaagaugaguagga

SEQ ID NO: 1773068 - RNA, 15 nt, Homo sapiens
ucagugugcaaagaa

SEQ ID NO: 1773069 - RNA, 19 nt, Homo sapiens
cuuaauuuacuuaaguguu

SEQ ID NO: 1773070 - RNA, 13 nt, Homo sapiens
cuugcuguuccca

SEQ ID NO: 1773071 - RNA, 17 nt, Homo sapiens
cuaaggauaugcauuaa

SEQ ID NO: 1773072 - RNA, 17 nt, Homo sapiens
ccaaaccuccaaaacuc

SEQ ID NO: 1773073 - RNA, 15 nt, Homo sapiens
ucagaaacagugagu

SEQ ID NO: 1773074 - RNA, 20 nt, Homo sapiens
acuuucccguuuuauuccag

SEQ ID NO: 1773075 - RNA, 18 nt, Homo sapiens
gacaagacaaaaccaaaa

SEQ ID NO: 1773076 - RNA, 18 nt, Homo sapiens
acugcccaccugccaggc

SEQ ID NO: 1773077 - RNA, 15 nt, Homo sapiens
gaagucuccaugaag

SEQ ID NO: 1773078 - RNA, 14 nt, Homo sapiens
ugaaacacaccagg

SEQ ID NO: 1773079 - RNA, 14 nt, Homo sapiens
guuacagaccucag

SEQ ID NO: 1773080 - RNA, 17 nt, Homo sapiens
ccagcaucuggagaccg

SEQ ID NO: 1773081 - RNA, 14 nt, Homo sapiens
uuuccuaauuuuga

SEQ ID NO: 1773082 - RNA, 17 nt, Homo sapiens
ccuuuaucauccuuaaa

SEQ ID NO: 1773083 - RNA, 23 nt, Homo sapiens
ucuguaaaccacuugucacuaca

SEQ ID NO: 1773084 - RNA, 13 nt, Homo sapiens
uuaaaauucucaa

SEQ ID NO: 1773085 - RNA, 17 nt, Homo sapiens
ccaggcaggugccugga

SEQ ID NO: 1773086 - RNA, 13 nt, Homo sapiens
cuguccuggucag

SEQ ID NO: 1773087 - RNA, 17 nt, Homo sapiens
accccuaccucuaguaa

SEQ ID NO: 1773088 - RNA, 22 nt, Homo sapiens
ccagucacugucccucaaauga

SEQ ID NO: 1773089 - RNA, 15 nt, Homo sapiens
uggcucugaugcuga

SEQ ID NO: 1773090 - RNA, 23 nt, Homo sapiens
caggugugagccaccgugcccag

SEQ ID NO: 1773091 - RNA, 23 nt, Homo sapiens
ucaucagucauuauuagcuuuua

SEQ ID NO: 1773092 - RNA, 18 nt, Homo sapiens
ugugcguguauaugugcu

SEQ ID NO: 1773093 - RNA, 11 nt, Homo sapiens
uaaucucucac

SEQ ID NO: 1773094 - RNA, 17 nt, Homo sapiens
gccaucuugaucugugu

SEQ ID NO: 1773095 - RNA, 14 nt, Homo sapiens
gccaggcugcaggg

SEQ ID NO: 1773096 - RNA, 21 nt, Homo sapiens
gcacauucucccuugauucca

SEQ ID NO: 1773097 - RNA, 21 nt, Homo sapiens
ccccucucccuugggcucuga

SEQ ID NO: 1773098 - RNA, 21 nt, Homo sapiens
cagccagguuugccagaacca

SEQ ID NO: 1773099 - RNA, 12 nt, Homo sapiens
gcaagcacuuga

SEQ ID NO: 1773100 - RNA, 19 nt, Homo sapiens
auauuuuuuauacuugaaa

SEQ ID NO: 1773101 - RNA, 16 nt, Homo sapiens
gccccucagggggcca

SEQ ID NO: 1773102 - RNA, 17 nt, Homo sapiens
uaaagcagacagucaca

SEQ ID NO: 1773103 - RNA, 14 nt, Homo sapiens
cuggaugucuccau

SEQ ID NO: 1773104 - RNA, 14 nt, Homo sapiens
uccaauguguucaa

SEQ ID NO: 1773105 - RNA, 14 nt, Homo sapiens
cucgccccaaaguu

SEQ ID NO: 1773106 - RNA, 18 nt, Homo sapiens
uccuuccagaccuuauca

SEQ ID NO: 1773107 - RNA, 15 nt, Homo sapiens
acucugaauccucag

SEQ ID NO: 1773108 - RNA, 19 nt, Homo sapiens
cccacguggacaagaaagu

SEQ ID NO: 1773109 - RNA, 17 nt, Homo sapiens
ccaaaacuauccugauu

SEQ ID NO: 1773110 - RNA, 21 nt, Homo sapiens
caaucacauuaacauuuugag

SEQ ID NO: 1773111 - RNA, 14 nt, Homo sapiens
ucugcucacagaca

SEQ ID NO: 1773112 - RNA, 20 nt, Homo sapiens
ccugagguuugccagcauuu

SEQ ID NO: 1773113 - RNA, 15 nt, Homo sapiens
aagagaucauauccu

SEQ ID NO: 1773114 - RNA, 20 nt, Homo sapiens
uccgcaggcaguuaccaagu

SEQ ID NO: 1773115 - RNA, 13 nt, Homo sapiens
aggaaucaagaag

SEQ ID NO: 1773116 - RNA, 18 nt, Homo sapiens
cuaauaaaauacauacua

SEQ ID NO: 1773117 - RNA, 18 nt, Homo sapiens
agacugaacauguuuaca

SEQ ID NO: 1773118 - RNA, 23 nt, Homo sapiens
agaacaaugcuauaauauauaau

SEQ ID NO: 1773119 - RNA, 13 nt, Homo sapiens
ucccaauguuuga

SEQ ID NO: 1773120 - RNA, 20 nt, Homo sapiens
cccucauuuaagaaaaauca

SEQ ID NO: 1773121 - RNA, 22 nt, Homo sapiens
accagccuggccaucaugguga

SEQ ID NO: 1773122 - RNA, 20 nt, Homo sapiens
auggguacuucguggccgca

SEQ ID NO: 1773123 - RNA, 13 nt, Homo sapiens
uauugaagacaau

SEQ ID NO: 1773124 - RNA, 19 nt, Homo sapiens
ccugcacucuuauuucacu

SEQ ID NO: 1773125 - RNA, 14 nt, Homo sapiens
uagggaaaaaccag

SEQ ID NO: 1773126 - RNA, 21 nt, Homo sapiens
cuaaaggaaagaugaugguga

SEQ ID NO: 1773127 - RNA, 23 nt, Homo sapiens
cacaagguugcuggcauuugcug

SEQ ID NO: 1773128 - RNA, 14 nt, Homo sapiens
uuuucaagucuccu

SEQ ID NO: 1773129 - RNA, 16 nt, Homo sapiens
gaagugguucagucua

SEQ ID NO: 1773130 - RNA, 14 nt, Homo sapiens
agacccaguguaaa

SEQ ID NO: 1773131 - RNA, 13 nt, Homo sapiens
cagggcugauaag

SEQ ID NO: 1773132 - RNA, 21 nt, Homo sapiens
aauuuccuuaaagcaagcuca

SEQ ID NO: 1773133 - RNA, 16 nt, Homo sapiens
cuugaaauuacugugu

SEQ ID NO: 1773134 - RNA, 18 nt, Homo sapiens
guucuuugucacagggac

SEQ ID NO: 1773135 - RNA, 20 nt, Homo sapiens
agacugggugaaagugacua

SEQ ID NO: 1773136 - RNA, 11 nt, Homo sapiens
aaugcagagaa

SEQ ID NO: 1773137 - RNA, 16 nt, Homo sapiens
uuugacacugaauaaa

SEQ ID NO: 1773138 - RNA, 21 nt, Homo sapiens
aagacagagaagaccaaagca

SEQ ID NO: 1773139 - RNA, 17 nt, Homo sapiens
uaucuguuuucuaccuc

SEQ ID NO: 1773140 - RNA, 23 nt, Homo sapiens
ucuuuaagaguuuaaaaucauca

SEQ ID NO: 1773141 - RNA, 14 nt, Homo sapiens
gccgcugcaccugc

SEQ ID NO: 1773142 - RNA, 14 nt, Homo sapiens
auguauguuuacac

SEQ ID NO: 1773143 - RNA, 20 nt, Homo sapiens
ucgccaaguuggagugcaau

SEQ ID NO: 1773144 - RNA, 20 nt, Homo sapiens
cuuuguaagcgggacauuua

SEQ ID NO: 1773145 - RNA, 19 nt, Homo sapiens
ucuuuauugcuuacugugu

SEQ ID NO: 1773146 - RNA, 18 nt, Homo sapiens
aagaucccaucucuccau

SEQ ID NO: 1773147 - RNA, 20 nt, Homo sapiens
cuuauuguggauaacaaaga

SEQ ID NO: 1773148 - RNA, 17 nt, Homo sapiens
ucuuaccuaaacugagc

SEQ ID NO: 1773149 - RNA, 21 nt, Homo sapiens
ggucaagagaguucugaccug

SEQ ID NO: 1773150 - RNA, 14 nt, Homo sapiens
aggggcaguggugg

SEQ ID NO: 1773151 - RNA, 14 nt, Homo sapiens
uaugggagaauugc

SEQ ID NO: 1773152 - RNA, 16 nt, Homo sapiens
cgccugaaacuuugag

SEQ ID NO: 1773153 - RNA, 22 nt, Homo sapiens
agaucugcuuucuguucaucuc

SEQ ID NO: 1773154 - RNA, 21 nt, Homo sapiens
gaacuuuguggucgacaucaa

SEQ ID NO: 1773155 - RNA, 13 nt, Homo sapiens
aaaucuagaucaa

SEQ ID NO: 1773156 - RNA, 17 nt, Homo sapiens
uaugggagaaggccagu

SEQ ID NO: 1773157 - RNA, 22 nt, Homo sapiens
uaguguugugcacuucauguca

SEQ ID NO: 1773158 - RNA, 13 nt, Homo sapiens
uaagauaguugau

SEQ ID NO: 1773159 - RNA, 18 nt, Homo sapiens
acucugacauaaacccau

SEQ ID NO: 1773160 - RNA, 17 nt, Homo sapiens
aaaauggcgaacaugug

SEQ ID NO: 1773161 - RNA, 24 nt, Homo sapiens
ccacccucaugcugugugacucaa

SEQ ID NO: 1773162 - RNA, 14 nt, Homo sapiens
guagauauuugaaa

SEQ ID NO: 1773163 - RNA, 14 nt, Homo sapiens
cuuuccguuucucu

SEQ ID NO: 1773164 - RNA, 14 nt, Homo sapiens
aggggcauuucaca

SEQ ID NO: 1773165 - RNA, 16 nt, Homo sapiens
cuacugggcugcauuc

SEQ ID NO: 1773166 - RNA, 14 nt, Homo sapiens
ggcccuuucuuugu

SEQ ID NO: 1773167 - RNA, 19 nt, Homo sapiens
cauuauugacgaacuggcu

SEQ ID NO: 1773168 - RNA, 21 nt, Homo sapiens
agagaaaauugugaaagugac

SEQ ID NO: 1773169 - RNA, 15 nt, Homo sapiens
ggcacugaagcccga

SEQ ID NO: 1773170 - RNA, 20 nt, Homo sapiens
ucacauggccuaugcacaua

SEQ ID NO: 1773171 - RNA, 23 nt, Homo sapiens
cauguugacauaugucuaugucc

SEQ ID NO: 1773172 - RNA, 16 nt, Homo sapiens
acuuaaaccugugcuu

SEQ ID NO: 1773173 - RNA, 23 nt, Homo sapiens
uccugugagcucaacuaaguuca

SEQ ID NO: 1773174 - RNA, 19 nt, Homo sapiens
uaaacucaaaacucuugaa

SEQ ID NO: 1773175 - RNA, 20 nt, Homo sapiens
auuaaauuuuagucagauuu

SEQ ID NO: 1773176 - RNA, 12 nt, Homo sapiens
aaaaggugauua

SEQ ID NO: 1773177 - RNA, 23 nt, Homo sapiens
aucagugggauuugguaaugugu

SEQ ID NO: 1773178 - RNA, 21 nt, Homo sapiens
ugcucggcuguaaacagcucu

SEQ ID NO: 1773179 - RNA, 18 nt, Homo sapiens
aggcaugagccacugcgc

SEQ ID NO: 1773180 - RNA, 18 nt, Homo sapiens
aggcaugaaccacugcac

SEQ ID NO: 1773181 - RNA, 23 nt, Homo sapiens
ugacuaaguuuuuauaccagcuu

SEQ ID NO: 1773182 - RNA, 15 nt, Homo sapiens
aaaacagacgggucu

SEQ ID NO: 1773183 - RNA, 11 nt, Homo sapiens
uuuccagucag

SEQ ID NO: 1773184 - RNA, 22 nt, Homo sapiens
agccaguguggucaguauucca

SEQ ID NO: 1773185 - RNA, 16 nt, Homo sapiens
ugaugggagggauuga

SEQ ID NO: 1773186 - RNA, 20 nt, Homo sapiens
agaauauuauuagucugcau

SEQ ID NO: 1773187 - RNA, 14 nt, Homo sapiens
ccaucugauuuacu

SEQ ID NO: 1773188 - RNA, 17 nt, Homo sapiens
ucauuaaauguuugaca

SEQ ID NO: 1773189 - RNA, 17 nt, Homo sapiens
aaagauguagauuuauu

SEQ ID NO: 1773190 - RNA, 15 nt, Homo sapiens
aggcccaaauuauca

SEQ ID NO: 1773191 - RNA, 18 nt, Homo sapiens
cacugcaagucacauaaa

SEQ ID NO: 1773192 - RNA, 19 nt, Homo sapiens
uggcaacaacagauucucu

SEQ ID NO: 1773193 - RNA, 15 nt, Homo sapiens
uguaagcagaaugga

SEQ ID NO: 1773194 - RNA, 13 nt, Homo sapiens
acuuacauuucag

SEQ ID NO: 1773195 - RNA, 15 nt, Homo sapiens
cuauccuauguuaaa

SEQ ID NO: 1773196 - RNA, 19 nt, Homo sapiens
ugcugcccugcuguggaag

SEQ ID NO: 1773197 - RNA, 13 nt, Homo sapiens
agccaaugcuguc

SEQ ID NO: 1773198 - RNA, 22 nt, Homo sapiens
aaaugagaauuuuauauucuaa

SEQ ID NO: 1773199 - RNA, 16 nt, Homo sapiens
uaccuuuaaauugaua

SEQ ID NO: 1773200 - RNA, 19 nt, Homo sapiens
ucaugcaucuccaccugcu

SEQ ID NO: 1773201 - RNA, 18 nt, Homo sapiens
cgaguggcgaguccagac

SEQ ID NO: 1773202 - RNA, 14 nt, Homo sapiens
cgcccccaccagcu

SEQ ID NO: 1773203 - RNA, 21 nt, Homo sapiens
cugaccuuucugagugacaug

SEQ ID NO: 1773204 - RNA, 14 nt, Homo sapiens
gaccccagacugua

SEQ ID NO: 1773205 - RNA, 19 nt, Homo sapiens
cauuuauuuacaugugauu

SEQ ID NO: 1773206 - RNA, 13 nt, Homo sapiens
ucuggaaccucag

SEQ ID NO: 1773207 - RNA, 15 nt, Homo sapiens
uuucuguguacugua

SEQ ID NO: 1773208 - RNA, 15 nt, Homo sapiens
cuucugagcacuguu

SEQ ID NO: 1773209 - RNA, 14 nt, Homo sapiens
augggguccagaga

SEQ ID NO: 1773210 - RNA, 13 nt, Homo sapiens
guggguuuuacac

SEQ ID NO: 1773211 - RNA, 16 nt, Homo sapiens
aguggugguauguaau

SEQ ID NO: 1773212 - RNA, 22 nt, Homo sapiens
cucgcaggccucccugccagua

SEQ ID NO: 1773213 - RNA, 18 nt, Homo sapiens
agcccugucgagacacuu

SEQ ID NO: 1773214 - RNA, 21 nt, Homo sapiens
ggaggcaguuuuuguuccuuc

SEQ ID NO: 1773215 - RNA, 16 nt, Homo sapiens
uauccauaaccucuau

SEQ ID NO: 1773216 - RNA, 17 nt, Homo sapiens
gaauauagcaucuuuca

SEQ ID NO: 1773217 - RNA, 17 nt, Homo sapiens
uuucuagaugucucuga

SEQ ID NO: 1773218 - RNA, 19 nt, Homo sapiens
ugcaaaucacucugcaaug

SEQ ID NO: 1773219 - RNA, 23 nt, Homo sapiens
gcuaugcuauggaauauacaugu

SEQ ID NO: 1773220 - RNA, 13 nt, Homo sapiens
accuccucccacu

SEQ ID NO: 1773221 - RNA, 16 nt, Homo sapiens
auuccagaugcaugau

SEQ ID NO: 1773222 - RNA, 15 nt, Homo sapiens
caucccuggaaggac

SEQ ID NO: 1773223 - RNA, 18 nt, Homo sapiens
gucagauuaucuacuuag

SEQ ID NO: 1773224 - RNA, 12 nt, Homo sapiens
gcucauuuacuu

SEQ ID NO: 1773225 - RNA, 17 nt, Homo sapiens
uaaguaguaaucuguca

SEQ ID NO: 1773226 - RNA, 20 nt, Homo sapiens
gugcuuuauaccccauuuga

SEQ ID NO: 1773227 - RNA, 20 nt, Homo sapiens
agccuugggggggcugccuu

SEQ ID NO: 1773228 - RNA, 20 nt, Homo sapiens
gauccccacgccacagcccu

SEQ ID NO: 1773229 - RNA, 22 nt, Homo sapiens
ugacccaggaaccgauuaucua

SEQ ID NO: 1773230 - RNA, 22 nt, Homo sapiens
acugcagucagcaugaauccag

SEQ ID NO: 1773231 - RNA, 14 nt, Homo sapiens
cauuccaugacgca

SEQ ID NO: 1773232 - RNA, 18 nt, Homo sapiens
gugaauggcugugcccca

SEQ ID NO: 1773233 - RNA, 18 nt, Homo sapiens
cauagaauacucagggaa

SEQ ID NO: 1773234 - RNA, 12 nt, Homo sapiens
gaucucaguauu

SEQ ID NO: 1773235 - RNA, 18 nt, Homo sapiens
uucauauguggaaauaua

SEQ ID NO: 1773236 - RNA, 17 nt, Homo sapiens
cuauuuggaaagcacug

SEQ ID NO: 1773237 - RNA, 14 nt, Homo sapiens
uuaucccgccaggg

SEQ ID NO: 1773238 - RNA, 13 nt, Homo sapiens
cacuaaagcuuca

SEQ ID NO: 1773239 - RNA, 20 nt, Homo sapiens
ucaaaauggacguacugguu

SEQ ID NO: 1773240 - RNA, 21 nt, Homo sapiens
cgcagaacuaccagguggcaa

SEQ ID NO: 1773241 - RNA, 17 nt, Homo sapiens
gucuugagcucuauuau

SEQ ID NO: 1773242 - RNA, 15 nt, Homo sapiens
aaaccugugcuuuca

SEQ ID NO: 1773243 - RNA, 15 nt, Homo sapiens
cuuccugcuugccaa

SEQ ID NO: 1773244 - RNA, 14 nt, Homo sapiens
ccaccuauccccau

SEQ ID NO: 1773245 - RNA, 13 nt, Homo sapiens
auaagauaaauac

SEQ ID NO: 1773246 - RNA, 18 nt, Homo sapiens
agauaggaguucucugau

SEQ ID NO: 1773247 - RNA, 15 nt, Homo sapiens
cauuaccuccaucca

SEQ ID NO: 1773248 - RNA, 15 nt, Homo sapiens
acugaauaaauaccu

SEQ ID NO: 1773249 - RNA, 19 nt, Homo sapiens
gcuuaacacuugaccuaaa

SEQ ID NO: 1773250 - RNA, 19 nt, Homo sapiens
acuccacuccccucaucca

SEQ ID NO: 1773251 - RNA, 21 nt, Homo sapiens
auauauuuuugguugucaaua

SEQ ID NO: 1773252 - RNA, 19 nt, Homo sapiens
acuggcacagucuuugcau

SEQ ID NO: 1773253 - RNA, 13 nt, Homo sapiens
uaaaaucacuuca

SEQ ID NO: 1773254 - RNA, 22 nt, Homo sapiens
uaggguuacagagaccuaugua

SEQ ID NO: 1773255 - RNA, 17 nt, Homo sapiens
cgcuccaaugccuacug

SEQ ID NO: 1773256 - RNA, 16 nt, Homo sapiens
cuccagaagggcagcu

SEQ ID NO: 1773257 - RNA, 16 nt, Homo sapiens
ggcauguguaguuaau

SEQ ID NO: 1773258 - RNA, 14 nt, Homo sapiens
uuauuguuaauaca

SEQ ID NO: 1773259 - RNA, 20 nt, Homo sapiens
uuucacauaucuaguaugaa

SEQ ID NO: 1773260 - RNA, 17 nt, Homo sapiens
ugaaacacaagaauuac

SEQ ID NO: 1773261 - RNA, 23 nt, Homo sapiens
caaaguaaaaauugaacuguaaa

SEQ ID NO: 1773262 - RNA, 12 nt, Homo sapiens
cacaguggcacc

SEQ ID NO: 1773263 - RNA, 14 nt, Homo sapiens
uaggcagugcagua

SEQ ID NO: 1773264 - RNA, 13 nt, Homo sapiens
uccucugagcagc

SEQ ID NO: 1773265 - RNA, 23 nt, Homo sapiens
auauccagauggcauguguuuac

SEQ ID NO: 1773266 - RNA, 17 nt, Homo sapiens
uaccaaccugaagacac

SEQ ID NO: 1773267 - RNA, 21 nt, Homo sapiens
uuccuuuuaaaacacuuccau

SEQ ID NO: 1773268 - RNA, 22 nt, Homo sapiens
gggaggaucguuugagcccagg

SEQ ID NO: 1773269 - RNA, 14 nt, Homo sapiens
ggcuucccaugucu

SEQ ID NO: 1773270 - RNA, 23 nt, Homo sapiens
cauccagggguucauuuucauga

SEQ ID NO: 1773271 - RNA, 20 nt, Homo sapiens
uuuaucaauaaagcacuauu

SEQ ID NO: 1773272 - RNA, 16 nt, Homo sapiens
aaccaggacucugccc

SEQ ID NO: 1773273 - RNA, 19 nt, Homo sapiens
cagugagguucuuggguuu

SEQ ID NO: 1773274 - RNA, 15 nt, Homo sapiens
ugagauccucaaaaa

SEQ ID NO: 1773275 - RNA, 24 nt, Homo sapiens
uagaaacaacacuguaguaaauaa

SEQ ID NO: 1773276 - RNA, 12 nt, Homo sapiens
aaauccauagau

SEQ ID NO: 1773277 - RNA, 18 nt, Homo sapiens
cugcgucauuacagggca

SEQ ID NO: 1773278 - RNA, 21 nt, Homo sapiens
aaaguuauauucacaguuuuu

SEQ ID NO: 1773279 - RNA, 11 nt, Homo sapiens
uugucucaaga

SEQ ID NO: 1773280 - RNA, 13 nt, Homo sapiens
guggagugucaca

SEQ ID NO: 1773281 - RNA, 13 nt, Homo sapiens
ugcugccacugag

SEQ ID NO: 1773282 - RNA, 14 nt, Homo sapiens
uaacagugugcuca

SEQ ID NO: 1773283 - RNA, 23 nt, Homo sapiens
cucggccuccucccacaagcacc

SEQ ID NO: 1773284 - RNA, 18 nt, Homo sapiens
cucuucuaacacaaaaua

SEQ ID NO: 1773285 - RNA, 18 nt, Homo sapiens
aauccccaacaugcacug

SEQ ID NO: 1773286 - RNA, 13 nt, Homo sapiens
aauaaauaauuaa

SEQ ID NO: 1773287 - RNA, 23 nt, Homo sapiens
uuggcccgcggccugcaccgacc

SEQ ID NO: 1773288 - RNA, 21 nt, Homo sapiens
aaagccauauggacacuguga

SEQ ID NO: 1773289 - RNA, 14 nt, Homo sapiens
ucuacuccaauuca

SEQ ID NO: 1773290 - RNA, 20 nt, Homo sapiens
auccaggccugccaagguga

SEQ ID NO: 1773291 - RNA, 14 nt, Homo sapiens
uccccacauaccau

SEQ ID NO: 1773292 - RNA, 17 nt, Homo sapiens
ccaaucagguagcuuaa

SEQ ID NO: 1773293 - RNA, 15 nt, Homo sapiens
ccacggccaggccag

SEQ ID NO: 1773294 - RNA, 17 nt, Homo sapiens
aaucccacccacaugug

SEQ ID NO: 1773295 - RNA, 23 nt, Homo sapiens
cuauuaacuuuaauucucuuuca

SEQ ID NO: 1773296 - RNA, 19 nt, Homo sapiens
ucugagcguuuaaaguacu

SEQ ID NO: 1773297 - RNA, 18 nt, Homo sapiens
guuuuaaauaaaccuaua

SEQ ID NO: 1773298 - RNA, 20 nt, Homo sapiens
auauuuuguguauaaugugc

SEQ ID NO: 1773299 - RNA, 13 nt, Homo sapiens
cuaccuacauauu

SEQ ID NO: 1773300 - RNA, 13 nt, Homo sapiens
caccuuacaacuc

SEQ ID NO: 1773301 - RNA, 15 nt, Homo sapiens
gcaagacaccuuccc

SEQ ID NO: 1773302 - RNA, 19 nt, Homo sapiens
auacuaauagaguacuuaa

SEQ ID NO: 1773303 - RNA, 17 nt, Homo sapiens
aaaaugcagaacuuaau

SEQ ID NO: 1773304 - RNA, 19 nt, Homo sapiens
aucaccucucuguaucccc

SEQ ID NO: 1773305 - RNA, 22 nt, Homo sapiens
caagauuaugugacuugcaaua

SEQ ID NO: 1773306 - RNA, 21 nt, Homo sapiens
ucuauauugcugaaugcaaga

SEQ ID NO: 1773307 - RNA, 12 nt, Homo sapiens
acuuucccugac

SEQ ID NO: 1773308 - RNA, 23 nt, Homo sapiens
gugccaccaccccucccucugcu

SEQ ID NO: 1773309 - RNA, 20 nt, Homo sapiens
cuguuaaauuuguaaacaau

SEQ ID NO: 1773310 - RNA, 16 nt, Homo sapiens
acuuugaagaugucau

SEQ ID NO: 1773311 - RNA, 17 nt, Homo sapiens
aaaguuuuguaccauuu

SEQ ID NO: 1773312 - RNA, 19 nt, Homo sapiens
aaagagagucgcaucucag

SEQ ID NO: 1773313 - RNA, 18 nt, Homo sapiens
ucaggaguuugagaccag

SEQ ID NO: 1773314 - RNA, 12 nt, Homo sapiens
uguugacauaca

SEQ ID NO: 1773315 - RNA, 19 nt, Homo sapiens
uaauacaaaaagcaaaaau

SEQ ID NO: 1773316 - RNA, 13 nt, Homo sapiens
gacuucucuugaa

SEQ ID NO: 1773317 - RNA, 18 nt, Homo sapiens
gauuuccaaaaguacuag

SEQ ID NO: 1773318 - RNA, 20 nt, Homo sapiens
gagcuuuccuucuccaggaa

SEQ ID NO: 1773319 - RNA, 18 nt, Homo sapiens
aaacguggcacacacuga

SEQ ID NO: 1773320 - RNA, 14 nt, Homo sapiens
agagcagcauuccc

SEQ ID NO: 1773321 - RNA, 21 nt, Homo sapiens
auaaaaaagauucuacuaaca

SEQ ID NO: 1773322 - RNA, 22 nt, Homo sapiens
aagaggagcacuuccaaaauuc

SEQ ID NO: 1773323 - RNA, 23 nt, Homo sapiens
gaaucuuuuucagaaacagugag

SEQ ID NO: 1773324 - RNA, 23 nt, Homo sapiens
aguugcugugaacuuucauguca

SEQ ID NO: 1773325 - RNA, 20 nt, Homo sapiens
auuuaaaaaaaaaagaggaa

SEQ ID NO: 1773326 - RNA, 14 nt, Homo sapiens
cccuggugguggau

SEQ ID NO: 1773327 - RNA, 23 nt, Homo sapiens
ugugaaauuuuuauuuguauuag

SEQ ID NO: 1773328 - RNA, 13 nt, Homo sapiens
ugggcuacuggca

SEQ ID NO: 1773329 - RNA, 15 nt, Homo sapiens
accagacacccagga

SEQ ID NO: 1773330 - RNA, 15 nt, Homo sapiens
cuuauacaauuauga

SEQ ID NO: 1773331 - RNA, 18 nt, Homo sapiens
uuucucuuucccuggucc

SEQ ID NO: 1773332 - RNA, 16 nt, Homo sapiens
cuauaaaguaaagcua

SEQ ID NO: 1773333 - RNA, 18 nt, Homo sapiens
cacauuaaauguggaagg

SEQ ID NO: 1773334 - RNA, 22 nt, Homo sapiens
aagcaaggagccccccaaagac

SEQ ID NO: 1773335 - RNA, 13 nt, Homo sapiens
auucaaagcucua

SEQ ID NO: 1773336 - RNA, 23 nt, Homo sapiens
uaagccucucccuccagccaaua

SEQ ID NO: 1773337 - RNA, 15 nt, Homo sapiens
aggaauugaauuaau

SEQ ID NO: 1773338 - RNA, 16 nt, Homo sapiens
gaguccuuaaaaaaua

SEQ ID NO: 1773339 - RNA, 16 nt, Homo sapiens
cugaaaacaagccaug

SEQ ID NO: 1773340 - RNA, 14 nt, Homo sapiens
ucccugugccagac

SEQ ID NO: 1773341 - RNA, 23 nt, Homo sapiens
ucugagcccugcccucacuccac

SEQ ID NO: 1773342 - RNA, 18 nt, Homo sapiens
cugaacgcguguguacac

SEQ ID NO: 1773343 - RNA, 16 nt, Homo sapiens
aagcucacucuggauu

SEQ ID NO: 1773344 - RNA, 16 nt, Homo sapiens
ccacgucaacagaauu

SEQ ID NO: 1773345 - RNA, 23 nt, Homo sapiens
uggagcugcguuuccugugcaug

SEQ ID NO: 1773346 - RNA, 16 nt, Homo sapiens
gucugguuaguuaaaa

SEQ ID NO: 1773347 - RNA, 18 nt, Homo sapiens
cauaaacaauauugcuag

SEQ ID NO: 1773348 - RNA, 22 nt, Homo sapiens
uuaucaccgugggcucccugac

SEQ ID NO: 1773349 - RNA, 16 nt, Homo sapiens
ugaaaggggacaccug

SEQ ID NO: 1773350 - RNA, 14 nt, Homo sapiens
augcaucauuucag

SEQ ID NO: 1773351 - RNA, 18 nt, Homo sapiens
auagaggaggauggucau

SEQ ID NO: 1773352 - RNA, 23 nt, Homo sapiens
uauucucaguguagggcagagag

SEQ ID NO: 1773353 - RNA, 22 nt, Homo sapiens
augaggaaggaacagcaauggu

SEQ ID NO: 1773354 - RNA, 21 nt, Homo sapiens
gaagcagugcgugugaaacag

SEQ ID NO: 1773355 - RNA, 22 nt, Homo sapiens
acuuaaaaaauacuugcaugaa

SEQ ID NO: 1773356 - RNA, 22 nt, Homo sapiens
cuaucuuccagaaacuacauga

SEQ ID NO: 1773357 - RNA, 20 nt, Homo sapiens
ucuugggcuacuggcagcuc

SEQ ID NO: 1773358 - RNA, 18 nt, Homo sapiens
aaguacaaaauugccuau

SEQ ID NO: 1773359 - RNA, 23 nt, Homo sapiens
accacaggcagcauuuagcacau

SEQ ID NO: 1773360 - RNA, 23 nt, Homo sapiens
auccagaacugaggucacugggu

SEQ ID NO: 1773361 - RNA, 19 nt, Homo sapiens
agacaggguuucaccaugu

SEQ ID NO: 1773362 - RNA, 15 nt, Homo sapiens
ugaggccaggggaga

SEQ ID NO: 1773363 - RNA, 15 nt, Homo sapiens
uucuaggucuguaau

SEQ ID NO: 1773364 - RNA, 22 nt, Homo sapiens
augacaagaacaaagccacuga

SEQ ID NO: 1773365 - RNA, 16 nt, Homo sapiens
caggaguagugagcug

SEQ ID NO: 1773366 - RNA, 18 nt, Homo sapiens
caaagggucuaucuugua

SEQ ID NO: 1773367 - RNA, 21 nt, Homo sapiens
ucuuuuuagagaaauuugcca

SEQ ID NO: 1773368 - RNA, 21 nt, Homo sapiens
auuggccacuggauccugcug

SEQ ID NO: 1773369 - RNA, 21 nt, Homo sapiens
ccuuacuauggaaagcagcca

SEQ ID NO: 1773370 - RNA, 15 nt, Homo sapiens
cacuuggccauuuau

SEQ ID NO: 1773371 - RNA, 21 nt, Homo sapiens
cuugguuuuuuaaaaucugua

SEQ ID NO: 1773372 - RNA, 23 nt, Homo sapiens
ccugcucagaaucugauaccaaa

SEQ ID NO: 1773373 - RNA, 17 nt, Homo sapiens
uuuguugcuaauuugcc

SEQ ID NO: 1773374 - RNA, 17 nt, Homo sapiens
ggcccaggucucucaac

SEQ ID NO: 1773375 - RNA, 18 nt, Homo sapiens
caaguaggugggauuaca

SEQ ID NO: 1773376 - RNA, 13 nt, Homo sapiens
cuggaugucucca

SEQ ID NO: 1773377 - RNA, 17 nt, Homo sapiens
agcaugaauaaaacacu

SEQ ID NO: 1773378 - RNA, 11 nt, Homo sapiens
ucagcuuuauu

SEQ ID NO: 1773379 - RNA, 18 nt, Homo sapiens
aacucuguaaucaagaau

SEQ ID NO: 1773380 - RNA, 14 nt, Homo sapiens
uuagauccuuuaua

SEQ ID NO: 1773381 - RNA, 22 nt, Homo sapiens
uuagcucaguuucccuccuucc

SEQ ID NO: 1773382 - RNA, 17 nt, Homo sapiens
acucacucauuccuuca

SEQ ID NO: 1773383 - RNA, 19 nt, Homo sapiens
auuuccugauacauuaaaa

SEQ ID NO: 1773384 - RNA, 16 nt, Homo sapiens
aucagagaacuuuccc

SEQ ID NO: 1773385 - RNA, 14 nt, Homo sapiens
cuuuuaucugcaga

SEQ ID NO: 1773386 - RNA, 22 nt, Homo sapiens
gauggggucucgcucugucacc

SEQ ID NO: 1773387 - RNA, 15 nt, Homo sapiens
gauuauucaacagag

SEQ ID NO: 1773388 - RNA, 19 nt, Homo sapiens
ggaucccgaagaauggaga

SEQ ID NO: 1773389 - RNA, 16 nt, Homo sapiens
ccacaguuugagacca

SEQ ID NO: 1773390 - RNA, 16 nt, Homo sapiens
gaacugaagaccucca

SEQ ID NO: 1773391 - RNA, 16 nt, Homo sapiens
aaaaagaaaacaacca

SEQ ID NO: 1773392 - RNA, 23 nt, Homo sapiens
auuuuucaaaacauacaagcaac

SEQ ID NO: 1773393 - RNA, 22 nt, Homo sapiens
cagccugggcaacauagugaga

SEQ ID NO: 1773394 - RNA, 19 nt, Homo sapiens
cacaagcuucuguccugcc

SEQ ID NO: 1773395 - RNA, 15 nt, Homo sapiens
acaggugugagucac

SEQ ID NO: 1773396 - RNA, 21 nt, Homo sapiens
gacucugucucaaaacaaaca

SEQ ID NO: 1773397 - RNA, 15 nt, Homo sapiens
uccuccacaaauuau

SEQ ID NO: 1773398 - RNA, 16 nt, Homo sapiens
caacaauaaagacuga

SEQ ID NO: 1773399 - RNA, 15 nt, Homo sapiens
ugaguagauauuacu

SEQ ID NO: 1773400 - RNA, 18 nt, Homo sapiens
uuggauacauacaccagc

SEQ ID NO: 1773401 - RNA, 21 nt, Homo sapiens
ucaagugccuagacuguuacu

SEQ ID NO: 1773402 - RNA, 14 nt, Homo sapiens
gcccggcaauggga

SEQ ID NO: 1773403 - RNA, 18 nt, Homo sapiens
ugaaagcaauaagcucuu

SEQ ID NO: 1773404 - RNA, 14 nt, Homo sapiens
uuuuauugccuuga

SEQ ID NO: 1773405 - RNA, 19 nt, Homo sapiens
cccuuuuucuccagcuggg

SEQ ID NO: 1773406 - RNA, 11 nt, Homo sapiens
augacuggugg

SEQ ID NO: 1773407 - RNA, 20 nt, Homo sapiens
aggaaauguguguauuuagu

SEQ ID NO: 1773408 - RNA, 18 nt, Homo sapiens
ucaacaugguuaccucug

SEQ ID NO: 1773409 - RNA, 13 nt, Homo sapiens
aacaguguaccuu

SEQ ID NO: 1773410 - RNA, 12 nt, Homo sapiens
uaaccacauuaa

SEQ ID NO: 1773411 - RNA, 12 nt, Homo sapiens
cucccacacaca

SEQ ID NO: 1773412 - RNA, 12 nt, Homo sapiens
agauguuugcaa

SEQ ID NO: 1773413 - RNA, 12 nt, Homo sapiens
agaaguuugcau

SEQ ID NO: 1773414 - RNA, 20 nt, Homo sapiens
agaugguuuucaaaucauuu

SEQ ID NO: 1773415 - RNA, 21 nt, Homo sapiens
aagaaaauuccuauaaggaag

SEQ ID NO: 1773416 - RNA, 13 nt, Homo sapiens
uggcagcaugcaa

SEQ ID NO: 1773417 - RNA, 20 nt, Homo sapiens
aaagauuugugaacuggaag

SEQ ID NO: 1773418 - RNA, 19 nt, Homo sapiens
gaugcuccagcaacacagc

SEQ ID NO: 1773419 - RNA, 12 nt, Homo sapiens
cagcauuugcuu

SEQ ID NO: 1773420 - RNA, 23 nt, Homo sapiens
uuauaggaaaaaaacugggauaa

SEQ ID NO: 1773421 - RNA, 18 nt, Homo sapiens
aauuaugaaaaaauguuc

SEQ ID NO: 1773422 - RNA, 21 nt, Homo sapiens
ccccuccccaaagccacugga

SEQ ID NO: 1773423 - RNA, 23 nt, Homo sapiens
uaguauaguaaaaccaaccagcu

SEQ ID NO: 1773424 - RNA, 20 nt, Homo sapiens
ggaggcggagcuugcaguga

SEQ ID NO: 1773425 - RNA, 23 nt, Homo sapiens
ccugaucaaggugcucuucucau

SEQ ID NO: 1773426 - RNA, 19 nt, Homo sapiens
augccaaugucagcaucaa

SEQ ID NO: 1773427 - RNA, 11 nt, Homo sapiens
cauggcacuga

SEQ ID NO: 1773428 - RNA, 15 nt, Homo sapiens
ccaaaaguacuuacc

SEQ ID NO: 1773429 - RNA, 13 nt, Homo sapiens
cugaacccacugc

SEQ ID NO: 1773430 - RNA, 18 nt, Homo sapiens
caucaacaaugauuaauc

SEQ ID NO: 1773431 - RNA, 14 nt, Homo sapiens
cuuuucugauccag

SEQ ID NO: 1773432 - RNA, 16 nt, Homo sapiens
ugguggucuuacugag

SEQ ID NO: 1773433 - RNA, 18 nt, Homo sapiens
gauacuucuaaaagcuaa

SEQ ID NO: 1773434 - RNA, 24 nt, Homo sapiens
agaguuuccugaaacaacuuggaa

SEQ ID NO: 1773435 - RNA, 16 nt, Homo sapiens
cugaggcugaaauuca

SEQ ID NO: 1773436 - RNA, 16 nt, Homo sapiens
accaaaagugcauuca

SEQ ID NO: 1773437 - RNA, 14 nt, Homo sapiens
uguuuucauacaau

SEQ ID NO: 1773438 - RNA, 23 nt, Homo sapiens
aaugaccuuuagggaguuuuccu

SEQ ID NO: 1773439 - RNA, 13 nt, Homo sapiens
aaugcaccuggaa

SEQ ID NO: 1773440 - RNA, 15 nt, Homo sapiens
auguucuuccaguga

SEQ ID NO: 1773441 - RNA, 22 nt, Homo sapiens
guagucaggugccucaagagaa

SEQ ID NO: 1773442 - RNA, 14 nt, Homo sapiens
gccauucacuuccc

SEQ ID NO: 1773443 - RNA, 14 nt, Homo sapiens
cuggggccugggac

SEQ ID NO: 1773444 - RNA, 20 nt, Homo sapiens
cgggauggagaggugagaac

SEQ ID NO: 1773445 - RNA, 16 nt, Homo sapiens
uccagcucagucucag

SEQ ID NO: 1773446 - RNA, 20 nt, Homo sapiens
uuuaacucagaucacuacug

SEQ ID NO: 1773447 - RNA, 19 nt, Homo sapiens
ccuggcucccucacucuca

SEQ ID NO: 1773448 - RNA, 14 nt, Homo sapiens
ugccugcugagcug

SEQ ID NO: 1773449 - RNA, 23 nt, Homo sapiens
uucacaccucacgcucuggacau

SEQ ID NO: 1773450 - RNA, 23 nt, Homo sapiens
gaacacuuuagguagaugaacua

SEQ ID NO: 1773451 - RNA, 19 nt, Homo sapiens
ggucaggaugcacauuucu

SEQ ID NO: 1773452 - RNA, 20 nt, Homo sapiens
uacaauauguauuuaugucu

SEQ ID NO: 1773453 - RNA, 13 nt, Homo sapiens
agucccugaagga

SEQ ID NO: 1773454 - RNA, 19 nt, Homo sapiens
uagagcccauuaaucuuga

SEQ ID NO: 1773455 - RNA, 17 nt, Homo sapiens
uucccuuccuccauugc

SEQ ID NO: 1773456 - RNA, 19 nt, Homo sapiens
uguacuuucccuguguacc

SEQ ID NO: 1773457 - RNA, 13 nt, Homo sapiens
gcaguuuuuccca

SEQ ID NO: 1773458 - RNA, 17 nt, Homo sapiens
auuccucuguagaauuu

SEQ ID NO: 1773459 - RNA, 21 nt, Homo sapiens
agucacacagcuagugaagac

SEQ ID NO: 1773460 - RNA, 18 nt, Homo sapiens
ucaccaguggccuuucag

SEQ ID NO: 1773461 - RNA, 23 nt, Homo sapiens
agaauguagacagguauaaugau

SEQ ID NO: 1773462 - RNA, 22 nt, Homo sapiens
ugcugauacugggucugcgaug

SEQ ID NO: 1773463 - RNA, 18 nt, Homo sapiens
caauguucuuuauauaca

SEQ ID NO: 1773464 - RNA, 16 nt, Homo sapiens
uacaauucagucuucu

SEQ ID NO: 1773465 - RNA, 21 nt, Homo sapiens
cauuggguccugggucuuuca

SEQ ID NO: 1773466 - RNA, 15 nt, Homo sapiens
gccuugugaggagcu

SEQ ID NO: 1773467 - RNA, 13 nt, Homo sapiens
uaaggucacagcu

SEQ ID NO: 1773468 - RNA, 21 nt, Homo sapiens
accaucugaagaaacuuccca

SEQ ID NO: 1773469 - RNA, 22 nt, Homo sapiens
gcacaccccuggggcugagucu

SEQ ID NO: 1773470 - RNA, 10 nt, Homo sapiens
caauucugua

SEQ ID NO: 1773471 - RNA, 16 nt, Homo sapiens
aaauaaagcugugaca

SEQ ID NO: 1773472 - RNA, 19 nt, Homo sapiens
uugcuaauauaauagauga

SEQ ID NO: 1773473 - RNA, 13 nt, Homo sapiens
accgaaacugacu

SEQ ID NO: 1773474 - RNA, 22 nt, Homo sapiens
accuaagagggcaggagggaaa

SEQ ID NO: 1773475 - RNA, 19 nt, Homo sapiens
agaauggaaguagcuguau

SEQ ID NO: 1773476 - RNA, 23 nt, Homo sapiens
auuuaaagcauuccuuucuuuaa

SEQ ID NO: 1773477 - RNA, 16 nt, Homo sapiens
gaucuccuguggcuca

SEQ ID NO: 1773478 - RNA, 13 nt, Homo sapiens
aacaugugcucag

SEQ ID NO: 1773479 - RNA, 17 nt, Homo sapiens
uuaacugagcuacuaga

SEQ ID NO: 1773480 - RNA, 22 nt, Homo sapiens
guacccaccugagcuuuggaca

SEQ ID NO: 1773481 - RNA, 18 nt, Homo sapiens
cuaaaaaacagaggccau

SEQ ID NO: 1773482 - RNA, 22 nt, Homo sapiens
ccauauaaaucucaaugaauuc

SEQ ID NO: 1773483 - RNA, 16 nt, Homo sapiens
aaagccuuguguauau

SEQ ID NO: 1773484 - RNA, 19 nt, Homo sapiens
gcugcagacaaguggacag

SEQ ID NO: 1773485 - RNA, 14 nt, Homo sapiens
ccaaaacgugcaug

SEQ ID NO: 1773486 - RNA, 16 nt, Homo sapiens
agauguaaaguuauuc

SEQ ID NO: 1773487 - RNA, 18 nt, Homo sapiens
agcaauaaguucauuaaa

SEQ ID NO: 1773488 - RNA, 20 nt, Homo sapiens
uaacauguaauuaaguacua

SEQ ID NO: 1773489 - RNA, 18 nt, Homo sapiens
cucaguaacagugcagua

SEQ ID NO: 1773490 - RNA, 17 nt, Homo sapiens
uucuuugggccagacau

SEQ ID NO: 1773491 - RNA, 20 nt, Homo sapiens
agaacuuauucuccaucuca

SEQ ID NO: 1773492 - RNA, 23 nt, Homo sapiens
auuauguuuuauuuaaaugcuuu

SEQ ID NO: 1773493 - RNA, 13 nt, Homo sapiens
aaaguagauugag

SEQ ID NO: 1773494 - RNA, 18 nt, Homo sapiens
uucuuacguacacuguac

SEQ ID NO: 1773495 - RNA, 23 nt, Homo sapiens
uguguugcagccucaaccaacaa

SEQ ID NO: 1773496 - RNA, 13 nt, Homo sapiens
ugaguauguguau

SEQ ID NO: 1773497 - RNA, 21 nt, Homo sapiens
uucaucucugguuuucuugcc

SEQ ID NO: 1773498 - RNA, 17 nt, Homo sapiens
gaagauuauaaaagcca

SEQ ID NO: 1773499 - RNA, 22 nt, Homo sapiens
uuaccccauggcugcacaguug

SEQ ID NO: 1773500 - RNA, 17 nt, Homo sapiens
uuacauuauuacuccuu

SEQ ID NO: 1773501 - RNA, 23 nt, Homo sapiens
aaagcuucaaauuaaaacagcug

SEQ ID NO: 1773502 - RNA, 20 nt, Homo sapiens
uacacuuauuuuacuaguuu

SEQ ID NO: 1773503 - RNA, 14 nt, Homo sapiens
aguuugaucuguca

SEQ ID NO: 1773504 - RNA, 17 nt, Homo sapiens
gucaguguucaugcgaa

SEQ ID NO: 1773505 - RNA, 22 nt, Homo sapiens
cauauagaccaauugaagcaug

SEQ ID NO: 1773506 - RNA, 13 nt, Homo sapiens
gcuuucucucaga

SEQ ID NO: 1773507 - RNA, 16 nt, Homo sapiens
uacauuauauuccucu

SEQ ID NO: 1773508 - RNA, 19 nt, Homo sapiens
uggucuaaaacagcuauuu

SEQ ID NO: 1773509 - RNA, 19 nt, Homo sapiens
aauaaauauuuagucugca

SEQ ID NO: 1773510 - RNA, 15 nt, Homo sapiens
aacucaggcauuuca

SEQ ID NO: 1773511 - RNA, 20 nt, Homo sapiens
gaugcacauuucauguauuc

SEQ ID NO: 1773512 - RNA, 21 nt, Homo sapiens
caaauauggggaaaaaacugu

SEQ ID NO: 1773513 - RNA, 17 nt, Homo sapiens
accguguaacacgugaa

SEQ ID NO: 1773514 - RNA, 13 nt, Homo sapiens
ucuguuuugccug

SEQ ID NO: 1773515 - RNA, 20 nt, Homo sapiens
cucccaacucagccuguucc

SEQ ID NO: 1773516 - RNA, 16 nt, Homo sapiens
gaaaccagagccuuuc

SEQ ID NO: 1773517 - RNA, 17 nt, Homo sapiens
aaauguucuuaaccuuu

SEQ ID NO: 1773518 - RNA, 12 nt, Homo sapiens
uagcaucagagg

SEQ ID NO: 1773519 - RNA, 23 nt, Homo sapiens
gaauuggauacauacaccagcau

SEQ ID NO: 1773520 - RNA, 15 nt, Homo sapiens
uuaaaaaggaaauuu

SEQ ID NO: 1773521 - RNA, 14 nt, Homo sapiens
acuaucugcauuau

SEQ ID NO: 1773522 - RNA, 20 nt, Homo sapiens
uccggaagaaaaagagccau

SEQ ID NO: 1773523 - RNA, 17 nt, Homo sapiens
uaagauguucacugugg

SEQ ID NO: 1773524 - RNA, 14 nt, Homo sapiens
uguaugacuaaaga

SEQ ID NO: 1773525 - RNA, 18 nt, Homo sapiens
uguguccuugaacugagg

SEQ ID NO: 1773526 - RNA, 19 nt, Homo sapiens
ccaccaccugcucacuggu

SEQ ID NO: 1773527 - RNA, 20 nt, Homo sapiens
acagauuugagccuccuuga

SEQ ID NO: 1773528 - RNA, 19 nt, Homo sapiens
uagcuuaagggaauaugca

SEQ ID NO: 1773529 - RNA, 23 nt, Homo sapiens
ugccucucccaaguccaguguga

SEQ ID NO: 1773530 - RNA, 22 nt, Homo sapiens
aauaagguauaaggaucuuuug

SEQ ID NO: 1773531 - RNA, 13 nt, Homo sapiens
auaaaucagucaa

SEQ ID NO: 1773532 - RNA, 21 nt, Homo sapiens
uuagcuuacccaaugggaccg

SEQ ID NO: 1773533 - RNA, 21 nt, Homo sapiens
uguuuaauguuucuguccuuu

SEQ ID NO: 1773534 - RNA, 21 nt, Homo sapiens
aagcugcucggagcucagugc

SEQ ID NO: 1773535 - RNA, 19 nt, Homo sapiens
ugucaguuucagauccuga

SEQ ID NO: 1773536 - RNA, 18 nt, Homo sapiens
uucaucguggggcucuca

SEQ ID NO: 1773537 - RNA, 18 nt, Homo sapiens
uacuauagauucuuuauu

SEQ ID NO: 1773538 - RNA, 23 nt, Homo sapiens
cuauaaaggaaacacguuuagaa

SEQ ID NO: 1773539 - RNA, 14 nt, Homo sapiens
gagagaaguggcca

SEQ ID NO: 1773540 - RNA, 16 nt, Homo sapiens
auuucaagugccuaga

SEQ ID NO: 1773541 - RNA, 22 nt, Homo sapiens
uucuaaggaccugaaauuccaa

SEQ ID NO: 1773542 - RNA, 18 nt, Homo sapiens
ggacaaucuagcucucca

SEQ ID NO: 1773543 - RNA, 15 nt, Homo sapiens
ucaguaugaagacac

SEQ ID NO: 1773544 - RNA, 14 nt, Homo sapiens
aaaaggcuccaguu

SEQ ID NO: 1773545 - RNA, 18 nt, Homo sapiens
uuggcuuuuguuacccac

SEQ ID NO: 1773546 - RNA, 23 nt, Homo sapiens
aggaaaugucuuuagagcacagg

SEQ ID NO: 1773547 - RNA, 16 nt, Homo sapiens
ugaacacaggcaaaga

SEQ ID NO: 1773548 - RNA, 17 nt, Homo sapiens
uggcaaaacagcccuca

SEQ ID NO: 1773549 - RNA, 21 nt, Homo sapiens
aguaucuaaagccaguggcag

SEQ ID NO: 1773550 - RNA, 11 nt, Homo sapiens
ccgagugcaau

SEQ ID NO: 1773551 - RNA, 17 nt, Homo sapiens
agaaaagggaguuuaaa

SEQ ID NO: 1773552 - RNA, 18 nt, Homo sapiens
cguguauaggacucucag

SEQ ID NO: 1773553 - RNA, 22 nt, Homo sapiens
aaucacagucucaguucucuug

SEQ ID NO: 1773554 - RNA, 18 nt, Homo sapiens
guucccagcagcugggcc

SEQ ID NO: 1773555 - RNA, 14 nt, Homo sapiens
agaaacugcuuaga

SEQ ID NO: 1773556 - RNA, 14 nt, Homo sapiens
accaaaucuugcuc

SEQ ID NO: 1773557 - RNA, 18 nt, Homo sapiens
cugcacaggaaaugcaag

SEQ ID NO: 1773558 - RNA, 17 nt, Homo sapiens
gacuguugccacuuaac

SEQ ID NO: 1773559 - RNA, 11 nt, Homo sapiens
gagccacagaa

SEQ ID NO: 1773560 - RNA, 17 nt, Homo sapiens
ucagagcacucauuccu

SEQ ID NO: 1773561 - RNA, 14 nt, Homo sapiens
cuuauagagcacaa

SEQ ID NO: 1773562 - RNA, 17 nt, Homo sapiens
ccccuuuccaauuccaa

SEQ ID NO: 1773563 - RNA, 19 nt, Homo sapiens
cuguacauaaauuccagag

SEQ ID NO: 1773564 - RNA, 20 nt, Homo sapiens
uuggccuguagaguugcuga

SEQ ID NO: 1773565 - RNA, 22 nt, Homo sapiens
uuuacugaauaaauacaaagca

SEQ ID NO: 1773566 - RNA, 18 nt, Homo sapiens
ccaagagggcugcaaaag

SEQ ID NO: 1773567 - RNA, 15 nt, Homo sapiens
cugcuuccucugaau

SEQ ID NO: 1773568 - RNA, 23 nt, Homo sapiens
guggcaccgccuccccaccucca

SEQ ID NO: 1773569 - RNA, 23 nt, Homo sapiens
acaauaaagaucgcccccaccuc

SEQ ID NO: 1773570 - RNA, 15 nt, Homo sapiens
ggaccccagccucaa

SEQ ID NO: 1773571 - RNA, 13 nt, Homo sapiens
aaauacacuuuau

SEQ ID NO: 1773572 - RNA, 22 nt, Homo sapiens
gaguucuauuagaagcuaucaa

SEQ ID NO: 1773573 - RNA, 22 nt, Homo sapiens
uggguccccggcgggacuguca

SEQ ID NO: 1773574 - RNA, 17 nt, Homo sapiens
ucugcucgucaucauuu

SEQ ID NO: 1773575 - RNA, 21 nt, Homo sapiens
accccacuuuuuguuguucau

SEQ ID NO: 1773576 - RNA, 19 nt, Homo sapiens
ccuccugcaaggggcucaa

SEQ ID NO: 1773577 - RNA, 17 nt, Homo sapiens
accagcccugagccaug

SEQ ID NO: 1773578 - RNA, 17 nt, Homo sapiens
guacacguguccuguag

SEQ ID NO: 1773579 - RNA, 15 nt, Homo sapiens
cugcauuuauggugu

SEQ ID NO: 1773580 - RNA, 19 nt, Homo sapiens
guguccugagccccaggga

SEQ ID NO: 1773581 - RNA, 15 nt, Homo sapiens
ggcuccccugcagcc

SEQ ID NO: 1773582 - RNA, 21 nt, Homo sapiens
acuccugggggagaaccacug

SEQ ID NO: 1773583 - RNA, 16 nt, Homo sapiens
aaggaaggaaauagua

SEQ ID NO: 1773584 - RNA, 19 nt, Homo sapiens
aaugacagaugcaaguuau

SEQ ID NO: 1773585 - RNA, 16 nt, Homo sapiens
aauauuuuucauacaa

SEQ ID NO: 1773586 - RNA, 18 nt, Homo sapiens
ucuguccccaaaugucca

SEQ ID NO: 1773587 - RNA, 12 nt, Homo sapiens
aagaaggggcca

SEQ ID NO: 1773588 - RNA, 22 nt, Homo sapiens
cuauuucaauaacagauggugc

SEQ ID NO: 1773589 - RNA, 17 nt, Homo sapiens
cugaaaugcucucagag

SEQ ID NO: 1773590 - RNA, 19 nt, Homo sapiens
gucucucuauuacacugga

SEQ ID NO: 1773591 - RNA, 20 nt, Homo sapiens
agaucgagaccauccuggcu

SEQ ID NO: 1773592 - RNA, 15 nt, Homo sapiens
caggccagcuccuau

SEQ ID NO: 1773593 - RNA, 19 nt, Homo sapiens
gaggccccuggagccagau

SEQ ID NO: 1773594 - RNA, 21 nt, Homo sapiens
agugggaggguaccagcagaa

SEQ ID NO: 1773595 - RNA, 13 nt, Homo sapiens
aauaacauguaau

SEQ ID NO: 1773596 - RNA, 11 nt, Homo sapiens
uuacuuuccau

SEQ ID NO: 1773597 - RNA, 24 nt, Homo sapiens
cuacagagagugaauacacuggaa

SEQ ID NO: 1773598 - RNA, 11 nt, Homo sapiens
uuucuuuccaa

SEQ ID NO: 1773599 - RNA, 16 nt, Homo sapiens
gccucagcucccacaa

SEQ ID NO: 1773600 - RNA, 21 nt, Homo sapiens
gauggccucucucaaaagaga

SEQ ID NO: 1773601 - RNA, 19 nt, Homo sapiens
aagaacugcuuaguauuag

SEQ ID NO: 1773602 - RNA, 18 nt, Homo sapiens
caccgagacaccaccuau

SEQ ID NO: 1773603 - RNA, 19 nt, Homo sapiens
gcacagacccugcccugug

SEQ ID NO: 1773604 - RNA, 17 nt, Homo sapiens
uguucaaaaacaagaca

SEQ ID NO: 1773605 - RNA, 16 nt, Homo sapiens
uacaaaguaagccaug

SEQ ID NO: 1773606 - RNA, 12 nt, Homo sapiens
gccacagacuga

SEQ ID NO: 1773607 - RNA, 12 nt, Homo sapiens
cugacagagcca

SEQ ID NO: 1773608 - RNA, 16 nt, Homo sapiens
gaggccucucucagga

SEQ ID NO: 1773609 - RNA, 13 nt, Homo sapiens
agucucucaccac

SEQ ID NO: 1773610 - RNA, 15 nt, Homo sapiens
ggcauggcuggggug

SEQ ID NO: 1773611 - RNA, 13 nt, Homo sapiens
uaagucucuagcc

SEQ ID NO: 1773612 - RNA, 16 nt, Homo sapiens
gguucuuacagcacau

SEQ ID NO: 1773613 - RNA, 15 nt, Homo sapiens
gauacauuuggauaa

SEQ ID NO: 1773614 - RNA, 16 nt, Homo sapiens
aucucuuauuuuacaa

SEQ ID NO: 1773615 - RNA, 15 nt, Homo sapiens
gcauaguaauagggc

SEQ ID NO: 1773616 - RNA, 18 nt, Homo sapiens
acagaacucgaugcacug

SEQ ID NO: 1773617 - RNA, 9 nt, Homo sapiens
ugagcagac

SEQ ID NO: 1773618 - RNA, 18 nt, Homo sapiens
acauucuggaucugaccc

SEQ ID NO: 1773619 - RNA, 19 nt, Homo sapiens
cuacaguucuuuuguugua

SEQ ID NO: 1773620 - RNA, 17 nt, Homo sapiens
acuuugucucugagaac

SEQ ID NO: 1773621 - RNA, 21 nt, Homo sapiens
auauucaggcuacucauucag

SEQ ID NO: 1773622 - RNA, 21 nt, Homo sapiens
cucuuucaauugcagaugcca

SEQ ID NO: 1773623 - RNA, 15 nt, Homo sapiens
caugccagugccuua

SEQ ID NO: 1773624 - RNA, 20 nt, Homo sapiens
ccaauuuuuuaagugaaaau

SEQ ID NO: 1773625 - RNA, 16 nt, Homo sapiens
uggggaaaaaaaucau

SEQ ID NO: 1773626 - RNA, 16 nt, Homo sapiens
uucugggggacagaga

SEQ ID NO: 1773627 - RNA, 19 nt, Homo sapiens
agggucugagacucccuuu

SEQ ID NO: 1773628 - RNA, 17 nt, Homo sapiens
ucaucauguugaccagg

SEQ ID NO: 1773629 - RNA, 19 nt, Homo sapiens
gggccuccagggcccaggu

SEQ ID NO: 1773630 - RNA, 16 nt, Homo sapiens
cuuacaagacuguaaa

SEQ ID NO: 1773631 - RNA, 15 nt, Homo sapiens
gcaagcaccaaccuc

SEQ ID NO: 1773632 - RNA, 19 nt, Homo sapiens
uguuuaaugucugccaggu

SEQ ID NO: 1773633 - RNA, 20 nt, Homo sapiens
ucucaggaggguaagaacuc

SEQ ID NO: 1773634 - RNA, 18 nt, Homo sapiens
guuaaaaguuaccagggu

SEQ ID NO: 1773635 - RNA, 23 nt, Homo sapiens
augcuguugauugcuaaauguaa

SEQ ID NO: 1773636 - RNA, 19 nt, Homo sapiens
aagugacaagcucacagac

SEQ ID NO: 1773637 - RNA, 22 nt, Homo sapiens
auguuuccauuuuuuucuaaug

SEQ ID NO: 1773638 - RNA, 20 nt, Homo sapiens
gcgaaaccucaucucuacua

SEQ ID NO: 1773639 - RNA, 17 nt, Homo sapiens
uccgaaguagcugggau

SEQ ID NO: 1773640 - RNA, 22 nt, Homo sapiens
caccaaagggaaggcuuccuau

SEQ ID NO: 1773641 - RNA, 19 nt, Homo sapiens
acccuaaagucucagguga

SEQ ID NO: 1773642 - RNA, 17 nt, Homo sapiens
gaacacgaauugcucaa

SEQ ID NO: 1773643 - RNA, 23 nt, Homo sapiens
cugggugcucagggcaugcuuau

SEQ ID NO: 1773644 - RNA, 11 nt, Homo sapiens
uguacuguaaa

SEQ ID NO: 1773645 - RNA, 19 nt, Homo sapiens
gccucuccccaaacauuaa

SEQ ID NO: 1773646 - RNA, 16 nt, Homo sapiens
augcugaagacauuca

SEQ ID NO: 1773647 - RNA, 20 nt, Homo sapiens
cacaagucauaccuacauuc

SEQ ID NO: 1773648 - RNA, 12 nt, Homo sapiens
auaacugugaag

SEQ ID NO: 1773649 - RNA, 20 nt, Homo sapiens
ugaggacuugggcgggacac

SEQ ID NO: 1773650 - RNA, 12 nt, Homo sapiens
uaauaaauggga

SEQ ID NO: 1773651 - RNA, 16 nt, Homo sapiens
uccaggccaaagugcc

SEQ ID NO: 1773652 - RNA, 14 nt, Homo sapiens
gugcugaguacuca

SEQ ID NO: 1773653 - RNA, 18 nt, Homo sapiens
guuccuucacauccugug

SEQ ID NO: 1773654 - RNA, 15 nt, Homo sapiens
cuugggacauggcac

SEQ ID NO: 1773655 - RNA, 14 nt, Homo sapiens
cuuacaucuguaaa

SEQ ID NO: 1773656 - RNA, 12 nt, Homo sapiens
ccguggaaccag

SEQ ID NO: 1773657 - RNA, 17 nt, Homo sapiens
accaucaaacaaaucau

SEQ ID NO: 1773658 - RNA, 14 nt, Homo sapiens
acagucaaaaccaa

SEQ ID NO: 1773659 - RNA, 21 nt, Homo sapiens
ucccuguaaacguuaaaaaca

SEQ ID NO: 1773660 - RNA, 23 nt, Homo sapiens
uuagaugcaaguggcugaggcca

SEQ ID NO: 1773661 - RNA, 22 nt, Homo sapiens
uuuccauaguuuugaugacugg

SEQ ID NO: 1773662 - RNA, 16 nt, Homo sapiens
aaaauuuucauucuga

SEQ ID NO: 1773663 - RNA, 21 nt, Homo sapiens
aacauguuuuugauauuugau

SEQ ID NO: 1773664 - RNA, 18 nt, Homo sapiens
gucccugucaccaagcuc

SEQ ID NO: 1773665 - RNA, 17 nt, Homo sapiens
aaagcuaacaucuuuac

SEQ ID NO: 1773666 - RNA, 19 nt, Homo sapiens
gcuggagugcaaugcacga

SEQ ID NO: 1773667 - RNA, 18 nt, Homo sapiens
uaucccuuuucuugacua

SEQ ID NO: 1773668 - RNA, 21 nt, Homo sapiens
auuuuaucaaggaagucuuca

SEQ ID NO: 1773669 - RNA, 20 nt, Homo sapiens
auucaguuguuuugcauaac

SEQ ID NO: 1773670 - RNA, 20 nt, Homo sapiens
ugcccggugguuugccaugu

SEQ ID NO: 1773671 - RNA, 15 nt, Homo sapiens
gcagaacacacucuu

SEQ ID NO: 1773672 - RNA, 23 nt, Homo sapiens
cgaaauauaaaacugagacugua

SEQ ID NO: 1773673 - RNA, 20 nt, Homo sapiens
acuguuaguauuaacuauua

SEQ ID NO: 1773674 - RNA, 23 nt, Homo sapiens
gaacuuucauuuuauauguuucu

SEQ ID NO: 1773675 - RNA, 22 nt, Homo sapiens
ggaucuugaauguggucucagg

SEQ ID NO: 1773676 - RNA, 14 nt, Homo sapiens
uggagcugcuucca

SEQ ID NO: 1773677 - RNA, 23 nt, Homo sapiens
uuucaaucaaaacucaguaucau

SEQ ID NO: 1773678 - RNA, 11 nt, Homo sapiens
uagacucacuc

SEQ ID NO: 1773679 - RNA, 18 nt, Homo sapiens
agaggcaugugccaucau

SEQ ID NO: 1773680 - RNA, 20 nt, Homo sapiens
gcgccaggcugaccacagca

SEQ ID NO: 1773681 - RNA, 20 nt, Homo sapiens
uaagauauucagaaguauau

SEQ ID NO: 1773682 - RNA, 14 nt, Homo sapiens
cuuaacacacuggc

SEQ ID NO: 1773683 - RNA, 22 nt, Homo sapiens
uccuaagccaagagucauguca

SEQ ID NO: 1773684 - RNA, 18 nt, Homo sapiens
uuuguggcaucuugccaa

SEQ ID NO: 1773685 - RNA, 17 nt, Homo sapiens
ucaggaugcacauuucu

SEQ ID NO: 1773686 - RNA, 14 nt, Homo sapiens
cugcacccaugaca

SEQ ID NO: 1773687 - RNA, 23 nt, Homo sapiens
cauuaaaauuuuuuaacauauug

SEQ ID NO: 1773688 - RNA, 21 nt, Homo sapiens
uuuaaugaugccauggcaacu

SEQ ID NO: 1773689 - RNA, 17 nt, Homo sapiens
gagcauauauguagcuu

SEQ ID NO: 1773690 - RNA, 19 nt, Homo sapiens
uccucaucccuccaucuca

SEQ ID NO: 1773691 - RNA, 17 nt, Homo sapiens
auaaaaccccaucucua

SEQ ID NO: 1773692 - RNA, 16 nt, Homo sapiens
ucaggcagcacaucaa

SEQ ID NO: 1773693 - RNA, 17 nt, Homo sapiens
ucccucuucugugguca

SEQ ID NO: 1773694 - RNA, 21 nt, Homo sapiens
guguccauuuugcaaacccaa

SEQ ID NO: 1773695 - RNA, 17 nt, Homo sapiens
ugcugauguagugacca

SEQ ID NO: 1773696 - RNA, 15 nt, Homo sapiens
auugaauuagaaaca

SEQ ID NO: 1773697 - RNA, 16 nt, Homo sapiens
gcuuugcuuagcuugu

SEQ ID NO: 1773698 - RNA, 21 nt, Homo sapiens
uccugcuccguuccucaucca

SEQ ID NO: 1773699 - RNA, 21 nt, Homo sapiens
uuaaucugccauaaagccauu

SEQ ID NO: 1773700 - RNA, 23 nt, Homo sapiens
gauggaggcgggaaaaucauuug

SEQ ID NO: 1773701 - RNA, 17 nt, Homo sapiens
accaccuucuucuccua

SEQ ID NO: 1773702 - RNA, 21 nt, Homo sapiens
agauucccuugaaauuuagau

SEQ ID NO: 1773703 - RNA, 15 nt, Homo sapiens
agcaauucauucucu

SEQ ID NO: 1773704 - RNA, 18 nt, Homo sapiens
uacacugauacacuugaa

SEQ ID NO: 1773705 - RNA, 15 nt, Homo sapiens
ccacuguuucaugag

SEQ ID NO: 1773706 - RNA, 21 nt, Homo sapiens
uuugacuacaaagauauuuca

SEQ ID NO: 1773707 - RNA, 18 nt, Homo sapiens
ucauuggugaaguaaauu

SEQ ID NO: 1773708 - RNA, 20 nt, Homo sapiens
gcccuucagucuuaauacuu

SEQ ID NO: 1773709 - RNA, 17 nt, Homo sapiens
ccacccccgccaugcaa

SEQ ID NO: 1773710 - RNA, 14 nt, Homo sapiens
acuuugaauaaugg

SEQ ID NO: 1773711 - RNA, 14 nt, Homo sapiens
cuuuaucauuucuc

SEQ ID NO: 1773712 - RNA, 15 nt, Homo sapiens
uaguacuauugcuau

SEQ ID NO: 1773713 - RNA, 13 nt, Homo sapiens
aaccucaaaaugu

SEQ ID NO: 1773714 - RNA, 16 nt, Homo sapiens
accugauuuauugaaa

SEQ ID NO: 1773715 - RNA, 16 nt, Homo sapiens
cuuaguaagugcuuuu

SEQ ID NO: 1773716 - RNA, 13 nt, Homo sapiens
auuagccauuuga

SEQ ID NO: 1773717 - RNA, 13 nt, Homo sapiens
ugaggccaagaaa

SEQ ID NO: 1773718 - RNA, 19 nt, Homo sapiens
cacucaauaaaucuuugau

SEQ ID NO: 1773719 - RNA, 17 nt, Homo sapiens
uggucugugugugacac

SEQ ID NO: 1773720 - RNA, 21 nt, Homo sapiens
gcagucagccaagaucuugcc

SEQ ID NO: 1773721 - RNA, 21 nt, Homo sapiens
aaaagguuugagauuccugua

SEQ ID NO: 1773722 - RNA, 16 nt, Homo sapiens
aguaaguggugagaac

SEQ ID NO: 1773723 - RNA, 20 nt, Homo sapiens
ucagugugcugaucauucac

SEQ ID NO: 1773724 - RNA, 16 nt, Homo sapiens
aucccacccaacagcu

SEQ ID NO: 1773725 - RNA, 15 nt, Homo sapiens
acugcugggcuccac

SEQ ID NO: 1773726 - RNA, 22 nt, Homo sapiens
uguucuucuaccacccaccagu

SEQ ID NO: 1773727 - RNA, 10 nt, Homo sapiens
uccaucucug

SEQ ID NO: 1773728 - RNA, 10 nt, Homo sapiens
agcaucucac

SEQ ID NO: 1773729 - RNA, 21 nt, Homo sapiens
uguauuagccagucauuguaa

SEQ ID NO: 1773730 - RNA, 14 nt, Homo sapiens
uauacaggucauau

SEQ ID NO: 1773731 - RNA, 17 nt, Homo sapiens
cauaacaauaaaaacca

SEQ ID NO: 1773732 - RNA, 22 nt, Homo sapiens
auauuuuaggacuuuuugucaa

SEQ ID NO: 1773733 - RNA, 14 nt, Homo sapiens
cagcaugugcaaua

SEQ ID NO: 1773734 - RNA, 20 nt, Homo sapiens
uaucaggaaauaucugugaa

SEQ ID NO: 1773735 - RNA, 14 nt, Homo sapiens
caauucaucaauau

SEQ ID NO: 1773736 - RNA, 11 nt, Homo sapiens
ugggguugagg

SEQ ID NO: 1773737 - RNA, 15 nt, Homo sapiens
uuuaauuuuaguuuc

SEQ ID NO: 1773738 - RNA, 17 nt, Homo sapiens
ugugcccccaggguccu

SEQ ID NO: 1773739 - RNA, 20 nt, Homo sapiens
ucuuucccuggugauggucu

SEQ ID NO: 1773740 - RNA, 12 nt, Homo sapiens
cuuccauggugg

SEQ ID NO: 1773741 - RNA, 13 nt, Homo sapiens
aaccucugaugcc

SEQ ID NO: 1773742 - RNA, 20 nt, Homo sapiens
ggacucaguggacacucaga

SEQ ID NO: 1773743 - RNA, 17 nt, Homo sapiens
cagaagcaggagcaaaa

SEQ ID NO: 1773744 - RNA, 17 nt, Homo sapiens
uagcuaauuuaggaguu

SEQ ID NO: 1773745 - RNA, 11 nt, Homo sapiens
aaaacauguau

SEQ ID NO: 1773746 - RNA, 17 nt, Homo sapiens
gcugcuugagggcugau

SEQ ID NO: 1773747 - RNA, 14 nt, Homo sapiens
ucugccuucaaaca

SEQ ID NO: 1773748 - RNA, 20 nt, Homo sapiens
agagaccugcuccagauccu

SEQ ID NO: 1773749 - RNA, 15 nt, Homo sapiens
ucucuucacucccaa

SEQ ID NO: 1773750 - RNA, 20 nt, Homo sapiens
aaacuuggaugucacugccu

SEQ ID NO: 1773751 - RNA, 19 nt, Homo sapiens
guccauuuauccacaggaa

SEQ ID NO: 1773752 - RNA, 19 nt, Homo sapiens
gacaaaccauaacugacaa

SEQ ID NO: 1773753 - RNA, 16 nt, Homo sapiens
aacuuuuaaugaacuu

SEQ ID NO: 1773754 - RNA, 20 nt, Homo sapiens
uacuugcauacaccacugca

SEQ ID NO: 1773755 - RNA, 15 nt, Homo sapiens
gaacuucaucugcca

SEQ ID NO: 1773756 - RNA, 22 nt, Homo sapiens
ggagcauuuauguagacauugu

SEQ ID NO: 1773757 - RNA, 13 nt, Homo sapiens
acauauauauuac

SEQ ID NO: 1773758 - RNA, 18 nt, Homo sapiens
aguguuaugugaauuuga

SEQ ID NO: 1773759 - RNA, 22 nt, Homo sapiens
gccuccaacagcaucaucugca

SEQ ID NO: 1773760 - RNA, 19 nt, Homo sapiens
caggcuggucucaaacucc

SEQ ID NO: 1773761 - RNA, 21 nt, Homo sapiens
guguccuguuuuuauucccuu

SEQ ID NO: 1773762 - RNA, 14 nt, Homo sapiens
ucuaucacauuaca

SEQ ID NO: 1773763 - RNA, 18 nt, Homo sapiens
gcgacuggaggcaggacu

SEQ ID NO: 1773764 - RNA, 17 nt, Homo sapiens
ucacuucauacuucuaa

SEQ ID NO: 1773765 - RNA, 19 nt, Homo sapiens
aggaaacugagucacucac

SEQ ID NO: 1773766 - RNA, 21 nt, Homo sapiens
cuuuacuuuaaucuccuaauc

SEQ ID NO: 1773767 - RNA, 14 nt, Homo sapiens
ccauguaaugugua

SEQ ID NO: 1773768 - RNA, 13 nt, Homo sapiens
gccaaaagccuuu

SEQ ID NO: 1773769 - RNA, 20 nt, Homo sapiens
ucaucacagggauuuagacu

SEQ ID NO: 1773770 - RNA, 12 nt, Homo sapiens
agaaaguucuca

SEQ ID NO: 1773771 - RNA, 17 nt, Homo sapiens
ugucauccauauuugcu

SEQ ID NO: 1773772 - RNA, 22 nt, Homo sapiens
ugggagguugguuuaaugcaau

SEQ ID NO: 1773773 - RNA, 13 nt, Homo sapiens
agaaaccucggga

SEQ ID NO: 1773774 - RNA, 22 nt, Homo sapiens
ggccugcucugcuuuuccuguc

SEQ ID NO: 1773775 - RNA, 17 nt, Homo sapiens
cuauuucugcugugauu

SEQ ID NO: 1773776 - RNA, 16 nt, Homo sapiens
auuuaaggauuauucu

SEQ ID NO: 1773777 - RNA, 17 nt, Homo sapiens
cugggucucaguguccu

SEQ ID NO: 1773778 - RNA, 13 nt, Homo sapiens
gggccaucucaga

SEQ ID NO: 1773779 - RNA, 21 nt, Homo sapiens
agaguggagcccagggugcug

SEQ ID NO: 1773780 - RNA, 15 nt, Homo sapiens
aucucccucuaagca

SEQ ID NO: 1773781 - RNA, 20 nt, Homo sapiens
gugauuccauuuuacuucca

SEQ ID NO: 1773782 - RNA, 12 nt, Homo sapiens
ccaggaaucuca

SEQ ID NO: 1773783 - RNA, 19 nt, Homo sapiens
accaaggaaagaacaaaug

SEQ ID NO: 1773784 - RNA, 17 nt, Homo sapiens
auuuuccuguuuacuga

SEQ ID NO: 1773785 - RNA, 17 nt, Homo sapiens
aacuaguguuucugcag

SEQ ID NO: 1773786 - RNA, 21 nt, Homo sapiens
aaagauguuugaaaaugcucu

SEQ ID NO: 1773787 - RNA, 18 nt, Homo sapiens
cgguugguaccaugcuaa

SEQ ID NO: 1773788 - RNA, 15 nt, Homo sapiens
auaaacuaguuucca

SEQ ID NO: 1773789 - RNA, 13 nt, Homo sapiens
ucuugaucuccug

SEQ ID NO: 1773790 - RNA, 21 nt, Homo sapiens
aaucucauggagaagcagaaa

SEQ ID NO: 1773791 - RNA, 15 nt, Homo sapiens
auugcauugugacua

SEQ ID NO: 1773792 - RNA, 16 nt, Homo sapiens
agcugucccauacucc

SEQ ID NO: 1773793 - RNA, 18 nt, Homo sapiens
uucaaugcaaaguacaug

SEQ ID NO: 1773794 - RNA, 13 nt, Homo sapiens
uuacuuccaugau

SEQ ID NO: 1773795 - RNA, 17 nt, Homo sapiens
agaaccuucaacccagu

SEQ ID NO: 1773796 - RNA, 15 nt, Homo sapiens
acuagccaguauggc

SEQ ID NO: 1773797 - RNA, 14 nt, Homo sapiens
agcauacagagugu

SEQ ID NO: 1773798 - RNA, 19 nt, Homo sapiens
uuaagcugaagaguuuacu

SEQ ID NO: 1773799 - RNA, 23 nt, Homo sapiens
acaauccuucuauucuagccugc

SEQ ID NO: 1773800 - RNA, 21 nt, Homo sapiens
cguagagcacagccucacuca

SEQ ID NO: 1773801 - RNA, 13 nt, Homo sapiens
ggugcaugcaguu

SEQ ID NO: 1773802 - RNA, 20 nt, Homo sapiens
uccaaacugugucacgcagg

SEQ ID NO: 1773803 - RNA, 17 nt, Homo sapiens
gccucauuacugugagg

SEQ ID NO: 1773804 - RNA, 12 nt, Homo sapiens
cucaucccaugg

SEQ ID NO: 1773805 - RNA, 14 nt, Homo sapiens
uagcugacaucucc

SEQ ID NO: 1773806 - RNA, 21 nt, Homo sapiens
ccauuaaauagggaaaaaaca

SEQ ID NO: 1773807 - RNA, 22 nt, Homo sapiens
agcuguacucuucugacugccc

SEQ ID NO: 1773808 - RNA, 12 nt, Homo sapiens
uaccagcucacu

SEQ ID NO: 1773809 - RNA, 19 nt, Homo sapiens
uagaaaugacugcauuuga

SEQ ID NO: 1773810 - RNA, 12 nt, Homo sapiens
aucacuuaccac

SEQ ID NO: 1773811 - RNA, 18 nt, Homo sapiens
acucuuuccuaaagccaa

SEQ ID NO: 1773812 - RNA, 15 nt, Homo sapiens
aauaacaacugcugg

SEQ ID NO: 1773813 - RNA, 13 nt, Homo sapiens
agaggcagugaga

SEQ ID NO: 1773814 - RNA, 20 nt, Homo sapiens
auggaaauccuguuacuuaa

SEQ ID NO: 1773815 - RNA, 23 nt, Homo sapiens
gacccaggggucagccuuaggaa

SEQ ID NO: 1773816 - RNA, 14 nt, Homo sapiens
acaggcauacacau

SEQ ID NO: 1773817 - RNA, 18 nt, Homo sapiens
aaagauuuucugguucua

SEQ ID NO: 1773818 - RNA, 14 nt, Homo sapiens
agcagucauaagcu

SEQ ID NO: 1773819 - RNA, 22 nt, Homo sapiens
ugucacuacgugacuguggcac

SEQ ID NO: 1773820 - RNA, 16 nt, Homo sapiens
gcuaugccuugcacac

SEQ ID NO: 1773821 - RNA, 14 nt, Homo sapiens
uccagaacacggcu

SEQ ID NO: 1773822 - RNA, 15 nt, Homo sapiens
uguaaacacugaugg

SEQ ID NO: 1773823 - RNA, 22 nt, Homo sapiens
acacaccaaguggaggauucau

SEQ ID NO: 1773824 - RNA, 14 nt, Homo sapiens
acaccugccuuaac

SEQ ID NO: 1773825 - RNA, 16 nt, Homo sapiens
auuacaggcaugagcc

SEQ ID NO: 1773826 - RNA, 20 nt, Homo sapiens
ggcuuccgagggcacuaccg

SEQ ID NO: 1773827 - RNA, 19 nt, Homo sapiens
agaguguuuuuucugucau

SEQ ID NO: 1773828 - RNA, 18 nt, Homo sapiens
agaauaguucccuagucu

SEQ ID NO: 1773829 - RNA, 22 nt, Homo sapiens
guuaacuuuuguaccaaauagc

SEQ ID NO: 1773830 - RNA, 18 nt, Homo sapiens
acaagagacugcuugaca

SEQ ID NO: 1773831 - RNA, 22 nt, Homo sapiens
cuccacacagcaaugacauuua

SEQ ID NO: 1773832 - RNA, 13 nt, Homo sapiens
auuggacagugag

SEQ ID NO: 1773833 - RNA, 18 nt, Homo sapiens
gauuugaaugaaaugcca

SEQ ID NO: 1773834 - RNA, 18 nt, Homo sapiens
ucaggccauugucccuga

SEQ ID NO: 1773835 - RNA, 12 nt, Homo sapiens
cuguguaaccag

SEQ ID NO: 1773836 - RNA, 14 nt, Homo sapiens
acucuaguccuugg

SEQ ID NO: 1773837 - RNA, 19 nt, Homo sapiens
gucugacuguuuccaucaa

SEQ ID NO: 1773838 - RNA, 22 nt, Homo sapiens
agaguguuuggggguuccguga

SEQ ID NO: 1773839 - RNA, 20 nt, Homo sapiens
gaggcugucuucucaggcuc

SEQ ID NO: 1773840 - RNA, 20 nt, Homo sapiens
agauaugcacacacacggau

SEQ ID NO: 1773841 - RNA, 15 nt, Homo sapiens
agacccagagagcuu

SEQ ID NO: 1773842 - RNA, 19 nt, Homo sapiens
accuccaucgccuugcagg

SEQ ID NO: 1773843 - RNA, 12 nt, Homo sapiens
uaaaaacaugau

SEQ ID NO: 1773844 - RNA, 22 nt, Homo sapiens
uaugcaugaaguaauaugcaca

SEQ ID NO: 1773845 - RNA, 19 nt, Homo sapiens
guuacugcaguucaucuca

SEQ ID NO: 1773846 - RNA, 14 nt, Homo sapiens
ucccacagggccag

SEQ ID NO: 1773847 - RNA, 16 nt, Homo sapiens
gucccauugugcagaa

SEQ ID NO: 1773848 - RNA, 22 nt, Homo sapiens
gugaaaacgcaaacaugaauau

SEQ ID NO: 1773849 - RNA, 21 nt, Homo sapiens
cuggcaaagaacucauuugaa

SEQ ID NO: 1773850 - RNA, 19 nt, Homo sapiens
cuugugguuuaugucauca

SEQ ID NO: 1773851 - RNA, 18 nt, Homo sapiens
caaauuauaaaaaccaug

SEQ ID NO: 1773852 - RNA, 15 nt, Homo sapiens
caggagauggggaau

SEQ ID NO: 1773853 - RNA, 20 nt, Homo sapiens
ucccuugggcucugaugaaa

SEQ ID NO: 1773854 - RNA, 18 nt, Homo sapiens
uauucucuuccucaucca

SEQ ID NO: 1773855 - RNA, 17 nt, Homo sapiens
uguuucaguucagauaa

SEQ ID NO: 1773856 - RNA, 20 nt, Homo sapiens
cuggaggagcaagggggcca

SEQ ID NO: 1773857 - RNA, 21 nt, Homo sapiens
acaguuagggcuccuauucaa

SEQ ID NO: 1773858 - RNA, 19 nt, Homo sapiens
ugccacauugcuucauuaa

SEQ ID NO: 1773859 - RNA, 15 nt, Homo sapiens
gcugucccugcacug

SEQ ID NO: 1773860 - RNA, 16 nt, Homo sapiens
uucuaugacaauaaau

SEQ ID NO: 1773861 - RNA, 15 nt, Homo sapiens
gccucacugcaucuu

SEQ ID NO: 1773862 - RNA, 19 nt, Homo sapiens
uuuuuaaaauguuggugca

SEQ ID NO: 1773863 - RNA, 11 nt, Homo sapiens
auucuggguuu

SEQ ID NO: 1773864 - RNA, 16 nt, Homo sapiens
ccagcagaauugacag

SEQ ID NO: 1773865 - RNA, 21 nt, Homo sapiens
uaauuauguuuugugauucaa

SEQ ID NO: 1773866 - RNA, 20 nt, Homo sapiens
aaacuuuccucuuccugccu

SEQ ID NO: 1773867 - RNA, 15 nt, Homo sapiens
cacccccagucucca

SEQ ID NO: 1773868 - RNA, 16 nt, Homo sapiens
cgcaccacuguguauu

SEQ ID NO: 1773869 - RNA, 21 nt, Homo sapiens
auuuaugucccugacuguaaa

SEQ ID NO: 1773870 - RNA, 17 nt, Homo sapiens
uagacuuacugcaguua

SEQ ID NO: 1773871 - RNA, 21 nt, Homo sapiens
gacaccuccauuucucuccag

SEQ ID NO: 1773872 - RNA, 13 nt, Homo sapiens
auuuaucaccuaa

SEQ ID NO: 1773873 - RNA, 21 nt, Homo sapiens
uucagugauaacuccuaagag

SEQ ID NO: 1773874 - RNA, 18 nt, Homo sapiens
ugcucaagguuacuggga

SEQ ID NO: 1773875 - RNA, 21 nt, Homo sapiens
aaagacagagauaccauucaa

SEQ ID NO: 1773876 - RNA, 14 nt, Homo sapiens
aaugagacugacca

SEQ ID NO: 1773877 - RNA, 17 nt, Homo sapiens
uuggagaccaggccuca

SEQ ID NO: 1773878 - RNA, 23 nt, Homo sapiens
aaaaaguucagcaugaaggaugc

SEQ ID NO: 1773879 - RNA, 24 nt, Homo sapiens
uuuugaaaaaguguacaugaagaa

SEQ ID NO: 1773880 - RNA, 16 nt, Homo sapiens
ucagcacccaacugag

SEQ ID NO: 1773881 - RNA, 15 nt, Homo sapiens
agcccuucagucuua

SEQ ID NO: 1773882 - RNA, 18 nt, Homo sapiens
ugauguuugccauuugcu

SEQ ID NO: 1773883 - RNA, 19 nt, Homo sapiens
uuuccuuuaaaaauacaua

SEQ ID NO: 1773884 - RNA, 14 nt, Homo sapiens
aguggccugagaag

SEQ ID NO: 1773885 - RNA, 20 nt, Homo sapiens
uuugaaugaacuaguuuaau

SEQ ID NO: 1773886 - RNA, 20 nt, Homo sapiens
caaaugagccggagccccuu

SEQ ID NO: 1773887 - RNA, 16 nt, Homo sapiens
guauuugaaauaagaa

SEQ ID NO: 1773888 - RNA, 23 nt, Homo sapiens
auaauccacgcucaucuugcaaa

SEQ ID NO: 1773889 - RNA, 18 nt, Homo sapiens
agaacaucauuacuuaug

SEQ ID NO: 1773890 - RNA, 13 nt, Homo sapiens
accagcagcaugg

SEQ ID NO: 1773891 - RNA, 20 nt, Homo sapiens
augugcagaugcuaacugga

SEQ ID NO: 1773892 - RNA, 19 nt, Homo sapiens
uauaaauagaugcugugua

SEQ ID NO: 1773893 - RNA, 13 nt, Homo sapiens
aggaaucaggcaa

SEQ ID NO: 1773894 - RNA, 11 nt, Homo sapiens
gcagcaaugag

SEQ ID NO: 1773895 - RNA, 15 nt, Homo sapiens
uugaacugcagguga

SEQ ID NO: 1773896 - RNA, 19 nt, Homo sapiens
acaagaggcucccucuuga

SEQ ID NO: 1773897 - RNA, 14 nt, Homo sapiens
auaaagaguucucc

SEQ ID NO: 1773898 - RNA, 19 nt, Homo sapiens
gcugccccugcaguuggca

SEQ ID NO: 1773899 - RNA, 19 nt, Homo sapiens
uuaaacaaaaacuuuccau

SEQ ID NO: 1773900 - RNA, 19 nt, Homo sapiens
gagggcugggggcugaccc

SEQ ID NO: 1773901 - RNA, 15 nt, Homo sapiens
cuucauuucaaucau

SEQ ID NO: 1773902 - RNA, 15 nt, Homo sapiens
cauuauuucuaccau

SEQ ID NO: 1773903 - RNA, 22 nt, Homo sapiens
aacuuaagggaaaaguucuccu

SEQ ID NO: 1773904 - RNA, 12 nt, Homo sapiens
ucugaucuugga

SEQ ID NO: 1773905 - RNA, 17 nt, Homo sapiens
augagcaugaacugucc

SEQ ID NO: 1773906 - RNA, 16 nt, Homo sapiens
auuuaucauuuaguua

SEQ ID NO: 1773907 - RNA, 19 nt, Homo sapiens
ucaccuuuccucucccuca

SEQ ID NO: 1773908 - RNA, 17 nt, Homo sapiens
uuacagcuccuuugaaa

SEQ ID NO: 1773909 - RNA, 16 nt, Homo sapiens
gacuugagcuuggcag

SEQ ID NO: 1773910 - RNA, 16 nt, Homo sapiens
acacaguaagugugaa

SEQ ID NO: 1773911 - RNA, 19 nt, Homo sapiens
aauccaugcuucucaucug

SEQ ID NO: 1773912 - RNA, 15 nt, Homo sapiens
guugcuuuagucacu

SEQ ID NO: 1773913 - RNA, 22 nt, Homo sapiens
cugaucuugcaugucuacaauc

SEQ ID NO: 1773914 - RNA, 22 nt, Homo sapiens
gcuuucguccauguuucucaca

SEQ ID NO: 1773915 - RNA, 10 nt, Homo sapiens
cuugcauaau

SEQ ID NO: 1773916 - RNA, 22 nt, Homo sapiens
acugcuugcuuacaaucuuuau

SEQ ID NO: 1773917 - RNA, 14 nt, Homo sapiens
gcuuuaacuauauc

SEQ ID NO: 1773918 - RNA, 16 nt, Homo sapiens
uggaaucagauuuuaa

SEQ ID NO: 1773919 - RNA, 18 nt, Homo sapiens
agggauuuggggcucaga

SEQ ID NO: 1773920 - RNA, 17 nt, Homo sapiens
cacagggugguggcaca

SEQ ID NO: 1773921 - RNA, 17 nt, Homo sapiens
uggauaaauuuuggaag

SEQ ID NO: 1773922 - RNA, 15 nt, Homo sapiens
cucugacaguccaca

SEQ ID NO: 1773923 - RNA, 12 nt, Homo sapiens
auaaacugccaa

SEQ ID NO: 1773924 - RNA, 21 nt, Homo sapiens
auugcccccagggcacuucac

SEQ ID NO: 1773925 - RNA, 15 nt, Homo sapiens
agcccucagaacuuu

SEQ ID NO: 1773926 - RNA, 19 nt, Homo sapiens
cauuuauaaagggacacuu

SEQ ID NO: 1773927 - RNA, 16 nt, Homo sapiens
acugugaccaaagcau

SEQ ID NO: 1773928 - RNA, 19 nt, Homo sapiens
cagugaauuuuugcaauaa

SEQ ID NO: 1773929 - RNA, 13 nt, Homo sapiens
cugaauauauaaa

SEQ ID NO: 1773930 - RNA, 16 nt, Homo sapiens
guuugcucaauuccaa

SEQ ID NO: 1773931 - RNA, 16 nt, Homo sapiens
ccugcagccacauggg

SEQ ID NO: 1773932 - RNA, 13 nt, Homo sapiens
guuacugugccca

SEQ ID NO: 1773933 - RNA, 22 nt, Homo sapiens
ucacuggaugucaaacaguaau

SEQ ID NO: 1773934 - RNA, 20 nt, Homo sapiens
uuaaaacuauaacauuauau

SEQ ID NO: 1773935 - RNA, 15 nt, Homo sapiens
gugugucucguguca

SEQ ID NO: 1773936 - RNA, 16 nt, Homo sapiens
cugcacguuuucaucu

SEQ ID NO: 1773937 - RNA, 14 nt, Homo sapiens
gccagggugacaga

SEQ ID NO: 1773938 - RNA, 15 nt, Homo sapiens
ccccucucugggcag

SEQ ID NO: 1773939 - RNA, 17 nt, Homo sapiens
uugaacuugauugccua

SEQ ID NO: 1773940 - RNA, 20 nt, Homo sapiens
caaacugccuauauugauaa

SEQ ID NO: 1773941 - RNA, 14 nt, Homo sapiens
agucucuauaccaa

SEQ ID NO: 1773942 - RNA, 19 nt, Homo sapiens
cacugucuagagcaacuuu

SEQ ID NO: 1773943 - RNA, 17 nt, Homo sapiens
ugugccuuggucucucc

SEQ ID NO: 1773944 - RNA, 19 nt, Homo sapiens
cuuuggccugugagccauu

SEQ ID NO: 1773945 - RNA, 15 nt, Homo sapiens
aaaaaguagagacag

SEQ ID NO: 1773946 - RNA, 11 nt, Homo sapiens
aauguauauau

SEQ ID NO: 1773947 - RNA, 19 nt, Homo sapiens
cuuuucugacccauguuca

SEQ ID NO: 1773948 - RNA, 16 nt, Homo sapiens
aagcuccaguagcucc

SEQ ID NO: 1773949 - RNA, 16 nt, Homo sapiens
aucuaugccacucaga

SEQ ID NO: 1773950 - RNA, 15 nt, Homo sapiens
accuuugcugaugcc

SEQ ID NO: 1773951 - RNA, 18 nt, Homo sapiens
aauuaaagugaggagaaa

SEQ ID NO: 1773952 - RNA, 13 nt, Homo sapiens
ugcccauccuccc

SEQ ID NO: 1773953 - RNA, 11 nt, Homo sapiens
uaaacuguaaa

SEQ ID NO: 1773954 - RNA, 15 nt, Homo sapiens
ggcccagcgcagugc

SEQ ID NO: 1773955 - RNA, 17 nt, Homo sapiens
cuacgaauauagagggu

SEQ ID NO: 1773956 - RNA, 18 nt, Homo sapiens
cccauagcacugggcucu

SEQ ID NO: 1773957 - RNA, 16 nt, Homo sapiens
aagggaaaaguuauuu

SEQ ID NO: 1773958 - RNA, 14 nt, Homo sapiens
cugaacauugcaua

SEQ ID NO: 1773959 - RNA, 23 nt, Homo sapiens
agggaggguguuuuggguggcau

SEQ ID NO: 1773960 - RNA, 20 nt, Homo sapiens
ucgcccacaaacugauuucu

SEQ ID NO: 1773961 - RNA, 18 nt, Homo sapiens
ucgacuucauuuugccac

SEQ ID NO: 1773962 - RNA, 13 nt, Homo sapiens
cagccucagaaua

SEQ ID NO: 1773963 - RNA, 20 nt, Homo sapiens
ggcuauggaggguccuccuc

SEQ ID NO: 1773964 - RNA, 18 nt, Homo sapiens
cauaucuuaaaacuaaau

SEQ ID NO: 1773965 - RNA, 21 nt, Homo sapiens
uaaagaaagaaauauuaacua

SEQ ID NO: 1773966 - RNA, 18 nt, Homo sapiens
cuucuccuuccccaggau

SEQ ID NO: 1773967 - RNA, 14 nt, Homo sapiens
accccuuagccucc

SEQ ID NO: 1773968 - RNA, 17 nt, Homo sapiens
gugaaguguucugcuga

SEQ ID NO: 1773969 - RNA, 14 nt, Homo sapiens
ugaaaauggagaaa

SEQ ID NO: 1773970 - RNA, 20 nt, Homo sapiens
aagaugaaacaucauuucaa

SEQ ID NO: 1773971 - RNA, 13 nt, Homo sapiens
gaguggcuuccau

SEQ ID NO: 1773972 - RNA, 13 nt, Homo sapiens
guuucaacagaug

SEQ ID NO: 1773973 - RNA, 16 nt, Homo sapiens
ugaaacccuguaucua

SEQ ID NO: 1773974 - RNA, 21 nt, Homo sapiens
guacuaauacagacuauguca

SEQ ID NO: 1773975 - RNA, 16 nt, Homo sapiens
ccucugagcugcaguu

SEQ ID NO: 1773976 - RNA, 17 nt, Homo sapiens
gcacaaucuacacugcc

SEQ ID NO: 1773977 - RNA, 20 nt, Homo sapiens
ccagggcaguguggugggag

SEQ ID NO: 1773978 - RNA, 18 nt, Homo sapiens
uaaaacccuggauugaaa

SEQ ID NO: 1773979 - RNA, 22 nt, Homo sapiens
acucuugagaaaugaauaagcu

SEQ ID NO: 1773980 - RNA, 14 nt, Homo sapiens
uuacagaaugggag

SEQ ID NO: 1773981 - RNA, 18 nt, Homo sapiens
augcagugguaugaucac

SEQ ID NO: 1773982 - RNA, 21 nt, Homo sapiens
gucuccacugugccuuugcaa

SEQ ID NO: 1773983 - RNA, 20 nt, Homo sapiens
aaccuuccacccagugcuga

SEQ ID NO: 1773984 - RNA, 23 nt, Homo sapiens
agcugaugccugaauguauccua

SEQ ID NO: 1773985 - RNA, 22 nt, Homo sapiens
uuuuaauuuaaucuuccaugga

SEQ ID NO: 1773986 - RNA, 21 nt, Homo sapiens
agccagccacccuaacugagc

SEQ ID NO: 1773987 - RNA, 20 nt, Homo sapiens
gaaguaaaagcaaguacucu

SEQ ID NO: 1773988 - RNA, 16 nt, Homo sapiens
cccugggcuggacugg

SEQ ID NO: 1773989 - RNA, 18 nt, Homo sapiens
agccaccuccuuggcacc

SEQ ID NO: 1773990 - RNA, 14 nt, Homo sapiens
uagugacuaugaac

SEQ ID NO: 1773991 - RNA, 22 nt, Homo sapiens
caggcagcauuuagcacauacu

SEQ ID NO: 1773992 - RNA, 19 nt, Homo sapiens
uugccuauggaguagccau

SEQ ID NO: 1773993 - RNA, 14 nt, Homo sapiens
aaugauuaguuaaa

SEQ ID NO: 1773994 - RNA, 15 nt, Homo sapiens
uggcugcacucaaga

SEQ ID NO: 1773995 - RNA, 13 nt, Homo sapiens
cucgcaugacugu

SEQ ID NO: 1773996 - RNA, 12 nt, Homo sapiens
ugaaggugaccu

SEQ ID NO: 1773997 - RNA, 20 nt, Homo sapiens
agguagcugccccuggcucu

SEQ ID NO: 1773998 - RNA, 17 nt, Homo sapiens
gguaaauacugugaaau

SEQ ID NO: 1773999 - RNA, 22 nt, Homo sapiens
gaaagucacggcugcgcacugu

SEQ ID NO: 1774000 - RNA, 12 nt, Homo sapiens
uaugcacuaauc

SEQ ID NO: 1774001 - RNA, 17 nt, Homo sapiens
uauauuuccauucaugc

SEQ ID NO: 1774002 - RNA, 22 nt, Homo sapiens
agucucgcuauugucaccaggg

SEQ ID NO: 1774003 - RNA, 21 nt, Homo sapiens
aaucugccuagaaaaccucuc

SEQ ID NO: 1774004 - RNA, 10 nt, Homo sapiens
aguagcugag

SEQ ID NO: 1774005 - RNA, 18 nt, Homo sapiens
uuaauuuuaaccaaaaca

SEQ ID NO: 1774006 - RNA, 18 nt, Homo sapiens
gccgaaaaggauaugcag

SEQ ID NO: 1774007 - RNA, 18 nt, Homo sapiens
ccaaagggucccaggcug

SEQ ID NO: 1774008 - RNA, 19 nt, Homo sapiens
aucugagaaaagcuuugaa

SEQ ID NO: 1774009 - RNA, 19 nt, Homo sapiens
aucauugugaaauuauuca

SEQ ID NO: 1774010 - RNA, 20 nt, Homo sapiens
ugcaccgugcagcccgccau

SEQ ID NO: 1774011 - RNA, 12 nt, Homo sapiens
acacacauggau

SEQ ID NO: 1774012 - RNA, 18 nt, Homo sapiens
cucuugauuaagaucuca

SEQ ID NO: 1774013 - RNA, 14 nt, Homo sapiens
uucagucucuauac

SEQ ID NO: 1774014 - RNA, 13 nt, Homo sapiens
auuuauaucuuau

SEQ ID NO: 1774015 - RNA, 23 nt, Homo sapiens
aaauugauuauuuugugcaacau

SEQ ID NO: 1774016 - RNA, 21 nt, Homo sapiens
uucccugucacuacacacuaa

SEQ ID NO: 1774017 - RNA, 21 nt, Homo sapiens
cagaaaguaucacaaauggaa

SEQ ID NO: 1774018 - RNA, 14 nt, Homo sapiens
gccuguguacugcc

SEQ ID NO: 1774019 - RNA, 18 nt, Homo sapiens
agggaaacccaucuucac

SEQ ID NO: 1774020 - RNA, 22 nt, Homo sapiens
aagugcuggaacuuuagugaaa

SEQ ID NO: 1774021 - RNA, 10 nt, Homo sapiens
uuuuguucau

SEQ ID NO: 1774022 - RNA, 22 nt, Homo sapiens
auauuaauaaaacuuuauguac

SEQ ID NO: 1774023 - RNA, 15 nt, Homo sapiens
gauaaaaggaaccaa

SEQ ID NO: 1774024 - RNA, 15 nt, Homo sapiens
ccaacaagccucaaa

SEQ ID NO: 1774025 - RNA, 20 nt, Homo sapiens
cacacagauauacacaugga

SEQ ID NO: 1774026 - RNA, 22 nt, Homo sapiens
cuuuccaaauaagugcauuuau

SEQ ID NO: 1774027 - RNA, 21 nt, Homo sapiens
ucaguuccugaaguucacuca

SEQ ID NO: 1774028 - RNA, 21 nt, Homo sapiens
ugcuaauggaauuacugccuu

SEQ ID NO: 1774029 - RNA, 14 nt, Homo sapiens
gaagagacaggcac

SEQ ID NO: 1774030 - RNA, 15 nt, Homo sapiens
uccccugaccuguga

SEQ ID NO: 1774031 - RNA, 20 nt, Homo sapiens
cuugauguuccaccugccac

SEQ ID NO: 1774032 - RNA, 22 nt, Homo sapiens
ugagguuaaguuucucuucacc

SEQ ID NO: 1774033 - RNA, 22 nt, Homo sapiens
uucuuuaaaaaacaacuaugga

SEQ ID NO: 1774034 - RNA, 12 nt, Homo sapiens
ccagugauccca

SEQ ID NO: 1774035 - RNA, 21 nt, Homo sapiens
ucucugaguuuuaguuggucu

SEQ ID NO: 1774036 - RNA, 13 nt, Homo sapiens
auuuaucauucuu

SEQ ID NO: 1774037 - RNA, 16 nt, Homo sapiens
gcauuuggccucuugu

SEQ ID NO: 1774038 - RNA, 20 nt, Homo sapiens
ccugauuacacuacauagaa

SEQ ID NO: 1774039 - RNA, 22 nt, Homo sapiens
gcuuagaugagggugacuguca

SEQ ID NO: 1774040 - RNA, 16 nt, Homo sapiens
ugcugacuucacuuau

SEQ ID NO: 1774041 - RNA, 14 nt, Homo sapiens
cgagcauguuguuu

SEQ ID NO: 1774042 - RNA, 16 nt, Homo sapiens
cccaauaggugaucuu

SEQ ID NO: 1774043 - RNA, 14 nt, Homo sapiens
agucccucccucac

SEQ ID NO: 1774044 - RNA, 18 nt, Homo sapiens
uccagcuuauagucuucc

SEQ ID NO: 1774045 - RNA, 16 nt, Homo sapiens
agaacaugcacauuua

SEQ ID NO: 1774046 - RNA, 22 nt, Homo sapiens
gguacaguuugauuuuugacca

SEQ ID NO: 1774047 - RNA, 15 nt, Homo sapiens
ugagggagaugccau

SEQ ID NO: 1774048 - RNA, 16 nt, Homo sapiens
uucccuuagugacucu

SEQ ID NO: 1774049 - RNA, 20 nt, Homo sapiens
uaaacaacucaagggcacau

SEQ ID NO: 1774050 - RNA, 14 nt, Homo sapiens
ggcccccacaggag

SEQ ID NO: 1774051 - RNA, 19 nt, Homo sapiens
uacaaaugagugauuccag

SEQ ID NO: 1774052 - RNA, 18 nt, Homo sapiens
ugcacuucaagaagucac

SEQ ID NO: 1774053 - RNA, 13 nt, Homo sapiens
acgcacuggugcc

SEQ ID NO: 1774054 - RNA, 12 nt, Homo sapiens
ccugacaccccc

SEQ ID NO: 1774055 - RNA, 18 nt, Homo sapiens
aagcugcucaacuugcaa

SEQ ID NO: 1774056 - RNA, 15 nt, Homo sapiens
gcuccugugcuacuu

SEQ ID NO: 1774057 - RNA, 19 nt, Homo sapiens
uaucugcaaucuuugccaa

SEQ ID NO: 1774058 - RNA, 22 nt, Homo sapiens
aaauauucacucuccauuagaa

SEQ ID NO: 1774059 - RNA, 17 nt, Homo sapiens
uaccuuguuuugccagu

SEQ ID NO: 1774060 - RNA, 20 nt, Homo sapiens
uuuuccuuuuuugucuauga

SEQ ID NO: 1774061 - RNA, 22 nt, Homo sapiens
aucuaucuuaauacuaaggaac

SEQ ID NO: 1774062 - RNA, 12 nt, Homo sapiens
ggccaccugcca

SEQ ID NO: 1774063 - RNA, 13 nt, Homo sapiens
cucauugcagcua

SEQ ID NO: 1774064 - RNA, 21 nt, Homo sapiens
caucaccucuacugucuccuc

SEQ ID NO: 1774065 - RNA, 23 nt, Homo sapiens
gugaauaaaccaucaucuugcca

SEQ ID NO: 1774066 - RNA, 14 nt, Homo sapiens
auggagacuucuaa

SEQ ID NO: 1774067 - RNA, 21 nt, Homo sapiens
gauucugccuuugccagguga

SEQ ID NO: 1774068 - RNA, 21 nt, Homo sapiens
accugggagaccagggaccac

SEQ ID NO: 1774069 - RNA, 13 nt, Homo sapiens
agaaaagccugaa

SEQ ID NO: 1774070 - RNA, 22 nt, Homo sapiens
guuuuaaaacucuuuaucccau

SEQ ID NO: 1774071 - RNA, 23 nt, Homo sapiens
cuaauuccuggcaugacacucua

SEQ ID NO: 1774072 - RNA, 20 nt, Homo sapiens
gcccuaaaagcacacucauc

SEQ ID NO: 1774073 - RNA, 21 nt, Homo sapiens
accagagccuucaagugccaa

SEQ ID NO: 1774074 - RNA, 18 nt, Homo sapiens
ccucauguauacuucaag

SEQ ID NO: 1774075 - RNA, 17 nt, Homo sapiens
caaagcuguugauggua

SEQ ID NO: 1774076 - RNA, 20 nt, Homo sapiens
uacaguucugggguacaugu

SEQ ID NO: 1774077 - RNA, 17 nt, Homo sapiens
cuucaccaagaagcaaa

SEQ ID NO: 1774078 - RNA, 14 nt, Homo sapiens
acuguggucauccu

SEQ ID NO: 1774079 - RNA, 12 nt, Homo sapiens
aauaugacauau

SEQ ID NO: 1774080 - RNA, 17 nt, Homo sapiens
cucuauugauacucuuu

SEQ ID NO: 1774081 - RNA, 20 nt, Homo sapiens
ucauuucuggaaagugcaau

SEQ ID NO: 1774082 - RNA, 17 nt, Homo sapiens
ggaacaguguaaauccc

SEQ ID NO: 1774083 - RNA, 23 nt, Homo sapiens
ucaaaaauagggaaguaacagua

SEQ ID NO: 1774084 - RNA, 23 nt, Homo sapiens
ccuuuuuucaaaauccaaaaaga

SEQ ID NO: 1774085 - RNA, 17 nt, Homo sapiens
ucucacugaaacauuua

SEQ ID NO: 1774086 - RNA, 23 nt, Homo sapiens
auuucuguuguuuuaagccacaa

SEQ ID NO: 1774087 - RNA, 16 nt, Homo sapiens
uaaagaaauuucucau

SEQ ID NO: 1774088 - RNA, 23 nt, Homo sapiens
ucacaucuuaugcuaacuguaga

SEQ ID NO: 1774089 - RNA, 23 nt, Homo sapiens
uuacccuuuggccccacuuugaa

SEQ ID NO: 1774090 - RNA, 22 nt, Homo sapiens
cugaaauugcguucuaagaggu

SEQ ID NO: 1774091 - RNA, 23 nt, Homo sapiens
acuucacccacccuccaggaccc

SEQ ID NO: 1774092 - RNA, 12 nt, Homo sapiens
caagcauuucac

SEQ ID NO: 1774093 - RNA, 19 nt, Homo sapiens
aaacuggacagucacugcc

SEQ ID NO: 1774094 - RNA, 16 nt, Homo sapiens
caucggccuccaugac

SEQ ID NO: 1774095 - RNA, 16 nt, Homo sapiens
ucucugaacacaggca

SEQ ID NO: 1774096 - RNA, 14 nt, Homo sapiens
uccauauacauaua

SEQ ID NO: 1774097 - RNA, 23 nt, Homo sapiens
ugaagaugcagcucacuacccua

SEQ ID NO: 1774098 - RNA, 19 nt, Homo sapiens
aaguucuuucaaccuauac

SEQ ID NO: 1774099 - RNA, 20 nt, Homo sapiens
ucuucuagcugagcuuuaaa

SEQ ID NO: 1774100 - RNA, 18 nt, Homo sapiens
caugacauauguagaugu

SEQ ID NO: 1774101 - RNA, 15 nt, Homo sapiens
cuagagccagcagua

SEQ ID NO: 1774102 - RNA, 19 nt, Homo sapiens
ugcgaaacgggggaaggga

SEQ ID NO: 1774103 - RNA, 21 nt, Homo sapiens
uggugcuuugcgacuugucac

SEQ ID NO: 1774104 - RNA, 18 nt, Homo sapiens
cauuucacaaaacagccu

SEQ ID NO: 1774105 - RNA, 23 nt, Homo sapiens
cuaaccauaguuauuuacuugaa

SEQ ID NO: 1774106 - RNA, 13 nt, Homo sapiens
guuauucucuuca

SEQ ID NO: 1774107 - RNA, 20 nt, Homo sapiens
aaaacaacuucaauauccaa

SEQ ID NO: 1774108 - RNA, 23 nt, Homo sapiens
cacagcugggguggggaccucag

SEQ ID NO: 1774109 - RNA, 12 nt, Homo sapiens
gagaagccucau

SEQ ID NO: 1774110 - RNA, 14 nt, Homo sapiens
caagcucuucauug

SEQ ID NO: 1774111 - RNA, 20 nt, Homo sapiens
aacauuaggaguaacuuuca

SEQ ID NO: 1774112 - RNA, 22 nt, Homo sapiens
aagaguauuuuuaacacuuaaa

SEQ ID NO: 1774113 - RNA, 19 nt, Homo sapiens
cauguuuugauuuguagca

SEQ ID NO: 1774114 - RNA, 20 nt, Homo sapiens
cuuggaagucugucucagga

SEQ ID NO: 1774115 - RNA, 14 nt, Homo sapiens
gaaaugccaguggu

SEQ ID NO: 1774116 - RNA, 14 nt, Homo sapiens
uauuuuaguuccuu

SEQ ID NO: 1774117 - RNA, 16 nt, Homo sapiens
agugauggucauucau

SEQ ID NO: 1774118 - RNA, 21 nt, Homo sapiens
gacaaagaauuccaaagcaaa

SEQ ID NO: 1774119 - RNA, 23 nt, Homo sapiens
ggacaggugccagguguguggug

SEQ ID NO: 1774120 - RNA, 20 nt, Homo sapiens
uguuauccacaagcaaugga

SEQ ID NO: 1774121 - RNA, 15 nt, Homo sapiens
auaauggcauguauu

SEQ ID NO: 1774122 - RNA, 11 nt, Homo sapiens
uguccaugugu

SEQ ID NO: 1774123 - RNA, 12 nt, Homo sapiens
aggaacacugcu

SEQ ID NO: 1774124 - RNA, 19 nt, Homo sapiens
auauuaggagacacaggga

SEQ ID NO: 1774125 - RNA, 19 nt, Homo sapiens
gccugucucuagcuguucu

SEQ ID NO: 1774126 - RNA, 19 nt, Homo sapiens
gagguuuggggucugccac

SEQ ID NO: 1774127 - RNA, 22 nt, Homo sapiens
gggcaucucccucugauuuccu

SEQ ID NO: 1774128 - RNA, 21 nt, Homo sapiens
ccagccugaugccaccuccuc

SEQ ID NO: 1774129 - RNA, 15 nt, Homo sapiens
cuuggagcaggcaaa

SEQ ID NO: 1774130 - RNA, 21 nt, Homo sapiens
agagaaggaccagaaaaugua

SEQ ID NO: 1774131 - RNA, 16 nt, Homo sapiens
aggagacuuucaugca

SEQ ID NO: 1774132 - RNA, 19 nt, Homo sapiens
acaaaggauacuuuuacag

SEQ ID NO: 1774133 - RNA, 22 nt, Homo sapiens
ggacuacaggcucaugccauca

SEQ ID NO: 1774134 - RNA, 14 nt, Homo sapiens
uaaaggcaccuccc

SEQ ID NO: 1774135 - RNA, 19 nt, Homo sapiens
cucucccucuucucaagug

SEQ ID NO: 1774136 - RNA, 23 nt, Homo sapiens
gauagcucucugacugcuuugga

SEQ ID NO: 1774137 - RNA, 14 nt, Homo sapiens
ugagugcacuggca

SEQ ID NO: 1774138 - RNA, 15 nt, Homo sapiens
ccucuguguaucuca

SEQ ID NO: 1774139 - RNA, 12 nt, Homo sapiens
gcaaagaugaag

SEQ ID NO: 1774140 - RNA, 12 nt, Homo sapiens
aacgagauacca

SEQ ID NO: 1774141 - RNA, 15 nt, Homo sapiens
cccucaggauuguuu

SEQ ID NO: 1774142 - RNA, 23 nt, Homo sapiens
cugucugaguaguggccacuggg

SEQ ID NO: 1774143 - RNA, 17 nt, Homo sapiens
uccuugcucagugcaaa

SEQ ID NO: 1774144 - RNA, 22 nt, Homo sapiens
augaaaaacaaaaagcuaacau

SEQ ID NO: 1774145 - RNA, 15 nt, Homo sapiens
uaguuuucuaucccu

SEQ ID NO: 1774146 - RNA, 13 nt, Homo sapiens
cucauuacuuuac

SEQ ID NO: 1774147 - RNA, 19 nt, Homo sapiens
uuaagaaaaacaugucaug

SEQ ID NO: 1774148 - RNA, 17 nt, Homo sapiens
cuuacgcacgauaucua

SEQ ID NO: 1774149 - RNA, 18 nt, Homo sapiens
aacugcaucuggcagcug

SEQ ID NO: 1774150 - RNA, 21 nt, Homo sapiens
agacugaagaccaguauuuca

SEQ ID NO: 1774151 - RNA, 16 nt, Homo sapiens
ucacaugcccauucac

SEQ ID NO: 1774152 - RNA, 14 nt, Homo sapiens
ccuugggcucugcu

SEQ ID NO: 1774153 - RNA, 20 nt, Homo sapiens
uguuaccuuaaaacuaggca

SEQ ID NO: 1774154 - RNA, 21 nt, Homo sapiens
cugcaguauugaguuguuuaa

SEQ ID NO: 1774155 - RNA, 22 nt, Homo sapiens
uuuuuuaaaaagaugauuggaa

SEQ ID NO: 1774156 - RNA, 17 nt, Homo sapiens
cucugccccaggcccua

SEQ ID NO: 1774157 - RNA, 13 nt, Homo sapiens
ugcuuaaggcaua

SEQ ID NO: 1774158 - RNA, 18 nt, Homo sapiens
uuugucuagaacacucag

SEQ ID NO: 1774159 - RNA, 11 nt, Homo sapiens
gggguggagca

SEQ ID NO: 1774160 - RNA, 13 nt, Homo sapiens
uaguaauucucag

SEQ ID NO: 1774161 - RNA, 14 nt, Homo sapiens
cauuagaaacugaa

SEQ ID NO: 1774162 - RNA, 13 nt, Homo sapiens
uugucuguaaaua

SEQ ID NO: 1774163 - RNA, 22 nt, Homo sapiens
uuuguaaugggaacugccucuu

SEQ ID NO: 1774164 - RNA, 14 nt, Homo sapiens
auaggagugagcca

SEQ ID NO: 1774165 - RNA, 22 nt, Homo sapiens
uaacuuauugcauaacagcaga

SEQ ID NO: 1774166 - RNA, 14 nt, Homo sapiens
ccuaacugcaaugu

SEQ ID NO: 1774167 - RNA, 14 nt, Homo sapiens
uauauguauacaua

SEQ ID NO: 1774168 - RNA, 13 nt, Homo sapiens
auauauccaagaa

SEQ ID NO: 1774169 - RNA, 17 nt, Homo sapiens
ucccaaggaaaauggac

SEQ ID NO: 1774170 - RNA, 11 nt, Homo sapiens
ccucucuugcc

SEQ ID NO: 1774171 - RNA, 20 nt, Homo sapiens
uucacuguagaaugauuuca

SEQ ID NO: 1774172 - RNA, 18 nt, Homo sapiens
uuuaacaccccacaggca

SEQ ID NO: 1774173 - RNA, 21 nt, Homo sapiens
aaacuuucucauaagcaccua

SEQ ID NO: 1774174 - RNA, 16 nt, Homo sapiens
cauaaauaaaggugua

SEQ ID NO: 1774175 - RNA, 13 nt, Homo sapiens
aauaucugugaag

SEQ ID NO: 1774176 - RNA, 22 nt, Homo sapiens
uaagccugaaacagccucucca

SEQ ID NO: 1774177 - RNA, 22 nt, Homo sapiens
augaugccgaacauuaggaauu

SEQ ID NO: 1774178 - RNA, 12 nt, Homo sapiens
gauacugauuau

SEQ ID NO: 1774179 - RNA, 18 nt, Homo sapiens
ugcggccuuuggcuucac

SEQ ID NO: 1774180 - RNA, 23 nt, Homo sapiens
acccaauuccacucugauagaau

SEQ ID NO: 1774181 - RNA, 14 nt, Homo sapiens
cuuaaauccauccu

SEQ ID NO: 1774182 - RNA, 14 nt, Homo sapiens
auaaauucaaacca

SEQ ID NO: 1774183 - RNA, 19 nt, Homo sapiens
cucagcuuuuuaauuaaau

SEQ ID NO: 1774184 - RNA, 14 nt, Homo sapiens
ucacauucccaugg

SEQ ID NO: 1774185 - RNA, 16 nt, Homo sapiens
aauccuagacuugaaa

SEQ ID NO: 1774186 - RNA, 21 nt, Homo sapiens
acccacccucugguccuucug

SEQ ID NO: 1774187 - RNA, 20 nt, Homo sapiens
ggaggagcacacauccaaga

SEQ ID NO: 1774188 - RNA, 22 nt, Homo sapiens
ccuuguuguuguguugagaucc

SEQ ID NO: 1774189 - RNA, 21 nt, Homo sapiens
cacaggaagcugcaauucucu

SEQ ID NO: 1774190 - RNA, 23 nt, Homo sapiens
cauguuacuaaauuacguaugca

SEQ ID NO: 1774191 - RNA, 15 nt, Homo sapiens
cauuuuggucucuau

SEQ ID NO: 1774192 - RNA, 19 nt, Homo sapiens
ugugcauucaugcaagagu

SEQ ID NO: 1774193 - RNA, 15 nt, Homo sapiens
cuguaccaguuaauu

SEQ ID NO: 1774194 - RNA, 15 nt, Homo sapiens
acagugauauacuua

SEQ ID NO: 1774195 - RNA, 18 nt, Homo sapiens
uacaggugagugccacca

SEQ ID NO: 1774196 - RNA, 13 nt, Homo sapiens
ucacuggaacuca

SEQ ID NO: 1774197 - RNA, 23 nt, Homo sapiens
cuguaaucccagcaauuugggag

SEQ ID NO: 1774198 - RNA, 15 nt, Homo sapiens
cuuugcugcugugaa

SEQ ID NO: 1774199 - RNA, 12 nt, Homo sapiens
uuuuaagguauu

SEQ ID NO: 1774200 - RNA, 21 nt, Homo sapiens
uggcuguccucuuaagacacu

SEQ ID NO: 1774201 - RNA, 17 nt, Homo sapiens
cuguugguaaagcacau

SEQ ID NO: 1774202 - RNA, 21 nt, Homo sapiens
ccauuacuuuaauacucaccu

SEQ ID NO: 1774203 - RNA, 22 nt, Homo sapiens
uaucggagacagugaucuccau

SEQ ID NO: 1774204 - RNA, 19 nt, Homo sapiens
ccaagauuguccuuuucuc

SEQ ID NO: 1774205 - RNA, 21 nt, Homo sapiens
uuuauugcauggugugaacua

SEQ ID NO: 1774206 - RNA, 20 nt, Homo sapiens
gagauugagcagaagaucaa

SEQ ID NO: 1774207 - RNA, 19 nt, Homo sapiens
ugccgugcauuagcacaga

SEQ ID NO: 1774208 - RNA, 15 nt, Homo sapiens
ugaaugcuuaauuca

SEQ ID NO: 1774209 - RNA, 19 nt, Homo sapiens
gaauguaaucaacauucca

SEQ ID NO: 1774210 - RNA, 20 nt, Homo sapiens
ccugaggaugggcaaccccc

SEQ ID NO: 1774211 - RNA, 19 nt, Homo sapiens
gccuuaaggccacacuggc

SEQ ID NO: 1774212 - RNA, 20 nt, Homo sapiens
auuuuauuuuuuucuaccuu

SEQ ID NO: 1774213 - RNA, 18 nt, Homo sapiens
ccaauaguugguuucaaa

SEQ ID NO: 1774214 - RNA, 12 nt, Homo sapiens
cuacugacauau

SEQ ID NO: 1774215 - RNA, 16 nt, Homo sapiens
uuaaaauuagugcugu

SEQ ID NO: 1774216 - RNA, 12 nt, Homo sapiens
ccugugcucacc

SEQ ID NO: 1774217 - RNA, 22 nt, Homo sapiens
uuaggaguucauaguuggaaaa

SEQ ID NO: 1774218 - RNA, 22 nt, Homo sapiens
cuuguuuuaagauuguaauuca

SEQ ID NO: 1774219 - RNA, 22 nt, Homo sapiens
gaacaauaaaaugucuucuccc

SEQ ID NO: 1774220 - RNA, 17 nt, Homo sapiens
acaugaauccugugaua

SEQ ID NO: 1774221 - RNA, 19 nt, Homo sapiens
auccacacagccaauacaa

SEQ ID NO: 1774222 - RNA, 22 nt, Homo sapiens
uuuaaugaagacccaguguaaa

SEQ ID NO: 1774223 - RNA, 17 nt, Homo sapiens
ugcuaauagaaaacugu

SEQ ID NO: 1774224 - RNA, 12 nt, Homo sapiens
uucaagccauuc

SEQ ID NO: 1774225 - RNA, 21 nt, Homo sapiens
cccccagccugccuuugccac

SEQ ID NO: 1774226 - RNA, 14 nt, Homo sapiens
auacugaaggacac

SEQ ID NO: 1774227 - RNA, 12 nt, Homo sapiens
cacuucuuccau

SEQ ID NO: 1774228 - RNA, 20 nt, Homo sapiens
gugacauuugucauuuucau

SEQ ID NO: 1774229 - RNA, 18 nt, Homo sapiens
aucacauucccauuugcu

SEQ ID NO: 1774230 - RNA, 19 nt, Homo sapiens
uguauucuccuuugcacug

SEQ ID NO: 1774231 - RNA, 19 nt, Homo sapiens
ggcgugggggcacugacca

SEQ ID NO: 1774232 - RNA, 16 nt, Homo sapiens
acgagaacgacaucac

SEQ ID NO: 1774233 - RNA, 14 nt, Homo sapiens
uuauaauugcaucu

SEQ ID NO: 1774234 - RNA, 18 nt, Homo sapiens
aaggacuccacccauccu

SEQ ID NO: 1774235 - RNA, 19 nt, Homo sapiens
ccgguguuuuaaguggaaa

SEQ ID NO: 1774236 - RNA, 16 nt, Homo sapiens
agucagagaaaacacu

SEQ ID NO: 1774237 - RNA, 14 nt, Homo sapiens
agcauuagcuuuaa

SEQ ID NO: 1774238 - RNA, 23 nt, Homo sapiens
cuugcaaaccaucccagcacugc

SEQ ID NO: 1774239 - RNA, 17 nt, Homo sapiens
uggauauuugcacuuau

SEQ ID NO: 1774240 - RNA, 23 nt, Homo sapiens
cuuaaaggccuggaaccagggag

SEQ ID NO: 1774241 - RNA, 16 nt, Homo sapiens
aauuuuaagaauuuca

SEQ ID NO: 1774242 - RNA, 22 nt, Homo sapiens
acagauggaauuagaaauauau

SEQ ID NO: 1774243 - RNA, 19 nt, Homo sapiens
cuaaaacuuggauggacuu

SEQ ID NO: 1774244 - RNA, 22 nt, Homo sapiens
uaaaauuuuuuuagaaagcauu

SEQ ID NO: 1774245 - RNA, 17 nt, Homo sapiens
gaaugacucugacuuug

SEQ ID NO: 1774246 - RNA, 23 nt, Homo sapiens
acaaagaaggaaaagaguaucaa

SEQ ID NO: 1774247 - RNA, 15 nt, Homo sapiens
gaguccuaggacuua

SEQ ID NO: 1774248 - RNA, 23 nt, Homo sapiens
guuauuuauuuccuuagugccag

SEQ ID NO: 1774249 - RNA, 14 nt, Homo sapiens
caacaguugcuaaa

SEQ ID NO: 1774250 - RNA, 22 nt, Homo sapiens
aagcacacucagaaggcuucau

SEQ ID NO: 1774251 - RNA, 20 nt, Homo sapiens
aaauuaugucuuaguuauaa

SEQ ID NO: 1774252 - RNA, 15 nt, Homo sapiens
cacauugccagugac

SEQ ID NO: 1774253 - RNA, 18 nt, Homo sapiens
cuucccagagaguaucug

SEQ ID NO: 1774254 - RNA, 15 nt, Homo sapiens
ccugcaccaugcugc

SEQ ID NO: 1774255 - RNA, 18 nt, Homo sapiens
cccaaguagcugagauua

SEQ ID NO: 1774256 - RNA, 13 nt, Homo sapiens
gcccagggugcug

SEQ ID NO: 1774257 - RNA, 14 nt, Homo sapiens
cagccaaacacaga

SEQ ID NO: 1774258 - RNA, 19 nt, Homo sapiens
aaucauauaagcuauauca

SEQ ID NO: 1774259 - RNA, 19 nt, Homo sapiens
ucaucggcaggcgcaugag

SEQ ID NO: 1774260 - RNA, 21 nt, Homo sapiens
uugauaaaucauuuuauguca

SEQ ID NO: 1774261 - RNA, 19 nt, Homo sapiens
uaagauuccaaaaagcaca

SEQ ID NO: 1774262 - RNA, 16 nt, Homo sapiens
cuauauaugacuggaa

SEQ ID NO: 1774263 - RNA, 20 nt, Homo sapiens
acacaauuguuuuaccuguu

SEQ ID NO: 1774264 - RNA, 20 nt, Homo sapiens
ugguaugcuggccagcaccc

SEQ ID NO: 1774265 - RNA, 19 nt, Homo sapiens
ugcuguuaaaauugcucau

SEQ ID NO: 1774266 - RNA, 16 nt, Homo sapiens
ugccccaccccaucca

SEQ ID NO: 1774267 - RNA, 15 nt, Homo sapiens
ugcacaggagccaaa

SEQ ID NO: 1774268 - RNA, 19 nt, Homo sapiens
cuuuguucaaauguacuau

SEQ ID NO: 1774269 - RNA, 23 nt, Homo sapiens
agaauccaguuugcaauuacuuu

SEQ ID NO: 1774270 - RNA, 21 nt, Homo sapiens
cugaaaaaugcucaaucucag

SEQ ID NO: 1774271 - RNA, 23 nt, Homo sapiens
ugaguagcucuccugacuuuuaa

SEQ ID NO: 1774272 - RNA, 19 nt, Homo sapiens
uugaauaaacaccacugga

SEQ ID NO: 1774273 - RNA, 13 nt, Homo sapiens
aaaaagucacaaa

SEQ ID NO: 1774274 - RNA, 18 nt, Homo sapiens
cugacuauucuugaugua

SEQ ID NO: 1774275 - RNA, 21 nt, Homo sapiens
ggcucagccucaaaugcagua

SEQ ID NO: 1774276 - RNA, 17 nt, Homo sapiens
ugaaaaugauguagaca

SEQ ID NO: 1774277 - RNA, 14 nt, Homo sapiens
ucuuucagcacuca

SEQ ID NO: 1774278 - RNA, 15 nt, Homo sapiens
ugaaugacauugaac

SEQ ID NO: 1774279 - RNA, 19 nt, Homo sapiens
gcccagcaaggaccaguga

SEQ ID NO: 1774280 - RNA, 23 nt, Homo sapiens
ucaacaaauuaaauaaauuaccc

SEQ ID NO: 1774281 - RNA, 17 nt, Homo sapiens
cuugguccuaagcaccu

SEQ ID NO: 1774282 - RNA, 22 nt, Homo sapiens
ugagccagccuugcaguaggca

SEQ ID NO: 1774283 - RNA, 16 nt, Homo sapiens
ggacaggcaccaugcu

SEQ ID NO: 1774284 - RNA, 17 nt, Homo sapiens
gccccggggccuguuau

SEQ ID NO: 1774285 - RNA, 16 nt, Homo sapiens
ugcauacauucuucaa

SEQ ID NO: 1774286 - RNA, 16 nt, Homo sapiens
gguacacuguuuccau

SEQ ID NO: 1774287 - RNA, 17 nt, Homo sapiens
cacaauuaugugcaaag

SEQ ID NO: 1774288 - RNA, 21 nt, Homo sapiens
ucacugagaagauggcacugu

SEQ ID NO: 1774289 - RNA, 16 nt, Homo sapiens
caaaaaaccacaaaaa

SEQ ID NO: 1774290 - RNA, 11 nt, Homo sapiens
aauugcaacaa

SEQ ID NO: 1774291 - RNA, 18 nt, Homo sapiens
gcauuuaccaugugcuaa

SEQ ID NO: 1774292 - RNA, 20 nt, Homo sapiens
ucucuggggcuguguuuuga

SEQ ID NO: 1774293 - RNA, 12 nt, Homo sapiens
ucuucaacaucc

SEQ ID NO: 1774294 - RNA, 13 nt, Homo sapiens
agccccagcaccu

SEQ ID NO: 1774295 - RNA, 21 nt, Homo sapiens
cgaggagugccguguguugca

SEQ ID NO: 1774296 - RNA, 21 nt, Homo sapiens
cacauuguagccuaauauuca

SEQ ID NO: 1774297 - RNA, 15 nt, Homo sapiens
ccuucgaaaggccuu

SEQ ID NO: 1774298 - RNA, 20 nt, Homo sapiens
ccuuagcagggaaacagcua

SEQ ID NO: 1774299 - RNA, 18 nt, Homo sapiens
ugacucaggcugcuccuu

SEQ ID NO: 1774300 - RNA, 11 nt, Homo sapiens
cgcauagcacu

SEQ ID NO: 1774301 - RNA, 12 nt, Homo sapiens
aggacaucuccu

SEQ ID NO: 1774302 - RNA, 18 nt, Homo sapiens
ugcugccuaauaaagaga

SEQ ID NO: 1774303 - RNA, 17 nt, Homo sapiens
cuucuacggccaugaga

SEQ ID NO: 1774304 - RNA, 23 nt, Homo sapiens
aaaucauaguuuaaacugcauua

SEQ ID NO: 1774305 - RNA, 18 nt, Homo sapiens
uacuguaaauguauuugg

SEQ ID NO: 1774306 - RNA, 16 nt, Homo sapiens
gaagagccacugccau

SEQ ID NO: 1774307 - RNA, 17 nt, Homo sapiens
auaccauggcacugaca

SEQ ID NO: 1774308 - RNA, 15 nt, Homo sapiens
uguaaaugcuauuau

SEQ ID NO: 1774309 - RNA, 21 nt, Homo sapiens
cagaaaccuuccugcugagcc

SEQ ID NO: 1774310 - RNA, 20 nt, Homo sapiens
cacuuagaauccgaagggaa

SEQ ID NO: 1774311 - RNA, 19 nt, Homo sapiens
gagguucugggccucugaa

SEQ ID NO: 1774312 - RNA, 15 nt, Homo sapiens
acagugccuaauaau

SEQ ID NO: 1774313 - RNA, 12 nt, Homo sapiens
uacuauccaaau

SEQ ID NO: 1774314 - RNA, 14 nt, Homo sapiens
cuucugggccucca

SEQ ID NO: 1774315 - RNA, 22 nt, Homo sapiens
aaggagauucaaacucaaugau

SEQ ID NO: 1774316 - RNA, 20 nt, Homo sapiens
ugagaaauggcagucugccu

SEQ ID NO: 1774317 - RNA, 18 nt, Homo sapiens
uacacgggguuacacugu

SEQ ID NO: 1774318 - RNA, 16 nt, Homo sapiens
ggaaagccaguuacau

SEQ ID NO: 1774319 - RNA, 17 nt, Homo sapiens
cucugacguugauccca

SEQ ID NO: 1774320 - RNA, 14 nt, Homo sapiens
aaacacacuguaaa

SEQ ID NO: 1774321 - RNA, 21 nt, Homo sapiens
gaguuuaacuuugggcccaga

SEQ ID NO: 1774322 - RNA, 17 nt, Homo sapiens
ucuggggagcucaggaa

SEQ ID NO: 1774323 - RNA, 20 nt, Homo sapiens
guuuaagucucugacucuug

SEQ ID NO: 1774324 - RNA, 13 nt, Homo sapiens
aaauuuugcacca

SEQ ID NO: 1774325 - RNA, 22 nt, Homo sapiens
ucugauaaacacaaucugcuag

SEQ ID NO: 1774326 - RNA, 11 nt, Homo sapiens
cacaaagggau

SEQ ID NO: 1774327 - RNA, 16 nt, Homo sapiens
acugcuuggaagaagg

SEQ ID NO: 1774328 - RNA, 21 nt, Homo sapiens
acucuauacuuaaucucacau

SEQ ID NO: 1774329 - RNA, 21 nt, Homo sapiens
gccaaccagaauaaaauaacc

SEQ ID NO: 1774330 - RNA, 12 nt, Homo sapiens
gaaaaguuuuca

SEQ ID NO: 1774331 - RNA, 21 nt, Homo sapiens
aaauauuugugaaagugccaa

SEQ ID NO: 1774332 - RNA, 23 nt, Homo sapiens
cucucaccuguacuauugcagac

SEQ ID NO: 1774333 - RNA, 18 nt, Homo sapiens
cgugggccgaggugacug

SEQ ID NO: 1774334 - RNA, 15 nt, Homo sapiens
aagcuagacagaucc

SEQ ID NO: 1774335 - RNA, 19 nt, Homo sapiens
auucuagcugagaagcaau

SEQ ID NO: 1774336 - RNA, 11 nt, Homo sapiens
cugcuggugag

SEQ ID NO: 1774337 - RNA, 21 nt, Homo sapiens
aaucaucugcauuccugauga

SEQ ID NO: 1774338 - RNA, 21 nt, Homo sapiens
cgaggugcaaauucauuucau

SEQ ID NO: 1774339 - RNA, 15 nt, Homo sapiens
aaggaaggacuauga

SEQ ID NO: 1774340 - RNA, 22 nt, Homo sapiens
acaguaacaaauaaagugcagu

SEQ ID NO: 1774341 - RNA, 17 nt, Homo sapiens
aaugcacuccugaccaa

SEQ ID NO: 1774342 - RNA, 22 nt, Homo sapiens
ccccacaagcaccacucugggc

SEQ ID NO: 1774343 - RNA, 18 nt, Homo sapiens
aucaacaucuuggucaga

SEQ ID NO: 1774344 - RNA, 16 nt, Homo sapiens
aaguuguaccaaaaca

SEQ ID NO: 1774345 - RNA, 21 nt, Homo sapiens
cagcucugcauuaucugaggu

SEQ ID NO: 1774346 - RNA, 17 nt, Homo sapiens
accagaggcugcagaag

SEQ ID NO: 1774347 - RNA, 18 nt, Homo sapiens
caaggucuccagagggug

SEQ ID NO: 1774348 - RNA, 12 nt, Homo sapiens
gucuuagugcaa

SEQ ID NO: 1774349 - RNA, 15 nt, Homo sapiens
agugggaagggagca

SEQ ID NO: 1774350 - RNA, 16 nt, Homo sapiens
cuucuguaaucaauau

SEQ ID NO: 1774351 - RNA, 22 nt, Homo sapiens
uaaugagaacuucaaucacugu

SEQ ID NO: 1774352 - RNA, 12 nt, Homo sapiens
aauagaaagcca

SEQ ID NO: 1774353 - RNA, 22 nt, Homo sapiens
ucgauauguauaucauucuaca

SEQ ID NO: 1774354 - RNA, 13 nt, Homo sapiens
auucuuaacaaga

SEQ ID NO: 1774355 - RNA, 18 nt, Homo sapiens
gcugcgagagaaagggag

SEQ ID NO: 1774356 - RNA, 19 nt, Homo sapiens
ggccacgcaggggcccuga

SEQ ID NO: 1774357 - RNA, 12 nt, Homo sapiens
aaagcauuucag

SEQ ID NO: 1774358 - RNA, 14 nt, Homo sapiens
cuucauuaugcagc

SEQ ID NO: 1774359 - RNA, 14 nt, Homo sapiens
ugacagcacuacaa

SEQ ID NO: 1774360 - RNA, 14 nt, Homo sapiens
ucagaaaacucugg

SEQ ID NO: 1774361 - RNA, 21 nt, Homo sapiens
gaaaguagaacuuacuauuca

SEQ ID NO: 1774362 - RNA, 23 nt, Homo sapiens
cugguuaaaucaauucugauaca

SEQ ID NO: 1774363 - RNA, 15 nt, Homo sapiens
ugaucaagaaugcaa

SEQ ID NO: 1774364 - RNA, 14 nt, Homo sapiens
ggaauauacggaau

SEQ ID NO: 1774365 - RNA, 12 nt, Homo sapiens
ugauacaugacu

SEQ ID NO: 1774366 - RNA, 14 nt, Homo sapiens
gaagaagcuauguc

SEQ ID NO: 1774367 - RNA, 12 nt, Homo sapiens
gaaaacauugca

SEQ ID NO: 1774368 - RNA, 23 nt, Homo sapiens
agagauggaauaaagcccuugaa

SEQ ID NO: 1774369 - RNA, 15 nt, Homo sapiens
ggacccagcacugac

SEQ ID NO: 1774370 - RNA, 10 nt, Homo sapiens
uauacauuug

SEQ ID NO: 1774371 - RNA, 14 nt, Homo sapiens
uuuguaccgaaaca

SEQ ID NO: 1774372 - RNA, 19 nt, Homo sapiens
ugaccaagggaagugacca

SEQ ID NO: 1774373 - RNA, 22 nt, Homo sapiens
aucugaaaugcuugaaaccaga

SEQ ID NO: 1774374 - RNA, 16 nt, Homo sapiens
gagaccagcaucccag

SEQ ID NO: 1774375 - RNA, 23 nt, Homo sapiens
uguagagauuuaccuguuuuuca

SEQ ID NO: 1774376 - RNA, 22 nt, Homo sapiens
caacguucgauuucuaccucag

SEQ ID NO: 1774377 - RNA, 21 nt, Homo sapiens
ggggacauuccaauuugcacu

SEQ ID NO: 1774378 - RNA, 22 nt, Homo sapiens
accuguucugguagcuccacaa

SEQ ID NO: 1774379 - RNA, 22 nt, Homo sapiens
cugccaaaaauauaauucuuag

SEQ ID NO: 1774380 - RNA, 21 nt, Homo sapiens
gccccugcuacugccaaccuc

SEQ ID NO: 1774381 - RNA, 13 nt, Homo sapiens
accuaugugccaa

SEQ ID NO: 1774382 - RNA, 15 nt, Homo sapiens
ucagguauaccucac

SEQ ID NO: 1774383 - RNA, 20 nt, Homo sapiens
uuacugaaaacaaaauaucu

SEQ ID NO: 1774384 - RNA, 20 nt, Homo sapiens
gucauauauuaaacauccac

SEQ ID NO: 1774385 - RNA, 19 nt, Homo sapiens
uccaauaauuuuccuguga

SEQ ID NO: 1774386 - RNA, 18 nt, Homo sapiens
aacaagaaauuguuucuu

SEQ ID NO: 1774387 - RNA, 14 nt, Homo sapiens
cacaauucuguccc

SEQ ID NO: 1774388 - RNA, 16 nt, Homo sapiens
accacugaauucacuc

SEQ ID NO: 1774389 - RNA, 18 nt, Homo sapiens
uuaacuuuauaaauccag

SEQ ID NO: 1774390 - RNA, 20 nt, Homo sapiens
agcuuccagagcucugaccc

SEQ ID NO: 1774391 - RNA, 16 nt, Homo sapiens
aauaaagcuguucuca

SEQ ID NO: 1774392 - RNA, 16 nt, Homo sapiens
acaugugcuauugaac

SEQ ID NO: 1774393 - RNA, 15 nt, Homo sapiens
ugaaacaaacaugga

SEQ ID NO: 1774394 - RNA, 14 nt, Homo sapiens
aauaaaacauucag

SEQ ID NO: 1774395 - RNA, 17 nt, Homo sapiens
cuugaaggugcugccac

SEQ ID NO: 1774396 - RNA, 15 nt, Homo sapiens
gaccaauacuacugu

SEQ ID NO: 1774397 - RNA, 18 nt, Homo sapiens
uccucacugggcucacug

SEQ ID NO: 1774398 - RNA, 14 nt, Homo sapiens
gggaucuugaggga

SEQ ID NO: 1774399 - RNA, 18 nt, Homo sapiens
cagugauuugccaaagug

SEQ ID NO: 1774400 - RNA, 23 nt, Homo sapiens
gaaggcuuaagaacugcuucaug

SEQ ID NO: 1774401 - RNA, 16 nt, Homo sapiens
aaaagcuacaguuuug

SEQ ID NO: 1774402 - RNA, 21 nt, Homo sapiens
ggaagggucccuuuugcauug

SEQ ID NO: 1774403 - RNA, 24 nt, Homo sapiens
cugaauuaaagucuacacugccuu

SEQ ID NO: 1774404 - RNA, 15 nt, Homo sapiens
acaaaucguccaaag

SEQ ID NO: 1774405 - RNA, 17 nt, Homo sapiens
aagguuuuuuuuaucuu

SEQ ID NO: 1774406 - RNA, 14 nt, Homo sapiens
cgccuuccggugag

SEQ ID NO: 1774407 - RNA, 22 nt, Homo sapiens
aagaaauuccuguagcaucuuc

SEQ ID NO: 1774408 - RNA, 16 nt, Homo sapiens
aaucucacuucaucaa

SEQ ID NO: 1774409 - RNA, 14 nt, Homo sapiens
cccugucucuaaaa

SEQ ID NO: 1774410 - RNA, 13 nt, Homo sapiens
accuacugcugag

SEQ ID NO: 1774411 - RNA, 18 nt, Homo sapiens
ccaaggguacuaaggaau

SEQ ID NO: 1774412 - RNA, 11 nt, Homo sapiens
guaaaauggaa

SEQ ID NO: 1774413 - RNA, 19 nt, Homo sapiens
agaaaagccuuuuaaucuc

SEQ ID NO: 1774414 - RNA, 21 nt, Homo sapiens
uggagguuuguuuagaagaag

SEQ ID NO: 1774415 - RNA, 14 nt, Homo sapiens
ggggucguuugcuu

SEQ ID NO: 1774416 - RNA, 20 nt, Homo sapiens
acaccaggcugugggccuca

SEQ ID NO: 1774417 - RNA, 19 nt, Homo sapiens
gcagguaaccccagauuca

SEQ ID NO: 1774418 - RNA, 16 nt, Homo sapiens
uauuuauucaucugca

SEQ ID NO: 1774419 - RNA, 14 nt, Homo sapiens
agcaaaagauucua

SEQ ID NO: 1774420 - RNA, 12 nt, Homo sapiens
uuuaaauucucu

SEQ ID NO: 1774421 - RNA, 12 nt, Homo sapiens
ucuuaauuccca

SEQ ID NO: 1774422 - RNA, 16 nt, Homo sapiens
auacuuaagaauacac

SEQ ID NO: 1774423 - RNA, 19 nt, Homo sapiens
gacuaauccaauaccucuu

SEQ ID NO: 1774424 - RNA, 22 nt, Homo sapiens
auaggaugcuugggaagacucc

SEQ ID NO: 1774425 - RNA, 13 nt, Homo sapiens
cauauuuauaugu

SEQ ID NO: 1774426 - RNA, 15 nt, Homo sapiens
acauacaucuaaguc

SEQ ID NO: 1774427 - RNA, 13 nt, Homo sapiens
agggccucaucuc

SEQ ID NO: 1774428 - RNA, 22 nt, Homo sapiens
uauguaugaguggcuucuggga

SEQ ID NO: 1774429 - RNA, 14 nt, Homo sapiens
aucaacugucaaau

SEQ ID NO: 1774430 - RNA, 14 nt, Homo sapiens
cccaucagcacucu

SEQ ID NO: 1774431 - RNA, 19 nt, Homo sapiens
uuguuuuguguaacauauu

SEQ ID NO: 1774432 - RNA, 19 nt, Homo sapiens
gcuauuacuaguacuauua

SEQ ID NO: 1774433 - RNA, 17 nt, Homo sapiens
cuguuugaacccaggag

SEQ ID NO: 1774434 - RNA, 15 nt, Homo sapiens
gccuggcaucugugu

SEQ ID NO: 1774435 - RNA, 16 nt, Homo sapiens
caacgugcaaagccaa

SEQ ID NO: 1774436 - RNA, 20 nt, Homo sapiens
aauaccuucaaggcucuucu

SEQ ID NO: 1774437 - RNA, 20 nt, Homo sapiens
cuuuccucgccugacaacca

SEQ ID NO: 1774438 - RNA, 13 nt, Homo sapiens
ucagaauugcaca

SEQ ID NO: 1774439 - RNA, 20 nt, Homo sapiens
agugaauuuggucucuccca

SEQ ID NO: 1774440 - RNA, 16 nt, Homo sapiens
caaugaagauccaagc

SEQ ID NO: 1774441 - RNA, 15 nt, Homo sapiens
uuccugauaaacaga

SEQ ID NO: 1774442 - RNA, 21 nt, Homo sapiens
augaagaucuuuauauuucaa

SEQ ID NO: 1774443 - RNA, 14 nt, Homo sapiens
aaccaguugaauca

SEQ ID NO: 1774444 - RNA, 22 nt, Homo sapiens
agcagcuuuagccaagugcagg

SEQ ID NO: 1774445 - RNA, 22 nt, Homo sapiens
cagcuacccaggaggcugaggu

SEQ ID NO: 1774446 - RNA, 15 nt, Homo sapiens
gauccugggggacca

SEQ ID NO: 1774447 - RNA, 23 nt, Homo sapiens
uuaagaaagagaaugaacugugg

SEQ ID NO: 1774448 - RNA, 15 nt, Homo sapiens
uccauauacauauau

SEQ ID NO: 1774449 - RNA, 22 nt, Homo sapiens
uugaacaacucgaaucacucau

SEQ ID NO: 1774450 - RNA, 20 nt, Homo sapiens
agcuauuuaucuguaguaaa

SEQ ID NO: 1774451 - RNA, 21 nt, Homo sapiens
cugcacagugguccagggucc

SEQ ID NO: 1774452 - RNA, 21 nt, Homo sapiens
cuguaauaguuuuauauuguu

SEQ ID NO: 1774453 - RNA, 17 nt, Homo sapiens
aucauugaaacauuuau

SEQ ID NO: 1774454 - RNA, 17 nt, Homo sapiens
cugccaucuagccagcc

SEQ ID NO: 1774455 - RNA, 20 nt, Homo sapiens
aauccccaauaauugcagaa

SEQ ID NO: 1774456 - RNA, 21 nt, Homo sapiens
caccaugacccucuuccucau

SEQ ID NO: 1774457 - RNA, 18 nt, Homo sapiens
gccagcucccagccacau

SEQ ID NO: 1774458 - RNA, 13 nt, Homo sapiens
caugaaacauguu

SEQ ID NO: 1774459 - RNA, 22 nt, Homo sapiens
agagggcgagcaugaacuggcc

SEQ ID NO: 1774460 - RNA, 19 nt, Homo sapiens
aaaggucaagaacacagug

SEQ ID NO: 1774461 - RNA, 12 nt, Homo sapiens
aauacauucacc

SEQ ID NO: 1774462 - RNA, 14 nt, Homo sapiens
uugcacagcagcaa

SEQ ID NO: 1774463 - RNA, 16 nt, Homo sapiens
gaugaaauaacacagc

SEQ ID NO: 1774464 - RNA, 17 nt, Homo sapiens
cuagggcucuuguguuu

SEQ ID NO: 1774465 - RNA, 14 nt, Homo sapiens
gccaagaagcagug

SEQ ID NO: 1774466 - RNA, 14 nt, Homo sapiens
caaagccaugccaa

SEQ ID NO: 1774467 - RNA, 21 nt, Homo sapiens
acaaaacgaaaugcuaugacu

SEQ ID NO: 1774468 - RNA, 17 nt, Homo sapiens
aaacugccuuccacaau

SEQ ID NO: 1774469 - RNA, 20 nt, Homo sapiens
uugcuucuguaguacuccuu

SEQ ID NO: 1774470 - RNA, 19 nt, Homo sapiens
acauuuaaagcauugcugu

SEQ ID NO: 1774471 - RNA, 18 nt, Homo sapiens
uuggcguaggcuacagag

SEQ ID NO: 1774472 - RNA, 15 nt, Homo sapiens
cagacaccugccuua

SEQ ID NO: 1774473 - RNA, 14 nt, Homo sapiens
auauauacuauuaa

SEQ ID NO: 1774474 - RNA, 16 nt, Homo sapiens
auucuacuagcaggca

SEQ ID NO: 1774475 - RNA, 18 nt, Homo sapiens
ucugugcccuacucauug

SEQ ID NO: 1774476 - RNA, 14 nt, Homo sapiens
gccugaaccuucca

SEQ ID NO: 1774477 - RNA, 23 nt, Homo sapiens
caaaccagcccagagcagggucu

SEQ ID NO: 1774478 - RNA, 20 nt, Homo sapiens
aguugcacuacauaaucucu

SEQ ID NO: 1774479 - RNA, 18 nt, Homo sapiens
agacuuucuuaucacuua

SEQ ID NO: 1774480 - RNA, 15 nt, Homo sapiens
acugcugaucaauga

SEQ ID NO: 1774481 - RNA, 23 nt, Homo sapiens
uggcuuacuacaugugggagcuu

SEQ ID NO: 1774482 - RNA, 14 nt, Homo sapiens
gugacagugccugg

SEQ ID NO: 1774483 - RNA, 20 nt, Homo sapiens
acacucucuggaagcccugg

SEQ ID NO: 1774484 - RNA, 13 nt, Homo sapiens
uuauuaaaaacug

SEQ ID NO: 1774485 - RNA, 14 nt, Homo sapiens
uuguguuaccugua

SEQ ID NO: 1774486 - RNA, 18 nt, Homo sapiens
cguuaaagcaaagcgcua

SEQ ID NO: 1774487 - RNA, 12 nt, Homo sapiens
uccaacuuguca

SEQ ID NO: 1774488 - RNA, 12 nt, Homo sapiens
guccacuuuccc

SEQ ID NO: 1774489 - RNA, 18 nt, Homo sapiens
cuacugcuaugugucaca

SEQ ID NO: 1774490 - RNA, 17 nt, Homo sapiens
gcaaauuuuguauuucu

SEQ ID NO: 1774491 - RNA, 17 nt, Homo sapiens
cugaaacaugugccccu

SEQ ID NO: 1774492 - RNA, 13 nt, Homo sapiens
aaugcucacuggg

SEQ ID NO: 1774493 - RNA, 15 nt, Homo sapiens
cagugagugcugcuc

SEQ ID NO: 1774494 - RNA, 18 nt, Homo sapiens
cacugggucucugcaaac

SEQ ID NO: 1774495 - RNA, 19 nt, Homo sapiens
cauuccaugagucuucaga

SEQ ID NO: 1774496 - RNA, 22 nt, Homo sapiens
cauggaugaauaaauguuauag

SEQ ID NO: 1774497 - RNA, 15 nt, Homo sapiens
uuuuaauggugaugg

SEQ ID NO: 1774498 - RNA, 16 nt, Homo sapiens
aaucucagaacccaga

SEQ ID NO: 1774499 - RNA, 12 nt, Homo sapiens
agauuuauuagu

SEQ ID NO: 1774500 - RNA, 16 nt, Homo sapiens
auaauguuacauuauu

SEQ ID NO: 1774501 - RNA, 15 nt, Homo sapiens
uaauuuggaucucuu

SEQ ID NO: 1774502 - RNA, 17 nt, Homo sapiens
aagaguugccaaaauac

SEQ ID NO: 1774503 - RNA, 17 nt, Homo sapiens
cugaaagucaugcacau

SEQ ID NO: 1774504 - RNA, 21 nt, Homo sapiens
cucccacaugaggccaucuca

SEQ ID NO: 1774505 - RNA, 15 nt, Homo sapiens
aaagagucacucaca

SEQ ID NO: 1774506 - RNA, 20 nt, Homo sapiens
cuuucaacaaugacuaauga

SEQ ID NO: 1774507 - RNA, 20 nt, Homo sapiens
aaauagcaguccccagugau

SEQ ID NO: 1774508 - RNA, 22 nt, Homo sapiens
uccuaacccugggcucccugga

SEQ ID NO: 1774509 - RNA, 14 nt, Homo sapiens
ucacccccugagau

SEQ ID NO: 1774510 - RNA, 13 nt, Homo sapiens
gcuggguguugca

SEQ ID NO: 1774511 - RNA, 14 nt, Homo sapiens
auauaaauaucaca

SEQ ID NO: 1774512 - RNA, 14 nt, Homo sapiens
uaaauaugugaaaa

SEQ ID NO: 1774513 - RNA, 21 nt, Homo sapiens
auauucuacauauauguauau

SEQ ID NO: 1774514 - RNA, 21 nt, Homo sapiens
agaaaaacaccgcuucugccu

SEQ ID NO: 1774515 - RNA, 21 nt, Homo sapiens
uuggcuuuaugcaaauacaau

SEQ ID NO: 1774516 - RNA, 15 nt, Homo sapiens
acgugggcauucaaa

SEQ ID NO: 1774517 - RNA, 14 nt, Homo sapiens
agaaacaauacaaa

SEQ ID NO: 1774518 - RNA, 19 nt, Homo sapiens
ugccaagagccgacaaugc

SEQ ID NO: 1774519 - RNA, 16 nt, Homo sapiens
caucaauucucuauca

SEQ ID NO: 1774520 - RNA, 22 nt, Homo sapiens
cuguacccuugagaccuggaac

SEQ ID NO: 1774521 - RNA, 21 nt, Homo sapiens
ugcugaauuuacaguaguuaa

SEQ ID NO: 1774522 - RNA, 20 nt, Homo sapiens
caaauccccucccugugacc

SEQ ID NO: 1774523 - RNA, 14 nt, Homo sapiens
uuagguuugucaac

SEQ ID NO: 1774524 - RNA, 15 nt, Homo sapiens
acaaucuguaauugc

SEQ ID NO: 1774525 - RNA, 16 nt, Homo sapiens
caaggauauacugcag

SEQ ID NO: 1774526 - RNA, 13 nt, Homo sapiens
cccuacuggaguc

SEQ ID NO: 1774527 - RNA, 12 nt, Homo sapiens
uagaacagccag

SEQ ID NO: 1774528 - RNA, 19 nt, Homo sapiens
cuccuuuggaaggugacac

SEQ ID NO: 1774529 - RNA, 18 nt, Homo sapiens
uauaccaugagugugcca

SEQ ID NO: 1774530 - RNA, 19 nt, Homo sapiens
uuccaaaucuuaauucaac

SEQ ID NO: 1774531 - RNA, 12 nt, Homo sapiens
uguuaaguuaca

SEQ ID NO: 1774532 - RNA, 17 nt, Homo sapiens
caacacugggaaacaga

SEQ ID NO: 1774533 - RNA, 17 nt, Homo sapiens
ccuucaccagagcccau

SEQ ID NO: 1774534 - RNA, 19 nt, Homo sapiens
gcaauaacaguaguguuac

SEQ ID NO: 1774535 - RNA, 20 nt, Homo sapiens
cccaggcugcagugcaaugg

SEQ ID NO: 1774536 - RNA, 23 nt, Homo sapiens
ucccugacucuuagccccagacu

SEQ ID NO: 1774537 - RNA, 18 nt, Homo sapiens
aauaauggaaacauuaca

SEQ ID NO: 1774538 - RNA, 20 nt, Homo sapiens
guguuugguucuggggcccc

SEQ ID NO: 1774539 - RNA, 18 nt, Homo sapiens
gguuaucaaaaauuucau

SEQ ID NO: 1774540 - RNA, 18 nt, Homo sapiens
ucaaaacaaccacuuucu

SEQ ID NO: 1774541 - RNA, 21 nt, Homo sapiens
gaaugccacacguaaacacuu

SEQ ID NO: 1774542 - RNA, 19 nt, Homo sapiens
cuggcuuccuaaacccauc

SEQ ID NO: 1774543 - RNA, 22 nt, Homo sapiens
agugaaagcuuucaugaccaua

SEQ ID NO: 1774544 - RNA, 20 nt, Homo sapiens
cuuuggguccauucagauga

SEQ ID NO: 1774545 - RNA, 22 nt, Homo sapiens
gaaacaauggcuaagauaccaa

SEQ ID NO: 1774546 - RNA, 20 nt, Homo sapiens
uccaagucucucugugaaua

SEQ ID NO: 1774547 - RNA, 19 nt, Homo sapiens
gaaaaaaaauuuguuuuca

SEQ ID NO: 1774548 - RNA, 13 nt, Homo sapiens
ccacacuggacuc

SEQ ID NO: 1774549 - RNA, 15 nt, Homo sapiens
auucuuccaaaggau

SEQ ID NO: 1774550 - RNA, 14 nt, Homo sapiens
acuaggcucagaga

SEQ ID NO: 1774551 - RNA, 17 nt, Homo sapiens
cgaauuaauuaccuggc

SEQ ID NO: 1774552 - RNA, 15 nt, Homo sapiens
ucauucucagaauuc

SEQ ID NO: 1774553 - RNA, 19 nt, Homo sapiens
aagccaaagagccucccac

SEQ ID NO: 1774554 - RNA, 14 nt, Homo sapiens
aagaacucauuuga

SEQ ID NO: 1774555 - RNA, 12 nt, Homo sapiens
uuccugcuuauu

SEQ ID NO: 1774556 - RNA, 23 nt, Homo sapiens
gaaaaaugaaagaugauuugcaa

SEQ ID NO: 1774557 - RNA, 13 nt, Homo sapiens
cuaaggugaaaag

SEQ ID NO: 1774558 - RNA, 13 nt, Homo sapiens
auaaugugcaaau

SEQ ID NO: 1774559 - RNA, 13 nt, Homo sapiens
augcagugcagca

SEQ ID NO: 1774560 - RNA, 19 nt, Homo sapiens
ucauuccaugugcccaguu

SEQ ID NO: 1774561 - RNA, 23 nt, Homo sapiens
guccuguauaagaauuacuaaau

SEQ ID NO: 1774562 - RNA, 17 nt, Homo sapiens
gagacaggauugggcca

SEQ ID NO: 1774563 - RNA, 17 nt, Homo sapiens
cugcaucuauaauguca

SEQ ID NO: 1774564 - RNA, 15 nt, Homo sapiens
uagugagcagcaucu

SEQ ID NO: 1774565 - RNA, 15 nt, Homo sapiens
cuuuaaggugcuaaa

SEQ ID NO: 1774566 - RNA, 22 nt, Homo sapiens
gaaaggcagaaugagugcuuca

SEQ ID NO: 1774567 - RNA, 21 nt, Homo sapiens
uccccauccccagcugggaag

SEQ ID NO: 1774568 - RNA, 18 nt, Homo sapiens
ucaggguuggugugcuga

SEQ ID NO: 1774569 - RNA, 14 nt, Homo sapiens
cccuaaaacaugug

SEQ ID NO: 1774570 - RNA, 17 nt, Homo sapiens
auucucugaugcacugu

SEQ ID NO: 1774571 - RNA, 17 nt, Homo sapiens
uauuuuuuaaguauuua

SEQ ID NO: 1774572 - RNA, 18 nt, Homo sapiens
uuggcaucuugcugcuaa

SEQ ID NO: 1774573 - RNA, 14 nt, Homo sapiens
ggacaaagccuuug

SEQ ID NO: 1774574 - RNA, 19 nt, Homo sapiens
uaaaucugcagcacauuga

SEQ ID NO: 1774575 - RNA, 19 nt, Homo sapiens
uacuguuuauaucuucacc

SEQ ID NO: 1774576 - RNA, 14 nt, Homo sapiens
gaaguauguauauu

SEQ ID NO: 1774577 - RNA, 16 nt, Homo sapiens
auccacacugagcuga

SEQ ID NO: 1774578 - RNA, 13 nt, Homo sapiens
aaauuccacagau

SEQ ID NO: 1774579 - RNA, 17 nt, Homo sapiens
uuuacaguaaauguuac

SEQ ID NO: 1774580 - RNA, 13 nt, Homo sapiens
cacaucuucaggc

SEQ ID NO: 1774581 - RNA, 13 nt, Homo sapiens
uguuccaugucuc

SEQ ID NO: 1774582 - RNA, 19 nt, Homo sapiens
ucugggccucuuuuugccc

SEQ ID NO: 1774583 - RNA, 18 nt, Homo sapiens
aauuugggggacuuacau

SEQ ID NO: 1774584 - RNA, 12 nt, Homo sapiens
gaaauaaucucu

SEQ ID NO: 1774585 - RNA, 21 nt, Homo sapiens
cuaaauuuucugaaacugcau

SEQ ID NO: 1774586 - RNA, 20 nt, Homo sapiens
aaaucuaugagcaacuccuu

SEQ ID NO: 1774587 - RNA, 22 nt, Homo sapiens
acauugugcaauugauauugcc

SEQ ID NO: 1774588 - RNA, 17 nt, Homo sapiens
cuuccccaugcuuccuu

SEQ ID NO: 1774589 - RNA, 16 nt, Homo sapiens
ugaucagugugcuaac

SEQ ID NO: 1774590 - RNA, 15 nt, Homo sapiens
ucugaugcaucagaa

SEQ ID NO: 1774591 - RNA, 20 nt, Homo sapiens
aagauggaugcgacccaaga

SEQ ID NO: 1774592 - RNA, 18 nt, Homo sapiens
cauugauuugcucuuacu

SEQ ID NO: 1774593 - RNA, 23 nt, Homo sapiens
acaucugccuuaaaaccaaagag

SEQ ID NO: 1774594 - RNA, 17 nt, Homo sapiens
accauagcacaggcuaa

SEQ ID NO: 1774595 - RNA, 18 nt, Homo sapiens
ccccagugauagaaagaa

SEQ ID NO: 1774596 - RNA, 22 nt, Homo sapiens
uaaacauuaaguaaaugcugua

SEQ ID NO: 1774597 - RNA, 15 nt, Homo sapiens
acaaacaaugcaaac

SEQ ID NO: 1774598 - RNA, 21 nt, Homo sapiens
ccaaccaacaaacaaugccau

SEQ ID NO: 1774599 - RNA, 15 nt, Homo sapiens
uaacuguuguugaca

SEQ ID NO: 1774600 - RNA, 22 nt, Homo sapiens
accagugaauuuuugcaauaau

SEQ ID NO: 1774601 - RNA, 14 nt, Homo sapiens
uaguuccacugaga

SEQ ID NO: 1774602 - RNA, 13 nt, Homo sapiens
uuccucgccacgc

SEQ ID NO: 1774603 - RNA, 12 nt, Homo sapiens
guccuguucuca

SEQ ID NO: 1774604 - RNA, 17 nt, Homo sapiens
ugaaucuaaaagcuuuu

SEQ ID NO: 1774605 - RNA, 14 nt, Homo sapiens
gaacuucacaguga

SEQ ID NO: 1774606 - RNA, 14 nt, Homo sapiens
ccgugacagcacuu

SEQ ID NO: 1774607 - RNA, 19 nt, Homo sapiens
guaauuuauuaacuaauca

SEQ ID NO: 1774608 - RNA, 14 nt, Homo sapiens
uuucuuaauauaca

SEQ ID NO: 1774609 - RNA, 12 nt, Homo sapiens
acauagcacuug

SEQ ID NO: 1774610 - RNA, 13 nt, Homo sapiens
ugcuucucugggg

SEQ ID NO: 1774611 - RNA, 14 nt, Homo sapiens
uuuauaucugagca

SEQ ID NO: 1774612 - RNA, 23 nt, Homo sapiens
gugcuagcaacacccaaaggugg

SEQ ID NO: 1774613 - RNA, 14 nt, Homo sapiens
cugugggcuuaugu

SEQ ID NO: 1774614 - RNA, 14 nt, Homo sapiens
uuggaaaccacagu

SEQ ID NO: 1774615 - RNA, 18 nt, Homo sapiens
ugggcagauuugcaacag

SEQ ID NO: 1774616 - RNA, 20 nt, Homo sapiens
caucuccgccuccacacuga

SEQ ID NO: 1774617 - RNA, 16 nt, Homo sapiens
ucaagugaucuuucaa

SEQ ID NO: 1774618 - RNA, 15 nt, Homo sapiens
ugauauuucuugcuu

SEQ ID NO: 1774619 - RNA, 15 nt, Homo sapiens
uuuauuuaaagcauu

SEQ ID NO: 1774620 - RNA, 14 nt, Homo sapiens
uguaauaagacuau

SEQ ID NO: 1774621 - RNA, 18 nt, Homo sapiens
auguauuugaacacuugg

SEQ ID NO: 1774622 - RNA, 19 nt, Homo sapiens
aaauuucuucgaucccaag

SEQ ID NO: 1774623 - RNA, 18 nt, Homo sapiens
caggcucuuccccugcuc

SEQ ID NO: 1774624 - RNA, 21 nt, Homo sapiens
agacuaaccucuaccagcaca

SEQ ID NO: 1774625 - RNA, 14 nt, Homo sapiens
ucaagagugagcua

SEQ ID NO: 1774626 - RNA, 14 nt, Homo sapiens
gauggacucugaaa

SEQ ID NO: 1774627 - RNA, 22 nt, Homo sapiens
aaccauuguuucuuauucuuuc

SEQ ID NO: 1774628 - RNA, 17 nt, Homo sapiens
guggaugccugcugcau

SEQ ID NO: 1774629 - RNA, 17 nt, Homo sapiens
aggaaaaggccuggggu

SEQ ID NO: 1774630 - RNA, 15 nt, Homo sapiens
uguguaaugugcaaa

SEQ ID NO: 1774631 - RNA, 18 nt, Homo sapiens
augaggaaggacuugacu

SEQ ID NO: 1774632 - RNA, 13 nt, Homo sapiens
agaugccuuccag

SEQ ID NO: 1774633 - RNA, 13 nt, Homo sapiens
ccccuccuagcaa

SEQ ID NO: 1774634 - RNA, 13 nt, Homo sapiens
cuguaaagccagu

SEQ ID NO: 1774635 - RNA, 15 nt, Homo sapiens
cauccucacugccgu

SEQ ID NO: 1774636 - RNA, 22 nt, Homo sapiens
ucaggagaguagcaacaaaagg

SEQ ID NO: 1774637 - RNA, 14 nt, Homo sapiens
aggugcugacaaua

SEQ ID NO: 1774638 - RNA, 13 nt, Homo sapiens
gagggcagcugcu

SEQ ID NO: 1774639 - RNA, 14 nt, Homo sapiens
agauaucuauggca

SEQ ID NO: 1774640 - RNA, 22 nt, Homo sapiens
auauuccugguguagcacuuaa

SEQ ID NO: 1774641 - RNA, 20 nt, Homo sapiens
agugucauccucacagugaa

SEQ ID NO: 1774642 - RNA, 14 nt, Homo sapiens
aaacugcacauugg

SEQ ID NO: 1774643 - RNA, 21 nt, Homo sapiens
auaacaaccugggcauuccuu

SEQ ID NO: 1774644 - RNA, 16 nt, Homo sapiens
aaaauaucacuuugua

SEQ ID NO: 1774645 - RNA, 19 nt, Homo sapiens
cuuuucuuuuuuuguccac

SEQ ID NO: 1774646 - RNA, 17 nt, Homo sapiens
acgucauuugugcaaga

SEQ ID NO: 1774647 - RNA, 20 nt, Homo sapiens
cuggcaaagaacucauuuga

SEQ ID NO: 1774648 - RNA, 22 nt, Homo sapiens
uaaaauagccacuuaccuucaa

SEQ ID NO: 1774649 - RNA, 19 nt, Homo sapiens
acauuuguauuuugugaug

SEQ ID NO: 1774650 - RNA, 17 nt, Homo sapiens
aauggaauauaaauauc

SEQ ID NO: 1774651 - RNA, 21 nt, Homo sapiens
ucucugcuguccuaagaacuu

SEQ ID NO: 1774652 - RNA, 18 nt, Homo sapiens
cagagcaagcacuggacu

SEQ ID NO: 1774653 - RNA, 14 nt, Homo sapiens
cgccacgcuugugu

SEQ ID NO: 1774654 - RNA, 13 nt, Homo sapiens
uguccauuaucua

SEQ ID NO: 1774655 - RNA, 11 nt, Homo sapiens
ggacucuccaa

SEQ ID NO: 1774656 - RNA, 11 nt, Homo sapiens
ggccucuccac

SEQ ID NO: 1774657 - RNA, 20 nt, Homo sapiens
uauuuuuaaaaacaacuuaa

SEQ ID NO: 1774658 - RNA, 20 nt, Homo sapiens
ucacgaacuugaaaguuuuc

SEQ ID NO: 1774659 - RNA, 16 nt, Homo sapiens
uaaauccuaccaaagu

SEQ ID NO: 1774660 - RNA, 17 nt, Homo sapiens
aaacuuuagaguagcau

SEQ ID NO: 1774661 - RNA, 22 nt, Homo sapiens
agcuagccaggacacauuucca

SEQ ID NO: 1774662 - RNA, 20 nt, Homo sapiens
aauccuucuaacuaaacuaa

SEQ ID NO: 1774663 - RNA, 14 nt, Homo sapiens
gaaaagcugccauu

SEQ ID NO: 1774664 - RNA, 21 nt, Homo sapiens
gcaauaaaugcccucucugaa

SEQ ID NO: 1774665 - RNA, 13 nt, Homo sapiens
uauuaaaagacag

SEQ ID NO: 1774666 - RNA, 18 nt, Homo sapiens
uaugccuucacuacaaca

SEQ ID NO: 1774667 - RNA, 15 nt, Homo sapiens
aagaagagaaaauuu

SEQ ID NO: 1774668 - RNA, 17 nt, Homo sapiens
cuacuucuuuugcucuu

SEQ ID NO: 1774669 - RNA, 12 nt, Homo sapiens
cagggagcauuu

SEQ ID NO: 1774670 - RNA, 20 nt, Homo sapiens
gccuaugcaaaccagcuuua

SEQ ID NO: 1774671 - RNA, 19 nt, Homo sapiens
agaucgugccauugcacuc

SEQ ID NO: 1774672 - RNA, 19 nt, Homo sapiens
caccucggcacacacugug

SEQ ID NO: 1774673 - RNA, 20 nt, Homo sapiens
aggaacaguugcauuuagcu

SEQ ID NO: 1774674 - RNA, 18 nt, Homo sapiens
agaugucuguguauacau

SEQ ID NO: 1774675 - RNA, 17 nt, Homo sapiens
auggauguuugucaaaa

SEQ ID NO: 1774676 - RNA, 15 nt, Homo sapiens
agucauauauaugau

SEQ ID NO: 1774677 - RNA, 19 nt, Homo sapiens
gcccagucauauguucuca

SEQ ID NO: 1774678 - RNA, 18 nt, Homo sapiens
uaaaggcucgauuuugua

SEQ ID NO: 1774679 - RNA, 20 nt, Homo sapiens
aguauuuucuacuagccauu

SEQ ID NO: 1774680 - RNA, 19 nt, Homo sapiens
cuuauuuaaucuguacuau

SEQ ID NO: 1774681 - RNA, 17 nt, Homo sapiens
aagaaguccaugugaua

SEQ ID NO: 1774682 - RNA, 13 nt, Homo sapiens
ucauuuaccauaa

SEQ ID NO: 1774683 - RNA, 20 nt, Homo sapiens
cccaggccugggaugcagug

SEQ ID NO: 1774684 - RNA, 22 nt, Homo sapiens
aaacacaagugcgccuugcaaa

SEQ ID NO: 1774685 - RNA, 22 nt, Homo sapiens
cagccagucucagagaccagca

SEQ ID NO: 1774686 - RNA, 17 nt, Homo sapiens
cucaaaugcacaucuca

SEQ ID NO: 1774687 - RNA, 18 nt, Homo sapiens
cucauaccuacaucagac

SEQ ID NO: 1774688 - RNA, 16 nt, Homo sapiens
ugcuucaguugcauau

SEQ ID NO: 1774689 - RNA, 20 nt, Homo sapiens
agcacaacccccccaaaaca

SEQ ID NO: 1774690 - RNA, 19 nt, Homo sapiens
ggcuguuucuugucuguua

SEQ ID NO: 1774691 - RNA, 23 nt, Homo sapiens
uuaaaccaauugcugcuacuuau

SEQ ID NO: 1774692 - RNA, 20 nt, Homo sapiens
augaucucuuaggaagccuu

SEQ ID NO: 1774693 - RNA, 16 nt, Homo sapiens
uaucagagcucuuaau

SEQ ID NO: 1774694 - RNA, 19 nt, Homo sapiens
ucugaagauacaugucuuu

SEQ ID NO: 1774695 - RNA, 18 nt, Homo sapiens
caagggcacgugaaguca

SEQ ID NO: 1774696 - RNA, 15 nt, Homo sapiens
gguuagauaaugaau

SEQ ID NO: 1774697 - RNA, 14 nt, Homo sapiens
gcuagucacuggaa

SEQ ID NO: 1774698 - RNA, 15 nt, Homo sapiens
aaucucagccagccu

SEQ ID NO: 1774699 - RNA, 18 nt, Homo sapiens
agaagugcgaguccauug

SEQ ID NO: 1774700 - RNA, 20 nt, Homo sapiens
cugcugguuuugguuuccac

SEQ ID NO: 1774701 - RNA, 16 nt, Homo sapiens
ugaguaggaugucucu

SEQ ID NO: 1774702 - RNA, 20 nt, Homo sapiens
cuaccuguguucauucuuac

SEQ ID NO: 1774703 - RNA, 16 nt, Homo sapiens
agacaagugacuguau

SEQ ID NO: 1774704 - RNA, 17 nt, Homo sapiens
cggaggagaccagcuca

SEQ ID NO: 1774705 - RNA, 15 nt, Homo sapiens
gggagagccuuccag

SEQ ID NO: 1774706 - RNA, 16 nt, Homo sapiens
gaguucugaucuguac

SEQ ID NO: 1774707 - RNA, 21 nt, Homo sapiens
guucugagggguguccgagag

SEQ ID NO: 1774708 - RNA, 17 nt, Homo sapiens
augcacuaagacaagaa

SEQ ID NO: 1774709 - RNA, 17 nt, Homo sapiens
cuuaugaaguaaaguuu

SEQ ID NO: 1774710 - RNA, 16 nt, Homo sapiens
uuucccaggacaggaa

SEQ ID NO: 1774711 - RNA, 13 nt, Homo sapiens
aacuguuaaucag

SEQ ID NO: 1774712 - RNA, 13 nt, Homo sapiens
cagaauuacugua

SEQ ID NO: 1774713 - RNA, 16 nt, Homo sapiens
ugagacucugucucaa

SEQ ID NO: 1774714 - RNA, 16 nt, Homo sapiens
cuccaccuuccaaagg

SEQ ID NO: 1774715 - RNA, 23 nt, Homo sapiens
cgcauuuuugacagguugcugaa

SEQ ID NO: 1774716 - RNA, 19 nt, Homo sapiens
uuacaauuaaacucaaagc

SEQ ID NO: 1774717 - RNA, 18 nt, Homo sapiens
cugagaacuccucauucc

SEQ ID NO: 1774718 - RNA, 20 nt, Homo sapiens
aguuugacauuguauguauc

SEQ ID NO: 1774719 - RNA, 13 nt, Homo sapiens
ucaaaccaagaag

SEQ ID NO: 1774720 - RNA, 12 nt, Homo sapiens
uaauguugcuuu

SEQ ID NO: 1774721 - RNA, 19 nt, Homo sapiens
ccugcaauucuacaguuuc

SEQ ID NO: 1774722 - RNA, 17 nt, Homo sapiens
ccugaacuuucucuagc

SEQ ID NO: 1774723 - RNA, 13 nt, Homo sapiens
cgacaaagccaaa

SEQ ID NO: 1774724 - RNA, 14 nt, Homo sapiens
aaugggaagaccaa

SEQ ID NO: 1774725 - RNA, 16 nt, Homo sapiens
aaugaaauacuugaca

SEQ ID NO: 1774726 - RNA, 19 nt, Homo sapiens
auuuaauguauuaguccaa

SEQ ID NO: 1774727 - RNA, 17 nt, Homo sapiens
caggauggucucugcca

SEQ ID NO: 1774728 - RNA, 14 nt, Homo sapiens
aaauacuauuucaa

SEQ ID NO: 1774729 - RNA, 17 nt, Homo sapiens
accaagguggcuucucc

SEQ ID NO: 1774730 - RNA, 15 nt, Homo sapiens
uguguccugcaguuc

SEQ ID NO: 1774731 - RNA, 15 nt, Homo sapiens
aaaggaagaaaccau

SEQ ID NO: 1774732 - RNA, 15 nt, Homo sapiens
cuguggacaccacug

SEQ ID NO: 1774733 - RNA, 15 nt, Homo sapiens
uucauggauuuucca

SEQ ID NO: 1774734 - RNA, 18 nt, Homo sapiens
ugucaagcuuacuacagu

SEQ ID NO: 1774735 - RNA, 14 nt, Homo sapiens
uauguuacaauuaa

SEQ ID NO: 1774736 - RNA, 13 nt, Homo sapiens
aaaugguccuauu

SEQ ID NO: 1774737 - RNA, 11 nt, Homo sapiens
cagaugugcau

SEQ ID NO: 1774738 - RNA, 23 nt, Homo sapiens
aauuuaaaaaguuagccagguau

SEQ ID NO: 1774739 - RNA, 13 nt, Homo sapiens
ucuucacucacag

SEQ ID NO: 1774740 - RNA, 13 nt, Homo sapiens
cauucacuuccag

SEQ ID NO: 1774741 - RNA, 21 nt, Homo sapiens
aaaggauguuuugucccauuu

SEQ ID NO: 1774742 - RNA, 15 nt, Homo sapiens
aaaaccuuuacaguu

SEQ ID NO: 1774743 - RNA, 20 nt, Homo sapiens
cacgaaagaaauguaccuuc

SEQ ID NO: 1774744 - RNA, 23 nt, Homo sapiens
cuauucccugucacuacacacua

SEQ ID NO: 1774745 - RNA, 20 nt, Homo sapiens
uucugcagcaugaccuguga

SEQ ID NO: 1774746 - RNA, 22 nt, Homo sapiens
auggugagaugcagcuggaaaa

SEQ ID NO: 1774747 - RNA, 18 nt, Homo sapiens
ucaggaccacucaguuaa

SEQ ID NO: 1774748 - RNA, 22 nt, Homo sapiens
acuuuggaaccagacucuugcc

SEQ ID NO: 1774749 - RNA, 13 nt, Homo sapiens
ucacaaacaguug

SEQ ID NO: 1774750 - RNA, 16 nt, Homo sapiens
cagaaugaugagucca

SEQ ID NO: 1774751 - RNA, 15 nt, Homo sapiens
aaauaaaacuaagcu

SEQ ID NO: 1774752 - RNA, 17 nt, Homo sapiens
uucaagggaccucucca

SEQ ID NO: 1774753 - RNA, 17 nt, Homo sapiens
caugucuccucaugucu

SEQ ID NO: 1774754 - RNA, 15 nt, Homo sapiens
cauuuugagguuuug

SEQ ID NO: 1774755 - RNA, 18 nt, Homo sapiens
gucacagguuaauguggu

SEQ ID NO: 1774756 - RNA, 13 nt, Homo sapiens
gcgaggacgugaa

SEQ ID NO: 1774757 - RNA, 17 nt, Homo sapiens
caacaauaaagacugag

SEQ ID NO: 1774758 - RNA, 15 nt, Homo sapiens
auaauaaaaagcauu

SEQ ID NO: 1774759 - RNA, 17 nt, Homo sapiens
guaaauacaacacaucu

SEQ ID NO: 1774760 - RNA, 21 nt, Homo sapiens
aaguccccguggagguucugu

SEQ ID NO: 1774761 - RNA, 14 nt, Homo sapiens
cuagagcugggaaa

SEQ ID NO: 1774762 - RNA, 16 nt, Homo sapiens
gaggcaaauggcacug

SEQ ID NO: 1774763 - RNA, 22 nt, Homo sapiens
gaaguggaguugacucuggaag

SEQ ID NO: 1774764 - RNA, 18 nt, Homo sapiens
aauaucaagagagguuaa

SEQ ID NO: 1774765 - RNA, 18 nt, Homo sapiens
cucagcaguugacaucca

SEQ ID NO: 1774766 - RNA, 20 nt, Homo sapiens
ugggcuggaacgugaacuca

SEQ ID NO: 1774767 - RNA, 18 nt, Homo sapiens
ccagagaugccagcccuu

SEQ ID NO: 1774768 - RNA, 13 nt, Homo sapiens
acaagcuuuccaa

SEQ ID NO: 1774769 - RNA, 17 nt, Homo sapiens
ccuauuuucuuuuccau

SEQ ID NO: 1774770 - RNA, 15 nt, Homo sapiens
aggacccaggucugc

SEQ ID NO: 1774771 - RNA, 19 nt, Homo sapiens
aaauuguaucucagucuaa

SEQ ID NO: 1774772 - RNA, 20 nt, Homo sapiens
gcuuaacccauggauccuga

SEQ ID NO: 1774773 - RNA, 18 nt, Homo sapiens
uccagaguucugugacac

SEQ ID NO: 1774774 - RNA, 16 nt, Homo sapiens
cauaguagcaauggau

SEQ ID NO: 1774775 - RNA, 20 nt, Homo sapiens
cccagguugcugugggugca

SEQ ID NO: 1774776 - RNA, 23 nt, Homo sapiens
ccaaacccaguaaaacagauucu

SEQ ID NO: 1774777 - RNA, 14 nt, Homo sapiens
aagugucacuaaga

SEQ ID NO: 1774778 - RNA, 12 nt, Homo sapiens
uggcucagggag

SEQ ID NO: 1774779 - RNA, 18 nt, Homo sapiens
ucugaaccauuacuguaa

SEQ ID NO: 1774780 - RNA, 14 nt, Homo sapiens
ugaaucacaguaua

SEQ ID NO: 1774781 - RNA, 16 nt, Homo sapiens
uuccugagaccacaga

SEQ ID NO: 1774782 - RNA, 14 nt, Homo sapiens
gaaaguaugugaua

SEQ ID NO: 1774783 - RNA, 19 nt, Homo sapiens
cuaaggaacuaaaacuuga

SEQ ID NO: 1774784 - RNA, 22 nt, Homo sapiens
gcaucuggaaagggggggaaaa

SEQ ID NO: 1774785 - RNA, 17 nt, Homo sapiens
uccauccauuaccucca

SEQ ID NO: 1774786 - RNA, 14 nt, Homo sapiens
caaaugcccagcuu

SEQ ID NO: 1774787 - RNA, 18 nt, Homo sapiens
guucucgaacuccugacc

SEQ ID NO: 1774788 - RNA, 15 nt, Homo sapiens
uuggcaugaccucau

SEQ ID NO: 1774789 - RNA, 14 nt, Homo sapiens
cugcucgcucccug

SEQ ID NO: 1774790 - RNA, 18 nt, Homo sapiens
cucaaaccccugaccuca

SEQ ID NO: 1774791 - RNA, 22 nt, Homo sapiens
ucuucaucacuucuuccacugu

SEQ ID NO: 1774792 - RNA, 12 nt, Homo sapiens
cuuccuaagucu

SEQ ID NO: 1774793 - RNA, 15 nt, Homo sapiens
uugugugagugcaug

SEQ ID NO: 1774794 - RNA, 17 nt, Homo sapiens
cauaugauuguccguga

SEQ ID NO: 1774795 - RNA, 22 nt, Homo sapiens
aaaaggauguuacaaguuugcu

SEQ ID NO: 1774796 - RNA, 19 nt, Homo sapiens
aacugaauugcuaucauuu

SEQ ID NO: 1774797 - RNA, 14 nt, Homo sapiens
gcuuacuaaugugc

SEQ ID NO: 1774798 - RNA, 14 nt, Homo sapiens
caaagcaugugaau

SEQ ID NO: 1774799 - RNA, 17 nt, Homo sapiens
aaaacugucauuuagcu

SEQ ID NO: 1774800 - RNA, 20 nt, Homo sapiens
cuggccccacaagccaggac

SEQ ID NO: 1774801 - RNA, 14 nt, Homo sapiens
accauaauguuaca

SEQ ID NO: 1774802 - RNA, 21 nt, Homo sapiens
acagaggaaggccuccugagg

SEQ ID NO: 1774803 - RNA, 13 nt, Homo sapiens
gccuguugccucg

SEQ ID NO: 1774804 - RNA, 23 nt, Homo sapiens
uaauaaaggccuuauucauuuca

SEQ ID NO: 1774805 - RNA, 12 nt, Homo sapiens
cugaaucucaua

SEQ ID NO: 1774806 - RNA, 20 nt, Homo sapiens
cacgugaacuaugcaauuua

SEQ ID NO: 1774807 - RNA, 16 nt, Homo sapiens
aaagucuacacugccu

SEQ ID NO: 1774808 - RNA, 11 nt, Homo sapiens
uuaaagucaau

SEQ ID NO: 1774809 - RNA, 18 nt, Homo sapiens
gccgacaucagcccggug

SEQ ID NO: 1774810 - RNA, 20 nt, Homo sapiens
agcccugggguuugaagcug

SEQ ID NO: 1774811 - RNA, 14 nt, Homo sapiens
uauaauauuuacug

SEQ ID NO: 1774812 - RNA, 14 nt, Homo sapiens
uaaaauauuuucug

SEQ ID NO: 1774813 - RNA, 21 nt, Homo sapiens
aucaagaauggggaucacaga

SEQ ID NO: 1774814 - RNA, 21 nt, Homo sapiens
agccucugcuuccguacuaug

SEQ ID NO: 1774815 - RNA, 18 nt, Homo sapiens
uauuaaagaauaagcugu

SEQ ID NO: 1774816 - RNA, 19 nt, Homo sapiens
ccugugguuacagugcaga

SEQ ID NO: 1774817 - RNA, 18 nt, Homo sapiens
cuagagaaggcauuucau

SEQ ID NO: 1774818 - RNA, 17 nt, Homo sapiens
uuaggggaagugacaag

SEQ ID NO: 1774819 - RNA, 15 nt, Homo sapiens
gaaagaacuaugaaa

SEQ ID NO: 1774820 - RNA, 20 nt, Homo sapiens
auuuacauuuaauacagaua

SEQ ID NO: 1774821 - RNA, 14 nt, Homo sapiens
cugugaucaagcaa

SEQ ID NO: 1774822 - RNA, 23 nt, Homo sapiens
cugagaauuauagaugggguuca

SEQ ID NO: 1774823 - RNA, 21 nt, Homo sapiens
auucauuaccuguuuauucuc

SEQ ID NO: 1774824 - RNA, 18 nt, Homo sapiens
ucacucuucaaaugccug

SEQ ID NO: 1774825 - RNA, 16 nt, Homo sapiens
acacacaccuagccag

SEQ ID NO: 1774826 - RNA, 16 nt, Homo sapiens
ucuaggcuaagcacuu

SEQ ID NO: 1774827 - RNA, 13 nt, Homo sapiens
agcccgucucagu

SEQ ID NO: 1774828 - RNA, 19 nt, Homo sapiens
uaaagugacccugcucuca

SEQ ID NO: 1774829 - RNA, 17 nt, Homo sapiens
gucccagaaugacccca

SEQ ID NO: 1774830 - RNA, 14 nt, Homo sapiens
ugcuauagacauua

SEQ ID NO: 1774831 - RNA, 18 nt, Homo sapiens
ugcauucaaccuuaccaa

SEQ ID NO: 1774832 - RNA, 14 nt, Homo sapiens
gggaagcccugacu

SEQ ID NO: 1774833 - RNA, 12 nt, Homo sapiens
cucccaaagugc

SEQ ID NO: 1774834 - RNA, 17 nt, Homo sapiens
uucguggaaggcuguau

SEQ ID NO: 1774835 - RNA, 15 nt, Homo sapiens
uccaaaugagccaca

SEQ ID NO: 1774836 - RNA, 13 nt, Homo sapiens
acacugugcuaua

SEQ ID NO: 1774837 - RNA, 17 nt, Homo sapiens
accugaauuaaagucua

SEQ ID NO: 1774838 - RNA, 19 nt, Homo sapiens
ugccagccccgccacgcuu

SEQ ID NO: 1774839 - RNA, 15 nt, Homo sapiens
ugacuaacuuuuuga

SEQ ID NO: 1774840 - RNA, 14 nt, Homo sapiens
gccaccgcacucca

SEQ ID NO: 1774841 - RNA, 18 nt, Homo sapiens
agaagauagggaacacuc

SEQ ID NO: 1774842 - RNA, 19 nt, Homo sapiens
gagauugcacagucaaaac

SEQ ID NO: 1774843 - RNA, 19 nt, Homo sapiens
acccaggcuggagugcaga

SEQ ID NO: 1774844 - RNA, 18 nt, Homo sapiens
cugccacagguaacauga

SEQ ID NO: 1774845 - RNA, 18 nt, Homo sapiens
auguuuuuagaggacuau

SEQ ID NO: 1774846 - RNA, 15 nt, Homo sapiens
agaggcucugagaaa

SEQ ID NO: 1774847 - RNA, 14 nt, Homo sapiens
uccaguuugcccac

SEQ ID NO: 1774848 - RNA, 13 nt, Homo sapiens
gcaugcuucucac

SEQ ID NO: 1774849 - RNA, 19 nt, Homo sapiens
agcuacuugggagguugaa

SEQ ID NO: 1774850 - RNA, 15 nt, Homo sapiens
uccagauauuucaca

SEQ ID NO: 1774851 - RNA, 24 nt, Homo sapiens
aaagcaacugguuagguagcaaca

SEQ ID NO: 1774852 - RNA, 13 nt, Homo sapiens
ucuaagugcugcu

SEQ ID NO: 1774853 - RNA, 22 nt, Homo sapiens
aggggaucuaaaaggaggacag

SEQ ID NO: 1774854 - RNA, 17 nt, Homo sapiens
auguguguuuucuaaua

SEQ ID NO: 1774855 - RNA, 15 nt, Homo sapiens
cuuauaagaauuaau

SEQ ID NO: 1774856 - RNA, 23 nt, Homo sapiens
caaacacugcuuaaggaaaagag

SEQ ID NO: 1774857 - RNA, 17 nt, Homo sapiens
agagggcagucuagucc

SEQ ID NO: 1774858 - RNA, 16 nt, Homo sapiens
auuugcuugcaaucua

SEQ ID NO: 1774859 - RNA, 19 nt, Homo sapiens
ucagcuguaguccucauaa

SEQ ID NO: 1774860 - RNA, 23 nt, Homo sapiens
caugucuggacucacggagcuca

SEQ ID NO: 1774861 - RNA, 22 nt, Homo sapiens
aagauagggaacacucaucccu

SEQ ID NO: 1774862 - RNA, 13 nt, Homo sapiens
gcucaccaagaag

SEQ ID NO: 1774863 - RNA, 22 nt, Homo sapiens
aaagggagcagagaaggccagg

SEQ ID NO: 1774864 - RNA, 22 nt, Homo sapiens
gcaucccaaaccacgccucuug

SEQ ID NO: 1774865 - RNA, 13 nt, Homo sapiens
aauauuucacuua

SEQ ID NO: 1774866 - RNA, 19 nt, Homo sapiens
cuuguaaaagacaguguau

SEQ ID NO: 1774867 - RNA, 15 nt, Homo sapiens
caauccuagugcuuu

SEQ ID NO: 1774868 - RNA, 20 nt, Homo sapiens
uuaauugaucgacuugccaa

SEQ ID NO: 1774869 - RNA, 15 nt, Homo sapiens
aucuccauacuuugg

SEQ ID NO: 1774870 - RNA, 21 nt, Homo sapiens
aacuuaauacaaaacugugaa

SEQ ID NO: 1774871 - RNA, 20 nt, Homo sapiens
acaguaaguaguaaugauuc

SEQ ID NO: 1774872 - RNA, 13 nt, Homo sapiens
uaauuuuguagua

SEQ ID NO: 1774873 - RNA, 17 nt, Homo sapiens
aauacagaacccauucc

SEQ ID NO: 1774874 - RNA, 15 nt, Homo sapiens
agcucuggguugugc

SEQ ID NO: 1774875 - RNA, 15 nt, Homo sapiens
uuuaauagcgucaua

SEQ ID NO: 1774876 - RNA, 23 nt, Homo sapiens
caagauacuugaacacuguguuu

SEQ ID NO: 1774877 - RNA, 15 nt, Homo sapiens
acaccuagcuuuauu

SEQ ID NO: 1774878 - RNA, 13 nt, Homo sapiens
gauagagugcagu

SEQ ID NO: 1774879 - RNA, 21 nt, Homo sapiens
acaaaucugcaccccacuuca

SEQ ID NO: 1774880 - RNA, 20 nt, Homo sapiens
acggcaacugccuuccugcc

SEQ ID NO: 1774881 - RNA, 20 nt, Homo sapiens
uguacaaauguaaauagaua

SEQ ID NO: 1774882 - RNA, 14 nt, Homo sapiens
uaauuauuugaaca

SEQ ID NO: 1774883 - RNA, 15 nt, Homo sapiens
aguuguucuguuaac

SEQ ID NO: 1774884 - RNA, 19 nt, Homo sapiens
acauuucuaucaguacuuu

SEQ ID NO: 1774885 - RNA, 20 nt, Homo sapiens
ccauuuguguacacagucag

SEQ ID NO: 1774886 - RNA, 21 nt, Homo sapiens
gagagaacagggaugcuaucu

SEQ ID NO: 1774887 - RNA, 20 nt, Homo sapiens
acaaugggcacugauuugau

SEQ ID NO: 1774888 - RNA, 19 nt, Homo sapiens
ucaagcagagaaaauaauu

SEQ ID NO: 1774889 - RNA, 16 nt, Homo sapiens
uucaugaaaaucugcc

SEQ ID NO: 1774890 - RNA, 15 nt, Homo sapiens
cguuucaaaaacaca

SEQ ID NO: 1774891 - RNA, 19 nt, Homo sapiens
ugcuguauacuguacugag

SEQ ID NO: 1774892 - RNA, 18 nt, Homo sapiens
cagauugaauauauauga

SEQ ID NO: 1774893 - RNA, 15 nt, Homo sapiens
caagacuccaucuca

SEQ ID NO: 1774894 - RNA, 15 nt, Homo sapiens
cgagacuccgucuca

SEQ ID NO: 1774895 - RNA, 15 nt, Homo sapiens
cccauaguaaugagu

SEQ ID NO: 1774896 - RNA, 13 nt, Homo sapiens
uggggcugccaua

SEQ ID NO: 1774897 - RNA, 15 nt, Homo sapiens
aucacacacaugcac

SEQ ID NO: 1774898 - RNA, 18 nt, Homo sapiens
uugccagagaaacuaacu

SEQ ID NO: 1774899 - RNA, 19 nt, Homo sapiens
uaaaggaaaaucacaucuc

SEQ ID NO: 1774900 - RNA, 17 nt, Homo sapiens
uaccacauuccaugacg

SEQ ID NO: 1774901 - RNA, 13 nt, Homo sapiens
aaauugugccaaa

SEQ ID NO: 1774902 - RNA, 16 nt, Homo sapiens
auccuagugggcacuu

SEQ ID NO: 1774903 - RNA, 19 nt, Homo sapiens
auguguuuucagucuuucu

SEQ ID NO: 1774904 - RNA, 14 nt, Homo sapiens
ugacagugccucuu

SEQ ID NO: 1774905 - RNA, 23 nt, Homo sapiens
uugaaacauacagaauguucuau

SEQ ID NO: 1774906 - RNA, 16 nt, Homo sapiens
uggacgcacacagcuu

SEQ ID NO: 1774907 - RNA, 13 nt, Homo sapiens
uuugccugugauu

SEQ ID NO: 1774908 - RNA, 15 nt, Homo sapiens
aaagccuucaagaug

SEQ ID NO: 1774909 - RNA, 21 nt, Homo sapiens
ugugugggauaaugucauuaa

SEQ ID NO: 1774910 - RNA, 18 nt, Homo sapiens
ucucaggacagaaccacu

SEQ ID NO: 1774911 - RNA, 11 nt, Homo sapiens
uugccaaaaac

SEQ ID NO: 1774912 - RNA, 24 nt, Homo sapiens
ucaaaauuccauuuacuugaucau

SEQ ID NO: 1774913 - RNA, 19 nt, Homo sapiens
ggaugcagcaccucucagg

SEQ ID NO: 1774914 - RNA, 12 nt, Homo sapiens
auccacaaagua

SEQ ID NO: 1774915 - RNA, 24 nt, Homo sapiens
acuguccagagagcaacucugaga

SEQ ID NO: 1774916 - RNA, 13 nt, Homo sapiens
uuacccuuaggga

SEQ ID NO: 1774917 - RNA, 21 nt, Homo sapiens
ccucucacuaaguaugaucua

SEQ ID NO: 1774918 - RNA, 14 nt, Homo sapiens
aguccauuguggag

SEQ ID NO: 1774919 - RNA, 15 nt, Homo sapiens
aaauacucaugugua

SEQ ID NO: 1774920 - RNA, 20 nt, Homo sapiens
uuaaggcaaugguuucacau

SEQ ID NO: 1774921 - RNA, 14 nt, Homo sapiens
gacugaaaagccau

SEQ ID NO: 1774922 - RNA, 21 nt, Homo sapiens
gauucugggaaaggugcucaa

SEQ ID NO: 1774923 - RNA, 22 nt, Homo sapiens
uuaccuuuuauuuuaauguuuc

SEQ ID NO: 1774924 - RNA, 20 nt, Homo sapiens
aaccggucccuuccaugccc

SEQ ID NO: 1774925 - RNA, 19 nt, Homo sapiens
cucaaggacuuugcagccg

SEQ ID NO: 1774926 - RNA, 11 nt, Homo sapiens
caccaucucac

SEQ ID NO: 1774927 - RNA, 15 nt, Homo sapiens
gacaguacacuguca

SEQ ID NO: 1774928 - RNA, 12 nt, Homo sapiens
acucagcacuuu

SEQ ID NO: 1774929 - RNA, 13 nt, Homo sapiens
gacugcacccagg

SEQ ID NO: 1774930 - RNA, 17 nt, Homo sapiens
ccuucggcagcuacuca

SEQ ID NO: 1774931 - RNA, 13 nt, Homo sapiens
caagguccaagau

SEQ ID NO: 1774932 - RNA, 22 nt, Homo sapiens
augacuucacccacgcauauac

SEQ ID NO: 1774933 - RNA, 18 nt, Homo sapiens
accugucaccucuguucc

SEQ ID NO: 1774934 - RNA, 11 nt, Homo sapiens
uucucauggcu

SEQ ID NO: 1774935 - RNA, 13 nt, Homo sapiens
agggcaggagcuu

SEQ ID NO: 1774936 - RNA, 15 nt, Homo sapiens
augugcaaaggcauc

SEQ ID NO: 1774937 - RNA, 22 nt, Homo sapiens
aauaauagacacuggagacuug

SEQ ID NO: 1774938 - RNA, 15 nt, Homo sapiens
cugacucuggccuua

SEQ ID NO: 1774939 - RNA, 15 nt, Homo sapiens
gacuauuuuauauga

SEQ ID NO: 1774940 - RNA, 15 nt, Homo sapiens
gcaaugcugaugaau

SEQ ID NO: 1774941 - RNA, 15 nt, Homo sapiens
uuugcuuucugcuca

SEQ ID NO: 1774942 - RNA, 13 nt, Homo sapiens
gagucauggucag

SEQ ID NO: 1774943 - RNA, 17 nt, Homo sapiens
cauuucuucagucagaa

SEQ ID NO: 1774944 - RNA, 18 nt, Homo sapiens
agcgaucccuccccucag

SEQ ID NO: 1774945 - RNA, 21 nt, Homo sapiens
ucuucguagguugugaugaua

SEQ ID NO: 1774946 - RNA, 19 nt, Homo sapiens
cacugggcucugauggcug

SEQ ID NO: 1774947 - RNA, 14 nt, Homo sapiens
cacucuccaaacag

SEQ ID NO: 1774948 - RNA, 14 nt, Homo sapiens
gcauugcauggaca

SEQ ID NO: 1774949 - RNA, 14 nt, Homo sapiens
gguuucucuguaua

SEQ ID NO: 1774950 - RNA, 14 nt, Homo sapiens
aagcaauaauaauu

SEQ ID NO: 1774951 - RNA, 14 nt, Homo sapiens
gaacuuuagugaaa

SEQ ID NO: 1774952 - RNA, 13 nt, Homo sapiens
agacugagcucuc

SEQ ID NO: 1774953 - RNA, 23 nt, Homo sapiens
aagacuggacauuuaacuuuucu

SEQ ID NO: 1774954 - RNA, 13 nt, Homo sapiens
ggcuggauccuau

SEQ ID NO: 1774955 - RNA, 14 nt, Homo sapiens
gcaucuuuccugcc

SEQ ID NO: 1774956 - RNA, 18 nt, Homo sapiens
gaacugguccaggccagg

SEQ ID NO: 1774957 - RNA, 19 nt, Homo sapiens
aauuuguucagucuuucau

SEQ ID NO: 1774958 - RNA, 18 nt, Homo sapiens
aacguaggugugacacuu

SEQ ID NO: 1774959 - RNA, 23 nt, Homo sapiens
augaagugcuacagaaagcacaa

SEQ ID NO: 1774960 - RNA, 13 nt, Homo sapiens
ucagggucacugu

SEQ ID NO: 1774961 - RNA, 13 nt, Homo sapiens
ucagugucacugg

SEQ ID NO: 1774962 - RNA, 16 nt, Homo sapiens
ucagacugccaaagaa

SEQ ID NO: 1774963 - RNA, 22 nt, Homo sapiens
cucgagaucauucuucacucag

SEQ ID NO: 1774964 - RNA, 19 nt, Homo sapiens
caaauggcuuguucaguca

SEQ ID NO: 1774965 - RNA, 17 nt, Homo sapiens
gcccuugaagacuuccc

SEQ ID NO: 1774966 - RNA, 14 nt, Homo sapiens
aaauagcagcuuua

SEQ ID NO: 1774967 - RNA, 19 nt, Homo sapiens
gcaauacguuugugcagaa

SEQ ID NO: 1774968 - RNA, 20 nt, Homo sapiens
ccgugaagggauuucuuaau

SEQ ID NO: 1774969 - RNA, 22 nt, Homo sapiens
ucaccucagggguuaagagcuc

SEQ ID NO: 1774970 - RNA, 17 nt, Homo sapiens
aggaagaugggggcaag

SEQ ID NO: 1774971 - RNA, 16 nt, Homo sapiens
gcauaaauuacaguca

SEQ ID NO: 1774972 - RNA, 20 nt, Homo sapiens
acacaggauggucucugcca

SEQ ID NO: 1774973 - RNA, 22 nt, Homo sapiens
cuaaaauuguaucaaaugugac

SEQ ID NO: 1774974 - RNA, 15 nt, Homo sapiens
ucaaguuccagugca

SEQ ID NO: 1774975 - RNA, 20 nt, Homo sapiens
ccucauuguuggaguguaaa

SEQ ID NO: 1774976 - RNA, 23 nt, Homo sapiens
cuaaucuuaacccugugcuguca

SEQ ID NO: 1774977 - RNA, 9 nt, Homo sapiens
aauugagau

SEQ ID NO: 1774978 - RNA, 17 nt, Homo sapiens
cgcauccccugccucca

SEQ ID NO: 1774979 - RNA, 23 nt, Homo sapiens
uugaggugguaguaaaacacaga

SEQ ID NO: 1774980 - RNA, 16 nt, Homo sapiens
uauuuuuguacguuau

SEQ ID NO: 1774981 - RNA, 18 nt, Homo sapiens
uucacuugaugauacaau

SEQ ID NO: 1774982 - RNA, 16 nt, Homo sapiens
gagggcagaucacuuc

SEQ ID NO: 1774983 - RNA, 11 nt, Homo sapiens
augcacuucaa

SEQ ID NO: 1774984 - RNA, 14 nt, Homo sapiens
auauguucauuaaa

SEQ ID NO: 1774985 - RNA, 19 nt, Homo sapiens
cuaaagaagacacacagcc

SEQ ID NO: 1774986 - RNA, 12 nt, Homo sapiens
uucaacacagcu

SEQ ID NO: 1774987 - RNA, 14 nt, Homo sapiens
uugccgcauauuau

SEQ ID NO: 1774988 - RNA, 22 nt, Homo sapiens
uucugcaggcuucagccaucca

SEQ ID NO: 1774989 - RNA, 17 nt, Homo sapiens
caccuucugccaugauu

SEQ ID NO: 1774990 - RNA, 15 nt, Homo sapiens
augugcaaccacugc

SEQ ID NO: 1774991 - RNA, 13 nt, Homo sapiens
uauuuucuguuga

SEQ ID NO: 1774992 - RNA, 22 nt, Homo sapiens
uggaauugacugccuaugccaa

SEQ ID NO: 1774993 - RNA, 14 nt, Homo sapiens
acuuuaacagucua

SEQ ID NO: 1774994 - RNA, 21 nt, Homo sapiens
ucggccguacaucucugugag

SEQ ID NO: 1774995 - RNA, 11 nt, Homo sapiens
acaguggaauc

SEQ ID NO: 1774996 - RNA, 20 nt, Homo sapiens
cuccuacauaucccuuccag

SEQ ID NO: 1774997 - RNA, 16 nt, Homo sapiens
cuggaaugggcacagc

SEQ ID NO: 1774998 - RNA, 17 nt, Homo sapiens
aguuaaugucagugaca

SEQ ID NO: 1774999 - RNA, 18 nt, Homo sapiens
ccgcagggcgcuccggca

SEQ ID NO: 1775000 - RNA, 14 nt, Homo sapiens
cuuccaacauguga

SEQ ID NO: 1775001 - RNA, 16 nt, Homo sapiens
aaggccaucugcuuac

SEQ ID NO: 1775002 - RNA, 17 nt, Homo sapiens
acaucguuguuuugcug

SEQ ID NO: 1775003 - RNA, 17 nt, Homo sapiens
cuuacauuuaaaagaca

SEQ ID NO: 1775004 - RNA, 13 nt, Homo sapiens
aauacuaguauua

SEQ ID NO: 1775005 - RNA, 18 nt, Homo sapiens
auguauuuucaguuacaa

SEQ ID NO: 1775006 - RNA, 18 nt, Homo sapiens
cugugaagcccuuugccu

SEQ ID NO: 1775007 - RNA, 13 nt, Homo sapiens
uccaucucucauc

SEQ ID NO: 1775008 - RNA, 23 nt, Homo sapiens
ccuggcagcuuuuucaaaguguu

SEQ ID NO: 1775009 - RNA, 18 nt, Homo sapiens
acauuuucaauaauguga

SEQ ID NO: 1775010 - RNA, 19 nt, Homo sapiens
caauaguaauucucaggcc

SEQ ID NO: 1775011 - RNA, 22 nt, Homo sapiens
aagaacuguugccuaauuggaa

SEQ ID NO: 1775012 - RNA, 14 nt, Homo sapiens
gacgucuucuaggg

SEQ ID NO: 1775013 - RNA, 21 nt, Homo sapiens
gaggcagaauggugggcucca

SEQ ID NO: 1775014 - RNA, 20 nt, Homo sapiens
ccuucuggccucugcugaau

SEQ ID NO: 1775015 - RNA, 14 nt, Homo sapiens
caugucagacacag

SEQ ID NO: 1775016 - RNA, 15 nt, Homo sapiens
uaaaauuucuaagag

SEQ ID NO: 1775017 - RNA, 14 nt, Homo sapiens
aguugguggggcca

SEQ ID NO: 1775018 - RNA, 12 nt, Homo sapiens
acuaaugcuuua

SEQ ID NO: 1775019 - RNA, 16 nt, Homo sapiens
ugcaacugcuacugac

SEQ ID NO: 1775020 - RNA, 16 nt, Homo sapiens
guaauguucauuuccc

SEQ ID NO: 1775021 - RNA, 15 nt, Homo sapiens
ccacucaggccaaca

SEQ ID NO: 1775022 - RNA, 19 nt, Homo sapiens
auuuuauugucagaauuua

SEQ ID NO: 1775023 - RNA, 18 nt, Homo sapiens
caagccucaaagucccuu

SEQ ID NO: 1775024 - RNA, 12 nt, Homo sapiens
uucaaguuuaca

SEQ ID NO: 1775025 - RNA, 19 nt, Homo sapiens
cauauggacucugcacaug

SEQ ID NO: 1775026 - RNA, 22 nt, Homo sapiens
caucaaggagaauguacuggcg

SEQ ID NO: 1775027 - RNA, 22 nt, Homo sapiens
ugaaguggucugaauucuggaa

SEQ ID NO: 1775028 - RNA, 14 nt, Homo sapiens
gugugaagugcaga

SEQ ID NO: 1775029 - RNA, 15 nt, Homo sapiens
cacacgccuguaauc

SEQ ID NO: 1775030 - RNA, 22 nt, Homo sapiens
aaucgaggugugggccagagau

SEQ ID NO: 1775031 - RNA, 20 nt, Homo sapiens
cauuugaagaggagaacaaa

SEQ ID NO: 1775032 - RNA, 12 nt, Homo sapiens
ccacagccugcu

SEQ ID NO: 1775033 - RNA, 20 nt, Homo sapiens
uugacauugcuuuacuguca

SEQ ID NO: 1775034 - RNA, 13 nt, Homo sapiens
auaugucuagaua

SEQ ID NO: 1775035 - RNA, 18 nt, Homo sapiens
cuaccauuugaauuugug

SEQ ID NO: 1775036 - RNA, 12 nt, Homo sapiens
uggacacagcuc

SEQ ID NO: 1775037 - RNA, 17 nt, Homo sapiens
gcuucuacagacuguag

SEQ ID NO: 1775038 - RNA, 17 nt, Homo sapiens
ugugcuggugggggccu

SEQ ID NO: 1775039 - RNA, 14 nt, Homo sapiens
auguauacuugaaa

SEQ ID NO: 1775040 - RNA, 21 nt, Homo sapiens
agacggagucucgcucuguca

SEQ ID NO: 1775041 - RNA, 22 nt, Homo sapiens
agauaccuggugagcucagaua

SEQ ID NO: 1775042 - RNA, 16 nt, Homo sapiens
ccuuaagggaaaggua

SEQ ID NO: 1775043 - RNA, 19 nt, Homo sapiens
guugaaagacaucaaugaa

SEQ ID NO: 1775044 - RNA, 17 nt, Homo sapiens
guugggcuagauuacag

SEQ ID NO: 1775045 - RNA, 15 nt, Homo sapiens
gugcggcggucccag

SEQ ID NO: 1775046 - RNA, 22 nt, Homo sapiens
aauaauuuccuucaggcagcug

SEQ ID NO: 1775047 - RNA, 18 nt, Homo sapiens
ugccaugacaacuucuaa

SEQ ID NO: 1775048 - RNA, 11 nt, Homo sapiens
auucugaccau

SEQ ID NO: 1775049 - RNA, 18 nt, Homo sapiens
cccucauucuacugaaaa

SEQ ID NO: 1775050 - RNA, 12 nt, Homo sapiens
aaaucuuccaau

SEQ ID NO: 1775051 - RNA, 15 nt, Homo sapiens
auauggacacuguga

SEQ ID NO: 1775052 - RNA, 15 nt, Homo sapiens
auauguccacuguuc

SEQ ID NO: 1775053 - RNA, 19 nt, Homo sapiens
uccaacuccugaccucagg

SEQ ID NO: 1775054 - RNA, 17 nt, Homo sapiens
caguuuauaaagccaag

SEQ ID NO: 1775055 - RNA, 23 nt, Homo sapiens
guggccaugccucagcccugacc

SEQ ID NO: 1775056 - RNA, 12 nt, Homo sapiens
aaugaggcacau

SEQ ID NO: 1775057 - RNA, 19 nt, Homo sapiens
ccauuugcguuccaugaug

SEQ ID NO: 1775058 - RNA, 18 nt, Homo sapiens
cuccaagucuguaccuca

SEQ ID NO: 1775059 - RNA, 18 nt, Homo sapiens
ggcccaggaauuagagaa

SEQ ID NO: 1775060 - RNA, 18 nt, Homo sapiens
cuccagcuucgaugaugu

SEQ ID NO: 1775061 - RNA, 17 nt, Homo sapiens
caucaauaaaggggaau

SEQ ID NO: 1775062 - RNA, 15 nt, Homo sapiens
agggguuucagaauu

SEQ ID NO: 1775063 - RNA, 17 nt, Homo sapiens
aguacaggucaucugcu

SEQ ID NO: 1775064 - RNA, 16 nt, Homo sapiens
uuaaauuuuaaacaau

SEQ ID NO: 1775065 - RNA, 19 nt, Homo sapiens
ucacauacauaagcagcau

SEQ ID NO: 1775066 - RNA, 13 nt, Homo sapiens
acugacgcuggag

SEQ ID NO: 1775067 - RNA, 17 nt, Homo sapiens
auucuuucccaacaccu

SEQ ID NO: 1775068 - RNA, 15 nt, Homo sapiens
ccugcccuuccucag

SEQ ID NO: 1775069 - RNA, 15 nt, Homo sapiens
cauguaguuacuucc

SEQ ID NO: 1775070 - RNA, 21 nt, Homo sapiens
uugaaacuuugggaaaacaug

SEQ ID NO: 1775071 - RNA, 13 nt, Homo sapiens
cggcuuccaggga

SEQ ID NO: 1775072 - RNA, 14 nt, Homo sapiens
cacugaacaaaacc

SEQ ID NO: 1775073 - RNA, 12 nt, Homo sapiens
gcagagcuggug

SEQ ID NO: 1775074 - RNA, 18 nt, Homo sapiens
ccucagaucuuugcacca

SEQ ID NO: 1775075 - RNA, 13 nt, Homo sapiens
ggccacacguguc

SEQ ID NO: 1775076 - RNA, 17 nt, Homo sapiens
cagaugaccguguacaa

SEQ ID NO: 1775077 - RNA, 13 nt, Homo sapiens
cgauucacuccuu

SEQ ID NO: 1775078 - RNA, 23 nt, Homo sapiens
agccagcuuggggccaccaaagc

SEQ ID NO: 1775079 - RNA, 14 nt, Homo sapiens
agcauccaguguga

SEQ ID NO: 1775080 - RNA, 21 nt, Homo sapiens
caggguuacaaaucuucuuga

SEQ ID NO: 1775081 - RNA, 16 nt, Homo sapiens
uauuucuaguuauuac

SEQ ID NO: 1775082 - RNA, 20 nt, Homo sapiens
uagugggagguugugcaugg

SEQ ID NO: 1775083 - RNA, 17 nt, Homo sapiens
cugcacugaucacccaa

SEQ ID NO: 1775084 - RNA, 13 nt, Homo sapiens
ccucuaaaacccu

SEQ ID NO: 1775085 - RNA, 16 nt, Homo sapiens
aucacagccucacccc

SEQ ID NO: 1775086 - RNA, 13 nt, Homo sapiens
aagcuaaguagaa

SEQ ID NO: 1775087 - RNA, 15 nt, Homo sapiens
uguacuacauuugca

SEQ ID NO: 1775088 - RNA, 18 nt, Homo sapiens
ucuaaaacaaucugucca

SEQ ID NO: 1775089 - RNA, 14 nt, Homo sapiens
aguauuacaugauu

SEQ ID NO: 1775090 - RNA, 19 nt, Homo sapiens
ccuucucuuuaaugccuag

SEQ ID NO: 1775091 - RNA, 20 nt, Homo sapiens
cugagcccccugcacccacc

SEQ ID NO: 1775092 - RNA, 15 nt, Homo sapiens
accugugcaccuacc

SEQ ID NO: 1775093 - RNA, 15 nt, Homo sapiens
ucaaaugcucaagcc

SEQ ID NO: 1775094 - RNA, 20 nt, Homo sapiens
auuucuuuguuauacauuua

SEQ ID NO: 1775095 - RNA, 16 nt, Homo sapiens
gagccacaacacccag

SEQ ID NO: 1775096 - RNA, 12 nt, Homo sapiens
ccaagucagcag

SEQ ID NO: 1775097 - RNA, 14 nt, Homo sapiens
ucgagucuaccucu

SEQ ID NO: 1775098 - RNA, 17 nt, Homo sapiens
auaaaucauauucucau

SEQ ID NO: 1775099 - RNA, 15 nt, Homo sapiens
auacuaggugccuuu

SEQ ID NO: 1775100 - RNA, 15 nt, Homo sapiens
uaauacuuuuccaca

SEQ ID NO: 1775101 - RNA, 15 nt, Homo sapiens
guaaugaaacuugga

SEQ ID NO: 1775102 - RNA, 22 nt, Homo sapiens
uugcauuccuuacuugcacugu

SEQ ID NO: 1775103 - RNA, 23 nt, Homo sapiens
aagagcuaagauaaagacugugg

SEQ ID NO: 1775104 - RNA, 15 nt, Homo sapiens
caauccugucauaua

SEQ ID NO: 1775105 - RNA, 13 nt, Homo sapiens
cuuucuguuuccu

SEQ ID NO: 1775106 - RNA, 17 nt, Homo sapiens
ccuggcccgggccuaug

SEQ ID NO: 1775107 - RNA, 17 nt, Homo sapiens
agaauauaauacuguau

SEQ ID NO: 1775108 - RNA, 17 nt, Homo sapiens
uaaaaaaaacaauucca

SEQ ID NO: 1775109 - RNA, 17 nt, Homo sapiens
augacaagcaucaguag

SEQ ID NO: 1775110 - RNA, 17 nt, Homo sapiens
acaaaccauuaccugua

SEQ ID NO: 1775111 - RNA, 15 nt, Homo sapiens
cagcgggagcacugc

SEQ ID NO: 1775112 - RNA, 20 nt, Homo sapiens
ucugucccauucccugggau

SEQ ID NO: 1775113 - RNA, 15 nt, Homo sapiens
acaaaaucacagcac

SEQ ID NO: 1775114 - RNA, 13 nt, Homo sapiens
cagaagugagcuc

SEQ ID NO: 1775115 - RNA, 21 nt, Homo sapiens
gccuuuagaguuccaugaaca

SEQ ID NO: 1775116 - RNA, 19 nt, Homo sapiens
cugugugaugaacuuucuc

SEQ ID NO: 1775117 - RNA, 19 nt, Homo sapiens
ucuaguaucacuuuugcug

SEQ ID NO: 1775118 - RNA, 19 nt, Homo sapiens
gcaaucuuguccacagucu

SEQ ID NO: 1775119 - RNA, 16 nt, Homo sapiens
uuacuaagcauagcaa

SEQ ID NO: 1775120 - RNA, 18 nt, Homo sapiens
cgguuuuucucuucaaua

SEQ ID NO: 1775121 - RNA, 17 nt, Homo sapiens
uggaaaaauacugccua

SEQ ID NO: 1775122 - RNA, 18 nt, Homo sapiens
ucagacauaaagccaugu

SEQ ID NO: 1775123 - RNA, 20 nt, Homo sapiens
gaacugcaucaagacuucaa

SEQ ID NO: 1775124 - RNA, 22 nt, Homo sapiens
ucgccaugggggucuuugaaca

SEQ ID NO: 1775125 - RNA, 17 nt, Homo sapiens
uagcuauauccauguac

SEQ ID NO: 1775126 - RNA, 20 nt, Homo sapiens
cuuuacuguccccaucauca

SEQ ID NO: 1775127 - RNA, 21 nt, Homo sapiens
uuuaagggcauguugggauaa

SEQ ID NO: 1775128 - RNA, 20 nt, Homo sapiens
acggauccugcacugacucu

SEQ ID NO: 1775129 - RNA, 22 nt, Homo sapiens
uagcugagcacagcaagggagg

SEQ ID NO: 1775130 - RNA, 19 nt, Homo sapiens
agaauauuuucaacauaaa

SEQ ID NO: 1775131 - RNA, 17 nt, Homo sapiens
uccuggcacucucaugu

SEQ ID NO: 1775132 - RNA, 17 nt, Homo sapiens
augguguggucaagccc

SEQ ID NO: 1775133 - RNA, 13 nt, Homo sapiens
ccccacuccagcc

SEQ ID NO: 1775134 - RNA, 13 nt, Homo sapiens
cccuccuccagua

SEQ ID NO: 1775135 - RNA, 18 nt, Homo sapiens
uugcaauaguuaccucaa

SEQ ID NO: 1775136 - RNA, 17 nt, Homo sapiens
cuaauuuaaguacauuu

SEQ ID NO: 1775137 - RNA, 12 nt, Homo sapiens
uggccucaggag

SEQ ID NO: 1775138 - RNA, 21 nt, Homo sapiens
ugauccacaaaaacaacuuau

SEQ ID NO: 1775139 - RNA, 18 nt, Homo sapiens
agcaaagauuauuuucau

SEQ ID NO: 1775140 - RNA, 16 nt, Homo sapiens
cuugguucacugcaac

SEQ ID NO: 1775141 - RNA, 17 nt, Homo sapiens
aucugccuguaucucuc

SEQ ID NO: 1775142 - RNA, 21 nt, Homo sapiens
uucaguaaacaacuuguacuu

SEQ ID NO: 1775143 - RNA, 13 nt, Homo sapiens
acauggaauuuaa

SEQ ID NO: 1775144 - RNA, 22 nt, Homo sapiens
cuaaauauuuguugacugaaua

SEQ ID NO: 1775145 - RNA, 21 nt, Homo sapiens
cugugcacggccagcugcauc

SEQ ID NO: 1775146 - RNA, 23 nt, Homo sapiens
auaggagcugcaggggugccugg

SEQ ID NO: 1775147 - RNA, 15 nt, Homo sapiens
aauaaagcaaugugg

SEQ ID NO: 1775148 - RNA, 23 nt, Homo sapiens
aaguaaucuguugacagugccaa

SEQ ID NO: 1775149 - RNA, 13 nt, Homo sapiens
ggcagcaucccaa

SEQ ID NO: 1775150 - RNA, 14 nt, Homo sapiens
gcacacacccagag

SEQ ID NO: 1775151 - RNA, 14 nt, Homo sapiens
cuugaggccugugc

SEQ ID NO: 1775152 - RNA, 13 nt, Homo sapiens
acacccagcaaua

SEQ ID NO: 1775153 - RNA, 17 nt, Homo sapiens
ucuucaaagacaaugga

SEQ ID NO: 1775154 - RNA, 16 nt, Homo sapiens
cugauguauaauguaa

SEQ ID NO: 1775155 - RNA, 19 nt, Homo sapiens
caugcaugggaaagugcaa

SEQ ID NO: 1775156 - RNA, 21 nt, Homo sapiens
ucuccaugucuguaguugcuu

SEQ ID NO: 1775157 - RNA, 18 nt, Homo sapiens
gauaaguggggacuagug

SEQ ID NO: 1775158 - RNA, 13 nt, Homo sapiens
gccugcugcugag

SEQ ID NO: 1775159 - RNA, 23 nt, Homo sapiens
gagagggguggaggcugccccau

SEQ ID NO: 1775160 - RNA, 15 nt, Homo sapiens
agugaauuguugaca

SEQ ID NO: 1775161 - RNA, 13 nt, Homo sapiens
gacagccauacuu

SEQ ID NO: 1775162 - RNA, 18 nt, Homo sapiens
aaccagaauuaggucaag

SEQ ID NO: 1775163 - RNA, 13 nt, Homo sapiens
agguccaccugcg

SEQ ID NO: 1775164 - RNA, 13 nt, Homo sapiens
cuaacuguucccu

SEQ ID NO: 1775165 - RNA, 19 nt, Homo sapiens
uucagaucauggcauccaa

SEQ ID NO: 1775166 - RNA, 21 nt, Homo sapiens
uuguuaaacacgugucuauaa

SEQ ID NO: 1775167 - RNA, 16 nt, Homo sapiens
caagagaucagcagug

SEQ ID NO: 1775168 - RNA, 23 nt, Homo sapiens
cagcucauuucaguuucuaucaa

SEQ ID NO: 1775169 - RNA, 19 nt, Homo sapiens
ucuuuggaaaaauguuugu

SEQ ID NO: 1775170 - RNA, 17 nt, Homo sapiens
ugcugcuggggucauuu

SEQ ID NO: 1775171 - RNA, 21 nt, Homo sapiens
caaauuuuuuguagacagggu

SEQ ID NO: 1775172 - RNA, 22 nt, Homo sapiens
acuguggguagacacacaugaa

SEQ ID NO: 1775173 - RNA, 15 nt, Homo sapiens
ccuauggaguagcca

SEQ ID NO: 1775174 - RNA, 15 nt, Homo sapiens
guuugguuucuagca

SEQ ID NO: 1775175 - RNA, 19 nt, Homo sapiens
agccacugaauauuaucau

SEQ ID NO: 1775176 - RNA, 16 nt, Homo sapiens
agaccucaugccaugg

SEQ ID NO: 1775177 - RNA, 23 nt, Homo sapiens
agaauuugguaaauuaguauuua

SEQ ID NO: 1775178 - RNA, 18 nt, Homo sapiens
caccuugaugacuuccua

SEQ ID NO: 1775179 - RNA, 16 nt, Homo sapiens
uacuugaacacugugu

SEQ ID NO: 1775180 - RNA, 23 nt, Homo sapiens
gucauuuugggaccuauaucuca

SEQ ID NO: 1775181 - RNA, 21 nt, Homo sapiens
uuacaguuagaaacaccagcc

SEQ ID NO: 1775182 - RNA, 14 nt, Homo sapiens
uaucaaugacaaug

SEQ ID NO: 1775183 - RNA, 20 nt, Homo sapiens
acacaaccaacgcgaaacca

SEQ ID NO: 1775184 - RNA, 15 nt, Homo sapiens
cuuuaaacagacucg

SEQ ID NO: 1775185 - RNA, 18 nt, Homo sapiens
uguaguuuuacuuuccua

SEQ ID NO: 1775186 - RNA, 14 nt, Homo sapiens
guacugugcugauu

SEQ ID NO: 1775187 - RNA, 22 nt, Homo sapiens
gccagucucauugucaccucug

SEQ ID NO: 1775188 - RNA, 16 nt, Homo sapiens
ucaagguuuaaccuua

SEQ ID NO: 1775189 - RNA, 19 nt, Homo sapiens
uaaaaaaaacaauuccaca

SEQ ID NO: 1775190 - RNA, 21 nt, Homo sapiens
uaagaccucugagaccaaaau

SEQ ID NO: 1775191 - RNA, 14 nt, Homo sapiens
aggccacguccagg

SEQ ID NO: 1775192 - RNA, 20 nt, Homo sapiens
caaaggauaaacugcagaga

SEQ ID NO: 1775193 - RNA, 20 nt, Homo sapiens
agcaacaccuccagcagaga

SEQ ID NO: 1775194 - RNA, 15 nt, Homo sapiens
uuaaaacugcauuuu

SEQ ID NO: 1775195 - RNA, 23 nt, Homo sapiens
uaggaaaaggggaaaguauuuau

SEQ ID NO: 1775196 - RNA, 15 nt, Homo sapiens
ucuaagucuccaaga

SEQ ID NO: 1775197 - RNA, 15 nt, Homo sapiens
agcauuacaguauuu

SEQ ID NO: 1775198 - RNA, 20 nt, Homo sapiens
gcagaggaagagacaugaga

SEQ ID NO: 1775199 - RNA, 14 nt, Homo sapiens
aagcgugugugaac

SEQ ID NO: 1775200 - RNA, 19 nt, Homo sapiens
cagugcacacggaugcaca

SEQ ID NO: 1775201 - RNA, 17 nt, Homo sapiens
caagacaccaaauugaa

SEQ ID NO: 1775202 - RNA, 17 nt, Homo sapiens
uaaaacaugagcuuaca

SEQ ID NO: 1775203 - RNA, 20 nt, Homo sapiens
uccacaccuagcaucucaug

SEQ ID NO: 1775204 - RNA, 14 nt, Homo sapiens
aaucacacugagga

SEQ ID NO: 1775205 - RNA, 18 nt, Homo sapiens
auuuacauauagcugaua

SEQ ID NO: 1775206 - RNA, 13 nt, Homo sapiens
aagaaaaccagcg

SEQ ID NO: 1775207 - RNA, 14 nt, Homo sapiens
gguaacuagcugag

SEQ ID NO: 1775208 - RNA, 16 nt, Homo sapiens
acccacagaugucucu

SEQ ID NO: 1775209 - RNA, 20 nt, Homo sapiens
aaccuccgccuuccggguuc

SEQ ID NO: 1775210 - RNA, 15 nt, Homo sapiens
ccaauuuauuuuaac

SEQ ID NO: 1775211 - RNA, 19 nt, Homo sapiens
cacuaacccguuuuauucu

SEQ ID NO: 1775212 - RNA, 15 nt, Homo sapiens
uuggaggaucaaaga

SEQ ID NO: 1775213 - RNA, 18 nt, Homo sapiens
uacauaacuucagugcaa

SEQ ID NO: 1775214 - RNA, 21 nt, Homo sapiens
uacucaguuaggcagugcagu

SEQ ID NO: 1775215 - RNA, 20 nt, Homo sapiens
gagucucgcucuguugccca

SEQ ID NO: 1775216 - RNA, 21 nt, Homo sapiens
gugauuuucaaauauguaaac

SEQ ID NO: 1775217 - RNA, 18 nt, Homo sapiens
aagugccaaagccugggg

SEQ ID NO: 1775218 - RNA, 18 nt, Homo sapiens
gaaacaccacugcuaggg

SEQ ID NO: 1775219 - RNA, 15 nt, Homo sapiens
cagugcccccuggug

SEQ ID NO: 1775220 - RNA, 16 nt, Homo sapiens
cuagcuucugcaaugu

SEQ ID NO: 1775221 - RNA, 22 nt, Homo sapiens
cucgaggcggaucuuuggacag

SEQ ID NO: 1775222 - RNA, 14 nt, Homo sapiens
aaauaaacugugug

SEQ ID NO: 1775223 - RNA, 16 nt, Homo sapiens
cuuuuaguuguaucuc

SEQ ID NO: 1775224 - RNA, 19 nt, Homo sapiens
cuauuucuucuacugcuau

SEQ ID NO: 1775225 - RNA, 16 nt, Homo sapiens
accucccgaagccacc

SEQ ID NO: 1775226 - RNA, 22 nt, Homo sapiens
cuugugauuuuuauaauacaaa

SEQ ID NO: 1775227 - RNA, 13 nt, Homo sapiens
agaaugcauuccc

SEQ ID NO: 1775228 - RNA, 17 nt, Homo sapiens
cuccugugcuacuuugc

SEQ ID NO: 1775229 - RNA, 24 nt, Homo sapiens
gccaaguaucuuuccagcauguuu

SEQ ID NO: 1775230 - RNA, 21 nt, Homo sapiens
aagggucucccucuguugcca

SEQ ID NO: 1775231 - RNA, 19 nt, Homo sapiens
gaccuuccugccaccaguc

SEQ ID NO: 1775232 - RNA, 22 nt, Homo sapiens
gcaagacuucucuuugccucaa

SEQ ID NO: 1775233 - RNA, 22 nt, Homo sapiens
uucaaagcacuguuucucucac

SEQ ID NO: 1775234 - RNA, 16 nt, Homo sapiens
aauuuuuagccauuuc

SEQ ID NO: 1775235 - RNA, 23 nt, Homo sapiens
ggagcuagaacauuccauuugcu

SEQ ID NO: 1775236 - RNA, 15 nt, Homo sapiens
agugugaaugcugaa

SEQ ID NO: 1775237 - RNA, 14 nt, Homo sapiens
uucccaccauuccc

SEQ ID NO: 1775238 - RNA, 14 nt, Homo sapiens
uccucaccacuucc

SEQ ID NO: 1775239 - RNA, 13 nt, Homo sapiens
uccugcucucuuc

SEQ ID NO: 1775240 - RNA, 20 nt, Homo sapiens
acuguauuaaauguaacuua

SEQ ID NO: 1775241 - RNA, 17 nt, Homo sapiens
agcaguuugcugccaug

SEQ ID NO: 1775242 - RNA, 14 nt, Homo sapiens
cccucagagugcaa

SEQ ID NO: 1775243 - RNA, 14 nt, Homo sapiens
cuuucuaaugcuga

SEQ ID NO: 1775244 - RNA, 16 nt, Homo sapiens
ccaggccucuuggcag

SEQ ID NO: 1775245 - RNA, 20 nt, Homo sapiens
agcuggagagagaguucuca

SEQ ID NO: 1775246 - RNA, 23 nt, Homo sapiens
ugugcauaaugcuuuggaaaaau

SEQ ID NO: 1775247 - RNA, 22 nt, Homo sapiens
aaauggagggaggaauuuucau

SEQ ID NO: 1775248 - RNA, 17 nt, Homo sapiens
guuugcagaugacaaaa

SEQ ID NO: 1775249 - RNA, 16 nt, Homo sapiens
aaccucaaacugggua

SEQ ID NO: 1775250 - RNA, 13 nt, Homo sapiens
cauacacauugga

SEQ ID NO: 1775251 - RNA, 14 nt, Homo sapiens
aacugaacugugaa

SEQ ID NO: 1775252 - RNA, 19 nt, Homo sapiens
cacugggagaggugccagc

SEQ ID NO: 1775253 - RNA, 19 nt, Homo sapiens
uguauuaauaaagcauucu

SEQ ID NO: 1775254 - RNA, 15 nt, Homo sapiens
acugugaaaccuuua

SEQ ID NO: 1775255 - RNA, 16 nt, Homo sapiens
ugaaaacaaaggugcc

SEQ ID NO: 1775256 - RNA, 13 nt, Homo sapiens
augcauguucaaa

SEQ ID NO: 1775257 - RNA, 16 nt, Homo sapiens
uucaauugcagaugcc

SEQ ID NO: 1775258 - RNA, 19 nt, Homo sapiens
uguuaaauuaacucacuau

SEQ ID NO: 1775259 - RNA, 23 nt, Homo sapiens
aaaaugaaugaggucugggcuag

SEQ ID NO: 1775260 - RNA, 20 nt, Homo sapiens
aaacucuguuacacuuuuug

SEQ ID NO: 1775261 - RNA, 19 nt, Homo sapiens
uacaauaaguuacuugaaa

SEQ ID NO: 1775262 - RNA, 15 nt, Homo sapiens
gugugaaugcacguu

SEQ ID NO: 1775263 - RNA, 17 nt, Homo sapiens
ugugugagaauaaacua

SEQ ID NO: 1775264 - RNA, 16 nt, Homo sapiens
gcaguuuacaguauuu

SEQ ID NO: 1775265 - RNA, 20 nt, Homo sapiens
cagaaagcuccuuccagacc

SEQ ID NO: 1775266 - RNA, 20 nt, Homo sapiens
gaggcaggaggaucauuuga

SEQ ID NO: 1775267 - RNA, 13 nt, Homo sapiens
uuuuaauugagau

SEQ ID NO: 1775268 - RNA, 23 nt, Homo sapiens
agcaucuccagcauucucagcca

SEQ ID NO: 1775269 - RNA, 16 nt, Homo sapiens
uuaaaccaagcagcuu

SEQ ID NO: 1775270 - RNA, 23 nt, Homo sapiens
cauucuuauggccacaagcaaag

SEQ ID NO: 1775271 - RNA, 23 nt, Homo sapiens
auuacaagcgugagccacugcac

SEQ ID NO: 1775272 - RNA, 22 nt, Homo sapiens
ucuuagaguuaccacaccccau

SEQ ID NO: 1775273 - RNA, 16 nt, Homo sapiens
gaccucacacaccucu

SEQ ID NO: 1775274 - RNA, 22 nt, Homo sapiens
aucaaggaguacaaugcccaga

SEQ ID NO: 1775275 - RNA, 13 nt, Homo sapiens
agacagacauuca

SEQ ID NO: 1775276 - RNA, 15 nt, Homo sapiens
aucucugcuugaguc

SEQ ID NO: 1775277 - RNA, 20 nt, Homo sapiens
uguggcaaagccuucauugc

SEQ ID NO: 1775278 - RNA, 23 nt, Homo sapiens
gcuggaggccucaggugcugucc

SEQ ID NO: 1775279 - RNA, 15 nt, Homo sapiens
uaucagugaacacag

SEQ ID NO: 1775280 - RNA, 11 nt, Homo sapiens
gguugcaguga

SEQ ID NO: 1775281 - RNA, 18 nt, Homo sapiens
cagguggacugacugugu

SEQ ID NO: 1775282 - RNA, 23 nt, Homo sapiens
aaugaggucccucuagcuuuagc

SEQ ID NO: 1775283 - RNA, 12 nt, Homo sapiens
uugcugacuuua

SEQ ID NO: 1775284 - RNA, 20 nt, Homo sapiens
cuggcacuuagcccaagagg

SEQ ID NO: 1775285 - RNA, 15 nt, Homo sapiens
uucccccagcacaaa

SEQ ID NO: 1775286 - RNA, 15 nt, Homo sapiens
uggcucuugccugua

SEQ ID NO: 1775287 - RNA, 14 nt, Homo sapiens
aagaucaagccagu

SEQ ID NO: 1775288 - RNA, 20 nt, Homo sapiens
aaccuucuggccucccacag

SEQ ID NO: 1775289 - RNA, 14 nt, Homo sapiens
gauacagaucucag

SEQ ID NO: 1775290 - RNA, 14 nt, Homo sapiens
aacagcaugacaaa

SEQ ID NO: 1775291 - RNA, 21 nt, Homo sapiens
agcguuaccgccacacuugaa

SEQ ID NO: 1775292 - RNA, 12 nt, Homo sapiens
cucacauaugcc

SEQ ID NO: 1775293 - RNA, 24 nt, Homo sapiens
gcugcagugacccagauauugcac

SEQ ID NO: 1775294 - RNA, 22 nt, Homo sapiens
acaaauaaaaagaaaauauuua

SEQ ID NO: 1775295 - RNA, 14 nt, Homo sapiens
ggcuauaccugggg

SEQ ID NO: 1775296 - RNA, 14 nt, Homo sapiens
cugucgcaucucag

SEQ ID NO: 1775297 - RNA, 23 nt, Homo sapiens
caugauggcaccacugcacucca

SEQ ID NO: 1775298 - RNA, 19 nt, Homo sapiens
aaaguuugguaaugggaua

SEQ ID NO: 1775299 - RNA, 14 nt, Homo sapiens
uaauguacuguaca

SEQ ID NO: 1775300 - RNA, 20 nt, Homo sapiens
gccaauacagacaaagcaua

SEQ ID NO: 1775301 - RNA, 21 nt, Homo sapiens
aucagccuccgccauuccaag

SEQ ID NO: 1775302 - RNA, 22 nt, Homo sapiens
gggagaagcuuuuuuucuugcu

SEQ ID NO: 1775303 - RNA, 17 nt, Homo sapiens
uuagucauaaacaugca

SEQ ID NO: 1775304 - RNA, 14 nt, Homo sapiens
cacccauggccuca

SEQ ID NO: 1775305 - RNA, 21 nt, Homo sapiens
ggcagagaagccccuaggcaa

SEQ ID NO: 1775306 - RNA, 15 nt, Homo sapiens
ugagcccugccacuc

SEQ ID NO: 1775307 - RNA, 18 nt, Homo sapiens
cuuuaucaagaagucuga

SEQ ID NO: 1775308 - RNA, 12 nt, Homo sapiens
caagaugagauu

SEQ ID NO: 1775309 - RNA, 13 nt, Homo sapiens
ugugcuguuagaa

SEQ ID NO: 1775310 - RNA, 15 nt, Homo sapiens
auggucuugaucucc

SEQ ID NO: 1775311 - RNA, 18 nt, Homo sapiens
gugugugaccuacaagau

SEQ ID NO: 1775312 - RNA, 14 nt, Homo sapiens
agcauuuugcuaag

SEQ ID NO: 1775313 - RNA, 22 nt, Homo sapiens
aauaaugaaguuauucuugaca

SEQ ID NO: 1775314 - RNA, 18 nt, Homo sapiens
caaggcuuugguuuccaa

SEQ ID NO: 1775315 - RNA, 23 nt, Homo sapiens
cagugaggaacccugaucucuca

SEQ ID NO: 1775316 - RNA, 18 nt, Homo sapiens
cauaacugguagcuauaa

SEQ ID NO: 1775317 - RNA, 22 nt, Homo sapiens
agaggaauccagugaauguucc

SEQ ID NO: 1775318 - RNA, 14 nt, Homo sapiens
agacaaauuguuaa

SEQ ID NO: 1775319 - RNA, 21 nt, Homo sapiens
ucaaagaauuucuucagucca

SEQ ID NO: 1775320 - RNA, 17 nt, Homo sapiens
uaguucuuuucaugcaa

SEQ ID NO: 1775321 - RNA, 17 nt, Homo sapiens
gaggcaaacagcaagag

SEQ ID NO: 1775322 - RNA, 19 nt, Homo sapiens
aucauaaacugacuaucau

SEQ ID NO: 1775323 - RNA, 23 nt, Homo sapiens
ugggaggagacaucccaggaaaa

SEQ ID NO: 1775324 - RNA, 13 nt, Homo sapiens
cugugaauggcag

SEQ ID NO: 1775325 - RNA, 17 nt, Homo sapiens
agcauuuucugcaucuc

SEQ ID NO: 1775326 - RNA, 19 nt, Homo sapiens
ucuuucuaaaauauuucau

SEQ ID NO: 1775327 - RNA, 19 nt, Homo sapiens
gauuuugcaaucuguguuc

SEQ ID NO: 1775328 - RNA, 22 nt, Homo sapiens
gauggguauuaaacuugucaga

SEQ ID NO: 1775329 - RNA, 16 nt, Homo sapiens
gaaaauuagcaugaaa

SEQ ID NO: 1775330 - RNA, 12 nt, Homo sapiens
uggaucugugag

SEQ ID NO: 1775331 - RNA, 16 nt, Homo sapiens
cacuguuccccaaaac

SEQ ID NO: 1775332 - RNA, 17 nt, Homo sapiens
gcuucuucacaggcacu

SEQ ID NO: 1775333 - RNA, 12 nt, Homo sapiens
uccgucugaccc

SEQ ID NO: 1775334 - RNA, 21 nt, Homo sapiens
caacaugcacauucauccuca

SEQ ID NO: 1775335 - RNA, 11 nt, Homo sapiens
cagcugucaca

SEQ ID NO: 1775336 - RNA, 22 nt, Homo sapiens
ggcaguuuaaaaaauaacuuca

SEQ ID NO: 1775337 - RNA, 15 nt, Homo sapiens
gccgugcugagcaca

SEQ ID NO: 1775338 - RNA, 15 nt, Homo sapiens
caucagccuugggau

SEQ ID NO: 1775339 - RNA, 21 nt, Homo sapiens
ucacauuuuuaaaagaacaau

SEQ ID NO: 1775340 - RNA, 20 nt, Homo sapiens
guuucagcucacuuccucca

SEQ ID NO: 1775341 - RNA, 15 nt, Homo sapiens
cuuggccucccaagg

SEQ ID NO: 1775342 - RNA, 15 nt, Homo sapiens
caaaaggaaaaagcu

SEQ ID NO: 1775343 - RNA, 18 nt, Homo sapiens
ugauauucuuuaaacaaa

SEQ ID NO: 1775344 - RNA, 15 nt, Homo sapiens
gauucuuaacuaaaa

SEQ ID NO: 1775345 - RNA, 14 nt, Homo sapiens
aaacaauucaaaga

SEQ ID NO: 1775346 - RNA, 13 nt, Homo sapiens
ugcccugccccac

SEQ ID NO: 1775347 - RNA, 13 nt, Homo sapiens
uuucauacacuua

SEQ ID NO: 1775348 - RNA, 21 nt, Homo sapiens
uauuucugcacaguguuccca

SEQ ID NO: 1775349 - RNA, 17 nt, Homo sapiens
ggcugcacaggcacugu

SEQ ID NO: 1775350 - RNA, 21 nt, Homo sapiens
cuacaagcauuugcccugugg

SEQ ID NO: 1775351 - RNA, 15 nt, Homo sapiens
uuuggucacauauca

SEQ ID NO: 1775352 - RNA, 18 nt, Homo sapiens
aaccacaggcagcauuua

SEQ ID NO: 1775353 - RNA, 15 nt, Homo sapiens
uaaaauucuauuaua

SEQ ID NO: 1775354 - RNA, 19 nt, Homo sapiens
cuugcuuguuccugcauua

SEQ ID NO: 1775355 - RNA, 15 nt, Homo sapiens
gaaguuuuucuuugu

SEQ ID NO: 1775356 - RNA, 17 nt, Homo sapiens
auuuaugagaucacuga

SEQ ID NO: 1775357 - RNA, 19 nt, Homo sapiens
gcgcuucaguucagcuuua

SEQ ID NO: 1775358 - RNA, 18 nt, Homo sapiens
gcauacagguuaaccugc

SEQ ID NO: 1775359 - RNA, 17 nt, Homo sapiens
ggguggacggagccaaa

SEQ ID NO: 1775360 - RNA, 22 nt, Homo sapiens
cgcuguugucacaucucaggga

SEQ ID NO: 1775361 - RNA, 22 nt, Homo sapiens
cauucaacccuggagaguucaa

SEQ ID NO: 1775362 - RNA, 17 nt, Homo sapiens
auggcuaugccuugcac

SEQ ID NO: 1775363 - RNA, 13 nt, Homo sapiens
aaagaaaccagac

SEQ ID NO: 1775364 - RNA, 16 nt, Homo sapiens
aauucucagaaucuca

SEQ ID NO: 1775365 - RNA, 16 nt, Homo sapiens
agaugagggguugagg

SEQ ID NO: 1775366 - RNA, 19 nt, Homo sapiens
ugggauguccuacuaucac

SEQ ID NO: 1775367 - RNA, 15 nt, Homo sapiens
aaggucucacacucc

SEQ ID NO: 1775368 - RNA, 23 nt, Homo sapiens
aaacccacgcguguucugaaggu

SEQ ID NO: 1775369 - RNA, 18 nt, Homo sapiens
ugucugaauauucuagaa

SEQ ID NO: 1775370 - RNA, 20 nt, Homo sapiens
ggccuggccccuucuccucu

SEQ ID NO: 1775371 - RNA, 19 nt, Homo sapiens
ucucccucuaggcucugcc

SEQ ID NO: 1775372 - RNA, 14 nt, Homo sapiens
uuuuagcacaaaga

SEQ ID NO: 1775373 - RNA, 18 nt, Homo sapiens
aaauuaacuuuccuuccu

SEQ ID NO: 1775374 - RNA, 14 nt, Homo sapiens
uaucccuaugcugc

SEQ ID NO: 1775375 - RNA, 16 nt, Homo sapiens
gagcugucugaacuca

SEQ ID NO: 1775376 - RNA, 19 nt, Homo sapiens
guccaggaaggcagcugcu

SEQ ID NO: 1775377 - RNA, 17 nt, Homo sapiens
auuuucuaaugugccua

SEQ ID NO: 1775378 - RNA, 12 nt, Homo sapiens
aagggacuccca

SEQ ID NO: 1775379 - RNA, 18 nt, Homo sapiens
cccagccaggcagggggc

SEQ ID NO: 1775380 - RNA, 15 nt, Homo sapiens
uuguuaucagucaau

SEQ ID NO: 1775381 - RNA, 15 nt, Homo sapiens
ucuagguuauacaau

SEQ ID NO: 1775382 - RNA, 19 nt, Homo sapiens
caggugaucuaccugccuc

SEQ ID NO: 1775383 - RNA, 15 nt, Homo sapiens
cccagguaccacccu

SEQ ID NO: 1775384 - RNA, 18 nt, Homo sapiens
aguuuuauggcaugauuu

SEQ ID NO: 1775385 - RNA, 22 nt, Homo sapiens
uaaauacauccuuuuucugcua

SEQ ID NO: 1775386 - RNA, 20 nt, Homo sapiens
ggacauugccuuuucuagcc

SEQ ID NO: 1775387 - RNA, 17 nt, Homo sapiens
uacgcugucucugacau

SEQ ID NO: 1775388 - RNA, 14 nt, Homo sapiens
gagguugcagugag

SEQ ID NO: 1775389 - RNA, 18 nt, Homo sapiens
gcaggacuuccccggagg

SEQ ID NO: 1775390 - RNA, 20 nt, Homo sapiens
ggcauucuuugcaauacugc

SEQ ID NO: 1775391 - RNA, 14 nt, Homo sapiens
uacugcucugagaa

SEQ ID NO: 1775392 - RNA, 22 nt, Homo sapiens
aaaauacagccauguaccacau

SEQ ID NO: 1775393 - RNA, 17 nt, Homo sapiens
gaaacagcugcccugug

SEQ ID NO: 1775394 - RNA, 21 nt, Homo sapiens
ugugcugcagcucccauuuca

SEQ ID NO: 1775395 - RNA, 15 nt, Homo sapiens
aagccuccaaggguu

SEQ ID NO: 1775396 - RNA, 14 nt, Homo sapiens
agaaauauuuaacu

SEQ ID NO: 1775397 - RNA, 12 nt, Homo sapiens
agggucaaggac

SEQ ID NO: 1775398 - RNA, 13 nt, Homo sapiens
gcugguguuaaca

SEQ ID NO: 1775399 - RNA, 18 nt, Homo sapiens
ggcuuaauaaaaaugaca

SEQ ID NO: 1775400 - RNA, 22 nt, Homo sapiens
gaccacuuuccccgugggccau

SEQ ID NO: 1775401 - RNA, 14 nt, Homo sapiens
caguuaauggcuca

SEQ ID NO: 1775402 - RNA, 16 nt, Homo sapiens
auuaaacaugcuguua

SEQ ID NO: 1775403 - RNA, 16 nt, Homo sapiens
uuauacagaacucaca

SEQ ID NO: 1775404 - RNA, 19 nt, Homo sapiens
ugcaguacaagaaccucuc

SEQ ID NO: 1775405 - RNA, 14 nt, Homo sapiens
cuggagugauucua

SEQ ID NO: 1775406 - RNA, 14 nt, Homo sapiens
cugcuugugcacug

SEQ ID NO: 1775407 - RNA, 17 nt, Homo sapiens
auucaauaagaagucaa

SEQ ID NO: 1775408 - RNA, 18 nt, Homo sapiens
uccuugauaaaguauuau

SEQ ID NO: 1775409 - RNA, 16 nt, Homo sapiens
agacuuaaucauauca

SEQ ID NO: 1775410 - RNA, 16 nt, Homo sapiens
aaauauuaacauucuu

SEQ ID NO: 1775411 - RNA, 16 nt, Homo sapiens
cugccugcacuggaac

SEQ ID NO: 1775412 - RNA, 17 nt, Homo sapiens
guaaugcugcacagaaa

SEQ ID NO: 1775413 - RNA, 16 nt, Homo sapiens
uagccaggauccacaa

SEQ ID NO: 1775414 - RNA, 21 nt, Homo sapiens
uacgcuuaagguggaaagugu

SEQ ID NO: 1775415 - RNA, 15 nt, Homo sapiens
ucccucaaaugacag

SEQ ID NO: 1775416 - RNA, 22 nt, Homo sapiens
aggacgagacccccauccagcc

SEQ ID NO: 1775417 - RNA, 20 nt, Homo sapiens
guccacccccauacauuuau

SEQ ID NO: 1775418 - RNA, 16 nt, Homo sapiens
ugagacagcacagcca

SEQ ID NO: 1775419 - RNA, 15 nt, Homo sapiens
gagggagagggaggu

SEQ ID NO: 1775420 - RNA, 14 nt, Homo sapiens
uucaaaauccaaaa

SEQ ID NO: 1775421 - RNA, 19 nt, Homo sapiens
ccuguaacuacaaugaugg

SEQ ID NO: 1775422 - RNA, 18 nt, Homo sapiens
cugucucuccagugaaau

SEQ ID NO: 1775423 - RNA, 18 nt, Homo sapiens
acagugucuugagcucua

SEQ ID NO: 1775424 - RNA, 15 nt, Homo sapiens
uggaaaagccaagag

SEQ ID NO: 1775425 - RNA, 15 nt, Homo sapiens
uugauugaaaguccu

SEQ ID NO: 1775426 - RNA, 12 nt, Homo sapiens
auuuuucacaaa

SEQ ID NO: 1775427 - RNA, 19 nt, Homo sapiens
aaaguggcaggacacugca

SEQ ID NO: 1775428 - RNA, 19 nt, Homo sapiens
auugauugaacguucucaa

SEQ ID NO: 1775429 - RNA, 12 nt, Homo sapiens
agauaccucucu

SEQ ID NO: 1775430 - RNA, 12 nt, Homo sapiens
aacauaaaucag

SEQ ID NO: 1775431 - RNA, 16 nt, Homo sapiens
gagcuaucauuaugca

SEQ ID NO: 1775432 - RNA, 16 nt, Homo sapiens
aggcccuggaggucuc

SEQ ID NO: 1775433 - RNA, 21 nt, Homo sapiens
auugcucucccagcccuugca

SEQ ID NO: 1775434 - RNA, 13 nt, Homo sapiens
aauauccuuugcc

SEQ ID NO: 1775435 - RNA, 17 nt, Homo sapiens
gaagcugcccucagcca

SEQ ID NO: 1775436 - RNA, 14 nt, Homo sapiens
cuucuguaugcauc

SEQ ID NO: 1775437 - RNA, 17 nt, Homo sapiens
aggacuucugccugaac

SEQ ID NO: 1775438 - RNA, 16 nt, Homo sapiens
cauaaguauuaugucu

SEQ ID NO: 1775439 - RNA, 22 nt, Homo sapiens
agaacagcuucauguucccaaa

SEQ ID NO: 1775440 - RNA, 19 nt, Homo sapiens
acagcuacacagaucacag

SEQ ID NO: 1775441 - RNA, 21 nt, Homo sapiens
acccgcuacaauucugcagaa

SEQ ID NO: 1775442 - RNA, 23 nt, Homo sapiens
uucuagaaagccccucaccucag

SEQ ID NO: 1775443 - RNA, 13 nt, Homo sapiens
ucucguucccaaa

SEQ ID NO: 1775444 - RNA, 12 nt, Homo sapiens
aaaagaagcagu

SEQ ID NO: 1775445 - RNA, 14 nt, Homo sapiens
accuuccaugucaa

SEQ ID NO: 1775446 - RNA, 15 nt, Homo sapiens
aaacagauaucuuca

SEQ ID NO: 1775447 - RNA, 21 nt, Homo sapiens
aacccugacuccucuuugugc

SEQ ID NO: 1775448 - RNA, 15 nt, Homo sapiens
uccaguucugacaca

SEQ ID NO: 1775449 - RNA, 15 nt, Homo sapiens
ucccaacauaugccc

SEQ ID NO: 1775450 - RNA, 14 nt, Homo sapiens
cugccuaugucaua

SEQ ID NO: 1775451 - RNA, 18 nt, Homo sapiens
caaacagggcaaaguguu

SEQ ID NO: 1775452 - RNA, 14 nt, Homo sapiens
aagacugagucaag

SEQ ID NO: 1775453 - RNA, 14 nt, Homo sapiens
aagccugaguccag

SEQ ID NO: 1775454 - RNA, 19 nt, Homo sapiens
ccaucuaaaacucauacaa

SEQ ID NO: 1775455 - RNA, 15 nt, Homo sapiens
uauacuguaggcaca

SEQ ID NO: 1775456 - RNA, 16 nt, Homo sapiens
acauugaccgcaacuc

SEQ ID NO: 1775457 - RNA, 13 nt, Homo sapiens
ggauuaaaccuuu

SEQ ID NO: 1775458 - RNA, 13 nt, Homo sapiens
ccaaucagaucaa

SEQ ID NO: 1775459 - RNA, 19 nt, Homo sapiens
ugacucuguagccagaaga

SEQ ID NO: 1775460 - RNA, 21 nt, Homo sapiens
cugcugcccaggccacagccg

SEQ ID NO: 1775461 - RNA, 14 nt, Homo sapiens
acuguuaccagaua

SEQ ID NO: 1775462 - RNA, 17 nt, Homo sapiens
uaacuggugauauaucu

SEQ ID NO: 1775463 - RNA, 22 nt, Homo sapiens
agccugucucccccaacacccc

SEQ ID NO: 1775464 - RNA, 13 nt, Homo sapiens
aaguugugcuuga

SEQ ID NO: 1775465 - RNA, 13 nt, Homo sapiens
uaacuuacuguau

SEQ ID NO: 1775466 - RNA, 19 nt, Homo sapiens
agacuagauguaguauuuu

SEQ ID NO: 1775467 - RNA, 12 nt, Homo sapiens
gaaucauuccac

SEQ ID NO: 1775468 - RNA, 19 nt, Homo sapiens
gagaaugugccauguauaa

SEQ ID NO: 1775469 - RNA, 14 nt, Homo sapiens
cucugguuuuagua

SEQ ID NO: 1775470 - RNA, 21 nt, Homo sapiens
caucucuucaugaauugugag

SEQ ID NO: 1775471 - RNA, 15 nt, Homo sapiens
cucuauuacacugga

SEQ ID NO: 1775472 - RNA, 15 nt, Homo sapiens
uuuaaguauauagua

SEQ ID NO: 1775473 - RNA, 18 nt, Homo sapiens
auggguggugaauucuga

SEQ ID NO: 1775474 - RNA, 24 nt, Homo sapiens
caugaccuccguguagugucugua

SEQ ID NO: 1775475 - RNA, 23 nt, Homo sapiens
acacaaaggaaguccaaccugag

SEQ ID NO: 1775476 - RNA, 19 nt, Homo sapiens
cuaggagaacugcuguguu

SEQ ID NO: 1775477 - RNA, 19 nt, Homo sapiens
acaugauaaauguaucaau

SEQ ID NO: 1775478 - RNA, 17 nt, Homo sapiens
gcauaguuuguucaaau

SEQ ID NO: 1775479 - RNA, 18 nt, Homo sapiens
aaaagcaaugcuuucuug

SEQ ID NO: 1775480 - RNA, 18 nt, Homo sapiens
auaaucaucucugucaca

SEQ ID NO: 1775481 - RNA, 14 nt, Homo sapiens
gaagagaagggaag

SEQ ID NO: 1775482 - RNA, 20 nt, Homo sapiens
gaaauccagcugguuaucca

SEQ ID NO: 1775483 - RNA, 14 nt, Homo sapiens
caaaaaacuacuuc

SEQ ID NO: 1775484 - RNA, 22 nt, Homo sapiens
aagagucaacaggucacuugau

SEQ ID NO: 1775485 - RNA, 21 nt, Homo sapiens
auuuuuuagaugaccaaaacu

SEQ ID NO: 1775486 - RNA, 18 nt, Homo sapiens
gguaauauaaaguguaau

SEQ ID NO: 1775487 - RNA, 20 nt, Homo sapiens
ugucagagcugggaguagca

SEQ ID NO: 1775488 - RNA, 15 nt, Homo sapiens
aacucacagagcuuu

SEQ ID NO: 1775489 - RNA, 12 nt, Homo sapiens
cuccuacuguag

SEQ ID NO: 1775490 - RNA, 23 nt, Homo sapiens
ccuuucauugcuguugucucugc

SEQ ID NO: 1775491 - RNA, 14 nt, Homo sapiens
cacucuuagcuaug

SEQ ID NO: 1775492 - RNA, 22 nt, Homo sapiens
cucuggcggcuuccuguccacu

SEQ ID NO: 1775493 - RNA, 21 nt, Homo sapiens
cccuuggaggcugucuucuca

SEQ ID NO: 1775494 - RNA, 19 nt, Homo sapiens
auccacaugcucugcaguc

SEQ ID NO: 1775495 - RNA, 23 nt, Homo sapiens
uccugccuagucucacauguccc

SEQ ID NO: 1775496 - RNA, 20 nt, Homo sapiens
uaaagauacuaaaccagcau

SEQ ID NO: 1775497 - RNA, 14 nt, Homo sapiens
ucugcccucuagag

SEQ ID NO: 1775498 - RNA, 22 nt, Homo sapiens
gacauucaccaacaacagucag

SEQ ID NO: 1775499 - RNA, 12 nt, Homo sapiens
aacuacagaugg

SEQ ID NO: 1775500 - RNA, 16 nt, Homo sapiens
cagcugcgcuugcuuu

SEQ ID NO: 1775501 - RNA, 16 nt, Homo sapiens
cauccucucuggugug

SEQ ID NO: 1775502 - RNA, 17 nt, Homo sapiens
cacccagugaaagccca

SEQ ID NO: 1775503 - RNA, 17 nt, Homo sapiens
aguuugucagacuuuaa

SEQ ID NO: 1775504 - RNA, 23 nt, Homo sapiens
uaaguacuauguaucaaugagua

SEQ ID NO: 1775505 - RNA, 14 nt, Homo sapiens
ugacgcguggucac

SEQ ID NO: 1775506 - RNA, 14 nt, Homo sapiens
uacgguuccauguu

SEQ ID NO: 1775507 - RNA, 16 nt, Homo sapiens
gacagauacuccucca

SEQ ID NO: 1775508 - RNA, 16 nt, Homo sapiens
aagugaaaaaagcaaa

SEQ ID NO: 1775509 - RNA, 13 nt, Homo sapiens
ugccgcugagaag

SEQ ID NO: 1775510 - RNA, 19 nt, Homo sapiens
gacauuuuaaacacuuaca

SEQ ID NO: 1775511 - RNA, 23 nt, Homo sapiens
ugauauaacaaagacuucuguca

SEQ ID NO: 1775512 - RNA, 21 nt, Homo sapiens
uucccuucuccuuccaacugc

SEQ ID NO: 1775513 - RNA, 21 nt, Homo sapiens
aauacugcugagauacauaca

SEQ ID NO: 1775514 - RNA, 14 nt, Homo sapiens
auuuuauauaugaa

SEQ ID NO: 1775515 - RNA, 19 nt, Homo sapiens
ucaacuaggcucauacuca

SEQ ID NO: 1775516 - RNA, 15 nt, Homo sapiens
aauaagaauuugcau

SEQ ID NO: 1775517 - RNA, 17 nt, Homo sapiens
cuuucaucggugccugg

SEQ ID NO: 1775518 - RNA, 20 nt, Homo sapiens
ucgaggacugauacugcagu

SEQ ID NO: 1775519 - RNA, 18 nt, Homo sapiens
aguggcagggcacagggc

SEQ ID NO: 1775520 - RNA, 14 nt, Homo sapiens
cauuaauacaaaga

SEQ ID NO: 1775521 - RNA, 20 nt, Homo sapiens
gucuuaacuuuucaccaggg

SEQ ID NO: 1775522 - RNA, 17 nt, Homo sapiens
ccacacuccacugacaa

SEQ ID NO: 1775523 - RNA, 20 nt, Homo sapiens
ccagauguuuuauuuaugaa

SEQ ID NO: 1775524 - RNA, 23 nt, Homo sapiens
gacguuugacuagccaucucaag

SEQ ID NO: 1775525 - RNA, 20 nt, Homo sapiens
aagucucacuuuuauugaua

SEQ ID NO: 1775526 - RNA, 23 nt, Homo sapiens
aacccuguuuuauugaguucuga

SEQ ID NO: 1775527 - RNA, 20 nt, Homo sapiens
uuccaggaccagaagcauuu

SEQ ID NO: 1775528 - RNA, 21 nt, Homo sapiens
cguuugcauuugcagugcauc

SEQ ID NO: 1775529 - RNA, 13 nt, Homo sapiens
augggaugcacuc

SEQ ID NO: 1775530 - RNA, 22 nt, Homo sapiens
gagaaggacaugagaucagggc

SEQ ID NO: 1775531 - RNA, 19 nt, Homo sapiens
cccaggguggagugcagug

SEQ ID NO: 1775532 - RNA, 23 nt, Homo sapiens
ccaggcaucugcuuuacucugga

SEQ ID NO: 1775533 - RNA, 21 nt, Homo sapiens
aaucaagauaaaggacaguga

SEQ ID NO: 1775534 - RNA, 14 nt, Homo sapiens
gccauccaugugcu

SEQ ID NO: 1775535 - RNA, 17 nt, Homo sapiens
agaugagugauccugcc

SEQ ID NO: 1775536 - RNA, 15 nt, Homo sapiens
cacagacuucacaca

SEQ ID NO: 1775537 - RNA, 12 nt, Homo sapiens
caucugacucac

SEQ ID NO: 1775538 - RNA, 15 nt, Homo sapiens
gcuucaaaccccagg

SEQ ID NO: 1775539 - RNA, 15 nt, Homo sapiens
aagugguggagccaa

SEQ ID NO: 1775540 - RNA, 17 nt, Homo sapiens
augaaaugucaguggaa

SEQ ID NO: 1775541 - RNA, 17 nt, Homo sapiens
cucuacaaaaaccaaaa

SEQ ID NO: 1775542 - RNA, 16 nt, Homo sapiens
gcgggacucuguccaa

SEQ ID NO: 1775543 - RNA, 20 nt, Homo sapiens
gauuaauuugguugucaagu

SEQ ID NO: 1775544 - RNA, 20 nt, Homo sapiens
uuggagcugucccaccugca

SEQ ID NO: 1775545 - RNA, 17 nt, Homo sapiens
ggagugcccccaacagc

SEQ ID NO: 1775546 - RNA, 21 nt, Homo sapiens
caggcacugggcaagugaaga

SEQ ID NO: 1775547 - RNA, 20 nt, Homo sapiens
agcaguaaacuuucucugca

SEQ ID NO: 1775548 - RNA, 19 nt, Homo sapiens
gucugccagcauaugcaga

SEQ ID NO: 1775549 - RNA, 12 nt, Homo sapiens
ccugcaggugag

SEQ ID NO: 1775550 - RNA, 15 nt, Homo sapiens
uucuccuuguacuug

SEQ ID NO: 1775551 - RNA, 19 nt, Homo sapiens
uuauguuuuuucugauucc

SEQ ID NO: 1775552 - RNA, 14 nt, Homo sapiens
ccaugugcccaguu

SEQ ID NO: 1775553 - RNA, 21 nt, Homo sapiens
guagagcuggggccacccugg

SEQ ID NO: 1775554 - RNA, 14 nt, Homo sapiens
acuuagucaugagg

SEQ ID NO: 1775555 - RNA, 15 nt, Homo sapiens
gaauuccaaagcaaa

SEQ ID NO: 1775556 - RNA, 15 nt, Homo sapiens
ccaguugcugucaca

SEQ ID NO: 1775557 - RNA, 20 nt, Homo sapiens
auuuuguccagaagaauuca

SEQ ID NO: 1775558 - RNA, 21 nt, Homo sapiens
cacucacuccacaacccaaga

SEQ ID NO: 1775559 - RNA, 18 nt, Homo sapiens
uggccuggcacacaucag

SEQ ID NO: 1775560 - RNA, 18 nt, Homo sapiens
gccaucacaugaucuguu

SEQ ID NO: 1775561 - RNA, 14 nt, Homo sapiens
aucacguugcaaug

SEQ ID NO: 1775562 - RNA, 15 nt, Homo sapiens
ucaggagacugaguu

SEQ ID NO: 1775563 - RNA, 13 nt, Homo sapiens
ugaggcugucagu

SEQ ID NO: 1775564 - RNA, 17 nt, Homo sapiens
cuggccagcugacuccc

SEQ ID NO: 1775565 - RNA, 13 nt, Homo sapiens
aggguuuugcccc

SEQ ID NO: 1775566 - RNA, 12 nt, Homo sapiens
aaggaugugauu

SEQ ID NO: 1775567 - RNA, 21 nt, Homo sapiens
uccacguacuuaauuuacuua

SEQ ID NO: 1775568 - RNA, 19 nt, Homo sapiens
aggugaagucgggucaaaa

SEQ ID NO: 1775569 - RNA, 14 nt, Homo sapiens
cuaaaucugaggaa

SEQ ID NO: 1775570 - RNA, 17 nt, Homo sapiens
gcagccaggagugcccc

SEQ ID NO: 1775571 - RNA, 14 nt, Homo sapiens
acuuggcugcauuu

SEQ ID NO: 1775572 - RNA, 21 nt, Homo sapiens
acagaaccaauucacuuuaga

SEQ ID NO: 1775573 - RNA, 14 nt, Homo sapiens
agaaggaagggcag

SEQ ID NO: 1775574 - RNA, 16 nt, Homo sapiens
ccacaaacacauuaua

SEQ ID NO: 1775575 - RNA, 17 nt, Homo sapiens
ugggggauaagggaguc

SEQ ID NO: 1775576 - RNA, 13 nt, Homo sapiens
ucccuuccuauuc

SEQ ID NO: 1775577 - RNA, 24 nt, Homo sapiens
accaguaggaggaggaugagccac

SEQ ID NO: 1775578 - RNA, 16 nt, Homo sapiens
cugcaguuccaaaaga

SEQ ID NO: 1775579 - RNA, 16 nt, Homo sapiens
gugccuaaagugcugc

SEQ ID NO: 1775580 - RNA, 18 nt, Homo sapiens
auacaggaggcagacaau

SEQ ID NO: 1775581 - RNA, 22 nt, Homo sapiens
acuuacuguuaaaacuguaccu

SEQ ID NO: 1775582 - RNA, 20 nt, Homo sapiens
uggcacagaaagggcagcuu

SEQ ID NO: 1775583 - RNA, 19 nt, Homo sapiens
uagagccauaugcccucau

SEQ ID NO: 1775584 - RNA, 21 nt, Homo sapiens
cacugguuuggucaguuacaa

SEQ ID NO: 1775585 - RNA, 19 nt, Homo sapiens
ggcugccucauuuagagag

SEQ ID NO: 1775586 - RNA, 21 nt, Homo sapiens
gguccauuuuccuaaccacaa

SEQ ID NO: 1775587 - RNA, 16 nt, Homo sapiens
cucauaucuuccucau

SEQ ID NO: 1775588 - RNA, 15 nt, Homo sapiens
uuagaggaaggagau

SEQ ID NO: 1775589 - RNA, 19 nt, Homo sapiens
uugguuaguuaacacugaa

SEQ ID NO: 1775590 - RNA, 15 nt, Homo sapiens
cacacaguguuuuaa

SEQ ID NO: 1775591 - RNA, 18 nt, Homo sapiens
guagagauuuuuaugugu

SEQ ID NO: 1775592 - RNA, 13 nt, Homo sapiens
accuucugaugaa

SEQ ID NO: 1775593 - RNA, 19 nt, Homo sapiens
gccucaccagcgcuugaag

SEQ ID NO: 1775594 - RNA, 15 nt, Homo sapiens
gaccaaagauuagua

SEQ ID NO: 1775595 - RNA, 18 nt, Homo sapiens
agguaacauagaugccug

SEQ ID NO: 1775596 - RNA, 21 nt, Homo sapiens
ugagauaguuuucauccauaa

SEQ ID NO: 1775597 - RNA, 16 nt, Homo sapiens
ggcuucgggcagggaa

SEQ ID NO: 1775598 - RNA, 17 nt, Homo sapiens
ucuacauguuuuagaca

SEQ ID NO: 1775599 - RNA, 17 nt, Homo sapiens
uagcuuugucacuguuu

SEQ ID NO: 1775600 - RNA, 16 nt, Homo sapiens
cuuaaauaauggugca

SEQ ID NO: 1775601 - RNA, 15 nt, Homo sapiens
ccacccuaccaugaa

SEQ ID NO: 1775602 - RNA, 20 nt, Homo sapiens
accccacaccccagcccacc

SEQ ID NO: 1775603 - RNA, 22 nt, Homo sapiens
cagccuguggagagacccugca

SEQ ID NO: 1775604 - RNA, 19 nt, Homo sapiens
uuaaggaugcuuguacaua

SEQ ID NO: 1775605 - RNA, 20 nt, Homo sapiens
cuaauagggcaauuaauucc

SEQ ID NO: 1775606 - RNA, 23 nt, Homo sapiens
cugccugggaacacgugugcaca

SEQ ID NO: 1775607 - RNA, 17 nt, Homo sapiens
aaagagggcuuccucua

SEQ ID NO: 1775608 - RNA, 15 nt, Homo sapiens
aauucauaccucccu

SEQ ID NO: 1775609 - RNA, 13 nt, Homo sapiens
augaacugccaaa

SEQ ID NO: 1775610 - RNA, 21 nt, Homo sapiens
uaaaacaugcugaaaacuaca

SEQ ID NO: 1775611 - RNA, 15 nt, Homo sapiens
cucaccacuaccagc

SEQ ID NO: 1775612 - RNA, 12 nt, Homo sapiens
gcaucagcuuuu

SEQ ID NO: 1775613 - RNA, 23 nt, Homo sapiens
gggaccugccacugcacaccagc

SEQ ID NO: 1775614 - RNA, 21 nt, Homo sapiens
gcuguuuauuuauucacugua

SEQ ID NO: 1775615 - RNA, 19 nt, Homo sapiens
uuguaugaaauauauguga

SEQ ID NO: 1775616 - RNA, 11 nt, Homo sapiens
uaggggaugag

SEQ ID NO: 1775617 - RNA, 16 nt, Homo sapiens
ugucucaaauucaugg

SEQ ID NO: 1775618 - RNA, 17 nt, Homo sapiens
acuucccaauugccaca

SEQ ID NO: 1775619 - RNA, 15 nt, Homo sapiens
guuauuuccugagaa

SEQ ID NO: 1775620 - RNA, 21 nt, Homo sapiens
cuguuccuuucagaugaccuu

SEQ ID NO: 1775621 - RNA, 15 nt, Homo sapiens
agcugcaucuacuca

SEQ ID NO: 1775622 - RNA, 16 nt, Homo sapiens
acagccuuaccaaagc

SEQ ID NO: 1775623 - RNA, 16 nt, Homo sapiens
gcaagaaggaaggagg

SEQ ID NO: 1775624 - RNA, 16 nt, Homo sapiens
gcaaaacuuuacuuuc

SEQ ID NO: 1775625 - RNA, 19 nt, Homo sapiens
cuugccaucccucccucca

SEQ ID NO: 1775626 - RNA, 22 nt, Homo sapiens
cucaggauauuaguuaaugagc

SEQ ID NO: 1775627 - RNA, 12 nt, Homo sapiens
agaugaugcaag

SEQ ID NO: 1775628 - RNA, 22 nt, Homo sapiens
gugaauuuuccaagaacauagu

SEQ ID NO: 1775629 - RNA, 20 nt, Homo sapiens
caaaaaaaauuuuagcucuu

SEQ ID NO: 1775630 - RNA, 18 nt, Homo sapiens
cauaaccgcacagacauu

SEQ ID NO: 1775631 - RNA, 16 nt, Homo sapiens
gauugcugaaacugug

SEQ ID NO: 1775632 - RNA, 17 nt, Homo sapiens
gaucuguuuuucaccac

SEQ ID NO: 1775633 - RNA, 17 nt, Homo sapiens
aagcagaauaaagcaau

SEQ ID NO: 1775634 - RNA, 21 nt, Homo sapiens
uuaccgguugauugaaauauc

SEQ ID NO: 1775635 - RNA, 13 nt, Homo sapiens
auagaaagcacua

SEQ ID NO: 1775636 - RNA, 18 nt, Homo sapiens
gcuguucucugucgugag

SEQ ID NO: 1775637 - RNA, 21 nt, Homo sapiens
caaagugcuggauuguccuug

SEQ ID NO: 1775638 - RNA, 19 nt, Homo sapiens
uaaacuucuggugugauac

SEQ ID NO: 1775639 - RNA, 19 nt, Homo sapiens
acacacaggucgccaguga

SEQ ID NO: 1775640 - RNA, 16 nt, Homo sapiens
aggauuacuagucaaa

SEQ ID NO: 1775641 - RNA, 20 nt, Homo sapiens
gaaauacugaggggucucca

SEQ ID NO: 1775642 - RNA, 13 nt, Homo sapiens
uggcucuacuucc

SEQ ID NO: 1775643 - RNA, 23 nt, Homo sapiens
ggcagaauaaaccggauccuguu

SEQ ID NO: 1775644 - RNA, 19 nt, Homo sapiens
ccuguaaucccagaacuuu

SEQ ID NO: 1775645 - RNA, 21 nt, Homo sapiens
cuuuucugcauuuugcuauug

SEQ ID NO: 1775646 - RNA, 20 nt, Homo sapiens
augugggccaaguccacugu

SEQ ID NO: 1775647 - RNA, 15 nt, Homo sapiens
aaaccugauuuacua

SEQ ID NO: 1775648 - RNA, 18 nt, Homo sapiens
cagccucagcaacccagg

SEQ ID NO: 1775649 - RNA, 23 nt, Homo sapiens
cccucgacaagaccacacuuugg

SEQ ID NO: 1775650 - RNA, 23 nt, Homo sapiens
uagaggaaaaaacagaucagggc

SEQ ID NO: 1775651 - RNA, 12 nt, Homo sapiens
uagaaacaguga

SEQ ID NO: 1775652 - RNA, 13 nt, Homo sapiens
ccaacuccaugac

SEQ ID NO: 1775653 - RNA, 21 nt, Homo sapiens
agggaacagcagcagugccau

SEQ ID NO: 1775654 - RNA, 21 nt, Homo sapiens
uuaggcaauggugaacuguca

SEQ ID NO: 1775655 - RNA, 16 nt, Homo sapiens
gaaacccuugacuguu

SEQ ID NO: 1775656 - RNA, 16 nt, Homo sapiens
cuuuguucacugugag

SEQ ID NO: 1775657 - RNA, 14 nt, Homo sapiens
cacaguuauacaug

SEQ ID NO: 1775658 - RNA, 12 nt, Homo sapiens
uaaaaucuugca

SEQ ID NO: 1775659 - RNA, 17 nt, Homo sapiens
ugcauaauaaaugcuuc

SEQ ID NO: 1775660 - RNA, 17 nt, Homo sapiens
gaacaguuuacuuggaa

SEQ ID NO: 1775661 - RNA, 18 nt, Homo sapiens
auggcagggggcugcugc

SEQ ID NO: 1775662 - RNA, 16 nt, Homo sapiens
uuuguaaaguuagccu

SEQ ID NO: 1775663 - RNA, 16 nt, Homo sapiens
uuccaugauacuuuaa

SEQ ID NO: 1775664 - RNA, 18 nt, Homo sapiens
gccugagucuccugugcc

SEQ ID NO: 1775665 - RNA, 19 nt, Homo sapiens
acuugcugcccugugcucc

SEQ ID NO: 1775666 - RNA, 17 nt, Homo sapiens
acaucacagaugaauau

SEQ ID NO: 1775667 - RNA, 22 nt, Homo sapiens
ggccucaagagcacacagagaa

SEQ ID NO: 1775668 - RNA, 16 nt, Homo sapiens
gccuaugcaaaccagc

SEQ ID NO: 1775669 - RNA, 13 nt, Homo sapiens
ccuugguggcagg

SEQ ID NO: 1775670 - RNA, 13 nt, Homo sapiens
gcugcgugccauc

SEQ ID NO: 1775671 - RNA, 21 nt, Homo sapiens
acaaacucuugguuucuucaa

SEQ ID NO: 1775672 - RNA, 18 nt, Homo sapiens
caacucuccaauguucua

SEQ ID NO: 1775673 - RNA, 21 nt, Homo sapiens
uauuuuuuaaagucuauuguu

SEQ ID NO: 1775674 - RNA, 23 nt, Homo sapiens
ccagucgcccuuacuucuugccc

SEQ ID NO: 1775675 - RNA, 15 nt, Homo sapiens
ccccacgggaacauu

SEQ ID NO: 1775676 - RNA, 18 nt, Homo sapiens
acauuaaugagaauuccu

SEQ ID NO: 1775677 - RNA, 14 nt, Homo sapiens
ucagaccugcauug

SEQ ID NO: 1775678 - RNA, 18 nt, Homo sapiens
gaccccgagaagugcucu

SEQ ID NO: 1775679 - RNA, 21 nt, Homo sapiens
gucccaugaccuugggguaca

SEQ ID NO: 1775680 - RNA, 23 nt, Homo sapiens
agguuuuuaaguugucugucuga

SEQ ID NO: 1775681 - RNA, 15 nt, Homo sapiens
uuggaagaugcagaa

SEQ ID NO: 1775682 - RNA, 17 nt, Homo sapiens
uuaauaaacucacaacu

SEQ ID NO: 1775683 - RNA, 22 nt, Homo sapiens
gaaguacucauacauguuacaa

SEQ ID NO: 1775684 - RNA, 19 nt, Homo sapiens
auguacgcugcgugccaug

SEQ ID NO: 1775685 - RNA, 19 nt, Homo sapiens
ccuuggcuaguaaaagcca

SEQ ID NO: 1775686 - RNA, 20 nt, Homo sapiens
uggaaacacuaggugccugc

SEQ ID NO: 1775687 - RNA, 19 nt, Homo sapiens
cgccccccgccucucccca

SEQ ID NO: 1775688 - RNA, 16 nt, Homo sapiens
ucccaucgcugucaca

SEQ ID NO: 1775689 - RNA, 16 nt, Homo sapiens
ccugaaacacuggacc

SEQ ID NO: 1775690 - RNA, 16 nt, Homo sapiens
cuauauaaauauguca

SEQ ID NO: 1775691 - RNA, 20 nt, Homo sapiens
gcacucuuuaacacauucuu

SEQ ID NO: 1775692 - RNA, 22 nt, Homo sapiens
ugcugaaggaagaaaaaguguu

SEQ ID NO: 1775693 - RNA, 20 nt, Homo sapiens
ugcaggccaggccagcugcc

SEQ ID NO: 1775694 - RNA, 19 nt, Homo sapiens
uagacauuuuaagcauuuu

SEQ ID NO: 1775695 - RNA, 20 nt, Homo sapiens
uuaagcacacuugacaucaa

SEQ ID NO: 1775696 - RNA, 14 nt, Homo sapiens
cacggaaaugcagu

SEQ ID NO: 1775697 - RNA, 13 nt, Homo sapiens
uagaaaucucauc

SEQ ID NO: 1775698 - RNA, 21 nt, Homo sapiens
aggaguuuuauauacugugua

SEQ ID NO: 1775699 - RNA, 19 nt, Homo sapiens
aacaucuuaguugaugcua

SEQ ID NO: 1775700 - RNA, 11 nt, Homo sapiens
guugcugccag

SEQ ID NO: 1775701 - RNA, 17 nt, Homo sapiens
ucagauuucucuuugaa

SEQ ID NO: 1775702 - RNA, 19 nt, Homo sapiens
gaaugucauagucuugaaa

SEQ ID NO: 1775703 - RNA, 18 nt, Homo sapiens
agaguccaagaagccagc

SEQ ID NO: 1775704 - RNA, 19 nt, Homo sapiens
aguacuagaugcaucacug

SEQ ID NO: 1775705 - RNA, 13 nt, Homo sapiens
acgaaaguggaaa

SEQ ID NO: 1775706 - RNA, 20 nt, Homo sapiens
cacagggaggggaugaugac

SEQ ID NO: 1775707 - RNA, 18 nt, Homo sapiens
ggcugagugagccacaga

SEQ ID NO: 1775708 - RNA, 13 nt, Homo sapiens
aaaagagauuuac

SEQ ID NO: 1775709 - RNA, 18 nt, Homo sapiens
agagaaauccuuccuaaa

SEQ ID NO: 1775710 - RNA, 23 nt, Homo sapiens
aaccuguccuaaggaaccuuccu

SEQ ID NO: 1775711 - RNA, 13 nt, Homo sapiens
ccagaaccuggag

SEQ ID NO: 1775712 - RNA, 14 nt, Homo sapiens
auaucaccucucuu

SEQ ID NO: 1775713 - RNA, 23 nt, Homo sapiens
agacacugccgacaucagcauug

SEQ ID NO: 1775714 - RNA, 13 nt, Homo sapiens
ccacaagcacaau

SEQ ID NO: 1775715 - RNA, 16 nt, Homo sapiens
uaaggaggcacugcug

SEQ ID NO: 1775716 - RNA, 13 nt, Homo sapiens
cagaauugcacau

SEQ ID NO: 1775717 - RNA, 13 nt, Homo sapiens
caauaacauuccc

SEQ ID NO: 1775718 - RNA, 21 nt, Homo sapiens
acaucccgggacgcagcagga

SEQ ID NO: 1775719 - RNA, 15 nt, Homo sapiens
uuaagaacaagcagu

SEQ ID NO: 1775720 - RNA, 17 nt, Homo sapiens
agucaccccaaguaguc

SEQ ID NO: 1775721 - RNA, 13 nt, Homo sapiens
gugcccaugaaga

SEQ ID NO: 1775722 - RNA, 19 nt, Homo sapiens
ccaccauuccugccuuuaa

SEQ ID NO: 1775723 - RNA, 17 nt, Homo sapiens
cuuuaugcaaauacaau

SEQ ID NO: 1775724 - RNA, 20 nt, Homo sapiens
aacacuccacccccuccagc

SEQ ID NO: 1775725 - RNA, 17 nt, Homo sapiens
uacguuuuucuggugcu

SEQ ID NO: 1775726 - RNA, 15 nt, Homo sapiens
agccucaauuuccuc

SEQ ID NO: 1775727 - RNA, 13 nt, Homo sapiens
augucaccaccuu

SEQ ID NO: 1775728 - RNA, 13 nt, Homo sapiens
ucccuaccuugcc

SEQ ID NO: 1775729 - RNA, 20 nt, Homo sapiens
acuugccucuuuuaccugcu

SEQ ID NO: 1775730 - RNA, 20 nt, Homo sapiens
augaagcaagccccacuuau

SEQ ID NO: 1775731 - RNA, 20 nt, Homo sapiens
cuguggaaugagugugcaug

SEQ ID NO: 1775732 - RNA, 18 nt, Homo sapiens
gaaggacagcucuucccc

SEQ ID NO: 1775733 - RNA, 22 nt, Homo sapiens
aaccaaagcugccugugccaug

SEQ ID NO: 1775734 - RNA, 14 nt, Homo sapiens
gguaaaauacauau

SEQ ID NO: 1775735 - RNA, 13 nt, Homo sapiens
ugcguguguuugg

SEQ ID NO: 1775736 - RNA, 17 nt, Homo sapiens
auggcagcuuuccucaa

SEQ ID NO: 1775737 - RNA, 22 nt, Homo sapiens
aaagaaguaugguaaucuuuac

SEQ ID NO: 1775738 - RNA, 16 nt, Homo sapiens
uuccugauacaugacu

SEQ ID NO: 1775739 - RNA, 18 nt, Homo sapiens
acagcaaaaaaagcaacu

SEQ ID NO: 1775740 - RNA, 19 nt, Homo sapiens
caggcccccaccacacauc

SEQ ID NO: 1775741 - RNA, 15 nt, Homo sapiens
gccagcagcaccugc

SEQ ID NO: 1775742 - RNA, 12 nt, Homo sapiens
gaaaacauaugc

SEQ ID NO: 1775743 - RNA, 16 nt, Homo sapiens
auaauuguacuuugaa

SEQ ID NO: 1775744 - RNA, 14 nt, Homo sapiens
gagguggagccaag

SEQ ID NO: 1775745 - RNA, 19 nt, Homo sapiens
cugcuucuaccaacuggaa

SEQ ID NO: 1775746 - RNA, 22 nt, Homo sapiens
aaugucaacagauccgacuuug

SEQ ID NO: 1775747 - RNA, 20 nt, Homo sapiens
aacggugaccagcaaauccu

SEQ ID NO: 1775748 - RNA, 16 nt, Homo sapiens
aagaaaaugcuugaca

SEQ ID NO: 1775749 - RNA, 21 nt, Homo sapiens
aggguuuuuuuuaaugugaau

SEQ ID NO: 1775750 - RNA, 23 nt, Homo sapiens
accccaagggggcugcugcuccu

SEQ ID NO: 1775751 - RNA, 13 nt, Homo sapiens
cucaaacagucuu

SEQ ID NO: 1775752 - RNA, 19 nt, Homo sapiens
cagaccccacccuacgcuc

SEQ ID NO: 1775753 - RNA, 15 nt, Homo sapiens
acccuccuccuguca

SEQ ID NO: 1775754 - RNA, 16 nt, Homo sapiens
caucaggagcugcuca

SEQ ID NO: 1775755 - RNA, 18 nt, Homo sapiens
uuuuaaaugaaaguauug

SEQ ID NO: 1775756 - RNA, 14 nt, Homo sapiens
agcaggauuucuca

SEQ ID NO: 1775757 - RNA, 13 nt, Homo sapiens
aggcuccuguuag

SEQ ID NO: 1775758 - RNA, 20 nt, Homo sapiens
caauguacaggaaguaguuc

SEQ ID NO: 1775759 - RNA, 11 nt, Homo sapiens
uaacacuuugg

SEQ ID NO: 1775760 - RNA, 13 nt, Homo sapiens
uccuacacuugag

SEQ ID NO: 1775761 - RNA, 22 nt, Homo sapiens
acacacagaaaauauacuguaa

SEQ ID NO: 1775762 - RNA, 13 nt, Homo sapiens
auuuagugucuug

SEQ ID NO: 1775763 - RNA, 21 nt, Homo sapiens
accucuccaaccuaacuggcu

SEQ ID NO: 1775764 - RNA, 22 nt, Homo sapiens
gauagcccaggagcaacagccu

SEQ ID NO: 1775765 - RNA, 21 nt, Homo sapiens
aucagcucacuggcaggaaag

SEQ ID NO: 1775766 - RNA, 12 nt, Homo sapiens
accuacuccugg

SEQ ID NO: 1775767 - RNA, 20 nt, Homo sapiens
ucuugguguuugacuguaau

SEQ ID NO: 1775768 - RNA, 15 nt, Homo sapiens
gcuuuuauaguuuag

SEQ ID NO: 1775769 - RNA, 18 nt, Homo sapiens
ucacaguaaagaguacac

SEQ ID NO: 1775770 - RNA, 16 nt, Homo sapiens
uucaccaagugcaaua

SEQ ID NO: 1775771 - RNA, 21 nt, Homo sapiens
auguuuuuauaaaagcaaaag

SEQ ID NO: 1775772 - RNA, 18 nt, Homo sapiens
gucccaccccuaccucua

SEQ ID NO: 1775773 - RNA, 22 nt, Homo sapiens
aggaaagaaagagcaucaggaa

SEQ ID NO: 1775774 - RNA, 16 nt, Homo sapiens
caauuuucagguuucu

SEQ ID NO: 1775775 - RNA, 23 nt, Homo sapiens
uugagagcccgcgugcuggagaa

SEQ ID NO: 1775776 - RNA, 15 nt, Homo sapiens
gcucgagcaguccug

SEQ ID NO: 1775777 - RNA, 19 nt, Homo sapiens
gacaaacugcaccaguugc

SEQ ID NO: 1775778 - RNA, 12 nt, Homo sapiens
ccagcaccacac

SEQ ID NO: 1775779 - RNA, 15 nt, Homo sapiens
gucaugcacaugccu

SEQ ID NO: 1775780 - RNA, 16 nt, Homo sapiens
agacauguaucacugu

SEQ ID NO: 1775781 - RNA, 12 nt, Homo sapiens
aaaagugggcca

SEQ ID NO: 1775782 - RNA, 15 nt, Homo sapiens
uucaagccucuaaac

SEQ ID NO: 1775783 - RNA, 15 nt, Homo sapiens
aucgcgccacugcac

SEQ ID NO: 1775784 - RNA, 21 nt, Homo sapiens
cugcucagagcuuuaaaagua

SEQ ID NO: 1775785 - RNA, 22 nt, Homo sapiens
gaaacuccaccuauuuugcaaa

SEQ ID NO: 1775786 - RNA, 17 nt, Homo sapiens
gaagcuuuuuguugccu

SEQ ID NO: 1775787 - RNA, 22 nt, Homo sapiens
ggaaauaaaauuuaggaccaau

SEQ ID NO: 1775788 - RNA, 18 nt, Homo sapiens
guaccuugaacacugggg

SEQ ID NO: 1775789 - RNA, 15 nt, Homo sapiens
aucguccauccucuu

SEQ ID NO: 1775790 - RNA, 14 nt, Homo sapiens
cucccacaugaugu

SEQ ID NO: 1775791 - RNA, 12 nt, Homo sapiens
acuggccugcac

SEQ ID NO: 1775792 - RNA, 20 nt, Homo sapiens
uugguuuuuuguucuugcga

SEQ ID NO: 1775793 - RNA, 17 nt, Homo sapiens
uuauuuguacaguucag

SEQ ID NO: 1775794 - RNA, 15 nt, Homo sapiens
cagccacgcugauaa

SEQ ID NO: 1775795 - RNA, 12 nt, Homo sapiens
auggaucagauc

SEQ ID NO: 1775796 - RNA, 20 nt, Homo sapiens
acuauaaacuuaagggcaag

SEQ ID NO: 1775797 - RNA, 19 nt, Homo sapiens
ugcauuuugugugaugcau

SEQ ID NO: 1775798 - RNA, 20 nt, Homo sapiens
cuuuaacuuaguauuuuacc

SEQ ID NO: 1775799 - RNA, 20 nt, Homo sapiens
ucucaggaccacccugccaa

SEQ ID NO: 1775800 - RNA, 16 nt, Homo sapiens
agacacuuuaccucuu

SEQ ID NO: 1775801 - RNA, 22 nt, Homo sapiens
ugagcuugcuuuuaagagcaau

SEQ ID NO: 1775802 - RNA, 15 nt, Homo sapiens
caugucaugugagug

SEQ ID NO: 1775803 - RNA, 12 nt, Homo sapiens
ugauucuugccu

SEQ ID NO: 1775804 - RNA, 20 nt, Homo sapiens
caauuaaaacuaagcacaaa

SEQ ID NO: 1775805 - RNA, 16 nt, Homo sapiens
aaacccaaacuuccaa

SEQ ID NO: 1775806 - RNA, 16 nt, Homo sapiens
aggacuguggagggga

SEQ ID NO: 1775807 - RNA, 16 nt, Homo sapiens
gaaucuguaucagaaa

SEQ ID NO: 1775808 - RNA, 21 nt, Homo sapiens
uauguaucuggguucuaacca

SEQ ID NO: 1775809 - RNA, 16 nt, Homo sapiens
cuuucaucuuugugga

SEQ ID NO: 1775810 - RNA, 23 nt, Homo sapiens
cccugggccuggcagcucagcuu

SEQ ID NO: 1775811 - RNA, 16 nt, Homo sapiens
ccaacccgaggcaaua

SEQ ID NO: 1775812 - RNA, 17 nt, Homo sapiens
ugcugcucccaucugca

SEQ ID NO: 1775813 - RNA, 23 nt, Homo sapiens
accuagggacacacaggcagcug

SEQ ID NO: 1775814 - RNA, 16 nt, Homo sapiens
auguauuuugucauau

SEQ ID NO: 1775815 - RNA, 16 nt, Homo sapiens
cuccacuuccaagcaa

SEQ ID NO: 1775816 - RNA, 15 nt, Homo sapiens
aggcuggauggcucc

SEQ ID NO: 1775817 - RNA, 19 nt, Homo sapiens
uauguuuggaauaaaguca

SEQ ID NO: 1775818 - RNA, 18 nt, Homo sapiens
uucauuuggaugcaguga

SEQ ID NO: 1775819 - RNA, 20 nt, Homo sapiens
aggagaucgacaccauccug

SEQ ID NO: 1775820 - RNA, 22 nt, Homo sapiens
uucuuuaagcagcgccagugac

SEQ ID NO: 1775821 - RNA, 12 nt, Homo sapiens
guccccaccagc

SEQ ID NO: 1775822 - RNA, 16 nt, Homo sapiens
caaauguuagagccau

SEQ ID NO: 1775823 - RNA, 19 nt, Homo sapiens
aaugcugcaggauggacug

SEQ ID NO: 1775824 - RNA, 17 nt, Homo sapiens
accccggugucaucccu

SEQ ID NO: 1775825 - RNA, 15 nt, Homo sapiens
cuguaaacuguguau

SEQ ID NO: 1775826 - RNA, 15 nt, Homo sapiens
ugugaguccuguuga

SEQ ID NO: 1775827 - RNA, 15 nt, Homo sapiens
aaacagagccugccu

SEQ ID NO: 1775828 - RNA, 20 nt, Homo sapiens
auaagugcucaauagcuuga

SEQ ID NO: 1775829 - RNA, 14 nt, Homo sapiens
ucccaccucugagg

SEQ ID NO: 1775830 - RNA, 20 nt, Homo sapiens
uuccuaagccuguugcugaa

SEQ ID NO: 1775831 - RNA, 13 nt, Homo sapiens
auaaaagacuuuu

SEQ ID NO: 1775832 - RNA, 16 nt, Homo sapiens
ugcugaagacauucaa

SEQ ID NO: 1775833 - RNA, 19 nt, Homo sapiens
aaauauaaacugugagaua

SEQ ID NO: 1775834 - RNA, 15 nt, Homo sapiens
acaugacaacuuugc

SEQ ID NO: 1775835 - RNA, 16 nt, Homo sapiens
aacuagagggaccuau

SEQ ID NO: 1775836 - RNA, 16 nt, Homo sapiens
cacauacacacucaua

SEQ ID NO: 1775837 - RNA, 16 nt, Homo sapiens
auauuucaauaacuua

SEQ ID NO: 1775838 - RNA, 16 nt, Homo sapiens
guucuguuuggcacuu

SEQ ID NO: 1775839 - RNA, 22 nt, Homo sapiens
ucugcaugucuacucagcauuu

SEQ ID NO: 1775840 - RNA, 23 nt, Homo sapiens
uuugauaccauggcacugacaau

SEQ ID NO: 1775841 - RNA, 23 nt, Homo sapiens
ccucuuguaagucaucuacuuaa

SEQ ID NO: 1775842 - RNA, 18 nt, Homo sapiens
gggcuaggggacaucaga

SEQ ID NO: 1775843 - RNA, 15 nt, Homo sapiens
uuccacgcugauguu

SEQ ID NO: 1775844 - RNA, 16 nt, Homo sapiens
agugggugguggaucu

SEQ ID NO: 1775845 - RNA, 20 nt, Homo sapiens
ggcuggagugcaaugacaca

SEQ ID NO: 1775846 - RNA, 15 nt, Homo sapiens
aaaacaauaucugca

SEQ ID NO: 1775847 - RNA, 20 nt, Homo sapiens
cagggccuugacaaguacau

SEQ ID NO: 1775848 - RNA, 20 nt, Homo sapiens
auauguagcuuuauccuuag

SEQ ID NO: 1775849 - RNA, 19 nt, Homo sapiens
auacuacaaauuaguguca

SEQ ID NO: 1775850 - RNA, 16 nt, Homo sapiens
gcuuuaaacugcauuu

SEQ ID NO: 1775851 - RNA, 15 nt, Homo sapiens
aucccauuggcaaaa

SEQ ID NO: 1775852 - RNA, 21 nt, Homo sapiens
cuaaauuuggggacagauuca

SEQ ID NO: 1775853 - RNA, 20 nt, Homo sapiens
uaaguuuauuuauggcucuu

SEQ ID NO: 1775854 - RNA, 18 nt, Homo sapiens
ugagcaauaugucaguca

SEQ ID NO: 1775855 - RNA, 15 nt, Homo sapiens
ugucauaaaugucac

SEQ ID NO: 1775856 - RNA, 21 nt, Homo sapiens
caauaauaaauauuuuugcca

SEQ ID NO: 1775857 - RNA, 20 nt, Homo sapiens
cccgcaggccugccuucuca

SEQ ID NO: 1775858 - RNA, 14 nt, Homo sapiens
aggaaaguccuugu

SEQ ID NO: 1775859 - RNA, 20 nt, Homo sapiens
cagacugaacuuacacugua

SEQ ID NO: 1775860 - RNA, 16 nt, Homo sapiens
aaucuucccugucagg

SEQ ID NO: 1775861 - RNA, 22 nt, Homo sapiens
cuuauuaaaaccuuaguguccu

SEQ ID NO: 1775862 - RNA, 21 nt, Homo sapiens
cuuuuauuuuuuaaguucaau

SEQ ID NO: 1775863 - RNA, 18 nt, Homo sapiens
cuccagggcgagcacuuu

SEQ ID NO: 1775864 - RNA, 14 nt, Homo sapiens
caaacuaccuucca

SEQ ID NO: 1775865 - RNA, 18 nt, Homo sapiens
gcaucaauacaaccagcc

SEQ ID NO: 1775866 - RNA, 12 nt, Homo sapiens
gagaugucauca

SEQ ID NO: 1775867 - RNA, 17 nt, Homo sapiens
cuguaauuauuguguau

SEQ ID NO: 1775868 - RNA, 16 nt, Homo sapiens
agggaugucuguugaa

SEQ ID NO: 1775869 - RNA, 18 nt, Homo sapiens
aauuuaaaacauuacucu

SEQ ID NO: 1775870 - RNA, 20 nt, Homo sapiens
agcacagaaggaaucugugc

SEQ ID NO: 1775871 - RNA, 14 nt, Homo sapiens
ccagcuaucuguca

SEQ ID NO: 1775872 - RNA, 18 nt, Homo sapiens
aagggcuugauggugaca

SEQ ID NO: 1775873 - RNA, 22 nt, Homo sapiens
caaccagccaggcagguccaca

SEQ ID NO: 1775874 - RNA, 19 nt, Homo sapiens
cuguugagacugauucaga

SEQ ID NO: 1775875 - RNA, 12 nt, Homo sapiens
ucuccucaugcc

SEQ ID NO: 1775876 - RNA, 12 nt, Homo sapiens
gccucucagguu

SEQ ID NO: 1775877 - RNA, 19 nt, Homo sapiens
uuucuucaauacaaaaagc

SEQ ID NO: 1775878 - RNA, 21 nt, Homo sapiens
auucauuguguuaccuguaga

SEQ ID NO: 1775879 - RNA, 15 nt, Homo sapiens
gaugcagacacagau

SEQ ID NO: 1775880 - RNA, 17 nt, Homo sapiens
gugaccaaaaugccaaa

SEQ ID NO: 1775881 - RNA, 23 nt, Homo sapiens
ccgggagguggagguugcaguga

SEQ ID NO: 1775882 - RNA, 16 nt, Homo sapiens
guuguuaaaaauguca

SEQ ID NO: 1775883 - RNA, 19 nt, Homo sapiens
cugugucuaggcaggcaag

SEQ ID NO: 1775884 - RNA, 13 nt, Homo sapiens
acaaauacauuca

SEQ ID NO: 1775885 - RNA, 12 nt, Homo sapiens
gcuguugucaca

SEQ ID NO: 1775886 - RNA, 13 nt, Homo sapiens
gaauggaauucua

SEQ ID NO: 1775887 - RNA, 14 nt, Homo sapiens
uuuagaauauauca

SEQ ID NO: 1775888 - RNA, 19 nt, Homo sapiens
gaccccccuuucacaggca

SEQ ID NO: 1775889 - RNA, 17 nt, Homo sapiens
aaaaaccgaauaaaugu

SEQ ID NO: 1775890 - RNA, 14 nt, Homo sapiens
gagagcaaagugac

SEQ ID NO: 1775891 - RNA, 13 nt, Homo sapiens
cuuguauggauau

SEQ ID NO: 1775892 - RNA, 18 nt, Homo sapiens
augggagagucaagggaa

SEQ ID NO: 1775893 - RNA, 22 nt, Homo sapiens
uacaucgaggcucuugcucaag

SEQ ID NO: 1775894 - RNA, 20 nt, Homo sapiens
cuagagugcgguggcgcgau

SEQ ID NO: 1775895 - RNA, 21 nt, Homo sapiens
uccccaccccuccuggucugu

SEQ ID NO: 1775896 - RNA, 22 nt, Homo sapiens
ucuguagcuauaaugagcaugu

SEQ ID NO: 1775897 - RNA, 15 nt, Homo sapiens
uaaagaauacuugaa

SEQ ID NO: 1775898 - RNA, 15 nt, Homo sapiens
uauauaauacauuaa

SEQ ID NO: 1775899 - RNA, 21 nt, Homo sapiens
caggcuccugguuguuccucu

SEQ ID NO: 1775900 - RNA, 15 nt, Homo sapiens
cuugcuggucuaguc

SEQ ID NO: 1775901 - RNA, 20 nt, Homo sapiens
uaugcaugaaguaauaugca

SEQ ID NO: 1775902 - RNA, 21 nt, Homo sapiens
gcugaggggcuucaaccacuc

SEQ ID NO: 1775903 - RNA, 15 nt, Homo sapiens
cagacugaugccaga

SEQ ID NO: 1775904 - RNA, 21 nt, Homo sapiens
uguaucaacaaaaggagccaa

SEQ ID NO: 1775905 - RNA, 14 nt, Homo sapiens
acaugcuucagugc

SEQ ID NO: 1775906 - RNA, 18 nt, Homo sapiens
aggaaauauauaugugug

SEQ ID NO: 1775907 - RNA, 13 nt, Homo sapiens
uccuccccagcgc

SEQ ID NO: 1775908 - RNA, 12 nt, Homo sapiens
uuguucuacucu

SEQ ID NO: 1775909 - RNA, 11 nt, Homo sapiens
acacacacaga

SEQ ID NO: 1775910 - RNA, 11 nt, Homo sapiens
ucacacacuga

SEQ ID NO: 1775911 - RNA, 15 nt, Homo sapiens
cuugcuaccugugag

SEQ ID NO: 1775912 - RNA, 22 nt, Homo sapiens
uucaggacauggggcauagaaa

SEQ ID NO: 1775913 - RNA, 17 nt, Homo sapiens
aaauaaucuacuguaca

SEQ ID NO: 1775914 - RNA, 14 nt, Homo sapiens
uccaagaauggagg

SEQ ID NO: 1775915 - RNA, 17 nt, Homo sapiens
ccugaaggcaccuguca

SEQ ID NO: 1775916 - RNA, 17 nt, Homo sapiens
aguagacuuggacccaa

SEQ ID NO: 1775917 - RNA, 23 nt, Homo sapiens
aaaagcaggcgacaaaaucuccu

SEQ ID NO: 1775918 - RNA, 22 nt, Homo sapiens
ugguguugauacgugugugaag

SEQ ID NO: 1775919 - RNA, 17 nt, Homo sapiens
cugggccccacuggaca

SEQ ID NO: 1775920 - RNA, 18 nt, Homo sapiens
ugcaaaucaaacauauuc

SEQ ID NO: 1775921 - RNA, 18 nt, Homo sapiens
accaaaucugacauauua

SEQ ID NO: 1775922 - RNA, 20 nt, Homo sapiens
augcuacugcugccuaguua

SEQ ID NO: 1775923 - RNA, 21 nt, Homo sapiens
uauaaagcacagauuugcauu

SEQ ID NO: 1775924 - RNA, 16 nt, Homo sapiens
auauccuugcgaugua

SEQ ID NO: 1775925 - RNA, 13 nt, Homo sapiens
uucuuuccucaca

SEQ ID NO: 1775926 - RNA, 23 nt, Homo sapiens
cuggagaguguggggaaugggaa

SEQ ID NO: 1775927 - RNA, 20 nt, Homo sapiens
aacucaaaacacccaaaaau

SEQ ID NO: 1775928 - RNA, 22 nt, Homo sapiens
aacacccccaucaccuucucaa

SEQ ID NO: 1775929 - RNA, 14 nt, Homo sapiens
cuaugcauguguuu

SEQ ID NO: 1775930 - RNA, 21 nt, Homo sapiens
agugguccauggaaugcuuga

SEQ ID NO: 1775931 - RNA, 14 nt, Homo sapiens
uaaacuguacagug

SEQ ID NO: 1775932 - RNA, 22 nt, Homo sapiens
ucuuccuuccacaguuaucuua

SEQ ID NO: 1775933 - RNA, 19 nt, Homo sapiens
gacagguguauggagucac

SEQ ID NO: 1775934 - RNA, 22 nt, Homo sapiens
aaggccagguguggugacucac

SEQ ID NO: 1775935 - RNA, 18 nt, Homo sapiens
accaauugugcugccauu

SEQ ID NO: 1775936 - RNA, 18 nt, Homo sapiens
ccagcauaguucugcaau

SEQ ID NO: 1775937 - RNA, 22 nt, Homo sapiens
cucggcaccagugccucagugc

SEQ ID NO: 1775938 - RNA, 13 nt, Homo sapiens
cuaauaauuauuc

SEQ ID NO: 1775939 - RNA, 15 nt, Homo sapiens
cagaucucccacugc

SEQ ID NO: 1775940 - RNA, 22 nt, Homo sapiens
cuaugcauuuucuucacagugc

SEQ ID NO: 1775941 - RNA, 14 nt, Homo sapiens
gaggugacacucca

SEQ ID NO: 1775942 - RNA, 23 nt, Homo sapiens
agauuugcccauuuacacuuuug

SEQ ID NO: 1775943 - RNA, 18 nt, Homo sapiens
gccgccggaguccacucc

SEQ ID NO: 1775944 - RNA, 14 nt, Homo sapiens
aaaaugagaguuuu

SEQ ID NO: 1775945 - RNA, 19 nt, Homo sapiens
acugugaggggaaggccuu

SEQ ID NO: 1775946 - RNA, 20 nt, Homo sapiens
auuuaagugaauacauuaac

SEQ ID NO: 1775947 - RNA, 20 nt, Homo sapiens
cucccaaaguguuaggauua

SEQ ID NO: 1775948 - RNA, 20 nt, Homo sapiens
accacucuuccugaguucag

SEQ ID NO: 1775949 - RNA, 15 nt, Homo sapiens
aggagaaaggcauga

SEQ ID NO: 1775950 - RNA, 20 nt, Homo sapiens
caagcacccacugugcacca

SEQ ID NO: 1775951 - RNA, 19 nt, Homo sapiens
gccagacaugccacaagga

SEQ ID NO: 1775952 - RNA, 16 nt, Homo sapiens
ucccaucccaucccau

SEQ ID NO: 1775953 - RNA, 14 nt, Homo sapiens
caaugcucaaacac

SEQ ID NO: 1775954 - RNA, 14 nt, Homo sapiens
cacacgaugcauuu

SEQ ID NO: 1775955 - RNA, 21 nt, Homo sapiens
ccaggaauauaugucagugau

SEQ ID NO: 1775956 - RNA, 16 nt, Homo sapiens
caucuugcagcauuua

SEQ ID NO: 1775957 - RNA, 13 nt, Homo sapiens
agucccucccuca

SEQ ID NO: 1775958 - RNA, 22 nt, Homo sapiens
ugaauguuacaacgaauuuaca

SEQ ID NO: 1775959 - RNA, 21 nt, Homo sapiens
cagccguuuguuccccaagac

SEQ ID NO: 1775960 - RNA, 16 nt, Homo sapiens
uacccacuggucugcu

SEQ ID NO: 1775961 - RNA, 23 nt, Homo sapiens
gacagccauacuuccagcgaaau

SEQ ID NO: 1775962 - RNA, 12 nt, Homo sapiens
cucacacacaaa

SEQ ID NO: 1775963 - RNA, 12 nt, Homo sapiens
uacccacauuac

SEQ ID NO: 1775964 - RNA, 13 nt, Homo sapiens
ccuugagcacuca

SEQ ID NO: 1775965 - RNA, 16 nt, Homo sapiens
accacaaggggcucca

SEQ ID NO: 1775966 - RNA, 14 nt, Homo sapiens
agcagagugcuuua

SEQ ID NO: 1775967 - RNA, 13 nt, Homo sapiens
ggcacccaccacu

SEQ ID NO: 1775968 - RNA, 14 nt, Homo sapiens
gaaggcauaugcac

SEQ ID NO: 1775969 - RNA, 17 nt, Homo sapiens
aaaauugggcaugccau

SEQ ID NO: 1775970 - RNA, 22 nt, Homo sapiens
gaccauccuggcuaacacguga

SEQ ID NO: 1775971 - RNA, 12 nt, Homo sapiens
agugagcccaug

SEQ ID NO: 1775972 - RNA, 20 nt, Homo sapiens
agauuuugcccuugacaaag

SEQ ID NO: 1775973 - RNA, 15 nt, Homo sapiens
guauuccagcuggug

SEQ ID NO: 1775974 - RNA, 14 nt, Homo sapiens
cuacugcaaauggc

SEQ ID NO: 1775975 - RNA, 21 nt, Homo sapiens
cacuauagccuaggugacaga

SEQ ID NO: 1775976 - RNA, 19 nt, Homo sapiens
cuggccacaguuguuugau

SEQ ID NO: 1775977 - RNA, 21 nt, Homo sapiens
aguguaacgaugcacuuugga

SEQ ID NO: 1775978 - RNA, 16 nt, Homo sapiens
gccucucgaguucucc

SEQ ID NO: 1775979 - RNA, 19 nt, Homo sapiens
cucuuuaagggaguguacu

SEQ ID NO: 1775980 - RNA, 14 nt, Homo sapiens
caguagcccagagu

SEQ ID NO: 1775981 - RNA, 10 nt, Homo sapiens
cuugauggag

SEQ ID NO: 1775982 - RNA, 16 nt, Homo sapiens
aacuguaaaucacuug

SEQ ID NO: 1775983 - RNA, 13 nt, Homo sapiens
ggcgugggcgcuu

SEQ ID NO: 1775984 - RNA, 21 nt, Homo sapiens
gacucaagacuuccagagccu

SEQ ID NO: 1775985 - RNA, 20 nt, Homo sapiens
gaacauuuacacauucucac

SEQ ID NO: 1775986 - RNA, 13 nt, Homo sapiens
auuauaguacuga

SEQ ID NO: 1775987 - RNA, 12 nt, Homo sapiens
aaguuguugcau

SEQ ID NO: 1775988 - RNA, 15 nt, Homo sapiens
cuccaacucaacuca

SEQ ID NO: 1775989 - RNA, 14 nt, Homo sapiens
uccuaagcucagag

SEQ ID NO: 1775990 - RNA, 19 nt, Homo sapiens
auuuaaagggaaaacccuc

SEQ ID NO: 1775991 - RNA, 18 nt, Homo sapiens
ccacauccugugggaccu

SEQ ID NO: 1775992 - RNA, 17 nt, Homo sapiens
cguuuccuuucauuuac

SEQ ID NO: 1775993 - RNA, 21 nt, Homo sapiens
cgucuacucauuccccggggc

SEQ ID NO: 1775994 - RNA, 17 nt, Homo sapiens
gugcaaucacagcucac

SEQ ID NO: 1775995 - RNA, 21 nt, Homo sapiens
aaagcaucuauucccaaagaa

SEQ ID NO: 1775996 - RNA, 21 nt, Homo sapiens
cagcaaucuguguacugaaca

SEQ ID NO: 1775997 - RNA, 19 nt, Homo sapiens
ccucagccuaagaaacacu

SEQ ID NO: 1775998 - RNA, 14 nt, Homo sapiens
uuauaucaguuuca

SEQ ID NO: 1775999 - RNA, 17 nt, Homo sapiens
ccccagccccuagccca

SEQ ID NO: 1776000 - RNA, 16 nt, Homo sapiens
gugucaucaaguagua

SEQ ID NO: 1776001 - RNA, 22 nt, Homo sapiens
cugacaauauacaagcuuuuag

SEQ ID NO: 1776002 - RNA, 13 nt, Homo sapiens
uauaaucauauca

SEQ ID NO: 1776003 - RNA, 16 nt, Homo sapiens
acuagugcaauuccaa

SEQ ID NO: 1776004 - RNA, 19 nt, Homo sapiens
aagacaucuuaauccugaa

SEQ ID NO: 1776005 - RNA, 22 nt, Homo sapiens
gcuuaagguuuguuuucauuaa

SEQ ID NO: 1776006 - RNA, 16 nt, Homo sapiens
auucuuauggcugcug

SEQ ID NO: 1776007 - RNA, 20 nt, Homo sapiens
cccagacugaugagcacauc

SEQ ID NO: 1776008 - RNA, 17 nt, Homo sapiens
caaucugcaaaauggag

SEQ ID NO: 1776009 - RNA, 15 nt, Homo sapiens
uuuggaaaauagauu

SEQ ID NO: 1776010 - RNA, 18 nt, Homo sapiens
ugcugauggcugcuggag

SEQ ID NO: 1776011 - RNA, 15 nt, Homo sapiens
agacaugguaaacuu

SEQ ID NO: 1776012 - RNA, 15 nt, Homo sapiens
cccuacuaacauccc

SEQ ID NO: 1776013 - RNA, 17 nt, Homo sapiens
gugacuuacagugccaa

SEQ ID NO: 1776014 - RNA, 15 nt, Homo sapiens
uuaacuucagccagc

SEQ ID NO: 1776015 - RNA, 17 nt, Homo sapiens
guggaacgaacuuucca

SEQ ID NO: 1776016 - RNA, 20 nt, Homo sapiens
accuagguuaacaacccugu

SEQ ID NO: 1776017 - RNA, 17 nt, Homo sapiens
cugaaagagcauuauuc

SEQ ID NO: 1776018 - RNA, 22 nt, Homo sapiens
uaagaaguugcugcagauuccu

SEQ ID NO: 1776019 - RNA, 12 nt, Homo sapiens
auuuagaacuug

SEQ ID NO: 1776020 - RNA, 16 nt, Homo sapiens
aacuauguacuuuaaa

SEQ ID NO: 1776021 - RNA, 17 nt, Homo sapiens
ugcaaaguguauuagga

SEQ ID NO: 1776022 - RNA, 20 nt, Homo sapiens
uccuguaccgucgacaagaa

SEQ ID NO: 1776023 - RNA, 12 nt, Homo sapiens
gacuccaagaac

SEQ ID NO: 1776024 - RNA, 18 nt, Homo sapiens
auccuggagccccugugu

SEQ ID NO: 1776025 - RNA, 21 nt, Homo sapiens
aaagagacccacaauaaacuc

SEQ ID NO: 1776026 - RNA, 14 nt, Homo sapiens
uaaucaagccucug

SEQ ID NO: 1776027 - RNA, 14 nt, Homo sapiens
agaauuauguaaua

SEQ ID NO: 1776028 - RNA, 22 nt, Homo sapiens
gagacacugagucagaauucuu

SEQ ID NO: 1776029 - RNA, 12 nt, Homo sapiens
uuucucugugaa

SEQ ID NO: 1776030 - RNA, 21 nt, Homo sapiens
cauuuggacaaucugcaaaau

SEQ ID NO: 1776031 - RNA, 20 nt, Homo sapiens
cccucagauuccaccuagag

SEQ ID NO: 1776032 - RNA, 14 nt, Homo sapiens
acauaccuugucau

SEQ ID NO: 1776033 - RNA, 14 nt, Homo sapiens
ucauaucuagucac

SEQ ID NO: 1776034 - RNA, 13 nt, Homo sapiens
agggaaugcauua

SEQ ID NO: 1776035 - RNA, 13 nt, Homo sapiens
gaaauuauacuua

SEQ ID NO: 1776036 - RNA, 18 nt, Homo sapiens
gcccuuccucccauuucc

SEQ ID NO: 1776037 - RNA, 23 nt, Homo sapiens
accaggucucccgggaagccacc

SEQ ID NO: 1776038 - RNA, 19 nt, Homo sapiens
ugaaggacgugucucagga

SEQ ID NO: 1776039 - RNA, 18 nt, Homo sapiens
cuuguuguuucuugccug

SEQ ID NO: 1776040 - RNA, 22 nt, Homo sapiens
cucugauuucacauauugcaac

SEQ ID NO: 1776041 - RNA, 14 nt, Homo sapiens
cugagcucuuaucu

SEQ ID NO: 1776042 - RNA, 15 nt, Homo sapiens
cuagcacuugucuca

SEQ ID NO: 1776043 - RNA, 18 nt, Homo sapiens
uaaagaauucgguugaaa

SEQ ID NO: 1776044 - RNA, 16 nt, Homo sapiens
ucaagagcuccuugac

SEQ ID NO: 1776045 - RNA, 22 nt, Homo sapiens
cauaccauuucuacaccucaau

SEQ ID NO: 1776046 - RNA, 17 nt, Homo sapiens
uuauuccaauaugaccu

SEQ ID NO: 1776047 - RNA, 15 nt, Homo sapiens
uugcuuuugcuucua

SEQ ID NO: 1776048 - RNA, 18 nt, Homo sapiens
uauuauauauagaaaaga

SEQ ID NO: 1776049 - RNA, 16 nt, Homo sapiens
acaggcugugacucuu

SEQ ID NO: 1776050 - RNA, 15 nt, Homo sapiens
auguggguugugaua

SEQ ID NO: 1776051 - RNA, 16 nt, Homo sapiens
caagccccacuuauuc

SEQ ID NO: 1776052 - RNA, 23 nt, Homo sapiens
caggcccuguccuaagcacuuua

SEQ ID NO: 1776053 - RNA, 18 nt, Homo sapiens
aagacugaccuugauguc

SEQ ID NO: 1776054 - RNA, 15 nt, Homo sapiens
cccagaaaucagugu

SEQ ID NO: 1776055 - RNA, 16 nt, Homo sapiens
gccacagcaggacuga

SEQ ID NO: 1776056 - RNA, 13 nt, Homo sapiens
cuggccccugugc

SEQ ID NO: 1776057 - RNA, 18 nt, Homo sapiens
uauauuuuuauaagacua

SEQ ID NO: 1776058 - RNA, 19 nt, Homo sapiens
aucccagucugauauucac

SEQ ID NO: 1776059 - RNA, 17 nt, Homo sapiens
acucaaguaccaccaag

SEQ ID NO: 1776060 - RNA, 21 nt, Homo sapiens
uuccagcauguuucucccauu

SEQ ID NO: 1776061 - RNA, 20 nt, Homo sapiens
acauguguuugaacuauugc

SEQ ID NO: 1776062 - RNA, 14 nt, Homo sapiens
ggaacaaguugagc

SEQ ID NO: 1776063 - RNA, 13 nt, Homo sapiens
gaucucaguucuc

SEQ ID NO: 1776064 - RNA, 21 nt, Homo sapiens
cguuugagaagaaaacaucua

SEQ ID NO: 1776065 - RNA, 21 nt, Homo sapiens
aaccucaacugccuacuccaa

SEQ ID NO: 1776066 - RNA, 14 nt, Homo sapiens
acugccuccaugau

SEQ ID NO: 1776067 - RNA, 19 nt, Homo sapiens
cugccauugauccagcuca

SEQ ID NO: 1776068 - RNA, 15 nt, Homo sapiens
uuccccacaaaacaa

SEQ ID NO: 1776069 - RNA, 18 nt, Homo sapiens
ccagagcuggaaggcagg

SEQ ID NO: 1776070 - RNA, 21 nt, Homo sapiens
uggguguuucaguuugaaaau

SEQ ID NO: 1776071 - RNA, 23 nt, Homo sapiens
ucccaguguguguuuaacauuca

SEQ ID NO: 1776072 - RNA, 18 nt, Homo sapiens
ucagugauaucuuucuca

SEQ ID NO: 1776073 - RNA, 19 nt, Homo sapiens
cugccucuccagcacuucu

SEQ ID NO: 1776074 - RNA, 12 nt, Homo sapiens
gucugccuggca

SEQ ID NO: 1776075 - RNA, 18 nt, Homo sapiens
accugcccacccacuccu

SEQ ID NO: 1776076 - RNA, 24 nt, Homo sapiens
ggcauucucucugcucagugaucu

SEQ ID NO: 1776077 - RNA, 19 nt, Homo sapiens
uauauuuguaaacuacaaa

SEQ ID NO: 1776078 - RNA, 18 nt, Homo sapiens
uaucccaaccucucccaa

SEQ ID NO: 1776079 - RNA, 16 nt, Homo sapiens
ugguuuuaaaagagaa

SEQ ID NO: 1776080 - RNA, 17 nt, Homo sapiens
uaauuuuuuacuuucag

SEQ ID NO: 1776081 - RNA, 14 nt, Homo sapiens
ugauuuugugauau

SEQ ID NO: 1776082 - RNA, 14 nt, Homo sapiens
ugcaagugugcaug

SEQ ID NO: 1776083 - RNA, 18 nt, Homo sapiens
aaacauaauaccaccauu

SEQ ID NO: 1776084 - RNA, 17 nt, Homo sapiens
auguggcucagugccuu

SEQ ID NO: 1776085 - RNA, 22 nt, Homo sapiens
ugagcccacaaagccuuaucaa

SEQ ID NO: 1776086 - RNA, 23 nt, Homo sapiens
guauucagcuuuaguagauauua

SEQ ID NO: 1776087 - RNA, 19 nt, Homo sapiens
aagcucggagccagggcuc

SEQ ID NO: 1776088 - RNA, 14 nt, Homo sapiens
accuggaaccagag

SEQ ID NO: 1776089 - RNA, 22 nt, Homo sapiens
cuccagcucaccagccccagug

SEQ ID NO: 1776090 - RNA, 17 nt, Homo sapiens
caggcuguucaccacca

SEQ ID NO: 1776091 - RNA, 13 nt, Homo sapiens
caagcagacacac

SEQ ID NO: 1776092 - RNA, 15 nt, Homo sapiens
cuuguguccugauga

SEQ ID NO: 1776093 - RNA, 20 nt, Homo sapiens
agauggaaaagaaauugcau

SEQ ID NO: 1776094 - RNA, 18 nt, Homo sapiens
acauuucugcacaugguu

SEQ ID NO: 1776095 - RNA, 13 nt, Homo sapiens
uagcaucuucuca

SEQ ID NO: 1776096 - RNA, 20 nt, Homo sapiens
aggcagaggcaggaaacuaa

SEQ ID NO: 1776097 - RNA, 17 nt, Homo sapiens
aguaucucucugccuau

SEQ ID NO: 1776098 - RNA, 20 nt, Homo sapiens
cagguuuucuucacugccag

SEQ ID NO: 1776099 - RNA, 16 nt, Homo sapiens
cauauucuguuggcca

SEQ ID NO: 1776100 - RNA, 18 nt, Homo sapiens
gaugcuuuaccaaacagc

SEQ ID NO: 1776101 - RNA, 12 nt, Homo sapiens
guugaugacugu

SEQ ID NO: 1776102 - RNA, 17 nt, Homo sapiens
ggcacaaaaugugacau

SEQ ID NO: 1776103 - RNA, 16 nt, Homo sapiens
ugccucuuaagccugc

SEQ ID NO: 1776104 - RNA, 21 nt, Homo sapiens
cauggcguaucaggaaagcau

SEQ ID NO: 1776105 - RNA, 16 nt, Homo sapiens
agauguguguucucag

SEQ ID NO: 1776106 - RNA, 16 nt, Homo sapiens
uacaacuuccacucca

SEQ ID NO: 1776107 - RNA, 13 nt, Homo sapiens
agggaaucucuug

SEQ ID NO: 1776108 - RNA, 22 nt, Homo sapiens
aauauuugcuuuauacugagcu

SEQ ID NO: 1776109 - RNA, 15 nt, Homo sapiens
aucagaaguuugcau

SEQ ID NO: 1776110 - RNA, 16 nt, Homo sapiens
uaugaaaugaccucug

SEQ ID NO: 1776111 - RNA, 18 nt, Homo sapiens
augaugcuauuaauacug

SEQ ID NO: 1776112 - RNA, 13 nt, Homo sapiens
cagucucugggag

SEQ ID NO: 1776113 - RNA, 15 nt, Homo sapiens
ccuagcccugggaca

SEQ ID NO: 1776114 - RNA, 23 nt, Homo sapiens
aaacuuuuguaaauuauugauga

SEQ ID NO: 1776115 - RNA, 21 nt, Homo sapiens
gcugaacacaagcaaaccuuc

SEQ ID NO: 1776116 - RNA, 21 nt, Homo sapiens
guaaaaaauacaaacauucua

SEQ ID NO: 1776117 - RNA, 20 nt, Homo sapiens
ucgauuagacuggacagcuu

SEQ ID NO: 1776118 - RNA, 21 nt, Homo sapiens
cuuuugaaaagguaaggugaa

SEQ ID NO: 1776119 - RNA, 23 nt, Homo sapiens
agcugcaugggugccugcugcug

SEQ ID NO: 1776120 - RNA, 20 nt, Homo sapiens
ucaucacgacacauuugccu

SEQ ID NO: 1776121 - RNA, 16 nt, Homo sapiens
gagagcugcauguguc

SEQ ID NO: 1776122 - RNA, 13 nt, Homo sapiens
gaaugaacaaauu

SEQ ID NO: 1776123 - RNA, 14 nt, Homo sapiens
aggcauguacaaaa

SEQ ID NO: 1776124 - RNA, 19 nt, Homo sapiens
guggcccuggcucugcugu

SEQ ID NO: 1776125 - RNA, 20 nt, Homo sapiens
uagacuccauguaguuacuu

SEQ ID NO: 1776126 - RNA, 13 nt, Homo sapiens
acucuugacagcu

SEQ ID NO: 1776127 - RNA, 21 nt, Homo sapiens
auucaguaugauuuauccuca

SEQ ID NO: 1776128 - RNA, 23 nt, Homo sapiens
aucuggcucuggacaggcacuau

SEQ ID NO: 1776129 - RNA, 21 nt, Homo sapiens
uuaucaucccaacagccaaga

SEQ ID NO: 1776130 - RNA, 17 nt, Homo sapiens
cagauauacacauggau

SEQ ID NO: 1776131 - RNA, 22 nt, Homo sapiens
ggcccagagggccugcaaggga

SEQ ID NO: 1776132 - RNA, 16 nt, Homo sapiens
uaauuguugaccuaag

SEQ ID NO: 1776133 - RNA, 23 nt, Homo sapiens
uuaguguucuguuugaaacuaau

SEQ ID NO: 1776134 - RNA, 19 nt, Homo sapiens
gggagggguuaaugcagau

SEQ ID NO: 1776135 - RNA, 16 nt, Homo sapiens
gaaccaauaccuucaa

SEQ ID NO: 1776136 - RNA, 23 nt, Homo sapiens
cuucaaaucauauccucagauau

SEQ ID NO: 1776137 - RNA, 21 nt, Homo sapiens
ggaccaaggagcuuccaucua

SEQ ID NO: 1776138 - RNA, 15 nt, Homo sapiens
ugccuguauuuccaa

SEQ ID NO: 1776139 - RNA, 15 nt, Homo sapiens
gauguuucauaagaa

SEQ ID NO: 1776140 - RNA, 19 nt, Homo sapiens
auuaacaguuuuccaugaa

SEQ ID NO: 1776141 - RNA, 15 nt, Homo sapiens
guaauuuugauuucu

SEQ ID NO: 1776142 - RNA, 19 nt, Homo sapiens
cccucggcauucacacaca

SEQ ID NO: 1776143 - RNA, 22 nt, Homo sapiens
uaugcaguaaauuaucuuggga

SEQ ID NO: 1776144 - RNA, 17 nt, Homo sapiens
aaucaauaaacuguguc

SEQ ID NO: 1776145 - RNA, 19 nt, Homo sapiens
gcuguguucacagaccuca

SEQ ID NO: 1776146 - RNA, 13 nt, Homo sapiens
aggacgagugcuu

SEQ ID NO: 1776147 - RNA, 16 nt, Homo sapiens
uacucucugaguacau

SEQ ID NO: 1776148 - RNA, 11 nt, Homo sapiens
gagacuaggau

SEQ ID NO: 1776149 - RNA, 11 nt, Homo sapiens
ugccacugggc

SEQ ID NO: 1776150 - RNA, 11 nt, Homo sapiens
gugcacuguug

SEQ ID NO: 1776151 - RNA, 22 nt, Homo sapiens
ccacaucaauauugucauuccu

SEQ ID NO: 1776152 - RNA, 14 nt, Homo sapiens
aagaaaacauguaa

SEQ ID NO: 1776153 - RNA, 19 nt, Homo sapiens
aagauggcauccugugaag

SEQ ID NO: 1776154 - RNA, 20 nt, Homo sapiens
cauguauaucuaacuucgaa

SEQ ID NO: 1776155 - RNA, 23 nt, Homo sapiens
uucauaaaaaauaauggugucca

SEQ ID NO: 1776156 - RNA, 14 nt, Homo sapiens
augggguagaaaca

SEQ ID NO: 1776157 - RNA, 16 nt, Homo sapiens
acuuucugacugcaac

SEQ ID NO: 1776158 - RNA, 15 nt, Homo sapiens
caaaacacccaaaaa

SEQ ID NO: 1776159 - RNA, 15 nt, Homo sapiens
aaacaaacacacaca

SEQ ID NO: 1776160 - RNA, 14 nt, Homo sapiens
uaacggcacugugg

SEQ ID NO: 1776161 - RNA, 18 nt, Homo sapiens
cugaucaagaacauguca

SEQ ID NO: 1776162 - RNA, 14 nt, Homo sapiens
ucccagcauuuuga

SEQ ID NO: 1776163 - RNA, 22 nt, Homo sapiens
ccacuucccugggcaaaugaau

SEQ ID NO: 1776164 - RNA, 21 nt, Homo sapiens
uccacuacgcuccugucucca

SEQ ID NO: 1776165 - RNA, 17 nt, Homo sapiens
ucuauuuggaacccaag

SEQ ID NO: 1776166 - RNA, 20 nt, Homo sapiens
auauaauuuccucacugccu

SEQ ID NO: 1776167 - RNA, 14 nt, Homo sapiens
gcaccuaucaccca

SEQ ID NO: 1776168 - RNA, 17 nt, Homo sapiens
caucugucacuugcauu

SEQ ID NO: 1776169 - RNA, 15 nt, Homo sapiens
ucagaucucauggga

SEQ ID NO: 1776170 - RNA, 18 nt, Homo sapiens
accugcacuuaaggcacu

SEQ ID NO: 1776171 - RNA, 20 nt, Homo sapiens
cuugagcaauaaaguggaaa

SEQ ID NO: 1776172 - RNA, 13 nt, Homo sapiens
uuuuaacuuugaa

SEQ ID NO: 1776173 - RNA, 19 nt, Homo sapiens
accgagccccugaacugcu

SEQ ID NO: 1776174 - RNA, 21 nt, Homo sapiens
uuguuaguaugaggcauuugu

SEQ ID NO: 1776175 - RNA, 14 nt, Homo sapiens
aucauugcauaaca

SEQ ID NO: 1776176 - RNA, 18 nt, Homo sapiens
uaaccauaaaucaauuca

SEQ ID NO: 1776177 - RNA, 18 nt, Homo sapiens
uauaauuuauaacuuacu

SEQ ID NO: 1776178 - RNA, 15 nt, Homo sapiens
cuugcauacagagac

SEQ ID NO: 1776179 - RNA, 14 nt, Homo sapiens
ccaagguaggcaga

SEQ ID NO: 1776180 - RNA, 20 nt, Homo sapiens
cuuagcaugugacuccugaa

SEQ ID NO: 1776181 - RNA, 20 nt, Homo sapiens
ucuuuauauuuuuagccuaa

SEQ ID NO: 1776182 - RNA, 18 nt, Homo sapiens
guauauuaaagcaccaaa

SEQ ID NO: 1776183 - RNA, 19 nt, Homo sapiens
gcagugggucccacuuccc

SEQ ID NO: 1776184 - RNA, 16 nt, Homo sapiens
aacaugcuuuuccaaa

SEQ ID NO: 1776185 - RNA, 13 nt, Homo sapiens
aaaugacauuaaa

SEQ ID NO: 1776186 - RNA, 23 nt, Homo sapiens
gcuuugaaggaaccaagugcauu

SEQ ID NO: 1776187 - RNA, 23 nt, Homo sapiens
caucucucccuccccugccauuu

SEQ ID NO: 1776188 - RNA, 23 nt, Homo sapiens
gcauuuagacucucgacuggcca

SEQ ID NO: 1776189 - RNA, 17 nt, Homo sapiens
uaauaacuguguacugu

SEQ ID NO: 1776190 - RNA, 14 nt, Homo sapiens
guacuuugugcuga

SEQ ID NO: 1776191 - RNA, 21 nt, Homo sapiens
aaucuguacaucucuacuuau

SEQ ID NO: 1776192 - RNA, 22 nt, Homo sapiens
aacuccaugucucugagcauua

SEQ ID NO: 1776193 - RNA, 13 nt, Homo sapiens
acuccagccugag

SEQ ID NO: 1776194 - RNA, 13 nt, Homo sapiens
aucuccuccaugu

SEQ ID NO: 1776195 - RNA, 14 nt, Homo sapiens
gcgaaaauugcgaa

SEQ ID NO: 1776196 - RNA, 23 nt, Homo sapiens
aauccuaagacacaaaugcauga

SEQ ID NO: 1776197 - RNA, 16 nt, Homo sapiens
cugguauauccaaaag

SEQ ID NO: 1776198 - RNA, 12 nt, Homo sapiens
agauucccacug

SEQ ID NO: 1776199 - RNA, 19 nt, Homo sapiens
agcuccccauuacccucag

SEQ ID NO: 1776200 - RNA, 20 nt, Homo sapiens
cuggagugcaguggcgccau

SEQ ID NO: 1776201 - RNA, 21 nt, Homo sapiens
ucccagcccucaucccacuuc

SEQ ID NO: 1776202 - RNA, 22 nt, Homo sapiens
accagggcuccaggagccucau

SEQ ID NO: 1776203 - RNA, 13 nt, Homo sapiens
ccugagaugauuu

SEQ ID NO: 1776204 - RNA, 15 nt, Homo sapiens
gccaacccuuucauu

SEQ ID NO: 1776205 - RNA, 19 nt, Homo sapiens
gccugggauuucuaugcag

SEQ ID NO: 1776206 - RNA, 15 nt, Homo sapiens
acucaggccacagug

SEQ ID NO: 1776207 - RNA, 14 nt, Homo sapiens
cacagagacacgug

SEQ ID NO: 1776208 - RNA, 12 nt, Homo sapiens
cagugaguccag

SEQ ID NO: 1776209 - RNA, 15 nt, Homo sapiens
aaagaguaggaagac

SEQ ID NO: 1776210 - RNA, 15 nt, Homo sapiens
uguuauccacuacag

SEQ ID NO: 1776211 - RNA, 16 nt, Homo sapiens
auuauuuuauguugca

SEQ ID NO: 1776212 - RNA, 19 nt, Homo sapiens
acugaaaaaaacauaucca

SEQ ID NO: 1776213 - RNA, 21 nt, Homo sapiens
agggagaguuggggaaggcaa

SEQ ID NO: 1776214 - RNA, 21 nt, Homo sapiens
agugcacuaauucugcaucug

SEQ ID NO: 1776215 - RNA, 22 nt, Homo sapiens
caacaccuccuccugcugcuca

SEQ ID NO: 1776216 - RNA, 24 nt, Homo sapiens
agguggcaagcugugacuucucca

SEQ ID NO: 1776217 - RNA, 20 nt, Homo sapiens
cuuccuuuaaagaugaacuc

SEQ ID NO: 1776218 - RNA, 17 nt, Homo sapiens
uucaaggaggugcuuag

SEQ ID NO: 1776219 - RNA, 16 nt, Homo sapiens
uguaaauuuaacugca

SEQ ID NO: 1776220 - RNA, 15 nt, Homo sapiens
cacacauuuacugua

SEQ ID NO: 1776221 - RNA, 13 nt, Homo sapiens
uugacucuacuau

SEQ ID NO: 1776222 - RNA, 15 nt, Homo sapiens
gccagccgggagcuu

SEQ ID NO: 1776223 - RNA, 18 nt, Homo sapiens
augagcacaaacuucugu

SEQ ID NO: 1776224 - RNA, 19 nt, Homo sapiens
gcucagucgcuagcauuuc

SEQ ID NO: 1776225 - RNA, 13 nt, Homo sapiens
ucgucuacugcaa

SEQ ID NO: 1776226 - RNA, 21 nt, Homo sapiens
agcuguuuuaucguuaagugc

SEQ ID NO: 1776227 - RNA, 22 nt, Homo sapiens
ugcgacgauccccauggaacag

SEQ ID NO: 1776228 - RNA, 16 nt, Homo sapiens
ccagggacacauuucu

SEQ ID NO: 1776229 - RNA, 15 nt, Homo sapiens
uccauucaucucaug

SEQ ID NO: 1776230 - RNA, 16 nt, Homo sapiens
gucauuauuuuuguua

SEQ ID NO: 1776231 - RNA, 18 nt, Homo sapiens
cucauuucuuauaucaua

SEQ ID NO: 1776232 - RNA, 15 nt, Homo sapiens
caaaaagaugaccuu

SEQ ID NO: 1776233 - RNA, 16 nt, Homo sapiens
agaccauggauuucau

SEQ ID NO: 1776234 - RNA, 12 nt, Homo sapiens
agcccugccagg

SEQ ID NO: 1776235 - RNA, 18 nt, Homo sapiens
cucccuuugccagugccu

SEQ ID NO: 1776236 - RNA, 17 nt, Homo sapiens
guggcuucuuaaucuuu

SEQ ID NO: 1776237 - RNA, 13 nt, Homo sapiens
uaauaucaaugaa

SEQ ID NO: 1776238 - RNA, 18 nt, Homo sapiens
ccagccaaacacacagaa

SEQ ID NO: 1776239 - RNA, 19 nt, Homo sapiens
accuccgccagauccugca

SEQ ID NO: 1776240 - RNA, 14 nt, Homo sapiens
guucuguauuugaa

SEQ ID NO: 1776241 - RNA, 22 nt, Homo sapiens
uauguaacaaaccugcacuuau

SEQ ID NO: 1776242 - RNA, 20 nt, Homo sapiens
acauugugggauguucagca

SEQ ID NO: 1776243 - RNA, 14 nt, Homo sapiens
uugagcaucuggau
